United States Patent 12,553,037 (ENGINEERED CLASS 2, TYPE V REPRESSOR SYSTEMS) - sequence listing, part 2

SEQ ID NO: 11866 - protein, 81 aa, Colobus angolensis
PQGLLTFRDVAIEFSQEEWKCLDPAQRTLYRDVMLENYRNLVSLDISSKCMMNTLSSTGQGNTEVLHTGTLQRQASYHIGA

SEQ ID NO: 11867 - protein, 81 aa, Colobus angolensis
TKGCVTFEDIAVYFSQEEWGLLDEAQRRLYLEVMLENFALVASQGCGHGTEDEETPSEQNVSVRVSQSKAGSSTQKTQSCE

SEQ ID NO: 11868 - protein, 81 aa, Colobus angolensis
GRRAEEAVTFKDVAVIFTEEELELLDPAQRKLYRDVMLENFRNLLSVGHQPFRGDTFHFLREEKFWVMETKSQRERNSGPL

SEQ ID NO: 11869 - protein, 81 aa, Colobus angolensis
AQESLTLRDVAVDFTWEEWQLLGPAQKHLYQDVMLENYSNLVSVGFQASKPDALTKLEQGEPLWALEDEIHSPTHPEIEKA

SEQ ID NO: 11870 - protein, 81 aa, Colobus angolensis
EIRSCAPVTFDDITVYLLQEEWVLLSQQQKELCGSDKLVAPLGPTVANPELFCKFGRGPESWLGSVQGQGSHLEHHSGKKQ

SEQ ID NO: 11871 - protein, 81 aa, Colobus angolensis
CEVSVSFEDVTVDFSREEWQQLDSTQRRLYQDVMLENYSHLLSVGFEVPKPEVIFKLEQGEGPWTSEGEAPHQSCSDGKFG

SEQ ID NO: 11872 - protein, 81 aa, Erinaceus europaeus
SQESVTFQDVAVDFTEKEWPLLDSSQRKLYKDVMLENYSNLTSIGYHVGKPSLISHLEQELEPRTEERGSPSGRCPDREAP

SEQ ID NO: 11873 - protein, 81 aa, Carlito syrichta
AQGSMSFEDVTVELTQEEWQQMGPRERSLYRDMMLENYGHLVTVGCCITKPKVILKLEQGEEPWPLEVKFLNRKYPGYYKI

SEQ ID NO: 11874 - protein, 81 aa, Delphinapterus leucas
FQEPVSFKDVAVTFTKEELGLLDSTQRKLYQDVMLENFWNLVSVGYLPFKLDMILQLGRKKKLWVMEPEAQGAGCSGHGNQ

SEQ ID NO: 11875 - protein, 81 aa, Carlito syrichta
MSQVTFSDVAIDFSHEEWTWLDSAQRNLYKDVMVQNYKNLVSLAGLSVTKPYVITLLEDGKEPWMVEKKLSKDWESRWENK

SEQ ID NO: 11876 - protein, 81 aa, Carlito syrichta
QDTAAYEDLSVDYTQKKWKGPALSQKALYRNMMPENYHSMVSLDANMMEHSVLTLKQKMSKGSLSSDRTSGGLFGVAPGKP

SEQ ID NO: 11877 - protein, 81 aa, Delphinapterus leucas
LEGSVTLQDVAVEFTPEEWQLLDCDQRTLYWDVMLENFRNLISMGCPVTKTVVIFKVEQGQEPWMVEGENPRWRSPEADCP

SEQ ID NO: 11878 - protein, 81 aa, Carlito syrichta
LQELLSFEDLSVDFTQKEWQLLNPYQKNLYKDVMLENYSSLVSLEVWQVDDDMIWPQDNQDKLKNMGREHEYGAFGKNFSL

SEQ ID NO: 11879 - protein, 81 aa, Carlito syrichta
MLENYRNLVSVGLCISKPHMISLLEQEKEPWVTKGEMTRGLCPDLEYVWVTKELSLNQHIYEENLPQGIVMRRLTSYDLEC

SEQ ID NO: 11880 - protein, 81 aa, Carlito syrichta
DPTRDSVAFEDVAVNFTQEEWALLNPSQKNLYRDVMQETFSNLASIGSKGEDQSIEDQYKNSWRNLTHIMYHSGSKSYDCE

SEQ ID NO: 11881 - protein, 81 aa, Erinaceus europaeus
RSEALSFADVSVSFSREEWGCLRPAQKALYRDVMRETCGLLGALGLSGPKPAFISWLEGEMEAWSPEAHEPERESRAADAR

SEQ ID NO: 11882 - protein, 81 aa, Mustela putorius
PKVPVSFEDVSVYFTKTEWKLLDVQQRILYKTVMLENYHHLVSLGCLSTKPHLVSWLEQGEGPWTTDIWRTPATAKTQTEG

SEQ ID NO: 11883 - protein, 81 aa, Mustela putorius
EAAVVSFQDVAVDFTREEWWLLSHTQRMLYRCVMLENYSNLVSLGIPFPKPTLVILLEQGEEPWTEEGEALPSSCSADAKP

SEQ ID NO: 11884 - protein, 81 aa, Mustela putorius
SSVTFEDVAVYFSQEEWRFLNKAQKHLYHDVMLEVFALIASLGGGQGALEAAAPSEQNVSGGGSQKAYAQDCSLDTNPGQT

SEQ ID NO: 11885 - protein, 81 aa, Tupaia chinensis
KKAAVSFKDVTVELTQEEWRHMDPAQRTLYRDVMLENYSHLVSVGYCFTKPELIFTLEQGEDPWLSRKENNFLSKSPPGTS

SEQ ID NO: 11886 - protein, 81 aa, Mustela putorius
QVTFEDVVVDFTREEWGQLEPAQRTLYLDVMLETFRLLVSVDLETRPKTRLSSPKQDITEERSSSDLVERFLWEGLWDAEG

SEQ ID NO: 11887 - protein, 81 aa, Tupaia chinensis
GWVPALFDEVAIYFSDEEWEVLTEQQKALYREVMRMNYETVLSLEFPFPKPDMISRLEGEEESPNSDEWQLQGGTFAEHED

SEQ ID NO: 11888 - protein, 81 aa, Mustela putorius
SLDSDLFRDVAVVFSREEWERLAPAQRVLYRDVMLETYSNLVSLGLAIYKPDVISFLEQGREPWLVEEAAGRSRCPVLESK

SEQ ID NO: 11889 - protein, 81 aa, Mustela putorius
PKVPVTFDDISIQFSTPEWDKLEERQKELYKNIMKGNYESLISMDYAMNQPDVLSQIQPEGEHNTEEQPGPEESEIATDPS

SEQ ID NO: 11890 - protein, 81 aa, Tupaia chinensis
VTFEDVAIYFSQEEWGLLNEAQICLYLDVMLGNFALITSLGYEHGAEDTEATSTQSITVEEGLQGRTSKADSSNQKTHPFD

SEQ ID NO: 11891 - protein, 81 aa, Tupaia chinensis
FQASVAFEDVAVNFTREEWALLDPSQKKLYKDVMQETACNLAFVESRCERDEGVPGDVQKESPPGAKPHNSGVYEEGFVGP

SEQ ID NO: 11892 - protein, 81 aa, Tupaia chinensis
GKESLTFGDVALAFTQIEWRHLDAAQRALYRDVMLENYGNLVSVGLLASKPKLISQLEQGAEPWMEVEEIPFSTCTVEDYW

SEQ ID NO: 11893 - protein, 81 aa, Odobenus rosmarus
ALALITFKDVAVTFTGEEWRHLDLAQRTLYREVMLETCGLLVSLGHPVPKPELTYLVEDGQELWTVRRDLSKSTYTGEKAK

SEQ ID NO: 11894 - protein, 81 aa, Odobenus rosmarus
PKVPVTFDDISIYFSTPEWEKLEEWQKELYKNIMKGNYESLISMDYAMNQPDVLSQIQPEGEHNTEEQAGPEENEIPTDPS

SEQ ID NO: 11895 - protein, 81 aa, Odobenus rosmarus
FQAKVTFEDVAVLLSQEEWDRLGPAQRGLYRHVMMETYGNVVSLGLPGSKPNVISQLERGEEPWVLDGQGAEESRGLGSGH

SEQ ID NO: 11896 - protein, 81 aa, Odobenus rosmarus
MAVSEPGGSAAEWEQLDPAQRNLYKDVMLENYSNLASMGYQAPKPDMISKLEKGEEPWLGKGKRPRQGGPSEIARPKQIGT

SEQ ID NO: 11897 - protein, 81 aa, Odobenus rosmarus
LQGSVTFPDVAVDFTPEEWQLLDCEQRTLYWDVMLENFRNLISVGGPVTKTKAIFKAEQGQEPWMREGANPRWRHPEADCL

SEQ ID NO: 11898 - protein, 81 aa, Odobenus rosmarus
ISFEDVAVGFTSEEWQLLNPSQKSLYREVMLENYSNLVFLEVWLDNSLKMWHQDNQDKLRSMERGHEYDVFRKIFHSSINF

SEQ ID NO: 11899 - protein, 81 aa, Odobenus rosmarus
SLELVSFEDVAVNFSWEEWQDLDDAQRTLYRVVMLETYSSLVSLGHCITKPEVIVKLEQGAEPWTVEEAPAQSLPDVQTAD

SEQ ID NO: 11900 - protein, 81 aa, Odobenus rosmarus
RSQESLTFQDVAVNFTREEWDQLYPAQKNLYRDVMLENYRNLVALGHQLYKPEVISHLEQEEQWVMERDSPLDTHTDGESR

SEQ ID NO: 11901 - protein, 81 aa, Odobenus rosmarus
PQATVSFKDVTVEFTQEEWRQMDSAQRTLYRDVMLENYSHLVSVGYCFTKPELIFTLEQGEDPWLLKKEFLRKTSPEDSQP

SEQ ID NO: 11902 - protein, 81 aa, Odobenus rosmarus
LLTFRDVAIEFSPEEWECLDPAQRALYRDVMVENYRNLVFLDIFTRCVSKELPPKEDINNGELFQTLIFLERHIRHEFEDF

SEQ ID NO: 11903 - protein, 81 aa, Odobenus rosmarus
MAVTFEDVTVIFTWEEWKFLDSSQKKLYREVMWENYTNVMSVGNWKESYKPQEERFRYLEHENLPCWQAWRNASAQIYENR

SEQ ID NO: 11904 - protein, 81 aa, Odobenus rosmarus
WKELLSFEDVAMYFTREEWNKLEWAQKDLYRDVMLENYRNMILLGFQFPKPEVICLLEQWEEPWILDLPRAGTRKASSSAC

SEQ ID NO: 11905 - protein, 81 aa, Odobenus rosmarus
APGSVTFEEVAVYFSQEEWRLLNEAQRHLYRDVMLEVFALVASLGCGRGTEDEAAPSEQNVSVGGSQINSTQKAYTQERGL

SEQ ID NO: 11906 - protein, 81 aa, Delphinapterus leucas
AQVLVTFKDVAVTFTQEEWRQLDLDQRTLYQEVMLEICGLLVSLGHPVPKPELIHLLEHGQELWMGRRGLPRSMCPDDRAK

SEQ ID NO: 11907 - protein, 81 aa, Carlito syrichta
MASPSPPPEPKEWDYLDPAQRSLYKDVMMENYGNLVSLDVLNRDKDDEPTVKQEIEEIEEEVEPQGVIVTRIKSEIDQDPM

SEQ ID NO: 11908 - protein, 81 aa, Carlito syrichta
AERPPEMAVSEDRASAAEWKQLDPAQRNLYKNVMLENYSNIASMGCQASKPDIISKLEKGEEPWLGKEKRPSQGHLSKTAG

SEQ ID NO: 11909 - protein, 81 aa, Ornithorhynchus anatinus
MLENYDHVASLGFPVSKPTVILQLERGVEPWVLNTREAEKRRSPTGARRTGSSVPPQAAGEIEPPASLSARETETGIGSLP

SEQ ID NO: 11910 - protein, 81 aa, Erinaceus europaeus
TQGPLSFEDVAVDFSREEWQLLSPSQKALYRDTMLETHSNLVSVGCQAAKPDSLLWLEKGEPLWMVKGAAKCQSCAGRTSD

SEQ ID NO: 11911 - protein, 81 aa, Erinaceus europaeus
RWRLVTFGDVAVDFSRAEWQRLTSTQKGLYRKVMLENYRSLASLGLCVSKPDLISLLEQRGEPWMKRKTRGLCPDLKALQE

SEQ ID NO: 11912 - protein, 81 aa, Gulo gulo
FQELVSFEDVAVNFSWEEWQDLDDAQRTLYRAVTLETYSSLVSLGHCISKPEVIVKLEQGAEPWAVGEAPAQRLPDVQSAG

SEQ ID NO: 11913 - protein, 81 aa, Erinaceus europaeus
KIPILKGVAMDFTLEDWGQLGLNQGDLFWDKALDNYQNLFLLNPLRSSLTSCPDGVEELEVKGNPEVMGPDKAETKKTLLE

SEQ ID NO: 11914 - protein, 81 aa, Erinaceus europaeus
SPKDTVTFPDVAVSFTQEEWNLLNPSERNLFRDVMLENYKNLISVGYHKVKPSVISWLEQEDLWTVEKEVLQEWELQLKKN

SEQ ID NO: 11915 - protein, 81 aa, Ornithorhynchus anatinus
PKGPVAIENDGAYFSEQEWENLEEWQKELYRNVMKSNYETLVSLDCALPTLELLPPQARGEDPVVPEELGHLEERESLAGP

SEQ ID NO: 11916 - protein, 81 aa, Ornithorhynchus anatinus
PKVPVTFDDVAVHFSEQEWGNLSEWQKELYKNVMRGNYESLVSMDYAISKPDLMSQMERGERPGPGQEPEDSEMPTDPSAA

SEQ ID NO: 11917 - protein, 81 aa, Ornithorhynchus anatinus
GRVEVTFKDVAIFLTQQEWESLADAQRELYTTVMLENYGHLQSLGAGFPKPHCIRQLEKGKDPWIPEPPEEQMPSTAFAES

SEQ ID NO: 11918 - protein, 81 aa, Mustela putorius
MDSVVFEDVVVDFTQEEWALLNPSQRKIYRDVMLETFRNLVSVDDETQFKTTGSISQQDSFGEKLSNEQKIARFTKNDFWT

SEQ ID NO: 11919 - protein, 81 aa, Mustela putorius
MDLVIFEDVAVDFTLEEWALLDSMQRNLYRDVMLETFQNLVSVDYETLFKASGLVSQQDTLEKKKSIEQKMAKFTRNHSCA

SEQ ID NO: 11920 - protein, 81 aa, Tupaia chinensis
LPSHTCGMLQDSVAFKDVAVNFTKEEWALLEPSEKKLYRDVMLETIKNLDCIVSAFFFHTRGMLQDSVVFEDVVVNFTKEE

SEQ ID NO: 11921 - protein, 81 aa, Tupaia chinensis
FQDSVAFEDVVVNFTQDEWTLLDTSQKKLYGDVIWETIENLDFTGRNWEDEDIEEKYENAIKDLSAVSLSLPPPHTCGMLQ

SEQ ID NO: 11922 - protein, 81 aa, Tupaia chinensis
VSFEDVAVDFTWEEWQNLNDAQRTLYKDVMLETYSSLVFLGHCIAKPAVIFKLEQGGEPWTLEFPNQTFPGEKPYGCEQCK

SEQ ID NO: 11923 - protein, 81 aa, Tupaia chinensis
AAESVTFKDVAVDFTEEEWHHVDPAQRSLYRDVMLENYSHLVSLGYQVSKPEVIFKLEQGKEPWISEGEIQRPFCADWKTR

SEQ ID NO: 11924 - protein, 81 aa, Delphinapterus leucas
RMEAVTFGDVAVHFSREEWQCLDPGQRALYKEVMLENHSSVAGLGFLVFKPELISRLEQGQEPWVLDLQGAEGREAARTSQ

SEQ ID NO: 11925 - protein, 81 aa, Erinaceus europaeus
FQDFVTFGDVAVDFSQEEWEWLTPVQRNLYKKVMLENYRSLVSLAGVSVSKPDVISLLEQGKEPWMMKEEARGICHDWKYA

SEQ ID NO: 11926 - protein, 81 aa, Erinaceus europaeus
SQASVSFKDVTVEFTQDEWRLMSSAQRTLYREVMLENYSHLISMGYCSTKPELIFALEQKDFRESILERESLSTIPPEDFQ

SEQ ID NO: 11927 - protein, 81 aa, Ornithorhynchus anatinus
RPTPVTFEDVAVYLTREEWKLLGPSQRDLYRDTMLENYRHVVSLGYPAAKPAVIAQLERGMELCFRNLPSTKGRRHLRDAC

SEQ ID NO: 11928 - protein, 81 aa, Carlito syrichta
SQRPLTFRDVAIEFSQEEWTCLDPAQKALYRDVMLENYRNLVSLGISLSGMPVTSMLEQEREPWTVESEVRIAKNPDGWER

SEQ ID NO: 11929 - protein, 81 aa, Carlito syrichta
QKTNMAQGSVSFEDVTVELTREEWQQMGPWERSLYRDVTLENYGHLVAVGCCITKPKVILKLEQGEEPWSLEVKFLNRKYP

SEQ ID NO: 11930 - protein, 81 aa, Delphinapterus leucas
SLGTVTFKDVAVDLTQEEWQQMKPAQRDLYRDVMLENYSNLVTVGCQVTKPDVIFKLEQEEEPWVIEEEMLGRPCPVWEDD

SEQ ID NO: 11931 - protein, 81 aa, Delphinapterus leucas
GLLTFKDVAITFSQEEWECLDPAQRALYRDVMLETYRNLLSLGSLSAGFTIKELSPREGINKGELYHLVILDRNDNHGIKD

SEQ ID NO: 11932 - protein, 81 aa, Delphinapterus leucas
LLTFEDVALFFTEEEWQLLDPAQKILYNNVMQENYETVISLGLKLKNDTGNDQPMSLSTLEIQASGCKVLRKARMKVAQKT

SEQ ID NO: 11933 - protein, 81 aa, Carlito syrichta
MAFEDVAVYFSQEEWGLLDTTQRALYRRVMLENFALVSSLGLSTSRPRVVIQLERGEDPWVPHGMDTTPARNTHRRHNPGS

SEQ ID NO: 11934 - protein, 81 aa, Carlito syrichta
SQGELTFRDVAIEFSQEEWRCLDPGQRDLYKDVMLENYWNLVSLGISHFDMNIISMLEEGKEPWTVKSYVKIARKRNVWKY

SEQ ID NO: 11935 - protein, 81 aa, Delphinapterus leucas
FQDPVTFEDVAVVFTDEEWRCLVPTQRALYKEVMLENYKSIVSLGLPVPGPDVIFQLKRGDEPWIVELHGSEGKECAENVS

SEQ ID NO: 11936 - protein, 81 aa, Carlito syrichta
SWGSLSFMDVFVDFTWEEWQLLDPTQKHLYRSVMLENYSNLVSLGYQHTKPDVIFKLEQEELCVVQSKTPSQGHPVLEAEK

SEQ ID NO: 11937 - protein, 81 aa, Gulo gulo
SQDSLTFQDVAVNFTREEWNQLYPAQKILYRDVMLENYRNLVALGHQLYKPEVISQLEQEEQRGTERDSPADAHADGESRP

SEQ ID NO: 11938 - protein, 81 aa, Gulo gulo
VQVLVTFKDVAVTFTQEEWGHLDLDQRALYQEVMLETCGLLVSLGHPVPRAELAHLLEHGQELWTGKGGLSRSTCSGDSVR

SEQ ID NO: 11939 - protein, 81 aa, Delphinapterus leucas
LQGSVSFEDVAVDFTRQEWYRLDPAQRTMHKDVMLENYSNLASVGLCVAKPEMIFKLERGEELWILEEESSGHGYPGSLSL

SEQ ID NO: 11940 - protein, 81 aa, Delphinapterus leucas
NFWILRLPPGSKGEAPKEWGNLSEWQKELYKHVMRGNYETLVSLDYAISKPEVLSQIEQGKEPCSWRRAGPKVPDVPVDPS

SEQ ID NO: 11941 - protein, 81 aa, Delphinapterus leucas
ELVTFRDVVISFSQEEWEYLDSAQRDLYWDVMMENYSNLVSLDLESKCDKETLSTEKDIIEKNGSHWEVIESSKLVGLENS

SEQ ID NO: 11942 - protein, 81 aa, Delphinapterus leucas
MKFTWEEWQLLDPDQKDLYRDVMLENYSNLLSVGYQASKPDAVSRLERGEQLWPVEDDSHGRICPEIRKVDDPLQHHLPNH

SEQ ID NO: 11943 - protein, 81 aa, Carlito syrichta
VVFEDVAIYFSQEEWGHLDEAQRLLYRDVMLENLALLSSLGCCHGAEDEASSGQGVSLGVSQVMTSKPLLSTQKTHQPCET

SEQ ID NO: 11944 - protein, 81 aa, Delphinapterus leucas
MLENFRNLISMGCPVTKTVVIFKVEQGQEPWMVEGENPRWRSPEADCPLIDESDKHQESKDNFLNSVLFMFNKILTVKRLH

SEQ ID NO: 11945 - protein, 81 aa, Carlito syrichta
RPRALKFADVAVYFSSEEWGCLRPAQRALYRDVMRENYGHLGALGCAGPKPALISWLERNTDDWEPAALDPLEYPRGVTIQ

SEQ ID NO: 11946 - protein, 81 aa, Carlito syrichta
GMAHMAFTDVAVDFTQEEWRLLSPAQRTLYREVMLENYSNLVSLGIPFSKPKLITQLEQEKETWREERKCPLATCPAEPEP

SEQ ID NO: 11947 - protein, 81 aa, Delphinapterus leucas
WKGLLSFEDVALYFTREEWDTLDWAQKDLYRDVMLDNYRNVLSLGVQFPKPEVICQLEQWEEPWILDLPRAGTRKASGSAC

SEQ ID NO: 11948 - protein, 81 aa, Carlito syrichta
PQASVCFEDVAVTFTYEEWRQLDTAQRMLYRDVTLETCRHLVSLGLLLSKPDVISQLEQREDLWRVEQASPQDWKATLEKK

SEQ ID NO: 11949 - protein, 81 aa, Delphinapterus leucas
KEAFMAFGDVAVDFTQEEWRLLSPAQRTLHREVMLETYNHLVSLEIPFCKPKLISQLERGEEPWIEERQRPPSLCPAGSKL

SEQ ID NO: 11950 - protein, 81 aa, Carlito syrichta
QGHLTFRDVSIEFSQEEWKCLDPAQRALYRDVMLENYRNLISLGISPKYVIKELSLKWKSNTREVFYIVTLGRHESHDIED

SEQ ID NO: 11951 - protein, 81 aa, Gulo gulo
QGLLTFRDVAIEFSEEEWGHLTHTQRQLYRDVMLENCGHLLFLGLLLSKPDLMIYLEQEKQLWDVKRKETRGFHPALSSHE

SEQ ID NO: 11952 - protein, 81 aa, Gulo gulo
VTFRDVAIDFSQEEWEFLDSAQRDLYRDVMWENYSNFISLGKAIYPKLCWLSLLSISGLCFEKLDNFFLCSRGMVLASLGW

SEQ ID NO: 11953 - protein, 81 aa, Erinaceus europaeus
AISCEDVTVNFSQEEWALLNPSEKKLYKDVMWEIFHNLVLIGKLQEDSFIEQQQDHEGSKQRNIEDKISEKKEGSRYRENP

SEQ ID NO: 11954 - protein, 81 aa, Ornithorhynchus anatinus
AVSFEDVAVYFSPEEWARLGPAQRALARDVMWDNYRTGSLIHLRTHTGARPYRCPDCGKAFSRGSHLTISTLVTHQRTHTG

SEQ ID NO: 11955 - protein, 81 aa, Ornithorhynchus anatinus
WAQMPVMFEDVAMYLSREEWGQLNATQRGFYKDVLQKWNGLSWGFPLSKPAWIAQPEGRGEPSSAPRRGPEEKSTTCSAGG

SEQ ID NO: 11956 - protein, 81 aa, Carlito syrichta
YQELLTFKDISVDFTQEEWGQLAPAHRNLYREVMLENYGNLVSVGYQLPKPGVIFHLEKGEDPWLRDRDISGGPSSDLESK

SEQ ID NO: 11957 - protein, 81 aa, Carlito syrichta
EVGLLSFKDVAIEFSPEEWACLNSPQRILYRTVMLENHRNLVFLGLTVSKPDLITCLEQRQDPWNVKRHGTLAKLPAVTSH

SEQ ID NO: 11958 - protein, 81 aa, Carlito syrichta
MLENYRNLLSLGLPGSKPDVICRLERGEEPKMEEREGLRVTCPEKKPFTCVECGKAFIYHSDYILHQRIHTGEKPYKCNDC

SEQ ID NO: 11959 - protein, 81 aa, Carlito syrichta
EVGLLSFKDVAIEFSPDEWACLNSPQRILYRTVMLENHRNLVFLGLSVSKPDLITCLEQRKEPWNVKRHGTLAKFPAVTSH

SEQ ID NO: 11960 - protein, 81 aa, Delphinapterus leucas
QEQLTFKDVAIEFSQEEWECLDPAQRALYRDVMLETYKNLVSLDICHIYVMKKLQPKVNSDGGEVFQTVMLETRESREIRD

SEQ ID NO: 11961 - protein, 81 aa, Delphinapterus leucas
FRGSVMFRDVSINFSQEEWECLDLGQMNLYKEVMLENFSNLVSVGLSSSKPTVISLLEQGKEPWMVDRELTRGLCSDLESM

SEQ ID NO: 11962 - protein, 81 aa, Erinaceus europaeus
DKESEYEDVTVIFTQEEWALLNPAEKKLYRDVMWENFRNFLSLEKIQEHSIKEQHNFQGSKQSTLWTHERIHSGEKPYKCR

SEQ ID NO: 11963 - protein, 80 aa, Erinaceus europaeus
MSDLKRMLTFKDVAIEFTQEEWECLDQAQKDLYKDVMLENYGHLVSLDCMISKPDLITFLEQKKEPWAKKRKKLSIFKGT

SEQ ID NO: 11964 - protein, 81 aa, Mustela putorius
KVPVTFVDIAVYFSEDEWKNLDEWQKELYNNLVKENYKTLMSLDTEGTVPKPDAPSQVEPREEPCVWEQRDPEEREILMDP

SEQ ID NO: 11965 - protein, 81 aa, Mustela putorius
PQESVTFKDVAVDFTQEEWHHVDPAQRRLYRDVMLENYSHLVSLGYQVSKPEVIFKLEQGEEPWISEGEIQRPFCPDWKTR

SEQ ID NO: 11966 - protein, 81 aa, Mustela putorius
MLENYSNLVSLGYQDSKPDIIFKLEQEEPWMMPAQIPRPGHPEKVGEIDRMEWHQENQSKLESMAKGYECTTFGKLCLLST

SEQ ID NO: 11967 - protein, 81 aa, Mustela putorius
SHTLVTFRDILVNFTREEWKLLDSAQQIMYKDVMLENYKNLVSLGHQLPKPHVILQLEKGEEPWLVERGIHQETQADLETA

SEQ ID NO: 11968 - protein, 81 aa, Tupaia chinensis
ECGREGELNGEGKELGEEIAVSSRKLRALYRIVMLENYGNLTSLGYPVPKPALISLLEEGDLPLGLQAQDAETNIGNDSTQ

SEQ ID NO: 11969 - protein, 81 aa, Tupaia chinensis
MDVMLENYCHLISVGIEVQPITVKSYFRLSGCHMTKPDVILKLERGEEPWTSFVGHTYLEEKPYQCHQCGNAFRRKSYLID

SEQ ID NO: 11970 - protein, 81 aa, Carlito syrichta
MASPSPPPEPKEEWDYLDPAQRSLYKDVMMENYGNLVSLDVLNRDKDDEPTVKQEIEEIEEEVEPQGVIVTRIKSEIDQDP

SEQ ID NO: 11971 - protein, 81 aa, Delphinapterus leucas
SQELLTFKDISVDFTQEEWGQLAPAHRNLYREVMLENYGNLVSVGYQLSKPGVISQLEKGEEPWLMEREISGGPTPDLEDE

SEQ ID NO: 11972 - protein, 81 aa, Carlito syrichta
AEGSVSFEDVTMEFTWEEWRLMGPRERSLYRDVMLENYGHLVAVGCCITKPKVILKLEQGEEPWPLEVKFLNRKYPGYYKI

SEQ ID NO: 11973 - protein, 81 aa, Carlito syrichta
YQDSVSFEDVAVDFTQEEWTLLDSAQRDLYRDVMLETCENLASIGSDLLNHNVICCLEGEEELRTVQGRVLEEWRLKTRGS

SEQ ID NO: 11974 - protein, 81 aa, Delphinapterus leucas
LKGLVMFKDVAIDVSQEEWECLNPAQRNLYKDVMLENYSNLVSLGLSISKPAVISSLEQGKEPWMVMREVIGDQFPDLVSK

SEQ ID NO: 11975 - protein, 81 aa, Carlito syrichta
CQEAVTFEDVAVVFTDEEWKHLVPVQRDLYKEVMLENYESIASLGLPVPRPDVIFQLKMRDEPWIVDLCEPEERECPETVS

SEQ ID NO: 11976 - protein, 81 aa, Carlito syrichta
GILTFKDVTVDFSLEEWACLSPAQQNLYSDVMLENYRNLVFVDLTQHKRIHNGDKPCKCGECGKAFNQYSNFIQHKIIHTR

SEQ ID NO: 11977 - protein, 81 aa, Carlito syrichta
AQGSVSFEDVTMELTREEWQQMGPAERNLYRDVTLENYGHLVAVGCCITKPKVILKLEQGEEPWSLEVKFLNGKYPGYYKI

SEQ ID NO: 11978 - protein, 81 aa, Carlito syrichta
MVTFKDVAVVFSEEELRLLDSAQRKLYRDVMLENFRNLLSVAHQPFKPDLISQLEREEKLLMVETETQRNGCSGSKNQQMM

SEQ ID NO: 11979 - protein, 81 aa, Delphinapterus leucas
AQGKVNFEDVFVYFSQEEWGLLDEAQRLLYREVMLENFALMASLGCSHGMEEEEIHFEQSVSVKGVSQVTIPKTIPSSQKA

SEQ ID NO: 11980 - protein, 81 aa, Gulo gulo
QGLLTFRDVAIEFSEKEWGHLTHTQQQLYRDVMLENYGHLHFLETGLLLSMPHLIMVLEQEKQLWDVKTKERLETSIQAAA

SEQ ID NO: 11981 - protein, 81 aa, Gulo gulo
SQYLVTFEDVAVTFTQEEWTLLDQTQRDLYRNVMLENYQNLIILGYESCKPDLYSLMGGAEELRTGGRGILQELDLRLKTE

SEQ ID NO: 11982 - protein, 81 aa, Mustela putorius
PLTFRDVAVVFTEEELRLLDPAQRKLYRDVMLENFRNLLSVGDKNTKEMEYIPERELKGHYLREVSCWKIWEQVAGELIGS

SEQ ID NO: 11983 - protein, 81 aa, Mustela putorius
STEPVIFRDVAMYFTQKEWQLLKPAQKDLYKEVMLENYGNLASLGYRFFKPKLITRLEQGDEPCVKERDVPQEPQQSSAGV

SEQ ID NO: 11984 - protein, 81 aa, Mustela putorius
MLENYGHLCFLGLLLSKPDLIMFLEQEKVLWDVKRKETGGFHPAVSSHDTQSFLLKQSIEDSFQTVSVYRYKHSAVETLHL

SEQ ID NO: 11985 - protein, 81 aa, Mustela putorius
KEMVTFKDVAVVFTEEELGLLDPSQRKLYRDVMLENFGNLVSVGHQPFKRGGVHLVREEKFGMMKLATQRKGISGDKVQHE

SEQ ID NO: 11986 - protein, 81 aa, Tupaia chinensis
LQGTVTFKDVAIDFTQEEWKRLDPAQRNLYRNVMLENYNNLITVGYPFTKPEVIFKLEQEEEPWVVEEEVLRRHCPGDLWG

SEQ ID NO: 11987 - protein, 81 aa, Tupaia chinensis
MLENYSSLVSLGYEVMKPDIIFKLEQGEEPWIGDGEIPSPDIPEEVLQVDHCLTWHPDNHNKLKNGKKGHECDAFWKKFNL

SEQ ID NO: 11988 - protein, 81 aa, Vicugna pacos
AYMSLAFRDVAIDLSQEEWECLDPDQRTLYRDVMLENYSNLVSLGCSTPKPDVITLLEQEKEPWMVMREGTRSWYTDLESK

SEQ ID NO: 11989 - protein, 81 aa, Vicugna pacos
SQHLVTFEDVAVNFTQEEWTLLDQTQRDLYRDVMLENYQNLMALGSESCKPHVNSPLEGAEELRTRARRILQSEFMAESDL

SEQ ID NO: 11990 - protein, 81 aa, Odobenus rosmarus
SQGSISFEDVTVNFTQEEWGQLDPDQRTLYRDVMLENYSIFISLEELKVDGIIESKENQHRHYGKMITEKENVLRKTFNLY

SEQ ID NO: 11991 - protein, 81 aa, Odobenus rosmarus
MAFRDVAVAFTQKEWKLLSPAQRTLYRDVMLENYSHLVSLGIAFSKPKLITQLEQGDEPWREESECLLDLCPAEPGTEFQP

SEQ ID NO: 11992 - protein, 81 aa, Odobenus rosmarus
SQGPLTFRDVAIEFSQEEWGCLNHTQRELYRDVMLENYGHLLFLGLVVWKPDLVIFLEQEKQLWDVKRKETVAFHPAVSSD

SEQ ID NO: 11993 - protein, 81 aa, Odobenus rosmarus
PKVPVSFEDVSVYFTKTEWKLLDLRQRILYKRVMLENYRHLASLGFLSSKPHLVSWLEQGEGPRAADTCRTRAAAGMQKGD

SEQ ID NO: 11994 - protein, 81 aa, Odobenus rosmarus
CEVSVSFEDVTVDFSREEWQHLDPAQRRLYQDVMLENYSHLLSVGYEVPKPEVIFKLEQGEEPWILERKTPHQSCSDGRFR

SEQ ID NO: 11995 - protein, 81 aa, Odobenus rosmarus
SPVSCAPVTMRGPKEEWDYLDPAQRSLYKDVMMENYGNLVSLDVLNRDKDEEPTVKQEIEEIEEEVEPQGVIVTRIKSEID

SEQ ID NO: 11996 - protein, 81 aa, Odobenus rosmarus
SQELVTFEDVAVYFIRKEWKRLEPAQRDLYRDVMLENYGNVFSLDGETRTEHDQEISEDTGSHGVLLGRFQKDISQGLKFE

SEQ ID NO: 11997 - protein, 81 aa, Delphinapterus leucas
QGHVVFEDVAVSFSQEEWGLLNDAQRLLYCDVMLENLSLIASLGCWCAVGTEEAASEQCVSVELVTQDRNPNPDPSILKTL

SEQ ID NO: 11998 - protein, 81 aa, Carlito syrichta
KQEAVTFKDVAVVFTREELRLLDLAQRKLYQDVMVENFKNMVAVGHLLFKPDMVSQLEAEEKLWMMEAEAQRSGYSDENYV

SEQ ID NO: 11999 - protein, 81 aa, Vicugna pacos
CEESVTFKDVAVDFTQEEWGQLDSPQRALYRDVMLENYQNLLALGPPVCKPDVISHLERERGPRPEIGELSPQQLVIYKEE

SEQ ID NO: 12000 - protein, 81 aa, Vicugna pacos
FQEAVTFKDVAVTFTEEELGLLDPAQRKLHRDVMLENFRNVVSVGHQSSKPEMIAQLEREDKLWMTEIQTQGGVRSHSEME

SEQ ID NO: 12001 - protein, 81 aa, Vicugna pacos
PQKSVTFEDVAVYFTQTEWDGLSPAQRALYRDVMLENYGNVASLGFPLLKPAVISQLEGGGKLGGPSPLASGTGTGPQGLW

SEQ ID NO: 12002 - protein, 81 aa, Vicugna pacos
TQVSVTFEDVAVTFTQEEWGQLDPAQRTLYQEVMLENCRLLVSLGCPVPRPELICQLEHGQELWTGRKDCSQSPCPGDKGK

SEQ ID NO: 12003 - protein, 81 aa, Vicugna pacos
SQGSLSFSDVAVDFTREEWQLLDTVQKNLYRDVMLENYSNLLSLGYQVSKPEALVPLEEGREQGIVEREFPSQCRLEVMWQ

SEQ ID NO: 12004 - protein, 81 aa, Vicugna pacos
MLENYGALASLAAFPFPKPALIFQLEQGEAPWSSAPQGALDGEGPRGISSGYPFLKPAGVSHLEEVEEPLKRKLQGEGPSL

SEQ ID NO: 12005 - protein, 81 aa, Vicugna pacos
MAHGSVMFSDVSIVFSQEEWEYLDLKQRDLYRDVMLENYSNLVSLDVISLLEQGKEPWKVMRKGRGRYPDLETRYETKKLS

SEQ ID NO: 12006 - protein, 81 aa, Vicugna pacos
LQNSFAFEDLSVDFTQKEWQLLEPNQKDLYRDVMLENYSSLVSLGYKVTKPGVILKLERGEEPWVGDGGAPRADAVEQVLQ

SEQ ID NO: 12007 - protein, 81 aa, Vicugna pacos
MLETYRNLVSLGAGPAGPKPGVIAQLERGDEPWVLDLPGAEGSKQPRVRGSAHGTRTEYKELTSGEMLDGDLGQLRGTVLQ

SEQ ID NO: 12008 - protein, 81 aa, Vicugna pacos
DSWGPLSFMDVFVDFTWEEWRLLDPAQKHLYRSVMLENYNNLASLGHQHTKPSVVFQLEQEELWMMQIPSQGRAGIYLPVV

SEQ ID NO: 12009 - protein, 81 aa, Vicugna pacos
LQEPVTFADVAVLFTPEEWLFLDSAQRSLYRDVMLENYRNLASVGDQLCTPSTFSHLEPREELCITERGLFPGAHAEPQLQ

SEQ ID NO: 12010 - protein, 81 aa, Carlito syrichta
GLLTFEDVAVFFTQEEWDYLDPAQRSLYKDVMMENYGNLVSLDVLNRDKDDEPTVKQEIEEIEEEVEPQGVIVTRIKSEID

SEQ ID NO: 12011 - protein, 81 aa, Mustela putorius
MNKYQGPVTFKDVTVEFSREEWQLMNDAQRTLYREVMQENYGLLVSVGYRVNKSNSVFKLKQGKEPWILEVEFPHRNYPGE

SEQ ID NO: 12012 - protein, 81 aa, Mustela putorius
FKEAVTFKDVAVAFTEEELGLLDSAQRKLYQDVMLENFRNLVSVGHQPFKRDKWLTEREERRPWLTKTAPQIERNVGGNSQ

SEQ ID NO: 12013 - protein, 81 aa, Mustela putorius
QGQLAFRDVAVELSQEEWGRLTHTQRQLYRDVMLENYGHLCFLGLNVSKPGLITFLEQEKQLWDMKRKETKGFHPAVSSHD

SEQ ID NO: 12014 - protein, 81 aa, Mustela putorius
PQAKVTFEDVAVLLSQEEWDRLGPAQRGLYRHVMMETYGNVVSLGLPGSKPSVISQLERGEEPWVLDGHGAEETRGLGSGR

SEQ ID NO: 12015 - protein, 81 aa, Mustela putorius
HGSTAFSSVTVAFTQDGWRHLVPAPRGTPRFKEGLPENARNLVLLGLPVSQPSVNSELDQREDGPRAPQGGGLRSACPDWK

SEQ ID NO: 12016 - protein, 81 aa, Tupaia chinensis
MAPAQKTLYRDVMLENYSHLISVGYCITKPRVIFKLEQGEEPWSLEEKLLNQKYSGYLTVDVHIKGKQEKREKPLWQVILI

SEQ ID NO: 12017 - protein, 81 aa, Tupaia chinensis
SQELVTFEDVAVYFIRKEWKRLEPAQRDLYRDVMLENYGNVFSLDGETRTQNDREISEDSGSHGVLLGRFQKDISQGLKFE

SEQ ID NO: 12018 - protein, 81 aa, Tupaia chinensis
SLRSVSLKDVTVDFSHEEWQQLDLAQRILYWDVMLENYFNLISVGCHVPKLQVIFNLEQGQESCVLDGSILANQSCPGGDF

SEQ ID NO: 12019 - protein, 81 aa, Tupaia chinensis
SQDPVKDVHMMGGFSYKKNVHQIPAHRDFYQDIRKENIGNMISLGSTVSTSNKMVRLEQRKEPWAIGLHSSNKRNVLRSSY

SEQ ID NO: 12020 - protein, 81 aa, Vicugna pacos
FQGSVTFRDVAIAFSQQEWESLDSAQRDLYRDVMLENYSNVVSLGHSRSKPHVITLLEQCKEPWMVVKKDQRRQYTDFQPK

SEQ ID NO: 12021 - protein, 81 aa, Vicugna pacos
RPRAVKFADVAVYFSPEEWECLRPAQRALYRDVMQETYGHLGALGCAGPKPALISWLERNTNDWELAALDPQECPRQMTVQ

SEQ ID NO: 12022 - protein, 81 aa, Vicugna pacos
SQLTFEDVAIEFSQEEWECLDAAQRALYRDVMLETCRNLLSLDTSEVHVIKKLQLKASTERGELFQTAMLAGHERNKIKHF

SEQ ID NO: 12023 - protein, 81 aa, Vicugna pacos
CQGSFSFKDVAVGFTRKEWQQLNDSQKTLYREVMLENYSHLVSVGCQVTKPAVISRLERGQEPWMKEEEMLRWSSPVLQVD

SEQ ID NO: 12024 - protein, 81 aa, Vicugna pacos
LQEPVTFRDVAVDFTQEEWGQLGPAQRTLYRDVMLETFGHLLSVGPELPKPEVISQLEQGAELWVAERELAQGCCPGWEPG

SEQ ID NO: 12025 - protein, 81 aa, Vicugna pacos
AHGSVTFRDVAIDFSQEEWEFLDSAQRDLYRDVMWENYSNFISLGLESRYRTSILSSEKDIYEICSFQWELMERIKSCSLQ

SEQ ID NO: 12026 - protein, 81 aa, Vicugna pacos
SQHLVTFEDVAVNFTQEEWTLLDQTQRDLYRDVMLENYQNLMALGSESCKPHVNSPLEGAEELRTRARRILQKSDLQLKTK

SEQ ID NO: 12027 - protein, 81 aa, Odobenus rosmarus
ALLTFKDVVVTFTQEEWELLDLPQRTLYWKSSVLRVPGGGTLGLECLLRESRWGWECGPPWSRPAWGLARWEWTKLEGPGR

SEQ ID NO: 12028 - protein, 81 aa, Delphinapterus leucas
FEESVTFEDVAIYFSENEWTGLTPAQRALYRDVMLEDYGAVASLAAFPFPKPALIFQLERSTMELGSSGSSGWRGPEGHLL

SEQ ID NO: 12029 - protein, 81 aa, Delphinapterus leucas
MSLSFRDVAIDLSQEEWECLDPVQRALYRDVMLENYSNLVSLGCSSPKPDVITLLEQEKEPWTVMKEGTRSWYTDLESKYV

SEQ ID NO: 12030 - protein, 81 aa, Tupaia chinensis
EVTFEDVAVLLSWEEWAHLGPAQRGLYRDVMLENYRNLISVGAGPASPKPGVISQLERGDEPWVLDEQGTKGGEQLRVTSP

SEQ ID NO: 12031 - protein, 81 aa, Vicugna pacos
QGSLTFEDVAIEFSQEEWECLDPAQRILYRDVMLETCRNLLSLDIFHIHVMKKLQPKMNSDREVFQTVRLGRHESHEMKDF

SEQ ID NO: 12032 - protein, 81 aa, Vicugna pacos
SGLSNSKPAVISLLEQGKEPWMVDRELTRGLCSDLESMCETKLLSLKKRHFSQVIFTHEDIPTFIQPTFLIPHQKTIHEEK

SEQ ID NO: 12033 - protein, 81 aa, Vicugna pacos
LQNSITFEDVAMDFTQEEWTLLNSSQRKLYRDVMLENYRNLAWLGHQLSKPPLITQMEQEDDMEAAERRTHQDSCPGEMIL

SEQ ID NO: 12034 - protein, 81 aa, Vicugna pacos
FQEAVTFKDVAVVFTEEELGLLDSAQRELYQDVMLENFRNLVSVGHLPFKPDMVSQLEAEEELWMTERETQRNGCSGNRNQ

SEQ ID NO: 12035 - protein, 81 aa, Vicugna pacos
RDPPQCSVTLEDIAVHFSWDEWRLLDETQRRLYLDVMLENFALISSLGCCCGPGDAEAPFEWTVSLGGSQARTPKAALSSQ

SEQ ID NO: 12036 - protein, 81 aa, Odobenus rosmarus
KPGAVSFADVAVYFSPEEWGCLRPAQRALYRDVMRETYGHLGALGFPGPKPALISWMEQESEAWSPAAQDPEEGESLGGAL

SEQ ID NO: 12037 - protein, 81 aa, Odobenus rosmarus
FLLGLLTFRDVAIEFSQEEWGCLNHTQRELYRDVMLENYGHLLFLGLIVSKPDLVSFLEQKKEPWDVKRKKTVAIHRGRWE

SEQ ID NO: 12038 - protein, 81 aa, Odobenus rosmarus
FQGSVTFRDVAIDFSQEEWEWLQPAQRDLYRHVMLENYGHLVSLAGLDISKPYVVSLLEQGREPWLVKGDVRRDPFSESND

SEQ ID NO: 12039 - protein, 81 aa, Odobenus rosmarus
MAMYLTREEWRPLDPTQRDLYRDVMQENYGNVVSLDFEIRSENEVNPKQEISEDVEFGTASERPVENTEENPENEEAFESG

SEQ ID NO: 12040 - protein, 81 aa, Odobenus rosmarus
IEGSLTFGDVAVALTQFEWKHLDATQQALYRDVMLENYGNLVSVGLLSSKPKLITQLEQGVEPWMEVQQIPSDTCSVQEYW

SEQ ID NO: 12041 - protein, 81 aa, Delphinapterus leucas
RPRAVKFGDVAVYFSPEEWECLRPAQRALYRDVMQETYGHLGALGCAGPKPALISWLERNTDDWEPAALDPQECPRRVTVQ

SEQ ID NO: 12042 - protein, 81 aa, Delphinapterus leucas
QESVTFKDVAVDFTLEEWGQLGPGQRELYRDVMLENYQNLLSLGAGLPGSKPDVICRLERGEEPRMERREAWRVTCSDLET

SEQ ID NO: 12043 - protein, 81 aa, Delphinapterus leucas
KSQGSLSFKDVAVVFTWEEWQLLDRVQKNLYQDVMLENYINLVSVAYQVTKTDAFYRLEQETPWIIEEESQSQIHPEDTWQ

SEQ ID NO: 12044 - protein, 81 aa, Delphinapterus leucas
PHWLVTFRDVAINFSQEEWECLDPIQRDLYREVMVENYSHLISLAGCSIPKPDVFSLLERGKEPWMVVRAMTRWSSDLEYS

SEQ ID NO: 12045 - protein, 81 aa, Delphinapterus leucas
VKESVTFKDVAIDFTLEEWRLMDPTQRKLHKDVMLENYRNLVSLGLAVSKPDMISHLEDGKGPWVVVRETSKTPYSELETK

SEQ ID NO: 12046 - protein, 81 aa, Erinaceus europaeus
MSGCQELLTFRDVAIEFSQEEWESLHQTQQNLYWDVMLENYRNLVSLGLTIFKPDLVTFLEEKKEPWNVEKNDKVTIYPGR

SEQ ID NO: 12047 - protein, 81 aa, Ornithorhynchus anatinus
NFWILRLPPATNGEVPKELGNLDQGQKELYKNATKGNYETLVSLDYAISKPDLLTQMERGEEPCGRDQPGAVEAGIPPHPA

SEQ ID NO: 12048 - protein, 81 aa, Carlito syrichta
ASAFVSFEDVAVIFTEEEWEHLDLAQRTLYQEVMLDTCRLLVSLGHPVPNPELLCLLEHRQELWMVKRGLYQSTYAGEKAK

SEQ ID NO: 12049 - protein, 81 aa, Delphinapterus leucas
RVTFEDVAVYFSQEEWGLLDKTQRLLYRSVMLEIFSLMASLGCWCGAEAEDVAPEQGVYVEGVLRANLHQHQKLSSGEKPS

SEQ ID NO: 12050 - protein, 81 aa, Carlito syrichta
SRELVMFKDVAIEISQEEWECLNSAQRNLYKDVMLENYSNLVSLGLSISKPAVISSLEQGKEPWIVMREETGRWYPDLASR

SEQ ID NO: 12051 - protein, 81 aa, Delphinapterus leucas
SQESVTFKDVAVDFTQEEWALLDTSQRKLFRDVMLENISHLVSVGNQLYKSDVISHLEQGEQLSREELGFLQGQSPGREDD

SEQ ID NO: 12052 - protein, 81 aa, Carlito syrichta
MVLFQISFEDVAVDFTLEEWQLLNPLQKNLYRDVMLENYTNLVFLGHQITIPDAICKLEQEEPWIIDQKLLCQNFSELWLH

SEQ ID NO: 12053 - protein, 81 aa, Delphinapterus leucas
GQLTFEDLAIEFTQEEWECLDPAQRALYRDVMSETYRNLLSLDISHIHVIKKLQLKANTDRGEVFQTLMFQRHNWNEMKHF

SEQ ID NO: 12054 - protein, 81 aa, Carlito syrichta
RSQELLTFQDVAVDFTREEWAQLYPAQKNLYRDVMLENYRNLVALGHQLCKPEVITQLEQEEQWMIERDSPLDTHPDGENR

SEQ ID NO: 12055 - protein, 81 aa, Erinaceus europaeus
AQVSVTFEDVAVLFSREEWRKLGPSQRDLYQDVMLENYSNLVSLGLLFSKPKVISLLQQGEDPWKVEKGGPGSSCLGWKSS

SEQ ID NO: 12056 - protein, 81 aa, Erinaceus europaeus
VTYEDVAVIFTQEEWALLNPSEKKLYRDVMGENLRNFLSIEKIQELSTKKQHYLHRSQQRISYIHSNQKYERIHSGKKPYG

SEQ ID NO: 12057 - protein, 81 aa, Erinaceus europaeus
QPLESVTFEDVAIDFTQEEWALLNISQKSLFRDVMLENISHLVSMGYQHSKSDVLLHLEQEDLWSEVSRFLQGQSLGRENA

SEQ ID NO: 12058 - protein, 81 aa, Ornithorhynchus anatinus
PVTFADVAVRFSQEELERLSPEQRQLYGDVIWENYKNAVSLGEDLAFRGAAAAAGLETPQRRGRGGLRISTAPFHPSPATS

SEQ ID NO: 12059 - protein, 81 aa, Carlito syrichta
EMGLLSFKDVAIEFSAEEWACLNSPQRILYRTVMLENHRNLVFLGLAISKPDLIICLEQRKEPWDVKRHGTLAKFPAVTSH

SEQ ID NO: 12060 - protein, 81 aa, Carlito syrichta
QISFEDVAVDFTLEEWQLLNPLQKNLYRDVMLENYTNLVFLELWLHNNSKMQPQDYQDKLKSMERGYEYVFEKILNSSINF

SEQ ID NO: 12061 - protein, 81 aa, Ornithorhynchus anatinus
PKVPVTFDDVAVYFSEQEWGNLDRGQKELYKNVMKGNYETLVSLDYAVSKPDFLSRIEQGEEPCVQSLGAEEDGSAGDPNP

SEQ ID NO: 12062 - protein, 81 aa, Cervus elaphus
VFDAVTFTDVAVDFSQDEWERLTLAQRTLYKKVMLENYSNLASLGLCISKPDVISSLEQDKEPWTMKGELTRGPCADLEYV

SEQ ID NO: 12063 - protein, 81 aa, Cervus elaphus
MAHGPITFRDVVTQFFPHEWEFDPLQKKPYQDRMMENYSNLASQGHSIPQPDITVLLEQGKDPWMVVGEETRRWNTNLNSS

SEQ ID NO: 12064 - protein, 81 aa, Cervus elaphus
LQESLTFKDVAVNFTQEEWHHVDAAQRRLYRDVMLENYSHLVSLGYQVSKPEVIFKLEQGEEPWIAEGEIQRPVCPDWKTR

SEQ ID NO: 12065 - protein, 81 aa, Colobus angolensis
EMGPLTFRDVAIEFSLEEWQCLDTAQRNLYRKVMFENYRNLVFLGITVSKPHLITCLEQGKEPWNRKRQEMVAKPPVINSH

SEQ ID NO: 12066 - protein, 81 aa, Colobus angolensis
VASEDVAVNFTLEEWALLDPSQKKLYRDVMRETFRNLACVGKKWEDQSIEDWYKNQGRILSNHMEEGLSESKEYDQCGEAF

SEQ ID NO: 12067 - protein, 81 aa, Colobus angolensis
VQEPVTFKDVAVDFTQEEWGQLDLVQRTLYRDVMLETYGHLLSVGNQIAKPEVISLLEQGEEPWSVEQACPQHTCPEWMRN

SEQ ID NO: 12068 - protein, 81 aa, Colobus angolensis
AHGSVTFRDVAIDFSQEEWEFLDPAQRDLYRDVMWENYSNFISLGPSISKPDVITLLDEEGKEPGMVVREGTRRYCPDLES

SEQ ID NO: 12069 - protein, 81 aa, Colobus angolensis
KVPVTFVDIAVYFSEDEWKNLDEWQKELYNNLVKENYKTLMSLDAEGPVPKPDAPAQPEPREEPCVWEQRHPEEREISMDP

SEQ ID NO: 12070 - protein, 81 aa, Colobus angolensis
TGENVTFSDVAIDFSHEEWGWLDSAQRDLYKDVMVQNYENLVSVAGLSVTKPYVIMLLEDGKEPWMVEKKLSKGMIPDWES

SEQ ID NO: 12071 - protein, 81 aa, Colobus angolensis
AAVSLTFEDVAVLFTRDEWRKLAPSQRNLYRDVMLENYRNLVSLGLPFTKPKVISLLQQGEDPWKVEKDSSGDSSLGSKSS

SEQ ID NO: 12072 - protein, 81 aa, Colobus angolensis
PRLPLTFEDVAIYFSEQEWQDLEAWQKELYKHVMRSNYETLVSLDDGLPKPELISWIEHGGEPFRNWRESQKSGNIICSSG

SEQ ID NO: 12073 - protein, 81 aa, Colobus angolensis
SQASVSFQDVTVEFSQEEWQHLGPVERTLYRDVMLENYSHLISVGYCITKPKVISKLEQGEEPWSLEDEFLNQKYQGYFKV

SEQ ID NO: 12074 - protein, 81 aa, Colobus angolensis
MVEGEEEWQQLNPAQKTLHRDVMLETYSHLVSVGCSGIKPDVIFKLEHGKDPWIIESELSRWIYSDRVKGLESSQQIISGE

SEQ ID NO: 12075 - protein, 81 aa, Carlito syrichta
VQGSLSFEDVAVYFTREEWQFLDATQKVLYKEVMLENYGNLVSVGYQGTKPDSLFHLEQGEHPWRMEGAAHSRKCPGFVIL

SEQ ID NO: 12076 - protein, 81 aa, Ornithorhynchus anatinus
GRVEVTFKDVAIFLTQQEWESLADAQRELYTTVMLENYGHLQSLGKDTESLPHCIRQLEKGKDPVHTGERPFRCPECQKNF

SEQ ID NO: 12077 - protein, 81 aa, Desulfobacca acetoxidans
GVFVFLDEAFIDFVEEASLKTSLRRFPRLLILRSFTKFFAIPGLRLGYLLAAPELIARLAALQEPWSVNTLAQAVGRACLQ

SEQ ID NO: 12078 - protein, 81 aa, unidentified candidate division WOR-3 bacterium
MRVIIVENYDSMSRLAAKFVKEELVRKPDLVLGLATGSTPLGLYKELIRMHKEEGLDFSKVTTFNLDEYVGLPKNHPESYH

SEQ ID NO: 12079 - protein, 81 aa, Acidimicrobiaceae bacterium
RGLVGEILARFERRTLKIVAAELRTITPELAAKHYEEHVGKGFYDELVSFIGRSPSLVFVLEGPEDTWKVVRDMMGATNPR

SEQ ID NO: 12080 - protein, 81 aa, Armatimonadetes bacterium
CRVWIDETYVDFAPEGWCCEAIAARDRRVVVAKSMSKFYALSGLRVGYLVANPEWIASLEPMSPPWSVGLVAQVAAVEALR

SEQ ID NO: 12081 - protein, 81 aa, Cellulomonas gilvus
SGNHFIEVSVDETGGVWLFLHSGSRGVGNKIAQHHIKVATELCRRWWIALPDPDLAYLVEGTEEFWAYVRQLRWAQHFALL

SEQ ID NO: 12082 - protein, 81 aa, Chelonia mydas
MPVTFEDVAVYFSEGQGALLDPGQRALYRDVMQENYETVTSLGLSIPKPDLIARLEAGEELWVPDLQDPKESNIQRGSRTG

SEQ ID NO: 12083 - protein, 81 aa, Chelonia mydas
REPVTFEEVAVYFTQGQGPLLDPGPRALYRDVMQENYEMVTSLGGAGMVSQNEEENPQREGGEDMGLQGTVLGRSEGNFYQ

SEQ ID NO: 12084 - protein, 81 aa, Chelonia mydas
VTFEEVAVYFSEEEWALLDPGQRALYRDVMQENYETVTLLGTDSCLDSLSVPAGDGTVSETEEENPEQEGPERVEPQGTVL

SEQ ID NO: 12085 - protein, 81 aa, Platysternon megacephalum
FQALVAFEEVAVYFSREEWGLLDEGQRQLYRDVMQENYQTLISLGVPVPDPAAISWMERGEEPGVPDLQGSEEREIMRGTG

SEQ ID NO: 12086 - protein, 81 aa, Chelonia mydas
FQMLVTFEEVAMYFTEGQAALLDPSQRALYREVMQENYEMVTSLGFPIPKPDLIARLERGEEPWVPDLQADKERESPRDTH

SEQ ID NO: 12087 - protein, 81 aa, Platysternon megacephalum
FQMPVMFEEVAVYFSEDEWALLDEKQKELYRDVMQENYERLISLGFLIAKPDVLSQMERGEEPWFPDLQGSEEREIPRGTS

SEQ ID NO: 12088 - protein, 81 aa, Chelonia mydas
YSMSLTFEDVAMYFSPAEWALLGEEQRQLYKHVMWENYQTLVSLGIQTPKPVVISSIERGEELCVQGPTEDEDEDVLSGTR

SEQ ID NO: 12089 - protein, 81 aa, Chelonia mydas
QMPVTFEEVAVYFTEGQGALLDPAQRALYRDVMQENHETVTSLAGDRTVSENKEENQQQEGPEQVEPQERFLRKADGNFSQ

SEQ ID NO: 12090 - protein, 81 aa, Micrurus surinamensis
LVSFKEVAVYFSEHEWSQLDSDQKALHSEVMVENHRNVVSLGNNMQENQDSCELFQVINAKDGTEKFVIRMEFKSHERNLS

SEQ ID NO: 12091 - protein, 81 aa, Micrurus surinamensis
FDHVEEVALDFTEEEWRLLDSGQKALCWEVMREVFRNMAALDDGPANENDKSAKLTLQQLEKNEVEVMFGTQGDITRQERS

SEQ ID NO: 12092 - protein, 81 aa, Micrurus surinamensis
ATSQSLVSFEEVAVYFTEDEWELLDPSQKALYGEVMLENSRNVAALAYGQEHENNKKPSMVVFQMIKSEKDVLQNQEPSQR

SEQ ID NO: 12093 - protein, 81 aa, Chelonia mydas
AQMLVTFEEVAVYFTQGQGALLGPAQRALYRDVMQENYEMVTSLGFSLPKPELISRLERGEEPWVPDLQACEKRESLRGAR

SEQ ID NO: 12094 - protein, 81 aa, Chelonia mydas
LQVPVTFEDVAVYFSPEEWAALEEWQRELYRDVMMENYELVASLGSVGPKPKASARKAKREKAPYVWDHQYSRAKVLVLPA

SEQ ID NO: 12095 - protein, 81 aa, Chelonia mydas
PKVPLAFENDAVYFSEQEWQNLEEWQKELYKNVMKGNYESLISLDYALSKPDLLARIERGEAPCEGEEGDAEERGIPAEPS

SEQ ID NO: 12096 - protein, 81 aa, Ficedula albicollis
LQIPVLFEDVAVRFSQQEWASLDEGQKEMYRSVMEGNYEMLVSLYCALYKPELLLQLEREELSTPPESEPEAAEVSPELTV

SEQ ID NO: 12097 - protein, 81 aa, Chelonia mydas
MSVTFEDVAVYFTEEQGTLLDPSQRALYRDIMQENYEMVISMAGLLIPKPDLIARLERGEEPWVPDLQASEERKIPRGTHT

SEQ ID NO: 12098 - protein, 81 aa, Chelonia mydas
PAQGLVAFEEVAVYFTREEGALLDPAQRALYRDVMQENYENVTSLGERPYECSECGKQFSERSSLNKHQTSHTEERPYECC

SEQ ID NO: 12099 - protein, 81 aa, Chelonia mydas
PKVPVTFNNNSFNFSEQEWKSLDEWQKELYRHIMKGNYEAVISLDAAISKPDLLSRIERGEEPSVGDQSDSEERQIPADPG

SEQ ID NO: 12100 - protein, 81 aa, Pterocles gutturalis
VPKVPTSEGEATCFSAHKRENLEEWQRELYRNVLRAKNEPLISLDDAIAKPDLLSWLQRGESPGSGDKVASGEVPAEPTDC

SEQ ID NO: 12101 - protein, 81 aa, Chelonia mydas
AQGPLTFEEVAVYFTREEGSLLDPTQRALYRDVMQENYETVVLLGDGMVSENKDEKPQQKYAEQVEPHRKLSGRSKGKVSG

SEQ ID NO: 12102 - protein, 81 aa, Chelonia mydas
AAGLVTFEEVAVYFTQGEWALLDPTQRALYRDVMQENYETVVFLGFLVSKPDVISQLERGEELWVPDLQGSEKEVLPRAAC

SEQ ID NO: 12103 - protein, 81 aa, Chelonia mydas
PKVPVKFDEVSGCFSGQEWGVLEQRREELHKNTMRNNYETLISLGSPISTPSDSSWIKQEETPCAESQGGLVEREIPTDPI

SEQ ID NO: 12104 - protein, 81 aa, Chelonia mydas
MYFSPVEWVLLGEEQRQLYRHVMWENYQTLVSLGIQTPKPVVISNIERGEELCVQGPTEDDEDVLSGTCPGEEGVKVLSRE

SEQ ID NO: 12105 - protein, 81 aa, Chelonia mydas
PEVPVQFKDVAVTLAEAEWLLLDEEQRQLYGTVMQETYRSISSLGCPVRKPALISQLERGEEPCIPDPPAPEEQETQRDVP

SEQ ID NO: 12106 - protein, 81 aa, Chelonia mydas
MEPWVMLDPRQRALYRDVMQESYETLMSLAADGLVSDNEEEDAEEEEEEEEEEGSEELEPRTSQNPEWEKSPAGSDEQKKA

SEQ ID NO: 12107 - protein, 81 aa, Charadrius vociferus
PKAPAAFESDAADFSAQEWENLEDWQRELYKNVLRGKNESLISLDYAISKPDLLSRLQREVPCNGDKAASREIPAEPNYSV

SEQ ID NO: 12108 - protein, 81 aa, Chelonia mydas
PGIPATFEEVAVYFTKEEGALLDPTPRALYRDVMQENYETVVRQGDGMVSEEDAEQVEPHGMLSGISKGNVSGSCALPEKA

SEQ ID NO: 12109 - protein, 81 aa, Chelonia mydas
MLVTFKEVAVYFTQGQGALLDAGQRALYRDVMQEIYETVTSLAGSDRSSGNRSAVASGTPPQREAEVVSTGERRPSIPRHE

SEQ ID NO: 12110 - protein, 81 aa, Chelonia mydas
QEPVAFEEVVVYFAREEWALLDPAQRDLYWDIMQENYENVTSLGFPVSKPEVMSQLKQGEELWISDLQSSGEREILRGTCP

SEQ ID NO: 12111 - protein, 81 aa, Chelonia mydas
MGAFPIPKPEVISQLERGEEPRVTELWGYVERELFKNTCTGDGLVGENKEKNPGQEGPEQVELQGTLQGRCEVEVSQSPDK

SEQ ID NO: 12112 - protein, 81 aa, Chelonia mydas
MPVTFEEVAVYFTQGQGALLDPAQRALYRDVMQENYETVTSLGFPIPKPELIAQLERGEEPWVPDLQASEKKEVPRVTHTA

SEQ ID NO: 12113 - protein, 81 aa, Chelonia mydas
QGSVTFEEVAVYFTKEEWSLLDPAQRALYRDVMQENYENVTSLELGSWRVAAVGQVPSSEGSPLPAAAQKAEILDSSHCSP

SEQ ID NO: 12114 - protein, 81 aa, Chelonia mydas
GGLRVAFEDVALYFSREEWELLSRPEKQLYRDQMLRNYRALVSLGYSGSTPDLIHRIEVGEAELWIQDVEDSRENSGPESP

SEQ ID NO: 12115 - protein, 81 aa, Chelonia mydas
GEVPKVPVTFDDVSVYFNEKEWEKLDEWQKELYKNVMKGNYESLVSLDDGIVIKTEEEDDPDTLEPYAMFSGRAEQQIFQN

SEQ ID NO: 12116 - protein, 81 aa, unidentified Halomonas sp. BC04
VTVVVDEAFIDFVDEPGAALTSLLPRFDNLVLLRSLTKLYTLPGLRLGYLLADAETVRRLQAGQPPWSVNHLSAALVAPLL

SEQ ID NO: 12117 - protein, 81 aa, Thalassotalea sp. 42_200_T64
GSVKGQYKTAMIYLTNEEYKDLDKGVKYLKKAARSKNVDAAFLLGVIYYKPDFYERDLEEADKWLAKAYVWRHKKINAFIE

SEQ ID NO: 12118 - protein, 81 aa, Streptomyces sp. SID11726
VDEAFADITLDPGTRQGEPASIADRRADDMAVIRSVTKTFGLAGLRAGYLLAAPDVIARLTVGRRPWPLGTLALTALAECV

SEQ ID NO: 12119 - protein, 81 aa, Acidimicrobiaceae bacterium
RGLVGEIIGRFERKGLRIVAAELRTLDRDVLDRHYAEHVGKGFYDDLVAFMGRGPVVVAVVEGPEDTWSVVRQMMGATNPM

SEQ ID NO: 12120 - protein, 81 aa, Acidobacteria bacterium
CLALVIAIVFNYLAAFWIKLPTKHTAIYRRIGPETGPQVFCAGSSLLQFALSWPEVSEILDQGIESWGMAASTPSEWEVFQ

SEQ ID NO: 12121 - protein, 81 aa, Bacteroidetes bacterium GWA2 30 7
NVTFEQIALEFSPEIAKGVLALTKNESLEKELQLEDSVNRILLEPKEIWIVKMADRITNLQKPPDSWTFEKKESYKKEAIM

SEQ ID NO: 12122 - protein, 81 aa, Magnetospirillum kuznetsovii
RLPTGTLDRLVAFTAEELAALEAATRLFERDNREDEAAELATLGAKLRALLKPEVARRVEPDLEALLEAEGLAMRPGPRPR

SEQ ID NO: 12123 - protein, 81 aa, Actinobacteria bacterium
HTGPFRIIEYFTNRWNDEVTIYDMEKHFHMSSEELRDVSQSSLYRHLRLLKGKGIIRNNSPTWSLAPKYRDYFERYKENWS

SEQ ID NO: 12124 - protein, 81 aa, Leptotrombidium deliense
CPLEPLTLRDVTIDFSEEEWECLDPAQQTLYRDVMSEIYRNLIFLVQISAHNLEIEYTSVEVEWSVRKKNWKNNCLESSKI

SEQ ID NO: 12125 - protein, 81 aa, Loxodonta africana
QESVTFKDVAVDFTQEEWHHMDPTQRILYRDVMLETYSHLVSLGYQVSKPEVIFKLEQGEEPWISEEEIQRPFCPDWEIRP

SEQ ID NO: 12126 - protein, 81 aa, Loxodonta africana
LQGTVTFRDVAIDFTQEEWQQLDPAQRNLYRNVMLENYNNLITVGCPFTKPDVIFKLEQEEEPWVVEKEVLRRHCPGEVWG

SEQ ID NO: 12127 - protein, 81 aa, Capra hircus
EAVTFGDVAVHFSREEWQCLDPGQRALYKEVMLENHSSVAGLAGFLVFKPELISRLEQGQDPWVLDLQGAEGREAARTTRT

SEQ ID NO: 12128 - protein, 81 aa, Capra hircus
VTFEDVFVSFSQEEWGLLDETQRLLYREVMLENFALMASLGCWHGMEEDEIRFEQSISVNRVSKGMIPKMIPSSQKAHPCE

SEQ ID NO: 12129 - protein, 81 aa, Capra hircus
MASPSPPPQPKEEWDYLDPAQRSLYKDVMMENYGNLVSLDVLNRDKDEEPTVKQEIEEIEEEMEPQGIIVTRIKSEIDQDP

SEQ ID NO: 12130 - protein, 81 aa, Capra hircus
LQNSITFEDVAINFTQKEWALLNSSQRMLYKDVMLENYRNLASLGHQLCKPPLITHLEQEDEMKIVERRIHQDTCSYEIIL

SEQ ID NO: 12131 - protein, 81 aa, Capra hircus
MDPVAFEDVAVNFTLEEWALLGPSQKKLYRDVMRETLSNLALIRDKWEDHNTEDQYRIQERNLRCHMLQRLCESKEGSQCG

SEQ ID NO: 12132 - protein, 81 aa, Chlorocebus sabaeus
MGPLQFRDVAIEFSLEEWHCLDTAQRNLYRDVMLENYRNLVFLDLITCLEQGKKPLTMKRHEMIAKPPDVWSEQSIKDSFQ

SEQ ID NO: 12133 - protein, 81 aa, Chlorocebus sabaeus
SQHLVTFEDVAVDFTQEEWTLLDQTQRDLYRDVMLENYKNLIILAGSELCKPSLTSGLEQMEELRTGVTGVLQELDLRLKT

SEQ ID NO: 12134 - protein, 81 aa, Chlorocebus sabaeus
MKPDVIFKLEQGEEPWVGDGEIPSSDSPEVWNVNGNMMWHQDNQDKLKIIKRGHECDAFGKNFNLNMNFVPLRKSNNEGDL

SEQ ID NO: 12135 - protein, 81 aa, Chrysochloris asiatica
VIVEDVAVVFSQEEWALLDLVQRKLYRDVMIETFRNLASVVSHNINSGEKLPSEQVMVRFIKNSTWSSMLEVFKRHVNKDQ

SEQ ID NO: 12136 - protein, 81 aa, Chlorocebus sabaeus
GPLTFRDVAIEFSQEEWKSLDPVQKALYWDVMLENYRNLVFLGILPKCMTKELPPIGNSNTGEKFQTVMLERHECYDIENF

SEQ ID NO: 12137 - protein, 81 aa, Suricata suricatta
MDVAVEFSQEEWGCLNHSQWELYRDVMLETYGHLVFLGLVVSKPDLVIFLEQKRELWDVKRKETVASFPAVFPNETDSLLL

SEQ ID NO: 12138 - protein, 81 aa, Chrysochloris asiatica
QAQDSLTLEDVAVEFTGEEWQLLAPAQKALYRDVMLENYSHLVSVGYIACEQDTLVRLDRGELWTVGGEIHCRTSSEIGKV

SEQ ID NO: 12139 - protein, 81 aa, Suricata suricatta
LVMFKDVAIDVSQEEWECLNPTQRSLYRDVMLENYSNLVSLDLVSRCEAKKLSPKRDIFETESSQWAIVEEFKGHNPEKSI

SEQ ID NO: 12140 - protein, 81 aa, Suricata suricatta
PRSLLTFRDVAIEFSQEEWGCLNHSQWELYKNVMLENFGHLLFLGLVVLRPDLVIFLEQQREVSDMKRKETVASYPVFFFR

SEQ ID NO: 12141 - protein, 81 aa, Suricata suricatta
MDTSERTLYRDVMLENISHLVSVGMKNNHNKEEIIPMQDICTKDPPNCWTVKCHAGEDLCLYSGYDEIFTHAYTLTQHVLN

SEQ ID NO: 12142 - protein, 81 aa, Chrysochloris asiatica
QQEVVTFEDVAVYFTRTEWAGLSPVQRALYRNVMLENYGNLTSLGYLVPKSSLVSLPEAGDLSRNMKSQDDPPAEMTEDIY

SEQ ID NO: 12143 - protein, 81 aa, Suricata suricatta
TQDPVVFEDVAVDFTQEEWALLNLAQRNLYRDVMLENFQNLASLGYPLHIPYLISQWKQEEDLGTVERGTIQGEHQEGFET

SEQ ID NO: 12144 - protein, 81 aa, Chrysochloris asiatica
KRDSVIFEDVAVVFSQEEWALLDFSQRQLYRDVMMETFRNLESAFVDQSSFKHHIRSHTGYKSHHCTECGENCICPSYLKP

SEQ ID NO: 12145 - protein, 81 aa, Chrysochloris asiatica
GQEPVTFKDVAVDFSQEEWGWLDPIQRTLYRDVMLETFGHLLSVGNEITKPEVISLLEQGEEPWTVERDCPASSYPDECDV

SEQ ID NO: 12146 - protein, 81 aa, Chlorocebus sabaeus
ESVTLEDVAVEFIQEWALLNSARRSLCRYGMLDQCRTLTSRGTPPCKPSCVSQLGPRAEPRATERGILHATGVAWESQLKP

SEQ ID NO: 12147 - protein, 81 aa, Chrysochloris asiatica
MFTREEWQLLAPAQKALYRDVMLENYTNLASVATFPESQISSRTRSKKHQLFKHQKREKLHVGSECGEALVKKSFLTDHQI

SEQ ID NO: 12148 - protein, 81 aa, Mandrillus leucophaeus
WPESVTFEDVAVYFTQNQWASLDPAQRALYGEVMLENYANVASLVAFPFPKPALISHLERGEAPWGPDPWDTEIPRGISQG

SEQ ID NO: 12149 - protein, 81 aa, Mandrillus leucophaeus
EMGLLTFRDVAIEFSLEEWQHLDIAQQNLYRNVMLENYRNLAFLGIAVSKPDLITCLEQGKEPWNMTRHEMVDKSPGLYFL

SEQ ID NO: 12150 - protein, 81 aa, Mandrillus leucophaeus
SKGSLMFRDVSIDFSQEEWECLDSGQMNLYKEVMLENFSNLVSVGLSSSKPAVISLLEQGKEPWMVDRELTRGLCSDLESM

SEQ ID NO: 12151 - protein, 81 aa, Mandrillus leucophaeus
MIKTQEYLTLEDVAKDLYQDVMVENYNHLVSLGYQTSKQDALSRLAHGQEPWITDAKIQNKNCPGIRKVDSHLQDVQQCSG

SEQ ID NO: 12152 - protein, 81 aa, Sus scrofa
AQGLMAFEDVAVYFSREEWGLLDTAQRALYRRVTLENFALLASLGLSVSRPRVVTQLERGEEPWVLSGTDVTLARNAQSRP

SEQ ID NO: 12153 - protein, 81 aa, Mandrillus leucophaeus
ACESITFGDVAIDFSHQEWEYLNLVQKTLYQEVMMENYDNLVSLGHFISKPDLITLLEQGKEPWMIVGEETRGECTDLDSR

SEQ ID NO: 12154 - protein, 81 aa, Mandrillus leucophaeus
DSVTFDDVAVDFTQEEWTLLDPTQRSLYSDVMLENYKNLATVGWEMQLETQWSALQQDSLTGQTSIGMQLEGKHNGGELCD

SEQ ID NO: 12155 - protein, 81 aa, Mandrillus leucophaeus
EDSVTFDDVAMEFTPEEWALLDTTEKYLYRDVMLENYMNLASVGKSNITLLEWEIQPRIKGSSLQQGFLKNPIFNGIQMQT

SEQ ID NO: 12156 - protein, 81 aa, Mandrillus leucophaeus
MLENYRNLVFLGIAVSKPDLIIFLEQGKEPWNMKRHEMAEEPPVICSHFAQDLWPEQGIEDSLQKVTLRRYEKCGPQNLQL

SEQ ID NO: 12157 - protein, 81 aa, Mandrillus leucophaeus
EDVAVDFTLEEWALLDSAQRNLYRDVISVSRFEMWERTKTQFKANGSVSQQDMYGEEKSKEQTIPNFTRNNSCAYTLEKTC

SEQ ID NO: 12158 - protein, 81 aa, Mandrillus leucophaeus
GLVTFGDVAVDFSQEEWEWLNPNQRNLYRKVMLENYRNLASLGKGDCISVWTPDVISSLEQGKEPWTVKRKMTRAWCPDLK

SEQ ID NO: 12159 - protein, 81 aa, Sus scrofa
AQESVMFSDVSIDFSQEEWECLNDDQRALYRDVMLENYSNLVSMAGHSISKPDVISFLEQGKEPWLVDRELTRGQWPVLES

SEQ ID NO: 12160 - protein, 81 aa, Sus scrofa
EQGRVVFEDVAISFSQEEWGLLDEAQRRLYHAVMTEILALLTSPGCWHGAQDEEARSEQALSVAVSPARTPEPDPSTRTAR

SEQ ID NO: 12161 - protein, 81 aa, Sus scrofa
VSETSAFRDVFVDFTLEEWQQLDAAQKTLYRDVTLENYSHLLSVGYLVAQPEGIFSLGQAEGAGKADGEAPTRSGPEFWQA

SEQ ID NO: 12162 - protein, 81 aa, Sus scrofa
KVPVTFVDIAVYFSEDEWKNLDEWQKELYHNLVKENYKTLMSLDAEGPVPKPDAPSQAEPSDEPCVWEQRDPEGREILMDP

SEQ ID NO: 12163 - protein, 81 aa, Sus scrofa
RESGKAPVTFDDITVYLLQEEWMLLSQQQKEICGSDKLVAPLEPTLASSELFYKFEQGPEPWLANVQDQRNLLNCHPGKNK

SEQ ID NO: 12164 - protein, 81 aa, Sus scrofa
MMFRDVSINFSQEEWECLDSGQMNLYKEVMLENFSNLVSVGLSNSKPAVITLLEQGKQPWMVDRELTKGLCSDLESMCETQ

SEQ ID NO: 12165 - protein, 81 aa, Sus scrofa
PQEPAEYEFLSVDYTQKKWKGPALSQRALYRNIVPENCHSLASLGENGMECSDLPPKQESSKESEASDRTSGVLYEVIPGG

SEQ ID NO: 12166 - protein, 81 aa, Bos mutus
RSIVTFEDVFIHFTREEWDLLTESQKRLYHKTMVNNFSLVMSVGLESSRYRLISPPEPESAPEVPARIGIAAAVAEVSQES

SEQ ID NO: 12167 - protein, 81 aa, Neophocaena asiaeorientalis
AQEPVTFKDVAVDFTQEEWGQLDPVQRTLYRDVMLETYGHLLSVGNKIAKPEVISLLEQGEEPWSVEQAYPPQGTCPERHT

SEQ ID NO: 12168 - protein, 81 aa, Neophocaena asiaeorientalis
PQGCAISEDVFVYFSREEWVLLDEDQRLLYRDVMLENFALLASLGIASSRSHLVTQLEQGEEPWMPAQVDMTPATEKEAQK

SEQ ID NO: 12169 - protein, 81 aa, Nomascus leucogenys
FQGSVTFRDVAIDFSQEEWKWLQPAQRDLYRCVMLENYGHLVSLGLSISKPDVVSLLEQGKEPWLGKRDVKRDLFSVSESS

SEQ ID NO: 12170 - protein, 81 aa, Nomascus leucogenys
EKGPLTFRDVAIEFSLEEWQCLDTAQQGLYRKVMLENYRNLVFLAGIAVTKPDLITCLEQGKEPWNMKRHEMVAKPPVICS

SEQ ID NO: 12171 - protein, 81 aa, Nomascus leucogenys
PLTFKDVAIEFSQEEWKCLEPVQKALYKDVMLENYRNLVFLGISPKCVIKELPPTENSDTGERFQTVTLERHQSYDIENLY

SEQ ID NO: 12172 - protein, 81 aa, Nomascus leucogenys
WPESVTFEDVAVYFTQNQWASLDPAQRALYREVMLENYANVASLVAFPFPKPALISHLERGEAPWGPDPWDTEIPRGISQG

SEQ ID NO: 12173 - protein, 81 aa, Bos indicus
QAQETLTFDDVAVDFTWEEWQLLAPAQKALYRDVMLENYSNLVSAGFQASTPEVVSKLDQGEPWMMDDETHCQTRSEVWKF

SEQ ID NO: 12174 - protein, 81 aa, Bos indicus
LQGSVSFEDVAVDFTRQEWHTLDLAQRTMHRDVMLENYSNLASVGLCVAKPEMIFKLERGEELWILEEESSDNGYTGSFSL

SEQ ID NO: 12175 - protein, 81 aa, Bos indicus
FQGLVSFKDVAVGFTQEEWQHLDSTQRSLYRDVMLENYRNLVSVGFCITKPEVIFRLEQGEEPWILEEEFLAQSFSEVWKT

SEQ ID NO: 12176 - protein, 81 aa, Bos indicus
MLENYSSLVSLGYEVMKPGVILKLEQGEDPWTGDGEIPSSASIDQVFQVNGHMTWHKDNKKFKNMKQDHECAALGKKFNLS

SEQ ID NO: 12177 - protein, 81 aa, Bos indicus
MLETCSHLLSIGYQVPETKVFMLEQGKEPWALQGEGPYQSCPGEKLRDHNQCGKILNYKQVPSQHQKIHTGVKFYECPEFG

SEQ ID NO: 12178 - protein, 81 aa, Bos indicus
PRVPVTFDDVAVYFSEPEWGKLDEWQKELYKHVMRGNYEMLVSLDYAISKPDILTRMERGEEPCPEGPWGREEGNEREEVC

SEQ ID NO: 12179 - protein, 81 aa, Bos indicus
GKESVMFSDVSIDFSLEEWEFLNLEQRDLYRDVMLENYSNLVSLGCFISKPDVISLLEQGKEPWKVVRKGRRQYPDLETNY

SEQ ID NO: 12180 - protein, 81 aa, Bos indicus
QVSIAFQDLAVRFSEDEWRLLGEGQRALYLDVMRENYDTLASLGTAEPLPLSAFLSPSEPGGAVGARSRAGDRQEPPQGGG

SEQ ID NO: 12181 - protein, 81 aa, Bos indicus
MSQESLTFQDVAVDFTREEWDQLYPAQKNLYRDVMLENYRNLVALGHQLYKPEVITQLEQEEQWMMGRVSPPDTHPDGENR

SEQ ID NO: 12182 - protein, 81 aa, Bos indicus
ASQGWMTFQDVAIDFTQEEWECLDLSQRELYRDVMLENYGNLASLGLVSNLDLVTFLEPLKDPRNIRRMGTTVIYPGVSPQ

SEQ ID NO: 12183 - protein, 81 aa, Bos indicus
QERLTSEDVAIEFTQEEWEFLDPAQRALYRDVMLETYRNLLSVDISPTHVIKHLQLKANSEKLETFQTSMLGRPESCEIKH

SEQ ID NO: 12184 - protein, 81 aa, Canis lupus
ARELVTYEDVAVDFTQEEWQHLDPAQKTLHRDVMLEIYSHLVSVGCSGIKPGIIFKLEHEEDPWIKKSELSRWIHSDREES

SEQ ID NO: 12185 - protein, 81 aa, Bos indicus
MGMAGLISEGFVQRCHVGELQELGLSISKPNMISLLEQGKEPWMVEREMSDGQHADWESWYEIKALSPKWYTDEEEISQGV

SEQ ID NO: 12186 - protein, 81 aa, Capra hircus
MFQVTFSDVAIDFSHEEWRWLNSTQRDLYKDVMVQNYENLVSLGLSIPKPYVIALLEDGREPWMVEEKLSKDMFSDCKSRW

SEQ ID NO: 12187 - protein, 81 aa, Capra hircus
SQESVTFQDVAVDFTEKEWPLLDSTQRKLYKDVMLENYSNLASVGCQMGKPSLISHLEQEEELRTEDRELHRGPCPDWATP

SEQ ID NO: 12188 - protein, 81 aa, Capra hircus
RPRAVKFGDVALYFSREEWGCLRPAQRALYRDVMQETYGHLGALGCAGPKPALISWLERNTDDWETAALDPQECPKGVAVQ

SEQ ID NO: 12189 - protein, 81 aa, Chlorocebus sabaeus
WSQMPVTFEDVALYLSREEWGRLDHTQQNFYRDVLQKRNGLSLGFPFSKPFWAPQAQGKGEASGSSRQTGDEKEEWRGAYS

SEQ ID NO: 12190 - protein, 81 aa, Chrysochloris asiatica
SLEQVSFKDVCVDFTQEEWYLLDPAQKILYRDVILENYSNIVSVGHCGTKPEVIFKIEQGEEPWVLGEGFSSLQHPERNWK

SEQ ID NO: 12191 - protein, 81 aa, Chlorocebus sabaeus
KSLVTFEDVAVYFSQEEWELLDAAQRHLYHSVMLENLELVTSLGCWHGVEGEEAHPKQNISVEEVLLVRIPNADSSTKKAN

SEQ ID NO: 12192 - protein, 81 aa, Chrysochloris asiatica
LLLTFEDIAVYFSEQEWQNLEAWQRDLYKHVMRANYEILASLGGQQAVEAGDSEGHFPPDPGRTPGRPHGHPAARYSREAL

SEQ ID NO: 12193 - protein, 81 aa, Chlorocebus sabaeus
GMEPLQFRDVAIEFSLEEWHCLDTAQQNLYRDVMLENYRNLVFLGIVVSKPDLITRLEQGEKPLTVKRHKMTANPSVMCSH

SEQ ID NO: 12194 - protein, 81 aa, Chlorocebus sabaeus
MGPLQFRDVAIEFSLEEWHCLDTAQRNLYRDVMLENYRNLVFLGIVVSKPDLVTCLEQGKKPMERHEMIAKPPVVSSHFAQ

SEQ ID NO: 12195 - protein, 81 aa, Suricata suricatta
FQESVMFSDVSIDFSQEEWECLNDDQKDLYRDVMLENYSHLVSMAGHSVSKPDVISFLERGKEPWLVGRELTRDQWPVLES

SEQ ID NO: 12196 - protein, 81 aa, Chrysochloris asiatica
LFTFKDVAVEFSQEEWDCLAPAQRALYRDVMLENYRNLVSLDFFSKSLMKELPPKEIVSKGELFQRMMLERHESHDTEGVY

SEQ ID NO: 12197 - protein, 81 aa, Chrysochloris asiatica
RPTGLLTLRDVIIEFSQEEWDCLNLPQKALYRDVMLENYRNLVSLGVSSRCMLKELLPDENITKGELFQTMIISPDVNFNI

SEQ ID NO: 12198 - protein, 81 aa, Chlorocebus sabaeus
QESLTLEDVAVEFSWEEWQLLDTAQKNLYRDVMVENYNHLVSLGTGYQTSKPDVLSKWAHGQEPWITVAKIQNKNCPGIGK

SEQ ID NO: 12199 - protein, 81 aa, Chrysochloris asiatica
TQDSLTLEDVAVEFTGEEWELLAPAQKALYRDVMLENYSHLVSVGYQVPQPDALSRLARGELPCSMPDSSHSQDYSEFQNV

SEQ ID NO: 12200 - protein, 81 aa, Suricata suricatta
LQGPLSFEDVAVTFTQEEWQQLDLAQRTLYRDVMLENFSHVVSLGHPVSTPDVISKLEQGEEPWIIKRDVSERETRLDNPQ

SEQ ID NO: 12201 - protein, 81 aa, Chlorocebus sabaeus
HRGPLTFMDVAIEFSLKEWQCLDTAQQNLYRDVMLENYRNLVFLGIASSKPDLITYLEQGKEPWNMKRHETVAKPLVMCSY

SEQ ID NO: 12202 - protein, 81 aa, Suricata suricatta
GNQESLTLEDVAVDFSREEWQLLAPAQKDLYRDVMLENYRNLVSLGYHASKPDALSKLEQGELWTIEDAINSRIRPEIRKV

SEQ ID NO: 12203 - protein, 81 aa, Suricata suricatta
MSKDLVTFGDVAIDFSKEEWEWLNPAQRNLYKKVMLENYRNLVSLGVSVSKPDVISLLEHGKEPWMVKEGTRGTYPDWEYA

SEQ ID NO: 12204 - protein, 81 aa, Suricata suricatta
PQEPVTFEDVAVYFTRNQWAILDLAQRALYREVMLENYTNVASLVAFPFPKPPLVSRLERGDAAWGPDPWQAEVLRGLRPG

SEQ ID NO: 12205 - protein, 81 aa, Chlorocebus sabaeus
FQEQVTFEDVVVDFSQEEWGQLKPAQRTLYRDVMLDTFRLLVSVVGHWLPKPNVISLLEQEAEPRAVDSGVPPGVYPDLET

SEQ ID NO: 12206 - protein, 81 aa, Suricata suricatta
MYFTNFSNVLKPNFSLSGCHMTKPDVILKLERGEEPWTSFTGHTCLEENWKDEDFLVKFKENQDKFCRSVVFINHKKLIKE

SEQ ID NO: 12207 - protein, 81 aa, Chrysochloris asiatica
EGPVVFEDVAVDFSLEEWALLGPAQRKLYRDVMLETFRNLASVDDETPLKASGPVSQQDAHQEQISQEDNVQKSTRNASWS

SEQ ID NO: 12208 - protein, 81 aa, Chlorocebus sabaeus
MYKQEMKTNYQTLDSLGYAFSKPDLITWMEQGRMLFISEQGCLDKTRRTTSPPTDEQLDMKDTGKLPCFDHEGTLRTKEED

SEQ ID NO: 12209 - protein, 81 aa, Sus scrofa
AQGSLTLEDVAVDFTWEEWQLLTPDQKDLYQDVMLENYGNLVAVGHQVSKLGVLSKLEQREPPPTLEDAVHSHPHPETEKV

SEQ ID NO: 12210 - protein, 81 aa, Mandrillus leucophaeus
TNGPLTFRDVAIEFSLEEWQCLDTAQQGLYRKVMLENYRNLVFLAGIAVTKPDLITCLEQGKEPWNIKRHEMVAKPSVICS

SEQ ID NO: 12211 - protein, 81 aa, Sus scrofa
LQGLVTFEDVAVYFSLEEWERLDSEQRELYKEVMQENYGILVSLGYPIPKPDLISRLEQGEEPWVPDSPRPEDGDIVTGVY

SEQ ID NO: 12212 - protein, 81 aa, Sus scrofa
GSVSFTDVTVDFTQEEWEQLDPSQRILYMDVMLENYSNLLSVEVWKADDQMEKDHRNPDEQARPFIIFKNQTPIEERDHHL

SEQ ID NO: 12213 - protein, 81 aa, Sus scrofa
LRFASDVTVDFSREEWQHLDPAQRRLYRDVTLENYSHLRSVGYHVPKPEVICKLEQGEGPWTLEEETPHQSYSGERNIGQT

SEQ ID NO: 12214 - protein, 81 aa, Mandrillus leucophaeus
VASEDVAVNFTLEEWALLDPSQKKLYRDVMRETFRNLACVGKKWEDQSIEDWYKNQGRILSNHTEEGLSESKEYDQCGEAF

SEQ ID NO: 12215 - protein, 81 aa, Sus scrofa
TPEPVKFADVAVYFSPEEWAYLRPAQKALYRDVMRETYGLLGALGFRGTKPALISWVEQEAELWGLEARDPEVGECLTEAD

SEQ ID NO: 12216 - protein, 81 aa, Mandrillus leucophaeus
KEASVAFRDVAVDFTQEEWRLLSPAQRTLHREVMLETYNHLVSLEIPSSKPKLIAQLERGEEPWREERKCSLDLCPESKPE

SEQ ID NO: 12217 - protein, 81 aa, Sus scrofa
TMTFEDVAVNFSWEEWGLLDEAQRRLYHDVMLENLALITSLGCWCGAEDEEGLSERSISVQGGSQIRTVKAALSTQKANPY

SEQ ID NO: 12218 - protein, 81 aa, Sus scrofa
AQSLLTFEEVAIYFSQEEWELLDPTQKALYNDVMHENYETVISVALFVFPKPNVIACLEQGEEPWVQRSLEFKDSSEELPA

SEQ ID NO: 12219 - protein, 81 aa, Sus scrofa
AGSSVTFRDVAVDFTQEEWEHLDPCQRHLYREVMLENYGNLISLGHLLSKPEMTFHFEQGDVWMEGKIPRNSYSGEKPYRC

SEQ ID NO: 12220 - protein, 81 aa, Sus scrofa
PQVSVTFDDVAVTFTQEEWAQLDPAQRTLYQEVMLENFRLLVSLGDRGKPKTREPSPWEPAVSEGASLREPTQGGLGDPQS

SEQ ID NO: 12221 - protein, 81 aa, Sus scrofa
PLTLEDVAIKFSPEEWACLDPAQRALYRDVMLETCRNLLSLAVSHMQAIKKLKPKANVDMGEALQTVMLGRHESHEIGDFY

SEQ ID NO: 12222 - protein, 81 aa, Sus scrofa
SQGLVSFKDVAVDFTQEEWQQLDSAQRTLYRDVMLENYSHLVSMGHPVSKPDVISKLEQGEDPWIIKRSISNWIYSDENRA

SEQ ID NO: 12223 - protein, 81 aa, Sus scrofa
FYGSLSFEDVTVGFTQEEWQQLDPVQRTLYRDVMLENYSHLISVGYCIPKPELIFRLEQGEQPWILEEESPSQSYPGVCRV

SEQ ID NO: 12224 - protein, 81 aa, Sus scrofa
CEVSVSFEDVTVDFSREEWQHLDPAQRRLYQDVMLENYSHLLSLGYEIPKPEVILKLEQGEEPWMLERDTPHRRCSGIPLG

SEQ ID NO: 12225 - protein, 81 aa, Sus scrofa
SSVTFGDVAVDFSQDEWAWLDATQRSLYRSVMLENYRNLVSLDLETRPEMKEPDPKEEISGDKPSVEVVAEGHAGSAGWGS

SEQ ID NO: 12226 - protein, 81 aa, Sus scrofa
SQSPVSFKDVAVTFTWEEWGQLDPAQRTLYREVTLETCSHLVSLGLLLTKPDVISHLEQGEDPWKAEWGPPRDQKSALERK

SEQ ID NO: 12227 - protein, 81 aa, Sus scrofa
TQEELLTLEDVAVEFSWEEWQLLAPDQKDLYWDVMLENYNNLLSLGYQPTKLDTLSKFECGEPWIIEDKIQNRTCPGEALS

SEQ ID NO: 12228 - protein, 81 aa, Sus scrofa
WSQMPVTFEDVALYLSREEWGRLDHTQQSFYRDVLQQRNGLSLAGCPFSRPVWASPAQGKGEAPSSSRLMGEEEKRGAAQL

SEQ ID NO: 12229 - protein, 81 aa, Sus scrofa
QAEVTFEDVAVLLSREEWGRLGPAQKGLYRDVMLETYRNLVSLGAGHAGPKPGVIAQLERGDEPWVLDMQGREQSTIDGSA

SEQ ID NO: 12230 - protein, 81 aa, Sus scrofa
PLTLEDVAIEFSQEEWACLDPAQRALYRDVMLETCRNLLSLGEHRFPPGVGSHPPGLRINLAPREDMKKRELGHLVILERN

SEQ ID NO: 12231 - protein, 81 aa, Sus scrofa
QVTFSDVAIDFSHEEWGWLDSAQRDLYKDVMVQNYENLVSLDWESRHGNKELSVKEDIYDEDSPQMVIMEKTIKQRHEFSN

SEQ ID NO: 12232 - protein, 81 aa, Bos mutus
FQGSVVFSDVSIDFSQEEWEFLNPAQRDLYRDVMLENYSNLVSMGLYIPKPQVISLLEQGMDDWQRADKRPMLRIHLPMPV

SEQ ID NO: 12233 - protein, 81 aa, Bos mutus
RAPGGTARAHGRVGSEQEWQNLEAWQKELYKQVMRANYEILLSLDNGLPKPELISWIEQGRELFKKWGESQESRNIICSAA

SEQ ID NO: 12234 - protein, 81 aa, Neophocaena asiaeorientalis
QEAAVFKFLSVDYTQQKWKGLALSQRALYWNIVLENCCSLASLAGENRMESSELPPKQELSKVLKSSDRTSVVLCGMIPGG

SEQ ID NO: 12235 - protein, 81 aa, Neophocaena asiaeorientalis
PLESVTLEDVAINFTQEEWALLDTSQKTLFRNVMLENITHLVSVGYQISKSDVISQLEQGKELRKSNVSKQHGKSLSQGSF

SEQ ID NO: 12236 - protein, 81 aa, Bos mutus
SVSFKDISVDFSREEWQQLDLAQKSLYRDVMLENYFNLISVGFQVPKAEVIFSLEWGEEPYMWNGKISSQGCLDQDIGFET

SEQ ID NO: 12237 - protein, 81 aa, Neophocaena asiaeorientalis
LQRPVTFKDVAVDFTQEEWQYLDPPQRDLYRDVMLENYINLISVGCKTTKPALIYKLEQGEEPWMVEREISSWRYPEKVWQ

SEQ ID NO: 12238 - protein, 81 aa, Bos mutus
QVTFEDVAVYFSWEEWGLLDEAQRLLYCGVMLETFSLMASLGCWCGAEADEAPSEQSGCVEADRANLHQHQDPNSGEKPST

SEQ ID NO: 12239 - protein, 81 aa, Bos mutus
QAQLTFKDMFIDFTPEEWECLNPAQRTLYQDAMVETLRNLLSVDSETHITENSFPLTEKLKRFWTINDYVWCHPETLSIGK

SEQ ID NO: 12240 - protein, 81 aa, Bos mutus
LQELLSFTDISMEFSWEEWQLLDSVQKHLYRDVTLENYSNLVSVGYHGTKPDLIFKLEQGEEPWIINFEVSHQSCPDPKQS

SEQ ID NO: 12241 - protein, 81 aa, Neophocaena asiaeorientalis
APLPLTFEDVAVYFSEQEWRDLEPWQKELYKQVMRTNYEILVSLHDGLPKPELISWLEQGRELFRIWGESQKSGNIICTSA

SEQ ID NO: 12242 - protein, 81 aa, Neophocaena asiaeorientalis
TFQEAVTFKDVAVAFTEEELGLLDSAQRKLYQDVMVENFRNLVSVEENNQSELRAVQDRGSREELSCRQIWQQIANDLTRC

SEQ ID NO: 12243 - protein, 81 aa, Bos mutus
VTFEDVAVVFTDEEWRRLVPTQRDLYKEVMLENYKSIVSLGLPVPGPDVIFQLKRGDEPWLVEFHGFEGKEGAENVSLEEE

SEQ ID NO: 12244 - protein, 81 aa, Nomascus leucogenys
MDSVVFEEVAVNFTPEEWALLDHAQRSLYRDVMLETCRNLASLDCCIYVRTSGSSSQRDVFGNGISDDEEIVKFTRSDSWS

SEQ ID NO: 12245 - protein, 81 aa, Nomascus leucogenys
QAEVTFEDVAVFLSREEWGRLGPAQRGLYRDVMLETYGNLVSLGVGPAGPKPGVISQLEQGDEPWVLDVQGTSGKEHLRVN

SEQ ID NO: 12246 - protein, 81 aa, Nomascus leucogenys
KSLESVSFKDITVDFSRDEWQQLDLAQKSLYREVMLENYFNLISVGCQVPKPEVIFSLEQEEPCMLDGEIPSQSRLDGDIG

SEQ ID NO: 12247 - protein, 81 aa, Nomascus leucogenys
QGLLTFRDVAIEFSQEEWKCLDPAQRTLYRDVMLENYRNLVSLDISSKCTMKEVLSTAQGNREVFHAGPLQRHESHHIGDF

SEQ ID NO: 12248 - protein, 81 aa, Nomascus leucogenys
FQEAVTFKDVAVAFTEEELGMLDSAQKKLYRDVMLENFRNLVSVGHQSFKPDMISQLEREEKLWMKELQTQRGKHSGEYCA

SEQ ID NO: 12249 - protein, 81 aa, Nomascus leucogenys
MGLLTFRDVAIEFSLEEWQCLDTAQKNLYRNVMLENYRNLAFLGIAVSKPDLIICLEKEKEPWNMKRHEMVDEPPDICPHF

SEQ ID NO: 12250 - protein, 81 aa, Nomascus leucogenys
RYVPVTFVDIAVYFSEDEWKNLDEWQKELYNNLVKENYKTLMSLGKDSPSQMLQPRLSPGKSLVVWEQRHPEDREVPMDPD

SEQ ID NO: 12251 - protein, 81 aa, Bos indicus
TLESVTFQDVAVDFTQEEWALLDTSQRTLFREVMLENISHLVSVGNQLYKSDVISHLEQGEQLSREGLGFLQGQSPVISDR

SEQ ID NO: 12252 - protein, 81 aa, Bos indicus
WKEWVKKPVTFEDVAVNFTQEEWKCLDVSQRVLYQDVISETVRNLMSVDLIAKLEQEEKQWEADLCSPNGEGFHSGGKKEE

SEQ ID NO: 12253 - protein, 81 aa, Bos indicus
GLLTFEDVAVFFTQEEWDYLDPAQRSLYKDVMMENYGNLVSLDVLNRDKDEEPTVKQEIEEIEEEMEPQGIIVTRIKSEID

SEQ ID NO: 12254 - protein, 81 aa, Bos indicus
LRDPPQGMKFEDVAIDFSQEEAGLLDEAQRLLYYSVMLENFALVASLDFHWQHRDDSGEKPWERDVERVSFVRSCHLFVSG

SEQ ID NO: 12255 - protein, 81 aa, Bos indicus
PQAKVTFEDVAVFLSQDEWDRLGPAQRGLYRHVMMETYGNVVSVGIPGSKPEVISQLERGEEPWVLDKQGNEQLRGWGISR

SEQ ID NO: 12256 - protein, 81 aa, Bos indicus
SQDSVTFADVAVNFTQEEWTLLNRFQRKLYRDVMLENYKNLTTAGYQVFKPTLISWLEEEELSTVERGVLQEWGMQLKAKD

SEQ ID NO: 12257 - protein, 81 aa, Bos indicus
PLGLTTPRGVRGFRRLFNPVLLAGPTAAAARMDRAQGGVTFADVFVYFSREEWELLEEAQRLLYRDVMLENFAHVAALDPM

SEQ ID NO: 12258 - protein, 81 aa, Capra hircus
SLETVTFKDVAVDLTQEEWQQMKPAQRNLYRDVMLENYSNLVTVGCQVTKPDVIFKLEQEEEPWVVEEEMLGRHCPEVWKV

SEQ ID NO: 12259 - protein, 81 aa, Capra hircus
LQGSVSFKDVTVDFTREEWQQLDPAQKALYRDVMLENYCHLISVGFHMTKPDMICKLEQGKELWTTEKIFQSQSYLEEDWK

SEQ ID NO: 12260 - protein, 81 aa, Capra hircus
SQGLVTIKDVSLCFSQEEWRSLDPSQTDFYGEYVMQENCGIVVSLRFPIPKLDMLSQLEGGEEQWVPDPPDLEERDILKVT

SEQ ID NO: 12261 - protein, 81 aa, Chlorocebus sabaeus
QEPLSFKDVAVVFTEEELGLLDSTQRQLYRDVMLENFRNVLSVGERNPPGDKNGRDMEYIQDEELRLFSHEELSSCKIWEE

SEQ ID NO: 12262 - protein, 81 aa, Chrysochloris asiatica
AHGSLSFRDVAINFSQEEWECLDRVQRDLYSDVMLENYNHLISLGSSFSSKPDVITFLEQRREPWMVVREESSGRYSDLEA

SEQ ID NO: 12263 - protein, 81 aa, Chrysochloris asiatica
MFSDVSVDFSQEEWECLDPAQKDLYRDVMLETYSNMVSMGTYIPKPQVISLLEQGKEPWMVGRELTKGLCSDLQSMCETKL

SEQ ID NO: 12264 - protein, 81 aa, Chrysochloris asiatica
MAFTQKEWEQLDPVQGNLYKDAMLENYSNLASMAGYETPQPNMISKLEKGKEPWLRRRKRPSQGCLSEVMRHKQIVANGEE

SEQ ID NO: 12265 - protein, 81 aa, Chrysochloris asiatica
WSQMPVTFEDMALYLSREEWGRMGHEQQRVYREALQKKNGLNMGVSGSRPFWASHVQGKGEASSSSLQRGDEEEKTVVCTD

SEQ ID NO: 12266 - protein, 81 aa, Chrysochloris asiatica
MGLAQRTLYRDVMLENYSHLVSVGYCIFKPEVIFKLEQGREPWFLEEGFSNKSCPEDYKIKRNKKIKDKHLQQIIFISNET

SEQ ID NO: 12267 - protein, 81 aa, Chrysochloris asiatica
GSVSFTDVTVDFTQEEWEQLDPSQRILYMDVMLENYSNLLSVEVWKADDQMERDLRNPDKQARQFRILRNQTPVEERGNLF

SEQ ID NO: 12268 - protein, 81 aa, Chrysochloris asiatica
HQRSVSFKDVAVGFTQEEWHRLNPAQRALYRDVMLETYSNLVSVGYEGTKPDVILKLEEEEAPWISEAARPGCYCQEDFWE

SEQ ID NO: 12269 - protein, 81 aa, Chrysochloris asiatica
MATPSPPPEPKEEWDYLDPAQRSLYKDVMMENYGNLVSLDVLSKDNDEEPIVKQEIEEIEEVEPQSVIVTRIKSEIDQDPM

SEQ ID NO: 12270 - protein, 81 aa, Chlorocebus sabaeus
FVTLKDVGMDFTLEDWEHLGLEQGDMFWDTALDNCQDLFLLDPPRPNLTSHPDGGEDLEPLPGGSPEATGRDATETKNSPL

SEQ ID NO: 12271 - protein, 81 aa, Suricata suricatta
DEALMAFRDVAVAFTQKEWKLLSPAQRTLYRDVMLENYSHLVSLGIAVSKPKLITQLEQGDEPWREESECLLDLCPAEPGT

SEQ ID NO: 12272 - protein, 81 aa, Chrysochloris asiatica
IPSQEGVNFKVLTVDYTQEEQDTLNSAMKTLDRDVMLENHRDLVSWGIPDGKDQLEKQQENQERLLKELAFTRRKATVYEK

SEQ ID NO: 12273 - protein, 81 aa, Suricata suricatta
EAGEGSGHVNFEDVARLLYRDVMLENLTLMASLGYESSTSRTDASLELGTQPWVSDWAYLTPARTREAQGCWHGAEGEEIA

SEQ ID NO: 12274 - protein, 81 aa, Chlorocebus sabaeus
QGLLTFRDVAIEFSLAEWQCLDRAQQNLYRDVMLENYRNLVSLGIAVSKPDLITHLEQNKEPRNIKKNEMLAKHPVMCSHC

SEQ ID NO: 12275 - protein, 81 aa, Suricata suricatta
IWGPLSFVDVCVDFTWEEWRLLDPAQKRLYRRVMLENYSHLVSLGYQDTKPDIIFRLEQGEELWMLQAHVPSQGHPEKVRE

SEQ ID NO: 12276 - protein, 81 aa, Suricata suricatta
EEPPVVFEDVAVYFTREEWGTLVTRQKELYRDVMRLNYELLASLEPAAAKPDLISKLERRAAPWIRDPSGPKWGKGRPPGK

SEQ ID NO: 12277 - protein, 81 aa, Chrysochloris asiatica
MLAPVTFEDVTVVFTEAEWVTLSTEQKNLYKEVTLETYRNLLSLAEPTPETYPGPSCLLPFSCQQFLSQHVLQIFPGVCAE

SEQ ID NO: 12278 - protein, 81 aa, Suricata suricatta
LQELMTLEDVALDFSREEWQLLAPAQKGLYWDVMLENYRNLVSPGCQAREPDPLSELKQGEPLWILEDEVQSQTHAQIEKA

SEQ ID NO: 12279 - protein, 81 aa, Suricata suricatta
QESVTFEDVAVIFTEEEWTHLVPIQRDLYKEVMLENYKSIVSLDWETKPETPGASEEESGGTVRERLGRQGPLCPKSEAHA

SEQ ID NO: 12280 - protein, 81 aa, Suricata suricatta
MIQSQISFEDVAVDFSLEEWQLLNPTQKNLYRDVMLENYSNLVFLGYQIIKPDATFRLKREQPWRTDEVLSQNFSEEVWLD

SEQ ID NO: 12281 - protein, 81 aa, Mandrillus leucophaeus
FQGSISFKDVTVGFSQEEWQHLNPSQRALYRDVMLENYSNLVSVGYCVHKPEVISRLEQGEEPWRLEEEFPSQSFSEVWTA

SEQ ID NO: 12282 - protein, 81 aa, Mandrillus leucophaeus
DSVTFEDVAVDFTQEEWTLLDQTQRNLYRDVMLENYKNLVAVDWESHINTKWSAPQQNFLQGKTSNVVEMERNHFGEELFD

SEQ ID NO: 12283 - protein, 81 aa, Mandrillus leucophaeus
TMFKEAVTFKDVAVFFTEEELGLLDPAQRKLYQDVMLENFTNLLSVGHQPFHPFHFLREEKFWMMETATQREGSSGGKTVV

SEQ ID NO: 12284 - protein, 81 aa, Sus scrofa
PQGGVTFADVAVRFSCGEWRLLDEAQRRLYLDVMLDNYTLISSLGCCCGAGAVESRLEKTVPAGVSQAWSPKTAPFSQKIH

SEQ ID NO: 12285 - protein, 81 aa, Sus scrofa
YQELVTFRDVAVDFSQEEWDCLNSSQRHLYSNVMLENYRILVSLGLCFSKPSVILLLEQGKEPWKVKRELTRGSYSDWESM

SEQ ID NO: 12286 - protein, 81 aa, Mandrillus leucophaeus
PVTFRDVAVIFTEAEWKRLSPEQRNLYKEVMLENYRNLLSLAEPKPEIYPCSSCLLAFSCQQFLSQHVLQIFLGLCAENHF

SEQ ID NO: 12287 - protein, 81 aa, Mandrillus leucophaeus
HREPVTFEDVAVDFTKEEWQQLNPAQKTLHRDVMLETYSHLVSVGCSGIKPGVIFKLEHGKDPWIIESELSRWIYSDRVKG

SEQ ID NO: 12288 - protein, 81 aa, Sus scrofa
PKVPVTFDDISIYFSTPEWEKLEEWQKELYKNIMKGNYESLISMDYAMNQPDVLSQIQPEGGQTEDQAGPEESEIPTDPSE

SEQ ID NO: 12289 - protein, 81 aa, Sus scrofa
PQEPVSFKDVAVDFTQEEWLQLDADEKTTYRDVMLENYSHLVSVGYDSTKPNVIIRLEQGEEPWVADSELPQQCHPEEVWK

SEQ ID NO: 12290 - protein, 81 aa, Mandrillus leucophaeus
RRGHLTFRDVAIEFSQEEWKCLDPAQRTLYRDVMLENYRNLVFLGICLPDLSIISMLEQRRDPRNLQSEVKIANNPDGREC

SEQ ID NO: 12291 - protein, 81 aa, Sus scrofa
FQGLLTVEDVAIDFSPEEWECLDLGQRHLYRDVMLEICRHLVSLEYVISKPDLVRLLEQKKDPWDVKGMETVAIQPALSSH

SEQ ID NO: 12292 - protein, 81 aa, Sus scrofa
SQDSVTFEEVTVDFSQEEWALLDPAQKILYRDVMLENFRNLASLAGYQLCKHSLITEMEQEEQKPEGRGILQGAGTDWETQ

SEQ ID NO: 12293 - protein, 81 aa, Mandrillus leucophaeus
LVMFQDLFIDFSQEEWECLDAAQKDLYRDVMMENYSSLVSLDSEFRCKTKDSCLPKEIYEVTSSQWVRMEKCHSLVGSSVR

SEQ ID NO: 12294 - protein, 81 aa, Sus scrofa
TDGSVTFKDVAINFSAEEWEFLDSAQRDLYVNVMLENYSNLVSLDWESTYETQNTSSKKNIFEINFSQWEIVESSETLDLE

SEQ ID NO: 12295 - protein, 81 aa, Mandrillus leucophaeus
SQEQVSFKDVCVDFTQEEWYLLDPAQKILYRDVILENYSNLVSVGYCITKPEVIFKIEQGEEPWILEKGFPSQCHAERKWK

SEQ ID NO: 12296 - protein, 81 aa, Sus scrofa
MAFEDVAVYFSREEWGLLDTAQRALYRRVTLENFALLASLGCSPPAADRDVSGKAALPGPLQEGRPPAAPRALPTTGACQR

SEQ ID NO: 12297 - protein, 81 aa, Sus scrofa
MAFRDVAVAFSQKEWKLLSPAQRTLYRDVMLENYSLLVSLGIAFPKPKLITQLEQGDEPWREESECFLDLYSEPRTEFQPC

SEQ ID NO: 12298 - protein, 81 aa, Sus scrofa
CEGSLSFEDVTMDFSREEWLQLDSAQRRLYQDVMLEIYSHLFSVGYHIPNPEVIFSTEKGEEPWMGAAECRHQRYQDGELG

SEQ ID NO: 12299 - protein, 81 aa, Sus scrofa
FQGPVTFKDVAVEFTQEEWVMLDSAQRSMYRDVMLENYINLSSVEYHLCKPVISLLGQDLRTVKKIPQGTCPDQEIQLKTK

SEQ ID NO: 12300 - protein, 81 aa, Sus scrofa
SQGLLTFEDVAIDFSPEEWECLDLGQRDLYRDVMIEICRHLVSLEYVISKPDLVRLLEQKTDPWDVKGMETVAIQPALSSH

SEQ ID NO: 12301 - protein, 81 aa, Sus scrofa
AHGLVTFSDVAIDFSQEEWACLDSTQRDLYWDVMLENYSNLVSLELESPYETKTLPRQKGIYEMNFSKRNSGGKSKSLGLN

SEQ ID NO: 12302 - protein, 81 aa, Sus scrofa
FQGLLTFQDVAIDFSQEEWECLDLGHRKLYRDVMLETYGNLVSLGLVDSKPDVVIFLEQMKDPWSVTRVEARAMHPEHNQR

SEQ ID NO: 12303 - protein, 81 aa, Mandrillus leucophaeus
TLVTFKDVFVDFTREEWKLLDTAQQIVYRNVMLENYKNLVSLDSETAFEIKSSVSSRSIFKDKQSCDIKMEGMARNDLWYL

SEQ ID NO: 12304 - protein, 81 aa, Sus scrofa
VKELVTFKDVAIDFTLEEWRLMDPTQRNLHKDVMLENYRNLVSLGLAVSKPDMISHLEDGKGPWVVVREISRTSNPELGTK

SEQ ID NO: 12305 - protein, 81 aa, Sus scrofa
MLETYSNLVSVGYKGTKPYVILRLEQQEAPWICEAACSGCHCRENIWQVNVQRKRRQDTLLRQGTFISKKTLPKERSHEYN

SEQ ID NO: 12306 - protein, 81 aa, Sus scrofa
MAVSQGQMALNDVAIEFSREEWACLDPAQRALYRDVMLETYWNLLSVSEINFLPKVQICCLFMIAVCLLGSSASFSHSKPW

SEQ ID NO: 12307 - protein, 81 aa, Neophocaena asiaeorientalis
AQEPVTFEDVTLGFTPDEWGMLDLEQKSLYREVLLENYRNLVSVEHQLSKPDVVSQLEEEEELWSVERGIPRDTFSECPEA

SEQ ID NO: 12308 - protein, 81 aa, Neophocaena asiaeorientalis
FEESVTFEDVAIYFSENEWTGLTPAQRALYRDVMLEDYGAVASLAAFPFPKPALIFQLEAEAPWSLAPQGALDGEGPRGIA

SEQ ID NO: 12309 - protein, 81 aa, Neophocaena asiaeorientalis
PKVPVTFDDVAVHFSEQEWGNLSEWQKELYKNVMRGNYESLVSMDYAISKPDLMSQMERGERPAMQEREDSEEGEAPADPS

SEQ ID NO: 12310 - protein, 81 aa, Bos mutus
QGCVTFEDVTIYFSPEEWGLLDEAQRLLYCDVMLENFALIASLGLASFRSHIVAQLEMGAEPWVPDQVDMTSAMARGVYRG

SEQ ID NO: 12311 - protein, 81 aa, Neophocaena asiaeorientalis
EEVPVVFEDVAVYFTREEWGTLDKRQKELYRDVMRMNYELLASLGPAAAKPDLISKLERRAAPWIKDPNGPKWGKGRPPGK

SEQ ID NO: 12312 - protein, 81 aa, Bos mutus
TRSLGPALRTETTFPRRHCGACPTATQPRQCFVRLRHLPAPEATGLAISKPDVISFLEQGKEPWTVEEVVTEGLCPVLKSR

SEQ ID NO: 12313 - protein, 81 aa, Bos mutus
REGTASPRLPLISIGSGLSELCRSLTEILKRTDQCLQFKTMAHEWCPSMSKPDVITLLDEGKEPWMVVREGTGKHHPDLES

SEQ ID NO: 12314 - protein, 81 aa, Neophocaena asiaeorientalis
PHSLVSFKDVAIDFSQEEWECLDLQQKDLYRDVMLENYSNLVSLGFSISKPDVLSLLEQGKDPWKVVRDVTRGLSPDWESR

SEQ ID NO: 12315 - protein, 81 aa, Neophocaena asiaeorientalis
SQEMLTIRDVFVDFTLEEWQQLDATQKNLCRDVMLENYSHLVSVGFLVAQPGRISRLGQGGEEARMAAGESTTRRCPDLHP

SEQ ID NO: 12316 - protein, 81 aa, Neophocaena asiaeorientalis
MFRDVAVDFSQEEWECLDSTQRDLYRDVMMENYSNLVLLALSIPKLDVIFLLEEGKEPWMVSRNMVGGWCPDLEFRCKTKE

SEQ ID NO: 12317 - protein, 81 aa, Neophocaena asiaeorientalis
AQVLVTFKDVAVTFTREEWGQLDLDQRTLYQEVMLEICGLLVSLGHPVPKPELIHLLERGQEPWMGRRDLPRSMCPDDRAK

SEQ ID NO: 12318 - protein, 81 aa, Neophocaena asiaeorientalis
AQGSVSFEDVTVEFTQDEWQYVGPALRTLYKDVMLENYSHLVSLGYCIIKPQVIFKLEHGEEPWPSEEEFLNQKYPGCYRV

SEQ ID NO: 12319 - protein, 81 aa, Neophocaena asiaeorientalis
VMESVTLEDVAVGLIQEWTLLDDARRNLCRYVLLDNCRTLAPRAGTPSCKACLVSQVGPREELMTAEQGILCATGVDWESQ

SEQ ID NO: 12320 - protein, 81 aa, Nomascus leucogenys
QEMPLTFQDVAVYFSQAEGQQLGPQQRALYRDVMLENYGNVASLGFPVPKPELISQLEQGKELWVLNLLGAEEPDILKSCQ

SEQ ID NO: 12321 - protein, 81 aa, Nomascus leucogenys
RQAFLAFGDVTVDFTQKEWRLLSPAQRALYREVTLENYSHLVSLGILHSKPELIRRLEQGEAPWGEERRRRPGPCAGIYAE

SEQ ID NO: 12322 - protein, 81 aa, Nomascus leucogenys
RRGHLTFRDVAIEFSQEEGKCLDPAQRTLYRDVMLENYRNLVFLGICLPDLSVISMLEQRRDPQNLQSEVKIANNQGGREC

SEQ ID NO: 12323 - protein, 81 aa, Nomascus leucogenys
SVAFEDVAVNFTQEEWALLSPSQKNLYRDVMLETFRNLASVGIQWKDQNIENLYQNLGIKLRSLVERLCGPQEGSEHRETF

SEQ ID NO: 12324 - protein, 81 aa, Nomascus leucogenys
LPAKDSAWSWKEKPRYLGPVTFEDVAVLFTEAEWKRLSLEQRNLYKEVMLENLRNLVLLVLELGSPRSGLLPLDLNLDLWL

SEQ ID NO: 12325 - protein, 81 aa, Bos indicus
AHGSVTFRDVAIDFSQEEWEFLDSAQRDLYRDVMWEAYSNFISLGPSMSKPDVITLLDEGKEPWMVVREGTGKHHPDWKSR

SEQ ID NO: 12326 - protein, 81 aa, Bos indicus
GSVSFTDVTVDFTQEEWEQLDPSQRILYMDVMLENYSNLLSVEVWKADDQMETDPRNPDEQARPFVIFKDQTPTEERDNNL

SEQ ID NO: 12327 - protein, 81 aa, Bos indicus
FQMPLTFSDVSIDFSQEEWECLNSDQKNLYRDVMLETYTNLVSLDFDFTTENNKLSSEKSSFEVNSYHWEIMKSKTFNLMG

SEQ ID NO: 12328 - protein, 81 aa, Bos indicus
YQELVTFRDVAVDFSQEEWDYLNPSQRHLYSNVMLENYRILVSLGLCFSKPSVILLLEQGKEPWMAKREMTKDLCSDWESM

SEQ ID NO: 12329 - protein, 81 aa, Bos indicus
MDSVVFEDVAVNFTLEEWELLDPAQRKLYRDVMLETCRNLATVGSCPQVKVSVSSPQWDILETGLCIEREVVRFTRNDSRS

SEQ ID NO: 12330 - protein, 81 aa, Bos indicus
SEDLVTFRDVAVNFSQEEWEWLNPAQRSLYRTVMLDNYRSLVSLGVSVSKPDVISLLEQGKEPWMVKEEGPRGACPGWEYT

SEQ ID NO: 12331 - protein, 81 aa, Equus caballus
VQEPVTFKDVAVDFTQEEWGQLDPVQRTLYRDVMLETYGHLLSVGNQIPKPEVISLLEQGEEPWSVEQAYPQSTCPEWMRI

SEQ ID NO: 12332 - protein, 81 aa, Equus caballus
CEGSVSFEDVTMDFSREEWQQLDPAQRRLYQDVMLEIYSHLFSVGYHIPIPEIIFRMEKGKEPWIGKAKLLPHQRCQEGDL

SEQ ID NO: 12333 - protein, 81 aa, Equus caballus
WSQDSVTFEEVAVDFSQEEWALLDPAQKILYRDVMLENFRNLASVGYHLCKHNLITEVEQEELRPEERGILQGACTDWDTQ

SEQ ID NO: 12334 - protein, 81 aa, Equus caballus
DLYTFPNGGLYFAEGQLDCFFLDLLKLTIFSSFSAVNPSSSDFHLIGHPVSKPDVISKLEQGEDPWIIKRDISNWIYPDEN

SEQ ID NO: 12335 - protein, 81 aa, Equus caballus
TRVSVTFDDVAVTFTQEEWGQLDLAQRTLYQEVMLENCGLLVSLGCPVPRPELICQLEHGQELWTVKKDLSQSPCPGDKGQ

SEQ ID NO: 12336 - protein, 81 aa, Equus caballus
SEASVTFRDVAVLFSRDEWLHLDSAQRTLYREVMLENYSTLVSLGIPFSTPKVICQLQQGEDPCMMEREIPQDTCRGFKTW

SEQ ID NO: 12337 - protein, 81 aa, Equus caballus
FQPPVSFKDVAVTFTREEWGQLDPAQRMLYRDVTLETCSHLFSLGLLLSKPDMISWLEQGEDPWRARQGPPQDWKTTLEKK

SEQ ID NO: 12338 - protein, 81 aa, Loxodonta africana
FQGSVTFKDVIVDFTQEEWKWLDPVQRDLFRDVTLENYTHLVSIGLQVSKPDVISQLEQGTEPWTVEPGVPVVPLQNWETR

SEQ ID NO: 12339 - protein, 81 aa, Capra hircus
DPEAVTFKDVAVIFTEEEMGLLDLAQRKLYQEVMLENFQNLLSVGHQSFTPDVPSQLEREEKLQMIKTAAQSCCSSGNQNL

SEQ ID NO: 12340 - protein, 81 aa, Capra hircus
WKGLLSFEDVALYFTREEWDTLDWAQKALYRDVMLDNYRHVVSLGFQFPKPEVICQLEQWEEPWILDLQRAGTRKASGSAC

SEQ ID NO: 12341 - protein, 81 aa, Capra hircus
AQELLTLEDVAVEFNREEWQLLDSSQRDLYWDVMLENYNNLVSLGYQGTKPDLLSKLEHGKEPCIIENEMQNRICPGIGKG

SEQ ID NO: 12342 - protein, 81 aa, Capra hircus
RLTSEDVAIEFTQEEWEFLDPAQRALYRDVMLETYRNLLSLDISPTHVMKHLQPKANSDKRETFQTLMLGSPESCEIKHFH

SEQ ID NO: 12343 - protein, 81 aa, Capra hircus
AQELVTFEDVAVYFIRKEGKRLEPAQRDLYRDVMLENYGNVFSLDGETRTEPDSEISEDGGSHGVLLGRFQKDISQGLKFE

SEQ ID NO: 12344 - protein, 81 aa, Capra hircus
IKSPLTFGDVAVEFSGEEWAWLDSAQRSLHRSVMLENYRNLASLGLCLSKPEMISSLEQRKEPWAVKRKSTSGKCPDLQTL

SEQ ID NO: 12345 - protein, 81 aa, Capra hircus
IQRPVSFKDVVVGFTQEEWHGLNPAQRALYRDVMLETYSNLVSVGYEGTKPYVILQLEQEEAPWICEAACSGCHCQENIWQ

SEQ ID NO: 12346 - protein, 81 aa, Capra hircus
SQVSVTFEDVAVLFTRDEWRKLAPSQRNLYQDVMLENYSNLVSLGLPFSKPEVISLLQQGEDPWKVEKESPGGSSLGEWSS

SEQ ID NO: 12347 - protein, 81 aa, Capra hircus
PSESVTFKDVIVDFTQEEWKQLDPVQRGLFRDVTLENYTHLVSIGLQVSKPDVISQLEQGTEPWIVEPSIPVGTLGDWVTR

SEQ ID NO: 12348 - protein, 81 aa, Capra hircus
KQEPVTFEDVAVYFTQNQWASLDSAQRALYREVMLENYANVASLVSPFPRPDLISQLERGEAPWDPDPWETEDLRGICPGG

SEQ ID NO: 12349 - protein, 81 aa, Chlorocebus sabaeus
SQAPVTFEDMAMYLTREEWRPLDPAQRDLYRDVMQENYGNVVSLDFEIRSENEVNPKQEISEDVQFGTSERPAENAEENPE

SEQ ID NO: 12350 - protein, 81 aa, Chrysochloris asiatica
ETESVTFKDVAVVFTEEELELLDPAQKRLYRDVMVENFRNLVSVGDENPRPMETVPQAAAQEELSSTYIWQQITNDFTRGP

SEQ ID NO: 12351 - protein, 81 aa, Suricata suricatta
ELHGLLISSYSSRTMTDGLVTFRDVAIDFSQEEWECLDPAQRDLYVDVMLENYSNLVSLGKVICLKYFRIFSLHHWLSLWD

SEQ ID NO: 12352 - protein, 81 aa, Chlorocebus sabaeus
FQGLLTFEDVAVFFTQEEWDYLDPAQRSLYKDVMMENYGNLVSLDYFSLQPYQLLILSIHMIFWLIEPNKCPYVNTIWTRS

SEQ ID NO: 12353 - protein, 81 aa, Suricata suricatta
GSPLACGLSCLPSRQGCVTFEDVFVYFSREEWELLEEAQRLLYRDVMLENFALVSSLGLAVSRSHVVSQMEPEGSPGCLRR

SEQ ID NO: 12354 - protein, 81 aa, Suricata suricatta
GTLYRDVMLETYGHLLSVGNQIAKPEVICLLEQGEDPWSVEQAHPQSTCPEWMRNLESKALIPTQSIFEEEQSHSMKLERY

SEQ ID NO: 12355 - protein, 81 aa, Suricata suricatta
AQGSVVFSDVSVDFSQEEWECLDPGQRDLYRNVMLENYSSLLSVGLYIPKPQVISLLEQGKEPWMVGRELTRGLCSDLESM

SEQ ID NO: 12356 - protein, 81 aa, Chlorocebus sabaeus
FQGLLTFRDVAIEFSQEEWKCLDPAQRTLYRDVMLENYRNLVSLDISSKCMMKTLSSTGQGNTEVIHKGTLQRQASHHIGE

SEQ ID NO: 12357 - protein, 81 aa, Suricata suricatta
AGSQDLLTFGDVAIEFSQECLNHSQQELRRDVMLDNYGHLLFLGLVSEPDLVIFLEQKKDSWDVRRKETEASYPRMIMNVI

SEQ ID NO: 12358 - protein, 81 aa, Suricata suricatta
MQGSVTFRDVAIDFSQEEWEFLDSAQRDLYRDVMWENYSNFISLAEPSISKPDVIEGKEPWMVVREGTRRHCPDLESRYRT

SEQ ID NO: 12359 - protein, 81 aa, Chlorocebus sabaeus
QGSLTFRDVAIEFSLEEWQCLDTAQQNLYRNVMLENYRNLVFLGIAAFKPDLIIFLEQGKEPWNVKRYEMVEEPPVICSHF

SEQ ID NO: 12360 - protein, 81 aa, Suricata suricatta
CEGSVSFEDVTVNFSREEWQHLDPVQRRLYRDVTLENYSHLRAVGYQVPKPEVIFKLEQGEGPWTLEGETSHQSCSDEDIG

SEQ ID NO: 12361 - protein, 81 aa, Chlorocebus sabaeus
MLENCINLVFVGIVASKPDLITCLEKEKEPWNMKRHEIVDEPPVMCSHFVEELWPEQNIKDSFQKMILRRYNKCGHKNLQL

SEQ ID NO: 12362 - protein, 81 aa, Suricata suricatta
HQELVTFEDVAVYFTQTEWAGLCSGQKALYRSVMLENYGNLTSLGYSVPRPALISLLEAGSLPWGLEAQVNLSAERTKDIY

SEQ ID NO: 12363 - protein, 81 aa, Chrysochloris asiatica
MGTMVIEGVSVVFTQEEWTLLNPAQRKLYRDMMMETFRNLASVVAGNLNDGDKLPSVWIIDRSVESDTFILVVYSPSLNAG

SEQ ID NO: 12364 - protein, 81 aa, Chlorocebus sabaeus
VTFEDVAVNFTQEEWNLLSEAQRCLYRDVMLENLALISSLGLRCPYSPAPFLEQPQHLLIQRETQVRIPMAGVSPKKVHPC

SEQ ID NO: 12365 - protein, 81 aa, Chlorocebus sabaeus
QESVTLEDVAVDFTWEEWQLLGPAQKDLYRDVMLENYSNLVAVGTGYQASKPDVFFKLEQGEPPWTIEDGIHSGACSEIWK

SEQ ID NO: 12366 - protein, 81 aa, Suricata suricatta
CKGSVSFEDVTVDFSREEWQQLDSTQRRLYQDVMLENYSHLLSLGYQVPKPEVIFKLEQGEEPWILERKTPHQSCSDGRFE

SEQ ID NO: 12367 - protein, 81 aa, Mandrillus leucophaeus
MDVMLENYCHLISVGCHMTKPDVILKLERGEEPWTSFSGHTCLEENWKAEDFLVKFKEHQEKYSRSVVSINHKKLVKEKSK

SEQ ID NO: 12368 - protein, 81 aa, Sus scrofa
LQVSVTFDDVAVTFTQEEWGQLDPAQRTLYQEVMLENRGLLVSLGCPVPRPELICQLEHGRELWMVQKDLSQSTCPGEQGK

SEQ ID NO: 12369 - protein, 81 aa, Mandrillus leucophaeus
SPPESVSFKDVTVDFSRDEWQQLDLAQKSLYREVMLENYFNLISVGCQVPKPEVIFSLEQEEPCMLDGELSGQSHPDGDFG

SEQ ID NO: 12370 - protein, 81 aa, Mandrillus leucophaeus
VTLRDVVINFSQEEWEYLDSAQRNLYWDVMMENYSNLLSLDLESRSETKHLSVGKDIIKNTGSQWEVMESSKLRGLESSIC

SEQ ID NO: 12371 - protein, 81 aa, Mandrillus leucophaeus
KEPGEAPVTFDDITVYLLQEEWVLLSQQQKELCSSDKLVAPLGPTVANPELFCKFGPGPEPWLGSVQGQRSHLEHHQGKKQ

SEQ ID NO: 12372 - protein, 81 aa, Mandrillus leucophaeus
MDTVVFEDVVVGFTLEEWALLNPAQRNLYREVMLETFKHLASVRNPRVERPCKSGKGNKRGGTFRKTRNCNRHLRKNHRTG

SEQ ID NO: 12373 - protein, 81 aa, Mandrillus leucophaeus
AATLRLSAQGTVTFEDVAVKFTQEEWNLLSEAQRCLYRDVMLENLALISSLDPALDGSADNTQTGNLGQSVLPSHPEQKTA

SEQ ID NO: 12374 - protein, 81 aa, Mandrillus leucophaeus
EEALMAFRDVAVAFTQKEWKLLSSAQRTLYREVMLENYSHLVSLGIAFSKPKLIEQLEQGNEPWREENEHLLDLCPESCSV

SEQ ID NO: 12375 - protein, 81 aa, Sus scrofa
DLGVTFEDVVVYFSWEEWGLLDETQRCLYHDVMLENFALLTSLGCWYGMEDEEAFSVQSVSVEQMSLGKTPNLDPSIQKTH

SEQ ID NO: 12376 - protein, 81 aa, Sus scrofa
VMFQVTFSDVAIDFSHEEWGWLDSAQRDLYKDVMVQNYENLVSLGLSIPKPYVIALLEDGREPWMVEEKLSKSLFPDWESR

SEQ ID NO: 12377 - protein, 81 aa, Mandrillus leucophaeus
TQESLTLEDVAVEFSSEEWQLLDTAQKNLYRDVMVENYNHLVSLGYQTSKPDVLSKLAHGQEPWITVAKIQNKNCPGIGKV

SEQ ID NO: 12378 - protein, 81 aa, Mandrillus leucophaeus
QEGVNFKIVTVDFTQEEQGTWNPAQRTLDRDVILENHRDLVSWDLTTAVGKKDPTSKQSIFDEEPANGVKIERLTRDDPWL

SEQ ID NO: 12379 - protein, 81 aa, Mandrillus leucophaeus
ASVALGDVAVNFTREEWALLGPCQKNLYKDVMQETIRNLDCVGMKWKDQFLFKDQIEDQYKYPRKNLRCRMLERFGESKDG

SEQ ID NO: 12380 - protein, 81 aa, Sus scrofa
FPEPVTFEDVTLGFTPEEWGMLDLEQKSLYREVLLENYRNLVSVEHQLSKPDVVSQLEEEEELWSVERGIPQDTFSECPEA

SEQ ID NO: 12381 - protein, 81 aa, Sus scrofa
ARELVTFKDVAVDFTQEEWGQLDPVQRTLYRDVMLETYGHLLSVGHQMAKPEVISLLEQGEEPWSTEQPYSPPGTCPEWMR

SEQ ID NO: 12382 - protein, 81 aa, Mandrillus leucophaeus
MHESVTLEDVAVEFIQEWALLDSARRSLCRYGMLDQCRTLTSRGTPPCKPSRVSQLGPRAEPRATERGILHATGVEQLQCY

SEQ ID NO: 12383 - protein, 81 aa, Sus scrofa
EEVPVVFEDVAVYFTRDEWGTLDKRQKELYRDVMQMNYELLASLGPAAAKPDLISKLEQRAAPWIKDPHGPTWGKGRPPGK

SEQ ID NO: 12384 - protein, 81 aa, Sus scrofa
SQSSVTFGDVAVDFSQDEWAWLDATQRSLYRSVMLENYRNLVSLGLCSSKPDMISSLEQRKEPWTVKRKLPGGGCPDPQAV

SEQ ID NO: 12385 - protein, 81 aa, Sus scrofa
MLENYAAVASLAAFPFPKPALIFLLERGEAPWSSAPEGPLDGEGPRGISSGPFLKWAGISHLEQVEEPLKQKLQEEGPSLL

SEQ ID NO: 12386 - protein, 81 aa, Sus scrofa
VMESVTLKDVAMGLIQEWALLDDAWRNLCRYMLLDNCRTLAPRAGAPPCKASLVSQVGPRKELRAAEGGILQATCADWESQ

SEQ ID NO: 12387 - protein, 81 aa, Sus scrofa
LQDLVTFEDVTVEFTREEWALLDPSQRTLYRDVTLENCRNLASLGYHIDKPSLISQLEQEDKVMTEERGVLPGSCPDLETV

SEQ ID NO: 12388 - protein, 81 aa, Sus scrofa
GRGCVISEGVFVYFSLEEWKLLDEAQRRLYRDVMLENLALLASLGIASSRSHLVMQLQQGGGPWIPTQVAVTPAAEKEAQQ

SEQ ID NO: 12389 - protein, 81 aa, Nomascus leucogenys
PQASVCFEDVAMAFTQEEWEQLDLAQRTLYREVTLETWEHIGLCPWKEVLPPGLKAVPSSEGCSRMGWKILEAGPRGCPSF

SEQ ID NO: 12390 - protein, 81 aa, Nomascus leucogenys
MAKPREWRHLDLSQRNLYRDVMLETYSHLLSVGYQVPEAEVVMLEQGKEPWALQGERPRHSCPGEKLWDHNQCRKILSYKQ

SEQ ID NO: 12391 - protein, 81 aa, Nomascus leucogenys
PQGLLTFRDVAIEFSQEEWKCLDPAQRTLYRDVMLENYRNLVSLDISSKCMLKTLSSTGQGNTEVFHTRTLHRQASHHIGD

SEQ ID NO: 12392 - protein, 81 aa, Nomascus leucogenys
VTFEDVAVNFTQEEWNLLSEAQRCLYRDVTLENLALMSSLGCWCGVEDEAAPSKQNIYIQRETQVRTPMAGVSPKKAPHCE

SEQ ID NO: 12393 - protein, 81 aa, Nomascus leucogenys
SLDSMTFEDIVVDFTQEEWALLDTSQRKLFQDVMLENISHLVSIGKQLCKSTVLSHLEQVEKFSTQRISLLQGREVDIKHQ

SEQ ID NO: 12394 - protein, 81 aa, Canis lupus
LLTFRDVAIEFSQEEWGCLNHTQRELYRDVMLENYGNLLFLAISSRDTQSLLSKPSIKASFQRVSMGRLKNNALENLHFMT

SEQ ID NO: 12395 - protein, 81 aa, Canis lupus
SQGPLSFVDVFVDFTWEEWRLLDPAQKHLYRSVMLENYSHLVSLGYQDAKPDIIFKLEQGEELWMMQTQIPSQGQPGKAWE

SEQ ID NO: 12396 - protein, 81 aa, Chlorocebus sabaeus
TQGHLTFRDVAIEFSQEEWKCLDPVQKALYRDVMLENYRNLVSLGICLPDLSIISMMKQRTEPWTVENEMKVAKTPVRWEG

SEQ ID NO: 12397 - protein, 81 aa, Chlorocebus sabaeus
MLENYRNLVSLAGISLSEMSIISMLGQGKEPWTVESEVRITKTSNGWERIKGVNTDVSPTHMIKKSPPKQNNSTEKVFQAV

SEQ ID NO: 12398 - protein, 81 aa, Chrysochloris asiatica
QGCVTFEDVFVYFSREEWGLLDEPQRLLYRDVMLDNFALAASLGCWREAEKEETPCKQDVCVGGGVSQVMALSNQKAKLCE

SEQ ID NO: 12399 - protein, 81 aa, Chrysochloris asiatica
GQKLLSFEDVALFFTREEWENLNWAQKYLYRDVMLENYRSMIFLGFQFPKPEVISQLEDWDEPWILDLPRTWTRMTSGTAS

SEQ ID NO: 12400 - protein, 81 aa, Suricata suricatta
KPGVLTFADVAVYFSSEEWGCLRPAQRALYRDVMRETYGHLGALGFRGTKPALICWVEEEADLWGPEARDPEVGACLTEAD

SEQ ID NO: 12401 - protein, 81 aa, Suricata suricatta
KPGAVSFADVAVYFSPEEWGCLRPAQRALYRDVMRETYGHLGALGFPGPKPALISWMEQESEESEAWSPAAKDPEEGESLG

SEQ ID NO: 12402 - protein, 81 aa, Suricata suricatta
GWLTFRDVIVEFSPEEWECLGPAQRALYRDVMLENYRNLVSLGRNLFPCVMEPGLDHPAEEPRGTWRSWKGGALFHTGGLK

SEQ ID NO: 12403 - protein, 81 aa, Chlorocebus sabaeus
LKALMAFRDVAVAFTQKEWKLLSSAQRTLYREVMLENYSHLVSLVGIAFSKPKLIEQLEQGNEPWREENEHLLDLCPAEPR

SEQ ID NO: 12404 - protein, 81 aa, Chrysochloris asiatica
FGSVVIEDVAVVFSQEEWALLDVAQRRLYREVMMETFRNLASVALNQPGTALRDEMCHECGKDFYSFSSFWTSVRGYGECK

SEQ ID NO: 12405 - protein, 81 aa, Chrysochloris asiatica
MLENCGLLVSLGYPVPEPEAIYELELRQEVKAVKRALSQWTCPADKTRLETTEPTSPEPVLYEKASVQGRLKQRPSWDSQV

SEQ ID NO: 12406 - protein, 81 aa, Chrysochloris asiatica
LLASVSFRDVTVEFTQEEWKCMSPVQRTLYRDVMLENYSLLISVGYCFTKPEVIFKLEQAKYSCLLEEGFLNRSYPEDCQL

SEQ ID NO: 12407 - protein, 81 aa, Suricata suricatta
GSVSFTDVTVDFTQEEWEQLDPSQRILYMDVMLENYSNLLSVEVWKADAQLEQDHSGPDEQARPFIIFKNQTPIEERDNLF

SEQ ID NO: 12408 - protein, 81 aa, Suricata suricatta
THGLVMFKDVAIDVSQEEWECLNPTQRSLYRDVMLENYSNLVSLGLSLSKPAVISSLEQGMEPWMVVREVTGKQCPDLVSR

SEQ ID NO: 12409 - protein, 81 aa, Chlorocebus sabaeus
EMGLLTFRDIAIEFSLAEWQCLDRAQRNLYRDVMLENYRNLVSLGIAVSKPDLITCLEQNKEPQNIKRNEMVSKHPVTCSH

SEQ ID NO: 12410 - protein, 81 aa, Suricata suricatta
SKLPVTFGDLAIYFSQEEWEWLSPIQKDLYEDVMLENYQNLVSLGLSFRRPNVITLLEKGKAPWMVEPVRKRRGLDSKSKC

SEQ ID NO: 12411 - protein, 81 aa, Suricata suricatta
AQESVTFRDVAVVFSRDEWLRLDSAQRSLYREVMLENYGTLVSLGIPSSTPKVICRLQLGEDPCVLERETPQDACLGFKTG

SEQ ID NO: 12412 - protein, 81 aa, Suricata suricatta
VSVTFDDVAVTFTQEEWGQLDPAQRTLYQEVMLENCGLLVSLGDKDKPKTTDPTACEPALPGGASFQELRQGDAGSCQRGH

SEQ ID NO: 12413 - protein, 81 aa, Suricata suricatta
CQRAVSFKDVVVGFTQEEWHRLNPAQRALYRDVMLETYSNLVSVGYEGTKPYVILKLEQEEAPWICEAACSGCHCRENICQ

SEQ ID NO: 12414 - protein, 81 aa, Sus scrofa
PKVPVTFDDVAVYFSEQEWGKLDEWQKELYKHVMRGNYETLVSLDYAISKPDILSRMERGEEPCPEGTWGREEGRQSEEAR

SEQ ID NO: 12415 - protein, 81 aa, Mandrillus leucophaeus
SQAPVTFEDMAMYLTREEWRPLDPAQRDLYRDVMQENYGNVVSLDFEIRSENEVNPKQEISEDVQFGTSERPAENTEENPE

SEQ ID NO: 12416 - protein, 81 aa, Suricata suricatta
VPSSVAHILFDFPSTGYHGTKPDLIFKLEQGQEPWIINARVSRQSYPENWEDWYQINQDELENVERSYTCSTFGKLHLSRT

SEQ ID NO: 12417 - protein, 81 aa, Mandrillus leucophaeus
MNSVAFEDVAVNFTQEEWALLDPSQKNLYRDVMQETFRNLASIGNKGKDQSIEDQYKNSSRNLSSFQMHQRNHTGEKPYEC

SEQ ID NO: 12418 - protein, 81 aa, Mandrillus leucophaeus
TSKEAVTFKDVVVVFTEEELGLLDLAQRKLYRDVMLENFRNLLSVGHQPFHRDTFHFLREEKFWMMDIATQREGNSGGKIQ

SEQ ID NO: 12419 - protein, 81 aa, Sus scrofa
SQDPMTFEDVAVEFTQWEWEQLDTAQKDLYREVMLENFKNLASLGFPVSKPYVICQLEEGEEPCTVEREISTGAHSDWERR

SEQ ID NO: 12420 - protein, 81 aa, Mandrillus leucophaeus
LQDLVTFKDVAIDFSQEEWQWMNPAQKHLYRSMMLENYQSLVSLGLCISKPCVISLLEQGREPWEMTSEMTRSPFSDWESI

SEQ ID NO: 12421 - protein, 81 aa, Sus scrofa
MDFTLEDWEQLRLDQSNLFWDTALDNYQSLFLLNPPRPNVTSRPDGGKELEALAKGSPESTAPDTAETKTSPLPQDLLAEG

SEQ ID NO: 12422 - protein, 81 aa, Mandrillus leucophaeus
AQESLTLRDVAVDFTWEEWQLLGPAQKHLYRDVMLENYSNLVSVGFQAGKPDALTKLEQGEPLWALEDEIHSPTHPEIEKA

SEQ ID NO: 12423 - protein, 81 aa, Sus scrofa
VKKSLTFKDVAVTFSKDEWKQLVPTQRALYREVMLENYQDFISLGLLLPKADVIFQLKRGDEPWKLEFWEAEERDVPRGLY

SEQ ID NO: 12424 - protein, 81 aa, Sus scrofa
PQGSTPFSSVTVAFTQEGWRQLVPAPRDRFKEGIPEKSRNLVLLGLPVSEPGVNAQLEQRESSWMLEREGLRAACPDWKIV

SEQ ID NO: 12425 - protein, 81 aa, Mandrillus leucophaeus
PLVMAETDPTQGRVVFEDVAIYFSQEEWGHLDEAQRLLYRDVMLENLALLSSLGKALTLAQCPGLGCVVPFYPKAALRFPQ

SEQ ID NO: 12426 - protein, 81 aa, Mandrillus leucophaeus
MAFEDVAVYFSQEEWGLLDTAQRALYRRVMLDNFALVASLGLSTSRPRVVIQLERGEEPWVPSRTDTILSRNTYRRRNPGS

SEQ ID NO: 12427 - protein, 81 aa, Sus scrofa
FKGLVTFRDVALNFSQEEWEWLDSSQKDLYRDVMLENYRNLVWLGLSISKPNMISLLEQGKEPCMVEREMSDGQYADWESW

SEQ ID NO: 12428 - protein, 81 aa, Mandrillus leucophaeus
MDSVVFEDVAVDFTLEEWALLDSAQRNLYRDVMLETFRNLASVDKTQFKANGSVSQQDMYGEEKSKEQTIPNFTRNNSCAY

SEQ ID NO: 12429 - protein, 81 aa, Sus scrofa
QLTFQDVAIEFSEEEWACLDPAQRAFYVDVMLETYRNLLSLDTSHIHGMGKLQPTVNNDRGDVFQTGTLESQESHHMKHFY

SEQ ID NO: 12430 - protein, 81 aa, Sus scrofa
SLERVTFKDVAVDLTQEEWQQMKPAQRNLYRDVMLENYSNLVTVGCQVTKPEVIFKLEQEEEPWVVEEEMLGRHCPGPHSQ

SEQ ID NO: 12431 - protein, 81 aa, Sus scrofa
ALGSVTFRDVAVFFSQDEWLHLDSAQKTLYQEVMLENYSTLVSLGIPFSMPKVICQLQQGEDPCMVEGEALRDPCLDFKTW

SEQ ID NO: 12432 - protein, 81 aa, Sus scrofa
YSLVFEDVAVNFTLEEWVLLDPSQRKLYRDVMRENFRNLVLVESQQEDHVIDDQYKNQGKELRSAMVERLSESKDSNSCGE

SEQ ID NO: 12433 - protein, 81 aa, Sus scrofa
VTFEDVALYFSRDEWRLLDEAQRRLYHDVMLQNFSLISSLGCCCGAEDAESPFQPSMFRDVSQARTLKAASLSQKNHPCEK

SEQ ID NO: 12434 - protein, 81 aa, Sus scrofa
MHENYETVISVALFVFPKPNVIACLEQGEEPWVQRSLEFKDSSEELPAAGLKLKKDTENHQPVCLSDLEIQASVAIASRKA

SEQ ID NO: 12435 - protein, 81 aa, Sus scrofa
GSGRLTFEDLTIEFSQEEWDCLDPAQRALYWDVMLETFRNLLSLGEHRFLRKSGSKRPDEGNDKGMPANHKGSLSEGREPQ

SEQ ID NO: 12436 - protein, 81 aa, Sus scrofa
PQAKVTFEDVAVFLSQEEWDHLGPAQRGLYRHVMMETYGNVVSVGIPGSKPEVISQLERGEEPWVLDRKGAEERRGLGSGC

SEQ ID NO: 12437 - protein, 81 aa, Sus scrofa
MSLNSLGHQRTPSKTIFTENYFPTAVYGLLSINLPGGCSISKPDVITLLEQGKEPWMVVRDEKRRWSLDLESRYDTKKLFQ

SEQ ID NO: 12438 - protein, 81 aa, Neophocaena asiaeorientalis
AQESVMFSDVSIDFSQEEWEYLNDDQRDLYREVMLENYSNLVSMGHSISKPDVISFLEQGKEPWLVDRELTTDQWPVLESR

SEQ ID NO: 12439 - protein, 81 aa, Neophocaena asiaeorientalis
AQETLSFKDVAVDFTWEEWQLLAPPQKDLYRDVMLENYSNLLSVGYRVSKPDAMSKLERGEEPWTIEDEIHSQTCPETGNV

SEQ ID NO: 12440 - protein, 81 aa, Nomascus leucogenys
GKELLSFEDVAMYFTREEWGHLNLGQKDLYRDVMLENYRNMVLLGFQFPKPEVICQLENWDEQWILDLPRAGNRKASGSAC

SEQ ID NO: 12441 - protein, 81 aa, Nomascus leucogenys
MGPLQFRDVAIEFSLEEWHCLDTAQRNLYRNVMLENYRNLVFLGIVVSKPDLITRLEQGKKPSTMKRCEMVANPSGPVLHS

SEQ ID NO: 12442 - protein, 81 aa, Nomascus leucogenys
EAVTFKDVAVVFTEEELGLLDLAQRKLYRDVMLENFRNLLSVGHQPFHQDTFHFLREEKFWMMDIAPQRERNSGGKIQPEM

SEQ ID NO: 12443 - protein, 81 aa, Nomascus leucogenys
SARGMTFEDVAIYFSQEEWELLDESQRFLYCDVMLENFAHVTSLGYCHGAENEAIASEQSVSIQVRTSKGNTPTQKTHLSE

SEQ ID NO: 12444 - protein, 81 aa, Nomascus leucogenys
MLETYSSLVSLGHHITKPEMIFKLEQGAEPWIVEETPNLRLSAVQIIDDLIERSHESHDRFFWQIVITNSNTSTQERVELG

SEQ ID NO: 12445 - protein, 81 aa, Nomascus leucogenys
SYEGSVSFRDVAINFSREEWQHLDLSQRNLYRDVMLETYSHLLSVGYQVPKPEVVMLEQGKESWALQGERPRHSCPGEKLW

SEQ ID NO: 12446 - protein, 81 aa, Nomascus leucogenys
SQASVSFKDVTIEFTQEEWQQMAPVQKNLYRDVMLENYSNLISVGYCHFKPEVIFKLEHGEEPWFSEEEFSNQSHPKDYRG

SEQ ID NO: 12447 - protein, 81 aa, Canis lupus
VQESLTLEDVAVDFTWEEWQLLGPAQKNLYRDVMLENYRNLVSVGCQATKPDALSKLEHRDEPWITEDEIQSRTHTGFGKL

SEQ ID NO: 12448 - protein, 81 aa, Canis lupus
LQEPVTFRDVAVDFTQEEWGQLGPAQRTLYRDVMLETFGHLLSLGPELPKPEVISQLEQGAELWAAEREIAQGYCPGREPG

SEQ ID NO: 12449 - protein, 81 aa, Canis lupus
WKELLSFDDVAMYFTREEWNRLDWAQKDLYRDVMLENYRNMILLGFQFPKPEVIYLLEQWEEPWILDLPRAGTRKATSSAC

SEQ ID NO: 12450 - protein, 81 aa, Capra hircus
PKVPVSFEDVAMYFTKTEWKLLDHRQRKLYKQVMLENYHHLVSLGFSFAKPQLVIQLEQGQKPWVADVHRMRITTGMQAGD

SEQ ID NO: 12451 - protein, 81 aa, Capra hircus
ARESVMFSDVSIDFSLEEWEFLNLEQRDLYRDVMLENYSNLVSLGCFISKPDVISLLEQGKEPWNVVRKGRRQYPDLETNY

SEQ ID NO: 12452 - protein, 81 aa, Capra hircus
VVFEDVAVDFTQEEWALLNLAQRNLYRDVMLENFRNLASLGFEIQLKIDESVAPQDTYGKISNEQDVVGFKRSDSSLSILH

SEQ ID NO: 12453 - protein, 81 aa, Capra hircus
NVGSLTFSDVAIGFSQQEWECLDPVQKTLYRDVMMENYGNLVSLAGHSISKPNVITLLEQGKEPWIVVREETRSWCTDLDS

SEQ ID NO: 12454 - protein, 81 aa, Capra hircus
RSEGQLTFQDVAIDFTQEEWECLDLGQRELYRDVMLQNYGNLASLGLVSKLDLVAFLEQLKDPRNIKRMETTAIYPAMSPQ

SEQ ID NO: 12455 - protein, 81 aa, Capra hircus
PLQVSVSFRDVAVDFSREEWQQLDLDQKNLYRDVMLETCSHLLSIGYQVPEIEVFMLEQGKEPWALQGEGPYQSCPGEKLQ

SEQ ID NO: 12456 - protein, 81 aa, Chrysochloris asiatica
SKAPVTFGDLAIYFSQEEWEQLSPMQRDLYEEVMLENYRNLVSLGLSIRRPNVITLLEKGKAPWLVEPARRRRGPDSGSAF

SEQ ID NO: 12457 - protein, 81 aa, Chlorocebus sabaeus
VTFKDVAVDLTQEEWEQMKPAQRNLYRDVMLENYSNLVTVGCQVTKPDVIFKLEQEEEPWVMELSLSSLDEGISCCTHCLQ

SEQ ID NO: 12458 - protein, 81 aa, Chrysochloris asiatica
PKGLLTFEDVAVFFTQEEWDYLDPAQRSLYKDVMMENYGNLVSLDVLSKDNDEEPIVKQEIEEIEEVEPQSVIVTRIKSEI

SEQ ID NO: 12459 - protein, 81 aa, Chlorocebus sabaeus
GCFISKPDVISLLEQGKEPWKVVRKGRRQYPDLETKYETKKLSLENDIYEINLSPWKIMERIKNHGLKGLILKHDWESTGK

SEQ ID NO: 12460 - protein, 81 aa, Suricata suricatta
RLHKSGTSEDVAVYFTRQEWASLVPAHRALYRDLMLENGGNAFLASPTSKPAISQLEQGRELCFTQPQGALSRRSKRAGPK

SEQ ID NO: 12461 - protein, 81 aa, Suricata suricatta
SQGLVSFKDVAVDFTQEEWQQLGPAQRTLYRDVMLENFSHVVSVGYPVSKPDVISKLEQGEDPWIIKRDVSNWIYTDENRA

SEQ ID NO: 12462 - protein, 81 aa, Chrysochloris asiatica
VDSVVFDDVAVVFSPEEWALLNLAQRKLYRDVMKETLSNLDSCESIDRVCRYQTLRECCEFGKAFKHPATSHVGFNICQCV

SEQ ID NO: 12463 - protein, 81 aa, Suricata suricatta
LQEPVTFRDVAVDFTQEEWGQLGPAQRTLYRDVMLETFGHLLSVGPELPKPEVISQLEQGAELWAAERGIAQGHCPGWEPG

SEQ ID NO: 12464 - protein, 81 aa, Suricata suricatta
PQAKVTFEDVAVLLSQEEWDRLGPAQRGLYRHVMMETYGNVVSLGLPGSKPNVICQLERGEEPWVLDGQGAEETRGLGSGH

SEQ ID NO: 12465 - protein, 81 aa, Chlorocebus sabaeus
QELVKFRDVAVVFSPDEWDHLNPEQRNLYRDVMLDNCKYLASLGNWTYKAHVMSSLKQGKEPWMMEREVTGVPCPGAYTTG

SEQ ID NO: 12466 - protein, 81 aa, Chrysochloris asiatica
EMDSVVVEDVAVVFSQEEWALLDVAQRKLYRDVMMETFRNLALEETRKVCDDKDQNKIQGSDSRNRILENLCESNEGSQSE

SEQ ID NO: 12467 - protein, 81 aa, Chlorocebus sabaeus
FQEPLKFRDVAVEFSLEEWQCLDTIQQNLYRNVMLENYRNLVFLGIAVSKPDLITCLEQEKEPWTRKRHRMVAKPVTCSHF

SEQ ID NO: 12468 - protein, 81 aa, Chrysochloris asiatica
VEDSLTLEDVTVKFTREEWQLLAPAQKALYRDVMLENYSHLVSLGYQLSKPDALSTLERGEPPWTIEDGLHRPACTDDMLL

SEQ ID NO: 12469 - protein, 81 aa, Chrysochloris asiatica
TQDHKSKGLSPEDTDRSQEEERKSPILEPVTFEDVTVVFTEEEWNMLNSEQKSLYREVMLETYRNLLSLGEGVLSFPPLIQ

SEQ ID NO: 12470 - protein, 81 aa, Chrysochloris asiatica
LQKASWKLLSFEDVALFLTREEWENLDWAQKYLYRDVMMENYRSMIFLGFQFPKPEVISQLEDWDEPWILDLPRAWNRTTS

SEQ ID NO: 12471 - protein, 81 aa, Suricata suricatta
FHESVTFKDVIVDFTQEEWKQLDPGQRDLFRDVTLENYTHLVSIGLQVSKPDVISHLEQGTEPWVVEPGVPGAARGDRDTR

SEQ ID NO: 12472 - protein, 81 aa, Suricata suricatta
PHTPVTFKDVLVNFSREEWKLLDTAQQVMYRDVMLENYKNLTSLGHQLPKPDVILHLEKGEEPWLVGRGIQQEARPDVDTA

SEQ ID NO: 12473 - protein, 81 aa, Chlorocebus sabaeus
MFENYRNLVFLGIAVSKPHLITCLEQGKEPWNRKRQEMVAKPPVIYSHFTEDLWPEHSIKDSFQKVILRGYGKCGHENLQL

SEQ ID NO: 12474 - protein, 81 aa, Chrysochloris asiatica
SQELLTFRDVAVEFSQEEWDCLDPAQRALYWDVMLENYSNLVALEVSLSEMNIVSILKKGTEPWTVENEMKIVKNPGKSDC

SEQ ID NO: 12475 - protein, 81 aa, Sus scrofa
AHGSVMFSDVSIDFSQEEWEYLNLEQRDLYRNVMLENYSNLVSLGCFISKPDVISLLEQGKEPWKVVRKGRRPYSGLETKK

SEQ ID NO: 12476 - protein, 81 aa, Mandrillus leucophaeus
QAEVTFEDVAVFLSREEWGRLGPAQRGLYRDVMLETYGNLVSLGVGPAGPKPGVISQLERGDEPWVLDVQGTSGREHLKVN

SEQ ID NO: 12477 - protein, 81 aa, Mandrillus leucophaeus
KSQESLTLEDVAVEFTWEEWQLLGPAQKDLYRDVMLENYSNLVSVGYQASKPDALSKLEQGEPWTVENEIHSQICPEIKKV

SEQ ID NO: 12478 - protein, 81 aa, Sus scrofa
AQGQVTFEDVAVCFSQEEWGLLDETQRLLYRSVMLETFSLMASLGLTSSRTHDISQLERWGEPFLSASGAMRATRPTGCWH

SEQ ID NO: 12479 - protein, 81 aa, Mandrillus leucophaeus
AQGCVTFEDVTIYFSQEEWGLLDEAQRLLYCDVMLENFALIASLGLISFRSHIVSQLEMGKKPWVPDSVDMTSAMARGAYG

SEQ ID NO: 12480 - protein, 81 aa, Sus scrofa
LQGSVSFEDVAVDFTRQEWHRLDPAQRTMHKDVMLENYSNLASVGLCVAKPEMIFKLERGEELWILEEESCGHGYPGSLSL

SEQ ID NO: 12481 - protein, 81 aa, Sus scrofa
SQGSLSFEDVTVEFTQDEWRFVGPAQRSLYRAVMLENYSHLVSLGCCITKPQVIFKLEQGEEPWSSEEEFLNQSIPGYYKV

SEQ ID NO: 12482 - protein, 81 aa, Sus scrofa
MLENYGNVASLGFPLLKPAVIAQLEGGVELGGPSPLASGTGSGPEDLWTDIEIQTDNNLTEDMYEEKHNTSFELQRDFSQE

SEQ ID NO: 12483 - protein, 81 aa, Mandrillus leucophaeus
KVPVTFVDIAVYFSEDEWKNLDEWQKELYNNLVKENYKTLMSLDAEGPVPKPDAPTQPEPREEPCVWEQRHPEEREISMDP

SEQ ID NO: 12484 - protein, 81 aa, Sus scrofa
FQESVTFKDVIVDFTQEEWKQLDPVQRDLFRDVTLENYTHLVSIAGLQVSKPDVISQLEQGTEPWIVEPSIPVGTFGDWET

SEQ ID NO: 12485 - protein, 81 aa, Mandrillus leucophaeus
AQTLLTFRDVAIEFSLEEWKCLDPAQQNLYRDVMLENYRNLFSIGLTVSKPGLITCLEQRKEPWNVKRQEAVDGHPAMSSH

SEQ ID NO: 12486 - protein, 81 aa, Mandrillus leucophaeus
FQASVSFKDVTVEFTQEEWQHMGPVERTLYRDVMLENYSHLVSVGYCFTKPELIFTLEQGEDPWLLEKEKGFLSRNSPEDS

SEQ ID NO: 12487 - protein, 81 aa, Sus scrofa
AQELVTFEDVAVYFIRKEWKRLEPAQRDLYRDVMLENYGNVFSLDGETRTEHDPEISEDSGPHGVLLGRFQKDISQGLKFE

SEQ ID NO: 12488 - protein, 81 aa, Mandrillus leucophaeus
EMGPLTFRDVAIEFSLEEWQCLDTSQQNLYRNVMLDNYRNLVFLGIAVSKPDLIICLEQGKEPCNMKRHAMVAKPPVVCSH

SEQ ID NO: 12489 - protein, 81 aa, Sus scrofa
LLVTVTFKDVAIDFTQEEWQQLDPAQRNLYRNVMLENYNNLITVGCPFTKPDVIFKLEREEEPWVVEEEVFKRHCPGEIWG

SEQ ID NO: 12490 - protein, 81 aa, Mandrillus leucophaeus
DSVTFEDVAVDFTQEEWTLLDQTQRNLYRDVMLENYKNLVAVDWESHINTKWSAPQQNFLQGKTSNVVEMSHTLSPRQECS

SEQ ID NO: 12491 - protein, 81 aa, Sus scrofa
ALALVSFEDVAITFTGEEWRHLDLAQRTLYQEVMLETCGLLVSLGHPVPKPELIHLLEHGQELWTVKRGHSKSTCADEETE

SEQ ID NO: 12492 - protein, 81 aa, Sus scrofa
MLENYKSIVSLGLPVPGPDVIFQLKRGDEPWIEELHGSEGKECAENVYLDWKTKPEIQGASEEEKSEGTLRGKLERKDPVS

SEQ ID NO: 12493 - protein, 81 aa, Bos mutus
SLAFEDVAVNFTLDEWVLLDSSQRKLYRDVMRENFRNVVSVEAKQEDQDIDDQDKNQERKLRNPKAERHSEKKDINSSEES

SEQ ID NO: 12494 - protein, 81 aa, Bos mutus
FQGRMTFQDVAIDFTQEKWECLDLDQRELYRDVMLEKYGNLASLELPLLKIHSLGRRPWKQQDKHKRCYFHQSVRGKKRLD

SEQ ID NO: 12495 - protein, 81 aa, Neophocaena asiaeorientalis
TKGCVTFEDVAIYFSQEEWGLLVEAQRCLYHKVMLENFLLTASMVCLHGTEKKETPSEQNVSLEVLSQVRTPKVGPISQKA

SEQ ID NO: 12496 - protein, 81 aa, Neophocaena asiaeorientalis
PQDSVTFKDVAIDFSQEEWEWLNPAQRSLYRSMMLENYQSLVSVGLCISKPYVISLLEQGKEPWEMKSEMRRTPFPDWESV

SEQ ID NO: 12497 - protein, 81 aa, Bos mutus
WQESVTFKDVAVDFTLEEWGRLGPGQRELYRDVMLENYQNLLSLGFPGAKPDVISHLERGEEPRMERRETQQVTCPGGLCV

SEQ ID NO: 12498 - protein, 81 aa, Bos mutus
RLVVEFEVICPQNSPVMPSVDSNQGYRNRDRLEFEVYPNSSDFYLIGHPVSKPDVISKLEQGEDPWIIKRDIPNWICPYEG

SEQ ID NO: 12499 - protein, 81 aa, Nomascus leucogenys
CYQDSVTFDDVAVDFTQEEWTLLDSTQRSLYSDVMLENYKNLATVGGHIIKPSLISWLEQEESRTVNGGVLQGWEMQLEAQ

SEQ ID NO: 12500 - protein, 81 aa, Nomascus leucogenys
MVQESVTFKDVAVLFTQEEWGQLSPAQRALYRDVMLENYSNLVSLGLLGPKPDMFSQLEKREVWMPEDTPGGFCLDWMTMP

SEQ ID NO: 12501 - protein, 81 aa, Nomascus leucogenys
PRGSTFFSSVTVAFAQKGWRCLVSTPRDKFKEGIPGKCRNLVLLGLPVSQPGMNSQLEQREGTWMLEGEDLRSPSPGWKII

SEQ ID NO: 12502 - protein, 81 aa, Nomascus leucogenys
MLETYSHLLSVGYQVPEAEVVMLEQGKEPWALQGERPRHSCPGEKLWDHNQCRKILSYKQVSSQRQKMYPGEKAYECTEFE

SEQ ID NO: 12503 - protein, 81 aa, Nomascus leucogenys
LQGLVTFEDVAVEFTQEEWALLDPAQRTLYRDVMLENCRNLASLGCRVNKPSLISQLEQDKKVMTEERGILPSTCPDLETL

SEQ ID NO: 12504 - protein, 81 aa, Capra hircus
RLTSEDVAIKFTQEEWEFLDPAQRALYRDVMLETYRNLLSVDISPTHVIKHLQPKVNSDKRETFRTLMLGSPENCEIKHFH

SEQ ID NO: 12505 - protein, 81 aa, Capra hircus
SQGRLRFQDVAIDFTLEEWECLDLGQRELYRDVMLENYGNLASLGLIVCKPDLVTFLEKMRDPQDVRGIETTAIHPDLASF

SEQ ID NO: 12506 - protein, 81 aa, Capra hircus
VVTFEDVAVYFTRTEWAGLSPAQRALYRSVMLEIYGNLTSLGYPVPKPALVSLLERGDLPVGLETQDNPPAQGTRDIYKNA

SEQ ID NO: 12507 - protein, 81 aa, Capra hircus
SVTFPDVAVYFSWEEWRLLDEAQRRLYLDVMLENYALISSLGCCCGTENPEAPSQQITSLGVSQARTPKAALSTQKMNPCE

SEQ ID NO: 12508 - protein, 81 aa, Capra hircus
APLPLTFEDVAVYFSEQEWQNLEAWQKELYKQVMRANYEILLSLDNGLPKPELISWIEQGRELFKKWGESQESRNIICSGA

SEQ ID NO: 12509 - protein, 81 aa, Chrysochloris asiatica
PQGSVSFKDVTVNFTQEEWQQLDPAQKALYKDVMLENYCHLISVGSHMTKPDMIRKLEQGEELWTTERVYPSQTYLEEDGK

SEQ ID NO: 12510 - protein, 81 aa, Suricata suricatta
MDTSQRTLYRDVTLENISHLVSVGMKNNHNKEEIIPMQDICTKDPPNCWTVKCHAGEDLCLYSGYDEIFTHAYTLTQHVLN

SEQ ID NO: 12511 - protein, 81 aa, Chlorocebus sabaeus
GEEPVTFEDVAVDFTKEEWQQLNPAQKTLHRDVMLETYSHLVSVGCSGIKPDVIFKLEHGKDPWIIESELSRWIYSDRVKG

SEQ ID NO: 12512 - protein, 81 aa, Suricata suricatta
RPRAVKFADVAVYFSTEEWGCLRPAQRALYRDVMRETYGHLGALGCAGPKPALISWLERNTDDWEPAALDPQECPKRVTVQ

SEQ ID NO: 12513 - protein, 81 aa, Chlorocebus sabaeus
MVTFKDVAVVFTREELGLLDLAQRKLYQDVMLENFRNLLSVGYHPFKLDVILQLGREDKLWLMETEIQGDGCSGHRNQKEI

SEQ ID NO: 12514 - protein, 81 aa, Chlorocebus sabaeus
MLETYGNLVSLGVGPAGPKPGVISQLERGDEPWVLDVQGTSGREHLKVNSPALGTRTEYKELTSRETFGKEELGQLRGIFP

SEQ ID NO: 12515 - protein, 81 aa, Suricata suricatta
AEGCVTFEDVTIYFSQEEWGLLDEAQRLLYCDVMLENFALIASLGLTSFRSHIVAQLEMGAEPWVPDRVDMTSAMARGVYS

SEQ ID NO: 12516 - protein, 81 aa, Suricata suricatta
GGCLCLPQREVYGDVMLEIYGHLLFLGLVVSKPDLVIFLEQKRELWDVKRKETVASYPGSALEDGHLMRDRNKDGDSEGRQ

SEQ ID NO: 12517 - protein, 81 aa, Suricata suricatta
SQELVTFEDVAVYFIRKEWKRLEPAQRDLYRDVMLENYGNVFSLDGETRTEHDQGISEDTGSHGVLLGRFQKDISQGLKFE

SEQ ID NO: 12518 - protein, 81 aa, Suricata suricatta
PVTFEDVALYLSREEWGRLDHAQQNFYRDVLQKRNGLSLVSPVSFWPGFPFSRPFWAQGQGKGEASSSWRQMGVEEKTGAV

SEQ ID NO: 12519 - protein, 81 aa, Suricata suricatta
QGSVTFEDVALYFSWEEWDLLDEAQRCLYHDVMLETFALTSSLGCGHGVEDEDAPSEESISVGVSQIRTLKAYSSPQKAQP

SEQ ID NO: 12520 - protein, 81 aa, Suricata suricatta
DQESLTLEDVAVDFSREEWQLLAPAQKDLYRDVMLENYRNLVSLGYQASTPDALCMLERGEGPWATGEAVRGGARPETRKV

SEQ ID NO: 12521 - protein, 81 aa, Suricata suricatta
LQEAFSFEDFSVDFTQKEWQLLDHSQKDLYKDVMLENYSSLVSLGYEIMKPDVIFKLEQGEEPWVGDGEVPSVDCSEHVWQ

SEQ ID NO: 12522 - protein, 81 aa, Suricata suricatta
KPGVLTFADVAVYFSSEEWGCLRPAQRALYRDVMRETYGHLGALGCAGPKPALISWLERNTDDWEPAALDPQECPKRVTVQ

SEQ ID NO: 12523 - protein, 81 aa, Chlorocebus sabaeus
LKAFVAFRDVAVDFTQEEWRLLSPAQRTLHREVMLETYNHLVSLEIPFSKPKLIAQLERGEEPWREERRCLLDLCPESKPE

SEQ ID NO: 12524 - protein, 81 aa, Suricata suricatta
ARIPVTFDDVAVTFTEEEWGQLDPAQRTLYREVLVETCRLLVSLGSPLPKPELIYSLEQSPELRTLQRGLFPSNPGDNAKP

SEQ ID NO: 12525 - protein, 81 aa, Chlorocebus sabaeus
QGLLTFRDVAIEFSQEEWKCLDPAQRTLYRDVMLENYRNLVSLDISSKCMMKDFLSTAQGNTEVIHTRTLERHHIGDFCFQ

SEQ ID NO: 12526 - protein, 81 aa, Mandrillus leucophaeus
SQGSVTFTDVAIDFSQDEWEWLNLAQRSLYKKVMLENYRNLVSVGLCLSKPDVISLLEQEKDPWVIKGEMTRSLCPDLECV

SEQ ID NO: 12527 - protein, 81 aa, Sus scrofa
GLLTFEDVAVFFTQEEWDYLDPAQRSLYKDVMMENYGNLVSLDVLNRDKDEAPTVKQEIEEIEEEVEPQSVIVTRIKSEID

SEQ ID NO: 12528 - protein, 81 aa, Chlorocebus sabaeus
QGPLTFMDVVIKFSPEEWQFLHTAQQNLYRDVMLENYRNLVFLGIGVPKPDLITCLEQGKEPWNMKRHKMVAKPPVVYSHF

SEQ ID NO: 12529 - protein, 81 aa, Mandrillus leucophaeus
DSVTFDDVAVDFTQEEWTLLDPSQRDLYRDVMLENYENLASVGHDLFKPGVICWLEEEEKLRAEQRGVLQEWRLKTKGPAL

SEQ ID NO: 12530 - protein, 81 aa, Mandrillus leucophaeus
AQESVTLEDVAVDFTWEEWQLLGPAQKDLYRDVMLENYSNLVAVGYQASKPDVFFKLEQGEPPWTIEDGIHSGACSKGFIQ

SEQ ID NO: 12531 - protein, 81 aa, Mandrillus leucophaeus
VQESVTFRDVAVFFSQDEWLHLGSAQRALYREVMLENYSSLVSLGILFSKPKVISQLEQGEDPWMVESGVPQGAHLGWESL

SEQ ID NO: 12532 - protein, 81 aa, Sus scrofa
VREPLTFEDVAVNFTQEEWQQLDPAQKTLHRDVMLEIYSHLVSVGCSGIKPDIISKLEHGEDPWIRESELPRWTYSDREKS

SEQ ID NO: 12533 - protein, 81 aa, Mandrillus leucophaeus
MYFSQEEWELLDPTQKALYNDVMQENYETVISLALFVLPKPKVISCLEQGEEPWVQVSREFKDSAGKSPTGLKLKNDTENH

SEQ ID NO: 12534 - protein, 81 aa, Sus scrofa
AHGSVTFRDVAIDFSQEEWEFLDAAQRDLYRDVMWENYSNFISLDLESRYRTNTLSPEKDIYEIYSFQWEIMERIKSYSLQ

SEQ ID NO: 12535 - protein, 81 aa, Mandrillus leucophaeus
MGPLQFRDVAIEFSLEEWHCLDTAQRNLYRDVMLENYRNLVFLGIVVSKPDLITCLEQGKKPLTMKRHEMIAKPPGQAWWL

SEQ ID NO: 12536 - protein, 81 aa, Sus scrofa
FHSSVSFEDVTVDFSREEWQHLDPAQRRLYRDVTLENYSHLRSVGYHVPKPEVICKLEQGEGPWTLEEETPHQSYSGERNI

SEQ ID NO: 12537 - protein, 81 aa, Mandrillus leucophaeus
GDEPVTFRDVAIYFSREEWACLEPSQRALYRDVMLDNFSSMAALGFCSPRPDLVSRLEQWEEPWVEDRERPELQAVQRGHW

SEQ ID NO: 12538 - protein, 81 aa, Mandrillus leucophaeus
VTFEDIAIYFSQEEWGLLDEAQRRLYLEVMLENFALVASLGCGHGTEDEETLSEQNVSVRVSQSKAGSSTQKTQSCEMCVP

SEQ ID NO: 12539 - protein, 81 aa, Mandrillus leucophaeus
MVEGEEEWQQLNPAQKTLHRDVMLETYSHLVSVGCSGIKPGVIFKLEHGKDPWIIESELSRWIYSDRVKGLESSQQIISGE

SEQ ID NO: 12540 - protein, 81 aa, Sus scrofa
NFWILRLPPGSKGEAPKEWGKLDEWQKELYKHVMRGNYETLVSLDYAISKPEVLSQIEQGKDPCSWRRAGPKVPDVPVDPS

SEQ ID NO: 12541 - protein, 81 aa, Mandrillus leucophaeus
IWGPLSFMDVFVDFTWEEWQLLDPAQKCLYRNVMLENYSNLVSLGYQHTKPDIIFKLEQGEELCVVQAQIPNQSCPILKAG

SEQ ID NO: 12542 - protein, 81 aa, Sus scrofa
WQGCVISEGVFVYFSLEEWKLLDEAQRRLYRDVMLENLALLASLGCWCGVEGEVISSEHNDSLERVSQCHRTPMAHLKTYS

SEQ ID NO: 12543 - protein, 81 aa, Sus scrofa
SLGSVSFKDVIVDFSREEWQQLDRVQKSLYRNVMLENYFNLISVGCQVPKPEVIFNLEWGEEPCMLGGEVSSLSCVDQVIG

SEQ ID NO: 12544 - protein, 81 aa, Mandrillus leucophaeus
MGPLQFRDVAIEFSLEEWHCLDTAQRNLYKNVMLENYSNLVFLGIVVSKPDLITRLEQGKKPLTMKRHEMVAKPPGPGMIV

SEQ ID NO: 12545 - protein, 81 aa, Mandrillus leucophaeus
CEASLSFEDVTVDFSREEWQQLDPAQRRLYQDVTLELYSHLFSVGYHIPNLDVIFRMLKEKEPCVEEAELSHQRYQGLAQL

SEQ ID NO: 12546 - protein, 81 aa, Sus scrofa
LKREGSTLANLKAMPQEEWQQLDPAQKALYRDVMLENYCHLISVGFHMTKPDMIRKLEQGKELWTTEKIFPSQSYPEEDGT

SEQ ID NO: 12547 - protein, 81 aa, Sus scrofa
FQGSLSFKDVAVGFTRKEWQQLDSAQRTLYREVMLENYSHLVSVGCQVTKPAVISRLEQGQEPWMKEEEILRWSLPFLPSF

SEQ ID NO: 12548 - protein, 81 aa, Sus scrofa
LQEPVTFRDVAVDFTQEEWGRLGPAQRILYRDVMLETFGHLLSVGPELPKPDVISQLEQGAELWVAERGIAQGCCPGWEPG

SEQ ID NO: 12549 - protein, 81 aa, Bos mutus
RESGKAPVMFDDITVYLLQEEWVLLSQQQKDICGSDKLVAPLGSTIASPELFYKFEQGPEPWLASVQGQRSHLSPNPGKTK

SEQ ID NO: 12550 - protein, 81 aa, Neophocaena asiaeorientalis
TQEPVVFEDVAVDFTQEEWALLDPAQRNLYRDVMLENFWNLASLGYPLHTPYLISQWKQEEDLEIAERGPTQGEHQEGFET

SEQ ID NO: 12551 - protein, 81 aa, Bos mutus
MSYVSHQYTPLSSRYCFTKPELIFMLEQGEDPWLLEKEFINRSSPEEFQPDELLEESLENQGKRLRQVLFINKSLTMEQEI

SEQ ID NO: 12552 - protein, 81 aa, Neophocaena asiaeorientalis
PQVLVSFEEVAVLLSQEEWGHLGPDQKRLYRDVMLETYGNLVSLGLQGSKPDVISKLEQGEEPWAPHSPRIEGSWIWRRRR

SEQ ID NO: 12553 - protein, 81 aa, Bos mutus
GLMTFEDVAVDFTQEEWQYLNPPQRTLYRDVMLETYSNLVSVGHRVTKPDLILKLEVEEKCLPEGKIPIWSFPDLEEELPV

SEQ ID NO: 12554 - protein, 81 aa, Bos mutus
PEFLCLKMLLAYVELNMPDSDLEQRARHLLEQLVTLEPTEAEGHGFCITKPEVIFRLEQGEEPWILEEEFLSQSFSEVWKT

SEQ ID NO: 12555 - protein, 81 aa, Neophocaena asiaeorientalis
AQESLTYDDVAMKFTWEEWQLLDPDQKDLYRDVMLENYSNLLSVGYQASKPAVLSRLERGEQLWPVEDDSHGRICPEIRKV

SEQ ID NO: 12556 - protein, 81 aa, Bos mutus
QGGVTFPDIAVRFSQREWRLLDETQRLLYLDVMLENYTLISSLVTQCRSTSPSRNHTSGNCEKAFGSEHTLVQDWSVYTER

SEQ ID NO: 12557 - protein, 81 aa, Neophocaena asiaeorientalis
AQGLVTFEDVAVHFSKEEWGLLDAAQRQLYHSVMLENLELMTSLGCWHGVEDEEVCSKQDASVDVVSQVRIFSAHPSTQKA

SEQ ID NO: 12558 - protein, 81 aa, Nomascus leucogenys
SQGIVTFKDVAIDFTQEEWKRLDPAQRNLYRNVMLENYNNLITVGYPFTKPDVIFKLEQEEEPWVMEEEILRRHWQGEIWG

SEQ ID NO: 12559 - protein, 81 aa, Nomascus leucogenys
KPGAVSFADVAVYFSREEWGCLRPAQRALYRDVMRETYGHLGALGVGGSKPALISWVEEKAELWGPAAQDPKVAKCPTEAD

SEQ ID NO: 12560 - protein, 81 aa, Nomascus leucogenys
TARSQETVTFKDVAMDFTPEEWGKLDPAQRDVMLENYRNLVSLWLPVSKPENHNLEHGKEPLKLERKAPKSSYSAVAVITL

SEQ ID NO: 12561 - protein, 81 aa, Nomascus leucogenys
LLTFRDVAIEFSQEEWKCLDPAQRTLYRDVMLENYRNLLSLDIFSKCEIKELPPKKKSNTGEVFQTAMLERHESHDIQDFC

SEQ ID NO: 12562 - protein, 81 aa, Nomascus leucogenys
STEPVTFRDVAIYFSREEWACLEPSQRALYRDVMLDNFSSVAALGFCSPRPDLVSRLEQWEEPWVEDRERPELQAVQRGPR

SEQ ID NO: 12563 - protein, 81 aa, Nomascus leucogenys
DVAIDFSHEEWACLDSAQRDLYKDVMVQNYENLVSVAGLSITKPYVITLLEVGKEPWRVEKKLSKVSFFSHTVSSIMSILP

SEQ ID NO: 12564 - protein, 81 aa, Nomascus leucogenys
QEVVTFGDVAVHFSREEWQCLDPGQRALYREVMLENHSSVAGLGEAEFLVFKHELISRLEQGEEPWVLDLQGAEGTEAPRT

SEQ ID NO: 12565 - protein, 81 aa, Nomascus leucogenys
YQEMVTFEDVAVHFTKTEWTGLSPAQRALYRSVMLENFGNLTALGYPVPKPALISLLEGGDMDWGLEAQDDPPAERTKNVC

SEQ ID NO: 12566 - protein, 81 aa, Nomascus leucogenys
AQESVTFEDVAVNFTNREWQCLTYAQRHLYKDVMLENYRNMASLGFPFPKPPLISHLEREVDPCVQDPQDRESLSCFYPVS

SEQ ID NO: 12567 - protein, 81 aa, Nomascus leucogenys
LQELLTLEDVTVEFTWEEWQLLDPFQKDLYRDVMLEIYSNLVSIGYQVSKPDALSKLERGEEPWTVEDERHSQICPVDDHL

SEQ ID NO: 12568 - protein, 81 aa, Nomascus leucogenys
TQGPLKFMDVAIEFSQEEWKCLDPAQRTLYRDVMLENYRNLVSLGICLPDLSVISMLEQKKDPWTLQSEEKIANNPDSREC

SEQ ID NO: 12569 - protein, 81 aa, Nomascus leucogenys
MLENYGAVASLAAFPFPKPALISQLERGEAPWCSLPQGALDGEAPRGISSGEILKLPGATIWSLRIKPIPKKTVTKQRETW

SEQ ID NO: 12570 - protein, 81 aa, Bos indicus
SVTFEDVVVYFSWEEWGLLDENQRCLYHDVMLENFALVTSLGCWYGMEEAVAFSVESVPVEQTSRGKTVVPYPSMEKTQPC

SEQ ID NO: 12571 - protein, 81 aa, Bos indicus
AHGSLTFSDVAIGFSQQEWECLDPVQKTLYRDVMMENYGNLVSLGHSISKPNVITLLEQGKEPWLVVREETRSWCTDLDSR

SEQ ID NO: 12572 - protein, 81 aa, Bos indicus
YQRPVSFKDVVVGFTQEEWHGLNPAQRALYRDVMLETYSNLVSVGYEGTKPYVILRLEQEEAPWICEAACLGCHCWENIWQ

SEQ ID NO: 12573 - protein, 81 aa, Bos indicus
AQGSVVFSDVSIDFSQEEWEFLNPAQRDLYRDVMLENYSNLVSMGLYIPKPQVISLLEQGKEPWMIGRELTRGLCSALESM

SEQ ID NO: 12574 - protein, 81 aa, Zalophus californianus
MLAFPFPKPDLVSQLERGEAPWSPDPWEAEVLKGTCPGGEFWIKEEEPAVKQETSEEAELPRMPGGGLLRNVSQHFDFKSK

SEQ ID NO: 12575 - protein, 81 aa, Zalophus californianus
MAHLMMFRDVAIDFSQEEWECLGLEQRHLYRDVMLENYSNMISLGLCIYQPDVFSLLEKGKEPWMVLQDETRGPCPDMQSR

SEQ ID NO: 12576 - protein, 81 aa, Zalophus californianus
SQGPVSFKDVAVDFTQEEWQYLDLPQRNLYRDVMLENYINLISVGYQTTKPSVIHKLEQGEEPWMVEREIPNWNYAEVWQL

SEQ ID NO: 12577 - protein, 81 aa, Zalophus californianus
MLENFSHLVSMGYPVSKPDVISKLEQGEDPWIIKRDIPNWIFPNENQDDGRQDRKSNLDNPKACILGSVSFRNNILKGVTK

SEQ ID NO: 12578 - protein, 81 aa, Equus caballus
GGSMMFRDVSINFSQEEWECLDSGQMNLYKEVMLENFSNLVSVVIFTYEDMPTFIHPTFLIPHQKTINEKKPYECKICGKA

SEQ ID NO: 12579 - protein, 81 aa, Equus caballus
SLVFEDVAVNFTPEEWALLDGAQRKLYRDVMLETCRNLASVGEDGFTVPPILNRSHLLESLHGCNGGDGCGETLKQITDLP

SEQ ID NO: 12580 - protein, 81 aa, Equus caballus
WKELLSFEDVALFFTREEWNQLDWAQKDLYRDVMLENYRNLILLGFQFPKPEVICQLEQWEEPWILDLPRAGTRKASGSAC

SEQ ID NO: 12581 - protein, 81 aa, Equus caballus
KAEPLTFQDVAVYFSRAEGRQLGPDQRALYRDVMLENYGHVASLGLPVPKPELILQLEQGKELWVLDLLGAEEPVALSSCR

SEQ ID NO: 12582 - protein, 81 aa, Chrysochloris asiatica
LAPVTFEDVTVVFTEAEWVTLSMEQKNLYKEVTLETYRNLLSLAEPMPETYPGPSCLLPFSCQQFLSQHVLQIFPGVCAEH

SEQ ID NO: 12583 - protein, 81 aa, Chlorocebus sabaeus
FQDLVTFGDVAVNFSQEEWEWLNPAQRNLYRKVMLENYRSLVSLAGVSVSKPDVISLLEQGKEPWMVKKEGTRGTCPDWEY

SEQ ID NO: 12584 - protein, 81 aa, Suricata suricatta
VQGHVTFEDVAVYFSQEEWGLLEEAQRLLYRDVMLETLTLMASLGYESSTSRTDASLELGIKPWESDWADLTPARTREAQG

SEQ ID NO: 12585 - protein, 81 aa, Suricata suricatta
AQAPLSFEDVAVGFSPEEWQLLAPAQKDLYRDVMLENYRNLVSLGYQASKPDSLFQLEHGGPPWAVGGAAPRPPCAEEIWE

SEQ ID NO: 12586 - protein, 81 aa, Mandrillus leucophaeus
KPVTFEDVAVNFTQEEWDCLDASQRVLYQDVMSEIFKNLASVEGKKKELREQHPSLRDEGTSDDKVFFACRGAGQCPLSAP

SEQ ID NO: 12587 - protein, 81 aa, Sus scrofa
MTFEDIAVYFSWEEWRLLDETQRRLYLDVMLDNYALISSLGCCCGAEDAESPFQPSMFRDVSQARTLKAASLSQKNHPCEK

SEQ ID NO: 12588 - protein, 81 aa, Mandrillus leucophaeus
MGLLTFRDVAVEFSLEEWEHLEPAQKNLYQDVMLENYRNLVSLGLLVSKPDLITFLEQRKEPWNVKREETVAVQPDVFSHY

SEQ ID NO: 12589 - protein, 81 aa, Mandrillus leucophaeus
PQGHLTFMDVAIEFSQEEWKCLDPGQRALYRDVMLENYRNLVSLGICLPDLSIISMLKQRREPLTLQSEVKIVKNPDGREC

SEQ ID NO: 12590 - protein, 81 aa, Sus scrofa
SVTFQDVAVDFTGEEWQLLGCAQRKLYWDVMLENFRNILSVGKDSFPVCPVPKTKVIFRMKQGHDPWMVDGENPHWTETLY

SEQ ID NO: 12591 - protein, 81 aa, Mandrillus leucophaeus
SKESVSFKDVAVDFTQEEWGQLDSPQRALYRDVMLENYQNLLALGPPLHKPDVISHLERGEEPWSMQREVPGGPRPEWQLK

SEQ ID NO: 12592 - protein, 81 aa, Mandrillus leucophaeus
EKETLTFRDVAIEFSLEEWECLNPAQQNLYMNVMLENYKNLVFLGIAVSKQDPVTCLEQEKEPWNMKRHEMVDEPPGKTDH

SEQ ID NO: 12593 - protein, 81 aa, Mandrillus leucophaeus
PRGSTFFSSVTVAFAQEGWRCLVSTPRERYKEGIPEKSRNLVLLGLPVSQPGMNSQLEQREGTWMLEGEDVRSPSPGWKIV

SEQ ID NO: 12594 - protein, 81 aa, Sus scrofa
LQESFSFEDLSVDFTQKEWQLLDPYQKDLYKDVMLENYSSLVSLEQVLQVNGHMTWHKDNQEKLQNMKQDHECDAPGKNFN

SEQ ID NO: 12595 - protein, 81 aa, Mandrillus leucophaeus
QGLLTFRDVAIEFSQEEWKCLDPSQRTLYRDVMLENYRNLVSLDISSKCMLKTLSSTGQGNTEVILIGTLQRQASHHTGEF

SEQ ID NO: 12596 - protein, 81 aa, Sus scrofa
VTVTFKDVAIDFTQEEWQQLDPAQRNLYRNVMLENYNNLITVGKDSFLYNANSGIKVPFFSSVSNVWKLSFFVFLPFLGPH

SEQ ID NO: 12597 - protein, 81 aa, Sus scrofa
MPVTYEDVATTFTQEEWGQLDPTQRTLHQEVMLDTYPQPTDLGQGWNPKPHGSYHTHASRSHLRQHQRSHTGEKPYVCSKC

SEQ ID NO: 12598 - protein, 81 aa, Sus scrofa
VLLPLTFEDVAIYFSEQEWRNLEAWQKELYKQVMRTNYEILVSLGEGLPKPELISWIEQGREPFRNWGESQKSGNTSYSST

SEQ ID NO: 12599 - protein, 81 aa, Sus scrofa
LTLEDVAIEFSPEEWACLDPAQRALYRDVMLETCRNLLSLREHHVFPVRVIKQLQPKVNNDTGEVLQTVMWGRPDVYEVKL

SEQ ID NO: 12600 - protein, 81 aa, Sus scrofa
NLLLQRPLSFEDVAVGFTLEEWRLLDPFQKDLYREVTLEICHSLVSVGYEAPKPDALFRLEQGEPPWRREGAAQSPTCPGE

SEQ ID NO: 12601 - protein, 81 aa, Neophocaena asiaeorientalis
FHESLLFEDVAVEFTREEWRLLDPAQKDLYQNVMLENYSNLLSVGYQSPKPIQIFRLKQRDKPWLEKENIHGQNFPAGEIG

SEQ ID NO: 12602 - protein, 81 aa, Neophocaena asiaeorientalis
KVPVTFVDIAVYFSEDEWKNLDEWQKELYNNLVKENYKTLMSLDSEGPVSKPDAPPQAEPREEPCVWEQRDPEEREILMDP

SEQ ID NO: 12603 - protein, 81 aa, Neophocaena asiaeorientalis
PLESVTFEDVAISFTQEEWALLDTSQRKLFRDVMLENISHLVSVGYQHCKSDVIFQLDQGEELWIEGRGFFQSHSPGRESA

SEQ ID NO: 12604 - protein, 81 aa, Neophocaena asiaeorientalis
LSQTSVSFKDVTVEFTLEEWQCMSSAQRTLYRDVMLENYSHLVSLGYYFTKPDVIIKLEQDDPLLLEEEFLNKSHADSKLD

SEQ ID NO: 12605 - protein, 81 aa, Bos mutus
SQSPLTFGDVAVEFSGEEWAWLDSAQRSLHRSVMLENYRNLASLGLCLSKPEMISSLEQRKEPWAVKRKSTRGMRPDSQTL

SEQ ID NO: 12606 - protein, 81 aa, Bos mutus
LQALISFEDVAITFTGEEWRHLDLAQRTLYQEVMLETCGLLVSLGHPVPKAELIHLLEYGPELWTVKRGLSRNTCTGEKAN

SEQ ID NO: 12607 - protein, 81 aa, Neophocaena asiaeorientalis
MAITFEDVTVNFTWEEWKFLDSSQKKLYREVMWENYTNVMSVGDWKESYRLQEERFRCFEHEHLSCWQGWRNASTQIYDNQ

SEQ ID NO: 12608 - protein, 81 aa, Neophocaena asiaeorientalis
PLTFKDVAIEFSREEWACLDPDQKAFYVDVMLETYSNLISLDISHIHVIKKLQPRANSDRGEVFQTVMLERQKSHEMKHFY

SEQ ID NO: 12609 - protein, 81 aa, Neophocaena asiaeorientalis
SEDLVTFGDVAVDFSQEEWEWLNPAQRNLYRKVMLQNYRSLVSLAGVSVSKPDVISLLEQGKEPWMVKKEGTRGACPDWEY

SEQ ID NO: 12610 - protein, 81 aa, Neophocaena asiaeorientalis
MAFRDVAVDFTQEEWMLLSPAQRSLYREVMLENYSNLVSLGIPFSKPRLITQLEQGKETWREERKCPPATGPAEPKPELHL

SEQ ID NO: 12611 - protein, 81 aa, Neophocaena asiaeorientalis
AQGSVMFSDVSVDFSQEEWEFLDPAQRDLYRDVMLENYSNLVSVGLYIPKPQVISLLEQGKEPWMIGRELTRGLCSDLESM

SEQ ID NO: 12612 - protein, 81 aa, Nomascus leucogenys
LYVFQGVLTFRDVAIEFSLEEWQCLDITQQNLYRHVMLENYRNLVFLGIAASKPDLITCLEQGKEPWNVKRHEMVAEPPGR

SEQ ID NO: 12613 - protein, 81 aa, Nomascus leucogenys
TQESLSLEDVAVEFSWEEWQLLDTAQKNLYRDVMVENYNHLVSLGYQTSKPDVLSKLAHGQEPWITDAKIQNKNCPGIRKV

SEQ ID NO: 12614 - protein, 81 aa, Nomascus leucogenys
PRPPTAAPQVSNAFLTSWASHPSIHPISQGSLYRDVMLENYTGYQVSKPEVIFKLEQGEEPWISEGEIQRPFYPGFVCLLP

SEQ ID NO: 12615 - protein, 81 aa, Nomascus leucogenys
LQEPVTFRDVAVDFTQEEWGQLDPTQRILYRDVMLETFGHLLSVGPELPKPEVISQLEQGTELWVAERGTTQGCHPGWEPR

SEQ ID NO: 12616 - protein, 81 aa, Nomascus leucogenys
YQDSVTFEDTAVDFTQEEWTLLDPVQRNLYRDVMLENYENVAKVGFQLLKPSVISWLEEEELRTFQQGVLQDWAIKHQTSV

SEQ ID NO: 12617 - protein, 81 aa, Bos indicus
MGWLTFQDVAIDFTQEEWECLDLGQRELYRDVMLENYGNLASLGLVSKLDLVTFLEQLDDPRNIRRMGTTAIYPAVSPQDT

SEQ ID NO: 12618 - protein, 81 aa, Bos indicus
LQGSVSFKDVTVDFTQEEWQQLDPAQKALYRDVMLENYCHLISVGFHMTKPDMIRKLEQGKELWTTEKFFQSQSYLEEDWK

SEQ ID NO: 12619 - protein, 81 aa, Pteropus vampyrus
MLENYRNLNSLRKEHLFSKPDEVPKLECKKKRWITEQEIPRTIVFDRQTISENQDSVLKQRISGEESSHGVIMTRLTQSGP

SEQ ID NO: 12620 - protein, 81 aa, Pteropus vampyrus
KQETVTFKDVAVDLTQEEWQQMKPAQKNLYRDVMLENYSNLVTVGYQVTKPDVIFKLEQREEPWVIEEEMFGRHCPEVWEV

SEQ ID NO: 12621 - protein, 81 aa, Trichechus manatus
IHESVTFEDVAVNFTDREWQCLTHAQRHLYKDVMLENYGNMVSLGFPFPKPPLISHLERETEPWVQDLQDRESLSSFYPVS

SEQ ID NO: 12622 - protein, 81 aa, Trichechus manatus
DSVTFEDVFVYFSREEWGLLDEAQRLLYRNVMLENFALVASLGCWHEAEEETPEQNVSVEGVSQVRTTQKAHPCERCDPIL

SEQ ID NO: 12623 - protein, 81 aa, Trichechus manatus
PQASVSFKDVAVELTQEEWQHMGPAQRTLYRDVMLENYSHLVSVGYCFTKPEVIFKLEQGRDPCLSDEEFLHRSYIDCQLD

SEQ ID NO: 12624 - protein, 81 aa, Trichechus manatus
AHELVMFRDVAIDFSKEEWECLDLEQRDLYRDVMLENYSNMVLLGLCIHQPDMFSLLEKGKEPWKVLRYQTRGPCPDMQSR

SEQ ID NO: 12625 - protein, 81 aa, Trichechus manatus
VKKPVTFDDVTVNFTQEEWKCLDATQRSLHQDVMLETFKNLASVARIFLPKSDLITKAEQAEEEWKADYHPSNGDYPPLGK

SEQ ID NO: 12626 - protein, 81 aa, Trichechus manatus
SVFVEDVAVVFSQEEWTLLDLAQRKLYRDVMMENFRNLASVVSRNLIEGEKLSSEHIMVRFMKNNTWFSMLGEISESHGSK

SEQ ID NO: 12627 - protein, 81 aa, Trichechus manatus
CWGLLSFKDISMEFTWEEWQLLDSAQKYLYQDVILENYYNLVSVGYPGSKPDLIFKLEQGEEPWTINAKLSSQSCPEGWEE

SEQ ID NO: 12628 - protein, 81 aa, Trichechus manatus
SVVIEDVAVVFSQEEWALLDLPQKKLYRDVMMETFRNLASVVSQNLNNGEKSSSEHIIVRFMKKNTWSSMLGEISELHGNK

SEQ ID NO: 12629 - protein, 81 aa, Trichechus manatus
IWGSLSFKDVAVGFTWEEWQLLDPSQKDLYKEVMLENYNNLVSVGYPATKPDSVFMLEQGVPPWIVEGVIHSGTSPEEIWA

SEQ ID NO: 12630 - protein, 81 aa, Zalophus californianus
LQGSVTFPDVAVDFTPEEWQLLDCEQRTLYWDVMLEDFRNLISVGGPVTKTKAIFKAEQGQEPWMGEGANPRWRHPEAICL

SEQ ID NO: 12631 - protein, 81 aa, Zalophus californianus
EQESVTFKDVAIDLTQEEWTLMDRSQRKMYIDVMLENITHLVSVGCQFFQSDVISQWEQGGVLWREDRRLAQGWSPGLENS

SEQ ID NO: 12632 - protein, 81 aa, Zalophus californianus
SQVSVTFQDVAVLFTRDEWRELGPSQRNVYQEVMLENYSNLVSLGLLFSKPKVISLLQQGEDPWRVEKESPGGPSLGCKSS

SEQ ID NO: 12633 - protein, 81 aa, Zalophus californianus
RESGKAPVTFDDITVYLLQEEWMLLSQQQREICGSDKLVAPLGPTIANPELFYKFEQGPEPWLGNVQGQRNVLSHHPGKNK

SEQ ID NO: 12634 - protein, 81 aa, Zalophus californianus
VQGQVNFEDVAVYFSQEEWGLLDEAQRLLYRDVMLENLALMASLGRWHGMEDEEIAFEQNISVGVSQVRTPKAGPSTQKAH

SEQ ID NO: 12635 - protein, 81 aa, Equus caballus
FQKLVTFEDVAVNFTREEWECLDASQRVLYQDVMSKTFENLMSVARFFLSNPNLTTKLEQEEKQWRFSASSTGPPFSCHIC

SEQ ID NO: 12636 - protein, 81 aa, Loxodonta africana
RPRAVRFADVALYFSPEEWGCLRPMQRALYRDVMQETYGHLGALGCAGPKPALISWLERNTDDWEPAALDPQECRRGITVQ

SEQ ID NO: 12637 - protein, 81 aa, Chlorocebus sabaeus
VVFEDVAVDFTLEEWALLDSAQRDLYRDVMLETFQNLASVDDETQFKASGSVSQQDIYGKKIPKESKIAAFTRNVSWASVL

SEQ ID NO: 12638 - protein, 81 aa, Suricata suricatta
NLGLLTFRDVATEFSQEEWRCLNHSHRGLYKDVILENYGHLLFLGLVVSQLDLVIFLEQKQVLWNVKRKETVASYPAVSSD

SEQ ID NO: 12639 - protein, 81 aa, Sus scrofa
VTFQDVAVDFTEKEWPLLDSSQRKLYKDVMLENYSNLASVDWETPSKTKWSILMEDIFGRGPSNGVTVERTQHGEKSTEYA

SEQ ID NO: 12640 - protein, 81 aa, Sus scrofa
MQENYHHLISVGYCVNKPNAVFKLKQGKEPWILEVEFPRRNNPEDLWNIHDQGAKHKKSQAENSRNGELTKPQETLTREKT

SEQ ID NO: 12641 - protein, 81 aa, Mandrillus leucophaeus
AQSSVTFEDVAVNFSLEEWSLLNEAQRCLYHDVMLETLTLISSLGCWHGGEDEAAPSKQSTCIHIYKDQGGHSGERPYECG

SEQ ID NO: 12642 - protein, 81 aa, Sus scrofa
LQGSVSFKDVTVGFTQEEWQHLDPIQRSLYRDVMLENYSNLVSVGYCITKPEMIFRLEQGEEPWILEDEFPSQSSPEVWKN

SEQ ID NO: 12643 - protein, 81 aa, Mandrillus leucophaeus
CWGLLSFKDISMEFTWDEWQLLDSTQKYLYRDVILENYHNLLSVGYHGTKPDLIFKLEQGEDPWIINAKISRQSCPDGWDE

SEQ ID NO: 12644 - protein, 81 aa, Sus scrofa
LKGLVMFKDVAIHVSQEEWECLNPAQRNLYKDVMLENYSNLVSLGLSISKPAVISSLEQGKEPWMVVREVTGGPCPDLVSK

SEQ ID NO: 12645 - protein, 81 aa, Mandrillus leucophaeus
VTFEDVAVYFSWKEWGLLDEAQKCLYHDVMLENLTLTTSLGGCGAGDEEASYQQSTSSQRVSQVRLPKALPSPQKTNPCEI

SEQ ID NO: 12646 - protein, 81 aa, Mandrillus leucophaeus
VTFADVAVNFTKEEWTLLDPAQRNLYRDVMLENSRNLAFIDWATPCETKDATPQPDILPKRTFPEANRVCLTSISSQLSTL

SEQ ID NO: 12647 - protein, 81 aa, Mandrillus leucophaeus
SVAFEDVAVNFTQEEWALLSPSQKNLYRDVMLETFRNLASVGIQWKDQDTENLYQNLGIKLRSLVERLCGRKEGSEHRETF

SEQ ID NO: 12648 - protein, 81 aa, Mandrillus leucophaeus
TQGPLIFMDVAIEFSQEEWKCLEPAQRTLYRDVMLENYRNLVSLGICLPDLSVISTLEQKKDPWILQSEEKIGNNPDGREC

SEQ ID NO: 12649 - protein, 81 aa, Mandrillus leucophaeus
AQESVTFRDVAVFFSQDEWLHLGSAQRALYREVMLENYSSLVSLGIPFSMPKLIHQLQQGEDPCLEEREVPSDTCVGFKTW

SEQ ID NO: 12650 - protein, 81 aa, Mandrillus leucophaeus
GYVTFEDVAVYFSQEEWRLLDETQRLLYRNVMLENFSLLASLGLASSKTHEITQLESWEEPFMPAWEVMTAALPKGTWWVE

SEQ ID NO: 12651 - protein, 81 aa, Sus scrofa
LQESFSFEDLSVDFTQKEWQLLDPYQKDLYKDVMLENYSSLVSLGYEVMKPGVILKLEQGEEPWTGDGEIPGSDPPEQVLQ

SEQ ID NO: 12652 - protein, 81 aa, Sus scrofa
CFEELGLLGPARRRLYPEVMLETFWNVVSVGNQPFKPELIFQLEREEMLLMLETEIQRGRCSGENLPAVTQPEKLSVWQTW

SEQ ID NO: 12653 - protein, 81 aa, Sus scrofa
AQESVMFSDVSIDFSQEEWECLNDDQRALYRDVMLENYSNLVSMGHSISKPDVISFLEQGKEPWLVDRELTRGQWPVLESR

SEQ ID NO: 12654 - protein, 81 aa, Sus scrofa
MTFKDVAMDFTPEEWGELDPAQRAVMLDNYRNLASLWLPVSKPDNYSLKNGKEPSMLERKVPKSSCSDLETRPESKDSTSV

SEQ ID NO: 12655 - protein, 81 aa, Sus scrofa
SWGSVTFSDVAIDFSQEEWEWLQPAQRDLYRHVMLENYGHLVSLGLNISKPDVVSLLEQGKEPWLGKGDVNRDLFSASESN

SEQ ID NO: 12656 - protein, 81 aa, Bos mutus
GMVTFRDVAIDFSQEEWEFLDPAQRDLYVDVMLENYSNLVSLDTPFLRRRALDNCWGCEEVQEVRSQEGKGRREPSAQGTT

SEQ ID NO: 12657 - protein, 81 aa, Neophocaena asiaeorientalis
LLTFRDVAIEFSQEEWECLDPAQRALYRDVMLETYRNLLSLGEDNTPPEVGICPNISISFLTKELLKKKNINNRELYQPVV

SEQ ID NO: 12658 - protein, 81 aa, Neophocaena asiaeorientalis
CEGSVSFEDVTIDFSREEWQQLDPAQRRLYQDVMLEIYSHLFSVGYHIPNPEIIFRMEKRKEQWVREAELPCQRHHEGESG

SEQ ID NO: 12659 - protein, 81 aa, Neophocaena asiaeorientalis
ELQETVTFKDVAIDFTEEEWQQLDPAQRNLYWNVMLENYNNLITVGCPFTKPDVIFKLEQEEPWVVEEEVSKRHCPGEIWG

SEQ ID NO: 12660 - protein, 81 aa, Bos mutus
WLQGPMSFKDVAVEFTQEEWMMLDSAQRSMYRDVMLENYINLTLVEYQLCKPVISLSGQEDIRTVKSRIPQGTCPDWEIQF

SEQ ID NO: 12661 - protein, 81 aa, Bos mutus
LQASVSFKDVTVEFTQEEWHQMDSAQRTLYRDVMLENYSHLVSVGYCFTKPELIFMLEQGEDPWLLEKEFINRSSPEEFQP

SEQ ID NO: 12662 - protein, 81 aa, Bos mutus
RLTSEDVAIEFTQEEWEFLDPAQRALYRDVMLETYRNLLSVDISPTHVIKHLQPKANSDKREIFQTLMLGRPESCDIKHFH

SEQ ID NO: 12663 - protein, 81 aa, Neophocaena asiaeorientalis
WLQGPVSFEDVTVEFTQEEWVMLDSAQRSMYRDVMLENYMNLTLVEYQLCKPVISLSGQEDIRAVKRRIPQGTCLDWEIQL

SEQ ID NO: 12664 - protein, 81 aa, Neophocaena asiaeorientalis
LQDLVTFGDVAVDFSQEEWEWLNPAQRNLYRKVMLQNYRSLVSLGVSVSKPDVISLLEQGKEPWMVKKEGTRGACPDWEYA

SEQ ID NO: 12665 - protein, 81 aa, Bos mutus
RLTSEDVAIEFTQEEWEFLDPAQRALYRDVMLETYRNLLSVDISPTHVIKHLQPKATSDKRETFQTLMLGRPESCEIECFH

SEQ ID NO: 12666 - protein, 81 aa, Bos mutus
MSRLGRRRGRTRREERAEAAAPGQSLGSPGPVSESRRGYDSTKPNVIIKLEQGEEPWVVDSKFLQQQHSEDIYHYVTCDWH

SEQ ID NO: 12667 - protein, 81 aa, Nomascus leucogenys
SQGRVTFKDVTVNFTHGEWQRLNPKQRNLYRDVMLENYSNLVSVGREETTKPDVILRLEQGKEPWSVEEEVLGSGRPEKNG

SEQ ID NO: 12668 - protein, 81 aa, Nomascus leucogenys
QGLLTFRDVAIEFSQEEWKCLDPAQRTLYRDVMLENYRNLVSLDISSKCTLKEVSSTAQGNTEVIHTGTLQRHERHHIGDF

SEQ ID NO: 12669 - protein, 81 aa, Nomascus leucogenys
SKESVSFKDVAVDFTQEEWGQLDSPQRALYRDVMLENYQNLLALGPPLHKPDVISHLERGEEPWSMQREVPGGPCPEWELK

SEQ ID NO: 12670 - protein, 81 aa, Nomascus leucogenys
MDVAIEFCLEEWQCLDTAQQNLYRTVMLENYRNLVFLGIAVSKPDLITCLEQEKEPWEPMRRHEMVAKPPGGIVSLLNFFD

SEQ ID NO: 12671 - protein, 81 aa, Nomascus leucogenys
NLIFLTFEDVAIDFTQEEWAMMDTSKRKLYRDVMLENISHLVSLRYQISKSYIILQLEQGNELWQEGREFLQDQIPDRESA

SEQ ID NO: 12672 - protein, 81 aa, Nomascus leucogenys
FQELVTFRDVAIDFSRQEWEYLDPNQRDLYRDVMLENYRNLLSLGGHSISKPVVVDLLERGKEPWMILREETEFTDLDLQC

SEQ ID NO: 12673 - protein, 81 aa, Nomascus leucogenys
GSLTFRDVAIEFSLEEWQCLDTAQQNLYRNVMLENYRNLVFLGIAAPKPDLIIFLEQGKEPWNVKRHEMVEEPPVICSHFA

SEQ ID NO: 12674 - protein, 81 aa, Nomascus leucogenys
PIGLLTFRDVAIEFSQEEWKCLDPAQRTLYRDVMLENYRNLLSLGEDNFPPEVGMFLLCHPGWSAVTRSRFTATSPSGVQA

SEQ ID NO: 12675 - protein, 81 aa, Canis lupus
KPGAVSFADVAVYFSPEEWGCLRPAQRALYRDVMRETYGHLGALGFRGAKPALISWVEEEADLWGPDARDPEVGECVTETD

SEQ ID NO: 12676 - protein, 81 aa, Pteropus vampyrus
AAENDQVPDVAVDFTREEWQLLDTVQKNLYRDVMLENYSNLMSLGYQAAKPGAVVHWEKEEQGLVEREFPSHFSSEVIWQV

SEQ ID NO: 12677 - protein, 81 aa, Pteropus vampyrus
SVTFKDVFVCFSREEWELLEEVQRCLYRDVMLENFALVASLDCWREADHQEVPSEQHTSIGVSQVRTPKSGPFTQKAHPCE

SEQ ID NO: 12678 - protein, 81 aa, Pteropus vampyrus
MLESYRNLLFLGISVSDLYIVSILEQGKAPWTLESEWKIPQEPNRREHIEGVNTDLCPSYVIKKLKPTKPSSKGGEYQTVI

SEQ ID NO: 12679 - protein, 81 aa, Trichechus manatus
MAAPSPPPEPKEEWDYLDPAQRSLYKDVMMENYGNLVSLDVLNKDKDEEPTVKQEIEEIEEEVEPQSVIVTRIKSEIDQDP

SEQ ID NO: 12680 - protein, 81 aa, Trichechus manatus
SVVVEDVAVDFTQEEWALLDLSQRQLYRDVMMEIFRSLASVASQNLSDGDKLSTENIIVRFMKNDTWFSMVGEICELPGTE

SEQ ID NO: 12681 - protein, 81 aa, Trichechus manatus
VQESVTFKDVAVLFSQDEWGHLSLAQRALYRDVMLENYSNLVSVGLLGPKPDMFSQMRVGEEWMLEDTSGHSCLDWMTVFV

SEQ ID NO: 12682 - protein, 81 aa, Trichechus manatus
FLESVMFSDVSIDFSQEEWECLNEDQRDLYRDVMLENYSNLVSMAGCSFSKPDVISFLEQGKEPWLVDRELTRGQWPDLES

SEQ ID NO: 12683 - protein, 81 aa, Zalophus californianus
AQVCVISEDVFVSFSREEWMLLDDSQRLLYQDVMLENFALLASLGIVSSRSHSVAQLEQKEDPQMAAQVDMTPVSEREAQK

SEQ ID NO: 12684 - protein, 81 aa, Zalophus californianus
APGSVTFEEVAVYFSQEEWRLLNEAQRHLYRDVMLEVFALVASLGCGRGTEDEATSSEQNVSVGGSQINSTQKAYTQEHGL

SEQ ID NO: 12685 - protein, 81 aa, Zalophus californianus
APNSITFEDVAMDFSQEEWALLNSRQRKLYRDVMLENYRNLASLEKQLSKPTVITQMKQEDEMKTGTGNHQDTCSNGMVLL

SEQ ID NO: 12686 - protein, 81 aa, Zalophus californianus
GHALLTFRDVAIEFSQEEWGCLNHTQRELYRDVMLENYGHLLFLGLIVSKPDLVSFLEQTKDPWDGKRKKTVAFHPGLALS

SEQ ID NO: 12687 - protein, 81 aa, Zalophus californianus
TLSFKDVVVDFTSEEWQLLDAVQKNLYWDVILENYSNLVSVEDYLHKEEREYSYNRTLLYRKENEPIVTTCTTVDESHRRN

SEQ ID NO: 12688 - protein, 81 aa, Zalophus californianus
SKVPVTFGDLAIYFSQEEWEWLSPIQKDLYEDVMLENYQNLVSLGLSFRRPNVITLLEKGKAPWIVEPVRKRRGMDSGSKS

SEQ ID NO: 12689 - protein, 81 aa, Zalophus californianus
QGHVTFEDVAVYFSQEEWALLDEAQRHLYRTVMLENLALIASLGCWHGVKAEEAFSEQCVFMERVSQARTPDPGLSIPKAH

SEQ ID NO: 12690 - protein, 81 aa, Zalophus californianus
LQEAIVFEDVAVYFTRIEWSCLAPDQRALYRDVMLENYGHMASLGFLVAKPALISLLEQGEEPGALILQGTEEPGSTASLC

SEQ ID NO: 12691 - protein, 81 aa, Zalophus californianus
FKETVTFKDVAVVFTEEELGLLDPAQRKLYGDVMLENFRNLISVGGKIQSKMKTVIEAEPPEELSCWRIWQQIASDLTRCQ

SEQ ID NO: 12692 - protein, 81 aa, Zalophus californianus
TQDSVVFEDVAVDFTQEEWALLDFAQRSLYRDVMLENFQNLASLGYPLQTPYLISQWKQEEDLETAERGPIQGEHQEDFEI

SEQ ID NO: 12693 - protein, 81 aa, Zalophus californianus
MVEGAAQSQTCQGYPATKPDVILNFERGEESWSVEDEMQCQCISGKKRYGCDKCAVNAYEPLMTVLQRTHAGKKSHECCDC

SEQ ID NO: 12694 - protein, 81 aa, Zalophus californianus
FQEPVTFEDVAVYFTQNEWVILDPSQRALYREVMLENYANVASLAFLFTRPVLVSQLERGELPWGLEPWEPAGREALRGIC

SEQ ID NO: 12695 - protein, 81 aa, Zalophus californianus
QGLLSFSDVAVDFTWEEWQLLDTVQRNLYRDVMLENYSNLMSLERPLQCFSRGIHLKQKSDSKFQSKNYAEMNSVELNSHG

SEQ ID NO: 12696 - protein, 81 aa, Zalophus californianus
ELDSVTFKDVAIDFTLEEWRLMDPSQRNLHKDVMLENYRNLVSLGLAVSKPDMISHLEDGKGPCVVEREIARTPYPELETK

SEQ ID NO: 12697 - protein, 81 aa, Equus caballus
VHGSVTFADVAVSFSQEEWACLSPAQKALYRDVMLDNYSHLASLGGSSISKPDVITLLEQEKEPWMGVRKETGGQNPDLQS

SEQ ID NO: 12698 - protein, 81 aa, Equus caballus
MTQDFVTLKDVTMDFTVEDWEQLDLDQGDLFWDTALDNYQSLFLLNPPRPKLTSRPDGTEELEARVRGSPEATGPDKAESK

SEQ ID NO: 12699 - protein, 81 aa, Equus caballus
ESMTFGDVAVYFSWEEWRLLGEAQRDLYHDVMLENFALISSLDCWSATEDAKAPFEHSISVGVSQATTPKTGLISQNTHTC

SEQ ID NO: 12700 - protein, 81 aa, Equus caballus
LQVSVSFEDVTVDFSREEWQHLDPAQRRLYRDVTLENYSHLCSVGYQVPKPEVIFKLEQGEGPWMLEGEAPHQSCSDDDIG

SEQ ID NO: 12701 - protein, 81 aa, Equus caballus
MLENYGNMASLGFPLLKPAVISQLEGGGELGGPSPLAAGTEACPQALWTDIDIQTDNNLTKEMDEEKVNTSFELQRDFSQE

SEQ ID NO: 12702 - protein, 81 aa, Equus caballus
PLGPVIFEDVAIYFSQDEWGLLDEAQRLLYHAVMMENFALLSSVGSWHGAQDEEAPSEQGVSVGVSQVSTPKPGPSFQKAR

SEQ ID NO: 12703 - protein, 81 aa, Neovison vison
FKDVAVDITQEDWEIMRPVQKELYKTVTLQNYWNMVSLGLTVYRPTVIPLLEEPWMVIKEILEGPSPEWKTEAQECTPVTN

SEQ ID NO: 12704 - protein, 81 aa, Neovison vison
TQEEWQQLDPAQRNLYRNVMLENYNNLITVGCPFTKPDVIFKLEQEEEPWVVEEEVLRRHYPGEMWGIEHQKIQDRLLTQF

SEQ ID NO: 12705 - protein, 81 aa, Neovison vison
MLETYRNLISLGLQGSKPDVISRLEKGEEPWAPYSPRIEEGWIWSHGSESFESRTGKRGLTPRQEISKAVGSQRAKSEEHV

SEQ ID NO: 12706 - protein, 81 aa, Capra hircus
VQGPVSFEDVAVGFSGEEWQLLGPSQKALYWDVMLENYCNLVSVGYQAPKPDSFFQLEQGGPPWMVKGAALSPTCPGYQAT

SEQ ID NO: 12707 - protein, 81 aa, Capra hircus
QGLMTFEDVAVDFTQEEWQYLNPPQRTLYRDVMLETYSNLVSVGKNGYHVTKPDLILKLEVEEQCLPEGKIPIWSFPEAFQ

SEQ ID NO: 12708 - protein, 81 aa, Capra hircus
PKVPVTFDDVAVHFSEQEWGNLSEWQKELYKNVMRGNYESLVSMDYAISKPDLMSQMERGERPAMQEQDDSEEGEAPADPS

SEQ ID NO: 12709 - protein, 81 aa, Capra hircus
KSWGPLSFMDVFVDFTWEEWQLLDSAQKHLYRSVMLENYRNLVSLGYQYTKPSIIFQLEQEELWMMHSPSQGHSDKVWEID

SEQ ID NO: 12710 - protein, 81 aa, Chrysochloris asiatica
GWVPALFDEVAIYFSDEEWDVLTEQQKALYREVMRMNYETVLSLEFPFPKPDMITRLEGEEESQKSKEWQLHGGTFAENED

SEQ ID NO: 12711 - protein, 81 aa, Suricata suricatta
FREPVTFEDVTLGFTSDEWGLLDLEKKSLYREVMLENYRNLVSVEHQLSKPDVVSQLEEEEALCSVERGIPQDTFSECLAV

SEQ ID NO: 12712 - protein, 81 aa, Suricata suricatta
VYIYTTSFRDVTIEFSQEDWRFLNHSQQELYRDVMLENYGHLLFFGLVLSKPDLVFLEQRKGLCHGKRKETVVSYPALSSN

SEQ ID NO: 12713 - protein, 81 aa, Chrysochloris asiatica
LYKPVTFTDVAVEFTQEEWVMLDTAQRNLYRDVMLENYRNLTSVESQLCRPTVISLINEKEKSVKRRISQAICPDWEDQLK

SEQ ID NO: 12714 - protein, 81 aa, Chrysochloris asiatica
ARSLEEDGVCLSKQEWENLEDWQRELYRNVMTSNYETLVSLKVLGQPEGEVELATEMLGGLEEDGAGIAHPADRAMIKQEA

SEQ ID NO: 12715 - protein, 81 aa, Chlorocebus sabaeus
MDFTPEEWGKLDPAQRDVMLENYRNLVSLWLPVSKPENYNLENGKEPLKLERKTPKSSYSGEPDRWESSEMIAQQDNEEIL

SEQ ID NO: 12716 - protein, 81 aa, Suricata suricatta
FKEAVTFKDVAVVFTIEELGLLDSAQRKLYRDVTLENFRNLVSVGHLPLKPDMVSQLEAEEELWVMERETQRNGCCSEIRL

SEQ ID NO: 12717 - protein, 81 aa, Chlorocebus sabaeus
MLENYGNLVSVGLLSSKPKLITQLEEGAEPWMEVREAPSGTRAVQDYWFETKMSALKQSTSAGSVVGERRKSVMMEKGLDW

SEQ ID NO: 12718 - protein, 81 aa, Chrysochloris asiatica
SQELVLFKDVAVNFTQEEWQQLDCDEKIMYRDVMLETYSHLISLGFDITKPDVIIKLEQGDEPWVVEGDFPWQSSPEEGWK

SEQ ID NO: 12719 - protein, 81 aa, Chrysochloris asiatica
CQEPVTFEDVAIIFTEEEWGHLVPIQRDLYKEVMLENYTSIVSLDLVTKHESQDTSEEEISEETLRESFENKGPICPKLEV

SEQ ID NO: 12720 - protein, 81 aa, Suricata suricatta
VSVTFDDVAVTFTQEEWGQLDPAQRTLYQEVMLENCGLLVSLALPILLICDKGKPKTTVSATGEPALSEGDPIHEQLIQGV

SEQ ID NO: 12721 - protein, 81 aa, Chlorocebus sabaeus
FQDSVAFEDVDVNFTQDEWALLDPSQKNLYRDVMQETFRNLASVGKKWKDQKIEDEYKNPRRNLSLMREKLFESKESHYCG

SEQ ID NO: 12722 - protein, 81 aa, Suricata suricatta
MDLAPRPDPAQKSFRKNVMWEKRGDLGSVGPCVSQADLVSLLERGTEPWMVAGELAEGPRPGQQSVQETQELFPKRDPFAA

SEQ ID NO: 12723 - protein, 81 aa, Chrysochloris asiatica
MGTMIIEDVAVVFTHEEWDLLDPAQRKLYRDVMMETLRNLVSVGAIKKSHGWKDHLDNQGRHLRTGAIENLGECSEGNQCG

SEQ ID NO: 12724 - protein, 81 aa, Chlorocebus sabaeus
EPGVVSFADVAVYFCREEWGCLRPAQRALYRDVMRETYGHLSALGIGGNKPALISWVEEEAELWGPAARDPEVTKCPTEAD

SEQ ID NO: 12725 - protein, 81 aa, Mandrillus leucophaeus
ICELLTFKDISVDFTQEEWGQLAPAYQNLYREVMLENYSNLVSVGYQLSKPSVISQLEKGEEPWMAEKEGPGDPSSDLKSK

SEQ ID NO: 12726 - protein, 81 aa, Mandrillus leucophaeus
SKDLVTFGDVAVNFSQEEWEWLNPAQRNLYRKVMLENYRSLVSLGVSVSKPDVISLLEQGKEPWMVKKEGTRGTCPDWEYV

SEQ ID NO: 12727 - protein, 81 aa, Mandrillus leucophaeus
AQGLVTFADVAIDFSQEEWACLNSAQRDLYWDVMLENYSNLVSLDLESAYENKSLATEKNIHELRASKRNSDRRSKSLGRN

SEQ ID NO: 12728 - protein, 81 aa, Sus scrofa
MKPAQRNLYRDVMLENYSNLVTVGCQVTKPEVIFKLEQEEEPWVVEEEMLGRHCPEVWEVDEQLKKQQETHVRKVTSISKE

SEQ ID NO: 12729 - protein, 81 aa, Loxodonta africana
NFWILRLPPGSKGEVPKEWGKLDEWQKELYKHVMRGNYETLVSLDYAISKPEVLSQIEQGKEPCSWRRAGPKIPDVPVDPS

SEQ ID NO: 12730 - protein, 81 aa, Loxodonta africana
LQGSVSFKDVTVDFTQEEWQQLDPAQKALYRDVMLENYCHLISVGCHMTKPDMIHKLEQGEEPWTTERVYPSHAYLEEDGK

SEQ ID NO: 12731 - protein, 81 aa, Loxodonta africana
VVFTDVAVDFSQEEWECLDSYQRSLYRDVILENYSNLVSLGGGSISKPDVVTLLEQGKEPWMVVRDTKIRWSLGLESNYDA

SEQ ID NO: 12732 - protein, 81 aa, Loxodonta africana
PVGNAPVTFDDITVYLLQEEWMLLSRQQQMEIWGSDKLVAPLAGLTIANPELFCKLEQGAEPWLGNIQGQRSLQNHRSRKD

SEQ ID NO: 12733 - protein, 81 aa, Capra hircus
NFWILRLPPGSKGEAPKEWGKLDEWQKELYKHVMRGNYETLVSLDYAISKPEVLTQTEQGKEPCWRRAGPKVPDVPVDPSP

SEQ ID NO: 12734 - protein, 81 aa, Capra hircus
KKPVTFEDVAVNFTQEEWKCLDASQKVLYQDVISETVRNLMSVGGEKEERQEQSQSLGDEGTVDDKKASLAHRGSGPTSAP

SEQ ID NO: 12735 - protein, 81 aa, Capra hircus
FTFKDVAIEFSQEEWECLAPSQRALYRDVMLETYRNLVSLGDDNFSPEVGILSAGFAINKLSPRENTNLGELYGNENHGIK

SEQ ID NO: 12736 - protein, 81 aa, Capra hircus
LQELVTFKDVAVDFTEEEWEHLDPSQRHLYREVMLENFGNLISLAGHLLSEPEMIFHFEQDVVWMEETIPRGSYSECGILS

SEQ ID NO: 12737 - protein, 81 aa, Chrysochloris asiatica
AQELVTYEDVAVYFIRKEWKRLEPAQRDLYRDVMLENYGNVFSLDGENRSENDQEISEDTGSHGVLLGRFQKDISQDLKFK

SEQ ID NO: 12738 - protein, 81 aa, Capra hircus
TFKEAVTFTDVAVTFTEEELGLLDSAQKKLYQDVMLENFRNLVSVGCHPFRHDIFHLEKEKRLWVVKTATQREGKSEEKIQ

SEQ ID NO: 12739 - protein, 81 aa, Chrysochloris asiatica
SLGSILFNDVAIVFSQEEWEQLVPAQRDLYKDVMLETYHTLVSLGLTISKPNVISFLEQGEEPWLGERAVTGGLGPVLESG

SEQ ID NO: 12740 - protein, 81 aa, Chrysochloris asiatica
KPGIVRFADVAVYFSREEWACLRPAQRALYRDVMRETYGHLGALGFPGPKPALISWMERESEAWSPAAQEPKEGENLGGAP

SEQ ID NO: 12741 - protein, 81 aa, Chlorocebus sabaeus
AQESVTFRDVAVFFSQDEWLHLGSAQRALYREVMLENYSSLVSLGIPFSMPKLIHQLQQGEDPCLVEREVPSDTCLGFKTW

SEQ ID NO: 12742 - protein, 81 aa, Chrysochloris asiatica
TKSQVSFEDVAVDFTWAEWQLLNPTQKNLYKDVMLENYSNLVFLGYQIIKPNAVFKLEQGEEPCMTDDEMLSHNLPEVWLD

SEQ ID NO: 12743 - protein, 81 aa, Chrysochloris asiatica
LQEAVTFKDVAVVFSEEELGLLDSTQRTLYREVMLETFRNLLSVGHPPFKPDLISQLEREGKILTMVTEAQRDGCSEKRYS

SEQ ID NO: 12744 - protein, 81 aa, Chrysochloris asiatica
KDDLVAFEDVAVYFSQEEWGLLDMAQRALYRHVMLENFTLMASLGLTASRPQMIVQLEGGEEPWVTNRMDLASVTAKKVQR

SEQ ID NO: 12745 - protein, 81 aa, Suricata suricatta
MKPDVIFKLEQGEEPWVGDGEVPSVDCSEHVWQGNGHVAWYQEDQEKLRNLKQDHECDAFGKKLNLSMNFVPLRKSNSEDN

SEQ ID NO: 12746 - protein, 81 aa, Suricata suricatta
WLSPLRDVAIEFSQEEWGCLSYSQRELYRDVMLENYRHVLFLGLVVSKPDLVIFLEQQRELWDVKRKKIIASYPGRMSVNR

SEQ ID NO: 12747 - protein, 81 aa, Suricata suricatta
PQVSVSFEDVAVLISREEWGCLGPAQRCLYRDVMLETYRNLVSLGLQGSKPDVISRLEKGEEPWAPHSLRIEEGWIRSHRS

SEQ ID NO: 12748 - protein, 81 aa, Chlorocebus sabaeus
LQASVSFQDVTVEFTQEEWQHLGPVERTLYRDVMLENYSHLISVGYCITKPKVISKLEQGEEPWSLEEEFLNEKHQGYFKV

SEQ ID NO: 12749 - protein, 81 aa, Suricata suricatta
AQESLTLEDVAVDFSREEWQLLAPAQKDLYRDVMLENYRNLVSLEIRKVDGHLQCQLQNQSIQKSVEQCCEYITFANIFNQ

SEQ ID NO: 12750 - protein, 81 aa, Suricata suricatta
GCLTNYSPDPVTLEDVAVEFTQEEWTSVDPTQRNLYREEMLENHMNLVTLGWEICLNTKRSAPQQSILRGKASNVEMNSRQ

SEQ ID NO: 12751 - protein, 81 aa, Suricata suricatta
AQESLTLEDVAVDFSREEWQLLGPAQKDLYRDVMLENYRNLVSLGYQASTPDALCMLERGEGPWATGEAVRGGARPETRKV

SEQ ID NO: 12752 - protein, 81 aa, Sus scrofa
MAVSQAPVTFEDVAIEFSPEEWACLDPAQRALYRDVMLETYRNLLSLGEHRFPPEVGICPWVSLHFPVCASWEPLLCLTEL

SEQ ID NO: 12753 - protein, 81 aa, Sus scrofa
CWGLLSFKDVSMEFTWEEWQLLDSAQKHLYRDVTLENYSNLLSVGYHDTKPDLIFKLEQGEEPWIVNASISGQSCPEGWKE

SEQ ID NO: 12754 - protein, 81 aa, Sus scrofa
KPAAVRFADVAVYFSPEEWGCLRPAQRALYRDVMRETYGHLGALGFPGPKPALISWMEQESEAWSPAAQDPEEGESLGGPL

SEQ ID NO: 12755 - protein, 81 aa, Sus scrofa
GQMSLSFTDVAIDLSQEEWECLDLDQRALFREVMLENYRNLVSLGCPTPKPDVITLLEQEKEPWVVMREGTRNWYTDLESK

SEQ ID NO: 12756 - protein, 81 aa, Mandrillus leucophaeus
DSVTFDDVAVDFTQEEWTLLDPSQRDLYRDVMLENYENLASVEWRLKTKGPALRQDRSWFRTSNETQTARSHNGGQLCDRT

SEQ ID NO: 12757 - protein, 81 aa, Sus scrofa
TQGLVTFRDVAIEFSQEEWKCLEPAQRDLYRDVTLENFGNLVSLGLSISKPDVISLLEQGKDPWMMANDMTGPWCPDWESR

SEQ ID NO: 12758 - protein, 81 aa, Sus scrofa
WKEMLTFEDVALYFTREEWDTLGWAQKGVYREVMLANYRNMVSLGFQFPKPEVICQLEQWEEPWILDLPRAGTGTASGSAC

SEQ ID NO: 12759 - protein, 81 aa, Sus scrofa
SQGLLTVKDVAIDFSPEEWECLDLGQRDLYRDVMIEIYRHLVSLEYVISKPDLVRLLEQKKDPWDVKGMETVAIQPALSSH

SEQ ID NO: 12760 - protein, 81 aa, Sus scrofa
GYCVPEPEVILKLEQGEEPWVLEEEFSSQSYPELINSSRTYSRKVFNKGRKWFHDEKHERIHSEEKLYEYNKNENCLCLNE

SEQ ID NO: 12761 - protein, 81 aa, Sus scrofa
ARVSVTFDDVAVTFTQEEWGQLDPAQRTLYQEVMLENRGLLVSLGCPVPRPELICQLEHGGELWMVQKDLSQSTCPGERYR

SEQ ID NO: 12762 - protein, 81 aa, Nomascus leucogenys
AQGYVTFEDVAVYFSQEEWRLLDEAQKLLYRNVMLENFSLLASLGLASSKTHEITQLESWEEPFMPAWEVVTSATPRGTWW

SEQ ID NO: 12763 - protein, 81 aa, Nomascus leucogenys
DSVAFEDVAINFTCEEWALLGPSQKSLYRDVMQETIRNLDCIGMTWQTHDIEEDQYKDLRRNLRCHMVERSCEIKDNSQCG

SEQ ID NO: 12764 - protein, 80 aa, Nomascus leucogenys
MALSQGLFTFKDVAVEFSQEEWECLDPAQRALYRDVMLENYRNLLSLDEDNIPPENAFYPVQELRETLVFLILYSSKICL

SEQ ID NO: 12765 - protein, 81 aa, Nomascus leucogenys
GTVTFEDVAVNFSQEEWSLLSEAQRCLYHDVMLENLTLISSLGCWYGAKDETPSKQTLSIQQESPLRTRQTGVCTKKVHLW

SEQ ID NO: 12766 - protein, 81 aa, Nomascus leucogenys
EKETLTFRDVAIEFSLEEWECLSPAQQNLYMNVMLENYKNLVFLDIAVFKQDSVTCLEQEKEPWNMKRHEMVDEPPGKPDH

SEQ ID NO: 12767 - protein, 81 aa, Nomascus leucogenys
TLKEAVTFKDVAVVFTEEELRLLDFAQRKLYREVMLENFRNLLSVGHQPLHRDTFHFLKEEKFWMMETATQREGNLGPAFQ

SEQ ID NO: 12768 - protein, 81 aa, Bos indicus
MDSVVFEDVAVNFTLEEWALLDPGERKLYRDVMLETCRNLASVVKTRSSTQCDILKNELCSEEKKVRFPRNDSWSVFGENW

SEQ ID NO: 12769 - protein, 81 aa, Bos indicus
AQLTFKDVAIEFTQEEWECLDPAQRALYRDVMVETLSNIVSLDISHMHVIKKLQLNANIYGGEGFQIVILGRHRRNKIEDF

SEQ ID NO: 12770 - protein, 81 aa, Bos indicus
MLENYGNLASLGLVISKPDLVTFLEQMKDPWDARRMETPAVHPGIIDIGEKTYNCYDYAKAFNQSSKVIQQQNIQTKQKHY

SEQ ID NO: 12771 - protein, 81 aa, Bos indicus
SQELVTFEEVSVDFSQEEWALLAPTQKILYRDVMLENFRNLASVGYHLCKHSPITEVAQEELRPEGRGILQSACTDGATQL

SEQ ID NO: 12772 - protein, 81 aa, Canis lupus
PCRLVLFKDVAVDFSQEEWECLDLEQKDLYRDVMLENYSNLVSLGFSISKADVLSLLKQGKEPWKVVQEVTRSQSSDWESR

SEQ ID NO: 12773 - protein, 81 aa, Canis lupus
FQGFVIFRDVSIDFSEEEWECLDSTQRNLYKYVMLENYSNLVSVGKYTFLQKVYNPPEYLLPLRRISQLLSYILCVSFPYS

SEQ ID NO: 12774 - protein, 81 aa, Zalophus californianus
QEPVTFEDVAVYFTQNQWASLDPMQRALYLEVMLENYANITSLGGKNKIEREEQSPRLNISKDSAAHRLMVEGLLTEAPQH

SEQ ID NO: 12775 - protein, 81 aa, Equus caballus
QDSVTTEDVAVNFTPEEWALLDPSQKKLYRDVMWETFRILASVGKNEDIPSLKHVVGRLCESEEGSQCGENVSLLANLSLN

SEQ ID NO: 12776 - protein, 81 aa, Equus caballus
LQGSVSFKDVTVDFSQEEWQQLDPAQKTLYRDVMLENYCHLISVGFHMSKPDMIRKLEQGEELWTTERIFPSQSHLEEDGK

SEQ ID NO: 12777 - protein, 81 aa, Equus caballus
NFWILRLPPGSKGEAPKEWGKLDEWQKELYKHVVRGNYETLVSLDYAISKPEVLSQTEQGKEPCSWRRPGPKLPDVPVGPS

SEQ ID NO: 12778 - protein, 81 aa, Equus caballus
PQESVTFEDVAVYFTQNQWASLDPAQRALYGEVMLENYANMASLVAFPFPKPVLISQLERGEAPWGPDPWEAEVLRGVRPG

SEQ ID NO: 12779 - protein, 81 aa, Loxodonta africana
KVPVTFVDIAVYFSEDEWKSLDGWQKELYNNLVKENYKTLMSLDAEDPAPKPDAPPQVEPREEPCVWEQRNPEERDIPMDP

SEQ ID NO: 12780 - protein, 81 aa, Capra hircus
RGSVTFEDVAVYFSWEEWALLDEAQRCLYHDVMLENFALTSSLGCWHGVEDKEAPSERSICRGASQIRTLKADSSPQKGQP

SEQ ID NO: 12781 - protein, 81 aa, Capra hircus
MADLVMFRDVTVDFSQEEWECLNSNQRNLYRDVILENYSNLVSLGGCSISKPDVITLLEQGKEPWMVVRDEKRRWRLDLES

SEQ ID NO: 12782 - protein, 81 aa, Capra hircus
ALALISFEDVAITFTGEEWRHLDLAQRTLYQEVMLETCGLLVSLGHPVPEAELIQLLEYGPELWRVKRGLSGNTCIGEKSN

SEQ ID NO: 12783 - protein, 81 aa, Capra hircus
ARLSVTFDDVAVTFTQEEWGHLEPAQRTLYREVMLENRGLLVSLGCPVPRPELIYQLEHGQELWTVKRDLSRSTCPGDKGK

SEQ ID NO: 12784 - protein, 81 aa, Suricata suricatta
FGGVTFGDIAIYFSWKEWSLLDEAQRRLYYDVMLENFTLVSSLGKALPVPRGPDWSVSVGVSQASVSTAALSSRKTHPCEM

SEQ ID NO: 12785 - protein, 81 aa, Chlorocebus sabaeus
NFWILRLPPGSKGESPKEWGKLEDWQKELYKHVMRGNYETLVSLDYAISKPEVLSQIEQGKEPCHWRRPGPKIPDVPVDPS

SEQ ID NO: 12786 - protein, 81 aa, Chlorocebus sabaeus
SQGLLIFRDVAIEFSPEEWSYLDPAQQNLYRDVMLENYRNLVSLGIAVSKPDLITCLEQRNEPWNVKKHETIGRHPAVSSH

SEQ ID NO: 12787 - protein, 81 aa, Capra hircus
PTEPVTFRDVAVDFTQEEWGQLGPAQRTLYRDVMLETFGHLLSVGPELPKPDVISQLEQGAELWVAERGLAQGCRPALPPF

SEQ ID NO: 12788 - protein, 81 aa, Chrysochloris asiatica
NFWILRLPPGSKGEVPKEWGKLDEWQKELYKHVMRGNYETLVSLDYAISKPEVLSQIEQGKEPCNWRRTGPKIPDVPVDPS

SEQ ID NO: 12789 - protein, 81 aa, Chrysochloris asiatica
VVTFRDVAVDFSQEEWDWLNLSQRDLYRDVMLENYRNLVWLDWESWCEIKEISPKCYLDEEEISQGMATEKLTSHDFECSN

SEQ ID NO: 12790 - protein, 81 aa, Chrysochloris asiatica
MMENYRNLLALGPPVCKPDMISHLEQGEAPWQVYPRVYTAACPELETAPARSKECSYEEDPAQDSTVGRLLGTRPYSSIWG

SEQ ID NO: 12791 - protein, 81 aa, Suricata suricatta
SLEPDSFGDVAVLFSQEEWARLAPAQRELYRDVMLETYSHLVSLGLAVSKPDVISFLEQGKEPWLGEKAAAGGLGPELESR

SEQ ID NO: 12792 - protein, 81 aa, Chlorocebus sabaeus
MLENFALIASLGLISFRSHIVSQLEMGKEPWVPDSVDMTSAMARGAYGRPGSDFCRGTEGKDLPSEHNVSVEGVAQDRSPE

SEQ ID NO: 12793 - protein, 81 aa, Suricata suricatta
AQESVTFRDVAVVFSRDEWLCLDPAQRSLYREVMLENYGTLVSLGIPSSTPKVICRLQLGEDPCVLERETPQDACLGFKTG

SEQ ID NO: 12794 - protein, 81 aa, Suricata suricatta
WLTFRDVIVEFSPEEWECLGPAQRALYRDVMLENYRNLVSLALSPKCMIKELPPKENSNTGEVLQAVILERHESRDTEDHS

SEQ ID NO: 12795 - protein, 81 aa, Chrysochloris asiatica
QGCVTFEDVAVSFSQEEWGLLDETQRLLFCDVMLENFAIIASLVTQHESICNEEGIYEGSKCKKDFTCKYGLVQNQGSHTG

SEQ ID NO: 12796 - protein, 81 aa, Suricata suricatta
LSLPNPPLDVAIEFPQEDGGCLCLPQREVYGDVMLEIYGHLLFLGLVVSKPDLVIFLEQKRELWDVKRKETVASYPGNATL

SEQ ID NO: 12797 - protein, 81 aa, Mandrillus leucophaeus
SVCFHNQQTVNKSLEVAVHFTWEEWQDLDDAQRTLYRDVMLETYSSLVSLGHCITKPEVIFKLEQGAEPWLGEEWANQCLS

SEQ ID NO: 12798 - protein, 81 aa, Sus scrofa
PQGRVTFEDVALYFSWEEWNLLDEAQRCLYQDVMLETFVLASSLGCWPRAEDKEASSEQSISVGVSQIRTIKADSSPQKAQ

SEQ ID NO: 12799 - protein, 81 aa, Mandrillus leucophaeus
MTFEDIVVDFTREEWALLDTSQRKLFQDVMLENISHLVSIGKQLCKSVVLSHLQHVEKLSTQGMSLLQGREGDIKHQEIPF

SEQ ID NO: 12800 - protein, 81 aa, Mandrillus leucophaeus
VMFRDVAIDFSQEEWECLDSAQRDLYRDVMLENYSNLVSLDLPSRCASKDLSPEKNTYETELSQWEMSDRLENRDLEESKS

SEQ ID NO: 12801 - protein, 81 aa, Nomascus leucogenys
EMELLTFRDIAIEFSLEEWQCLDRAQQNLYREVMLENYRNLVSLGITLSKSDLITCLEQNKEPQNIKRNEMVSKHPVTCSH

SEQ ID NO: 12802 - protein, 81 aa, Nomascus leucogenys
RAEEAVTFKDVAVVFTEEELQLLDLAQRKLYRDVMLENFRNLLSVGHQPFHGDTFHFLREEKFWVMETTSQREGNSGGKIQ

SEQ ID NO: 12803 - protein, 81 aa, Nomascus leucogenys
DSVTFEDVAVDFTQEEWTLLDQTQRNLYRDVMLENYKNLVAVGKAGTILFIYLALSPRLECSGVISAHCKLCLLGSRHSSA

SEQ ID NO: 12804 - protein, 81 aa, Nomascus leucogenys
CEASVSFEDVTVDFSREEWQQLDPAQRWLYQDVMLELYSHLFSVGYHIPNPDVIFRMLKEKEPRVEEAELSHQRCQGLAQL

SEQ ID NO: 12805 - protein, 81 aa, Bos indicus
QDLVTFEDVTVEFTQEEWALLDSSQRKLYRDVMLENCRNLASLGKLYIIPSFQFVLDLETVLKAKWLTPKKPIFRKEHSND

SEQ ID NO: 12806 - protein, 81 aa, Bos indicus
PQGGVTFEDVALSFSWKEWKLLDAAQRRLYHDVMVENYALISSLGFWSGEEKVETSFEQSVSVAVSQARTSKEPSSSQKTH

SEQ ID NO: 12807 - protein, 81 aa, Bos indicus
APVILKDVVVTFTRQEWKLLDLTQRTLYQEVVLETSRLLVSLVCFFCVGITNRPHLYIGFPSDDKAKTKTTETAASQQALF

SEQ ID NO: 12808 - protein, 81 aa, Bos indicus
AQGCVTFEDVTIYFSPEEWGLLDEAQRLLYCDVMLENFALIASLGLASFRSHIVAQLEMGAEPWVPDQADMTSAMARGVYR

SEQ ID NO: 12809 - protein, 81 aa, Bos indicus
ERLTCEDVAIEFTHEEWVFLDPAQRALYRDVMLETYRNLVSLDISPTHVIKHLQLEANSDKLETFQTLMLGRPESCEIKHF

SEQ ID NO: 12810 - protein, 81 aa, Bos indicus
QGLFTFKDVAVEFTQEEWECLDPIQRALYRDVMLETYRNLLSLGSYSATFAVKELSSPKEDISKGELCHLMTLEKNETYGI

SEQ ID NO: 12811 - protein, 81 aa, Canis lupus
MIAVTFEDVAVDFTQEEWILLDLNQRNLYRSVMLENYQNLVSVEYQLSKPKLVAWLEQQELRTVETGVFQEWEMRPQTKES

SEQ ID NO: 12812 - protein, 81 aa, Canis lupus
FHEPVTFEDVILGFTSEEWGLLDLQQKSLYREVMLENYRNLVSVEHQLSKPDVVSQLEEEEALWSVERGIPQDTFSEYPAT

SEQ ID NO: 12813 - protein, 81 aa, Canis lupus
MAMYLTREEWRPLDPTQRDLYRDVMQENYGNVVSLDFEIRSENEVNPKQEISEDVEFGTASERPVGNTEENAENEEGFESG

SEQ ID NO: 12814 - protein, 81 aa, Canis lupus
KVPVTFVDIAVYFSEDEWKNLDEWQKELYNNLVKENYKTLMSLDPEGAGPKPDAPSQVEPREEPCVWEQRDPEEREILMDP

SEQ ID NO: 12815 - protein, 81 aa, Capra hircus
CQERLTSEDVAIEFTQEEWEFLDPDQRALYRDVMLETYRNLLSVGEDDFLPELPLDIAPTHVIKLLQPKVNSDKQETFQKL

SEQ ID NO: 12816 - protein, 81 aa, Capra hircus
PQAKVTFEDVAVFLSQDEWDRLGPAQRGLYRHVMMETYGNVVSVGIPGSKPEVISQLERGEEPWVLDKQGLQSAILRCEHK

SEQ ID NO: 12817 - protein, 81 aa, Capra hircus
LQGSFSFEDLSVDFTQKEWQLLDPHQKDLYKDVMLENYSSLVSLGYEVMKPGVILKLEQGEEPWTGDGEIPSSDSLDQVFQ

SEQ ID NO: 12818 - protein, 81 aa, Capra hircus
MEAVTFKDVAVAFTEEELGLLDSAQRKLYQDVMVENFRNLVSVEENNQSELRAVEERGLHEELSCWQIWQQIANDLTRCQD

SEQ ID NO: 12819 - protein, 81 aa, Capra hircus
SQEQVSFKDVCVDFTQEEWYLLDPAQKILYRDVILENYSHLVSVGNCITKPEVIFKIEQGEEPWILEERFPKQYRSEDWKV

SEQ ID NO: 12820 - protein, 81 aa, Capra hircus
DLDQVTFEDVVVDFTREEWGCLEPAQRTLYRDVMLETFRLLVSVGHWLPKPDVISLLEQEAELWAADEGGPRGMCPDLETR

SEQ ID NO: 12821 - protein, 81 aa, Capra hircus
MDSVVFEDVAVNFTLEEWELLDPAQRKLYRDVMLETCRNLATVGSCPQVKVSVSSPQWDVLETELCIEREVVRFTRNDSRS

SEQ ID NO: 12822 - protein, 81 aa, Capra hircus
VMFRDVAIDFSQEEWDCLDSAQRDLYRDVMLENYSNLVSLDLPSRGANKLLSPKKDIYETELSQWEMSAGLENCDLENSSS

SEQ ID NO: 12823 - protein, 81 aa, Capra hircus
AHGSLTFSDVAIGFSQQEWECLDPVQKTLYRDVMMENYGNLVSLGHSISKPNVITLLEQGKEPWIVVREETRSWCTDLDSR

SEQ ID NO: 12824 - protein, 81 aa, Chrysochloris asiatica
HKVSVSFEDVTVEFSREEWQHLDSAQRRLYRDVTLENYSHLLSVGYQVPKPEVIFKLEQGEEPWTLETETLHQSCSEELWQ

SEQ ID NO: 12825 - protein, 81 aa, Chrysochloris asiatica
TASSQEPMTFKDVAMDFTPEEWGKLDPAQRDVMLANYRNLVSLWLPVSKAENYNLENGKEPWMFERKNPKSSSTDWEARPE

SEQ ID NO: 12826 - protein, 81 aa, Chrysochloris asiatica
LQDLVTFEDVAVEFTQEEWALLDPSQRKLYRDVMLENSRNLASLGNQVGKPSLKAQLEQEDKVMTEKRRILPGSCLDLETV

SEQ ID NO: 12827 - protein, 81 aa, Chlorocebus sabaeus
LVTFRDVAIDFSQEEWECLDPAQRDLYRDVMLENYSNLISLDLESSRATKELSPEKEIYEMESLQWENMGKLINHHLQYNG

SEQ ID NO: 12828 - protein, 81 aa, Chlorocebus sabaeus
SVALEDVAVNFTQEEWALLSPSQKNLYRDVMLETFRNLASVGIQWKDQDTENLYQNLGIKLRSLGERLCGRKEGSEHRETF

SEQ ID NO: 12829 - protein, 81 aa, Suricata suricatta
LGSMSFKGVTVDFTRDEWLQLTGTQRTLCRGVMLENYSHPAAVGGGARCVSISLNLLKLTQERKPLKVVTAGSVFYQESHL

SEQ ID NO: 12830 - protein, 81 aa, Suricata suricatta
MLENYGHLLFLGLVVLKPDLVTFLEQKQDLWDVKGKETIASYPALSSNANERLPPRIFIESSFQNVSVDRYKHRALENGPL

SEQ ID NO: 12831 - protein, 81 aa, Chlorocebus sabaeus
TDAQLTFKDVAIEFSQEEWTCLDPAQKILYRDVMLENYRNLVSLAGISPFDLSIISLLEQGKEPWNVDSQEKIASGSGSEA

SEQ ID NO: 12832 - protein, 81 aa, Suricata suricatta
AAVTMTFDDVALYFSEQEWEILEKWQKKMYLQVMKTNYETLDSLGGVFSKPDLITWMEQGRTLLIRDQGPLENRVTLSLSA

SEQ ID NO: 12833 - protein, 81 aa, Chlorocebus sabaeus
VAFEDVAVNFTQEEWALLDIFQKNLYREVMLETFRNLTSIGKSWKDQNIEYEYQNPRRNFRSLMEDKVHEIKEDSHCGETF

SEQ ID NO: 12834 - protein, 81 aa, Suricata suricatta
AHGSVTFRDVAIDFSQEEWEFLDSAQRDLYRDVMWENYSNFISLDLESRYRTNTLSPEKDIYEIYSFQWEIMERIKSYSLQ

SEQ ID NO: 12835 - protein, 81 aa, Mandrillus leucophaeus
GKELLSFEDVAMYFTREEWGHLDWGQKDLYRDVMLENYRNMVLLGFQFPKPEVICQLENWDEQWILDLPRAGSRKASGSAC

SEQ ID NO: 12836 - protein, 81 aa, Suricata suricatta
YQEFVTFEDVAVHLTREEWGCLDPVQRNLYREVMLENYGNVVSVGFSISMPDGISQLEQDLQVFDLETKNREGLRDDCSDG

SEQ ID NO: 12837 - protein, 81 aa, Mandrillus leucophaeus
PQESVTFKDVSVDFTQEEWYHVDPAQRSLYRDVMLENYSHLVSLGYQVSKPEVIFKLEQGEEPWISEGEIQRPFCPDWKTR

SEQ ID NO: 12838 - protein, 81 aa, Mandrillus leucophaeus
AQVSVTFDDVAVTFTQEEWGQLDLAQRTLYQEVMLENCGLLVSLGCPVPRPELIYHLEHGQEPWTRKEDLSQDTCPGNKGK

SEQ ID NO: 12839 - protein, 81 aa, Mandrillus leucophaeus
AQESLTLEDVAVDFTWEEWQFLSPAQKDLYRDVMLENYSNLVAVGYQASKPDALSKLEQGEEPCTTEDEIYTRICCGGQPQ

SEQ ID NO: 12840 - protein, 81 aa, Sus scrofa
MLENYSHLISVGYCIPKPELIFRLEQGEQPWILEEESPSQSYPGVCRVDNQLEQSQEIQNRQFWQAPLINNNALTIERGNV

SEQ ID NO: 12841 - protein, 81 aa, Sus scrofa
PQAAVSFKDVTVAFTQEEWQQLDSAQRTLYRDVTLENYSHLVSVGYCFTKPELIFMLEQGDDPWLLEKEFVKRRSPEEYQP

SEQ ID NO: 12842 - protein, 81 aa, Mandrillus leucophaeus
GWVPALFDEVAIYFSDEEWEVLTEQQKALYREVMRMNYETVLSLEFPFPKPDMITRLEGEEESQNSDEWQLHGGTSAENEE

SEQ ID NO: 12843 - protein, 81 aa, Sus scrofa
QQRAVSFKDVVVGFTEEEWHRLNPAQRALYRDVMLETYSNLVSVGYKGTKPYVILRLEQQEAPWICEAACSGCHCRENIWQ

SEQ ID NO: 12844 - protein, 81 aa, Mandrillus leucophaeus
GPLTFTDVAIEFSLEEWQGLDTAQQNLYRNVMLENYRNLVFLGITVSKPDLITCLEKEKEPWNMKRHEMVDEPPVICSHFA

SEQ ID NO: 12845 - protein, 81 aa, Sus scrofa
AHMAFRDVAVDFTQEEWMLLSPAQRSLYREVMLENYSNMVSLGIPFSKPKLITQLEQGKETWREERKCPPATCSAEPQPEL

SEQ ID NO: 12846 - protein, 81 aa, Mandrillus leucophaeus
AKGLPSNDTDWPQEKEGKAQIVVPVTFRDVAVIFTEAEWKRLSPEQRNLYKEVMLENYRNLLSLGQEIETILANMVKPRLY

SEQ ID NO: 12847 - protein, 81 aa, Sus scrofa
AVTFKDVAVTFTEEELGLLDSTQRKLYRDVMLENFRNLLSVGSKNPNEMETLRKVALKYLSHEELSCWQIWKQVAGDLTRR

SEQ ID NO: 12848 - protein, 81 aa, Sus scrofa
VSVTFDDVAVTFTQEEWGQLDPAQRTLYQEVMLENRGLLVSLGEQGKPTTTKPTTCERALSGGASFQEHLAQGASEDSRLG

SEQ ID NO: 12849 - protein, 81 aa, Neophocaena asiaeorientalis
DSVTCEDVAVNFTLEEWALLNPTQKKLYRDVMQETFRNLASVGTKWDDDDIEEQYKNQGGKPRNHTVVRFSEHKDHNPCGG

SEQ ID NO: 12850 - protein, 81 aa, Neophocaena asiaeorientalis
AHGSVTFRDVAIDFSQEEWEFLDSAQRDLYRDVMWENYSNFISLAGPSISKPDVITLLDEGKEPWMVVREGTRRHHPDLES

SEQ ID NO: 12851 - protein, 81 aa, Bos mutus
VTFKDVTVEFTREEWKLLDTAQRTLYREVMQENYSHLISVGYCANRPNAIFKLKQGKEPWILEVQFPRQNNPELIQNTPNF

SEQ ID NO: 12852 - protein, 81 aa, Nomascus leucogenys
QGTVTFEDVAVHFSWEEWGLLDEAQRCLYRDVMLENLALLTSLDVHHQKQHLGEKHFRSNVGRALFVKTCTFHVSEEPSTC

SEQ ID NO: 12853 - protein, 81 aa, Nomascus leucogenys
KSQESLTLEDVAVEFTWEEWQLLGPAQKDLYRDVMLENYSNLVSVGYQASKPDALFKLEQGEPWTVENDSHICPEIKKVDN

SEQ ID NO: 12854 - protein, 81 aa, Nomascus leucogenys
MLENYNSIVSLGLPVPQPDVIFQWKRGDKPWMVDLHGSEEREWPESVPLDWETKPEIHDASDEKSEGSLRECLGRQSPLCP

SEQ ID NO: 12855 - protein, 81 aa, Canis lupus
MNRSQEEWYLLDPAQKILYRDVILENYSHFVSVGYCITKPEVVFKIEQGEEPWILEAGFPSHCHQEDWKVADLIESSQNNE

SEQ ID NO: 12856 - protein, 81 aa, Suricata suricatta
ITGLLTFRDVAIEFSQEEWGCLSHSQRELYRDVMLENYGHLLFLDLVVLKPDLVTFLERKRELWDVKRKETVASYPGSTNL

SEQ ID NO: 12857 - protein, 81 aa, Suricata suricatta
GYLSHSQWELYRDVMLENYRHLLFLGLIVSKPDLVIFLEKKWVLWDVKRKETVMTAGGGGGGVSVDPYKPSAVENGPLVMD

SEQ ID NO: 12858 - protein, 81 aa, Chrysochloris asiatica
FQGSLSFEDVAVGFTWEEWQFLDPSQKDLYKDVMLENYNHLVSVGYPATKPDSIFRLEQGETPWIVEGAIHTRTSAGEDAE

SEQ ID NO: 12859 - protein, 81 aa, Chrysochloris asiatica
CRESVTFRDVAVLFSQEEWLYLDLAQRTLYRNVMLENYRNLVSLGIPFSKPKVISQLQQGEDPWMMEKGTPPGTCQGVKME

SEQ ID NO: 12860 - protein, 81 aa, Chrysochloris asiatica
LSPPRPRLRMFLGPLKTQWDLLDPAQRKLYRDVMVETLRNLASVGAIKKSRDWKDHLDNQERHLRIHMRTHSGERPYECKE

SEQ ID NO: 12861 - protein, 81 aa, Chlorocebus sabaeus
AQVSVTFEDVAVTFTQEEWGQLDAAQRTLYQEVMLETYGLLMSLGCPLFEPELIYQLDCREELWIVKKDLSWPVLPGDNTK

SEQ ID NO: 12862 - protein, 81 aa, Chlorocebus sabaeus
LQGLVSFKDVAVDFTQEEWQQLDPAQRTLYRDVMLENYSHLVSMGYPVSKPDVISKLEQGEEPWIIKRDISNWIYPDEYQA

SEQ ID NO: 12863 - protein, 81 aa, Chrysochloris asiatica
MLENYSHLVSLGYQVTKPDALSRLDSGDWPWISQQFASSQICISSIIHTGVKPHRCHLCGEAFSRQFKLAQHLRRIHRGEK

SEQ ID NO: 12864 - protein, 81 aa, Suricata suricatta
CQESVTFEDVAVIFTEEEWTHLVPIQRDLYKEVMLENYKSIVSLGLPVPRPDVIFQLKRGDEPWIVDLHGSEESDCPETIS

SEQ ID NO: 12865 - protein, 81 aa, Chrysochloris asiatica
MLENYRDFVSLGLLVPNPDVIFQLERGEEPWMLDFQEAEEKEGPEGLNARPNGQDSTQRQKVSKNAKPQNTLMGNIRKNGL

SEQ ID NO: 12866 - protein, 81 aa, Suricata suricatta
LVTFRDVVISFSQEEWECLDSAQRNLYWDVMMENYSNLVSLDLESKYDTKCLFNGKDIIDSPQCKEIESKFVGLENSTFRN

SEQ ID NO: 12867 - protein, 81 aa, Suricata suricatta
LQGQLTFQDVAVEFSQEEWGRLNHRQRELYADVILETYGHLLFLGLLVSKPDLVIFLEHEKEMRGVKRQETVASHPAISSP

SEQ ID NO: 12868 - protein, 81 aa, Chlorocebus sabaeus
FQEPVTFEDVAVYFTQNEWASLHPTQRALYREVMLENYANVTSLLAFPFPKPALISHLERGEAPWGPDPWDTEIPRGISQG

SEQ ID NO: 12869 - protein, 81 aa, Mandrillus leucophaeus
QGLLTFRDVAIEFSQEEWKCLDPAQRTLYRAVMLENYRNLVSLAISSKCMMKEFSSTVQGNREVLHTGTLQRHESHHIGDF

SEQ ID NO: 12870 - protein, 81 aa, Mandrillus leucophaeus
LAHLMMFRDVAVDFCQEEWECLDLEQRDLYRDVMLENYSNLVSLGLCIYQPEVFSLLEKGKEPWKILRDETRGPCPDMQSR

SEQ ID NO: 12871 - protein, 81 aa, Mandrillus leucophaeus
DSISLEDVAVNFTLEEWALLDPGQRNIYRDVMRATFKNLACIGEKWKDQDVEDDPKNQGRKPSSPTVETLCENKEDRPCGK

SEQ ID NO: 12872 - protein, 81 aa, Mandrillus leucophaeus
FQEAVTFKDVAVAFTEEELGLLDSAQRKLYRDVMLENFRNLVSVGHQSFKPDMISQLEREEKLWMKEFQTQRGKHSGFLCF

SEQ ID NO: 12873 - protein, 81 aa, Mandrillus leucophaeus
GTVAFEDVAVNFSQEEWSLLSEVQRCLYHDVMLENWVLISSLGYWCGSEDEEAPFKRNILQLADHQGTHHKQKLHRCEAWG

SEQ ID NO: 12874 - protein, 81 aa, Sus scrofa
YQEFVTFEDVAVHLTREEWGCLDPVQRDLYREVMLENYGNLVSLGFPLAKPDGISQLEQDLQVFDLETEHRDVLRDDCSDG

SEQ ID NO: 12875 - protein, 81 aa, Sus scrofa
KEAVTFKDVAVVFTEEELGLLDLTQRKLYQEVMLENFRNLVSVGGKIQHETETVPEAGPHEDLSCWQIWQHIARDLTRCQD

SEQ ID NO: 12876 - protein, 81 aa, Sus scrofa
VAFEDVAVNFTPEEWALLGPSQKKLYRDVMRETLRNLASVGKKWEDHNTEDQYKVQGRNLRSQTLESLCKSEEGSQCGEDF

SEQ ID NO: 12877 - protein, 81 aa, Bos mutus
GWVPALFDEVAIYFSDEEWEVLTEQQKALYREVMRMNYETVLSLEFPFPKPDMITRLEREEESQNSDEWQLQGGTFAEKEE

SEQ ID NO: 12878 - protein, 81 aa, Neophocaena asiaeorientalis
YQELVTFRDVAVDFSQEEWDCLNSSQRHLYSNVMLENYRILVSLGLCFSKPSVILLLEQGKEPWMVKRELTKDLCSDWESL

SEQ ID NO: 12879 - protein, 81 aa, Neophocaena asiaeorientalis
KSKSKAPVTFGDLAIYFSQEEWEWLSPIQKDLYEDVMLENYQNLVSLGLSFRRPNVITLLEKGKAPWMVEPVKRRRGLGPL

SEQ ID NO: 12880 - protein, 81 aa, Neophocaena asiaeorientalis
PALGSVTFEDVAVYFSQEEWKLLDEAQRFLYHDVMLETFALAASLGLSSSRYHVVQLELRGEPWVHDRVDMTPDRARGAQI

SEQ ID NO: 12881 - protein, 81 aa, Neophocaena asiaeorientalis
QGHVIFEDVAVSFSQEEWGLLNDAQRLLYCDVMLENLSLIASLGCWHGVEAEEAVSEQCVSVEQVTEDRNPKLEPSILKPL

SEQ ID NO: 12882 - protein, 81 aa, Bos mutus
ESVTFEDVAVDFTQEEWSLLDKSQKNLFRNVMLETVSHLVSVGNQISKSEVISQLEQGKELWTAAAGGLQGQSPGERQGPG

SEQ ID NO: 12883 - protein, 81 aa, Nomascus leucogenys
AQESLTLEDVAVDFTWEEWQFLSPAQKDLYRDVMLENYSNLVAVGYQARKPDALSKLERGEEPCTTEDEIYARICSGGQPQ

SEQ ID NO: 12884 - protein, 81 aa, Nomascus leucogenys
FQGSVSFKDVTVGFTQEEWQHLDPSQRALYRDVMLENYSNLVSVGYCVHKPEVIFRLEQGEEPWRLEEEFPSQSFPEVWTA

SEQ ID NO: 12885 - protein, 81 aa, Nomascus leucogenys
TQGHLTFRDVAIEFSQEEWKCLDPVQKALYRDVMLENYRNLVSLGICLPDLSVISMMKQRTEPWTVENEMKVAKNPDRWEG

SEQ ID NO: 12886 - protein, 81 aa, Nomascus leucogenys
RVQSCVTFEDVFVYFSREEWELLEEAQRFLYRDVMLENFALVATLAFIFPVPCSCAVGGGRPWVPDRADITAATVKETYRG

SEQ ID NO: 12887 - protein, 81 aa, Nomascus leucogenys
QQGYVTFEDVAVYFSQEEWRLLDEAQKLLYRNVMLENFSLLASLGLASSKTHEITQLESWEEPFMPAWEAVTSATPRGCWH

SEQ ID NO: 12888 - protein, 81 aa, Nomascus leucogenys
MRNMIPDNENPPQQGEADQNDSVAFEDVAVNFTPEEWALLDPSEKNLYREVMQETLRNLASIEVLWKRDSLKMKVISMEKF

SEQ ID NO: 12889 - protein, 81 aa, Nomascus leucogenys
DSISLEDVAVNFTLEEWALLDPGQRNIYRDVMRATFKNLACIGEKWKDQDIEDDYKNQGRNLRSPMVEALCENKEDRPCGK

SEQ ID NO: 12890 - protein, 81 aa, Nomascus leucogenys
EPGAVNFADVAVYFCREEWGCLRPAQRALYRDVMRDTYGHLSALGIGGHKPALISWVEEEAELWGPAAQDPEMAKCQTETD

SEQ ID NO: 12891 - protein, 81 aa, Nomascus leucogenys
SQTLVTFKDVFVDFTREEWKLLDTAQQIVYRNVMLENYKNLVSLGYQLTKPDVILRLEKGEEPWLMERGIHQETHPDSETA

SEQ ID NO: 12892 - protein, 81 aa, Nomascus leucogenys
YQIPVSFKDVVVGFTQEEWHQLSPAQRALYRDVMLETYSNLVSVGYEGTKPDVILRLEQEEAPWIGEAACLGCHCWGISKL

SEQ ID NO: 12893 - protein, 81 aa, Canis lupus
GLVTFRDVAIDFSQEEWECLDPAQRDLYVDVMLENYSNLVSLDLESTYETKNTNSEKDIFEINFSQWEVKERSKTLGLEAS

SEQ ID NO: 12894 - protein, 81 aa, Canis lupus
AQGLVTFRDVAIEFSQEEWKCLEPAQRDLYKDVTLENFSNLVSLGLSISKPDVISLLEQGREPWMITNDMTGLWCPELESR

SEQ ID NO: 12895 - protein, 81 aa, Canis lupus
SQGLVTFRDVALDFSQEEWEWLDPSQKDLYRDVMLENYRNLVWLGLSISKPNMISLLEQGKEPWMVEKEMSDDWESWYEIK

SEQ ID NO: 12896 - protein, 81 aa, Muntiacus muntjak
ALERLTSEDVAIEFTQEEWEFLDPAQRALYRDVMLETYRNLLSVDPMEAAAAENMCDFECQGRDDKRNYKGTPVSLDGNVP

SEQ ID NO: 12897 - protein, 81 aa, Muntiacus muntjak
TTVELKLPDLPANEKVSVSFEDVTVDFSREEWQHLDSAQRRLYQDVMLEIYSHLLSLGKPSQNVNLRGTLWVKCCPFKKTC

SEQ ID NO: 12898 - protein, 81 aa, Canis lupus
QLTFKDVAIKFSEEEWECLDSAQRALYRDVMLENYRNLVSLDSSASFMIKELLPKKEINNRKLCQPVVLGRQESHDLEDFD

SEQ ID NO: 12899 - protein, 81 aa, Chrysochloris asiatica
FQKLVTFEDVAVYFTQAEWDGLSPTQRVLYRDVMLENYGHVASLGFPLLKPAVISQLEGGGDLWGPPPVPTGMEIGPQGLW

SEQ ID NO: 12900 - protein, 81 aa, Chlorocebus sabaeus
EEGYVTFEDVAVYFSQEEWRLLDEAQRLLCHNVMLENFSLLSSLGLASSKTHDITQLESWKEPFMPASEVVTSAILRDCWH

SEQ ID NO: 12901 - protein, 81 aa, Suricata suricatta
AQGLVTFRDVAIEFSQEEWKCLEPAQRSLYRDVTLENFSNLVSLGLSISKPDVISLLEQGREPWMIANDMTGPWCPELESR

SEQ ID NO: 12902 - protein, 81 aa, Chlorocebus sabaeus
FQLPLTFEDVAIYFSEQEWQDLEAWQKELYKHVMRSNYETLISLDDGLPKPELISWIEHEGEPFRNWRESQKSGNIICSSG

SEQ ID NO: 12903 - protein, 81 aa, Chlorocebus sabaeus
MLYFGDSEAKQLAQVLLLFPLTGYDITKPNVIIKLEQGEEPWIMEGEFPCQHSPEVWKFDDLIERIQENEDKHSRQAACIN

SEQ ID NO: 12904 - protein, 81 aa, Suricata suricatta
LQGLLTFRDVAIEFSQEEWGCLNHSHQRELYRDVMLENYGHLLFLGLVLKPDLVFLLERKQEHLGTPFPENDYECIKNGEF

SEQ ID NO: 12905 - protein, 81 aa, Chrysochloris asiatica
LQGLVLFKDVTVDFSRDEWQQLDLAQKSLARDVMLENYFSLVSVGYHISKPQVIFNFEQGEEPYLLDDCEIWYQSCLVGDI

SEQ ID NO: 12906 - protein, 81 aa, Chrysochloris asiatica
ILEPVTFEDVTVVFTEAEWKRLSSEQKSLYREVMLEIYRNLFSLAESKPEIYPSSSCLLAFPCQQFLSQHMLQIFPGFCAD

SEQ ID NO: 12907 - protein, 81 aa, Suricata suricatta
SQDLVTFKDVAIDFSQEEWEWLNSAQRNLYKNMMLENYQNLVSLGLCLPKPYVIASLEQGRAPWEMKNEMTGSPELILEKN

SEQ ID NO: 12908 - protein, 81 aa, Chrysochloris asiatica
TLGLLTFRDVAVEFSQEEWDCLDPAQRALYWDVMLENYGNLVSLGIPPSGTNIVSILKKETEFWAVEKTTELAEHPELLEQ

SEQ ID NO: 12909 - protein, 81 aa, Mandrillus leucophaeus
NKGPVTLKDVIVEFTKEEWKLLTPAQRSLYKDVMLENYSHLVSVGYHVNKPNAVFKLKQGREPWILEVEYPHRGFPEDLWS

SEQ ID NO: 12910 - protein, 81 aa, Mandrillus leucophaeus
TFKEGLTFKDVAVVFTEEELGLLDPVQRNLYRDVMLENFRNLLSVGHHPFKHDVFPLEKEKKLGMMKTATQRKGKSADKIQ

SEQ ID NO: 12911 - protein, 81 aa, Sus scrofa
PQGSVSFKDVTVDFTQEEWQQLDPAQKALYRDVMLENYCHLISVGFHMTKPDMIRKLEQGKELWTTEKIFPSQSYPEEDGT

SEQ ID NO: 12912 - protein, 81 aa, Mandrillus leucophaeus
VAFEDVAVNFTHEEWALLGPSQKNLYRDVMRETIRNLNCVGMDDIINVLFVFYRCDVVERFGKSKDGSQCEETLSQIRNST

SEQ ID NO: 12913 - protein, 81 aa, Mandrillus leucophaeus
EMGPLTFRDVAIEFSLEEWQCLDTAQQDLYRKVMLENYRNLVLAGIDVSKPNLITCLEQGKDPWNMKRHSMVVKPPVETRF

SEQ ID NO: 12914 - protein, 81 aa, Sus scrofa
QEGVNFRIVTVDFTQEEEGTLNTAQRALDRDVILEDHRDIVSWESVTALGKRESTSKQSIVDDEPSRRVKIERLTRDSSWL

SEQ ID NO: 12915 - protein, 81 aa, Sus scrofa
FRGPVTFKDITVEFTQEEWQLLDNAQRTLYREVMQENYHHLISVGYCVNKPNAVFKLKQGKEPWILEVEFPRRNNPEDLWN

SEQ ID NO: 12916 - protein, 81 aa, Mandrillus leucophaeus
SQESVTFQDVAVDFTEKEWPLLDSSQRKLYKDVMLENYSNLTSLGYQVGKPSLISHLEQEEEPRTEERGTHQGACAGERER

SEQ ID NO: 12917 - protein, 81 aa, Mandrillus leucophaeus
EMGLLTFRDVAIEFSLGEWQCLDRAQQNLYRDVMLENYKNLVSLGIAVSKSDLITHLEQNKEPRNIKKNEMLAKHPVMCSH

SEQ ID NO: 12918 - protein, 81 aa, Sus scrofa
KSWGPLSFMDVFVDFTWEEWQLLDPAQKHLYRSVMLENYSNLVSLGYQHTKPRIIFQLEQEEPRLMQIPSQGHPDKVWEID

SEQ ID NO: 12919 - protein, 81 aa, Mandrillus leucophaeus
QEPLSFKDVAVVFTEEELGLLDSTQRQLYRDVMLENFRNLLSVGERNPPGDKNGRDMEYIQDEELRLFSHEELSSCKIWEE

SEQ ID NO: 12920 - protein, 81 aa, Sus scrofa
VTFRDVAVFFSQDEWLCLDSAQRTLYREVMLENYSTLFSLGWESLFETTVSEEENKEVMNKLIGDGPFDFKLGKIYINEDK

SEQ ID NO: 12921 - protein, 81 aa, Bos mutus
QDPVTFEEVSVDFSQEEWAQLAPAQKILYQDVMLENYRNLTSVGYHLRRPRLLTQEELRTRKRRLLQDTCAEGNDNPLQYS

SEQ ID NO: 12922 - protein, 81 aa, Neophocaena asiaeorientalis
APLPLTFEDVAVYFSEQEWRDLEPWQKELYKQVMRTNYEILVSLGDGLPKPELISWLEQGRELFRIWGESQKSGNIICTSA

SEQ ID NO: 12923 - protein, 81 aa, Nomascus leucogenys
SQESVTFQDIAVDFTEKEWPLLDSSQRKLYKDVMLENYSNLTSLGYQVGKPSLISHLEQEEEPRTEERGAHQGACADWETP

SEQ ID NO: 12924 - protein, 81 aa, Nomascus leucogenys
VMFRDVAIDFSQEEWECLDSAQRDLYRDVMLENYSNLVSLDLPSRCASKDLSPEKNTYETQLSQWEMSDRLENCDLEESNS

SEQ ID NO: 12925 - protein, 81 aa, Nomascus leucogenys
VKESVTFKDVAIDFTLEEWRLMDPTQRNLHKDVMLENYRNLVSLGLAVSKPDMISHLENGKGPWVTVREISRIPCPDMEPK

SEQ ID NO: 12926 - protein, 81 aa, Nomascus leucogenys
VTFEDVTIIFTWEEWKFLDSSQKSLYREVMWENYTNVMLVENWNESYKSQEEKFRYLEYENFSCWQGWWNAGTQMYENQNY

SEQ ID NO: 12927 - protein, 81 aa, Nomascus leucogenys
MKPAQRNLYRDVMLENYSNLVTVGCQVTKPDVIFKLEQEEEPWVMEEEMFGRHCPGFFFVLQCENTSYFLSCYFADWELGR

SEQ ID NO: 12928 - protein, 81 aa, Bos indicus
MAGQDLAVRFSEDEWRLLGEGQRALYLDVMRENYDTLASLGTAEPLPLSAFLSPSEPGGAVGARSRAGDRQEPPQGGGPLG

SEQ ID NO: 12929 - protein, 81 aa, Bos indicus
WSQMPVTFEDMALYLSREEWGRLDHTQQSFYREVLQKRSGLSLAGFPFSRPFWASQVQGKGEAPGSSRQLGHEEEEKRGVV

SEQ ID NO: 12930 - protein, 81 aa, Bos indicus
MLENYRNLVSVEHQLSKPDVVSQLEEEEELWSVERGIPQDTFSECPEAQLEPQLDPFPAGNPLMNIEVVEVLTLNQEVAVP

SEQ ID NO: 12931 - protein, 81 aa, Canis lupus
PWLPLTFEDVAIYFSEHEWPNLEAWQKELYKHVMRTNYEILVSLDGRLPKPELISWIEQGREFFKNWGESQKSGNIICPSA

SEQ ID NO: 12932 - protein, 81 aa, Canis lupus
SKVPVTFGDLAIYFSQEEWEWLSPIQKDLYEDVMLENYQNLVSLGLSFRRPNVITLLEKGKAPWVVEPVRKRRGLDSGFKC

SEQ ID NO: 12933 - protein, 81 aa, Canis lupus
GQGSVTFRDVTVEFTRDEWLQLTGTQRTLYRDVMLENYSHLLSVGCHLTKPEVIFRLEQGEDLWPSEGEFPDQGDQDRSEE

SEQ ID NO: 12934 - protein, 81 aa, Canis lupus
SQGSLSFGDVTVDFSQEEWQHLDPDQRTLYRDVMLENYHNFVSVGYLIKKPAVIFKLEEGKEPWIVEEELLYQNYQAQGKQ

SEQ ID NO: 12935 - protein, 81 aa, Canis lupus
SQGLVTFEDVAVYFSLEEWERLDTDQRDLYKDVMQENYGILVSLGYPIPKPDLIFRLEQGEEPWVPDSPRPEEGDIVTGVY

SEQ ID NO: 12936 - protein, 81 aa, Canis lupus
EEWALLNPSQKKLYRDVMQETFRNLCESIGNIHIFRKMPLITCFSFLRQACSKCGESFSQNPNHKQIKKTPTGIKLRKCSF

SEQ ID NO: 12937 - protein, 81 aa, Muntiacus muntjak
CEGLVSFEDVTMDFSREEWQQLDPSQRHLYQDVMLEIYSHFFSVGYHIPNPEIIFRIEEGKEPWVRETELPCQRYHEGEFG

SEQ ID NO: 12938 - protein, 81 aa, Canis lupus
EPVTFADVAVLFTPEEWMFLDSAQRNLYRDVMLENYRNLASVGKARLVTSSAHSCSTYRFPECAEPPLQPQDSISNQDIFA

SEQ ID NO: 12939 - protein, 81 aa, Muntiacus muntjak
APVTFDDITVYLLQEEWVLLSQQQKNICGSDKMVAPLGPSIASPELFYKLEQGPEPWLASVQGQRSHLSPNPGKNKMGFME

SEQ ID NO: 12940 - protein, 81 aa, Muntiacus muntjak
HLTFKDVAVEFSQEEWECLDPAQRALYRDVMLETYRNLLSVAVSHIHVIKKLKPKANSDTGVFQRVMLGRYESHEIRDFYF

SEQ ID NO: 12941 - protein, 81 aa, Mandrillus leucophaeus
MGPLTFRDVAIEFSLKEWQCLDTAQRNLYRNVMLENYRNLVFLVMCSHFAQDLWPEQNIKDSFQKATLKRYGTCRHENLPL

SEQ ID NO: 12942 - protein, 81 aa, Mandrillus leucophaeus
LQEPVTFRDVAVDFTQEEWGQLDPTQRILYRDVMLETFGHLLSIGPELPKPEVISQLEQGTELWVAERGTIQGCHPGWEPP

SEQ ID NO: 12943 - protein, 81 aa, Mandrillus leucophaeus
IQGQVNFEDVFVYFSQEEWVLLDEAQRLLYRDVMLENFALMASLGHTSFMSHIVASLVMGSEPWVPDWVDMTLPVATETLG

SEQ ID NO: 12944 - protein, 81 aa, Mandrillus leucophaeus
SKAPITFGDLAIYFSQEEWEWLSPIQKDLYEDVMLENYRNLVSLGLSFRRPNVITLLEKGKAPWMIEPVRRRRAPDSGSKC

SEQ ID NO: 12945 - protein, 81 aa, Mandrillus leucophaeus
PDLVMFRDVAVDFSQEEWECLNSYQRNLYRDVILENYSNLVSLGKHSISVSNNLVIHRTEFLDLESRYDTKKLFQEKDIYE

SEQ ID NO: 12946 - protein, 81 aa, Mandrillus leucophaeus
WSQNSVTFQEVAVDFSQEEWALLDPAQKNLYKDVMLENFRNLASVGYQLCGHSLISKVDQEELKTDERGILQGDCADWETR

SEQ ID NO: 12947 - protein, 81 aa, Mandrillus leucophaeus
YLGPVTFEDVAVLFTEAEWKRLNLEQRNLFKEVMLENLRNLVSLESKPEVHTCPSCPLAFGSQQFLSQDELHNHPIPGFHA

SEQ ID NO: 12948 - protein, 81 aa, Sus scrofa
PEDTVTFEDVAVVFTDEEWRHLIPIQRDLYKEVMLENYKSIVSLGLPVPGPDVIFQLKRGDEPWIEELHGSEGKECAENVY

SEQ ID NO: 12949 - protein, 81 aa, Sus scrofa
FHPVAFEDVAVNFTQEEWECLDAGQRVLYQEVMSETFRNLMSVGKKLGFLHKHPVPGLQDLWFPWAGRSVQLTSLFLDSVP

SEQ ID NO: 12950 - protein, 81 aa, Sus scrofa
FSHIQGAAWSEASLYSHSFCTLPRPAENDHIPGYCVPEPEVILKLEQGEEPWVLEEEFSSQSYPELINSSRTYSRKVFNKG

SEQ ID NO: 12951 - protein, 81 aa, Sus scrofa
GPESVTFKDVAVDFTQEEWGQLDSPQRALYRDVMLENYQNLLSLGPPVCKPDVISHLERGEEPWQVPRDVPAGARSGEQDT

SEQ ID NO: 12952 - protein, 81 aa, Sus scrofa
WFQDLKFKDVAIYFSQKEWECLHFAQKDLYREVMFENYNNLIALAGFSNSKPDVISLLEQGKEPWLVRSKEIKNGVQPPGS

SEQ ID NO: 12953 - protein, 81 aa, Sus scrofa
SQDSVTFEEVTVDFSQEEWALLDPAQKILYRDVMLENFRNLASLGYQLCKHSLITEMEQEEQKPEGRGILQGAGTDWETQL

SEQ ID NO: 12954 - protein, 81 aa, Neophocaena asiaeorientalis
SQELLTFKDISVDLTQEEWGQLAPAHRNLYREVMLENYGNLVSVGYQLSKPGVISQLEKGEEPWLMEREISGGPSPDLEDE

SEQ ID NO: 12955 - protein, 81 aa, Neophocaena asiaeorientalis
FQDLVMFRDVTVDFSQEEWECLNSNQRNLYRDVILENYSNLVSLGGCSVSKPDVITLLEQGKEPWMVVRDEKRRRSLDLES

SEQ ID NO: 12956 - protein, 81 aa, Bos mutus
SVTFEDVAVYFSWNEWCLLDEVQIRLYLDVMLENFALVCMLGSCHGVQHAETCSEQNVFAEGASQISTLRAELSPENTQPC

SEQ ID NO: 12957 - protein, 81 aa, Neophocaena asiaeorientalis
KSPGSISFEDVTVNFTQEEWGQLDPDQRTLCRDVTLENYRILISLGHCITKPEEIFKLEQEAPWILEEEFASHCYPDELKV

SEQ ID NO: 12958 - protein, 81 aa, Neophocaena asiaeorientalis
SEELVTFKDVAVDFTQEEWGQLDSPQRALYRDVMLENYQNLLALGPPVCKPDVISHLERGEEPWWAPRAVPGGAGPEPEWE

SEQ ID NO: 12959 - protein, 81 aa, Neophocaena asiaeorientalis
KDQGLLTLEDVAVDFTWEEWQLLAPAQKDLYRDVMLENYSNLLSVGYQASKPDALSRLKRGEPWPVEDEIHSQICPEMRKD

SEQ ID NO: 12960 - protein, 81 aa, Bos mutus
QGPLMFQDVAIDFTQEEWECLDLSQRELYRDVMLQKYGNLASLGLVSKLDLVTFLEQLEDPRNIRRMGTTAIYPGNMENLK

SEQ ID NO: 12961 - protein, 81 aa, Neophocaena asiaeorientalis
MLENYRNLVALGHQLYKPEVITQLEREEQWMMERDCPPDSHPDGENSPEIKKSNQNISDENKTCDMLMERLTGDSFWYSIL

SEQ ID NO: 12962 - protein, 81 aa, Nomascus leucogenys
IQGQVNFEDVFVYFSQEEWVLLDEAQRLLYRDVMLENFALMASLGHASFMSHIVASLVMGSEPWVPDWVDMTLAVATETPG

SEQ ID NO: 12963 - protein, 81 aa, Nomascus leucogenys
AHALVTFRDVAIDFSQKEWECLDTTQRKLYRDVMLENYNNLVSLGYSGSKPDVITLLEQGKEPCMAARDVTGRQYPGLLSR

SEQ ID NO: 12964 - protein, 81 aa, Nomascus leucogenys
GWLTNYSQDSVTFEDVAVDFTQEEWTLLDQTQRNLYRDVMLENYKNLVAVDWESRINTKWSAPQENFLQGKTSSVVEMNSE

SEQ ID NO: 12965 - protein, 81 aa, Nomascus leucogenys
QSLLTFRDVAIEFSQEEWKCLDPAQRTLYRDVMLENYRNLVSLGISSKCTLKEFSSTAQGNREVIHTGTLERHESHHIGDF

SEQ ID NO: 12966 - protein, 81 aa, Nomascus leucogenys
LLTFRDIAIEFSLVEWQYLDHAQQNLYRDVMLENYRNLVSLVTRSYFTQDLHPEQGIKDSLQKVTPRTYGKCGHENLQFKK

SEQ ID NO: 12967 - protein, 81 aa, Nomascus leucogenys
EMELLTFRDVAIEFSLEEWQHLDVAQQNLYRNVMLENYRNLAFLGIAVSKPDLITCLEQGKKPWNMKRHEMVDEPPGICPH

SEQ ID NO: 12968 - protein, 81 aa, Nomascus leucogenys
CEASVSFEDVTVDFSREEWQHLDPAQRRLYWDVTLENYSHLLSVGYQVPKSEATFKLEQGEGPWTLEGEAPHQSCSGGAIG

SEQ ID NO: 12969 - protein, 81 aa, Nomascus leucogenys
PQGLLTFRDVAIEFSQEEWKCLDPAQRTLYRDVMLENYRNLVSLDISSKCMMNMFSSTGQGNTEVIHTGTLQRHASHHTGD

SEQ ID NO: 12970 - protein, 81 aa, Nomascus leucogenys
VQEPVTFKDVAVDFTQEEWGQLDLVQRTLYRDVMLETYGHLLSVGNQIAKPEVISLLEQGEEPWSVEQACPQRTGPEWVRN

SEQ ID NO: 12971 - protein, 81 aa, Nomascus leucogenys
YQDSVTFDDVAVDFTPEEWALLDTTEKYLYRDVMLENYMNLASVEWEIQPRTKWSSLQQGFLKNQIFSGIQMTRGYNGWKL

SEQ ID NO: 12972 - protein, 81 aa, Bos indicus
HSEERLTFQDVAIDFTQEEWECLDLGQRKLYRDVMLENYRNLASLGLVSKVDLVTFLELLKDPRNIRRMKTTAIYPAVSPQ

SEQ ID NO: 12973 - protein, 81 aa, Bos indicus
MLENYKSIVSLAGLPVPGPDVIFQLKRGDEPWLVEFHGFEGKEGAENVSLDWETKPEIQGASEEEKSEGSLKENLGRKGPP

SEQ ID NO: 12974 - protein, 81 aa, Bos indicus
DEALMAFRDVAVAFTQKEWKLLSPAQRTLYRDVMLENYSHMVSLGIAFPKPKLIIQLEQGDEPWREESECLLDLCAEGRKE

SEQ ID NO: 12975 - protein, 81 aa, Bos indicus
MAALDLCALPQEEWGLLGPAQKGLYREVMLETYRNLVSLGAGLAGPKPEVIAQLEQGDELWVLDMHGAEQPSVDGSAHGTR

SEQ ID NO: 12976 - protein, 81 aa, Bos indicus
MVENFRNLVSVGHVPFKADMVSQLETEEKLWTMERETQRNGHSSEIHSAVTSGSKIPNEMETLGKVMFKYLSCEELSCWQI

SEQ ID NO: 12977 - protein, 81 aa, Canis lupus
PQKSVTFEDVAVYFTQTEWDGLSPAQRALYRDVMLENYGNVASLGFSLLKPAVISQLEGAGELEGPSPLAAGTEIGPQGLW

SEQ ID NO: 12978 - protein, 81 aa, Muntiacus muntjak
QNGSVSFEDVAVGFSQEEWQLLGPSQKALCWDVMLENYCNLVSVGYQAPKPDSLFRLEQGRPPWKVKGAALSPTCAEEMWE

SEQ ID NO: 12979 - protein, 81 aa, Canis lupus
AQVSVTFDDVAVIFTQEEWGQLDPAQRTLYQEVMLENCGLLVSLGCPVPRPELLYQLKHGQELWMVKKDLCQSTYPGDKGK

SEQ ID NO: 12980 - protein, 81 aa, Muntiacus muntjak
MGRLMFRDVAIDFTQEEWECLDLGQRELYKDVMLENYGNLASLGLVSKLDLIASLEQLNNPRNIRRLETTAIYPGSLLLAC

SEQ ID NO: 12981 - protein, 81 aa, Canis lupus
PKGLLTFRDVAIEFSQEEWGCLNHTQRELYRDVMLENYGNLLFLGLIVSKPDLVSFLEQKKEPWSVKRKKRVTIHPAQRFG

SEQ ID NO: 12982 - protein, 81 aa, Canis lupus
QGTMPFGTMTAALTHHGWRPLIPAPRGTPRFKEGIPENVRNLVLLGLPVSQPGMNSQSEQREEGPWMLEGGGLRSTCPDWK

SEQ ID NO: 12983 - protein, 81 aa, Muntiacus muntjak
ISFEDVAVNFTLEEWQLLNPTQKTLYRDVMLENYSNLVLLGYQVIKPEVIFKLEQEKPWLLDEEILSQNFSEKVWLDNDLK

SEQ ID NO: 12984 - protein, 81 aa, Muntiacus muntjak
RTGPLTFGDVAVEFSGEEWAWLDSAQRSLHRSVMLENYRNLASLGLCMSKPEMISSLEQSKEPWAVKAKSTRGRCPDLNLC

SEQ ID NO: 12985 - protein, 81 aa, Muntiacus muntjak
MGRLTFRDVAIDFTQEEWECLDLGQRELYTDVMLENYGNLASLGLVSKLELVAFLEQMKDPTNIRRMETTAIYPEMYHLTH

SEQ ID NO: 12986 - protein, 81 aa, Sus scrofa
HVTFEDVAVSFSQEEWGLLSEAQRLLYCDVMLENLSLVASLDCWHGGEAEEAIPEQCVSIEQVAQARNPKLDPSFLKTLTS

SEQ ID NO: 12987 - protein, 81 aa, Mandrillus leucophaeus
FQEPVTFEDVAVYFTQNEWASLHPMQRALYREVMLENYANVTSLSAFPFSKPDLIFQLEQGEAAWGPDPWTLAGGEALRGM

SEQ ID NO: 12988 - protein, 81 aa, Mandrillus leucophaeus
ARGCVVFEDVFVYFSREEWELLDDAQRLLYHDVMLENFALLASLGIAFSRSCAVIKLEQAEEPWVYDQVDMTSATEREAQS

SEQ ID NO: 12989 - protein, 81 aa, Sus scrofa
WECLDLGQRHLYRDVMLEICRHLVSLGEDPFLPEFLFSHWVWDPAFAECLLPFSCPYNRFSDPTILGVTESWWVQVERLHN

SEQ ID NO: 12990 - protein, 81 aa, Sus scrofa
MLENHSSVAGLAGFLVFKPELISRLEQGQEPWVLDLQGTEGREAPRPSRTDSMIGSNSQQACEDVDILKPDSRVTMVKLLP

SEQ ID NO: 12991 - protein, 81 aa, Sus scrofa
KSWGPLSFMDVFVDFTWEEWQLLDPAQKHLYRSVMLENYSNLVSLGYQHTKPRIIFQLEQEEPRLMQIPSQGHPELLPCLM

SEQ ID NO: 12992 - protein, 81 aa, Sus scrofa
MLENYRSLVSLGVSASKPDVISLLEQGKEPWMMKKEGTRRACPDWEYASKNNEFSSKQVTYEESSKVVIMARSHLSYNLDC

SEQ ID NO: 12993 - protein, 81 aa, Sus scrofa
MWENYSNFISLAGPSISKPDVITLLDEGKEPWMVVREGTRRHHPDLESRYRTNTLSPEKDIYEIYSFQWEIMERIKSYSLQ

SEQ ID NO: 12994 - protein, 81 aa, Sus scrofa
TARSQASMTLKDVAMDFTPEEWGELDPAQRAVMLENYRNLASLWLPVSKPDNYSLKNGKEPSMLERKVPKSSCSDLETRPE

SEQ ID NO: 12995 - protein, 81 aa, Sus scrofa
SEDLVTFGDVAVDFSQEEWEWLSPAQRHLYRKVMLENYRSLVSLGVSASKPDVISLLEQGKEPWMMKKEGTRRACPDWEYA

SEQ ID NO: 12996 - protein, 81 aa, Bos mutus
VTFEDVAVYFSWEEWRLLAEAQRSVYLDVMLENYALIASLGCCCGTENAEAPSEQITSLGVSQARTSKAALSSQKIHPCET

SEQ ID NO: 12997 - protein, 81 aa, Neophocaena asiaeorientalis
EEGRVTFEDVAVYFSQEEWGLLDRAQRLLYRSVMLENFSLMASLGLTSSRTHEVTQLEQWGEPFVPACGVVITATPRGCWC

SEQ ID NO: 12998 - protein, 81 aa, Neophocaena asiaeorientalis
ASQGLLTFQDVVIEFSQDKWEFLDSTQWELYRDAMLENYKNLVSLGPVSKPDLVTFMEQKKGPWDVKGMETIAIHPGTGDP

SEQ ID NO: 12999 - protein, 81 aa, Bos mutus
LQESVTFRDIAVLFSRDEWLHLDAAQRTLYREVMLENYSTLVSLGIPFSMPKLICQLQQGEDPCMVEREIPQDTCLGFKIW

SEQ ID NO: 13000 - protein, 81 aa, Neophocaena asiaeorientalis
MDSVVFEDVAVNFTAEEWALLDLAQRKLYRDVMLETFRNLASVGSCSQVKTSRSSAHWDILETGLCSEEKVVRFTRNDSMS

SEQ ID NO: 13001 - protein, 81 aa, Neophocaena asiaeorientalis
LESVTFRDVTVDFTQEEWQQLEPSQKDLYRDVMLENLQNLVSLDLEMRPEMKEPDLKGEISGDKPSGAWGSAVDGARTQGD

SEQ ID NO: 13002 - protein, 81 aa, Neophocaena asiaeorientalis
VMFRDVAIDFSQEEWECLDSAQRDLYRDVMLENYSNLVSLDLPSRGANKDLTPKEDTYETELSQWEMSARLENCDLEESNS

SEQ ID NO: 13003 - protein, 81 aa, Bos mutus
QLPLTFEDVAIYFSEQEWQNLEAWQKELYKQVMRANYEILLSLDNGLPKPELISWIEQGRELFKKWGESQESRNIICSAAD

SEQ ID NO: 13004 - protein, 81 aa, Nomascus leucogenys
YSEQVSFKDVCVDFTQEEWYLLDPAQKILYRDVILENYSNLVSVGYCITKPEVIFKIEQGEEPWILEKGFPSQWHPERKWK

SEQ ID NO: 13005 - protein, 81 aa, Nomascus leucogenys
SCEPVIFEDVTLGFTPEEWGLLDLKQKSLYREVMLENYRNLVSVEHQLSKPDVVSQLEEAEDFWPVERGIPQDTIPEYPEL

SEQ ID NO: 13006 - protein, 81 aa, Nomascus leucogenys
LPREIAPVTFDDITVYLLQEEWVLLSQQQKELCGSDKPVATLGPTVANPELFCKFGRGPEPWLGSVQGQRSLLEHHPGKKQ

SEQ ID NO: 13007 - protein, 81 aa, Nomascus leucogenys
GLLTFRDVAIEFSLVEWQCLDRAQQNLYRDVMLENYRNLVSLGIAVSKPDLITRLEQNKEPQNIKRNEMLAKHPVTCSHFT

SEQ ID NO: 13008 - protein, 81 aa, Nomascus leucogenys
GALTFRDVAIEFSLEEWQCLDTEQQNLYRNVMLDNYRNLVFLGIAVSKPDLITCLEQEKEPWNVKTHDMVAEPPVICSHIA

SEQ ID NO: 13009 - protein, 81 aa, Nomascus leucogenys
GCAFVAFRDVAVDFTQEEWRLLSPAQRTLHREVMLETYNHLVSLEIPSSKPKLIAQLERGEEPWREERKCPLDLCPESKPE

SEQ ID NO: 13010 - protein, 81 aa, Nomascus leucogenys
VTFEDVAVYFSQEEWELLDAAQRHLYHTVMLENLELVTSLGNALSQHVLLCSFVGADLPNCFPNWLHHFTSLSAVYKCSSC

SEQ ID NO: 13011 - protein, 81 aa, Bos indicus
MIENYRNLACLGLVVSKPDLVTFLEQMKDVRNIRRMETIGIYPGIKTYNCGEYGKVSNESSNLIQQQRAQNSQKQYKCNKC

SEQ ID NO: 13012 - protein, 81 aa, Bos indicus
PLESVTFEDVAVDFTQEEWALLDASQRKLFRDVMLENISHLVFVGYQHCKLDVIFQLEQGEELWIEGRGFFQSHSPGRESA

SEQ ID NO: 13013 - protein, 81 aa, Bos indicus
TSEPVSFADVAVYFSPEEWGYLRPAQRALYRDVMRETYGHLGALGFRGTKPALISWVEEEAQLWGPDAGPPEMGECVTEAD

SEQ ID NO: 13014 - protein, 81 aa, Bos indicus
SQGSVSFRDVAVDFTQEEWQQLDPEEKMTYRDVMLENYSHLVSVGYDSTKPNVIIKLEQGEEPWVVDSKFLQQQHSEKVWK

SEQ ID NO: 13015 - protein, 81 aa, Bos indicus
AQELLTLEDVAVEFNWEEWQLLDSAQRDLYWDVMLENYNNLVSLGYQGTKPDMLSKLEHGREPCIIENEMRNRICPGIWKG

SEQ ID NO: 13016 - protein, 81 aa, Bos indicus
VVFEDVAIYFSQEEWGLLDEAQRLLYCQVMVQNAALLSSVGCRHATQDEEALSEQHDVAARSQVKTPKPGPCIQKPHPSKT

SEQ ID NO: 13017 - protein, 81 aa, Bos indicus
LMEAVTFGDVAVHFSREEWQCLDPGQRALYKEVMLENHSSVAGLAGFLVFKPELISRLEQGQDPWVLDLQGAEGREEARTT

SEQ ID NO: 13018 - protein, 81 aa, Bos indicus
AQELVTFEDVAVYFIRKEWKRLEPAQRDLYRDVMLENYGNVFSLDGETRTEPDSEISEDRGAHGVLLGRFQKDISQGLKFE

SEQ ID NO: 13019 - protein, 81 aa, Bos indicus
VEEDFRFKDVVIYFSAKEWECLHSAQKDLYQDVMLENYNNLISLGFANFKPDVISLLEQRKEPWMVKGKETEEWCPDSESR

SEQ ID NO: 13020 - protein, 81 aa, Bos indicus
MDFTSENWEQLGQGQGDLFWDAALDNYWNLFLLNPPGPNLTFHPDGGEKLEALVKESPESTDTGIAETSPLPQDFLEAGLF

SEQ ID NO: 13021 - protein, 81 aa, Canis lupus
PQGSVSFKDVTVDFTQEEWQQLDPAQKALYRDVMLENYCHLISVGFHMTKPDMIRKLEQGEELWTTERIFPSQSYLEEDGK

SEQ ID NO: 13022 - protein, 81 aa, Canis lupus
SQDSVTFEEVVVDFSQEEWALLDHAQKILYRDVMLENFRNLASLGYPLCKHSLITEVEQEALGPEEGGIVQSACTDWNIQL

SEQ ID NO: 13023 - protein, 81 aa, Canis lupus
TFKEAVTFKDVAVVFTEEELGLLDSAQRKLYRDVMLENFGNLVSVGHQPFKRDMIHLVREEKFWMVKLATQRKGNSGDKVQ

SEQ ID NO: 13024 - protein, 81 aa, Canis lupus
VMAHMAFRDVAVNFSQEEWMLLSPAQRSLYREVMLENYSNLVSLGIPFSKPKLITQLEQGKESWREEGKCSPALCPAEPKP

SEQ ID NO: 13025 - protein, 81 aa, Canis lupus
EDSVVFEDVAVDFTVEEWALLDSAQRKLYREVMLENLKNLASVDDETQFKASGSVSQQDVYGNKIPKEHKIAKSTRNDSWA

SEQ ID NO: 13026 - protein, 81 aa, Canis lupus
TWVPLTFSDVAIDFSQEEWECLNSDQRDLYRDVMLENYTNLVSLDIDFTTETNKLSSGKSSYEVNSYHRETMKRSKTFNLM

SEQ ID NO: 13027 - protein, 81 aa, Canis lupus
CEGSVSFEDVTMDFSREEWQQLDPAQRCLYQDVMLEIYSHLLFVGYNIPNPEIISRMEKGEEPWMREIQLPHQRHRERAFG

SEQ ID NO: 13028 - protein, 81 aa, Muntiacus muntjak
SVTFEDVVVYFSWEEWGLLDENQRCLYHDVMLENFALVTSLGCWYGMEEAVAFSVESVPVEQTSRGKTVTPDPSIEKTQPC

SEQ ID NO: 13029 - protein, 81 aa, Canis lupus
PHWLVTFRDVAIDFSQEEWECLNSTQRDLYRDVMLENYSNVISLAGCSIPKPDVFSLLEQGKDPWMVMRAMTRRRSSDLES

SEQ ID NO: 13030 - protein, 81 aa, Canis lupus
SQELLTFQDVSVDFTHEEWGQLSLAHRNLYREVMLENYGNLVSVAGYQLSKPSVISQLEKGQEPWMTEKKGPGDPSPDLKN

SEQ ID NO: 13031 - protein, 81 aa, Muntiacus muntjak
VTFSDVAIDFSHEEWRWLNSTQRNLYKDVMVQNYENLVSLGLSIPKPYVIALLEDGKEPWMVEEKLSKDMFPDCKSRWENK

SEQ ID NO: 13032 - protein, 81 aa, Equus caballus
STTCDLFIDVAIAFSQQEWEGLDPVQKTLYQDVMMENYRNLLSLAGHAISKPGVITLLEQGKEPWMVVREETRRWCLFVCD

SEQ ID NO: 13033 - protein, 81 aa, Neovison vison
DQESVTFKDVAIDLTQEEWTLMDRSQRKLYIDVMLENITHLVSVGCQFFQADVISQWEQGGELWRDDRGFAQGWTPGLENS

SEQ ID NO: 13034 - protein, 81 aa, Loxodonta africana
EHQLSKPDVVSQLEEAEELWLKEREIPQDTFPEVAEAQLDPHVDPLPAGEGDSNPLRKIEVAEVLTLNQEAARSRNAQIRA

SEQ ID NO: 13035 - protein, 81 aa, Suricata suricatta
LKPAQRNLYRDVMLENYSNLVTVGYQVTKPDVIFRLEQEEEPWVVEEEMLGRHCSEVWEVDEQQIKKQQEALLRKVTSISK

SEQ ID NO: 13036 - protein, 81 aa, Chrysochloris asiatica
MLENYSNLVSLGYQAMKADTIFQLEQGKPWLVEEEITSQYLPGEKPYRCDECQKAFSSKSQLINHHRIHTGEKPYGCSECG

SEQ ID NO: 13037 - protein, 81 aa, Chlorocebus sabaeus
KLIQNHKAKGLPSNDTDWPQEKEGKAQIVVPVTFRDVAVIFTEAEWKRLSPEQRNLYKEVMLENYRNLLSLGEAVFFPFLH

SEQ ID NO: 13038 - protein, 81 aa, Suricata suricatta
FQVPVTFDDVAVYFSELEWGKLDEWQKELYKHVMRGNYEMLVSLDYAISKPDILTQMERGEEPCPAGLWGHEEGTDREAAR

SEQ ID NO: 13039 - protein, 81 aa, Suricata suricatta
YKGPVTFKDVTVEFTREEWQLLDAAQRTLYKEVMQENYRHLVSVGYRVNKPNAVFKLKQGKEPWILEVEFPGRNYPEDLWK

SEQ ID NO: 13040 - protein, 81 aa, Mandrillus leucophaeus
VAFEDVAVNFTQEEWALLDIFQKNLYREVMLETFRNLTSIGKSWKDQNIEYEYQNPRRNFRSLIEEKVNEIKEDSHCGETF

SEQ ID NO: 13041 - protein, 81 aa, Suricata suricatta
PQGSVSFQDVTVDFTQEEWQRLDPAQKTLYRDVMLENYCHLISVGFHMTKPDMIRKLEQGEELWTTERMFPSQSCLEEDEK

SEQ ID NO: 13042 - protein, 81 aa, Sus scrofa
SQVTVTFEDVAVLFSRDEWRKLGPSQKNLYQDVMLENYSNLVSLGLPFSKPKVISLLQQGEDPWKVEKESPGSFSPGWKSS

SEQ ID NO: 13043 - protein, 81 aa, Mandrillus leucophaeus
MGPLTFRDVTVEFSLEEWQCLDTAQRNLYRDVMLENYRNLVFLGIAVSKPDLITCLEQGKEPWNMKRHEMVAKPPAFYLMG

SEQ ID NO: 13044 - protein, 81 aa, Mandrillus leucophaeus
MEGLVMFQDLFIDFSQEEWECLDAAQKDLYRDVMMENYSSLVSLGLCIPKPDVISLLEQGKEPWMVSRDVLGGWCPDRLKK

SEQ ID NO: 13045 - protein, 81 aa, Sus scrofa
CQDTVTFEDVAVVFTDEEWRHLIPIQRDLYKEVMLENYKSIVSLDWKTKPEIQGASEEEKSEGTLRGKLERKDPVSPKLKV

SEQ ID NO: 13046 - protein, 81 aa, Sus scrofa
PLTFKDVAIEFSQEEWDCLDPDQRALFWDVMLETYGNLLSVGISPRCAIKELSPKEDVNNGELVQTRGFERPVSHNFDDSD

SEQ ID NO: 13047 - protein, 81 aa, Neophocaena asiaeorientalis
SQESVSFEDVAVYFTQNQWASLDSAQRTLYREVMLENYANVTSLAAFPFPKPDLIFQLERGKAPGGLDPWTPIRRKVRGVC

SEQ ID NO: 13048 - protein, 81 aa, Bos mutus
QGLLSFEDVALYFTREEWDMLDWAQKALYRDVMLDNYRHVVSLGFQFPKPEVICQLEQWEEPWILDLPRAGTRKASGSACP

SEQ ID NO: 13049 - protein, 81 aa, Neophocaena asiaeorientalis
SVTFEDVAVYFSQEEWRLLDEAQRFLYHDVMLETFALVASLGCSHGAEVKETPSEQNVFVEMPRINTSKTNLSTQEAYPWE

SEQ ID NO: 13050 - protein, 81 aa, Neophocaena asiaeorientalis
DGGKVSFKDVTVDFSREEWQHLDPAQRLLYRDVMLENYSHLRSVGYQVPKPEVIFKLEQGEGPWTLEEETPHQSCSDEDNG

SEQ ID NO: 13051 - protein, 81 aa, Neophocaena asiaeorientalis
PLGPVSFKDVAVDFTQDEWQQLDPEQKTTYRDVMLENYSHLVSVGCHIIKPEVITKLEKGEEPWIVGGEFLLQSYPEEDWE

SEQ ID NO: 13052 - protein, 81 aa, Neophocaena asiaeorientalis
AHGSVMFSDVSIDFSQEEWDYLDLEQRDLYRDVMLENYSNLVSLGCFVSKPDVISLLEQGKEPWKVVRKGRRRYPDLETNY

SEQ ID NO: 13053 - protein, 81 aa, Neophocaena asiaeorientalis
MLENISHLVSVGNQLYKSDVISHLEQGEQLSREELGFLQGQSPVISGREDDLRKQEMISMQHIYKKDTSVISAMQRSHSQE

SEQ ID NO: 13054 - protein, 81 aa, Nomascus leucogenys
VTLRDVVINFSQEEWEYLDSAQRNLYWDVMMENYSNLLSLDLESRNETKHLSIGKDIIKNTGSQCEVMENSKLHGLESSIL

SEQ ID NO: 13055 - protein, 81 aa, Nomascus leucogenys
LTQGQLSFRDVAIEFSQEEWKCLDPGQKALYKDVMLENYRNLVSLICLPDLSVISMLEQKKDPWTLQSEVKIAKNPNGREC

SEQ ID NO: 13056 - protein, 81 aa, Nomascus leucogenys
AAQMVTFKDVAVTFTREEWRQLDLAQRTLYREVMLETCGLLVSLGHQVPKPELVHLLEHGQELWTVKRGLSHPTCAGDRAQ

SEQ ID NO: 13057 - protein, 81 aa, Nomascus leucogenys
ETNLLGPLTFRDVTIEFSLEEWQCLDTAQQNLYRDVMLENYRNLVFLGIAVFKPDLITCLKQGKEPWNMKRHEMVTKPPGM

SEQ ID NO: 13058 - protein, 80 aa, Nomascus leucogenys
MELLTFRDVAIEFSPEEWKCLDPAQQNLYRDVMLENYRNLVSLELHTEHHQRTDGHFISLGEGQVYHGVMAIAASIGVWV

SEQ ID NO: 13059 - protein, 81 aa, Nomascus leucogenys
MHSLKKATFEDVAIDFWSFLLMDTSKRKLYRDVMLENISHLVSLGHQISKSCIILKQLWREGREFLQGQSPDRETALKKKH

SEQ ID NO: 13060 - protein, 81 aa, Nomascus leucogenys
MLENYRNLVFLDIAAFKPDLIIFLEQGKEPWNMKRHEMVEEPPVICPYFAQDLWPEQGIEDSFQKMILRRYENCGYGNLHL

SEQ ID NO: 13061 - protein, 81 aa, Nomascus leucogenys
DSVTFEDVAVDFTQEEWTLLDQTQRNLYRDVMLENYKNLVAVDWESRINTKWSAPQENFLQGKTSSVVEMVRFRRYNLLPS

SEQ ID NO: 13062 - protein, 81 aa, Bos indicus
ESVTFKDVAVLFTQDEWAQLSPAQRALYRDVMLENYSNLVSLDWVITPMNKKSILKAAIPEGELGQWMIKERFTRDSCWKY

SEQ ID NO: 13063 - protein, 81 aa, Bos indicus
PQESVTFEDVAVNFSHEEWQCLTHAQRHLYKDVMLENYGNMVSLGFSFSKPPLISRLEQGTEPYVQDRQDWEFLSCSYPVS

SEQ ID NO: 13064 - protein, 81 aa, Bos indicus
QACVTFEDVAIYFSQDEWRLLNETQRFLYCDVMLENFALTTSLGCWHGVDKEEAASEQSVSVAVSHIHTSKADSLTQMAHP

SEQ ID NO: 13065 - protein, 81 aa, Bos indicus
EAPKVPFDDVAVYFSEQEWGKLDEWQKELYKHVMRGNYETLVSLDYAISKPEVLSQIEQGKEPCSWRRAGPKVPDVPVDPS

SEQ ID NO: 13066 - protein, 81 aa, Bos indicus
CQDPVTFEDVAVVFTDEEWRRLVPTQRDLYKEVMLENYKSIVSLAGLPVPGPDVIFQLKRGDEPWLVEFHGFEGKEGAENV

SEQ ID NO: 13067 - protein, 81 aa, Bos indicus
MALSQKRLTSKDVAIEFTQEEWEFLDPAQRALYRDVMLETYRNLLSVGLGQAGGLDPLWLLLRKIYLSYTCDQAFTTQSEQ

SEQ ID NO: 13068 - protein, 81 aa, Canis lupus
YQRPVSFKDVVVGFTQEEWYRLNPAQRALYRDVMLETYSNLVSVGYEGTKPYVILKLEQEEAPWICEAACSGCHCQENICQ

SEQ ID NO: 13069 - protein, 81 aa, Canis lupus
SQESVTFRDVAIDFSQEEWEWLQPAQRDLYRHVMLENYSHLVSLGLNISKPYVVSLLEQGKGPWLEKGDVRRDLFSESHGE

SEQ ID NO: 13070 - protein, 81 aa, Canis lupus
YQGPVTFKDVIVEFTREEWQLLNAAQRTLYREVMQENYGHLISVGYHVNKPNAVFKLKQGKQPWILEVEFPHWNSPEDLWK

SEQ ID NO: 13071 - protein, 81 aa, Canis lupus
AQESVTFRDVAVLFSHDEWLHLDSAQRTLYREVMLENYGTLVSLGIPFSTPKVIYQLQQGEDPCTVDREVPQDACVGFKTQ

SEQ ID NO: 13072 - protein, 81 aa, Canis lupus
TARSQAPVTFKDVAMDFTPEEWGKLDPAQREVMLENYRNLVSLWLPVSKPDNYNLENGKEPLMLERKTPKSSYSDLESKPE

SEQ ID NO: 13073 - protein, 81 aa, Canis lupus
AQESVMFSDVSIDFSQEEWECLNDDQRDLYRDVMLENYSHLVSMAGHSVSKPDVISFLEQGKEPWLVDRELTRDQWPVLES

SEQ ID NO: 13074 - protein, 81 aa, Canis lupus
FQESVTFEDVAVIFTDEEWRHLVPIQRDLYKEVMLENYKSIVSLDWETKPEIHGTSDKEKSEGTVRGKLEGEVPVCPKFEV

SEQ ID NO: 13075 - protein, 81 aa, Canis lupus
QVLVSFEDVAVLLSREEWGRLGPAQRGLYSDVMLETYRNLISLGFQSLMEKKGLTPKQEISKAMGFRRAKSEYVRNVSKES

SEQ ID NO: 13076 - protein, 81 aa, Canis lupus
MFQVTFSDVAIDFSHEEWGWLDSAQRDLYKDVMVQNYENLVSVGLSIPKPYLISLLEDGKEPWMVEKKTSKDWESRWENKE

SEQ ID NO: 13077 - protein, 81 aa, Sus scrofa
SQEQVSFKDVCVDFTQEEWYLLDPAQKILYRDVILENYSHLVSVGNCITKPEVIFKIEQGEEPWILAEKFPKQCRSEDWKV

SEQ ID NO: 13078 - protein, 81 aa, Neophocaena asiaeorientalis
QAQETLTFDDVTVDFTWEEWQLLTPPQKDLYQEVMLENYSNLLSVGYRVRKPDVLSNWDHGEPWMMEDEIHCRIHSGYQAS

SEQ ID NO: 13079 - protein, 81 aa, Neophocaena asiaeorientalis
PQGSVSFKDVTVDFTQEEWQQLDPAQKALYRDVMLENYFHLISVGFHMTKPDMIHKLEQGKELWTTEKIFPSQSYLEEDWK

SEQ ID NO: 13080 - protein, 81 aa, Bos mutus
PDTVVFEDVAVDFTQEEWALLNLAQRNLYRDVMLENFRNLASLVVVRILKEDYQVYVVWAQASGVTLGDREKIGGLGPFEN

SEQ ID NO: 13081 - protein, 81 aa, Neophocaena asiaeorientalis
WSQMPVTFEDVAVYLSREEWGRLDHTQQSFYRDILQKRNGLSLGFPFSRPFWASQVQGKGEASGSCQQMGDEEEEKRGAVE

SEQ ID NO: 13082 - protein, 81 aa, Neophocaena asiaeorientalis
AQGSVTFEDVAVYFSCEEWCLLDEVQIHLYLDVMLENFALVCMLGSWRGVDEETPSEENICVEGVSQIRTPRAGSSPEKAQ

SEQ ID NO: 13083 - protein, 81 aa, Neophocaena asiaeorientalis
FRGPVTFKDVTVEFTQEEWQLLDAAQRTLYREVMQENYRHLISVGYCVNKPNAVFKLKQGKEPWILEVEFPRQKYPEDLWN

SEQ ID NO: 13084 - protein, 81 aa, Neophocaena asiaeorientalis
GPVKFEDVVVIFTEAEWKRLSLEQRNLYKEVMLENFRNLVLLADSKPEVHPWPFAFCPLAFDGQQFLSHHELCSHLIPYSC

SEQ ID NO: 13085 - protein, 81 aa, Neophocaena asiaeorientalis
GMKFEDVAIDFSQEEWGLLDEAQRLLYYNVMLENFALVASLGCCHGTEDEEAPSEQSISVEGESQVRASKAGPSTQKTHPC

SEQ ID NO: 13086 - protein, 81 aa, Neophocaena asiaeorientalis
SLGLVSFEDVAVNFTWEEAQDLDDAQRTLYRDVMLENYSSLVSLGHCITRPEVIIKLEQGAAPWTVKEKPQTRVSRANVQI

SEQ ID NO: 13087 - protein, 81 aa, Nomascus leucogenys
GTVTFEDVAVNFTQEEWNLLSEAQRCLYRDVMLENLALISSLSCWCGVEDEAAPSKRSIYIQRETQVRTPMAGVSPKKAPH

SEQ ID NO: 13088 - protein, 81 aa, Nomascus leucogenys
QGLLTFRDVAIEFSQEEWKCLDPAQRTLYRDVMLENYRNLVSLDTSSKCMMTTLSSTGQGNTEVFHTGTLQRQASYRIGAF

SEQ ID NO: 13089 - protein, 81 aa, Nomascus leucogenys
VTFKDVAVTFTREEWRQLDLAQRTLYREVMLETCGLLVSLGDRAQVHTREPTTYPPVLSEQAFLQGSLTLESSTSSDSRLG

SEQ ID NO: 13090 - protein, 81 aa, Nomascus leucogenys
DPEQVTFEDVVVEFSQEEWGQLKPAQRTLYRDVMLDTFRLLVSVAHWLLKLNVISLLEQEAELQAVDSGLPQGVYPEIKGH

SEQ ID NO: 13091 - protein, 81 aa, Nomascus leucogenys
QGLLTFRDVAIEFSQEEWKCLDPAQRTLYRDVMLENYRNLVSLDISSKCMVKEFLSAAQGKREEFHTGTLERHESHHIGHF

SEQ ID NO: 13092 - protein, 81 aa, Nomascus leucogenys
PQASVCFEDVAMAFTQEEWEQLDLAQRTLYREVTLETWEHIVSLGLFLSKSDVISQLEQEEGLCRAEQVAPRDWKATLEEN

SEQ ID NO: 13093 - protein, 81 aa, Nomascus leucogenys
TFKEAVTFKDVAVVFTEEELGLMDPAQRKLYRDVMLENFRNLLSVGNQPFHQDTFHFLRKEMFWMIKTTSQREGNSGGKIQ

SEQ ID NO: 13094 - protein, 81 aa, Nomascus leucogenys
TFKEAMTFKDVAVVFTEEELGLLDLAQRKLYQDVMLENFRNLLSVGHQAFHRDTFHFLREEKIWMMKTATQREGNSGDKIQ

SEQ ID NO: 13095 - protein, 81 aa, Nomascus leucogenys
EEALMAFWDVAVAFTQKEWKLLSSAQRTLYREVMLENYSHLVSVGIAFSKPKLIKQLEQGDEPWREENEHLDLCPAQTPSS

SEQ ID NO: 13096 - protein, 81 aa, Nomascus leucogenys
EMGPLTFRDVAIEFSLEEWQCLDTAQQDLYRKVMLENYRNLVFLAGIAVSKPDLVTCLEQGKDPWNMKRHSMVVKPPGFLL

SEQ ID NO: 13097 - protein, 81 aa, Nomascus leucogenys
PQGLLTFRDVAIDFSQEEWKCLDPAQRTLYRDVMLENYRNLVSLEFRSVTQAKVQWCHLSSLQPPLPRFKQFSCLSLPSSW

SEQ ID NO: 13098 - protein, 81 aa, Bos indicus
AQESVMFSDVSIDFSQEEWEFLNDDQRDLYRDVMLENYSNLVSMGHSISKPDVISFLEQGKEPWLVDRELTRDQWPVLESR

SEQ ID NO: 13099 - protein, 81 aa, Bos indicus
FQESVTFRDVSIDFSREEWEWLQPAQRDLYRHVMLENYGHLVSLGLNMSKPDVVSLLEQGKEPWLGNGDVSRELFPASKSN

SEQ ID NO: 13100 - protein, 81 aa, Bos indicus
ALVSVTFRDVAVFFSRDEWLCLDSAQRTLYQEVMLENYSTLFSLGILFSKPKVILRLEQGEDPWMVENGVSQSTYLGWESL

SEQ ID NO: 13101 - protein, 81 aa, Bos indicus
VTFPDIAVRFSQREWRLLDETQRLLYLDVMLENYTLISSLGCCCGAEGGETPCEKTVPIGVSWTGSPTATPFSQKTHPCEK

SEQ ID NO: 13102 - protein, 81 aa, Bos indicus
QGESVTFKDVAVDFTQEEWGQLDSPQRALYRDVMLENYQNLLSLGPPVCKPDVISHLERGEEPWQAPRDGPAGPDPEPGWE

SEQ ID NO: 13103 - protein, 81 aa, Bos indicus
MRPVQKELYKTVTLQNYWNMVSLGLTVYRPTVIPMLEEPWMVLKEILEGPSPEWETKAQECTLVENVSKLKKDGIKLIKLE

SEQ ID NO: 13104 - protein, 81 aa, Bos indicus
RKEGPCARDVAVGFTRKEWQELDPTQKTLYRDVMLENYSHLVSVGCQVTKPAVISRLEQGQEPWMEEEEILRWSFPEVSQV

SEQ ID NO: 13105 - protein, 81 aa, Bos indicus
MWLWTSHRAAWQQMKPAQRNLYRDVMLENYSNLVTVEVWKVDEQIKKQQETLVRNVTSISKKTLIKENAVEYKNVAKVFPL

SEQ ID NO: 13106 - protein, 81 aa, Bos indicus
ALKVKMALSCHADYRWICVTPLKVNETDFEWEKIKNHIGLLTFADVYIEFSQEEWECLDPAQRTLYRDVMLETYRNLLSVI

SEQ ID NO: 13107 - protein, 81 aa, Muntiacus muntjak
MAFEDVAVHFSQEEWGLLDTAQRSLYRRVMLENFALLASLGLSVSRPHVVTQLERGEEPWVLSGVDVTLPQDAQRRPRRGS

SEQ ID NO: 13108 - protein, 81 aa, Canis lupus
PQESVTFKDVAVDFTQEEWHHVDAAQRLLYRDVMLENYSHLVSLGYQVSKPEVIFKLEQGEEPWISEGEIQRPCCPVFRTW

SEQ ID NO: 13109 - protein, 81 aa, Muntiacus muntjak
PQGSTPFSSLTVDFTQGGWRQLAPAPRDRFEEGMPEKSRNLVLLGLPVSQPGMNFQLEQREGSWMLKRDGLRNACPDWKII

SEQ ID NO: 13110 - protein, 81 aa, Canis lupus
SCGSLSFEDVTVGFTQEEWQHLDHAQRTLYRDEMLENYSHLISVGCCIPKPEVILKLEEVDQPWILEEESPSQSYPGRLIT

SEQ ID NO: 13111 - protein, 81 aa, Muntiacus muntjak
ILGSLSFRDVAVGFTRKEWQQLDPTQRTLYRDVMLENYNHLVSVGCQVTKPAVISRLEQGQEPWMEEEEILTWSFPEFIAY

SEQ ID NO: 13112 - protein, 81 aa, Muntiacus muntjak
SEDPVTFQEVLVDFSQEEWAQLAPAQKILYQDMMLENCRNLTSVGYHLCKPRLLTQGELRTRKRRLLQDTCADQNSQLKTK

SEQ ID NO: 13113 - protein, 81 aa, Muntiacus muntjak
LTEAAELEFLSVNYTLKKWKGTALSQRALYWNIMLENCCSLAPLGENRMASSQLSQKQDISEELKSADRTSGILCGLILGG

SEQ ID NO: 13114 - protein, 81 aa, Muntiacus muntjak
AQELVTFEDVAVYFIRKEWKRLEPAQRDLYRDVMLENYGNVFSLDGETRTEPDSEISEDTGSHGVLLGRFQKDISQGLKFE

SEQ ID NO: 13115 - protein, 81 aa, Canis lupus
SEESVTFEDVAIYFSENEWTGLAPAQRVLYRDVMLENYGAVAALAAFPFPKPALISQLERGEAPWCKAPQGALDGEGPRGI

SEQ ID NO: 13116 - protein, 81 aa, Muntiacus muntjak
SQRSLTFRDVAIDFSQEEWGFLDPAQRELYAAVMSEIYQNLVWLGISVAEPNIAFLLERGSQPWVMRAEDAEAPGAGESGT

SEQ ID NO: 13117 - protein, 81 aa, Muntiacus muntjak
KSWGPLSFMDVFVDFTWEEWQLLVPAQKRLCRSVMLENYSNLVSLGYQHTKPSIIFQLEQEELWMMQILSQGHPGKLRQKT

SEQ ID NO: 13118 - protein, 81 aa, Canis lupus
SQSLVTFGDVAVNFSQEEWEWLNSAQRNLYRSVMLENYRNLVSLGLCVSKPDMISSLEQRKEPWMVKRKLTRGRCPDLKAV

SEQ ID NO: 13119 - protein, 81 aa, Equus caballus
AILSSSFRGPETHRLSQVIQFSSTGYCTPKPEVILKLEQGEEPWILEEEFPSQSDPELTNSSRNYSRKKFSVFNKGRKWPH

SEQ ID NO: 13120 - protein, 81 aa, Mandrillus leucophaeus
NSGLLTFRDVAIEFSLEEWQCLDTAQKNLYRNVMLENYRNLAFLGVAVSKPDLITCLEKDKEPWNMKRHEMVDEPPGICPH

SEQ ID NO: 13121 - protein, 81 aa, Mandrillus leucophaeus
MNKAGYSMDVIVEFTKEEWKLLTPAQRTLYKDVMLENYSHLVSVGYHVNKPTAVFKLKQGKEPWILEVEFPHRVLPYLWSI

SEQ ID NO: 13122 - protein, 81 aa, Sus scrofa
AQESLTFEDVAVNFSFGEWQCLTHIQKRLYKDVMLENYRNMVSLGFPFPKPSLISHLEQETEPCVQDPQDREFLSCSHPAD

SEQ ID NO: 13123 - protein, 81 aa, Neophocaena asiaeorientalis
TKASNVALLPGVVCADDECGMCLKFAETVTFKDVAVVFTEEELALLDSTQINLYQDVMLENFRNLVSVGEDSDLPDPGRSL

SEQ ID NO: 13124 - protein, 81 aa, Neophocaena asiaeorientalis
PKVSRSLENDGVCFSEQEWENLEGWQKELYTNAMKSSYETLVSLMEGVMIKQEIQYTQDGSTDLPGEFSGIAEEHAFLSPE

SEQ ID NO: 13125 - protein, 81 aa, Neophocaena asiaeorientalis
QLTFKDVAIEFSQEEWECLDPAQRALYRDVMLETYGNLLSLDTSLKCVIEESAPKENSHTGEVLQTVLLERHESCETEDYG

SEQ ID NO: 13126 - protein, 81 aa, Bos mutus
LTFEEVAMYFSQEEWELLDPTQKALYNDVMQENYENVIFLALFVLPKPKVISCLEQGEEPWVQRPLEFKDSSEELPTGLKL

SEQ ID NO: 13127 - protein, 81 aa, Bos mutus
SQESVTFQDVAVDFTEKEWPLLDSTQRKLYKDVMLENYSNLASVGCQVGKPSLISHLEQEEELRTEDRELHRGPCPDWATP

SEQ ID NO: 13128 - protein, 81 aa, Bos mutus
QETLTFDDVAVDFTWEEWQLLAPAQKALYRDVMLENYSNLVSAEVLSKLDQGEPWMMDDETHCQTRSEVWKFDDHLLEYLQ

SEQ ID NO: 13129 - protein, 81 aa, Nomascus leucogenys
AHALVTFRDVAIDFSQKEWECLDTTQRKLYRDVMLENYNNLVSLGLLSRHKTKKLSSEKDIHEISLSKGSIIEKSKTLRLK

SEQ ID NO: 13130 - protein, 81 aa, Nomascus leucogenys
CLQLRDVAIEFSQEEWKCLDPVQKALYRDVMLENYRNLVSLGICLPDLSVISMMKQRTEPWTVENEMKVAKNPDRWEGIKD

SEQ ID NO: 13131 - protein, 81 aa, Nomascus leucogenys
MAEEFVTLRDVGLDLPLEDWEQLGLEQGDMFWDTALDNCQDLFLLDPPRPNLTSHADGGEDLEPLAGGSPEATGPDVTETK

SEQ ID NO: 13132 - protein, 81 aa, Nomascus leucogenys
ELELLTFRDVAIEFSPEEWKCLDSAQQSLYRDVMLENYRNLVSLGVAISNPDLVIYLEQRKEPYKVKIHETVAKHPAMCSH

SEQ ID NO: 13133 - protein, 81 aa, Nomascus leucogenys
SQESLTFKDVFVDFTLEEWQQLDSAQKNLYRDVMLENYSHLVSVGYLVVKPDVIFRLGPGEESWMADGGTPVRTCAGEDRP

SEQ ID NO: 13134 - protein, 81 aa, Nomascus leucogenys
EMEPLQFRDVAVEFSLEEWHCLDTAQQNLYRDVMLENYRHLVFLGIVVSKPDLITCLEQGKKPLTMKRHEMIANPPVMCYH

SEQ ID NO: 13135 - protein, 81 aa, Nomascus leucogenys
LVTFRDVAIDFSQEEWECLDPAQRDLYRDVMLENYSNLISLDLESSRTTKKLSPEKEIDEMESLQWENMEKLINHQYNGLG

SEQ ID NO: 13136 - protein, 81 aa, Nomascus leucogenys
SLDMVSFEEVAVHFTWEEWQNLDDAQRTLYRDVMLETYSSLVSLGHHITKPEMIFKLEQGAEPWIVEETPNLRLSGGSRKV

SEQ ID NO: 13137 - protein, 81 aa, Nomascus leucogenys
IGGDVTFSDVAIDFSHEEWACLDSAQRDLYKDVMVQNYENLVSVAGLSITKPYVITLLEVGKEPWRVEKKLSKGMIPDNKE

SEQ ID NO: 13138 - protein, 81 aa, Bos indicus
AAGSVTFNDVTMAFTRKEWEQLDPAQKSLYKDVMLENYSNLASMGYQALKPDMISKLEKGEEPWLGKGKGARQGGSSEIAR

SEQ ID NO: 13139 - protein, 81 aa, Bos indicus
TATSSHWRSFKDVPVDLSREEWPHVDPVQRCLYQDVTLETYSQLCAVGNQVPKPEVIFKLEQEEGPWTLEEETPHQSCSDV

SEQ ID NO: 13140 - protein, 81 aa, Canis lupus
FQEAVTFKDVAVVFSEEELGLLGPAQRKLYRDVMLENFRNLVSVGHSSSKPDVISQLEREEKLCTKEFHTQGGGRNQKEME

SEQ ID NO: 13141 - protein, 81 aa, Canis lupus
PQASVSFKDVTVEFTHEEWRQMDSAQRTLYRDVMLENYSHLVSVGYCFTKPELIFTLEQGEDPWLLKKEFLRESSPEDSQP

SEQ ID NO: 13142 - protein, 81 aa, Muntiacus muntjak
SVTFPDVAVYFSWEEWRLLDEAQRCLYLDVMLENYALISSLGCCCGTENAEAPSERITSLGVSQARTTKAALSTQKTHPCE

SEQ ID NO: 13143 - protein, 81 aa, Canis lupus
SLETVTFKDVAVDLTQEEWQHMKPAQRNLYRDVMLENYSNLVTVGYQVTKPDVIFKLEQEEEPWVIEEEMLGRHCPEVWEV

SEQ ID NO: 13144 - protein, 81 aa, Neophocaena asiaeorientalis
HVIFEDVAVSFSQEEWGLLNDAQRLLYCDVMLENLSLIASLGCWHGVEAEKAVSEQCVSVEQVTEDWNPKLEPSILKPLTS

SEQ ID NO: 13145 - protein, 81 aa, Bos mutus
QDSVVFEDVAVNFTLEEWALLDPGQRKLYRDVMLETCRNLASVENWMFLDIGGHQTLERDWRNHLVEKLCIDNEGHHCLEA

SEQ ID NO: 13146 - protein, 81 aa, Neophocaena asiaeorientalis
TAQGSVLFEDVSVDFTQKEWQLLDRAQRLLYRDVMLENYGHLVSLGHCVSKPELILKLEQEEPWILKGQLPSESHPEVQRT

SEQ ID NO: 13147 - protein, 81 aa, Bos mutus
SLTLEDVAVDFTWEEWQLLAPPQKALYRDVMLENYSNLVSVGSFFSSFLEMRKDDCLLQENLQNQSCPKRMEQCHEHNALG

SEQ ID NO: 13148 - protein, 81 aa, Bos mutus
MYLGLQVSKPDVISQLEQGTEPWIVEPSIPVGTPGDWVTRPENSITASELDISGEEPSPGAVAEKHKRDDPWSTNFLETCE

SEQ ID NO: 13149 - protein, 81 aa, Bos mutus
VSFRDVAVDFSREEWQQLDLDQKNLYRDVMLETCSHLLSIELSRSLRNVAFIKKVLTIQRDYAYKGIRKIIRVSQNIPSPK

SEQ ID NO: 13150 - protein, 81 aa, Neophocaena asiaeorientalis
GVMESVTLEDVAVGLIQEWTLLDDARRNLCRYVLLDNCRTLAPRGTPSCKACLVSQVGPREELMTAEQGILCATGVDWESQ

SEQ ID NO: 13151 - protein, 81 aa, Bos mutus
QGPVTFEDVAVYFSLEEWGLLNLTQKSLYRDVMLENFGLIGSLGCLRRLQDEDALLELGESCRVRLSEKPSLCGTSGQVFP

SEQ ID NO: 13152 - protein, 81 aa, Neophocaena asiaeorientalis
KAQETLTFDDVAVDFTWEEWQFLAPPQKDLYRDVMLENYSNLLSVGFQASKPDILSKLDQGEPWTMEDEIRCRTHSEVWKV

SEQ ID NO: 13153 - protein, 81 aa, Bos mutus
DFTQEEWQQLAPAQKTLHRDVMLEIYSHLVSVGCSYLKLDIISKLEHGKDPWTIESELSRWTYSGGEKSSDSCQQIISGEL

SEQ ID NO: 13154 - protein, 81 aa, Neophocaena asiaeorientalis
DEALMAFKDVAVAFTQKEWKLLSPAQRTLYRDVMLENYSHMVSLGIAFPKPKLIIQLEQGDEPWREENSSLLDLCPEPRTE

SEQ ID NO: 13155 - protein, 81 aa, Nomascus leucogenys
VAFEDVAVNFTQEEWTLLDISQKNLFREVMLETFRNLTSIGKKWKDQNIDYEYQNPRRSFRSLIEEKVNEIKDDSHCGETF

SEQ ID NO: 13156 - protein, 81 aa, Nomascus leucogenys
LQGPVSFRDVAVDFTQEEWQQLDPDEKITYRDVMLENYSHLVSVGYDITKPNVIIKLEQGEEPWIVEGEFPCQHSPEVWKV

SEQ ID NO: 13157 - protein, 81 aa, Nomascus leucogenys
MFKEAVTFKDVAVAFTEEELGLLGPAQRKLYRDVMVENFRNLLSVGHQPFKQDVSPIERNEQLWIMTTATRRQGNLDTLLV

SEQ ID NO: 13158 - protein, 81 aa, Bos indicus
KSWGPLSFMDVFVDFTWEEWQLLDSAQKHLYRSVMLENFRNLVSLGYQYTKPSIIFQLEQEELWMMHSPSQGHSGAQEFVY

SEQ ID NO: 13159 - protein, 81 aa, Bos indicus
QETLTFKDMAMVFSKEELALLDSAQINLYQDVMLENFRNLVSVGEDNKHLVTKHQTTGLIFSSEQLRFSRQEAWSGMPLPS

SEQ ID NO: 13160 - protein, 81 aa, Bos indicus
IQDTVVFEDVAVDFTQEEWALLNLAQRNLYRDVMLENFRNLASLGYPLHKPYLILQWKQEEDLETVERRLFPRGASSFAQG

SEQ ID NO: 13161 - protein, 81 aa, Bos indicus
SRSLENDGVCFSEQEWENLEDWQKELYANVMKSNYETLVSLKVLGQPEGEVELGAEMPGDLEEEESRGVHPVEEVVVKQET

SEQ ID NO: 13162 - protein, 81 aa, Bos indicus
LQELVTFKDVAVDFTEEEWQHLDPSQRHLYREVMLENFGNLISLAGHLLSEPEMIFHFEQEDDVWMEETIPRSSYSGDEPY

SEQ ID NO: 13163 - protein, 81 aa, Canis lupus
FQGSVSFKDVTVGFTLEEWQHLDSTQRSLYRDVMLENYSNLVSLGYCVTKPEVIFRLEQGEEPWMLEEEFPSQSFPGYSID

SEQ ID NO: 13164 - protein, 81 aa, Crocuta crocuta
GWVPALFDEVAIYFSDDEWDVLTEQQKALYREVMRMNYETVLSLEFPFPKPDMITRLEGDEESQNSDEWQLQGGSFAENEE

SEQ ID NO: 13165 - protein, 81 aa, Canis lupus
LMEAVTFGDVAVHFSREEWQCLDPGQRALYKEVMLENHSSVAGLAGFLVFKPELISRLEQGQEPWVLDLKGVEGREGARTF

SEQ ID NO: 13166 - protein, 81 aa, Canis lupus
MFQVTFSDVAIDFSHEEWGWLDSAQRDLYKDVMVQNYENLVSVAGLSIPKPYLISLLEDGKEPWMVEKKTSKDWESRWENK

SEQ ID NO: 13167 - protein, 81 aa, Canis lupus
MAVTFEDVTVIFTWEEWKFLDSSQKKLYREVMWENYTNVMSVGNWKESYKFQEEKFRYLEHENLPWWQGWRNASTQIYENR

SEQ ID NO: 13168 - protein, 81 aa, Muntiacus muntjak
SRSLENDGVCFSEQEWENLEDWQKELYANVMKSNYETLVSLKVLGQPEGDMELGAEMPGDLEEEESRGGHPVEEVMVKQET

SEQ ID NO: 13169 - protein, 81 aa, Canis lupus
PQEPVTFEDVAVYFTQSQWASLDHAQRDLYREVMLENYANVASLGAFPFPKPVLVSQLERGEAPWGPDPWEAEVVRCISPG

SEQ ID NO: 13170 - protein, 81 aa, Muntiacus muntjak
EVQETLTFDDVAVAFTWEEWQLLAPAQKALYRDVMLENHSNLVSVGFQASTPEVLSKLDQGEPWTMDDEVHCRTRSEVWKF

SEQ ID NO: 13171 - protein, 81 aa, Canis lupus
VTTNPMTFTDVAVEFTQEEWMMLDSSQRRIYRDVVLENYINLTSVEHQLWKTIVISLLGQKEVRTMKRRVLQGEVGSMEGT

SEQ ID NO: 13172 - protein, 81 aa, Canis lupus
FQEVVTFKDVAVVFTIEELGLLDSTQRKLYRDVMVENFKNLVSVGHLPFKPDMVSQLEAEEKRWMMERETQRNGYSSEDHV

SEQ ID NO: 13173 - protein, 81 aa, Muntiacus muntjak
LLETVTFKDVAVDLTQEEWQQMKPAQRNLYRDVMLENYSNLVTVGCQVTKPDVIFKLEQEEEPWVVEEELLGRHCSEVWKV

SEQ ID NO: 13174 - protein, 81 aa, Muntiacus muntjak
RDGSVTFEDVAVYFSWEEWALLDDAQRCLYHDVMLENFALTSSLALLGTCRSSGGAMKKSSELHRMDMTPFSTRWTQSCWH

SEQ ID NO: 13175 - protein, 81 aa, Muntiacus muntjak
MHESVTFEDVAVDFTQEEWALLDTSQRKLFRDVMLENISHLVFVGYQHCKLDVIFQLEQGEELWIEGRGFFQSHSPGRKSA

SEQ ID NO: 13176 - protein, 81 aa, Muntiacus muntjak
LLESVTFGDVAVVFSRDEWLHLDAAQRSLYREVMLENYSALVSLGIPLSIPKLICQLQQGEDPCMVEREIPQDVCLGFKTW

SEQ ID NO: 13177 - protein, 81 aa, Muntiacus muntjak
SHSGSVSFSDVAVDFSREEWQQLDLDQKNLYRDVMLETYSHLLSIGYQVPETEVFMLEQGKEPWALQGEGPYQSCPEELWQ

SEQ ID NO: 13178 - protein, 81 aa, Gorilla gorilla
QEGVNFKIVTVDFTQEEQGTWNPAQRTLDRDVILENHRDLVSWDLATAVEKKDSASKQRIFDEEPANGVKIERFTRDDPWL

SEQ ID NO: 13179 - protein, 81 aa, Gorilla gorilla
SITFKDLAVRFSEEEWRLLEEGQREFYRDVMRENYETLVSVGTAELLPLSAFLSPSEPGRAVGGGSHADEGQEPAGCEDPQ

SEQ ID NO: 13180 - protein, 81 aa, Sus scrofa
MKISDLVSEFGLCISKPYVISLLEQGKEPWVMKSERTSSPFPDWESIYETQELPLKQFVCDDVLMERITTCGLKCSTFGEN

SEQ ID NO: 13181 - protein, 81 aa, Sus scrofa
LSQVSVTFQDVAVDFTGEEWQLLGCAQRKLYWDVMLENFRNILSVSGPKTKVIFRMKQGHDPWMVDGENPHWHCPVESEKP

SEQ ID NO: 13182 - protein, 81 aa, Sus scrofa
SEGSLSFGDVTVDFTQEEWKHLDPSLRMLYRDVMLENYHNLVSVGYFTTKPEVIFKLEQGGEPWILEEEFLYQTCPGELVI

SEQ ID NO: 13183 - protein, 81 aa, Sus scrofa
FQGSLSFKDVAVGFTRKEWQQLDSAQRTLYREVMLENYSHLVSVGCQVTKPAVISRLEQGQEPWMKEEEILRWSAPGERTS

SEQ ID NO: 13184 - protein, 81 aa, Bos mutus
VTFEDVAVLFTRDEWRKLAPPQRNLYQDVMLENYNNLVSLGHLFPKPKVISLLQQGEDPWKVEKESPGGSSLEEQEIKLST

SEQ ID NO: 13185 - protein, 81 aa, Neophocaena asiaeorientalis
SYESLSFEDVTLDFTQEEWQQLDPAQRTLYRDVMLENYSHLVSVGYCIPKPELIFRLEQGEQPWVLEEESPSKSSPEVCKV

SEQ ID NO: 13186 - protein, 81 aa, Bos mutus
MAFRDVAVDFTQDEWVLLSPAQRSLYREVMLENYSNLVSLGIPFSKPELITQLEQGKETWREERKCSPVSCLGADCRAGTE

SEQ ID NO: 13187 - protein, 81 aa, Neophocaena asiaeorientalis
LQEPVTFADVAVLFTPEEWLFLDSAQRSLYRDVMLENYRNLASVGDQLCKASTFSHLEQREELCVTERGIFPGTHLEPQLQ

SEQ ID NO: 13188 - protein, 81 aa, Neophocaena asiaeorientalis
AQGKVNFEDVFVYFSQEEWGLLDEAQRLLYREVMLENFALMASLGCSHGMEEEEIHFEQSVSVKGVSQVTIPKTFPSSQKA

SEQ ID NO: 13189 - protein, 81 aa, Nomascus leucogenys
QGLLTFRDVAIEFSQEEWKCLDPAQRTLYRDVMLENYRNLVSLDISSKCLAKEFSSTGQGNTEVIHTGTLQRHESHHIGEC

SEQ ID NO: 13190 - protein, 81 aa, Nomascus leucogenys
RRESVTFEDVAVYFSENEWIGLGPAQRALYRDVMLENYGAVASLAFPFPKPALISQLERGEAPWCSLPQGALDGEAPRGIS

SEQ ID NO: 13191 - protein, 81 aa, Nomascus leucogenys
TQTLLTFRDVAIEFSLEEWKCLDLAQQNLYRDVMLENYRNLFSIGLTVSKPGLITCLEQRKEPWNVKRQEAVDGHPEMGFH

SEQ ID NO: 13192 - protein, 81 aa, Bos indicus
NKSGMTLSQTQLTVEDVDIKFTPEEWECLDPAQRALYWDVMEETYRNLLSVDCSDQVKTHIYPEGQSKIFIIHVSLLPQSI

SEQ ID NO: 13193 - protein, 81 aa, Bos indicus
MDPVAFEDVAVNFTLEEWALLGPSQKKLYRDVMRETLSNLALIRDAWEDHNTEDQYKNQERNLRSHILQRLCESKEGSQAG

SEQ ID NO: 13194 - protein, 81 aa, Bos indicus
GQSHVTFEDVAVYFSQEEWCLLDEAQIQLYLDVMLENFALVCMLGSWPGVGDEETPFEQSKSAGVSQIGAPRTDSSAEKVQ

SEQ ID NO: 13195 - protein, 81 aa, Canis lupus
GAELLTFRDVCVDFTLEEWQQLDSAQKNLYRDVMLENYSHLVSVGYLGAKPDVVLRLGRGEEAGMTEGETPTWKYPGERAL

SEQ ID NO: 13196 - protein, 81 aa, Canis lupus
LVTFRDVAIDFSQEEWECLNSTQRDLYRDVMLENYSNVISLDLESSCKIIKSSPEKGAYEMESLQGENMRKSFSHNLDCNG

SEQ ID NO: 13197 - protein, 81 aa, Canis lupus
SQESVTFQDVAVDFTEKEWPLLDSSQRKLYKDVMLENYSNLASVDWETPSKSKWSILMEDIFGKETSSGVTVERTHLGDKP

SEQ ID NO: 13198 - protein, 81 aa, Muntiacus muntjak
MGLLTFQDVTVDFTQEEWECLDLGQRGLYRDVMLENYGNLACLGLVVSKPDLVTFLEQMKDPWNVRRIETAIYPGMCLLNI

SEQ ID NO: 13199 - protein, 81 aa, Muntiacus muntjak
VSVTFEDVAVYFSWEEWGLLNDAQRCLYHSVMLENLSLVISLGCWHGVEDEEAPSEQNISVHGLSQVRIPKAGMFSQKAHF

SEQ ID NO: 13200 - protein, 81 aa, Muntiacus muntjak
SQEAVTFKDVAVVFTEEELGLLDSAQRKLYQDVMVENFRNLVSVGHLPFKADMVSQLETEEKLWTMERETQRNGHSNEIHS

SEQ ID NO: 13201 - protein, 81 aa, Canis lupus
PQAKVTFEDVAVLLSQEEWDRLGPAQRGLYRHVMMETYGNVVSLGLPGSKPNVICQLERGEEPWVLDGQGTKETGGLGSGH

SEQ ID NO: 13202 - protein, 81 aa, Ailuropoda melanoleuca
SPGAVSFADVAVYFSPEEWGCLRPAQRALYRDVMRETYGHLGALGEARRSIQDPVEGPVPGRDAGDLRPPGRARAAARQRG

SEQ ID NO: 13203 - protein, 81 aa, Gorilla gorilla
LYEAVTFKDVAVIFTEEELGLLDPAQRKLYRDVMLENFRNLLSVGGKIQTEMETVPEAGTHEEFSCKQIWEQIASDLTRSQ

SEQ ID NO: 13204 - protein, 81 aa, Mandrillus leucophaeus
GVNKMSNEELVGQNHGMEGEACVGGDRDLYKDVMVQNYKNLVSVTGLSVTKPYVITVLEDGREPWMVEKKLSKDWESRWEN

SEQ ID NO: 13205 - protein, 81 aa, Mandrillus leucophaeus
VAFEDVAIHFSQEEWELLDETQRLLYHDVMLENFAVMASLGCWCGAEDEGAPSAESISVAELSQGRTPKADTSTDKSHPCE

SEQ ID NO: 13206 - protein, 80 aa, Sus scrofa
TQASVSLEDVTVDFSREEWQHLDPAQRRLYRDVTLENYSHLRSVGYHVPKPEVICKLEQGEGPWTLEEETPHQRCSGERV

SEQ ID NO: 13207 - protein, 81 aa, Neophocaena asiaeorientalis
TQVSVTFDDVAVTFTQEEWRQLDPAQRTLYQEVMLENCRLLVSLGCPVPRFELIFQLEQGQKLWTMKKDLSQSTCPGKRCR

SEQ ID NO: 13208 - protein, 81 aa, Bos mutus
PLLSQSCKLFREQRKMNQSLLISQPFAYMTDLEAQQPSSSSLLYLLTGCHIIKPEVITKLEQGEEPWVVEGEFLLQSHPEE

SEQ ID NO: 13209 - protein, 81 aa, Bos mutus
LTFQDVAIDFTQEEWECLDLGQRKLYRDVMVENYRNLASLDNSEHRLRVNIHSSMSEHLQFNNECENSQSKQFEGSMSRGS

SEQ ID NO: 13210 - protein, 81 aa, Neophocaena asiaeorientalis
FQEPVSFKDVAVTFTKEELGLLDSTQRKLYQDVMLENFRNLVSVGYLPFRLDMILQLGRKKKLWVMEPEAQGAGCSGHGNQ

SEQ ID NO: 13211 - protein, 81 aa, Bos mutus
QEPVTFEDVAVYFTQNQWASLDSAQRALYREVMLENYANVASLVVSPFPRPDLISQLERGEAPWDPDPWEAEDLRGICPGG

SEQ ID NO: 13212 - protein, 81 aa, Neophocaena asiaeorientalis
TRVSVTFDDVAVTFTQEEWGQLDLDQRTLYQEVMLENCGLLVSLGCPVPRSELIYQLEQGQELWTVKKDLSRSTCPGDKGK

SEQ ID NO: 13213 - protein, 81 aa, Neophocaena asiaeorientalis
FQEPVSFKDVAVVFTEGELGLLDSAQRKLYRDVMLENFRNLLSVGNQPFKPELIFQLEREELLMMETETQRDGCSGTKSQH

SEQ ID NO: 13214 - protein, 81 aa, Nomascus leucogenys
ACGSITFGDVAIDFSHQEWEYLNLVQKTLYQEVMMENYDNLVSLGHSISKPDLITLLEQGKEPWMIVREETRGECTDLDSR

SEQ ID NO: 13215 - protein, 81 aa, Nomascus leucogenys
PQVSLTFEDVAVLFTRDEWRKLAPSQRNLYRDVMLENYRNLVSLGLSFTKPKVVSLLQQGEDPWKVEKDSSGVSSLGCKST

SEQ ID NO: 13216 - protein, 81 aa, Nomascus leucogenys
MGSLTFRDVTIEFSLEEWQCLDTAQDVMLENYRNLLHLITCLKQGKEPWNMKRHEMVTKPPVISSHFTRDFWPDQSIKDCF

SEQ ID NO: 13217 - protein, 81 aa, Nomascus leucogenys
MFSDVSIDFSPEEWEYLDLEQKDLYRDVMLENYSNLVSLGCFISKPDVISLLEQGKEPWKVVRKGRRQYPDLETRYETKKL

SEQ ID NO: 13218 - protein, 81 aa, Nomascus leucogenys
GCMTFEDIAIYFSQEEWGLPDEARRLLYLEVMLENFALDFVQKYRVWWSLQQTSCNVPLVKGASPGCGHGKEDEETPSEQN

SEQ ID NO: 13219 - protein, 81 aa, Bos indicus
MLDFEEIRYDSTKPNVIIKLEQGEEPWVVDSKFLQQQHSEKVWKVGDLIERIQENGDECSRQAVSINSRTLTEEREDAFDK

SEQ ID NO: 13220 - protein, 81 aa, Bos indicus
MDPTQRDLHKDVMLENYRNLVSLGLAISKPDMISHLENGKGPWVVVREASRTPFSELETKPTTKNTIPTEDFSKKHLSQDA

SEQ ID NO: 13221 - protein, 81 aa, Bos indicus
LAVRFADVAVYFSPEEWGCLRPAQRALYRDVMQETYGHLGALGATPNKKEEEPEAGLGAKSPRKAPGKERPEELVKHNPGT

SEQ ID NO: 13222 - protein, 81 aa, Muntiacus muntjak
ESVTFEDIAVDFTQEEWALLDTSQRKLFRDVMLENISHLVSVGNQLYKSDVISQLEQGEQLSRKKLGFLQGQSPVISDRED

SEQ ID NO: 13223 - protein, 81 aa, Canis lupus
WKESVTFKDVIVDFTQEEWKQLDPFQRDLFRDVTLENYTHLVSIGLQVSKPDVISQLEQGTEPWIIEPGIPVGTFGDCETR

SEQ ID NO: 13224 - protein, 81 aa, Muntiacus muntjak
RDPVAFEDVAVNFTLEEWALLGPSQKKLYRDVMRETLSNLALIRDKWEDHYTEDQYKNQERNLRSHILQRLCESKEGSQCG

SEQ ID NO: 13225 - protein, 81 aa, Muntiacus muntjak
PQESVTFQDVAVDFTEKEWPLLDSTQRKLYKDVMLENYSNLASVGCQVGKPSLISHLEQEEELRTEDRELHQGPCPDWATP

SEQ ID NO: 13226 - protein, 81 aa, Gorilla gorilla
YEGSVSFRDVAIDFSREEWQHLDLSQRNLYRDVMLETYSHLLSVGEKLWDHNQHRKIIGYKPASSQDQKIYSGENSYECAE

SEQ ID NO: 13227 - protein, 81 aa, Ailuropoda melanoleuca
ISFEDVAVDFTSEEWQLLNPTQKSLYRDVMLENYSNLVFLEVWLDNCLKMWHQDNQDKLRSMERGHEYDVFRKIFHSSINF

SEQ ID NO: 13228 - protein, 81 aa, Mandrillus leucophaeus
GPLTFMDVAIEFSLEEWQCLDTAQQNLYRDVMLENYRNLIFLGIAVSKPDLITCLEQGKEPWNMKRHEMMAKPPGWSAVAS

SEQ ID NO: 13229 - protein, 81 aa, Mandrillus leucophaeus
IMEEAVTFKDVAVFFTEEELGLLDPAQRKLYRDVMLENFRNLLSAGHQPFHQDTFHFLREEKFWMMETVTQREGNSGGKIQ

SEQ ID NO: 13230 - protein, 81 aa, Mandrillus leucophaeus
MSNVTFSDVAIDFSHEEWAWLDSAQRDLYKDVMVQNYENLVSVAGLSVTKPYVIMLLEDGKEPWMVEKKLSKVYPFPLLHS

SEQ ID NO: 13231 - protein, 81 aa, Mandrillus leucophaeus
LQVSLTFEDVAVLFTRDEWRKLAPSQRNLYRDVMLENYRNLVALGLPFTKPKVISLLQQGEDPWKVEKDSSGDSSLGSKSS

SEQ ID NO: 13232 - protein, 81 aa, Sus scrofa
MTFEDVAVDFTQEEWQYLNPLQRTLYRDVMLETYSNLVSVEEACQVDEQIERQHEDDQDKYLLQIGLPDKKTVITKSGHDY

SEQ ID NO: 13233 - protein, 81 aa, Neophocaena asiaeorientalis
VQASLSFEDVAVRFTWEEWQLLDPSQKDLYRNVMLENYCNLVSVGYQTPKPDSLFQLEQGEPPWRVEGAGQSQTCPEEIWE

SEQ ID NO: 13234 - protein, 81 aa, Bos mutus
QEPVTFEDVAVYFTQNQWASLDSAQRALYREVMLENYPNITSLTFPFPKPDLVFWLERGEEPGCLDPWTLVRGEDPRGTCG

SEQ ID NO: 13235 - protein, 81 aa, Neophocaena asiaeorientalis
MTFEDVAVDFTQEEWQYLNPPQRNLYRDVMLETYSNLVSVGQQVTKPDLILKLEVEEPFLPEGKIPIWSFPEEACQVDEQF

SEQ ID NO: 13236 - protein, 81 aa, Bos mutus
VFLQVSFEDVTVDFSQEEWQHLDPVQQRLYWDVTLETYSHLCAVGYQVPKPEVIFRLEQGEGSWTLDKETPHHSCSAIPFS

SEQ ID NO: 13237 - protein, 81 aa, Neophocaena asiaeorientalis
AQESVMFSDVSIDFSQEEWEYLNDDQRDLYREVMLENYSNLVSMAGHSISKPDVISFLEQGKEPWLVDRELTTDQWPVLES

SEQ ID NO: 13238 - protein, 81 aa, Bos mutus
QQSLTFQDVAIDFSQEEWGFLDPAQRELYTAVMLETYQNLVWLGISVAEPNIAFLLERGPQPWVMREEDAGAPGAESESTE

SEQ ID NO: 13239 - protein, 81 aa, Neophocaena asiaeorientalis
FQGSVSFTDVTVGFTQEEWQHLDPTQRSLYRDVMLENYSNLVSVGYCVTKPEVIFRLEQGEEPWILEEEFPRQSFPEVWKT

SEQ ID NO: 13240 - protein, 81 aa, Bos mutus
QESVVFSDVSIDFSLEEWEFLNLEQRDLYRDVMLENYSNLVSLGCFISKPDVISLLEQGKEPWKVVRKGRRQYPDLETNYE

SEQ ID NO: 13241 - protein, 81 aa, Nomascus leucogenys
ELLAFKDVAIEFSAEEWKCLDPAQDVMLQNYRNLGVAICNPDLITCLEQRKEPYNVKIHETVAKSPVISLQVYRENQCPLY

SEQ ID NO: 13242 - protein, 81 aa, Nomascus leucogenys
QGLLTFRDVAIDFSQEEWKCLDPAQRTLYRDVMLENYRNLVSLDTSSKCMMKIFFSTGQGNTEVFHMGTLQTQASHHIGDF

SEQ ID NO: 13243 - protein, 81 aa, Nomascus leucogenys
LVMFQDLSIDFSQEEWECLDAAQKDLYRDVMMENYSSLVSLDSEFRCKTKDSCLPKEIYEATSSQWVRMEKCHSLVGSSVR

SEQ ID NO: 13244 - protein, 81 aa, Nomascus leucogenys
CEVSVSFEDVTVDFSREEWQQLDSTQRRLYQDVMLENYSHLLSVGFKVPKPEVIFKLEQGEGPWTLEGEAPHQSCSDGKFG

SEQ ID NO: 13245 - protein, 81 aa, Nomascus leucogenys
EKGPLTFRDVVIEFSQEEWQCLDTAQQDLYRKVMLENFRNLVFLGIAVSKPDLVTCLEQGRDPWNMKRHSMVATPPGVFFV

SEQ ID NO: 13246 - protein, 81 aa, Nomascus leucogenys
WSQNSVTFQEVAVDFSQEEWALLDPAQKNLYKDVMLENFRNLASVGYQLCRHSLISKVDQEQLKTDERGILQGGCADWETQ

SEQ ID NO: 13247 - protein, 81 aa, Nomascus leucogenys
SQELLTFKDISIDFTQEEWGQLAPAHQSLYREVMLENYSNLVSVGYQLSKPSVISQLEKGEEPWMAEKEGPGDPSSDSKSK

SEQ ID NO: 13248 - protein, 81 aa, Nomascus leucogenys
SQELLTFKDVSVDFTQEEWGQLAPAHRNLYREVMLENYGNLVSVGYRLSKPGVISQLEKGEEPWLMERDISGVPSSDLESK

SEQ ID NO: 13249 - protein, 81 aa, Canis lupus
ISFEDVAVDFTLEEWQLLNPTQKNLYRDVMLENYSNLVFLEVWLDNSLKMWHQDNQDKLRSMERGHEYDVFRKIFHSSINF

SEQ ID NO: 13250 - protein, 81 aa, Canis lupus
AQESLTFDDVAVEFTLEEWQLLAPFQKDLYRDVMLENYRNLVSVGFHTSKPDVLSKLDQGEPTWTVENEIPCRTRSEIWKL

SEQ ID NO: 13251 - protein, 81 aa, Canis lupus
LTFDDVAVEFTLEEWQLLAPFQKDLYRDVMLENYRNLVSVEIWKLDYLPEHLQNKIMENNLEQWHELKTFENNVHQSTTHF

SEQ ID NO: 13252 - protein, 81 aa, Canis lupus
AQVLVTFKDVAVTFTREEWGQLDLDQKALYQEVMLETYGLLVSLGHPVPKPELTHLLECGQELWKGKRGLSHSTCSGDDTK

SEQ ID NO: 13253 - protein, 81 aa, Canis lupus
DHVTFEDVFVYFSREEWELLEEAQRLLYRDVMLENFALVASLDCWREADNEETPSEQSVSVGGSQLRTSKSGAFIPKPHLC

SEQ ID NO: 13254 - protein, 81 aa, Muntiacus muntjak
QLTFKDVFIDFSPEEWECLDPAQRTLYKDVMVETLMNLLSVEMSHIHMIKKLHAKASSGKGEIFQRVMFGRAESLDIKDFR

SEQ ID NO: 13255 - protein, 81 aa, Muntiacus muntjak
SIAFQDLAVRFSEDEWRLLGEGQRALYLDVMRENYDTLASLGTAEPLPLSAFLSPSELGGAVGARSRVGDGKEPTQGGGPV

SEQ ID NO: 13256 - protein, 81 aa, Canis lupus
AHHLVMFRDVAVDFSQEEWECLNSYQRNLYRDVILENYSNLVSVGCSISKPDVITLLEQGKEPWMVVRDERRRSLDLESRY

SEQ ID NO: 13257 - protein, 81 aa, Muntiacus muntjak
MRENYETVISLELFVLPKPKAISCLEQGEEPYIQGSPVFKDNPGALLSEIKLKNDMENYQPMCLSDLEIQAPGDIVSKKPS

SEQ ID NO: 13258 - protein, 81 aa, Canis lupus
LQRLLTFRDVAIEFSQEEWTCLNHTQRKLYRDVMLENYGHLLFLGLIVSKPDLVSFLEQKKEPWSVKRKKRVTIHPGKVAQ

SEQ ID NO: 13259 - protein, 81 aa, Gorilla gorilla
GEGSLSFEDVAVGFTREEWQFLDQSQKVLYKEVMLENYSNLVSIGYQGTKPDSLFKLEQGEPPGIVEGAAHSQICPGFVIQ

SEQ ID NO: 13260 - protein, 81 aa, Ailuropoda melanoleuca
NFWVLRLPPGSSGEAPKEWGKLDEWQKELYKHVMRGNYETLVSLDYAISKPEVLSQTEQGKEPCSWRRTGPKVPDVPVDPS

SEQ ID NO: 13261 - protein, 81 aa, Gorilla gorilla
WEESLTLEDVAVDFTWEEWQFLSPAQKDLYRDVMLENYRNLVAVGYQASKPDALSKLEREEETCTTEDEIYSRICSEIRKI

SEQ ID NO: 13262 - protein, 81 aa, Sus scrofa
GGVTFEDIALYFSWEEWRLLDEAQRCLYRDVMLENYALISSLGFWSEEDIEVPFEQSFSVGTSQARTSKEPSSSQKTQPCE

SEQ ID NO: 13263 - protein, 81 aa, Sus scrofa
YKGSVMFSDVSVDFSQEEWEFLDPAQRDLYKDVMLENYSNLVSMGLCMPKPQVISLLEQGKEPWMVGRELTKGLCSDLESM

SEQ ID NO: 13264 - protein, 81 aa, Neophocaena asiaeorientalis
MAHLMMFRDVAVDFSQEEWECLNLEQRALYRDVMLENYSNMVSLGLCLYQPDVFSLLEKGKEPWMVLKDETGGPCPDMQSR

SEQ ID NO: 13265 - protein, 81 aa, Bos mutus
FSFPTQLTFKDVFIDFTPEEWECLDPAQRTLYKDVMVETLRILLWVRITSFRSGGILWGTSACSLCVSWEPLFFLLRSKPC

SEQ ID NO: 13266 - protein, 81 aa, Neophocaena asiaeorientalis
AQGSLTLKDVAVDFTWEEWQLLDPDQKDLYRDVMLENYSNLVSVGYQVNKPDILSMLEQGEPPWTLEDEVHSHPHPETDKV

SEQ ID NO: 13267 - protein, 81 aa, Bos mutus
QGNVTFEDVFVSFSQEEWGLLDEAQRLLYREVMLENFALMASLGYASSMSHGVSPQELGREPWVSDWANTIPALTREAQSA

SEQ ID NO: 13268 - protein, 81 aa, Bos mutus
FQGSLSFRDVAVGFTRKEWQELDPTQKTLYRDVMLENYSHLVSVGCQVTKPAVISRLEQGQEPWMEEEEILRWSFPEVSQV

SEQ ID NO: 13269 - protein, 81 aa, Bos mutus
EWQRLSPEQRDLYRDVTLENYRNLVSMGGEDSTKPEVILRLENGEEPWMVGTQELRSCSPAEKDWAIEEQSWRFQDIEQNL

SEQ ID NO: 13270 - protein, 81 aa, Neophocaena asiaeorientalis
WSQDSVTFEEVAVDFSQEEWALLDPAQKILYRDVMLENFRNLASVGYHLCKHSLITEVEQEELRPEQRGILQGTYRDRDTQ

SEQ ID NO: 13271 - protein, 81 aa, Neophocaena asiaeorientalis
VLLTFRDVAIEFSQGEWECLDPTQRALYREVILETYRNMLSLDISTRCVIKELSPKEDINKGELFRILMLGRHKRNDIKDF

SEQ ID NO: 13272 - protein, 81 aa, Nomascus leucogenys
EMGPLTFRDVAIEFSLEEWQCLDTSQQNLYRNVMLDNYRNLVFLGIAVSKPDLITCLEQGKEPCNMKRHAMVAKPPVVCSH

SEQ ID NO: 13273 - protein, 81 aa, Nomascus leucogenys
EKGPLTFRDVAIEFSLEEWQCLDTAQQDLYRKVMLENYRNLVFLAGIAVSKPDLITCLEQGKEPWNMKRHAMVDEPPVIYS

SEQ ID NO: 13274 - protein, 81 aa, Nomascus leucogenys
MIYVAIEFSLEEWQCLDTAQRDLYRNVLLENYRNLVFLGIAVSKPYLITCLEQKKEPWNIKRHEMVAKPPVMSFHFAQDLW

SEQ ID NO: 13275 - protein, 81 aa, Nomascus leucogenys
DKKESLTFQDVAVDFTREEWDQLYPAQKNLYRDVMLENYRNLVALGYQLYKPEVIAQLELEEEWVIERDSLLDTHPDGENR

SEQ ID NO: 13276 - protein, 81 aa, Nomascus leucogenys
MFREAVTFKDVAVVFTKEELGLLDLSQRKLYRDVMLENFRNLLSVGHQPSHRDTFHFRREEKFWIMETATQTEGNSGGKIQ

SEQ ID NO: 13277 - protein, 81 aa, Nomascus leucogenys
SLGSELFRDVAIVFSQEEWQWLAPAQRDLYRDVMLETYSNLVSLGLAISKPDVISFLEQGKEPWMVERVVSRGLCPVLESR

SEQ ID NO: 13278 - protein, 81 aa, Nomascus leucogenys
PQGHLTFMDVAIEFSQEEWKSLDPGQRALYRDVMLENYRNLVSLGICLPDLSIISMLKQRREPLTLQSQVKIVKNTDGREC

SEQ ID NO: 13279 - protein, 81 aa, Bos indicus
PAQLTFKDVFIDFTPKEWDSLDPAQRTLYKDVMVETLRNLLSVDVSQIRMIKKLQAKGNSGKEEIFQRVVFGRAESHEIED

SEQ ID NO: 13280 - protein, 81 aa, Bos indicus
MAMYLTREEWRPLDPTQRDIYRDVMQENYGNVVSLDFEIRSENEVNPKQEISEDVEFETASERPVGNTEENPESEEAFDNR

SEQ ID NO: 13281 - protein, 81 aa, Bos indicus
LQGSVTFEDVAVYFSWEEWSLLDDAQRRLYHSVMLENLALIISLGCWHGAEDEEASSEQNISVHGMSQVRIPKAGMFSQKA

SEQ ID NO: 13282 - protein, 81 aa, Bos indicus
PKVPVTFDDVAVHFSEQEWGNLSEWQKELYKNVMRGNYESLVSMDYAISKPDLMSQMERGERPAMQEQEDSEEGEAPADPS

SEQ ID NO: 13283 - protein, 81 aa, Bos indicus
SQESVTFQDVAVDFTQEEWALLDTSQRTLFREVMLENISHLVSVGNQVYKSDVISHLEQGEQFSREGLGFLQGQSPVISDR

SEQ ID NO: 13284 - protein, 81 aa, Canis lupus
MLYRELMLENYGTLVSLGILFSKPKVIFQLQQGEDPWMVENGVSQSPCVGWENLFETTVSEEENQEVMNKLLGDSFFDFKL

SEQ ID NO: 13285 - protein, 81 aa, Canis lupus
RSAFVAFRDVAVDFTQEEWRLLSPAQRTLHREVMLETYNHLVSLEIPFSKPKLISQLEQGEEPWIEERQHPLGLCSGSKLN

SEQ ID NO: 13286 - protein, 81 aa, Muntiacus muntjak
MGWLTFWDVAIDFTQEEWECLDLGQRDLYTDVMVENYRNLASLGLVVSKPDLVTFLEQMKDLRNIRRMQTAVIYPVFSKSS

SEQ ID NO: 13287 - protein, 81 aa, Muntiacus muntjak
AVTFTDVAVDFSQDEWEWLTLAQRTLYKKVMIENYSNLASLGLCVSKPDVISLLEQDKEPWTMKGELTRGPCADLEYVWMK

SEQ ID NO: 13288 - protein, 81 aa, Muntiacus muntjak
WREDSVTFADVAVYFTQEEWTLLNPFQRKLYGNVMLENYKNLTTAGYQAFKPTLISWLEQEVLKTVERGILQEWEMQLTSN

SEQ ID NO: 13289 - protein, 81 aa, Canis lupus
HRGGLLTFRDVAIEFSQEEWGCLNHTQRELYRDVMLENYGNLLFLDLIVSKPDLVSFLEQKKEPWSVKRKKRVTIHPGKWK

SEQ ID NO: 13290 - protein, 81 aa, Crocuta crocuta
QAQLTFRDVAIEFSQEEWECLDPAQRALYRDVMLETYRNLVSLGEESVPPEIIGYFFNIYLSDSSATFMIKELLSVRDINN

SEQ ID NO: 13291 - protein, 81 aa, Gorilla gorilla
KEPGEAPVTFDDITVYLLQEEWVLLSQQQKELCGSNKLVAPLGPTVANPELFCKFGRGPEPWLGSVQGQRSLLEHHPGKKQ

SEQ ID NO: 13292 - protein, 81 aa, Gorilla gorilla
PQKSVTFEDVAVYFTQAEWDGLSPAQRALYRDVMLENYGNVASLGFPLLKPAVISQLEGGGELGGPSPLAAGTGLQGLQTV

SEQ ID NO: 13293 - protein, 81 aa, Sus scrofa
GNASGLTLEDVTLGDVAIEFSPEEWACLDPAQRALYRDVMLETCRNLLSLGEHRFPPGVGICPWVSLRFPSCASWEPLCLA

SEQ ID NO: 13294 - protein, 81 aa, Neophocaena asiaeorientalis
QLTFEDVAITFSQEEWECLDPAQRALYRDVMLETYRNLLSLAVSHIHVIKKLKPKANSDTGEVFQTVMLGRHESHEIRDFY

SEQ ID NO: 13295 - protein, 81 aa, Bos mutus
PQESVTFEDVAVNFSHEEWQCLTHAQRHLYKDVMLENYGNMVSLGFSFSKPPLISRLEQGAEPYVQDRQDWEFLSCSYPVS

SEQ ID NO: 13296 - protein, 81 aa, Bos mutus
TARSQASVTFKDVAMDFTPEEWGRLDPTQRDVMLENYRNLVSLWLPVSKPENHSLENGKEPLLLERKAPKSSCSDSETSPR

SEQ ID NO: 13297 - protein, 81 aa, Neophocaena asiaeorientalis
QESVTFKDVAVDFTLEEWGQLGPGQRELYRDVMLENYQNLLSLGAGLPGSKPDVISRLERGEEPRMERREAWRVTCSDLET

SEQ ID NO: 13298 - protein, 81 aa, Neophocaena asiaeorientalis
VSVNFEDVAVTFSWEEWGLLDEAQRYLYHDVMLENLALITSLGCCHEVENEKASFEQRTSVQRVSQIRSPKANLSFKKVHP

SEQ ID NO: 13299 - protein, 81 aa, Neophocaena asiaeorientalis
SLGSDLFRDVAVVFSQEEWEQLAPAQRDLYRDVMLEIYSNLVSLGLAISKPDVISFLEQGREPWMVEKVATGGHCPDQVSQ

SEQ ID NO: 13300 - protein, 81 aa, Neophocaena asiaeorientalis
SQGPVSFTDVAVDFTQEEWQQLDPDEKTTYRDVMLENYSHLVSVGYDSTKPNVILKLEQGEEPWVADGEFPRQFHPEEVWK

SEQ ID NO: 13301 - protein, 81 aa, Neophocaena asiaeorientalis
FQMSLSFRDVAIDLSQEEWECLDPVQRALYRDVMLENYSNLVSLGCSSPKPDVITLLEQEKEPWTAMREGTRSWYTDLESK

SEQ ID NO: 13302 - protein, 81 aa, Nomascus leucogenys
EMGPLTFRDVAIEFSLEEWQCLDTAQQDLYRKVMLENYRNLVFLGIAVSKPDLVTCLEQGKDPWNMKRHSMVVKPPVICSH

SEQ ID NO: 13303 - protein, 81 aa, Nomascus leucogenys
ARGCVVFEDVFVYFSWEEWELLDDAQRLLYHDVMLENFALLASLGIAFSRSRAVMKLEQGEEPWVYDQVDMTSATEREAQR

SEQ ID NO: 13304 - protein, 81 aa, Nomascus leucogenys
MLENHQNLLALGPPLHKPDVISHLERGEEPWSMQREVPGGPCPEWELKAVPSQQQGICKEEAAQEPIMERPLGGAQAWGLQ

SEQ ID NO: 13305 - protein, 81 aa, Canis lupus
PKVLVSFEDVSVYFTKTEWKLLDLRQRILYKRVMLENYGHLESLGFLSSKPHLVSWLEQGEGPWGADMCGTPAAAGIQTDD

SEQ ID NO: 13306 - protein, 81 aa, Canis lupus
AQGSVMFNDVSIVFSQEEWEYLDLEQKDLYRDVMLENYSNLVSLGCFISKPDVISLLEQGKEPWKVVRKGRRRYLDLENRY

SEQ ID NO: 13307 - protein, 81 aa, Canis lupus
AQGGVTFEDIAVYFSWKEWRLLDEAQRRLYHHVMLENFTLISSLGCCCGAEAVEAPIEQNASGGVSQTRTPRVALTSQKTH

SEQ ID NO: 13308 - protein, 81 aa, Canis lupus
QESVTFKDVAVDFTLEEWGQLGPGQRELYRDVMLENYRNLLSLGAGPPGSKPEVITRLERGEEPKMEKREARQATCPDLDT

SEQ ID NO: 13309 - protein, 81 aa, Crocuta crocuta
PKVPVTFDDVAVHFSEQEWGNLSEWQKELYKNVMRGNYESLVSMDYAISKPDLMSQMERGERPPMREQEDSEEGETPADPS

SEQ ID NO: 13310 - protein, 81 aa, Muntiacus muntjak
RMKSVTFEDVAVYFTQTEWDSLSTAQRALYRDVMLENYGNVASLGFPLLKPAVISQLEGGGELEGPSPLASGAGTGPQGLW

SEQ ID NO: 13311 - protein, 81 aa, Canis lupus
MSRAEGRCSTAEPPRCPSYLFLYAGLCISKPDIISLLEQGKEPWMMKGEMTRDLYPDLKYVWMTRELPPNQDIYEEKLSQA

SEQ ID NO: 13312 - protein, 81 aa, Canis lupus
GWLTFRDMAIEFSQEKECLDSAQWALYRDVMLENYRNLVSLDISPTHVIKKLQPKENSDTEVFQTVMLQRSEGYEIKDFFF

SEQ ID NO: 13313 - protein, 81 aa, Muntiacus muntjak
MGRLTFWDVAIDFTQEEWECLDLGQRELYMDVMLENYANVASLGLVSKLDLVTLLEQLKDPRSIRRMETTAIYPAMTPQDT

SEQ ID NO: 13314 - protein, 81 aa, Canis lupus
FQGSLTFSDVAIGFSQQEWECLDPVQKSLYRDVMMENYGNLVSLGYSISKPDVITLLEQGKEPWMVLREETKRWDTDSFLS

SEQ ID NO: 13315 - protein, 81 aa, Canis lupus
KCLINYSQDPVTFDDVAVEFTQEEWTLPDQIQRRPYRDVVLENYKNLASIDWEICLNSKWSAPQQNILQGKTPSVVEMNSR

SEQ ID NO: 13316 - protein, 81 aa, Muntiacus muntjak
QVTFKDVAIEVSQEEWKFPDPAQRTLYRDVMVETYRNLLSVENSLFDLNIISILEQVREPQNVENKVKKVNAWGHIKGMNT

SEQ ID NO: 13317 - protein, 81 aa, Bos mutus
FLKGISQESVKFRDVAVVFSPDLWAHLSPEERELYRDVMLDTCAQLVLLGRWTYKVEVISSLRQGRDPRMLEGEATSAAWP

SEQ ID NO: 13318 - protein, 81 aa, Bos mutus
SQGLVTFEDVAVYFSLEEWERLDAEQRELYKEVMRENYGILVSLGYPVPKPDLIFRLEQGEEPWVPDSPRPEDGDIVTGVY

SEQ ID NO: 13319 - protein, 81 aa, Neophocaena asiaeorientalis
MLENYRNLASLGLCISKPDVISLLEQDKEPWMMKGEITRRLPTDLEYVWMRKELSPNQDIYEEKLSQAMIMERLTGCDLKC

SEQ ID NO: 13320 - protein, 81 aa, Neophocaena asiaeorientalis
RKVPVSFEDVSVYFTKTEWKLLDLRQRVLYKRVMLENYRHLVSLGFSSSKPHLVSRLERGEGPWVADVHRMGTTTGMQAGD

SEQ ID NO: 13321 - protein, 81 aa, Neophocaena asiaeorientalis
MDSVVFEDVAVNFTAEEWALLDLAQRKLYRDVMLETFRNLASVGSCPQVKTSRSSAHWDILETGLCSEEKVVRFTRNDSCS

SEQ ID NO: 13322 - protein, 81 aa, Bos mutus
SKAPVTFGDLAIYFSQEEWEWLSPIQKDLYEDVMLENYQNLVSLGLSFRRPNVITLLEKGKAPWMVDPVKRRRGLDLGSKC

SEQ ID NO: 13323 - protein, 81 aa, Bos mutus
SQGLLTFEEVAIYFSQEEWELLNPTQKALYNDVMHENYETVISLALFVLPKPKVMYLEQGEEPYIQGSPMFKDNPGELLSD

SEQ ID NO: 13324 - protein, 81 aa, Bos mutus
FQDQVTFEDVVVDFTQEEWGHLEPAQRTLYRDVMLETFGLLVSVGHWLPKPDVISLLEQEAELWAADKGGPRDLETRPQSK

SEQ ID NO: 13325 - protein, 81 aa, Bos mutus
QEQVSFKDVCVDFTQEEWYLLDPAQKILYRDVILENYSHLVSVGNCITKPEVIFKIEQGEEPWILEERFPKQWHSGKSYKY

SEQ ID NO: 13326 - protein, 81 aa, Nomascus leucogenys
MNMSQASVSFQDVTVEFTQEEWQHLGPVERTLYREVMLENYSRLVSVIYKLEQGAEPWSLDDEFLNQRYPGYFKVDHIKGI

SEQ ID NO: 13327 - protein, 81 aa, Nomascus leucogenys
AQGLVTFRDVAIEFSLEEWKCLEPAQRDLYREVTLENFGHLASLGLSISKPDVVCLLEQGKEPWMIANDVTGPWCPDLESR

SEQ ID NO: 13328 - protein, 81 aa, Nomascus leucogenys
EEALMAFWDVAVAFTQKEWKLLSSAQRTLYREVMLENYSHLVSVGIAFSKPKLIKQLEQGDEPWREENEHLDLCPESRSVA

SEQ ID NO: 13329 - protein, 81 aa, Bos indicus
TQVSVTFDDVAVTFTQEEWGHLDPAQRTLYREVMLETCRLLMSLGCPVPRPELIYQQEHGQELWTVKRDLSRSTCAGYSSE

SEQ ID NO: 13330 - protein, 81 aa, Bos indicus
MLENYRNLASLGLVVSKLDLVTFLEQMKNPWDVRRLEAPAIYTGWKPFACTECGNTSNQNSKLAQDRQIHAGKKPYECKEC

SEQ ID NO: 13331 - protein, 81 aa, Canis lupus
AQGGVTFEDIAVYFSWKEWRLLDEAQRRLYHHVMLENFTLISSLGCCCGAEAVEAPIEQSASGGVSQTRTPRVALTSQKTH

SEQ ID NO: 13332 - protein, 81 aa, Canis lupus
GQSPVTFEDVAVYFSKEEWKLLDAGQRHLYYSVMLENFELMTSLGCWYGMEDEGARSKQNASVERMSQVRIPSVNPSTQKA

SEQ ID NO: 13333 - protein, 81 aa, Muntiacus muntjak
GLVMFKDVAIDVSQEEWECLNPAQRNLYKDVMLENYSNLVSLGLSVSKPAMITSLEQGKEPWMVLREVTGERCPDLVSKCE

SEQ ID NO: 13334 - protein, 81 aa, Canis lupus
QAEVTFEDVAVLFSREEWGRLGPSQRGLYRDVMLETYRNLVSLGAGPAGPKPGVITQLERGDEPWDLDAQGAKGTERLRVS

SEQ ID NO: 13335 - protein, 81 aa, Muntiacus muntjak
HSGFVVFEDVAIYFSQEEWGLLDEAQRLLYCQVMLQNVALLSSVGCRHGTQDEVALSEQHDAAARSQVKTPKPGPCIQKPP

SEQ ID NO: 13336 - protein, 81 aa, Canis lupus
DRGLVVFTDVAIHFSQEEWGLLDEAQRSLYHSVMLENFALLSSLGCLHRAQDEGAPSEQGVSAGTSQVRTPKPGPSIQDAQ

SEQ ID NO: 13337 - protein, 81 aa, Muntiacus muntjak
MTFRDVAIDFTQEEWECLDLGQRELYTDVMLETYGNLASLALTHSFPNLESVHCHMSSSHCCFLTCIQMSQEEGTVVWCSH

SEQ ID NO: 13338 - protein, 81 aa, Muntiacus muntjak
GLVTFRDVAIDFSQEEWEFLDPAQRDLYVDVMLENYSNLVSLDLESTYETKNTFSKKDIFEINFSQWKIKERNKTIKLEAS

SEQ ID NO: 13339 - protein, 81 aa, Muntiacus muntjak
EPGPVTFKDVAVDFTQEEWGQLDSPQRALYRDVMLENYQNLLSLGPPVCKPDVISHLERGEEPWQAARDGPAGPGPGWEPR

SEQ ID NO: 13340 - protein, 81 aa, Muntiacus muntjak
MGLLTFQDVTVDFTQEEWECLDLGQQELYRDVMLENHGNLACLGLVVSKPDLVTFLEQMKDPWGVRRMETAIHPGISNVTI

SEQ ID NO: 13341 - protein, 81 aa, Gorilla gorilla
LQISFEDVAVDFTVEEWQLLNPTQKNLYRDVMLENYSNLVFLGKNILIIIIEGITQYEVWLDNPKMWLRDNQDNLKSMERG

SEQ ID NO: 13342 - protein, 81 aa, Sus scrofa
SQALLTLGDVAIEFSQEEWACLDPAQRRALYRDVMLETCRNLLSLGEHRFPPEASVNSVWDECSVFLLPSAVRLCPSRPSC

SEQ ID NO: 13343 - protein, 81 aa, Sus scrofa
MLENINHLASVGCQISKADVISQLEQGKELWRETTGCLQNKSPGSKCPLRQQEMISMLQVKRKHLSTTMPMQVSHAQEDPV

SEQ ID NO: 13344 - protein, 81 aa, Neophocaena asiaeorientalis
ARLTFKDVVIEFSPEEWECLDPAQRALYRDVMVETYRNLISVDLSHVHVIKKLQLKSNTDVGEIFPTVMLGSHGSCEIKHF

SEQ ID NO: 13345 - protein, 81 aa, Neophocaena asiaeorientalis
PLESVTLEDVAINFTQEEWALLDTSQKTLFRNVMLENITHLVSVGYQISKSDVISQLEQGKELWSEATGCLQSQSPDGESL

SEQ ID NO: 13346 - protein, 81 aa, Neophocaena asiaeorientalis
MTFEDVAVDFTQEEWQYLNPPQRNLYRDVMLETYSNLVSVAGQQVTKPDLILKLEVEEPFLPEGKIPIWSFPEEACQVDEQ

SEQ ID NO: 13347 - protein, 81 aa, Bos mutus
KGLVTFSDVAIDFSQEEWACLDSRQRDLYWDVMLENYSNLVSLGNCGDTPAYRESTPVRPQQRLPNRENSYECKECGKAFS

SEQ ID NO: 13348 - protein, 81 aa, Nomascus leucogenys
YQDLVTFDDVAVDFTQEEWTLLDPSQRDLYRDVMLENYENLASVGHDLFKPNVISWLEEEEELRAGRRGVLQEWRLKTKGP

SEQ ID NO: 13349 - protein, 81 aa, Nomascus leucogenys
QGRLTFRDVAIEFSLAEWKFLNPSQRALYREVMLENYRNLEAVDISSKCMMKEVLSTGQGNSEVFYTGTLQRHESHHVGGF

SEQ ID NO: 13350 - protein, 81 aa, Nomascus leucogenys
PQESVAFEDVAVYFTAKEWDIMVPAERALYRDVMLENYEAVAFVVPPTSKPALVSHLEQGKESCFTRPQGVLCRNDWRAGL

SEQ ID NO: 13351 - protein, 81 aa, Nomascus leucogenys
SLGSVTFTDVAIDFSQDEWEWLNLAQRSLYKKVMLENYRNLVSVGLCISKPDVISLLEQEKDPWVIKGEMTRGLCPDLECV

SEQ ID NO: 13352 - protein, 81 aa, Nomascus leucogenys
MSNVTFSDVAIDFSHEEWACLDSAQRDLYKDVMVQNYENLVSVAGLSITKPYVIMLLEDGKEPWTVEKKLSKVYPFPLSHS

SEQ ID NO: 13353 - protein, 81 aa, Nomascus leucogenys
DSVVFEDVAVDFTLEEWALLDSAQRNLYRDVISVARFEMWERTKTDMFTQDMHGQEKSKEQTIPNFTGNNSCAYTLEKNCR

SEQ ID NO: 13354 - protein, 81 aa, Bos indicus
MIDLASLMLPEEDTQKMRKRKEKESGMALSQEQLTFEDVAIDFSLEEWECLDPAQRALYRDVMVETYRNLFSLGFHFCLDS

SEQ ID NO: 13355 - protein, 81 aa, Bos indicus
SQGWLTFQDIAIDFTQEEWECLDLGQRELYRDMMLENYGNLASLGTCVSKPDLVTFLEQRKDSRNIRRVETTPIAPAASSL

SEQ ID NO: 13356 - protein, 81 aa, Bos indicus
EQLTFKDVAVEFSQEEWECLDPAQRAFYMDVMVETLRNLISVDISHIYVVKKLQPIASSDRGDAFQTVTLERQESPEMKYF

SEQ ID NO: 13357 - protein, 81 aa, Canis lupus
FQEPVMFKDVAVVFSEEELGLLDSTQRKLYRDVMLENFRNLVSVGNQFYKPELIFQLEREEKLLMMETETQRDGYIDFIYF

SEQ ID NO: 13358 - protein, 81 aa, Canis lupus
SRMSVTFEDVAVLFTRDEWRKLGPSQRHVYQEVMLENYSNLVSLGLLFSKPKVISLLQRGEDPWKVEKESPGGPSLGWKSS

SEQ ID NO: 13359 - protein, 81 aa, Canis lupus
LKGSVTFKDVTMAFTQKEWEQLDPAQRSLYKDVMLENYSNLASMGYQAPKPDMISKLEKGEEPWLGKGKRLQQGGPGEIAR

SEQ ID NO: 13360 - protein, 81 aa, Canis lupus
SQHLVTFEDVAVDFTQEEWTLLDQAQRDLYRDVMLENYQNLITLAGYESCQPGLNSTMEVAEELRAGGRGVLQGEKQCWSE

SEQ ID NO: 13361 - protein, 81 aa, Canis lupus
SQELVAFEDVLVDFTPEEWQYLNSSQKTLYREVMLETYGNLVSVAGQQDTKPDLILKLELEGPCLAERKISVWSFPEEACQ

SEQ ID NO: 13362 - protein, 81 aa, Canis lupus
PQGPVTFEDVAVYFPQSQWTSLDPMQRALYREVMLENYANITSLAAFPFPKPDLIFQLERGEAPWGLDPWIPIEGEALGGV

SEQ ID NO: 13363 - protein, 81 aa, Canis lupus
PKVPVTFDDVAVYFSEPEWGKLDNWQKELYKHVMRGNYEMLVSLDYAISKPDILTQMERGEEPCPEGPWGQEEGNKREAAC

SEQ ID NO: 13364 - protein, 81 aa, Canis lupus
MLETYGLLVSLGHPVPKPELTHLLECGQELWKGKRGLSHSTCSGDDTKLQIRNPSTSPLVLSEGALLQGSLTQGSSGDSRL

SEQ ID NO: 13365 - protein, 81 aa, Muntiacus muntjak
SLAFEDVAVNFTLDEWVLLDSSQRKLYRDVMRENFRNVVSVEAKQEDHDIEDQDKNQERKLRNPKAERHSEKKDINSSEES

SEQ ID NO: 13366 - protein, 81 aa, Muntiacus muntjak
LGNLITFEDVAINFTQKEWALLNPSQRRLYKDVMLENYRNLASLGYQLSKPPLITHLEQEDEMKIVEQRIHQGTCSCEHQA

SEQ ID NO: 13367 - protein, 81 aa, Muntiacus muntjak
EVGSVSFKDISVDFSREEWQQLDLAQKSLYRDVMLENYFNLISVGCQVPKPEVIFNLEWGEEPFMWNDKTSSQSCLDQDIG

SEQ ID NO: 13368 - protein, 81 aa, Canis lupus
LYLELVILRDVAMDFTLEDWEHLGLDQGDLFWDTALDNYQNLFLLNPSKPKLTSCPDGGEKLEVLVRASTESECPDTAGAK

SEQ ID NO: 13369 - protein, 81 aa, Canis lupus
DEAVMAFRDVAVAFTQKEWKLLSSAQRTLYRDVMLENYSHLVSLGIAFSKPKLITQLEQGDEPWREENECFLDLCPGEWEA

SEQ ID NO: 13370 - protein, 81 aa, Crocuta crocuta
GLVTFRDVAIEFSQEEWKCLEPAQRNLYRDVTLENFSNLVSLGLSISKPDVISLLEQGREPWMIANDMTGPWCPELKSRCE

SEQ ID NO: 13371 - protein, 81 aa, Canis lupus
PLTFKDVAVVFTEEELKLLDPTQRKLYRDVMLENFRNLLSVGDKNEKVLEYIQERELKCLSYRELSYWKIWEQVAGELTGS

SEQ ID NO: 13372 - protein, 81 aa, Sus scrofa
MSPARRTLYRDVMLENYSHLVSSGLKMEHFDASLSTYFRAWLGPRDLRVKGWFLLDNYIPTLVCSILYLLIVWLGPKYMKN

SEQ ID NO: 13373 - protein, 81 aa, Sus scrofa
SMTFEDIAVYFSWEEWRLLDETQRRLYLDVMLDNYALISSLGCCCGAEGSEASFEQIDSLGASEATTPKAALSSQKTHPCG

SEQ ID NO: 13374 - protein, 81 aa, Sus scrofa
FKEAVTFKDVAVAFTEEELGLLDSAQRKLYQEVMVENFRNLVSVGENSQNQSELRAIQDRGSHEELSCRQIWQQIADDLTR

SEQ ID NO: 13375 - protein, 81 aa, Sus scrofa
EVVPLTFQDVAVYFSWEEGRQLGPDQRTLYRDVMLENYGHVASLGLPVSKPELISQLEQGEEWWVLGLLRAEQQEVLSRTD

SEQ ID NO: 13376 - protein, 81 aa, Sus scrofa
MSRTDVAIDFSPEEWECLDLGQRHLYRDVMLEICRHLVSLEYVISKPDLVRLLEQKTDPWDVKGMETVSLNLGRERKKHTG

SEQ ID NO: 13377 - protein, 81 aa, Bos mutus
FQEFVTFEDVAVHLTREEWGCLDPVQRALYREVMLENYGNLVSLGFPIFKPDGISQLEQDLQVFDLETKNREVLRDDCSDG

SEQ ID NO: 13378 - protein, 81 aa, Neophocaena asiaeorientalis
ERLTFEDVAIEFTEEEWECLDPAQRALYRDVMVETYRNLLSLGKGERKQWLMRAHLLTQAREREGYSIHNWDVRGVPLAAE

SEQ ID NO: 13379 - protein, 81 aa, Bos mutus
DSVTFEDMSVKFTTEEWGLLDLTQKKLYRDVMRETFKNLTSVDAVKIKKVISMGKHLARFQIIIKKKETTGIKLYKFSIYG

SEQ ID NO: 13380 - protein, 81 aa, Neophocaena asiaeorientalis
PQKSVTFEDVAVYFTQTEWDGLSPAQRALYRDVMLENYGNVASLGFPLLKPTVISQLEGGGELEGPSPLTSGTGTGHQGLW

SEQ ID NO: 13381 - protein, 81 aa, Neophocaena asiaeorientalis
QGSVTFEDVAVYFSWEEWCLLDEVQMHLYLDVMLENFALVCMLGSWHWVEDEETPSEQSVSAEGVSQIRTSSAGSSPEKTQ

SEQ ID NO: 13382 - protein, 81 aa, Neophocaena asiaeorientalis
RESGKAPVTFDDITVYLLQEEWTLLSQQQEEICGSDELVAPLGPTIANPELFYKFERGPEQWLANVQGQRSLLSLHRGKNK

SEQ ID NO: 13383 - protein, 81 aa, Neophocaena asiaeorientalis
AKDCVTFEDVTIYFSQEEWGLLDEAQRLLYCDVMLENFALIASLGLTSFRSHVVAQLEMGAEPWVPDRVDMTSAMARGAYR

SEQ ID NO: 13384 - protein, 81 aa, Bos mutus
DLGRLMFQDVTIDFTLEEWECLDLDQRELYRNVMLENYGNLASLGLVVSKPDLVTFLEQMKNPWDIRRTDTTATYPSVSSH

SEQ ID NO: 13385 - protein, 81 aa, Bos mutus
VTFEDVFVYFSREEWELLEEAQRLLYRDVMLENFAHVAALVLFTIIVSLLITASPPYLPRPRTDNGPFLTDPGPSSCQRPV

SEQ ID NO: 13386 - protein, 81 aa, Neophocaena asiaeorientalis
AVWGPLSFMDVFVDFTWEEWQLLDPAQKHLYRSVMLENYSNLVSLGYQHTKPNIIFQLEQEELWMMQIPSESHMDEVWEID

SEQ ID NO: 13387 - protein, 81 aa, Nomascus leucogenys
ESVTFQDIAVDFTEKEWPLLDSSQRKLYKDVMLENYSNLTSLDWETPSKTKWSLLMEDIFGKETPRGVTMERARLGEKSAE

SEQ ID NO: 13388 - protein, 81 aa, Nomascus leucogenys
VDFPQEEWTLLDQTQRDFYRDVMLENYKNLIILGKTELRTGVTGVLQELDLQLKTKGSPLLQDISAERSPNGIQLERSNTA

SEQ ID NO: 13389 - protein, 81 aa, Nomascus leucogenys
PKVPVAFDDVSIYFSTPEWEKLEEWQKELYKNIMKGNYESLISMDYAINQPDVLSQIQPEGEHNTEDRAGPEESEIPTDPS

SEQ ID NO: 13390 - protein, 81 aa, Nomascus leucogenys
ESVTFEDVAVEFIQEWALLDSARRSLCRYRMLDQCRTLASRGTPPCKPSCTSQLGPTAEPRATERGIFHATGVAWESQLKP

SEQ ID NO: 13391 - protein, 81 aa, Nomascus leucogenys
QDAVAYEDLSVDYTQKKWKGLPLSQRALQWNMMPENDRSMASLGENMMKGSELTPKQEIFKGSESSNRTSGGLFGVVPGAA

SEQ ID NO: 13392 - protein, 81 aa, Nomascus leucogenys
AEGLVMFEDVTVYFSREEWGLLNVTQKGLYRDVMLENFALVSSLGLAPSRSPVFTQLEDDEQSWVPNWVDVTPVSRAEARR

SEQ ID NO: 13393 - protein, 81 aa, Nomascus leucogenys
IGGDVTFSDVAIDFSHEEWACLDSAQRDLYKDVMVQNYENLVSVGLSITKPYVITLLEVGKEPWRVEKKLSKDNKELSTKK

SEQ ID NO: 13394 - protein, 81 aa, Bos indicus
CEGLVSFEDVTMDFSREEWQQLDPAQRHLYQDVMLEIYSHFFSVGYHIPNPEIIFRIEEGKEPWVRKTELPCQRYHEGEFG

SEQ ID NO: 13395 - protein, 81 aa, Bos indicus
RDQDFRASLLHTASQEQWRHLDSTQKEQYWDLMLETYGKMVSGGAGISSARPDLTDPAGYGVELAGPHLQANEKIPRPTCI

SEQ ID NO: 13396 - protein, 81 aa, Bos indicus
PQGSVTFEDVAVYFSWEEWALLDEAQRCLYHDVMLENFALTSSLGYWHGVEDKEAPSEQSICIGVSQIRTLKVDSSPHKGQ

SEQ ID NO: 13397 - protein, 81 aa, Bos indicus
TQLTVEDVDIKFTPEEWECLDPAQRALYQDVMVETYRNLLSVDVSRIHMTMKLQAKGNNGKGEIFQRVMFGRAKTHEIKDY

SEQ ID NO: 13398 - protein, 81 aa, Canis lupus
MFKEAVTFNDVAVAFTEEELGLLDSAQRKLYQDVMLENFRNLVSVGHQPFKRDKWQIEREEKLWLMKTTTQIERNVGGNNQ

SEQ ID NO: 13399 - protein, 81 aa, Canis lupus
WEETVTFKDVAVIFTEEELGLLDPAQRKLYGDVMLENFRNLLSVGHQPFTPDVILQLERGEKLRMVKMAAWGPSASGDKNL

SEQ ID NO: 13400 - protein, 81 aa, Canis lupus
QGPLLFEDLAVYFSQEECVSLYPAQRSLSRDTTLECFEDMALMGGEGKTEIPQQLNLESTGFEELSPENSIAVPLVYYPEK

SEQ ID NO: 13401 - protein, 81 aa, Canis lupus
LTFRDVAIEFSEEEWECLDPAQRALYRDVMLENYRNLVSLGEDNVPSAVGICPWVSLHFPLFASWEPLPCLIEIEALLMQK

SEQ ID NO: 13402 - protein, 81 aa, Muntiacus muntjak
PCEPVTFEDVAVYFSQNQWASLDSAQRALYREVMLENYATVASLVSPFPRPDLISQLERGEAPWDPNPWEAEDLRGICPGG

SEQ ID NO: 13403 - protein, 81 aa, Muntiacus muntjak
DSLVFEDVAVNFTWEEWVSLDSSQKKLYRDVMLENFRNIVSVEFFDFLPSLAVWYGNQKLVFIQKKIPGEENDNPLQYSCL

SEQ ID NO: 13404 - protein, 81 aa, Gorilla gorilla
EPGAVSFADVAVYFCREEWGCLRPAQRTLYRDVMRETYGHLSALGIGGKKPALISWVEEEAELWGPAAQDPEVAKCPTQTD

SEQ ID NO: 13405 - protein, 81 aa, Sus scrofa
SEDLVTFGDVAVDFSQEEWEWLSPAQRHLYRKVMLENYRSLVSLAGVSASKPDVISLLEQGKEPWMMKKEGTRRACPVMWK

SEQ ID NO: 13406 - protein, 81 aa, Sus scrofa
SLVFEDVAINFTPEEWALLDPAQRRLYRDVMLETFKNLAFVGFCPRVKTTGSSPQWNILENKLCSDEKILRFIRNGSWSVF

SEQ ID NO: 13407 - protein, 81 aa, Sus scrofa
PPKGSLTLEDVAVDFTWEEWQLLTPDQKDLYRDVTLENHRNLVAVGYQALKPDALSRLERGELWPEEDEILGQICPEMRKD

SEQ ID NO: 13408 - protein, 81 aa, Mandrillus leucophaeus
FQDSVAFEDVAVSFTQEEWALLDPSQKNLYRDVMQETFKNLTSVGKTWKIQNMEDKYKNPRRNLSLMREKLFESKESHHCG

SEQ ID NO: 13409 - protein, 81 aa, Sus scrofa
FQDLVMFRDVTVDFSQEEWECLNSNQRNLYRDVILENYSNLVSLGGCSISKPDVITLLEQGKEPWMVVRDEKRRWSLDLES

SEQ ID NO: 13410 - protein, 81 aa, Sus scrofa
TQGLVTFKDVAVCFSQDQWSDLDPTQKEFYGEYVLEEDCGIVVSLSFPIPRLDEIAHIEEEERSTPDIPEPQEPDILSFTY

SEQ ID NO: 13411 - protein, 81 aa, Sus scrofa
FQAPVTFGDLAIYFSQEEWECLSPIQKDLYEDVMLENYQNLVSLGLSFRRPNVITLLEKGKAPWMVEPVKRRRGLDLGSKC

SEQ ID NO: 13412 - protein, 81 aa, Sus scrofa
QAQGTLTFDDVAVDFTWEEWQLLTPAQKDLFRDVMLENYRNLVAVGYQARSADVLSRLDRGEPRPVEADIHAHTRAETCKV

SEQ ID NO: 13413 - protein, 81 aa, Sus scrofa
EMLTFEDVALYFTREEWDTLGWAQKGVYREVMLANYRNMVSLGSTARFEVQEPTAKQNISEDFESCTMSLVKQKTARKPSE

SEQ ID NO: 13414 - protein, 81 aa, Sus scrofa
AGSTVTLKDLFIHFTQEEWEPLDEDQKHLYCNMMPENFALVISLRLTVSRSHIISQPELETYISNPHPSQHKKVHTTVRPV

SEQ ID NO: 13415 - protein, 81 aa, Neophocaena asiaeorientalis
MLENFALIASLGLTSFRSHVVAQLEMGAEPWVPDRVDMTSAMARGAYRGPGSDFCHGTEGEGSPAELSVSVEVSQDMNPKV

SEQ ID NO: 13416 - protein, 81 aa, Neophocaena asiaeorientalis
SRSLENDGVCFSEQEWENLEGWQKELYTNAMKSSYETLVSLKVLGRPEGEAELGTEMLGDLEEEDSRGVHPVEGVMIKQEI

SEQ ID NO: 13417 - protein, 81 aa, Bos mutus
GQSHVTFEDVAVYFSQEEWCLLDEAQIQLYLDVMLENFALVCMLGSWPGVGDEETPFEQSKSAGVSQIGSPRTDSSAEKVQ

SEQ ID NO: 13418 - protein, 81 aa, Neophocaena asiaeorientalis
WSQMPVTFEDVAVYLSREEWGRLDHTQQSFYRDILQKRNGLSLGAVEVGKEELAPSLGALGDMKSFKSRVGRAQGDASRCG

SEQ ID NO: 13419 - protein, 81 aa, Bos mutus
RLTFKDVAIEFTPEEWECLDLAQRALYREVMVETLRNLLSVDTSPKRVLKGSAPKQSSHTGGILQTMLSERHKSHDTKDQG

SEQ ID NO: 13420 - protein, 81 aa, Neophocaena asiaeorientalis
MLENYSSLVSLGYEVMKPGVILKLEHGEEPWTGDGEIPGSDSSEQVLQVNGHITWHKDNQEKLKNMKQDQECDALGKNFNL

SEQ ID NO: 13421 - protein, 81 aa, Bos mutus
QVSVTFDDVAVTFTQEEWGHLDPAQRTLYREVMLETCRLLMSLGCPVPRPELIYRLEHGQELWTVKRDLSRSTCAGRSQAV

SEQ ID NO: 13422 - protein, 81 aa, Neophocaena asiaeorientalis
ALESVTFRDVAVFFSRDEWLHLDSAQRTLYQEVMLENYSTLFSLGILFSKPKVILQLEQGEDPWMVENGVSQSTCLGWESL

SEQ ID NO: 13423 - protein, 81 aa, Bos mutus
MNQNICYSSILGKRVGVVIKKGCPFTKPDVIFKLEQEEEPWVMEEEVLKKHCPGEIWGMDEQLKIQDRLLTQLEDKFTKTL

SEQ ID NO: 13424 - protein, 81 aa, Nomascus leucogenys
MFQDSVAFEDVAVSFTQEEWALLDPSQKNLYRDVMQETFKNLTSVGKTWKVQSIEEYKNPRRNLSLMREKLCESKESHHCG

SEQ ID NO: 13425 - protein, 81 aa, Nomascus leucogenys
EMGPLTFMDVAIEFCLEEWQCLDTAQQNLYRTVMLENYRNLVFLGIAVSKPDLITCLEQEKEPWEPMRRHEMVAKPPVMCS

SEQ ID NO: 13426 - protein, 81 aa, Nomascus leucogenys
VTFADVAVNFTNEEWTLLDPAQRNLYRDVMLENSRNLAFIILPKRTFPEANRVCLTSISSQLSTLREDWRCPKTEEPHRQG

SEQ ID NO: 13427 - protein, 81 aa, Nomascus leucogenys
IMEEAVTFKDVAVVFTEEELGLLDPAQRKLYRDVMLENFRNLLSMGHQPFHRDTFHFLREEKFWMMGTATESEGNPGGKIQ

SEQ ID NO: 13428 - protein, 81 aa, Bos indicus
LQGSFSFEDLSVDFTQKEWQLLDPHQKDLYKDVMLENYSSLVSLGYEVMKPGVILKLEQGEDPWTGDGEIPSSASIDQVFQ

SEQ ID NO: 13429 - protein, 81 aa, Bos indicus
FQDTVTFKDVAIDFTQEEWKQLDPAQRNLYRNVMLENYNNLITVGCPFTKPDVIFKLEQEEEPWVIEEEVLKKHCPGEIWG

SEQ ID NO: 13430 - protein, 81 aa, Bos indicus
MKPMQLTQVLKYFPFTGYCFTKPELIFMLEQGEDPWLLEKEFINRSSPEEFQPDELLEESLENQGKALRQVLFINKSLTME

SEQ ID NO: 13431 - protein, 81 aa, Bos indicus
SLGSDLFRDVAAVFSQEEWEQLAPTQRDLYRDVMLETYSNLVSLGLAISKPDVISFLEQGKEPWTVEEVVTEGLCPVLQSR

SEQ ID NO: 13432 - protein, 81 aa, Bos indicus
SVTFEDVAVYFSWEEWALLDEAQRCLYHDVMLENFALTSSLGCWHGAEDKGAPSEKSISVEGVSQIKTLKADSCPQKGQPF

SEQ ID NO: 13433 - protein, 81 aa, Bos indicus
HQGSVTFEDVAMYFSWEEWCLLDEAQIQLYLDVMLENFALVCMLGSWRGVQDKETPSEEIAPAGVLQFRTPRAGLSPEKTQ

SEQ ID NO: 13434 - protein, 81 aa, Canis lupus
VKDSVTFKDVAIDFTLEEWRLMDPSQRNLHKDVMLENYRNLASLGLAVSKPDMISHLEDGKGPWVVVRELARTPYPELETI

SEQ ID NO: 13435 - protein, 81 aa, Canis lupus
QVLVTFKDVAVTFTREEWGQLDLDQKALYQEVMLETYGLLVSLGDDTKLQIRNPSTSPLVLSEGALLQGSLTQGSSGDSRL

SEQ ID NO: 13436 - protein, 81 aa, Canis lupus
AQGSVMFSDVSIDFSQEEWECLDPGQRDLYRDVMLENYSNLLSMGLYIPKPQVISLLEQGKEPWMVGRELTRGLCSDLESM

SEQ ID NO: 13437 - protein, 81 aa, Canis lupus
MLENYINLISVGYQTAKPSVTHKLEQGEEPWMVEREIPCGSYAEIWQLDDHMERNQENQETLLKHVAFTDQGTMTEEKSNK

SEQ ID NO: 13438 - protein, 81 aa, Muntiacus muntjak
CSELVTFRDVAVDFSQEEWDCLNPSQRHLYSNVMLENYRILVSLGLCFSKPSVILLLEQGKEPWMAKREMTKDLYSDWESM

SEQ ID NO: 13439 - protein, 81 aa, Muntiacus muntjak
SVMFSDVSIDFSLEEWEFLNLEQRDLYRDVMLENYSNLVSLGCFISKPDVISLLEQGKEPWKVVRQGRRQYPDLETNYEIK

SEQ ID NO: 13440 - protein, 81 aa, Ailuropoda melanoleuca
FKEAVTFKDVAVVFTEEELGLLDPAQRKLYGDVMLENFRNLISVGRQPLTPDVILQFERGEKFRMIKTATQGHSPSGDKNL

SEQ ID NO: 13441 - protein, 81 aa, Gorilla gorilla
MGPLQFRDVAIEFSLEEWHCLDTAQRNLYRDVMLENYRNLVFLGIVVSKPDFITCLEQGKKPLTMKKHEMVANPSETGFHH

SEQ ID NO: 13442 - protein, 81 aa, Ailuropoda melanoleuca
FEGSVSFEDVAVDFTRQEWHRLDPAQRTMHKDVMLENYSNLASVGLCVAKPEMIFKLERGEELWILEDESSGHGYPGSLSL

SEQ ID NO: 13443 - protein, 81 aa, Gorilla gorilla
KFQEMVTFKDVAVVFTREELGLLDLAQRKLYQDVMLENFRNLLSVGYQPFKLDVILQLGKEDKLWMMETEIQGDGCSGLTL

SEQ ID NO: 13444 - protein, 81 aa, Nomascus leucogenys
QEPLSFKDVAVVFTEEELELLDSTQRQLYQDVMQENFRNLLSVGERSPLGDKNGKDMEYIQDEELRFFSHKELSSCKIWEE

SEQ ID NO: 13445 - protein, 81 aa, Nomascus leucogenys
SLKKVTFEDVAIDFTQEEWAMMDTSKRKLYRDVMLENISHLVSLGYQMSKSYIILQLEQGKELWREGREFLQGQNPDRESA

SEQ ID NO: 13446 - protein, 81 aa, Nomascus leucogenys
SKGPVMFRDVSIDFSQEEWECLDAGQMNLYKEVMLENFSNLVSVGLSNSKPAVISLLEQGKEPWMVDRELTRGLCSDLESM

SEQ ID NO: 13447 - protein, 81 aa, Nomascus leucogenys
TPFSCLSLLSSWDYSSGFSGFCASPIEESHGALISSCNSRTMTDGLVTFRDVAIDFSQEEWECLDPAQRDFFLHWKLQGYL

SEQ ID NO: 13448 - protein, 81 aa, Bos indicus
QKRKEQESGMALSQAQLTFKDVFIDFTPEEWECLDPAQRTLYKDVMVETLGNLLSVGSSVSDLNIISILVAQGRRPLDCGE

SEQ ID NO: 13449 - protein, 81 aa, Nomascus leucogenys
TEGRVVFEDVAIYFSQEEWGHLDEAQRLLYRDVMLENLALLSSLGSWHGAEDEEAPSQQGFSVGVSEVTTSKPCLSSQKVH

SEQ ID NO: 13450 - protein, 81 aa, Bos indicus
RLTSEDVAIEFTQEEWEFLDPAQRALYRDVMLETYRNLLSVDISPTHVIKHLQPKGNSDKREIFQTLMLGRPESCEIKHFH

SEQ ID NO: 13451 - protein, 81 aa, Bos indicus
PQGLLTFGDVAVHFTQEEGARLDAGQRTLYRDVMLETYRNLVSLGVPESKPDLISQLEQGREPWGSDLLGAQEAETAGNAG

SEQ ID NO: 13452 - protein, 81 aa, Bos indicus
QSQLTLNDVAIHFSPEEWECLDPAQKALYVDVMLDTFRNLLSVDISHLYIWKLQLKSHADRGGVCRTVIWGRNEIPETKHF

SEQ ID NO: 13453 - protein, 81 aa, Bos indicus
PQVSVNFEDVAVTFSWEEWGLLDETQRCLYRDVMLENLALITSLGCCHEVENKKTSFEQNVSFQRMSQIRTPKADLSSKEA

SEQ ID NO: 13454 - protein, 81 aa, Bos indicus
PLESVTFGDVAIDFTQEEWSLLDKSQKNLFRNVMLETVTHLVSAGAQISKSDVVFQLEQGKELWTQAAGGLQGQSPVPFRS

SEQ ID NO: 13455 - protein, 81 aa, Canis lupus
MLENCGLLVSLGCPVPRPELLYQLKHGQELWMVKKDLCQSTYPGDKGKPKTIELTTCEPALNKSPEGPLFQELKQGDPGNF

SEQ ID NO: 13456 - protein, 81 aa, Canis lupus
HQELVTFKDVAVYFTQTEWAGLSPAQKALYRSVMLENYGNLTSLGYPVPRPALVSLLEGGNLPWGLEAQNNPSAERSKGIC

SEQ ID NO: 13457 - protein, 81 aa, Canis lupus
MWENYSNFISLEPSISKPDVITLLDEGKEPWMVVREETKRHYSDLESRYRTNTLSPEKDIYEIYSFQWEIMERIKSYSLQD

SEQ ID NO: 13458 - protein, 81 aa, Canis lupus
MQENYGHLISVGYHVNKPNAVFKLKQGKQPWILEVEFPHWNSPEDLWKIHDLGARYQESRTENSRNGELTKKQQTHAREKI

SEQ ID NO: 13459 - protein, 81 aa, Canis lupus
SQGLLTFRDVAIEFSQEEWGCLNHTQRELYRDVMLENYGHLLFLGLVVWKPDLVIFLEQEKELWDVKRKETIDFHPAVSSS

SEQ ID NO: 13460 - protein, 81 aa, Canis lupus
SRSLENDGVCFSEQEWENLDDWQKELYRNVMKSNYETLVSLKVLGQPEGEAELGAGMLGDLEEEGPGDVNPAEGVLIKQEI

SEQ ID NO: 13461 - protein, 81 aa, Canis lupus
PMLSSSWQGSGTFEDVAVYFSWEEWELLDEAQRHLYCKVMLENLALVASLGKAFPPLPSPPASVLVSVLLLFPGIALSSYS

SEQ ID NO: 13462 - protein, 81 aa, Muntiacus muntjak
TQEPVTFNDVAVDFTQEEWGQLDLVQRTLYRDVMLETYGHLLSVGNQIAKPEVISLLEQGEEPWSMEPAYPLQGTCPEWMK

SEQ ID NO: 13463 - protein, 81 aa, Muntiacus muntjak
LQGGVTFEDVAVALTQEEWQRLSPEQRDLYKDVTLENFRNLVSVGGEEAAKPEVILRLENGEEPWTVETQGLRSCGPAEKD

SEQ ID NO: 13464 - protein, 81 aa, Canis lupus
SEESVTFKDVAVDFTQEEWGQLDSPQRALYRDVMLENYQNLLALGPPVCKPDVISHLERGEEPWWMPGEVPGGACSGGEPG

SEQ ID NO: 13465 - protein, 81 aa, Canis lupus
SVTFKDVIVDFTQEEWKQLDPFQRDLFRDVTLENYTHLVSIDCETRPENSVSVPELDVSEEQPSDEAIVEKHKRDDPCSSN

SEQ ID NO: 13466 - protein, 81 aa, Muntiacus muntjak
QEPVIFKDVAVEFSKEEWGQLDPAVKTLYRHVMLENYRNLNSLQEGDHLLSKPVESSKLESKKESWIMEQEIPRTAVVDRE

SEQ ID NO: 13467 - protein, 81 aa, Ailuropoda melanoleuca
SQESVTFQDVAVDFTEKEWPLLDSSQRKLYKDVMLENYSNLASVGYQVGKPSLISHLEQEEEPRTEERAPHRATSPDWEAP

SEQ ID NO: 13468 - protein, 81 aa, Ailuropoda melanoleuca
QAPVTFEDMAMYLTREEWRPLDPTQRDLYRDVMQENYGNVVSLDFEIRSENEVNPKQEISEDVEFGTASERPVGNTEENPE

SEQ ID NO: 13469 - protein, 81 aa, Gorilla gorilla
PGQHVSFEDVTVDFSREEWQHLDPAQRRLYWDVTLENYSHLLSVGYQVPKSEAAFKLEQGEGPWMLEGEAPHQSCSGEAIG

SEQ ID NO: 13470 - protein, 81 aa, Gorilla gorilla
KKKPVTFEDVAVNFSQEEWDCLDASQRVLYQDVMSETFKNLTSVARIFLHKPELITKLEQEEEQWREFVHLPNTEGLSEGK

SEQ ID NO: 13471 - protein, 81 aa, Gorilla gorilla
EKGPLTFRDVAIEFSLEEWQCLDTAQQDLYRKVMLENYRNLVFLGIAVSKPDLITCLEQGKEPWSMKRHAMVDEPPVIYSH

SEQ ID NO: 13472 - protein, 81 aa, Ailuropoda melanoleuca
LFQMPVTFEDVALYLSREEWGRLDHAQQNFYRDVLQKRNGLSLGFPFSRPFWASQGQGKGETSSSCRQMGDEEKTGAIEVG

SEQ ID NO: 13473 - protein, 81 aa, Gorilla gorilla
MFKEAVTFKDVAVVFTEEELGLLDVSQRKLYRDVMLENFRNLLSVGHQPSHRDTFHFQREEKFWIMETATQREGNSGGKIQ

SEQ ID NO: 13474 - protein, 81 aa, Gorilla gorilla
CEASVSFEDVTVDFSREEWQQLDPAQRCLYRDVMLELYSHLFSVGYHIPNPEVIFRMLKEKEPRVEEAEVSYQRGQERDFG

SEQ ID NO: 13475 - protein, 81 aa, Gorilla gorilla
FQASVSFQDVTVEFTQEEWQHMGPVERTLYRDVMLENYSHLVSVGYCFTKPELIFTLEQGEDPWLLEKEKGFLSRNSPEDS

SEQ ID NO: 13476 - protein, 81 aa, Ailuropoda melanoleuca
FQVPLTFSDVAIDFSQEEWECLNSDQKDLYRDVMLENYTNLVSLDFDFTTETNKLSSEKSSYEVNSYHQETMKRSKIFNPT

SEQ ID NO: 13477 - protein, 81 aa, Ailuropoda melanoleuca
KGLLTFEDVAVFFTQEEWDYLDPAQRSLYKDVMMENYGNLVSLDVLNRDKDEEPTVKQEMEEIEEEVEPQGVIVTRIKSEI

SEQ ID NO: 13478 - protein, 81 aa, Nomascus leucogenys
QGRLTFRDVAIEFSLAEWKFLNPSQRALYREVMLENYRNLEAVDISSKRLKKEVLSTGQGNTEVFHSGTLQRHESYHIGDF

SEQ ID NO: 13479 - protein, 81 aa, Nomascus leucogenys
TFKEGLTFKDVAVVFTEEELGLLDPVQRNLYRDVMLENFRNLLSVGHHPFKHDVFPLEKEKKLHMMKTAAQRKGKSADKIQ

SEQ ID NO: 13480 - protein, 81 aa, Nomascus leucogenys
KEGVNFKIVTVDFTQEEEGTWNPAQRTLDRDVILENDRDLVSWDLATAVGKKDSTSKQRIFDEEPANGVKIERFTRDDPWL

SEQ ID NO: 13481 - protein, 81 aa, Nomascus leucogenys
NIVIVTFDDVAFYFSEQEWEILEKWQKQMYRQEMKTNYETLDSLGYAFSKPDLITWMEQGRMLLISEQGCLDKTRRTISPP

SEQ ID NO: 13482 - protein, 81 aa, Nomascus leucogenys
IWGPLSFMDVFVDFTWEEWLLLDPAQKCLYRSVMLENYSNLVSLGYQHTKPDVIFKLEQGEELCMVQAQVPNQSCPILKAG

SEQ ID NO: 13483 - protein, 81 aa, Nomascus leucogenys
CLTNCYQDSVTFDDVAVDFTQEEWTLLDSTQRSLYSDVMLENYKNLATVGGHIIKPSLISWLEQEESRTVNGGVLQGEGTL

SEQ ID NO: 13484 - protein, 81 aa, Nomascus leucogenys
SYEGSVSFRDVAIDFSREEWRHLDLSQRNLYRDVMLETYSHLLSVGYQVPEAEVVMLEQGKEPWALQGERPRHSCPGEKLW

SEQ ID NO: 13485 - protein, 81 aa, Nomascus leucogenys
AQVSVTFDDVAVTFTKEEWGQLDLAQRTLYQEVMQENCGLLVSLGCPVPRPELIYHLEHGQEPWTRKEDLSQGTCPGDKGK

SEQ ID NO: 13486 - protein, 81 aa, Nomascus leucogenys
AQSSVTFEDVAVNFSMEEWSLLNEAQRCLYRDVMLETLTLISSLGCWHGGEDEAAPSKQSTCIYIYKEQGGHSGERPYECG

SEQ ID NO: 13487 - protein, 81 aa, Bos indicus
MWENYRNLLSVGYQSPKPIEIFKLKQGDKPWIERGNIHDPEVGDPMQQSLEIQYKHKNMERGHELSSLGNIFCLHGNLVTL

SEQ ID NO: 13488 - protein, 81 aa, Bos indicus
SHTLVTFKDILVNFTREEWKLLDTAQQIMYKDVMLENYRNLVSLGHQLPKPDVILRLEKGEEPWLVEREIHQETQPDAETS

SEQ ID NO: 13489 - protein, 81 aa, Bos indicus
EEGQVTFEDVAVYFSWEEWGLLDEAQRLLYCGVMLETFSLMASLGLTPSRTHAMTQLEQRGEPCVPTGGVSTTATPAGCWC

SEQ ID NO: 13490 - protein, 81 aa, Bos indicus
FKGSVTLQDVAVEFTPEEWQLLDCDQRTLYWDVMLENFRNLISVGCPVTETTVIFKVEQGQGPWMVEGENSRWSSPEADCP

SEQ ID NO: 13491 - protein, 81 aa, Bos indicus
PKVPVTFDDISIYFSTPEWEKLEEWQKELYKNIMKGNYESLISMDYAMNQPDVLSQIQPEGDRNTEDQTGPEESGIPTDPS

SEQ ID NO: 13492 - protein, 81 aa, Bos indicus
SQESVTFRDVSIDFSREEWEWLQPAQRDLYRHVMLENYGHLVSLAGLNMSKPDVVSLLEQGKEPWLGNGDVSRELFPASKS

SEQ ID NO: 13493 - protein, 81 aa, Bos indicus
WGSLVAFEEVAMHFSREEWELLDEAQRQLYHAVMLETLELVTSLGCWPVVEDEEVPSEKNASGEVVSQVKTPSVPPSMQKA

SEQ ID NO: 13494 - protein, 81 aa, Bos indicus
ARLSVTFDDVAVTFTQEEWGHLDPAQRTLYQEVMLENCGLLVSLGCPVPRPELIYRLEHGQELWTVARDLSRSTCAGDKGK

SEQ ID NO: 13495 - protein, 81 aa, Bos indicus
LQEPVTFRDVAVDFTQEEWGQLGPAQRTLYRDVMLETFGHLLSVGPELPKPDVISQLEQGAELWVAERGLAQGCRPGQEAA

SEQ ID NO: 13496 - protein, 81 aa, Canis lupus
ELVTFRDVVISFSQEEWEYLDSAQRDLYWDVMMENYSNLVSLDLESKYDTKCLSTGKDVENNGSQGKVTENKFIGLESCIF

SEQ ID NO: 13497 - protein, 81 aa, Muntiacus muntjak
VSVTFEDVAVLFTRDEWRKLAPPQRNLYQDVMLENYSNLVSLGWKNSYKTTKSTQTQGHSFQELIMKRSKRSGPGDFKSEK

SEQ ID NO: 13498 - protein, 81 aa, Canis lupus
KSVGPVSFKDVAVDFTQEEWQQLDPEQKTTYRDVMLENYNHLVSVEVWKADDLVERVQENEGKYSKQAVSFNSKTLIEERG

SEQ ID NO: 13499 - protein, 81 aa, Canis lupus
WSQMPVTFEDVALYLSREEWGRLDHTQQSFYRDVLQKRNGLALGFPFSRPFWTSQGQGKGEASSSCQQMGDEEEEKTGTCR

SEQ ID NO: 13500 - protein, 81 aa, Canis lupus
ENFSIIMRDVAVEFSPEEWRCLNHTQRELYRDVMLENYGHLLFVGLIVSKPDLVSFLEQRKEPWDLKTKKTVAIHPVLFCL

SEQ ID NO: 13501 - protein, 81 aa, Muntiacus muntjak
MGPITFRDVVIEIFLHEWEFLNSLQKKLYRDVMMENYSNLVSLGHSISKPDIIVLLEEGRNPWMVVRKEARSWHTDLYRSP

SEQ ID NO: 13502 - protein, 81 aa, Muntiacus muntjak
SGETLTFRDVFVDFTQEEWQQLDAAQKNLHRDVMLENYSHLVSVEFWKVNDQTDNHKESQDKPLWQAASIDKETLKDKSGQ

SEQ ID NO: 13503 - protein, 80 aa, Muntiacus muntjak
MGRLMFRDVAIDFTQEEWECLDLGQRDLYRDVMLETYGNLASLGLVVSKPDLVTFLEQMKNPWDVRRTVTTATYPENANL

SEQ ID NO: 13504 - protein, 81 aa, Muntiacus muntjak
GSMMFRDVSVNFSQEEWKCLDSGQMNLYKEVMLENFSNLVSVGLSSSKPAVISLLEQGKEPWMIDRELTRGLCSDLESMCE

SEQ ID NO: 13505 - protein, 81 aa, Muntiacus muntjak
IPPLVTFEDVAVYFSWEEWGLLDETQRLLYHGVMLETFSLMASLGLTSFRTHDMTQLEQRGEPCVPAEGVSATATPAGCWC

SEQ ID NO: 13506 - protein, 81 aa, Crocuta crocuta
MAFEDVAVYFSQEEWALLDAAQRALYCHVMLENFALVSSLGLSASRPRVVMRLERGEEPWVVSGTVATAARNAQRKPSPGE

SEQ ID NO: 13507 - protein, 81 aa, Muntiacus muntjak
TAGSVTFNDVTMAFTRKEWEQLDPAQKSLYKDVMLENYSNLASMGYQALKPDMISKLEKGEEPWLGKGKRPKQGGWSEIAR

SEQ ID NO: 13508 - protein, 81 aa, Gorilla gorilla
GLRSVMFSDVSIDFSPEEWEYLDLEQKDLYRDVMLENYSNLVSLGCFISKPDVISSLEQGKDMCLLSYLESRYRTNTLSPE

SEQ ID NO: 13509 - protein, 81 aa, Canis lupus
AQGSLTLEDVAVDFTWEEWQLLAPAEKNLYRDVMLENYRNLVSVGYQARKPDVLSKLEQGEEPWAKQKEVLHGTRPETSKV

SEQ ID NO: 13510 - protein, 81 aa, Gorilla gorilla
MWLSWNTAQKDLYQDVMVENSNHLVSLGYQTSKPDALSKLAHGREPLKTDAKVQNKNCPGIRKVDSHLQEHSPNHMQQCSG

SEQ ID NO: 13511 - protein, 81 aa, Ailuropoda melanoleuca
NRNIVTFEDVCVYFSPEEWELLDESQKRLYCSVILENFLLVTSLGLAISRVENEGASSQQGISVKESQARILSVGPSNQKS

SEQ ID NO: 13512 - protein, 81 aa, Gorilla gorilla
LTFKDVAVVFTEEELGLLDPVQRNLYQDVMLENFRNLLSVGHHPFKHDVFLLEKEKKLDMMKTATQRKGKSADKIQSEVET

SEQ ID NO: 13513 - protein, 81 aa, Ailuropoda melanoleuca
CQESVTFEDVAVIFTDEEWRHLVPIQRDLYKEVMLENYKSIVSLGLPVPRPDVIFQLKRGDEPWVVDLHGSEERECPENVS

SEQ ID NO: 13514 - protein, 81 aa, Ailuropoda melanoleuca
QSLVTFGDVAVDFSREEWEWLNSAQRTLHRDVMLENYRNLVSLGLCVSKPDMISSLEQRKEPWMLKRKLTRGRCPDLKTMQ

SEQ ID NO: 13515 - protein, 81 aa, Sus scrofa
SRSLESDGVCFSEQDWENLEGWQKELYANVMRSNYEALVSLKVLGQPEGEAELGTEMLGDLEEGEGPGGDHPAEGRLMKQE

SEQ ID NO: 13516 - protein, 81 aa, Sus scrofa
MIKSQISFEDVAVDFTLEEWQLLNPTQKNLYRDVMLENYSSLVFLGYQIIKPDTIFKLEQEDPWILDEEILSQSFPEEVWL

SEQ ID NO: 13517 - protein, 81 aa, Sus scrofa
SQESVTFEDVAVDFTQEEWALLNSSQRKLFRDVMLENISHLVSIGNQLHKSDVISHAEQEEQLSREGLGFLQGQSPVISGR

SEQ ID NO: 13518 - protein, 81 aa, Bos mutus
TYPNGVLDADAGRASPPSWTVGRMAARGAPCSRCSPASVEGFQGYGVSVSKPDVISLLEQGKEPWMVKEEGPRGACPGWEY

SEQ ID NO: 13519 - protein, 81 aa, Bos mutus
QAPVTFEDMAMYLTREEWRPLDPTQRDIYRDVMQENYGNVVSLVVQPKECLLERWKHGSTKKKTKQVSCPNKFGNRLNNVY

SEQ ID NO: 13520 - protein, 81 aa, Bos mutus
LQETLTFRDVFVDFTQEEWQQLDAAQKNLHRDVMLENYSHLVSVGYLVAQPNGIFRLGQGEEEARIAAGESVIWSCPGRSP

SEQ ID NO: 13521 - protein, 81 aa, Nomascus leucogenys
RDVTIEFSLEEWEFLKPAQQNLYRKVMLENYRNLVSLGLTVSKPELISCLEQRQEPWNVKRHETIAKPPAISSHYPEDFLP

SEQ ID NO: 13522 - protein, 81 aa, Bos mutus
SQSLLKFEEVAIYFSQEEWELLDPTQKALYNGVMHENYKTVIFLALFVLPKPKVISYLEQEEKPYIQGSPVFKDNPGDLLS

SEQ ID NO: 13523 - protein, 81 aa, Neophocaena asiaeorientalis
VKESVTFKDVAIDFTLEEWRLMDPTQRKLHKDVMLENYRNLVSLGLAVSKPDMISHLEDGKGPWVVVRETSKTPSSELETK

SEQ ID NO: 13524 - protein, 81 aa, Nomascus leucogenys
VHGSVTFRDVAIDFSQEEWECLQPDQRTLYRDVMLENYSHLISLGSSISKPDVITLLEQEKEPWMVVRKETNRRYPDLESK

SEQ ID NO: 13525 - protein, 81 aa, Nomascus leucogenys
VAFEDVAIYFSQEEWELLDEMQRLLYCDVMLENFAVMASLGCWCGAEDEGAPSAESVSVEELSQGRTPKADISTDKSHSCE

SEQ ID NO: 13526 - protein, 81 aa, Bos indicus
VVFEDVAVDFTQEEWALLNLAQRNLYRDVMLENFRNLASLGFEIQLKINESVAPQDAYGKISNEQDVAGFKASDSSLSILH

SEQ ID NO: 13527 - protein, 81 aa, Bos indicus
WSQMPVTFEDMALYLSREEWGRLDHTQQSFYREVLQKRSGLSLGVVEVDKEELAASLGALGDAKSFKSRMARAQGEAPRCG

SEQ ID NO: 13528 - protein, 81 aa, Bos indicus
LQGGVTFEDVAVDFTQEEWQRLSPEQRDLYRDVTLENYRNLVAMGEQDSTKPEVILRLENGEEPWMVGTQELRSCSPAAKD

SEQ ID NO: 13529 - protein, 81 aa, Canis lupus
LQDSVTFKDVAVDLTQEEWTLMDRSQRKLYIDVMLENITHLVSVGCQFFQSDMIAQWEQGGELWKEERGLAQGWGPVISGL

SEQ ID NO: 13530 - protein, 81 aa, Canis lupus
MLENYSNLVFLGYHIIRPDAIFKREQEEPWMVQKEVLSQSFAEEVWLDNSLKMWHQDNQDKLRSMERGHEYDVFRKIFHSS

SEQ ID NO: 13531 - protein, 81 aa, Muntiacus muntjak
GSVSFKDVTVDFSQEEWQHLDPAQKTLYMDVMLENYCHLISVGCHMTKPDVILKLERGEEPWTSFKGHTCLEENWKTEDFL

SEQ ID NO: 13532 - protein, 81 aa, Muntiacus muntjak
LQEPVTFRDVAVDFTQEEWGQLGPAQRTLYRDVMLETFGHLLSVGPELPKPDVISQLEQGAELWVAEGGLAQGCRPGQETG

SEQ ID NO: 13533 - protein, 81 aa, Gorilla gorilla
QGRLTFRDVAIEFSLAEWKFLNPAQRALYREVMLENYRNLESVDISSKRMMKEVLSTGQGNREVIHTGTLQRHESHHIGDF

SEQ ID NO: 13534 - protein, 81 aa, Ailuropoda melanoleuca
SVGPVSFRDVAVDFTQEEWQQLEPEQKTTYRDVMLENYRHLVSVGCHIIKPEVIIKLEQGEEPWIVEGEFLPQSYPGVLVQ

SEQ ID NO: 13535 - protein, 81 aa, Ailuropoda melanoleuca
PKVPVTFDDVAVYFSEPEWGKLDNWQKELYKHVMRGNYEMLVSLDYAISKPDILTRLERGEDPCPEGPWGQEERSKKEAAR

SEQ ID NO: 13536 - protein, 81 aa, Ailuropoda melanoleuca
GCVTFEDMAIYFSQEEWVLLDEAQRHLYHDAMLENFALIASLVCWHGMEDEEAPFEQSVAGEVLLWVRTPKAGLSTQKTRP

SEQ ID NO: 13537 - protein, 81 aa, Ailuropoda melanoleuca
PQAKVTFEDVAVLLSQEEWDRLGPAQRGLYRHVMMETYGNVVSLAGLPGSKPNVISQLERGEEPWVLDGQGAEKTRGLGSG

SEQ ID NO: 13538 - protein, 81 aa, Ailuropoda melanoleuca
PVAFEDVAVNFTLEEWALLDPSQKKLYRDVMQETLRNLASIGKKWKDHSIEDQYKNQGRKLSHVVEALCQSKEGSQCGGNF

SEQ ID NO: 13539 - protein, 81 aa, Bos mutus
MFQESLTFQDVAVDFTREEWDQLYPAQKNLYRDVMLENYRNLVALGHQLYKPEVITQLEQEEQWMMGRVSPLDTHPENTEV

SEQ ID NO: 13540 - protein, 81 aa, Bos mutus
VTFKDVAVDFSMEEWELLDPGQRKLYRDVMLETCGNLASVELVLSRDSIGRHFYDYDLAIASLVSDPFLNHHQMGYPDQRP

SEQ ID NO: 13541 - protein, 81 aa, Neophocaena asiaeorientalis
AQLTFKDVAIEFSQEEWECLDPAQRALYRDVMLETYRNLVSLDISHVHVIKKLQLNANTDRAEVFQTLILGRHEKIKHFYL

SEQ ID NO: 13542 - protein, 81 aa, Nomascus leucogenys
ASAAVSVTFKHVTMAFTQKEWKQLDPAQRNLYNDVMLENYSNQASMAPKPDMISKLEKGEAPWLGKRKRPSQGCSSKIARY

SEQ ID NO: 13543 - protein, 81 aa, Nomascus leucogenys
DSVTFEDVAVDFTQEEWTLLDQTQRNLYRDVMLENYKNLVAVDWESRINTKWSAPQENFLQGKTSSVVEMERNHFGEELFD

SEQ ID NO: 13544 - protein, 81 aa, Nomascus leucogenys
PQASVCFEDVAMAFTQEEWEQLDLAQRTLYREVTLETWEHIVSLGLFLSKSDVISQLEQEEGLCRAEQVAPRGARPSKEQR

SEQ ID NO: 13545 - protein, 81 aa, Nomascus leucogenys
EMGLLTFRDVVIEFSLEEWQFLDHAKQNLYRDVMLENYRNLVSLGIAVSKPDLITCLEQNKEPWNIKRNEMVTKHPVTCSH

SEQ ID NO: 13546 - protein, 81 aa, Nomascus leucogenys
QLTFRDVAIEFSQEEWKCLNSTQRTLYRDVMLENYRNLVSLDLSRNCVIKELAPQWESNTGEVFHTVTLEQHEKHDIEEFC

SEQ ID NO: 13547 - protein, 81 aa, Nomascus leucogenys
PKVPVTFDDVAVYFSELEWGKLEDWQKELYKHVMRGNYETLVSLDYAISKPDILTRLERGEEPCPDRWGQEKGNEVEVGHP

SEQ ID NO: 13548 - protein, 81 aa, Nomascus leucogenys
SQSLLTFRDVAIEFSQEEWKCLDPAQRTLYRDVMLENYRNLVSLGSCCVVEVGLDLLGSRHPPWPPKKLGLQAPTPVPNYW

SEQ ID NO: 13549 - protein, 81 aa, Bos indicus
ELVTFRDVVISFSQEEWEYLDSAQRDLYWDVMMENYSNLVSLDLESKYDTKTLSVDKVILEKNNSQWEVIENSKLVGLQNS

SEQ ID NO: 13550 - protein, 81 aa, Bos indicus
MMKSQISFEDVAVNFTLEEWQLLNPTQKTLYRDVMLENYSNLVLLGYQVIKPEMIFKLEQENPWLLDEEILSQNFSEKVWL

SEQ ID NO: 13551 - protein, 81 aa, Bos indicus
AQVVVTFKDVAVTFTREEWGQLDLGQRTLFREVMLETCGLLVSLGHPIPKPELIHLLEHGQKLWTGTRGLPHSTSPGDRPK

SEQ ID NO: 13552 - protein, 81 aa, Bos indicus
MDSVVFEDVAVNFTLEEWALLDPGQRKLYRDVMLETCRNLASVVKTRSSTQCDILKNELCSEEKKVRFPRNDSWSVFGENW

SEQ ID NO: 13553 - protein, 81 aa, Canis lupus
NQESLTFDDVAVDFTWEEWQLLAPAQKDLYWDMMLENYRNLVSVGFHTSKPDVLSKLDQGEPTWTVENEIPCRTRSEIWKL

SEQ ID NO: 13554 - protein, 81 aa, Muntiacus muntjak
RVSPVTFEDVAVYFSQEEWRLLGEAQKFLYRDVMLETFALVLSLGCCHTAEDEQTPSEQNFSVEVPQRNTKKTDLSSQKIC

SEQ ID NO: 13555 - protein, 81 aa, Muntiacus muntjak
TLSDLVSFKAVTVVFTWEEWQLLDSLQKNLYQDVMLENYINLESVGYHVTKAHAFYQLQQEAPWITGKNPEDWHEVNHGNL

SEQ ID NO: 13556 - protein, 81 aa, Canis lupus
MLENYSHLVSLGLNISKPYVVSLLEQGKGPWLEKGDVRRDLFSESHGEIKEFSPNNVICEDDSSQYLVVERILNQDPDHSS

SEQ ID NO: 13557 - protein, 81 aa, Gorilla gorilla
VHGSVTFRDVAIDFSQEEWECLQPDQRTLYRDVMLENYSHLISLGSCISKPDVVTLLEQEKEPWIVVSKETSRWYPDLESK

SEQ ID NO: 13558 - protein, 81 aa, Gorilla gorilla
VAFEDVAVNFTQEEWALLDISQRKLYREVMLETFRNLTSEGKKWKDQNIEYEYQNPRRNFRSLIEEKVNEIKEDSHCGETF

SEQ ID NO: 13559 - protein, 81 aa, Ailuropoda melanoleuca
QGSVLFEDISVDFTQKEWQLLNPAQRLLYKEVMLENYRQLVSLGHCVTKPELVLKLEQGEEPWAPKRELPSQSRPEIQKAN

SEQ ID NO: 13560 - protein, 81 aa, Gorilla gorilla
MLENYGNVASLGFPLLKPAVISQLEGGGELGGPSPLAAGTGLQGLQTVDIQTDNDLTKEMYEGKENVSFELQRDFSQETDF

SEQ ID NO: 13561 - protein, 81 aa, Ailuropoda melanoleuca
QGCVTFEDVFVYFSREEWELLEEAQRVLYRDVMLENFALVSSLGRWRVTDDEETPSEQSISVGVSRLRTPESGAFIQKAHP

SEQ ID NO: 13562 - protein, 81 aa, Gorilla gorilla
AQEPVTFRDVAIYFSREEWACLEPSQRALYRDVMLDNFSSVAALGFCSPRPDLVSRLEQWEEPWVEDWERPELQAVQRGPR

SEQ ID NO: 13563 - protein, 81 aa, Ailuropoda melanoleuca
IAASEILCNHLVMFRDVAVDFSQEEWECLNSYQRNLYRDVILENYSNLVSVAGCSISKPDVITLLEQGKEPWMVVRDERRR

SEQ ID NO: 13564 - protein, 81 aa, Ailuropoda melanoleuca
QVTFDDVAVDFTQEEWGLLGPAQRTLYHDVMLETLRHLVTVEWEKRPKSQQLPPTEAFSGKELPSSMNLTRSAVDDCWHST

SEQ ID NO: 13565 - protein, 81 aa, Ailuropoda melanoleuca
MFKEAVTFKDVAVAFTEEELGLLDSSQRKLYQDVMLENFRNLVSVGHQPFKRDKWHIEREERLWLMKTATQIERNVGGNNQ

SEQ ID NO: 13566 - protein, 81 aa, Ailuropoda melanoleuca
KKNKSQGSISFEDVTVNFTQEEWGQLDPDQRALYRDVMLENYSIFISLGHCITKPGEILKLEQEAPWVLEKECASQCHPDE

SEQ ID NO: 13567 - protein, 81 aa, Neophocaena asiaeorientalis
WLTFKDVVIEFSQEEWECLDPAQRALYRDVMLETYRNLISVDICPIHVVKQLQPKGNSDPGEVFQRVILGRSKSHEIKHFY

SEQ ID NO: 13568 - protein, 81 aa, Neophocaena asiaeorientalis
EMDSVTIEDVAVDFTLEEWALLGPSQRKLYRDVMQETLRNLAAVGAKREYHDIEDQYKNQGRKLRTFMVERFCKSKDISLC

SEQ ID NO: 13569 - protein, 81 aa, Neophocaena asiaeorientalis
EGSVTFEDVAVNFSLEEWGLLDEAQRCLYHDVMLENLALTTSPGCWHGEEDEEALSEQTISDQGSSQIRIVKAGLSPQKAN

SEQ ID NO: 13570 - protein, 81 aa, Neophocaena asiaeorientalis
SQGLLSFNDVAVDFTWEEWQLLDIVQKNLYRDVMLENYSNLMSLGYQVTKPEPVMHLEKGEEKEKAVVEREFPSQCGPERP

SEQ ID NO: 13571 - protein, 81 aa, Neophocaena asiaeorientalis
SQGPVSFEDVAVDFTQEEWQQLDPAQRTLYRDVMLENYSHLVSVGYPVSKPGVISKLEQGEEPWIMKRDISNWIYPDRETR

SEQ ID NO: 13572 - protein, 81 aa, Neophocaena asiaeorientalis
MFQVTFSDVAIDFSHEEWGWLDPTQRNLYKDVMVQNYENLVSLAGLSIPKPYVIALLEDGKEPWMVEKKLSKSLFPDWKSR

SEQ ID NO: 13573 - protein, 81 aa, Bos mutus
KSWGPLSFMDVFVDFTWEEWQLLDSAQKHLYRSVMLENFRNLVSLGYQYTKPSIIFQLEQEELWMMHSPSQGHSDEVWEID

SEQ ID NO: 13574 - protein, 81 aa, Bos mutus
LTIEDVDIKFTPEDWECLDPAQRALYRDVMVETYRNLLSVGEDHFPVKLDSDVSRIDMTMKLQAKGNSGKGEIFQRVIFGR

SEQ ID NO: 13575 - protein, 81 aa, Nomascus leucogenys
MIQAQVMMENYSNLVAVGYQPSKPDALFKLEQGEQPWTTEDGIHSGACSDIWKVDDHVLERLQSESLVDRRKRCHEHDAFE

SEQ ID NO: 13576 - protein, 81 aa, Nomascus leucogenys
SVAFEDVAVTFTQEEWALLDPSQKNLYRDVMQETFKNLASIGKKWKAQNIYVEYKNLRRNLRIVGERLFESKEGHQHGEIL

SEQ ID NO: 13577 - protein, 81 aa, Nomascus leucogenys
FQEMVTFKDVAVVFTEEELELLDSVQRKLYRDVMLENFRNLLLVAHQPFKPDLISQLEREEKLLMVETEAPRDGCSGRKNQ

SEQ ID NO: 13578 - protein, 81 aa, Bos indicus
EELPVVFEDVAVYFTREEWGALDKWQKELYRDVMQMNYELLASLGPAAAKPDLISKLERRAAPWIRDPHGPKLGKGRPPPG

SEQ ID NO: 13579 - protein, 81 aa, Canis lupus
SQGPVSFRDVAVDFTQEEWQQLEPNEKTIYRDVMLENYSHLVSVGYDSTKPKVILKLEQGEEPWVAEGELPCQSHLEVWKV

SEQ ID NO: 13580 - protein, 81 aa, Canis lupus
SRTLVTFKDILVNFTREEWKLLDSSQQIMYKDVMLENYKNLISLGHQLPKPDVILQLEKGEEPWLVERVIHRETHPDLETA

SEQ ID NO: 13581 - protein, 81 aa, Muntiacus muntjak
PVTFDDVAVYFSQEEWRLLGEAQRLLYHDVMLENFTLVASLGCWHTAENVSVEVPQRNTKKTDLSSQKICPWEMGNLALEG

SEQ ID NO: 13582 - protein, 81 aa, Ailuropoda melanoleuca
RPRAVKFADVAVYFSPEEWGCLRPAQRALYRDVMRETYGHLGALGCAGPKPALISWLERNTDEWEPAALDPRECPRGVTVQ

SEQ ID NO: 13583 - protein, 81 aa, Ailuropoda melanoleuca
AVTFKDVAVVFTEEELGLLDPAQRKLYGDVMLENFRNLISVRDRHQKEMETLHEAGIRCLSLGELSCWQIKRHVVSKLTKN

SEQ ID NO: 13584 - protein, 81 aa, Ailuropoda melanoleuca
VTFEDVAVDFTKEEWALLDTSQRKLFRDVMLENIRHLVSLGYQHCKSDVIFQLEQGEELWREGPGFLRGPSPGQESALKEQ

SEQ ID NO: 13585 - protein, 81 aa, Ailuropoda melanoleuca
QGLVTFRDVAIEFSQEEWKCLEPAQRDLYRDVTLENFSNLVSLGLSISKPDVISLLEQGREPWMITNDMTGPWCPGERGVI

SEQ ID NO: 13586 - protein, 81 aa, Gorilla gorilla
AQTLLTFRDVAIEFSLEEWKCLDLAQQNLYRDVMLENYRNLFSVGLTVSKPGLITCLEQRKEPWNVKRQEAADGHPAMSSC

SEQ ID NO: 13587 - protein, 81 aa, Ailuropoda melanoleuca
VLLTFRDVAIEFSPEEWECLDPAQRALYRDVMLENYRNLVSLGEDNVPLNLSDISVRSMIKELSPKEDINKEELFQTLMLE

SEQ ID NO: 13588 - protein, 81 aa, Nomascus leucogenys
VALEDVAVNFTREEWALLGPCQKNLYKDVMQETIRNLDCVGMKWKDQNIEDQYRYPRKNLRCRMLERFVVSKGGSQCGETS

SEQ ID NO: 13589 - protein, 81 aa, Nomascus leucogenys
PQGHLTFRDVAIEFSQAEWKCLDPAQRALYKDVMLENYRNLVSLGISLPDLNINSVLEQRREPWSGQSEVKIAKNSDGRER

SEQ ID NO: 13590 - protein, 81 aa, Bos indicus
SQGPVTFEDVAVYFSQEEWRLIDEVQRLLYHDVMLENAALVASLGCWHAAEDEQTPSEQNVSVEVPQRNTKKTDLSSQKVC

SEQ ID NO: 13591 - protein, 81 aa, Bos indicus
SQAPVTFEDMAMYLTREEWRPLDPTQRDIYRDVMQENYGNVVSLDFEIRSENEVNPKQEISEDVEFETASERPVGNTEENP

SEQ ID NO: 13592 - protein, 81 aa, Bos indicus
AQGPVTFEDVAVYFSLEEWGLLNLTQKSLYRDVMLENFGLIGSLGFAPSRSSKVAQMEGEGEAWVPNMVDSVVSRAEARKG

SEQ ID NO: 13593 - protein, 81 aa, Bos indicus
QEQLTFEDVAIDFSLEEWECLDPAQRALYRDVMVETYRNLFSLVVPQFLQRESKVFVKIHNSHHLAPVNWSLLEFEEHNVG

SEQ ID NO: 13594 - protein, 81 aa, Canis lupus
APALVSFKDVAVTFTGEEWRHLDLAQRTLYREVMLETCGLLVSLGHPVPKPELIYLLEHGQELWSVNRGLSKSTHTGEKAK

SEQ ID NO: 13595 - protein, 81 aa, Muntiacus muntjak
MGWLTFQDVVIGFTQEEWECLDLSQRDLYREVMLENYRNLASLGFVVSGLNLVTFLEQLNDPRSIRRIETTAIYPLHDAYS

SEQ ID NO: 13596 - protein, 81 aa, Muntiacus muntjak
PKVPVTFDDVAVYFSELEWGKLDEWQKELYKHVMRGNYEMLVSLDYAISKPDILTRMERGEEPCPEGPWGQEEGNEREEAC

SEQ ID NO: 13597 - protein, 81 aa, Muntiacus muntjak
GSVSFTDVTVDFTQEEWEQLDPSQRILYMDVMLENYSNLLSVEVWKADDQMEADHRSPDEQARPFVIFKDQTTIEERDNNL

SEQ ID NO: 13598 - protein, 81 aa, Muntiacus muntjak
EQVSFKDVCVDFTQEEWYLLDPAQKILYRDVILENYSHLVSVGNCTTKPEVVFKIEQGEEPWILEERCPKRCRSEDWKVDD

SEQ ID NO: 13599 - protein, 81 aa, Muntiacus muntjak
MLENYVNITSLAFPLPKPDLIFWLERGEEPGHLDPWTLVGGEDLRGICRGGKAKTENRGQTTELSISKGPESHKLITEVPL

SEQ ID NO: 13600 - protein, 81 aa, Gorilla gorilla
VAFKDVAVNFTQEEWALLDISQRKLYREVMLETFRNLTSIGKSWKDQNIEYEYQNPRRNFRSLIEEKVNEIKDDSHCGETF

SEQ ID NO: 13601 - protein, 81 aa, Ailuropoda melanoleuca
SRSLENDGVCFSEQEWENLEDWQKELYRNVMKSNYETLVSLKVLGQPEGEAELGAGMLGDLEEEGPGDVHPAEGVMIKQEI

SEQ ID NO: 13602 - protein, 81 aa, Gorilla gorilla
KVPVTFVDIAVYFSEDEWKNLDEWQKELYNNLVKENYKTLISLDAEGSVPKPDAPVQAEPREEPCVWEQRHPEEREIPMDP

SEQ ID NO: 13603 - protein, 81 aa, Ailuropoda melanoleuca
LQEQVSFKDVCVDFTQEEWYLLDPAQKILYRDVILENYSHFVSVGYCITKPEVVFKIEQGEEPWILEAGFPSHCNQEDWKV

SEQ ID NO: 13604 - protein, 81 aa, Ailuropoda melanoleuca
KMGPVTFKDVIVEFSREEWQLLNAAQRTLYREVMQENCGLLISVGYRVNKPNAVFKLKQGKEPWILEVEFPHRNYPGENGE

SEQ ID NO: 13605 - protein, 81 aa, Ailuropoda melanoleuca
ELGLLTFRDVAIEFSQEEWRCLSHTQWELYRDVLLENYGHLLFSGLIVSKPDLVSFLEQTKELWDVKRWKTIVFDPVQCGS

SEQ ID NO: 13606 - protein, 81 aa, Gorilla gorilla
QVTFSDVAIDFSHEEWGWLNSAQRDLYKDVMVQNYENLVSVAGLSVTKPYVITLLEDGKEPWMMEKKLSKAISVITPASSV

SEQ ID NO: 13607 - protein, 81 aa, Gorilla gorilla
PQGLLTFSDVAIEFSQEEWKCLDPAQRTLYRDVMLENYRNLVSLEFRSVTQAKVQWCHLSSLQPPLPRFKQFSCLSLPSSW

SEQ ID NO: 13608 - protein, 81 aa, Ailuropoda melanoleuca
VTFEDVTVIFTWEEWKFLDSSQKKLYREVMWENYTNVMSVGKKIEQDISQDTITSQIQISTHNQFCVVLNLFSLQDSNWRL

SEQ ID NO: 13609 - protein, 81 aa, Ailuropoda melanoleuca
SLESVTFKDVAIDLTQEEWTLMDRSQRKLYIDVMLENITHLVSVGCQFFQSDVISQWEQGGELWREDRGFAQGWNPGLENS

SEQ ID NO: 13610 - protein, 81 aa, Ailuropoda melanoleuca
KQGLLTFGDVAIEFSQEEWRCLSHMQRELYRDVMLENYGHLLFLGLIVSNPDLVIFLEQKRELWDVRRKETVYIHPGRNPR

SEQ ID NO: 13611 - protein, 81 aa, Lynx canadensis
RCLTNYSHDLVILEDVAVEFTQEEWTLLDPTQRNLYRDVMLENHKNLVAVDWEICLNTKWSAPQQNILQGKTPNVEMNSRQ

SEQ ID NO: 13612 - protein, 81 aa, Lynx canadensis
AAGSVTFKDVTMAFTQKEWEQLDPAQRNLYKDVMLENYSNLASMGYQAPKPDMISKLEKGEEPWLGKGKKPRQGGPSEIAR

SEQ ID NO: 13613 - protein, 81 aa, Nomascus leucogenys
PQASVCFEDVAMAFTQEEWEQLDLAQRTLYREVTLETWEHIVSLGLFLSKSDVISQLEQEEGLCRAEQVAPREKGMLPGTF

SEQ ID NO: 13614 - protein, 81 aa, Nomascus leucogenys
EMGVLTFRDVAIEFSLEEWQCLDITQQNLYRNVMLENYRNLVFVGIAASKPDLITCLEQGKEPWNVKRHEMVAEPPVVCSY

SEQ ID NO: 13615 - protein, 81 aa, Bos indicus
AQEILSFKDVAVEFTWEEWQLLTPAQKTLYRDVMLENYSNLVSVGYRVSKSDVLFKLEQGEERWMTEDEIHSHTWPETGNI

SEQ ID NO: 13616 - protein, 81 aa, Muntiacus muntjak
LQGLMTFEDVAVDFTQEEWQYLNPPQRTLYRDVMLETYSNLVSVGHHITKPDLILKLEVEERCLLEGKIPTWSFPDMGPQT

SEQ ID NO: 13617 - protein, 81 aa, Muntiacus muntjak
QAEVTFEDVAVLLSQEEWGLLGPSQKGLYREVMLETYRNLLSLGAGLADPKPEVIVQLERGDELWVLDMHGAEQPSVDGSA

SEQ ID NO: 13618 - protein, 81 aa, Muntiacus muntjak
QILESLTFQDVAVDFTREEWDQLYPAQKNLYRDVMLENYRNLVALGHQLYKPEVITQLEQEERWMMGRVSPPDTHPDGENR

SEQ ID NO: 13619 - protein, 81 aa, Muntiacus muntjak
TFRDVAFHFSQQEWECLNPVQKNLYQDVMMKNYDNLVSLGHSISKPDVISLLEQGKEPWMVVGEETRRWCTVEACELLVKA

SEQ ID NO: 13620 - protein, 81 aa, Canis lupus
AHQLMVFRDVAIDFSQEEWECLDLEQRHLYRDVMLENYSNMILLGLCIYQPDVFSLLEKGKEPWMVLQDETRGPCPDMQSS

SEQ ID NO: 13621 - protein, 81 aa, Canis lupus
RPQVTYEFLSVDYTERKWKGPAVGQRAVYRSIMPGNYCSVASLGDTRMRCSELPVKLAVSKGPESSDGTSRGLCAVVSGEP

SEQ ID NO: 13622 - protein, 81 aa, Muntiacus muntjak
PQDLMTFEDVAVEFTWWEWGQLDPAQKDLYREVMLENFKNLASLDWERRPQAKEAMLSQGLSKEELLQRASEEKHLRDELR

SEQ ID NO: 13623 - protein, 81 aa, Muntiacus muntjak
VSFEDVTVDFSQEEWQHLDPVQRCLYRDVTLETYSHLCAVGYQVPKPEVIFRLEQGEESWTLEKETPHHSCSDEDIGQTQQ

SEQ ID NO: 13624 - protein, 81 aa, Canis lupus
WQKSLKFKDVAVKFSKDEWKQLVPAQRALYREVMLENYQDFVSLGLLVPKPDVIFQLKRGEEPWNFDFQEDEEREVPANTF

SEQ ID NO: 13625 - protein, 81 aa, Gorilla gorilla
ELLTFRDVAIEFSPEEWKCLDPAQQNLYRDVMLENYRNLVSLAVYSYYNQGILPEQGIEDSFKKATLGRYGSCGLENICLW

SEQ ID NO: 13626 - protein, 81 aa, Ailuropoda melanoleuca
PGGHCEFEDVAVYFSWEEWGLLDEAQRCLYHDVMLENLALITSLGCWCGVEDKAVSSEQCVSARVLSPKAGMSPQKAHFCE

SEQ ID NO: 13627 - protein, 81 aa, Gorilla gorilla
KSMVTFEDVAVYFSQEEWELLDAAQRHLYHSVMLENLELVTSLGCWHGVEGEEAHPEQNVSVEVLQVRIPNADPSTKKANS

SEQ ID NO: 13628 - protein, 81 aa, Gorilla gorilla
MAFTQLTFRDVAIEFSQDEWKCLNSTQRTLYRDVMLENYRNLVSLEYYPMWEHRKEPWTIESQVQIARKPKGWEWIKGVKT

SEQ ID NO: 13629 - protein, 81 aa, Gorilla gorilla
RVTFKDVAVVFTKEELALLDKAQINLYQDVMLENFRNLMSVRDGIKNNILNLQAKGLSYLSQEVLHCWQIWKQRIRDLTVS

SEQ ID NO: 13630 - protein, 81 aa, Gorilla gorilla
MALVTFRDVAIDFSQKEWECLDTTQRKLYRDVMLENYNNLVSLGYSGSKPDVITLLEQGKEPCVAARDVTGRQCPGLLSRH

SEQ ID NO: 13631 - protein, 81 aa, Gorilla gorilla
MLENYRILVSLGLCFSKPSVILLLEQGKAPWMVKRELTKGLCSGWEPICETEELTPKQDFYEEHQSQKIIETLTSYNLEYS

SEQ ID NO: 13632 - protein, 81 aa, Ailuropoda melanoleuca
FQESVKLRDVAVIFSPDQWAYLSSEEKQLYKDVMLESCDYLVSLGHWTYKAEVISALREGEDLWMVENEVTSAPCPGSSLS

SEQ ID NO: 13633 - protein, 81 aa, Lynx canadensis
FTLLTFRDVAIEFSQEEWGCLNHSQRELYRDVMLETYGHLLFLACFDYLSPLPLPLHCLHDLSLTVSSQCTQNFLPKPCLE

SEQ ID NO: 13634 - protein, 81 aa, Lynx canadensis
SQVLLTFRDVTIDFSQEEWECLDPAQRALYREVMLENYRNLVSLGVDKVRPDVGICPNISVRSVIKELSTKEDINKEELFQ

SEQ ID NO: 13635 - protein, 81 aa, Lynx canadensis
MLENYRNLVSVGHQASKPDVLAKLERGEEPWAIEEEVRSGTSPETGKVDNHLQGHWEDERMLKGMELYPEYNAFGNIVPQS

SEQ ID NO: 13636 - protein, 81 aa, Lynx canadensis
LLQESLTLEDVAVDFTQEEWRLLAPAQKDLYRDVMLENFRNLVSVGYVASMPAALSRLERGGRWMTEDETRRGICPEIKKD

SEQ ID NO: 13637 - protein, 81 aa, Lynx canadensis
LPHSVTFEDVAVEFTQEEWALLDPSQRTLYRDVMQENCRNLASLGNQVGKPGVVSKLEQKDKVVTKETGILPGSFPGERQL

SEQ ID NO: 13638 - protein, 81 aa, Lynx canadensis
APGLLTFRDVAIEFSQEEWGFLNQSQRELYRDVMLETYGHLLFLGLIVSKPHLVIFLEQKRELWDVKRKKTVASPTQWVRD

SEQ ID NO: 13639 - protein, 81 aa, Lynx canadensis
PCEVSVSFEDVTMDFSREEWEQLGPAQRCLYWDVMLEICSHLLSLGTLIRPEMIFRMEKEQESWIREAQLPHQWRPEGEFG

SEQ ID NO: 13640 - protein, 81 aa, Neophocaena asiaeorientalis
LQEPVTFRDVAVDFTQEEWGQLGPAQRTLYRDVMLETFGHLLSVGPELPKPEVISQLEQGAELWVAERGISQGRCPGWESG

SEQ ID NO: 13641 - protein, 81 aa, Nomascus leucogenys
VTFKDVAVVFSREELRLLDLTQRKLYRDVMVENFKNLVAVGFLPWPKLFTALISKYCLFFLIGSKHQNKMETLQKFALKYL

SEQ ID NO: 13642 - protein, 81 aa, Bos mutus
TQLTVEDVDIKFTPEEWECLDPAQRALYQDVMVETYKNLLSVDVSRIHMTMKLQAKGNNGKGEIFQRVMFGRAKTHEIKDY

SEQ ID NO: 13643 - protein, 81 aa, Nomascus leucogenys
GPVTFEDVAVLFTEAEWKRLSLEQRNLYKEVMLENLRNLVLLESKPEVHTCSSCPLAFGSQQFLSQDELHNHPIPGFHAGN

SEQ ID NO: 13644 - protein, 81 aa, Nomascus leucogenys
KERPVSFQDLTVNFTQEEWQQLDPAQRLLYRDVMLENYSNLVSVGYHVSKPDVIFKLEQGEEPWIMEKFSNQNYPEVDDAL

SEQ ID NO: 13645 - protein, 81 aa, Nomascus leucogenys
AAVILPPTGLVTFEDFTQEEWALLDPAQRTLLRQENCLNPGGGGNQVDKPSLISQLEQEDKVMTEERGILSGTCPGEHQER

SEQ ID NO: 13646 - protein, 81 aa, Nomascus leucogenys
EMGLLTFRDVAIEFSLVEWQCLDRAQQNLYRDVMLENYRNLVSLGIAVSKPDLITRLEQNKEPWNIKRNEMLAKHPVMCSH

SEQ ID NO: 13647 - protein, 81 aa, Nomascus leucogenys
TVTFEDVAVNFSQEEWCLLSEAQRCLYRDVMLENLALISSLGCWCGSKDEEAPCKQIISVQRESQSRTPRAGVSPKKAHPC

SEQ ID NO: 13648 - protein, 81 aa, Nomascus leucogenys
SQGLVTFGDVAIDFSQEEWEWLNPIQRNLYRKVMLENYRNLASLGLCVSKPDVISSLEQGKEPWTVKRKMTRAWCPDLKAV

SEQ ID NO: 13649 - protein, 81 aa, Nomascus leucogenys
PLTFRDVAIEFSQEEWKSLDPVQKALYWDVMLENYRNLVFLGILPKCMTKELPPVGNSNTGEKFQTVMLERHECYDVENFY

SEQ ID NO: 13650 - protein, 81 aa, Nomascus leucogenys
GSLTFRDVAIELSLEEWQCLDTAQQNLYRNVMLENYRNLVFLGIAAFKPDLIIFLEQGKEPWNMKRHEMVEEPPGMVGSSG

SEQ ID NO: 13651 - protein, 81 aa, Nomascus leucogenys
VTFEDVAVYFIRKEWKRLEPAQRDLYRDVMLENYGNVFSLDWIHVSLTTQKVMLAWLTGTLSVGKGLCSSELESVELPDTF

SEQ ID NO: 13652 - protein, 81 aa, Bos indicus
FQGSLSFEDVTVGATQEEWQKLDPAQRTLYRDVMLENYSHLISVGYCIPKPELIFKLEQGEHPWVLEAESPSQSYPVCRIV

SEQ ID NO: 13653 - protein, 81 aa, Bos indicus
QESVTFKDVAVDFTLEEWGRLGPGQRELYRDVMLENYQNLLSLGAGFPGAKPDVISRLERGEEPRTERRETQQVTCPDLET

SEQ ID NO: 13654 - protein, 81 aa, Bos indicus
PLESVTFGDVAADFTQEEWALLDKSQKNLFRNVMLETVTHLVSVGYQISKSDVVFQLEQGKELWTQAAGGFQGQSPGSEAL

SEQ ID NO: 13655 - protein, 81 aa, Canis lupus
FQGSVTFQDVAVDFTPDEWQLLDCDQRTLYWDVMLENFRNLISVGDPVTKTKVIFKAEQGQEPWMAEREQPCWHYPEADYM

SEQ ID NO: 13656 - protein, 81 aa, Muntiacus muntjak
QAQETLTFDDVAVAFTWEEWQLLAPAQKVLYRDVMLENHSNLVSVGFQASTPEVLSKLDQGEPWTMDDEVHCRTRSEVWKV

SEQ ID NO: 13657 - protein, 81 aa, Muntiacus muntjak
ECLDLGQRELYRDVMLENYGNLACLGLHHLLKHTCSLKGNVENRESHLVSTANTHSNLYSEHRCLLNIHSNISGNQKLKHE

SEQ ID NO: 13658 - protein, 81 aa, Muntiacus muntjak
RSGSVTFEDVAVNFSWEEWGLLDESQKHLYHDVMLENLALISSLGCWPGEEDKEAFSEQSISDQGCSQMRIAKADLSPQKA

SEQ ID NO: 13659 - protein, 81 aa, Muntiacus muntjak
RAETLSFKDVAVDFTWEEWQLLAPAQKTLYRDVMLENYSNLVSMGYQVSKSDVLSKFEQGEEQWMTEDEIHSHTWPETGSV

SEQ ID NO: 13660 - protein, 81 aa, Muntiacus muntjak
MGRLMFQDVAIDFTQEEWECLDLGQRDLYRDVLLETYGNLASLGLVVSKPDLITFLEQMKNPWGVRRTDTTATYPVWNIFH

SEQ ID NO: 13661 - protein, 81 aa, Canis lupus
PLTSLTFEDVAVRFSSPEWRCLNRMQRLLYTDVMLENYRNMLAVGSAFPKPPLISQLEQGAEPCLPDQGFLSCFPVSPDKS

SEQ ID NO: 13662 - protein, 81 aa, Muntiacus muntjak
WLQGPMSFKDVAVEFTQEEWMMLDSAQRSMYRDVMLENYINLTLVEYQLCKPVISLLGQEDIRTVKSRIPQGTCPDWEIQL

SEQ ID NO: 13663 - protein, 81 aa, Gorilla gorilla
AQESITLEDVAVDFTWEEWQLLGAAQKDLYRDVMLENYSNLVAVGYQASKPDALFKLEQGEQPWTIEDGIHSGACSDIWKV

SEQ ID NO: 13664 - protein, 81 aa, Ailuropoda melanoleuca
FQESVTFEDVAVDFTQEEWALLDRSQRRLFRDVMLENISHLVSIVMYVYIPSLVQQKKKKKRPWRLGGTVRICLSFSLPLP

SEQ ID NO: 13665 - protein, 81 aa, Gorilla gorilla
GWLTNYSQDSVTFEDVAVDFTQEEWTLLDQTQRNLYRDVMLENYKNLVAVDWESHINTKWSAPQQNFLQGKTSSVVEMNSE

SEQ ID NO: 13666 - protein, 81 aa, Ailuropoda melanoleuca
AQESVTFRDVAVFFSQDEWLRLDSAQRTLYREVMLENYGTLVSLGILFSKPKVIFQLQQGEDPWMAENGVSQGPCVGWERL

SEQ ID NO: 13667 - protein, 81 aa, Ailuropoda melanoleuca
YKELVTFKDVVVDFSPEELTYLSAAQKNLYREVMLENYRNLVSLGYQFSKPDIISQLEEEESRVREEDSNAEICQGESSPN

SEQ ID NO: 13668 - protein, 81 aa, Ailuropoda melanoleuca
TARSQASVTFKDVAMDFTPEEWGKLDPTQREVMLENYRNLVSLWLPVSRPENYNLENGKEPLMLERKAPKSSCSDLETKPE

SEQ ID NO: 13669 - protein, 81 aa, Ailuropoda melanoleuca
SDEAFSFEDLSVDFTQKEWQLLNPGQKDLYKDVMLENYSSLVSLGYEIMKPDVIFKLEQGEEPWIGDGEVPSSGCPADMSY

SEQ ID NO: 13670 - protein, 81 aa, Gorilla gorilla
FQESVTFQDVAVDFTAEEWQLLDCAERTLYWDVMLENYRNLISVGCPITKTKVILKVEQGQEPWMVEGVNPHESSPESRSV

SEQ ID NO: 13671 - protein, 81 aa, Ailuropoda melanoleuca
LQGSVSFKDVTVDFTQEEWQHLDPAQKALYRDVMLENYCHLISVGLHMTKPDMIRKLEQGEELWTTERMFPSQSYLEEDGK

SEQ ID NO: 13672 - protein, 81 aa, Sus scrofa
VQESVTFKDVAVLFTQDEWAQLSPAQRALYRDVMLENYSHLVSLGLLGPKPDMFSQLGKGEEWMLEDSLGGFCLDWMTMPV

SEQ ID NO: 13673 - protein, 81 aa, Sus scrofa
ALESVTFRDVAVFFSQDEWLCLDSAQRTLYREVMLENYSTLFSLGILFSKPKVIFQLEQGEDPWMVENEVSQSTCLGWESL

SEQ ID NO: 13674 - protein, 81 aa, Sus scrofa
LRGLLTFEDVAIDFSPEEWECLDLGQRHLYRDVMLEICRHLVSLEYVISKPDLVRLLEQKTDPWDVKGMETGSSIFNQQIF

SEQ ID NO: 13675 - protein, 81 aa, Nomascus leucogenys
PQGSLTFRDVAVEFSQEEWKSLDPVQKALYRDVMLENYRNLGFLGLCLPDLNIISMLEQGKEPWTVVSQVKIAKNPNCGEC

SEQ ID NO: 13676 - protein, 81 aa, Nomascus leucogenys
VAFEDVDVNFTQDEWALLDPSQKNLYRDVMQETFRNLASVGKWKDQKIEDEYKNPRRNLRGLMGERLLEGKKDHQHGEILA

SEQ ID NO: 13677 - protein, 81 aa, Bos indicus
MVQNYENLVSLAGLSIPKPYVIALLEDGKEPCMVEEKLSKDTFPDCKTRWENKELSMKEDIYDEDLPQMVLKEKTIQQNHE

SEQ ID NO: 13678 - protein, 81 aa, Bos indicus
AQESVMFSDVSIDFSQEEWEFLNDDQRDLYRDVMLENYSNLVSMAGHSISKPDVISFLEQGKEPWLVDRELTRDQWPVLES

SEQ ID NO: 13679 - protein, 81 aa, Bos indicus
RESGKAPVTFDDITVYLLQEEWVLLSQQQKDICGSDKLVAPLGSTIASPELFYKFEQGPEPWLASVQGQRSHLSPNPGKTK

SEQ ID NO: 13680 - protein, 81 aa, Bos indicus
VFQGRMTFQDVAIDFTQEKWECLDLDQRELYRDVMLQNYGNLASLGLVSTLDLVAFLEQLKDPRNTRMETTTIYPGAVVAE

SEQ ID NO: 13681 - protein, 81 aa, Bos indicus
MITLQEEWQHLDPAQRMLYRDVMLENYSHLISVELINNSRKKFDFNKGRKWSHDDKHERIHYGEKSYEYNKNENGLCLNED

SEQ ID NO: 13682 - protein, 81 aa, Bos indicus
MVQNYENLVSLGLSIPKPYVIALLEDGKEPCMVEEKLSKDTFPDCKTRWENKELSMKEDIYDEDLPQMVLKEKTIQQNHEF

SEQ ID NO: 13683 - protein, 81 aa, Bos indicus
ERLTCEDVAIEFTHEEWVFLDPAQRALYRDVMLETYRNLLSVDISPTHVIKHLQLEANSDKLETFQTLMLGRPESCEIKHF

SEQ ID NO: 13684 - protein, 81 aa, Canis lupus
VPVTMTFDDVALYFSEQEWEILEKWQKEMYQQVMKNNYETLDSLGRVFSKPDLIIWIEQGRMLLIRDQGPLEKRMACSPST

SEQ ID NO: 13685 - protein, 81 aa, Canis lupus
KSQGFVSFKDVTVDFTWEEWQQLDCAQRNLYRDVMLENYSNLVSVGCQYLKSDVMLLNQGEPWMEEEEISSWAYSDFDIIT

SEQ ID NO: 13686 - protein, 81 aa, Canis lupus
SKGSMMFRDVSVNFSQEEWECLDSGQMNLYKEVMLENFSNLVSVGLSNSKPAVISLLEQGKEPWMVERELTRGLCSDLESM

SEQ ID NO: 13687 - protein, 81 aa, Canis lupus
ESVTFRDVAIDFSQEEWEWLQPAQRDLYRHVMLENYSHLVSLESHGEIKEFSPNNVICEDDSSQYLVVERILNQDPDHSSF

SEQ ID NO: 13688 - protein, 81 aa, Muntiacus muntjak
RGSVTFEDVAVYFSWEEWALLDEAQRCLYHDVMLENFALTSSLGCWHGVEDKGAPSEKSISVEGVSQIKTLKADSSPQKDR

SEQ ID NO: 13689 - protein, 81 aa, Muntiacus muntjak
LGLLTFEDVAVHFTQEEGARLDAGQRTLYRDVMLETYRILISLGEPFPPPHPQSPSELRWDLGGARLAVTLGPEVGHSAPR

SEQ ID NO: 13690 - protein, 81 aa, Muntiacus muntjak
SVNFEDVAVTFSWEEWGLLDESQRCLYRDVMLENLALITSLGCCHEVENEKTSFEQNVYFQRMSQIRTPKADLSSRKAHPC

SEQ ID NO: 13691 - protein, 81 aa, Canis lupus
MDSVVFEDVAVYFTPEEWALLDRGQRRLYRDVMLETCRNLAAVDCCTQVKPCGSRTQLNILESELSSEEKIVRFTRNDSWA

SEQ ID NO: 13692 - protein, 81 aa, Gorilla gorilla
SLKKVTFEDVAIDFTQEEWAMMDTSKRKLYRDVTLENISHLVSLGYQISKSYIILQLEQGKELWQEGREFLQDQNPDRESA

SEQ ID NO: 13693 - protein, 81 aa, Gorilla gorilla
VTLRDVVINFSQEEWEYLDSAQRNLYWDVMMENYSNLLSLDLESRNETKQLSVGKDIIQNTGSQWEVMESSKLCGLEGSIF

SEQ ID NO: 13694 - protein, 81 aa, Ailuropoda melanoleuca
QGLVTFRDVALDFSQEEWEWLDTSQKDLYRDVMLENYRNLVWLGLSISKPNMISLLEQGKEPWMVEKEMSDGQYADWESWY

SEQ ID NO: 13695 - protein, 81 aa, Gorilla gorilla
FQEPVTFEDVAVYFTQNEWASLHPTQRALYREVMLENYANVTSLSAFPFPKPDLIFQLEQGEAAWGPDPWTLAGGEALRGM

SEQ ID NO: 13696 - protein, 81 aa, Ailuropoda melanoleuca
MAFRDVAVDFSQEEWLLLSPAQRSLYREVMLENYSNLVSLGIPFSKPKLISQLEQGKETWREERACPPATCPAEPKPELHL

SEQ ID NO: 13697 - protein, 81 aa, Gorilla gorilla
CYQDSVTFDDVAVDFTQEEWTLLDSTQRSLYSDVMLENYKNLATVGGQIIKPSLISWLEQEESRTVQGGVLRGWEMRLETQ

SEQ ID NO: 13698 - protein, 81 aa, Ailuropoda melanoleuca
FGGSVTFRDVAIDFSQEEWEFLDSAQRDLYRDVMWENYSNFISLEPSISKPDVITLLDEGKEPWMVVKEGTRRHYSDLESR

SEQ ID NO: 13699 - protein, 81 aa, Gorilla gorilla
PQGLLTFRDVAIEFSQEEWKCLDPAQRTLYRDVMLENYRNLVSLDISSKCIMKEFSSIGKGNTEVIHTGTLQRLASHHIGE

SEQ ID NO: 13700 - protein, 81 aa, Gorilla gorilla
SQESLTFKDVFVDFTLEEWQQLDSAQKNLYRDVMLENYSHLVSVGYLVEKPDVIFRLGPGEESWMADGGTPVRTCAGTVLQ

SEQ ID NO: 13701 - protein, 81 aa, Ailuropoda melanoleuca
SQGLVTFEDVAVYFSLEEWERLDVDQRDLYKDVMQENYGILVSLGYPIPKPDLIFRLEQGEEPWVPDSPRPEEGDIVTGVY

SEQ ID NO: 13702 - protein, 81 aa, Gorilla gorilla
MGPLTFRDVAIEFSLKEWQCLDTAQRNLYRNVMLENYRNLVFLVTCSYFAQDLWPEQNIKNSFQKVIPRRYGKCGDENLPL

SEQ ID NO: 13703 - protein, 81 aa, Ailuropoda melanoleuca
PKVPVTFDDISIYFSTPEWEKLEEWQKELYKNIMKGNYESLISMDYAMNQPDVLSQIQPEGEHNTEEQTGPEESEIPADPS

SEQ ID NO: 13704 - protein, 81 aa, Gorilla gorilla
LLTFRDVAIEFSQEEWKCLDPAQRTLYRDVMLENYRNLVSLGIFSKCEIKELPPKKESNTGEIFQTVMLERHESRDIQDFC

SEQ ID NO: 13705 - protein, 81 aa, Gorilla gorilla
EMGLLTFRDVAIEFSPEEWQCLDTAQQNLYRNVMLENYRNLAFLGIALSKPDLITCLEQGKEPWNMKQHEMVDEPTDGVLL

SEQ ID NO: 13706 - protein, 81 aa, Lynx canadensis
SEGGVTFEDIAIYFSWKEWRLLDEAQRRLYYDVMLENFTLISSLGCCCGAEDAEAPLEQSVSVGVSQAGTPKAALSSRKTH

SEQ ID NO: 13707 - protein, 81 aa, Lynx canadensis
SQVSLTFEDVAVLFTRDEWRKLGPFQRNLYQDVMLENYSNLVSLGLLFSKPKVISLLQQGEDPWKVEKESPGGPSLGWKGS

SEQ ID NO: 13708 - protein, 81 aa, Bos indicus
DPDQVTFEDVVVDFTQEEWGHLEPAQRTLYRDVMLETFGLLVSVGHWLPKPDVISLLEQEAELWAADKGGPRAVCPDLETR

SEQ ID NO: 13709 - protein, 81 aa, Bos indicus
AQEPVTFNDVAVDFTQEEWGQLDLVQRTLYRDVMLETYGHLLSVGNQITKPEVISLLEQGEEPWSMEPAYPLQGTCPAPEI

SEQ ID NO: 13710 - protein, 81 aa, Bos indicus
HSEGRLTFQDVAIDFTQEEWECLDPGQRKLYRDVMVENYRNLASLGLVSKVDLVTFLELLKDPRNIRRMKTTAIYPAVSPQ

SEQ ID NO: 13711 - protein, 81 aa, Bos indicus
VFQGRMTFQDVAIDFTQEEWECLDLSQRELYRDVMLQNYGNLASLGLVSTLDLVAFLEQLKDPRNTRMETTTIYPAMSPQD

SEQ ID NO: 13712 - protein, 81 aa, Canis lupus
AEGHVTFEDVAVYFSWEEWGLLDEAQRLLYRDVMLENFSLMASLGLASSRTHEVSRLEWWREPFLPPCGVMTAAMPGGWWH

SEQ ID NO: 13713 - protein, 81 aa, Canis lupus
SLDSMTFTDVAIDFSQDEWEWLNLAQRILYKRVMLENYRNLVSLGLCISKPDIISLLEQGKEPWMMKGEMTRDLYPDLKYV

SEQ ID NO: 13714 - protein, 81 aa, Muntiacus muntjak
GLESVTFKDVAVDFTLEEWGRLGPGQRELYRDVMLENYQNLLSLGFPGAKPDVISRLEQGEEPRMERRETQQLTCPDLATS

SEQ ID NO: 13715 - protein, 81 aa, Muntiacus muntjak
PKVPVTFDDISIYFSTPEWEKLEEWQKELYKNIMKGNYESLISMDYAMNQPDVLSQIQPEGDRNTEDQAGPEESGIPSDPS

SEQ ID NO: 13716 - protein, 81 aa, Muntiacus muntjak
CQDPVTFEDVAIVFTDEEWRHLVPTQRDLYKEVMLENYKSIVSLGLPIPGPDVIFQLKRGDEPWLVEFHGFEGKEGAENVS

SEQ ID NO: 13717 - protein, 81 aa, Muntiacus muntjak
EPVTFEDVAVYFSQNQWASLDSAQRALYREVMLENYANVASLVSPFPRPDLISQLERGEAPWDPNPWEAEDLRGICPGGER

SEQ ID NO: 13718 - protein, 81 aa, Muntiacus muntjak
AQVCVTFDDVAVTFTQEEWGHLDPAQRTLYQEVMLETCGLLMSLGCPVPRPELIYQLEHGQELWTVKRDLSGSTCPVDKGK

SEQ ID NO: 13719 - protein, 81 aa, Canis lupus
QGLVTFEDVAVYFSREEWGLLNLTQRSLYRDVMLENFALIGSLGFAPSRSHVVAQLENEEELCVPNVVDLTLISRAEARRG

SEQ ID NO: 13720 - protein, 81 aa, Canis lupus
DHGLLTFRDVAVEFSPEEWRCLNHTQRELYRDVMLENYGHLLFVGLMVSKPDLVSFLEQRKEPWDLKTKKTVAIHPGRWEY

SEQ ID NO: 13721 - protein, 81 aa, Canis lupus
VQEPVTFKDVAVDFTQEEWGQLDPVQRTLYRDVMLETYGHLLSVGNQIAKPEVISLLEQGEEPWSVEQAYPQSTCSEWMRN

SEQ ID NO: 13722 - protein, 81 aa, Muntiacus muntjak
ELVTFRDVVISFSQEEWEYLDSAQRDLYWDVMMENYCNLVSLDLESRYDTKTLSVEKDILEKNNSQWEVIENSKLVGLQNS

SEQ ID NO: 13723 - protein, 81 aa, Gorilla gorilla
YQDSVTFDDVAVEFTPEEWALLDTTEKCLYRDVMLENYVNLASVEWEIQPRTKRSSLQQGFLKNQIFTGIQMQTRSYSGWK

SEQ ID NO: 13724 - protein, 81 aa, Gorilla gorilla
MEPLTFRDVAIEFSPEEWKCLDPAQQNLYRDVMLENYRNLVSLVSSLVSSCRVISHGLSRGRNRATEKNDLLTTEEPVVKH

SEQ ID NO: 13725 - protein, 81 aa, Ailuropoda melanoleuca
QLPLTFEDVAIYFSEQEWQNLEVWQKELYKHVMRTNYKILVSLDDGLPKPELISWIEQGREFFKNWGESQKSGNIICSSAD

SEQ ID NO: 13726 - protein, 81 aa, Ailuropoda melanoleuca
AQDSMTFEDVAVCFSGGEWQCLTHAQRHLYADVMLENYGNMISVGFAVPKPPLISHLEQGAKPCIQDLQDWGFLTCSFPVS

SEQ ID NO: 13727 - protein, 81 aa, Ailuropoda melanoleuca
AQISVTFDDVAVTFTQEEWGQLDPAQRTLYQEVMLENCGLLVSLGCPVPRPELIYQLEHGQELWTVKRDLSQSAYPGDKGK

SEQ ID NO: 13728 - protein, 81 aa, Ailuropoda melanoleuca
FREPVTFEDVTLGFTSDEWGLLDLEQKSLYREVMLENYRNLVSVEHQLSKPDVVSQLEEEEALWSVERGIPQDTFSEYPTA

SEQ ID NO: 13729 - protein, 81 aa, Ailuropoda melanoleuca
ELVTYKDVAVDFTQEEWQHLDPAQKTLHRDVMLETYSHLVSVGCSGIKPGIIFKLEREEDPWIIKSELSTWIHSDREKSLD

SEQ ID NO: 13730 - protein, 81 aa, Gorilla gorilla
PQGLLTFRDVAIEFSQEEWKCLGPAQRTLYRDVMLENYRNLVSLDISSKCMMRTLSSTGQGNTEVIHTGTLQRQASYHIGA

SEQ ID NO: 13731 - protein, 81 aa, Gorilla gorilla
TQGQVTFRDVAIEFSQEEWTCLDPAQRTLYRDVMLENYRNLASLGISCFDLSIISMLEQGKEPFTVESQVQTARNPDGWEW

SEQ ID NO: 13732 - protein, 81 aa, Lynx canadensis
PKVPVTFDDVAVYFSEPEWGKLDEWQKELYKHVMRGNYEMLVSLDYAISKPDILTQMERGEEPCPESLWGHEEGSKREAAH

SEQ ID NO: 13733 - protein, 81 aa, Lynx canadensis
SQESVTFEDVAVDFTQEEWTLLDWSQRKLFRDVMLENISHLVSVGKQLYKLDTIFHLEQGEQLSTEGIGLLQCQSLDREDD

SEQ ID NO: 13734 - protein, 81 aa, Lynx canadensis
MAHLMMFRDIAVDFSQEEWECLDLEQRHLYRDVMLENYSNMISLGLCIYQPDVFSLLEKGKEPWIFLQDETRGHCPDMPFR

SEQ ID NO: 13735 - protein, 81 aa, Lynx canadensis
LILHRNVWILLRCKTGHSIRQPPRQHLGLRDLKGVQPVPACLHSSLTGYDSTKPKVILKLEQGEEPWVVEGDLPCRSRPEV

SEQ ID NO: 13736 - protein, 81 aa, Lynx canadensis
ESVTFQDVAVDFTEKEWPLLDSSQRKLYKDVMLENYSNLASVDWETPSKSKWSILMEDIFGKETPRGVTVERTRLGEKPAE

SEQ ID NO: 13737 - protein, 81 aa, Lynx canadensis
FQEAVTFGDVAVHFSREEWQCLDPGQRALYKEVMLENHSSVAGLAGFLVFKPELISRLEQGQEPWVLDLKGVEGREVARTS

SEQ ID NO: 13738 - protein, 81 aa, Lynx canadensis
WSQMPVTFEDVALYLSREEWGRLDHTQQNFYRDVLQKRNGLSLGFPFSRPFWASQGQGKGEASGSCRQMGDEEKTGAIEVG

SEQ ID NO: 13739 - protein, 81 aa, Lynx canadensis
SQESVTFQDVAVDFTEKEWPLLDSSQRKLYKDVMLENYSNLASVGYQVGKPSLISHLEQEEELRTEERGLHRATSPDWETP

SEQ ID NO: 13740 - protein, 81 aa, Phyllostomus discolor
PQALVSFKDVTVEFTQEEWQQMGPLQRTLYRDVMLENYNNLVSVGNCIFKPEVIFKLEQGEEPWFLEEEFSNQSHHEYYRD

SEQ ID NO: 13741 - protein, 81 aa, Desmodus rotundus
EAVPLTFQDVAVYFSQEEGQQLGPDQRALYRDVMLENYGHVASLGLPVPKPELISQLEQGEELWVLDLMGAEEPEPLSSCS

SEQ ID NO: 13742 - protein, 81 aa, Desmodus rotundus
SQGPLTFRDVLVDFSQEEWDCLDPAQRKLYMDVMLENYRNLVSLGCVFPKPVLVTIVEEMKEYWDVCRKKTISAPQAMSSE

SEQ ID NO: 13743 - protein, 81 aa, Macaca fascicularis
KPRTVSFADVAVYFSREEWGCLRPAQRALYRDVMRETYGHLGALGVGGSKPALISWVEEEAELWDPAARDPEVTKCPTETD

SEQ ID NO: 13744 - protein, 81 aa, Macaca fascicularis
LQGPVSFKDVAVDFTQEEWQQLDPDEKITYRDVMLENYSHLVSVGYDITKPNVIIKLEQGEEPWIMEGEFPCQHSPEVWKF

SEQ ID NO: 13745 - protein, 81 aa, Macaca fascicularis
GVAISNPDLVTFLEQRKEPYNVKIHETVAKHPAMCSHFTQDFLPVQEIEDSFHKLILRRYEKCGHENLQLRKGCKKKVQKA

SEQ ID NO: 13746 - protein, 81 aa, Macaca fascicularis
GMEPLQFRDVAIEFSLEEWHCLDTAQQNLYRDVMLENYGNLVFLGIVVSKPDLITRLEQGENPLTVKRHKMTANPSGPGMV

SEQ ID NO: 13747 - protein, 81 aa, Macaca fascicularis
VRLTFRDVAIEFSQEEWKCLDPAQRTLYRDVMLENYWNLVSLGLCHFDMNIISMLEEGKEPWTVKNCVKIARKPRMRECVK

SEQ ID NO: 13748 - protein, 81 aa, Macaca fascicularis
SYQDSVTFDDVAVDFTPEEWALLDTAEKYYRDVMLENYMNLASVEWEIQPRTKRSSLQQGFLKNPIFNGIQMQTRNYSGWK

SEQ ID NO: 13749 - protein, 81 aa, Macaca fascicularis
MVSFEDVAVLLSQEEWDCLIPAQRGLYRDVMLETYGNLVSLGLQASKPDVISRLEQGDKPWTPHILRTQISWSWRHKRECY

SEQ ID NO: 13750 - protein, 81 aa, Macaca fascicularis
SQESVAFEDVAVYFTTKEWAIMVPAERALYRDVMLENYEAVAFVVPPTSKPALVSHLEQGKESCFIRPQGVLSRSDWRAGL

SEQ ID NO: 13751 - protein, 81 aa, Macaca fascicularis
KVTFEDVAIDFTQEEWAMMDTSKRKLSRDVMLENVSHLVSLGYRISKSYITLQLEQGKELWREGREFLQGQNLDKESALKK

SEQ ID NO: 13752 - protein, 81 aa, Macaca fascicularis
MLETYSSLVSLGHCITKPEVIFKLEQGAEPWLGEEWANQCLSGVQTVDIIERSQEIHHRRIWQVAVTNSKTSTKETVELGK

SEQ ID NO: 13753 - protein, 81 aa, Phascolarctos cinereus
FQESVTFQDVAVEFTREEWEHLRPAQRELYRDVMLENYRNLVSLGLPFSKPEMIFHLEQVEALWNAEKEVLTRIHTGEKPY

SEQ ID NO: 13754 - protein, 81 aa, Phascolarctos cinereus
RAGLVTFEDVSVDFSRSEWKQLKPAQRDLYKDVMLENYKNLVSLGEEHCFLGLRICLPFGMDVFYTRRATPVGGRKRRGNS

SEQ ID NO: 13755 - protein, 81 aa, Phascolarctos cinereus
PQELVTFSDVAVYLSKEEWGQLDPSQRALYKDVMLENYGNVVSLGLSLCKPEMISQLEQGKMPWVPDLQGTEDDQTTWPDD

SEQ ID NO: 13756 - protein, 81 aa, Phascolarctos cinereus
SRVSVTFKDVAVDFTKEEWQELEPSQKDLYREVMLENYKNLISLGVPISKPDVIYQLEQGEAPWMLERRVPRGSSPDGEKL

SEQ ID NO: 13757 - protein, 81 aa, Phascolarctos cinereus
GWVPALFDEVAIYFSDEEWEVLTEQQKALYREVMRMNYETVLSLEFPFPKPDVISQLEVEESPWVPYPQNSEDWKLQGGSF

SEQ ID NO: 13758 - protein, 81 aa, Phascolarctos cinereus
YQESVTFEDVSVDFTQEEWSHLGPTQRALYREVMLETFENLTSLGLPGLKPEVISCLERGEAPWMLEGEVPRDPYPGSFHE

SEQ ID NO: 13759 - protein, 81 aa, Phascolarctos cinereus
MLENYRNLIFLGFSVFTPVVISRLEGGEEPWTVEREIPGSPGADWETNPEARELAPKLSMPVEELSLQSFTRISSQGYRLG

SEQ ID NO: 13760 - protein, 81 aa, Phascolarctos cinereus
PQESVTFKDIAVEFTRTEWRHLTSCQKELYRDVMLENYGNLVCLGLAVSKPDVISQLERREAPWTPGGIQRSSCPAFLSNF

SEQ ID NO: 13761 - protein, 81 aa, Phascolarctos cinereus
MLENYRNLVSLGAECQSAKPKLISQLEQSRESWLLEEDPHGLCPGGCPKPETLNSVPYQGVSEKPSSREERLEGLGRDDSL

SEQ ID NO: 13762 - protein, 81 aa, Phascolarctos cinereus
FQASVTFKDVAVDFTQEEWGHLDPTQRALYRDVMLENYRNLVSLGCQVFKPDVISQLEQGKEPWMVKAKILRGSCPDFKIR

SEQ ID NO: 13763 - protein, 81 aa, Phascolarctos cinereus
ARDPVSFADVAVYFSPEEWGRLRPAQRALYRDVMRETYGHLGALGFPGPKPALISWVEQEPEVWGPDARDPEEEKESPREE

SEQ ID NO: 13764 - protein, 81 aa, Phascolarctos cinereus
GNESVTFKDVAVEFTQEEWVQLDPSQKKLYWDVMLENYRNLVSLESREFAGDKPLECNGYGNAFWSKEHLAVCQIIHTGDN

SEQ ID NO: 13765 - protein, 81 aa, Myotis lucifugus
DAVTFPDVAIDFSRDEWECLNLAQRTLYRKVMLENYRTLVSVGLCVSKPDVISLLEQGEEPWVTDGEMAGGLCPHSECVWM

SEQ ID NO: 13766 - protein, 81 aa, Myotis lucifugus
SKDMNFEDVVIAFSQEEWGLLDEVQRHLYCNVMLEMFALVASVGCWHKMNNEEAYSDQSVSVQGESRVRASKTAPATQKSH

SEQ ID NO: 13767 - protein, 81 aa, Puma concolor
SEESVTFKDVAVDFTQEEWGQLDSPQRALYRDVMLENYQNLLALGPPVCKPDVISHLERGEEPWWMPREAPGGAWPEGEPG

SEQ ID NO: 13768 - protein, 81 aa, Puma concolor
MLLDDSQRLLYQDVMLENFALLASLGIAPSTSRLVAQPKQREDPWVPDQVDVTPATEREAPKGPGPGCWCAVEDNDTSSVS

SEQ ID NO: 13769 - protein, 81 aa, Puma concolor
AEGGVTFEDVAVYFSQEEWKLLDEAQKRLYHDVMLETFALISSLGCCCGAEDAEAPLEQSISVGVSQASVPKAALSSRKTH

SEQ ID NO: 13770 - protein, 81 aa, Puma concolor
MASPSPPPEPKEWDYLDPAQRSLYKDVMMENYGNLVSLDVLNRDKDEEPTVKQEIEEIEEEVEPQGVIVTRIKSEIDQDPI

SEQ ID NO: 13771 - protein, 81 aa, Sapajus apella
FQEAVTFKDVAVAFTEEELGLLDSSQRKLYRDVMLENFRNLVSVGRQSFKPDMISQLEREEKLWMKEFQNQRGDRNQNEMA

SEQ ID NO: 13772 - protein, 81 aa, Sapajus apella
MGPLTFRDVAIEFSLEEWQCLDTAQQNLYRHVMLENYRNLVFLAGIAVSKPDLITCLEQGKEPWNMKRHAMVAKPPVVCSQ

SEQ ID NO: 13773 - protein, 81 aa, Sapajus apella
MGVLTFRDVAIEFSPEEWECLDSAQQHLYRDVMLENYRNLVSLAGSFLFTAEILPEHDIKDSFQKVILRKYRSCDLNNLHL

SEQ ID NO: 13774 - protein, 81 aa, Sapajus apella
RSQESLTFQDVAVDFTREEWDQLYPAQKDLYRDVMLENYRNLVALGHQLYKPEVITQLELEEEWVIEGDSLLDTCPDGENR

SEQ ID NO: 13775 - protein, 81 aa, Sapajus apella
MFKEAVTFKDVAVVFTEEELGLLDPAQRKLYRDVMLENFRNLLSVGQQAFDRDTFQFLREEKVWMMKTATQREGNSGSKIQ

SEQ ID NO: 13776 - protein, 81 aa, Sapajus apella
NFWILRLPPGSKGEAPKEWGKLEDWQKELYKHVMRGNYETLVSLDYAISKPEVLSQIEQGKEPCSWRRPGPKIPDVPVDPS

SEQ ID NO: 13777 - protein, 81 aa, Sapajus apella
MLYRDVILENYSNLVSVGYCITKPEVIFKIEQGEEPWILEKGFPSQCNPERKWKVDDVLKGSQENEDDHFWELLFHNNKTV

SEQ ID NO: 13778 - protein, 81 aa, Sapajus apella
MSVESVSFKDVTVDFSRDEWQQLNTAQKSLYRDVMLENYFNLISVGCQVPKPEVIFNLEQEEPCMLNGGISSQSCPDGKIG

SEQ ID NO: 13779 - protein, 81 aa, Sapajus apella
EEKGNEMLTFRDVAKGFCPEEWECLDSSQQHLYRDVMLENYRNLVSLGLGDSKPELITHLEQGKDPWNVKRQETVVKHSGR

SEQ ID NO: 13780 - protein, 81 aa, Oryctolagus cuniculus
NFWILRLPPGSKGEVPKEWGKLEDWQKELYKHVMRGNYETLVSLDYAISKPEVLSQIEQGKEPCTWRRTGPKIPDVPVDPS

SEQ ID NO: 13781 - protein, 81 aa, Oryctolagus cuniculus
QGSVTFEDVSVNFTQEEWQWLTPRQRRLHRDVMLENYSNVVSLAQHEEASKPEVILRLERGEEPWTVGGEGLSSSGRGNQG

SEQ ID NO: 13782 - protein, 81 aa, Pteropus alecto
VKESVTFKDVAIDFTLEEWRLMDPTQRDLHKDVMLENYRNLVSLGLAVSKPDMIAHLEDGQGPWVVVREISRTSNPELETK

SEQ ID NO: 13783 - protein, 81 aa, Oryctolagus cuniculus
MAFEDLAVYFTWEEWQNMNKAQKILYRDEMLETYSSLLFLGHCITKPDLIFKLEQGAEPWMVSEFLNQNLPVKPYECNNCG

SEQ ID NO: 13784 - protein, 81 aa, Oryctolagus cuniculus
HFPLQAPVTFDDITVYLLQEEWMLLSQQQKEICGSDKLVAPLGPTVANPELFYKFGQGPEPWLGDVQGQRSLLDHHPGKKQ

SEQ ID NO: 13785 - protein, 81 aa, Oryctolagus cuniculus
VLVMIGFEDLAVYFTWKEWQNMNNAQKILYRDVMLETYSILFSLGHCMTKPDLILKLEQGAEPWMGEECLHQSLPVAVKSD

SEQ ID NO: 13786 - protein, 81 aa, Oryctolagus cuniculus
FQEAVTFGDVAVHFSREEWQCLDSGQRALYREVMLENHSSVAGLAGFLVFKPELISRLEQGQEPWVLDLQGAEKTEASRSP

SEQ ID NO: 13787 - protein, 81 aa, Pteropus alecto
DPVTFQDVTVEFTQEEWEHLGTAQRALYCENSYWRKNHYKCSECGKAFYQSTCLTQHQRIHTGEKPYECSQCGKAFSQSSH

SEQ ID NO: 13788 - protein, 81 aa, Gorilla gorilla
ALALVSFEDVVVTFTGEEWGHLDLAQRTLYQEVMLETCRLLVSLGHPVPKPELIYLLEHGQELWTVKRGLSQSTCTGEKAK

SEQ ID NO: 13789 - protein, 81 aa, Gorilla gorilla
MGPLQFKDVAIEFSLEEWHCLDTAQRNLYRNVMLENYSNLVFLGIVVSKPDLIARLEQGKKPLTMKRHEMVANPSGARLLF

SEQ ID NO: 13790 - protein, 81 aa, Gorilla gorilla
SQGRVTFEDVTVNFTQGEWQWLNPEQRNLYRDVMLENYSNLVSVGQEETTKPDVILRLEQGKEPWSVEEEVLGSGRAEKNG

SEQ ID NO: 13791 - protein, 81 aa, Gorilla gorilla
EDVAVDFTLEEWALLDSAQRDLYRDVISVARCEMWERTKTDMFTDMYGQEKSKEQTIPNFTGNNSCAYTLEKNCEGYGTED

SEQ ID NO: 13792 - protein, 81 aa, Ailuropoda melanoleuca
ASLLPSLPTEHWRHLDSTQKEQYWDLMLETYGKMVSGAGISNSKCDLTNSTEYGEELAGLHLHVGEKISRPTCIGDRQEND

SEQ ID NO: 13793 - protein, 81 aa, Gorilla gorilla
PPTGDILIQGTVTFEDVAVNFTWEEWNLLSEAQRCLYRDVTLENLALISSLDPALDGSADNTQTGNLGQSVLPSHPEQKTA

SEQ ID NO: 13794 - protein, 81 aa, Ailuropoda melanoleuca
LQGLVTFEDVAVDFTPEEWQYLNPPQKTLYREVMLETYSNVVSVGPQATKPDLVLKLEVEEPRPAETKISYFLLEAACQID

SEQ ID NO: 13795 - protein, 81 aa, Ailuropoda melanoleuca
QGSVSFRDVAIDFSQEEWEWLQPAQRDLYRHVMLENYGHLVSLGLNISKPYVVSLLEQGREPWLEKAEVRRDLFSGKLITT

SEQ ID NO: 13796 - protein, 81 aa, Phyllostomus discolor
VTFADIALYFSKKEWYLLDEDQRRLYLDVMLENFELISSLGCCCGAEGVKASNEENVSIEVSQAKKSNIPFSPWHCHPCES

SEQ ID NO: 13797 - protein, 81 aa, Phyllostomus discolor
KVPVTFVDIAVYFSEDEWKNLDEWQKELYNNLVKENYKTLMSLDAEGPGPKPEAPSQAEPREEPCVWEQRDPEEREILMDP

SEQ ID NO: 13798 - protein, 81 aa, Desmodus rotundus
AQVSVTFDDVAVTFTQEEWGQLDPAQRTLYQEVMVETCRLLVSLGCPVPRHELIHQLEHGQELRMVKKDLSQSTYPGEKGK

SEQ ID NO: 13799 - protein, 81 aa, Macaca fascicularis
PLTFKDVAIEFSQEEWKCLEPVQKALYKDVMLENYRNLVFLGISPKCVIKELPPTENSNTGERFQTVALERHQSCDIENLY

SEQ ID NO: 13800 - protein, 81 aa, Macaca fascicularis
ESVTLEDVAVEFIQEWALLDSARRSLCRYGMLDQCRTLTSRGTPPCKPSRVSQLAPRAEPRATERGILHATGVAWESQLKP

SEQ ID NO: 13801 - protein, 81 aa, Macaca fascicularis
QESVTFQDVAVDFTEKEWPLLDSSQRKLYKDVMLENYSNLTSLDWETPSKTKWSLLMEDIFGKETPSGVTMERAGLAEKST

SEQ ID NO: 13802 - protein, 81 aa, Macaca fascicularis
QGRLTFRDVAIEFSQEEWKCLDPAQRALYRDVMLENYRNLVSLAISSKCMMKEFSSTAQGNREVLHTGTLQRHESHHIGDF

SEQ ID NO: 13803 - protein, 81 aa, Macaca fascicularis
TTFKEAVTFKDVAVFFTEEELGLLDPAQRKLYQDVMLENFTNLLSVGYQPFHPFHFLREEKFWMMETATQREGSSGGRTVV

SEQ ID NO: 13804 - protein, 81 aa, Phascolarctos cinereus
YQESVTFRDVAVNFSREEWGQLNPAQRDLYKDVMLENYRNLVSLGLPISKPDVIFQLEQGKEPWLLGLPRAEERELPNNSS

SEQ ID NO: 13805 - protein, 81 aa, Phascolarctos cinereus
AQELVTFQDVAVDFTQEEWGLLDHPQKELYKEVMLENARNALSLGLPVPREGLISHFGQREAPWMMELEDPRTSYPVSQKL

SEQ ID NO: 13806 - protein, 81 aa, Macaca fascicularis
EELPVVFEDVAVYFTRKEWGMLDKRQKELYRDVMRMNYELLASLGPAAAKPDLISKLERRAAPWIKDPNGPKWGKGRPPGN

SEQ ID NO: 13807 - protein, 81 aa, Macaca fascicularis
AQGSVSFNDVTVDFTQEEWQHLDHAQKTLYMDVMLENYCHLISVGCHMTKPDVILKLERGEEPWTSFSGHTCLEENWKAED

SEQ ID NO: 13808 - protein, 81 aa, Phascolarctos cinereus
SQESVTFRDVTVDFSPEEWRQLGPSQKELYKEVMLENYRNLVCLGLAASKPRVICQLEQGEAPWMPGSDVAQRSSCPDWRT

SEQ ID NO: 13809 - protein, 81 aa, Phascolarctos cinereus
MWLWNSLRKSGYNLNPSQKKLYRDVMLENYRNLVFLGFAASRPNDSDQLERKEVSSLPEADIPRSSCPESREFAGDKPLEC

SEQ ID NO: 13810 - protein, 81 aa, Phascolarctos cinereus
RLRESVTFKDVAVNFTWEEWRYLEPAQRALYRDVMLENYKNLVSLGLPVSKLDVISLLERKVQWMPEGEVSRGSCTGKNLS

SEQ ID NO: 13811 - protein, 81 aa, Phascolarctos cinereus
MWENYRNLASVAGFPFPKPELISSLERGEEPWLPDVLGSSERRRILFFCIAGDEPGTPLRLQKGLEEVGVLKGHISRAWRD

SEQ ID NO: 13812 - protein, 81 aa, Phascolarctos cinereus
PQESVTFREVAIDFSLEEWGWLTPAQKELYQEVMLENYRNLVCLGLAISKPDVICQLERGEAPWVPEGDVSQSSCADSEVI

SEQ ID NO: 13813 - protein, 81 aa, Phascolarctos cinereus
SQESLMFKDSSVSFTEDEWGHFDSAQKGLYRDVMLENYRNLASMGHPVSKPDVISQLKHGKDPWTKKEIPKSHRLDSKDPE

SEQ ID NO: 13814 - protein, 81 aa, Phascolarctos cinereus
RQELVTFKDVAVDFSWEEWGHLERSQKELYREVMLENYRNLVCLGLEESKPDVIEQLEQQGAPGIQGGSALASACPDWENR

SEQ ID NO: 13815 - protein, 81 aa, Phascolarctos cinereus
WSAVTFQDVTIDLSPDQWKGLGPTQRQLYRDVMLENYRNLVSLGPESPGSRPQIISWLEQGEGREFPGSIPSDSKTQTEAR

SEQ ID NO: 13816 - protein, 81 aa, Phascolarctos cinereus
IQESVTFRDVAVDFTWEEWSRLDPAQRDLYRKVMLENCENLVSVGIPVSTTDMISLLEKRGAPWMPEGEAVSGSCPDSLSE

SEQ ID NO: 13817 - protein, 81 aa, Phascolarctos cinereus
GEEAVTFRDVALDFTWEEWGCLSAAQRELYKDVMLENYRNLVSLAGLPGPKPGLISWLEGEEEPHPWDSLVHAARSTSLSK

SEQ ID NO: 13818 - protein, 81 aa, Phascolarctos cinereus
MLENYRNLVSLGFAVSKPDVICQLERKETSWMPEADILRSSCSGSKEFTGEKCYECRECGKAFKSKKQLTVHQRIHTGAKH

SEQ ID NO: 13819 - protein, 81 aa, Phascolarctos cinereus
MRTGILKDSRVGDWSEEEWTHLDPAQRELYGDVMLENYGNLVSLGLPVFKPDVISQLKLGGESWVLNDPGIKEKEIFRGVS

SEQ ID NO: 13820 - protein, 81 aa, Phascolarctos cinereus
LQESLTFKDVAVDFTPEKWGCLDPFEKELYRNVMLENYGHLIYLGLAVSKPDVICHLERGDPPWKPVIEVPRTSFPESHLL

SEQ ID NO: 13821 - protein, 81 aa, Phascolarctos cinereus
SQESLMFKDSSVSFTEDEWGHFDSAQKGLYRDVMLENYRNLASMGHPVSKPDVISQLKHGKDPWTKKEIPKSHRLGTSLAK

SEQ ID NO: 13822 - protein, 81 aa, Phascolarctos cinereus
REAVTFQDVAVDFTWEEWARLAPSQKELYKDVMLENYRNLVCLGWKNRSDTEELAPDVEAWECKARLLKQERNEDKHSRLD

SEQ ID NO: 13823 - protein, 81 aa, Myotis lucifugus
AQEPLTFHDVAVDFTWEEWQLLDPEQKDLYRDVMLETYSHLVSVGYEASKPDILSKLDHGEAPWTVAGEIHCGTHSEIWKR

SEQ ID NO: 13824 - protein, 81 aa, Myotis lucifugus
LQGSDLFRDVAVVFSREEWEWLAPAQRDLYRDVMLETYSNLRSLDLAISKPDVIAFLEQGKEPWRAVEAAAGGLCPALEAR

SEQ ID NO: 13825 - protein, 81 aa, Myotis lucifugus
TVSNMDFEDVAIVFSEEEWGLLDEAQRLLYCDVMLEVFALVSSAGCWHNTDDEETCFEQSVSVQGESQVRSCKTEPATQRT

SEQ ID NO: 13826 - protein, 81 aa, Myotis lucifugus
GDMDFEDVAIAFSQEEWGLLDEAQRLLYCDVMLEVFALVSCADCWHKMDDEEVGPVPFVSIQGESQVRASKTAPATQRTHL

SEQ ID NO: 13827 - protein, 81 aa, Myotis lucifugus
WDMNFEDVAIVFSQEEWRLLDEAQRLLYYDVMLKVFALVSSVGCWHKMDDKEACSSQSVSIQGESQVRASKTAAATQKTLL

SEQ ID NO: 13828 - protein, 81 aa, Puma concolor
EMDSVVFEDVVVDFTQEEWALLKPAQKKLYKDVMLETFRNLVTVGKENWEDQCIEDKHNDQGRHLRNHMVERLCDSSKGNT

SEQ ID NO: 13829 - protein, 81 aa, Puma concolor
LQGSVLFEDVSVDFTLKEWRLLDPAQRLLCRDVILENYGHLVSLGRCVARPELIFKLEQGEEPWVPRRELPSQSPPGELTK

SEQ ID NO: 13830 - protein, 81 aa, Puma concolor
FQPPVSFKDVAVTFTREEWGQLDPAQRTLYRNVTLETCSHLAFLGLLLSKPAVICWLEQGQDPWRAEHGPPRDWKNTLEKE

SEQ ID NO: 13831 - protein, 81 aa, Puma concolor
FQASVVFEDVAVKFTPEEWALLDRGQRKLYRDVMLETCRNLSSVEKQKFHSNGDLTRMQEGLLRSPLVESVCERIEGDQCG

SEQ ID NO: 13832 - protein, 81 aa, Puma concolor
FKEAVTFKDVAVVFTEEELGLLDPAQKKLYGDVMLENFRNLLSLGHQPFTPDAVPQFKRGGRLWMIKAATQSHGSSGDRNL

SEQ ID NO: 13833 - protein, 81 aa, Puma concolor
MAFRDVAVDFSQEEWMLLSPAQRSLYREVMLENYSNLVSLGIPVTKPKLITQLEQGKETWREERKCSPATCPAEPKPELHL

SEQ ID NO: 13834 - protein, 81 aa, Puma concolor
SVGPVSFRDVAVDFTQEEWQYLDPEQKTTYRDVMLENYSHLVSVGCHIIKPEVIIKLEQGEEPWIVEGEFLPHSYPEEVWK

SEQ ID NO: 13835 - protein, 81 aa, Puma concolor
AQVSVTFDDVAVTFTQEEWGQLDPAQRTLYQEVMLENCGLLVSLGCPVPRPELICQLERGQEPWTAKRGLSQNTYPGDKDK

SEQ ID NO: 13836 - protein, 81 aa, Sapajus apella
KEAFAAFRDVAVDFTQEEWRLLSPAQRTLHREVMLETYNHLVSLEIACSKPKLIAQLERGEEPWREERKCSLDLRPGSKPE

SEQ ID NO: 13837 - protein, 81 aa, Sapajus apella
YQDSVTFDDVAVDFTQEEWTLLDPSQRDLYRDVMLENCENLASVGRHLFKPSVICWLEEEGQLRAGQRGVLQEWQLESKGS

SEQ ID NO: 13838 - protein, 81 aa, Sapajus apella
MVTFKDVAVVFTEEELGLLDSVQRKLYRDVMLENFSNLLLVAHQPFKPDLISQLEREEKLLMVETETPRDGCSGRKNQQKM

SEQ ID NO: 13839 - protein, 81 aa, Gorilla gorilla
EMGPLTFRDVAIEFSLEEWQCLDTAQQDLYRKVMLENYRNLAFLAGIAVSMPDLVTCLQQGKDPWNVKRQSTVVKPPVQTG

SEQ ID NO: 13840 - protein, 81 aa, Ailuropoda melanoleuca
QEAVVFADVAVDFTPEEWALLDGGQRRLYRDVMLETCRNLASLDCYTQVKPCGSRSQLNILENELSSEEKIVRFIRNDSWA

SEQ ID NO: 13841 - protein, 81 aa, Ailuropoda melanoleuca
GSLSFRDVAISFFQEEWECLDPAQRALYRDVMLETYSNLVSVGSSISKPDVIALLEQDKEPWVVLRRETSGWYSDLESSYG

SEQ ID NO: 13842 - protein, 81 aa, Gorilla gorilla
QGYVTFEDVAVYFSQEEWRLLDDTQRLLYRNVMLENFTLLASLGLASSKTHEITQLESWEEPFMPAWEVVTSAILRVWLRN

SEQ ID NO: 13843 - protein, 81 aa, Ailuropoda melanoleuca
SQESLTFQDVAVNFTREEWDQLYPAQKNLYRDVMLENYRNLVALGIGHQLYKPEVISQLEQEEQWVMERGRALDTHADGES

SEQ ID NO: 13844 - protein, 81 aa, Ailuropoda melanoleuca
RESLTLEDVAVDFTWEEWQLLAPTQKNLYRDVMLENYRNLVSVGTGYVASKPDALSRLEQEEPWTTEDEIHSRFHPGERKP

SEQ ID NO: 13845 - protein, 81 aa, Ailuropoda melanoleuca
QGSVSFRDVAVDFSREEWQHLDLAQRSLYRDVMLETYSHLLSVGFEVPQPEVFMLEQGKEPWALQGESPHQNCPGEKLWDY

SEQ ID NO: 13846 - protein, 81 aa, Lynx canadensis
MLFVSRTELPNPCPILYLSPCTGHQLPKPDVILRLEKGEEPWLVERGTHRETHPDLDTAVEIKSSVSSESISKDKQSYGIK

SEQ ID NO: 13847 - protein, 81 aa, Lynx canadensis
AHRSLMFSDVSIVFSQEEWEYLDLEQRDLYRDVMLENYSNLVSLGCFISKPDVISLLEQGKEPWKVVRKGRRRYADLETRY

SEQ ID NO: 13848 - protein, 81 aa, Lynx canadensis
DEALMAFRDVAVAFTQKEWRLLSPAQRTLYRDVMLENYSHLVSLEPGTEFQPCVHSCPVAFSSPQFLQQYVLCGHLPQIFP

SEQ ID NO: 13849 - protein, 81 aa, Phyllostomus discolor
AQAPVTFKDVSVTFTREEWELLAPAQRTLYHEVMLETCRILVSLGHPVPRPELVHLLEHGQELWTVKRGSPRHTCPGDGAK

SEQ ID NO: 13850 - protein, 81 aa, Phyllostomus discolor
GPVTFKDVIVEFTQEEWQLLDTAQRTLYREVMQENYGHLVSVDLWNIHDRGGRYQKSQAENSRTGEPMDQKIHTRAKIYTC

SEQ ID NO: 13851 - protein, 81 aa, Phyllostomus discolor
FQEAVTFKDVAVVFTEEELGLLDPSQRKLYQDVMVENFRNLVSVGHQSFTADVIPQLERRGKLWVVRTAPQSQSSSGDKTL

SEQ ID NO: 13852 - protein, 81 aa, Phyllostomus discolor
AQALLSFEDVAVGFTWEEWRLLDPAQKDLYRDVMLENYSNLLSVGYQSSNSDSLFWLEQGGPRWIAEEAAHSPACPDHSVV

SEQ ID NO: 13853 - protein, 81 aa, Phyllostomus discolor
PQKLVTFEDVAVYFTPTEWDGLSPAQRALYRDVMLENYGNVASLGFPILKPAVISQLEGGGELGIPSLLAAGVGSDPPGLW

SEQ ID NO: 13854 - protein, 81 aa, Phyllostomus discolor
NFWVLRLPPGSKGEAPKEWGKLDEWQKELYKHVMRGNYETLVSLDYAISKPEVLSQGEQGKEPCGWRRTAPKVPDAPVDPS

SEQ ID NO: 13855 - protein, 81 aa, Phyllostomus discolor
PKVPVTFDDVAVHFSEQEWGNLSEWQKELYKNVMRGNYESLVSMDYAISKPDLMSQMERGERPTMQEQEDSEEGEPPADPS

SEQ ID NO: 13856 - protein, 81 aa, Phyllostomus discolor
CQGSLSFSDVAVGFTRKEWQQLDPTQRTLYRDVMLETYSHLVSVGCQVTKPAVISKLELGQEAWMEEEEIRRWGVPDPSGG

SEQ ID NO: 13857 - protein, 81 aa, Phyllostomus discolor
SRSLDSDGVCFSEQEWENLEDWQKELYRNVMMSNYETLVSLKVLGQPEGEAELGTEMLGDLEEEGLGGVHPAGGVMIKQEI

SEQ ID NO: 13858 - protein, 81 aa, Phyllostomus discolor
KPRAMKFADVAVYFSPEEWECLRPAQRALYRDVMQETYRHLGALGCAGPKPALISWLERNTDDWEPAALDPQECPRGLTVQ

SEQ ID NO: 13859 - protein, 81 aa, Phyllostomus discolor
AKAFVTFEDVAVHLSKKEWLLLDESQRRLYLDVMLDNYGLISSLGCCCGTEDEETPNEQNITVRVSKAMNLKTALSSQKSH

SEQ ID NO: 13860 - protein, 81 aa, Phyllostomus discolor
QDSVVFADVAVDFTLEEWALLDSAQRNLYRDVMLENFQNLASVDNETLFTARGPIIQQDMHEEKISNKQEIAKFTRSNSCI

SEQ ID NO: 13861 - protein, 81 aa, Phyllostomus discolor
MEPVTFGDVTLNFTKEEWSLLDLKQRRLYRDVMLENFRNLACIDQAIQPKTKDSVSQQDILAKKTLHTANRVSLTSNSAAL

SEQ ID NO: 13862 - protein, 81 aa, Phyllostomus discolor
AHDSVTFGDVAIDFSQEEWEFLDAAQRDLYRNVMWENFSNFISLGLFISNLDVITLLDEGKEPGRVLRERTRRLYLDLESR

SEQ ID NO: 13863 - protein, 81 aa, Myotis lucifugus
RIMNMNFEDVAIVFSEEEWGLLDEAQRLLYCNVMLEVFALVSSAGCWHKSDDEEACSERSLSVQVKSQVRASKTEPATQRT

SEQ ID NO: 13864 - protein, 81 aa, Myotis lucifugus
ISFEDVAVDFTLEEWQLLNPIQKNLYRDVMLENYSNLVFLGHEIIKPDAVWKLEQEEPWKINEEILNHNFSEELWLDNNLK

SEQ ID NO: 13865 - protein, 81 aa, Sapajus apella
PQDLMTFEDVAVEFTQWEWGQLNPAQKNLYREVMLENFRNLTLLGLLVSKPYVICQLEEGGEPFMVKREISIGAHSDWERR

SEQ ID NO: 13866 - protein, 81 aa, Sapajus apella
WQGQVNFEDVFVYFSQEEWVLLDEAQRLLYRDVMLENFALMASLGCWPGMKDEEIPFEQSFSIGLSQIRIPKGSPFTQKAY

SEQ ID NO: 13867 - protein, 81 aa, Sapajus apella
MPGRPGSLEMGPLTFRDVAIEFSLEEWQCLNTDQQDLYRKVMLENYRNLVFLGRSDHLSAGRKRSLEYEETQYGSQAPRGR

SEQ ID NO: 13868 - protein, 81 aa, Sapajus apella
CYQDSVTFDDVAVDFTQEEWTLLDPTQRSLYSDVMLENYKNLATVGGQIIKPSLISWLEKEESRTVQGGVLQGWELQLETQ

SEQ ID NO: 13869 - protein, 81 aa, Sapajus apella
AQGTVTFEDVAVKFSQEEWSLLSEAQRCLYHDVMLENLALISSLGCWYGAKDETPSKQTLSIQQQSPLRSHWTGGHDVTLK

SEQ ID NO: 13870 - protein, 81 aa, Sapajus apella
PGASVSFQDVAVEFTQEEWQHLGPVEWTLYRDVMLENYSHLVSVGYCITKPKVISQLEQGEEPWSLEDEFLNQRYPGHFKV

SEQ ID NO: 13871 - protein, 81 aa, Sapajus apella
LPFQVTFSDVAIHFSHEEWGWLDSAQRDLYKDVMVQNYKILVSLAGLSITKPYVITLLEDGKEPWMMEEKLSKGVTPGESW

SEQ ID NO: 13872 - protein, 81 aa, Sapajus apella
KQGSVTFRDVAIDFSQEEWEFLDPAQRDLYRDVMWENYSNFISLDLDSRYRTNTLSPEKDLYEIYSFQWDIMERIKSYSLQ

SEQ ID NO: 13873 - protein, 81 aa, Oryctolagus cuniculus
SQEPLSFKDVSVDFSQEEWGQLAPVHQNLYREVMLENYRNLVSVGYQLSKPSVISQLEKGEEPWMAEREDLGDPSSDLRSK

SEQ ID NO: 13874 - protein, 81 aa, Oryctolagus cuniculus
SLGPVSFKDVAVGFTQEEWRQLEPAQRRTYREVMLENYSHLVAVGCHFIKPDVITKLERGEEPWIEGGFLPQGCADEVWQA

SEQ ID NO: 13875 - protein, 81 aa, Oryctolagus cuniculus
QVQGSVTFRDVAVFFSQDEWLHLDSAQRRLYREVMLENYSNLLSLGILFSKPKVISQLEQADHWLVKKEVPRGTRLGWESL

SEQ ID NO: 13876 - protein, 81 aa, Oryctolagus cuniculus
LGHGDGCRGEEELRLLDTAQRALYRAVMLENFRNLLSGPSTWAILHCTPWPQQRAGSEEKQPGLEPQIWEHAAGDSTRLQD

SEQ ID NO: 13877 - protein, 81 aa, Oryctolagus cuniculus
RPRALKFVDVAVYFSEEEWGCLRPAQRALYRDVMRENYGHLGALGCAGPKPALISWLERNTEDWEPAALDPQEYPRGLTAQ

SEQ ID NO: 13878 - protein, 81 aa, Oryctolagus cuniculus
MTAFEDLAVYFTWEEWQKMNNAQKILYRDVMLETYSSLFSLGHCITKPDLIFKLERGEEPWIVDECLNLSLSVVMKRDDLI

SEQ ID NO: 13879 - protein, 81 aa, Pteropus alecto
SVAFEDVAVNFTPEEWALLDPSQKKLYRDVMRETFENLASVGKGMEDYDTEDQYKNQGRKLRSHIEERICESEASSECEEN

SEQ ID NO: 13880 - protein, 81 aa, Oryctolagus cuniculus
KPGAVRFADVAVYFSSEEWGCLRPAQRALYRDVMRENYGHLGALGFPGPKPALISWMERESEAWSPAAQDPDEGQSPGGAL

SEQ ID NO: 13881 - protein, 81 aa, Pteropus alecto
SRESVTFKDVAVDFTQEEWRHVDPAQRRLYRDVMLENYSNLVSLGYQVSKPEVIFKLEQGEEPWLSEGEIQRPFFPDESTL

SEQ ID NO: 13882 - protein, 81 aa, Oryctolagus cuniculus
MKSVGCPVPRPELICQLERVQEPWTLKNDLSQSSRSGPKGRLKNTEPAACEPALRDGASGDSQLVQARHQDRSSEMQEGYL

SEQ ID NO: 13883 - protein, 81 aa, Desmodus rotundus
SQSLVTFGDVAVDFSQEEWEQLTCAQRALYRDVMLENYRNLVSLGLCFSKPDMISSLEQREEPWMAKRKLTRGPCPDWRAV

SEQ ID NO: 13884 - protein, 81 aa, Desmodus rotundus
AQDCVVFEDVAIHFSQEEWGLLDEAQRHLYHSVMLENLALLSSVGCWSGAQVEEAPLEQGDSGGGSQVRTPKSALSTQKAQ

SEQ ID NO: 13885 - protein, 81 aa, Macaca fascicularis
SQEQVSFKDVCVDFTQEEWYLLDPAQKILYRDVILENYSNLVSVGYCITKPEVVFKIEQGEEPWILEKGFPSQCHPERKWK

SEQ ID NO: 13886 - protein, 81 aa, Macaca fascicularis
MAMYLTREEWRPLDPAQRDLYRDVMQENYGNVVSLDFEIRSENEVNPKQEISEDVQFGTSERPAENAEENPESEEGFESGD

SEQ ID NO: 13887 - protein, 81 aa, Macaca fascicularis
LTFKVVAIEFSAEEWKCRDPAQQNLYRDVMLQNYRNLGVAICNPDMVTCLEQRKEPYNMKIYETVAKPPDIHQWGIFCLIL

SEQ ID NO: 13888 - protein, 81 aa, Macaca fascicularis
VKESVTFKDVAIDFTLEEWRLMDPTQRNLHKDVMLENYRNLVSLGLAVSKPDMISHLENGKGPWPKPATKNATRTKDISED

SEQ ID NO: 13889 - protein, 81 aa, Macaca fascicularis
FQGPLTFRDVTVEFSLEEWQCLDTVQQNLYRDVMLENYRTLVFLAGIAVSKPDLITCLEQGKEPWNMNRHEMVATPPVFSL

SEQ ID NO: 13890 - protein, 81 aa, Macaca fascicularis
AQVSVTFEDVAVTFTQEEWGQLDAAQRTLYQEVMLETYGLLVSLGCPLFEPELIYQLDRREELWIVKKDLSQSSYPGDNTK

SEQ ID NO: 13891 - protein, 81 aa, Macaca fascicularis
AKGLPSNDTDWPQEKEGKAQIVVPVTFRDVAVIFTEAEWKRLSPEQRNLYKEVMLENYRNLLSLGQGIETILANMVKPHLY

SEQ ID NO: 13892 - protein, 81 aa, Phascolarctos cinereus
IQGLVTFEDVSVDFSRSEWKQLKPAQRDLYKDVMLENYKNLVSLGLQSFKPEVISRLEQGEVPWILADHVPKEFALERIRG

SEQ ID NO: 13893 - protein, 81 aa, Phascolarctos cinereus
WKTPSQQSVTYEDVAVDFTQEEWYLLDLSQKALYRDVMLETYQHLLSLGLPVPKDRGEAPWILEEYQRKSCLDEGTIPQTK

SEQ ID NO: 13894 - protein, 81 aa, Macaca fascicularis
MFKEAVTFNDVAVAFTEEELGLLGPAQRKLYRDVMVENFRNLLSVGHQPFKQDVSPIERNEQLWIVTTATQRQRNLGEKNQ

SEQ ID NO: 13895 - protein, 81 aa, Macaca fascicularis
GLTFRDVAVEFSQEEWKCLDSTQRTLYRDVMLENYRNLVSLDLSRNCMIKELAPQRESNREEVFHTVTLEQHEKHDIEEFC

SEQ ID NO: 13896 - protein, 81 aa, Phascolarctos cinereus
WQESLTFKDVAVDFTQEEWGLLDHSQKRLYKEVMLENSQNLLSLGIPPLREDLISHLEEGEASWILDRKGPRKSCPDAETR

SEQ ID NO: 13897 - protein, 81 aa, Phascolarctos cinereus
QHLVTFRDVAVDFSLEEWRCLSPTQRALYRDVMLEIYDNLVSVGAGLPVSKADVISLLERGAAPQKPKGKVPRGTCPDFGK

SEQ ID NO: 13898 - protein, 81 aa, Phascolarctos cinereus
PSQEAVTFKDVAVDFTQEEWCLLDTSQKALYKDVMLETSQNLLSLGLPVAKADLISHLNQEETWMLKEDDPRNSSIGGETR

SEQ ID NO: 13899 - protein, 81 aa, Phascolarctos cinereus
EELPVVFEDVAVYFTREEWAMLDKRQKELYRDVMRMNYELLASLGPAAAKPELISKLERRAAPWIKDPNGPKWGKGRPPGK

SEQ ID NO: 13900 - protein, 81 aa, Phascolarctos cinereus
AQGLLTFEDVAVIFSQEEWRHLDCVQRALYKDVMWENYRNLASVAGFPFPKPELISSLERGEEPWLPDVLGSSERRRILFF

SEQ ID NO: 13901 - protein, 81 aa, Phascolarctos cinereus
GKESVTFKDVAVEFTQEEWVQLNSSQKKLYKDMMLENYRNLVSLGFAISKPDVIYQLERKEASWMPEADIPRSSCPERRGF

SEQ ID NO: 13902 - protein, 81 aa, Phascolarctos cinereus
GRESVTFKDVAVEFSLEEWVYLNPSQKKLYGDVMLENYRNLVSLGFAVSKPDVIYQMERKEASWMPETDIPRNSCPESKEF

SEQ ID NO: 13903 - protein, 81 aa, Phascolarctos cinereus
PQALVTFKDVAVDFTPEEWRHLDPSQKRLYWDVMLENYRNLVYLGLEGSRPEAVYLLEGGEARWTPEGDVLRSTCPDWKTK

SEQ ID NO: 13904 - protein, 81 aa, Phascolarctos cinereus
GARGPVSFADVAVYFSPEEWGRLSPAQRALYRDVMRETYGHLGALGFPGPKPALISWMEQEAWDSDAKSPEGEWEKAVTCG

SEQ ID NO: 13905 - protein, 81 aa, Phascolarctos cinereus
PKVPLTFDDVAVYFSEQEWGKLDEWQKDLYKHVMRGNYETLVSLDYAISKPEVLSRIEQGKEPCGWRRAGPKNPDIHTDPN

SEQ ID NO: 13906 - protein, 81 aa, Phascolarctos cinereus
SQETVMFDDVAVYFTRKEWMCLDSPQRALYRDVMLENYGNLVCLAGFPVSKPDLIFQLEQGEEPWDLELQGTEEREDTWES

SEQ ID NO: 13907 - protein, 81 aa, Myotis lucifugus
PKVPVTFDDISIYFSTPEWEKLEEWQKELYKNIMKGNYESLISMDYAMNQPDVLSQIQPEGEHNTEDHAGPEESEIPTDPS

SEQ ID NO: 13908 - protein, 81 aa, Puma concolor
QASVVFEDVAVYFTPEEWALLDRGQRKLYRDVMLETCRNLAAVENPVFHNIGDQSQSQERRLRSPLVESVCERIEGDPCGE

SEQ ID NO: 13909 - protein, 81 aa, Puma concolor
TQDSVTFEDVAMYFSWEEWGLLDEAQRWLFHNVMLENFALVTSLGCWHGAGDGEAPSEQSAFVGASQVRTHQASPDPQKAH

SEQ ID NO: 13910 - protein, 81 aa, Puma concolor
PQASVSFKDITVEFTQEEWRQMDSAQRTLYRDVMLENYSHLVSVGYCFTKPELIFTLEQGEDPWLFKKEFLRKGSPEEYQP

SEQ ID NO: 13911 - protein, 81 aa, Puma concolor
PQVSVSFEDVAVLLSWEEWGCLGPAQKGLYRDVMLETYRNLVSLGLQRSKPDVISRLEKGEEPWAPHSLRIEESWIRNHRS

SEQ ID NO: 13912 - protein, 81 aa, Sapajus apella
WLGPLTFMDVAIEFCLEEWQCLDTAQQNLYRNVMLENYRNLVFLGIAVSKPDLITCLEQEKEPWNMKRHEMVAKSSVTCSH

SEQ ID NO: 13913 - protein, 81 aa, Sapajus apella
EKDSVAFEDVSVNFSQEEWALLAPSQKKLYRDVMQETFKNLASIGKKWEDQNVEDQHKNQGKNLRSHMVERLCESKEGSQC

SEQ ID NO: 13914 - protein, 81 aa, Sapajus apella
EMTKFQKAVTFKDVAVVFSSEELRLLDLTQRTLYRDVMVENFKNLVAVDMVSQLEAEEKLWMMEAETQRSRYSGENPAAIL

SEQ ID NO: 13915 - protein, 81 aa, Sapajus apella
AQGLVTFRDVAIEFSLEEWKCLEPAQRDLYREVTLENFGHLVSLGLSIPKPDVISLLEQGKEPWMIANDVTGPWCPDLESR

SEQ ID NO: 13916 - protein, 81 aa, Sapajus apella
PKVPVTFDDVAVYFSEQEWGKLEDWQKELYKHVMRGNYETLVSLDYAISKPEVLSQIEQGKEPCSWRRPGPKIPDVPVDPS

SEQ ID NO: 13917 - protein, 81 aa, Sapajus apella
RGSLLTFEEVAMYFSQEEWELLDPTQKALYNDVMQENYETVISLALFVLPKPKVISCLEQGEEPWVQVSPEFKDSARGSST

SEQ ID NO: 13918 - protein, 81 aa, Sapajus apella
PLTFRDVTIEFSQEEWKCLDPMQKALYKDVMLENYRNLVFLGISPKCMIKELPPTENSNIRERFQTVTLERHQSYNLENLY

SEQ ID NO: 13919 - protein, 81 aa, Sapajus apella
TSKEAVTFKDVAVVFTEEELGLLDPVQRRLYQDVMLENFRNLLSVGHQPFNRDTFYFLREEKFWMMDIATQREGSSGGKIQ

SEQ ID NO: 13920 - protein, 81 aa, Sapajus apella
VHGSVTFRDVAIDFSQEEWECLQPAQKTLYRDVMLENYSHLISLGSSISKPDVITLLEQEKEPWMVRRKETNRWYPDLESK

SEQ ID NO: 13921 - protein, 81 aa, Oryctolagus cuniculus
RLTFRDVAIDFSQEEWKCLDPDQRALYRDVMLENYKNLVSLDICAKIGIKEFLPEDTHHSPLHGSHTGRGSLRTAGVWETR

SEQ ID NO: 13922 - protein, 81 aa, Oryctolagus cuniculus
QVTFRDVTIEFSQEEWDCLDPTQRALYRDVMLENYRTLLSLDIFSKYVTKELPPERNSNLEEIFQTVVLEAQESHEIEEFH

SEQ ID NO: 13923 - protein, 81 aa, Oryctolagus cuniculus
MTFDDVALYFSEQEWEILQKWQKEMYQQVMKANYETLDSLGCIWSKPVLITSIEQGRTLLIRDQGSLDKTRKTTGSCTDDL

SEQ ID NO: 13924 - protein, 81 aa, Pteropus alecto
EEEEVAALRLTARSQASVTFKDVAMDFTPEEWGKLDPAQRDTMLENYRNLVSLYPHLKETDPVWASYTKQQRIQGTQSRKG

SEQ ID NO: 13925 - protein, 81 aa, Oryctolagus cuniculus
RVKNSVHGCLVYSDDALNFRDIYVQSHRFLWEALGCLDPAQRALYRDVVLEHHRTLPSLPEFLTPSIPSAYTALCGSLWFS

SEQ ID NO: 13926 - protein, 81 aa, Phyllostomus discolor
RQLFCESLTFKDVSVDFSWEEWECLDPAQRKLYSDVMLENYSNLVSLGLVVSKPVLVTFLEQMQEIWDVSRKKSISTAPGR

SEQ ID NO: 13927 - protein, 81 aa, Macaca fascicularis
KSKEPVTFKDVAVVFSEEELRLLNLAQRKLYRDVMLENFRNVVSVGHQSTPDGLPQLEREEKLWMMKMATQRDNSSGGKNL

SEQ ID NO: 13928 - protein, 81 aa, Macaca fascicularis
EAVTFKCVAVFFTEEELGLLDPAQRKLYQDVMLENFTNLLSVGHQPFHPFHFLREEKFWMMETATQREGSSGGRTVVEAGP

SEQ ID NO: 13929 - protein, 81 aa, Macaca fascicularis
MLENYGAVASLAAFPFPKPALISQLERGEAPWCSVPWGALDGEDPRSISSGYPFLKPAGISHLEQVEEPLNLKLQEEGPSL

SEQ ID NO: 13930 - protein, 81 aa, Macaca fascicularis
CYQDSVTFDDVAVDFTQEEWTLLDPTQRSLYSDVMLENYKNLATVGGQIIKPSLISWLEQEESRTVRGGVLQGRKTQWRGT

SEQ ID NO: 13931 - protein, 81 aa, Macaca fascicularis
MTFEDIVVDFTREEWALLDTSQRKLFQDVMLENISHLVSIGKRLCKSVVLSHLQHVEKLSTQGMSLLQGREGDIKHQEIPF

SEQ ID NO: 13932 - protein, 81 aa, Macaca fascicularis
PQASVCFEDVAMAFTQEEWEQLDLAQRTLYREVTLETWEHIVSLGLFLSKSDVISQLEQEEDLCRAEQVAPRGARSSKEQR

SEQ ID NO: 13933 - protein, 81 aa, Macaca fascicularis
EMGPLTFMDVAIEFCLEEWQCLDTAQQNLYRNVMLENYRNLVFLGIAVSKPDLITCLEQEKEPWEPMRRHEMVAKPSVMCS

SEQ ID NO: 13934 - protein, 81 aa, Macaca fascicularis
FQGSVSFEDVTVGFSQEEWQHLDPSQRALYRDVMLENYSNLVSVGYCVHKPEVIFRLEQGEEPWRLEEEFPSQSFPEVWTA

SEQ ID NO: 13935 - protein, 81 aa, Macaca fascicularis
RREQVTFEDVVVDFSQEEWGQLKPAQRTLYRDVMLDTFRLLVSVGHWLPKPNVISLLEQEAEPRAVDSGVPPGVYPDLETR

SEQ ID NO: 13936 - protein, 81 aa, Macaca fascicularis
MALVTFRDVAIDFSQKEWECLDTTQRKLYRDVMLENYSNLVSLGYSGSKPDVITLLEQGKEPCVAVRDVTGRQYPGLLSRH

SEQ ID NO: 13937 - protein, 81 aa, Macaca fascicularis
AQESVTFEDVAVNFTNREWQSLTYAQRHLYKHVMLENYGNMVSLGFPFPKPPLISHLERGVEPCVQDPQDRESLSCSYPVS

SEQ ID NO: 13938 - protein, 81 aa, Macaca fascicularis
PQASVCFEDVAMAFTQEEWEQLDLAQRTLYREVTLETWEHIVSLGLFLSKSDVISQLEQEEDLCRAEQVAPRDWKTTLEEN

SEQ ID NO: 13939 - protein, 81 aa, Phascolarctos cinereus
MLENFGNLVCMGLAGSKPDVIHQLEQGEVAWRPREGLSRSSGPDWETRLENKEFISALGTFIEESSREKLRVDRPCVLKLR

SEQ ID NO: 13940 - protein, 81 aa, Phascolarctos cinereus
AKESVTFKDVSVDFTREEWGQLDPAQKNLYRDVMLENYRNLVSLGLQVFKPDVIARLERTEVPWTLENKVLRPSCLDWKRQ

SEQ ID NO: 13941 - protein, 81 aa, Phascolarctos cinereus
PQESVTFGDVAVDFTWEEWGRLGSSQKKLYREVMLENYRNLACLGLAFSKPPLISQLEQGEAAWMPGEESQRAVCADWKSK

SEQ ID NO: 13942 - protein, 81 aa, Phascolarctos cinereus
CQEPVTFRDVVVDFTPEEWGRLGPSQRQLYQDVMLETYRNLVSLGIPVPDCDTLCHLEQVDMLRVGEEADGKPGPEASRPK

SEQ ID NO: 13943 - protein, 81 aa, Phascolarctos cinereus
SFIPLTFQDVAVDFTWEEWGLLEPSQKDMYWDVMLENYENFVSLGGVPVSLPDVISRMERIEAPWMAEGGVLVTTFLDSLS

SEQ ID NO: 13944 - protein, 81 aa, Phascolarctos cinereus
AQELVTYKDVAVDFTPEEWGLLDHAQKELYKTVMLENAQTLLSLGLPVPREDLISHFEQGGLRNCCPDTENRLDVKEMSAH

SEQ ID NO: 13945 - protein, 81 aa, Phascolarctos cinereus
IRAFLTFDDVAVYFSEKEWGNLEEWQKETYKHVMRTNYETLTSLDHAVPKPDLISWIEQGKEPFIKDLVDLKRRETVVTCG

SEQ ID NO: 13946 - protein, 81 aa, Phascolarctos cinereus
GGEAVTFEDVALHFTRKEWTHLDPSQKALYRDVMLENYGNMVWLGFPVSKPDLIHQLEQGEELWALDLQGSEDREETLRTS

SEQ ID NO: 13947 - protein, 81 aa, Phascolarctos cinereus
GKELVTFKDVAVEFTPEEWVQLNPSQKKLYRDVMLENYRNLVSLGFAVSKPDVIYQLERKEASWMPKADIPRSSCPESREF

SEQ ID NO: 13948 - protein, 81 aa, Phascolarctos cinereus
VGHPVTFRDVAVDFSLEEWRCLSPAQRALYRDVMLENYENLVSVGLPVSKPTVISLLEKGEAPWMPQAGAPRGPCPDYLSW

SEQ ID NO: 13949 - protein, 81 aa, Phascolarctos cinereus
LYESVTFQDVAVEFTWEEWVRLNPSQKTLYKDVMLENYRNLVSLGFAVSKPDVIYQLEHKEASWMSEPDFPSSSCPGSKEF

SEQ ID NO: 13950 - protein, 81 aa, Phascolarctos cinereus
AQELVTFQDVAVDFTEEEWGLLDHSQKELYKEVMLENAQNLLSLGLPVTREDLISFFQKGEAPWILEPKGPWNFCPDAVTR

SEQ ID NO: 13951 - protein, 81 aa, Myotis lucifugus
VTFGDLAIYFSQEEWEGLSPQQRGLYKGVMLENYQTLVSLGLCGRKPSMIALLEKGQAPWMERFVRLPCGLGEWSKCETNK

SEQ ID NO: 13952 - protein, 81 aa, Myotis lucifugus
QDMNFEDVAIAFSQEEWGLLNNAQRLLYCDVLLEVFALVSFIGHCHKIDDVEAYSEHSVSVGESQVRASKTAVATQRTHLC

SEQ ID NO: 13953 - protein, 81 aa, Puma concolor
LLFQVTFSDVAIDFSHEEWGWLDSAQRDLYKDVMVQNYENLVSLGLSIPKPYVISLLEDGKEPWMVDKKLSKDWESRWENK

SEQ ID NO: 13954 - protein, 81 aa, Puma concolor
AEGSVTFEDVALYFSWEEWDLLDEDQRCLYHDVMLENFALTSSLGLLLGSSRSLTQLGLGEESSVLPRMDIAPVSMRWAQR

SEQ ID NO: 13955 - protein, 81 aa, Puma concolor
VVTQERLTFRDVAIEFSQEEWVCLDPCLREGTSLENYRNLVSLGKENVPPEVGICPNSSATFVIKELLRKKDINNGELYQS

SEQ ID NO: 13956 - protein, 81 aa, Sapajus apella
PRLPLTFEDVAIYFSEQEWQDLQAWQKEIYKHVMRSNYETLRSLDDGLPKPELIYWIEQGEEPFRNWRESQKSGNIICSSV

SEQ ID NO: 13957 - protein, 81 aa, Sapajus apella
VVFEDVAVDFTLEEWALLDSAQRDLYRDVMLETFRNLASVDDETPCKADRSVSQQDMYRGKISQEQTILNFTRSNSCAYAL

SEQ ID NO: 13958 - protein, 81 aa, Oryctolagus cuniculus
SQSLVEFGDVAIDFSQEEWEWLNPAQRTLYRKVMLENYRNLASLGLCGSKPAVISSLEQGKEPWAVKRKVARGWSPDLKTV

SEQ ID NO: 13959 - protein, 81 aa, Oryctolagus cuniculus
AAGSVTFKDVTMAFTQKEWEQLDPAQRKLYKDVMLENYSNLTSMGYEASKPDMISKLEKGEELWLGKGRRPSQSRLNKVER

SEQ ID NO: 13960 - protein, 81 aa, Oryctolagus cuniculus
SPVLLSFEDVAVYFTWEEWQKLDNTQRTLYRDVMLEIYSNLLSLGYYLTKPEVISKLEQGAEPWNTEESPNQSLPVVQRMD

SEQ ID NO: 13961 - protein, 81 aa, Pteropus alecto
QEGPVTFKDVAVNFSRGEWKKLEPFQKQLYKEVLLENFRNLEFLGFPVSKLDLISQLKWIELPWLLEKEVSKGSKPECNSR

SEQ ID NO: 13962 - protein, 81 aa, Pteropus alecto
MEFTWEEWQLLDPTQRYLYREVILENYRNLVSVGYHGTKPDLIFKLEQGEEPWILSARISHESCAGWKEWYQKNQDELQSI

SEQ ID NO: 13963 - protein, 81 aa, Pteropus alecto
HGSMPFSNVTVAFTHEQWRHLVPAPRDKFKEGIPDKSRNLVLLDRKIVSQSPPEQDISEESCQDTSVEVSPGKSNHRNSDL

SEQ ID NO: 13964 - protein, 81 aa, Pteropus alecto
LLTFEDVAISFSEEEWKLMDPAQKMLYSDVMQENYEAVISLGLKLKKDTGNDQPISTSTLEIQASGCKVLRKARMKVAQKT

SEQ ID NO: 13965 - protein, 81 aa, Oryctolagus cuniculus
MRPGTVWVEGSAVLGTLTQGLRFSQTGGDISKPRVIVKLEQGEEPWVPEGELPCRSRAEEAWKAGAPAERVRAAGGARSAR

SEQ ID NO: 13966 - protein, 81 aa, Muntiacus muntjak
LRLSVTFDDVAVTFTQEEWGHLDPAQRTLYQEVMLENCGLLVSLGCPVPRPELIYQLEHGQELWTVKRDLSRSTCPGDNGK

SEQ ID NO: 13967 - protein, 81 aa, Muntiacus muntjak
MGRLMFQDVAIDLTQEEWECLDLGQRDLYRDVMLETYGNLTSLGLVVSKPDLVTFLEQMKNPWDVRRTDTTATYLGPRSSE

SEQ ID NO: 13968 - protein, 81 aa, Muntiacus muntjak
APVTFGDLAIYFSQEEWEWLSPIQKDLYEDVMLENYQNLVSLGLCFRRPNVITLLERGKAPWMVDPVKRRRGLDLGSKGET

SEQ ID NO: 13969 - protein, 81 aa, Canis lupus
SFEGSVSFRDVAVDFSREEWQHLDLAQRNLYRDVMLETYSHLLSVGYEVPQPEVFMLEQGKEPWALQGESPHQNCPEDLWQ

SEQ ID NO: 13970 - protein, 80 aa, Muntiacus muntjak
MGRLMFQDVAIDFTQEEWECLDLGQRDLYRDVMLETYGNLASLGLVVSKPDLVTFLEQMKNPWNVRRTDTTATYPENANL

SEQ ID NO: 13971 - protein, 81 aa, Canis lupus
RSQESLTFQDVAVNFTREEWDQLYPAQKNLYRDVMLENYRNLVALGHQLYKPEVISQLEQEEQWVMERDSPLESHADGENR

SEQ ID NO: 13972 - protein, 81 aa, Muntiacus muntjak
DLVTFKDVAVDFSQEEWQWLSPAQRGLYRSMMLENYQSLVSLGLCISKPYVISLLEQGKEPWMMMENEMRSPFPDWESIHE

SEQ ID NO: 13973 - protein, 81 aa, Muntiacus muntjak
GQGLVTFRDVALNFSQEEWEWLDSSQKDLYRDVMLENYRNLVWLGLSISKPNMISLLEQGKEPWMVEREMSDGQHADWESW

SEQ ID NO: 13974 - protein, 81 aa, Canis lupus
PVIFRDVAMYFTQNEWQLLEPAQKDLYRDVMLENYGHLASLDKKRRLVLKTFPKPGISMRPSPGKAKEVVQRGSRTERILE

SEQ ID NO: 13975 - protein, 81 aa, Ailuropoda melanoleuca
EFVPLGDAAMDFTLEDWEHLGLDQADLFWDTALDNYQNLFLLNPFKPNLTFHPDGAEEPKVLVRESPESAGPGTAEVKNCL

SEQ ID NO: 13976 - protein, 81 aa, Ailuropoda melanoleuca
LQASLSFEDVAVGFSWEEWQLLAPSQKDLYRDVMLENYRNLVSVGYQASKLDSLFQSEQGGPPWTVEGAAQSHTCPEEIWE

SEQ ID NO: 13977 - protein, 81 aa, Ailuropoda melanoleuca
QGCVTFEDVFVYFSREEWELLEEAQRVLYRDVMLENFALVSSLGKALPMWWEAQLERGRKSWVSDRAFLTLATVRETQRRS

SEQ ID NO: 13978 - protein, 81 aa, Ailuropoda melanoleuca
LQSPVTFEDVAVYFSKEEWGLLDASQRHLYHNVMLENFELMTSLGCWHRVEDEGAHSKQNTSVEGMSQVRIPSANPSTQKA

SEQ ID NO: 13979 - protein, 81 aa, Ailuropoda melanoleuca
QALMAFRDVAVAFTQKEWKLLSPAQRTLYRDVMLENYSHLVSLGKAFSKPRLITQLEQGDEPWREESECLLDLCPGEWTEF

SEQ ID NO: 13980 - protein, 81 aa, Gorilla gorilla
QDTVAYEDLSVDYTQKKWKGLTLSQRALQWNMMPENHYSMASLGENVMKGSELTPKQEIFKGSESSNRTSGGLFGVVPGAA

SEQ ID NO: 13981 - protein, 81 aa, Lynx canadensis
SRGPLSFVDVFVDFTWEEWRLLDPAQKHLYRSVMLENYSHLVSLGYQDTKPDIIFKLEQGEELWMLQAQIPSQGHPEKVLE

SEQ ID NO: 13982 - protein, 81 aa, Lynx canadensis
KPQGLVTFEDVAVDFTHEEWQYLNPSQKSLYREVMLETYSNLVSVGQQVTKPDLILKLEVEEPCLAETKISIWDFPEAYQV

SEQ ID NO: 13983 - protein, 81 aa, Lynx canadensis
YQGPVTFKDVIVEFTREEWQLLDAAQRTLYKEVMRENYGHLVSVGYCVNKPNAVFKLKQGKEPWILEVEFPRRNYPEDLWK

SEQ ID NO: 13984 - protein, 81 aa, Lynx canadensis
KEAFVAFRDVAVDFTREEWSLLSPAQRTLHREVMLETYNHLVSLEIPFSKPKLISQLEQGEEPWIEEKRCPLVLCPGSKLE

SEQ ID NO: 13985 - protein, 81 aa, Lynx canadensis
QKESVTFRDVAVFFSQDEWLRLDSAQRTLYREVMLENYGTLVSLGILFSKPKVIFQLQQGEDPWMVENGVSQDPRVGWESL

SEQ ID NO: 13986 - protein, 81 aa, Lynx canadensis
FHESVTFKDVIVDFTQEEWKQLDPVQRDLFRDVTLENYTHLVSIGLQVSKPDVISQLEQGTEPWVVESGVPGATGGDRDIG

SEQ ID NO: 13987 - protein, 81 aa, Lynx canadensis
VPSGSAHILCDFPSTGYHGTKPDLIFKLEQGEEPWIINAKVSRQSCPEDWKEWYQKNPDDLENVERTYACSAFGKLNLSRT

SEQ ID NO: 13988 - protein, 81 aa, Lynx canadensis
MGLAQLTCRFPFTGCCVPKPDVIFRLEQGQQPWLVEEESLDQIWPEVCRVDNQLEQNQEIQHRHFWQAPFINNKTLTVHRG

SEQ ID NO: 13989 - protein, 81 aa, Lynx canadensis
MLENYRNLVSVGYLASKPDALSKLEGGELWTAEDEIDSRICPEIRKVDDPLQCRLQNRSIQKSVEQCCEHNTFASIFNQSE

SEQ ID NO: 13990 - protein, 81 aa, Phyllostomus discolor
SEVSVSFEDVTVDFSREEWQHLDPVQRCLYRDVTLENYNHLLSVGYQVPKPEVIFKLEQGEGLWTLEGETPHQSCSDEDIG

SEQ ID NO: 13991 - protein, 81 aa, Phyllostomus discolor
IKWLVTFRDVAIDFSQEEWNYLDPAQRDLYREVMMENYSNLVLLGLSISKPDVISLLEQGKEPWMQRNMAGGWCPGLELGC

SEQ ID NO: 13992 - protein, 81 aa, Phyllostomus discolor
MEAVTFGDVAVHFSREEWQCLDPGQRALYKEVMLENHSSVAGLGFLLFKPELISRLEQGEEPWVLDLQGTEGRELPRTPQT

SEQ ID NO: 13993 - protein, 81 aa, Phyllostomus discolor
TVQEPVTLRDVAVLFTQEEWAQLSPVQRRLYQDVMLENCSHLASLGLLGPKPDLFAQLGKGEEWTSEVASGGFCLDWMPLP

SEQ ID NO: 13994 - protein, 81 aa, Phascolarctos cinereus
RTTAVTFKDVAVDFTQEEWGQLDPAQRNLYRDVMLENYENLVSLGLPVSKPDVISQLEKGKVPWVQDGESLKDICPDSVIQ

SEQ ID NO: 13995 - protein, 81 aa, Myotis lucifugus
GSVTFKDVIVEFTKEEWQLLDEAQRALYKEVMQENYRHLVSVGYFVNKSNAVLKLKQGKEPWILEVEFPRQNYTDLWKIHE

SEQ ID NO: 13996 - protein, 81 aa, Myotis lucifugus
EDMNFEDVAIAFSSEEWAILDEAQRLLYCEVMLEVFALGSSVGCWHQKYDDDACSEQSVSVGGESQVMFSRRAPATQKTHL

SEQ ID NO: 13997 - protein, 81 aa, Oryctolagus cuniculus
AQGSVTFEDVTVHFSWEEWRLLDEAQRCLYRDVMLENLALISSLGCLRGVEDEEVPSEQSASLEGVSQIRTSKATCTEESN

SEQ ID NO: 13998 - protein, 81 aa, Oryctolagus cuniculus
ILQVMIAFEDLAVYFTWEEWQKMNNAQKILYRDVMLETYSSLFSLVVMKRDDLIRINQESHDKNLNQDFMKNNKTSALKRV

SEQ ID NO: 13999 - protein, 81 aa, Oryctolagus cuniculus
QSRASPFKDMILCFSEEDWSLLDPGQTGFYGEFIIGEDCGVSVTPNDPAALPGPFQGEERELLPELLELQGKEAPQASPTD

SEQ ID NO: 14000 - protein, 81 aa, Oryctolagus cuniculus
LQVLVSFEDLAVDFTQEEWQDLDNAQKTLYKDVMLETYSSLLSLGHCIIKPDLIYKLEQGAEPWIVEKSLKQSLPGQSTHI

SEQ ID NO: 14001 - protein, 81 aa, Oryctolagus cuniculus
KTQELLTLEDVAVEFTWEEWQLLSPAQKALYRDVMLENYSSLVAVGYQASKPDALSKLERGEPWTVEDDIHSHIRREIKTV

SEQ ID NO: 14002 - protein, 81 aa, Oryctolagus cuniculus
MITFEDLAVYFTWEEWQNMNKAQKILYKDVMLETYSSLFSLGQCISKPDLIVKLEQGAEPWMMEECLNQSPPVSIKRDGLP

SEQ ID NO: 14003 - protein, 81 aa, Pteropus alecto
AQDLVTFEEVVVDFSQEEWALLDPAQKMLYRDVMLENLRNLASVGAGYHLCKHSLITEVEQEELRTEDRSLRGARSVTIMY

SEQ ID NO: 14004 - protein, 81 aa, Ailuropoda melanoleuca
QVSVTFEDVAVLFTRDEWRKLGPSQRNVYQEVMLENYTNLVSLGLLFSKPKVISLLQQGEDPWKVEKESPGGPSLGWKSSH

SEQ ID NO: 14005 - protein, 81 aa, Ailuropoda melanoleuca
FQESVMFSDVSIDFSEEEWECLNDDQRDLYRDVMLENYSHLVSMAGHSVSKPDVISFLEQGKEPWLVDRELTRDHWPVLES

SEQ ID NO: 14006 - protein, 81 aa, Gorilla gorilla
LFQVTFSDVAIDFSHEEWGWLNSAQRDLYKDVMVQNYENLVSVGLSVTKPYVITLLEDGKEPWMMEKKLSKGMIPGWESRW

SEQ ID NO: 14007 - protein, 81 aa, Ailuropoda melanoleuca
QRESVTFKDVAVDFTQEEWHHVDPAQRRLYRDVMLENYSHLVSLDWKTRPEAKSSHLQQSVSAGSRSTDGLSHATLESTWV

SEQ ID NO: 14008 - protein, 81 aa, Ailuropoda melanoleuca
QVHLTFEDVAVYFSQEEWGLLDEAQRHLYHTVMLENLALIASLGWWHGVKAEEALSEQCVFVERVSQANTPDPGLSIPKAH

SEQ ID NO: 14009 - protein, 81 aa, Gorilla gorilla
LFQVTFSDVAIDFSHEEDLYKDVMVQNYENLVSVGLSVTKPYVITLLEDGKEPWMMEKKLSKGMIPGWESRWENKELSTKK

SEQ ID NO: 14010 - protein, 81 aa, Gorilla gorilla
FQGVLTFRDVAIEFSLEEWHCLDTLENTLQGIIQENFPNLASKWSNRLFLFLAVVYSYFAQDFWPKQGIKNCFQKVILRRY

SEQ ID NO: 14011 - protein, 81 aa, Ailuropoda melanoleuca
AKELLTLEDVAVDFTWEEWQLLGPAQKDLYRDVMLENYSNLVSVGCQATKPDALSKFEHRDELWLTEDEIQNRTHPGFGNF

SEQ ID NO: 14012 - protein, 81 aa, Ailuropoda melanoleuca
YREVMLENYGNLVSVGYQLSKPSVISQLEKGQEPWMTEKEGPGDPRSDLKNKTETDASAAKNDILQEHLYHGIMMEGFLRD

SEQ ID NO: 14013 - protein, 81 aa, Desmodus rotundus
KPRAMKFADVAVYFSPEEWGCLRPAQRALYRDVMKETYGHLGALGCAGPKPALISWLERNTDDWEPAALDPQECPSGLTVQ

SEQ ID NO: 14014 - protein, 81 aa, Desmodus rotundus
SPTLVTFKDIHVNFTREEWKLLDAAQQIMYKDVMLENYKNLVSLGHQLPKPAVILQLEKGEEPWLVEREIRQDTHPDWDTA

SEQ ID NO: 14015 - protein, 81 aa, Macaca fascicularis
DTVVFEDVVVGFTLEEWALLNPAQRNLYREVMLETFKHLASVDNEAQPKTNGSISQQDTSGEKLSLKQKIEKFTRKHTWAS

SEQ ID NO: 14016 - protein, 81 aa, Macaca fascicularis
IQDSVVFEDVAVDFTQEEWALLDLAQRNLYREVMLENFQNLASLGYLLHTPHLICQWEQEEDLQRVKRELIQVIFMGEHQE

SEQ ID NO: 14017 - protein, 81 aa, Macaca fascicularis
EKGPLTFRDVAIEFSLEEWQCLDTAQQDLYRKVMLENYRNLVFLAGIAVSNPDLITCLEQGKEPWNMKRHVMADEPPGWSA

SEQ ID NO: 14018 - protein, 81 aa, Macaca fascicularis
LKGLVTFEDVAVEFTQEEWALLDPAQRTLYRDVMLENFRNVASLGDQVDKPGLITQLEQEDEVMTEERGILPGTCSDVENP

SEQ ID NO: 14019 - protein, 81 aa, Macaca fascicularis
SQTLVTFKDVFVDFTREEWKLLDTAQQIVYRNVMLENYKNLVSLGYQLTKPDVILRLEKGEEPWLVERGIHQEAHPDSETA

SEQ ID NO: 14020 - protein, 81 aa, Macaca fascicularis
MAFEDVAVYFSQEEWGLLDTAQRALYRHVMLENFTLVTSLGLSTSRPHVVIQLERGEEPWVPSGKDMTLARNTYRRLNAGE

SEQ ID NO: 14021 - protein, 81 aa, Macaca fascicularis
RPESVTFEDVAVYFSENEWIGLGPAQRALYRDVMLENYGAVASLAFPFPKPALISQLERGEAPWCSVPWGALDGEDPRSIS

SEQ ID NO: 14022 - protein, 81 aa, Macaca fascicularis
PKVPVTFDDVAVYFSELEWGKLEDWQKELYKHVMRGNYETLVSLDYAISKPDILTRIERGEEPCLDGWGQEKQNEVEVGHP

SEQ ID NO: 14023 - protein, 81 aa, Phascolarctos cinereus
AQELVTFKEVAVDFTQEEWGLLDHPQKELYKEVMLENAQNLLSLGLPVPRQELISYFEEKEAPWLLEQEGLRSCCPEKEIR

SEQ ID NO: 14024 - protein, 81 aa, Phascolarctos cinereus
AQGLVTFKDVVVDFTPEEWGLLDHSQKELYKEVMGENARNLLSLGLPVPREDSISHLGQGEAPWMLEIEDPRTSCPGGKMG

SEQ ID NO: 14025 - protein, 81 aa, Myotis lucifugus
MNFEDVAIDFSEEEWGLLDEAQRLLYCNVMLDVFALVSSAGCWHITDDEEACSEQSISVQGQSQVTVSKTEPATQKTHLCK

SEQ ID NO: 14026 - protein, 81 aa, Myotis lucifugus
LPSSKVPTFSNKDSLGDEMLAAALLKAKSQELVTFEDVAVYFIRKEWKRLEPAQRDLYRDVMLENYGNVFSLGLPFLYFDI

SEQ ID NO: 14027 - protein, 81 aa, Puma concolor
GWVPALFDEVAIYFSDEEWEVLTEQQKALYREVMRMNYETVLSLEFPFPKPDMITRLEGDEESQNSDEWQLQGGTLAENEE

SEQ ID NO: 14028 - protein, 81 aa, Puma concolor
CEVSVSFEDVTMDFSREEWEQLGPTQRCLYWDVMLEICSHLLSLGYPIPRPEMIFRMEKEEEPWIREAQLPHQWRPEGEFG

SEQ ID NO: 14029 - protein, 81 aa, Puma concolor
PKVPVTFDDISIYFSTPEWEKLEEWQKELYKNIMKGNYESLISMDYAMNQPDVLSQIQPEGEHNTEEQAGPEDSEIPTDPS

SEQ ID NO: 14030 - protein, 81 aa, Puma concolor
RTCAEGPERLLRPSRKRALSFLRPWRHLLRNQPSGLGDFGLIDHVGLSIPKPEVILKLEQGEEPWILESPGQSDPELINSS

SEQ ID NO: 14031 - protein, 81 aa, Puma concolor
LQVSVSFEDVTVNFSREEWQHLDPAQRRLYRDVTLENYSHLRSVGYQVPKPEVIFKLEQGEGPWTLEGETPHQSCSGEDIG

SEQ ID NO: 14032 - protein, 81 aa, Sapajus apella
CQESVTFEDVAVVFTDEEWSHLVPIQKDLYKEVMLENYKSVVSLGLPVPQPDMIFQLKRGDEPWMVDLHGSEETEWPKSVS

SEQ ID NO: 14033 - protein, 81 aa, Sapajus apella
QVSITFKDLAVRFSEEEWRLLEEGQREFYRDVMRENYETLVSVGTAELLPLSAFLSPPEPGGAVGGGSRTDEGQEPAGCGG

SEQ ID NO: 14034 - protein, 81 aa, Sapajus apella
RRGPLTFRDVAIEFSQEEWRCLDPAQRTLYRDVMLENYRNLVSLGICLPDLSIISMMKQRTEPWTVESEMKVAKNPGRWEG

SEQ ID NO: 14035 - protein, 81 aa, Sapajus apella
MGPLTFRDVAIEFSLEEWQCLDTAQQDLYRKVMLENYRNVAFLAGIAVSKPDLITCLEQGKEPWNMKRYEMVDEPPATCSY

SEQ ID NO: 14036 - protein, 81 aa, Sapajus apella
QDSMTFEDIVVDFTREEWALLDTSQRKLFRDVMLENISHLVSIGNQFCKSVVFSQGIRLPQGKEGDIKHQEIPFIQHIDQK

SEQ ID NO: 14037 - protein, 81 aa, Sapajus apella
CVYVFQGVLTFMDVAIEFSLEEWQCLNTAQQNLYRNVMLENYRNLVFLDLITCLEQGKEPWNVTRHEMVAEPPGSLSAVIK

SEQ ID NO: 14038 - protein, 81 aa, Sapajus apella
FQAKLTFEDVAVLLSQDEWDRLGPAQRGLYRNVMMETYGNVVSLGLPISKPDLISQLERGEDPWVLDGKGAKESQGLWSGH

SEQ ID NO: 14039 - protein, 81 aa, Sapajus apella
AQSSVTFEDVAVNFSLEEWNLLNEAQRYLYRDVMLETLTLISSLGCWHGGEEEAASSKQSTCIHVYKDQRVHNGEGPYECG

SEQ ID NO: 14040 - protein, 81 aa, Sapajus apella
GPVTFKDVAVVFTEAEWKRLSLEQRNVYKDVMLENLRNLVSLESKPEVHTCPSCPVVFGSQQFLSQDELHNHPIPGFYAGN

SEQ ID NO: 14041 - protein, 81 aa, Sapajus apella
ESFMAFGDVTVDFTQKEWRLLSPAQRALYREVTLENYSHLISLGIYAECVLPPKNLGLAHQRQHQLQFSDQSCQSDTAEGQ

SEQ ID NO: 14042 - protein, 81 aa, Sapajus apella
ASETLTFRDVAIEFSLEEWQCLNPAQQNLYRNVMLENYRNLVFLAGIAVSKQNPVTCLEHGKEPWNMKRYEIMAKPTAMCS

SEQ ID NO: 14043 - protein, 81 aa, Sapajus apella
QGHLTFSDVAIEFSLVEWKCLTPAQRALYRDVMLENYRNLESVDISSKCMRKMVSSTGQGNTEMFHTRTLETHESHHTGDF

SEQ ID NO: 14044 - protein, 81 aa, Sapajus apella
MDSVASEDVAVNFTLEEWALLDPSQKKLYRDVMRETFRNLACVGKKWEDQSIEDWYKNQGRILSNHAGVGLSESKEHDQCG

SEQ ID NO: 14045 - protein, 81 aa, Sapajus apella
ACIFQGALTFRDVAIEFSRKEWQCLDTAQQNLYRTVMLENYRNLVFLGIAASKPDLITCLEQGKEPWKVKRHEMVAESPGR

SEQ ID NO: 14046 - protein, 81 aa, Sapajus apella
MLENYRNLVCLGLAISKPDLITFLEQRKEPWNVKSAETVAIQPDMFSHYNKDLLTEHCTEASFQKVIPRTHESCDLENLHI

SEQ ID NO: 14047 - protein, 81 aa, Sapajus apella
MGPLTFMDVAVEFSLEEWQCLDTAQRHLYRNVMLENYRNLVFLGIAVSKPDLITCLEKEKEPWNMKRHGMVDKPPVTFFHF

SEQ ID NO: 14048 - protein, 81 aa, Oryctolagus cuniculus
LQEVVTFQDVAVVFSEEELRLLDTAQRALYRAVMLENFRNLLSVGEDGRARILGVTLCSDLVCPGIKALESHLGEKSHTRC

SEQ ID NO: 14049 - protein, 81 aa, Oryctolagus cuniculus
PQESVTFKDVAVDFTREEWHHVDSAQRTLYKDVMLENYSHLVALGYQVSKPEVIFKLEQGEEPWISEGEIQRRFCADWKTR

SEQ ID NO: 14050 - protein, 81 aa, Oryctolagus cuniculus
MTKPDLIFKLEQGAEPWMGKECLHHSLPVAMKRDDLISKNQKSQDKNLNQNVMKNNKTSTPKIIELRKTLRLSSNHIPKLS

SEQ ID NO: 14051 - protein, 81 aa, Oryctolagus cuniculus
MHQCWFLNVLMTFKLLAMTFTWEEWRQLDQDQKHLYQEVMMETCRHLVSLGRAHLSLPPFLSHSGLEKAFWSQASHAGVWS

SEQ ID NO: 14052 - protein, 81 aa, Canis lupus
CWGLLSFKDISMEFTWEEWQLLDSAQKYLYRDVILENYSHLVSLGYHGTKPDLIFKLEQGEEPWMINAKVSRQSYPELRED

SEQ ID NO: 14053 - protein, 81 aa, Canis lupus
VMFNDVSIVFSQEEWEYLDLEQKDLYRDVMLENYSNLVSLDLENRYETKKLSSENDVYEINLPQWKIMERIKNHGLKGLIL

SEQ ID NO: 14054 - protein, 81 aa, Canis lupus
SQDLVTFKDVAIDFSQDEWEWLNPVQRNLYKNMMLENYQNLVSLGLCISKPYVISLLEQGKEPWEMKTEMTRSPFPDLGST

SEQ ID NO: 14055 - protein, 81 aa, Canis lupus
RPGAVSFADVAVYFSPEEWGCLRPAQRALYRDVMRETYGHLGALGCAGPKPALISWLERNTDDWEPAALDPQECPRRVTVQ

SEQ ID NO: 14056 - protein, 81 aa, Ailuropoda melanoleuca
GSVSFTDVTVDFTQEEWEQLDPSQRILYMDVMLENYSNLLSVEVWKADDQMERDHRNPDEQARPFIIFKNQTPMEERGNLF

SEQ ID NO: 14057 - protein, 81 aa, Gorilla gorilla
DPEQVTFEDVVVDFSQEEWGQLKPAQRTLYHDVMLDTFRLLVSVGHWLPKPNVISLLEQEAELWAVDSGLPQGVYPEIKGH

SEQ ID NO: 14058 - protein, 81 aa, Ailuropoda melanoleuca
QGCVTFEDVTIYFSQEEWGLLDEAQRLLYCDVMLENFALIASLGLTAFRSHIVAQLQMGAEPWVPDRVDMTSAMARGVYSG

SEQ ID NO: 14059 - protein, 81 aa, Phyllostomus discolor
NMGSVSFEDVAVDFTRQEWQQLDPAQRTMHKDVMLENYSNLASVGLCVAKPEMIFKLEQGEELWVLEEESSGHGYPGSLSL

SEQ ID NO: 14060 - protein, 81 aa, Phyllostomus discolor
CWGLLSFKDISMDFTWEEWQLLDSAQKYLYRDVILENYRNLVSVGYHGTKPDLIFKLEQGEEPWIRNAKISRPRCSEGWKE

SEQ ID NO: 14061 - protein, 81 aa, Phyllostomus discolor
FQEPVSFRDVAVDFTQEEWQQLDPVEKTTYRDVMLENYSHLVSVGYDSTKPHVIVRLEQGEEPWVAEGDFPCQSCPEGTWK

SEQ ID NO: 14062 - protein, 81 aa, Phyllostomus discolor
MASPSPSLEPKEEWDYLDPAQRSLYKDVMMENYGNLVSLDVLNRDKDEEPTVKQEIEEIEEEVESKGIIVTRIKSETDQDP

SEQ ID NO: 14063 - protein, 81 aa, Phyllostomus discolor
LVEPVSFKDVYVDFTKEEWYLLDPAQKILYRDMMLENYSHLVSVGYCITKPEVIIKIEQGEEPWILKQGFPSQCHPENWKV

SEQ ID NO: 14064 - protein, 81 aa, Puma concolor
PRSLENDGGCFSEQEWENLEDWQKELYRNVMKSNYEALVSLKVLGPPEEEAELGTGMLGDLEEEGPGDVHPAEGVMIKQEI

SEQ ID NO: 14065 - protein, 81 aa, Puma concolor
TVTFKDVAVVFTEEELVLLDKAQIHLYQDVMLENFRNIVSVGDRIKDNISHLQGKGLSYLSPEGLYRWPIWKQRISELTGS

SEQ ID NO: 14066 - protein, 81 aa, Puma concolor
FQDLVTFGDVAVDFSQEEWEWLNPAQRNLYRKVMLENYRSLVSLGVSVSKPDVISLLEQGKEPWMVKKEGTRGTYPDWEYA

SEQ ID NO: 14067 - protein, 81 aa, Puma concolor
MIKSQISFEDVAVDFTLEEWRLLNPTQKNLYRDVMLENYSNLVFLGYQIIKPHGIFKLEQEEPWIIDEVLSQNFSEVWLDN

SEQ ID NO: 14068 - protein, 81 aa, Puma concolor
SQESVTFEDVAVDFTQEEWTLLDWSQRKLFRDVMLENISHLVSVGKQLYKLDTIFHLEQGEQLSTEGIGLLQFQSLGREDD

SEQ ID NO: 14069 - protein, 81 aa, Puma concolor
AHRSVTFRDVAIHFSQQEWEYLDSVQKNLYRDVMMENYDNLVSLEHSISKPDVITLLEQRKEPWMVVREDTKRWCTDLESK

SEQ ID NO: 14070 - protein, 81 aa, Puma concolor
ARELVTYEDVAVDFTQEEWQHLDPAQKILHRDVMLEIYSHLVSVGCSGISPGIIFKLEHEEDPWIMKSELSRWIHSDREKS

SEQ ID NO: 14071 - protein, 81 aa, Sapajus apella
MLLDPTQRNLYRDVMLENYKNLATVGCQLLKPSLISWLEQEESRTVQRGDFYEWKVQLKTKELALQQDFLGEPTSSGIQMM

SEQ ID NO: 14072 - protein, 81 aa, Sapajus apella
FQGQLTFNDVTIEFTLEEWQCLDKTQQNLYREVMLENYRNLVFLGIAVSKPDLITCLKQGKEPWNIRRHEMVTKPPAMCSH

SEQ ID NO: 14073 - protein, 81 aa, Sapajus apella
EMGPLTFRDVAIEFSLEEWQCLNTDQQDLYRKVMLENYRNLVFLAGIAVSKADLITCLQEEKDPWNMKRHSMVAKPPVIYS

SEQ ID NO: 14074 - protein, 81 aa, Sapajus apella
MQENYETVISLALFVLPKPKVISCLEQGEEPWVQVSPEFKDSARGSSTGLKLKNDTENHQPVSLSDLEIQAPADIISKKAK

SEQ ID NO: 14075 - protein, 81 aa, Sapajus apella
MLENYGNVASLGFPLLKPAVISQLEGGGELGAPSPLAAGTGLHGLRTDIQTDSDFTKEMYYGKEDVSFELQRDFSQETGFL

SEQ ID NO: 14076 - protein, 81 aa, Sapajus apella
SQESVSFKDVTIEFTQEEWQQMAPVERNLYRDVMLENYSHLVSVGYCLFKPEVIFKLERGAEPWFSEEEFSNKSHPKDYRG

SEQ ID NO: 14077 - protein, 81 aa, Sapajus apella
MLENYRNLVCLGLAVSKPDLITFLEQRKEPWNAKSAETVAIQPDMFSHYNKDLLTEHCTEASFQKVIPRTHESCDLENLHI

SEQ ID NO: 14078 - protein, 81 aa, Sapajus apella
MGPLQFRDVAIEFSLEEWHCLDTTQRNLYTDVMLENYRNLVFLGIVVSKPDLITCLEQGKKPLTVKKREMIATPPVMCSHL

SEQ ID NO: 14079 - protein, 81 aa, Sapajus apella
MELLTFRDVAVEFSSEEWKCLDPAQQNLYRDVMLENYRNLVSLGVVISNPDLVTYLEQRKEPYNLKIHETAAKPPATCSPF

SEQ ID NO: 14080 - protein, 81 aa, Sapajus apella
ACVFQGLLTFRDVAIEFSLEEWQCLDTAQRNLYKNVILENYRNLVFLGIAVSKPDLITCLEQEKEPLIMKKDEMADEPPGK

SEQ ID NO: 14081 - protein, 81 aa, Sapajus apella
QASVALEDVAVNFTREEWALLGPCQKNLYKDVMQETIRNLDCVGMKWKDQNIEDQYRYPRKNLRCYMLERFGESKDGSQCG

SEQ ID NO: 14082 - protein, 81 aa, Sapajus apella
TQGQVTFRDVAIEFSQEEWTCLDPAQRSLYRDVMLENYRNLASLAGISCFDLSIISMLEQRKEPFTLESQVQIAGNPDGWE

SEQ ID NO: 14083 - protein, 81 aa, Sapajus apella
RVTFKDVAVVFTKEELALLDKTQINLYQDVMLENFRNLISVGDRIENNILNLQEKGLSYLSQEVLHCWQIWKQRIWDLTVS

SEQ ID NO: 14084 - protein, 81 aa, Oryctolagus cuniculus
AQVSRPLPACLGVRTQEEWRQLEPAQRRTYREVMLENYSHLVAVGGDISKPRVIVKLEQGEEPWVPEGELPCRSRAEEAWK

SEQ ID NO: 14085 - protein, 81 aa, Oryctolagus cuniculus
EAVTFKDVAVAFTEEELGLLDPAQRKLYQDVMVENFWNLLSVGHRPCQQGIPHVLSEREAKLWGMKTAVHRGRNLDIFVVK

SEQ ID NO: 14086 - protein, 81 aa, Oryctolagus cuniculus
SSALVSFEDLAVDFTWEEWQDLSHAQRILYKDVMLETYSSLLSLGYCITKPDLIFKLEQGEEPWIVQEYLNPNLKVSQERD

SEQ ID NO: 14087 - protein, 81 aa, Canis lupus
ALLNPSQKKLYRDVMQETFRNLASIGDRWKGNSLKTPFMIITFDNSNDHLLAEHLGYTHFQTVHVIERPCKNKEGSKCGES

SEQ ID NO: 14088 - protein, 81 aa, Canis lupus
SLGSVSFKDVTVDFSREEWQQLDLAQKSLYRDVMLENYFNLISVGCQVPKPEVIFNLEQEVLRMLAGDICSHSHHDGDIGF

SEQ ID NO: 14089 - protein, 81 aa, Canis lupus
VTFTDVAVNFTEEEWALLDSTQRNLYRDVMLENCRNLASVDLMSQHKTQNSTPQQDILAKKTLDEANRVCAVNNSSQFSLL

SEQ ID NO: 14090 - protein, 81 aa, Gorilla gorilla
SQGTVTFKDVAIDFTQEEWKRLDPAQRKLYRNVMLENYNNLITVGHPFTKPDVIFKLEQEEEPWVMEEEVLRRHWQGEIWG

SEQ ID NO: 14091 - protein, 81 aa, Ailuropoda melanoleuca
LKSKQGSMSFEDVIVEFTQDEWQYVSPAQRTLYRDVMLENYSHLISVGYCTTKPEMIFKLEQGEKPWSLEEEFLNQTYPGG

SEQ ID NO: 14092 - protein, 81 aa, Ailuropoda melanoleuca
QIKRDMLLQGLLSFSDVTVDFTWEEWQLLDTVQRNLYRDVMLENYSNLMSLGYQATRPEATVHLEKEQGMVEREFPSQRSP

SEQ ID NO: 14093 - protein, 81 aa, Lynx canadensis
MESVTFEDVAVGLLREWALLDGARTNLCRYVILDKCRTLAPKGTPPRKPSLGSQLGPGAELRPRGVDWDSRLKSQASPPVQ

SEQ ID NO: 14094 - protein, 80 aa, Lynx canadensis
MTSGLLTFRDVAIEFSQEEWGCLSHSQQELYRDVMLENYGHLLFLGLVLSKPDLVIFLEQKELWDVKRNHTVTSHPGRWE

SEQ ID NO: 14095 - protein, 81 aa, Lynx canadensis
LPHSVTFEDVAVEFTQEEWALLDPSQRTLYRDVMQENCRNLASLGCHVDKPSLTSQLEQEDKVMTQERGILPGTCPGLETV

SEQ ID NO: 14096 - protein, 81 aa, Lynx canadensis
MAVTFEDVTVIFTWEEWKFLDSSQKKLYREVMWENYTNVMSVGNWKESYKPQEERFRYLEHENHPCWQGWRSASTQIYKNR

SEQ ID NO: 14097 - protein, 81 aa, Lynx canadensis
AQGSVVFSDVSVDFSQEEWECLDSGQRDLYRDVMLENYSNLLSMGFYIPKPQVISLLEQGKEPWMVGRELTKGLCSDLESM

SEQ ID NO: 14098 - protein, 81 aa, Phyllostomus discolor
KDQELLKLEDVAVDFTWEEWQLLDPDQKDLYRDVMLENYRNLVSVGYPASKPDTLSRLEQGELWTIEDEFHSGICSEIKKN

SEQ ID NO: 14099 - protein, 81 aa, Phyllostomus discolor
KPGSVSFADVAVYFSSEEWGCLRPAQRALYRDVMRETYGHLGALGFPGPKPDLISWMEQESEAWSTDAQDPEEGESVGGAL

SEQ ID NO: 14100 - protein, 81 aa, Phyllostomus discolor
FQEAVTFKDVAVVFTEEELGLLDPSQRKLYQDVMVENFRNLVSVGDKTLNNMEIIQEVGLKYLPHEEFFCSQIWQQITKDL

SEQ ID NO: 14101 - protein, 81 aa, Phyllostomus discolor
MITSQISFEDVAVDFTLEEWRLLNPTQRNLYRDVMLETYSNLVFLGHQSVKPDAVFKLEQEPWTVNEEIVSHHFSEELWID

SEQ ID NO: 14102 - protein, 81 aa, Phyllostomus discolor
AEVGVTFEDVAVYLSRTEWLLLDEAQRRLYFDVMLENYTLISSLGCCCGVENLEAPTEQNITVRVSKAMNLKSTLSSQESH

SEQ ID NO: 14103 - protein, 81 aa, Phyllostomus discolor
AQESVMFSDVSIDFSQEEWECLNDDQRDLYRDVMLENYNNLVSMGHSISKPDVISFLEQGKEPWLVNREVTGGQCPVLGSR

SEQ ID NO: 14104 - protein, 81 aa, Phascolarctos cinereus
LQGSVTFQDVAVDFSWEEWGHLGPAQKELYREVMLENYGNLVCLGLAVSSPDVVCQLERGEGPWMPEGDVPGSSCAGWETK

SEQ ID NO: 14105 - protein, 81 aa, Phascolarctos cinereus
VQEAVTFKDVSVDFTQEEWGFLSPVQRELYREVMLENYRNLVSLGLLDPTSGSISWLKEAEEPLAQDLQGRAPRSAHPPEG

SEQ ID NO: 14106 - protein, 81 aa, Myotis lucifugus
KSQDMIFEDVAVAFSQEEWELLDEAQRRLYCDVMLEVFALLSIGGHWHKMDDVEAYSEHSVSVGESQVRASKTAAATQRTY

SEQ ID NO: 14107 - protein, 81 aa, Myotis lucifugus
GDVNFEDVAIAFSEEEWVILDEAQRLLYCDVMLEVFAVVSSVGCWHKMEDEEACSDQRVCIQGESQVRASKTAPATHKNHL

SEQ ID NO: 14108 - protein, 81 aa, Puma concolor
YQELVTFRDVAVDFSREEWDCLNSSQRHLYSNVMLENYRILVSLGLCFSKPSVILLLEQGKEPWMVTRELAKGLCSGWESR

SEQ ID NO: 14109 - protein, 81 aa, Myotis lucifugus
QELVTFGDVAVDFSQEEWDCLNSSQRHLYSNVMLENYRILVSLGLCFSKPSVILLLEQGKEPWMVKKELAKDLCSGWESVC

SEQ ID NO: 14110 - protein, 81 aa, Puma concolor
SHALVTFKDVLVNFTREEWKLLDTAQQIMYKDVMLENYKNLVSLGHQLPKPDVILQLEKGEEPWLVERGTHRETHPDLDTA

SEQ ID NO: 14111 - protein, 81 aa, Myotis lucifugus
RDMNFEDVAIAFSQEEWGLLDEAQRHLYCDVMLEVFALVSFVGHWHKMDDVEAYSEHSVSVGESQVRASKTGVATQRTHLC

SEQ ID NO: 14112 - protein, 81 aa, Puma concolor
GCVTFEDVFVYFSREEWELLEEAQRLLYRDVMLENFALVASLDCWREADNEETPEQNVSVGVSQLRTPESGPFVQKAHPCE

SEQ ID NO: 14113 - protein, 81 aa, Puma concolor
SQGLVTFEDVAVYFSLEEWERLDAGERDLYKDVMQENYGILVSLGYPIPKPDLIFRLEQGEEPWVPDSPRPEEGDIVTGVY

SEQ ID NO: 14114 - protein, 81 aa, Sapajus apella
MLENYRNLVFLGIAACKPDLITCLEKAKEPWKMKRHAMVDEPPGIFPHFAQHLWPEQGMEDSLQKVILRRDEKCGHENLQF

SEQ ID NO: 14115 - protein, 81 aa, Sapajus apella
MEPLTFKDVAIEFSLEEWQCLDNAQRDLYRHVLLENYRNLVFLGIAVCKPYLITCLEQKKEPWNMKRREMVAKTPVMCFHF

SEQ ID NO: 14116 - protein, 81 aa, Desmodus rotundus
PKVPVAFDDISIYFSTPEWEKLEEWQKELYKNIMKGNYESLISMDYAMNQPDVLSQIQPEGEHNTEDQAGPEESAIPTDPS

SEQ ID NO: 14117 - protein, 81 aa, Desmodus rotundus
QGRVVLEDVAIHFSQEEWGLLDEAQRHLYHSVMLENLALLSSIGCWPGAQEEEVPLGQGDSVRVSQVQTPNQDPCTQKSHS

SEQ ID NO: 14118 - protein, 81 aa, Desmodus rotundus
VTLEDVAVYFSRTEWRLLNEAQRRLYLDVMLENFALVSSLGCCCGAKDVEAPSEQTISVGVSQTRTPKESPSSQKTHPCEM

SEQ ID NO: 14119 - protein, 81 aa, Macaca fascicularis
PQVSLTFEDVAVLFTRDEWRKLVPSQRNLYRDVMLENYRNLVALGLPFTKPKVISLLQQGEDPWKVEKDSSGDSSLGSKSS

SEQ ID NO: 14120 - protein, 81 aa, Macaca fascicularis
RSQESLTFQDVAVDFTKEEWDQLYPAQKNLYRDVMLENYRNLVALGYQLYKPEVIAQLELEEEWVIERDSLLDTHPDGENR

SEQ ID NO: 14121 - protein, 81 aa, Macaca fascicularis
FRGMVTFKDVAVVFTREELGLLDLAQRKLYQDVMLENFRNLLSVGYHSFKLDVILQLGREDKLWLMETEIQRDGCSGLILW

SEQ ID NO: 14122 - protein, 81 aa, Macaca fascicularis
FQESVTFKDVIVDFTQEEWKQLDPGQRDLFRDVTLENYTHLVSIGLQDSKPDVISQLEQGTEPWIMEPSIPVGTCADWETR

SEQ ID NO: 14123 - protein, 81 aa, Macaca fascicularis
PQGLVTFGDVAVDFSQEEWEWLNPNQRNLYRKVMLENYKNLASLGLCVSKPDVISSLEQGKEPWTVKRKMTRAWCPDLKIV

SEQ ID NO: 14124 - protein, 81 aa, Macaca fascicularis
QGSVTFEDVAVYFSWEEWDLLDEAQKHLYFDVMLENFALTSSLGCWHGVEHEETPSEQRISVEGVPQFRTSKEGSSSQNAY

SEQ ID NO: 14125 - protein, 81 aa, Macaca fascicularis
FQGPVTLKDVIVEFTKEEWKLLTPAQRTLYKDVMLENYSHLVSVGYHVNKPNAVFKLKQGKEPWILEVEYPHRGFPEDLWS

SEQ ID NO: 14126 - protein, 81 aa, Macaca fascicularis
YQDLLIFEDTAVDFTQEEWTLLDPVQRNLYRDVMLENYENVAKVGFQLLKPSVISWLEEEELRTLQQGVLQDRAMKHQTSV

SEQ ID NO: 14127 - protein, 81 aa, Macaca fascicularis
CEASLSFEDVTVDFSREEWQQLDPAQRRLYQDVTLELYSHLFSVGYHIPNPDVIFRMLKEKEPCVEEAELSHQRCQEGEFG

SEQ ID NO: 14128 - protein, 81 aa, Macaca fascicularis
MEEWQQLNPAQKTLHRDVMLETYSHLVSVGCSGIKPDVIFKLEHGKDPWIIESELSRWIYSDRVKGLESSQQIISGELLFQ

SEQ ID NO: 14129 - protein, 81 aa, Macaca fascicularis
TLQGPVSFKDVAVDFTQEEWQQLDPDEKITYRDVMLENYSHLVSVEVWKFDDLIERIQENEDKHSRQAACINSKTLTEEKE

SEQ ID NO: 14130 - protein, 81 aa, Macaca fascicularis
FFSREPVCPFEEKTKAERMVEDYLANSYQDSVTFDDVAVDFTPEEWALLDTTEKYLYRDVMLENYMNLASVDKRLQWMETL

SEQ ID NO: 14131 - protein, 81 aa, Macaca fascicularis
MGPLQFRDVAIEFSLEEWHCLDTAQRNLYRDVMLENYRNLVFLGIPVSKPDLITCLEQGKKPWTMKRHEMVAKSPVIYSHF

SEQ ID NO: 14132 - protein, 81 aa, Macaca fascicularis
VTFEDVAVYFSWKEWGLLDEAQKCLYHDVMLENLTLTTSLGGCGAGDEEAPYQQSTSSQRVSQVRLPKALPSPQKTNPCEI

SEQ ID NO: 14133 - protein, 81 aa, Macaca fascicularis
GEACVGGGVTFSDVAIDFSHEEDLYKDVMVQNYKNLVSVTGLSVTKPYVITLLEDGREPWMVEKKLSKGMIPGELRKILLK

SEQ ID NO: 14134 - protein, 81 aa, Macaca fascicularis
MSNVTFSDVAIDFSHEEWAWLDSAQRDLYKDVMVQNYENLVSVAGLSITKPYVIMLLEDGKEPWMVEKKLSKVYPFPLSHS

SEQ ID NO: 14135 - protein, 81 aa, Phascolarctos cinereus
HQELLTFRDVAVGFSQEEWGHLHPYQKALYRDVMLENYQNLVFLGLVVSKPAMIDQLERGEEPWIAEGDVPRGPCPGWESW

SEQ ID NO: 14136 - protein, 81 aa, Phascolarctos cinereus
AQELVTFRDVAVDFTPEEWGFLDHPQKELYKNVMLENAQNLLSLGLPVPREDLISYLEEREAPWLLEQEDLRSCCPEGEIR

SEQ ID NO: 14137 - protein, 81 aa, Phascolarctos cinereus
GKESVTFKDVAVEFTQEEWVQLNPSQKKLYRDVMLENYRNLVSLGFAVSKPDVIYQMERKETSWIPEADIPRSSFPENREF

SEQ ID NO: 14138 - protein, 81 aa, Phascolarctos cinereus
AQELVTFKDVSVDFTQEEWGLLDHPQKELYKEVMLENAQNLLSLGLPVPREDLVSYFEEKDAPQLLEHEGLRSCYPEGDVR

SEQ ID NO: 14139 - protein, 81 aa, Phascolarctos cinereus
GQESLTFEDVAVYFTRKEWKHLDSCQKDLYRNVMLENYGNMTLLKFSVSKPELISQLERGEEPWVLDLQGTEDQDTPKGFN

SEQ ID NO: 14140 - protein, 81 aa, Phascolarctos cinereus
YVVSVTFQDVAVEFSSEEWTHLNPSQKKLYRDVMLENYRNLASLGFAVSRPDVICQLERKEVPWMPEADVLKSSCTGSKEF

SEQ ID NO: 14141 - protein, 81 aa, Phascolarctos cinereus
PLELVTFKDVAVDFSWEEWGHLEPSQKELYREVMLENYRNLVCLGLAISKPDVIFQLEQGEAPWMPEREGPKCRCADWKTR

SEQ ID NO: 14142 - protein, 81 aa, Phascolarctos cinereus
QVPVTFEDLAVKFSSDEWHLLEEWQREFHRDVMRENYETLVSLGTAQLLPLSAFLSLTEPQEDMGDSGCSDGEWERPGGGL

SEQ ID NO: 14143 - protein, 81 aa, Phascolarctos cinereus
SQKALTFQDVAVEFTLEEWGLLEPAQRDMHRDVMLENYENFVSLGLPVPKPALIFHLERRETSWLPGGAVLKSTYPDFLVR

SEQ ID NO: 14144 - protein, 81 aa, Myotis lucifugus
LQGSDLFRDVAVVFSREEWEWLAPAQRDLYRDVMLETYSNLRSLDLAISKPDVIAFLEQGKEPWRAAEAAAGGLCPALEAR

SEQ ID NO: 14145 - protein, 81 aa, Phascolarctos cinereus
QQELVTFKDVAVDFTPEEWGNLDSSQKALYKDVMLENYRNLVFLAGLTVWKPDVISHLEEGEAPWMQDREVPKTINPDLET

SEQ ID NO: 14146 - protein, 81 aa, Myotis lucifugus
PLESVIFEDVAVDFTQEEWALLDTPQRKLYRDVMLENISHLVSLGYRICKSDVTFQLEQGEELWSEGTGFLQGQSAGRESA

SEQ ID NO: 14147 - protein, 81 aa, Myotis lucifugus
VSFRDVAVDFTQEEWQQLGPEQKTTYRDVMLENYSHLVSVGYDSTKPSVIVRLEQGEEPWVAEGGSPCQGCPEKIKKVDDV

SEQ ID NO: 14148 - protein, 81 aa, Myotis lucifugus
PQKSVTFEDVAVYFTPTEWDGLSPAQRALYRDVMLENYGNVASLGFPLIKPAVILQLEGGGELGGPSPLAAETGTDPPGLW

SEQ ID NO: 14149 - protein, 81 aa, Myotis lucifugus
LGMNMNFEDVAVVFSEEEWGLLNEAQRLLYCNVMLEVFALVSSAGCRHEMDDEEACPEQSVSVQGESQVRASKTEPATQKT

SEQ ID NO: 14150 - protein, 81 aa, Puma concolor
IQGSLTFGDVAVAFTHIEWKHLDAAQRALYKDVMLENYGNLVSVGLLSSKPKLITQLEQGSEPWMEVQQVPSGTCSVQEYW

SEQ ID NO: 14151 - protein, 81 aa, Puma concolor
AQESLTFDDVAVNFTWEEWQLLAPAQKNLYRDVMLENYRNLVSLGFYPRRPDVLTKLDQGKPTGTVEDDIPFRTCSEIWKL

SEQ ID NO: 14152 - protein, 81 aa, Puma concolor
MDSVVFEDVAVDFTLEEWALLDSAQRKLYRDVMLENLKNLAAVGKIWEELSTEDQPTNQGRHLRNPVVERLSESNGQCREG

SEQ ID NO: 14153 - protein, 81 aa, Puma concolor
FKEAVTFRDVAVAFTEEELGLLDSAQRKLYQDVMLENFRNLVSVGGNSQSELRTLQDREPREELSCWQIWQHIASDLTRWQ

SEQ ID NO: 14154 - protein, 81 aa, Puma concolor
TKESVTFRDVAVVFSQDEWLHLDSAQRTLYREVMLENYGTLVSLGIPSSMPKVICRLQQGEDPCVVERETPQDACLGFKTW

SEQ ID NO: 14155 - protein, 81 aa, Sapajus apella
RSGAVSFADVAVYFSLEEWGCLWPAQRALYRDMMRETCGHLGVLGFSGPKSAFISWVEEEVEAWSLEVQDPESESSGTVSR

SEQ ID NO: 14156 - protein, 81 aa, Sapajus apella
QTEVTFEDVAVLLSREEWGRLGPAQRGLYRDVMLETYGNLVSLGVGPAGPKPGVISQLERGDEPWVLDVQGTSGREYLRVN

SEQ ID NO: 14157 - protein, 81 aa, Oryctolagus cuniculus
LQGSLSFKDVTVDFTQEEWQHLDPAQKTLYMDVMLENYCHLISVGCHMTKPDVILKLERGEEPWTSFLGHTLEENWKTEDF

SEQ ID NO: 14158 - protein, 81 aa, Oryctolagus cuniculus
VRESVTFKDVIVDFTQEEWKQLDPVQRDLFRDVTLENYTHLVSIGLQVSKPDVISQLEQGTEPWMVEPGRPAGPCGDLQIQ

SEQ ID NO: 14159 - protein, 81 aa, Oryctolagus cuniculus
PEVSVSFKDVTVDFSREEWQHLDPAQRRLYRDVTLENYSHLLSVGYQVPKPDAILKLKQGEGPWTLETEAPHQSCSEKNVV

SEQ ID NO: 14160 - protein, 81 aa, Canis lupus
SVVFEDVVVDFTPEEWALLDCAQRRLYRDVMRETCRNLTSVGENWKCHGIEDQHKNLGTCMRCHAVEILSENNGTNQCGET

SEQ ID NO: 14161 - protein, 81 aa, Muntiacus muntjak
MGRLTFRDVAIDFTQEEWECLDLGQRDLYWEVMLENYGNLASLGLVASKPNLVTFLEELNDPRSIRRMDTAAIHPVVSHSL

SEQ ID NO: 14162 - protein, 81 aa, Canis lupus
KPVTFKDVAVDFIQEEWGLLDPTQRILYYDVMLTNYSNSVSLGEAFLSPFYPCPMYICHVMCILFVWLLIYLFIYLFIYLF

SEQ ID NO: 14163 - protein, 81 aa, Ailuropoda melanoleuca
WLTFRDVAVEFSQEEWECLDPAQRALYRDVMVENYRNLVSLAISSKCMIKELPPKENSNTGEVLQTVILERHKSCDTKDYA

SEQ ID NO: 14164 - protein, 81 aa, Ailuropoda melanoleuca
SQELVTFEDVAVYFIRKEWKRLEPAQRDLYRDVMLENYGNVFSLDGETRPEHGQEISEDTGSHGVLLGRFQKDISQGLKFE

SEQ ID NO: 14165 - protein, 81 aa, Ailuropoda melanoleuca
SKDLVTFKDVAVDFSQEEWEWLNPAQRNLYKNMMLENYQNLVSLGLCVSKPYVISLLEQGKEPWEKTLLKPSKPEEKIRTL

SEQ ID NO: 14166 - protein, 81 aa, Gorilla gorilla
GSVSFRDVAIDFSREEWQHLDLSQRNLYRDVMLETYSHLLSVGNTKYGKMSFYTYCECTPTGEKLWDHNQHRKIIGYKPAS

SEQ ID NO: 14167 - protein, 81 aa, Gorilla gorilla
PQGLLTFRDVAIEFSQEEWKCLDPAQRTLYRDVMLENYRNLVSLGSCCVVEVGLDLLVSRHPPWPPKKLGLQAPTPVPNYW

SEQ ID NO: 14168 - protein, 81 aa, Myotis lucifugus
FQGPVKDVHVTRGFSYKKSVHQIPAHGDLYRDIREENVGDMVSLGSAVSTSNKIAQVEQRKELWMHYSNKRNSLRSNCIKE

SEQ ID NO: 14169 - protein, 81 aa, Myotis lucifugus
VTFEDIALFFSREEWSLLDEGQRQLYLNVMLENFELISSLGCCCGAENVEAPFEENISVRVSQARNPKLVLSSQKSHPCES

SEQ ID NO: 14170 - protein, 81 aa, Myotis lucifugus
RQNDMNFEDVAIVFSQEEWGLLDEAQRLLYYDVMLKVFALVSSVGCWHNMDDKEACSSQSVSIQGESQVRASKTAPATQKT

SEQ ID NO: 14171 - protein, 81 aa, Myotis lucifugus
QSKDMNFEDVVIAFSQEEWGLLDEVQRHLYCNVMLEVFALVASVGCWHKMDNEEAYSDQSVSVQGESRVRASETAPTTQKS

SEQ ID NO: 14172 - protein, 81 aa, Myotis lucifugus
VGEDMNFEDVAIAFSQEEWGLLDEAQRLLYCDVMLEVFALVSSIDCWHKMDNEEACSEQSESVQGESQVRASETEPAAQRT

SEQ ID NO: 14173 - protein, 81 aa, Puma concolor
ALALVSFEDVAVTFTGEEWRQLDLAQRTLYQEVMLETCGLLVSLGHPVPKPELIYPLEPGQELWTGKRGVSKSTYTGEKAK

SEQ ID NO: 14174 - protein, 81 aa, Sapajus apella
RPRALKFVDVAVYFSSEEWGCLRPAQRALYRDVMRETYGHLGALGCAGPKPALISWLERNTDDWEPAALDPQEYPRGLTVQ

SEQ ID NO: 14175 - protein, 81 aa, Sapajus apella
AHGSVTFRDVAIDFSQEEWEFLDPAQRDLYRDVMWENYSNFISLGPSISKTDVITLLDEEGKEPGMVVREGIRRYCPDLDS

SEQ ID NO: 14176 - protein, 81 aa, Sapajus apella
LQGPVSFKDVAVDFTQEEWQQLDPDEKITYRDVMLENYSHLVSVGCDITKPNVIVKLEQGEEPWITEDEFPCQHSPEVWKV

SEQ ID NO: 14177 - protein, 81 aa, Oryctolagus cuniculus
VTFQDVAVVFSEEELRLLDTAQRALYRAVMLENFRNLLSVGEDGRARILGVTLCSDLVCPGIKALEALHLQLESAHPPEGP

SEQ ID NO: 14178 - protein, 81 aa, Oryctolagus cuniculus
PQDLLTFKDVAICFSQEEWEWLNPAQRHLYSSVMLENYQNLVSLGVCISKPFMISLLEQGKEPWKMKSEMTRTSLSDGEPL

SEQ ID NO: 14179 - protein, 81 aa, Oryctolagus cuniculus
TARSQTTVTFKDVAMDFTPEEWGKLDPTQRAVMLENYRNLVSLWLPISKPESYDVENGKEPLTLERKVPSSSYPDVETRPK

SEQ ID NO: 14180 - protein, 81 aa, Ursus maritimus
QLVSVSFEDVTVDFSREEWQQLDPAQRRLYQDVTLENYSHLLSVGYEVPKPEIIFKLEQGEEPWILERKTPHQSCSDGRFG

SEQ ID NO: 14181 - protein, 81 aa, Ursus maritimus
AKGLLTFGDVAIEFSQEEWECLSHTQRELYRDVILENYGHLLFLGVIVSKPDLVSLLEQRKEPWGEKRNKTRIHVGKNPFG

SEQ ID NO: 14182 - protein, 81 aa, Ursus maritimus
GWVPALFDEVAIYFSDEEWEVLTEQQKALYREVMRMNYETVLSLEFPFPKPDVISRLEGDEESQNSDEWQLRGGTFAEQEE

SEQ ID NO: 14183 - protein, 81 aa, Ursus maritimus
LCELLTFKDISVDFTQEEWGHLAPAHRNLYREVMLENYGNLVSVGYQLSKPSVISQLEKGQEPWMTEKEGPGDPRSDLKNK

SEQ ID NO: 14184 - protein, 81 aa, Ursus maritimus
MEMLTFGDVAIEFSQEEWRCLSHTQRELYRDVMLENYGHLLFLGVIVSKPDLVSLLEQRKEPWDEKRNKTAGFDPALYTFE

SEQ ID NO: 14185 - protein, 81 aa, Ursus maritimus
VQGLVTFRDVALDFSQEEWEWLDPSQKDLYRDVMLENYRNLVWLGLSISKPNMISLLEQGKEPWMVEKEMSDGQYADWESW

SEQ ID NO: 14186 - protein, 81 aa, Ursus maritimus
GQGQVNFEDVAVYFSQEEWGLLDETQRLLYRDVMLENLALMASLGYESSMSRGVTSLELGSKPWGSDWADATPARTREAQG

SEQ ID NO: 14187 - protein, 81 aa, Ailuropoda melanoleuca
QAEVTFEDVAVLFSREEWGRLGPAQRGLYRDVMLETYRNLVSLGAGPAGPKPGVITQLERGDEPWVLDTQGAKGKERLRVS

SEQ ID NO: 14188 - protein, 81 aa, Gorilla gorilla
VVFEDVDVNFTQEEWALLDPSQKNLYRDVMQETFRNLASVGKKWKDQKIEDEYKNPRRNLRGLTGERLLESKKDHQHGEIL

SEQ ID NO: 14189 - protein, 81 aa, Ailuropoda melanoleuca
AHGLVMFKDVAIDVSQEEWECLNSTQRDLYKDVMLENYSNLVSLGLSISKPAVISSLEQGKEPWMVVREVAGGRCPDLVSR

SEQ ID NO: 14190 - protein, 81 aa, Ailuropoda melanoleuca
SQVHLTFEDVAVYFSQEEWGLLDEAQRHLYHTVMLENLALIASLGCWHGAEDGKSPSKQAVSVGVSQVRTHHAGPYPQKAY

SEQ ID NO: 14191 - protein, 81 aa, Gorilla gorilla
PQGHLTFMDVAIEFSQEEWKSLHPGQRALYRDVMLENYRNLVFLGICLPDLSIISMLKQRREPLTLQSQVKIVKTTDGREC

SEQ ID NO: 14192 - protein, 81 aa, Ailuropoda melanoleuca
FQDLVTFKDVAVDFSQEEWEWLNPAQRNLYKNMMLENYQNLVSLGLCVSKPYVISLLEQGKEPWETKTEMTSLFPDSGSIY

SEQ ID NO: 14193 - protein, 81 aa, Lynx canadensis
MLENYQNLLSLGAGPPGFKPDVISRLERGEEPRMEKREGWQMACPDLETRSAPTQETLVKKSISAEAASPVGKTGGGLGAA

SEQ ID NO: 14194 - protein, 80 aa, Lynx canadensis
LAVSFLGRLTFKDVAIEFSQEEWECLDPAQRALYRDVMLENYRNLVSLGEDNICSEVGICPWVSLHFSLVCLLGAPALLA

SEQ ID NO: 14195 - protein, 81 aa, Lynx canadensis
DEALMAFRDVAVAFTQKEWRLLSPAQRTLYRDVMLENYSHLVSLGIAFSKPKLITQLEQGDEPWREESECLLDLCPEPGTE

SEQ ID NO: 14196 - protein, 81 aa, Phyllostomus discolor
DTVASPSPTSQSRAQSALAASPRRPAEVGMTFADIALYFSREEWRLLNEAQRRLYLDVMLENFELVSSLVPNQAATLHLCL

SEQ ID NO: 14197 - protein, 81 aa, Phyllostomus discolor
FQGSLTFQDVAVDFTSEEWQLLDCDQRTLYWDVMLENFRNLVSLGAPVTKPKAVFKVEQGPELQVVEGESPHWSHLEADCP

SEQ ID NO: 14198 - protein, 81 aa, Phyllostomus discolor
MAEGLKFKDVAIFFSQKEWECLHSAQKDLYRAVMLENYNNLILLDWESRRETRNLSPKEGCCEMKSLQPEIKTPIRSNLVC

SEQ ID NO: 14199 - protein, 81 aa, Phyllostomus discolor
KALGSVAFRDVIVDFTQEEWQQLKPAQKDLYRNVMMEIYWNLVSLDLETRPVLKESDPQEDKWEDKSSIVVVEEGPTRNGA

SEQ ID NO: 14200 - protein, 81 aa, Phyllostomus discolor
YQELVTFRDVAIDFSQEEWDCLNSSQRHLYSNVMLENYRILVSLGLCFSKPSIILLLEQGKEPWMVKRELVKGLCSGWESV

SEQ ID NO: 14201 - protein, 81 aa, Phyllostomus discolor
AEVGVTFADIALYFSREEWHLLDEAQRRLYLDVMLENFELISSLGNAFTVPVVWTRLCISLCPLFSRGYSVLIRGLEVLLD

SEQ ID NO: 14202 - protein, 81 aa, Myotis lucifugus
DPVTFDDVAVYFSRREWRLLDEAQRRLYHEVMLDNLALASSLGPCCGAEDADAPCEQSVSVGGSPSSTSQAVLSSLKTHFC

SEQ ID NO: 14203 - protein, 81 aa, Myotis lucifugus
PKVPVTFDDVAVYFSELEWGKLDPWQKNLYKHVMRGNYEMLVSLDYAISKPDILTRIERGEEPCPEGLWGQEEGEEREAAC

SEQ ID NO: 14204 - protein, 81 aa, Myotis lucifugus
FREPVAFEDVAVDFTREEWGRLTPAQRALHREVMLETWGLLVAVGPWLLRPTLVTLLEQEAGRWLGDREVPQGVCPDLETK

SEQ ID NO: 14205 - protein, 81 aa, Myotis lucifugus
SQELVTFEDVAVYFIRKEWKRLEPAQRDLYRDVMLENYGNVFSLDGETRTEHDQEISEDTESDGVLLGRFQKDISQGLKFE

SEQ ID NO: 14206 - protein, 81 aa, Myotis lucifugus
SQDSVTFQDVAVDFTEKEWPLLDSSQRKLYKDVMLENYSNLASVGCQVGKPSLIFHLEQEEELRTEESGFPQGTCPDWEIP

SEQ ID NO: 14207 - protein, 81 aa, Puma concolor
MDFTLEDWEQLGLDQGDLFWDTALDNYQNLFLLNPCKPKLTSCPDGGEELEAVVRESPESEGLAPYVRPHAERRHLHLPLW

SEQ ID NO: 14208 - protein, 81 aa, Sapajus apella
PQKLVTFEDVAVYFTQAEWDGLSPAQRILYRDVMLENYGNVASLGFPLLKPAVISQLEGGGELGAPSPLAAGTGLHGLRTV

SEQ ID NO: 14209 - protein, 81 aa, Sapajus apella
MGHLTFMDVAIEFSQEEWKCLDPAQQALYRDVMLENYRNLVSLGICLPDLSIISMLEQRREPSTLQGEVKIVKIQDGKECV

SEQ ID NO: 14210 - protein, 81 aa, Sapajus apella
FQEVVTFGDVAVHFSREEWQCLDPGQRALYREVMLENHSSVAGLAGFLVFKPELISRLEQGQEPWVLDLQGAEGTEAPKTS

SEQ ID NO: 14211 - protein, 81 aa, Sapajus apella
VPVTFRDVAFTEAEWKRLSPEQRNLYREVMMENARNLLSAAEPKPEIYPCSSCLLAFSFQQFLSQHVLQIFLGLRAENHFH

SEQ ID NO: 14212 - protein, 81 aa, Sapajus apella
ILTEAVTFKDVAVVFTEEELGLLDPVQRRLYQDVMLENFRNLLSVGHQPFHGDTFHLQREEKFWMMETATQREGNSGGKIQ

SEQ ID NO: 14213 - protein, 81 aa, Sapajus apella
AHALVTFRDVAIDFSQKEWECLDPTQRKLYRDVMLENYGNLVSLGYSGSKPDVITLLEQGKEPCVAVRDMAGRQYPGLLSR

SEQ ID NO: 14214 - protein, 81 aa, Sapajus apella
VSFGDVAVYFSREEWGCLQPAQRALYRDVMRETYSHLGALADSRNKEEKRPREGVGALEKPLPVATGPLGLKAPQALSAGP

SEQ ID NO: 14215 - protein, 81 aa, Sapajus apella
AQDHVVFEDVVIYFSQEEWGHLDEAQRLLYRDVMLENLALLSSLGCCHGAEDEEAPLEQGVSVGVSQVMAPKPSLSTQKTQ

SEQ ID NO: 14216 - protein, 81 aa, Sapajus apella
MLFIFNKAGIAVSKADLITCLQEEKDPWNMKRHSMVAKPPVIYSHFAQDLWPEQGIKDSFQEVILRRYRKCGHEDLQLRTG

SEQ ID NO: 14217 - protein, 81 aa, Sapajus apella
MLENYSNLVSVGYHIIKPDVITKLEQGEEPWIVEGEFLLQSYPDEVWQTDNLIERVQEDENKLSRQTVFIKTLTEERGNVP

SEQ ID NO: 14218 - protein, 81 aa, Sapajus apella
VTFEDVAVVFTDEEWSHLVPIQKDLYKEVMLENYKSVVSLDWETKPEIYDASEEKAEGSLRESLGRQSPLCPKFEVHAPDS

SEQ ID NO: 14219 - protein, 81 aa, Oryctolagus cuniculus
FQVLVSFEDVAVDFTWEEWQDLDNAQKTLYRDVMLETYNSLLSLGYCVTKPDVIFKLEQGAEPWTVEEPPQQSLQVVQKMD

SEQ ID NO: 14220 - protein, 81 aa, Oryctolagus cuniculus
MIAFEDLAVYFTWEEWQKMNNAQKILYRDVMLETYSSLFSLGHCITKPDLIFKLEQGAEPWIVEECLNQSLPVVMKRDDLI

SEQ ID NO: 14221 - protein, 81 aa, Sapajus apella
FQAPLTFTDVAMEFTLEEWQCLDTAQQNLYKNVMLENYRNLVFLGIIVSKQDLITFLEKEKEPWNMKQHEMVDEAPGFWKN

SEQ ID NO: 14222 - protein, 81 aa, Oryctolagus cuniculus
MTAFEDLAVYFTWEEWQKMNNAQKILYRDVMLETYSSLFSLGHCITKPDLIFKLERGEEPWMVDECLNLSLSVVMKRDDLI

SEQ ID NO: 14223 - protein, 81 aa, Oryctolagus cuniculus
LQVLVSFEDLTVDFTWEEWQNLNSAQRILYRDTMLEIYNNLQSLGHCITKPHLICKLEQGAEPWMVEEEVYISFPLLLLVT

SEQ ID NO: 14224 - protein, 81 aa, Oryctolagus cuniculus
LREAVTFQDVAVVFSEEELRLLDAAQRALYREVMLENFRNLLSVGHQSFKPDVISQLEREERLQVQEIQTQRGSKNGNKTG

SEQ ID NO: 14225 - protein, 81 aa, Oryctolagus cuniculus
SQVMITFEDLAVYFTWEEWQNMNQAQKILYRDVMLETYSSLFSLGHCMTKPDLILKLEQGAEPWMGKECLHHSLSVAMKRD

SEQ ID NO: 14226 - protein, 81 aa, Pteropus alecto
MLETCGFLVSLGQLVPIPELIYFLEPGQKLWTVKRDLSESTCTGEKAKLETKEPPASQLAFTEEAAFKEGVTQRASRDSRL

SEQ ID NO: 14227 - protein, 81 aa, Oryctolagus cuniculus
SPGLLSFEDLAVDFTQEEWQDLDNAQKTLYKDVMLETYSSLQSLGHCITKPDLIFKLEQGAEPWLVKECLNQSLPVAQRRD

SEQ ID NO: 14228 - protein, 81 aa, Rhinolophus ferrumequinum
VQEPVTFRDVAVDFTQEEWGQLGPAQRTLYRDVMLETYGHLLSLGKQIAKPEVISLLEQGEEPWLVEHTYPQSTCPEMMRN

SEQ ID NO: 14229 - protein, 81 aa, Gorilla gorilla
QGLLTFRDVAIEFSQEEWKCLDPAQRTLYRDVMLENYRNLVSLDISSKCTMKEFLSTAQGNREVFHAGTSQRHESHHNGDF

SEQ ID NO: 14230 - protein, 81 aa, Ailuropoda melanoleuca
QGLLTFGDVAIEFSQEEWRCLSHTQRELYRDVMLENYGHLLFLGLIVSKPDLVSLLEQRKEPWDVKRKKTVVFDPAVSSHG

SEQ ID NO: 14231 - protein, 81 aa, Phyllostomus discolor
RKTDMSFADVAIAFSQEEWGLLDEAQRLLYCDVMLEIFVLLASVGCWHKKEDEEAPCEPSVYVHEESQGGVSKTSPATQKT

SEQ ID NO: 14232 - protein, 81 aa, Desmodus rotundus
TQEEWQQLDPVEKTTYRDVMLENYSHLVSVGCQVVKPEVIIKLEQGEEPWVEGELLPRRWPGVWRADVTEIVRESEDKCPR

SEQ ID NO: 14233 - protein, 81 aa, Macaca fascicularis
MGPLTFRDVKIEFSLEEWQCLDTAQRNLYRDVMLENYRNLVFLGIAVSKPDLITWLEQGKEPWNMKRREMVDKTPVICSHF

SEQ ID NO: 14234 - protein, 81 aa, Macaca fascicularis
TQGPLKFMDVAIEFSQEEWKCLEPAQRTLYRDVMLENYRNLVSLGICLPDLSVISTLEQKKDPWILQSEEKIANNPDGREC

SEQ ID NO: 14235 - protein, 81 aa, Macaca fascicularis
EQGYVTFEDVAVYFSQEEWRLLDEAQRLLCRNVMLENFSLLASLGLASSKTHDITQLESWKEPFMPASEVVTSAIPRGCWH

SEQ ID NO: 14236 - protein, 81 aa, Macaca fascicularis
MEHLTFRDVAIEFSPEEWKCLDPAQQNLYRDVMLENYRNLVSLGVAISNPDLVTFLEQRKEPYNVKIHETVAKHPAMCSHF

SEQ ID NO: 14237 - protein, 81 aa, Macaca fascicularis
PLETVTFKDVAVDLTQEEWEQMKPAQRNLYRDVMLENYSNLVTVGCQVTKPDVIFKLEQEEEPWVMEEEIFGRHCPEVWEV

SEQ ID NO: 14238 - protein, 81 aa, Macaca fascicularis
GSVSFSDVALGFTQEEWQHLDPAQRTLYRDVMLENYNLLLCTGYCITKPVVICKLEHGEVLWILEEESPSQSHLDCCIDDN

SEQ ID NO: 14239 - protein, 81 aa, Macaca fascicularis
PQGSLTFRDVAIEFSQEEWKCLDPIQKALYRDVMLENYRNLGFLGLCLPDLNIISMLEQGKEPWTVVSQVKIARNPNWGEC

SEQ ID NO: 14240 - protein, 81 aa, Macaca fascicularis
GKELLSFEDVAMYFTREEWGRLDWGQKDLYRDVMLENYRNMVLLGFQFPKPEVICQLENWDEQWILDLPRAGSRKASGSAC

SEQ ID NO: 14241 - protein, 81 aa, Macaca fascicularis
GTVTFEDVAVKFTREEWNLLSEAQRCLYRDVTLENLALISSLGCWCGVEDEAPSKQSIYIQRETQVRIPMAGVSPKKAHPC

SEQ ID NO: 14242 - protein, 81 aa, Macaca fascicularis
FQRSVSFQDLTVNFTQEEWQQLDPAQRLLYRDVMLENYSNLVSVGYHVSKPDVIFKLEQGEEPWIVEEFSNQNYPEVNDAL

SEQ ID NO: 14243 - protein, 81 aa, Macaca fascicularis
GMEPLQFRDVAIEFSLEEWHCLDAAAAAAAAAAAAAAVMLENYRNLVFLEPDLITRLEQGENPLTVKRHKMTANPSVMCSH

SEQ ID NO: 14244 - protein, 81 aa, Macaca fascicularis
HQEMVTFEDVAVHFTKTEWTGLSPAQRALYRSVMLENFGNLTALGYPVPKPALISLLEGGDMAWGLEAQDDAPAERTKNIC

SEQ ID NO: 14245 - protein, 81 aa, Phascolarctos cinereus
RQELLTFRDVAVVFTPEEWGHLRPAQKELYRDVMLENYRNLVCLGLVISKPDVIDQLERGGKLWMPEGDVLRSTCPGRSLR

SEQ ID NO: 14246 - protein, 81 aa, Phascolarctos cinereus
MVVDFTQEEWSLLDPAEKDLFWDVMLENYENFVSLASFQMFPHEQGLPDSKPLLISQLERREAPWLPMEEVLKSIYVDFLP

SEQ ID NO: 14247 - protein, 81 aa, Phascolarctos cinereus
MLENYKNLVSLGLLVSQPDVLSQLQRGKVPWIPEGDIPRGTCPDFLTQETRQDTMEPVAKQGIFMGKSSMERHMMNGPWGY

SEQ ID NO: 14248 - protein, 81 aa, Puma concolor
LQEAVVFEDVAVYFTRIEWSCLAPDQRALYRDVMLENYGHVASLGFVVAKPALISLLEQGEEPGALILQVAEEQGTVANLC

SEQ ID NO: 14249 - protein, 81 aa, Myotis lucifugus
QESVTFEDVAVYFTQNQWASLDPVQRALYRDVMLENYANVAALVAFPAPKPDLISQLERGSAPWGPDPWEAEVLRGICPGD

SEQ ID NO: 14250 - protein, 81 aa, Puma concolor
MLENFSHVISLGYPVSKPDVISKLEQGEDPWIIKRDVSNWIYTDENQKMHNGVMPCNNNQCGNIFSSKQSLMQYQNVETKE

SEQ ID NO: 14251 - protein, 81 aa, Puma concolor
LQNSITFEDVAMDFTEEEWVLLNPRQRKLYRDVMLENYRNLASLEKQLSRPALITQMQQEDEMKSETRNHQDTCSNGIVLP

SEQ ID NO: 14252 - protein, 81 aa, Puma concolor
FQESLTFRDVFVDFTLEEWRCLDSAQKNLYRDVMLENYSHLVSVGQLVPKPDVVIRLGQGEEARTAEGETPTRNPPEFWQV

SEQ ID NO: 14253 - protein, 81 aa, Puma concolor
RPGAVCFADVAVYFSPEEWGCLRPAQRALYRDVMRETYGHLGALGFRGTKPALISWVEEEADLWGPDARDPEVGECLTAAD

SEQ ID NO: 14254 - protein, 81 aa, Sapajus apella
PQVSLTFEDVAVLFSREEWRKLAPSQRNLYRDVMLENYRNLASLGLPFTKPKVISLLQQGEDPWKVEKDSSGGPCLGLKSS

SEQ ID NO: 14255 - protein, 81 aa, Sapajus apella
NFWILRLPPGSKGEAPKEWGKLEDWQKELYKHVMRGNYETLVSLDYAISKPDILTQIERGEEPCPDQWSQKKGSEVEVAHS

SEQ ID NO: 14256 - protein, 81 aa, Sapajus apella
FQGPVSFRDVSVGFTQEEWQHLDPAQRTLYRDVMMENYSHLVSVGYCIRKPEVILKLEKGEEPWILEEKFPSQSHLGELVC

SEQ ID NO: 14257 - protein, 81 aa, Sapajus apella
MLENFALIASLGLISFRSHIVSQLEMGKEPWVPDSMDMTSAMARGAYGRPGSDFCHGTEGKELPSEHNVSVEGVAQDRSPK

SEQ ID NO: 14258 - protein, 81 aa, Sapajus apella
VCVLQGPLTFMDVAIEFSLEEWQCLDTAQQNLYRNVMLENYRNLVFLGIAVSKPDLIACLEQEKKPWNIKRNEMVAKPPGR

SEQ ID NO: 14259 - protein, 81 aa, Sapajus apella
LQEPVTFRDVAVDFTQEEWGQLDPTQRILYRDVMLETFGHLLSIGPELPKPEVISHLEQGTEPWVTERGITQGYYPGCEPR

SEQ ID NO: 14260 - protein, 81 aa, Sapajus apella
MGPLTFRDVAIEFSLEEWQCLDTAQRNLYRKVMFENYRNLAFLGIAVSKPHLITCLEQGKEPWNRKRQEMVAEPPVMCSHF

SEQ ID NO: 14261 - protein, 81 aa, Sapajus apella
EKDLMAFEDVAVYFSQEEWGLLDTAQRALYRHVMLENFTLVTSLGLSTSRPLVVIQLEHGEEPWVPSVKDMTLARNAYGRH

SEQ ID NO: 14262 - protein, 81 aa, Sapajus apella
SQESLTFKDVFVDFTLEEWQQLDSAQKNLYRDVMLENYSHLVSVGYLLAKPDMIFRLGPGEESWRADGGTPVRTCAVLKER

SEQ ID NO: 14263 - protein, 81 aa, Sapajus apella
MEEAVTFKDVAVFFTEEELGLLDLAQRKLYRDVMLENFRNLLSVGHQPFHQDVFHFLREEKFWMMETATQREGNSGGKIQT

SEQ ID NO: 14264 - protein, 81 aa, Sapajus apella
PQESVAFEDVAVYFTKKEWAIMVPDQRALYCVMLENCEAVALVAVPPTSKLALVSHLEQGKEPCFTQPQGVLSRRGWRAGF

SEQ ID NO: 14265 - protein, 81 aa, Oryctolagus cuniculus
NYGNVPSLGFPVPKPELISQLEQGEELWVLDLVGAEDPRVLDNSFMFFVTDSEVGTKKELSVLNQQCSEEVENPEFISRRF

SEQ ID NO: 14266 - protein, 81 aa, Sapajus apella
LVTFEDVAVEFTQEEWALLDPAQRTLYKDVMLENCRNLASLDLETLLKAKWLTPKKHVFKKEQSKRVKTERSHRGVKLNEC

SEQ ID NO: 14267 - protein, 81 aa, Oryctolagus cuniculus
SVTFEDVAVHFSWEEWDLLDEAQRRLYLDVMLENFALTSALGCCLGVEHEEALSEQSISLGLSQVRTPKEGSSFQNAYPCD

SEQ ID NO: 14268 - protein, 81 aa, Oryctolagus cuniculus
QEFVTFEDVAVHLTREEWGCLDPVQRDLYREVMLENYGNVVSLDGETTEENKLLIPKQNISEEVHSYKTRVGRLKQDIAHV

SEQ ID NO: 14269 - protein, 81 aa, Oryctolagus cuniculus
MLENYSNLLSLGLPCTKPKVISLLQQGEDPWKIEKDSPGGSSVDWKSGPKTTTSTQTQDSSFQGLIMKRSRRNRPWDLKSE

SEQ ID NO: 14270 - protein, 81 aa, Oryctolagus cuniculus
AHALVMFRDVAVEFSQEEWECLDTSQRNLYRDVMLENYRNLVSLGHAASKPDVITLLEQGREPCTVARVVTARPYPGLFPR

SEQ ID NO: 14271 - protein, 81 aa, Oryctolagus cuniculus
SQESVTFQDVAVDFTEKEWPLLDSSQRKLYIDVMLENYSNLTSLGYQVGKPSLISHLEQEEEPRTEQRGIHQDTCPDWETP

SEQ ID NO: 14272 - protein, 81 aa, Pteropus alecto
TLVSVTFNDVAVTFTQEEWGQLDLSQRTLYQEVMLENCRILLSLGCPVPRPELIYQLEHGQELWMVNRDLSQSTCPGNKEK

SEQ ID NO: 14273 - protein, 81 aa, Oryctolagus cuniculus
AEVMIAFEDLAVYFTWEEWQNMNKAQKILYRDVMLETYSSLLFLGHCITKPDLIFKLEQGAEPWMVNECLNQRLPVAMKSD

SEQ ID NO: 14274 - protein, 81 aa, Pteropus alecto
MLDPTQKILYRNVMLENYSHLVSIGCCTIKPEVIIKIEQKEEPWILEQGFPSQCHPEDWKVDDLIESSQENQDEHFWQLAF

SEQ ID NO: 14275 - protein, 81 aa, Rhinolophus ferrumequinum
VKESVTLEVVTVDFTWEEWQLLVPEQKDLYRDVMLETYSNLVSVVYQASKPDTLSKLECGEELEPARGRPGSRILVSRRRC

SEQ ID NO: 14276 - protein, 81 aa, Desmodus rotundus
KFQEPLTFKDVAVVFTEEELGLLDPSQRKLYRDVMLENFRNLVSLGQPFKPNEIPHLEQGRETWVTERGTIRESHPGDKNV

SEQ ID NO: 14277 - protein, 81 aa, Macaca fascicularis
ASVTVTFDDVALYFSEQEWEILEKWQKQMYKQEMKTNYQTLDSLGYAFSKPDLITWMEQGRMLFIREQGCLDKTRRTTSPP

SEQ ID NO: 14278 - protein, 81 aa, Macaca fascicularis
LQASVSFEDVTVDFSREEWQHLDPAQRRLYWDVTLENYSHLLSVGYQVPKSEAAFKLEQGEGPWTLAGEAPHQSCSGEAIE

SEQ ID NO: 14279 - protein, 81 aa, Macaca fascicularis
AQESVMFSDVSIDFSQEEWECLNDDQRDLYRDVMLENYSNLVSMAGHSISKPNVISYLEQGKEPWLVDRELTRGQWPVLES

SEQ ID NO: 14280 - protein, 81 aa, Macaca fascicularis
MGSVSFKDVTVGFTQEEWQHLDPAQTTLSRDVMLENYSHFVSVGYCIPKPEVILKLEKGEEPWILEEKFPLQSHLELINTS

SEQ ID NO: 14281 - protein, 81 aa, Macaca fascicularis
RAEEAVTFKDVAVVFTEEELELLDPDQRKLYRDVMLENFRNLLSVGHQPFHGDTFHFLRDEKFWVMETTSQREGTSGGKIQ

SEQ ID NO: 14282 - protein, 81 aa, Macaca fascicularis
NKGPVTLKDVIVEFTKEEWKLLTFAQRTLYKDVMLENYSHLVSVGYHVNKPNAVFKLKQGKEPWILEVEFPHRVLPYLWSI

SEQ ID NO: 14283 - protein, 81 aa, Macaca fascicularis
VAFEDVAVNFSQEEWSLLSEVQRCLYHDVMLENWVLISSLGYWCGSEDEEAPSKRNILRSLHLSAQAEVSRSQLTAASASR

SEQ ID NO: 14284 - protein, 81 aa, Macaca fascicularis
AHGSVTFRDVAIDFSQEEWEFLDPAQRDLYRDVMWENYSNFISLGPSISKPDMITLLDEEGKEPGMVVREGTRRYCPGDVQ

SEQ ID NO: 14285 - protein, 81 aa, Macaca fascicularis
MDVAIEFSQEEWKCLEPAQRTLYRDVMLENYRNLVSLGICLPDLSVISTLEQKKDPWILQSEEKIANNPDGRECIKGVNTV

SEQ ID NO: 14286 - protein, 81 aa, Macaca fascicularis
TGGDVTFSDVAIDFSHEEWAWLDSAQRDLYKDVMVQNYENLVSVGLSITKPYVIMLLEDGKEPWMVEKKLSKDWESRWENK

SEQ ID NO: 14287 - protein, 81 aa, Phascolarctos cinereus
GKESVTFKDVAIEFTPEEWVQLNPSQKKLYRDVMLENYRNLVSLGFAVCKPDVIYQLERKEASWKPEADIPRSSCPESREF

SEQ ID NO: 14288 - protein, 81 aa, Macaca fascicularis
RESGKAPVTFDDITVYLLQEEWVLLSQQQKELCGSDKLVAPLGPTVANPELFCKFGPGPEPWLGSVQGQRSHLEHHPGKKQ

SEQ ID NO: 14289 - protein, 81 aa, Phascolarctos cinereus
APVPVKFDDVAIYFSEQEWDILDDWQKDLYKHVMRANYSTLVSLDYTIPKPELIFRIELGEVLFVGNWGDLEQAEIGVSLN

SEQ ID NO: 14290 - protein, 81 aa, Phascolarctos cinereus
SQIPLTFQDVAVDFTWEEWGLLEPSQKDMYWDVMLENYENFVSLGGIPVSFPDVISQMERIEAPWMTERGVLVSAFLDSPN

SEQ ID NO: 14291 - protein, 81 aa, Phascolarctos cinereus
VKIEDVADVAVSFILEEWGHLDQTQKDLSRNDRQENYETVTSVDYEPRNENMELIVKQEISEEAESLWMTPESIQKNDSQD

SEQ ID NO: 14292 - protein, 81 aa, Phascolarctos cinereus
PQELVTFEDVAVYLTKEEWGQLGPAQRKLYRDVMLENYENVISLGFPVSKPDLISQLERGEVPCLPDVPRTEVPETHGAKS

SEQ ID NO: 14293 - protein, 81 aa, Phascolarctos cinereus
FQESVTFRDVAVDFTQEEWGYLDLSEKELYRDVMLENYRHLVHLGLAVSKPDVIFHLERGEPPWRPESEVTRTSFPDWEYI

SEQ ID NO: 14294 - protein, 81 aa, Phascolarctos cinereus
MMFEDVAVYLTQEEWGCLGPAQRGLYKDVMLENYGNLVSLGFPVSKPDVISQLERGEEPWVLNMQQRAEKREILRGSCSGT

SEQ ID NO: 14295 - protein, 81 aa, Phascolarctos cinereus
SLASLTFQDVAVAFSREEWRCLDPAQKTLYREVMLENYRHLVFLGLPVSKPELISQLECGEGPWMLLEEEPRSPCADQNSS

SEQ ID NO: 14296 - protein, 81 aa, Phascolarctos cinereus
PQALIIFEDVAVYLTRGEWNCLEPAQKSLYRDVMLENYENLVSLGFPLSKPDVICQLERGEEPWVVHTQEKVTLKGNCSDL

SEQ ID NO: 14297 - protein, 81 aa, Phascolarctos cinereus
MFKDVAVEFTQEEWRQLDPAQRSLFKDVMLENYRNLVSLGLAVNKPGIISHLERGRAPWIPEKAVSGGTFPGIPIKLKANL

SEQ ID NO: 14298 - protein, 81 aa, Phascolarctos cinereus
GKESVTFQDVVVEFSLEEWKHLHPSQKKLYRDVMLENYKNLVSLGFAVSKPHVIYQLERKEAAWMPEADIPRSSCPGNKGF

SEQ ID NO: 14299 - protein, 81 aa, Myotis lucifugus
TQDSVVFEDVAVDFSQEEWALLDRAQRSLYREVMLENFRNLASLGYPLHTPCLIFQWKQEEDREITKRGLSMGSTRKARIL

SEQ ID NO: 14300 - protein, 81 aa, Myotis lucifugus
HNDMDFEDVAIAFSQEEWGLLDEAQRLLYCEVMLENFALVASVGAGRTLLLSQAVHRKMVSGEGWPCQHRYLSISLLSGCW

SEQ ID NO: 14301 - protein, 81 aa, Myotis lucifugus
VTFEDVAVCFSKKEWCLLDEAQRHLYLEVMLENYDLISSLGCCCRTEDVEAPTEQHVSVRVSQAKNPNVALSSQKSHPCES

SEQ ID NO: 14302 - protein, 81 aa, Myotis lucifugus
LLSFEDVAMYFTREEWNKLDWAQKDLYRDVMLENYRNMILLGFQIPKPEVICQLEQWEDPWILDLPRAGTRRASSSACPGS

SEQ ID NO: 14303 - protein, 81 aa, Puma concolor
IQEPVMFKDVAVVFSEEELGLLGPTQRKLYRDVMLENFRNLVSVGNQPFKPELISQLEREEKLLMMETETQRDGCLGTKSQ

SEQ ID NO: 14304 - protein, 81 aa, Myotis lucifugus
GWEDMNFEDVAIAFSQEEWELLDEAQRRLYCDVMLEVFTLVSFVGPWHKIDDVEAYSEHSVSVGDSHVRASKTAAATQRTH

SEQ ID NO: 14305 - protein, 81 aa, Puma concolor
HQEVVTFEDVAVYFTGTEWTGLSPGQKALYRSVMLENYGNLTSLGYQVPRPALISLLEAGNLPWGLEAQDNLSAERTKDLC

SEQ ID NO: 14306 - protein, 81 aa, Puma concolor
MEFTWDEWQLLDSAQKYLYRDVILENYSHLVSVGYHGTKPDLIFKLEQGEEPWIINAKVSRQSCPGGARPYECTKCERAFS

SEQ ID NO: 14307 - protein, 81 aa, Puma concolor
FQGSLSFGDVTVDFSWEEWQCLNPAQRTLYRDVMLENYHNFVSLGFLINKPEVIFRLEEGEEPWIVKEEFLYQNYPGELVS

SEQ ID NO: 14308 - protein, 81 aa, Puma concolor
EGSVTFEDVALYFSWEEWDLLDEDQRCLYHDVMLENFALTSSLGCGHGVDDEDVPLEESISVGVLAANLQQYEGQHTREVP

SEQ ID NO: 14309 - protein, 81 aa, Sapajus apella
SRSLENDGVCFTEQEWENLEDWQKELYRNVMESNYETLVSLKVLGQPEGEAELGTEMLGDLEEEGPGGAHPAGGVMIKQEL

SEQ ID NO: 14310 - protein, 81 aa, Sapajus apella
VTFEDVAVNFSKEEWCLLSEAQRCLYRDVMLENLALISSLGCWCGLKDEAALSKQSITVQTESQDRTPRAVSPKKAHSCHM

SEQ ID NO: 14311 - protein, 81 aa, Sapajus apella
HLTFRDVAIEFSQEEWKCLNSTQRTLYRDVMLENYRNLVSLALSHNGVINELAPKQESNMGDVFHTVALEQHETPDMQEFC

SEQ ID NO: 14312 - protein, 81 aa, Sapajus apella
KPGAVSFADVAVYFSPEEWGCLRPAQRALYRDVMRETYGHLGALGFPGPKPALISWMEQESEAWSSAAQDPEKGESLGGAR

SEQ ID NO: 14313 - protein, 81 aa, Sapajus apella
MEGLVMFQDLSIDFSQEEWECLNPAQKDLYRDVMMENYNSLLSLGLSIPKPDVISLLEQGKEPWMVSRDVLGGWCPDLKFR

SEQ ID NO: 14314 - protein, 81 aa, Sapajus apella
FQVLLTFRDVAIEFSLTEWQFLDTAQRNLYRNVMLENYENLVFLGIAVSKPDLITCLEQEKELWNMKRHEMVDKPPVMCSH

SEQ ID NO: 14315 - protein, 81 aa, Oryctolagus cuniculus
MLENYGNMVSLGFGFPKPPLISYLEQETELCAQDPWNRKSLSCSYSVSTDRTLPGNERASSEQEVFENRDVFQLKSSSLPK

SEQ ID NO: 14316 - protein, 81 aa, Oryctolagus cuniculus
IYLKVREREAGRGCSISKPDLITLLEQGKEPWMVVRGEKRRWSLDLESRYDTKKLFQEKDNYEMKLSQWEIMERVKSRGLD

SEQ ID NO: 14317 - protein, 81 aa, Oryctolagus cuniculus
LQVLVSFEDLAVDFTWEEWQDLDSAQRTLYRDVMLETYSSLLSLGFCITKPEVIFKLEQGAEPWTVEESLNQSVSVVQKID

SEQ ID NO: 14318 - protein, 81 aa, Ailuropoda melanoleuca
WKELLSFEDVAMYFTREEWNKLDWAQKDLYRDVMLENYRNMILLGFQFPKPEVICLLEQWEEPWILDLPRAGTRKASSSAC

SEQ ID NO: 14319 - protein, 81 aa, Macaca fascicularis
AQGCVTFEDVTIYFSQEEWGLLDEAQRLLYCDVMLENFALIASLGLISFRSHIVSQLEMGKEPWVPDSVDMTSAMARGAYG

SEQ ID NO: 14320 - protein, 81 aa, Macaca fascicularis
DSVVFEEVAVNFTPEEWALLDHAQRSLYRDVMLETCRNLASLDCCIYVRTSGSSSQRDVLGNGISNDEEIVKFTSDYWSIF

SEQ ID NO: 14321 - protein, 81 aa, Macaca fascicularis
MALPQVLLTFRDVAIEFSQEEWKCLDPAQRTLYRDVMLENYRNLVSLATVPGPYFLFFLDTVSLSVTQCGVRWCDHGSLQS

SEQ ID NO: 14322 - protein, 81 aa, Macaca fascicularis
AEGLVMFEDVAVYFSREEWGLLNVTQKGLYRDVMLENFALVSSLGLAPSRSPVFSQLEKDEQLWVRSWVDVTPVSRAEARR

SEQ ID NO: 14323 - protein, 81 aa, Macaca fascicularis
EPGIVSFADVAVYFCREEWGCLRPAQRALYRDVMRETYGHLSALGIGGNKPALISWVEEEAELWGPAARDPETKCPTETDP

SEQ ID NO: 14324 - protein, 81 aa, Macaca fascicularis
MELLTFRDVAIEFSPEEWKCLDPAQQNLYKDVMLENYRNLVSLGFVISNPDLVTCLEQIKEPYNLKIHETAAKPPVVQHFW

SEQ ID NO: 14325 - protein, 81 aa, Macaca fascicularis
VAFEDVAVNFTQEEWALLDIFQKNLYREVMLETFRNLTSIGKSWKDQNIEYEYQNPRRNFRSLIEEKVNEIKEDSHCGETV

SEQ ID NO: 14326 - protein, 81 aa, Phascolarctos cinereus
AQGLVTFKDVAVDFTQEEWGLLDHPQKELYKGVMLENAQNLLSLGLPVPREDVMCYFEQREAPWMLEQEVLRSHCLVASWV

SEQ ID NO: 14327 - protein, 81 aa, Macaca fascicularis
APGSVTFEDVAVYFSWEEWDLLDEAQKHLYFDVMLENFALTSSLGLTSSWSHVVAQLGLGEVSSVLHRMFMTPASARWDQR

SEQ ID NO: 14328 - protein, 81 aa, Phascolarctos cinereus
GESGQMLVTFDDITVYLLQEEWMLLGEQQREICGSDKLVAPLGTPIANPELFCKLERGVEPWLGDAPGRRKLLSHHLGNKK

SEQ ID NO: 14329 - protein, 81 aa, Phascolarctos cinereus
AQESVTFKDVAVDFTQEEWEQLDPAQRDLYRDVMLENYKNFISLGFPVFKPDVISQLERGEEPWTSETEVSYIVCPDSIIQ

SEQ ID NO: 14330 - protein, 81 aa, Myotis lucifugus
PRSLENDGVCFSEQEWENLEDWQKELYRNVMMSNYETLVSLKVLGQPEGEAELGTEMLGDLEEEGLGGVHPAEGVVIKQEV

SEQ ID NO: 14331 - protein, 81 aa, Myotis lucifugus
QTGDVNFEDVAIAFSEVEWVILDDAQRLLYYDVMLEVFALVSSVGCWHKMEDEEACSDQRVCIQGKSQVRTSKTAPVTHKN

SEQ ID NO: 14332 - protein, 81 aa, Puma concolor
SLEDGLLTFRDVAVEFSQEEWGCLNHSQQELYWDVMLETYGHLLFLGLVSKPDLVIFLEQKRELWDIKREETVATHPGRWE

SEQ ID NO: 14333 - protein, 81 aa, Sapajus apella
QEMPLTFQDVAVYFSQAEGQQLGPQQRALYRDVMLENYGNVASLGFPVPKPELISQLEQGKELWVLNLLGVEEPEILKSCQ

SEQ ID NO: 14334 - protein, 81 aa, Sapajus apella
MLENYRNLVSLGLTVSKPELISCLEQRQEPWSVKRPETVAKPPAMSCHYTEDFLPEQGMKDSFQKVILRRSGSCGLENLHL

SEQ ID NO: 14335 - protein, 81 aa, Sapajus apella
SLGPVSFKDVAVDFTQEEWQQLDPEQKITYRDVMLENYSNLVSVGYHIIKPDVITKLEQGEEPWIVEGEFLLQSYPDEVWQ

SEQ ID NO: 14336 - protein, 81 aa, Sapajus apella
VRAGSALTVQWPRRGREEWGLLNVTQKGLYRDVMLENFALLSSLGLAPSRSPVFTQLVDDEQPCVPSWVDVTLVSRTEASR

SEQ ID NO: 14337 - protein, 81 aa, Sapajus apella
MDFTPEEWGKLDPAQRDVMLENYRNLVSLWLPVSKPENYTLENGKEPLKLERKAPKNSYSDMKTRPESKDSTSVQDFSKAE

SEQ ID NO: 14338 - protein, 81 aa, Sapajus apella
FQDLVTFEDVSVDFTHEEWTLLDPLQRNFYRDVMLENYENLAKVGFQLLKPSLISWLEEEEELRTLQQGLLQEWAIKLLHT

SEQ ID NO: 14339 - protein, 81 aa, Oryctolagus cuniculus
SRSLENDGVCFTEQEWENLEDWQKELYRNVMQSNYETLVSLKVLGQPEGEAELGTEMLGDLEEEGPGGAHPPDGIVLRQEL

SEQ ID NO: 14340 - protein, 81 aa, Sapajus apella
AHVSLAFRDVSIDLSQEEWECLDPAQRDLYKDVMFENYSNLVSLGYTIPKPDVIALLEQEKEPWIVMREGTRSWYTESEDK

SEQ ID NO: 14341 - protein, 81 aa, Sapajus apella
TARPQAFEDMAVYFTKKEWANMAPDQRALYRDVMMENYEAVAFEVPPTSKPVLVSHLEAGKEPCFAQPQGVLSRRDWRAVF

SEQ ID NO: 14342 - protein, 81 aa, Sapajus apella
MDVAVEFSLEEWQCLDTAQRHLYRNVMLENYRNLVFLGIAVSKPDLITCLEKEKEPWNMKRHGMVDKPPVTFFHFAEDLWP

SEQ ID NO: 14343 - protein, 81 aa, Sapajus apella
MLENYRNLVSLAGISLPEMNIVSTLEQGKEPRTVESEVKITKTSNGWKCVKGVNTGVSPTHMIKELPPKENNSTGKAFQAV

SEQ ID NO: 14344 - protein, 81 aa, Oryctolagus cuniculus
AEGFVTFADVAVSFSWEEWNLLDTAQRHLYRSVMLETSALLDSLGLKASKTHEIVQLELWGQPFTPRGRWPGGDTAEAPWE

SEQ ID NO: 14345 - protein, 81 aa, Oryctolagus cuniculus
AQGSLTFEDVAICFSQEEWGLVDEAQRLLYFGVMLENFALTASLGCKHRTEYEKIPPEKSIGMPQVRTSKAGPSTQKIHPC

SEQ ID NO: 14346 - protein, 81 aa, Oryctolagus cuniculus
EALPVVFEDVAVYFTREEWGMLDKRQKELYRDVMRMNYELLASLGPAAAKPDLISKLERRTAPWIKDPNGPKLGKGCPPGK

SEQ ID NO: 14347 - protein, 81 aa, Oryctolagus cuniculus
PLESLTFKDVAIDFTLEEWRLMDPTQRSLHKDVMLENYRNLVSLGLAVSKPDMISHLENGKGPWAVVREISRGPYPDLETK

SEQ ID NO: 14348 - protein, 81 aa, Oryctolagus cuniculus
PKVPVAFDDVSIYFSTPEWEKLEEWQKELYKNIMKGNYESLISMDYAMNQPDVLSQIQPEGEHHTEDQAGPEESEIPADPS

SEQ ID NO: 14349 - protein, 81 aa, Oryctolagus cuniculus
SKVPVSFEDVSVYFTKTEWKLLDLSQRLLYKRVMLENYSHLVSLGFAFCKPHVVSQLERGKGPWVSDFPRLGDPAGLRAGD

SEQ ID NO: 14350 - protein, 81 aa, Rhinolophus ferrumequinum
PLESMMFEDVAIDFTQEEWALLDTFQRKLFRDVMLETISHLVSLGYQHCKSAVIFQLEQGEELWHEGTGFLQSQRITIRTG

SEQ ID NO: 14351 - protein, 81 aa, Rhinolophus ferrumequinum
SLGPVSFHDVAVDFTQEEWRQLDPEQKTTYRDVMLENYSHLVSVGCHIIKPEVIIKLEQGEEPWIVEGEFFLQSYPEEVWK

SEQ ID NO: 14352 - protein, 81 aa, Rhinolophus ferrumequinum
AQGLMVFEDVAVYFSREEWGLLDAAQRALYHHVMLENFALVASLGLSASRPRVVIQLERGEEPWVLSGTDVTLARNNQRRP

SEQ ID NO: 14353 - protein, 81 aa, Rhinolophus ferrumequinum
AHGSVTFMDVAIDFSQEEWEFLNSAQRDLYRDVMWENYSNFISLGPSISKPDVITLLDEGKEPWMVVREGTRRHYPDLESR

SEQ ID NO: 14354 - protein, 81 aa, Ursus maritimus
QHLDPAQKTLHRDVMLETYSHLVSVGEDTFSVEKSLDSPQQIISEELSFQKEILEKAPKEAACQIHEQIERQHQDDQDRYL

SEQ ID NO: 14355 - protein, 81 aa, Ursus maritimus
PQGSVSFKDVTVDFTQEEWQHLDPAQKALYRDVMLENYCHLISVGFHMTKPDMIRKLEQGEELWTTERMFPSQSYLEEDGK

SEQ ID NO: 14356 - protein, 81 aa, Ursus maritimus
VTFEDVAVYFSWKEWRLLDEAQRRLYHRVMLENFTLISSLGCCCGAEGEEAPFAQSTTVGASQAGTPAAAVSSRKTHPCEL

SEQ ID NO: 14357 - protein, 81 aa, Gorilla gorilla
QDSVTFDDVAVEFTPEEWALLDTTEKCLYRDVMLENYVNLASVDFFFCLTSEWEIQPRTKRSSLQQGFLKNQIFTGIQMTR

SEQ ID NO: 14358 - protein, 81 aa, Gorilla gorilla
TGEDVTFNDVAIDFTHEEWGWLNSAQRDLYKDVMVQNYENLVSVAGLSVTKPYVITLLEDGKEPWMMEKKLSKGMIPDWES

SEQ ID NO: 14359 - protein, 81 aa, Ailuropoda melanoleuca
SQDADEIQGESLKDEVTSGSPGAESKELLTFKDISVDFTQEEWGHLAPAHRNLYREVMLENYGNLVSVAGYQLSKPSVISQ

SEQ ID NO: 14360 - protein, 81 aa, Ailuropoda melanoleuca
LQGSVSLKDVTVGLTQEEWQHLDPAQKALYRDVMLGNYCHLISVGFHMTKPDMIRKLEQGEELWTTEFFQVRATLKKMEKL

SEQ ID NO: 14361 - protein, 81 aa, Ailuropoda melanoleuca
DSVVFEDVAVDFTQEEWALLDLAQRSLYRDVMLENFQNLASLVTGYPLHTPYLISQWKQEEDLETVERGPIQGEHQEGFEI

SEQ ID NO: 14362 - protein, 81 aa, Ailuropoda melanoleuca
NQITVTFNDVAVDFIQEEWILLDLTQRSLYRHVMLENYQNLVAVGYQLPKPKLITWLEQQELRTVEKRVFQGELETSLVNE

SEQ ID NO: 14363 - protein, 81 aa, Lynx canadensis
LQGWLTFRDVAIEFSQEEWECLDPAQRALYRDVMLENYRNLVSLEIFLELNIISIISFQGKDPWTVESEVNIGEHPDRWEC

SEQ ID NO: 14364 - protein, 81 aa, Lynx canadensis
MLENYGHLLLLGLVSKPDLVNFLEQKKEAWDVNGKGTVATHPAVSSHGTLSFLPKSCIEASFQNKSMGRCKHSTLENLHLM

SEQ ID NO: 14365 - protein, 81 aa, Lynx canadensis
SLESDLFRDVAVVFSQEEWERLAPAQRDLYRDVMLETYSNLVSLGLAISKPDVISFLEQGKEPWLVEKAAAGGLCPELDSR

SEQ ID NO: 14366 - protein, 81 aa, Lynx canadensis
PLTFKDVAVVFTEEELRLLDPTQRKLYRDVMLENFQNLLSLGDKNEKDLEYIQERELKCLSCRELSYWKIGEQAAGELTGR

SEQ ID NO: 14367 - protein, 81 aa, Lynx canadensis
MAFEDVAVYFSQEEWELLDAAQRALYCHVMLENFALVSSLGLSASRPRVVLQLERGEEPWVLSGTVVTPARNAQRKPSPGE

SEQ ID NO: 14368 - protein, 81 aa, Lynx canadensis
FQAKVTFEDVAVLLSQEEWDRLGPAQRGLYRHVMMETYGNVVSLGLPGSKPNVICQLERGEEPWVLDGQGAEETGGLGIGH

SEQ ID NO: 14369 - protein, 81 aa, Lynx canadensis
TQVLVTFKDVAVTFTQEEWGQLELDQRALYQEVMLETCGLLVSLGHEVPEAELTHLLEHGRELWTGKGGLLWSTCPGDSTR

SEQ ID NO: 14370 - protein, 81 aa, Lynx canadensis
FQGRLTFRDVAIDFSQEEWECLDPAQRALYKDVMLENYRNLVSVGEDNLPPEVGNYFLSVCCAFSIESPCFDHKSSNSLFF

SEQ ID NO: 14371 - protein, 81 aa, Lynx canadensis
KFQEAVTFKDVAVVFTEEELGLLDPTQRKLYREVMLENFRNLVSVGHSSSKPDVISQLEREEKLCMKEIHTQRGRHSGFLW

SEQ ID NO: 14372 - protein, 81 aa, Phyllostomus discolor
SQMPVTFEDVALYLSREEWGRLDHPQQSFYRDVLQKRNGLALGMADVRKEEPTSSPAVPGDGKSFKARAGRAQEDVLQCGR

SEQ ID NO: 14373 - protein, 81 aa, Phyllostomus discolor
VQEPVTFKDVAVDFTQEEWGQLDPVQRMLYRDVMLETFGHLLSVGNQIAKPKVISVLEQGGEPWLVEQTYSQGTGTEMVRY

SEQ ID NO: 14374 - protein, 81 aa, Phyllostomus discolor
MASPSPSLEPKEWDYLDPAQRSLYKDVMMENYGNLVSLDVLNRDKDEEPTVKQEIEEIEEEVESKGIIVTRIKSETDQDPM

SEQ ID NO: 14375 - protein, 81 aa, Phyllostomus discolor
DMNFADVAIAFSQEEWGLLDEAQRLLHCDVMLEIFALVASVGCWHKMEDEEAPAEHIVSIEGESQVRVSTTTPIMQKTHLC

SEQ ID NO: 14376 - protein, 81 aa, Phyllostomus discolor
LQESLTFHDVAVDFTLEEWQLLDPNQKDLYRDVMLENYSNLVSVGYQASKPDTLSRLERGEEPRAVQDEMHHVVCPELRRV

SEQ ID NO: 14377 - protein, 81 aa, Phyllostomus discolor
KALGPVAFRDVIVDFTQEEWQQLKPAQKDLYRDVMMEIYWNLVSLDLETRPDMRELDPQEDIWKERPTLVVEAERPIRNGA

SEQ ID NO: 14378 - protein, 81 aa, Phyllostomus discolor
KMTKFQAAVTFMDVAVVFTEEELGLLDLSQRKLYRDVMLENFRNLVSLSMATQLEAEEKLWMMERETQRNGASGSKNQNEV

SEQ ID NO: 14379 - protein, 81 aa, Myotis lucifugus
SQAPVTFEDMAMYLTREEWRPLDPTQRDLYRDVMQENYGNVVSLDFEIRSENEVNPKQEISEDVELGTASERPVGNAEENP

SEQ ID NO: 14380 - protein, 81 aa, Sapajus apella
FQEPVTFEDVAVYFTQNEWTSLQPSQRALFREVMLENYATVTSLSFPFPKPDLIFRLEQGEAAWGPDPWTLAGEEALRGLC

SEQ ID NO: 14381 - protein, 81 aa, Sapajus apella
MESVTFEDVAVEFIQEWALLDSARRNLCRYGMLDKCRSLASRAWESQLKPKELPSMRDILEEASSRDVQMGPGLFLRMQLV

SEQ ID NO: 14382 - protein, 81 aa, Sapajus apella
EMGPLTFRDVAIEFSLEEWQCLNTDQQDLYRKVMLENYRNLVFLGIAVSKADLITCLQEEKDPWNMKRHSMVAKPPVIYSH

SEQ ID NO: 14383 - protein, 81 aa, Sapajus apella
MLQNYRNLVFLGLAVTKPDLITHLEQEKELWNVERQETVAKYPEILPKQNIKDSSKNVTPRKYKSCDLDNLCLKKAWQDEN

SEQ ID NO: 14384 - protein, 81 aa, Oryctolagus cuniculus
LQEPVTFRDVAVDFTQEEWGQLDPTQRTLYRDVMLETFGHLLSVGPELPKPEVISQLEQGAELWVAERGITQSCHPGWEPR

SEQ ID NO: 14385 - protein, 81 aa, Oryctolagus cuniculus
MLTFEDLAVYFTWEEWQNMNKAQKILYRDVMLETYSSLLSLGNCITKPDLIFKLEQEAEPWMVNECLNQSLPVAMKSDDII

SEQ ID NO: 14386 - protein, 81 aa, Pteropus alecto
FQEAVTFGDVAVHFSREEWQCLDPGQRALYKEVMLENHSSVAGLAGFLVFKPELISRLEQGQEPWVLDLQGAERREAPRTP

SEQ ID NO: 14387 - protein, 81 aa, Pteropus alecto
EGVNFKIVTVDFTREEERTLKHVQRTLDRGVILENHKDLVSWDSATAFERRESTSKQSIFDDEPPCGVKTERLTRDDPWLS

SEQ ID NO: 14388 - protein, 81 aa, Desmodus rotundus
LQVSVSFEDVTVDFSREEWQHLDPAQRRLYWDVTLENYSHLLSVGYQVPKPEVILKLEQGEGPWTLEGETPHQSCSDEDIG

SEQ ID NO: 14389 - protein, 81 aa, Desmodus rotundus
SQELVTFEDVAVYFIRKEWKRLEPAQRNLYRDVMLENYGNVFSLDGETRPEHDPEISEDTGSHGVLLGRFQKDISQGLKFE

SEQ ID NO: 14390 - protein, 81 aa, Desmodus rotundus
VVTFKDVAVIFTEEELGLLEPSQRMLYRDVTLENLRNLVSVGHWNQKEIESLQEVASWYLLHEDLACWHIWDQLLRKLTRN

SEQ ID NO: 14391 - protein, 81 aa, Desmodus rotundus
DSVTFEDVAVDFTLEEWALLDPSQKKLYRNVMRETYRNLASIGLHLGEKWEDHNIENQYKTQGRKLRDHMVEKLYESKEGS

SEQ ID NO: 14392 - protein, 81 aa, Desmodus rotundus
DLVTFTDVAIVFSQDEWEWLNLAQRKLYKKVMLENYKNLVSVGLCLSKPDMISLLEQGKEPWVMNGEMTGGLCPDLKYMWM

SEQ ID NO: 14393 - protein, 81 aa, Macaca fascicularis
FQEMVTFKDVAVVFTEEELGLLDSVQRKLYRDVMLENFRNLLLVAHQPFKPDLISQLEREEKLLMVEMETPKDGCSGRKNQ

SEQ ID NO: 14394 - protein, 81 aa, Macaca fascicularis
MGPLQFRDVAIEFSLEEWHCLDTAQRNLYRNVMLENYRNLVFLGIVVSKPDLITCLEQGEKPLTMKKHEMVANPSETGFHH

SEQ ID NO: 14395 - protein, 81 aa, Macaca fascicularis
QQGYVTFEDVAVYFSQEEWRLLDETQRLLYRNVMLENFSLLASLGLASSKTHEITQLESWEEPFMPAWEVMTSALPKGCWH

SEQ ID NO: 14396 - protein, 81 aa, Macaca fascicularis
MTFEDVSVEFTQGEWGQLNPAQKDLYREVMLENFRNLAFLGLPVSKPYVICQLEEGGEPFIVEREVSTGAYSDWERRSKSK

SEQ ID NO: 14397 - protein, 81 aa, Macaca fascicularis
YDSVAFEDVAVNFTREEWALLGPSQKTLYRDVMWETIRNLNCIGMKWEDTDVEDQHKNPRRSLRCLIVERFSESNQIPGST

SEQ ID NO: 14398 - protein, 81 aa, Macaca fascicularis
IYFSQEEWELLEYTQKALYNDVMQENYETVISLALFVLPKPKVISCLEQGEEPWVQVSPEFKDSAGKSPTGLKLKNDTENH

SEQ ID NO: 14399 - protein, 81 aa, Macaca fascicularis
MELLTFRDVTIEFSLEEWEFLKPAQQNLYRKVMLENYRNLVSLGLTVSKPELISCLEQRQEPWNVKRHETIAKPSAVSSHC

SEQ ID NO: 14400 - protein, 81 aa, Macaca fascicularis
LVTKESMTFKDVAVDITQEDWELMRPVQKELYKTVTLQNYWNMVSLGLTVYRPTVIPMLEEPWMVIKEILEGPSPEWETKV

SEQ ID NO: 14401 - protein, 81 aa, Phascolarctos cinereus
PQASVTFEDVAVYLTQEEWGHLEPAQRGLYRDVMLENYGNVVSLGFPVSKPDVILQLELRGEPWFLDMQGTEGREILRDCE

SEQ ID NO: 14402 - protein, 81 aa, Macaca fascicularis
AQGLVTFADVAIDFSQEEWACLNSAQRDLYWDVMLENYSNLVSLDLESAYENKSLPTGKSIHEIRASKRNSDRRSKSLGRN

SEQ ID NO: 14403 - protein, 81 aa, Phascolarctos cinereus
QQGSVTFRDVAVDFTLEEWGHLDPFQKELYRDVMLENFRNLVCLGLTVSKPDVIHQLEQGEAPWIPEGESPRNSFAGCASD

SEQ ID NO: 14404 - protein, 81 aa, Phascolarctos cinereus
GHLPQELVTYKDVAVDFTQEQWSFLDHPQELYKEVMLENAQNLLSLGQPVAREDLIYYFEEREAPWMLEVEGRRSCCRGAH

SEQ ID NO: 14405 - protein, 81 aa, Phascolarctos cinereus
WQESLTFKDVAVDFTQEEWSLLDHSQKELYKEVMLENSQNLLSLGIPLLREDFISHFEEREPSWILDQKGPRNCCPGAETK

SEQ ID NO: 14406 - protein, 81 aa, Phascolarctos cinereus
QESSVTFEDVAVYFTWEEWRQLDLAQRALYREVMLENYGNAASLGFMGPKPYLISQLERGQMLWTLDLQGTETIEARRGTW

SEQ ID NO: 14407 - protein, 81 aa, Phascolarctos cinereus
CQEPVTFRDVVVDFTPEEWGRLGPSQRQLYQDVMLETYRNLVSLAGIPVPDCDTLCHLEQVDMLRVGEEADGKPGPEASRP

SEQ ID NO: 14408 - protein, 81 aa, Phascolarctos cinereus
DQEVVSFRDVAVDFTEEERGCLSPAQWQLYKEVMLENYRNLVSLGLIEDKPDLVSWLEQEEEPWALDLQGEGPRSPCPWGG

SEQ ID NO: 14409 - protein, 81 aa, Phascolarctos cinereus
NKESLTFKDVAVDFTQEEWGQLDPAQRNLYREVMLENYRNLVFLGYPFSKPNMISQLEQGEEPWILEKEISRCIYAGGLFS

SEQ ID NO: 14410 - protein, 81 aa, Phascolarctos cinereus
RQGSLTFQDVAVDFTWEEWGQLGPTQKELYREVMLENYGNLVCVGLAGSKPDVICRLEQGEAPWRPGEGFSGSGRPDWETR

SEQ ID NO: 14411 - protein, 81 aa, Myotis lucifugus
ETGDVNFEDVAIAFSEVEWVILDDAQRLLYYDVMLEVFALVSSVGCWHKMEDEEASSDQQVCRQGKLQVRTSKTAQDTHKN

SEQ ID NO: 14412 - protein, 81 aa, Myotis lucifugus
VKFADVAVYFSPEEWGCLRPAQRALYRDVMRENYGHLGALGCAGPKPALISWLERNTEDWEPAALDPQDCPRGLMVQRKWP

SEQ ID NO: 14413 - protein, 81 aa, Myotis lucifugus
MNFKDVAIAFSQEEWGLLDEAQRLLYYEVMLEVFALVSSLGCWHKMEDEEACSIQSVSIQGESQVRASKTAPATQKIPLCK

SEQ ID NO: 14414 - protein, 81 aa, Myotis lucifugus
VNFEDVAIAFSQEEWGLLDEPQRLLYCDVMLEVFALISSVDVAFSLLQQTMGSEKNMQGEPWFFHRVNMQDGLRRGLALLS

SEQ ID NO: 14415 - protein, 81 aa, Myotis lucifugus
SQGLVTIKDVSLCFSQEEWRSLDPSQTDFYGEYVMQENCGIVVSLRFPIPKLDMLSQVEGGEEQWVPDPQDLEERDILRVT

SEQ ID NO: 14416 - protein, 81 aa, Myotis lucifugus
FGDVAIDFSQEEWEWLNLAQRNLYRKVMLENYRNLESLGVSVSKPEVISLLEQGREPWMATKARTEGTCSDWEYAFKNSEF

SEQ ID NO: 14417 - protein, 81 aa, Puma concolor
APGCVTFEDVAVRFSWEEWGLLDEAQRLLYRDVMLENFALMASLGLASSRTHEITQLEWWRQPSLPPRGVMTAAMPRGLRR

SEQ ID NO: 14418 - protein, 81 aa, Myotis lucifugus
PPPGRPQEPVTFRDVAVDFSPEEWGHLGPEQRTLYRDVMLETFGHLLSVGPELPKPEVISQLERGAELWVVERGLAQGCCP

SEQ ID NO: 14419 - protein, 81 aa, Puma concolor
MLENYGHLLFLGLVVSKPDLVIFLEQKKDVWDVKRKETVATHPEKPYQCKECGHVFNQFSTLTGHQRIHTGEKTYQEKEGG

SEQ ID NO: 14420 - protein, 81 aa, Puma concolor
WSQDSVTFEEVAVDFSQEEWALLDPTQKILYRDVMLENYRNLASVGYPLCKHSLITEVGQEALSTEKRGMLQGACVGLDIQ

SEQ ID NO: 14421 - protein, 81 aa, Puma concolor
VGDQDFTASVLQAAPQEPWRHLESVQKEHYWDLMLETYGKMVSGGISSSKPDPTGPTEYGEEPAGRHPHLSEKIPRPTCLG

SEQ ID NO: 14422 - protein, 81 aa, Puma concolor
LFQGSLALEDVAVNFTQDEWQLLDSAQKNLYRNVMLENVSSLVSLGFQLIKPDVIFKLEREQPWIIGEEVPSQSLSEYWKV

SEQ ID NO: 14423 - protein, 81 aa, Sapajus apella
LQEAVVFEDVAVYFTRIEWSCLAPDQQVLYRDVMLENYRNLASLGFLVAKPALISLLEQGEEPGALILQVAEQRGAKTSLC

SEQ ID NO: 14424 - protein, 81 aa, Sapajus apella
MELLTFRDVTIEFSLEEWEFLKPAQQNLYRNVMLENYRNLVSLGLTVSKPELISCLEQRQEPWSVKRPETVAKPPAMSCHY

SEQ ID NO: 14425 - protein, 81 aa, Sapajus apella
QEQVSFKDVCVDFTQEEWYLLDPAQKMLYRDVILENYSNLVSVERKWKVDDVLKGSQENEDDHFWELLFHNNKTVSAESGD

SEQ ID NO: 14426 - protein, 81 aa, Sapajus apella
QLQETMTFKDVEVTFSQDEWGLLDSAQRNLYRDVMLENYRNMAFLVGPFTKPALISWLEAREPWGLNVQVAQPKGNPGAAP

SEQ ID NO: 14427 - protein, 81 aa, Sapajus apella
MLENYSNLVSVAGYQLSKPVVISQLEKGEEPWMTEKEGPGDPSSDLKSNTETTESTAKSTISQEQLYHGIMMERFMRDDII

SEQ ID NO: 14428 - protein, 81 aa, Sapajus apella
WEESLTLEDVAVDFTWEEWRLLGPTQKDLYRDVMLENYSNLVAVGYQASKPDALLKLERGEEPCCTTEDEIYTQICSEIRK

SEQ ID NO: 14429 - protein, 81 aa, Sapajus apella
KESVSFKDVAVDFTQEEWGQLDSPQRALYRDVMLENYQNLLALGAGPPLHKPDVISHLERGEEPWCVQRDIPGGPCPEWEM

SEQ ID NO: 14430 - protein, 81 aa, Sapajus apella
DMGPLTFMDVAIEFSLEEWQCLDTAQQNLYRNVMLENYRNFVFLGIAVSNLDLITCLEQGKEPWNMKRHEMVAKSPVICSD

SEQ ID NO: 14431 - protein, 81 aa, Sapajus apella
SQGLVSFKDVAVDFTQEEWQQLDPAQRTLYRDVMLENYSHLVSMGYPVSKPDVISKLEQGEEPWIVKRDISNWIYPDEYQA

SEQ ID NO: 14432 - protein, 81 aa, Sapajus apella
FQEAVTFKDVAVAFTEEELGLLDSSQRKLYRDVMLENFRNLVSVGRQSFKPDMISQLEREEKLWMKEFQNQRGRHSGDRNQ

SEQ ID NO: 14433 - protein, 81 aa, Sapajus apella
PQGHLTFKDVAIEFSLEEWKCLTPSQRALYRDVMLENYSNLESVDISSKCMMKTFSLTAQGNTEMFHTRTLETHENHHIAD

SEQ ID NO: 14434 - protein, 81 aa, Sapajus apella
SVAFEDVAVTFTQEEWALLDPSQKTLYRDVMQENFRNLASVGKKWKAQNIYVEYKNLRRNLRNLMGKRLFESKKDHQHGEI

SEQ ID NO: 14435 - protein, 81 aa, Sapajus apella
ILALLGLLTFRDVAIEFSLEEWQCLDTAQQNLYRNVMLENYRNLAFLGIAASKPDLITCLEKAKEPWKVKRHAMVDEPPGR

SEQ ID NO: 14436 - protein, 81 aa, Sapajus apella
LSFEDVAMYFTREEWGHLDWGQKDLYRDVMLENYRNMVLLGSEARHKMKKLTPRQKFSEDLESYKISVVMQESAKKLSEKL

SEQ ID NO: 14437 - protein, 81 aa, Sapajus apella
MLENYCHFISVGFHMTKPDMIRKLEQGEELWTQRIFPSYSYLEEDGKTEDVLVKFKEYQDRHSRSLILINHKKLIKERSNI

SEQ ID NO: 14438 - protein, 81 aa, Sapajus apella
SQEPVTFEDVAVDFTQEEWQQLNPAQKTLHRDVMLETYSRLVSVGCSGIKPDVIFKVEHGMDPWIKDSELSRWVYPDREKG

SEQ ID NO: 14439 - protein, 81 aa, Oryctolagus cuniculus
STVMIAFEDLAVYFSWEEWQNMNNAQKILYRDVMLETYSSLFSLGHCITKPDLIFKLEQGAEPWMVDECLNQSLSVGMKRD

SEQ ID NO: 14440 - protein, 81 aa, Oryctolagus cuniculus
IAFEDLAVYFSWEEWQKMNNAQKTLYRDVMLETYSSLFSLGDGPNQLQGGEKFDNTKIPGKSLQFCEPLRQHDNIHIMKQP

SEQ ID NO: 14441 - protein, 81 aa, Oryctolagus cuniculus
LSQVMTTFEDLAVYFTWEEWQNMNKAQKILYKDVMLETYSSLFSLVSIKGDDLTRINQESQDKNLNQNVMKNKKISIPKRA

SEQ ID NO: 14442 - protein, 81 aa, Oryctolagus cuniculus
SPTMIAFEDLAVYFSWEEWKNMNKAQKILYRDVMLETYSSLLSLGHYITKPDLIFKLEQGAEPWMVEECLYQSLPVAMKND

SEQ ID NO: 14443 - protein, 81 aa, Phyllostomus discolor
GSVAFRDVIVDFTQEEWQQLKPAQKDLYRDVMMETYWNLVSLDLETEGDMNEPDPEKDSWEDRTSIVVAEELMRNGAQDYA

SEQ ID NO: 14444 - protein, 81 aa, Macaca fascicularis
FQGSVTFEDVAIAFSQQEWESLDSSQRGLYRDVMLENYRNLVSMAGHSLSKPHVIALLERWKEPKVTERKDGRRWCTDLQL

SEQ ID NO: 14445 - protein, 81 aa, Macaca fascicularis
LTLEDVAKDLYQDVMVENYNHLVSLGYQTSKQDALSRLAHGQEPWITDAKIQNKNCPGIRKVDSHLQDMQQCSGQNAFRNI

SEQ ID NO: 14446 - protein, 81 aa, Macaca fascicularis
LQELLTLEDVTVEFTWEEWQLLDPFQKGLYRDVMLEIYSNLVSMGYQVSKPDALSRLERGEEPWTMEDERHSQICPENNKV

SEQ ID NO: 14447 - protein, 81 aa, Macaca fascicularis
MLENYGAVASLAFPFPKPALISQLERGEAPWCSVPWGALDGEDPRSISSGYPFLKPAGISHLEQVEEPLNLKLQEEGPSLI

SEQ ID NO: 14448 - protein, 81 aa, Macaca fascicularis
MFKEAVTFKDVAVVFTEEELGLLDPAQKKLYRDVMLENFRNLLSVGHQLSYQDTFHFQREEKFWIMETATQKEGNSGGKIQ

SEQ ID NO: 14449 - protein, 81 aa, Macaca fascicularis
TKGCVTFEDIAIYFSQEEWGLLDEAQRRLYLEVMLENFALVASLGCGHGTEDEETPSEQNVSVRVSQSKAGSSTQKTQSCE

SEQ ID NO: 14450 - protein, 81 aa, Macaca fascicularis
FQGSISFKDVTVGFTQEEWQHLDPSQRALYRDVMLENYSNLVSVGYCVHKPEVISRLEQGEEPWRLEEEFPSQSFPVWTAD

SEQ ID NO: 14451 - protein, 81 aa, Phascolarctos cinereus
PQESVTFRDVAVDFTWEEWGQLDPSQKELYREVMLENYGNLACLGLAVSKPDVILQLERGEIPWMSERKVPEGICPDWEAR

SEQ ID NO: 14452 - protein, 81 aa, Phascolarctos cinereus
LRESVTFKDVAVDFTGEEWRRLDPAQRALYRDVMLENYENLVSLGLPVSKLDVISLLERGEAPWWLEGGGLQSPCSDALSQ

SEQ ID NO: 14453 - protein, 81 aa, Puma concolor
APLPLTFEDVAIYFSEQEWQNLEAWQKELYKHVMRTNYEILVSLDDGLPKPELISRIEQGKEFFKNWGESQKSGNIICSSA

SEQ ID NO: 14454 - protein, 81 aa, Puma concolor
MRENYGHLVSVGYCVNKPNAVFKLKQGKEPWILEVEFPRRNYPEDLWKIHDLGARSQGSQAENSRNGELTKHQQTPAREKI

SEQ ID NO: 14455 - protein, 81 aa, Puma concolor
QQGCVTFEDVAIDFSQEEWGLLDEAQRRLYHDAMLENLALTASLVCWHGMEDEGTPFEQSVSIEVLSQVRIPKAGASIQKT

SEQ ID NO: 14456 - protein, 81 aa, Puma concolor
SRSLVTFGDVAVDFSQEEWEWLNSAQRNLYRSVMLENYRNLASLGLCVSKPDMISSLEQRKEPWMVKRRLTRGRGPDLEAG

SEQ ID NO: 14457 - protein, 81 aa, Puma concolor
RMDSVTFEDVAVNFTLEEWALLDSSQKKLYRDVMRETFRNVASVEKKWKDHDTEYRCKTQGRKTGSPTVGKPCESKEGLQC

SEQ ID NO: 14458 - protein, 81 aa, Puma concolor
QAEVTFEDVAVLFSREEWGRLGPTQRGLYRDVMLETYRNLVSLGAGRAGPKPGVITQLERGDEPWVLDAQGAKGKGRPRVS

SEQ ID NO: 14459 - protein, 81 aa, Sapajus apella
MCVFQRPLTFMDVAIEFSPEEWQCLDTTQQNLYRNVMLENYRNMVFLGIAVSKPDLITCLEQGKEPWNMKRQEMVAKPPGR

SEQ ID NO: 14460 - protein, 81 aa, Sapajus apella
VCNVGGSVPEIPGPWVCIGTLSSGAGKTRLRLHSSLHSPRVTENEHISGYCFTKPELIFTLEQGEDPWLLEKEKGFLSRTS

SEQ ID NO: 14461 - protein, 81 aa, Sapajus apella
LLDPVAFEDVAVNFTQEEWALLDISQKNLYREVMLETFRNLTSIGKKWKDKSIEDECQNPGRNLRSLIEEKVNEIKEDSHC

SEQ ID NO: 14462 - protein, 81 aa, Sapajus apella
MYKQEMKTNYETLDSLGYAFSKPDLITWMEQGRMLLISDQGLLHRTKRTTGPPTDEQLDMKNTEKLPCFDDRGTLGTKEDC

SEQ ID NO: 14463 - protein, 81 aa, Sapajus apella
TQESLTLEDVAVEFSWEEWQLLDTAQKDLYRDVMVENYNHLVSLGYQTSKPDVLSKLAHGQEPWITDAKIQNKNCPGIRKV

SEQ ID NO: 14464 - protein, 81 aa, Pteropus alecto
GGWVPALFDEVAIYFSDEEWDVLTEPQRALYREVMRMNYDTVLSLVGLRLPRDIAELPEWSEGYPFYMAMGFPGYDLAADD

SEQ ID NO: 14465 - protein, 81 aa, Oryctolagus cuniculus
SPESVAFEDVAVYFTKKEWASLLPAQRALYKEVMLENYGMVASLAPPPISKPALISQLEQGKEPWFTRPQGALNRRARRVV

SEQ ID NO: 14466 - protein, 81 aa, Oryctolagus cuniculus
DHGLVMFRDVAVDVSQEEWECLNPAQRNLYKDVMLENYRNLVSLGLSISKPAVISSLEQGKEPWMGVRDVTGRQCPDLASR

SEQ ID NO: 14467 - protein, 81 aa, Oryctolagus cuniculus
NPVMTAFEDLAVYFTWEEWQKMNNAQKILYRDVMLETYSNLSSLGHCITKPDLIFKLERGEEPWMVDECLNQSLSVVMKRD

SEQ ID NO: 14468 - protein, 81 aa, Oryctolagus cuniculus
SPVMTAFEDLAVYFTWEEWQKMNNAQKILYRDVMLETYSSLFSLGHCITKPDLIFKLEQGEEPWMVDECLNQSLSVVMKRD

SEQ ID NO: 14469 - protein, 81 aa, Oryctolagus cuniculus
LQVLVSFEDLAVDFTQEEWQDLDNAQKTLYKDVMLETYSSLLSLGHCIIKPDLIYKLEQGAEPWIVEKPLNQSLPGKSTHI

SEQ ID NO: 14470 - protein, 81 aa, Pteropus alecto
GCVTFEDVAIFFSQEEWCLLDEAQRCLYHHVMLENLALMASLVCWRATENEETPSEQSVSIEALSQVRTPKAGPSTQKTHP

SEQ ID NO: 14471 - protein, 81 aa, Pteropus alecto
TTELVTFQDVVVDFSPEELASLSAAQRNLYREVMLENYRNLVSLGYQFSKPDVISQLEEEESRVIEEDSDKKMCQDWEKRT

SEQ ID NO: 14472 - protein, 81 aa, Oryctolagus cuniculus
MIGFEDLAVYFTWKEWQNMNNAQKILYRDVMLETYSILFSLGHCMTKPDLILKLEHGAEPWMVEECLHQSLPVAVKRDDLI

SEQ ID NO: 14473 - protein, 81 aa, Pteropus alecto
MLENYSHLLSVGYEIPKPEVIFKLEQGEEPWVLERETPHQSCSDGKFGIKISQKRSSRKASFYSEMEGEDTRDGPLYSILE

SEQ ID NO: 14474 - protein, 81 aa, Oryctolagus cuniculus
MTFDDVALYFSEQEWEILQKWQKEMYQQVMKANYETLDSLDGGLPKPELITWIEQQGEFGSCTESQKPRNIICSSADTHFD

SEQ ID NO: 14475 - protein, 81 aa, Oryctolagus cuniculus
SQGLVTFEDVAVYFSLEEWARLDASQRGLYQEVMQENYGILVSLGAWFWADDMEDHEEEDDEDFLAEVAEEENEPPGLWSA

SEQ ID NO: 14476 - protein, 81 aa, Oryctolagus cuniculus
VMIAFEDLAVYFSWEEWQKMNNAQKILYRDVMLETYSSLFSLGEIHMEETCNTSTVTRPHTGKKPYACKPCEKSFDSKCCH

SEQ ID NO: 14477 - protein, 81 aa, Oryctolagus cuniculus
AGYQVSKPEVIFKLEQGEEPWISEGEIQRRFCADWKTRSEAKSSNLHQGIAEVSRSTDGLSSATLEDTCDISSQLERHQEN

SEQ ID NO: 14478 - protein, 81 aa, Oryctolagus cuniculus
MVLMSFEDLAVDFTWEEWKFLTNAQKTLYRNVMLETYSNLLFLIAPNDDLIGNNQESQDIKLNQNVITNNSTSTPKRIKLR

SEQ ID NO: 14479 - protein, 81 aa, Rhinolophus ferrumequinum
KPRGLKFADVAVYFSPEEWGCLRPAQRALYRDVMRETYGHLGALGFRGTKPALISWVEEEAELWGPDARDPEMGECLTEAD

SEQ ID NO: 14480 - protein, 81 aa, Rhinolophus ferrumequinum
QNHCQRNLVSYCHRRSIYLLTHLCCEEEDRGCSISKPHVITLIEQGKDPWMVVRDEKKRWSLDLESRYDIKKLSQKDIYEM

SEQ ID NO: 14481 - protein, 81 aa, Phyllostomus discolor
DENVVTFQDLYICFTPEEWLLLDEGQRRLYCSVALETFLTAASVGLLICRPPMITQPGPVRQPNVPHRVDVSLVRTNMIQG

SEQ ID NO: 14482 - protein, 81 aa, Phyllostomus discolor
SRKPVSFADVAVYFSPEEWGCLRPVQRALYRDVMRETYGHLGALGFQDTKPALISWMEEEAELWGSDARDPELGECLSEDT

SEQ ID NO: 14483 - protein, 81 aa, Macaca fascicularis
KPRTVSFADVAVYFSREEWGCLRPAQRALYRDVMRETYGHLGALGFPGPKPALISWMEQETEAWSPAAQDPEKGERLGGAR

SEQ ID NO: 14484 - protein, 81 aa, Macaca fascicularis
TEECMVFEDVAIYFSREEWGILNDAQRHLHSNVMLENFALLSSVGCWHGAKDEEVLSKQCVSVRVLQVTAPKPALPTLKAQ

SEQ ID NO: 14485 - protein, 81 aa, Macaca fascicularis
QVTFSDVAIDFSHEEDLYKDVMVQNYKNLVSVTGLSVTKPYVITLLEDGREPWMVEKKLFIFFTYCFIYYVYFTHFCYHSF

SEQ ID NO: 14486 - protein, 81 aa, Macaca fascicularis
AQESLTLRDVAVDFTWEEWQLLGPAQKHLYRDVMLENYSNLVSVGFQASKPDALTKLEQGEPLWALEDEIHSPTHPEIEKA

SEQ ID NO: 14487 - protein, 81 aa, Macaca fascicularis
ADVSLAFRDVSIDLSQEEWECLNPAQRDLYKDVMLENYSNLVSLGYTIPKPDVITLLEQQKEPWIVMREGTRSWYTDLEYK

SEQ ID NO: 14488 - protein, 81 aa, Macaca fascicularis
TARSQETVTFKDVAMDFTPEEWGKLDPAQRDVMLENYRNLVSLWLPVSKPENYNLENGKEPLKLERKTPKSSYSDVETRPQ

SEQ ID NO: 14489 - protein, 81 aa, Macaca fascicularis
ASVALGDVAVNFTREEWALLGPCQKNLYKDVMQETIRNLDCVGMKWKDQFLFKDQIEEQYKYPRKNLRCRMLERFGESKDG

SEQ ID NO: 14490 - protein, 81 aa, Macaca fascicularis
YQDSVTFDDVAVEFTPEEWVLLDTTQKYLYRDVMLENYMNLASVEWEIQPRTKRSSLQQGFLKNQIFTGIQMTRGYSGWKL

SEQ ID NO: 14491 - protein, 81 aa, Macaca fascicularis
MLENYSHLVSVGYLVAKPDVIFRLGPGEESWMADGGTPVRTCAEVWQVDEQIDCYKESQDKLLWQAAFIGKETLKDESGQE

SEQ ID NO: 14492 - protein, 81 aa, Macaca fascicularis
EMGPLTFRDVAIEFSLEEWQCLDTAQQDLYRKVMLENYRNLVLAGIDVSKPNLITCLEQGKYPWNMKRHSMVVKPPGFLLP

SEQ ID NO: 14493 - protein, 81 aa, Phascolarctos cinereus
SQELVTFQDVAVDFTQEEWGHLEPAQKDLYREVMLENYQNFVSLGLAVSKPEVISQLERGKALWLPDGGVPRCTFLTSFAQ

SEQ ID NO: 14494 - protein, 81 aa, Phascolarctos cinereus
NFWILRLPPGSKGEVPKEWGKLEEWQKELYKHVMRGNYEMLVSLDYAVSKPDILSQIERGEKPCLKDQWGSDEEVSCPGKL

SEQ ID NO: 14495 - protein, 81 aa, Phascolarctos cinereus
FQKLLTFKDVAVEFTQEEWGQLNSSQKNLFRDVMLENYKNFVYLGLPVSMPAVILLLERGEVPRMSEGEVPRGIHSDSVSQ

SEQ ID NO: 14496 - protein, 81 aa, Phascolarctos cinereus
LKQSVTFKDVAVDFTREEWRRLGPAQRDLYRDVMLENYNNFASLGLPFFKPDMISQLERGEGPWTPEAEVPQVTCPESLVQ

SEQ ID NO: 14497 - protein, 81 aa, Phascolarctos cinereus
IQASVTFRDVAVDFTWEEWRRLDPAQRALYRDVILENYENLISLGIPVSKLDVISLLVRGEAPWMPSGEGQRVFCADSISG

SEQ ID NO: 14498 - protein, 81 aa, Phascolarctos cinereus
CKESVTFKDVAVEFTWEEWVHLNSSQKTLYRDVMLENYRNLVSLGFAVSKPDVIYQLERKEASWIPGADIPRSSCPESKEF

SEQ ID NO: 14499 - protein, 81 aa, Myotis lucifugus
FQGSVTFRDVAIDFSQEEWAWLQPAQRDLYRHVMLENYGHLVSLGLNISKPDVVSLLEQGKEPWLGKGDVRTDFFPVSESN

SEQ ID NO: 14500 - protein, 81 aa, Myotis lucifugus
QNMNFEDVAIVFSEEEWGLLDEAQRLLYCNVMLEVFALVSSTGCCHKTDDEETCSEQSVSVQGESQVRTSKTEPATQRTHL

SEQ ID NO: 14501 - protein, 81 aa, Myotis lucifugus
QTGDVNFEDVAIAFSEVEWVILDDAQRLLYYDVMLEVFALVSSVGCWHKMEDEEASFDQQVCIQGKLQVRTSKTAPVTQKN

SEQ ID NO: 14502 - protein, 81 aa, Myotis lucifugus
RVQNMNFEDVAIVFSEEEWGLLDEAQRLLYCNVMLEVFTHFSSAGCWHNTDDEETCSELSMCVQGESQVRASQTEPATQRT

SEQ ID NO: 14503 - protein, 81 aa, Puma concolor
FREPVTFEDVTLGFTSDEWGLLDLEKKSLYREVMLENYRNLVSVEHQLSKPDVVSQLEEEEALWSVERGIPQDTFSECPAA

SEQ ID NO: 14504 - protein, 81 aa, Sapajus apella
VQVSLTFEDVAVLFTRDEWRKLAPSQRNLYRDVMLENYRNLVSLGLPFTKPKVISLLQQGEDPWKVEKDCSGSSSLGCKSN

SEQ ID NO: 14505 - protein, 81 aa, Sapajus apella
SQELLTFKDISIDFTQEEWGQLTPAHQNLYREVMLENYSNLVSVGYQLSKPVVISQLEKGEEPWMTEKEGPGDPSSDLKSN

SEQ ID NO: 14506 - protein, 81 aa, Sapajus apella
SQDLVTFKDVAIDFSQEEWQWMNPAQKRLYRSMMLENYQSLVSLGLCVSKPYVISLLEQGREPWEMTSEMTRSPFSDWESI

SEQ ID NO: 14507 - protein, 81 aa, Sapajus apella
GTVTFEDVAVKFSQEEWSLLSEAQRCLYHDVMLENLALISSLGCWYGAKDETPSKQTLSIQQQSPLRSHWTGVCTKKAHPW

SEQ ID NO: 14508 - protein, 81 aa, Sapajus apella
SQELVTFKDVVVHFSLEELSSLSAAQRNLYREVTLENYRNLVSLGYHFSKPDIISRLEKEESRAVETDSNAVICQGESHDD

SEQ ID NO: 14509 - protein, 81 aa, Sapajus apella
WSQMPVTFEDVALYLSREEWGRLDHTQQNFYRDVLQKRNGLSLGFPFSRPFWAPQVQGKGEASGSSRQTGEEKEDWRGACT

SEQ ID NO: 14510 - protein, 81 aa, Sapajus apella
FQKAVTFKDVAVVFSSEELRLLDLTQRTLYRDVMVENFKNLVAVGHLPFQPDMVSQLEAEEKLWMMEAETQRSSKHQNKME

SEQ ID NO: 14511 - protein, 81 aa, Sapajus apella
MLETYNHLVSLEIACSKPKLIAQLERGEEPWREERKCSLDLRPAGSKPEIQLCPSCPLMFSSQQALSQHVWLSHLPQLSSS

SEQ ID NO: 14512 - protein, 81 aa, Sapajus apella
QTEVTFEDVAVLLSREEWGRLGPAQRGLYRDVMLETYGNLVSLAVGTSTEYKELTSWETFDEEELGQLKGIFPQGSEPVDA

SEQ ID NO: 14513 - protein, 81 aa, Sapajus apella
MGPLEFMDVAIEFSLEEWQCLDTAQRNLYRDVMLENYRNLVFLGIVVSEPDLITCLEKGKKPLTVKGHEMIATPPVMCSHF

SEQ ID NO: 14514 - protein, 81 aa, Sapajus apella
MLENYRNLVFLAGIAVSKADLITCLQEEKDPWNMKRHSMVAKPPVIYSHFAQDLWPEQGIKDSFQEVILRRYRKCGHEDLQ

SEQ ID NO: 14515 - protein, 81 aa, Sapajus apella
AQEQVTFWDVAVYFSREEWECLEPSQRALYRDVMLDNFSNVAALGFCSPRPDLVSRLEQWEEPWVEDQERPELQAVQRGPR

SEQ ID NO: 14516 - protein, 81 aa, Sapajus apella
MPEQVTFEDVVVDFTQEEWRQLEPAQRTLYCDVMLDTFRLLVTVGHWLPKPNIISLLEQEAELWDVDPGVPQSVYQDLESR

SEQ ID NO: 14517 - protein, 81 aa, Sapajus apella
EMDSVAFEDVDVNFTQEEWALLSPSRKQLYRDMMLETLRNLASAASLVERFSGRKEGSDHRETFSQIPDCHLNKKSHTAVK

SEQ ID NO: 14518 - protein, 81 aa, Oryctolagus cuniculus
PQALVTFEDVAVDFSQEEWQYLNPQQRTLYRDVMLEAYSNLVSVGQQVTKPDLILRLEAEELYPEGKIPIWNFLEVGHVDE

SEQ ID NO: 14519 - protein, 81 aa, Sapajus apella
LQGLLTFRDVAIEFSLEEWQCLDTAQQNLYRNVMLENYRNLAFLGIAVSKPDLITCLEKEKGPWNMKRHEMVDEPPGICPH

SEQ ID NO: 14520 - protein, 81 aa, Sapajus apella
MKLLTFRDVTIEFSPEEWKCLDPAQQNLYKDVMLENYRNLVSLGVAISNPSLVTCLEQRKEPFNVKIRKTVARPPAMCSPF

SEQ ID NO: 14521 - protein, 81 aa, Oryctolagus cuniculus
VQRPVTFEDVAVDFTQDEWDYLDDSQRALYQDVMSETCKNLASVARIFLTKPNVIAKCEPKEAPWRAAVRPPDNEVLSGGK

SEQ ID NO: 14522 - protein, 81 aa, Oryctolagus cuniculus
VMFQVTFSDVAVDFSPEEWGWLSSAQRDLYREVTVQNYENLVSLGLSVAKPCVITLLEDGKEPWMVEKNLPKDWEPRWESK

SEQ ID NO: 14523 - protein, 81 aa, Oryctolagus cuniculus
LQVMIAFEDLAVYFTWEEWQKMNNAQKILYRDVMLETYSSLFSLGSCITKPDLIIKLEQGAEPWMVEEYLNESLPGQCAHN

SEQ ID NO: 14524 - protein, 81 aa, Oryctolagus cuniculus
FQGLVTFRDVALDFSQEEWEWLNTSQKDLYKEVMLENYRNLVWLGISISKPNMISLLEQGKEPWIVERKLSRGHRADWEPW

SEQ ID NO: 14525 - protein, 81 aa, Rhinolophus ferrumequinum
DEALMAFRDVAVAFTRKEWKLLSPAQRILYRDVMLENYSHLVSLGIAFSKPKLITQLEQGDEPWREESEWTETFSPAEPRK

SEQ ID NO: 14526 - protein, 81 aa, Rhinolophus ferrumequinum
VDGRLTFRDVAIDFSQEEWECLHPAERKLYTDVMLENYRNLCSLGLAVSKPDLVIFLERMKDAWDVQRKKTVSIHPAMSSA

SEQ ID NO: 14527 - protein, 81 aa, Rhinolophus ferrumequinum
PKVPVTFDDVAVYFSELEWGKLDEWQKELYKHVMRGNYEMLVSLDYAISKPDILTRMERGEEPCPEGVWCQEEGKEREAAC

SEQ ID NO: 14528 - protein, 81 aa, Rhinolophus ferrumequinum
GSDLFRDVAVVFSQEEWERLVPAQRDLYRDVMLETYSNLVSLDLETKPDVKESDLKEGISESRPSAGVVVEGPTRNGAWRS

SEQ ID NO: 14529 - protein, 81 aa, Ursus maritimus
TQEEWGQLEPDQRTLYRNVMLETFRLLVSVGKATTEPPMNISIFFLSDLETQPKTKLLAPKQDITEERASSVLVERFLWDS

SEQ ID NO: 14530 - protein, 81 aa, Rhinolophus ferrumequinum
FKVTLSFKDVFVDFTSGEWQLLDAAQKNLYWNVMLENYSNLVSVEDTWRVDDGVNWHQEHSDKLDPVETHGVLCGYGACGE

SEQ ID NO: 14531 - protein, 81 aa, Ursus maritimus
LFQGSLSFKDVAVVFTWEEWQLLDPVQKNLYQDVMLENYSNLVSVGYQVTKADAFYQLENGTPWITEEEIQSQSHPEDTWE

SEQ ID NO: 14532 - protein, 81 aa, Gorilla gorilla
VTLKDVGMDFTLGDWEQLGLEQGDTFWDTALDNCQDLFLLGEFPRGSPLWETFALALSDVTETKNSPLMEDFFEEGFSQEI

SEQ ID NO: 14533 - protein, 81 aa, Gorilla gorilla
IQSQISFEDVAVDFTVEEWQLLNPTQKNLYRDVMLENYSNLVFLEVWLDNPKMWLRDNQDNLKSMERGHKYDVFGKIFNSS

SEQ ID NO: 14534 - protein, 81 aa, Ailuropoda melanoleuca
MDVMLENYCHLISVGCHMTKPDVILKLERGEEPWTSFTGHTCLEENWKEEDFLVKFKEHQDKFSRSVVFINHKKLSKENSN

SEQ ID NO: 14535 - protein, 81 aa, Ailuropoda melanoleuca
RESGKAPVTFDDITVYLLQEEWMLLSQQQKEICGSDKLVAPLGPTIATPELFYKFEQGPEPWLGNVQGQRNVLSHQPGKNK

SEQ ID NO: 14536 - protein, 81 aa, Ailuropoda melanoleuca
QEPVTFEDVAVYFTQNQWAKLDPTQRALYREVMLENYANVASLGVAFPFPKPDLVSQLERGEVPWGPDPWEAEVLRGICPG

SEQ ID NO: 14537 - protein, 81 aa, Ailuropoda melanoleuca
RKGCVTFEDMAIYFSQEEWVLLDEAQRHLYHDAMLENFALIASLVCWHGMEDEEAPFEQSVAGEVLLWRVHTGERPHECSE

SEQ ID NO: 14538 - protein, 81 aa, Ailuropoda melanoleuca
FQGSLSFEDVTVGFTQEEWQHLDPAQRSLYRDVMLENYSHLVSLGCCIPKPEVILKLEQGEQPWILEEESPGQSYPEVCRV

SEQ ID NO: 14539 - protein, 81 aa, Ailuropoda melanoleuca
FRGTVTFKDVAIDFTQEEWQQLDPAQRNLYRNVMLENYNNLITVGCPFTKPDVIFKLEQEEEPWVVEEEVLRRHCPGEMWG

SEQ ID NO: 14540 - protein, 81 aa, Gorilla gorilla
MLENYSHLVSVGYLVEKPDVIFRLGPGEESWMADGGTPVRTCAEVWQVDEQIDHYKESQDKLPWQAAFIGKETLKDESGQE

SEQ ID NO: 14541 - protein, 81 aa, Ailuropoda melanoleuca
QGHVTFEDVAVYFSWEEWGLLDEAQRLLYRDVMLENFSLMASLGKVLTTHSNVLFSDSSTCLHVLGIAITDSTSLNFAFLK

SEQ ID NO: 14542 - protein, 81 aa, Ailuropoda melanoleuca
LMGSLSFGDVAVDFSQEEWQHLDPAQRTLYRDVMLENYHNFVSVGYLIKKPALIFKLEEGKEPWILEEEFLYQNYPGELVS

SEQ ID NO: 14543 - protein, 81 aa, Gorilla gorilla
SPLAMAEMDPTQGRVVFEDVAIYFSQEEWGHLDEAQRLLYRDVMLENLALLSSLGKLTLAQCPGLGCVTPFYPKAALRFPQ

SEQ ID NO: 14544 - protein, 81 aa, Gorilla gorilla
QGTVTFEDVAVNFSQEEWCLLSEAQRCLYRDVMLENLALISSLGCWCGSKDEEAPCKQSISVQRESQSRTPRAGVSPKKAH

SEQ ID NO: 14545 - protein, 81 aa, Lynx canadensis
KSPGLLSFKDVAVVFTWEEWQLLDPIQKHLYQDVMLENYSNLVSVGCQVTKADAFYQLEQGPPWITEEEIQSQIHPDDTWQ

SEQ ID NO: 14546 - protein, 81 aa, Lynx canadensis
PLRLSSSASHTQAAPSFKDVTVEFTEEEWKHLGPAQRTLYRHMRILVDEQTLPRHCLENAILFFMIATFIICVISCSVSTN

SEQ ID NO: 14547 - protein, 81 aa, Lynx canadensis
FQGSVTFQDVAVDFTPEEWQLLDCDQRTLYWDVMLENFRNLTAVGGPVTKTKVIFKEEQGQESWMVEGENPCWRYPEADWL

SEQ ID NO: 14548 - protein, 81 aa, Lynx canadensis
IQGSLTFGDVAVAFTQIEWKHLDAAQRALYTDVMLENYGNLVSVGLLSSKPKLITQLEQGSEPWMEVQQVPSGTCSVQEYW

SEQ ID NO: 14549 - protein, 81 aa, Lynx canadensis
MLENYGNLVSVGLLSSKPKLITQLEQGSEPWMEVQQVPSGTCSVQEYWFETKVSTLKQNTSEGSDLGEQTKIDMMERGLDW

SEQ ID NO: 14550 - protein, 81 aa, Lynx canadensis
FQWLVTFRDVAINFSQEEWECLNSTQRDLYRDVMLENYSNLISLAGCAIPKPDVFSLLEQGKDPWMVTRAMTRRWSSDLES

SEQ ID NO: 14551 - protein, 81 aa, Lynx canadensis
LFIGLLTFRDVAIEFSRKELGCLNHSQWELYRDVMLENYGHLLFLGLVVSKPDLVIFLEHKRDVWAVKRKETVATHPGWWN

SEQ ID NO: 14552 - protein, 81 aa, Lynx canadensis
WSQDSVTFEEVAVDFSQEEWALLDPTQKILYRDVMLENYRNLASVGYPLCKHSLITEVGQEALSTEERGMLQGACIGLDIQ

SEQ ID NO: 14553 - protein, 81 aa, Phyllostomus discolor
LQEPVTFRDVAVDFTQEEWGQLGPAQRTLYRDVMLETFGHLLSVGPELPKPDVISQLEQGTELWMVERGIAQGRHPGENPP

SEQ ID NO: 14554 - protein, 81 aa, Phyllostomus discolor
AQGHVVFEDVAVHFSQEEWGLLNEAQRCLYHSVMLENLALLSSVGCWSGAQDEEAPLEQGDSGGGSQVRTPKSALSTQKTQ

SEQ ID NO: 14555 - protein, 81 aa, Myotis lucifugus
VNFEDVAIAFSEVEWVILDDAQRLLYYDVMLEVFALVSSVGCWHKMEDEEAPSDQQVCIQGKSQVRTSKTAPVTHKNHLCK

SEQ ID NO: 14556 - protein, 81 aa, Puma concolor
SQHLVTFEYVAVDFTQEEWTLLDQTQIVLYRDVMLENYQNLITLGSELSPQSLTSALEAAELLRTGGRGVLQEVDLQLQTK

SEQ ID NO: 14557 - protein, 81 aa, Puma concolor
SQGSVTFRDVAIDFSQEEWEWLQPPQRDLYRHVMLENYSHLVSLGLNISKPYVVSLLEQGKEPWLEKRGVRRDLFSVSEPN

SEQ ID NO: 14558 - protein, 81 aa, Sapajus apella
FQGSISFKDVTVGFTQEEWQHLDPSQRALYRDVTLENYSNLVSVGYCVHKPEVIFRLEQGEEPWRLEEEFPSQSFPEVWTA

SEQ ID NO: 14559 - protein, 81 aa, Sapajus apella
PQERLTFRDVAIEFSQEEWKCLDPAQRTLYRNVMLENYRNLVSLGISLPEMNIVSTLEQGKEPRTVESEVKITKTSNGWKC

SEQ ID NO: 14560 - protein, 81 aa, Sapajus apella
MGPLTFMDVTIEFSLEEWQCLNTAQQNLYRDVMLENYRNLVFLGIALSKPALITYLEQGKEPWNMKRHETVAKPPVMCSYF

SEQ ID NO: 14561 - protein, 81 aa, Sapajus apella
MLENYSHLVSVGYLLAKPDMIFRLGPGEESWRADGGTPVRTCAGEDRPVFHYGRLRLNSSCCSCHPPKEVWQVDKQIDCYK

SEQ ID NO: 14562 - protein, 81 aa, Sapajus apella
VQGLMAFKDVAVDFSREEWDFLDATQRHLYRCVMLENYSNLASVRLSILKPDVISLLEEESQPWLVNRGMTAGPCPGEWEL

SEQ ID NO: 14563 - protein, 81 aa, Sapajus apella
SQNSVTFQEVAVDFSQEEWALLDLAQKNLYKDVMLENFRNLTSVGYQLCRHNLISKVHQEELKTDEGGILQSDSAEWETQL

SEQ ID NO: 14564 - protein, 81 aa, Sapajus apella
GSRGCAPGDVAVEFTQEEWQHLGPVEWTLYRDVMLENYSHLVSVGYCITKPKVISQLEQGEEPWSLEDEFLNQRYPGHFKV

SEQ ID NO: 14565 - protein, 81 aa, Sapajus apella
LVTFRDVALDFSQEEWEWLKPSQKDLYRDVMLENYRNLVWLDWESWCEIKELSPKWFTDEDEISQEVVMERLASHGLDHCS

SEQ ID NO: 14566 - protein, 81 aa, Sapajus apella
FQELVTFTDVAIDFSRQEWEYLDPHQRDLYRDVMLENYRNLVSLGGHSISKPVLVDLLEQGKEPWMILREETQFPDLDLQC

SEQ ID NO: 14567 - protein, 81 aa, Sapajus apella
MLENYSHLVSLGYQVSKPEVIFKLEQGEEPWISEGEIQRPFCPDWKTRPEFKSSHLQQDVSHCTDDFSRATLEDSWDVSSQ

SEQ ID NO: 14568 - protein, 81 aa, Sapajus apella
ELESVTFKDVAIDFTLEEWRLMDPTQRNLHKDVMLENYRNLVFVGLAVSKPDMISHLENGKGPWVTVREISRIPYPDLETK

SEQ ID NO: 14569 - protein, 81 aa, Sapajus apella
FQEPLTFMDVAIEFSLEAWQCLDNAQQNLYRKVMLENYRNLVFLGIAVSKADLITCLQQGKDPWNMKRHSMVAKPPVIYSH

SEQ ID NO: 14570 - protein, 81 aa, Oryctolagus cuniculus
VYFSQEEWELLEPTQKALYDAVMQENYEAVISLALFVLPKPKVISCLEQGEEPWVRGALEIQHGLGEPPTGVKLKNDTENH

SEQ ID NO: 14571 - protein, 81 aa, Oryctolagus cuniculus
SLVLMSFEDLAVDFTWEEWKFLTNAQKTLYRNVMLETYSNLLFLRHCITKPDLIFKLEQGPEPWMVEEHLNQSLPVAPNDD

SEQ ID NO: 14572 - protein, 81 aa, Oryctolagus cuniculus
ASEGSVSFRDVAIDFSSEEWQHLEPAQRSLYWDVMQETFSHLLSVGYQVPEPEIFMLEQGKGPWALWNESRYQSCSEEKLW

SEQ ID NO: 14573 - protein, 81 aa, Oryctolagus cuniculus
LVTFRDVALDFSQEEWEWLNTSQKDLYKEVMLENYRNLVWLDWEPWCEIKELSPKCFIDDEEISQGMVMERPIRNDLECSS

SEQ ID NO: 14574 - protein, 81 aa, Macaca fascicularis
MEHLTFRDVAIEFSPEEWKCLDPAQQNLYRDVMLENYRNLVSLAMCSHFTQDFLPVQEIEDSFHKLILRRYEKCGHENLQL

SEQ ID NO: 14575 - protein, 81 aa, Macaca fascicularis
TQGQVTFRDVAIEFSQEEWTCLDPAQRTLYRDVMLENYRNLASLAGISCFDLSIISMLEQGKEPFTVESQVQIARNPDGWE

SEQ ID NO: 14576 - protein, 81 aa, Macaca fascicularis
MAQVTFSDVAIDFSHEEWAWLDSAQRDLYKDVMVQNYENLVSVGLSVTKPYVIMLLEDGKEPWMVEKKLSKGMIPDWESRW

SEQ ID NO: 14577 - protein, 81 aa, Macaca fascicularis
QRGGVAASGPCPEDPVQRCDAGELQPPPLYRDVMLENYSLLLSVGYCITKPVVICKLEHGEVLWILEEESPSQSHLDCCID

SEQ ID NO: 14578 - protein, 81 aa, Macaca fascicularis
PQGLVTFEDVAVDFTQEEWQYLNPPQRTLYRDVMLETYSNLVFVGQQVTKPNLILKLEVEEYPAEGKIPFWNFPEVCQVDE

SEQ ID NO: 14579 - protein, 81 aa, Macaca fascicularis
PRGLEMGLLTFRDVAIEFSLEEWQHLDIAQQNLYRNVMLENYRNLAFLGIAVSKPDLITCLEQGKEPWNMTQHEMVDESPG

SEQ ID NO: 14580 - protein, 81 aa, Macaca fascicularis
VMFRDVAIDFSQEEWECLDSAQRDLYRDVMLENYSNLVSLDLPSRCASKDLSPEKNTYETELSQWEMSDRLENCDLEESKS

SEQ ID NO: 14581 - protein, 81 aa, Macaca fascicularis
WSQNSVTFQEVAVDFSQEEWALLDPAQKNLYKDVMLENFRNLASVGYQLCRHSLISKVDQEELKTDERGILQGDCADWETR

SEQ ID NO: 14582 - protein, 81 aa, Phascolarctos cinereus
CKESVTFKDVAVDFSQEEWGQLNPAQRQLYRDVMLENYRNLVSLGLPVSKPEVISHLERGVIPWMLERKVPRDICPESISR

SEQ ID NO: 14583 - protein, 81 aa, Phascolarctos cinereus
SQESVTFKDVAVNFTQEEWGQLNPAQRELYRDVMLENYRNLISLGLPISKPDVIFQLEQGQEPWMLDVQGTEGGGVPRNTS

SEQ ID NO: 14584 - protein, 81 aa, Phascolarctos cinereus
SQELVTFEDVAIYLTEEEWVLLDPAQKRLYRNVMLENYGNVLLQGFPIPKPDLISRLERGEIPCVPFLLRTKIQVIRFDCG

SEQ ID NO: 14585 - protein, 81 aa, Phascolarctos cinereus
PKVPVTFDDVAVYFSEKEWGNLDKWQKELYKHVMTGNYEMLVSLDYALSKPEFLTRIEQGEEPCVQNQLDSEETEIATNPE

SEQ ID NO: 14586 - protein, 81 aa, Phascolarctos cinereus
RFQLPVTFRDVAVDFSSEEWRRLSPAQRALYRDVMLENYENLVSLGLSVSKPDVISQLEKDVPWTPEGGFPSDPYPDSFKQ

SEQ ID NO: 14587 - protein, 81 aa, Phascolarctos cinereus
PQESVTFKDVAVDFTWEEWGYLDTSQKELYQEVMLENYRNLVSLGFVVAKPDVISQLEQGEAPWRPEGRFPRSRHPDSDTR

SEQ ID NO: 14588 - protein, 81 aa, Phascolarctos cinereus
AQELVTFKDVVVDFTPEEWGLLNHSQKELYKEVMVENTRNLLSLGLPVLREGLISHFGQGEAPRMQEQEDLRTSCPDGETR

SEQ ID NO: 14589 - protein, 81 aa, Phascolarctos cinereus
PQEPVTFKDVAVDFSQEEWGLLGPAQRHLYRDVMLENYRNLVSLGLILAKPEVVCHLEQGGELWKPEHGVLCSGDGELWVR

SEQ ID NO: 14590 - protein, 81 aa, Phascolarctos cinereus
LLPVTFSDVAVDFSSEEWRLLSPAQRALYRDVMLENYENLVSVGAGLPPSKPDVISQLEKGETPQMLKAGVLRAIYPGIHV

SEQ ID NO: 14591 - protein, 81 aa, Phascolarctos cinereus
KVPVTFVDIAVYFSEDEWKNLDEWQKELYNNLVKENYKTLMSLGAENPMPKPDAQSRVEPREEPCVWEQHNPEEREIPMDP

SEQ ID NO: 14592 - protein, 81 aa, Phascolarctos cinereus
PQELVTFQDVAVDFTQEEWGLLDHPQKELYKEVMLENAQNLLSLGVPVPKENFISNFEQREGPLILVREDPRHSSPDGETR

SEQ ID NO: 14593 - protein, 81 aa, Phascolarctos cinereus
DQEVVSFRDVAVDFTEEEWECLSPAQWQLYKEVMLENYRNLVSLGLLEDKPDLVSRLEQGEEAWASDMQEEGPRSPCPWGG

SEQ ID NO: 14594 - protein, 81 aa, Phascolarctos cinereus
HQEPVTFQDVVVVFTREQWAYLDPSQKELYRDVMLETYRNLLCLGLAMSKPQVIRQLERREAPWIPERRIPGSSCPDWETR

SEQ ID NO: 14595 - protein, 81 aa, Phascolarctos cinereus
EQELVTFKDVAVDFTQDEWRQLSQAQRDLYRNVMLENYKNLVSLGLLVSQPDVLSQLQRGKVPWIPEGDIPRGTCPDFLTQ

SEQ ID NO: 14596 - protein, 81 aa, Phascolarctos cinereus
CQESVTFKDVAIDFTQEEWGHLDSSQKELYREVMLENYSNLVCLGLAASRPDLISHLKQGEAPWVARRDVEAGTWPDCETG

SEQ ID NO: 14597 - protein, 81 aa, Phascolarctos cinereus
TGESVTFKDVAVDFTAEEWGCLGPSEKKLYRDVMLENYGHLVHLGLAVSKPDVICHLERGDPPWKPVIKVPRTSFPDGETR

SEQ ID NO: 14598 - protein, 81 aa, Phascolarctos cinereus
AAVPMTFDDLAMYFSEQEWRQLVEWQKELYKQVMKANYETLISLDYSISKPDLISLIELGEEPFIRNLKDSQETKTAFSSS

SEQ ID NO: 14599 - protein, 81 aa, Phascolarctos cinereus
HQGSVTFGDVAVDFSQDEWGHLDPAQKELYREVMLENYGNLVCLGLAVSKPHVIEQLERGEVPWLPRGAVPRSCGPGWEAE

SEQ ID NO: 14600 - protein, 81 aa, Myotis lucifugus
GSVSFADVAVYFSPEEWGCLRPAQRALYRDVMRETYGHLGALGGAPNKKEEEPKAVPGARSPRKTPGKDRPGEPVQHHPDW

SEQ ID NO: 14601 - protein, 81 aa, Myotis lucifugus
FQDLVTFGDVAIDFSQEEWEWLNLAQRNLYRKVMLENYRNLESLGVSVSKPEVISLLEQGREPWMATKARTEGTCSDWEYA

SEQ ID NO: 14602 - protein, 81 aa, Myotis lucifugus
LRQDMNFEDMAIPFSQEEWGLLDEAQRLLYCDVMLEVFAVVSSVGCWHKTDDVEACSEQNASIEGESLVRASKTAPTTQKS

SEQ ID NO: 14603 - protein, 81 aa, Puma concolor
MLETYNHLVSLEIPFSKPKLISQLEQGEEPWTEEKRCPLVLCPARSKLEIQPYPPCPLAFSSQRGLSQHVWLRHLPQLFSS

SEQ ID NO: 14604 - protein, 81 aa, Puma concolor
LTFKDVAIEFSQEEWECLDPAQRALYRDVMLENYRNLVSLGEDNICSELFSQNSHLANHQRIHAGQKPYKCNGCGKAFSVR

SEQ ID NO: 14605 - protein, 81 aa, Puma concolor
PQEPVTFEDVAVLFTPEEWMFLDSAQRSLYRDVMLENYRNLASVGDQLGKFSSFSHLEQGEEWWPTERRVFPGSCPEPSLP

SEQ ID NO: 14606 - protein, 81 aa, Sapajus apella
RESGKAPVTFDDITVYLLQEEWVLLSQQQKELCGSDKLVPPLGPTVANPELFCKFGRGPEPWLGSVQDQRNLLEHHPGKKQ

SEQ ID NO: 14607 - protein, 81 aa, Sapajus apella
LTFRDVAIEFSQEEWKCLDRAQRTLYRDVMLENYRNLVSLATYLQSGKVFNQKRQLVRHRRFHTGEKPYKCNECGKNFSQM

SEQ ID NO: 14608 - protein, 81 aa, Sapajus apella
IWGPLSFMDVFVDFTWEEWELLDPAQKCLYRSVMLENYSNLVSLGYQHTKPDIIFKLEQGEELCMVPAPIPNQCCPNKVWK

SEQ ID NO: 14609 - protein, 81 aa, Sapajus apella
PQGHLTFTDVAIEFSQEEWKCLDPAQRALYKDVMLENYRNLVSLGISLPDLNINSMLEQRREIWSGESEVKIAKSSDRREC

SEQ ID NO: 14610 - protein, 81 aa, Sapajus apella
MAHMAFRDVAVDFTQDEWRLLSPAQRTLYREVMLENYSNLVSLGISFSKPEIITQLEQGKETWREEKKCPPATCPDHQEYG

SEQ ID NO: 14611 - protein, 81 aa, Sapajus apella
ASVTVTFDDVALYFSEQEWEILEKWQKQMYKQEMKTNYETLDSLGYAFSKPDLITWMEQGRMLLISDQGLLHRTKRTTGPP

SEQ ID NO: 14612 - protein, 81 aa, Sapajus apella
EMETLTFRDVAIEFSLEEWQCLNPAQQNLYRNVMLENYRNLVFLGITVSKQNPITCLVQRKEPCNMKRHEMVARPKAMCSY

SEQ ID NO: 14613 - protein, 81 aa, Sapajus apella
SLETVTFKDVAVDLTQEEWEQMKPAQRNLYRDVMLENYSNLVTVGCQVTKPDVIFKLEQEEEPWVMEDEMFGRHCPEVWKV

SEQ ID NO: 14614 - protein, 81 aa, Gorilla gorilla
VHGSVTFRDVAIDFSQEEWECLQPDQRTLYRDVMLENYSHLISLAGSSISKPGVITLLEQEKEPWMVVRKETSRWYPDLES

SEQ ID NO: 14615 - protein, 81 aa, Gorilla gorilla
QGHVTFEDIAVYFSQEEWGLLDESQRCLYHDVMLENFSLMASVAGLSQSNHKDSCSQQKVPVSLNNCVAQCSPDDGHYAPK

SEQ ID NO: 14616 - protein, 81 aa, Ailuropoda melanoleuca
DSEAVVFEDVAVYFTRIEWSCLAPDQRALYRDVMLENYGHVASLGFLIAKPALISLLEQGEEPGALILQMTEERGSTASLR

SEQ ID NO: 14617 - protein, 81 aa, Macaca fascicularis
MGPLTFRDVTVEFSLEEWQCLDTVQQNLYRDVMLENYRNLVFLGIAVSKPDLITCLEQGKEPWNMNRHEMVATPPAFYLMG

SEQ ID NO: 14618 - protein, 81 aa, Macaca fascicularis
EPGIVSFVDVAVYFCREEWGCLRPAQRALYRDVMRETYGHLSALGIGGNKPALISWVEEEAELWGPAARDPETKCPTETDP

SEQ ID NO: 14619 - protein, 81 aa, Macaca fascicularis
MKPGVISHAPDSVVPAAFPFSKPDLIFQLEQGEAAWGPDPWTLAGGEALRGMCTGGKTKTKNEEQTAQLNISKESESHRLI

SEQ ID NO: 14620 - protein, 81 aa, Macaca fascicularis
SQGSVTFRDVAIDFSQEEWKWLQPAQRDLYRCVMLENYGHLVSLGLSISKPDVVSLLEQGKEPWLGKRNVNRDLFSVSESS

SEQ ID NO: 14621 - protein, 81 aa, Macaca fascicularis
LKGLVTFEDVAVEFTQEEWALLDPAQRTLYRDVMLENFRNVASLGDQVDKPGLITQLEQEDEVMTEERGILPGTCPDVENP

SEQ ID NO: 14622 - protein, 81 aa, Macaca fascicularis
QASVCFEDVAMAFTQEEWEQLDLAQRTLYREVTLETWEHIVSLDWKTTLEENRLNSEKDRAREELSHHVEVKQCVQEEPPC

SEQ ID NO: 14623 - protein, 81 aa, Macaca fascicularis
QGTVTFEDVAVNFSQEEWSLLSEAQRCLYHDVMLENLALISSLGCWYGAKDEPPSKQTLSIQQESPLRTHWTGVCTKKVHL

SEQ ID NO: 14624 - protein, 81 aa, Macaca fascicularis
TFQDVAIDFSKEEWGFLNPAQRDLYTTVMLENYQNLVWLGLSISKSVISLLEKRKLPWIMGKEEIRVPLPATIYIYFYKCL

SEQ ID NO: 14625 - protein, 81 aa, Macaca fascicularis
MAFTQLTFRDVAVEFSQEEWKCLDSTQRTLYRDVMLENYRNLVSLEYYLMWEHRKEPWTMESQVQIARKPKGWEWIKGVKI

SEQ ID NO: 14626 - protein, 81 aa, Phascolarctos cinereus
FQESLTFKDVAVDFTQEEWQRLKPDQRYLYRDVMLENYRNLVSLGYQVSKPDVISQLEQGEEPWTIEREVSTYSCRDWETR

SEQ ID NO: 14627 - protein, 81 aa, Phascolarctos cinereus
IKESVTFKDVAVEFTWEEWRHLETAQRDLYRRVMMENYKNFVFLGLPVSKLDVISLLERGEAPWMPEGGVPSRCCPGSHTQ

SEQ ID NO: 14628 - protein, 81 aa, Phascolarctos cinereus
QQGSVTFQDVAVDFSWEEWGHLGPTQKELYREVMLENYGNLVCLGLAVSSPDVVCQLERGEGPWMPEGDAPGSSRAGSSKH

SEQ ID NO: 14629 - protein, 81 aa, Phascolarctos cinereus
PEGSVTFQDVAVTFTPEEWGRLATPQKELYREVMLENFGHLACLGLALSKPEVICQLERGEAPWMPGGDVPQMPSADLEVA

SEQ ID NO: 14630 - protein, 81 aa, Phascolarctos cinereus
AQEVVTFQDVAVDFTQEEWGFLDHPQKELYKEVMLENAQNLLFLGLPVPREDLISYFEEREAPWLLEQEGLRGCCPEGQIG

SEQ ID NO: 14631 - protein, 81 aa, Phascolarctos cinereus
SEKSLTFQDVAVDFTREEWGQLDPAQKNMYRDVMLENYENFISLGLPVSKLDVISHLEKREAPWLLGGKVLQSPQLDSLVL

SEQ ID NO: 14632 - protein, 81 aa, Phascolarctos cinereus
PKVPVTFDDVSIYFSTPEWEKLEEWQKELYKNIMKGNYESLISMDYAMTQPEVLSQTQPESQQNTENQVRPDESEMTAEPS

SEQ ID NO: 14633 - protein, 81 aa, Phascolarctos cinereus
RKESVTFKDVAVEFTQEEWVQLNPSQKKLYRDVMLENYKNLVSLGFAASKPNLINQLERKESSSLPEADIPRNSCPGDYIK

SEQ ID NO: 14634 - protein, 81 aa, Phascolarctos cinereus
LEPEGMARGSCRPPAQEEWGLLDHPQKELYKEVVVENAHNLLSLGRPVPRKDLMSYFEEKEAPWLLEQEGLRSCCPEGEIR

SEQ ID NO: 14635 - protein, 81 aa, Phascolarctos cinereus
TQDSVTFKDVAVDFTREEWERLNSTQRDLYRDVMLENYRNLVSLGLAVSKPDIIFQLEQEKELWMLKRKVLRSTRPAQKTE

SEQ ID NO: 14636 - protein, 81 aa, Phascolarctos cinereus
AQELVTFKDVVVDFTLEEWGLLDHSQKELYKEVMLETSQNLLSLGLPVLREDLIPPFHQGEAPGMLEQKGPRNSWPDAENK

SEQ ID NO: 14637 - protein, 81 aa, Myotis lucifugus
EYQLSKPEVVSRLEEEEELWSVERGIPQDTFSGRPEAPRDPPRDPLPAAAPPMQIEVVEVLSLNEEAARSRNARIWALYAG

SEQ ID NO: 14638 - protein, 81 aa, Myotis lucifugus
FQGLVTFRDVEIEFSQEEWKYLEPAQRDLYRDVTLENFGNLVSLGLSISKPDIISLLERGKEPWMIANDITGPRCPDLESR

SEQ ID NO: 14639 - protein, 81 aa, Myotis lucifugus
FQEPVTFKDVAVIFTEEELGLLNPSQRKLYRDVTLENFRNLVSVGTQLFKPDLIFQLEREEKLLFILIGIKNQHNVKSFQE

SEQ ID NO: 14640 - protein, 81 aa, Sapajus apella
ELVTFRDVLINFSQEEWEYLDSAQRNLYWDVMMENYSNLLSLDLESKYETKLLPVGTDIIKNSGSQWEVMESSKLCGLENS

SEQ ID NO: 14641 - protein, 81 aa, Sapajus apella
SLGSELFKDVAIVFSQEEWQWLAPAQRDLYRDVMLETYSNLVSLGLAISKPDVISFLEQGREPWMVERVVAGGLCPVLESR

SEQ ID NO: 14642 - protein, 81 aa, Sapajus apella
YQDSVTFDDLAVDFTPEEWMLLDPTQRNLYRDVMLENYKNLATVGCQLLKPSLISWLEQEESRTVQRGDFYEWKVQLKTKE

SEQ ID NO: 14643 - protein, 81 aa, Sapajus apella
LTFRDVAIEFSPEEWRCLDPTQRALYRDVMLENYRNLVSLDISSKCMMKEFSSTGPGNTKVFHTGTLEIHESHHIENFCFQ

SEQ ID NO: 14644 - protein, 81 aa, Sapajus apella
WDRTRSRSLKGTNPRSQPCISAFSAHCFTNRRIERRTGRLGMLSHGSCLCIYQPDVFSLLEKGKEPWKILRDETRGPCPDM

SEQ ID NO: 14645 - protein, 81 aa, Sapajus apella
EKETLTFRDVAIEFSLEEWQCLNPAQQNLYRNVMLENYRNLVFLADIAVSKQSPITGLEQKKESCNMKRHEMVARPTAMCS

SEQ ID NO: 14646 - protein, 81 aa, Sapajus apella
GKELLSFEDVAMYFTREEWGHLDWGQKDLYRDVMLENYRNMVLLGFQFPKPEVICQLENWDEQWILDLPRAGNRKASGSAC

SEQ ID NO: 14647 - protein, 81 aa, Sapajus apella
QQGPLTFRDVAIEFSLEEWQCLDTAQQDLYRKVMLENYTNLASLGIAVSKPDLITCLEQGKEPWNMKRHEMADEPPPVIYS

SEQ ID NO: 14648 - protein, 81 aa, Sapajus apella
YMGVLTFRDVAIEFCLEEWQCLDTAQQNLYRNVMLENYRNLVFLGIAAFKPDLITCLEQGQEPWNVKRHGMVAELPVVCSY

SEQ ID NO: 14649 - protein, 81 aa, Sapajus apella
LQGTVTFKDVAIDFTQEEWKRLDPAQRNLYRNVMLENYNNLITVGYPFTKPDVIFKLEQEEEPWVMEEEVLRRHWQGEIWG

SEQ ID NO: 14650 - protein, 81 aa, Oryctolagus cuniculus
MITFEDLAVYFTWEEWQNMNKTQKTLYRDVMLEIYSSLLSLGYCMTKPDLIFKLEQGAEPWIVEECLSQSLPVAMKWDYLT

SEQ ID NO: 14651 - protein, 81 aa, Oryctolagus cuniculus
VQGQVNFEDVFVHFSQEEWGLLDEAQRLLYRDVMLENFALTASLGHVSSVSHVVASLEMGSESRVPDWVNMIPDKETVGGC

SEQ ID NO: 14652 - protein, 81 aa, Oryctolagus cuniculus
VTFQDVAVVFSEEELRLLDTAQRALYRAVMLENFRNLLSVGEDGRARILGVTLCSDLVCPGIKALESSALRVHQRAHRGER

SEQ ID NO: 14653 - protein, 81 aa, Oryctolagus cuniculus
MVTFQDVAVVFSEEELRLLDAAQRALYRAVMLENFRNLLCVGHQSFKPDVISQLEREERLQVQEIQTQRGSKNGNKTGTCL

SEQ ID NO: 14654 - protein, 81 aa, Pteropus alecto
PYVSVTFEDVAVLFTRDEWRKLRPSQRSLYQDVMLENYGHLVSLGFPLSKPKVISLLQQGEEPWKVEEGSRRGSWLGWKSS

SEQ ID NO: 14655 - protein, 81 aa, Gorilla gorilla
RPGAVSFADVAVYFSPEEWECLRPAQRALYRDVMRETFGHLGALGFSGPKPAFISWVEGEVEAWSPESQDPDGESSAAFSR

SEQ ID NO: 14656 - protein, 81 aa, Ailuropoda melanoleuca
LQGLLTFRDVAIEFSQEEWGCLSHTQRELYRDVMLENYGHLLFSGLIASKPDLVSCLEQKKEPWDLKRKKTVAIHPVYELK

SEQ ID NO: 14657 - protein, 81 aa, Gorilla gorilla
LKGLVTFEDVAVEFTQEEWALLDPAQRTLYRDVMLENCRNLASLGNQVDKPSLISQLEQEDKVMTEERGILSGTCPDVENP

SEQ ID NO: 14658 - protein, 81 aa, Gorilla gorilla
CYQDSVTFDDVAVDFTQEEWTLLDSTQRSLYSDVMLENYKNLATVGGQIIKPSLISWLEQEESRTVQGGVLRGRKTQWRGT

SEQ ID NO: 14659 - protein, 81 aa, Ailuropoda melanoleuca
SEPFRLSRNVLLQASVSFKDVTVEFTQEEWQQMGPIQRTLYRDVMLENYNNLVSVGNCIFKPAVIVKLEQGEEPWFLEEKF

SEQ ID NO: 14660 - protein, 81 aa, Ailuropoda melanoleuca
EFLTFDDVAVDFTWEEWQLLAPAQKDLYRDMMLENYRNLVSVGYQASKPDALSKLERGEELWMIEDEIHSQICPGEKPHGC

SEQ ID NO: 14661 - protein, 81 aa, Gorilla gorilla
AQVSVTFEDVAVTFTQEEWGQLDAAQRTLYQEVMLETWGLLMSLGCPLFKPELIYQLDHRQELWMVTKDLSQSSYPGDNTK

SEQ ID NO: 14662 - protein, 81 aa, Ailuropoda melanoleuca
AQGLMAFEDVAVYFSQEEWELLDAAQRALYCHVMLENFALVASLGLSASRPRVVIQLERGEEPWVLSGTVVTPARNAHRKP

SEQ ID NO: 14663 - protein, 81 aa, Ailuropoda melanoleuca
QGSLSFRDVAVGFTRKEWQQLEPAQRMLYRDVMLENYSHLVSVATGCQVTKPAVISRLEQGQEPWMEEEEILRWSFPEEIL

SEQ ID NO: 14664 - protein, 81 aa, Lynx canadensis
APGLLTFRDVAIEFSQEEWGCLNQSQRELYRDVMLETYGHLLFLGLIVSKPHLVIFLEQKRELWDVKREKTVASPAGSGIG

SEQ ID NO: 14665 - protein, 81 aa, Lynx canadensis
GLVTFRDVAIDFSQEEWECLDPAQRDLYVDVMLENYSNLVSLDLESTYATKNKISEKDIFEIHFSQWERTERSKTLGLEAF

SEQ ID NO: 14666 - protein, 81 aa, Lynx canadensis
AHGSVTFRDVAIDFSQEEWEFLDSAQRDLYRDVMWENYSNFISLEPSISKPDVITLLDEGKEPWMVIREGTRRHYPDLESR

SEQ ID NO: 14667 - protein, 81 aa, Lynx canadensis
MVENFENLLSVGHLPFKPDMMSQLEAEEKLWMMERETQRNGYSSENHVAVPSGSKHQKEVETLRKVALKYLSHEELSCWQI

SEQ ID NO: 14668 - protein, 81 aa, Phyllostomus discolor
FQEELTFKDVAVVFTEEELGLLDPFQRKLYRDVMLENFRNLVSLGNQPFKPDLICQLEREEKCVMMETEAQRDACSGTKNQ

SEQ ID NO: 14669 - protein, 81 aa, Phyllostomus discolor
VQVSVTFNDVAVTFTQEEWGQLDPAQRTLYQEVMLETCRLLVSLGCPVPSPKLVNQLEHGQDLWMVKKDLSQSTCPGDEIK

SEQ ID NO: 14670 - protein, 81 aa, Phyllostomus discolor
LQSPMTFEDVAVYFSKEEWGLLDEAQKHLYHDVMLENFELMTSLGRWHEVQGEACSKQNAPIEGLSQLRIPYPSTLKTDTC

SEQ ID NO: 14671 - protein, 81 aa, Phyllostomus discolor
SEESVTFKDVAVDFTQEEWGQLDSPQRALYRDVMLENYQNLLALAGPPVCKPDVISHLERGEEPWQVPRKVPGGAPEWEPR

SEQ ID NO: 14672 - protein, 81 aa, Macaca fascicularis
MAKPVREEWRHLDPSQRNLYRDVMLETYSHLLSVGYQVPEAEVVMLEQGKEPWALQGERPRQSCPGEKLWDHNQCRKILTY

SEQ ID NO: 14673 - protein, 81 aa, Macaca fascicularis
AQVSVTFDDVAVTFTKEEWGQLDLAQRTLYQEVMLENCGLLVSLGCPVPRPELIYHLEHGQEPWTRKEDLSQDTCPGNKGK

SEQ ID NO: 14674 - protein, 81 aa, Macaca fascicularis
KSLVTFEDVAVYFSQEEWELLDAAQRHLYHSVMLENLELITSLGCWHGVEGEEAHPKQNISVEEVLPVRIPNADSSTKKAN

SEQ ID NO: 14675 - protein, 81 aa, Macaca fascicularis
PQGLLTFRDVAIEFSQEEWKCLDPSQRTLYRDVMLENYRNLVSLDISSKCMMEFLSTAQSNREVIHTGTLERHESHHIGDF

SEQ ID NO: 14676 - protein, 81 aa, Macaca fascicularis
RNVMLENYKNLVFLGIDISKQDPITSLEQEKELWNMKRHEMVDESPGQVWLTPVISALWEARAGGLLEPRSLRPAWSTWKN

SEQ ID NO: 14677 - protein, 81 aa, Macaca fascicularis
PLSFKDVAVVFTEEELGLLDSTQRQLYRDVMLENFRNLLSVGDKNGRDMEYIQDEELRLFSHKELSSCKIWEEVVGELPGS

SEQ ID NO: 14678 - protein, 81 aa, Macaca fascicularis
SVTGSVTFQDVAIDFSKEEWGFLNPAQRDLYTTVMLENYQNLVWLGLSISKSVISLLEKRKLPWIMGKEEIRVPLPGYFKV

SEQ ID NO: 14679 - protein, 81 aa, Macaca fascicularis
LTFRDVAIEFSLAEWKCLNPAQRALYREVMLENYRNLESVDSSFKTMMEYSSTGQGNTEVLHTGMLERHESHHIGDFCFPE

SEQ ID NO: 14680 - protein, 81 aa, Phascolarctos cinereus
GKESVTFKDVAVEFTQEEWVQLNPSQKKLYRDVMLENYRNLVSLGFAASRPNDSDQLERKEVSSLPEADIPRSSCPESREF

SEQ ID NO: 14681 - protein, 81 aa, Phascolarctos cinereus
RQGSVTFQDVAVDFSWEEWGRLGPTQKELYREVMLENYRNLVCLGLEVSKPDVVYQLERGEAPWMPEGAVRRSCSQNWGAR

SEQ ID NO: 14682 - protein, 81 aa, Phascolarctos cinereus
HQESVTFEDVAVEFTPEEWEHLRSFQKALYRDVMLENYRNLVCLGLAVSKPRVIYQLEQGKVPWMPEGDIPRTPYPDWDTG

SEQ ID NO: 14683 - protein, 81 aa, Phascolarctos cinereus
LTMEGLSLMFEDRGLLSPPSAGLPQDNSIEEKEEEEGKTSGFCSAQVQELVTFRDVAVDFTQEEWRRLDPAQRALYRASCF

SEQ ID NO: 14684 - protein, 81 aa, Phascolarctos cinereus
SAASVTFRDVAVDFSREEWSRLDAAQRALYRDVMWETYENLVSTGIPVSRLDVISLLAKQEAQWTPEEVPGWTSPDSFSEE

SEQ ID NO: 14685 - protein, 81 aa, Phascolarctos cinereus
SQELVTFKDVVVDFTWEEWELLEPGQKALYRDVMLENYRNLVALGHPVSKPNVIFQLEQSETPWMLEREAPSSIFPDWEAR

SEQ ID NO: 14686 - protein, 81 aa, Phascolarctos cinereus
PQESVTFKDVAVDFTWEEWGYLDTSQKELYWEMMLENYRNLVSLGLADANLDMISQLESGEAHGIPVGGVLRSCWPAWDTR

SEQ ID NO: 14687 - protein, 81 aa, Phascolarctos cinereus
PQELVTFKDVAVDFTQEEWGLMDHPQKELYKEVMLENAWNLLSLGLPVPREDVISNFERREAAWMLEQEGLRNCCPEREIR

SEQ ID NO: 14688 - protein, 81 aa, Myotis lucifugus
AHDLVIFRDVAVDFSQEEWKCLNSYQRNLYRDVILENYSNLVSVGCSISKPDVITLLEQGKEPWMVVRDEKKRWSLDLESK

SEQ ID NO: 14689 - protein, 81 aa, Myotis lucifugus
MNFEDVAIVFSEEEWGILDEAQRLLYCNVMLEVFALVSSAGCSHKTDDEEACSEKSVSVQGESQVRASKTEPATKRTHVCK

SEQ ID NO: 14690 - protein, 81 aa, Puma concolor
PQKSVTFEDVAVYFTQTEWNGLSPAQRALYRDVMLENYGNVASLGFSLLKPAVILQLEGAGELGDPSPLVAGTEIGSQGVW

SEQ ID NO: 14691 - protein, 81 aa, Puma concolor
LFKEAVTFRDVAVAFTEEELGLLDSAQRKLYQDVMLENFRNLVSVGHQSLKQDKWRIEREEKLWSMKTAAQMERNVGGNSQ

SEQ ID NO: 14692 - protein, 81 aa, Puma concolor
SQEPVTFEDVAVYFTQNEWVILDPSQRALYREVMLENYANVASLAFLFTRPVLVSQLERGELPWGPEPWEPAGREVLGGIC

SEQ ID NO: 14693 - protein, 81 aa, Puma concolor
SWASVVFEDVAVNFTPEEWALLNRGQRKLYRDVMLETCRNLSAVEKRKFHSSGDLTRMQEGLLRSPLVESVCERIEGDPCG

SEQ ID NO: 14694 - protein, 81 aa, Puma concolor
FQELVTFEDVAVYFIRKEWKRLEPAQRDLYRDVMLENYGNVFSLDGETRTEHDQEISEDTGSRGVLLGRFQKDISQGLKFE

SEQ ID NO: 14695 - protein, 81 aa, Puma concolor
PQGSVSFKDVTVDFTQEEWQQLDPAQKTLYRDVMLENYCHLISVGFHMTKPDMIRKLEQGEELWTTERIFPSQSYLEEDGK

SEQ ID NO: 14696 - protein, 81 aa, Gorilla gorilla
MLENYFNLISVGCQVPKPEVIFSLEQEEPCMLDGEIPSQSRPDGDIGFGPLQQRMSEEVSFQSEINVNLFTRDDPYSILEE

SEQ ID NO: 14697 - protein, 81 aa, Gorilla gorilla
AVLTDRAQVSVTFDDVAVTFTKEEWGQLDLAQRTLYQEVMLENCGLLVSLAPSQTHPGSIRCILQSNQVDTLIKIPEHTEH

SEQ ID NO: 14698 - protein, 81 aa, Gorilla gorilla
MGPLTFRDVAIEFSLKEWQCLDTAQRNLYRNVMLENYRNLVFLGIAVSKPDLITCLEQGKEAWSMKRHEIMVAKPTVTCSY

SEQ ID NO: 14699 - protein, 81 aa, Ailuropoda melanoleuca
PAQGCVTFEDVFVYFSREEWELLEEAQRVLYRDVMLENFALVSSLGLAVSRSHVGTQMEPEGSPGCLRSIHTGEKPCKCKR

SEQ ID NO: 14700 - protein, 81 aa, Gorilla gorilla
QVTFSDVAIDFSHEEDLYKDVMVQNYENLVSVAGLSVTKPYVITLLEDGKEPWMMEKKLFLFSYTVLSIMYILPISVITPA

SEQ ID NO: 14701 - protein, 81 aa, Gorilla gorilla
GTVTFEDVAVKFTQEEWNLLSEAQRCLYHDVTLENLALMSSLGCWCGVEDEAAPSKQSIYIQRETQVRTPMAGVSPKKAHP

SEQ ID NO: 14702 - protein, 81 aa, Gorilla gorilla
KMGLLTFRDVVIEFSLEEWQCLDHTQQNLYRDVMLENYRNLVSLGIAVSKPDLITCLEQNKEPWNKKRNEMVTKHPVMCSH

SEQ ID NO: 14703 - protein, 81 aa, Lynx canadensis
MLENFSHVISLGHPVSKPDVISKLEQGEEPWIIKRDVSDWIYPERETRLDNPQLDIPGDVSFHKEVLESVTRDPSLYSIFK

SEQ ID NO: 14704 - protein, 81 aa, Lynx canadensis
SQGLLSFSDVAVDFTCEEWELLDTVQKNLYRDVMLENYSNLMSLGYHAPWPEATVPVEKGVQGLVERGFPSSCSPERPLQC

SEQ ID NO: 14705 - protein, 81 aa, Lynx canadensis
AEGGVTFEDIAIYFSWKEWRLLDEAQRRLYHDVMLENFTLISSLGCCCGAEDAEAPLEQSVSVGVSQAGTPKAALSSRKTH

SEQ ID NO: 14706 - protein, 81 aa, Lynx canadensis
PGGLLTFRDVAIEFSQDEWGCLNQSQRELYRDVMLETYGHLLFLDTLAQYSESETQSNQGSHVSKHLRTLQENHFEPNKDE

SEQ ID NO: 14707 - protein, 81 aa, Lynx canadensis
GNMPANQSSPGPSLALAVGRCDNPCEGSVSFEDVTVDFSREEWQQLDSTQRRLYQDVMLENYSHLLSLGKHSHSKNLQRSM

SEQ ID NO: 14708 - protein, 81 aa, Lynx canadensis
RRDPAEDVNFEDVAIDFSQEEWGLLDETQRLLYCDVMLETFALVASLDLHQQQRHGSGEKPWKRDVDRASCLKSCNIFVSR

SEQ ID NO: 14709 - protein, 81 aa, Lynx canadensis
SQHLVTFEYVAVDFTQEEWTLLDQTQIALYRDVMLENYQNLITLAGYKSCKPDLSSALEGAELLRTGGRGVLQGEKQCGKT

SEQ ID NO: 14710 - protein, 81 aa, Lynx canadensis
AHGLVMFKDVAIDVSQEEWECLNPTQRSLYKDVMLENYSNLVSLGLSISKPAVISSLEQGKEPWMVVREVTGEQCPDLVSR

SEQ ID NO: 14711 - protein, 81 aa, Phyllostomus discolor
AVMFKDVAVVFTEEELGLLDPSQRMLYQDVTLENLRNLISVGHWNQNDIETLHKVQLRYLLLENILCWQVWNQLLSKLTRK

SEQ ID NO: 14712 - protein, 81 aa, Phyllostomus discolor
MAMYLTREEWRPLDPTQRDLYRDVMQENYGNVVSLVQGALKDGSMEAPKKKSFRPNFEIRSENEVNPKQEISDDVEFGTAS

SEQ ID NO: 14713 - protein, 81 aa, Phyllostomus discolor
LEVVVTFEDVAVYLSRTEWCLLDEAQRRLYLDVMLENFAHVSSLGCCCGAKDVEAPTEENICVPVSQARNAKTAVSSQKSH

SEQ ID NO: 14714 - protein, 81 aa, Phyllostomus discolor
ATESLTFKDISEDLSWEEWECLDPAQWKLYSDVILENYSNLVSLGLVVSKPGLVTFLEQMQESRDVSPKKSIFTPPAVSSA

SEQ ID NO: 14715 - protein, 81 aa, Phyllostomus discolor
AVMFKDVAVVFTEEELGLLDPSQRKLYQDVTLENLRNLISVGHWNQNEIDTVHEVALRYIFHEDLVCWQIWDQLLSKLTRN

SEQ ID NO: 14716 - protein, 81 aa, Phyllostomus discolor
MDSVVTFEDVAVNFTLEEWALLDPSQKKLYRNVMRETYRNLASIGLHLGEKWEDRNIENQYKTQGEKLRGHIVEKLYEIQE

SEQ ID NO: 14717 - protein, 81 aa, Macaca fascicularis
AQVSVTFEDVTVTFTQEEWGQLDAAQRTLYQEVMLETYGLLVSLGCPLFEPELIYQLDRREELWIVKKDLSQSSYPGDNTK

SEQ ID NO: 14718 - protein, 81 aa, Macaca fascicularis
ENTLENISDVTIEFSLEEWQCLDTAQQTLYRDVMLENYRNLVFLGIAVSKLDLIACLKQGKESWNMKRHEMVTKPPVTRSH

SEQ ID NO: 14719 - protein, 81 aa, Macaca fascicularis
SQESLTFKDVFVDFTLEEWQQLDSAQKNLYRDVMLENYSHLVSVGYLVAKPDVIFRLGPGEESWMADGGTPVRTCVGEDRP

SEQ ID NO: 14720 - protein, 81 aa, Macaca fascicularis
SYEGSVSFRDVAINFSREEWQHLDLSQRNLYRDVMLETCSHLLSVGYQVPKPEVVMLEQGKEPWALQGERPRQSCPGEKLW

SEQ ID NO: 14721 - protein, 81 aa, Macaca fascicularis
MGLLTFRDVAIEFSLEEWQRLDAAQQNLYRNVMLENYRNLAFLGIAVSKPDLITCLEQGKEPWNMERHEMVAKPPGMCCYF

SEQ ID NO: 14722 - protein, 81 aa, Macaca fascicularis
QGRVTFRDVAIEFSLAEWKCLNPAQRALYREVMLENYRNLESVDISSKCIMKEFSSTGQCNAEVFHTGTLQRHESHHIRDF

SEQ ID NO: 14723 - protein, 81 aa, Macaca fascicularis
PQGHLTFMDVAIEFSQEEWKCLDPGQRALYRDVMLENYRNLVSLGICPPDLSIISMLKQRREPLTLQSGVKIVKNPDGREC

SEQ ID NO: 14724 - protein, 81 aa, Phascolarctos cinereus
NMEVATFEDVAVYLTRDEWGLLEPAQRDLYRDVMLENYGNFISLGFLGSKPDVISQLERGEESWVLDIEKPEERELSSRKG

SEQ ID NO: 14725 - protein, 81 aa, Phascolarctos cinereus
GQKSLTFKDVAVDFTQEEWKQLNPAQRDLYRDVMLENYRNLALLGLLVFQPDVIHHLENGEVPWTPEGEGSKSSCSDSFIQ

SEQ ID NO: 14726 - protein, 81 aa, Phascolarctos cinereus
IQESVTFKDVAVNFTQEEWQELDTAQRDLYWDVMLENYENLVFLAGLPISKPDVLCHLERGVAPWMLEGDFPGDVFPDSLS

SEQ ID NO: 14727 - protein, 81 aa, Phascolarctos cinereus
QAGQESVTFTDVAVDFTLEEWAYLDHFQKELYKDVMLENYRNLLCLVSKPDVISQLEQGDAPWMSEGGVPRSIYSDWETRP

SEQ ID NO: 14728 - protein, 81 aa, Phascolarctos cinereus
GEEAVTFRDVALDFTWEEWGCLSAAQRELYKDVMLENYRNLVSLGLPGPKPGLISWLEGEEEPHPWDSLVHAARSTSLSKA

SEQ ID NO: 14729 - protein, 81 aa, Phascolarctos cinereus
HQGSVTFGDVAVDFSQDEWGHLDPAQKELYREVMLENYGNLVCLGLAVSRPHVIEQLERGEAPWLPRGAVPRSCDLDWMTR

SEQ ID NO: 14730 - protein, 81 aa, Phascolarctos cinereus
MLENFRNLVCLGLAMSKPDVISQLERGEAPWMPEGNGLRCRLGNKTENKESSPGLGVCMEESSQKTLPKDCPCVPKVGEAW

SEQ ID NO: 14731 - protein, 81 aa, Phascolarctos cinereus
MTFEDVAVYFTKKEWKQLTPDQRHLYRDVMLENYGNMVSLGVPVHKPDVISQLEHGEEPWVLNLQEAGEREEIPRYFSIDC

SEQ ID NO: 14732 - protein, 81 aa, Phascolarctos cinereus
LGESVTFNDVAVEFTQEEWVQLNPSQKKLYKDVMLENYRNLVSLGFPVSKPDVIYQLERREASWMPEADISGSSCPGSREF

SEQ ID NO: 14733 - protein, 81 aa, Puma concolor
PQEPVTFEDVAVYFTQNQWASLDPMQRALYREVMLENYTNMASLVAFPFPKPVLVSHLERGEAPWGPDPWEAEVLRGICPG

SEQ ID NO: 14734 - protein, 81 aa, Puma concolor
PPARLTTPGGCREGLRAGIRLVASLRKELYKHVMRGNYETLVSLDYAISKPEVLSQTEQGKEPCSWRRTAPKVPDVPVDPS

SEQ ID NO: 14735 - protein, 81 aa, Puma concolor
PQDLMTFKDVAVEFTQWEWGQLDPAQKDLYREVMLENFKNLASLGLPVSKPYVICQLEEGEEPCVVEGEISTGAHPDWEKR

SEQ ID NO: 14736 - protein, 81 aa, Sapajus apella
SSEPVTFEDVTLGFNPEEWGLLDLKQKSLYREVMLENYRNLVSVEHQLSKPDVVSQLEEAEDFWPVERGIPQDTIPEYPEL

SEQ ID NO: 14737 - protein, 81 aa, Canis lupus
FEVSVSFEDVAVDFTRQEWHRLDPAQRTMHKDVMLENYSNLASVGLCVAKPEMIFKLERGEELWILEEDSSGHCYPGSLSL

SEQ ID NO: 14738 - protein, 81 aa, Canis lupus
LVTFRDVALDFSQEEWEWLDPSQKDLYRDVMLENYRNLVWLDWESWYEIKELSPKWYIDEEEISQGMVMERLTSIDLEYSS

SEQ ID NO: 14739 - protein, 81 aa, Canis lupus
CCISMSFEDVTVDFSREEWQHLDSAQRRLYRDVTLENYSHLCSVGYQVPKPEVIFKLEQGEEPWILETKTPHQSCLDEDVG

SEQ ID NO: 14740 - protein, 81 aa, Canis lupus
RASPTPPREPKEEWDYLDPAQRSLYKDVMMENYGNLVSLDVLNRDKDEEPTVKQEIEEIEEEVEPQGVIVTRIKSEIDQDP

SEQ ID NO: 14741 - protein, 80 aa, Muntiacus muntjak
MGRLMFRDVAVDFTQEEWECLDLGQRDLYMDVMLETYGNLASLGLVVSKPDLVTFLEQMKNPWDVRRTDTTATYPENANL

SEQ ID NO: 14742 - protein, 81 aa, Muntiacus muntjak
LSGSVSFRDVAVDFTQEEWQQLDPDEKMTYRDVMLENYSHLVSVGYDSTKPNVIIKLEQGEEPWVADSKFLQQQHPEKVWK

SEQ ID NO: 14743 - protein, 81 aa, Muntiacus muntjak
RDLVTFEEVSVDFSQEEWALLAPAQKILYRDVMLENFRNLASVGYHLCIHSPITEVAQEELRPEGRGILQSACTDGATQLK

SEQ ID NO: 14744 - protein, 81 aa, Muntiacus muntjak
YEVPKPEVIFKLEQGEEPWALKEKTLHHSCSDEKFGIKTLQKRISGKVSFHGEMEGEDAKDDSLYSILEVLCQDAEQIKSY

SEQ ID NO: 14745 - protein, 81 aa, Canis lupus
VMFRDVAIDFSQEEWEYLDSAQRDLYRDVMLENYSNLVSLVDLPSRSVNKDLSPKKDIYETELSQWQMSARHQNCDFEESS

SEQ ID NO: 14746 - protein, 81 aa, Muntiacus muntjak
GLLTFQDVTVDFTQEEWEYLDLGQWELYRDVMLENYGNLACLAFFNSQSLLTFISIESILLFNHLFFCRSLLLPSICPSIR

SEQ ID NO: 14747 - protein, 81 aa, Muntiacus muntjak
SQEPLTFKDIIVDFTQEEWGHLAPAHWHLYREVMLENYGNLVSVGYQLSKPGVISQLEKGEEPWLMEREVSGGPSPEHMSI

SEQ ID NO: 14748 - protein, 81 aa, Canis lupus
LQEAVVFEDVAVYFTRIEWSCLAPDQRALYRDVMLENYGHVASLGFLVAKPALISLLEQGEEPGALILQVTEERGSATSRC

SEQ ID NO: 14749 - protein, 81 aa, Canis lupus
MLENYKSIVSLGLPVPCPEVIFQLKRGDEPWIVDLHGSEERECPENISLVFSSPGEKLHLYFLSVPDWETKPEIHGTSDKE

SEQ ID NO: 14750 - protein, 81 aa, Gorilla gorilla
LVMFQDLSIDFSQEEWECLDAAQKDLYRDVMMENYSSLVSLDSEFRCKTKDSCLPKEIYEVTSPQWVRMEKCHSLVGSSVR

SEQ ID NO: 14751 - protein, 81 aa, Ailuropoda melanoleuca
KSEPVTFRDVAVDFTQEEWGQLGPAQRTLYRDVMLETFGHLLSLGPELPKPEVISQLEQGAELWLAERGIVQGYYPGREPG

SEQ ID NO: 14752 - protein, 81 aa, Ailuropoda melanoleuca
QGSVTFQDVAVDFTPEEWQLLDCDQRTLYWDVMLENFRNLISVGTGGPVTKTKAIFKAEQGQEPWMGERENPRWRYPEADC

SEQ ID NO: 14753 - protein, 81 aa, Desmodus rotundus
AWVPALFDEVAIYFSDEEWEVLTEPQKALYREVMRMNYETVLSLEFPFPKPDMISRLDGEEESQSSDPWQLQGGSFAEHEE

SEQ ID NO: 14754 - protein, 81 aa, Macaca fascicularis
QAMVKIEDMAVSLILEEWGCQNLARRNLSRDHRQENYGSTFPQANVFAAFQHAVHVFCFLEEKGHVQSCHGPEACPACSNG

SEQ ID NO: 14755 - protein, 81 aa, Macaca fascicularis
FQKPVTFEDVAVNFTQEEWDCLDASQRVLYQDVMSEIFKNLASVARIFLHKPELITKLEQEEEQWRETQVLQASQAGPPFF

SEQ ID NO: 14756 - protein, 81 aa, Macaca fascicularis
RVTFKDVAVVFTKEELALLDKAQINLYQDVMLENFRNLISVGDGIKNNILNLQEKGLSYLSQEVLRCWQIWKQRIRDLTVS

SEQ ID NO: 14757 - protein, 81 aa, Macaca fascicularis
QDTVAYEDLCVDYTQKKWKCPALSQRALQWNMIPENDHSMASLGRNMMESSELIPKQEIFKGSESSNSTSGGLFGVVPGAA

SEQ ID NO: 14758 - protein, 81 aa, Macaca fascicularis
EMGLLTYRDIAIEFSLAEWQCLDHAQRNLYRDVMLENYRNLVSLGITVPKLDLITCLEQNKEPQNMKRSEMVAKHPVMCSH

SEQ ID NO: 14759 - protein, 81 aa, Macaca fascicularis
MGSLRFRDVAIEFSVEEWQCLDTAQQNLYRNVMLENYRNLVFLGIAVPKPDLIIFLEQGKEPWNMKRHEMAGEPSVICSHF

SEQ ID NO: 14760 - protein, 81 aa, Macaca fascicularis
PQASVCFEDVAMAFTQEEWEQLDLAQRTLYREVTLETWEHIVSLGLFLSKSDVISQLEQEEDLCRAEQVAPREKGVLGSFL

SEQ ID NO: 14761 - protein, 81 aa, Phascolarctos cinereus
PQESVTFKDVAVDFTWEEWGYLDTSQKELYWEVMLENYRNLVSLGLADSNVNMISQLESGEAQGIPVDSVLTSCWPDGDRR

SEQ ID NO: 14762 - protein, 81 aa, Phascolarctos cinereus
FQESVTFQDVGVDFTLEEWRCLGPVQRALYKNVMLENLESLISLGLPVSILEVVSLLERGGAPGMPKVVDPRRLWPVTFLG

SEQ ID NO: 14763 - protein, 81 aa, Phascolarctos cinereus
QASVTFRDVAVDFTGEEWRCLEPAQRALYRDVMLETYENLVFLGLSVPISKLDLIFLLERGGALSRPMGRVPSDSCPDSFI

SEQ ID NO: 14764 - protein, 81 aa, Phascolarctos cinereus
MKSVTFKDVAVDFSQEEWGLLDPSQKELYKDVMLEISQSLLSLGLPVPKADLISQVDQAETPWMLKQVDTKNSGLDGETKP

SEQ ID NO: 14765 - protein, 81 aa, Phascolarctos cinereus
MLENYRNLVWLGLTASRPGVIDQLERVEVPWVPEGEAPEVSCPDFETRPETTQLFPELGLSMEVSSHEKFLTGDPYVSPLG

SEQ ID NO: 14766 - protein, 81 aa, Oryctolagus cuniculus
SKAPVTFGDLAIYFSQEEWEWLSPIQKDLYEEVMLENYQNLVSLGLSFRRPNVITLLEKGKAPWMVELLRRHRGPALPPQE

SEQ ID NO: 14767 - protein, 81 aa, Oryctolagus cuniculus
QAQEVLMFDDVAVRFTWEEWQLLNPAQKALYRDVMLENYRSLVSVGWRASKPDLLSQLERGEPWTIEGENHCGTPPEIWKA

SEQ ID NO: 14768 - protein, 81 aa, Oryctolagus cuniculus
AGGPVTFSDVSVDFSQEEWECLDPTQRDLYRDVMLENYSNLVAMGLYIPKPQVISLLEQGKEPWMIGKELTRGLCSDLESM

SEQ ID NO: 14769 - protein, 81 aa, Ailuropoda melanoleuca
RPGAVSFADVAVYFSPEEWGCLRPAQRALYRDVMRETYGHLGALGFAGPKPALISWLERKKEVWSPEAEDPEEGARHPGSG

SEQ ID NO: 14770 - protein, 81 aa, Gorilla gorilla
FEELVTFEDVFVDFSPEELSSLSAAQRNLYREVMLENYRNLVSLGHQFSKPDIISRLEEEESHAMETDSRHTVICQGESHD

SEQ ID NO: 14771 - protein, 81 aa, Ailuropoda melanoleuca
QDWGTFEDVAVYFSREEWELLDETQRHLYHDVMLENLALVASLGLKTFRSCAVAHLEQDKEPWEPERVDISPYTAREGGRG

SEQ ID NO: 14772 - protein, 81 aa, Ailuropoda melanoleuca
SRVVFEDVAIYFSQEEWGLLDEAQRFLYHAVMLENFALLSSLGATSVLTSSSGEDPGHLVRGPYCASGKRHSEVHGPGVRE

SEQ ID NO: 14773 - protein, 81 aa, Lynx canadensis
PRVSLTFEDVAVLFTREEWRKLGPSQRNLYQDVMLENYSNLVSLGLLFSKPKVISLLQQGEDPWKVEKESPGGPSLGYKRS

SEQ ID NO: 14774 - protein, 81 aa, Ailuropoda melanoleuca
VKDSVTFKDVAIDFTLEEWRLMDPSQRNLHKDVMLENYRNLVSLGLAVSKPDMISHLEDGKGPWVVVREMARAPYPELETK

SEQ ID NO: 14775 - protein, 81 aa, Lynx canadensis
MVQNYENLVSLGLSIPKPYVISLLEDGKEPWMVQKKLSKDWESRWENKELLMKEDIYDEDSPQMVIIEKITKQSHEFSNFN

SEQ ID NO: 14776 - protein, 81 aa, Lynx canadensis
VQEPVTFKDVAVDFTQEEWGQLDPIQRTLYRDVMLETYGHLLSVGNQIAKPEVISLLEQGEEPWSVEQAYPQSTCPEWMRN

SEQ ID NO: 14777 - protein, 81 aa, Lynx canadensis
DTTVYLDVAIEFSQEEWGCLNQSQRELYRDVMLETYGHLLFLGEDNSFQTSQTSLAENHFESNKGEEVFYPNSKYTNSKST

SEQ ID NO: 14778 - protein, 81 aa, Lynx canadensis
SGKPGALSFADVAVYFSSEEWGCLRPAQRALYRDVMRETYGHLGALGPKPALISWMERKKEAWSPEAEDPEDRARHPGYGI

SEQ ID NO: 14779 - protein, 81 aa, Phyllostomus discolor
AWVPALFDEVAIYFSDEEWEVLTEPQKALYREVMRMNYETVLSLEFPFPKPDMISRLDGEAESQSPDAWQLQGGSFAEHEE

SEQ ID NO: 14780 - protein, 81 aa, Phyllostomus discolor
SRKARSGLTSRTVSSASRTLPFLETKRRKMTKFREAVTFMDVAVVFTEEELGLLDSVQRKLYRDVTLENFRNLVLVGFRTP

SEQ ID NO: 14781 - protein, 81 aa, Phyllostomus discolor
SQELVTFEDVAVYFIRKEWKRLEPAQRNLYRDVMLENYGNVFSLDGETRTEHDQEISEDTGSHGALLGRFQKDISQGLKLE

SEQ ID NO: 14782 - protein, 81 aa, Phyllostomus discolor
TKFREAVTFMDVAVVFTEEELGLLDSVQRKLYRDVTLENFRNLVLVGCLVASLTSAHYFKASGPLRDQSFPVCLQVETRRF

SEQ ID NO: 14783 - protein, 81 aa, Macaca fascicularis
AQESVMFSDVSIDFSQEEWECLNDDQRDLYRDVMLENYSNLVSMGHSISKPNVISYLEQGKEPWLVDRELTRGQWPVLESR

SEQ ID NO: 14784 - protein, 81 aa, Macaca fascicularis
SYQDSVTFDDVAVDFTPEEWALLDTAEKYYRDVMLENYMNLASVEWEIQPRIKGSSLQQGFLKNPIFNGIQMTRNYSGWKL

SEQ ID NO: 14785 - protein, 81 aa, Macaca fascicularis
QESVTFKDVAVDFTLEEWGWLEPDQRELYRDVMLENYRNLLSLGAGLPGSKPDVISRLERGEEPRPEEREAWRVTCPDLET

SEQ ID NO: 14786 - protein, 81 aa, Macaca fascicularis
DTVAFEDVAVNFTQEEWALLGPSQKNLYRYVMQETIRNLDCIRCHMLERFSESKDSSQCGETFSLIRGSIVNNSICPGEDP

SEQ ID NO: 14787 - protein, 81 aa, Macaca fascicularis
QTDSISLEDVAVNFTLEEWALLDPGQRNIYRDVMRATFKNLACIGEKWKDQDVEDDPKNQGRKPSSPMVETLCENKEDRLC

SEQ ID NO: 14788 - protein, 81 aa, Macaca fascicularis
HQELVKFRDVAVVFSPDEWDHLNPEERNLHRDVMLDNCKYLASLGNWTYKAHVMSSLKQGKEPWMMEREVTGVPCPACQPA

SEQ ID NO: 14789 - protein, 81 aa, Phascolarctos cinereus
SQESLTFKDVAVDFTPEEWGQLYPAQRDLYREVMLENYRNLVSLGHQVSKPHLISQLEQRKEPWMMERKIPRGNFPDWETR

SEQ ID NO: 14790 - protein, 81 aa, Phascolarctos cinereus
YKESVTFKDVAVDFTQEEWEQLNPFQRDLYRDVMLENYGNLVSLGLSISKPQVIFQLEQGKEPWIHKLQRTNVKHVPKIIS

SEQ ID NO: 14791 - protein, 81 aa, Phascolarctos cinereus
FQVLVTFTDVTVNFTHEEWSLLNPAQRGLYKDVMLENYENVVSLGFPVCEPDVISYLEQGEEAWVLDMQEAEEKEIMRGDC

SEQ ID NO: 14792 - protein, 81 aa, Phascolarctos cinereus
SWASSLGVCSSIISNMEEWTHLDPAQRELYGDVMLENYGNLVSLGLPVFKPDVISQLKLGGESWVLNDPGIKEKEIFRGVS

SEQ ID NO: 14793 - protein, 81 aa, Phascolarctos cinereus
FQASMMFEDVAVYLTREEWSHLGPAQRNLYKDVMLENYGNVVSLGFPVSKPNVISQLERGEEPWILDIQEAEGREMLRGDC

SEQ ID NO: 14794 - protein, 81 aa, Phascolarctos cinereus
MAAALLTARPQEEWGLLDPAQRRLYRDVMLENYGNVASLGLPVSKPDLISQLERTDLPLVPRLPQTEIEDLFDEKLDITFI

SEQ ID NO: 14795 - protein, 81 aa, Phascolarctos cinereus
FQESVTFKDVAVDFSWEEWGQLGPAQKELYREVMLENYRNLVCLGLAVSKPDVISQLERGGAPWIPEGEGPRCWCADWKTG

SEQ ID NO: 14796 - protein, 81 aa, Phascolarctos cinereus
CQETLTFKDVVVDFTRGEWQHLDPAQKDLYKEVMLDNYKNLVSLEFLSQMARYATAESTENPSFSPEESSKEGAETGGSWE

SEQ ID NO: 14797 - protein, 81 aa, Phascolarctos cinereus
MLDNYKNLVSLGIQVSKPDVIFQLERGESPSMLEGKDPSDPCLEFLSQMARYATAESTENPSFSPEESSKEGAETGGSWEY

SEQ ID NO: 14798 - protein, 81 aa, Phascolarctos cinereus
GKESVTFQDVAVEFSLEEWIHLNLSQKNLYRDVMLENYKNLVFLGSKGFTEEKFYKCGECGKTFRSKTQLTMHQSIHTGKI

SEQ ID NO: 14799 - protein, 81 aa, Myotis lucifugus
AAGPPGMAAPEPGGRAGEWEQLDPAQRSLYKDVMLENYSNLTSMGYQAAKPDMISKLEKGEEPCLGKRKRPRQGGPSEIAR

SEQ ID NO: 14800 - protein, 81 aa, Myotis lucifugus
ESVSFTDVTVDFTQEEWEQLDPSQRILYMDVMLENYSNLLSVEVWKADDQVQREHSDPEEQARPFIICKNQTPIEERSDLF

SEQ ID NO: 14801 - protein, 81 aa, Myotis lucifugus
LQVSVSLEDVTVDFSREEWQQLNSTQRRLYQEVMLENYSHLLSVGYEVPKPEVIFKLEQGEEPWILEGETPHQSCADGKFG

SEQ ID NO: 14802 - protein, 81 aa, Myotis lucifugus
DMIFDDLAITFSQDEWGLLDEDQKLLYCDVMLEVFALLSSVEDEHHKMDEKEAPRQSVSVGESQDRASKMAPATQKTYLCK

SEQ ID NO: 14803 - protein, 81 aa, Puma concolor
GRVTFEDVAVYFSGEEWGLLDEAQRCLYQDVMLETLAHITSLGCWHGAGDEDAPEQSVSVQGVSRGRTSKAAVSSQKAPPR

SEQ ID NO: 14804 - protein, 81 aa, Puma concolor
SQEPVTFEDVAVYFTQNQWTSLDPMQRALYREVMLENYANMTSLGAFPFPKPELILQLERGEAPWGLDPWTPMGGEAPGDV

SEQ ID NO: 14805 - protein, 81 aa, Sapajus apella
TARSQETVTFKDVAMDFTPEEWGKLDPAQRDVMLENYRNLVSLWLPVSKPENYTLENGKEPLKLERKAPKNSYSDMKTRPE

SEQ ID NO: 14806 - protein, 81 aa, Sapajus apella
GAVSFADVAVYFSPEEWGCLRPAQRALYRDVMRETYGHLGALGDAPNMKEEEPEEGPRSKAPRKAPMESPEVLVGRKPDLA

SEQ ID NO: 14807 - protein, 81 aa, Sapajus apella
SQGRVTFEDVTVNFTKGEWQQLNPEQRNLYRDVMLENYSNLVSVGQEETTKPNVILRLEQGKEPWSEEEEVLRRGHPEKNW

SEQ ID NO: 14808 - protein, 81 aa, Sapajus apella
MDSVVFEDVAVDFTLEEWALLDSAQRDLYRDVMLETFQNLASVDDETQFKASGSVSQQDIYGEEISKESKIAEFTRNVSWA

SEQ ID NO: 14809 - protein, 81 aa, Sapajus apella
SQGLVTFGDVAIDFSQEEWEWLSPIQRNLYRKVMLENYRNLASLGLCVSKPDVISLLEQGKEPWTVKRRMTRAGCPDLKAV

SEQ ID NO: 14810 - protein, 81 aa, Sapajus apella
AQESVTFEDVAVNFTDREWQCLTYAQRHLYKDVMLENYGNMVSVGFLFPKPPLISHLERGVEPCVQDPQDRESLSCSCLVS

SEQ ID NO: 14811 - protein, 81 aa, Sapajus apella
VTFGDVAVHFSREEWQCLDPGQRALYREVMLENHSSVAGLDSTIRTDNEQACEDMDILKSESSGTVVRISPQDFAQNPCFG

SEQ ID NO: 14812 - protein, 81 aa, Sapajus apella
MGPLTFRDVAIEFSLEEWQCLDTAQQDLYRKVMLENYRNVAFLGIAVSKPDLITCLEQGKEPWNMKRYEMVDEPPATCSYF

SEQ ID NO: 14813 - protein, 81 aa, Sapajus apella
AQMLVTFKDVAVTFTQEEWRQLDLAQRTLYQEVMLETCGILVSLGYWVPKPELVHLLEHGQELWTVKRGRSHPTCVGDKAQ

SEQ ID NO: 14814 - protein, 81 aa, Sapajus apella
GTVTFEDVAVNFSREEWSLLSEVQRCLYHDVMLENWVLISSLGCWYESEDEEAPSKQNISIQRVSQVSTRRAGVSLKKAHP

SEQ ID NO: 14815 - protein, 81 aa, Ailuropoda melanoleuca
AEGPVSFRDVAVDFTQEEWQQLEPDEKTTYRDVMLENYSHLVSVGYDSTKPNVILKLEQGEEPWVAEGELPCQSHPEEVWK

SEQ ID NO: 14816 - protein, 81 aa, Ailuropoda melanoleuca
ESVTFEDVAVDFTQEEWALLDRSQRRLFRDVMLENISHLVSIGRQLYKSDTISHLEPGEQLSKGIGLLQCQSLDREDDLKK

SEQ ID NO: 14817 - protein, 81 aa, Ailuropoda melanoleuca
DNSYEGSVSFRDVAVDFSREEWQHLDLAQRSLYRDVMLETYSHLLSVETGFEVPQPEVFMLEQGKEPWALQGESPHQNCPG

SEQ ID NO: 14818 - protein, 81 aa, Gorilla gorilla
GQLTFKDVAIEFSQEEWTCLDPAQKTLYRDVMLENYRNLVSLDISCKCVNTDLPPKGKNDMGEAFYTVKLERLESCDTAGL

SEQ ID NO: 14819 - protein, 81 aa, Gorilla gorilla
LGPVTFEDVAVLFTEAEWKRLSLEQRNLYKEVMLENLGNLVSLAESKPEVHTCPSCPLAFGSQQFLSQDELHNHPIPGFHA

SEQ ID NO: 14820 - protein, 81 aa, Gorilla gorilla
TGGDVTFSDVAIDFSHEEWACLDTAQRDLYKDVMVQNYENLVSVGLSVTKPYVIMLLEDGKEPWMMEKKLSKDWESRWENK

SEQ ID NO: 14821 - protein, 81 aa, Ailuropoda melanoleuca
HQDLVTFKDVAVYFTRTEWAGLYPAQKALYRSVMLENYGNLTSLGYPVPKPALISLLEGGNLPWGLEAQDNPSAERTKDIC

SEQ ID NO: 14822 - protein, 81 aa, Lynx canadensis
KPGALSFADVAVYFSSEEWGCLRPAQRALYRDVMRETYGHLGALGFAGPKPALISWMERKKEAWSPEAEDPEDRASRIRAK

SEQ ID NO: 14823 - protein, 81 aa, Phyllostomus discolor
AVTFKDVAVVFTEEELGLLDPSQRMLYREVTLENLRNLVSVGHWNQNKVESLQEVALRYLLHEDLVCWQIWDQLLSKLSGN

SEQ ID NO: 14824 - protein, 81 aa, Phyllostomus discolor
SQPPVSFKDVVVSFTREEWGQLDTVQRTLYRDVTLETCGHLVSLGLLLPNLDVISHLENGEDPWRAEQEPPTQDWKTTLEK

SEQ ID NO: 14825 - protein, 81 aa, Phyllostomus discolor
AAASVTFEDVAVHFSWEEWRLLDEAQRRLYLCVMLENFSLISSLGCCCGRKDVETPIKQNVSVRVSQTKNPKAASSSQKTH

SEQ ID NO: 14826 - protein, 81 aa, Macaca fascicularis
EKGPLTFRDVAIEFSLEEWQCLDTAQQGLYRKVMLENYRNLVFLAGIAVTKPDLITCLEQQKEPWNIKRHEMVAKPSVICS

SEQ ID NO: 14827 - protein, 81 aa, Macaca fascicularis
RVQSCVTFEDVFVYFSREEWELLEEAQRFLYRDVMLENFALVATLAFIFPVPCSCPVGRGRKPWVPDRADTTAATVKETCR

SEQ ID NO: 14828 - protein, 81 aa, Macaca fascicularis
QESVTLEDVAVDFTWEEWQLLGPAQKDLYRDVMLENYSNLVAVGYQASKPDVFFKLEQGEPPWTTEDGIHSGACSEIWKVD

SEQ ID NO: 14829 - protein, 81 aa, Macaca fascicularis
MGPLQFRDVAIEFSLEEWHCLDTAQRNLYKNVMLENYSNLVFLGIVVSKPDLITRLEQGKKPLTVKRHEMVAKPPGPGVIV

SEQ ID NO: 14830 - protein, 81 aa, Phascolarctos cinereus
FQESVTFKDVAVDFTWEEWGYLDTSQKELYWEVMLENYRNLVSLGLADSNVNIISQLESGEAHGIPVDRVLRSCWPDGDTR

SEQ ID NO: 14831 - protein, 81 aa, Macaca fascicularis
MLENYSNLVSVGYQLSKPSVISQLEKGEEPWMAEKEGPGDPSSDLKSKMETIESSAKSAISQECLYHGIMMERFMRDDIIY

SEQ ID NO: 14832 - protein, 81 aa, Phascolarctos cinereus
SARSQESVAFKDVVMDFTQEDLPQKDPYEDLMLEKYSNLVLLGLPVSKPDVNSELEQGEDSWIPRKEDPGSTCSDWETVPK

SEQ ID NO: 14833 - protein, 81 aa, Phascolarctos cinereus
QRESVTFSDVAVEFTCEEWRHLAPPQKELYRDVMLENYRNLVRLGLTVSKPDVISQLERREAPWTPGGIQRSSCPDWEATC

SEQ ID NO: 14834 - protein, 81 aa, Phascolarctos cinereus
MLENYRNLVFLGFAVSRPDVIYQLEKKETSWMPEPDIPRSSCLESREFTGHKPLECNECGKAFTCKTNLTRHQIIHAGEEP

SEQ ID NO: 14835 - protein, 81 aa, Phascolarctos cinereus
MLENYRNLVSVGHQVYKPNLISQLEQGEEPWIIDREIPRGAFPDWEIRPETKKSTAKQDISEEKLSQKVTVERFPKHSMWP

SEQ ID NO: 14836 - protein, 81 aa, Phascolarctos cinereus
PQESVTFKDVAMDFTWEEWGYLDTSQKELYWEVMLENYRNLVSLGLSDSSLDVISQLESGEAHGIPVDSVLRTCWPDWNAR

SEQ ID NO: 14837 - protein, 81 aa, Phascolarctos cinereus
AQELVTFKDVIVDFTPEEWGLLNHSQKELYKEVTLENAQNLLSLRIPVPREGSISHFGQGEAPWMLELEDLRTSCPDEETR

SEQ ID NO: 14838 - protein, 81 aa, Phascolarctos cinereus
TSKEPVTFRDVAVDFTPEEWGQLGPSQRQLYWDVMLETYWNLVSLGLSIPKPTAISHLEPEEPRTAEGETPSGPHPDWNTR

SEQ ID NO: 14839 - protein, 81 aa, Phascolarctos cinereus
AQELVTFKDVSVDFTQEEWGLLDHPQKELYKEVVVENAHNLLSLGRPVPRKDLMSYFEEKEAPWLLEQEGLRSCCPEGEIR

SEQ ID NO: 14840 - protein, 81 aa, Phascolarctos cinereus
CQESVTFKDIAINFTQEEWGQLSPAQRNLYKDVMLENYRNLISLGFSISKPDVIFKLEQGKDPWIFNLQRSEEEDMPKNSL

SEQ ID NO: 14841 - protein, 81 aa, Phascolarctos cinereus
PQESVTFEDVAVDFTWEEWGYLDTSQKELYWEVMLENYKNLVSLGFVVAKPDAISQLEQEEAPWRPEVLFPRSSCSDLDTK

SEQ ID NO: 14842 - protein, 81 aa, Phascolarctos cinereus
QEDPVTFQDVAVVFTQEQWGYLDPSQKELYRDVMLENYQNLLCLGLAVSKPEVICQLEQGEAPWRPEGRVPGSSHPDGEVR

SEQ ID NO: 14843 - protein, 81 aa, Myotis lucifugus
GLLFSKPKVISLLQQGEEPWKTEEESPGGAPLGWKSNHKTTKSTQTQDSLFQELIMKRSKRNGPWVFKSEKTCIYEDRLEK

SEQ ID NO: 14844 - protein, 81 aa, Myotis lucifugus
MNFEDLAIAFSQEEWNLLDEDQRLLYCEEMLEVFALVSSVGCWHKMDEEEVPPEQSVSVGESQDRASKTAPATQKTYLCKW

SEQ ID NO: 14845 - protein, 81 aa, Myotis lucifugus
LQVPLTFEDIAIYFSEQEWQDLEAWQKELYRRVMRTNYEILVSLDGGLPKPELISQIEQGRELFRNLGEPQKSGNVIFNPA

SEQ ID NO: 14846 - protein, 81 aa, Myotis lucifugus
MNFEDVAIAFAQEEWEILDEAQRRLYCDVMLEVFSLVSFVGPWRKMDDVEAYSQHSVSIGDSQVRASRTAAATQRTHLCKP

SEQ ID NO: 14847 - protein, 81 aa, Puma concolor
APVTMTFDDVALYFSEQEWEILEKWQKEMYQQVMKTNYETLDSLGGVFSKPDLITWMEQGRTLLIRDQGPLEKRMTLSPSA

SEQ ID NO: 14848 - protein, 81 aa, Sapajus apella
MGPLTFRDVKIEFSLEEWQCLDTAQRNLYRDVMLENYRNLAFLGIAISKPDLITWLEQGKEPWNMKSHAMVAKPPVIWSHF

SEQ ID NO: 14849 - protein, 81 aa, Sapajus apella
MGPLTFRDVTVEFSLEEWQFLDAAQQNLYRDVMLENYRNLVFLSIFSKPDMITCLEQGIQPWNIKRHEMVAKPPFTCSHFA

SEQ ID NO: 14850 - protein, 81 aa, Sapajus apella
MVENFKNLVAVGHLPFQPDMVSQLEAEEKLWMMEAETQRSSKHQNKMETLQKFALKYLSNQELSCWQIWKQVANELTRCLQ

SEQ ID NO: 14851 - protein, 81 aa, Sapajus apella
MELLTFRDVAIEFSLEEWQCLDTAQQNLYRNVMLENYRNLVFLGIAACKPDLITCLEKAKEPWKMKRHAMVDEPPGIFPHF

SEQ ID NO: 14852 - protein, 81 aa, Sapajus apella
SQELLTFKDISIDFTQEEWGQLTPAHQNLYREVMLENYSNLVSVAGYQLSKPVVISQLEKGEEPWMTEKEGPGDPSSDLKS

SEQ ID NO: 14853 - protein, 81 aa, Gorilla gorilla
QEPLSFKDVAVVFTEEELELLDSTQRQLYQDVMQENFRNLLSVGERNPLGDKNGKDMEYIQDEELRFFSHKELSSCKIWEE

SEQ ID NO: 14854 - protein, 81 aa, Gorilla gorilla
HLTFMDVAIEFSQEEWKSLHPGQRALYRDVMLENYRNLVFLGRSCVLGSNAENKPIKNQLGLTLEPHLSELQLFQAGRKIY

SEQ ID NO: 14855 - protein, 81 aa, Ailuropoda melanoleuca
QESLTFQDVAVNFTREEWDQLYPAQKNLYRDVMLENYRNLVALGHQLYKPEVISQLEQEEQWVMERGRALDTHADGESRPE

SEQ ID NO: 14856 - protein, 81 aa, Gorilla gorilla
PVTFRDVTVIFTEAEWKRLSPEQRNLYKEVMLENYRNLLSLAEPKPEFYTCSSCLLALSCQQFLSQHVLQVFLGLCAENHF

SEQ ID NO: 14857 - protein, 81 aa, Phyllostomus discolor
MAFKDVAVDFTQEEWMLLSPAQRSLYREVMLENYSNLVSLGIPFSKPKLITQLEQGKETWREERKCPPATCLGQPKPELHL

SEQ ID NO: 14858 - protein, 81 aa, Macaca fascicularis
MDSVVFEDVAVDFTLEEWALLDSAQRDLYRDVMLETFRNLASVDNKTHFKASGSVSQQDTYREEKSKEQTIPNFTRNNSCA

SEQ ID NO: 14859 - protein, 80 aa, Macaca fascicularis
VFQGPLTFMDVVIKFSPEEWQFLDTAQQNLYRDVMLENYRNLIFLDKTGIAVSKPDLMTCLEQGKEPWNMKRHEMMAKAP

SEQ ID NO: 14860 - protein, 81 aa, Macaca fascicularis
SPPESVSFKDVTVDFSRDEWQQLDLAQKSLYREVMLENYFNLISVGCQVPKPEVIFSLEQEEPCMLDGEISGQSHPDGDIG

SEQ ID NO: 14861 - protein, 81 aa, Macaca fascicularis
PQLPESLEDVAMYISQEEWGHQDPSKRALSRDTVQESYENVDSLESHIPSQEVPGTQVGQGGKLWDPSVQSCKEGLSPRGA

SEQ ID NO: 14862 - protein, 81 aa, Macaca fascicularis
SKGSVMFRDVSIDFSQEEWECLDSGQMNLYKEVMLENFSNLVSVGLSNSKPAVISLLEQGKEPWMVDRELTRGLCSDLESM

SEQ ID NO: 14863 - protein, 81 aa, Macaca fascicularis
SQASVSFKDVTIEFTQEEWQQMAPVQKNLYRDVMLENYSNLVSVGYCHFKPEVIFKLEQGEEPWFSEEEFSNQSHPKDYRG

SEQ ID NO: 14864 - protein, 81 aa, Phascolarctos cinereus
AQELVSFRDVAIHFTQEEWSHLHPTQKDLYWHVTLENCENLVSLGLPVSKLDVLSLLGRGNASWKPEGEESPQSTCPDSLN

SEQ ID NO: 14865 - protein, 81 aa, Phascolarctos cinereus
PQELVTFQDVAVDFTPEEWALLDHPQKKLYKDVMLENARNLLSLGLPVPREYGISYFEERERPLMLEQEGLRSSCPEGEMK

SEQ ID NO: 14866 - protein, 81 aa, Phascolarctos cinereus
LFPELVTFEDISVDFAKKEWKTSAPAQRAFFRDLMLENYRDVVSLGFPFSKPTGISRREEEPWGLNRQGPLDLEGGRSTCT

SEQ ID NO: 14867 - protein, 81 aa, Phascolarctos cinereus
QQELVTFKDVAVDFTPEEWGNLDSSQKALYKDVMLENYRNLVFLGLTVWKPDVISHLEEGEAPWMQDREVPKTINPDLETR

SEQ ID NO: 14868 - protein, 81 aa, Phascolarctos cinereus
GKESVTFQDVAVEFSLEEWIHLNLSQKNLYRDVMLENYKNLVFLGFAVSKPDVIYQLERKETSWMPEADIPRSNCPGSKGF

SEQ ID NO: 14869 - protein, 81 aa, Phascolarctos cinereus
RQGSLTFRDVAVKFTQKEWRHLAPFQKELYRDVMLENYRNLVCLGLTVSKPDVISQLERREAPWTPGGIQRSSCPDWEAAH

SEQ ID NO: 14870 - protein, 81 aa, Phascolarctos cinereus
APVPVTFDDVTMYFTEQEWRSLEEWQKELYKHVVKTNYETLVSLGCAFPKPDLITWIEQGEEPFIRGQGNLGTKDLAIGPR

SEQ ID NO: 14871 - protein, 81 aa, Phascolarctos cinereus
PQESVTFKNVAVAFGQEEWGHLDPTQKDVYRDVILEKYRHLVSMGLPISKPDVISQLERKEDPWMLGREVSRDAYPDWETK

SEQ ID NO: 14872 - protein, 81 aa, Phascolarctos cinereus
AQHPVTFRDVAVHFTREEWSHLGPAQRALYREVMLETFENLVSLGSPVSKPQVICQLERGEAPCLPETEAPRPESLNSGTK

SEQ ID NO: 14873 - protein, 81 aa, Phascolarctos cinereus
SVESVTFKDVAVEFTQEEWVQLNPSQKKLYRDVMLENYRNLVSLGFAVSKPNVICQLERKEASLLPEADIPRSSCPETREF

SEQ ID NO: 14874 - protein, 81 aa, Phascolarctos cinereus
WQESLTFKDVAVDFTQEEWGLLDHSQKKLYREVMLENSQSLLFVGIPVLREDLIFHFEEREASWILDQIGPRNSCPDADTR

SEQ ID NO: 14875 - protein, 81 aa, Myotis lucifugus
LVTFKDVLVNFTREEWKFLDAAQQVMYRDVMLENYRNLVSLGHRLPKPDVILQLEKGEEPWLVERGTHQGAHPDWDTAVEI

SEQ ID NO: 14876 - protein, 81 aa, Myotis lucifugus
MFQESLTFQDVAVDFTGEEWDQLCPSQKNLYRDVMLENYRNLVALGHQLYKPEVITQLEQEEQWMMERDSPLDTRPDAENR

SEQ ID NO: 14877 - protein, 81 aa, Myotis lucifugus
FEDVAIAFSQEEWGLLDEDQRHLYCDVMLEVFALVSSVGCWHKKEEEEECSDGSVSVQVESKFMASKTVPPTQKTHLCKHC

SEQ ID NO: 14878 - protein, 81 aa, Puma concolor
RPRAVKFADVAVYFSTEEWGCLHPAQRALYRDVMRETYGHLGALGCAGPKPALISWLERNTDDWEPAALDPQECPRGVAVQ

SEQ ID NO: 14879 - protein, 81 aa, Puma concolor
KSQRFVSFKDVTVDFTWEEWQQLDSAQRNLYRDVMLENYSNLVSVGYQYLKSDVVLLKQGEPWMEGGEISNWAYPDFETGM

SEQ ID NO: 14880 - protein, 81 aa, Sapajus apella
KVPVTFVDIAVYFSEDEWKNLDEWQKELYNNLVKENYKTLMSLDADGPVPKPDAPAQAEAREEPCVWEQRHPEEREIPMDP

SEQ ID NO: 14881 - protein, 81 aa, Sapajus apella
TKGCVTFEDIAIYFSQEEWGLLDEAQRILYLEVMLENFALVASLGCGHGTEDKKTPSEQNVSIGVSQSKAGSSTQNTQPCE

SEQ ID NO: 14882 - protein, 81 aa, Sapajus apella
CEISVSFEDVTVDFSKEEWQHLDPAQRRLYWDVTLENYNHLLSVGYQVPKSEATFKLEQGEGPWTLEGEAPHQSCSGEAIG

SEQ ID NO: 14883 - protein, 81 aa, Sapajus apella
VYVFQGVLTFMDVAIEFSLEEWQCLNTAQQNLYRNVMLENYRNLVFLGIAASKPDLITCLEQGKEPWNVTRHEMVAEPPGR

SEQ ID NO: 14884 - protein, 81 aa, Sapajus apella
VQESVTFRDVAVFFSPDEWLHLDCAQRALYREVMLENYSSLVSLGWESLFETIVSEEENQEVMKKLIIDGPFDFKLEKTYI

SEQ ID NO: 14885 - protein, 81 aa, Sapajus apella
MLENYRNLAFLGIAVSKADLITCLQQGKDPWNMKRHSVAAKPPVLCSNFGQDLWPRLGIKDSFQKVILRENGKCGHKDLQL

SEQ ID NO: 14886 - protein, 81 aa, Sapajus apella
ETGPLTFRDVAIEFSLEEWQCLNPAQQDLYRKVMLENYRNLVFLGLAVSTPDWITCLEQGKDPWNMKRHSMVATPPVLCSH

SEQ ID NO: 14887 - protein, 81 aa, Sapajus apella
KPGAVRFGDVAVYFSREEWGCLRPAQRALYRDVMRETYSHLGALGVGGSKPALISWVEEEAELWVPAAQDPEVAKRPTEAD

SEQ ID NO: 14888 - protein, 81 aa, Oryctolagus cuniculus
AQVSVTFKDVALTFTQEEWGQLDVAQRTLYQEVMLETCELLVSLGCPLSQPELIHQMEHNPEVWMAMKELSQSFCPGENTK

SEQ ID NO: 14889 - protein, 81 aa, Oryctolagus cuniculus
PQESFSFEDLSVGFTRKEWQLLDPQQKKLYKDVMLENFSNLVSLGYEVMKPDVIFKLEQGEEPWIEDGEMPLPDSAEEVWQ

SEQ ID NO: 14890 - protein, 81 aa, Canis lupus
SKDLVTFGDVAVDFSQEEWEWLNPGQRNLYRKVMLENYRSLVSLAGVSVSKPDVISLLEQGKEPWMVKKEGTRGPCPDWEY

SEQ ID NO: 14891 - protein, 81 aa, Canis lupus
FQEPVMFKDVAVVFSEEELGLLDSTQRKLYRDVMLENFRNLVSVGHSSSKPDVISQLEREEKLCTKEFHTQGGGRNQKEME

SEQ ID NO: 14892 - protein, 81 aa, Canis lupus
CELSVSFEDVTVDFSREEWQQLDSTQRRLYQDVMLENYSHLLSVGYEVPKPEVIFKLEQGEEPWILERKTPHQSCSDLLNR

SEQ ID NO: 14893 - protein, 81 aa, Muntiacus muntjak
ISGSLSFRDVTVGFTQEEWQHLDPAQRMLYRDVMLENYSHLISVGYCIPKPEVILKLEQGEEPWILEEEYSSQSVPELINS

SEQ ID NO: 14894 - protein, 81 aa, Canis lupus
SQGSVLFEDISVDFTQKEWQLLDPAQRLLYRDVMLENYRHLVSLGHCVTKPELIFKLEQGEEPWVPKKELPSQSCPEVQEA

SEQ ID NO: 14895 - protein, 81 aa, Canis lupus
LQKPITFEDVAVNFTQEEWMCLDASQRVLYQDVMSETFRNLMSVAQNLSNPDLIIKLGQEESQQRAEFQAPVIPASRAGRP

SEQ ID NO: 14896 - protein, 81 aa, Muntiacus muntjak
DCVVFEDVAVYFSQEEWGLLDEAQRHLYRAVMTENLALVTSLGCWHGAQGEEPSSEQGVSIGMSEVRTAKPDPSSRKAQPS

SEQ ID NO: 14897 - protein, 81 aa, Muntiacus muntjak
FQVPLTFSDVSIDFSQEEWECLNSDQKNLYRDVMLETYTNLVSLDFDFTTENNKLSSEKSSFEVNSYHWETMKSKTFNLMG

SEQ ID NO: 14898 - protein, 81 aa, Muntiacus muntjak
MAFRDVAVDFTQDEWVLLSPAQRSLYREVMLENYSNLVSLGIPFSKPKLITQLEQGKETWREERKCSPVSCVEPKPELHLC

SEQ ID NO: 14899 - protein, 81 aa, Ailuropoda melanoleuca
FQESVTFKDVIVDFTQEEWKQLDPVQRDLFRDVTLENYTHLVSIGLQVSKPDVISQLEQGTEPWIVEPGIPVGTLGDYETR

SEQ ID NO: 14900 - protein, 81 aa, Macaca fascicularis
WSQMPVTFEDVALYLSREEWGRLDHTQQNFYRDVLQKRNGLSLGFPFSRPFWAPQALGKGEASGSSRQTGDEKEEWRGAYS

SEQ ID NO: 14901 - protein, 81 aa, Macaca fascicularis
KKKPVTFEDVAVNFTQEEWDCLDASQRVLYQDVMSEIFKNLASVARIFLHKPELITKLEQEEEQWREFVHLPNTEGLSEGK

SEQ ID NO: 14902 - protein, 81 aa, Macaca fascicularis
KPRTVSFADVAVYFSREEWGCLRPAQRALYRDVMRETYGHLGALGVGGSKPALISWVEEEAELWDPAAQDPEVTKCPTETD

SEQ ID NO: 14903 - protein, 81 aa, Macaca fascicularis
GSVTFEDVAIYFSQEEWGLLDEAQRLLYRDVMLENFALITALVCCHGMEDEETPEQSVSVERVSQVRTPEASPSTQKTQSC

SEQ ID NO: 14904 - protein, 81 aa, Macaca fascicularis
PQGLLTFRDVAIEFSQEEWKCLDPAQRTLYRDVMLENYRNLVSLAISSKCMMKFSSTGQGNTEVIHTGTLQRQASHHIGDI

SEQ ID NO: 14905 - protein, 81 aa, Macaca fascicularis
FQEMVTFKDVAVVFTEEELGLLDSVQRKLYRDVMLENFRNLLLVAHQPFKPDLISQLEREEKLLMVETETPKDGCSGRKNQ

SEQ ID NO: 14906 - protein, 81 aa, Macaca fascicularis
FSREPVCPFEEKTKVERMVEDYLANSYQDSVTFDDVAVEFTPEEWVLLDTTQKYLYRDVMLENYMNLASVADKKLQWMETL

SEQ ID NO: 14907 - protein, 81 aa, Phascolarctos cinereus
PKVPLTFDDVAVYFSEQEWGKLEEWQKELYKHVMRGNYEMLVSLDYAVSKPDILSQIERGEKPCLKDQWGSDEEVSCPGKL

SEQ ID NO: 14908 - protein, 81 aa, Phascolarctos cinereus
MLENYRNLVCLGLAVSKPRVIYQLEQGKVPWMPEGDIPRTPYPDWDTGPETMESAPKMDISMEKSFQEKFERSSLFLSKFE

SEQ ID NO: 14909 - protein, 81 aa, Phascolarctos cinereus
PQELVTFQDVAVDFTPEEWVFLDHPQKELYKEVMLENARNLLSLGLPVSREYWISCFDERKAPWMLEQEGLRSCCPEGEIR

SEQ ID NO: 14910 - protein, 81 aa, Phascolarctos cinereus
FQESVAFKDVAVDFTQEEWGQLDPAQRDLYRDVMLENYGNLVSLGFPVSKPYVISQLEQGEEPWVVEREVSRGICLDLGTR

SEQ ID NO: 14911 - protein, 81 aa, Phascolarctos cinereus
QESVTFRDVAVDFTQEEWGLLGPDQKELYREVMLENYWNLVCLGWESMFETKVSILTPEQSSQKRLTRDGLCASNLEESWK

SEQ ID NO: 14912 - protein, 81 aa, Phascolarctos cinereus
FQESLTFKDVAVEFTWEEWRHLDPAQRTLFREVMLENYGNLVSLGLTVTKPDVIFQLERGEAPWMLEIKVPSSTPAECLNL

SEQ ID NO: 14913 - protein, 81 aa, Myotis lucifugus
MNFEDLAIAFSPGEWGILDEAQRLLYCKVMLEVFALGSSVGYWHEKDDYEACSNQSVSVEGESQVRASETAPATQKNHPCK

SEQ ID NO: 14914 - protein, 81 aa, Myotis lucifugus
QDMNFEDVAIAFSQEEWGLLDEAQRHLYCDVMLEVFALVSFIGHCHKIDDVEAYSEHSVSVGESQVRASRTAAATQRTHLC

SEQ ID NO: 14915 - protein, 81 aa, Myotis lucifugus
VTLEDVAVHFSREEWRLVDEAQRRLYLRVMLENFALVSSLGCCCGADDVEAPGEQRVSVGMSQGKNPQTASSSQKRHPCES

SEQ ID NO: 14916 - protein, 81 aa, Myotis lucifugus
EPVTFKDVAVVFSEEELGLLDSVQRKLYRDVTLENFQNLVSVGHLFSKPDVISQLEREEQLWMTEIQTQRGGRNENEMETL

SEQ ID NO: 14917 - protein, 81 aa, Gorilla gorilla
FLLWLCSFQPFPRAAENEQVPGYHVNKPNAVFKLKQGKEPWILEVEFPHRGFPEDLWSIHDLEARYQESQAGNSRNGELTK

SEQ ID NO: 14918 - protein, 81 aa, Ailuropoda melanoleuca
QDSVVFEDVAVDFTQEEWALLDLAQRSLYRDVMLENFQNLASLALTGYPLHTPYLISQWKQEEDLETVERGPIQGEHQEGF

SEQ ID NO: 14919 - protein, 81 aa, Ailuropoda melanoleuca
QGLLTFKDVAIEFSQEEWGCLSHTQRELYRDVMLENYGHLLFLETGFILSKPDLITFLEQEKQLWDVKRKETVAFHPGRET

SEQ ID NO: 14920 - protein, 81 aa, Gorilla gorilla
SVAFEDVAVNFTQEEWALLSPSQKNLYRDVTLETFRNLASVGIQWKDQDIENLYQNLGIKLRSLVERLCGRKEGSEHRETF

SEQ ID NO: 14921 - protein, 81 aa, Lynx canadensis
QKFQGSVSFKDVTVGFTQEEWQCLDSSQRSLYRDVMLENYSHLVSVGKDCFYIIPSSIYFLPWRLDKKSKSKGRRQENQRK

SEQ ID NO: 14922 - protein, 81 aa, Lynx canadensis
FQELVTFQDVAVDFSLEELTYLSAAQRNLYREVMLENYRNLVSLGYQFSKPDIISQLEEEESHVMEADSDTEMHHGESSPD

SEQ ID NO: 14923 - protein, 81 aa, Lynx canadensis
GLLDPTQRKLYREVMLENFGNLVSVGHQPFKRDMVHLVREGKFWMMKLATQGKGSSGKIQTIPKVEPHEELSCWQIWQHIA

SEQ ID NO: 14924 - protein, 81 aa, Lynx canadensis
RPESVTFEDVAVYFSENEWIGLAPAQRVLYRDVMLENYGVVASLAFPFPKPALISQLERGEAPWCKAPQGALDGECPRGVS

SEQ ID NO: 14925 - protein, 81 aa, Lynx canadensis
GCVTFEDVFVYFSREEWELLEEAQRLLYRDVMLENFALVASLDGWREADNGETPEQNVFVGVSQLRTPESGLFIQKAHPCE

SEQ ID NO: 14926 - protein, 81 aa, Lynx canadensis
SQGTVTFRDVAIDFTQEEWQQLDLAQRNLYRNVMLENYNNLITVGCPFTKPDVIFKLEQEEEPWVVEEEVLRRHCPGEVWG

SEQ ID NO: 14927 - protein, 81 aa, Lynx canadensis
TQDSVVFEDVAVDFTQEEWALLDLAQRNLYRDVMLENFQNLASLGYPLHTPYLISQWKQEEDLETVERGPIQGEHQEGFET

SEQ ID NO: 14928 - protein, 81 aa, Lynx canadensis
FEGSVSFEDVAVDFTRQEWHRLDPAQRTMHKDVMLENYSNLASVGLCVAKPEMIFKLERGEELWILEEESSGQGFPGSLSL

SEQ ID NO: 14929 - protein, 81 aa, Lynx canadensis
LKPAQRNLYRDVMLENYSNLVTVGYQVTKPDVIFKLEQEEEPWVIEEEMLGRHCPEVWEVDEQQIKKQQEALVRKVTSISK

SEQ ID NO: 14930 - protein, 81 aa, Lynx canadensis
LLQESVTFKDVVVLFTQDEWAQLSPTQRALYRDVMLENYSNLVSLGLLGPQPDVLSQLGKGEEWMLEDTSAGFCLDWMTMP

SEQ ID NO: 14931 - protein, 81 aa, Phyllostomus discolor
AQLSLTFRDVSVDFSGEEWECLDPAQQKLYMDVMLENYKNLVSLGLTLSKPILVTCLEQMKECWDVNRKQTISVHPAMSSK

SEQ ID NO: 14932 - protein, 81 aa, Lynx canadensis
SSGSLSFRDVAVGFTRKEWQHLDPAQRTLYRDVMLENYSHLVSVGCQVTKPAVISRLERGQEPWMEEEELVRWSFPEAILQ

SEQ ID NO: 14933 - protein, 81 aa, Lynx canadensis
TARSQASVTFKDVAMDFTPEEWGKLDPAQREVMLENYRNLVSLWLPVSKSENYSLESGKEPLMLERKAPKSSYSDLEAKPE

SEQ ID NO: 14934 - protein, 81 aa, Lynx canadensis
LQSPVTFEDVAVYFSKEEWGLLDAGQRDLYHNVMLENFELMTSLGCWHGVEDEGAHSKQNASIQGMLQVRIPTANPSTQKA

SEQ ID NO: 14935 - protein, 81 aa, Lynx canadensis
GCLNQSQRELYRDVMLETYGHLLFLGLIVSKPHLVIFLEQKRELWDVKREKTVSTDWNDVPFFVICYLSAISSHGSQSFLP

SEQ ID NO: 14936 - protein, 81 aa, Phyllostomus discolor
WSQMPVTFEDVALYLSREEWGRLDHPQQSFYRDVLQKRNGLALGFPLSRTFWASQVQGKGEASSWCLQMGEEEKRGMADVR

SEQ ID NO: 14937 - protein, 81 aa, Phyllostomus discolor
SQECLTFKDVSVDFSWEEWGCLDPAQRKLYSDVMLENYSNLVSLGLVVSKPVLVTFLEQMQESWDVSRKKSISTAPAVSSV

SEQ ID NO: 14938 - protein, 81 aa, Phyllostomus discolor
LVAFEDVSVKFTLEEWALLDSSQKKLYRDVMRETFRNLASIGEICKDRDIEDHYKHHGTNLSHKVERLGKSKQGSQCGENF

SEQ ID NO: 14939 - protein, 81 aa, Phyllostomus discolor
PKVPVTFDDISIYFSTPEWEKLEEWQKELYKNIMKGNYESLISMDYAMNQPDVLSQIQPEGEHNTEDQAGPEESAIPTDPS

SEQ ID NO: 14940 - protein, 81 aa, Desmodus rotundus
RVTFEDVVVYFSWEEWGLLDETQRCLYHDVMLENFALVTSLGSWYGMEEEALSVQSVSVAQTSPSQTPDSDPAVQEDHPCE

SEQ ID NO: 14941 - protein, 81 aa, Phyllostomus discolor
AEVGVTFADIALYFSGEEWCLLNEDQRCLYLDVMLDNFELASSLGCCCGAEDVETPIEQTVPVAVSQAKNLKVALSSVKSL

SEQ ID NO: 14942 - protein, 81 aa, Macaca fascicularis
KPGAVSFADVAVYFSPEEWGCLRPAQRALYRDVMRETYGHLGALGFPGPKPALISWMEQETEAWSPAAQDPEKGERLGGAR

SEQ ID NO: 14943 - protein, 81 aa, Macaca fascicularis
PAQGMTFEDVAIYFSQEEWELLDESQRFLYCDVMLENFAHVTSLGYCHGTENEVIASEQSVSTQVRTSKGDTPTQKSLSEI

SEQ ID NO: 14944 - protein, 81 aa, Macaca fascicularis
VKIEEVADVAVSFILEEWGHLDQSQKSLYRDDRKENYGSITSMGYESRDNMELIVKQISDDAESHWVAPEHTERSVPQDPD

SEQ ID NO: 14945 - protein, 81 aa, Macaca fascicularis
IQSQISFEDVAVDFTLEEWQLLNPTQKNLYRDVMLENYSNLIFLEVWLDNPKMWLRDNQDNLKSMERGHKYDVFGKIFNSN

SEQ ID NO: 14946 - protein, 81 aa, Macaca fascicularis
VTFEDVTIIFTWEEWKFLDSSQKRLYREVMWENYTNVMSVENWNKSYKSQEEKFRYLEYENFSCWQGWWNAGAQMCENQNY

SEQ ID NO: 14947 - protein, 81 aa, Macaca fascicularis
CQESVTFEDVAVVFTDEEWSHLVPIQRDLYKEVMLENYNSIVSLGLPVPQPDVIFQLKRGDKPWVVDLHGSEERERPESVS

SEQ ID NO: 14948 - protein, 81 aa, Macaca fascicularis
VAFEDVAIYFSQEEWELLDETQRLLYHDVMLENFAVMASLGCWCGAEDEGAPSAESISVSELSQGRTPKADTSTDKSHPCE

SEQ ID NO: 14949 - protein, 81 aa, Phascolarctos cinereus
PQEAVTFKDVVVDFTQEEWKCLDSSQKEFYRDVMLENYSNLVSLGLAFPKPYVIDQLERREAPWIPEGDIPRISHPERKKK

SEQ ID NO: 14950 - protein, 81 aa, Phascolarctos cinereus
SQKSLTLKDMAVEFTREEWEQLDPAQRNLYRDVMLERYRNLVLLGLPISKPDVISQLEREKEPWMLERKDPKGGHLDWDIR

SEQ ID NO: 14951 - protein, 81 aa, Phascolarctos cinereus
PRGLVTFKDVAVDFTQEEWGLLDHNQKELYKEVMLENARNLLSLGLPVPREDVISYFEQREAPWMLEQEGLRSRCLEGEIR

SEQ ID NO: 14952 - protein, 81 aa, Macaca fascicularis
IVLFQISFEDVAVDFTLEEWQLLNPTQKNLYRDVMLENYSNLIFLEQQDPWIIEVWLDNPKMWLRDNQDNLKSMERGHKYD

SEQ ID NO: 14953 - protein, 81 aa, Phascolarctos cinereus
PALTAGPRKESVTFKDVAVEFTQEEWVQLNPSQKKLYRDVMLENYKNLVSLALPSVAFALPQEDSLEEEGMASAPKPGPGK

SEQ ID NO: 14954 - protein, 81 aa, Phascolarctos cinereus
LQTSLMFKDVAVYLTREEWGCLGPAQRGLYRDVMLENYGNLVSLGFSVSKPDIISQLEKGEEPWVLDTQGAGGRDIMKSDY

SEQ ID NO: 14955 - protein, 81 aa, Phascolarctos cinereus
SVTFQDVAVTFTPEEWGRLAAPQKELYREVMLENFGHLACLDLEVIFETKASTPKLDISIEESSLERIKRELPCVSKLGET

SEQ ID NO: 14956 - protein, 81 aa, Phascolarctos cinereus
KQGLVRFRDVAVDFTPEEWGCLAPSQKELYRDVMLENYLNLACLGLAVSKPAVICQLEQGAAPWLPEGDASVRCCPDWEIN

SEQ ID NO: 14957 - protein, 81 aa, Phascolarctos cinereus
PQEAVTFNDVAVDFTQAEWRHLDPSQKELYRDVMLENYRNLVSLVGLPVSKPEVISQLEQGERPWIMESEELRDWKTRSKT

SEQ ID NO: 14958 - protein, 81 aa, Phascolarctos cinereus
TAGPGKESVTFKDVAVEFTQEEWVQLNSSQKKLYKDMMLENYRNLVSLDVIYQLERKEASWMPEADIPRSSCPERRGFTGD

SEQ ID NO: 14959 - protein, 81 aa, Phascolarctos cinereus
ALESVTFKDVAVDFTQEEWGWLDPSQRELYKEVMLENYRNLLSLGFPVPKPDVISQLERGAAPGMLEREGPRASRPDWETR

SEQ ID NO: 14960 - protein, 81 aa, Phascolarctos cinereus
MELVFFEDVAVYLTREEWGLLDPAQKQLYKDVMLENYWILISLGFPISKPEVICQLEQGKEAWVLDIQVPKESMLSRNTYR

SEQ ID NO: 14961 - protein, 81 aa, Phascolarctos cinereus
GKETVTFKDVAVEFTWEEWVHLNPSQKTLYKDVMLENYRNLVSLGFGISKPDVIYQLERKEATWMQEPDILRSSWPGREEF

SEQ ID NO: 14962 - protein, 81 aa, Phascolarctos cinereus
GQESVTFTDVAVDFTLEEWAYLDHFQKELYKDVMLENYRNLLCLGLAVSKPDVISQLEQGDAPWMSEGGVPRSIYSDWETR

SEQ ID NO: 14963 - protein, 81 aa, Phascolarctos cinereus
CQVSLTFQDVAVDFSQEEWGLLEPAQKDMYRDVMLENYENFISLGLPISKPSILSQLERRETPWIAEEKVSLSAYLGSLGQ

SEQ ID NO: 14964 - protein, 81 aa, Canis lupus
GSVSFTDVTVDFTQEEWEQLDPSQRILYMDVMLENYSNLLSVEVWKADDQMERDHSNPDEQARPFIIFKNQTPIEERGNLF

SEQ ID NO: 14965 - protein, 81 aa, Canis lupus
MLENYGNLVSVGYQLSKPGVISQLEKGEEPWLIKRVISGSPSSALLSQDAKTQGESSKDGFTSRLPAAESQELLTFQDVSV

SEQ ID NO: 14966 - protein, 81 aa, Canis lupus
MTFEDVAIDFTLEEWALLNSHQRKLYRDVMLENYRNFASLGKTPHQSLHPGKVLGDCSQLNPRESILSRENDCKKDKNTFI

SEQ ID NO: 14967 - protein, 81 aa, Muntiacus muntjak
MLENYGHLVSLGLNISKPDVVSLLEQGKEPWLGNGDVSRELFPASKPNGEIKAFSPKNVIFEDNSSQYLMMERFLSQGSEY

SEQ ID NO: 14968 - protein, 81 aa, Muntiacus muntjak
KVESVKFRDVAVVFSPDQWVHLSPEKRELYRDVMLDTCDHLVSLGRWAYKAEVMSSLRQGKEPWMLEREVTSAPCPACQPA

SEQ ID NO: 14969 - protein, 81 aa, Muntiacus muntjak
RLLTFRDVTIDFTLEEWGCLDLSQRELYRDVMLENYRNLASLGLVVVKPDLVIFLEQRKHLWDVRRMETTATYPDNDSKSN

SEQ ID NO: 14970 - protein, 81 aa, Canis lupus
SHGPLSFEDVAVAFTKEEWQQLDPAQRTLYRDVMLENFSHLVSLGHPVSKPDVISKLEQGEEPWIIKRDIPNWIYPERENR

SEQ ID NO: 14971 - protein, 81 aa, Canis lupus
SQESVTFQDVAVDFTEKEWPLLDSSQRKLYKDVMLENYSNLASVGYQVGKPSLISHLEQEEELRTEERELHQATSPDWETP

SEQ ID NO: 14972 - protein, 81 aa, Muntiacus muntjak
YCFTKPELIFMLEQGADPWLLEKEFINRSSPEESQPDELLEESLENQGKRLRQVLFINKSLTVEQEISGKPCTLDINIFPA

SEQ ID NO: 14973 - protein, 81 aa, Muntiacus muntjak
MMFSDVAVDFSHEEWECLDLEQRHLYSDVILENYSNLVSLGLCFYHPEVFSLLEKEREPWMALKDETCPDIQCRCQTKKLS

SEQ ID NO: 14974 - protein, 81 aa, Desmodus rotundus
VSFRDVAVDFTQEEWQQLDPVEKTTYRDVMLENYSHLVSVGYDSTKPNVIVKLEQGEEPWVAEGDFPCQSCPEEIWKADDV

SEQ ID NO: 14975 - protein, 81 aa, Macaca fascicularis
SYEGSVSFRDVAIDFSREEWRHLDPSQRNLYRDVMLETYSHLLSVGYQVPKPEVVMLEQGKEPWALQGERPRQSCPGEKLW

SEQ ID NO: 14976 - protein, 81 aa, Macaca fascicularis
QGLLTFRDVAVEFSLEEWQRLAAAAAAAAAAAAAAAAAAAAAAIAVSKPDLITCLEQEKEPLTMQRHEMVDEPPVMCSHFA

SEQ ID NO: 14977 - protein, 81 aa, Macaca fascicularis
MAQVTFSDVAIDFSHEEWAWLDSAQRDLYKDVMVQNYENLVSVGLSITKPYVIMLLEDGKEPWMVEKKLSKGMIPDWESRW

SEQ ID NO: 14978 - protein, 81 aa, Macaca fascicularis
ALRSVMFSDVSIDFSPEEWEYLDLEQKDLYRDVMLENYSNLVSLGCFISKPDVISLLEQGKEPWKVVRKGRRQYPDLETKY

SEQ ID NO: 14979 - protein, 81 aa, Macaca fascicularis
MELLTFRDVAIEFSPEEWKCLDPAQQNLYKDVMLENYRNLVSLAMCSPFSQDLSPVQGIEDSFQKLVLRRYEKCGYENLQL

SEQ ID NO: 14980 - protein, 81 aa, Phascolarctos cinereus
RAGLVTFEDVSVDFSRSEWKQLKPAQRDLYKDVMLENYKNLVSLGLQSFKPEVISRLEQGEVPWILADHVPKDSLHHKTIC

SEQ ID NO: 14981 - protein, 81 aa, Phascolarctos cinereus
MLENYSNLLYLGLVISKPDVIHQFEQEAPWRPDRRVPGSVCPAEETGPECKESTPKWNISVEHSSPNRLTSSGLCVFSLKE

SEQ ID NO: 14982 - protein, 81 aa, Phascolarctos cinereus
SQELVTFEDVAVYFIRKEWKRLDPAQRDLYRDVMLENYGNVFSLGFPFPNPEIISHLDGEEEPWVLDLKGAESQGLQSASC

SEQ ID NO: 14983 - protein, 81 aa, Phascolarctos cinereus
CQEPVTFRDVAVDFTPEEWGQLGLAQRELYQDVMLENYRNLVSLGLPVSTPKVICHLEPRDEPWRAQGAAPPSTWSDWESK

SEQ ID NO: 14984 - protein, 81 aa, Phascolarctos cinereus
QKESVTFKDVTVHFTQEEWGNLDPSQKELYKDVMLENYKNLVFLGLTVWKPDVISHLEEGETPWIQDSEVLWSTSPDWMTG

SEQ ID NO: 14985 - protein, 81 aa, Phascolarctos cinereus
SQKSLTFKDVAVDFTKEEWRQLNPSQRDMYRDVMLENYKNLVFLGLLGSQPDVISQLEKGEMPWMPEGEVPRSPCLDSLIQ

SEQ ID NO: 14986 - protein, 81 aa, Phascolarctos cinereus
PQELVTFKDVTVDFTWEEWGCLYPSQKKLYHDVMLENYRNLICLGLEVSEPHVIYQLEHGEAPLKLEGDIPRTSRPGRGMS

SEQ ID NO: 14987 - protein, 81 aa, Phascolarctos cinereus
AQESVTFKDVAVEFTEEEWRHLDPAQRNLFRAVTLENYRNLVSLGQRITKSDLIFLLERGEAPWTEWSQAPGGSNSNSLIL

SEQ ID NO: 14988 - protein, 81 aa, Gorilla gorilla
QGRLTFRDVAIEFSLAEWKFLNPAQRALYREVMLENYRNLEAVDISSKCTMKEVLSTGQGNREVIHTGMLQRHESHHIGDF

SEQ ID NO: 14989 - protein, 81 aa, Ailuropoda melanoleuca
VKIEDVADVAVSFILEEWGHLDQSQKSLYRDDRKENYGSITSMDYESGHDNVELAVKQISDDTEPHWMTSGSPERNVPQSQ

SEQ ID NO: 14990 - protein, 81 aa, Ailuropoda melanoleuca
QESLTLEDVAVDFTWEEWQLLAPAQKELYRDVMLENYSNLVSVGYQASKPDALSKLERGEEPWAKQEEVPSGTRPGHWENP

SEQ ID NO: 14991 - protein, 80 aa, Ailuropoda melanoleuca
HVLQGLLTFGDVAIEFSQEEWRCLSHTQRELYRDVMLENYRHLVFLETGLIVSKPDLVSFLEQEKQLWGVKRKETVAFHP

SEQ ID NO: 14992 - protein, 81 aa, Gorilla gorilla
EPVTFEDVAVDFTQEEWQQLNPAQKTLHRDVMLETYNHLVSVGCSDIKPDVIFKVEHGKDPWIIESELSRWIYPDRVKGLE

SEQ ID NO: 14993 - protein, 81 aa, Ailuropoda melanoleuca
GQISISKIAISFEDVAVDFTSEEWQLLNPTQKSLYRDVMLENYSNLVFLGKNIHMMCPLCTELVMACTSFPIQRHKLVATI

SEQ ID NO: 14994 - protein, 81 aa, Ailuropoda melanoleuca
YQELVTFRDVAVDFSQEEWDCLNSSQRHLYSNVMLENYRILVSLGLCFSKPSVILLLEQGKEPWMVKRELAKGLCSGWESM

SEQ ID NO: 14995 - protein, 81 aa, Ailuropoda melanoleuca
STEPVIFRDVAMYFTQKEWQLLEPTQKDLYREVMLENYGNLASLGYRLFKPKLITRLEQGDEPCVKERDIPRAPQQGDAGI

SEQ ID NO: 14996 - protein, 81 aa, Ailuropoda melanoleuca
LQGLLTFGDVAIEFSQEEWRCLSHTQQELYRDVMLENYGDLLFLDFILLKPDLIMVLEQEKQLWDVKRKETVAFHPGRETS

SEQ ID NO: 14997 - protein, 81 aa, Ailuropoda melanoleuca
SKVPVTFGDLAIYFSQEEWEWLSPIQKDLYEDVMLENYQNLVSLGLSFRRPNVITLLEKGKAPWMVEPVRKRRGVDSGSKC

SEQ ID NO: 14998 - protein, 81 aa, Ailuropoda melanoleuca
YQRPVSFKDVVVGFTQEEWHRLNPAQRALYRDVMLETYSNLVSVGYEGTKPYVILKLEQEEAPWICEAACSGCPCQENISQ

SEQ ID NO: 14999 - protein, 81 aa, Lynx canadensis
RPRAVKFADVAVYFSTEEWGCLRPAQRALYRDVMRETYGHLGALGCAGPKPALISWLERNTDDWEPAALDPQECPRGVAVQ

SEQ ID NO: 15000 - protein, 81 aa, Lynx canadensis
GSPLACGSTVPPSRQGCVTFEDVFVYFSREEWELLEEAQRLLYRDVMLENFALVSSLGLAVSRTHVVSQMQPEGNAGCLRR

SEQ ID NO: 15001 - protein, 81 aa, Lynx canadensis
LQGLVTFEDVAVYFSREEWGLLNLTQRSLYRDVMLENFALIGSLGFASSRCHVVAQLQSEEEFWVPSMVDLTLVSRVEARS

SEQ ID NO: 15002 - protein, 81 aa, Lynx canadensis
SYEGSVSFRDVAVDFSREEWQHLDLAQRNLYRDVMLETYSHLLSVGYEVPQPEVFMLEQGKEPWALQGESPHQSCSGEKLW

SEQ ID NO: 15003 - protein, 81 aa, Lynx canadensis
CWGLLSFKDISMEFTWDEWQLLDSAQKYLYRDVILENYSHLVSVGYHGTKPDLIFKLEQGEEPWIINAKVSRQSCPEDWKE

SEQ ID NO: 15004 - protein, 81 aa, Lynx canadensis
FQESLSFEDVAVYFTREEWDKLDWAQKDLYRDVMLENYRNMILLGFQFPKPEVICLLEQWEEPWILDLPRTGTRKASSSAC

SEQ ID NO: 15005 - protein, 81 aa, Phyllostomus discolor
MLETCRILVSLGHPVPRPELVHLLEHGQELWTVKRGSPRHTCPGDGAKLQTREPSTIQPVLSEGALLQGSRTLELSRDPRL

SEQ ID NO: 15006 - protein, 81 aa, Lynx canadensis
LLTFRDVAIEFSQEEWGFLNQSQRELYRDVMLETYGHLLFLAISSHGSQSFLPKPCIEASSQNVSLGTWKHHALENLHLMI

SEQ ID NO: 15007 - protein, 81 aa, Lynx canadensis
MLETYNHLVSLEIPFSKPKLISQLEQGEEPWIEEKRCPLVLCPGSKLEIQPYPPCPLAFSSQRGLSQHVWLRHLPQLFSSY

SEQ ID NO: 15008 - protein, 81 aa, Lynx canadensis
RKAIVPLSPPYPLERNEEWPLLSHAQRLLYRYVMLENYSNLVFLGIPFPKPTLVIVLEQGEEPWREERECLWIVRGLLETN

SEQ ID NO: 15009 - protein, 81 aa, Phyllostomus discolor
KALGSVAFRDVIVDFTQEEWQQLKPAQKDLYREVMMENYWNLVSLDLETRPDLKELDPQEDNWGGRPSIAVTSGPMRNGTQ

SEQ ID NO: 15010 - protein, 81 aa, Phyllostomus discolor
AQGSVTFKDVTVDFTQEEWQHLDPAQKTLYMDVMLENYCHLISVGCHMTKPDVILKLEQGEEPWIPLTSHTCLEQNWSAED

SEQ ID NO: 15011 - protein, 81 aa, Phyllostomus discolor
VTFKDVAVDFTQEEWGQLDSPQRALYRDVMLENYQNLLALEWEPRLEVKEESCQQQDPYKGEPSQEPVVEGPARSGLHSPS

SEQ ID NO: 15012 - protein, 81 aa, Phyllostomus discolor
DPMQVTFEDVFMHFSQEEWGLLDEAQRLLYRDVMLENLALTASLGYASSMPRGVAPLELCNESWLSNWAHMTTAMTREAQG

SEQ ID NO: 15013 - protein, 81 aa, Phyllostomus discolor
TQEFLTFRDVAVDFTLEEWQLLDSDQKDLYRDVMLENYSNLVSVGYESSNPDVFSKLDHGEAPWTKEGEIHCGNHSEIWKL

SEQ ID NO: 15014 - protein, 81 aa, Phyllostomus discolor
TAGPVTFKDVTMAFTQKEWEQLDPAQRSLYKDVMLENYSNCASVGCQAAKPDMISKLEKGEEPCLGKGKRPRQGGTPRETP

SEQ ID NO: 15015 - protein, 81 aa, Desmodus rotundus
VQEPVTFKDVAVDFTQEEWGQLDPVQRTLYRDVMLETFGHLLSVGNQIAKPEVISLLEQGGEPWLVEQTDPQGTCAEMARN

SEQ ID NO: 15016 - protein, 81 aa, Desmodus rotundus
MASPSPPLEPKEEWDYLDPAQRSLYKDVMMENYGNLVSLDVLNRDKDEEPTVKQEIEEIEEEVESKGIIVTRIKSETDQDP

SEQ ID NO: 15017 - protein, 81 aa, Macaca fascicularis
QGLLTFRDVAIEFSQEEWKCLDPAQRALYRDVMLENYRNLVFLGICLPDLSIISMLEQRRDPRNLQSEVKIANNPDGRECI

SEQ ID NO: 15018 - protein, 81 aa, Macaca fascicularis
GRLTFRDVAIEFSLAEWKCLDPVQRALYTAVMLENYRNLEFVDSFLKFMMEFSSTGHSNTREGFHTGTLERHKSHPIGDFC

SEQ ID NO: 15019 - protein, 81 aa, Macaca fascicularis
LTFRDVAIEFSQEEWKCLDPAQRTLYRDVMLENYRNLVSLAISSKCMTRKFSSTGQGNTEVIHTGTLQRQASHHIGESCFQ

SEQ ID NO: 15020 - protein, 81 aa, Macaca fascicularis
FQEPVTFEDVAVSVTQNEWASLHPMQRALYREVMLENYANVTSLSAFPFSKPDLIFQLEQGEAAWGPDPWTLAGGEALRGM

SEQ ID NO: 15021 - protein, 81 aa, Macaca fascicularis
LDSMTFEDIVVDFTREEWALLDTSQRKLFQDVMLENISHLVSIGESLYIYYVCMYICIHSLTCFSLIHSFILHVSRTAFSS

SEQ ID NO: 15022 - protein, 81 aa, Macaca fascicularis
MLENYRNLVFLGIAAFKPDLIIFLEQGKEPWNVKRYEMVEEPPVICSHFAQDLWPEQGIEDSLQKVILRKYEKCGRENLQL

SEQ ID NO: 15023 - protein, 81 aa, Phascolarctos cinereus
WQELLTFKDVAVDFTQEEWGLLDHSRKELYKEVMLENSQNLLSLGIPVLREDLISHFEEREASWILDRIDLRNSCPEKPSL

SEQ ID NO: 15024 - protein, 81 aa, Macaca fascicularis
GLVTFGDVAVDFSQEEWEWLNPNQRNLYRKVMLENYKNLASLGKGDCISVWTPDVISSLEQGKEPWTVKRKMTRAWCPDLK

SEQ ID NO: 15025 - protein, 81 aa, Macaca fascicularis
DSVAFEDVAVNFTQEEWALLDSSEKNLSRKVMQETCRNLAFVEIIWYRDCVKAKKVVSMMDKLSAKFQILISMRTFLLDEN

SEQ ID NO: 15026 - protein, 81 aa, Phascolarctos cinereus
MQESVTFKDVAVDFTQEEWKQLDPAQRDLYRDVMLENYRNLVSLGLPVFKPDVISQLEKGEAPWTPEVPRSTCSGSFSQEA

SEQ ID NO: 15027 - protein, 81 aa, Myotis lucifugus
SQQDMDFEDVAIAFSQEEWRLLDEAQRLLYCDVMLEVFALVSSAGCWHKTVDEETCSGQSVSVHGESQVRAPKTEPATQRT

SEQ ID NO: 15028 - protein, 81 aa, Puma concolor
QGTVIFKDLTVYFSWEEWGLLDEAQMCLYHNVMLENLALMTSLAVNLYNQTSYVLMNYGGGTEQHIGEKHFRSNMGGALLL

SEQ ID NO: 15029 - protein, 81 aa, Bos mutus
KPLAVRFADVAVYFSPEEWGCLRPAQRALYRDVMQETYGHLGALGFPGPKPALISWMEQESEAWSPAAQDPEEGESLGGAL

SEQ ID NO: 15030 - protein, 81 aa, Neophocaena asiaeorientalis
QGPVSFEDVTVGFTQEEWQHLDPAQRTLDRDVMLENYSHLISVGRDCIIFDLMEKSQEKEDQHWWKVDFVNNRTLTKERNS

SEQ ID NO: 15031 - protein, 81 aa, Nomascus leucogenys
FQESVTFQDVAVDFTAEEWQLLDCAERTLYWDVMLENYRNLISVGCPITKTKVILKVEQGQEPWMVEGVNPDQSSPENDCP

SEQ ID NO: 15032 - protein, 81 aa, Nomascus leucogenys
VHGSVTFRDVAIDFSQEEWECLQPDQRTLYRDVMLENYSHLISLAGSSISKPDVITLLEQEKEPWMVVRKETNRRYPDLES

SEQ ID NO: 15033 - protein, 81 aa, Nomascus leucogenys
PVTFRDVTVIFTEAEWKRLSPEQRNLYKEVMLENYRNILSLAEPEPEIYTCSSCLLAFSCQQFLSQHVLQIFLGLCAENHF

SEQ ID NO: 15034 - protein, 81 aa, Muntiacus muntjak
PQEPVTFADVAVLFTPEEWLFLDSAQKSLYRDVMLENYRNLASVGDQLCKTRMSSHMEQREELCVTERGVFPGAHLGPHLQ

SEQ ID NO: 15035 - protein, 81 aa, Canis lupus
NFWILRLPPGSKGEVPKEWGKLDEWQKELYKHVMRGNYETLVSLDYAISKPEVLSQTEQGKEPCSWRRPGPKVPDVPVDPS

SEQ ID NO: 15036 - protein, 81 aa, Gorilla gorilla
VPLTFSDVAIDFSQEEWEYLNSDQRDLYRDVMLENYTNLTDFTTESDKLSSEKRNYEVNAYHQETWKINKTFNLMRFIFRT

SEQ ID NO: 15037 - protein, 81 aa, Gorilla gorilla
MLENYRNLLSLGLPFTKPQVISLLQQGEDPWEVEKEGSGVSSLGSKSSHKTTKSTQTQDSSFQGLILKRSNRNVPWDLKLE

SEQ ID NO: 15038 - protein, 81 aa, Phyllostomus discolor
VSFEDVAVYFSRTEWSLLDAAERRLYLHVMLENFGLISSLGCCCGVADVEAPTDQNLSVRVAQAKDPKAALSSKKSHPCDS

SEQ ID NO: 15039 - protein, 81 aa, Desmodus rotundus
AEANVTLEDVAVHFSGEEWRLLGEAQRRLYLRVMLENFSLISSLGCCCGPEDVEVSQARNAKAASSPQKSHPCEACGTVLR

SEQ ID NO: 15040 - protein, 81 aa, Macaca fascicularis
QGSVTFRDVAIDFSQEEWECLQPDQRTLYRDVMLENYSHLISLGSSISKPDVITLLEQEKEPWIVVRKETSRWYPDLESKY

SEQ ID NO: 15041 - protein, 81 aa, Canis lupus
GFASVSFKDVTVDFTQEEWQHLDPAQKTLYMDVMLENYCHLISVGCHMTKPDVILKLERGEEPWTSFTGHTCLEENWKEED

SEQ ID NO: 15042 - protein, 81 aa, Muntiacus muntjak
SQGLVTIKDVSLCFSQEEWRSLDPSQTDFYGEYVMQENCGIVVSLRFPIPKLDMLSQLEGGEEQWVPEPPDLEERDILKVT

SEQ ID NO: 15043 - protein, 81 aa, Muntiacus muntjak
SQESVTFKDVIVDFTQEEWKQLDSVQRGLFRDVTLENYTHLVSIGLQVSKPDVISQLEQGTEPWIVEPSIPVGTPGDGVTR

SEQ ID NO: 15044 - protein, 81 aa, Canis lupus
RTGLLTFRDVAVEFSQEEWRCLNHTQRELYRDVMLENYGHHLFVGLIISKPDLVSFLEQRKEPWDLKTKNTVAIHPDDEGD

SEQ ID NO: 15045 - protein, 81 aa, Muntiacus muntjak
MISFEDVAITFTGEEWRHLDLAQRTLYQEVMLETCSLLVSLGHPVPKAELIHLLEYGPGLWMVKRGLSRNTCIGEKANPKT

SEQ ID NO: 15046 - protein, 81 aa, Muntiacus muntjak
MDSVTFADVAVYFTQEEWTLLNPFQRKLYRNVMLENYKNLTTAAFKPNLISWLENKTIRGSSTFGAQTRSHSGQELYDCEQ

SEQ ID NO: 15047 - protein, 81 aa, Muntiacus muntjak
QGSVTFEDVAMYFSWEEWCLLDEAQIQLYLDVMLENFALVCMLGTWRGVQDEETPSEQSESVEGVSQIRTPRAGLSPEKVQ

SEQ ID NO: 15048 - protein, 81 aa, Muntiacus muntjak
IDELVTFKDVAVDFTEEEWEHLDPSQRHLYREVMLENFGNLISLAGHLLSEPEMIFHFEQEDDVWMEETIPRSSYSGVRDE

SEQ ID NO: 15049 - protein, 81 aa, Muntiacus muntjak
MGWLMFQDVAIEFPQEEWECLDLGQRDLYRDVMLETYGNLASLGLVFSKPDLITFLEQMKNPWDVRRTDTTATYPVWKIFH

SEQ ID NO: 15050 - protein, 81 aa, Canis lupus
SQESVKLRDVAVIFSPDQWACLNPEERQLYKDVMLDNCDYLVSLGHWTYKAEVISTLKKGKDIWMMEKEVMSAPCPACQPA

SEQ ID NO: 15051 - protein, 81 aa, Gorilla gorilla
MVFEDVAIYFSQEEWGILNDAQRHLHSNVMLENFTLLSSVGCWHGAKDEEVPSKQCVSVRVLQVTTALSTLKAQPCKTCSS

SEQ ID NO: 15052 - protein, 81 aa, Gorilla gorilla
PQVSLTFEDVAVLFTRDEWRKLAPSQRNLYRDVMLENYRNLLSLGLPFTKPQVISLLQQGEDPWEVEKEGSGVSSLGSKSS

SEQ ID NO: 15053 - protein, 81 aa, Gorilla gorilla
RRESVTFEDVAVYFSENEWIGLGPAQRALYRDVMLENYGAVASLAFPFPKPALISQLERGETPWCSVPRGALDGEAPRGIS

SEQ ID NO: 15054 - protein, 81 aa, Gorilla gorilla
NIVTVTFDDVALYFSEQEWEILEKWQKQMYKQEMKTNYETLDSLGYAFSKPDLITWMEEGRMLLISEQGCLDKTRRTTSPP

SEQ ID NO: 15055 - protein, 81 aa, Gorilla gorilla
MEFTWDEWQLLDSTQKYLYRDVILENYHNLISVGYHGTKPDLIFKLEQGEDPWIINAKISRQSCPDGWEEWYQNNQDELES

SEQ ID NO: 15056 - protein, 81 aa, Gorilla gorilla
MSNVTFSDVAIDFSHEEWACLDTAQRDLYKDVMVQNYENLVSVAGLSVTKPYVIMLLEDGKEPWMMEKKLSKAYPFPLSHS

SEQ ID NO: 15057 - protein, 81 aa, Gorilla gorilla
IMEEAVTFKDVAVVFTEGELGLLDPAQRKLYRDVMLENFRNLLSVGHQPFHQDTCHFLREEKFWMMGTATQREGNSGGKIQ

SEQ ID NO: 15058 - protein, 81 aa, Ailuropoda melanoleuca
TVTFKDVAVVFTEEELALLDKAQINLYQDVMLENFRNLVSVGDRIKNNISHLQGKGLSYLSQEVLYCWQIWKQRISELTVS

SEQ ID NO: 15059 - protein, 81 aa, Ailuropoda melanoleuca
FRDVSVNFSQEEWECLDSGQMNLYKEVMLENFSNLVSVGLSNSKPAVISLLEEGKEPWMVERELTRGLCSDLESMCETKIL

SEQ ID NO: 15060 - protein, 81 aa, Phyllostomus discolor
GSLGSVAFRDVIVDFTQEEWQQLKPEQKDLYRDVMMEIYWNLISLDLETERNMNEVDPEEESWEDRPSIAMVVEELMKNGA

SEQ ID NO: 15061 - protein, 81 aa, Phyllostomus discolor
SQGSVTFRDVAIDFSQEEWEWLQPAQRDLYRRVMLENYGHLVALGLNMSKPDVVSLLEQGKEPWLGKDVRTDFFSVSGSNG

SEQ ID NO: 15062 - protein, 81 aa, Myotis lucifugus
MNFEDVAIAFSPGEWGILDEAQRLLYYKVMLEVFVLGSSVDSWCGLDDEVVCSNQSVAIEGESQVRASKTAPATEKNHPFK

SEQ ID NO: 15063 - protein, 81 aa, Canis lupus
MDTVAFEDVTVNFTLEEWALLNPSQKKLYRDVMQETFRNLASIGEKWEDCNSKSLYKHHQTNLRHVIERPCKNKEGSKCGE

SEQ ID NO: 15064 - protein, 81 aa, Canis lupus
EGIQSISFEDVAVDFTLEEWQLLNPTQKNLYRDVMLENYSNLVFLGYHIIRPDAIFKREQEEPWMVQKEVLSQSFAEEVWL

SEQ ID NO: 15065 - protein, 81 aa, Muntiacus muntjak
SHTLVTFKDILVNFTREEWKLLDTAQQIMYRDVMLENYRNLVSLGHQLPKPDVILRLEKGEEPWLVEREIHQETHPDLETP

SEQ ID NO: 15066 - protein, 81 aa, Muntiacus muntjak
DTVTFKDVAIDFTQEEWQQLDPAQRNLYRNVMLENYNNLITVGCPFTKPDVIFKLEQEEEPWVMEEKVLKKHCPGEIWGMD

SEQ ID NO: 15067 - protein, 81 aa, Muntiacus muntjak
QLTSEDVAIKFTQEEWEFLDPAQRALYRDVMLETYRNLLSVDISPTHVIKHLQPKANSDKRELFQTLMLGRSESCEIKHFY

SEQ ID NO: 15068 - protein, 81 aa, Canis lupus
YQEFVTFEDVAVHLTREEWGCLDPVQRDLYREVMLENYGNVVSLGFPFSKPDGISQLEQDLQVFDLETKNREVLRDDCSDG

SEQ ID NO: 15069 - protein, 81 aa, Ailuropoda melanoleuca
LVTFEDVAVDFTPEEWQYLNPPQKTLYREVMLETYSNVVSVGPQATKPDLVLKLEVEEPRPAETKISCWSFPEAACQIDEQ

SEQ ID NO: 15070 - protein, 81 aa, Muntiacus muntjak
QGGVTFPDVAVCFSQREWRLLDETQRRLYLDVMLENYTLVSSLGCCCGAEGEETPCGKTVPVGVSWTGSPTAAPFSQKTHP

SEQ ID NO: 15071 - protein, 81 aa, Macaca fascicularis
RDSVAFEDVDVNFTQDEWALLDPSQKNLYRDVMQETFRNLASVGKKWKDQKIEDEYKNSRRNLRGLMGERLLESKKDHQHG

SEQ ID NO: 15072 - protein, 81 aa, Macaca fascicularis
MELLTFRDMAIEFSPEEWKCLDPSQQNLYRDVMLENRNLVSLGVTISNPDLVTCLEQRKELYNFKIHEAAARPSVYRESRC

SEQ ID NO: 15073 - protein, 81 aa, Macaca fascicularis
GPLQFRDVAIEFSLEEWHCLDIAQRNLYRDVMLENYRNLVFLGIVVSKPDLITCLEQGKKPLTMKRHEMIAKPPVICSHFA

SEQ ID NO: 15074 - protein, 81 aa, Macaca fascicularis
LYEAVTFKDVAVVFTEEELELLDPAQRKLYRDVMLENFRNLLSVGKIQTEMETVPEAGTHEEFSCKQIREQIASDLTRSQD

SEQ ID NO: 15075 - protein, 81 aa, Macaca fascicularis
FEGSVSFEDVAVDFTRQEWHRLDPAQRTMHKDVMLETYSNLASVGLCVAKPEMIFKLERGEELWILEEESSGHRYSGSLSL

SEQ ID NO: 15076 - protein, 81 aa, Macaca fascicularis
SQHLVTFEDVAVDFTQEEWTLLDQTQRDLYRDVMLENYKNLIILAGSEFCKPSLMSGLEQMEELRTGVTGVLQELDLQLKT

SEQ ID NO: 15077 - protein, 81 aa, Phascolarctos cinereus
FQESVTFKDVAVDFTWEEWGYLDTSQKELYWEVMLENYRNLVSLGLADSNVNMISQLESGEAHGISVDSVLRSCWPDGDTR

SEQ ID NO: 15078 - protein, 81 aa, Phascolarctos cinereus
MLETYWNLVSLGLSIPKPTAISHLEPEEPRTAEGETPSGPHPDWNTRPETRESAPRWDISEGGTSHGMMMTRFAQDGPWNP

SEQ ID NO: 15079 - protein, 81 aa, Phascolarctos cinereus
TRESVTFKDVAVAFTLEEWRQLGPSQKDLYRDVMLENYRNLVGLGLAISKPYVICQLEQGEAPWMPEGDIPQRHCADWEVI

SEQ ID NO: 15080 - protein, 81 aa, Phascolarctos cinereus
SQGLATFKDVTLSFSQEQWGDLDPTQKEFYGEYVLQEDCGIVVSLTFPIPRLDEVSQVEEEEESWVPDLEYPQDPEDAEIL

SEQ ID NO: 15081 - protein, 81 aa, Phascolarctos cinereus
KKPSVTFRDVAVDFTRAEWERLDSTQRDLYRDVMLENYKNLISLGFPISKPKVISKLERGGAQWMLGRKVPRRPFPGRLCQ

SEQ ID NO: 15082 - protein, 81 aa, Phascolarctos cinereus
QESVMFEDVAMYLTPEEWGQADPTQRALCRDRMLESCRNDVVLDDGSETENMESLSNLEVSEDVESEEKLSSEFPIALPQG

SEQ ID NO: 15083 - protein, 81 aa, Phascolarctos cinereus
PQESVTFKDVAVDFTWEEWGYLDTSQKELYWEVMLENYRNLVCLSLADSNKDVISQLELGEAYGIPTGSVLRVVWPDWDTR

SEQ ID NO: 15084 - protein, 81 aa, Gorilla gorilla
GRPLEMAVSEPEASAAKEWKQLDPAQSNLDNDVMLENYSNQASMGCQAPKPDMISKLEKGEAPWLGKGKRPSQGCPSKIAR

SEQ ID NO: 15085 - protein, 81 aa, Ailuropoda melanoleuca
QKPVTFDDVAVNFTQEEWVCLDAGQKVLYQDVMSETFRNLMSVVRIFLSNPDLIIKLEQEEKQWRAELQLRPPNGEGLPSG

SEQ ID NO: 15086 - protein, 81 aa, Gorilla gorilla
FQKPVTFEDVAVNFSQEEWDCLDASQRVLYQDVMSETFKNLTSVARIFLHKPELITKLEQEEEQWRETRVLQASQAGPPFF

SEQ ID NO: 15087 - protein, 81 aa, Ailuropoda melanoleuca
QDNVTLEDVAVYFSWEEWGLLDEAQRRLYHDVMLENLALITSLGKALTPTTVPWVQSISVEVSHSISKAGSSTQMAHPCDI

SEQ ID NO: 15088 - protein, 81 aa, Ailuropoda melanoleuca
MVFEDVIVDFTQEEWALLNPAQRRLYKDVMLETFRNLVSVDDDTQLKTNGSISQQDIFGKKLSNEQKIARFIKNDFWTSLF

SEQ ID NO: 15089 - protein, 81 aa, Lynx canadensis
GPWTLLTFRDVAIEFSQEEWGCLNHSQRELYRDVMLETYGHLLFLGLVSKPDLVILLEQKKELWGVKRKETVASHPGRWEI

SEQ ID NO: 15090 - protein, 81 aa, Lynx canadensis
PLDSVTFTDVAIDFSQEEWEWLNLAQRTLYKKVMLENYRNLVSLGLCISKPDVISLLEQGEDPWMMKGERTGGLCPDTLKM

SEQ ID NO: 15091 - protein, 81 aa, Lynx canadensis
NHQGFKFKDVAIYFSQKEWECLHPSQKGLYRDVMLENYNNLISLGLSDSKPNVISLLEQGKEPWLVKSKETKEWCPELSCL

SEQ ID NO: 15092 - protein, 81 aa, Lynx canadensis
FQEPVMFKDVAVVFSEEELGLLGPTQRKLYRDVMLENFRNLVSVGHSSSKPDVISQLEREEKLCMKEIHTQRGGRNQNEKE

SEQ ID NO: 15093 - protein, 81 aa, Lynx canadensis
THGSMPFSSVTVAFTQNGWRHLIPAPKDRFKEGIPENTRNLVLLGLPVSQPGMNSQLEQREEGPWMLEGGGLRSTCTDWKI

SEQ ID NO: 15094 - protein, 81 aa, Lynx canadensis
ESLSFEDVAVYFTREEWDKLDWAQKDLYRDVMLENYRNMILLGSEARWKMKKPTPGQKIFKDLESCKTSAVKQQTAKGSSE

SEQ ID NO: 15095 - protein, 81 aa, Phyllostomus discolor
MDSVILEDVAVIFTLEEWALLNPSQKKLYRDVMRETFRNLASVGKVWEDHDIEDQYKNQKRKRRRHMSERICEGKNVGQCG

SEQ ID NO: 15096 - protein, 81 aa, Macaca fascicularis
MCGPLQFRDVAIEFSLEEWHCLDTAQRNLYRDVMLENYRNLVFLGIIVSKPDLITRLEQGKKPLTMKRHEMVGKPPVLCSH

SEQ ID NO: 15097 - protein, 81 aa, Macaca fascicularis
MDQESVTFKDVAVLFTQEEWGQLSPAQRALYRDVMLENYSNLVSLGLLGPKPDMFSQLEKREVWMPEDTPGGFCPDWMTLP

SEQ ID NO: 15098 - protein, 81 aa, Macaca fascicularis
FQGSVTFEDVAIAFSQQEWESLDSSQRGLYRDVMLENYRNLVSMGHSLSKPHVIALLERWKEPKVTDRKDGRRWCTDLQLE

SEQ ID NO: 15099 - protein, 81 aa, Macaca fascicularis
QETLTFRDVAVEFSLEEWECLNPAQQNLYRNVMLENYKNLVFLAGIDISKQDPITSLEQEKEPWNMKRHEMVDESPGERYK

SEQ ID NO: 15100 - protein, 81 aa, Phascolarctos cinereus
QNPVTFRDVAVDFSLEEWKCLSPAQRALYRDVMLENYENLASVGPRLPFSKPYVISQLERGEAPWMPEEEVPRDHWPDLFN

SEQ ID NO: 15101 - protein, 81 aa, Phascolarctos cinereus
MLENYENFVFLVGMPVFKPSVISKPERRETSWMREEEAAFSFEDSLIQKTRSETKKSTPKQDICRERSSKERLKKDGPWDS

SEQ ID NO: 15102 - protein, 81 aa, Phascolarctos cinereus
GKESVTFKDVAVEFTQEEWVQLNPSQKKLYRDVMLENYKNLVFLGFAVSKPDVIYQLEKKETSWMPEPDIPKSNCPALPSV

SEQ ID NO: 15103 - protein, 81 aa, Phascolarctos cinereus
SQIPLTFQDVAVDFTWEEWGLLEPSQKDMYWDVMLENYENFVSLGGLPICLPDVISRMERIEAPWMAEGGVLVSTFLGSLS

SEQ ID NO: 15104 - protein, 81 aa, Phascolarctos cinereus
GVFLTFEDVAITFSQEEWEMLAAWQQQLYWDVMKENYETLSSLSAGRLGALPELFTTLGQVFETWEDQQNLLRRDNLESSY

SEQ ID NO: 15105 - protein, 81 aa, Phascolarctos cinereus
SLESVTFQDVAVDFTQEEWGRLEPAQKDLYREVMLENYQNFVSLGGLPAPKPHVISQLERGEAPWITEREALGGICQDSVI

SEQ ID NO: 15106 - protein, 81 aa, Myotis lucifugus
LQESVTFKDVAVLFTQDEWAQLSPAQRALYRDVMLENYSHLVSLGLLGPKPDLFAQLGKGEEWTPEDTSRGFCLDWMTIPV

SEQ ID NO: 15107 - protein, 81 aa, Myotis lucifugus
VKESVTFKDVAIDFTLEEWRLMDPTQRGLHRDVMLENYRNLVSLGLTVSKPDMISRLEDKKGPWVVMREISRAPYPELETK

SEQ ID NO: 15108 - protein, 81 aa, Myotis lucifugus
ELPVVFEEVAVYFTREEWGVLDQRQKELYRDVMRMNYELLASLAIGPVATKPDLISKLEHRAAPWIKDPKGTKSGKGRSPG

SEQ ID NO: 15109 - protein, 81 aa, Myotis lucifugus
CEVSLSFEDVTVDFSRDEWQHLDPAQRCLYWDVTLENYSHLLSVGYQVPKPEVIFKLEQGEGPWTLKGEIPYQSCSDKNIG

SEQ ID NO: 15110 - protein, 81 aa, Myotis lucifugus
ESQDMKFEDVAIAFSQEEWGLLDEAQRHLYCDVMLEVFTLVSFIGHWHKMDDVEAYSEHSVSVGESQVRASKTAVATQRTH

SEQ ID NO: 15111 - protein, 81 aa, Puma concolor
AHETVTFKDVAVDLTQEEWQQLKPAQRNLYRDVMLENYSNLVTVGYQVTKPDVIFKLEQEEEPWVIEEEMLGRHCPEVWEV

SEQ ID NO: 15112 - protein, 81 aa, Puma concolor
SQESVTFQDVAVDFTEKEWPLLDSSQRKLYKDVMLENYSNLASVGYQVGKPSLISHLEQEEELRTEERGRHRATSPDWETP

SEQ ID NO: 15113 - protein, 81 aa, Puma concolor
LLSFSDVAVDFTCEEWELLDPVQKNLYRDVMLENYSNLMSLAQYSEHNFCVKTFSMVKNLKRHHRIHTEGKPYECSECPKS

SEQ ID NO: 15114 - protein, 81 aa, Puma concolor
VLGPVKFEDVAVIFTEAEWKKLALEQRNLYKEVMLENFRNLVGLKSNPEVHPWPSCPLAFDEQQFLSQHELRSRPIPDLHS

SEQ ID NO: 15115 - protein, 81 aa, Puma concolor
GQCDFGGRGRVFSWEEWGLLDEVQRRLYHNVMLENLALITSLDYFCGIDNEEAPSGQNVSLGRTPPSRTSGPNLSTQKLHL

SEQ ID NO: 15116 - protein, 81 aa, Puma concolor
EELPVVFEDVAVYFTREEWGMLVKRQKELYRDVMRMNYELLASLGPAAAKPDLILKLERRAAPWIKDPNGPKWGKGRPPGK

SEQ ID NO: 15117 - protein, 81 aa, Puma concolor
ASREVEEDGSILLLVSTDVWSGMAEADKQQQFLAAPVTFKDVVVTFTQEEWELLDLSQRTLYWRVMRETCGLLLSLVISPD

SEQ ID NO: 15118 - protein, 81 aa, Puma concolor
AQESLTLEDVAVDFTWEEWQLLAPAQKDLYWNVMLENYRNLVSLGYQACQPDSLSELEQEEPPWIVKDEVQSQTHPEIERV

SEQ ID NO: 15119 - protein, 81 aa, Canis lupus
VNFEDVAVYFSPEEWGLLDEAQRLLYRDVMLENLALMASLGCWHGTEGEEIAFKQNISVGMSQIKTPKTGPATQKAHPCET

SEQ ID NO: 15120 - protein, 81 aa, Canis lupus
SVAFQDLAVRFSEEEWQLLGEGQRALYRDVMRENYETLRSLGTAERLPLSAFLSPTEPGGTMEGRSYAGEGQEPPRGGGPL

SEQ ID NO: 15121 - protein, 81 aa, Canis lupus
SQESVTFADVAVDFTQEEWTLLDRSQRQLFRDVMLENISHLVSIGKQLYKSDTISHLEPGVQLSKEGISLLQCQSLDKEDG

SEQ ID NO: 15122 - protein, 81 aa, Canis lupus
HQEPVTFEDVAVYFTQNEWVILDPSQRALYREVMLENYANVASLAFLFTRPVLVSQLERGELPWGLEPWEPVGREALRGIC

SEQ ID NO: 15123 - protein, 81 aa, Muntiacus muntjak
SFKDMAVTFTKEALGLLDLAQRKLYHEVMLENFWNLVSMGYQPFTLDILQLGREEQLWVMEPETRGDECSGHRNQNEIETL

SEQ ID NO: 15124 - protein, 81 aa, Muntiacus muntjak
VTFEDVFVYFSREEWELLEEPQRLLYRSVMLENFAHVAALGNSEEAPSEQSAFAELVSEFRALGSCAPILKSHPCETDDLL

SEQ ID NO: 15125 - protein, 81 aa, Muntiacus muntjak
WGSLVAFEEVAMHFSREEWELLDEAQRQLYHTVMLETLELVTSLGSWPVVEGEELPSEKNASGEVVAQVRTPSVPPSMQKA

SEQ ID NO: 15126 - protein, 81 aa, Canis lupus
MKPGVISHAPDSVAPAAFPFPKPDLIFQLERGEAPWGLDPWIPIEGEALGGVHPGGKNKTENEEQTPRLNISEDSVVHRLM

SEQ ID NO: 15127 - protein, 81 aa, Muntiacus muntjak
SVSFKDVTVDFTQEEWQQLDPAQKALYRDVMLENYCHLISVEEDWKAEDVLVKCKEYQDRHSRSVISVNHKRLIKERSNIW

SEQ ID NO: 15128 - protein, 81 aa, Ailuropoda melanoleuca
EELPVVFEDVAVYFTREEWGMLVKRQKELYRDVMRMNYELLAALGPAAAKPDLISKLERRAAPWIKDPNRPKWGKGRPLGK

SEQ ID NO: 15129 - protein, 81 aa, Gorilla gorilla
AQESLTLKDVAVDFTWEEWQLLGPAQKHLYRDVMLENYSNLVSVGYQAGKPDALTKLEQGEPLWTLEDEIHSPAHPEIEKA

SEQ ID NO: 15130 - protein, 81 aa, Ailuropoda melanoleuca
LVTFEDVAVEFTQEEWALLDPSQRTLYRDVMRENCRNLASLGYHVDKPNLISQLEQEDKVTTEEQGILPGTCPDLETVLKA

SEQ ID NO: 15131 - protein, 81 aa, Ailuropoda melanoleuca
QLVMFRDVVVDLSQEEWECLDLEQRHLYRDVMLENYSNMISLGLCIYQPDVFSLLEKGKEPWMVLQDETRGPCPGEGLSWH

SEQ ID NO: 15132 - protein, 81 aa, Ailuropoda melanoleuca
MTFEDVAVEFTQWEWGQLDPAQQDLYREVMLENFKNLASLGLPVSKPYVITQLEEGKDPCVLDGEISTEYLSPPPDWEKRP

SEQ ID NO: 15133 - protein, 81 aa, Ailuropoda melanoleuca
QGSVTFEDVVVYFSWEEWGLLDETQRCLYHDVMLENFALVISLGCWYGMEDEEAVSVQQMSLGRTPSPESPLWKVQPCEKC

SEQ ID NO: 15134 - protein, 81 aa, Gorilla gorilla
VAFEDVAIYFSQEEWELLDEMQRLLYRDVMLENFAVMASLGCWCGAVDEGAPSAESVSVEELSQGRTPKADTSTDKSHPCE

SEQ ID NO: 15135 - protein, 81 aa, Gorilla gorilla
TQESLTLEDVAVEFSWEEWQLLDTAQKNLYRDVMVENYNHLVSLGYQTSKPDVLSKLEHGQEPWITDAKIQNKNCPGIGKV

SEQ ID NO: 15136 - protein, 81 aa, Ailuropoda melanoleuca
LLTFRDVAIEFSQEEWRCLSHTQRELYRDVMLENYGHLLFLGFILSKPDLIMFLEQEEQFWDVNRTGTSSHDTQCFLPKLS

SEQ ID NO: 15137 - protein, 81 aa, Gorilla gorilla
MNLYKEVMLENFSNLVSVGLSNSKPAVISLLEQGKEPWMVDRELTRGLCSDLESMCETKILSLKKRHFSQVILTREDMSTF

SEQ ID NO: 15138 - protein, 81 aa, Phyllostomus discolor
MFQVTFSDVAIDFSYEEWEWLDSAQRSLYKDVMVQNYENLVSLAGLFIPKPYVITLLEDGKEPCMVQKNLTKDMFSDWKLR

SEQ ID NO: 15139 - protein, 81 aa, Phyllostomus discolor
SVTFRDVAIDFSQEEWEWLQPAQRDLYRRVMLENYGHLVALVSGSNGVIREFSPNNVIYENDSSQHLIKERILNYSPEHSC

SEQ ID NO: 15140 - protein, 81 aa, Phyllostomus discolor
AEASVTFEDVAVHFSWEEWRLLDEAQRRLYLRVMLENFSLISSLGCCCGAEDVEVSQTRNAKAASSPQKSHPCEGCGTVLR

SEQ ID NO: 15141 - protein, 81 aa, Phyllostomus discolor
SVTLEDVVVYFSWEEWGLLDEAQRRLYYDVMLENLALISSLGCLCGLEIEKAPSGQIVSLERLPQVRTPKLDLSIQTAPVS

SEQ ID NO: 15142 - protein, 81 aa, Desmodus rotundus
AEVGVAFADIALYFSREEWRLLDEAQRRLYLDVMLQNFELVSSLGCCCGAEDVEELIEQNISVRVVKAEIPKVALCSRKSH

SEQ ID NO: 15143 - protein, 81 aa, Desmodus rotundus
PVTFEDMAMYLTREEWRPLDPTQRDLYRDVMQENYGNVVSLDFEIRSENEVNPKQEISEDVEFGTAPERPVGNAEENPESE

SEQ ID NO: 15144 - protein, 81 aa, Macaca fascicularis
MLDNYRNLVFLGIAVSKPDLIICLEQGKEPCNMKRHAMVAKPPVVCSHFAQDLWPKQGLKDSFQKVILRRYGKYGHENLQL

SEQ ID NO: 15145 - protein, 81 aa, Gorilla gorilla
AQELLTLEDVTVEFTWEEWQLLGPFQKNLYRDVMLEIYSNLLSMGYQVSKPDALSKLERGEEPWTMEDERHSRICPENNKV

SEQ ID NO: 15146 - protein, 81 aa, Ailuropoda melanoleuca
GWVPALFDEVAIYFSDEEWEVLTEQQKALYREVMRMNYETVLSLEFPFPKPDVISRLEGDEESQNSDEWQLQGGTFAEQEE

SEQ ID NO: 15147 - protein, 81 aa, Ailuropoda melanoleuca
PDLVTFEDVAVEFTQEEWALLDPSQRTLYRDVMRENCRNLASLGIGYHVDKPNLISQLEQEDKVTTEEQGILPGTCPDLET

SEQ ID NO: 15148 - protein, 81 aa, Ailuropoda melanoleuca
QGLLTFGDVAIEFSQEEWRCLSHTQRELYRDVMLENYRHLVFLGLIVSKPDLVSFLEQEKQLWGVKRKETVAFHPAISSPD

SEQ ID NO: 15149 - protein, 81 aa, Ailuropoda melanoleuca
WQGQVNFEDVAVYFSQEEWGLLDEAQRLLYRDVMLENLALMASLGCFHGMEDEEIAFEQNIPVGVSQVRTPKTGPSTQKAR

SEQ ID NO: 15150 - protein, 81 aa, Phyllostomus discolor
IGSDLFRDVAVVFSREEWEQLTPAQRDLYRDVMLEIYSILLSLGPDLAVSKPDVISFLEQGKEPWRVEEAVTGGLCPVLES

SEQ ID NO: 15151 - protein, 81 aa, Phyllostomus discolor
VAVGVTFADIALYFSGEEWCLLSDKQRCLYLGVMVENFELVSSLGCCCGAEDVETPIEQTVPVAVSQAKNLKVALSSVKSL

SEQ ID NO: 15152 - protein, 81 aa, Phyllostomus discolor
AVMFKDVAVIFTEEELGLLDPSQRKLYQDVTLENLRNLISVGHWNQNEIEIVHEVALRYLFHVDLVCWQIWDQLLSKLTRN

SEQ ID NO: 15153 - protein, 81 aa, Macaca fascicularis
LQGLVMFEDVAVYFSREEWGLLNVTQKGLYRDVMLENFALVSSLGLAPSRSPVFPQLEKDEQLWVRSWVDVTPVSRAEARR

SEQ ID NO: 15154 - protein, 81 aa, Desmodus rotundus
LMEAVTFGDVAVHFSREEWQCLDPGQRALYKEVMLENHSSVAGLAGFLLFKPELISRLEQGEEPWVLDLQGTERGELPRTP

SEQ ID NO: 15155 - protein, 81 aa, Macaca fascicularis
FQDSVAFEDVAVSFTQDEWALLDPSQKNLYRDVMQETFKNLTSVGKTWKIQNMEDKYKNPRRNLSLMREKLFESKESHHCG

SEQ ID NO: 15156 - protein, 81 aa, Macaca fascicularis
VQESVTFRDVAVFFSQDEWLHLDSAQRALYREVMLENYSSLVSLGIPFSMPKLIHQLQQGEDPCLEEREVPSDTCLGFKTW

SEQ ID NO: 15157 - protein, 81 aa, Macaca fascicularis
MLENYGNVASLGFPLLKPAVISQLEGGGELGGPSPLAAGTGLWGLRTGKEVDIQTDNDLTKEMYEGKENVSFELQRDFSQE

SEQ ID NO: 15158 - protein, 81 aa, Phascolarctos cinereus
IKVSMVFEDVAVYLTQEEWGHLGPAQRDLYRDVMLENYSNLIFLGFPASNPDMISQLEQGDEPWVLDTQAAEGKDILSNDC

SEQ ID NO: 15159 - protein, 81 aa, Phascolarctos cinereus
ARGPVSFADVAVYFSPEEWGRLRPAQRALYRDVMRETYGHLGALGFPGPKPALMCWMDEETEVWGPDARDPEEAGEKGTEN

SEQ ID NO: 15160 - protein, 81 aa, Phascolarctos cinereus
QDLVTFKDVSVDFTREEWMRLDHPQRALYRDVMLENYRNLVLVSLGHPISKPDVISRLEQGGVPWVLKKGATGRAFSDRET

SEQ ID NO: 15161 - protein, 81 aa, Phascolarctos cinereus
FQESVTFKDVAVEFTQEEWRQLDPAQRSLFKDVMLENYRNLVSLGLAVNKPGIISHLERGRAPWIPERAVSGGTFPECLNL

SEQ ID NO: 15162 - protein, 81 aa, Phascolarctos cinereus
SQEAVTFRDVALDFTWEEWGCLSAAQRELYRDVMLENYRNLVSLGLLGPKPDLISWLEQGEETEIWDPLGCLARCTCLCEG

SEQ ID NO: 15163 - protein, 81 aa, Phascolarctos cinereus
GKESMTFKDVAVEFTWEEWRQLDHAQRDLYRNVMMENYENLISMGIFVSKPDVISLLERGEASWISEGEVSRSTYSDSLNL

SEQ ID NO: 15164 - protein, 81 aa, Phascolarctos cinereus
KALVTFVDVAVNLTQEEWHLLGPDQRSLYRDVMLENYGNIVSLDCETQTESEDLSPKQEISDELKCQSLILHRLRGLLPQA

SEQ ID NO: 15165 - protein, 81 aa, Phascolarctos cinereus
SQESLSFKDVAVDFTQEEWGRLDPDQRYLYKDVMLENYRNLVSVGHQVYKPNLISQLEQGEEPWIIDREIPRGAFPDWEIR

SEQ ID NO: 15166 - protein, 81 aa, Phascolarctos cinereus
SQKLLTFQDVAVDFTREEWGLLEPAQKDLFRDVMLESYENFVSLGLPDSKEDVISALEKTEEPGPPEGEVIPGNTYTDFLH

SEQ ID NO: 15167 - protein, 81 aa, Phascolarctos cinereus
LQESVTFNDVAVDFTAEEWGHLRPLQKELYRDVMLENYQNLVCLGLAISKPDVICQLERGETPRLPEGDIPQSGYAVRSHT

SEQ ID NO: 15168 - protein, 81 aa, Phascolarctos cinereus
PQESVTFKDVAVDFTWEEWGYLDTSQKELYWEVMLENYRNLVSLGLADSNVDMISQLESGEAQGIPVDSVLTSCWPDGDRR

SEQ ID NO: 15169 - protein, 81 aa, Phascolarctos cinereus
QESVTFTDVAVDFTLEEWAYLDHFQKELYKDVMLENYRNLLCLDWETRPETKESTVKLVISTEESFQGRLRRDDPSVSRLG

SEQ ID NO: 15170 - protein, 81 aa, Phascolarctos cinereus
LFQAVTFQDVAVYFTRKEWKHLDSFQRHLYRDVMLENYGNLLSLGFPVSKPDLISQLEQREELWVLDLQGTEKKETLRGSC

SEQ ID NO: 15171 - protein, 81 aa, Myotis lucifugus
QGLVTFEDVAVYFSREEWTLLTPTQRSLYREVMLENFALTVSLGKALRLRPQTGRLWLERETSMMRENPAGSQVQRLRDSL

SEQ ID NO: 15172 - protein, 81 aa, Myotis lucifugus
QESVTFKDVAVDFTQEEWHHMAPAQRRLYRDVMLENYSNLVSLGYQVSKPEVIFKLEQGEEPWLSEGEIQRSVCPDWKTRP

SEQ ID NO: 15173 - protein, 81 aa, Canis lupus
MLENYSHLLSVGYEVPKPEVIFKLEQGEEPWILERKTPHQSCSDGRFGIKTPQKRISGKASFHNEMDGEDTRDDSLYSILE

SEQ ID NO: 15174 - protein, 81 aa, Muntiacus muntjak
LPGLVSFKDVAVDFTQEEWQQLDPAQKTLYRDVMLENYSHLVSMGHPVSKPDVISKLEQGEDPWIIKRDIPNWICPYEVQT

SEQ ID NO: 15175 - protein, 81 aa, Muntiacus muntjak
KPLAVRFADVAVYFSPEEWGCLLPAQRALYRDVMRETYGHLGALGFPGPKPALISWMEQESEAWSPAAQDPEEGESLGGAL

SEQ ID NO: 15176 - protein, 81 aa, Canis lupus
ASVTFQDVAVDFTPEEWQLLECTQRKLYWDVMLENFIYLFNKFIFYWCSIFTKTKVIFKAEQGQEPWMAEGEKPHALSLCQ

SEQ ID NO: 15177 - protein, 81 aa, Gorilla gorilla
TFKEAVTFKDVAVVFTEEELGLLDPAQRKLYRDVMLENFRNLLSVGNQPFHQDTFHFLRKEKFWMMKTTSQREGNSGGKIQ

SEQ ID NO: 15178 - protein, 81 aa, Ailuropoda melanoleuca
ELVSFEDVAVNFSWEEWQHLDDAQRALYRVVMLETYSSLVSLAVIAQESTHIGEDHCRCNEWGNTFCAKPTQSNLHRADFE

SEQ ID NO: 15179 - protein, 81 aa, Ailuropoda melanoleuca
FQDPLTFKEVAVYFTNQEWQWLGPHQRQFSWAVTLENYGNMASLGEDYRQPSLPEVLRLKVENLLCVSDLTGDGCEDGEPS

SEQ ID NO: 15180 - protein, 81 aa, Ailuropoda melanoleuca
PGLLTFRDVAIEFSQKEWGCLNLVQRELYRDVMLENYGNLLFLETGLVVSKPDLVIFLEQKRELWDVKGKETVAIHPALVI

SEQ ID NO: 15181 - protein, 81 aa, Gorilla gorilla
DSVAFEDVAINFTCEEWALLGPSQKSLYRDVMQETIRNLDCIGMIWQNQDIEEDEYKDLRRNLRCHMVERSCEIKDDSQCG

SEQ ID NO: 15182 - protein, 81 aa, Ailuropoda melanoleuca
HGSPPFSNVTVAFTQDGWKHLIPAPRGTPKFMEGIPENARNLVLLGLPVSQPDMNSQLEQREEGPWMLEGGGLRSTCPDWK

SEQ ID NO: 15183 - protein, 81 aa, Lynx canadensis
ESCVTFEDVAVYFSQEEWGLLDEAQRFLYHDVMLETFALTTSLDCWCGAENEEVPSEQSVSVERVSQVRTSKTGSSIQKTH

SEQ ID NO: 15184 - protein, 81 aa, Lynx canadensis
SQELVTYEDVAVDFTQEEWQRLDPAQKILHRDVMLEIYSHLVSVGCSGISPGIIFKLEHEEDPWTMKSELSRWIHSDREKS

SEQ ID NO: 15185 - protein, 81 aa, Lynx canadensis
QPPVSFKDVAVTFTREEWGQLDPAQRTLYRNVTLETCSHLAFLDWKNTLEKEESASKEDTAVEEPFHNIEMKCCIQEEGPW

SEQ ID NO: 15186 - protein, 81 aa, Lynx canadensis
REESLTLEDVAVDFTWEEWQLLAPAQKDLYWNVMLENYRNLVSLGYQARQPDSLSELEQEEPPWIFKDEVQSQTHPEIERV

SEQ ID NO: 15187 - protein, 81 aa, Lynx canadensis
FQGLVSFEDVAVNFTWEEWQDLDDAQRTLYRVVMLETYSSLVSLGHCITKPEVIVKLEQGAEPWTVEEPLEQSLPGLSVHT

SEQ ID NO: 15188 - protein, 81 aa, Lynx canadensis
AQKSLTLEDVAVDFSREEWRLLAPAQKDLYRDVMLENYRNLVSVGHQASKPDVLAKLERGEEPWAIEEEVRSGTSPETGKV

SEQ ID NO: 15189 - protein, 81 aa, Lynx canadensis
MLQVTFSDVAIDFSHEEWGWLDSAQRDLYKDVMVQNYENLVSLGLSIPKPYVISLLEDGKEPWMVQKKLSKDWESRWENKE

SEQ ID NO: 15190 - protein, 81 aa, Lynx canadensis
HQELVTFEDVAIYFTGTEWTCLSPGQKALYRSVMLENYGNLTSLGYQVPRPALISLLEAGNLPWGLEAQDNLSAERTKDIC

SEQ ID NO: 15191 - protein, 81 aa, Lynx canadensis
MFQEQVTFEDVVVDFTQEEWGQLEPAQRTLYRDVMLETFRLLVSVGKPDVVSLPEQEEPWAVDGGVPRGVYLETRPQTKVS

SEQ ID NO: 15192 - protein, 81 aa, Phyllostomus discolor
FHEPVIFEDVTLGFDPEEWGLLDLEHKSLYREVILENYRNLVSVEHQLSKPDVVSQLEEEEELLSVERGIPQDTFSECPKT

SEQ ID NO: 15193 - protein, 81 aa, Phyllostomus discolor
SQGTVTFKDVAIDFTQEEWQQLDSSQRNLYWNVMLENYNNLITVGCPFIKPYVIFKLEQEEEPWVVEEEEVLRRHCPGEIW

SEQ ID NO: 15194 - protein, 81 aa, Phyllostomus discolor
GSVTFDDVAVYFSWEEWDLLDEAQRRLYQDVMLENLALITSLGCWYGAEDEAPEQSVSVETVSQVRIPKAGLSSQRAHPCD

SEQ ID NO: 15195 - protein, 81 aa, Phyllostomus discolor
VTFEDVVVDFTQEEWGQLEPAQRTLYCSVMLETFRLLVSVDLETRSKTKLPAAKQDISEKISNNVLVERFLWYGLPGYKPE

SEQ ID NO: 15196 - protein, 81 aa, Phyllostomus discolor
SVESLTFKDVSVDFSWDECKCLDPAQRKLYSDVMLENYSNLVSLGLDVSKPVLVTFLEEMRERCNVCMKKAISDPPGKPSL

SEQ ID NO: 15197 - protein, 81 aa, Phyllostomus discolor
AEVVVTFEDVAVYFSRTEWLLLDEAQRCLYLNVMLDNYALISSLGCCCGVENLEAPTEQNITVRVSKAMNLKSTLSSQESH

SEQ ID NO: 15198 - protein, 81 aa, Phyllostomus discolor
MNSVAFEDVAVSFSLEEWALLHPAQKKLYRDVMQETLRNLASIGTRWEEHNIEKYQNQGRKLRSQVIEKVCESKEGSQCGE

SEQ ID NO: 15199 - protein, 81 aa, Phyllostomus discolor
MLENYHSLVSLGILFSKPKVIFQLQQGEDPWMVGNGLSYGARLGWGSLFETTFSKEDYQEVMSKLIGDGTFNFKLEKIYIN

SEQ ID NO: 15200 - protein, 81 aa, Phyllostomus discolor
QVSVTFKDVAVDFTLEEWGQLGPGQRELYRDVMLENYQNLLSLGSGLLGSKPDVISRLERGEEPRMEKREAQQVTCPDLET

SEQ ID NO: 15201 - protein, 81 aa, Phyllostomus discolor
SPTLVTFKDIHVNFTREEWNLLDAAQQIMYKDVMLENYKNLVSVGHQLPKPDVILQLEKGEEPWLVERGVRQDTRPDWDTA

SEQ ID NO: 15202 - protein, 81 aa, Phyllostomus discolor
YKESVMFRDVAVDFSQEEWECLDPAQRDLYRDVMLENYSNLLSMGLYIPKPQVISLLEQGKEPWMVGRELTRGLCSDLESM

SEQ ID NO: 15203 - protein, 81 aa, Phyllostomus discolor
SQEAVSFEDVAVNFTREEWALLDASQRRLFTDVMLESISHLLSTGSWLHKSDVISQWKEGEQLSRDGTGALQGQSPVISDR

SEQ ID NO: 15204 - protein, 81 aa, Phyllostomus discolor
SEESVTFKDVAVDFTQEEWGQLDSPQRALYRDVMLENYQNLLALAGPPVCKPDVISHLERGEEPWQVPRKVPGGARPEWEP

SEQ ID NO: 15205 - protein, 81 aa, Myotis lucifugus
EDMNFEDVAIAFAQEEWEILDEAQRRLYCDVMLEVFSLVSFVGPWRKMDDVEAYSQHSVSLGDSQLRASRTATSTQRTHLC

SEQ ID NO: 15206 - protein, 81 aa, Canis lupus
GWVPALFDEVAIYFSDEEWEVLTEQQKALYREVMRMNYETVLSLEFPFPKPDMITRLEGDEESQNSDEWQLHGGTFAENEE

SEQ ID NO: 15207 - protein, 81 aa, Canis lupus
FQESVTFEDVAVIFTDEEWRHLVPIQRDLYKEVMLENYKSIVSLGLPVPCPEVIFQLKRGDEPWIVDLHGSEERECPENIS

SEQ ID NO: 15208 - protein, 81 aa, Canis lupus
TVTFKDVAVVFTEEELALLDKTQISLYQDVMLENFRNLVSVGDRIKNNISHLQGKGLSYLSQEVLYFWQIWKQRISELPVS

SEQ ID NO: 15209 - protein, 81 aa, Canis lupus
MYFSQEEWELLDPTQKALYNDVMRENYETVISLALFVLPKPKVISYLEQGEEPWVQGPLEFKDSLGELPTGLKLKTDTENH

SEQ ID NO: 15210 - protein, 81 aa, Canis lupus
SQELLTFKDIFVDFTQEEWGQLAPAHRNLYREVMLENYGNLVSVAGYQLSKPSVISQLEKGQEPWMTEKKGPGDPSPDLKN

SEQ ID NO: 15211 - protein, 81 aa, Muntiacus muntjak
SQDSVTFADVAVNFTQEEWTLLDCFQRKLYRDVMLENYKNLTTAGYQVFKPTLISWLEEEELSTVETGILQEWGMQLKAKD

SEQ ID NO: 15212 - protein, 81 aa, Muntiacus muntjak
MEMETLTFKDMFVDFTQEWQQLDTAQKNLHRDVMLENYSHLVSMGYLVTQPHGIFRLGQGEEAAGIAAGESPLWSCPVLQR

SEQ ID NO: 15213 - protein, 81 aa, Gorilla gorilla
CQESVTFEDVAVVFTDEEWSHLVPIQRDLYKEVMLENYNSIVSLGLPVPQPDVIFQMKRGDKPWMVDLHGSEEREWPESVS

SEQ ID NO: 15214 - protein, 81 aa, Phyllostomus discolor
AEVVVTFEDVAVYFSRTEWHLLDEAQRCLYINVMLENYALISSLGCCCGTEEVEAAIQENVSAGDSKAKNIKSALSSQKSH

SEQ ID NO: 15215 - protein, 81 aa, Macaca fascicularis
MTLKDVIVEFTKEEWKLLTFAQRTLYKDVMLENYSHLVSVGYHVNKPNAVFKLKQGKEPWILEVEFPHRVLPCELEEIISH

SEQ ID NO: 15216 - protein, 81 aa, Macaca fascicularis
PLTFRDVAIEFSQEEWKSLDPVQKALYWDVMLENYRNLVFLGILPKCMTKELPPMGNSNTGEKFQTVMLERHECYDIENFY

SEQ ID NO: 15217 - protein, 81 aa, Macaca fascicularis
MLENYRNLVSLGIAVSKPDLITCLEQRNEPWNVKKHETIGRHPAVSSHFTQDLLPEHGIKDSFQKVILGRYGSCGTENLDL

SEQ ID NO: 15218 - protein, 81 aa, Macaca fascicularis
MQEDVAVNFSQEEWSLLSEVQRCLYHDVMLENWVLISSLGKFLTPSPIFFFLRRSLTLSPRLECSGQISAHCNLWTPHLNH

SEQ ID NO: 15219 - protein, 81 aa, Macaca fascicularis
AGRPLEMAVSEPETSATEWKQLDPAQRNVYHDVMLENYSNQASMGYQAPKPDLISKLEKGEAPWLGKGKRPSQGCPSKIAR

SEQ ID NO: 15220 - protein, 81 aa, Macaca fascicularis
DSVAFEDVAINFTCEEWALLGPSQKSLYRDVMQETIRNLDCIGMIWQNHDIEEDQYKDLRRNLRCHMVERSCEIKDNSQCG

SEQ ID NO: 15221 - protein, 81 aa, Macaca fascicularis
REDPGTSESQEMEEWALLDIFQKNLYREVMLETFRNLTSIGKSWKDQNIEYEYQNPRRNFRSLIEEKVNEIKEDSHCGETV

SEQ ID NO: 15222 - protein, 81 aa, Phascolarctos cinereus
VREMISLNKKSVTFKDVAVDFTEDEWRQLNPTQRQLYRDVMLENYRNLIFLEGGEEPWTVEREIPGSPGADWETNPEAREL

SEQ ID NO: 15223 - protein, 81 aa, Phascolarctos cinereus
ARGPVSFADVAVYFSPEEWGRLRPAQRALYRDVMRETYGHLGALGFPGPKPALISWMEQETEAWGPAAQDPEEWGGDVRTA

SEQ ID NO: 15224 - protein, 81 aa, Phascolarctos cinereus
MLENYRNLVFLGFAASRPNDSDQLERKEVSSLPEADIPRSSCPESREFAGDKPLECNGYGNAFWSKEHLAVCQIIRTGEKP

SEQ ID NO: 15225 - protein, 81 aa, Phascolarctos cinereus
SQESVICSGMSRNLSHKKWGHLNPAHKNFCRDIMKENYRNMVSLGIPISTAKKMSQLARGKKPWVLALQGSNKRHVLRGIH

SEQ ID NO: 15226 - protein, 81 aa, Phascolarctos cinereus
ARIPVTFDDVAMYFSEQEWRNLEDWQKDLYKNIMKSNYETLVFLGCANSKPDLITWIERGQEPFIRDLGSLERKDLAISTR

SEQ ID NO: 15227 - protein, 81 aa, Canis lupus
SLESDLFRDVAVVFSQEEWEQLVPTQRDLYRDVMLETYNNLVSLGLAISKPDVISFLEQGKEPWMVEKAATGGLCPVLESR

SEQ ID NO: 15228 - protein, 81 aa, Canis lupus
RPRAVKFADVAVYFSPEEWGCLRPAQRALYRDVMRETYGHLGALGFRGAKPALISWVEEEADLWGPDARDPEVGECVTETD

SEQ ID NO: 15229 - protein, 81 aa, Canis lupus
MFQVTFSDVAIDFSHEEWGWLDSAQRDLYKDVMVQNYENLVSVDWESRWENKELLMKEDIYDEDSPQMVKIEKAIKQSHEF

SEQ ID NO: 15230 - protein, 81 aa, Muntiacus muntjak
WQAVVTFEDVAVYFTQTEWAGLSPAQRALYRSVMLEICGNLMSLGYPIPKPTLVSLLERGDLLAGLETQDNPPAQGTKDIY

SEQ ID NO: 15231 - protein, 81 aa, Canis lupus
ENFSIIMRDVAVEFSPEEWRCLNHTQRELYRDVMLENYGHLLFVGLMVSKPDLVSFLEQRKEPWDLKTKKTVAIHPVLFCL

SEQ ID NO: 15232 - protein, 81 aa, Muntiacus muntjak
MGRLMFRDVAIDFTQEEWECLDFGQRDLYRDVMLETYGNLASLGLVVSKLDLVTFLEQMKNPWGVRRTDTTATYPVWNIFH

SEQ ID NO: 15233 - protein, 81 aa, Muntiacus muntjak
MTFQDVTVAFTQEEWECLDLGQRELYRDVMLENYGNLACLGLVVSKPDLVTFLEQMKDPWDVRGMETAIHPVVSSHDTQGL

SEQ ID NO: 15234 - protein, 81 aa, Muntiacus muntjak
LTESLSFEDVTVGFTQEEWQKLDPAQRTLYRDVMLENYSHLISVGFCMPKPELIFKLERGEQPWVLKRQSLQARSTQVTEK

SEQ ID NO: 15235 - protein, 81 aa, Muntiacus muntjak
AQGSVMFTDVSIDFSQEEWEFLNPDQRELYRDVMLENYSNLVSMGLYIPKPQVISLLEQGKEPWMIGRELTRGLCSALESM

SEQ ID NO: 15236 - protein, 81 aa, Canis lupus
ASGLVMFKDVAIDVSQEEWECLNPTQRNLYKDVMLENYSNLVSLGLSISKPAVISSLEQGKEPWMVEREVTGGWCTDLVSR

SEQ ID NO: 15237 - protein, 81 aa, Muntiacus muntjak
LQETLTFKDMAMVFSREELALLDSAQINLYQDVMLENFRNLVSLEDRIENPNLMNLWGKGLSYLSPEVLYFWQIWNQRISE

SEQ ID NO: 15238 - protein, 81 aa, Muntiacus muntjak
MLETCGLLVSLGHPVPKPELTHLLEHGQKLWTGARGLPRGTGPGDRAKCQTREPSNSQPVLSEEALLRGSLTLGSSWDSRL

SEQ ID NO: 15239 - protein, 81 aa, Gorilla gorilla
MCESVTFEDVAVEFIQEWALLDSARRSLCKYRMLDQCRTLASRGTPPCKPSCVSQLGQRAEPKATERGILHATGVGEYQLW

SEQ ID NO: 15240 - protein, 81 aa, Gorilla gorilla
EDVAVKFTQEEWNLLSEAQRCLYHDVTLENLALMSSLGCWCGVEDEAAPSKQSIYIQRETQVRTPMAGVSPKKAHPCEMCG

SEQ ID NO: 15241 - protein, 81 aa, Ailuropoda melanoleuca
SPGAVSFADVAVYFSPEEWGCLRPAQRALYRDVMRETYGHLGALGFSGPKPAFISWVEGEVEAWSPEAQDPEGESPAAVIR

SEQ ID NO: 15242 - protein, 81 aa, Gorilla gorilla
KEALMAFRDVAVAFTQKEWKLLSSAQRTLYREVMLENYSHLVSLGIAFSKPKLIEQLEQGDEPWREENKHLLDLCPEPRTE

SEQ ID NO: 15243 - protein, 81 aa, Ailuropoda melanoleuca
RLTFRDVAIEFSQEEWECLDPAQRALYRDVMLENYRNLVSLDSSARFMIKELLPKKERNNRELCQPVVLGGHESHGLKDFD

SEQ ID NO: 15244 - protein, 81 aa, Gorilla gorilla
GTVSFADVAVYFSPEEWGCLRPAQRALYRDVMQETYGHLGALGDVPNRKEEEPEEVPRAKGPRKAPVKESPEVLVERNPDP

SEQ ID NO: 15245 - protein, 81 aa, Ailuropoda melanoleuca
SDLFRDVAIVFSQEEWEQLTPAQRDLYRDVMLETYSNLVSLGLAISKPDVISFLEQGMEPWMVEKAARGGLCPVLESRCDT

SEQ ID NO: 15246 - protein, 81 aa, Ailuropoda melanoleuca
REGLLTFKDVAIEFSQEEWGCLSHTQRELYRDVMLENYGHLLFLGFILSKPDLITFLEQEKQLWDVKRKETVAFHPAVSSH

SEQ ID NO: 15247 - protein, 81 aa, Ailuropoda melanoleuca
QGLLTFRDVAIEFSQEEWRCLSHTQRELYRDVMLENYGHLLFLGLIASKPDLVSCLEQKKEPWDLKRKKTVAIHPATSSHD

SEQ ID NO: 15248 - protein, 81 aa, Lynx canadensis
LQGLLTFRDVAIEFSQDEWGCLNQSQRELYRDVMLETYGHLLFLGLIVSKPHLVIFLEQKRELWDVKRKKTVRTQKGENTS

SEQ ID NO: 15249 - protein, 81 aa, Lynx canadensis
PKVPVTFDDVAVYFSEQEWGKLDEWQKELYKHVMRGNYETLVSLDYAISKPEVLSQTEQGKEPCSWRRTAPKVPDVPVDPS

SEQ ID NO: 15250 - protein, 81 aa, Phyllostomus discolor
AEASVTFEDVAVHFSREEWRLLDEAQRRLYLRVMLENFSLISSLGCCCGAEDVEVSQTRNAKAASSPQKSHPCEGCGTVLR

SEQ ID NO: 15251 - protein, 81 aa, Phyllostomus discolor
PEKSLTFKDVSVDFSWEEWECLDPAQRKLYSDVMLENYSNLVSLAMSSADNQDFSLRSGREDLFFEATLKIHTSKKPYECT

SEQ ID NO: 15252 - protein, 81 aa, Phyllostomus discolor
QVPIAFQDLAVRFSEEEWQLLGEGQRALYRDVMQENYEALVSLGTAELVPLSAFLSPAEPGGARSSSKAGEGQAPPGGGAL

SEQ ID NO: 15253 - protein, 81 aa, Neophocaena asiaeorientalis
LEGSVTLQDVAVEFTPEEWQLLDCDQRTLYWDVMLENFRNLISMGCPVTKTKVIFKVEQGQEPWMVEGENPRWRSPEADCP

SEQ ID NO: 15254 - protein, 81 aa, Bos mutus
LQVSVSFEDVTVDFSREEWQHLDSAQRRLYQDVMLENYSHLLSLGYEVPKPEVIFKLEQGEEPWALKEKTLHHSCSDDTTL

SEQ ID NO: 15255 - protein, 81 aa, Neophocaena asiaeorientalis
LLQGSLSFKDVAVVFTWEEWQLLDRVQKNLYQDVMLENYINLVSVGYQVTKTDAFYRLEQETPRIIEEESQSQIHPEDTWQ

SEQ ID NO: 15256 - protein, 81 aa, Bos mutus
MRALLCSSRVTLGLAWPSGESGELGFRGEARCPVPRPELIYRLEHGQELWTVKRDLSRSTCAGDKGKPKTRESTTSEPSLF

SEQ ID NO: 15257 - protein, 81 aa, Neophocaena asiaeorientalis
AHGSVTFRDVAIDFSQEEWEFLDSAQRDLYRDVMWENYSNFISLGPSISKPDVITLLDEGKEPWMVVREGTRRHHPDLESR

SEQ ID NO: 15258 - protein, 81 aa, Bos mutus
VPVTYEDVAVTFTQEEWGHLGPMQRTLYWEVMLETCRLLVSLAHSLAAQGCSVVFVCDNTKPETPQPAPSHPAPSEEVSPQ

SEQ ID NO: 15259 - protein, 81 aa, Bos mutus
MDFTSENWEQLGQGQGDLFWDTALDNYWNLFLLNPPGPNLTFHPDGGEKLEALVKESPESTDTAREGQGQLGSHSFSVVRQ

SEQ ID NO: 15260 - protein, 81 aa, Bos mutus
AECFPEMAVSGPGGSAAEWEQLDPAQKSLYKDVMLENYSNLASMGYQALKPDMISKLEKGEEPWLGKGKGSRQGGSSEIAR

SEQ ID NO: 15261 - protein, 81 aa, Bos mutus
QVSVTFEDVAVLFTRDEWRKLAPSQRNLYQDVMLENYSNLVSLGLPFSKPEVISLLQQGEDPWKVEKESPGDSSLGEWVGN

SEQ ID NO: 15262 - protein, 81 aa, Nomascus leucogenys
GHLTFRDVAIEFSQAEWKCLDPAQRALYKDVMLENYRNLVSLGSSYALGSNAEDKPIKKQLGVSFHLHLSEVELFPDERVI

SEQ ID NO: 15263 - protein, 81 aa, Nomascus leucogenys
RPGAVSFADVAVDFSPEEWGCLRPAQRALYRDVMRETFGHLGALGFSGPKPAFISWMEGEVEAWSPEAQDPYRESSAAFSR

SEQ ID NO: 15264 - protein, 81 aa, Nomascus leucogenys
QGHVTFEDIAVYFSQEEWGLLDEAQRCLYHDVMLENFSLMASVAGLSQSNHKDSCLQQKVPVSLNYCVAQCSPDDGHYNPK

SEQ ID NO: 15265 - protein, 81 aa, Canis lupus
QALVSFKDVAVTFTGEEWRHLDLAQRTLYREVMLETCGLLVSLGEKAKPETTELTASQLAFTEEAPFEEQVTQGVARDSRL

SEQ ID NO: 15266 - protein, 81 aa, Canis lupus
RPGAVSFADVAVYFSPEEWGCLRPAQRALYRDVMRETYGHLGALGFADAKPVLIAWLERKAEVWTPEAEDPEEGARHPGSG

SEQ ID NO: 15267 - protein, 81 aa, Canis lupus
AQESLTFDDVAVDFTWEEWQLLAPAQKDLYWDMMLENYRNLVSVGYQASKPDALSKLERGGELSMIEDEIHSRICPEIRKA

SEQ ID NO: 15268 - protein, 81 aa, Canis lupus
IQEALSFEDLFVDFTQKEWQLLDARQKDLYKDVMLENYSSLVSLGYEVVKPDVIFRLEQGEEPWIGAGELSSLDCPEQVLQ

SEQ ID NO: 15269 - protein, 81 aa, Muntiacus muntjak
MGLLTFQDVTVDFTQEEWECLDLGQRELYRDVMLENYGNLACLGVLVSKPDLVTFLEQMKHPWDVRRMETAIHPGMCLLNI

SEQ ID NO: 15270 - protein, 81 aa, Canis lupus
FAGSVSGQDMAMDLTLEEWQKLDSALRTAFRDVMLEKDRNLTSVGCPVSMSNVIFKLEPGEELWMVGEGTLPPACLGDVWE

SEQ ID NO: 15271 - protein, 81 aa, Muntiacus muntjak
KSWGHLSFMDVFVDFTWEEWQLLDSAQKHLYRSVMLENYRNLVSLGYQYTKPSIIFQLEQEELWMMHSPSLDQSDEVWEID

SEQ ID NO: 15272 - protein, 81 aa, Muntiacus muntjak
LQDLVTFKDVTVEFNQEEWALLDSSQQKLYRDVMLENYGNLASLGYHVDKPSLISQLEQEDKVMTEEGGILPGTCPDLETV

SEQ ID NO: 15273 - protein, 81 aa, Muntiacus muntjak
MGWLTFRDVTIDFTQEEWECLDLGQQELYRDVLLENYGNLASLGLVSKLDLVTFLEQLKDPRNIRRMETTAFYPGILGMGF

SEQ ID NO: 15274 - protein, 81 aa, Canis lupus
QGLLSFKDVAEVFTWEEWQLLDPVQKNLYQDVMLENYSNLVSVDDIWHVDCHTDWHQENKGNLETMENHHKNTAFRKILSL

SEQ ID NO: 15275 - protein, 81 aa, Bos mutus
FQATELEFLSVNYTLKNWKGTALSQRALYWNIMLENCCSLAPLAGENRMASSQLSPKQDISEESKSADRTSGILCGLILRG

SEQ ID NO: 15276 - protein, 81 aa, Neophocaena asiaeorientalis
PKVPVTFDDVAVYFSEPEWGKLDEWQKELYKHVMRGNYETLVSLDYAISKPDILTRMERGEEPCPEGPRGREEGSDREEAR

SEQ ID NO: 15277 - protein, 81 aa, Neophocaena asiaeorientalis
FQGLVTFRDVAIEFSQEEWKCLEPAQKDLYKDVTLENFSNLVSLGLSLSKPDVISLLEQGKEPWMVVNDMTGPWCPDLESR

SEQ ID NO: 15278 - protein, 81 aa, Bos mutus
SVMFRDVAIDFSQEEWDCLDSAQRDLYRDVMLENYSNLVSLGLSQWEMSARLENCDLENSSSRDYLEVKGTLEKQQEQAYF

SEQ ID NO: 15279 - protein, 81 aa, Neophocaena asiaeorientalis
ACVTFEDVAIYFSQEEWELLDEAQRFLYHDVMLENFELTTSLAVCETSNSFTPLSIPVQERSMGAEMTELRSSEWRCPRCT

SEQ ID NO: 15280 - protein, 81 aa, Nomascus leucogenys
EMGLLTFRDVAIEFSLEEWQCLDTAQQNLYRNVMLENYRNLAFLGIAVSKPDLITCLEQGKEPWNMKRHEMVDEPPDGVLL

SEQ ID NO: 15281 - protein, 81 aa, Nomascus leucogenys
VGLQFQGSVTFEDVAIAFSQQEWERLDSSQRGLYRDVMLENYRNLVSMGHSLSKPHVIALLEQWKEPEVTVRKDGRRWCTG

SEQ ID NO: 15282 - protein, 81 aa, Nomascus leucogenys
IQGPLTFGDVAVAFTWIEWRHLDAAQRALYRDVMLENYGNLVSVGLLSSKPKLITQLEQGAEPWTEVREAPSGTHAVQDYW

SEQ ID NO: 15283 - protein, 81 aa, Bos indicus
FQEPVSFKDVAVVFTEEELGLLDSAQRRLYQEVMLENFQNLLSVGNQPFKPELIFQLEREERLMMESQRGGCSGTKSPHNM

SEQ ID NO: 15284 - protein, 81 aa, Bos indicus
SQGLVTFEDVAVYFSLEEWERLDAEQRELYKEVMRENYGILVSLGYPVPKPDLIFRLEQGEEPWVPDSPRPEEGDIVTGVY

SEQ ID NO: 15285 - protein, 81 aa, Bos indicus
LQELVTFKDVAVDFTEEEWQHLDPSQRHLYREVMLENFGNLISLGHLLSEPEMIFHFEQEDDVWMEETIPRSSYSGVRDEN

SEQ ID NO: 15286 - protein, 81 aa, Bos indicus
PQDLMTFEDVAVEFTWWEWGQLDPTQKDLYREVMLENFKNLASLGFPVSKPYMICQLEEGEEPCILEREISTGVHSDWDRR

SEQ ID NO: 15287 - protein, 81 aa, Bos indicus
FQEPVSFKDVAVVFTEEELGLLDSAQRRLYQEVMLENFQNLLSVGNQPFKPELIFQLEREERLMMESQRGTKSPHNMESIQ

SEQ ID NO: 15288 - protein, 81 aa, Canis lupus
SQELVAFEDVLVDFTPEEWQYLNSSQKTLYREVMLETYGNLVSVEEACQVDEQIERQHQVDQDRYLLMQVGFPDKTIITKT

SEQ ID NO: 15289 - protein, 81 aa, Muntiacus muntjak
MTFKDVAVEFSQEEWECLDPAQRAFYMDVMVETLRNLMSVDISHIHVVKKLQPTSSSDTGDAFQTVTLERQKIPEMKYFCF

SEQ ID NO: 15290 - protein, 81 aa, Canis lupus
SQELLTFKDIFVDFTQEEWGQLAPAHRNLYREVMLENYGNLVSVAGYQLSKPGVISQLEKGEEPWLIKRVISGSPSSDLEN

SEQ ID NO: 15291 - protein, 81 aa, Muntiacus muntjak
EPVSFKDVAVVFTEEELGLLDSAQRKLYQEVMLENFRNLLSVGNQPFKPELIFQLEREELLMMETQRGGCSGTKSPHNMES

SEQ ID NO: 15292 - protein, 81 aa, Muntiacus muntjak
GSVTLQDVAVEFTPEEWLLLDCDQRTLYWDVMLENFRNLISVGTGCPVTETTVIFKVEQGQEPWMVEGENSRWSSPEADCP

SEQ ID NO: 15293 - protein, 81 aa, Muntiacus muntjak
GLFTFKDVAVEFTQEEWECLDPTQRALYRDVMLETYRNLLSLGSYSATFAIKELSSPKEDISKGELCHLMTLEKNETYGIK

SEQ ID NO: 15294 - protein, 81 aa, Muntiacus muntjak
ELLTLEDVAVEFNWEEWQLLDSAQKDLYWDVMLENYNNLVSLGYQGTKPDMLSKLEHGKEPCIIENKMQNRICPGIGKGDS

SEQ ID NO: 15295 - protein, 81 aa, Muntiacus muntjak
PKVPVSFEDVAVYFTKAQWKLLDHRQRKLYKQVMLDNYHNLVSLGFSSSKPQLVIQLEQGEKPWVADVQRMRITTGMQEGD

SEQ ID NO: 15296 - protein, 81 aa, Muntiacus muntjak
QLTFKDVFIDFTPEEWECLDPAQRNLYKDVMVETLRNLLSVDMSHMHTIKKLQAKANSVKGEIFQRVMFGRAESLDIKDFH

SEQ ID NO: 15297 - protein, 81 aa, Muntiacus muntjak
EAPKVPFDDVAVYFSEQEWGKLDEWQKELYKHVMRGNYETLVSLDYAISKPEVLSQIEQGKEPCSWRRTGPKVPDVPVDPS

SEQ ID NO: 15298 - protein, 81 aa, Muntiacus muntjak
DVAIDFTQEEWECLDLGQRELYTDVMVENYRNLASLGLVVSKPDLVTFLEQMKDLRNIRRMQTAGIYPGRREWMEPMTQSH

SEQ ID NO: 15299 - protein, 81 aa, Muntiacus muntjak
TSEPVSFADVAVYFSPEEWGCLQPAQRALYRDVMRETYGHLGALGFRGTKPALISWVEEEAELWGPDAGPPEMGECLTEAD

SEQ ID NO: 15300 - protein, 81 aa, Muntiacus muntjak
SVTFEDVAVDFTQEEWSLLDMSQKNLFRNVMVETITHLVSVGYQISKSDVISQLEQGKELWTEATGGLQGQSPVMPSVYRK

SEQ ID NO: 15301 - protein, 81 aa, Muntiacus muntjak
WKMWVKKPVTFEDVAVTFTQEEWKCLDASQRVLYQDVISETVRNLMSVDLIAKLEQEEKQWEADLCSPNEEGFHSGGKKEG

SEQ ID NO: 15302 - protein, 81 aa, Canis lupus
AQSLMAFEDVAVYFSQEEWELLDAAQRALYCHVMLENFALVASLGLSASRPRVVMQLERGEEPWVLSETDVMPARNAQRKA

SEQ ID NO: 15303 - protein, 81 aa, Gorilla gorilla
EKGPLTFRDVAIEFSLEEWQCLDTAQQDLYRKVMLENYRNLVFLAGIAVSKPDLITCLEQGKEPWSMKRHAMVDEPPGWSA

SEQ ID NO: 15304 - protein, 81 aa, Gorilla gorilla
QGRLTFRDVAIEFSLAEWKFLNPAQRALYREVMLENYRNLEAVDISSKRMMKEVLSTGQGNREVIHTGTLQRHHSYHIGDF

SEQ ID NO: 15305 - protein, 81 aa, Gorilla gorilla
LVTFRDVAIDFSQEEWECLDPAQRDLYRDVMLENYSNLISLDLESSCVTKKLSPEKEIYEMESLQWENMGKLTNHHLQYNG

SEQ ID NO: 15306 - protein, 81 aa, Mandrillus leucophaeus
SQESVTFQDVAVDFTEKEWPLLDSSQRKLYKDVMLENYSNLTSLGKASERAGLAEKSTEYAHLLEVFGMGPHLTQPMGRHA

SEQ ID NO: 15307 - protein, 81 aa, Sus scrofa
PHTLVTFKDVLVNFSREEWKLLDTAQQVMYKDVMLENYRNLVSLGLQLPKPDVILRLEKGEDLWPVERGIRQEPCPDLDTA

SEQ ID NO: 15308 - protein, 81 aa, Sus scrofa
SLEPVSFKDVAVDFTQEEWRQLDAEQKTTYRDVMLENYSHLVSVGCHIIKPEVITKLEQGEDPWIVEGEFLLQTYPEVWKV

SEQ ID NO: 15309 - protein, 81 aa, Sus scrofa
ARQSVTFQDVAISFSQEEWAFLVPSQRELYTAVMSETYQNLVWVGSQSIQESKESSLSKSIKEETYQHEIVTEKASSVFKK

SEQ ID NO: 15310 - protein, 81 aa, Nomascus leucogenys
HDTVAYEDLSEDYTQKKWKGLPLSQRALHWNMMLENDRSMASLGRNMMESSELTPKQEIFKGSESSNSTSGGLFGVVPGGT

SEQ ID NO: 15311 - protein, 81 aa, Nomascus leucogenys
FEELVTFEDVFVDFSPEELSSLSAAQRNLYRKVMLENYRNLVCLGYQFSKPDIISRLEEEESRAMETDSRHTVICQGESHD

SEQ ID NO: 15312 - protein, 81 aa, Canis lupus
AQESLTLEDVAVDFTWEEWQLLGPAQKNLYRDVMLENYRNLVSVGYQASKPDALSKLERGGELSMIEDEIHSRICPEIRKA

SEQ ID NO: 15313 - protein, 81 aa, Canis lupus
PQDLMTFEDVAVEFTQWEWGQLDPAQKDLYSEVMLENFKNLASLGLPVSKPYVISQLEEGKEPCVLEGEISTDWEKKPKVK

SEQ ID NO: 15314 - protein, 81 aa, Muntiacus muntjak
MVCESVTFKDVAVLFTRDEWAQLSPAQRALYRDVMLENYSNLVSLGLLGPKPDMFSQLGKGEAWMPEDSLGGFCLDWVITP

SEQ ID NO: 15315 - protein, 81 aa, Muntiacus muntjak
TSQGRLTFRDVAIDFTQEEWECLDLGQRELYKDVMLENYGNLASLGLVSKLDLIASLEQLKDPRNIRRLETTAIYPEHQSF

SEQ ID NO: 15316 - protein, 81 aa, Muntiacus muntjak
QAGSDLFRDVAVVFSQEEWEQLAPTQRDLYRDVMLETYSNLVSLGLAVSKPDVISFLEQGKEPWTVEGVATGGLCPVLKSR

SEQ ID NO: 15317 - protein, 81 aa, Canis lupus
VQESVTFKDVVVLFTRDEWAQLNPIQRALYRDVMLENYSNLVSLGLLGPQPDAFSQLGKEEEWMLEDTSGGFCVDWMTTPV

SEQ ID NO: 15318 - protein, 81 aa, Muntiacus muntjak
RLTFKDVAIEFTPEEWECLDLAQRTLYREVMVETLRNLLSVDTSPKRVMKGSAPKQSSHTGGILQTVLSERHKSHDTKDHA

SEQ ID NO: 15319 - protein, 81 aa, Gorilla gorilla
QGLLTFRDVAIEFSQEEWKCLDPAQRTLYRDVMLENYRNLVSLDISSKCMMKEVSSTAQGNREVIHTGTLQRHESHHTGDF

SEQ ID NO: 15320 - protein, 81 aa, Ailuropoda melanoleuca
HLQGSLSFKDVAVVFTWEEWQLLDPIQKNLYQDVMLENYSNLVSVGYQVTTADAFYQLENGTPWITEEEIQSQIHPAQRSH

SEQ ID NO: 15321 - protein, 81 aa, Ailuropoda melanoleuca
ARRDLAQQGHVTFEDVAVYFSWEEWGLLDEAQRLLYRDVMLENFSLMASLGLASSRTHEITQLEWWREPFLPPCGVLTAAM

SEQ ID NO: 15322 - protein, 81 aa, Ailuropoda melanoleuca
HVTFEDVAVYFSWEEWGLLDEAQRLLYRDVMLENFSLMASLGWRHRAEAEEAPREQSVHIEGVLRAKLQHQKLHCGGKPLR

SEQ ID NO: 15323 - protein, 81 aa, Ailuropoda melanoleuca
FQEPVMFKDVAVVFSEEELGLLDSSQRKLYRDVILENFRNLVSVGNQPFKPELIFQLEREEKLLMMEAEAQRGTKSQHNMD

SEQ ID NO: 15324 - protein, 81 aa, Lynx canadensis
AQVPLTFSDVAIDFSQEEWECLNSDQRDLYRDVMLENYTNLVSLDFDFTTETNKLSSEKSSYEVNSYHRETMKRSKTFNLM

SEQ ID NO: 15325 - protein, 81 aa, Phyllostomus discolor
AQGCVVFEDVAIYFSQEEWGLLNKAQRRLYHNVMLENLALLSSIGCWSGAQDEEAPLEQGDSGGGSQVRTPKSALSTQKTQ

SEQ ID NO: 15326 - protein, 81 aa, Phyllostomus discolor
DVVTFEDVTVYFSRTEWRLLDEAQRLLYLDVMLENFALISSLGCCCGAEDVEAPSEQKSKNPKAALSSQKSHPCERCGPVL

SEQ ID NO: 15327 - protein, 81 aa, Phyllostomus discolor
SQECLTFKDVSVDFSWEEWGCLDPAQRKLYSDVMLENYSNLVSLGLVVSKPVLVTFLEQMQESWDVSRKKSISTPPAVSSV

SEQ ID NO: 15328 - protein, 81 aa, Desmodus rotundus
KALESVAFRDVIVDFTEEEWQQLKPAQKDLYRDVMMENYWNLVSLDLETRPDLKESDPQEDNWEGRPSVAVTAEGPRRNST

SEQ ID NO: 15329 - protein, 81 aa, Canis lupus
GQSHVVFEDVAIYFSQEEWGLLDEAQRFLYHAVMMENFALLSSLGCWHGAQDEEAPSEQGVSSGASQVRTPKLGPSIQEAQ

SEQ ID NO: 15330 - protein, 81 aa, Muntiacus muntjak
MGLLTFQDVTIDFTQEEWECLDLGQRELYRDVMLENYGNLACLGLVVSKPDLVTFLEQMKDPWDVRRIETAIYPGMCIISV

SEQ ID NO: 15331 - protein, 81 aa, Canis lupus
SVTFRDVTVDFTQEEWQQLEPAQKDLYRDVMLENYRNLVSLDLETRVEMKQSRPTEDNVEHRPPVGVLGEGPARHGARGMA

SEQ ID NO: 15332 - protein, 81 aa, Muntiacus muntjak
MGRLTFWDVAIDFTQEEWECLDLGQRELYMDVIVENYRNLASLGLVVSKPDLVTFLEQMKDLRNIRRMQTTGIYPELSMCN

SEQ ID NO: 15333 - protein, 81 aa, Muntiacus muntjak
SLGSVSFRDVAVDFTQEEWQHLDPEQKTTYRDVMLENYSHLISVGCHIIKPEVITKLEQGEEPWVVEGEFLLQSRPEVWKV

SEQ ID NO: 15334 - protein, 81 aa, Muntiacus muntjak
AWSQMPVTFDDVALYLSREEWGRLDHTQQSYREVLQKRRGLSLGFPFSRPFWVSQVQGKGEAPGSSRQLGHEEEEKRGAVE

SEQ ID NO: 15335 - protein, 81 aa, Muntiacus muntjak
RLSFQDVAIDFTQEEWECLFLGQRELYRDVMLENYRNLASLQMKNPWDVRRLEMPAIYTAMSSHNTSFMSCSNLSQHQRIH

SEQ ID NO: 15336 - protein, 81 aa, Muntiacus muntjak
LKQGRLTFRDVAIDFIQEEWGCLDLGQRNFYRDVLIENYANLASLGVVSKLDLVAFLEQLKDPRNIRRMETTAIYPETLKS

SEQ ID NO: 15337 - protein, 81 aa, Muntiacus muntjak
LKMSLSFSDVAIDLSQEEWECMSPVQRALYRDVMLENYSNLVSLGCSTPKPDMITLLEQEKEPWMILREGTGSWFTDLESE

SEQ ID NO: 15338 - protein, 81 aa, Ailuropoda melanoleuca
QGLVSFKDVAVDFTQEEWQQLDPAQRTLYRDVMLENFSHLVSIGYAVSKPDVISKLEQGEDPWIIKRDIPNWIYPDENQAD

SEQ ID NO: 15339 - protein, 81 aa, Gorilla gorilla
VHGSVTFRDVAIDFSQEEWECLQPDQRTLYRDVMLENYSHLISLGSSISKPGVITLLEQEKEPWMVVRKETSRWYPDLESK

SEQ ID NO: 15340 - protein, 81 aa, Gorilla gorilla
EPLTFKDVAIEFSLEEWQCLDTAQRDLYRNVLLENYRNLVFLVMSFHFAQDLWPEQNIKDSFQKVTLRRYGKCEYENLQLR

SEQ ID NO: 15341 - protein, 81 aa, Ailuropoda melanoleuca
FQVLVTFKDVAVTFTQEEWGQLDLDQRALYEEVMLETCGLLVSLGHPVPKPELTHLLEHGQELWTGKGGLSHSTCSGRSRQ

SEQ ID NO: 15342 - protein, 81 aa, Gorilla gorilla
AYGSITFGDVAIDFSHQEWEYLNLVQKTLYQEVMMENYDNLVSLAGHSVSKPDLITLLEQGKEPWTIVREETRGECTDLDS

SEQ ID NO: 15343 - protein, 81 aa, Lynx canadensis
APGLLTFRDVAIEFSQEEWGFLNQSQRELYRDVMLETYGHLLFLGLIVSKPHLVIFLEQKRELWDVKRKKTVASPAGFFVL

SEQ ID NO: 15344 - protein, 81 aa, Lynx canadensis
LLTFRDVAIEFSQEELQCLNHSQWELYRDVMLENYGHLLFLVSLMVLHIHSEVFQNLIGSPLLGGLGEISAFLRKSRLMHF

SEQ ID NO: 15345 - protein, 81 aa, Lynx canadensis
SQGLVSFKDVAVDFTQEEWQQLDPAQRTLYRDVMLENFSHVISLGYPVSKPDVISKLEQGEDPWIIKRDVSNWIYTDENQA

SEQ ID NO: 15346 - protein, 81 aa, Lynx canadensis
REDAPVTFDDITVYLLQGEWMLLSQQQKEICGSDKCASPVPDSGPNYANPELFYKFERGPEPWVGSAQGQRNVLSHHPGKN

SEQ ID NO: 15347 - protein, 81 aa, Lynx canadensis
AQGLVTFRDVAIEFSQEEWKCLEPAQRNLYRDVTLENFSNLVSLGLSISKPDLISLLEQGREPWMIANDMTGPWCPELESR

SEQ ID NO: 15348 - protein, 81 aa, Lynx canadensis
VQGQVNFEDVAVYFSREEWGLLDEAQRLLYRDVMLENLALTASLGSWHGTEDEKTAFEQNISVGVSQVRTPKAVPSTQKAH

SEQ ID NO: 15349 - protein, 81 aa, Lynx canadensis
SQELLTFRDVAIEFSQDEWGFLNVVQWELYRDVMLENYGHLLFLGLAVSKPDLVMFLEEKKELCDVNEKETIATPPGFWST

SEQ ID NO: 15350 - protein, 81 aa, Phyllostomus discolor
VLFEDVSVDFTQEEWRLLDSAQRRLYRDVMLENYRHLASLEVQKASNRKERSQENEDKYSRQASFSNNKTLTKERSKTSGM

SEQ ID NO: 15351 - protein, 81 aa, Phyllostomus discolor
VVESVTFGDVAVLFSQDKWLCLDSAQRTLYQEVMLENYHSLVSLGILFSVPEVICLLAAGTDPCTMGRVIPPDTCLDFKTW

SEQ ID NO: 15352 - protein, 81 aa, Phyllostomus discolor
MLENYRNLVLLAGVSVSKPEVISLLEQGKEPWMVKEVETGGTYSDWEYAFKNSEFSSKQVIYEESSKVMRMGRSHFSYNLD

SEQ ID NO: 15353 - protein, 81 aa, Phyllostomus discolor
LQEPVTFEDVAVHFTQNQWASLDPAQRALYREVMLETYANVAALVAFPVPKPALIAQLERGEAPWGPDPWAAEVWSCICPG

SEQ ID NO: 15354 - protein, 81 aa, Phyllostomus discolor
AVVGVTFADIVLYFSREEWCLLDEDQRCLYLNVMLGNFELISSLGCCCGTEDVETLIEQSVLVMVSETKNLSVALSSQQSN

SEQ ID NO: 15355 - protein, 81 aa, Phyllostomus discolor
AAVGVTFADIALYFSRKEWCLLDEDQRHLYLDVMLENFELVSSLGCCCGAEDVEVPIEQNVSVGVSQAKNSKVASSSQKNH

SEQ ID NO: 15356 - protein, 81 aa, Phyllostomus discolor
AEVCVTLEDVAVYFSRTEWRLLDEAQRHLYLDVMLENFALVSSLGCCCGAKDVEAPSEQSIPVGVSQTRTPKEPPSSQKTH

SEQ ID NO: 15357 - protein, 81 aa, Canis lupus
RESGKAPVTFDDITVYLLQEEWMLLSQQQKEICGSDKLVAQLGPTITNPELFYKFERGPEPWLGNVQGQRTLLSHHPGKNK

SEQ ID NO: 15358 - protein, 81 aa, Canis lupus
SQSLLTFEEVAMYFSQEEWELLDPTQKALYNDVMRENYETVISLVVPVHQIPAFFEKTNTKDWTVTPELILPEFQSLLTFE

SEQ ID NO: 15359 - protein, 81 aa, Muntiacus muntjak
MLENYQAVASLDKDLSLWTLPLPFGISWLLLPQKLTCPFPTPALIFQLERGGTPWSLAPQEGLNGEGRRAIFLGREPQCSL

SEQ ID NO: 15360 - protein, 81 aa, Muntiacus muntjak
GQGHVTFEDVAVSFSQEEWGLLGEAQRLLYYDVMLENLSLIASLGCWRGGDTEEASSEQCVSAERVTRDRNPQEDPCILKA

SEQ ID NO: 15361 - protein, 81 aa, Canis lupus
TQDSVVFEDVAVDFTQEEWALLDLAQRSLYRDVMLENFQNLASLGYPLHTPYLISQWKQEEDLETVEQGLIQGKHQEGFKI

SEQ ID NO: 15362 - protein, 81 aa, Muntiacus muntjak
SQGLVTFEDVAVYFSLEEWERLDADQRELYKEVMRENYGILVSLGYPVPKPDLIFRLEQGEEPWVPDSPRPEEGEIVTGVY

SEQ ID NO: 15363 - protein, 81 aa, Muntiacus muntjak
MGLLTFSDVAIGFSQQEWECLDPVQKTLYRDVMMENYGNLVSLGHSISKPNVITLLEQGKEPWLVVREEARSWCTVLKPSL

SEQ ID NO: 15364 - protein, 81 aa, Gorilla gorilla
SQESLTFKDVFVDFTLEEWQQLDSAQKNLYRDVMLENYSHLVSVGHLVEKPDMIFRLGPGEESWMADGGTPVQTCAGEDRP

SEQ ID NO: 15365 - protein, 81 aa, Ailuropoda melanoleuca
QGSVTFRDVAVPFSREWESLSPAQRHLYRDVMLENYSNLVSLAGYSFSKPHVVTFLEQWKEPWMTVRELTTGCLPQFYGGE

SEQ ID NO: 15366 - protein, 81 aa, Ailuropoda melanoleuca
FESDLFRDVAIVFSQEEWEQLTPAQRDLYRDVMLETYSNLVSLGPGLAISKPDVISFLEQGMEPWMVEKAARGGLCPVLES

SEQ ID NO: 15367 - protein, 81 aa, Ailuropoda melanoleuca
KLYRDVMVENFKNLVSVGHLPFKLDMVSQLEAEENLWMMEGETQRSSKNQNEMETLQKVALKYLSHEELSCWQIWKQVASD

SEQ ID NO: 15368 - protein, 81 aa, Ailuropoda melanoleuca
LQVSVSFEDVTVDFSREEWQQLDPAQRRLYQDVTLENYSHLLSVGYRVPKPEVIFKLEQGEGPWTLEGETPHQSCSDEGIG

SEQ ID NO: 15369 - protein, 81 aa, Lynx canadensis
FQGLVSFEDVAVNFTWEEWQDLDDAQRTLYRVVMLETYSSLVSLGHCITKPEVIVKLEQGAEPWTVEEPLEQSLPDVQTAG

SEQ ID NO: 15370 - protein, 81 aa, Lynx canadensis
SHALVTFKDVLVNFTREEWKLLDTAQQIMYKDVMLENYKNLVSLGHQLPKPDVILRLEKGEEPWLVERGTHRETHPDLDTA

SEQ ID NO: 15371 - protein, 81 aa, Lynx canadensis
MFKEAVTFKDVAVVFTEEELGLLDPAQKKLYGDVMLENFRNLLSLEHRLFKHDTFRLEKVKTLWMMLASHRREKSGKSQAG

SEQ ID NO: 15372 - protein, 81 aa, Lynx canadensis
FQESVTFEDVAVYFSENEWIGLAPAQRVLYRDVMLENYGVVASLGYPFLKPAAISHLEQVEEPLNLKLQGEGPSLICTEGV

SEQ ID NO: 15373 - protein, 81 aa, Lynx canadensis
AQASVSFKDVTVDFSREEWQHLDPAQKTLYMDVMLENYCHLISVGCHMTKPDVILKLERGEEPWTSFTGHTCLEENWKDED

SEQ ID NO: 15374 - protein, 81 aa, Lynx canadensis
FQGSVSFKDVTVGFTQEEWQCLDSSQRSLYRDVMLENYSHLVSVGSCATKPEVIFRLEQGEEPWISEEEFPSQSLPEVWET

SEQ ID NO: 15375 - protein, 81 aa, Lynx canadensis
GKPGALSFADVAVYFSSEEWGCLRPAQRALYRDVMRETYGHLGALGEARPPALISWMERKKEAWSPEAEDPEDRARHPGYG

SEQ ID NO: 15376 - protein, 81 aa, Phyllostomus discolor
AEVGVTFADIALYFSREEWRLLDEAQRHLYLDVMLENFELISSLGCCCGTKDVEELIEQNISVRVVEEENPKVPLSSQKSH

SEQ ID NO: 15377 - protein, 81 aa, Phyllostomus discolor
VKDSVTFKDVAIDFTLEEWRLMDPTQRDLHKDVMLENYRNLVSLGLAVSKPDMISHLEDGKGLWVVVREISTSPYPELETK

SEQ ID NO: 15378 - protein, 81 aa, Phyllostomus discolor
QGFVSFKDVTVDFTQEEWQQLDSAQRNLYRDVMLENYSNLVAVAFEIRPKVKELTPQKIISEEVVLHNMIGYSISEDGKLR

SEQ ID NO: 15379 - protein, 81 aa, Phyllostomus discolor
AEVGMTFADIALYFSREEWRLLNEAQRRLYLDVMLENFELVSSLGCCCGTEDVEELMEKNISVRVVQAENLKMTLSSQKSH

SEQ ID NO: 15380 - protein, 81 aa, Phyllostomus discolor
RVTFEDVAVYFSLEEWDLLNEAQRHLYHDVMLENLALITSLGCWHGAQNEEVPSEHRDSLQGVSQVWTRKAGVSPQKAHPC

SEQ ID NO: 15381 - protein, 81 aa, Phyllostomus discolor
GEVLVTFEDVAVSLSRTEWLLLDETQRHLYLNVMLENYALISSLGCCCAAEHVVAPTEQNITIRISKAMNLKSALSFQKSH

SEQ ID NO: 15382 - protein, 81 aa, Phyllostomus discolor
FQRSLTFRDVAVDFSLEEWECLDPAQRKLYMDVMMENYRNLVSLGLVVSKPVLVTFLEKIKERWDVKGKKTCALSAMSSED

SEQ ID NO: 15383 - protein, 81 aa, Desmodus rotundus
LQEPFSFEDLSVDFTQKEWQLLDPSQKDLYKDVMLENYSSLVALGYEFMKPDVIFKLEQGEEPWIGDGEIPSSDSPEQVLQ

SEQ ID NO: 15384 - protein, 81 aa, Nomascus leucogenys
GYVTFEDVAVYFSQEEWRLLDEAQKLLYRNVMLENFSLLASLGCWHGAEAEEAPEQSASVGLLSSNIQQHQKQHCGEKPLK

SEQ ID NO: 15385 - protein, 81 aa, Nomascus leucogenys
MLENYKNLATVGCQLFKPSLISWLEQEESRTVQRGDFQALEWKMQLKTKESALQQDVLGEPTSSGIQMIGSHNGGEVNDVK

SEQ ID NO: 15386 - protein, 81 aa, Muntiacus muntjak
EQLTFKDVAIDFSPEEWECLDPAQRALYRDVIQLQLKSNSDTRKVLQTVLLRRPKSLEIKHFYLREMQENMNDFESQQRCD

SEQ ID NO: 15387 - protein, 81 aa, Muntiacus muntjak
IQDTVVFEDVAVDFTQEEWALLNLTQRNLYRDVMLENFRNLASLGYPLHKPYLISQWKQEEDLETVEKRPIQGEHQEGFKI

SEQ ID NO: 15388 - protein, 81 aa, Canis lupus
LGDVAIEFSQEEWTCLNHTQRKLYRDVMLENYGHLLFLGLIVSKPDLVSFLEQKKEPWSVKRKKRVTIHPAISFRDTQSLL

SEQ ID NO: 15389 - protein, 81 aa, Muntiacus muntjak
SFEALTFKDVAVTFTEEELGLLDLAQRKLYRDVMLENFRNLLSVGHQSSKPDMISQLEREEKLWTTEIQTQRGGRSGGRNH

SEQ ID NO: 15390 - protein, 81 aa, Muntiacus muntjak
EAVTFNDVAVVFTEEEMGLLDLAQRKLYQEVMLENFRNLLSVGHQSFTPDVPSQLEREEKLQMIKTAAQSCCSSVCQMGIW

SEQ ID NO: 15391 - protein, 81 aa, Muntiacus muntjak
QPGLVTFRDVAVEFSQEEWKCLEPAQRDLYREVTLENFGNLVSLGLSISKPDVVSLLEQGKEPWMVVNDVTGPWCPDLESR

SEQ ID NO: 15392 - protein, 81 aa, Muntiacus muntjak
SEMERLTSEDVAIKFTQEEWEFLDPAQRALYRDVMLETYRNLLSVGEDDLLPELPLGICIFPVCPLGGPDVFHLRVLVTRA

SEQ ID NO: 15393 - protein, 81 aa, Canis lupus
SQASLSFEDVAVSFSWEEWQLLTLSQKDLYWDVMLENYNNLVSLGYQASKQDSLFRLEQGGLPWTVEGVAHSQTCPEEIWE

SEQ ID NO: 15394 - protein, 81 aa, Muntiacus muntjak
KFQGSVSFKDVTVGFTQEEWQHLDSTQRSLYRDVMLENYRNLVSVEVCKTDLMKERSQENQPKHIWKVVLINNKSLTKEQG

SEQ ID NO: 15395 - protein, 81 aa, Muntiacus muntjak
LERPVSFKDVVVGFTQEEWHGLNPAQRALYRDVMLETYSNLVSVGYEGTKPYVILRLEQEEAPWICEAACSGCQGRENIWQ

SEQ ID NO: 15396 - protein, 81 aa, Muntiacus muntjak
VLFKDVAIDFSQEEWGYLDLEPKDMHRDVMLENCSNLVSLVSISKPDMLSLLKQGKEPWKVSRCETKKLPSKREIYELEAS

SEQ ID NO: 15397 - protein, 81 aa, Muntiacus muntjak
PQGGVTFEDVALSFSWKEWKLLDAAQRRLYHDVMLENYALIFSLGFWSGEEKVQTSFEQSVSVAVSQARTSKEPSSSQKTH

SEQ ID NO: 15398 - protein, 81 aa, Gorilla gorilla
MSKEAVTFKDVAVIFTEEELGLLDLAQRKLYRDVMLENFRNLLSVGHQPFHQDTFHFLREEKFWMMDIATQREGNSGGKIQ

SEQ ID NO: 15399 - protein, 81 aa, Phyllostomus discolor
SQGLLTFRDVSVDLSWEEWECLDPGQRKLYVDVMLENYRTLVSLGLFVSKPVLVTFLEQMKECWIINREKMVSAPPAVSSE

SEQ ID NO: 15400 - protein, 81 aa, Desmodus rotundus
CQESVTFMDVAVIFTDEEWRHLIPIQRDLYKQVMLENYESIVSLGLPVPQPDVIFQLKREDKPWIVDLHGSDESGNISLDW

SEQ ID NO: 15401 - protein, 81 aa, Macaca fascicularis
LQEPVTFRDVAVYFTQEEWGQLDPTQRILYRDVMLETFGHLLSIGPELPKPEVISQLEQGTELWVAERGTIQGCHPGWEPP

SEQ ID NO: 15402 - protein, 81 aa, Macaca fascicularis
IMEEAVTFKDVAVFFTEEELGLLDPAQRKLYRDVMLENFRNLLSAGHQPFHQDTFHFLREEKFWMMETVTQREGNLGSKIQ

SEQ ID NO: 15403 - protein, 81 aa, Macaca fascicularis
LPAKDSAWPWEGKPRYLGPVTFEDVAVLFTEAEWKRLNLEQRNLFKEVMLENLRNLVSLRLGSLRSGLLHLDMNMNLDLWL

SEQ ID NO: 15404 - protein, 81 aa, Nomascus leucogenys
LLVYLGPLTFIDVAIEFSLKEWQCLDTAQQNLYRDVMLENYRNLVFLGIAFSKPDLITYLEQGKEPWNMKRHETVAKPLGM

SEQ ID NO: 15405 - protein, 81 aa, Bos indicus
TEEPVTFEDVAVYFTQNQWASLDSAQRALYREVMLENYPNITSLTAFPFPKPDLIFWLERGEEPGRLDPWTLVRGEDPRGT

SEQ ID NO: 15406 - protein, 81 aa, Bos indicus
VQGSVSFEDVAVGFSQEEWQILGPSQKALYWDVMLENYCNLVSVGYQAPTPNSLFQLEQGGPPWTVEGAALSPTCSGKKLY

SEQ ID NO: 15407 - protein, 81 aa, Bos indicus
LMEAVTFGDVAVHFSREEWQCLDPGQRALYKEVMLENHSSVAGLGFLVFKPELISRLEQGQDPWVLDLQGAEGREEARTTR

SEQ ID NO: 15408 - protein, 81 aa, Bos indicus
KSWGPLSFMDVFVDFTWEEWQLLDSAQKHLYRSVMLENFRNLVSLGYQYTKPSIIFQLEQEELWMMHSPSQGHSGSKVETW

SEQ ID NO: 15409 - protein, 81 aa, Muntiacus muntjak
NPAFMAFLDVAVGFIQEEWKLLSPAQRTLHREVMLEIYNHLLSLNILLSKPELICMLEQGEEPWIEERQRSLGLCPEIQPC

SEQ ID NO: 15410 - protein, 81 aa, Muntiacus muntjak
MASPSPPPEPKEEWDYLDPAQRSLYKDVMMENYGNLVSLDVLNRDKDEEPTVKQEIEEIEEEMEPQGIIVTRIKSEIDQDP

SEQ ID NO: 15411 - protein, 81 aa, Muntiacus muntjak
GSFSFEDLSVDFTQKEWQLLDPYQKDLYKDVMLENYSSLVSLGYEVMKPGVILKLEQGEEPWTGDGEIPSSDSLDQVFQVN

SEQ ID NO: 15412 - protein, 81 aa, Canis lupus
YQEFVTFEDVAVHLTREEWGCLDPVQRDLYREVMLENYGNVVSLGILLRLPTTRIHSVNSCPALSHTQASAFSGETLAVLS

SEQ ID NO: 15413 - protein, 81 aa, Canis lupus
LLTFKDVVIEFSQEEWECLASAQRALYRDVMLENYRNLVSLDIPTICVRKELPPKDDLNNGELLQTLILERHLSHQFDDFD

SEQ ID NO: 15414 - protein, 81 aa, Muntiacus muntjak
RKRGSLTLEDVAVDFTWEEWQLLAPAQKALYRDVMLENYGNLVFVGYQASKPAALSRLERGEPWPVEDEVHSQLCPEMRKD

SEQ ID NO: 15415 - protein, 81 aa, Canis lupus
SVGPVSFKDVAVDFTQEEWQQLDPEQKTTYRDVMLENYNHLVSVGCHIIKPEVIIKLEQGEEPWIVGGEFLPQSYPEVWKA

SEQ ID NO: 15416 - protein, 81 aa, Muntiacus muntjak
LQGPVSFEDVAVYFSREEWGLLNWTQRSLYRHVMLENFALIGSLDFAPSKSPKVAQMEGEEEAWVPDMVDSVVSRAEARKG

SEQ ID NO: 15417 - protein, 81 aa, Gorilla gorilla
VSLAFRDVSIDLSQEEWECLDAVQRDLYKDVMLENYSNLVSLGTTPIPAPTQKNSIIAFVYSLLFFFADLEYKYITKNLLS

SEQ ID NO: 15418 - protein, 81 aa, Gorilla gorilla
YLGPVTFEDVAVLFTEAEWKRLSLEQRNLYKEVMLENLGNLVSLESKPEVHTCPSCPLAFGSQQFLSQDELHNHPIPGFHA

SEQ ID NO: 15419 - protein, 81 aa, Ailuropoda melanoleuca
QASVSFKDVTVEFTQEEWQQMGPIQRTLYRDVMLENYNNLVSVGNCIFKPAVIVKLEQGEEPWFLEEKFSNQSRQDYCDLW

SEQ ID NO: 15420 - protein, 81 aa, Ailuropoda melanoleuca
DSVVFEDVAVDFTQEEWALLDLAQRSLYRDVMLENFQNLASLGYPLHTPYLISQWKQEEDLETVERGPIQGEHQEGKNPWE

SEQ ID NO: 15421 - protein, 81 aa, Ailuropoda melanoleuca
MYFSQEEWELLDPTQEALYNDVMRENYETVISLALFVLPKPKVISYLERGEEPWVQGPLEFKNSPGDLPAGLKVKTDTENH

SEQ ID NO: 15422 - protein, 81 aa, Gorilla gorilla
AQVSVTFDDVAVTFTQEEWGQLDLAQRTLYQEVMLENCGLLVSLGCPVPRAELIYHLEHEQEPWTRKEDLSQGTCPGDKGK

SEQ ID NO: 15423 - protein, 81 aa, Ailuropoda melanoleuca
FEPLTFRDVAVVFTEEELGLLDPAQRKLYRDVMLENFRNLLSVGNQPFKPELIFQLEREEKLLMMEAEAQREGYLGTKSQH

SEQ ID NO: 15424 - protein, 81 aa, Ailuropoda melanoleuca
EEAVVFADVAVNFTPEEWALLDGGQRRLYRDVMLETCRNLASLVCLPVLNRSHWAEPVCESNEGNPCGETVNQTTGLTVLE

SEQ ID NO: 15425 - protein, 81 aa, Ailuropoda melanoleuca
SWVSVSFEDVTVDFSREEWQQLDPAQRRLYQDVTLENYSHLLSVAGYEVPKPEIIFKLEQGEEPWILERKTPHQSCSDGRF

SEQ ID NO: 15426 - protein, 81 aa, Phyllostomus discolor
KPRAMKFADVAVYFSPEEWECLRPAQRALYRDVMQETYRHLGALETRTRKKTEEKEVFPPKEAPRKGKRGRRPSKPRLIPR

SEQ ID NO: 15427 - protein, 81 aa, Phyllostomus discolor
SQGLVTFEDVAVYFSLEEWGRLDAGQRDLYEEVMRENYGILVSLGYPIPKPDLISRLEHGQEPWVPDSPRPEEGDIVTGVY

SEQ ID NO: 15428 - protein, 81 aa, Phyllostomus discolor
TVMFKDVAVVFTEEELALLDPSQKILYQDVTLENLRNLISVGQWNQNEIETVHEVALRYLFHEDLVCWQIWDQLLSKLIRN

SEQ ID NO: 15429 - protein, 81 aa, Muntiacus muntjak
MGRLTFWDVAIDFTQEEWECLDLGQRELYMDVMVENYRNLASLDLVTFLEQMKDLRNIRRMQTTGIYPVSTVHTLSNHSEH

SEQ ID NO: 15430 - protein, 81 aa, Muntiacus muntjak
MGHVTFEDVAVSFSQEEWGLLGEAQRLLYYDVMLENLSLIASLGCWQGGEAEKAISKQCVSVEQVTRDRNPQPDPSSLKTL

SEQ ID NO: 15431 - protein, 81 aa, Muntiacus muntjak
HCGSVTFRDVAIDFSQEEWEFLDSAQRDLYRDVMWENYSNFISLGPSMSKPDVITLLGEGKEPWMVVREGTGRHHPDLESR

SEQ ID NO: 15432 - protein, 81 aa, Muntiacus muntjak
FQEIATLKDVAMDFTLENWEQLGQGQGDLFWDTALDNYQNLFLLSEPPPRPNLTFHPDGGEKLEALVKESPESTDADIAET

SEQ ID NO: 15433 - protein, 81 aa, Canis lupus
MLENYANVASLAFLFTRPVLVSQLERGELPWGLEPWEPVGREALRGICPGGETRAEKEESTPKGHISKETESHRLTLRGLP

SEQ ID NO: 15434 - protein, 81 aa, Muntiacus muntjak
AQLTFKDVAIEFTQEEWECLDPAQRALYRDVMVETLRNLVSLDISHILVIKKLQLNAKTDRGEEFQTVILGRHERNKIKDF

SEQ ID NO: 15435 - protein, 81 aa, Muntiacus muntjak
ALNRVTFEDVAVYFSQEEWYLLDEAQIQLYLDVMLENFALVCMLGSWSGAGDEDTPFEQSKSVGVSQIGTPRADSSAENVQ

SEQ ID NO: 15436 - protein, 81 aa, Gorilla gorilla
SQHLVTFEDVAVDFTQEEWTLLDQAQRDLYRDVMLENYKNLIILAGSELCKLSLMSGLEQMEELRTGVTGVLQGEKQYCRE

SEQ ID NO: 15437 - protein, 81 aa, Ailuropoda melanoleuca
LVLFKDVAVDFSQEEWECLDLEQKDLYRDVMLENYSNLVSLAGFSISKADVLSLLKQGKEPWKVVQDVTRSQNSDWESKCE

SEQ ID NO: 15438 - protein, 81 aa, Phyllostomus discolor
PTVQESVTFKDVAVDFTQEEWHHMAPAQRRLYRDVMLENYSNLVSLGYQVSKPEVIFKLEQGEEPWLSEGEIQRSFCPEHG

SEQ ID NO: 15439 - protein, 81 aa, Phyllostomus discolor
MDSVAFEDVAVNFSLEEWALLQPAQKKLYRDVMRETFRNLASIGEKWKDPDIEDQYKKQGEKLRSHMVEKLCESKEDSQCE

SEQ ID NO: 15440 - protein, 81 aa, Desmodus rotundus
CVTFEDVDILFSQEEWGLLDEAQRHLYLDVMLENLSLIASLGEQLCPDPWHLVFQVLVCWHTAENEETPEQSVSVEALPRV

SEQ ID NO: 15441 - protein, 81 aa, Desmodus rotundus
SVAFRDVIVDFTQEEWQQLKPAQKDLYRDVMMENYWNLVSLDLETRPDKKESDPQEDDWEDRPSIAVVAEGPMRTGDQGCI

SEQ ID NO: 15442 - protein, 81 aa, Desmodus rotundus
VTFADIALYFSKKEWCLLDEDQRCLYLDVMLENFELISSLGCCCGAEDVKASNEENVSIEVSQAKQPKTPFSPWHCHPCES

SEQ ID NO: 15443 - protein, 81 aa, Macaca fascicularis
GSELFRDVAIVFSQEEWQCLAPAQRDLYRDVMLETYNNLVSLGLAISKPDVISFLEQGKEPWMVERVVSGGLCPVLESRYD

SEQ ID NO: 15444 - protein, 81 aa, Macaca fascicularis
MRDVMLENYRNLVSLGVAISNPDLVTCLEQRKEPYNVKIRKIVARPPAVRSHFTQDRWPVQGIEDSFHNLILRRYEKCRHE

SEQ ID NO: 15445 - protein, 81 aa, Macaca fascicularis
MFKEAMTFKDVAVVFTEEELGLLDLAQRKLYQDVMLENFRNLLSVGHQAFHRDTFHFLREEKIWMMKTATQREGDSGDKIQ

SEQ ID NO: 15446 - protein, 81 aa, Macaca fascicularis
EMGPLTFRDVVIEFSQEEWQCLDTAQQDLYRKVMLENFRNLVFLGIDVSKPDLITCLEQGKDPWNMKRHSMVAAPPVKCSH

SEQ ID NO: 15447 - protein, 81 aa, Macaca fascicularis
WLQEPMTFKDVAVEFTQDEWMMLDSAQRSLYRDVMLENYRNLTSVEYQLCKLTVISPLDQEEIRNVEKRIPQGICPDQKIL

SEQ ID NO: 15448 - protein, 81 aa, Canis lupus
LPDLVTFEDVAVEFSQEEWALLDPSQRTLYRDVMRENCRNLASLGYHVDKPSLISQLEQEDKVMTEERGILQGTCSDLETV

SEQ ID NO: 15449 - protein, 81 aa, Canis lupus
MLENYGHLLFLGLVWKPDFVIFLVEEKQLWDVKRKETVPFHPAVSSSGTQSFLPTLCIEASFQNVAVHRYKHSALENLHFM

SEQ ID NO: 15450 - protein, 81 aa, Muntiacus muntjak
TQLTIEDVDIKFTPEEWECLDPAQRALYWDVMEETYRNLLSVDVSHIHMTKKLQAKGNSGKGEILQRVMFRRTETHETKDF

SEQ ID NO: 15451 - protein, 81 aa, Canis lupus
ETVTFKDVAVIFTEEELGLLDPAQRKLYGDVMLENFRNLLSVGDKNLNDTETLQEIGLKYLPHEELFCSQIWQQVTKELTL

SEQ ID NO: 15452 - protein, 81 aa, Muntiacus muntjak
FQESVTFKDVAVDFTLEEWRLMDPTQRDLHKDVMLENYRNLVSLGLAISKPDMISHLEDGKGPWVVVREISRTPFSELETK

SEQ ID NO: 15453 - protein, 81 aa, Muntiacus muntjak
MGRLTFQDVAIDFTQEEWECLDLGQRELYRDVLLENYGNLASLGLVSKLDLVTFLEQLKDPRNIRRMETTTSYPGVSVFYF

SEQ ID NO: 15454 - protein, 81 aa, Canis lupus
QGSVTFEDVVVYFSWEEWGLLDETQRCLYHDVMLENFALVISLGCWYGMEDEAAVSVQRMSLGKTSSPDPSIWKAQPCEKC

SEQ ID NO: 15455 - protein, 81 aa, Muntiacus muntjak
KVPVTFVDIAVYFSEDEWKNLDEWQKELYNNLVKENYKTLMSLDSEGPVSKPEAPSQAEPREEPCVWEQRDPEEREILMDP

SEQ ID NO: 15456 - protein, 81 aa, Muntiacus muntjak
QPDLVTFGDVAVDFSQEEWEWLNPAQRSLYRTVMLDNYRSLVSLGVSASKPDVISLLEQGKEPWLVKEEGPRGARPDSSPT

SEQ ID NO: 15457 - protein, 81 aa, Ailuropoda melanoleuca
QEPVTFEDVAVYFTQNQWAKLDPTQRALYREVMLENYANVASLVAFPFPKPDLVSQLERGEVPWGPDPWEAEVLRGICPGG

SEQ ID NO: 15458 - protein, 80 aa, Gorilla gorilla
MCGPLQFTDVAIEFSLEEWHCLDTAQRNLYRDVMLENYRNLVFLGIVVSKPELITCLEQGKKPLTMKRHEMIAKPPGRCK

SEQ ID NO: 15459 - protein, 81 aa, Gorilla gorilla
FQEAVTFKDVAVAFTEEELGLLDSAQRKLYRDVMLENFRNLVSVGHQSFKPDMISQLEREEKLWMKELQTQRGDRNQNEMA

SEQ ID NO: 15460 - protein, 80 aa, Ailuropoda melanoleuca
QGWLTFRDVAIEFSQEEWECLDPAQRALYRDVMVENYRNLVSLGISLSDLNIVSFLEQGKEPWTVEGKVKKPNGWEYGIG

SEQ ID NO: 15461 - protein, 81 aa, Ailuropoda melanoleuca
QGSLSFRDVAVGFTRKEWQQLEPAQRMLYRDVMLENYSHLVSVATGCQVTKPAVISRLEQGQEPWMEDIVTNPLIRSQPGN

SEQ ID NO: 15462 - protein, 81 aa, Ailuropoda melanoleuca
LQASVSFKDVTVEFTQEEWQKIGPAQRTLYRDVMLEIFSHLVSVGYCYTTPEVILRLEQAEDACLLEKEFLTRNSSGEERF

SEQ ID NO: 15463 - protein, 81 aa, Phyllostomus discolor
SQDSVTFQDVAVDFTEKEWPLLDSSQRKLYKDVMLENYSNLASVGCQVGKPSLISHLEQEEELRTEERGLLQGTCPDWEIP

SEQ ID NO: 15464 - protein, 81 aa, Phyllostomus discolor
ADTSVTFEDIAMHFSWEEWRLLDEAQRRLYLHVMLDNFTLISSLGCCCGAKDVEAPTEENICVPVSQARNAKTAVSSQKSH

SEQ ID NO: 15465 - protein, 81 aa, Desmodus rotundus
GLFIPKPYVITLLEDGKEPWMVERNLTEDMFSDWNLRWENKELSTKENVYDDDSTQTRISAERKSHEYDIFKKSLLKKSLI

SEQ ID NO: 15466 - protein, 81 aa, Macaca fascicularis
MGPLTFMDVAIEFSLKEWQCLDTAQQNLYRDVMLENYRNLVFLGIAFSKPDLITYLEQGKEPWNMKRHETVAKPLVMCSYF

SEQ ID NO: 15467 - protein, 81 aa, Macaca fascicularis
FQEAVTFKDVAVAFTEEELGLLDSAQRKLYRDVMLENFRNLVSVGHQSFKPDMISQLEREEKLWMKEFQTQRGDRNQNEMA

SEQ ID NO: 15468 - protein, 81 aa, Gorilla gorilla
IGGDVTFSDVAIDFSHEEWGWLNSAQRDLYKDVMVQNYENLVSVAGLSVTKPYVITLLEDGKEPWMMEKKLSKGMIPGWES

SEQ ID NO: 15469 - protein, 81 aa, Gorilla gorilla
DGLVTFRDVAIDFSQEEWECLDPAQRDLYVDVMLENYSNLVSLDLESTTYETKKIFSENDIFEINFSQWEMKDKSKTLGLE

SEQ ID NO: 15470 - protein, 81 aa, Gorilla gorilla
MKPGVISHAPDSVVPAAFPFPKPDLIFQLEQGEAAWGPDPWTLAGGEALRGMCTGGKTKTENEEKTAQLNISKESESHRLI

SEQ ID NO: 15471 - protein, 81 aa, Gorilla gorilla
VTFEDVAVNFTWEEWNLLSEAQRCLYRDVTLENLALISSLGCHCVAQDGVHDPSTLASKHAGITGVSYCAWPFFFFFFFNF

SEQ ID NO: 15472 - protein, 81 aa, Gorilla gorilla
YQDSVTFEDTAVDFTQEEWTLLDPVQRNLYRDVMLENYENVAKVGFQLLKPSVISWLEEEVLRTLQQGVLQDWAIKHQTSV

SEQ ID NO: 15473 - protein, 81 aa, Gorilla gorilla
QLSFSDVAIEFSQEEWKCLDPGQKALYRDVMLENYRNLISLDFSLLAWDARVFRVEAWRASGGAEEPTGPNFVGNDSPLPS

SEQ ID NO: 15474 - protein, 81 aa, Ailuropoda melanoleuca
QEPVTFEDVAVYFTQNEWVILDPSQRALYREVMLENYANVASLAFLFTRPVLVSQLERGELPWGLELWEPAGREALRGVCP

SEQ ID NO: 15475 - protein, 81 aa, Ailuropoda melanoleuca
LQASVSFKDVTVEFTWEEWRQMDSAQRTLYRDVMLENYSHLVSVGYCFTKPELIFTLEQGEDPWLLKKEFLRKSTPEDSQP

SEQ ID NO: 15476 - protein, 81 aa, Lynx canadensis
RPRAVKFADVAVYFSTEEWGCLRPAQRALYRDVMRETYGHLGALGFPGPKPALISWMEQESEAWSPAAQDPEEGESLGGAL

SEQ ID NO: 15477 - protein, 81 aa, Lynx canadensis
GPWTLLTFRDVAIEFSQEEWGCLNHSQRELYRDVMLETYGHLLFLGLVSKPDLVILLEQKKELWGVKRKETVGCQFEGHVT

SEQ ID NO: 15478 - protein, 81 aa, Lynx canadensis
MFTGYCLTKPKMIFRLEQEEEPWSLEEEFLNQRYPGYLSIDIHIEGNQEKQEKPLWQVIFTNNKTLSKEEQKVLEKPFNLD

SEQ ID NO: 15479 - protein, 81 aa, Lynx canadensis
FQESLALEDVAVNFTWDEWQLLDSAQKNLYRNVMLENVSSLVSLGFQLIKPDVIFKLEREQPCIIGEEVPSQSLSGESPVR

SEQ ID NO: 15480 - protein, 81 aa, Lynx canadensis
PLESVTFEDVAVDFTQEEWALLDASQRKLFRDVMLENIRHLVSLGYQHCQSDVIFQLEQGEELWAEGSGSLQSQGPGGESA

SEQ ID NO: 15481 - protein, 81 aa, Phyllostomus discolor
LQESLTFHDVAVDFTLEEWQLLDPNQKDLYRDVMLENYSNLVSVAGYQASKPDTLSRLERGEEPRAVQDEMHHVVCPELRR

SEQ ID NO: 15482 - protein, 81 aa, Phyllostomus discolor
KAQGLVTFEDVAVDFTQEEWQYLNPPQRILYRGVMMETYRNLVFVGQQATKPDLILKMEVEEPYLAEDKIPIWSCPEEACQ

SEQ ID NO: 15483 - protein, 81 aa, Desmodus rotundus
FQPPVSFKDVVVSFTRDEWGQLDTIQRTLYRDVTLETCGHLVSLGLLLPNLDVISRLENGEDPWRAEQEPPTQDWKTTLEK

SEQ ID NO: 15484 - protein, 81 aa, Desmodus rotundus
SVTFRDVIVDFTQEEWEQLKPVQKDLYRDVMMENYWNLVSLDLETEGDMNDPDPEKDSWEDRPSVTSSMPAPPRLEGPRGA

SEQ ID NO: 15485 - protein, 81 aa, Desmodus rotundus
ELLTLEDVSVEFNWEEWQLLDAAQKDLYQDVMLENYHNLLSLGYHTAKPDALSKLEHGEEPQIIEDDIYNISCAEIRKVGS

SEQ ID NO: 15486 - protein, 81 aa, Macaca fascicularis
DSMTFEDIVVDFTREEWALLDTSQRKLFQDVMLENISHLVSIGREGDIKHQEIPFIQHTYQKGTSTISTMRSHTQEDPFLC

SEQ ID NO: 15487 - protein, 81 aa, Macaca fascicularis
IQDSVVFEDVAVDFTQEEWALLDLAQRNLYREVMLENFQNLASLGYLLHTPHLICQWEQEEDLQTVKRELIQVIFMGEHQE

SEQ ID NO: 15488 - protein, 81 aa, Macaca fascicularis
MLENFALLASLGIAFSRSCAVIKLEQAEEPWVYDQVDMTSATEREAQSGLRRGCWYGVENEEVSSEQSISVAGVSQVRTLT

SEQ ID NO: 15489 - protein, 81 aa, Macaca fascicularis
PQGLLTFRDVAIEFSQDEWKCLDPAQRSLYRDVMLENYRNLVSLDISSKCMLKTLSSTGQGNTEVILTGTLQRQASHHTGE

SEQ ID NO: 15490 - protein, 81 aa, Macaca fascicularis
QGHVTFEDIAVYFSQEEWGLLDEAQRCLYHDVMLENFSLMASVARLSESNHKDSCSQQKVTVSLNNCVAQCSPDDGHYTPK

SEQ ID NO: 15491 - protein, 81 aa, Macaca fascicularis
RQAFLAFGDVTVDFTQKDWRLLNPAQRALYREVTLENYSHLVSLGILHSKPELIRRLEQGEAPWGEERRCRPGPRAGIYAE

SEQ ID NO: 15492 - protein, 81 aa, Macaca fascicularis
IWDLVMFRDVAVDFSQEEWECLNSYQRNLYRDVILENYSNLVSLGCSISKPDVITLLEQGKEPWMVMRDEKRRWTLDLESR

SEQ ID NO: 15493 - protein, 81 aa, Macaca fascicularis
MGLLTFRDVAIEFSLEEWQCLDTAQKNLYRNVMLENYRNLAFLGVAVSKPDLIICLEKDKEPWNMKRHEMVDEPPGICPHF

SEQ ID NO: 15494 - protein, 81 aa, Phascolarctos cinereus
MYFSEQEWRNLEDWQKDLYKNIMKSNYETLVFLGCANSKPDLITWIERGQEPFIRDLGSLERKDLAISTRAEEHLHLKSAK

SEQ ID NO: 15495 - protein, 81 aa, Phascolarctos cinereus
MMENYKNFVFLGLPVSKLDVISLLERGEAPWMPEGGVPSRCCPGSHTQETRCETQESGWIQGISMGVSSKKILKEDSSWHY

SEQ ID NO: 15496 - protein, 81 aa, Phascolarctos cinereus
WQESLTFKDVTVDFTQEEWGLLDHSQKGLYKEVMLENSQNLLSLGIPVLREDFMSHFEKREVSWILDQIGPRNFCPDAETS

SEQ ID NO: 15497 - protein, 81 aa, Macaca fascicularis
PQGLLTFRDVAIEFSQDEWKCLDPAQRSLYRDVMLENYRNLVSLEFQSVTQAKVQWCDLGSLQPPLPRFKQFSCLGLPSSW

SEQ ID NO: 15498 - protein, 81 aa, Phascolarctos cinereus
KESVTFKDVAVEFTQEEWVQLNPSQKKLYRDVMLENYKNLVSLALPSVAFALPQEDSLEEEGMASAPKPGPGKVSASCSFP

SEQ ID NO: 15499 - protein, 81 aa, Phascolarctos cinereus
AQELLTFKDVAVDFTQEEWGLLDHPQKKLYKEVMLENAQNLLSLGLPVLREDLISYFEEKEAPWLLEYEGRRSCYPEGEIR

SEQ ID NO: 15500 - protein, 81 aa, Phascolarctos cinereus
APGSSRPPAQELVTFQDVAVDFTQEEWGLLDHPQKELYKEVMLENAQNLLSLGLPVPREDLISYCEEREAPWLLEQEGPRS

SEQ ID NO: 15501 - protein, 81 aa, Phascolarctos cinereus
SQESVTFQDVAVDFTREEWKRLDSAQRDLYRDVMLENYQNLVSLGLLVFQSDVISQLENGEVPLVPGGEVPRGTRPGSVNQ

SEQ ID NO: 15502 - protein, 81 aa, Gorilla gorilla
FQELVTFRDVAIDFSRQEWEYLDPNQRDLYRDVMLENYRNLVSLGGRSISKPVVVDLLERGKEPWMILREETQFTDLDLQC

SEQ ID NO: 15503 - protein, 81 aa, Ailuropoda melanoleuca
HRSMIFRDVAIDFSQQEWEYLDSVQKNLYRDVMMENYEYLGLTGAGHSISKPDVITLLEQGKDPWMVVKEDTRRWCTGKYE

SEQ ID NO: 15504 - protein, 81 aa, Lynx canadensis
FQERLTFRDVAIEFSQEEWVCLDPSQRALYRDVMLENYRNLVSLGKENVPPEVGICPRAASQSNIERTHWTRHVEGWGRSV

SEQ ID NO: 15505 - protein, 81 aa, Ailuropoda melanoleuca
FQGSMMFRDVSVNFSQEEWECLDSGQMNLYKEVMLENFSNLVSVGLSNSKPAVISLLEEGKEPWMVERELTRGLCSDLESM

SEQ ID NO: 15506 - protein, 81 aa, Lynx canadensis
GRVTFEDVAVYFSGEEWGLLDEAQRCLYQDVMLETLAHITSLDLAHQQQRTGEKCFGSNRGGASSWKDYTFCVSGKPFSCG

SEQ ID NO: 15507 - protein, 81 aa, Lynx canadensis
MFTFLYRISRPSVISQLEQKEEPWALPLQNFEARRILQESHTDFENQVTKLSRDISEAAERCGTSSERANKDISPPPSWGG

SEQ ID NO: 15508 - protein, 81 aa, Lynx canadensis
GLLTFRDVAIEFSQEEWGCLNQSQRELYRDVMLETYGHLLFLGEDNSFQTSQTSLTQSNQGSHVSKQITSKYDECGKALKQ

SEQ ID NO: 15509 - protein, 81 aa, Lynx canadensis
GYGSVSFRDVAISFSQEEWACLDPAQRALYRDVMLENYSHLLSLAGRSISKPDVITLLEQEKEPWVVIWSQIMELRSYLQK

SEQ ID NO: 15510 - protein, 81 aa, Lynx canadensis
MLETYRNLVSLGLQRSKPDVISRLEKGEEPWTPHSLRIEESWIRNHRSGSFESLMEKKELTPKQEISKAVESQRAKPEEHA

SEQ ID NO: 15511 - protein, 81 aa, Lynx canadensis
RSQESLTFQDVAVDFTREEWDQLYPAQKNLYRDVMLENYRNLVALGHQLYKPEVISQLEQEEQWMMERGSSGDIRAGGENR

SEQ ID NO: 15512 - protein, 81 aa, Lynx canadensis
SQDLVTFKDVAIDFSQEEWEWLNPAQRSLYKNMMLENYRNLVSLGLCISKPDVISLLEQGEDPWMMKGERTGGLCPDLESV

SEQ ID NO: 15513 - protein, 81 aa, Lynx canadensis
MLENFRNLVSVGCQATKRDALSVLEHRDEAWMKAEDEIQDRTHAGIGKVDSHLQEHSQNHRFLKGLQQYGEQSAFRNAVHL

SEQ ID NO: 15514 - protein, 81 aa, Lynx canadensis
LLTFRDVAIEFSQDEWGCLNQSQRELYRDVMLETYGHLLFLDTLAQYTLKQSSSIAGHQRIRVGENPYTGNESGNMFSQSL

SEQ ID NO: 15515 - protein, 81 aa, Lynx canadensis
AHHLVMFRDVAVDFSQEEWECLNSYQRNLYRDVILENYSNLVSVAGCTISKPDVITLLEQGKEPWMVVRDERRRRSLDLES

SEQ ID NO: 15516 - protein, 81 aa, Lynx canadensis
FKEAVTFKDVAVVFTEEELGLLDPAQKKLYGDVMLENFRNLLSLGHQNFTPDAVPQFKRGGRLWMIKAATQSHGSSGDRNL

SEQ ID NO: 15517 - protein, 81 aa, Lynx canadensis
LQEAFSFEDLSVDFTQKEWQLLDPSQKDLYKDVMLENYSSLVSLGYEVMKPDVIFKLEQGEEPWVGDGEVPSADCSEQDLQ

SEQ ID NO: 15518 - protein, 81 aa, Phyllostomus discolor
AQGHVTFEDVAVYFSWEEWELLDEAQRHLYRSVMLENFSLMASLGLASSRTHEITQLEQWGEPFLPAHGVITAAMPGGHWH

SEQ ID NO: 15519 - protein, 81 aa, Phyllostomus discolor
SVTFKDVIVDFTQEEWKQLDPVQRDLFRDVTLENYTHLVSIDWEAKLENSISVPEPDTPEEEPSPEAVVEKHKSDDVSESW

SEQ ID NO: 15520 - protein, 81 aa, Phyllostomus discolor
AQGLMVFEDVAVYFSREEWELLDAAQRALYRHVMLENFALVASLGLSASRPRIVIQLECGEEPWLLSGSDVTLARNAQRRP

SEQ ID NO: 15521 - protein, 81 aa, Phyllostomus discolor
GLLTFEDVAVFFTQEEWDYLDPAQRSLYKDVMMENYGNLVSLDVLNRDKDEEPTVKQEIEEIEEEVESKGIIVTRIKSETD

SEQ ID NO: 15522 - protein, 81 aa, Desmodus rotundus
DPLAIEDVVVTFTLEEWALLDSSQKKLYKDVMRKTFKNFLASIGKKWDIHDIEELYKNQGRKLRNYMVEKLCENKEGSQCG

SEQ ID NO: 15523 - protein, 81 aa, Macaca fascicularis
LQVSITFKDLAVRFSEEEWRLLEEGQREFYRDVMRENYETLVSVGTAELLPLSAFLSPSESGGAVVGGSHADEGQEPAGGG

SEQ ID NO: 15524 - protein, 81 aa, Macaca fascicularis
EQGLVTFEDVAVDFTQEEWQYLNLPQRTLYRDVMLETYSNLVFVGQQVTKPNLILKLEVEEYPAEGKIPFWNFPEVCQVDE

SEQ ID NO: 15525 - protein, 81 aa, Macaca fascicularis
YQDSVTFDDVAVEFTPEEWVLLDTTQKYLYRDVMLENYMNLASVEWEIQPRTKRSSLQQGFLKNQIFTGIQMTRNYSGWKL

SEQ ID NO: 15526 - protein, 81 aa, Macaca fascicularis
MNNSQGRVTFEDVTVNFTKGEWQRLNPEQRNLYRDVMLENYRREETTKPDVILRLEQGKEPWLVEEEVLGSGRPEKNGDVG

SEQ ID NO: 15527 - protein, 81 aa, Phascolarctos cinereus
AQESVTFEDVAVEFTGEEWRQLDPAQRNLFREVTLENYRNLVSLGLTVAKPNLIFLLERGEAPWTLQRQVPGGPSSDCHCW

SEQ ID NO: 15528 - protein, 81 aa, Phascolarctos cinereus
SQELVTFKDVTVNFTQEEWRQLNPAQRDLYRDVMLENYRNLISLGLPISTSDMIFQLEQEKGPWAFDLQRSEEKEVPRNIY

SEQ ID NO: 15529 - protein, 81 aa, Ailuropoda melanoleuca
QEAVVFADVAVDFTPEEWALLDGGQRRLYRDVMLETCRNLASLDCLLPFKSSLMLGCSPGAGQQPHLLSDLPVAAGTVQSG

SEQ ID NO: 15530 - protein, 81 aa, Ailuropoda melanoleuca
LVMFEEVSVCFTSEEWECLGPIQRALYWDVMLENYGNVTSLEWETMTENEEVTPKPSISQRADSQKGTSRRLQGGVPQTPD

SEQ ID NO: 15531 - protein, 81 aa, Gorilla gorilla
ESLQFRDVAVEFSLEEWHCLDTAQQNLYRDVMLENYRHLVFLGIIVSKPDLITCLEQGIKPLTMKRHEMIANSPVMCSHFA

SEQ ID NO: 15532 - protein, 81 aa, Ailuropoda melanoleuca
SLDSVTFTDVAIDFSQDEWEWLSLAQRTLYKKVMLENYRNLLSLGLCISKPDVISLLEQGREPWMMKGERTRGLCPDLEYV

SEQ ID NO: 15533 - protein, 81 aa, Lynx canadensis
RKYVGLPFQGSVTFRDVAVAFSQQKWESLNSAQRDLYRDVMLENCSNLVSLGHSLSKPHVITLSEWKEPWMIEDHRRPCTG

SEQ ID NO: 15534 - protein, 81 aa, Lynx canadensis
VQESVTFRDVAVVFSQDEWLRLDSAQRTLYREVMLENYGTLVSLGIPSSTPKVICRLQQGKDPCVVERETPQDACLGFKTW

SEQ ID NO: 15535 - protein, 81 aa, Lynx canadensis
WLVTFRDVAINFSQEEWECLNSTQRDLYRDVMLENYSNLISLDLESSCETKKSSPEKGAYEMESLQWENRRKPISHNFDYN

SEQ ID NO: 15536 - protein, 81 aa, Lynx canadensis
ILGKEIFKDVAIYFSQKEWECLHPSQKGLYRDVMLENYNNLISLGLSDSKPNVISLLEQGKEPWLVKSKETKEWCPDWESR

SEQ ID NO: 15537 - protein, 81 aa, Lynx canadensis
AQELLTLEDVAVDFSREEWQLLAPAQKDLYRDVMLENFRNLVSVGCQATKRDALSVLEHRDEAWMKAEDEIQDRTHAGIGK

SEQ ID NO: 15538 - protein, 81 aa, Phyllostomus discolor
LPDMVTFEDVCVEFTQEEWALLDPSQKTLYKDVMLENCRNLASLGYHVDKLNLISPLEQEDKVMAEGRGVLPDICPDLETI

SEQ ID NO: 15539 - protein, 81 aa, Phyllostomus discolor
VTFGDVAVLFSRDEWLCLDSAQRTLYREVMLENYHSLVSLGWGSLFETTFSKEDYQEVMSKLIGDGTFNFKLEKIYINEDK

SEQ ID NO: 15540 - protein, 81 aa, Phyllostomus discolor
SQSLVTFGDVAVDFSQEEWELLTCAQRALYRDVMLENYRNLVSLGLCFSKPDMIYSLEQREEPWMAKRKVTRGPCPDWQAL

SEQ ID NO: 15541 - protein, 81 aa, Phyllostomus discolor
VTFEDVAVYFSRTEWSLLDAAERRLYRHVMLENFGLISSLGCCCGAADVEAPTNQNLSVRVAQAKDPKAALSSKKSHPCDS

SEQ ID NO: 15542 - protein, 81 aa, Macaca fascicularis
MLENYRNLISLGEDNVPPEAWICSGICLPDLSVISILEQKRDPWTLQSDVKVANNPNGREYIKGVKTEKSSKLGRNAGNKP

SEQ ID NO: 15543 - protein, 81 aa, Macaca fascicularis
QGRVTFEDVTVNFTKGEWQRLNPEQRNLYRDVMLENYSNLVFVGREETTKPDVILRLEQGKEPWLVEEEVLGSGRPEKNGD

SEQ ID NO: 15544 - protein, 81 aa, Phascolarctos cinereus
VKMSVTFDDVAVYFSKNEWKKLEWSQKELYKHVMRTNYETLISLDYTIPKPDLISHIEQGKEPVFKSLANLETNVRTIQSS

SEQ ID NO: 15545 - protein, 81 aa, Phascolarctos cinereus
PKVPVTFDDVAVHFSEQEWGNLSEWQKELYKNVMRGNYESLVSMDYAISKPDLMSQMERGERPTMQEPEDSEEGETPTDPS

SEQ ID NO: 15546 - protein, 81 aa, Phascolarctos cinereus
GKESVTFKDVAVEFTREEWVQLNTSQKKLYRDVMLENYRNLFSLGFAVSKPDVIYQLERKEASWMPEADIPEGSCPESREF

SEQ ID NO: 15547 - protein, 81 aa, Phascolarctos cinereus
SVTFKDVAVDFTWEEWGYLDTSQKELYWEVMLENYRNLVSLDGDTRPQIKESTPKFSISMEPLSQQRSLWDDSCFSKMGKA

SEQ ID NO: 15548 - protein, 81 aa, Phascolarctos cinereus
WSQGSVTFSDVSVDFTQEEWKQLDLAQRNLYRDVMLENYRNFISLGQQVSKPRIISQLEQEEPWMVENTIPKDICPDWEAD

SEQ ID NO: 15549 - protein, 81 aa, Phascolarctos cinereus
QDLVTFKDVSVDFTREEWMRLDHPQRALYRDVMLENYRNLVLVSLAGHPISKPDVISRLEQGGVPWVLKKGATGRAFSDRE

SEQ ID NO: 15550 - protein, 81 aa, Phascolarctos cinereus
PKVPVIIEDVAVYFSEQEWGNLDEWQKELYKHVMRGNYETLVSLDYAISKPDLLSRIEQGEEPCGQELSNTEERENPVHPS

SEQ ID NO: 15551 - protein, 81 aa, Phascolarctos cinereus
TQESVTFKDVAVDFTRKEWEQLTPAQRYLYRDVMLENYRNLVSLGLPVSKPEVISQLEQGEVPWLAEEEVPRSTYSDWETR

SEQ ID NO: 15552 - protein, 81 aa, Myotis lucifugus
MNFEDVAIVFSEEEWGLLDEAQRLLYCNVMLEVFALVSSAGCCHKTDDEEACPEQSVSVQGESQVRASKTEPTTQRTHVCK

SEQ ID NO: 15553 - protein, 81 aa, Gorilla gorilla
FKDVCVDFTQEEWYLLDPAQKILYRDVILENYSNLVSVGYCITKPEVIFKIEQGEEPWILEKGFPSQCHPERKWKVDDVLE

SEQ ID NO: 15554 - protein, 81 aa, Ailuropoda melanoleuca
FESFSYIDVAIDFSQEEWECLNSDQKDLYRDVMLENYTNLVSLDGNGHLHSAPDLFFHLPSSYFPLPHPAIPSFSKIKFWK

SEQ ID NO: 15555 - protein, 81 aa, Ailuropoda melanoleuca
KVPVSFEDVSVYFTKTEWKLLDLRQRILYKRVMMENYRHLVSLGIGFLSSKPHLVSWLEQGEGPWAADICRTPAATGRQTG

SEQ ID NO: 15556 - protein, 81 aa, Gorilla gorilla
QGLLTFSDVAIEFSQEEWKCLDPAQRTLYRDVMLENYRNLVSLDISSKCMMKTFFSTGQGNTEVFHTGTLQRQASHHIGDF

SEQ ID NO: 15557 - protein, 81 aa, Ailuropoda melanoleuca
TFKETVTFKDVAVVFTEEELGLLDLTQRKLYRDVMLENFGNLVSVGHHPFKRDVVHLVREEKFWMVKLATQRKGSSGYKVQ

SEQ ID NO: 15558 - protein, 81 aa, Ailuropoda melanoleuca
DLMTFEDVAVEFTQWEWGQLDPAQQDLYREVMLENFKNLASLGEPSGLPVSKPYVITQLEEGKDPCVLDGEISTGEVSERS

SEQ ID NO: 15559 - protein, 81 aa, Ailuropoda melanoleuca
KFNEAVTFKDVAVVFTREELGLLDPIQRKLYWDVMLENFRNLVSVGYEPFRLDTLLLGREEKLWMMETETQGDGTSGLRNQ

SEQ ID NO: 15560 - protein, 81 aa, Ailuropoda melanoleuca
EAVTFKDVAVAFTEEELGLLDSSQRKLYQDVMLENFRNLVSVGIFRSFSFGFFPHAFLSLAPLIFSSIPPYTAVSEVHSCL

SEQ ID NO: 15561 - protein, 81 aa, Gorilla gorilla
VGLQYQGSVTFEDVAIAFSQQEWESLDSSQRGLYRDVMLENYRNLVSMGHSLSKPHVIALLEQWKEPEVTVRKDGRRWCTG

SEQ ID NO: 15562 - protein, 81 aa, Phyllostomus discolor
FSQHLVTFEDVAVDYEEWMLLDQMQRDLYRDVMLENYKNLITLTGYEPCKPGVNSGLEGAEELRTGTGVLQALDLQLKTKA

SEQ ID NO: 15563 - protein, 81 aa, Phyllostomus discolor
MMGLVTFEDVAVDFTQEEWQYLNPPQRILYRGVMMETYRNLVFVAGQQATKPDLILKMEVEEPYLAEDKIPIWSCPEEACQ

SEQ ID NO: 15564 - protein, 81 aa, Phyllostomus discolor
QAKVTFEDVAVLLSPEEWGHLGPAQRGLYRDVMLETYRNLVSLAYEISTECRELTSGEMLDGAEPDQLGGPVPQGTEPEEA

SEQ ID NO: 15565 - protein, 81 aa, Phyllostomus discolor
AEASVTFEDVAVHFSWDEWRLLDEAQRRLYLCVMLENFSLISSLGCCCGRKDVETPIEQNVSVQVSQTKNPKATSSSQKTH

SEQ ID NO: 15566 - protein, 81 aa, Macaca fascicularis
SVAFEDVAVTFTQEEWALLDPSQKTLYRDVMQETFRNLASVGKKWKAQNMYVEYENLKRNLSFVGERLFESKEGHQHGEIL

SEQ ID NO: 15567 - protein, 81 aa, Macaca fascicularis
RNMIPQDNENPPQQGEANQNDSMTFEDVAVNFTPEEWALLDPSQKNLYQEVMQETLRNLASIEVLWKRDYLKVKVISLEKF

SEQ ID NO: 15568 - protein, 81 aa, Macaca fascicularis
ACESITFGDVAIDFSHQEWEYLNLVQKTLYQEVMMENYDNLVSLAGHSISKPDLITLLEQGKEPWMIVGEETRGECTDLDS

SEQ ID NO: 15569 - protein, 81 aa, Macaca fascicularis
GQLTLKDVAIEFSQEEWTYLDPAQKTLYRDVILENYRNLVSLDISCKCVNKDPPPKGKNSMGEAFHMVKLEGLESCDEALS

SEQ ID NO: 15570 - protein, 81 aa, Macaca fascicularis
AQESVTFEDVAVNFTNREWQSLTYAQRHLYKHVMLENYGNMVSLGFPFPKPPLISHLERGVEPCVQDPQDGESLSCSYPVS

SEQ ID NO: 15571 - protein, 81 aa, Macaca fascicularis
KSLVTFEDVAVYFSQEEWELLDAAQRHLYHSVMLENLELITSLGNTLSQHGDDQLMPCNISVEEVLPVRIPNADSSTKKAN

SEQ ID NO: 15572 - protein, 81 aa, Phascolarctos cinereus
VPKVPGTFENDGVYFSEQEWENLDDWQKELYRNVMKSNFETLVSLDCAISNPEILAHQEEESGTEELGDLAGESPGGPHPD

SEQ ID NO: 15573 - protein, 81 aa, Phascolarctos cinereus
AQELVTFKDVAVDFTPEEWGLLDHAQKELYKTVMLENAQTLLSLGLPVPREDWIFHLEQEGLRNSCPDAETGFDVKRMNTN

SEQ ID NO: 15574 - protein, 81 aa, Macaca fascicularis
MLVTFKDVAVTFTQEEWRQLDLTQRTLYREVMLETCGLLVSLGDRTQVHTREPTTYPPVLSEWAFLRGSLTVASSTSSDSR

SEQ ID NO: 15575 - protein, 80 aa, Phascolarctos cinereus
MTPVLGTAGHRQGSVTFQDVAVVFTPEEWGHLEPSQKELYREVMLENFRNLVCLAGARGSTVEARGRSPENQLFRLGDSA

SEQ ID NO: 15576 - protein, 81 aa, Phascolarctos cinereus
EDEEEMLAGLVTARAQEEWSHLHPTQKDLYWHVTLENCENLVSLGLPVSKLDVLSLLGRGNASWKPEGEESPQSTCPDSLN

SEQ ID NO: 15577 - protein, 81 aa, Phascolarctos cinereus
FQEAVTFKEVTVDFTREEWERLDPLQRDLYKDVMLENYRNLVSLGLMDSKPVMISWLEWGEEFQMPYPQETEKGVVLEGTC

SEQ ID NO: 15578 - protein, 81 aa, Phascolarctos cinereus
MTFEDMAMYLTREEWRPLDPTQRDLYRDVMQENYGNVVSLDFDIRSENEANPKVISEDIEFGDISERPIESAHQTPECEEG

SEQ ID NO: 15579 - protein, 81 aa, Gorilla gorilla
VIFKDVAVVFTKEELALLDKAQINLYQDVMLENFRNLMSVSEDGIKNNILNLQEKGLSYLLQEVLHCWQISKQRIQDLTGS

SEQ ID NO: 15580 - protein, 81 aa, Gorilla gorilla
SQELLTFKDISIDFTQEEWGQLAPAHQNLYREVMLENYSNLVSVGYQLSKPSVISQLEKGEEPWMAEKEGPGDPSSDLKSK

SEQ ID NO: 15581 - protein, 81 aa, Gorilla gorilla
QASVCFEDVAMAFTQEEWEQLDLAQRTLYREVTLETWEHIVSLDWKATLEENRLNSEKDRAREELSHHVEVYRSVQEEPPS

SEQ ID NO: 15582 - protein, 81 aa, Ailuropoda melanoleuca
VLEAVTFKDVAVVFTEEELGLLDPAQRKLYGDVMLENFRNLISVGHHPFKRDVVHLVREEKFWMVKLATQRKGSSGGKIQS

SEQ ID NO: 15583 - protein, 81 aa, Ailuropoda melanoleuca
ELIAFQDVVVDFSQEEWGQLSPGQKALYWDVMLENYRNLVSLGKTSVQFKALFISLPLPLSASPSGSVSHNPCDRIDCPCV

SEQ ID NO: 15584 - protein, 81 aa, Ailuropoda melanoleuca
SEESVTFKDVAVDFTQEEWGQLDSPQRALYRDVMLENYQNLLALAGPPVCKPDVISHLERGEEPWWMPREVPGGACLEGEP

SEQ ID NO: 15585 - protein, 81 aa, Ailuropoda melanoleuca
QGSVLFEDISVDFTQKEWQLLNPAQRLLYKEVMLENYRQLVSLAGHCVTKPELVLKLEQGEEPWAPKRELPSQSRPEIQKA

SEQ ID NO: 15586 - protein, 81 aa, Ailuropoda melanoleuca
PVTFQDVTVEFTRGEWEHLDTYQRALYREVMLENYRSLASLDQETRSRIAKSNLKQVISEEFSQTMIINKGKRNGVCYPTR

SEQ ID NO: 15587 - protein, 81 aa, Ailuropoda melanoleuca
QWMPVTFDDVAVTFTQEEWGQLEPVQRTLYREVMLETCGLLVSLGCPLPKPELIYALDHSPELQTLKRGLSLNSCPGDSTK

SEQ ID NO: 15588 - protein, 81 aa, Ailuropoda melanoleuca
RPLPGGPWQRHKNHRTEQVLEWLFISQEQPKMTQSRGPLSFVDVCVDFTWEEWRLLEPAQKHLYRSVMLENYSHLVSLGRS

SEQ ID NO: 15589 - protein, 81 aa, Ailuropoda melanoleuca
GESVTFKDIAVDFTQEEWALLDTSQRKLYRDVMLENISHLVSVETGYHLCKSDVISQLEQGVELWREGEGFLQGLNPGELQ

SEQ ID NO: 15590 - protein, 81 aa, Lynx canadensis
MAHMAFRDVAVDFSQEEWMLLSPAQRSLYREVMLENYSNLVSLGIPVSKPKLITQLEQGKETWREERKCSPATCPAEPKPE

SEQ ID NO: 15591 - protein, 81 aa, Lynx canadensis
TQVSVTFDDVAVTFTREEWGQLDPAQKTLYQEVMLENCGLLVSLGCPVPRPELICQLERGQEPWTAKRGLSQNTYPGDKDK

SEQ ID NO: 15592 - protein, 81 aa, Lynx canadensis
AVTFRDVAVAFTEEELGLLDSAQRKLYQDVMLENFRNLVSVGHQSLKQDKWRIEKEKLWSMKTAAQMERNVGKNQARVSSF

SEQ ID NO: 15593 - protein, 81 aa, Lynx canadensis
AGYQVSKPEVIFKLEQGEEPWISEGEIQRPFCPDWKTRPEGKSSHLQQSVSEGSRSADGLSRATFENTWDVSSQLERHQEN

SEQ ID NO: 15594 - protein, 81 aa, Lynx canadensis
KSLGSVSFKDVMVDFSREEWQRLDLAQKSLYRDVMLENYFNLISVGCQVPKPEVIFNLEQEEPCVLDGDISSHNCLNGDIG

SEQ ID NO: 15595 - protein, 81 aa, Lynx canadensis
MYFSQEEWELLDPTQKALYNDVMRENYETVISLALFVLPKPKVISYLEQGEEPWVQGSTELKDSPGELPTGIKHKSDTENH

SEQ ID NO: 15596 - protein, 81 aa, Lynx canadensis
LQESLTLEDVAVDFTQEEWRLLAPAQKDLYRDVMLENFRNLVSVGCQATKRDALSVLEHRDEAWMKAEDEIQDRTHAGIGK

SEQ ID NO: 15597 - protein, 81 aa, Phyllostomus discolor
SQDLVTFEEVAVDFSPKEWALLSLAQKILYRDVMMETLRHVASVGYYLCKHSLVTEVEQEELRTEERRNLQVEPDLQISCS

SEQ ID NO: 15598 - protein, 81 aa, Phyllostomus discolor
IRSDLVAFEDVAVRFSLEEWALLQPAQKKFYREVMWETFRNLASVSKDDKSHLVERLHKGEKNGQCGENVGFIPNLNVKKK

SEQ ID NO: 15599 - protein, 81 aa, Phyllostomus discolor
LQGSVSFKDVTVDFTQEEWQQLDTDQKALYRDVMLENYCHLVSVGFHMTKPDMIRKLEEGEELWTTERIFPSQGYLEEDGK

SEQ ID NO: 15600 - protein, 81 aa, Desmodus rotundus
GPVLFRDVAVDFTQEEWQQLDPEQKTTYRDVMLENYSHLVSVGCQVVKPEVIIKLEQGEEPWVEGELLPRRWPGVWRADVT

SEQ ID NO: 15601 - protein, 81 aa, Macaca fascicularis
QESLTLEDVAVEFSWEEWQLLDTAQKNLYRDVMVENYNHLVSLGYQTSKADVLSKLAHGQEPWITRNPIYAVNCSDYGNAF

SEQ ID NO: 15602 - protein, 81 aa, Macaca fascicularis
MGPLTFTDVAVEFSLEEWQCLDTAQQNLYRNVMLENYRNLVFLGITVSKPDLITCLEKEKEPWNMKRYEMVDELPVICSHF

SEQ ID NO: 15603 - protein, 81 aa, Macaca fascicularis
ARDLVMFRDVAIDFSQEEWECLNSYQRNLYRDVILENYSNLVSLGCSISKPDVITLLEQGKEPWMVMRDEKRRWTLGPTFK

SEQ ID NO: 15604 - protein, 81 aa, Macaca fascicularis
EMGLLTFRDVAIEFSLAEWQCLDRAQQNLYRDVMLENYKNLVSLGIAVSKPDLITHLEQNKEPRNIKKNEMLAKHPVMCSH

SEQ ID NO: 15605 - protein, 81 aa, Gorilla gorilla
MEFVTLKDVGMDFTLGDWEQLGLEQGDTFWDTALDNCQDLFLLDPPRPNLTSHPDGGEDLEPLAGGSPEAPGPDVTETKNS

SEQ ID NO: 15606 - protein, 81 aa, Ailuropoda melanoleuca
LQESVTFRDVAVFFSQDEWLRLDSAQRTLYREVMLENYGTLVSLGIPFSTPKVICQLQQGEDPCVVDRELPQDAWPGLKTQ

SEQ ID NO: 15607 - protein, 81 aa, Ailuropoda melanoleuca
LLQGFVSFKDVTVDFTWEEWQQLDSAQRSLYRDVMLENYSNLVSVGCQSLKSDVILLKQGEPWMKEEEISSWAYSDWRFED

SEQ ID NO: 15608 - protein, 81 aa, Ailuropoda melanoleuca
PQAKVTFEDVAVLLSQEEWDRLGPAQRGLYRHVMMETYGNVVSLGLPGSKPNVISQLERGEEPWVLDGQGAEKTRGLGSGH

SEQ ID NO: 15609 - protein, 81 aa, Ailuropoda melanoleuca
MTFEDVAVEFTQWEWGQLDPAQQDLYREVMLENFKNLASLGLPVSKPYVITQLEEGKDPCVLDGEISTGEPDWEKRPKAKE

SEQ ID NO: 15610 - protein, 81 aa, Ailuropoda melanoleuca
VSFKDVTVDFTWEEWQQLDSAQRSLYRDVMLENYSNLVSIGCQSLKSDVILLKQGEPWMKEEEISSWAYSDFGIRPKMKEL

SEQ ID NO: 15611 - protein, 81 aa, Lynx canadensis
AHRSVTFRDVAIHFSQQEWEYLDPVQKNLYRDVMMENYDNLVSLEHSISKPDVITLLEQRKEPWMVVREDTKRWCTDLESK

SEQ ID NO: 15612 - protein, 81 aa, Lynx canadensis
MTSGLLTFRDVAIEFSQEEWGFLNHSQWALYRNVMLETYGHLLFLAGLVVSKPDLVIFLEQKESWNVKGKETVTTHPDRWE

SEQ ID NO: 15613 - protein, 81 aa, Lynx canadensis
FQGSVTFRDVAIDFSQEEWEWLQPTQRDLYRHVMLENYSHLVSLAGLNISKPYVVSLLEQGKEPWLEKRGVRRNLFSEPNR

SEQ ID NO: 15614 - protein, 81 aa, Lynx canadensis
APGLLTFRDVAIEFSQDEWGCLNQSQRELYRDVMLETYGHLLFLGLIVSKPHLVIFLEQKRELWDVKRKKTVASPAAISSH

SEQ ID NO: 15615 - protein, 81 aa, Lynx canadensis
LQESLTLEDVAVDFTQEEWRLLAPAQKDLYRDVMLENFRNLVSVGHQASKPDVLAKLERGEEPWAIEEEVRSGTSPETGKV

SEQ ID NO: 15616 - protein, 81 aa, Lynx canadensis
AQESVMFSDVSIDFSQEEWECLNDDQKDLYRDVMLENYSHLVSMAGHSVSKPDVISFLEQGKEPWLVDRELTRDQWPVLES

SEQ ID NO: 15617 - protein, 81 aa, Phyllostomus discolor
SWQGVTFEDVAVYFSREEWSVLNSTQRSLYRDVMLENFALIVSLGFVPSRSHAVAQVEDKEELQMANMVDMTLVRRAEARR

SEQ ID NO: 15618 - protein, 81 aa, Phyllostomus discolor
AEVGVTFADIALYFSGEEWCLLNEDQRCLYLDVMLDNFELASSLGSCCGAEDVEAPIEQNVPVRVAEAKNLRVALPCWKSH

SEQ ID NO: 15619 - protein, 81 aa, Phyllostomus discolor
GSVSFTDVTVDFTQEEWEQLEPSQRILYMDVMLENYSNLLSVEVWKADDQMEREHGDPEEQARPFIIFKNQSPVEERSDLF

SEQ ID NO: 15620 - protein, 81 aa, Phyllostomus discolor
MLENYGNLVSVAGYELCKPRVISKLEKGEEPWISEKEGPGHHSSDLKSKTETYMSTAKNDILQEELYQGIMTERFMRDDVI

SEQ ID NO: 15621 - protein, 81 aa, Phyllostomus discolor
SPRRPAEVGMTFADIALYFSREEWRLLNEAQRRLYLDVMLENFELVSSLGNAFTVPVVWTRLCISLYPLFSRGYSLLIRGL

SEQ ID NO: 15622 - protein, 81 aa, Phyllostomus discolor
GIRTASCWDISMDFTWEEWQLLDSAQKYLYRDVILENYRNLVSVGYHGTKPDLIFKLEQGEEPWIRNAKISRPRCSEGWKE

SEQ ID NO: 15623 - protein, 81 aa, Phyllostomus discolor
MYFSRTEWCLLGEAQRCLYLEVMLENYALISSLGCCCGTEEVEAAIQENVSAGDSKAKNIKSALSSQKSHPCESCGFILKD

SEQ ID NO: 15624 - protein, 81 aa, Phyllostomus discolor
TARSQASMTFKDVAMDFTPEEWGKLDPAQRNVMLENYRNLVSLWLPVSKPENYNLESGKDPLMLEKKVPKSSYSELESRPE

SEQ ID NO: 15625 - protein, 81 aa, Desmodus rotundus
VQESVTFKDVVVDFTQEEWKQLDPVQRDLFRDVTLENYTHLVSIGLQVSKPDVIFQLEQGTEPWIVEPGIPVGGSGDWETR

SEQ ID NO: 15626 - protein, 81 aa, Desmodus rotundus
QEPVTFRDVAVDFTREEWGQLGPAQRTLYRDVMLETFGHLLSVGPELPKPDVISQLEQGAELWMVERGIAQGRCPGWEPGP

SEQ ID NO: 15627 - protein, 81 aa, Desmodus rotundus
RAAWAKKPVTFEDVAVNFTQEEWESLDARQRVLYQDVMSETFKNLVSVDLITKLEQEEKQWRADLCPPNGEGLSSGGKKEE

SEQ ID NO: 15628 - protein, 81 aa, Macaca fascicularis
EPLTFRDVAIEFSPEEWKCLDPAQQNLYRDVMLENYRNLVSLAVCSYFTQDFLPVQGIEDSFHKCILRRYEKFSSLFSSCH

SEQ ID NO: 15629 - protein, 81 aa, Macaca fascicularis
LGPVTFEDVAVLFTEAEWKRLNLEQRNLFKEVMLENLRNLVSLAESKPEVHTCPSCPLAFGSQQFLSQDELHNHPIPGFHA

SEQ ID NO: 15630 - protein, 81 aa, Macaca fascicularis
SQASVSFQDVTVEFTQEEWQHLGPVERTLYRDVMLENYSHLISVGYCITKPKVISRLEQGEEPWSLEDEFLNQKHQGYFKV

SEQ ID NO: 15631 - protein, 81 aa, Macaca fascicularis
FQELVTFRDVAIDFSQQEWEYLDPNQRDLYRDVMLENYRNLVSLGGHSISKPVVVDLLEQGKEPWMILREETQFTDLDLQC

SEQ ID NO: 15632 - protein, 81 aa, Macaca fascicularis
QGLLTFRDVAIEFSQEEWKCLDPAQRTLYRDVMVENYRNLVSLDISSKCKMKEFLSTAQSNREVFHTGTLQRHESHQIGDY

SEQ ID NO: 15633 - protein, 81 aa, Macaca fascicularis
VHGSVTFRDVAIDFSQEEWECLQPDQRTLYRDVMLENYSHLISLGSSISKPDVITLLEQEKEPWMVVRKETSRWYPDLESK

SEQ ID NO: 15634 - protein, 81 aa, Canis lupus
MLQTTGLIGEFFQEEWDYLDPAQRSLYKDVMMENYGNLVSLDVLNRDKDEEPTVKQEIEEIEEEVEPQGVIVTRIKSEIDQ

SEQ ID NO: 15635 - protein, 81 aa, Muntiacus muntjak
LSLTFEDVAIYFSEQEWQNLEAWQKELYKQVMRANYEILLSLDNGLPKPELISWIEQGKELFKKWGESQESRSIICSSADL

SEQ ID NO: 15636 - protein, 81 aa, Muntiacus muntjak
CYSASVSFKDVTVEFTQEEWHQMDSAQRTLYRDVMLEIYSHLVSVVMQKKKKLCSRLPSPESWWNIFIIPPNSLYPFAVII

SEQ ID NO: 15637 - protein, 81 aa, Muntiacus muntjak
FILTFKDVAIEFTQEEWECLDPAQRALYRDVMVETLRNLVSLDISHMHVIKKLQLNANIYRGEGFQTVILGRHKRNKIEDF

SEQ ID NO: 15638 - protein, 81 aa, Canis lupus
TQGCVISEDVFVYFSWEEWMLLDDSQRLLYQDVMLENFALLASLGIASSRSHLVTQLNPREDPQMPEQVNMNPATEREAQK

SEQ ID NO: 15639 - protein, 81 aa, Muntiacus muntjak
LPGSSVHGDVAIDFTQEEWECLDLGQRELYTDVMVENYRNLASLGLVISKPDLVTFLEQMKDLRNIRRMQTAGIYPGRREW

SEQ ID NO: 15640 - protein, 81 aa, Gorilla gorilla
AQERVTFRDVAVFFSQDEWLHLDSAQRALYREVMLENYSILVSLGIPFSMPKLIHQLQQGEDPCMVEREVPSDTCLGFKTW

SEQ ID NO: 15641 - protein, 81 aa, Gorilla gorilla
VTFEDVTIIFTWEEWKFLNSSQKRLYREVMWENYTNVMSVENWNESYKSQEEKFRYLEYENFSCWQGWWNAGAQMYENQNY

SEQ ID NO: 15642 - protein, 81 aa, Gorilla gorilla
YQGSVTFEDVAIAFSQQEWESLDSSQRGLYRDVMLENYRNLVSMAGHSLSKPHVIALLEQWKEPEVTVRKDGRRWCTDLRL

SEQ ID NO: 15643 - protein, 81 aa, Ailuropoda melanoleuca
QGRLTFRDVAIEFSQEEWECLDPAQRALYRDVMLENYRNLVSLGIPLPDLNSIFILEQGKEPQTVESKVKTVKKPNGFQSH

SEQ ID NO: 15644 - protein, 81 aa, Ailuropoda melanoleuca
ERVLVSFEDVAVFLSREEWGCLGPAQRGLYRDVMLETYRNLISLAGFQDSKPDVISKLEKGEEPWAPYSPRIEECSKGYGH

SEQ ID NO: 15645 - protein, 81 aa, Ailuropoda melanoleuca
KQGGVTFEDVAVYFSQEEWSLLNEAQRRLYHDVMLENFALISSLGCCCRAEAVETPFEQSISVGVSQAKTPKEPRSSQKTH

SEQ ID NO: 15646 - protein, 81 aa, Gorilla gorilla
PHLLVTFRDVAIDFSQEEWECLDPAQRDLYRDVMLENYSNLISLEPARTHKEQHNLPVPKAGSVNLAAGFGHSRSQTGCGS

SEQ ID NO: 15647 - protein, 81 aa, Gorilla gorilla
IQGPLTFGDVAVAFTRIEWRHLDAAQRALYRDVMLENYGNLVSVGLLSSKPKLITQLEQGAEPWTEMREAPSGTHAAQDCW

SEQ ID NO: 15648 - protein, 81 aa, Gorilla gorilla
MFKEAVTFKDVAVAFTEEELGLLGPAQRKLYRDVMVENFRNLLSVGHQPFKQDTSPIERNEQLWIMTTATRRQGNLDTLLV

SEQ ID NO: 15649 - protein, 81 aa, Gorilla gorilla
GPVSFKDVAVDFTQEEWQQLDPDEKIAYGDVMLENYNHLVSVGYDYHQAKHHHGVEVKEVEQGEEPWIMEGEFPCQHSPGK

SEQ ID NO: 15650 - protein, 81 aa, Gorilla gorilla
TGLLAFSDVVIEFSPEEWACLDPAQRNLYRDVMFENYRNLVSLAILCYSIQDLLPEQDMKDLCQKVTLTRHRSWGLDNLHL

SEQ ID NO: 15651 - protein, 81 aa, Lynx canadensis
SQGSVTFRDVAIDFSQEEWEWLQPTQRDLYRHVMLENYSHLVSLGLNISKPYVVSLLEQGKEPWLEKRGVRRNLFSEPNRE

SEQ ID NO: 15652 - protein, 81 aa, Lynx canadensis
MLENYNNLVSVGNCIFKPAVIFKLEQGEEPWFLEEEFLNQSHQEDYRDDYLIKRNKKIKDNYFQEVISIDNKLLTGEEEEI

SEQ ID NO: 15653 - protein, 81 aa, Lynx canadensis
KPGAVSFADVAVYFSPEEWGCLRPAQRALYRDVMRETYGHLGALGFRGTKPALISWVEEEADLWGPDARDPEVGECLTAAD

SEQ ID NO: 15654 - protein, 81 aa, Lynx canadensis
MYFSQEEWEFLDPTQEALYNDVMRENYETVISLALFVLPKPKVISYLEQGEEPWVQGSTELKDSPGELPTGIKHKSDTENH

SEQ ID NO: 15655 - protein, 81 aa, Lynx canadensis
LQEAVVFEDVAVYFTRIEWSCLAPDQRALYRDVMLENYGHVASLGFLVAKPALISLLEQGEEPGALILQVAEEQGTVANLC

SEQ ID NO: 15656 - protein, 81 aa, Lynx canadensis
MDFTQEEWALLKPAQKKLYKDVMLETFRNLVTVDDENQLRTNGSTSQQVIFGEKLSNEQKIARFTKNDSWTSLFGENWENQ

SEQ ID NO: 15657 - protein, 81 aa, Lynx canadensis
KFKETETFKDVAVVFTEEELVLLDKAQIHLYQDVMLENFRNIVSVGEDNNPLVFQLEHKGKLWPLERKPEGCADKIPEVSE

SEQ ID NO: 15658 - protein, 81 aa, Lynx canadensis
SQGPVSFRDVAVDFTQEEWQQLEPEEKTTYRDVMLENYSHLVSVGYDSTKPKVILKLEQGEEPWVVEGDLPCRSRPEVWKV

SEQ ID NO: 15659 - protein, 81 aa, Phyllostomus discolor
GSVSFADVAVYFSSEEWGCLRPAQRALYRDVMRETYGHLGALGDSPNNKEEEPKELPGATGPRKTPGKHRPEELVKHNPDS

SEQ ID NO: 15660 - protein, 81 aa, Phyllostomus discolor
EAVTFGDVAVHFSREEWQCLDPGQRALYKEVMLENHSSVAGLDSAISTDGGQAHEDVYILKSESLAAMVKTPPRDSPQSPC

SEQ ID NO: 15661 - protein, 81 aa, Phyllostomus discolor
AQESLTLEDVAVDFTWEEWQLLDPDQKGLYKDVMLENYRNLVSLGYQVSKPDVLSKLELGEEPWTTEDELHSLVCPDTDKV

SEQ ID NO: 15662 - protein, 81 aa, Phyllostomus discolor
AEGCVVLEDVAIHFSQEEWRLLDEVQRCLYHSVMLENLALLSSIGCWPGAQEEEVPSGQGDSVGVSQVQTPSQDPCTQLSH

SEQ ID NO: 15663 - protein, 81 aa, Phyllostomus discolor
AQDSVTFEDVSIYFSQEEWGLLDEAQRLLYCDVMLENFALTASLGLTSFRSHIVAQLEMGAEPWVPDRVDMSSAMARGAYN

SEQ ID NO: 15664 - protein, 81 aa, Muntiacus muntjak
LWGPVTFKDVTVEFTQEEWKLLDTAQRTLYREVMQENYSHLISVGYCANRPNAIFKLKQGKEPWILEVQFPRQNNPKDVCN

SEQ ID NO: 15665 - protein, 81 aa, Muntiacus muntjak
GLLSFEDVALYFTREEWDTLDWAQKALYRDVMLDNYRHIVSLGFPFPKPEVICQLEQWEEPWILDLPRAGTRKASGSACPD

SEQ ID NO: 15666 - protein, 81 aa, Crocuta crocuta
AILREFVTHRDVAMDFTLEDWEQLGLDQGDLFWDTALDNYQNLFLLNPCKPKLTCPDGGEELEAVARESPESEGLDVAEVK

SEQ ID NO: 15667 - protein, 81 aa, Ailuropoda melanoleuca
QESVTFKDVAVDFTQEEWGQLDSPQRALYRDVMLENYQNLLALGPPVCKPDVISHLERGEEPWWMPREVPGGACLEGEPGP

SEQ ID NO: 15668 - protein, 81 aa, Gorilla gorilla
PVTFRDVTVIFTEAEWKRLSPEQRNLYKEVMLENYRNLLSLDGVSLLLPRLECSRALCLPGSSNSPATASRVAGITAEPKP

SEQ ID NO: 15669 - protein, 81 aa, Ailuropoda melanoleuca
LFTTGLLFSKPKVISLLQQGEDPWKVEKESPGGPSLGYKSTPKTTKSTQTQDSSFQGLRRKRLKRDEPWNFISEKPCIYED

SEQ ID NO: 15670 - protein, 81 aa, Ailuropoda melanoleuca
TVGSVMFSDVSVDFSQEEWECLDPGQRDLYRDVMLENYSNLLSMGLYIPKPQVISLLEQGKEPWMVGRELTRGLCSDLESM

SEQ ID NO: 15671 - protein, 81 aa, Ailuropoda melanoleuca
SVMFSDVSVDFSQEEWECLDPGQRDLYRDVMLENYSNLLSMGKGFYTRLYIPKPQVISLLEQGKEPWMVGRELTRGLCSDL

SEQ ID NO: 15672 - protein, 81 aa, Lynx canadensis
MLENYRNLVSVEHQLSKPDVVSQLEEEEALWSVERGIPQDTFSECPAAQLDPQVDPLPAGNPLMKIEVVEVLTLNQEVARP

SEQ ID NO: 15673 - protein, 81 aa, Ailuropoda melanoleuca
FQGSVSFEDVTVGFTQEEWEHLDPVQRSLYRDVMLENYSHLVSVGYCVTKPEVIFRLEQGEEPWILEEEFPSWSFPEIWET

SEQ ID NO: 15674 - protein, 81 aa, Lynx canadensis
WQGSVTFEDVALYFSWEEWDLLDEDQRCLYHDVMLENFALTSSLGCGHGVDDEDVPLEESISVGVSQIRTLEADSSPQKAQ

SEQ ID NO: 15675 - protein, 81 aa, Lynx canadensis
SQGLLSFGDVTVGFTEEEWQRLDPAQRTLYRDVMLENYSHLVAVGLSIPKPEVILKLEQGEEPWILDSPGQSDPELINSSR

SEQ ID NO: 15676 - protein, 81 aa, Lynx canadensis
SKVPVTFGDLAIYFSQEEWEWLSPIQKDLYEDVMLENYQNLVSLGLSFRRPNVITLLEKGRAPWMVEPVRKRRGLDSRSKY

SEQ ID NO: 15677 - protein, 81 aa, Lynx canadensis
RPRAVKFADVAVYFSTEEWGCLRPAQRALYRDVMRETYGHLGALGFRGTKPALISWVEEEADLWGPDARDPEVGECLTAAD

SEQ ID NO: 15678 - protein, 81 aa, Phyllostomus discolor
MMETYRNLVFVAGQQATKPDLILKMEVEEPYLAEDKIPIWSCPEEACQVEQIERQHQDDEDKYLLMQIGFPNKNAITTKGE

SEQ ID NO: 15679 - protein, 81 aa, Phyllostomus discolor
QDSVVFEDVAVDFSQEEWALLDIAQRSLYREVMLENFQNLASLGFETQLKSSASVISQNNYGEKISDEQKIVRFKRNDSWS

SEQ ID NO: 15680 - protein, 81 aa, Phyllostomus discolor
KSQESLTFQDVAVDFTREEWDQLYPAQKNLYRDVMLENYRNLVALGHQLHKPEVIIQLEEEEQWMMERDGPLDTHPDGENR

SEQ ID NO: 15681 - protein, 81 aa, Phyllostomus discolor
AQASVTFKDVAVTFTQDEWGHLNLAQRTVYREVMLETYRLLVSLGYRVPKSELIHLSEHLSRESACPGAKAKSETTELTFS

SEQ ID NO: 15682 - protein, 81 aa, Phyllostomus discolor
KSQESLSFTDVFVPFTWEEWQLLDPAQRHLHRSVMLENYSNLAFLGYQPTKPDIIFQLEHGELWMMQAQVASPGHSVPRSL

SEQ ID NO: 15683 - protein, 81 aa, Desmodus rotundus
QKSVTFEDVAVYFTPTEWDGLSPAQRALYRDVMLENYGNVASLGFPLLKPAVISQLEGGGELGSPSLLAAGVGSDPPGLWT

SEQ ID NO: 15684 - protein, 81 aa, Nomascus leucogenys
MELLTFRDVAIEFSPEEWKCLDPAQQNLYRDVMLENYRNLVSLAVYSYYKQGIVPKQGIEDSFKKATLGRYGSCGLENICL

SEQ ID NO: 15685 - protein, 81 aa, Bos indicus
MFQDVAIDFTQEEWECLDLSQRELYRDVMLENYGNLASLGLVSKLDLVTFLEQLEDPRNIRRMGTTAIYPAMSPQDTQDLM

SEQ ID NO: 15686 - protein, 81 aa, Bos indicus
LQESVTFRDIAVLFSRDEWLHLDAAQRTLYREVMLENYSTLVSLGIPFSMPKLICQLQQGEDPCMVEREVPQDTCLGFKIW

SEQ ID NO: 15687 - protein, 81 aa, Bos indicus
FKEAVTFKDVAVVFTEEEMGLLDLAQRKLYQEVMLENFRNLLSVGHQSFTPDVPSQLEREEKLQMIKTAAQSCCSSGNQNL

SEQ ID NO: 15688 - protein, 81 aa, Bos indicus
RLTSKDVAIEFTQEEWEFLDPAQRALYRDVMLETYRNLLSVDISPTHVIKHLQPKANSDKREIFQTLMLGRPESCEIKHFH

SEQ ID NO: 15689 - protein, 81 aa, Canis lupus
AQDSVTFEDVAVYFSWEEWGLLDEAQRHLYHDVMLENFALVTTLGYWHGAEDEEAPSEQDASVEVSQVRTHHVGPYPKKTH

SEQ ID NO: 15690 - protein, 81 aa, Gorilla gorilla
PQASVCFEDVAMAFTQEEWEQLDLAQRTLYREVTLETWEHIVSLGLFLSKSDVISQLEQEEDLCRAEQEAPRGTSGLSQVT

SEQ ID NO: 15691 - protein, 81 aa, Ailuropoda melanoleuca
VTFTDVAVNFTREEWALLDSAQRILYRDVMLENCRNLASVDLVTQHKAKNSIHQQDILARKTPDEANRVCAVSHSSRSSPS

SEQ ID NO: 15692 - protein, 81 aa, Ailuropoda melanoleuca
SQGSLSFRDVTVGFTQEEWQHLDPAQRSLYRDVMLENYSHLVSLGYSISKPEVILKLEQGEEPWILEEEFPSQSDPGELMA

SEQ ID NO: 15693 - protein, 81 aa, Gorilla gorilla
KPGAVSFADVAVYFSREEWGCLRPAQRALYRDVMRETYGHLGALGVGGSKPALISWVEEKAELWDPAAQDPEVAKCPTEAD

SEQ ID NO: 15694 - protein, 81 aa, Ailuropoda melanoleuca
LQVCVISEDVFVCFSREEWMLLDDSQRLLYQDVMLENFALLASLGIASSRSHLVTQLEQREDPRMPDQSTIKRRLASGTWQ

SEQ ID NO: 15695 - protein, 81 aa, Ailuropoda melanoleuca
PQKSVTFEDVAVYFTQTEWDGLSPAQRALYRDVMLENYGNVASLGFSLLKPAVISQLEGADELEGPSPLVAGTEIGPQGLW

SEQ ID NO: 15696 - protein, 81 aa, Ailuropoda melanoleuca
ELVTFRDVAIDFSRQEWEYLDPIQRDLYRDVMLENYRNLVSLAGHSISKPDVVDLLEQGKEPWIILREETQRQYTGKEDKE

SEQ ID NO: 15697 - protein, 81 aa, Ailuropoda melanoleuca
VQNSITFEDVAMDFTQEEWALLNSRQRKLYRDVMLENYRNLASLEKQLSKPTLITQMEQEDEMKTETGSHQDILEPFLKKR

SEQ ID NO: 15698 - protein, 81 aa, Ailuropoda melanoleuca
VTFEDVAVYFSWKEWRLLDEAQRRLYHRVMLENFTLISSLGCCCGAEGEEAPFAQGTSVGASQAGTPTAAVSSRKTHPCEM

SEQ ID NO: 15699 - protein, 81 aa, Ailuropoda melanoleuca
VHSVVFEDVAVDFTLDEWALLDSMQKNLYRDVMLETFQNLVSVDYETLFKASGLVSQQDRHEEKKPNEQKMEKFTRNHSCA

SEQ ID NO: 15700 - protein, 81 aa, Ailuropoda melanoleuca
NRGLLTFRDVAIEFSQEEWGCLSHTQRELYRDVMLENYGHLLFSGLIVWKPDLVIFLEQEKQLWDVKRKETVAFHPAISSN

SEQ ID NO: 15701 - protein, 81 aa, Gorilla gorilla
QGLLTFRDVTIEFSQEEWKCLDPAQRALYRDVMLENYRNLVSLDISSKCMLKTLSSTGQDNTEVFHTGTLHRQASHHTGEF

SEQ ID NO: 15702 - protein, 81 aa, Ailuropoda melanoleuca
CWGLLSFKDISMEFTWEEWQLLDSTQKYLYRDVILENYSHLVSLGYHGTKPDLIFKLEQGEEPWIINAKVSRQSYPEGWKE

SEQ ID NO: 15703 - protein, 81 aa, Lynx canadensis
SQEQVSFKDVCVDFTQEEWYLLDPAQKILYRDVILENYSHLVSVGYCFTKPEVVFKIEQGEEPWILEAGFPSHCHQEDWKV

SEQ ID NO: 15704 - protein, 81 aa, Lynx canadensis
MLVTFDDVAVTFTQEEWGQLDPAQRTLYQEVMLETCRLLVSLGCPLPKPEQIYPLERSPELWTLQRGLSSSNCPGDNVKPE

SEQ ID NO: 15705 - protein, 81 aa, Lynx canadensis
CEGSVSFEDVTVDFSREEWQQLDSTQRRLYQDVMLENYSHLLSLGYEVPKPEVIFKLEQGEEPWILERKTPHQSCSDGRLG

SEQ ID NO: 15706 - protein, 81 aa, Lynx canadensis
SQGLLTFRDVAIELSQEDWECLNLSQWDIYRDVMLENYRILLFLGLIMTTPDLITFIEQNNEPWKVKRKETSDAQLSHPGT

SEQ ID NO: 15707 - protein, 81 aa, Lynx canadensis
EKDSVTFKDVAIDFSLEEWRLMDLSQRNLHKDVMLENYRNLVSLGLAVSKPDMISHLEDGKGPWVVVREIARTPYPELETK

SEQ ID NO: 15708 - protein, 81 aa, Phyllostomus discolor
PVTFKDVAVVFTEEELGLLDPSQRMLYQDVTLENLRNLVYVGHWNQNEIDSLQEVALSYLLHEDVVCWQIWDQLRSKLTRN

SEQ ID NO: 15709 - protein, 81 aa, Phyllostomus discolor
SLGPVLFRDVAVDFTQEEWQQLDPEQKTTYRDVMLENYSHLVSVGCHAVKPEVIVKLEQGEEPWVEGELPSPRWPDAWKVD

SEQ ID NO: 15710 - protein, 81 aa, Phyllostomus discolor
VQVVVTFEDVAVYLSRTEWCLLDEAQRRLYLDVMLENFAHVSSLGCCCGAEDVEAPTEQKLSEQVSQEKYPKAALSSQKGH

SEQ ID NO: 15711 - protein, 81 aa, Phyllostomus discolor
AVTFKDVAVVFTEEELGLLDPSQRKLYRDVMLENFWNLVSLGDKNGKEMEYIQERELKFLSCRELSYWKIWEQAAGELTGS

SEQ ID NO: 15712 - protein, 81 aa, Phyllostomus discolor
MFGDLTVYFSLKEWEGLSPIAKDLYRDVTLENYQHLVSLRKDFSYQRPNVTTLLEKGIASWMEPVRRRRGLDSEFKCKTKK

SEQ ID NO: 15713 - protein, 81 aa, Phyllostomus discolor
MAPAQRRLYRDVMLENYSNLVSLGYQVSKPEVIFKLEQGEEPWLSEGEIQRSFCPDWKTMPEAKPSNLQQSISEVSPRTDD

SEQ ID NO: 15714 - protein, 81 aa, Phyllostomus discolor
AKEPFSFEDLSVDFTQKEWQLLDPSQKDLYKDVMLENYSSLVALGYEFMKPDVIFKLEQGEEPWIGDGEVPSSESPEQVLQ

SEQ ID NO: 15715 - protein, 81 aa, Phyllostomus discolor
EAVPLTFQDVAVYFSQEEGQQLGPDQRALYRDVMLENYGHVASLGLPVPKPELISQLEQGEELWVLDLMGPEDLEPLSSCS

SEQ ID NO: 15716 - protein, 81 aa, Phyllostomus discolor
AEASVTFEDVAVHFSWEEWRLLDEAQRHLYLDVMLENFALTSSLGCCSGPEDVEALFEQSSSVGVSQASTSRAALSSLKTH

SEQ ID NO: 15717 - protein, 81 aa, Ailuropoda melanoleuca
VTFEDVAVYFSWKEWRLLDEAQRRLYHRVMLENFTLISSLGCCCGAEGEEAPFAQGTSVGASQAGTPTAAVSFWKTHPCEM

SEQ ID NO: 15718 - protein, 81 aa, Ailuropoda melanoleuca
CVISEDVFVCFSREEWMLLDDSQRLLYQDVMLENFALLASLGIASSRSHLVTQLEQREDPRMPDQVDMTPATEREAQKGLG

SEQ ID NO: 15719 - protein, 81 aa, Ailuropoda melanoleuca
LQGSLTFGDVAVSFTQFEWKHLDATQQALYRDVMLENYGNLVFVGLLSSKPKLITQLEQGAEPWMEVQQITSDTCSVQEYW

SEQ ID NO: 15720 - protein, 81 aa, Gorilla gorilla
EMRLLTFRDIAIEFSLEEWQCLDCAQQNLYRDVMLENYRNLVSLGIADSKPDLITCLEQNKEAWNIKRNEMVAKHPVTCSH

SEQ ID NO: 15721 - protein, 81 aa, Gorilla gorilla
RQEPVTFEDVAVYFTQNEWASLDSVQRALYREVMLENYANVASLAFPFITPVLVSQLEQGELPWGLDPWEPMGREALRGIC

SEQ ID NO: 15722 - protein, 81 aa, Lynx canadensis
MLENYRNLVWLGLSISKPNMISLLEQGKEPWMVEKEMSDGQYADWESWYEIKELPPKWYIDEEEISQGMVMERLTSYNLEY

SEQ ID NO: 15723 - protein, 81 aa, Lynx canadensis
AQGCVTFEDVTIYFSQEEWGLLDEAQRLLYCDVMLENFALIASLGLTSFRSHIVARLEMGAEPWVPDRVDMTSAMARGAYG

SEQ ID NO: 15724 - protein, 81 aa, Phyllostomus discolor
PKVPVTFDDVAVYFSELEWSRLDEWQKELYKHVMRGNYEMLVSLDYAISKPDILARMERGEEPCPEGLWGQDEGQEREAAR

SEQ ID NO: 15725 - protein, 81 aa, Phyllostomus discolor
MLEIYSHLFSVGYHIPNPEVIFRMEKDKELWIGEAELPHQRHQEMKFVLNTPQQDISGTASFHDMAGKVTRDGSWYSILAE

SEQ ID NO: 15726 - protein, 81 aa, Phyllostomus discolor
QGCVTFEDVALYFSWEEWELLDETQKCLYQDVMLENFALTSSLGCWSGVEGDDVPSEQSIYLEGASQSRTFKAGSDLQKIQ

SEQ ID NO: 15727 - protein, 81 aa, Phyllostomus discolor
IKWLVTFRDVAIDFSQEEWDYLDPAQRDLYRDVMMENYSNLVLLGLSISKPDVISLLEQGKEPWMQRNLEGGWCPGLEFGC

SEQ ID NO: 15728 - protein, 81 aa, Desmodus rotundus
PQVKVTFEDVAVLLSQEEWDQLGPAQRGLYRHVMMETYGNVVSLGLPGTKPNVISQLERGEEPWVLEGHGAKESKGLDSSG

SEQ ID NO: 15729 - protein, 81 aa, Desmodus rotundus
QVSVTFEDVAVLFTRDEWRKLRPSQRSLYQDVMLENYHHLVSLGLPFSKPQVISLLQQGEEPWKAEEGRPGGSCPGPGWKS

SEQ ID NO: 15730 - protein, 81 aa, Macaca fascicularis
VTFEDVTIVFTWEEWKFLDSSQKRLYREVMWENYTNVMSVENWNKSYKSQEEKFRYLEYENFSCWQGWWNAGAQMCENQNY

SEQ ID NO: 15731 - protein, 81 aa, Desmodus rotundus
SVTFEDVAVYFSRTEWRLLDEAQRRLYLDVMLENFGLISSLGCCCGAEDVEAPTEQSVSLRVSKAKNPKTALSSQKSHPCE

SEQ ID NO: 15732 - protein, 81 aa, Desmodus rotundus
SQMPVTFEDVALYLSREEWGRLDHPQQSFYRDVLQKRNGLALGVAEVRKEEPTSSPAVPGDGKSFRTRAGRAQEDVLQCGR

SEQ ID NO: 15733 - protein, 81 aa, Macaca fascicularis
QGTVTFEDVAVHFSWEEWGLLDEAQRCLYRDVMLENLALLTSLDVHHRKQHLGEKHFRSNVGTALFVKTCTFHVSGEPSTC

SEQ ID NO: 15734 - protein, 81 aa, Macaca fascicularis
ASRYFTERDVAIEFSPEEWKCLDPAQQNLYRDVMLENYRNLVSLGVAISNPDLVTCLEQRKEPYNVKIRKIVARPPAVRSH

SEQ ID NO: 15735 - protein, 81 aa, Macaca fascicularis
HLTFMDVAIEFSQEEWKCLDPGQRALYRDVMLENYRNLVSLGRSCILGSNAENKPIKNQLGFTLESHLSELQLFEAGRKIF

SEQ ID NO: 15736 - protein, 81 aa, Macaca fascicularis
QESLTLRDVAVDFSWEEWQLLGPAQKHLYRDVMLENYSNLVSVRFQASKPDALTKLEQGEPLWALEDEIHSPTHPEIEKAD

SEQ ID NO: 15737 - protein, 81 aa, Ruminococcus albus 8
FNDSDAPQPFTENDVVYVIYDIPTDRSLWQESLTANSMYYRDVDLNDESSVVALSTCASDYEGARALFAGKLTWIKEIDIH

SEQ ID NO: 15738 - protein, 81 aa, Pan troglodytes
EPGAVSFADVAVYFCREEWGCLRPAQRALYRDVMRETYGHLGALGCAGPKPALISWLERNTDDWEPAALDPQEYPRGLTVQ

SEQ ID NO: 15739 - protein, 81 aa, Sapajus apella
MDVAIEFSLEEWQCLDTAQKNLYRTVMLENYRNLVFLGVSVSNLDLITCLEKGKEPWNMKRYKMGAKPQVLSYFPKDLWLE

SEQ ID NO: 15740 - protein, 81 aa, Ursus maritimus
HGSTPFSNVTVAFTQDGWKHLIPAPRGTPKFMEGIPENARNLVLLGLPVSQPDMNSQLEQREEGPWMLEGGGLRSTCPDWK

SEQ ID NO: 15741 - protein, 81 aa, Ursus maritimus
MDSVVFEDVAVDFTLDEWALLDSMQKNLYRDVMLETFQNLVSVDYETLFKASGLVSQQDRHEEKNPSEQNMAKFTRNHSCA

SEQ ID NO: 15742 - protein, 81 aa, Acinonyx jubatus
PCRLVLFKDVAIDFSQEEWECLDLEQKDLYRDVMLENYNNLVSLAGFSISKTDVLSLLKQGKEPWKVVQDVTRSQSSAWES

SEQ ID NO: 15743 - protein, 81 aa, Acinonyx jubatus
WLQGPVTFKDVAGEFTQGWMMLDSAQRRIYRDVMLGSYINLISVEYQLQKPTVISLLGKEEIRTMRKRGDWAPIQSSKFNL

SEQ ID NO: 15744 - protein, 81 aa, Rhinopithecus roxellana
FQEVVTFGDVAVHFSREEWQCLDPGQRALYREVMLENHSSVAGLAGFLVFKPELISRLEQGEEPWVLDLQGAEGTETPSQR

SEQ ID NO: 15745 - protein, 81 aa, Rhinopithecus roxellana
TQESLTLEDVAVEFSWEEWQLLDTAQKNLYRDVMVENYNHLVSLGYQTSKPDVLSKLAHGQEEPWITVAKIQNKNCPGIGK

SEQ ID NO: 15746 - protein, 81 aa, Acinonyx jubatus
LQGSLSFEDVTVGFSQEEWQRLDPAQRTLYRDVMLENYSHLVAVGCCVPKPDVIFRLEQGQQPWLVEEESLDQSCPEVCRV

SEQ ID NO: 15747 - protein, 81 aa, Rhinopithecus roxellana
DSVTFEDVAVDFTQEEWTLLDQTQRNLYRDVMLENYKNLVAVDWESHINTKRSAPQQNFLQGKTSSVVEMERNHFGEELFD

SEQ ID NO: 15748 - protein, 81 aa, Rhinopithecus roxellana
DSVVFEDVAVDFTLEEWALLDSAQRNLYREVIFEMWERTKTQFKANGSVSQQDMYGEEKSKERTVPNFTRKNSCAYTLEKT

SEQ ID NO: 15749 - protein, 81 aa, Bison bison
WGSLVAFEEVAMHFSREEWELLDEAQRQLYHTVMLETLELVTSLGCWPVVEDEEVPSEKNASGEVVSQVKTPSVPPSMQKA

SEQ ID NO: 15750 - protein, 81 aa, Rhinopithecus roxellana
AQESITLEDVAVDFTWEEWQLLGPAQKDLYRDVMLENYSNLVAVGYQASKPDVFFKLEQGEPPWTTEDGIHSGACSEIWKV

SEQ ID NO: 15751 - protein, 81 aa, Bison bison
ENKSGMTLSQTQLTVEDVDIKFTPEEWECLDPAQRALYWDVMEETYRNLLSVAGSLPLSHKEVPKACSFTCILELMNRGIP

SEQ ID NO: 15752 - protein, 81 aa, Bison bison
FQDTVTFKDVAIDFTQEEWKQLDPAQRNLYRNVMLENYNNLITVGCPFTKPDVIFKLEQEEEPWVMEEEVLKKHCPGEIWG

SEQ ID NO: 15753 - protein, 81 aa, Cebus imitator
PQESVAFEDVAVYFTKKEWAIMVPDQRALYCVMLENCDAVALVAVPPTSRLALVSHLEQGEEPCFTQPQGVLSRRGWRAGF

SEQ ID NO: 15754 - protein, 81 aa, Cebus imitator
TGGDVTFSDVAIHFSHEEWGWLDSAQRDLYKDVMVQNYKILVSLGLSITKPYVITLLEDGKEPWMMEEKLSKDWESRLENK

SEQ ID NO: 15755 - protein, 81 aa, Cebus imitator
KLLTFRDVTIEFSPEEWKCLDPAQQNLYKDVMLENYRNLVSLGVAISNPGLVTCLEQRKEPFNVKIRKTVARPPAMCSPFT

SEQ ID NO: 15756 - protein, 81 aa, Cebus imitator
TLKEAVTFKDVAVVFTEEELGLLDPAQRKLYRDVMLENFRNVLLVGYQLLHRDTFHFPREEKFWMVETATQREGNLGPVFQ

SEQ ID NO: 15757 - protein, 81 aa, Cebus imitator
MSQVTFSDVAIDFSHEEWGWLDSAQRDLYKDVMVQNYENLVSLGLSITKPYVITLLEDGKEPWMMEKNLSKGVTPDWESRW

SEQ ID NO: 15758 - protein, 81 aa, Macaca mulatta
KEKLVTFEDVAVYFTQAEWDGLSPAQRTLYRDVMLENYGNVASLGFPLLKPAVISQLEGGGELGGPSPLAAGTGLWGLRTG

SEQ ID NO: 15759 - protein, 81 aa, Macaca mulatta
MGPLTFRDVTVEFSLEEWQCLDTAQQNLYRDVMLENYRNLVFLGIAVSKPDLITCLEQEKEPWEPMRRHEMVAKPSVMCSH

SEQ ID NO: 15760 - protein, 81 aa, Macaca mulatta
AEGLVMFEDVAVYFSREEWGLLNVTQKGLYRDVMLENFALVSSLGLAPSRSPVFSQLEKDEQLWVPSWVDVTPVSRAEARR

SEQ ID NO: 15761 - protein, 81 aa, Callithrix jacchus
AQESVTFEDVAVNFTDREWQCLTDAQRHLYKDVMLENYGHVVSLGFPFPKPPLISHLERGVEPCVQDPQDTGLSLSCSYPV

SEQ ID NO: 15762 - protein, 81 aa, Callithrix jacchus
KQGQVNFEDVFVYFSQEEWVLLDEAQRLLYRDVMLENFALMASLGHTSFTSHIVASPVMGSDWVDVTPAVTTGTLSGSGPG

SEQ ID NO: 15763 - protein, 81 aa, Macaca mulatta
TFKEGLTFKDVAVVFTEEELGLLDPVQRNLYRDVMLENFRNLLSVGHQPFKQDVSPIERNEQLWIVTTATQRQRNLGEKNQ

SEQ ID NO: 15764 - protein, 81 aa, Monodon monoceros
MATGLLKAKKEVDLDSVELKAEIPFCKPKLISQLERGEEPWIEERQRPPSLCPGSKLEIQPCPSCPLAFSSQQALSQHVWL

SEQ ID NO: 15765 - protein, 81 aa, Callithrix jacchus
GAVSFGDVAVYFSREEWGCLRPAQRALYRDVMRETYSHLSALGESPTCSPGPCAPTSPAAPQGAARGVGVPAAGQAAFPAA

SEQ ID NO: 15766 - protein, 81 aa, Callithrix jacchus
SRSLENDGVCFTEQEWENLEDWQKELYRNVMESNYETLVSLKVLGQPEGEAELGTGMLGDLEEEGPGGAHPAGGVMIKQEL

SEQ ID NO: 15767 - protein, 81 aa, Bos taurus
ATFMVPGQGHVTFEDVAVSFSQEEWGLLGEAQRLLYYDVMLENLSLIASLGKNCIHTHRCAGLGPALCLAHSSLPRLGCGH

SEQ ID NO: 15768 - protein, 81 aa, Bos taurus
HPEPENWLWHKWAGLSPAQRALYRSVMLEIYRSLTSLGYPVPKPALISLLERGDLPVGLETQDNPPAQGTRDIYKNSRTHM

SEQ ID NO: 15769 - protein, 81 aa, Ovis aries
MAMYLTREEWRPLDPTQRDIYRDVMQENYGNVVSLDFEIRSENEVNPKQEISEDVEFEAASERPVGNTEENPESEEAFDNR

SEQ ID NO: 15770 - protein, 81 aa, Ovis aries
EEGQVTFEDVAVYFSWEEWGLLDEAQRLLYHGVMLETFSLMASLGLTSSRNHDMTQLEQRGEPCVPTGGVSTTATAAGCWC

SEQ ID NO: 15771 - protein, 81 aa, Ovis aries
LQDLVTFEDVTVEFTQEEWALLDSSQRKLYRDVMLENCRNLAWLGTGYHVDKRSLISQLEQEDKVITEEGGILPGTCPGER

SEQ ID NO: 15772 - protein, 81 aa, Ovis aries
MLENYANVASLVSPFPRPDLISQLERGEAPWDPDPWETEDLRGICPGGERGIKTEEPAVEQQASEGTEAHGRPVGGLLTNG

SEQ ID NO: 15773 - protein, 81 aa, Ovis aries
SLGSDLFRDVAVVFSQEEWEQLAPTQRDLYRDVMLETYSNLVSLGLAISKPDVISFLEQGKEPWTVEEVATGGLCPVLKSR

SEQ ID NO: 15774 - protein, 81 aa, Ovis aries
AQGSVVFSDVSIDFSQEEWEFLNAAQRDLYRDVMLENYSNLVSMGLYIPKPQVISLLEQGKEPWMIGRELTRGLCSALESM

SEQ ID NO: 15775 - protein, 81 aa, Ovis aries
KGSVTLQDVAVEFTPEEWQLLDCDQRTLFWDVMLENFRNLISVGTGCPVTETTVIFRVEQGQEPWMVEGEDSRWSSPEADC

SEQ ID NO: 15776 - protein, 81 aa, Ovis aries
GQVVVTLKDVAVTFTREEWGQLDLDQRTLFREVMLETCGLLVSLGHPVPKPELIHLLEHGQKLWTGTRGLPHSTGPGDRPK

SEQ ID NO: 15777 - protein, 81 aa, Phyllostomus discolor
WAAWAKKPVTFEDVAVNFTQEEWECLDARQRVFYQDVMSETFKNLVSVDLITKLEQEEKQWRADLCPPNGEGLSSGSKKEE

SEQ ID NO: 15778 - protein, 81 aa, Acinonyx jubatus
PQESVTFKDIAVDFTQEEWALLDASQRKLYRDVMLENIGHLVSVGYRVCKSDVISQLQQGVELWREGRGFPQGVIPDRKSS

SEQ ID NO: 15779 - protein, 81 aa, Rhinopithecus roxellana
EKEPLTFRDVAIEFSLEEWQCLDTAQQGLYRKVMLENYRNLVFLGIAVTKPDLITCLEQGKEPWNIKSHEMVAKPSVICSH

SEQ ID NO: 15780 - protein, 81 aa, Acinonyx jubatus
GYMQGLLTFRDVAIEFSQEEWGCLNHSQRELYMDVMLETYGHLLFLGLVSKPDLVIVLEQEKKLWGVKRKETVALHPGRWK

SEQ ID NO: 15781 - protein, 81 aa, Acinonyx jubatus
LVKIEDVADVAVSFILEEWGHLDQSQKSLYRDDRKENYGSIPSMDYESRNDNVELMVKQISDDAEAHWMTSASTERNVPQS

SEQ ID NO: 15782 - protein, 81 aa, Rhinopithecus roxellana
AQGLVTFADVAIDFSQEEWACLNSAQRDLYWDVMLENYSNLVSLDLESAYENKGLPSEKNIHEIRASKRNSDRRSKSLGRN

SEQ ID NO: 15783 - protein, 81 aa, Rhinopithecus roxellana
MDTVVFEDVVVGFTLEEWALLNPAQRNLYRDVMLETFKHLASVDNEAQPKTSGSISQQDTSGEKLSLKQKIEKFTRKNTWA

SEQ ID NO: 15784 - protein, 81 aa, Rhinopithecus roxellana
SQESLTFKDVFVDFTLEEWQQLNSAQKNLYRDVMLENYSHLVSVGYLVAKPDVIFRLGPGEESWMADGGTPVRTCAGEDRP

SEQ ID NO: 15785 - protein, 81 aa, Rhinopithecus roxellana
FQEMVTFKDVAVVFTREELGLLDPAQRKLYQDVMLENFRNLLSVGYHPFQLDVILQLGKEDKLWLMETEIQGDGCSGLILW

SEQ ID NO: 15786 - protein, 81 aa, Acinonyx jubatus
MLENYRNLVALGHQLYKPEVISQLEQEEQWMMERGSSGDIRAGGENRPDIRKSIPNQNISDENQNHDMIMERLTGDSFWYS

SEQ ID NO: 15787 - protein, 81 aa, Rhinopithecus roxellana
CYQGSVTFDDVAVDFTQEEWTLLDPTQRSLYSDVMLENYKNLATVGGQIIKPSLISWLEQEESRTVRAGVLQGRKTQRRGT

SEQ ID NO: 15788 - protein, 81 aa, Acinonyx jubatus
MLENYSHLVSVGYDSTKPKVILKLEQGEEPWVVEGDLPCRSRPEVWKVDDLIERIPENGDDISRQAVSTNSKTPNEEREDA

SEQ ID NO: 15789 - protein, 81 aa, Rhinopithecus roxellana
EEALMAFRDVAVAFTQKEWKLLSSSQRTLYREVMLENYSHLVSLGIAFSKPKLIEQLEQGNEPWREENEHLLDLCLAQTPS

SEQ ID NO: 15790 - protein, 81 aa, Acinonyx jubatus
CQESVTFEDVAVIFTDEEWRHLVPIQKDLYKEVMLENYKSIVSLGLPVPRPEVIFQLKRGDEPWIVDLHGSEERECPENVS

SEQ ID NO: 15791 - protein, 81 aa, Odocoileus virginianus
SQGLLTFQDVTVDFTQEEWECLDLGQRELYRDVMLENYGNLACLGLVVSKPDLVMFMEQMKDPWDVRRRETAIYPAVSSHD

SEQ ID NO: 15792 - protein, 81 aa, Odocoileus virginianus
GLLSFEDVALYFTREEWDTLDWAQKALYRDVMLDNYRHIISLDLETRFHLKELAPKENTSEDLMLWKMSAVKQKTAKEPSE

SEQ ID NO: 15793 - protein, 81 aa, Odocoileus virginianus
SQRLLTFRDVTIDFTLEEWGCLDLSQQELYRDVMLENYGNLASLGLVVFKPDLVTFMEQRKHLWDVRRMETTATYPVVSSH

SEQ ID NO: 15794 - protein, 81 aa, Odocoileus virginianus
DPEQVTFEDVVVDFTQEEWGHLEPAQRTLYRDVMLETFRLLVSVDLETRPQSKLSTEKQGVTEEIANSALVEGFLQESLWH

SEQ ID NO: 15795 - protein, 81 aa, Odocoileus virginianus
TQLTVEDVDVKFTPEEWECLDPAQRALYRDVMEETYRNLLSVDVSRIDMTMKLQVKGNSGKGEIFQRVIFGRAKTHEIKDF

SEQ ID NO: 15796 - protein, 81 aa, Odocoileus virginianus
PLQGSVSFSDVAVDFSREEWQQLDLDQKNLYRDVMLETYSHLLSIGYQVPETEVFMLEQGNEPWPLQEELWQIGDQIESYH

SEQ ID NO: 15797 - protein, 81 aa, Cebus imitator
MDTVALEDMAVNFTQEEWALLGPSQKNLYRDVMQETIRNLDCIKMIYEDQNIEDQYKNPRRNLRCHMAERLSESKDNSQCG

SEQ ID NO: 15798 - protein, 81 aa, Cebus imitator
SQGSVTFEDVAVYFSWEEWDLLDETQKHLYFDVMLENFVLTSSMGKALILNPCAGLELLTSGDTPTTASHSARITGVSHHA

SEQ ID NO: 15799 - protein, 81 aa, Cebus imitator
AQMLVTFKDVAVTFTQEEWRQLDLAQRTLYQEVMLETCGLLVSLGYWVPKPELVHLLEHGQELWTVKRGRSHPTCVKKPRK

SEQ ID NO: 15800 - protein, 81 aa, Callithrix jacchus
VTFGDVAVHFSREEWQCLDPGQRALYREVMLENHSSVAGLDSTIRTDNEQACEDMDILKSESSGTMVRISPQDFAQNPGFG

SEQ ID NO: 15801 - protein, 81 aa, Macaca mulatta
YQDSVTFDDVAVDFTQEEWTLLDPSQRDLYRDVMRENYENLASVGRDLFKPSVICWLEEEEELRAEQRGVLQEWRLKTKGP

SEQ ID NO: 15802 - protein, 81 aa, Macaca mulatta
TQGPLKFMDVAIEFSQEEWKCLEPAQRTLYRDVMLENYRNLVSLGICLPDLSVISMLEQKKDPWILQSEEKIANNPDGREC

SEQ ID NO: 15803 - protein, 81 aa, Macaca mulatta
EKGPLTFRDVVIEFSQEEWQCLDTAQQDLYRKVMLENFRNLVFLGIDVSKPDLITCLGQEKDPWNMKRHSMVATPPESGLL

SEQ ID NO: 15804 - protein, 81 aa, Callithrix jacchus
DHELVTFRDVLINFSQEEWEYLDSAQRNLYWDVMMENYSNLLSLDLESKYDTKLLSVGTDIIKNTGSQWEVMESSKLCGLE

SEQ ID NO: 15805 - protein, 81 aa, Callithrix jacchus
AQVSVTFDDVAVTFTQEEWGQLDLAQRTLYQEVMLENCGLLVSLGCPVPRPELICHLDHGQEPWTGKEDLSQGTRPGDKGK

SEQ ID NO: 15806 - protein, 81 aa, Macaca mulatta
VMFRDVAIDFSQEEWECLDSAQRDLYRDVMLENYSNLVSLDLPSRCASKDLSPEKNTYETELSQWEMSDRLEKCDLEESKS

SEQ ID NO: 15807 - protein, 81 aa, Callithrix jacchus
FQGLLTFRDVAIEFSLEEWEHLDSNQKNLYRDVMLENYRNLVCLGFAVSKPDLITFLEQRKEPCNVKSIETVAIQPVETGL

SEQ ID NO: 15808 - protein, 81 aa, Macaca mulatta
HLVTFEDVAVDFTQEEWTLLDQTQRDLYRDVMLENYKNLIILAGSEFCKPSLMSELEQMEELRTGVTGVLQELDLQLKTKG

SEQ ID NO: 15809 - protein, 81 aa, Bos taurus
KVPVTFDDVAVHFSEQEWGNLSEWQKELYKNVMRGNYESLVSMAHDGIVIKIEVQTNDEGSESLETPEPLMGQVEEHGFQD

SEQ ID NO: 15810 - protein, 81 aa, Bos taurus
SLDAVTFTDVAVNFSQDEWEWLTLAQRTLYKKVMLENYSSLASLGLCISKPDVISLLEQDKEPWMMKGELTRALYPDLEYV

SEQ ID NO: 15811 - protein, 81 aa, Bos taurus
RNLGWLTFQDVAIDFTQEEWECLDLGQRELYRDVMLENYGNLASLGLVSKLDLVTFLEQLEDPRNIRRMGTTAIYPAVSPQ

SEQ ID NO: 15812 - protein, 81 aa, Ovis aries
WSQMPVTFEDVALYLSREEWGRLDHTQQSFYREVLQKRSGLSLGFPFNRPFWASQVQGKGEAPGSSRQLGREEEKRGVVEA

SEQ ID NO: 15813 - protein, 81 aa, Ovis aries
MDVAVGVMWEEWQLLAPAQKALYRDVVLENYSNLVSVGTGYQVSKPDVLSKLELGIPFLFDILSFSLKSQITPSKEVDDHV

SEQ ID NO: 15814 - protein, 81 aa, Ovis aries
DLDQVTFEDVVVDFTQEEWGCLEPAQRTLYRDVMLETFRLLVSVGHWLPKPDVISLLEQEAELWAANEGGPRGVCPDLETR

SEQ ID NO: 15815 - protein, 81 aa, Ovis aries
LVLFKDVAIDFSQEEWAYLDLEQKDLYRDVMLENYSNLVSVETGVSISKLDVLSLLEQGKEPWKVVQDVTRDLSPDWESRC

SEQ ID NO: 15816 - protein, 81 aa, Ovis aries
SQGLVTFKDVALNFSQEEWEWLDSSQKDLYRDVMLENYRNLVWLGLSISKPNMISLLEQGKEPWMVEREMSDSQHADWESW

SEQ ID NO: 15817 - protein, 81 aa, Ovis aries
LGPVTFEDVAVYFSQEEWRILDETQRHLYCYVMLETFALVASLGCWQRAEVKEKSSERNASVEVPQIITSKTDPSIQKAYP

SEQ ID NO: 15818 - protein, 81 aa, Ovis aries
SLLTFEEVAMYFSQEEWELLDPTQKALYNDVMQENYETVISLAVPAHQLLAFPEQTDTSEWTVAPELILPESQSLLTFEEV

SEQ ID NO: 15819 - protein, 81 aa, Ovis aries
QVSIAFQDLAVRFSKDEWRLLGEGQRALYLDVMQENYDTLASLGTAELLPLSAFLSPSEPGGAVGARSRAGDRQELPQGGG

SEQ ID NO: 15820 - protein, 81 aa, Rhinopithecus roxellana
GAVSFADVAVYFSPEEWGCLRPAQRALYRDVMRETYGHLGALGDAPNRKEEEPEEVPRAKGPRKAPVKESPEVLVECNPDP

SEQ ID NO: 15821 - protein, 81 aa, Rhinopithecus roxellana
AQGQVNFEDVFVYFSQEEWVLLDEAQRLLYRDVMLENFALMASLGHTSFMSHVVASLVMGSEPWVPDWVDMTLPVATETPG

SEQ ID NO: 15822 - protein, 81 aa, Rhinopithecus roxellana
PKVPVSFEDVSVYFTKTEWKLLDLRQKVLYKRVMLENYSHLVSLGFSFSKPHLISQLERGEGPWVADIPRTWTTAGLHIGD

SEQ ID NO: 15823 - protein, 81 aa, Rhinopithecus roxellana
AQESLTLEDVAVDFTWEEWQFLSPAQKDLYRDVMLENYSNLVAVGYQASKPDALSKLEQGEEPCTTEDEVYTRICCGGQPQ

SEQ ID NO: 15824 - protein, 81 aa, Rhinopithecus roxellana
GPLTFRDVTVEFSLEEWECLDTVQQDLYWDVMLENYRNLVFLGIIVSKPDLITCLEQGKEPWNMKRHEMVAKTPVMCSHIA

SEQ ID NO: 15825 - protein, 81 aa, Rhinopithecus roxellana
LQEPVTFRDVAVDFTQEEWGQLDPTQRILYRDVMLETFGHLLSIGPELPKPEVISQLEQGTELWVAERETIQGCHPGWEAP

SEQ ID NO: 15826 - protein, 81 aa, Rhinopithecus roxellana
SQEQVSFKDVCVDFTQEEWYLLDPAQKVLYRDVILENYSNLVSVGYCITKPEVIFKIEQGEEPWILEKGFPSQCHPERKWK

SEQ ID NO: 15827 - protein, 81 aa, Bison bison
AQLTFKDVAIEFTQEEWECLDPAQRALYRDVMVETLRNLVSLDISHMHVIKKLQLNANIYGGEGFQIVILGRHKRNKIEDF

SEQ ID NO: 15828 - protein, 81 aa, Bison bison
RLTCEDVAIEFTQEEWEFLDPAQRALYREVMLETYRNLLSVDISPTHVIKHLQPKATSDKRETFQTLMLGRPESCEIECFH

SEQ ID NO: 15829 - protein, 81 aa, Bison bison
HVTFEDVAVSFSQEEWGLLGEAQRLLYYDVMLENLSLIASLGCWRGGDTEEARSDQCVSVEQVTRDRNPQVDSSILKAVTS

SEQ ID NO: 15830 - protein, 81 aa, Bison bison
GQSRVTFEDVAVYFSQEEWCLLDEAQIQLYLDVMLENFALACMLGSWPGVGDEETPFEQSKSAGVSQIGNPRTDSSAEKVQ

SEQ ID NO: 15831 - protein, 81 aa, Odocoileus virginianus
MFSDVAVDFSQKEWECLDLEQRHLYRDVILENYSNLVSLGLCIYQPEVFSLMEKGGEPWMTLKDETFPDIQYRCQIKKLSP

SEQ ID NO: 15832 - protein, 81 aa, Odocoileus virginianus
LQGLMTFEDVAVDFTQEEWQYLNPPQRTLYRDVMLETYSNLVSVAGHHVTKPDLILKLEVEERCLLEGKIPIWSFPEEACQ

SEQ ID NO: 15833 - protein, 81 aa, Odocoileus virginianus
PQESVTFEDVAVNFSYEEWQCLTHAQRHLYTDVMLENYGNMVSLGFSFSKPPLISRLEQGTEPYVQDRQDWEFLNCSYPAA

SEQ ID NO: 15834 - protein, 81 aa, Odocoileus virginianus
QQRPVSFKDVVVGFTQEEWHGLNPAQRALYRDVMLETYSNLVSVGYEGTKPYVILRLEQEEAPWICEAACSGCHCRENIWQ

SEQ ID NO: 15835 - protein, 81 aa, Odocoileus virginianus
PLQGSVSFSDVAVDFSREEWQQLDLDQKNLYRDVMLETYSHLLSIGYQVPETEVFMLEQGNEPWPLQGEGPYQSCPEELWQ

SEQ ID NO: 15836 - protein, 81 aa, Callithrix jacchus
TARSQETVTFKDVAMDFTPEEWGKLDPAQRDMMLENYRNLVSLWLPVSKLENYTLENGKEPLKLERKAPKNSYSDMKTRPE

SEQ ID NO: 15837 - protein, 81 aa, Callithrix jacchus
LVGVLTFRDVAIEFSRKEWQCLDTAQRNLYSNVMLENYGNLVFLGIAASKPDLITCLEQGKEPWNVKRHEFEAKLPETGVP

SEQ ID NO: 15838 - protein, 81 aa, Macaca mulatta
QLTFRDVAIEFSQEEWKCLNSTQRTLYRDVMLENYRNLVSLDLSRNCMIKELAPQRESNREEVFHTVTLEQHEKHDIEEFC

SEQ ID NO: 15839 - protein, 81 aa, Callithrix jacchus
AQESLTLEDVAVGFTREEWQLLGPAQKDLYRDVMLENYSNLVAVGYPASKPDALLKLERGEEPCCTTEDEIYTQICSDSGS

SEQ ID NO: 15840 - protein, 81 aa, Macaca mulatta
EEWKCLDPAQQNLYRDVMLENYRNLVFLGISPKCVIKELPPTENSNTGERFQTVALERHQSCDIENLYFREIQKHLYDLEF

SEQ ID NO: 15841 - protein, 81 aa, Callithrix jacchus
QEQVSFKDVCVDFTEEEWYLLDPAQKMLYRDVILENYSNLVSVERKWKADDVLKSSQDHEDDHFWELLFHNNKRVSAESGD

SEQ ID NO: 15842 - protein, 81 aa, Callithrix jacchus
MEFVTLKDVAMDFALEDWEQFGLDQGDLFWDTALENYQNLFLLNPPRPNLTSHADGSEDLEPLARGSPEAMGPDLAETTTN

SEQ ID NO: 15843 - protein, 81 aa, Callithrix jacchus
ASVSFKDVTVEFTQEEWQHMGPVERTLYRDVMLENYSHLVSVGYCFTKPELIFTLEQGEDPWLLEKEKGFLSRTSPENSQP

SEQ ID NO: 15844 - protein, 81 aa, Bos taurus
QDPVTFEEVSVDFSQEEWAQLAPAQKILYQDVMLENYRNLTSVGECGWPPLFVSRFCFSELSVTQVQSLGRLGRFPREGNG

SEQ ID NO: 15845 - protein, 81 aa, Ovis aries
SCEVSVSLRDVAVDFSREEWQQLDLDQKNLYRDVMLETCSHLLSIGYQVPEIEVFMLEQGKEPWALQEELWQIGDQIESYH

SEQ ID NO: 15846 - protein, 81 aa, Ovis aries
AQGLVVFEDVAIYFSQEEWGLLDEAQRLLYYQVMVQNVALLSSVGCQHTTQDEVALSEQHDVAAWSQVKTPQPGLCIQKPH

SEQ ID NO: 15847 - protein, 81 aa, Ovis aries
QGLFTFKDVAVEFTQEEWECLDPTQRALYRDVMLETYRNLLSLGSYSATFAVKELSSPKEDISKGELCHLMTLEKNETYGI

SEQ ID NO: 15848 - protein, 81 aa, Ovis aries
RLTFKDVAIEFTPEEWECLDLPQRALYREVMVETLRNLLSVDTSPKRVLKGSAPKQSGHTGGILQTMLSERHKSHDTKDHG

SEQ ID NO: 15849 - protein, 81 aa, Ovis aries
KDQGSLTLEDVAVDFTWEEWQLLAAPQKALYRDVMLENYSNLVSVGYQASKPAALSRLERGELWPMEDEVHSRICPDLCWE

SEQ ID NO: 15850 - protein, 81 aa, Ovis aries
ALALISFEDVAITFTGEEWRHLDLAQRTLYQEVMLETCGLLVSLGHPVPEAELIQLLEYGPELWTVKRGLSGNTCIGEKSN

SEQ ID NO: 15851 - protein, 81 aa, Callithrix jacchus
AQGLVTFADVAIDFSQEEWACLNSAQRDLYWDVMLENYSNVVSLDLESAYETKNLPTEKSLHEIRVSKRHSDRRSKSLGHS

SEQ ID NO: 15852 - protein, 81 aa, Callorhinus ursinus
PQVLVSFEDVAVFLSQEEWGCLGPAQRGLYSNVMLETYRNLISLGLQDTKPDVISRLEKGEEPWAPYSSRIEEGWIRSHRS

SEQ ID NO: 15853 - protein, 81 aa, Callorhinus ursinus
MAFRDVAVDFSQEEWMLLSPAQRSLYREVMLENYSNLVSLGIPFSKPKLITQLEQGKETWREERTCPPAARPVEPKPELHL

SEQ ID NO: 15854 - protein, 81 aa, Rhinolophus ferrumequinum
CKKPVSFAEVAVYFSPEEWGCLRPAQRALYRDVMRETYGHLGALGCPGPKPALISWMEQESEAWSPAAQDPEEGESVGGAL

SEQ ID NO: 15855 - protein, 81 aa, Rhinolophus ferrumequinum
APASVSFEDVAVTFTREEWRHLDLDQKTLYQEVMLEICGLLVSLGQPVPKPELIYLLEHGRELWTVKRGLSRSSCTGKEAK

SEQ ID NO: 15856 - protein, 81 aa, Acinonyx jubatus
EALESVTFRDVAVDFTQEEWQQLEPAQKDLYRDVMLENYRNLVSLDLESRPEMKESGPKEDIAEHRPSVGAVAEGPTRNGA

SEQ ID NO: 15857 - protein, 81 aa, Rhinopithecus roxellana
NKGPMTLKDVIVEFTKEEWKLLTSAQRTLYKDVILENYSHLVSVGYHVNKPNAVFKLKQGKEPWILEVEIPHQVLPYLWSI

SEQ ID NO: 15858 - protein, 81 aa, Rhinopithecus roxellana
SHELLTFKDISVNFTQEEWGQLAPAYQNLYREVMLENYSNLVSVGYQLSKPSVISQLEKGEEPWMAEKEGPGDPSSDLKSK

SEQ ID NO: 15859 - protein, 81 aa, Bison bison
KSGMTLSQTQLTVEDVDIKFTPEEWECLDPAQRALYWDVMEETYRNLLSVGSLPLSHKEVPKACSFTCILELMNRMCLIYI

SEQ ID NO: 15860 - protein, 81 aa, Bison bison
SCEGSVSFRDVAVDFSREEWQQLDLDQKNLYRDVMLETCSHLLSIGYQVPETKVFMLEQGKEPWALQGEGPYQSCPGEKLW

SEQ ID NO: 15861 - protein, 81 aa, Bison bison
SQESLTFQDVAVDFTEKEWPLLDSTQRKLYKDVMLENYSNLASVGCQVGKPSLISHLEQEEELRTEDRELHRGPCPDWATP

SEQ ID NO: 15862 - protein, 81 aa, Bison bison
HQGSVTFEDVAMYFSWEEWCLLDEAQIQLYLDVMLENFALVCMLGSWHGVQDEETPSEQSKSARVSQFCTPRACLSPEKTQ

SEQ ID NO: 15863 - protein, 81 aa, Odocoileus virginianus
AAGSVTFNDVTMAFTRKEWEQLDPAQKSLYKDVMLENYSNLASMGYQALKPDMISKLEKGEEPWLGKGKRPKQGGSSEIAR

SEQ ID NO: 15864 - protein, 81 aa, Odocoileus virginianus
LQGSVSFKDVTVDFTQEEWQQLDPAQKALYRDVMLENYCHLISVGFHITKPDMIRKLEQGKELWTTEKIFQSQSYLEEDWK

SEQ ID NO: 15865 - protein, 81 aa, Odocoileus virginianus
VTELLTFKDISVDFTQEEWGQLAPAHRNLYREVMLENYGNLVSVAGCQLSKPSVISQLEKGEEPWMTEKEGAGDPSSDLKS

SEQ ID NO: 15866 - protein, 81 aa, Odocoileus virginianus
FQGSVTFRDVSIDFSREEWEWLQPAQRDLYRNVMLENYGHLVSLGLNISKPDVVSLLEQGKEPWLGNGDVSRELFPASKPN

SEQ ID NO: 15867 - protein, 81 aa, Odocoileus virginianus
LTFKDVAMVFSKEELALLDSAQINLYQDMMLKNFRNLVSMEQTTEAQSGQVTCPGSPSLSEELGFEPPSLTLSPVLVITRS

SEQ ID NO: 15868 - protein, 81 aa, Odocoileus virginianus
ARLTFKDVAIEFSPEEWECLDPAQRTLYRDVMVETLRNLLSVGISHIHMIKKSQLKANIDIGERYQTLILGNPESHEIKHF

SEQ ID NO: 15869 - protein, 81 aa, Odocoileus virginianus
WKMWVKKPVTFEDVAVTFTQEEWKCLDASQRVLYQDVISETVRNLMSVDLIAKLEQEEKQWEADLCSPNGEGFHSGGKKEG

SEQ ID NO: 15870 - protein, 81 aa, Cebus imitator
MLENCGLLVSLGCPVPRPELIYHLEHGQEPWTRKEDLSQGTHPGDKGKPKTTEPTTCDPALSEGISLQGQLTKGNSVASQL

SEQ ID NO: 15871 - protein, 81 aa, Cebus imitator
MGVLTFMDVAIEFSLEEWQCLNTAQRNLYRNVMLENYRNLVFLGIAASKPDLITCLEQGKEPWNVKRHEMVAKPPAVCSYF

SEQ ID NO: 15872 - protein, 81 aa, Cebus imitator
PGSLEMGLLTFRDVAIEFSLEEWQCLDTAQQNLYRNVMLENYRNLAFLAGIAVSKPELITCLEKEKGPWNMKRHEMVDEPP

SEQ ID NO: 15873 - protein, 81 aa, Cebus imitator
TQESLTLEDVAVEFSWEEWQLLDTAQKDLYRDVMVENYNHLVSLGYQTSKPDALSKLAHGQEPWITDAKIQNKNCPGIRKV

SEQ ID NO: 15874 - protein, 81 aa, Cebus imitator
MGQLTFNDVTIEFSLEEWQCLDKPQQNLYREVMLENYRNLVFLGIAVSKPDLITCLKQGKEPWNIRRHEMVTKPPAMCSHF

SEQ ID NO: 15875 - protein, 81 aa, Cebus imitator
PLTFMDVAIEFSLEEWQCLDTAQQNLYRDVMLENYRNLVFLSENNFNIIALSKPALIRYLEQGKEPWNMKRHDTVTKPPGM

SEQ ID NO: 15876 - protein, 81 aa, Cebus imitator
LQGLVTFEDVAVEFTQEEWALLAPAQRMLYRNVMLENFWNLSSSLGNQVDKPSLISHLEQEDKLMTEERGIVPGTRPDVET

SEQ ID NO: 15877 - protein, 81 aa, Cebus imitator
PKVPVAFDDVSIYFSTPEWEKLEEWQKELYKNIMKGNYESLISMDYAINQPDVLSQIQPEGEHNTEAQTGPEESEIPTDPS

SEQ ID NO: 15878 - protein, 81 aa, Callithrix jacchus
SVFLQESLTLEDVTVEFTWEEWQLLDPSQKDLYRDVMLEIYSNLVSVGFQVSKPDALSKLERGEEPWTIGDERHSRICPGT

SEQ ID NO: 15879 - protein, 81 aa, Callithrix jacchus
MGVLTFKDMAAEFSLEEWQCLDTSQQNLYTDVMLENYRNLVFLSIAASMQDMITCLEQGKEPWNVKRHEMVAEPPEFCPCH

SEQ ID NO: 15880 - protein, 81 aa, Macaca mulatta
VAVDFTQEEWGQLDPTQRILYRDVMLETFGHLLSIGPELPKPEVISQLEQGTELWVAERGTIQGCHPGWEPPSESQASRKE

SEQ ID NO: 15881 - protein, 81 aa, Callithrix jacchus
TQGCVTFEDIAIYFSQEEWGLLDEAQRLLFLEVMLENFALVASLGCGHGTEDEKTPSEQNVSIGVSQSKAGSSAQKTQPCE

SEQ ID NO: 15882 - protein, 81 aa, Bos taurus
LQDLVTFEDVTVEFTQEEWALLDSSQRKLYRDVMLENCRNLASLGYHVDKPSLISQLEQEDKVVTEEGGILPGTRPDLETV

SEQ ID NO: 15883 - protein, 81 aa, Bos taurus
ETFGMKFEDVAIDFSQEEWGLLDEAQRLLYYSVMLENFALVASLGCCHGTEDEEAPSEQSLSVEAESQVGVSKAGPSIQKI

SEQ ID NO: 15884 - protein, 81 aa, Bos taurus
LLEMHSWDPAMAIRTLTSKGQESVTFKDVAVDFTLEEWGRLGPGQRELYRDVMLENYQNLLSLGEALPPAVLSWPLCPPTA

SEQ ID NO: 15885 - protein, 81 aa, Bos taurus
ESVTFKDVAVLFTQDEWAQLSPAQRALYRDVMLENYSNLVSLDWVITPMNKKSILKADIPEGELGQWMIKERFTRDSCWKY

SEQ ID NO: 15886 - protein, 81 aa, Ovis aries
KDQGSLTLEDVAVDFTWEEWQLLAPPQKALYRDVMLENYSNLVSVGYQASKPAALSRLERGELWPMEDEVHSRICPEMRKD

SEQ ID NO: 15887 - protein, 81 aa, Ovis aries
SEEPVTFKDVAVDFSQEEWGQLGSPQRALYRDVMLENYQNLLSLGPPVCKPDVISHLERGEEPWRAPRGGPAGPGPEPGRE

SEQ ID NO: 15888 - protein, 81 aa, Delphinapterus leucas
GSVSFEDVTVEFTQDEWQYVGPALRTLYKDVMLENYSHLVSLVVTFAGYCIIKPQVIFKLEHGEEPWPSEEEFLNQKYPGC

SEQ ID NO: 15889 - protein, 81 aa, Sapajus apella
QESVTFKDVAVDFTLEEWGWLEPGQRELYRDVMLENYRNLLSLGAGLPGSKPDVISRLERGQEPRPEDREAQRVTCPDLKT

SEQ ID NO: 15890 - protein, 81 aa, Sapajus apella
AQESLTLEDVAVDFTWEEWQLLGPAQKDLYRDVMLENYSNLVAVGYQASKPDALFKLEQGQPPWTIKDGIHSGGCSEIWKF

SEQ ID NO: 15891 - protein, 81 aa, Sapajus apella
ARDLVMFRDVAVDFSQEEWECLNSYQRNLYRDVILENYSNLVSLAGCSISKPDVITLLEQGKEPWLVVRDEKRRWSLDLES

SEQ ID NO: 15892 - protein, 81 aa, Sapajus apella
FQESVAFEDVAVYFTQNQWGSLDPAQRALYSEVMLENYANVASLVAFPFPKPALISHLEKGEAPWGPDPWDAEIPSGINQG

SEQ ID NO: 15893 - protein, 81 aa, Sapajus apella
MLENYRNLAFLGIAISKPDLITWLEQGKEPWNMKSHAMVAKPPVIWSHFAQDLWPEESIKDSFQKGILRTYGKYGHESLQL

SEQ ID NO: 15894 - protein, 81 aa, Macaca mulatta
GEGSLSFEDVAVDFTREEWQFLDWSQKVLYKEVMLENYSNLVSVGYQGTKPDSLFKLEQGEPPWIVEGAAHSQTCPGFVIQ

SEQ ID NO: 15895 - protein, 81 aa, Sapajus apella
GYQDSVTFDDVAVEFTPEEWALLDTTQKYLYRDVMLENYKNLASVGCQLFIPNPTSWLKQEELKTMESGVLQQWEIQPRTQ

SEQ ID NO: 15896 - protein, 81 aa, Vombatus ursinus
MEENAWTFLFLGLPVLREDLISPFHQGEAPGTLEQKGPRNSWPDVETRFEVNEKTTQLRIFVEESGQQKFMGDGAWDLSLR

SEQ ID NO: 15897 - protein, 81 aa, Balaenoptera acutorostrata
SQLSVTFEDVAVLFTRDEWRKVTPSQRNLYRDVMLENYGNLVSLGLPFSKPEVISLLQQGEDPWKVEKESPGGSSLGCKSS

SEQ ID NO: 15898 - protein, 81 aa, Ovis aries
FREPVTFEDVALGFTPDEWGQLDLEQKSLYREVTLENYRNLVSVEHQLSKPDVVSQLEEEEELWSVERGIQDTFSECPEAQ

SEQ ID NO: 15899 - protein, 81 aa, Ursus maritimus
MAHLMMFRDVVVDLSQEEWECLDLEQRHLYRDVMLENYSNMISLGLCIYQPDVFSLLEKGKEPWMVLQDETRGPCPDVQSR

SEQ ID NO: 15900 - protein, 81 aa, Rhinolophus ferrumequinum
VDGRLTFRDVAIDFSQEEWECLHPAERKLYTDVMLENYRNLCSLGLAVSKPDLVIFLERMKDAWDVQRKKAVSIHPAMSSA

SEQ ID NO: 15901 - protein, 81 aa, Ursus maritimus
VMAHMAFRDVAVDFSQEEWLLLSPAQRSLYREVMLENYSNLVSLAGIPFSKPKLISQLEQGKETWREERTCPLATCPAEPK

SEQ ID NO: 15902 - protein, 81 aa, Phyllostomus discolor
MHFSWEEWRLLDEAQRRLYLHVMLDNFTLISSLGCCCGAKDVEAPTEENICVPVSQARNAKTAVSSQKSHPCESCGPVLRD

SEQ ID NO: 15903 - protein, 81 aa, Ursus maritimus
MMLENYRNLVSVEHQLSKPDVVSQLEEEEALWSVERGIPQDTFSEYPTAQLDPQLDPFPAGNPLMKIEVVEVLTLNQEVAR

SEQ ID NO: 15904 - protein, 81 aa, Acinonyx jubatus
QGSVTFEDVALYFSWEEWDLLDEDQRCLYHDVMLENFALTSSLGCGHGVDNEDVPLEESISVGVSQIRTLEADSSPQKAQP

SEQ ID NO: 15905 - protein, 81 aa, Acinonyx jubatus
LFQGLLTLRDVAIEFSQEEWGCLNHSQRELYRDVMLETYGHLLFLGLIVSKPDLVIVLEQEEELWGVKRKETVASHSGRWE

SEQ ID NO: 15906 - protein, 81 aa, Rhinopithecus roxellana
RDVTVEFSLEEWECLDTVQQDLYWDVMLENYRNLVFLGIIVSKPDLITCLEQGKEPWNMKRHEMVAKTPVEMRFHHVSQAS

SEQ ID NO: 15907 - protein, 81 aa, Rhinopithecus roxellana
RAEEAMTFKDVAVVFTEEELGLLDPAQRKLYQDVMLENFRNLLSVGHQAFHRDTFHFLREERIWMMKTATQREGNSGDKIQ

SEQ ID NO: 15908 - protein, 81 aa, Acinonyx jubatus
MLENYGNLVSVGYQLSKPGVISQLEKGQEPWLIEREVSGGPRSDLESKAETKESAVKNDTSWEELHHGLMKEQSTRGSTLY

SEQ ID NO: 15909 - protein, 81 aa, Rhinopithecus roxellana
HLTFMDVAIEFSQDEWKCLDPGQRALYRDVMLENYRNLVSLGRSCILGSNAENKPIKNQLGFTLESRLSELQLFQAGRKIY

SEQ ID NO: 15910 - protein, 81 aa, Rhinopithecus roxellana
AHALVTFRDVAIDFSQKEWECLDTTQRKLYRDVMLENYSNLVSLGYSGSKPDVITLLEHGKEPCVAVRDVTGRQYPGLLSR

SEQ ID NO: 15911 - protein, 81 aa, Rhinopithecus roxellana
TGGDVTFSDVAIDFSHEEWAWLDSAQRDLYKDVMVQNYENLVSVGLSVTKPYVIMLLEDGKEPWMVEKKLSKDWKSRWENK

SEQ ID NO: 15912 - protein, 81 aa, Rhinopithecus roxellana
MDSLVFEEVAVNFTPEEWALLDHAQRSLYRDVMLETCRNLASLDCCIYVRTSGSSSQSDVLGNGISNDEEIVKFTSDYWSI

SEQ ID NO: 15913 - protein, 81 aa, Acinonyx jubatus
YTLESLTLEDVAVDFTQEEWRLLAPAQKDLYWDVMLENFRNLVSVGYVASMPAALSRLERGGQWMTEDETRHWICPEIKKD

SEQ ID NO: 15914 - protein, 81 aa, Rhinopithecus roxellana
SLESELFRDVAIVFSQEEWQCLAPAQRDLYRDVMLETYSNLVSLGLAISKPDVISFLEQGKEPWMVERVVSGGLCPVLKYR

SEQ ID NO: 15915 - protein, 81 aa, Rhinopithecus roxellana
KSQESLTLEDVAVEFTWEEWQFLGPAQKDLYRDVMLENYSNLVSVGYQASKPDALSKLEQGEPWTVENEIHSQICPEIKKV

SEQ ID NO: 15916 - protein, 81 aa, Acinonyx jubatus
SVTFEDVAVEFTPEEWALLDPCQRTLYRDVMQENRRNLASLDLETLLRAKGLTSKQHVFRQEQHKGVKMERNHLGVKVNEC

SEQ ID NO: 15917 - protein, 81 aa, Rhinopithecus roxellana
FQGSVSFKDVTVGFTQEEWQHLDPSQRALYRDVMLENYSNLVSVGYCVHKPEVIFRLEQGEEPWRLEEEFPSQRFPEVWTA

SEQ ID NO: 15918 - protein, 81 aa, Rhinopithecus roxellana
MELLTFRDVAIEFSPEEWKCLDPAQQNLYRDVMLENYRNLVSLGFVISNPDLVTCLEQIKEPYSLKIHETAAKPPVVQHFW

SEQ ID NO: 15919 - protein, 81 aa, Rhinopithecus roxellana
FQEAVTFKDVAVAFTEEELGLLDPAQRKLYRDVMLENFRNLVSVGHQSFKPDMISQLEREEKLWMKEFQTQRGKHSGDRNL

SEQ ID NO: 15920 - protein, 81 aa, Bison bison
MLENYQNLLSLGPPVCKPDVISHLERGEEPWQAPRDGPAGPDPEPGWEPGPEAEETLVYKEEPPWELIAVGLVRSGVHNPG

SEQ ID NO: 15921 - protein, 81 aa, Bison bison
SLSPVTFEDVAVYFSQEEWRLLGEAQKFLYRDVMLETFALVMSLGCCHTAEDEQTPSEQNVSVEVPQRNTKKTDLSSQKVC

SEQ ID NO: 15922 - protein, 81 aa, Bison bison
SQGLVSFKDVAVDFTQEEWQQLDSAQKTLYRDVMLENYSHLVSMGHPVSKPDVISKLEQGEDPWIIKRDIPNWICPYEGQA

SEQ ID NO: 15923 - protein, 81 aa, Bison bison
QVSIAFQDLAVRFSKDEWRLLGEGQRALYLDVMRENYDTLASLGTAEPLPLSAFLSPSEPGGAVGARSRAGDRQEPPQGGG

SEQ ID NO: 15924 - protein, 81 aa, Odocoileus virginianus
SEIELVTFEDVAIDFTQEEWSLLDKSQKNLFRNVMMEIITHLVSVGYQISKSDVISQLEQGKELWSEAGGFQGQRPGSERP

SEQ ID NO: 15925 - protein, 81 aa, Odocoileus virginianus
PQDLLTFEDVAVEFTWWEWGQLDPAQKDLYWEVMLENFKNLASLGFPVSKPYMIRQLEEGEEPCILEREISTGVHSDWERR

SEQ ID NO: 15926 - protein, 81 aa, Odocoileus virginianus
MLENYQNLLSLGPPVCKPDVISHLERGEEPWQAPRDGPAGPGPEPGWEPRPAAETLVYKEEPPWEPIADGPARSSVHNPGF

SEQ ID NO: 15927 - protein, 81 aa, Odocoileus virginianus
FQGSVSFKDVTVGFTQEEWQHLDSTQRSLYRDVMLENYRNLVSVGYCITKPEVIFRLEQGEEPWILEEEFPSQSFSEVCKT

SEQ ID NO: 15928 - protein, 81 aa, Odocoileus virginianus
SKDLVTFKDVAVDFSQEEWGWLSPAQRGLYRSMMLENYQSLVSLGLCISKPYVISLLEQGKEPWTMMENEMRSPFPDWESI

SEQ ID NO: 15929 - protein, 81 aa, Odocoileus virginianus
QGFVVFEDVAVYFSQEEWGLLDEAQRLLYCQVMLQNIALLSSIGGDRGSELDPSHGPTTPRGVCGFRRLFNTVLLTGPHGG

SEQ ID NO: 15930 - protein, 81 aa, Cebus imitator
KSLESVSFKDVTVDFSRDEWQQLNIAQKSLYRDVMLENYFNLISVGCQVPKPEVIFNLEQEEPCMLNGGISSQSCPDGKIG

SEQ ID NO: 15931 - protein, 81 aa, Cebus imitator
EPGAVSFGDVAVYFSREEWGCLRPAQRALYRDVMRETYSHLGALGVGGSKPALISWSGNKEEERQREGSGALEKSLPVATG

SEQ ID NO: 15932 - protein, 81 aa, Cebus imitator
PQGLVTFEDVAVAFTQEEWQYLNPLQRTLYRDVMLETYSNLVFVGQQVTKPDLILKLEVEECLVEGKIPFWSFPEVCQVNE

SEQ ID NO: 15933 - protein, 81 aa, Cebus imitator
TSKEAVTFKDVAVVFTEEELGLLDPAQRRLYRDVMLENFRNLLSVGHQPFNRDTFYFLREEKFWMMDIATQREGNSGGKIQ

SEQ ID NO: 15934 - protein, 81 aa, Cebus imitator
PQESVAFDDVAVYFTKKEWAIMVPDQRALYRDVMLENYEAVAFVAVPPTSKPALVSHLEQGKEPCFTQPQGVLSRRDWRAG

SEQ ID NO: 15935 - protein, 81 aa, Callithrix jacchus
SQELLTFKDISIDFTQEEWGQLTPAYQNLYREVMLENYSNLVSVGYQLSKPSVISQLEKGEEPWMTEKEGSGDPSSDLKSN

SEQ ID NO: 15936 - protein, 81 aa, Callithrix jacchus
MLENYGNLVFLGIAASKPDLITCLEQGKEPWNVKRHEFEAKLPVASSYFAQDLWPKQVIKNHFQKVILRRYKKCRHENFQL

SEQ ID NO: 15937 - protein, 81 aa, Callithrix jacchus
TQEPLGFRDVAIEFSLEEWHCLDTVQRNLYWDVMLENYRNLVFLGKHNLNTQGDSLEFGRGRLQSAMTLCIILDLWPEQGI

SEQ ID NO: 15938 - protein, 81 aa, Macaca mulatta
VAVDFTQEEWQQLDPAQKALYRDVMLENYCHFVSVGFHMTKPDMIRKLEQGEELWTQRIFPSYSYLEEDGKTEDVLVKFKE

SEQ ID NO: 15939 - protein, 81 aa, Callithrix jacchus
PQVSLTFEDVAVLFTRDEWRKLAPSQRNLYRDVMLENYRNLVSLGLPFTKPKVISLLQQGEDPWKVEKDCFGGSFLGCKSN

SEQ ID NO: 15940 - protein, 81 aa, Callithrix jacchus
FQGSISFKDVTVGFTQEEWHHLDPSQRALYRDVMLENYSNLVSVGYCVHKPEVIFRLEQGEEPWRLEEEFPSQSFPEIWTA

SEQ ID NO: 15941 - protein, 81 aa, Callithrix jacchus
FQELVTFKDVVVHFSLEELRSLSAAQRSLYREVTLENYRNLVSLGYRFSKPDIISRLEKEESRAVETDSNAVICQGESHED

SEQ ID NO: 15942 - protein, 81 aa, Callithrix jacchus
LLTFRDVAIEFSQEEWRCLDPAQRTLYRDVMLENYRNLVSLDIFSKCETKELPPEEKSNTGETFQTVMLERENQGVGDVSC

SEQ ID NO: 15943 - protein, 81 aa, Bos taurus
AVTFTQEEWGHLDPAQRTLYQEVMLENCGLLVSLGCPVPRPELIYRLEHGQELWTVKRDLSRSTCAGDKGKPKTRESTTSE

SEQ ID NO: 15944 - protein, 81 aa, Bos taurus
QGHLTFKDVAIEFSQEEWECLHTAQRALYRDVMLETYRNLLSVGGFLTTGPPGKLLCMFHFPIYSLINSQSICDVSHMIWG

SEQ ID NO: 15945 - protein, 81 aa, Ovis aries
QEQLTSEDVAIEFSQEEWEFLDAAQRALYRDVMLETYRNLLSVDISPTHVTKHLQPKATSDKRETFQTLMLGSPESCEIER

SEQ ID NO: 15946 - protein, 81 aa, Bos taurus
MYFSQEEWELLDPTQKALYNDVMQENYETVISLALFVLPKPKVISCLEQGEEPWVQRPLEFKDSSEELPAGLKLKNDTENI

SEQ ID NO: 15947 - protein, 81 aa, Acinonyx jubatus
SQGLLTFRDVAIEFSQDEWGCLNQSQRELYRDVMLETCGHLLFLGLIVSKPHLVIFLEQKRELWDVKRKKTVASPAAIASH

SEQ ID NO: 15948 - protein, 81 aa, Rhinopithecus roxellana
SCEGSVSFRDVAINFSREEWQHLDPSQRNLYRDVMLETYSHLLSVGYQVPEAEVVMLEQGKEPWALQGERPRQSCPGEKLW

SEQ ID NO: 15949 - protein, 81 aa, Rhinopithecus roxellana
QEGVNFKIVTVDFTQEEKSTWNPAQRTLDRDVILENHRDLISWDLATAVGKKDPTSKQSIFDEEPANGVKIERLTRDDPWL

SEQ ID NO: 15950 - protein, 81 aa, Rhinopithecus roxellana
GSVTFEDVAIYFSQEEWGLLDEAQRLLYRDVMLENFALITALVCCHGTEDEETPEQSVSVERVPQVRTPEASPSTQKTQSC

SEQ ID NO: 15951 - protein, 81 aa, Acinonyx jubatus
SKGSMMFRDVSINFSQEEWECLDSGQMNLYKEVMLENFSNLVSVGLSNSKPAVISLLEQGKEPWMVERELTRGLCSDLESM

SEQ ID NO: 15952 - protein, 81 aa, Rhinopithecus roxellana
GKELLSFEDVAMYFTREEWDHLDWGQKDLYRDVMLENYRNMVLLGFQFPKPEVICQLENWDEQWILDLPRAGSRKASGSAC

SEQ ID NO: 15953 - protein, 81 aa, Acinonyx jubatus
WRAWVQKPVTFEDVAVNFTQEEWMYLDASQRALYQDVMSEIVRNLMSVDLVTKLEEEEQWRTELQLQPPNGEGLPSGSRKQ

SEQ ID NO: 15954 - protein, 81 aa, Rhinopithecus roxellana
CWGLLSFKDISMEFTWDEWQLLDSTQKYLYRDVILENYHNLLSVGYHGTKPDLIFKLEQGEDPWIINAKISRQSHPDGWEE

SEQ ID NO: 15955 - protein, 81 aa, Rhinopithecus roxellana
QGLLTFSDVAIEFSQEEWKCLDPAQRTLYRDVMLENYRNLVSLDISSKCMMKEFSSTAQGNTEVIHRGTMQRRECHHIGDF

SEQ ID NO: 15956 - protein, 81 aa, Rhinopithecus roxellana
PQASVCFEDVAMAFTQEEWEQLDLAQRTLYREVTLETWEHIVSLGLFLSKSDVISQLEQEEDLCRAEQVAPREKRVLGSFL

SEQ ID NO: 15957 - protein, 81 aa, Acinonyx jubatus
VQRFVSFKDVTVDFTWEEWQQLDSAQRNLYRDVMLENYSNLVSVDFETGMKELTTQKSISEEVVLHNMIVYSTFEDWKLED

SEQ ID NO: 15958 - protein, 81 aa, Odocoileus virginianus
WGSLVAFEEVAMHFSREEWELLDEAQRQLYHTVMLETLELVTSLGCWPVVEGEELPSEKNASGEVVAQVRTPSVPPSIQKA

SEQ ID NO: 15959 - protein, 81 aa, Odocoileus virginianus
QGCVTFEDVAVYFSQEEWGLLDEAQRHLYHKVMLENFALTASMVCLHETETKEIPSEQNVSLEALSQVRTPKVVTFKDVAM

SEQ ID NO: 15960 - protein, 81 aa, Odocoileus virginianus
PLESVTFEDVAVDFTQEEWALLDTSQRKLFRDVMLENISHLVFVGYQHCKLDVTFQLEQGEELWIEGRGFFQSHSPGRESA

SEQ ID NO: 15961 - protein, 81 aa, Odocoileus virginianus
KVSRSLENDGVCFSEQEWENLEDWQKELYANVMKSNYETLVSLKPRPVEACPEGQCDRSGGRETEGEDGQRGDEVLGQPEG

SEQ ID NO: 15962 - protein, 81 aa, Odocoileus virginianus
RGSVTFEDVAVYFSWEEWALLDEAQRCLYHDVMLENFALTSSLGYWHGVEDKGAPSEKSISVEGVSLIKTLKADSSPQKDQ

SEQ ID NO: 15963 - protein, 81 aa, Odocoileus virginianus
QACVTFEDVAIYFSQEEWRLLNETQRFLYCDVMLENFALTTSLGCWRGVGKEEAPSEQSVFVAVSHIHTSKADSLTQMAYP

SEQ ID NO: 15964 - protein, 81 aa, Cebus imitator
SYEGSVSFRDVAIDFSREEWRHLDLSQRNLYRDVMLETYSHLLSVGYQVPEAEVVMLEQGNEPWALQGERPHQSCPGEKLW

SEQ ID NO: 15965 - protein, 81 aa, Cebus imitator
SQELLTFKDISIDFTQEEWGQLTPAHQNLYREVMLENYSNLVSVGYQLSKPIVISQLEKGEEPWMTEKEGPGDPSSDLKSN

SEQ ID NO: 15966 - protein, 81 aa, Cebus imitator
QESVTFQDVAVDFTEKEWPLLDSSQRKLYKDVMLENYSNLTSLDWETPSKTKWSLLMEDIFGKETPSGVTMERAGLGEKPT

SEQ ID NO: 15967 - protein, 81 aa, Cebus imitator
SQELVTFEDVAVYFIRKEWKRLEPAQRDLYRDVMLENYGNVFSLDGETRTENDQAVSEDTRSHGVLLGRFQKDISQGLKFK

SEQ ID NO: 15968 - protein, 81 aa, Cebus imitator
GPLTFRDVTIEFSHEEWKCLDPAQKALYKDVMLENYRNLVFLGITPKCTTKELPPIGNNNTGEKFRTVTLERHECYDIEDI

SEQ ID NO: 15969 - protein, 81 aa, Macaca mulatta
RVTFKDLAVVFTKEELALLDKAQINLYQDVMLENFRNLISVGDGIKNNILNLQEKGLSYLSQEVLRCWQIWKQRIRDLTVS

SEQ ID NO: 15970 - protein, 81 aa, Macaca mulatta
GTVTFEDVAVNFTQEEWNLLSEAQRCLYRDVMLENLALISSLGCWCGVEDEEGPSKQSIYKQRETQIRIPMAGVSLKKAHP

SEQ ID NO: 15971 - protein, 81 aa, Callithrix jacchus
EMETLTFRDVAIEFSLEEWQCLNPAQQDLYRNVMLENYRNLVFLAGITVCKENPITCLVQGKEPCNVKTHEMVARPNESRS

SEQ ID NO: 15972 - protein, 81 aa, Callithrix jacchus
KSLESVSFKDVTVDFSRDEWQRLNIAQKSLYRDVMLENYFNLISVGCQVPKPEVIFNLEQEEPCMLNGGISSQSCPDGKIG

SEQ ID NO: 15973 - protein, 81 aa, Macaca mulatta
AVTFKDVAVVFSREELRLLDLTQRKLYRDVMVENFKNLVAVGSKHQNKMETLQKFALKYLSNQELSCWQIWKQVARELTRC

SEQ ID NO: 15974 - protein, 81 aa, Callithrix jacchus
SSRDPPASDVSVEFSSAEWKCLTPAQRALYRDVMLENYRNLESVGEENVPPDTSNPSLFIWKPYKCNECGKTFHQVSFLTC

SEQ ID NO: 15975 - protein, 81 aa, Callithrix jacchus
CRSITFRDVAIDFSHQEWEYLNLVQKTLYQEVMMENYDNLVSLVNKMFFFYVLCLLDLDSRREIINDKKMDIYRKDSSVTL

SEQ ID NO: 15976 - protein, 81 aa, Monodon monoceros
VKKPVTSEDVAVNFNQEEWECLDASQRVLYQDVMSETFRNLMSVVRIFLSNPDLIAKFEQEEKQWRAGLRPPNGEGLHSGG

SEQ ID NO: 15977 - protein, 81 aa, Macaca mulatta
GQLTLKDVAIEFSQEEWTYLDPAQKTLYRDVMLENYRNLVSLDISCKCVNKDPPPKGKNSTGEAFHMVKLEGLESCDEALS

SEQ ID NO: 15978 - protein, 81 aa, Callithrix jacchus
QDSVAFEDVDVNFTQDEWALLDPSQKNLYRDVMQETFRNLASVGKKWKDQKIEDEYKNPRSNLRGLMGERLLESKTGHQLG

SEQ ID NO: 15979 - protein, 81 aa, Macaca mulatta
MLDNYRNLVFLGIAVSKRDLIPCLEQEKEPWNVKTHDMVAKPPVICSRIAQDLWPEQGIKDYFQEVILRQYKKCGHENLLL

SEQ ID NO: 15980 - protein, 81 aa, Macaca mulatta
MEPLKFRDVAVEFSLEEWQCLDTIQQNLYRNVMLENYRNLVFLGIAVSKPDLITCLEQEKEPLTMQRHEMVDEPPVMCSHF

SEQ ID NO: 15981 - protein, 81 aa, Callithrix jacchus
EMEPLTFRDVAIEFSLEEWQCLNPAQQDLFRNVMLENYRNLVFLGIAASKPDLITCLEKAKEPWKMKQHEMVDEPPGASTF

SEQ ID NO: 15982 - protein, 81 aa, Callithrix jacchus
MGFTQEEWQHLDPAQRTLYKDVMLENYSPVVSVGYYIPKPGVIVKLEQGEHPWILEEELPGHKYPVEQKFQGSISFKDVTV

SEQ ID NO: 15983 - protein, 81 aa, Macaca mulatta
SVAFEDVAVNFTQEEWSLLDPSQKNLYREVMQETLRNLASIGKKWKDQNIENEYKNPRSNQRGLMEERLFESEGHQPGEIL

SEQ ID NO: 15984 - protein, 81 aa, Bos taurus
LQGLMTFEDVAVDFTQEEWQYLNPPQRTLYRDVMLETYSNLVSVAGHHVTKPDLILKLEVEEKCLPEGKIPIWSFPEEACQ

SEQ ID NO: 15985 - protein, 81 aa, Acinonyx jubatus
ELVTFRDVVISFSQEEWEYLDSAQRDLYWDVMMENYSNLVSLDLESKYDTKYLFNGKDIIENNGFQWKVTEGKFIGLESSI

SEQ ID NO: 15986 - protein, 81 aa, Rhinopithecus roxellana
MGLLTFRDVAIEFSLEEWQCLDTAQRNLYKNVILENYRNLVFLGIAVSKPDLITCLEQEKEPLTMQRHEMVDEPPVMCSHF

SEQ ID NO: 15987 - protein, 81 aa, Rhinopithecus roxellana
PQASVCFEDVAMAFTQEEWEQLDLAQRTLYREVTLETWEHIVSLGLFLSKSDVISQLEQEEDLCRAEQVAPRGTSGLSQVT

SEQ ID NO: 15988 - protein, 81 aa, Rhinopithecus roxellana
SQGLVTIKDVSLCFSQEEWRSLDPSQTDFYGEYVMQENCGIVVSLRFPIPKLDMLSQLEGGEEQWVPDSQDLEERDILRVT

SEQ ID NO: 15989 - protein, 81 aa, Acinonyx jubatus
SQELLTFKDISVDFTQEEWGQLPLAHRNLYREVMLENYGNLLSVGYQLSKPSVISQLEKGQEPWMTEKEGPGDPSSDLKNK

SEQ ID NO: 15990 - protein, 81 aa, Rhinopithecus roxellana
VTFEDIAIYFSQEEWGLLDEAQRLLYLEVMLENFALVASLGCSHGTEDEETPSGQNVSVRVSQSKAGSSTQKTQSCEMCVP

SEQ ID NO: 15991 - protein, 81 aa, Rhinopithecus roxellana
GTVTFEDMAVKFPREEWNLLSEVQRCLYCDVTLENLALISSLGKPCLYSLCYTPRVRIPMAGVSPKKAHPCEMCGSILGDI

SEQ ID NO: 15992 - protein, 81 aa, Rhinopithecus roxellana
QLTFRDVAIEFSQEEWKCLNSTQRTLYRDVMLENYRNLVSLDLSRNCMIKELAPQWEGNREEVLHTVTLEQHEKHDIEEFC

SEQ ID NO: 15993 - protein, 81 aa, Rhinopithecus roxellana
QGHVTFEDIAVYFSQEEWGLLDEAQRCLYHDVMLENFSLMASVAGLSQSNHKDSCSQQKVTVSLNNGVAQCSPDDGHYTPK

SEQ ID NO: 15994 - protein, 81 aa, Acinonyx jubatus
SQESVTFADVAVDFTQEEWTLLDWSQRKLFRDVMLENISHLVSVGKQLYKLDTIFHLEQGEQLSTEGIGLLQCQSLGVPAD

SEQ ID NO: 15995 - protein, 81 aa, Rhinopithecus roxellana
HGKGPLQFRDVAIEFSLEEWHCLDTAQRNLYRNVMLENYRNLVFLGIIVSKPDLITRLEQGKKPLTMKRHEMVVKPPGRCE

SEQ ID NO: 15996 - protein, 81 aa, Rhinopithecus roxellana
MSQGSVTFQDVAIDFSEEEWGFLNPAERDLYTTVMLENYQNLVWLGLSISKSVISLLEKRKLPWIMGKEEIRVPLPDAPGA

SEQ ID NO: 15997 - protein, 81 aa, Bison bison
ARLSVTFDDVAVTFTQEEWGHLDPAQRTLYQEVMLENCGLLVSLGCPVPRPELIYRLEHGQELWTVKRDLSRSTCAGDKGK

SEQ ID NO: 15998 - protein, 81 aa, Bison bison
MAFRDVAVDFTQDEWVLLSPAQRSLYREVMLENYSNLVSLGIPFSKPELITQLEQGKETWREDRKCSPVSCLEPKPELHLC

SEQ ID NO: 15999 - protein, 81 aa, Bison bison
EQLTFKDIAVEFSQEEWECLDPAQRAFYMDVMVETLRNLISVDISHIHVVKKLQPIASSDRGDAFQTVTLERQESPEMKYF

SEQ ID NO: 16000 - protein, 81 aa, Bison bison
AHGSLTFSDVAIGFSQQEWECLDPVQKTLYRDVMMENYGNLVSLAGHSISKPNVITLLEQGKEPWLVVREETRSWCTDLDS

SEQ ID NO: 16001 - protein, 81 aa, Cebus imitator
MVTFSDVAIHFSHEEWGWLDSAQRDLYKDVMVQNYKILVSLGLSITKPYVITLLEDGKEPWMMEEKLSKGVTPDWESRLEN

SEQ ID NO: 16002 - protein, 81 aa, Cebus imitator
YQTPVSFKDVVVGFTQEEWHQLNPTQRALYRDVMLETYSNLVSVGYEGTKPDVILRLEQEEAPWIGEAACLGCHCWEDTWQ

SEQ ID NO: 16003 - protein, 81 aa, Cebus imitator
AQGSVTFEDVAVTFTQEEWGQLDATQRTLYQEVMMETCGLLVSLGCPLSKPELIYQLDHRQELWMSKKDLSQSSYPGDSTK

SEQ ID NO: 16004 - protein, 81 aa, Cebus imitator
SKAPITFGDLAIYFSQEEWEWLSPIQKDLYEDVMLENYRNLVSLGLSFRRPNVITLLEKGKAPWMVEPARRRRGPELTEAS

SEQ ID NO: 16005 - protein, 81 aa, Cebus imitator
VQESVTFKDVAVLFTQEEWGQLSPAQRALYRDVMLENYSNLVSLGLLGPKPDIFSQLEKREEWMPEDPSGGFCLDWMTMPV

SEQ ID NO: 16006 - protein, 81 aa, Cebus imitator
TESVMAFGDVTVDFTQKEWRLLSPAQRALYREVTLENYSHLISLGILHSKPELIKRLEQGEAPWGEERRRQPGPHAGIYAE

SEQ ID NO: 16007 - protein, 81 aa, Callithrix jacchus
AQVSVTFEDVAVTFTQEEWGQLDATQRTLYQEVMLETCGLLASLGCPLSKPELIYRLDHRQEPWMVKRDLSQSSYPGDSTK

SEQ ID NO: 16008 - protein, 81 aa, Macaca mulatta
FQGLVTFADVAIDFSQEEWACLNSAQRDLYWDVMLENYSNLVSLDLESAYENKSLPTGKNIHEIRASKRNSDRRSKSLGRN

SEQ ID NO: 16009 - protein, 81 aa, Callithrix jacchus
SQASVSFQDVAVEFTQEEWQHLGLVEWTLYRDVMLENYSHLVSVGYCITKPKVISQLEQGEEPWSLEDEFLNQKYPGHFKV

SEQ ID NO: 16010 - protein, 81 aa, Macaca mulatta
QGYVTFEDVAVYFSQEEWRLLDETQRLLYRNVMLENFSLLASLGLASSKTHDITQLESWKEPFMPASEVVTSAIPRGCWHG

SEQ ID NO: 16011 - protein, 81 aa, Callithrix jacchus
FQLPLTFEDVAIYFSEQEWQDLQAWQKELYKRVMRSNYETLISLDDGLPKPELIAWIEQGEEPFRNWRESQKSGNIICSSV

SEQ ID NO: 16012 - protein, 81 aa, Callithrix jacchus
SQESVSFKDVTIEFTQEEWQQMAPVQRNLYRDVMLENYSHLVSVGYCLFKPEVIFKLEQGAEPWFSEEEFSNKSHPKDYRG

SEQ ID NO: 16013 - protein, 81 aa, Macaca mulatta
QELLTFRDVAIEFSPEEWKCLDPAQQNLYKDVMLENYRNLVSLGFVISNPDLVTCLEQIKEPYNLKMHETAAKPPAMCSPF

SEQ ID NO: 16014 - protein, 81 aa, Macaca mulatta
MLETYSNLVFVGQQVTKPNLILKLEVEEYPAEGKIPFWNFPEVCQVDEQIERQHQDDQEKRLLMQVGFSDKKTITTKSGRD

SEQ ID NO: 16015 - protein, 81 aa, Callithrix jacchus
TIKEAVTFKDVTVVFTEEELGLLDPAQRKLYRDVMLENFRNLLSIGNQPFHEDTFHFLRKEKFWMMKTTSQREGNLGGKIQ

SEQ ID NO: 16016 - protein, 81 aa, Macaca mulatta
QVLLTFRDVAIEFSQEEWKCLDPAQRTLYRDVMLENYRNLVSLDISSKCTMKEVLSTAQGNREVFHTGTLQRHESHHIGDF

SEQ ID NO: 16017 - protein, 81 aa, Callithrix jacchus
TQESLTLEDVAVDFTREEWQLLGPAQKDLYRDVMLENYSNLVAVGYQASKPDALFKLGQGQPPWTVKDGIHSGACSEIWKF

SEQ ID NO: 16018 - protein, 81 aa, Macaca mulatta
MSSGRAFPFSKPDLIFQLEQGEAAWGPDPWTLAGGEALRGMCTGGKTKTKNEEQTAQLNISKESESHRLIVEGLLMNIPQH

SEQ ID NO: 16019 - protein, 81 aa, Callithrix jacchus
ARGCMVFEDVFVYFSREEWELLDDAQRLLYHDVMLENFALLASLGIAFSRSDAVMKLEQGEEPWVYDQVDMTSATGREAKR

SEQ ID NO: 16020 - protein, 81 aa, Bos taurus
MKLGSVTFEDVAVYFSWEEWALLDEAQRCLYHDVMLENFALTSSLVVSSSSHTIAQLGLGEESFVLPRMHMIPLSTRWAQR

SEQ ID NO: 16021 - protein, 81 aa, Acinonyx jubatus
IQGSLTFGDVAVAFTHIEWKHLDAAQRALYKDVMLENYGNLVSVGLLSSKPKLITQLEQGSEPRMEVQQVPSGTCSVQEYW

SEQ ID NO: 16022 - protein, 81 aa, Rhinopithecus roxellana
VAFEDVAIYFSQEEWELLDETQRLLYHDVMLENFAVMASLGCWCGAEDEGAPSAESISVAELSQGRTPKADTSTDKSHPCE

SEQ ID NO: 16023 - protein, 81 aa, Rhinopithecus roxellana
MDLLLVTFDDVAVDFTQEEWTLLDPTQRSLYSDVMLENYKNLATVGGQIIKPSLISWLEQEESRTVRAGVLQGWEMQLETQ

SEQ ID NO: 16024 - protein, 81 aa, Rhinopithecus roxellana
PQESVAFEDVAVYFTTKEWAIMMPAERALYRDVMLENYEAVAFVVPPTSKPALVSHLEQGKESCFIQPQGVLSRSDWRAGL

SEQ ID NO: 16025 - protein, 81 aa, Acinonyx jubatus
SQELLTFKDISVDFTQEEWGQLPLAHRNLYREVMLENYGNLLSVAGYQLSKPSVISQLEKGQEPWMTEKEGPGDPSSDLKN

SEQ ID NO: 16026 - protein, 81 aa, Rhinopithecus roxellana
GSVTFEDVAVYFSWEEWDLLDEAQKRLYFDVMLENFALTSSLGCWHGVEHEETPEQRISVEGVPQFRTSKEGSSSQNAYSC

SEQ ID NO: 16027 - protein, 81 aa, Cebus imitator
LQGSVSFKDVTVDFTQEEWQQLDPAQKALYRDVMLENYCHFISVGFHMTKPDMIRKLEQGEELWTQRIFPSYSYLEEDGKT

SEQ ID NO: 16028 - protein, 81 aa, Cebus imitator
TEDRVVFEDVAIYFSQEEWGHLDEAQRLLYRDVMLENLALLSSLGCWHGAEDEVAPSQQGFSAGVSEVTTSKSCMITQKIH

SEQ ID NO: 16029 - protein, 81 aa, Cebus imitator
SQGPLTFMDVAIEFSQEEWKCLDLAQRTLYKDVMLENYRNLVSLGVGLPDLSVVSMLEQKREPWTLQSEEKIARDPDGREC

SEQ ID NO: 16030 - protein, 81 aa, Cebus imitator
RNTMPQDNESPPQQGEANQNDSLAFEDVAVNFTSEEWALLDPSQKTLYQEVMQETLRNLASIEVLWKRDSLKAKVISVEKF

SEQ ID NO: 16031 - protein, 81 aa, Cebus imitator
RDVAIEFSLEEWEHLDSNQKNLYGDVMLENYRNLVCLGLAVSKPDLITFLEQRKEPWNVKSAETVAIQPDIFSLDTQALLR

SEQ ID NO: 16032 - protein, 81 aa, Cebus imitator
SYEGSVSFRDVAIDFSREEWRHLDLSQRNLYRDVMLETYSHLLSVGYQFPKPEVVMLEQGKEPWILQGERPHHSCPGEKLW

SEQ ID NO: 16033 - protein, 81 aa, Cebus imitator
VRLTFRDVAIEFSQEEWRCLDPTQRALYRDVMLENYWSLVSLGLCHFDMNIISMLEEGKEPWTVKSYLKIARKPRMRECVK

SEQ ID NO: 16034 - protein, 81 aa, Cebus imitator
METLTFRDVAIEFSLEEWQSLNPAQQNLYRNVMLENYRNLVFLADIAVSKQNPITGLEQKKESCNMKRHEMVARPTAMCSS

SEQ ID NO: 16035 - protein, 81 aa, Cebus imitator
LQGLVMFEDVAVYFSREEWGLLNVTQKGLYQDVMLENFALLSSLGLAPSRSPVFTQLVDDEQLCVPSWVDVTLVSRTEASR

SEQ ID NO: 16036 - protein, 81 aa, Cebus imitator
GQGLLSFEDVAVDFTREEWQFLDPSQKVLYKEVMSENYRNLVSVGYQGTKPDSLFKLERGEPPWIVEGAARCQTCLGFVIQ

SEQ ID NO: 16037 - protein, 81 aa, Cebus imitator
AGWLTNYSQDSVTFEDVAVDFTPEEWTLLDQTQRNLYRDVMLENYKNLVAVDWKIHINIKWTAPQQNFFQGKSSMVEMNSE

SEQ ID NO: 16038 - protein, 81 aa, Macaca mulatta
PPQESVSFKDITVDFSRDEWQQLDLAQKSLYREVMLENYFNLISVGCQVPKPEVIFSLEQEEPCMLDGEISGQSHPDGDIG

SEQ ID NO: 16039 - protein, 81 aa, Macaca mulatta
RREQVTFEDVVVDFSQEEWGQLKPAQRTLYRDVMLDTFRLLVSVGHWLPKPNVISLLEQEAEPRAVDSRVPPGVYPEIKGH

SEQ ID NO: 16040 - protein, 81 aa, Callithrix jacchus
AAGSVTFKDVTMAFTQKEWEQLDPAQRNLYKDVMLENYSNLASMGCQAPKPDMISKLEKGEAPCLGKGKRLSQGCPSKIAR

SEQ ID NO: 16041 - protein, 81 aa, Callithrix jacchus
MLENYGNVASLGFPLLKPAVISQLEGGGELGGPSPLAAGTGLHVLRTGKGVDIQTDSDFTKEMYDRKEDVSFELQRDFSQE

SEQ ID NO: 16042 - protein, 81 aa, Macaca mulatta
ESVTFKDVAVLFTQEEWGQLSPAQRALYRDVMLENYSNLVSLDWMTLPASKKSTLRVAIPEEELGQWTIKERFRSSSHWKC

SEQ ID NO: 16043 - protein, 81 aa, Callithrix jacchus
RESGKAPVTFDDITVYLLQEEWVLLSQQQKELCGSDKLVPPLGPTVANPELFRKFRRGPEPWLGSVQGQRSLLEHHPGKKQ

SEQ ID NO: 16044 - protein, 81 aa, Callithrix jacchus
PPLPPGFKDVAIEFSLEEWQCLDTAQRNLYKNVILENYRNLVFLGIAVSKPDLIACLEQEKEPLIMKRDEMAGEPPVMCSH

SEQ ID NO: 16045 - protein, 81 aa, Macaca mulatta
ESVSFKDVAGDFTQEEWGQLDSPQRALYRDVMLENYQNLLALGPPLHKPDVISHLERGEEPWSMQREVPGGPRPEWQLKAV

SEQ ID NO: 16046 - protein, 81 aa, Callithrix jacchus
VAFEDVAVNFTQEEWALLDRSQKKLYREVMQETLRNLTSIGKTWSNQNAEERHQNPRRNLRRLIGERLFQSKESHQHAEVL

SEQ ID NO: 16047 - protein, 81 aa, Callithrix jacchus
SQGSVTFRDVAIDFSQEEWKWLQPAQRDLYRCVMLENYGHLVSLGLSISKPDVVSLLEQGKEPWLGKRDVKRDLFPALSPQ

SEQ ID NO: 16048 - protein, 81 aa, Macaca mulatta
VKESVTFKDVAIDFTLEEWRLMDPTQRNLHKDVMLENYRNLVSLGLAVSKPDMISHLENGKGPWVTMREISRIPYPDMEPK

SEQ ID NO: 16049 - protein, 81 aa, Callithrix jacchus
PTPNIWSVEFTQEEWTLLDPTERNLYRDVMLENYKNLFSVGKCGIIPCSFLWNKIQIMYLLCSRISDVKSEYSGMYTHCKN

SEQ ID NO: 16050 - protein, 81 aa, Bos taurus
LQGSVSFEDVAVDFTRQEWHTLDLAQRTMHRDVMLENYSNLASVGLCVAKPEMIFKLERGEELWILEEESSDNGRSSGLVF

SEQ ID NO: 16051 - protein, 81 aa, Bos taurus
SLGSVSFRDVAVDFTQEEWQHLDPEQKTTYRDVMLENYSHLISVEEVWKVHDLMEGSQENEDKHSRQTESINNKTLPEGRG

SEQ ID NO: 16052 - protein, 81 aa, Bos taurus
LQGSFSFEDLSVDFTQKEWQLLDPHQKDLYKDVMLENYSSLVSLGYEVMKPGVILKLEQGEDPWTGDGEIPSSGSIDQVFQ

SEQ ID NO: 16053 - protein, 81 aa, Bos taurus
MASFLVRIQGLILNVFHFPQAGLNMSKPDVVSLLEQGKEPWLGNGDVSRELFPASKSNGEIKEFSPKNVIFEDDSSQYLIM

SEQ ID NO: 16054 - protein, 81 aa, Papio anubis
KSKEPVTFKDVAVVFSEEELRLLNLAQRKLYRDVMLENFRNVVSVGHQSTPDGLTQLEREEKLWMMNMATQRDNSSGGKNL

SEQ ID NO: 16055 - protein, 81 aa, Callorhinus ursinus
VQESVTFKDVVVLFTRDEWAQLSPTQRALYRDVMLENYSNLVSLGLLGPQPELFSQLGKGEEWMLEDASGSFCLDWMTMPV

SEQ ID NO: 16056 - protein, 81 aa, Callorhinus ursinus
APGLVTFEDVAVYFSREEWGLLNLTQRSLYRDVMLENFALIGSLGFAPSRSHVVAQLESEEDLWMPNMVDLTLGSRAEARR

SEQ ID NO: 16057 - protein, 81 aa, Vulpes vulpes
MFLDSAQRNLYRDVMLENYRNLASVGDQLGKPSMFSHLEPGEELWPTERRIFPGTHPEPPIQPQDSISNQDIFAEISSIGM

SEQ ID NO: 16058 - protein, 81 aa, Callorhinus ursinus
QQRPVSFKDVVVGFTQEEWHRLNPAQRALYRDVMLETYSNLVSVGYEGTKPYVILKLEQEEAPWICEAACSGCHCQENICQ

SEQ ID NO: 16059 - protein, 81 aa, Callorhinus ursinus
CQGSLSFRDVAVGFTRKEWQQLDPTQRTLYRDVMLENYSHLVSVGCQVTKPAVISRLEQGQEPWMEEEEILRWSFPEEILQ

SEQ ID NO: 16060 - protein, 81 aa, Rhinolophus ferrumequinum
GQESLTFDDVAVDFTWEEWQLLVPEQKDLYRDVMLENYSHLVSLGYQACKPDMLSKLDRGESPWTMADEVHCWTRSEIWKD

SEQ ID NO: 16061 - protein, 81 aa, Rhinolophus ferrumequinum
SYERSVSFRDVAVDFSREEWQHLDLAQKNLYRDVMLETYSHLLSVGYQVPEPEVFMLEQGKKSWTLQDESPHQSCSEEKLW

SEQ ID NO: 16062 - protein, 81 aa, Ursus maritimus
VFKEAVTFKDVAVAFTEEELGLLDSAQRKLYQDVMLENFRNLVSVGHQPFKRDKWHIEREERLWSMKTATQIERNVGGSNQ

SEQ ID NO: 16063 - protein, 81 aa, Phyllostomus discolor
VQESVTFKDVIVDFTQEEWKQLDPVQRDLFRDVTLENYTHLVSIGLQVSKPDVISQLEQGTEPWIMEPGILVGGSGDWEAK

SEQ ID NO: 16064 - protein, 81 aa, Rhinopithecus roxellana
PQGLLTFRDVAIEFSQEEWKCLDPAQRTLYRDVMLENYRNLVSLDISSKCMMEFLSTAQSNREVIHTGTLERHESHHIGDF

SEQ ID NO: 16065 - protein, 81 aa, Acinonyx jubatus
LQVSVSFEDVTVNFSREEWQRLDPAQRRLYRDVTLENYSHLRSVGYQVPKPEVIFKLEQGEGPWTLEGETPHQSCSGEDIG

SEQ ID NO: 16066 - protein, 81 aa, Acinonyx jubatus
PQDLMTFKDVAVEFTQWEWGQLDPAQKDLYREVMLENFKNLASLGLPVSKPYVICQLEEGEEPCVVEGEISTGEGSYKSDT

SEQ ID NO: 16067 - protein, 81 aa, Acinonyx jubatus
NSQGLLTFRDVAIEFSQEELRCLNHSQWELYRDVMFENYGHLLFLGLVVSKPDLVIFLEQKKDVWAVKRKETVATHPGRWE

SEQ ID NO: 16068 - protein, 81 aa, Cebus imitator
QDSVAFEDVAVRFTQEEWALLVPSQKNLYRDVMQETFKNLASVGKTWKVQNIEDGYKDFRRNLSLLIREKHIESKESNHCG

SEQ ID NO: 16069 - protein, 81 aa, Cebus imitator
PEGLLSFKDISVEFTWDEWQLLDSTQKYLYREVVLENYHNLISVGYHGAKPDLIFKLEQGEDPWIVNAKISRESCPDGWEE

SEQ ID NO: 16070 - protein, 81 aa, Cebus imitator
LQESFSFDDLSVDFTQKEWQLLDPSQKNLYKDVMLENYSSLVSLGYEAMKPDVIFKLEQGEEPWIGDEEIPSSYSPEVWKV

SEQ ID NO: 16071 - protein, 81 aa, Bubalus bubalis
SQESVTFQDVAVDFTQEEWALLDTSQRMLSRDVMLENISHLVSVGNQLYKSDVISHLEQGEQLSREGLGFLQGQSPVISDR

SEQ ID NO: 16072 - protein, 81 aa, Cebus imitator
GSVSFTDVTVDFTQEEWEQLDPSQRILYMDVMLENYSNLLSVEVWKADDQMERDHRNPDQQPRQFIILKNQTPMEERGDLF

SEQ ID NO: 16073 - protein, 81 aa, Cebus imitator
AAGSVTFKDVTMAFTQKEWEQLDPAQRNLYKDVMLENYSNLASMGCQAPKPDMISKLEKGEAPCLGKGKRPSQHCPSKMAR

SEQ ID NO: 16074 - protein, 81 aa, Cebus imitator
QLTFRDVAIEFSQEEWKCLNSTQRTLYRDVMLENYRNLVSLALSHNGVIKELAPKQESNMGDVFHTVALEQHETPDMQEFC

SEQ ID NO: 16075 - protein, 81 aa, Cebus imitator
LPFQVTFSDVAIHFSHEEWGWLDSAQRDLYKDVMVQNYKILVSLAGLSITKPYVITLLEDGKEPWMMEEKLSKALSRLDSV

SEQ ID NO: 16076 - protein, 81 aa, Macaca mulatta
MLENYNNLITVGYPFTKPDVIFKLEQEEEPWVMEEEVLRRHWKGEIWGVDEHQKNQDRLLRQVEVKFQKTLTEEKGNECQK

SEQ ID NO: 16077 - protein, 81 aa, Macaca mulatta
MLETYNNLVSLGLAISKPDVISFLEQGKEPWMVERVVSGGLCPVLESRYDTKELSPKQHVYEVESPQWEIMESLTSYGLEC

SEQ ID NO: 16078 - protein, 81 aa, Macaca mulatta
KTGLLAFSDVVIEFSPEEWACLDPAQRNLYRDVMFENYRNLVSLAILSYSIQDLLPEQDMKDLCQKVTLTRHRSWGLDNLH

SEQ ID NO: 16079 - protein, 81 aa, Callithrix jacchus
VQESVTFRDVAVFFSPDEWLHLDSAQRALYREVMLENYSSLVSLGILFSKPKVISHLEQGENPWMVESGVPQGTHLGWESL

SEQ ID NO: 16080 - protein, 81 aa, Callithrix jacchus
MCEIHVIFNKTGIAASKPDLITCLEQGKEPWNVKRHEFEAKLPVASSYFAQDLWPKQVIKNHFQKVILRRYKKCRHENFQL

SEQ ID NO: 16081 - protein, 81 aa, Macaca mulatta
AQESVTFRDVAVFFSQDEWLHLGSAQRALYREVMLENYSSLVSLGIPFSMPKLIHQLQQGEDPCLEEREVPSDTCLGFKTW

SEQ ID NO: 16082 - protein, 81 aa, Callithrix jacchus
AQVSVTFDDVAVTFTEEEWGQLDLAQRTLYQEVMLENCGLLVSLGCPVPRPELICHLDHGQEPWTGKEDLSQGTRPGDKGK

SEQ ID NO: 16083 - protein, 81 aa, Monodon monoceros
CFVSKPDVISLLEQGKEPWKVVRKGRRRYPDLETNYETKKLSSENDIHEINLSQWKVMERIKNHGLNRLILKNDWESKRKF

SEQ ID NO: 16084 - protein, 81 aa, Callithrix jacchus
YQELVTFRDVAVDFSQEEWDCLDSSQRHLYSNVMLENYRILVSLGLCFSKPGVILLLEQGKAPWMVKRELTKGLCSGWAPL

SEQ ID NO: 16085 - protein, 81 aa, Macaca mulatta
LGIAVSKPDLITCLEQRNEPWNVKKHETIGRHPAVSSHFTQDLLPEHGIKDSFQKVILGRYGSCGTENLDLKKDWERVGES

SEQ ID NO: 16086 - protein, 81 aa, Monodon monoceros
MLEKGRGIENEGLGSSLQREHSGGNGYCVSDYQIPGLPVPGPDVIFQLKRGDEPWIVELHGSEGKECAENVSQDWETKPEI

SEQ ID NO: 16087 - protein, 81 aa, Monodon monoceros
GVMESVTLEDVAVGLIQEWALLDDARRNLYRYVLLDNCRTLAPRGTPSCKACLVSQVGPREELMTAEQGILCATGVDWESQ

SEQ ID NO: 16088 - protein, 81 aa, Callithrix jacchus
SYEGSVSFRDVAIDFSREEWRHLDPSQRNLYRDVMLETYSHLLSVGYQVPEAEVVMLEQGNEPWALQGERPRHSCPGEKLW

SEQ ID NO: 16089 - protein, 81 aa, Bos taurus
PQGSVTFEDVAVYFSWNEWCLLDEVQIRLYLDVMLENFALVCMLGSWRGVQDKETPSEEIKPAGVLQFRTPRAGLSPEKTQ

SEQ ID NO: 16090 - protein, 81 aa, Bos taurus
SLDAVTFTDVAVNFSQDEWEWLTLAQRTLYKKVMLENYSSLASLGLCISKPDVISLLEQDKEPWMMKGELTRGLCPDLEYV

SEQ ID NO: 16091 - protein, 81 aa, Zalophus californianus
ASVSFKDVTVEFTQEEWQQMGPIQRTLYRDVMLENYNNLVSVGEHIGNCIFKPAVIFKLEQGEEPWFLEEEFSNQSHREDY

SEQ ID NO: 16092 - protein, 81 aa, Pan troglodytes
MLENYKNLATVGYQLFKPSLISWLEQEESRTVQRGDFQASEGKVQLKAKELALQQDVLGEPTSSGIQMIGSHNGGEVSDVK

SEQ ID NO: 16093 - protein, 81 aa, Sapajus apella
AQKVLTFRDVAIEFSLEEWKFLDPAQQNLYRDVMLENYRNLFSIGLTVSKPGLITCLEQRKAPWNLKRREAVDGHPAMSSH

SEQ ID NO: 16094 - protein, 81 aa, Delphinapterus leucas
AQGLMTFEDVAVDFTQEEWQYLNPPQRNLYRDVMLETYSNLVSVAGQQVTKPDLILKLEVEEPCLPEGKIPIWSFPEEACQ

SEQ ID NO: 16095 - protein, 81 aa, Pan troglodytes
TFKEGLTFKDVAVVFTEEELGLLDPVQRNLYQDVMLENFRNLLSVGHHPFKHDVFLLEKEKKLDIMKTAIQRKGKSADKIQ

SEQ ID NO: 16096 - protein, 81 aa, Sapajus apella
MAHLMFRDVAIDFSQEEWEGLDLKQRDLYRDVMLENYSNMVSLGLCIYQPDVFSLLEKGKEPWKILRDETRGPCPDMQSRC

SEQ ID NO: 16097 - protein, 81 aa, Acinonyx jubatus
KPGALSFADVAVYFSSEEWGCLRPAQRALYRDVMRETYGHLGALGFAGPKPALISWMERKKEAWSPEAEDPEDRARHPGYG

SEQ ID NO: 16098 - protein, 81 aa, Acinonyx jubatus
FQGSVSFRDVAISFSQEEWACLDPAQRALYRDVMLENYSHLLSLGRSISKPDVITLLEQEKEPWVVVRKETSGWYPDLESN

SEQ ID NO: 16099 - protein, 81 aa, Acinonyx jubatus
VQERLTFRDVAIEFSQEEWVCLDPSQRALYRDVMLENYRNLVSLGKENVPPEVGICPNSSATFVIKELLPKKDLNNGELYQ

SEQ ID NO: 16100 - protein, 81 aa, Rhinopithecus roxellana
PQSLLTFSDVAIEFSQEEWKCLDPVQRTLYRDVMLENYRNLVSLEFRSVTQAKVQWCDLGSLQPPLPRFKQLSCLSLPSSW

SEQ ID NO: 16101 - protein, 81 aa, Acinonyx jubatus
QEPVTFEDVAVYFTQNQWASLDPMQRALYREVMLENYTNMASLGGESRIKNEEAAGKREASEEAEWPRMPGGGLLRNVSQH

SEQ ID NO: 16102 - protein, 81 aa, Rhinopithecus roxellana
MAFEDVAVYFSQEEWGLLDTAQRALYRRVMLDNFALVASLGLSTSRPRVVIQLERGEEPWVPSGTDTVLSRNTYRRRNPGS

SEQ ID NO: 16103 - protein, 81 aa, Rhinopithecus roxellana
FSREPVCPFEEETKVERMVEDYLANSYQDSVMFDDVAVEFTPEEWVLLDTTQKYLYRDVMLENYMNLASVADKKLQWMETL

SEQ ID NO: 16104 - protein, 81 aa, Rhinopithecus roxellana
VMFRDVAIDFSQEEWECLDSAQRDLYRDVMLENYSNLVSLDLPSRCASKDLSPEKNTYETELSQWEMNDRLENCDLEESKS

SEQ ID NO: 16105 - protein, 81 aa, Acinonyx jubatus
MDSVAFEDVTVKFTMEEWALLDPSQKKLYRDVMQETFRNLASIVCISEEKWEVYDSEDQDENHGTHLISQMVGRLCKCKEC

SEQ ID NO: 16106 - protein, 81 aa, Rhinopithecus roxellana
FQELVTFRDVAIDFSQQEWEYLDPNQRDLYRDVMLENYRNLVSLGGHSISKPVVVDLLERGKEPWMILREETQFTDLDLQC

SEQ ID NO: 16107 - protein, 81 aa, Rhinopithecus roxellana
LIGLLQFRDVAIEFSLEEWHCLDTAQRNLYRDVMLENYRNLVFLGIPVSKPDLITCLEQGKKPLTMKRHEMVAKSPGPGMV

SEQ ID NO: 16108 - protein, 81 aa, Rhinopithecus roxellana
GRLTFRDVAIEFSFMEWKCLNPAQRALYREVMLENYRNLEFVDSSLKSMMEFSSHEHSNTGEGFYTGTLERRKSYHIGDFC

SEQ ID NO: 16109 - protein, 81 aa, Rhinopithecus roxellana
QASVCFEDVAMAFTQEEWEQLDLAQRTLYREVTLETWEHIVSLDWKTTLEENRLNSEKDGAREELSHHVEVKQCVQEEPPC

SEQ ID NO: 16110 - protein, 81 aa, Acinonyx jubatus
NFWILRLPPGSKGEAPKEWGKLDEWQKELYKHVMRGNYETLVSLDYAISKPEVLSQTEQGKEPCSWRRTAPKVPDVPVDPS

SEQ ID NO: 16111 - protein, 81 aa, Bison bison
PLESVTFGDVAIDFTQEEWSLLDKSQKNLFRNVMLETVTHLVSVAYQISKSDVVFQLEQGKELWTQAAGGLQGQSPGSESL

SEQ ID NO: 16112 - protein, 81 aa, Bison bison
FQEPVSFKDVAVVFTEEELGLLDSAQRRLYQEVMLENFQNLLSVGNQPFKPELIFQLEREERLMMESQRDGCSGTKSPHNM

SEQ ID NO: 16113 - protein, 81 aa, Bison bison
FQGSVTFRDVSIDFSQEEWEWLQPAQRDLYRHVMLENYGHLVSLGLNMSKPDVVSLLEQGKEPWLGNGDVSRELFPASKSN

SEQ ID NO: 16114 - protein, 81 aa, Cebus imitator
VQEPVTFKDVAVDFTQEEWGQLDLVQRTLYRDVMLETYGHLLSVGNQIAKPEVISLLEQGEEPWSVEQTCPQRACPEWMRN

SEQ ID NO: 16115 - protein, 81 aa, Cebus imitator
LQGLVTFEDVAVEFTQEEWALLDPAQRTLYKDVMLENCRNLASLGCHVNKPRLISQLEQDKKVMTEERGILPNTCPDLETL

SEQ ID NO: 16116 - protein, 81 aa, Cebus imitator
IQDSVVFEDVAVNFTQEEWALLDLAQRNLYRDVMLENFQNLASLGYLLHTPHLISQWEQEEDLQTVKRELIQGICVREHQE

SEQ ID NO: 16117 - protein, 81 aa, Cebus imitator
MNSVAFEDVAVNFTQEEWALLDPSQKNLYRDVMQETFRNLASIGNKGEDQSFEDQYKKSWRNLRHIISHSGNNPHRCEECR

SEQ ID NO: 16118 - protein, 81 aa, Callithrix jacchus
KPGLVTFEDVAVAFTQEEWQYLNPLQRTLYRDVMLETYSNLVFVGQQVTKPDLILKLEVEECPVEEKIPFWSFPEICQVNE

SEQ ID NO: 16119 - protein, 81 aa, Callithrix jacchus
GHLTFTDVAIEFSQEEWKCLEPTQKALYKDVMLENYRNLVSLGISLPDLNINSMLERRRELWSGESEVKIAKRSDRRERIE

SEQ ID NO: 16120 - protein, 81 aa, Callithrix jacchus
LVTKESMTFKDVAVDITQEDWELMRPVQKELYKTVTLQNYWNMVSLGLTVYRPTVIPILEEPWMVIKEILEGPSPEWETKA

SEQ ID NO: 16121 - protein, 81 aa, Monodon monoceros
LVKYILSVLFSQGGCSVSKPDVITLLEQGKEPWMVVRDEKRRRSLDLESRYGTKKLFEVKDVCEMNVSQWEIMERIRSCGL

SEQ ID NO: 16122 - protein, 81 aa, Callithrix jacchus
PKVPVSFEDVSLYFTKTEWKLLDLRQKVLYKRVMLENYSHLVSLGFSFSKPHLISQLERGEGPWVADIPRTRATRGLLIGD

SEQ ID NO: 16123 - protein, 81 aa, Callithrix jacchus
SQGLVTFRDVALDFSQEEWEWLKPSQKDLYRDVMLENYRNLVWLGLSFSKPNMISLLEQGKEPWMVERKMSQGHCADWESW

SEQ ID NO: 16124 - protein, 81 aa, Callithrix jacchus
ALRSVIFSDISIDFSPEEWEYLDLEQKDLYRDVMLENYSNLVSLGCFISKPDVISLLEQGKEPWKVVRKRRRQYPDLETKC

SEQ ID NO: 16125 - protein, 81 aa, Callithrix jacchus
EMGVLTFREVAIEFCLEEWQCLDTAQRNLYRNVMLENYRNLVFLGIAASKPDLITCLEQGKEPWNVKRREMVAEAPGWSHV

SEQ ID NO: 16126 - protein, 81 aa, Callithrix jacchus
KVSITFKDLAVRFSEEEWRLLEEGQREFYRDVMRENYETLVSVGTAELLPLSAFLSPSEPGGAIGGGSRTDEGQEPAGCGG

SEQ ID NO: 16127 - protein, 81 aa, Callithrix jacchus
NFWILRLPPGSKGEAPKEWGKLEDWRKELYKHVMRGNYETLVSLDYAISKPEVLSQIEQGKEPCSWRCPGLKIPDVPVDPS

SEQ ID NO: 16128 - protein, 81 aa, Ovis aries
MTFKDVAVDITQEDWELMRPVQKELYKTVTLQNYWNMVSLGLTVYRPTVIPMLEEPWMVLKEILEGPSPEWETKAQEYTLV

SEQ ID NO: 16129 - protein, 81 aa, Ovis aries
LLEIHSWDPAMAIRTLMSKGQESVTFKDVAVDFTLEEWGRLGPGQRELYRDVMLENYQNLLSLGEALPPALLSCPLCPPTA

SEQ ID NO: 16130 - protein, 81 aa, Ovis aries
MEFSWEEWQLLDSVQKHLYRDVTLENYSNLVSVGYHGTKPDLIFKLEQGEEPWIINLEVSHQSCPDGWEKWHQKSHDEFES

SEQ ID NO: 16131 - protein, 81 aa, Ovis aries
DLMTFEDVAVEFTWWEWGQLDSTQKDLYREVMLENFKNLASLDWERRPQTKEPMLSQGLSKEELFQRASVEKHISDELRTS

SEQ ID NO: 16132 - protein, 81 aa, Ovis aries
AAGSVTFNDVTMAFTRKEWEQLDPAQKSLYKDVMLENYSNLASMGYQALKPDMISKLEKGEEPWLGKGKRPKQAGSSEIAR

SEQ ID NO: 16133 - protein, 81 aa, Ovis aries
SHTLVTFKDILVNFTREEWKLLDAAQQIMYKDVMLENYRNLVSLGHQLPKPDVILRLEKGEEPWLVEREIHQETHPDLETS

SEQ ID NO: 16134 - protein, 81 aa, Ovis aries
SLGSVSFKDISVDFSREEWQQLDLAQKSLYRDVMLENYFNLISVGCQVPKAEVIFNLEWGEEPFMWNGKISSQSCLDQHIG

SEQ ID NO: 16135 - protein, 81 aa, Vulpes vulpes
QESVTFKDVAVDFTLEEWGQLGPGQRELYRDVMLENYRNLLSLGAGPPGSKPEVISRLERGEEPKMEKREAWQATCPDLDT

SEQ ID NO: 16136 - protein, 81 aa, Ovis aries
RLEGQLTFQDVAIDFTQEEWECLDLGQRELYRDVMLQNYGNLASLGLVSKLDLVAFLEQLKDPRNIKRMETTATYPAMSPQ

SEQ ID NO: 16137 - protein, 81 aa, Phyllostomus discolor
AQESVTFGDVAVLFSRDEWLCLDSAQRTLYREVMLENYHSLVSLGILFSKPKVIFQLQQGEDPWMVGNGLSYGARLGWGSL

SEQ ID NO: 16138 - protein, 81 aa, Phyllostomus discolor
KLQGMLSFSDVAVYFTWEEWQLLDTAQRNLYQDVMLENHSNLMSLGCQATKPEAMVCLEKEEQGIIEREFPSHFSPEAMWQ

SEQ ID NO: 16139 - protein, 81 aa, Ursus maritimus
SQSFLTFEDVAMYFSQEEWELLDPTQKALYNDVMWENYETVISLAVPVHQILAFSEKTNTKDWTVAPELILPESQSFLTFE

SEQ ID NO: 16140 - protein, 81 aa, Phyllostomus discolor
AQESVMFSDVSIDFSQEEWECLNDDQRDLYRDVMLENYNNLVSMAGHSISKPDVISFLEQGKEPWLVNREVTGGQCPVLGS

SEQ ID NO: 16141 - protein, 81 aa, Phyllostomus discolor
PKVPVSFEDVSVYFTKTEWKLLDIKQRILYKRVMLENYRHLVSLGLSSSKPHLVSLLERGEGPWAADINRTRAATGIQTGE

SEQ ID NO: 16142 - protein, 81 aa, Rhinopithecus roxellana
GWVPALFDEVAIYFSDEEWEVLTEQQKALYREVMRMNYETVLSLEFPFPKPDMITRLEGEEESQNSDDWQLQGGTSAENEE

SEQ ID NO: 16143 - protein, 81 aa, Rhinopithecus roxellana
MLFISNKAGIAVTKPDLITCLEQGKEPWNIKSHEMVAKPSVICSHFAQDLWPERDIKDCFQEAILKKYGNYEHDNLQLQKG

SEQ ID NO: 16144 - protein, 81 aa, Rhinopithecus roxellana
QGRVTFRDVAIEFSLAEWKCLNPAQRALYREVMLENYRNLESVDISSKCMMKEVSSTGQCNTEVFHTGTVQRHESHHIRDS

SEQ ID NO: 16145 - protein, 81 aa, Rhinopithecus roxellana
MGLLTFRDVAIEFSLEEWEHLEPAQKNLYQDVMLENYRNLVSLGLLVSKPDLITFLEQRKEPWNVKREETVAIQPDVFSHY

SEQ ID NO: 16146 - protein, 81 aa, Rhinopithecus roxellana
ADVSLAFRDVSIDLSQEEWECLDPAQRDLYKDVMLENYSNLVSLGYTIAKPDVITLLEQQQEPWIVMREGTRSWYADLEYK

SEQ ID NO: 16147 - protein, 81 aa, Bison bison
APVVVTFKDVAVTFTPEEWGQLDLDQRTLFREVMLETCGLLVSLGHPIPKPELIHLLEHGQKLWTGTRGLPHSTSPGDRPK

SEQ ID NO: 16148 - protein, 81 aa, Bison bison
AHGSVTFRDVAIDFSQEEWEFLDSAQRDLYRDVMWENYSNFISLGPSMSKPDVITLLDEGKEPWMVVREGTGKHHPDLESR

SEQ ID NO: 16149 - protein, 81 aa, Odocoileus virginianus
PQVSVNFEDVAVTFSWEEWGLLDEPQRCLYRDVMLENLALITSLGCCHEVENEKTSFEQNVYFQRMSQIRTPRADLSSKKA

SEQ ID NO: 16150 - protein, 81 aa, Odocoileus virginianus
SRSLENDGVCFSEQEWENLEDWQKELYANVMKSNYETLVSLKVLGQPEGDMELGAEMPGDLEEEESHGGHPVEEVVVKQET

SEQ ID NO: 16151 - protein, 81 aa, Cebus imitator
SQGLVSFKDVAVDFTQEEWQQLDPAQRTLYRDVMLENYSHLVSMGYPVSKPDVISKLEQGEEPWIVKRGISNWIYPDEYQA

SEQ ID NO: 16152 - protein, 81 aa, Cebus imitator
MLENYRNLVSLGICLPDLSIISTLKQSRGPWNLQSEVKIENTPDGRECIKGVNTESSSKLGSNTGNKSLKNQLGLTFQLHL

SEQ ID NO: 16153 - protein, 80 aa, Cebus imitator
MPLFSQHVAIEFSLEEWQCLDTAQRNLYRNVMLENYRNLVFLGIAVSKPDLITCLEKEKEPWNMKRHGMVDKPPGWSAVK

SEQ ID NO: 16154 - protein, 81 aa, Cebus imitator
CQEMVTFEDVAVHFTKTEWTSLSPAQRALYRSVMLENYGNLTAMGYPVPKPALISLLEGGDVAWDLEAQDDPLAEGTKNIC

SEQ ID NO: 16155 - protein, 81 aa, Callithrix jacchus
SQGSVTFRDVAIDFSQEEWKWLQPAQRDLYRCVMLENYGHLVSLAGLSISKPDVVSLLEQGKEPWLGKRDVKRDLFPVSES

SEQ ID NO: 16156 - protein, 81 aa, Macaca mulatta
SLGSVTFTDVAIDFSQDEWEWLNLAQRSLYKKVMLENYRNLVSVGLCLSKPDMISLLEQEKDPWVIKGEMTRSLCPDLECV

SEQ ID NO: 16157 - protein, 81 aa, Callithrix jacchus
VKESVTFKDVAIDFTLEEWRLMDPIQRNLHKDVMLENYRNLVFVGLAVSKPDMISHLENGKGPWVTVREISRMPYPDLETK

SEQ ID NO: 16158 - protein, 81 aa, Macaca mulatta
FQGSVSFKDVTVGFTQEEWQHLDPAQRTLYRDVMLENYSHLVSVGYCIPKPEVILKLEKGEEPWILEEKFPSQRHLELINT

SEQ ID NO: 16159 - protein, 81 aa, Macaca mulatta
LKGLVTFEDVAVEFTQEEWALLDPAQRTLYRDVMLENFRNVASLGDQVDKPGLITQLEQEDEVMTEERGILPDVENPFKAK

SEQ ID NO: 16160 - protein, 81 aa, Ovis aries
SVTFEDVVVYFSWEEWGLLDENQRCLYHDVMLENFALVTSLGCWYGMEEAVAFSVESVPVEQTSRGKTVVPYPSIEKTQPC

SEQ ID NO: 16161 - protein, 81 aa, Ovis aries
PQEPVTFADVAVLFTPEEWLFLDSSQKSLYRDVMLENYRNVASVGDQLCKTRMSSHLEQREELCVTERGIFPGAHLGPHLQ

SEQ ID NO: 16162 - protein, 81 aa, Ovis aries
RGSVTFEDVAVYFSWEEWALLDEAQRCLYHDVMLENFALTSSLGCCHGVEDKGAPSEKSISVEGMSQIKTLKADSSPQKGQ

SEQ ID NO: 16163 - protein, 81 aa, Ovis aries
FQDPVTFEEVSVDFSQDEWAQLAPAQKILYQDVMLENYRDLTSVGYHLCKPRLLTQEELRTRKRRLLQDTCADQNSQLKTK

SEQ ID NO: 16164 - protein, 81 aa, Ovis aries
VQDCVVFEDVAVYFSQEEWGLLDEAQKHLYHAVMTENLALVTSLGCWHGAPGEEASSEQGVSIGMSEVRTAKPDPASRKAQ

SEQ ID NO: 16165 - protein, 81 aa, Ovis aries
QEQLTFEDVAIEFTQEEWEFLDPAQRALYRDVMLETYRNLLSVGVGQAGGLDPLWLLLRKMKQKTVMETVFLMLFSCSVQS

SEQ ID NO: 16166 - protein, 81 aa, Ovis aries
MGFSKQKISKPSVTSQLEQKEEAWVLPLQNFEARKILRESHTEFKHQVGQLDQDVSETAEPCGTSSEGANKDISPPPSWGG

SEQ ID NO: 16167 - protein, 81 aa, Ovis aries
FRKGQLTFQDVAIDFTQEEWECLDLGQRELYRDVMLQNYGNLASLGLVSMLDLVAFLEQLKDPRSMRRMETTAIYPAMSSQ

SEQ ID NO: 16168 - protein, 81 aa, Ovis aries
CGSLVAFEEVAMHFSREEWELLDEAQRQLYHTVMLETLELVTSLGCWPVVEDEEVPSERNASGEVVSQVRTPSVPPSMQKA

SEQ ID NO: 16169 - protein, 81 aa, Ovis aries
QAPVTLKDVVVTFTRQEWKLLDPTQRTLYQEVVLETSGLLASLGDKAETKTTETTASQQALFKGRLLQRSLTQEGCSVSPL

SEQ ID NO: 16170 - protein, 81 aa, Ovis aries
AHGLVMFKDVAIDVSQEEWECLNPAQRNLYKDVMLENYSNLVSLGLSISKPAVITSLEQGKEPWMVMREVTRERCPDLVSK

SEQ ID NO: 16171 - protein, 81 aa, Ovis aries
SQAPVTFEDMAMYLTREEWRPLDPTQRDIYRDVMQENYGNVVSLDFEIRSENEVNPKQEISEDVEFEAASERPVGNTEENP

SEQ ID NO: 16172 - protein, 81 aa, Ovis aries
SMCEVSFEDVTVDFSQEEWQHLDPVQRRLYWDVTLETYSHLCAVGYQVPKPEVIFRLEQGEGSWTLEKETPHHSCSDEGFG

SEQ ID NO: 16173 - protein, 81 aa, Bison bison
MGRLTFQDVAIDFTQEEWECLDLDQRELYRDVMLQNYGNLASLGLVSKLDLVTFLEQLKDSRNVRRMETTAIYPGRYEWLE

SEQ ID NO: 16174 - protein, 81 aa, Bison bison
LRGLVMFKDVAIDVSQEEWECLNPAQRNLYKDVMLENYSNLVSLGLSISKPAVITSLEQGKEPWMVMREMTRERCPDLVSQ

SEQ ID NO: 16175 - protein, 81 aa, Bison bison
QGHVTFEDVAVSFSQEEWGLLGEAQRLLYYDVMLENLSLIASLGCWQGGKAEKAISKQCVSVEQVTQDRSPQPDPSTLKTL

SEQ ID NO: 16176 - protein, 81 aa, Bison bison
QACVTFEDVAIYFSQDEWRLLNETQRFLYCDVMLENFALTTSLGCWHRVDKEEAASEQSVSVAVSHIHTSKADSLTQMAHP

SEQ ID NO: 16177 - protein, 81 aa, Bison bison
QITVEDVAIKFTPEEWECLAPAQRTLYWDVMLETYRNLLSVDISPIHIIKKLQSKENTNSTDTFQTVILGRHESHGVQDFY

SEQ ID NO: 16178 - protein, 81 aa, Odocoileus virginianus
FEGSVSFEDVAVDFTRQEWHSLDLAQRTMHRDVMLENYSNLASVGLCVAKPEMIFKLERGEELWILEEESSDHGYTGANSS

SEQ ID NO: 16179 - protein, 81 aa, Odocoileus virginianus
FKGSVTLQDVAVEFTPEEWQLLDCDQRTLYWDVMLENFRNLISVGCPVTETTVIFKVEQGQEPWMVEGENSRWSSPEADCP

SEQ ID NO: 16180 - protein, 81 aa, Odocoileus virginianus
QDSVTFEDVAVNFSWEEWGLLDESQKRLYHDVMLENLALISSLGCWPGEEDKEAFSEQSISDQGYSQIKIVKAGLSPQKAN

SEQ ID NO: 16181 - protein, 81 aa, Odocoileus virginianus
TQVSVTFDDVAVTFTQEEWGHLDPAQRTLYQEVMLETCRLLLSLGCPVPRPELIYQLEHGQELWVVKRDLSGSTCPGYRSE

SEQ ID NO: 16182 - protein, 81 aa, Odocoileus virginianus
PVTFDDVAVYFSQEEWRLLGEAQRLLYHDVMLENFALVASLGCWHTAENVSVEVPQRNTKKTDLSSQKICPWEMGNLALEG

SEQ ID NO: 16183 - protein, 81 aa, Odocoileus virginianus
AHTSLSFRDVAIDLSQEEWECLNPVQRALYRDVMLENYSNLVSLGCSTPKPDMITLLEQEKEPWMIMREGTGSWFTDLESK

SEQ ID NO: 16184 - protein, 81 aa, Odocoileus virginianus
TQLTIEDVDIKFTPEEWECLDPAQRALYWDVMEETYRNLLSVDMSQMHMVKKLQGTRNSGKGEITQKVMLGRAESHEIKDD

SEQ ID NO: 16185 - protein, 81 aa, Odocoileus virginianus
MESVTLEDVAMELIQEWTLLDDAGRNLCRRVLQDNCRTPAPRAAGTPPCKASLVSQVEPREELKAAEHSVLCATGVDWESQ

SEQ ID NO: 16186 - protein, 81 aa, Cebus imitator
AQELVMFRDVAIDVSQEEWECLNPAQRNLYKDVMLENYSNLVSLGLSVSKPAIISSLEQGKEPWMLVREESGRWCPDLASR

SEQ ID NO: 16187 - protein, 81 aa, Cebus imitator
MLENYGSVASLAAFPFPKPALISQLEQGEAPWCSAPQGALDGEGQRGISSGEILELPGATMWSLRIKPIPKKTVAKRETRS

SEQ ID NO: 16188 - protein, 81 aa, Callithrix jacchus
CEASVSFEDVTMAFSREEWQQLDPAQKRLYQDVMLELYSHLFSVGYQIPNPDVIFRRLKEKEPCTEEAELSHQRCQEGEFG

SEQ ID NO: 16189 - protein, 81 aa, Callithrix jacchus
PLGSELFRDVAIVFSQEEWQWLAPAQRDLYRDVMLETYSNLVSLGLAISKPDVISFLEQGKEPWMVERVVAGGLCPVLESR

SEQ ID NO: 16190 - protein, 81 aa, Macaca mulatta
FQGSVSFEDVTVGFSQEEWQHLDLSQRALYRDVMLENYSNLVSVGYCVYKPEVIFRLEQGEEPWRLEEEFPSQSFPEVWTA

SEQ ID NO: 16191 - protein, 81 aa, Callithrix jacchus
MLENYRNLVSLGLPFTKPKVISLLQQGEDPWKVEKDSSGSPCLGLKSSRKTTKSTQTQDSSFQGLILKRSNRNGPWDLKLE

SEQ ID NO: 16192 - protein, 81 aa, Callithrix jacchus
METLTFRDVAIEFSLEEWQCLNPAQQNLYRNVMLENYRNLVFLDIAVSKQNPITCLEQTKEPCNMKRHEMVARPTAMCSSF

SEQ ID NO: 16193 - protein, 81 aa, Callithrix jacchus
KPGAVSFADVAVYFSPEEWGCLRPAQRALYRDVMRETCGHLGALGFSGPKSAFISWVEGEMEAWSPEVQDPEGESPGTVSG

SEQ ID NO: 16194 - protein, 81 aa, Macaca mulatta
EMGPLTFQDVTIEFSLEEWQCLDTAQQTLYRDVMLENYRNLVFLGIAVSKLDLIACLKQGKESWNMKRHEMVTKPPVTRSH

SEQ ID NO: 16195 - protein, 81 aa, Macaca mulatta
FQGFVSFKDVAVNFTEEEWRELDPAERVLYRDVMLETYRNLVSLIGCPFSKPAIISQLEEVVNPQTHMQEGEVPRSSCTGK

SEQ ID NO: 16196 - protein, 81 aa, Callithrix jacchus
SRPGALSFADVAVYFSPEWGCLRPAQRALYRDVMRETCGHLGALGFSGPKSAFISWVEGEMEAWSPEVQDPEGESPGTVSG

SEQ ID NO: 16197 - protein, 81 aa, Callithrix jacchus
MLENYGSVASLAAFPFPKPALISQLEQGKAPWCLAPRVALDGEGQRGISSGEIRELPGATMWRLRIKPIPKKTVTKQRETR

SEQ ID NO: 16198 - protein, 81 aa, Callithrix jacchus
KPGAVSFGDVAVYFSREEWGCLRPAQRALYRDVMRETYSHLSALGVGGSMQALISWVKEAELWGPAAQDPEVAKRPTEADP

SEQ ID NO: 16199 - protein, 81 aa, Bos taurus
FQESVTFEDVAVNFSHEEWQCLTHAQRHLYKDVMLENYGNMVSLGFSFSKPPLISHLEQGTEPYVQDRQDWEFLSCSYPVS

SEQ ID NO: 16200 - protein, 81 aa, Bos taurus
FQMPLTFSDVSIDFSQEEWECLNSDQKNLCRDVMLETYTNLVSLDFDFTTENNKLSSEKSSFEVNSYHWEIMKSKTFNLMG

SEQ ID NO: 16201 - protein, 81 aa, Ovis aries
WKAWVKKPVTFEDVAVNFTQEEWKCLDASQKVLYQDVISETVRNLMSVDLIAKLEQEEKQWEADLCSPNGEGFHSGGEKEE

SEQ ID NO: 16202 - protein, 81 aa, Ovis aries
AHMSLSFRDVAIDLSQEEWECLDPVQRALYRDVMLENYSNLVSLGCSTPKPDMITLLEQEKEPWMIMREGTGSWFTGLESK

SEQ ID NO: 16203 - protein, 81 aa, Ovis aries
SQESVTFEDVAVDFTQEEWALLDTSQRKLFRDVMLENISHLASVGNQLYKSDVISHLEQGEQLSKEELGFLQSRSPDREDD

SEQ ID NO: 16204 - protein, 81 aa, Ovis aries
SQGPVTFEDVAVYFSQEEWRLIGEAQRLLYHDVMLENFTLVASLGCSHTAEDEQTPSEQNVSVEVPQRNTKKTDLSSQKVC

SEQ ID NO: 16205 - protein, 81 aa, Ovis aries
AQVSVTFDDVAVTFTQEEWGHLEPAQRTLYQEVMLETCRLLMSLGCPVPRPELIYQLEHGQELWTVKRDLSRSTCPGYSSE

SEQ ID NO: 16206 - protein, 81 aa, Ovis aries
HQGSVTFEDVAMYFSCEEWCLLDEAQIQLYLDVMLENFALVCMLGSWRGVQDKETPSEEIKPAGVLQFLTPRAGLSPEKTQ

SEQ ID NO: 16207 - protein, 81 aa, Ovis aries
RLTSEDVAIKFTQEEWEFLDPAQRALYRDVMLETYRNLLSVDISPTYVIKDLQPKVNSDKRETFRTLMLGRPKSCEIKHVH

SEQ ID NO: 16208 - protein, 81 aa, Vulpes vulpes
SQELVAFEDVLVDFTPEEWQYLNSSQKTLYREVMLETYSNLVSVAGQQDTKPDLILKLELEGPCLAERKISVWSFPEEACQ

SEQ ID NO: 16209 - protein, 81 aa, Vulpes vulpes
MLENYQNLVSLGLSFRRPNVITLLEKGKAPWVVEPVRKRRGLDSGFKCETKKLPPNLGIKSGQSIYQKQVSASQNIPTGKR

SEQ ID NO: 16210 - protein, 81 aa, Acinonyx jubatus
GCVTFEDVFVYFSQEEWELLEEAQRLLYRDVMLENFALVASLDCWREADNEETPEQNVFVGVSQLRTPESGPFIQKAHPCE

SEQ ID NO: 16211 - protein, 81 aa, Acinonyx jubatus
VQGQVNFEDVAVYFSREEWGLLDEAQRLLYRDVMLENLALTASLGSWHGTEDEETAFEQNISVGVSQVRTPKAGPSTQKAH

SEQ ID NO: 16212 - protein, 81 aa, Acinonyx jubatus
FQEAVTFGDVAVHFSREEWQCLDPGQRALYKEVMLENHSSVAGLGFLVFKPELISRLEQGQEPWVLDLKGVEGREVARTSL

SEQ ID NO: 16213 - protein, 81 aa, Rhinopithecus roxellana
DSVTFEDVAVDFTQEEWTLLDQTQRNLYRDVMLENYKNLVAVDWESHINTKRSAPQQNFLQGKTSSVVEMVRFRSLTLLPR

SEQ ID NO: 16214 - protein, 81 aa, Rhinopithecus roxellana
NQQTKNKSLFVSFEEVAVHFTWEEWQDRDDAQRTLYRDVMLETYSSLVSLGRCVSKPEVIFKLEQGSEPWLGEEWANQCLS

SEQ ID NO: 16215 - protein, 81 aa, Rhinopithecus roxellana
ACESITFRDVAIDFSHQEWEYLNLVQKTLYQEVMMENYDNLVSLGHSISKPDLITLLEQGKEPWMIVREETGGECTDLDSR

SEQ ID NO: 16216 - protein, 81 aa, Acinonyx jubatus
FKEAVTFKDVAVVFTVEELGLLDSAQRKLYRDVMVENFENLLSVGHLPFKPDMMSQLEAEEKLWMMERETQRNGYSSENHV

SEQ ID NO: 16217 - protein, 81 aa, Rhinopithecus roxellana
SRSLENDGVCFTEQEWENLEDWQKELYRNVMESNYETLVSLKVLGQTEGEAKLGTEMLGDLEEEGPGGAHPAGGVMIKQEL

SEQ ID NO: 16218 - protein, 81 aa, Rhinopithecus roxellana
MGPLTFTDVAIEFSLEEWQCLDPAQQNLYRNVMLENYRNLVFLGIAVSKPDLITCLEKEKEPWNMKRHEMVDEPPVICSHF

SEQ ID NO: 16219 - protein, 81 aa, Rhinopithecus roxellana
AQELLTLEDVTVEFTWEEWQLLDPFQKDLYRDVMLEIYSNLVSMGYQVSKPDALSRLERGEEPWTMEDERHSRICPENNKV

SEQ ID NO: 16220 - protein, 81 aa, Acinonyx jubatus
MDFSREEWEQLGPAQRCLYWDVMLEICSHLLSLGYPIPRPEMIFRMEKEEEPWIREAQLPHQWRPKGEFGLKTSRQKIFEK

SEQ ID NO: 16221 - protein, 81 aa, Acinonyx jubatus
KPGALSFADVAVYFSSEEWGCLRPAQRALYRDVMRETYGHLGALGCAGPKPALISWLERNTDDWEPAALDPQECPRGVAVQ

SEQ ID NO: 16222 - protein, 81 aa, Bison bison
LQGGVTFEDVAVDFTQEEWQRLSPEQRDLYRDVTLENYRNLVSMGEQDSTKPEVILRLENGEEPWMVGTQELRSCSPAGKD

SEQ ID NO: 16223 - protein, 81 aa, Bison bison
SLGSVSFRDVAVDFTQEEWQHLDPEQKTTYRDVMLENYSHLISVGCHIIKPEVITKLEQGEEPWVVEGEFLLQSHPEEVWK

SEQ ID NO: 16224 - protein, 81 aa, Acinonyx jubatus
PQDLMTFKDVAVEFTQWEWGQLDPAQKDLYREVMLENFKNLASLGLPVSKPYVICQLEEGEEPCVVEGEISTDWEKRPKAK

SEQ ID NO: 16225 - protein, 81 aa, Rhinopithecus roxellana
MDVAIEFSQDEWKCLDPGQRALYRDVMLENYRNLVSLGICLPDLSIISMLKQRREPLTLQSEVKIVKNPDGRECVRSVNTG

SEQ ID NO: 16226 - protein, 81 aa, Bison bison
MMFRDVAVDFSQEEWECLDLEQRHLYRAVMLENYSNLVLLGLCIYQPEVFSLLEKGREPWMALKDETCPDMQSRCQTKKLS

SEQ ID NO: 16227 - protein, 81 aa, Bison bison
QERLTSEDVAIEFTQEEWEFLDPAQRALYRDVMLETYRNLLSVGEDDFLPELPLGICIFPVCPLGGPDVFHLRVLTSLSKF

SEQ ID NO: 16228 - protein, 81 aa, Bison bison
FQGLLTFGDVAVHFTQEEGERLDAGQRTLYRDVMLETYRNLVSLGVPESKPDLISQLEQGREPWGSDLLGAQEAETAGNAG

SEQ ID NO: 16229 - protein, 81 aa, Bison bison
AQLTFKDVAIEFSPEEWECLDPAQRTLYRDVMVETLRNLLSVAISHIHMIKKSQLKSNIGIGERFQTVMLGNRESHEVKHF

SEQ ID NO: 16230 - protein, 81 aa, Cebus imitator
QLNKLSFKDVCVDFTQEEWYLLDPAQKMLYRDVILENYSNLVSVGYCITKPEVIFKIEQGEEPWILEKGFPSQCNPERKWK

SEQ ID NO: 16231 - protein, 81 aa, Cebus imitator
FQEQVSFKDVCVDFTQEEWYLLDPAQKMLYRDVILENYSNLVSVGYCITKPEVIFKIEQGEEPWILEKGFPSQCNPERKWK

SEQ ID NO: 16232 - protein, 81 aa, Cebus imitator
FVTFEDVAIYFSQEERELLSGTQRLLYRDMMLENFAVMASLGCWCGAEDKEAHSADSISEEELSQVRTPKADPSTHKSHPC

SEQ ID NO: 16233 - protein, 81 aa, Cebus imitator
SWGPLSFMDVFVDFTWEEWQLLDPAQKCLYRSVMLENYSNLVSLGYQHTKPDIIFKLEQGEELCMVPAPIPNQCCPNKVWK

SEQ ID NO: 16234 - protein, 81 aa, Cebus imitator
EQGCVAFEDVAVYFSQEEWRLLDEAQRLLYRNVMLENFSLMASLGLASSKTHEITQLESWEEPFMPAWEVMTSAIPRGCWH

SEQ ID NO: 16235 - protein, 81 aa, Callithrix jacchus
EMGPLTFRDVAIEFSLEEWQCLDTAQQNLYRHVMLENYRNLVFLGIAVSKPDLITCLEQGKEPWNMKRHAMVAKPPVVCSQ

SEQ ID NO: 16236 - protein, 81 aa, Callithrix jacchus
GRLTFKDVSVEFSSAEWKCLTPAQRALYRDVMLENYRNLDLYFVGISSKCIRKKFSSTGQGSTEVFHTGTLARQESHHIGE

SEQ ID NO: 16237 - protein, 81 aa, Callithrix jacchus
LQGLLTFRDVAIEFSLEEWQCLDTAQRNLYKNVILENYRNLVFLGIAVSKPDLIACLEQEKEPLIMKRDEMAGEPPVMCSH

SEQ ID NO: 16238 - protein, 81 aa, Callithrix jacchus
PQESVAFDDVAVYFTKKEWAIMVPDQRALYRDVMLENYEAVAFVAVPPTSKPALISHLEQGKEPCFTQPQGVLSRRDWRAG

SEQ ID NO: 16239 - protein, 81 aa, Callithrix jacchus
MPLDVAIVFSQEEWQWLAPAQRDLYRDVMLETYSNLVSLGLAISKPDVISFLEQGKEPWMVERVVAGGLCPVLESRYDTKE

SEQ ID NO: 16240 - protein, 81 aa, Macaca mulatta
PQGHLTFRDVAIEFSQAEWKCLDLAQRALYKDVMLENYRNLVSLGISLPDLNINSMLEQRREPWSGESEVKIAKNSDGKEH

SEQ ID NO: 16241 - protein, 81 aa, Callithrix jacchus
DFMTFEDIIIDFTREEWALLDTSQRKLFRDVMLENISHLVSIGKEGDIKHQEIPFIQHIYQKDTSTISTMRSHTQDDPFLC

SEQ ID NO: 16242 - protein, 81 aa, Callithrix jacchus
QLNKLSFKDVCVDFTEEEWYLLDPAQKMLYRDVILENYSNLVSVGYCITKPEVIFKIEQGEEPWILEKGFPSQCHPERKWK

SEQ ID NO: 16243 - protein, 81 aa, Macaca mulatta
FQGPVTLKDVIVEFTKEEWKLLTPAQRTLYKDVMLENYSHLVSVGYHVNKPNAVFKLKQGREPWILEVEYPHRGFPEDLWS

SEQ ID NO: 16244 - protein, 81 aa, Callithrix jacchus
GPPGSLEMGVLTFKHVAIEFSRKEWQCLDTAQQNLYRNVMLENYRNLVFLGIAASKPDLITCLEQGKEPWNVKRHDLLSYI

SEQ ID NO: 16245 - protein, 81 aa, Callithrix jacchus
VWGPLSFMDVFVDFTWEEWQLLDPAQKCLYRSVMLENYSNLVSLGYQHTKPDIIFKLEQGEELCMVQAPIPNQCCPNKVWK

SEQ ID NO: 16246 - protein, 81 aa, Macaca mulatta
MSQGSVTFQDVAIDFSKEEWRFLNPAQRDLYTTVMLENYQNLVWLGLSISKSVISLLEKRKLPWIMGKEEIRVPLPDTPGA

SEQ ID NO: 16247 - protein, 81 aa, Ovis aries
TFRGMVIEFFPHEWEFLDSLQKKLYCDVMMENYSNLVSLGHSISKPDIIVLLEEGRNPWMVEFTLFWQKKPRGLISSYRSK

SEQ ID NO: 16248 - protein, 81 aa, Ovis aries
HAEGQLTFQDVAIDFTQEEWECLDLGQRELYRDVMLENYGNLASLGLVSMLDLVTFLEQLKDPRNIRRMETTAIYPAVSPQ

SEQ ID NO: 16249 - protein, 81 aa, Ovis aries
QAQETFTFDDVAVDFTWEEWQLLAPVQKALYRDVMLENYSNLVSAGFQASTPEVLSKLEQGEPWMMDDEIHCQTRSEVWKF

SEQ ID NO: 16250 - protein, 81 aa, Ovis aries
NVLPEAPVTFDDITVYLLEEEWVLLSQQQKDICGSDKLVAPLGPTIASPELFYKFERGPEPWLASVQGQRSHLSPNPGKTK

SEQ ID NO: 16251 - protein, 81 aa, Ovis aries
MARSQASVTFKDVAMDFTPEEWGRLDPAQRDVMLENYRNLVSLWLPVSKPENHSLENGKEPLLLERKAPKSSCSDSETSPR

SEQ ID NO: 16252 - protein, 81 aa, Ovis aries
MLENYSNLVSVGYQASKPAALSRLERGELWPMEDEVHSRICPEIRKDDCLLQENLQNQSCPKRAERCHEHNALGNVYQSKS

SEQ ID NO: 16253 - protein, 81 aa, Ovis aries
AQGYVTFEDVTIYFSPEEWGLLDEAQRLLYCDVMLENFALIASLGLASFRSHIVAQLEMGAEPWVPDRVDMTSAMARGMYR

SEQ ID NO: 16254 - protein, 81 aa, Ovis aries
QERLTSEDVAINFTQEEWEFLDPAQRALYRDVMLETYRNLLSVDISPIHVMKHLQPKANSDKRETFQTLMLGSPESCEIKH

SEQ ID NO: 16255 - protein, 81 aa, Ovis aries
PQDLMTFEDVAVEFTWWEWGQLDSTQKDLYREVMLENFKNLASLGFPVSKPYMICQLEEGEEPCILERAISTGVHSDWERR

SEQ ID NO: 16256 - protein, 81 aa, Ovis aries
AKAPVTFGDLAIYFSQEEWEWLSPIQKDLYEDVMLENYQNLVSLGLSFRRPNVISLLEKGKAPWMVDPVKRRRGLDLGSKC

SEQ ID NO: 16257 - protein, 81 aa, Vulpes vulpes
CEGSVSFEDVTMDFSREEWQQLDPAQRCLYQDVMLEIYSHLLFVGYNIPNPEIISRMEKGEEPWMREVQLPHQRHRERAFG

SEQ ID NO: 16258 - protein, 81 aa, Vulpes vulpes
MLENYGHLESLGFLSSKPHLVSWLEQGEGPWGADMCGTPAAAGMQTDDRIKTRTSISKPKHCLEELARTDLPAGNNKSQGD

SEQ ID NO: 16259 - protein, 81 aa, Cebus imitator
KEAFAAFRDVAVDFTQEEWRLLSPAQRTLHREVMLETYNHLVSLEIASSKPKLIAQLERGEEPWREKRKCSLDLRPGSKPE

SEQ ID NO: 16260 - protein, 81 aa, Cebus imitator
EMGVLTFSDVTIGFCLQEWQCLDTAQQNLCRNVMLENYRNLVFLGIAAFKPYLITYLEQGKEPWSVKRHEMVPPKVLGLQV

SEQ ID NO: 16261 - protein, 81 aa, Cebus imitator
MFKEAVTFKDVAVAFTEEELGLLGPAQRKLYRDVMVENFRNLLSVGHQPFKRDVSPIERKEQLCIMKTATQRQRNSGENNQ

SEQ ID NO: 16262 - protein, 81 aa, Macaca mulatta
QVSLTFEDVAVLFTRDEWRKLVPSQRNLYRDVMLENYRNLVALFTKPKVISLLQQGEDPWKVEKDSSGDSSNPGRKASSCS

SEQ ID NO: 16263 - protein, 81 aa, Macaca mulatta
FQGSISFKDVTVGFSQEEWQHLDPSQRALYRDVMLENYSNLVSVGYCVHKPEVISRLEQGEEPWRLEEEFPSQSFPEVWTA

SEQ ID NO: 16264 - protein, 81 aa, Callithrix jacchus
VTFEDVAVNFSKEEWCLLSEAQRCLYRDVMLENLALISSLGCWCGLKDEAAPSKQSMIVQTESQDRTPRAVSPRKAHSCDT

SEQ ID NO: 16265 - protein, 81 aa, Callithrix jacchus
GWLSFKDISMEFTWDEWQLLDSTQKYLYREVILENYHNLISVDGWEEWYQKNQDELESVERSYACSVLGRLNLSKTHDSSR

SEQ ID NO: 16266 - protein, 81 aa, Callithrix jacchus
AQGSVSFNDVTVDFTQEEWQHLDHAQKTLYMDVMLENYCHLISVGCHMTKPDVILKLERGEEPWTSFAGHTRLEENWKAED

SEQ ID NO: 16267 - protein, 81 aa, Macaca mulatta
GTVTFEDVAVKFTREEWNLLSEAQRCLYRDVTLENLALISSLGCWCGVEDEEGPSKQSIYKQRETQIRIPMAGVSLKKAHP

SEQ ID NO: 16268 - protein, 81 aa, Macaca mulatta
SYEGSVSFRDVAINFSREEWQHLDLSQRNLYRDVMLETYSHLLSVGYQVPKPEVIMLEQGKEPWALQGERPRQSCPGEKLW

SEQ ID NO: 16269 - protein, 81 aa, Callithrix jacchus
PLRLLTFRDVAIEFSLEEWEHLDSDQKNLYGDVMLENYRNLVCLGLAVSKPDLITFLEQRKEPWNVKSAETVAIQPDIFSH

SEQ ID NO: 16270 - protein, 81 aa, Callithrix jacchus
SQEPVTFADVAVVFTPEEWVFLDSTQRSLYRDVMLENYRNLASVAGDQLCKPNALSYLEQRGEQWTTERGVISDICPEPQL

SEQ ID NO: 16271 - protein, 81 aa, Bos taurus
QAPVILKDVVVTFTRQEWKLLDLTQRTLYQEVVLETSRLLVSLGKFLFTSAPCPPQRPGPGCALRHFLGLPLTFPQLVLIL

SEQ ID NO: 16272 - protein, 81 aa, Bos taurus
MYFSWEEWCLLDEAQIQLYLDVMLENFALVCMLGSWHGVQDEETPSEQSKSARVSQFCIPRTCLSPEKTQPCKMCIPVLRD

SEQ ID NO: 16273 - protein, 81 aa, Ovis aries
RLTSADVAINFTQEEWEFLDPAQRALYRDVMLETYRNLLSVDISPTHVIKLLQPKANSDKRETFQTLMLGRPESCEIKHVH

SEQ ID NO: 16274 - protein, 81 aa, Ovis aries
SVTFEDVAVYFSWEEWRLLAETQRSVYLDVMLENYALISSLGCCCGTENAETPSEQITSLEVSQARTPKAALSSQKIHPCE

SEQ ID NO: 16275 - protein, 81 aa, Ovis aries
VKESVTFKDVAVDFTLEEWRLMDPMQRDLHKDVMLENYRNLVSLGLAISKPDMISHLEDGKGPWVVVREISRTSFSELETK

SEQ ID NO: 16276 - protein, 81 aa, Ovis aries
IQGLVTFRDVAVEFSQEEWKCLEPAQRDLYREVTLENFGNLVSLGLSISKPDVVSLLEQGKEPWMVVNDMTGPWCPDLESR

SEQ ID NO: 16277 - protein, 81 aa, Ovis aries
SQGRLTLQDVAIDFTEEEWECLDLGQAELYRDVMLENYSHLVSLGLVVSKPDLITFLEQLKNPWDVRRLETPAIYTAVSSH

SEQ ID NO: 16278 - protein, 81 aa, Ovis aries
MAFRDVAVDFTQDEWVLLSPAQRSLYREVMLENYSNLVSLGIPFSKPKLITQLEQGKESWREERKCSPVSCLGEWGHWVVQ

SEQ ID NO: 16279 - protein, 81 aa, Ovis aries
QDSVVFEDVAVNFTLEEWELLDPAQRKLYRDVMLETCRNLATVLALKLRSSISQIIDLTVHGSYQTKIQPHQCITCGKAFT

SEQ ID NO: 16280 - protein, 81 aa, Ovis aries
PQDLVTFKDVAVDFSQEEWQWLSPAQRSLYRRMMLENYQSLVSLGLCISKPSVISLLEQGKEPWMMMENELRSPFPDWESI

SEQ ID NO: 16281 - protein, 81 aa, Ovis aries
PQGSTPFSSVTVDFTHGGWRQLAPAPRDRFEEGMPEKSRNLVLLGLPVSQPGMNSQLEQREGSWMLEGDGLRNACPDWKII

SEQ ID NO: 16282 - protein, 81 aa, Ovis aries
QDSVVFEDVAVNFTLEEWELLDPAQRKLYRDVMLETCRNLATVGSCPQVKVSVSSPQWDILETELCIEREVVRFTRNDSRS

SEQ ID NO: 16283 - protein, 81 aa, Ovis aries
MEAVTFKDVAVAFTEEELGLLDSAQRKLYQDVMVENFRNLVSVEENNQSELRAVQERGLHEELSCWQIWQQIANDLTRCQD

SEQ ID NO: 16284 - protein, 81 aa, Vulpes vulpes
AQGLVTFEDVAVYFSREEWGLLNLTQRSLYRDVMLENFALIGSLGFAPSRSHVVAQLENEEELWVPNVVDLTLISRAEARR

SEQ ID NO: 16285 - protein, 81 aa, Vulpes vulpes
SVAFQDLAVRFSEEEWQLLGEGQRALYRDVMQENYETLRSLGTAERLPLSAFLSPTEPGGTMEGRSYAGEEQEPPRGGGPL

SEQ ID NO: 16286 - protein, 81 aa, Vulpes vulpes
ARELVTYEDVAVDFTQEEWQHLDPAQKTLHRDVMLEIYSHLVSVGCSGIKPGIIFKLEYEEDPWIIKNREESFDSSQQVIS

SEQ ID NO: 16287 - protein, 81 aa, Otolemur garnettii
LTFKDVAVVFTEEELELLDPIQRKLYQDVMLENFQNLLSVVFQICQGHLFEIEKGQKTVILWGNRKIEMAVGEKSHTYDEC

SEQ ID NO: 16288 - protein, 81 aa, Otolemur garnettii
VTFKDVAVDFTLEEWRLMDPTQRSLHKDVMLENYRNLASLGLAVSKPDMISYLENGKGPWAMVREITRTPYPVNLFPHYLT

SEQ ID NO: 16289 - protein, 81 aa, Vulpes vulpes
FQPPVNFKDVAVTFTQEEAGQLDLAQRMVYGNMTLETCSHLVSLGLLLSKPDVIIWLEQGQDPWRSEQGPPADWKNTFEKS

SEQ ID NO: 16290 - protein, 81 aa, Vulpes vulpes
FQHLVMFRDVAVDFSQEEWECLNSYQRNLYRDVILENYSNLVSVAGCSISKPDVITLLEQGKEPWMVVRDERRRSLDLESR

SEQ ID NO: 16291 - protein, 81 aa, Otolemur garnettii
EESVTFRDVAVFFSQDEWSHLDSAERTLYREVMLDNYRTLASLGTGIVFSKPKVISQLELGEDPWMVENGIPQSPLLGWES

SEQ ID NO: 16292 - protein, 81 aa, Vulpes vulpes
SAESVTFKDVAVDFTQEEWGQLDSPQRALYRDVMLENYQNLLALAGPPVCKPDVISHLERGEEPWWMPGEVPGGACSGGEP

SEQ ID NO: 16293 - protein, 81 aa, Vulpes vulpes
SQSLVTFGDVAINFSQEEWEWLNSAQRNLYRSVMLENYRNLVSLGLCVSKPDMISSLEQRKEPWMVKRKLTRGRCPDLKAV

SEQ ID NO: 16294 - protein, 81 aa, Vulpes vulpes
TQDSVVFEDVAVDFTQEEWALLDLAQRSLYRDVMLENFQNLASLGYPLHTPYLISQWKQEEDLETVEQGPIQGKHQEGFKI

SEQ ID NO: 16295 - protein, 81 aa, Carlito syrichta
FQEEVTFNDVAVVFTEEELGLLDSTQRQLYQDVMLENFRNLLSVGQQPFYQDTVHFIKEEEEEFWEMDTATQEEENSETSS

SEQ ID NO: 16296 - protein, 81 aa, Sapajus apella
SQDSMTFEDIVVDFTREEWALLDTSQRKLFRDVMLENISHLVSIGNQFCKSVVFSHLEQVEKLSTQGIRLPQGKEGDIKHQ

SEQ ID NO: 16297 - protein, 81 aa, Pan troglodytes
TFKEAVTFKDVAVVFTEEELGLLDPAQRKLYRDVMLENFRNLLLVGNQPFHQDTFHFLRKEEFWMMKTTSQREGNSGGKIQ

SEQ ID NO: 16298 - protein, 81 aa, Sapajus apella
FQRSVSFQDLTVNFTEEEWQQLDPAQRLLYRDVMLENYSNLVSVGYHVSKPDVIFKLEQGEEPWIVEEFSNQNYPEVDDAL

SEQ ID NO: 16299 - protein, 81 aa, Macaca mulatta
QGLLTFRDVAIEFSQEEWKCLDPAQRTLYRDVMLENYRNLVSLGQGNTEVIHTGTLQRQASHHIGDICFQEIGKDIHDFVF

SEQ ID NO: 16300 - protein, 81 aa, Sapajus apella
TSQESLTLEDVAVEFTLEEWQLLGASQKDLYRDVMLENYSNLVSVGYQASKPDVLSMLEQGEPWTTENEIHSQICPEIKKV

SEQ ID NO: 16301 - protein, 81 aa, Sapajus apella
PQERLTFRDVAIEFSQEEWKCLDPAQRTLYRNVMLENYRNLVSLAGISLPEMNIVSTLEQGKEPRTVESEVKITKTSNGWK

SEQ ID NO: 16302 - protein, 81 aa, Sapajus apella
MLETYSNLVSLGLAISKPDVISFLEQGREPWMVERVVAGGLCPVLESRYDTKELSPKPHVYEVESPQWELMESITSYGLEC

SEQ ID NO: 16303 - protein, 81 aa, Acinonyx jubatus
ASVVFEDVAVNFTPEEWALLNPGQRKLYRDVMLETCRNLSAVGCRSQGNTSTPRPQWSILLNEPPGEDKTGIFTRKDSCSV

SEQ ID NO: 16304 - protein, 81 aa, Rhinopithecus roxellana
DFISLEDVAVNFTLEEWALLDPGQRNIYRDVMRATFKNLACIGEKWKDQDIEDDPKNQGRKLSSPTVETLCENKDDRPCGK

SEQ ID NO: 16305 - protein, 81 aa, Rhinopithecus roxellana
TFKEGLTFKDVAVVFTEEELGLLDPVQRNLYRDVMLENFRNLLSVGHHPFKHDVFPLEKGKKLDMMKTATQRKGKSADKIQ

SEQ ID NO: 16306 - protein, 81 aa, Acinonyx jubatus
GRVTFEDVAVYFSGEEWGLLDEAQRCLYQDVMLETLAHITSLGCWHGAGDEEAPEQSVSVQGVSRGRTSKAAVSSQKAPPR

SEQ ID NO: 16307 - protein, 81 aa, Rhinopithecus roxellana
FEDVAVNFSQEEWCLLREVQRCLYRDVMLENLALISSLDCWCGSKDKEAPSKQSISVQRESQNTTPRAAVSPKKAHPCEMC

SEQ ID NO: 16308 - protein, 81 aa, Rhinopithecus roxellana
SVTFRDVAIDFSQEEWKWLQPAQRDLYRRVMLENYGHLVSLASESSGEIKDFSPKNVIYDDSSQYLIMERILSQGPMYSSF

SEQ ID NO: 16309 - protein, 81 aa, Rhinopithecus roxellana
MRSNYETLVSLDDGLPKPELISWIEHGGEPFRNWRESQKSRNIICSSSDLHFDPGFQEQLFWGSQQAVNSRKTKSHFQLDP

SEQ ID NO: 16310 - protein, 81 aa, Acinonyx jubatus
EEKERMQNELLQAMSKEEWECLDSGQMNLYKEVMLENFSNLVSVGLSNSKPAVISLLEQGKEPWMVERELTRGLCSDLESM

SEQ ID NO: 16311 - protein, 81 aa, Acinonyx jubatus
MGMAGPISEGFIQRCHVGELQELGLSISKPNMISLLEQGKEPWMVEKEMSDGQYADWESWYEIKELPPKWYIDEEEISQGM

SEQ ID NO: 16312 - protein, 81 aa, Acinonyx jubatus
RESGKAPVTFDDITVYLLQGEWMLLSQQQKEICGSDKLVAPLGPTIANPELFYKFERGPEPWVGSAQGQRNVLSHHPGKNQ

SEQ ID NO: 16313 - protein, 81 aa, Rhinopithecus roxellana
AHGSVTFRDVAIDFSQEEWEFLDPAQRDLYRDVMWENYNNFISLGPSISKPDVITLLDEEGKEPGMVVREGTRRYCPDLES

SEQ ID NO: 16314 - protein, 81 aa, Rhinopithecus roxellana
QGRVTFRDVAIEFSLAEWKCLNPAQRALYREVMLENYRNLESVDITSKCMMKEVLSTGQGNTEVFYPGTLQRPESHHIGDF

SEQ ID NO: 16315 - protein, 81 aa, Rhinopithecus roxellana
FQESVTFQDVAVDFTAEEWQLLDCTERTLYWDVMLENYRNLISVGCPINKTKVILKVEQGQEPWMVEGVNPHQSSPESDCP

SEQ ID NO: 16316 - protein, 81 aa, Acinonyx jubatus
RPRAVKFADVAVYFSTEEWGCLRPAQRALYRDVMQETYGHLGALGCAGPKPALISWLERNTDDWEPAALDPQECPRGVAVQ

SEQ ID NO: 16317 - protein, 81 aa, Rhinopithecus roxellana
SLGSVTFTDVAIDFSQDEWEWLNLAQRSLYRKVMLENYRNLVSVGLCLSKPDVISLLEQEKDPWVIKGEMTRGLCPDILKM

SEQ ID NO: 16318 - protein, 81 aa, Rhinopithecus roxellana
VMLENYSLLLSVGYCITKPVVICKLEHGEVLWILEEEFPSQSHLDCCIDDDLNGVLGKTFYLDTNPILLRKIHGNYGSYGV

SEQ ID NO: 16319 - protein, 81 aa, Bison bison
PLESVTFEDVAVDFTQEEWSLLDKSQKNLFRNVMLETVSHLVSVGYQMSKSEVISQLEQGKELWTAAAGGLQGQSPGSERP

SEQ ID NO: 16320 - protein, 81 aa, Bison bison
PQGSTPFSNVTVDFTQGGWRQLAPAPRDRFEEGMPENSRNLVLLGLPVSQPGMNSQLEQREGSWMLERDGLRNACPDWKII

SEQ ID NO: 16321 - protein, 81 aa, Bison bison
FQMPLTFSDVSIDFSQEEWECLNSDQKNLYRDVMLETYTNLVSLDFDFTTENNKLSSEKSSFEVNSYHWKIMKSKTFNLMG

SEQ ID NO: 16322 - protein, 81 aa, Bison bison
FQGLVSFKDVTVGFTQEEWQHLDSTQRSLYRDVMLENYRNLVSVGFCITKPEVIFRLEQGEEPWILEEEFLSQSFSEVWKT

SEQ ID NO: 16323 - protein, 81 aa, Bison bison
HSEGRLMFQDVAIDFTQEEWECLDPGQRKLYRDVMVENYRNLASLGLVSKVDLVTFLELLKDPRNMRRMEATAIYPAMSPQ

SEQ ID NO: 16324 - protein, 81 aa, Odocoileus virginianus
LQVSVSFEDVTVDFSREEWQHLDSAQRRLYQDVMLEIYSHLLSLGYEVPKPEVIFKLEQGEEPWALKKKTLHHSCSDGKFG

SEQ ID NO: 16325 - protein, 81 aa, Cebus imitator
MAHLMFRDVAIDFSQEEWEGLDLKQRDLYRDVMLENYSNMVSLGLCIYQPDVFSLLEKGKEPWKILTDETRGPCPDMQSRC

SEQ ID NO: 16326 - protein, 81 aa, Macaca mulatta
QGLLTFRDVAVEFSLEEWEHLEPAQKTLYQDVMLENYRNLVSLGLLVSKPDLITFLEQRKEAWNVKSEETVAVQPDVFSHY

SEQ ID NO: 16327 - protein, 81 aa, Callithrix jacchus
YQTPVSFRDVVVGFTQEEWHRLNPTQRALYRDVMLETYSNLVSVGYEGTKPDVILRLEQEEAPWIGEAACLGCHCWEDIWK

SEQ ID NO: 16328 - protein, 81 aa, Callithrix jacchus
MEPLTFKDVAIEFSLEEWQCLDTAQQDLYRNVMLENYGNLVFLGIAVSKPDLITCLEQGKVPWNRKRHEMVAKPPVVCSYF

SEQ ID NO: 16329 - protein, 81 aa, Callithrix jacchus
LTGRLTFKDVSVEFSSAEWKCLTPAQRALYRDVMLENYRNLESVGEENVPPDTSNPSLFIWKPYKCNECGKTFHQVSFLTC

SEQ ID NO: 16330 - protein, 81 aa, Callithrix jacchus
FFPREAICPLEEKTKVERTVVDYLANGYQDSVTFDDVAVEFTPEEWALLDTTQKYLYRDVMLENYKNLASVGKKLQVRETL

SEQ ID NO: 16331 - protein, 81 aa, Callithrix jacchus
GTVTFEDVAVNFSREEWSLLSEVQRCLYHDVMLENWVLTSSLGCWCESEYEEAPSKQNISIQRVSPVSTPRAGVSLKKAHP

SEQ ID NO: 16332 - protein, 81 aa, Callithrix jacchus
WQCLDAAQRNLYKNVILENYRNLVFLGIAVSKPDLIACLEQEKEPLIMKRDEMADEPPVMCSHFAQEFWPEQNIKDSSQNM

SEQ ID NO: 16333 - protein, 81 aa, Callithrix jacchus
RPRALKFVDVAVYFSSEEWGCLRPAQRALYRDVMRETYGHLGALGFSGPKSAFISWVEGEMEAWSPEVQDPEGESPGTVSG

SEQ ID NO: 16334 - protein, 81 aa, Macaca mulatta
AQVSVTFDDVAVTFTKEEWGQLDLAQRTLYQEVMLENCGLLVSLGCPIPRPELIYHLEHGQEPWTRKEDLSQDTCPGNKGK

SEQ ID NO: 16335 - protein, 81 aa, Macaca mulatta
YQEFVTFEDVAVHLTREEWGYLDPVQRDLYREVMLENYGNVVSLGFPISKPDGISQLEQDLQVFDLETKTREVLRGDCSDG

SEQ ID NO: 16336 - protein, 81 aa, Macaca mulatta
LSFEDVAMYFTREEWGHLDWGQKDLYRDVMLENYRNMVLLGSEARHRMKKLTPKQKFSEDLESYKISVVMQESAEKLSEKL

SEQ ID NO: 16337 - protein, 81 aa, Callithrix jacchus
GACGDSVSSLSGAVPSCGFSETRPTSFCSSKTMAHGSVTFRDVAIDFSQEEWEFLDPAERDLYRDVMWENYSNFISLDISL

SEQ ID NO: 16338 - protein, 81 aa, Callithrix jacchus
EMGPLTFMDVAVEFSLEEWQCVDTAQQNLYRNVMLENYRNLVFLGIAVSKPDLITFLDQEKKPWNIKRCEMVPKPSECDYS

SEQ ID NO: 16339 - protein, 81 aa, Monodon monoceros
LLKFLPFLQLHLLGISCYSGSVRNEEGMEAELLTARSHVILYLSLGTGHQLPKPEVILQLEKGEEPWLLERGIHQETYPGE

SEQ ID NO: 16340 - protein, 81 aa, Bos taurus
NLFEWQKELYKNVMRGNYESLVSMDYAISKPDLMSQMERGERPAMQEQEDSEEGEAPADPSAAHDGIVIKIEVQTNDEGSE

SEQ ID NO: 16341 - protein, 81 aa, Ovis aries
MAEPCSEESVQDGDAGQLQEPGVSVSKPDVISLLEQGKAPWMVEEEEPRGACPDWEYAFKNKEFPSKQVIYEESSKVMMMG

SEQ ID NO: 16342 - protein, 81 aa, Ovis aries
SQDSVTFADVAVNFTQEEWTLLNCFQRKLYRDVMLENYKNLTTAGYQVFKPTLISWLEEEELSTVEKGVLQEWGIQLKAKD

SEQ ID NO: 16343 - protein, 81 aa, Ovis aries
RRGSVTFEDVAVNFSWEEWGLLDESHKRLYHDVMLENYALISSLGFWSGEEKVETSFAQSVSVAVSQARTSKEASSSQKTH

SEQ ID NO: 16344 - protein, 81 aa, Ovis aries
QGHVTFEDVAVSFSQEEWGLLGEAQRLLYYDVMLENLSLIASLGCWRGGDTEEAGSEQCVSAEQVTRDRHPRVDSSILKAV

SEQ ID NO: 16345 - protein, 81 aa, Rhinopithecus roxellana
MEPLKFRDVAIEFSLEEWQCLDTAQQNLYRNVMLENYRNLVFLGIAVSKPDLITCLEQEKEPWTRKRHRIVAKPPVTCSHF

SEQ ID NO: 16346 - protein, 81 aa, Rhinopithecus roxellana
MAFEDVAVYFSQEEWGLLDTAQRALYRHVMLDNFTLVTSLGLSTSRPHVVIQLERGEEPWVPSGKDMTLARNTYRRLNAGE

SEQ ID NO: 16347 - protein, 81 aa, Rhinopithecus roxellana
FEELVTFEDVFVDFSPEELSSLSAAQRNLYREVMLENYRNLVSLGYQFSKPDIISRLEAEESHAMVTDSRHTVICQGESHD

SEQ ID NO: 16348 - protein, 81 aa, Acinonyx jubatus
QESVTFKDVAVDFTLEEWGWLGPGQRELYRDVMLENYQNLLSLGAGPPGFKPDVISRLERGEEPSMEKREGWQMACPDLET

SEQ ID NO: 16349 - protein, 81 aa, Acinonyx jubatus
SLLTFEEVAMYFSQEEWELLDPTQKALYNDVMRENYETVISLAVPAHQILAFPEQTITKDWTVAPELVLPESQSLLTFEEV

SEQ ID NO: 16350 - protein, 81 aa, Rhinopithecus roxellana
MAKPCEWQHLDPSQRNLYRDVMLETYSHLLSVGYQVPEAEVVMLEQGKEPWALQGERPRQSCPGEKLWDHNQCRKILSYKQ

SEQ ID NO: 16351 - protein, 81 aa, Rhinopithecus roxellana
QGLLTFRDVAIEFSQEEWKCLDAAQRTLYRDVMLENYRNLVSLDISSKCMRNTLLSTGQGNTEVFHTGTLQRQARYHIGAL

SEQ ID NO: 16352 - protein, 81 aa, Rhinopithecus roxellana
MVTFEDVAVHFTKTEWTGLSPAQRALYRSVMLENFGNLTALGYPVPKPALISLLEGGDMAWGLEAQDDPLAERTKNICKGV

SEQ ID NO: 16353 - protein, 81 aa, Acinonyx jubatus
AQAPLSFEDVAVSFSREEWRLLVPAQKDLYRDVMLENYRNLVSVGYQASEPDSLFQLEHGGPLWVVEGAAPRPPCPEEIWE

SEQ ID NO: 16354 - protein, 81 aa, Acinonyx jubatus
SQDLVTFKDVAIDFSQEEWEWLNPAQRSLYKNMMLENYRNLVSLDLESMYETHELSLKHFVYDDVLMERITGYGLEHSTFS

SEQ ID NO: 16355 - protein, 81 aa, Rhinopithecus roxellana
ASVTVTFDDVALYFSEQEWEILEKWQKQMYKQEMKTNYQTLDSLGYAFSKPDLITWMEQGRMLFISEQGYLDKTRRTTSPP

SEQ ID NO: 16356 - protein, 81 aa, Bison bison
RRVPVTYEDVAVTFTQEEWGHLGPMQRTLYWEVMLETCRLLVSLGCPLPEPELISPVEPGPESQTSRRGPTPSSCSGDNTK

SEQ ID NO: 16357 - protein, 81 aa, Bison bison
AQGNVTFEDVFVSFSQEEWGLLDEAQRLLYREVMLENFALMASLGYASSMSHGVSPQELGREPWVSDWADTIPALTREAQS

SEQ ID NO: 16358 - protein, 81 aa, Bison bison
SPVGERSGSRRLRGPRREWGCLRPAQRALYRDVMQETYGHLGALGFRGTKPALISWVEEEAQLWGPDAGPPEMGECVTEAD

SEQ ID NO: 16359 - protein, 81 aa, Odocoileus virginianus
KAQETLTFDDVAVAFTWEEWQLLAPAQKALYRDVMLENHSNLLSAGFQASTPEVLSKLDQGEPWTMDDEVHCRTRSEVWKF

SEQ ID NO: 16360 - protein, 81 aa, Odocoileus virginianus
SLGSDLFRDVAIVFSQEEWEQLAPTQRDLYRDVMLETYSNLVSLGLAVSKPDVISFLEQGKEPWTVEEVAAGGLCPVLKSR

SEQ ID NO: 16361 - protein, 81 aa, Odocoileus virginianus
QDSVVFEDVAVNFTLEEWELLDPAQRKLYRDVMLETCRNLATVGSCPQVKVNMSSPQWDILETGLCIEREVVRFTRNDSRS

SEQ ID NO: 16362 - protein, 81 aa, Odocoileus virginianus
EALPVVFEDVAVYFTREEWGALDKRQKEMYRDVMRMNYELLASLGPAAAKPDLISKLERRAAPWIKDPHGPKWGKGRPPGK

SEQ ID NO: 16363 - protein, 81 aa, Odocoileus virginianus
SQGLLTLQDVAIDFTQEEWECLDLSQRDLYRDVILENYRNLAALGLVVTGLNLVTFLEQLNDPRTIRRIETTAIYPGVSPQ

SEQ ID NO: 16364 - protein, 81 aa, Cebus imitator
MFKEAVTFKDVAVVFTEEELGLLGPAQRKLYRDVMLENFRNLLSVGHQPFHGDTFHLQREEKFWMMETATQREGNSGGKIQ

SEQ ID NO: 16365 - protein, 81 aa, Cebus imitator
ELVTFRDVLINFSQEEWEYLDSAQRNLYWDVMMENYSNLLSLDLESKYETKLLPVGTDIIKNTGSQWEVMESSKLCGLENS

SEQ ID NO: 16366 - protein, 81 aa, Callithrix jacchus
AHVSLAFRDVSIDLSQEEWECLDPAQRDLYKDVMFENYSNLVSLGYTIPKPDVITLLEQEKEPWIVMREGTRSWCTDLEYK

SEQ ID NO: 16367 - protein, 81 aa, Macaca mulatta
FQEAVTFKDVAVAFTEEELGLLDPAQRKLYRDVMLENFRNLVSVGHQSFKPDMISQLEREEKLWMKEFQTQRGDRNQNEMA

SEQ ID NO: 16368 - protein, 81 aa, Callithrix jacchus
ACRSITFRDVAIDFSHQEWEYLNLVQKTLYQEVMMENYDNLVSLGHSISKPDLITLLEQGKEPWMIVREETRGECTDLDSR

SEQ ID NO: 16369 - protein, 81 aa, Callithrix jacchus
TKDSFSFDDLSVDFTQKEWQLLDPSQKNLYKDVMLENYSSLVSLGYEAMKPDVIFKLEQGEEPWIGDEEIPSSWSPDIWKV

SEQ ID NO: 16370 - protein, 81 aa, Callithrix jacchus
AAGRVTFEDVTVSFTKGEWQQLNPEQRELYRDVMLENYGNLVSVGLEETSKPSVILRLEEGKEPWSEEEVLRGGRPEKNWD

SEQ ID NO: 16371 - protein, 81 aa, Macaca mulatta
TQGQVTFRDVAIEFSQEEWTCLDPAQRTLYRDVMLENYRNLASLGISCFDLSIISMLEQGKEPFTVESQVQIARNPDGWEW

SEQ ID NO: 16372 - protein, 81 aa, Macaca mulatta
GSLTFRDVAIEFSQEEWKCLDPIQKALYRDVMLENYRNLGFLGIYPKRVIKELPPIQNNNTGEKFQTVMLEGHESYDIENV

SEQ ID NO: 16373 - protein, 81 aa, Callithrix jacchus
PQESVAFDDVAVYFTKKEWAIMVPDQRALYRDVMLENYEAVAFVVPPTSKPALISHLEQGKEPCFTQPQGVLSRRDWRAGF

SEQ ID NO: 16374 - protein, 81 aa, Macaca mulatta
VAVDFTQEEWTLLDQTQRDLYRDVMLENYKNLIILAGCEFCKPSLMSGLEQMEELRTGVTGVLQELDLQLKTKGSPLLQDI

SEQ ID NO: 16375 - protein, 81 aa, Callithrix jacchus
ACRSITFRDVAIDFSHQEWEYLNLVQKTLYQEVMMENYDNLVSLAGHSISKPDLITLLEQGKEPWMIVREETRGECTDLDS

SEQ ID NO: 16376 - protein, 81 aa, Bos taurus
VQDCVVFEDVAVYFSQEEWGLLDETQRHLYHAVMTENLALVTSLGCCHGAQGEEASSEQGVSIGMSEVRTAKPDPSSRKAQ

SEQ ID NO: 16377 - protein, 81 aa, Bos taurus
PLESVTFGDVAIDFTQEEWNLLDKSQKNLFRNVMLETVTHLVSVGYQISKSDVVFQLEQGKELWTQAAGGFQGQSPGSESL

SEQ ID NO: 16378 - protein, 81 aa, Bos taurus
LQGLMTFEDVAVDFTQEEWQYLNPPQRTLYRDVMLETYSNLVSVGHHVTKPDLILKLEVEEKCLPEGKIPIWSFPDMGPQT

SEQ ID NO: 16379 - protein, 81 aa, Bos taurus
CSVVSDSFVTFEDVVVYFSWEEWGLLDENQRCLYHDVMLENFALVTSLGKALTPTPVPCTQLCSLQTQVLPPFPSCLAGRH

SEQ ID NO: 16380 - protein, 81 aa, Ovis aries
QEETLTFRDVFVDFTQEEWQQLDAAQKNLHRVVMLENYSHLVSVGYLVAQPHGIFRLGQEEEEAGMAAGESPPWSCPGKPM

SEQ ID NO: 16381 - protein, 81 aa, Ovis aries
VTFEDVAVDFTREEWSLLDKSQKNLFRNVMMETITHLVFVGSERPLGQQEMILMPSVYRKHISPTMAMVSHLQGNSAGCTD

SEQ ID NO: 16382 - protein, 81 aa, Ovis aries
FQEAVTFKDVAVVFTEEELGLLDSAQRKLYQDVMVENFRNLVSVGHLPFKADMVSQLETEEKLWTLERETQRNGHSSEIHS

SEQ ID NO: 16383 - protein, 81 aa, Ovis aries
QGRLRFQDVAIDFTLEEWECLDLGQRELYRDVMLENYGNLASLGLVVSKPDLVTFLEKMRDPQDVRGIETTAIHPEFLDND

SEQ ID NO: 16384 - protein, 81 aa, Ovis aries
AHGSVTFRDVAIDFSQEEWEFLDSAQRDLYRDVMWENYSNFISLGPSMSKPDVITLLDEGKEPWMVVREGIGRHHPDLESR

SEQ ID NO: 16385 - protein, 81 aa, Ovis aries
MDVAVDFSQDEWEWLTLAQRTLYKKVMLENYSNLASLGLCISKPDVISFLEQDKEPWMMKGELTRGLCPGLEYVWMKKELS

SEQ ID NO: 16386 - protein, 81 aa, Ovis aries
SQVSVTFEDVAVLFTRDEWRKLAPPQRNLYQDVMLENYSNLVSLGLLFPKPKVISLLQQGEDPWKVEKENLGGSSLGWKNS

SEQ ID NO: 16387 - protein, 81 aa, Ovis aries
VQGPVSFEDVAVGFSGEEWQLLGPSQKALYWDVMLENYCNLVSVGYQAPKPDSLFQLEQGGPPWTVKGAVLSPTCPGFVAE

SEQ ID NO: 16388 - protein, 81 aa, Ovis aries
YRGPVTFKDITVEFTREEWKLLDTAQRTLYREVMQENYSHLISVGYCANRPNAIFKLKQGKEPWILEVQFPRQKNPEDLCN

SEQ ID NO: 16389 - protein, 81 aa, Otolemur garnettii
QKLLTFEDVAIDFSVEEWTCLDSAQRNLYKDVMSENYRNLVSVDEIGLAASKPDLITCLEQSQEPWNVGEALAGHPGRWKW

SEQ ID NO: 16390 - protein, 81 aa, Cebus imitator
AHALVTFRDVAIDFSQKEWECLDPTQRKLYRDVMLENYGNLVSLGLLSRHKTKKLSSEKDIHEIGFSKGNIIEKSKTLHLK

SEQ ID NO: 16391 - protein, 81 aa, Cebus imitator
QGHLTFKDVAVEFSLEEWKCLTPAQRALYRDVMLENYSNLESVDISSKCMMKKFSLTAQGNTEMFHTGTLETHESHHIGVF

SEQ ID NO: 16392 - protein, 81 aa, Callithrix jacchus
GEGLLSFEDVAVDFTREEWQFLDPSQKVLYKEVMSENYRNLVSVGYQGTKPDSLFKLERGKPPWIVEGAAHSETCPGFVIQ

SEQ ID NO: 16393 - protein, 81 aa, Callithrix jacchus
KQGQVNFEDVFVYFSQEEWVLLDEAQRLLYRDVMLENFALMASLGCWPGMKDEEIPFEQSFSIGLSQIRIPKGSPSTQKAY

SEQ ID NO: 16394 - protein, 81 aa, Callithrix jacchus
AQKVLTFRDVAIEFSLEEWKFLDAAQQNLYRDVMLENYRNLFSIGLTVSKPGLITCLEQRKAPWNLKRREAADGHPELGFH

SEQ ID NO: 16395 - protein, 81 aa, Macaca mulatta
EMGPLTFRDVAIEFSLEEWQCLDTAQRNLYRKVMFENYRNLVFLVIYSHFTEDLWPEHSIKDSFQKVILRGYGKCEHENLQ

SEQ ID NO: 16396 - protein, 81 aa, Callithrix jacchus
TLVTFKDVFVDFTREEWKLLDTAQQIVYRNVMLENYKNLVSLDSETAFEIKSSVSSRSIFKDKQSCDIKMEGMARSDLWYL

SEQ ID NO: 16397 - protein, 81 aa, Callithrix jacchus
RPRALKFVDVAVYFSSEEWGCLRPAQRALYRDVMRETYGHLGALGFPGPKPALISWMEQESEAWSSAAQDPENGESLGGAR

SEQ ID NO: 16398 - protein, 81 aa, Callithrix jacchus
VNDLVTFKDVAIDFSQEEWQWMNPAQKRLYRSMMLENYQSLVSLGLCVSKPYVISLLEQGREPWEMTSEMRRSPFSDWESI

SEQ ID NO: 16399 - protein, 81 aa, Monodon monoceros
MGMGLTCDLTSLSNKKNPVSYDGFLLSKFYPSLGLSSSKPTVISLLEQGKEPWMVDRELTRGLCSDLESMCETKLLSLKKR

SEQ ID NO: 16400 - protein, 80 aa, Macaca mulatta
VFQGPLTFRDVTVEFSLEEWQCLDTAQQNLYRDVMLENYRNLVFLDKTGIAVSKPDLVTCLKQGKEPWNMKRHEMVAKTP

SEQ ID NO: 16401 - protein, 81 aa, Macaca mulatta
MRENYENLASVGRDLFKPSVICWLEEEEELRAEQRGVLQEWRLKTKGPALRQDRSWFRTSNETQTQARSHNGGQLCDRTQC

SEQ ID NO: 16402 - protein, 81 aa, Macaca mulatta
AIKFSQEEWKCLDPAQRTLCRDVMLENYRNLVSLDISSKCMMKEILSTGQGNTEVFHTGTLQRHESHHIGDFCFQDIEKEM

SEQ ID NO: 16403 - protein, 81 aa, Callithrix jacchus
MLENYSNLVAVGYQASKPDALFKLGQGQPPWTVKDGIHSGACSEIWKFDDQLLEHLQCENLVNRRKPCHENDAFENILHWS

SEQ ID NO: 16404 - protein, 81 aa, Bos taurus
VTFRDVAIDFSQEEWEFLDPAQRDLYVDVMLENYSNLVSLDLESTYETKNTLSKKDIFEINFSQWKIKERSKTIELEASIF

SEQ ID NO: 16405 - protein, 81 aa, Bos taurus
VKESVTFKDVAVDFTLEEWRLMDPTQRDLHKDVMLENYRNLVSLGLAISKPDMISHLENGKGPWVVVREISRTPFSELETK

SEQ ID NO: 16406 - protein, 81 aa, Bos taurus
MSSFHLICPPLLSSKDKAMRMNSEKALFSHCRKVTFFFLFQCIGLQVSKPDVISQLEQGTEPWIVEPSIPVGTPGDWVTRP

SEQ ID NO: 16407 - protein, 81 aa, Ovis aries
FKGSVTLQDVAVEFTPEEWQLLDCDQRTLFWDVMLENFRNLISVGCPVTETTVIFRVEQGQEPWMVEGEDSRWSSPEADCP

SEQ ID NO: 16408 - protein, 81 aa, Ovis aries
MLENYSHLLSLGYEVPKPEVIFKLEQGEEPWALKEKALHHSCSDGKFGIKNLQKRISGKVSFHGEMEGEDAKDDSLYSILE

SEQ ID NO: 16409 - protein, 81 aa, Ovis aries
FQGRLTFQDVAIDFTEEEWECLDLGQRELYRDVMLENYRNLASLGLVVSKPDLVTFLEQMQNPWDVRRLEMPAIYTGRCEW

SEQ ID NO: 16410 - protein, 81 aa, Ovis aries
QMAVTFEDVTVSFTWEEWKLLDSSQKKLYREVMWENYTNVMLVGNWKESCKPQEERFSYLDHENLSCWQGWKTASTPIYEN

SEQ ID NO: 16411 - protein, 81 aa, Ovis aries
MSKQAQLIFKDVFLDFTPEEWECLDPAQRTLYKDMMVETVRNGLSEAQKRRKMKEKESGMALSQAQSTFKDVFLDFTPEKW

SEQ ID NO: 16412 - protein, 81 aa, Ovis aries
QESVTFKDVAVDFTLEEWGRLGPGQRELYRDVMLENYQNLLSLGAGFPGAKPYVISCLERGEEPRMERRETQQVTCPDLET

SEQ ID NO: 16413 - protein, 81 aa, Ovis aries
MESVTLEDVAMELIQEWTLLDDAGRNLCRHVLQDNCRTPAARAGTPPCKASLVSQVESREELKAAEHGVLYATGVDWESQF

SEQ ID NO: 16414 - protein, 81 aa, Ovis aries
KVSRSLENDGVCFSEQEWENLEDWQKELYASVMKSNYEALASLKVLGQPEGEMELGAEMPGDLEEESRDVHPAEEVVAKQE

SEQ ID NO: 16415 - protein, 81 aa, Vulpes vulpes
MLENYSSLVSLGYEVVKPDVIFRLEQGEEPWIGAGELSSLDCPEQVLQVNGHMTWHQDNQEKLRNMKQDDECDAFGKKINL

SEQ ID NO: 16416 - protein, 81 aa, Otolemur garnettii
LTFKDVAVVFTEEELGLLDPAQRKLYRDVMLENFRNLVSVENDIPKVKESCLDFSLSDGNSQYKTSQWQRDCSRILHIGTY

SEQ ID NO: 16417 - protein, 81 aa, Otolemur garnettii
YQELVTFRDVAVDFSQEEWDCLNSSQKHLYSNVMLENYRILVSLGLCFSKPSLILLLEQGKEPWMVKRELTKDLYSGWEPI

SEQ ID NO: 16418 - protein, 81 aa, Otolemur garnettii
SDELVTFTDVAIDFSQQEWEYLDPNQRNLYRDVMLENYRNLVSLAGHSISKPDVVDLLEQGKEPWMILRDETQYTGPSVQL

SEQ ID NO: 16419 - protein, 81 aa, Macaca mulatta
MLVIFNKTGIAVSKPDLITCLEQGKEPWNMKRHEMVDKAPAICPHFAQDFWPEQGMEDSFQKVLLRKYEKCGHENLQLRKS

SEQ ID NO: 16420 - protein, 81 aa, Macaca mulatta
DSVTFEDVAVDFTQEEWTLLDQTQRNLYRDVMLENYNNLVAVDWESHINTKWSAPQQNFLQGKTSSVVEMERNHFGEELFD

SEQ ID NO: 16421 - protein, 81 aa, Callithrix jacchus
HEPLGFRDVAIEFSLEEWHCLDTVQRNLYWDVMLENYRNLVFLAPDLMVCLPCGILMVMHSHFAQDLWPEQGIKDSFQKMI

SEQ ID NO: 16422 - protein, 81 aa, Callithrix jacchus
KQGYVTFEDVAVYFSQEEWRLLDEAQRLLYRNVMLENFSLMASLGLASSKTHEITQLESWEEPFMPAWEVVTSAIPGGCWH

SEQ ID NO: 16423 - protein, 81 aa, Macaca mulatta
MLENYRNLVFLGIPVSKPDLITCLEQGKKPWTMKRHEMVAKSPVIYSHFAQDLWPEQSIKDTFQKVILRRYEKCGHDDLQL

SEQ ID NO: 16424 - protein, 81 aa, Bos taurus
LGHVTFEDVAVSFSQEEWGLLGEAQRLLYYDVMLENLNILELVLMRWMNLEPITQSEVSQKEKNKYINVCIYMCVCIYIYL

SEQ ID NO: 16425 - protein, 81 aa, Bos taurus
LQEPVTFRDVAVDFTQEEWGQLGPAQRTLYRDVMLETFGHLLSVGPELPKPDVISQLEQGAELWVAERGLPQGCRPALPLF

SEQ ID NO: 16426 - protein, 81 aa, Bos taurus
KGSTSTFRDVAIHFSQQEWECLNPVQKNLYQDVMMENYDNLVSLAGHSISKPDVITLLEQGKEPWMVVREETRRWCAGQYK

SEQ ID NO: 16427 - protein, 81 aa, Ovis aries
CEVSVSFEDVTVDFSREEWQHLDSAQRRLYQDVMLENYSHLLSLGYEVPKPEVIFKLEQGEEPWALKEKALHHSCSDGKFG

SEQ ID NO: 16428 - protein, 81 aa, Ovis aries
QAQLTFKDVFLDFTPEEWECLDPAQRTLYKDVMVEILRNLLSVDMSHIHMTKKLQAKANSGKGAIFQRVMFGRAEILEIRD

SEQ ID NO: 16429 - protein, 81 aa, Ovis aries
AQVSVTFDDVAVTFTQEEWGALEPAQRTLYQEVMLETCRLLMSLGCPVPRPELIYQLEHGQELWTVKRDLSRSTCPGYSSE

SEQ ID NO: 16430 - protein, 81 aa, Ovis aries
ELGPVTFEDVAVYFSQEEWRILDETQRHLYCYVMLETFALVASLGLASSRSHVVVPLELGGEPWVQDRVDMTPGTARGAQS

SEQ ID NO: 16431 - protein, 81 aa, Ovis aries
DVSLRSHIPTEDAEQEEEEEEMAASQGRLTFQDVAIDFTEEEWECLDLSQRELYRDVMLENYRNLASLDSQVTEWEEVCCR

SEQ ID NO: 16432 - protein, 81 aa, Ovis aries
AQGSVSFKDVTVDFSQEEWQHLDPAQKTLYMDVMLENYCHLISIGCHMTKPDVILKLERGEEPWTSFKGHTCLEENWKAED

SEQ ID NO: 16433 - protein, 81 aa, Ovis aries
MAQISFEDVAVNFTLEEWQLLNPTQKTLYRDVMLENYSNLVLLGYQVIKPETIFRLEQEKPWLLDEEILSQNFSEKVWLDN

SEQ ID NO: 16434 - protein, 81 aa, Ovis aries
ESVTFEDVAIDFTQEEWSLLDKSQKNLFRNVMLETVTHLVSVGYQISKSDVIFQLEQGKELWPEAAGGLQGQSPGSESLFR

SEQ ID NO: 16435 - protein, 81 aa, Ovis aries
QGRLTFEDVATDFTQEEWECLDLCQQELYRDVILENYGNLASLGLVVSKPDLVTFLEQMKDPWDIRRMEMPAIHPAVSSHD

SEQ ID NO: 16436 - protein, 81 aa, Vulpes vulpes
MARQDLAVRFSEEEWQLLGEGQRALYRDVMQENYETLRSLGTAERLPLSAFLSPTEPGGTMEGRSYAGEEQEPPRGGGPLA

SEQ ID NO: 16437 - protein, 81 aa, Otolemur garnettii
SKGSMMFKDVSVDFSQEEWECLDSGQMSLYKEVMLENFSNLVSVGLSNSKPAVISLLEQGKEPWMVERVLTRSLCSDLESM

SEQ ID NO: 16438 - protein, 81 aa, Otolemur garnettii
LKVFVAFRDVAVDFTQQEWKLLSPAQRTLHREVMLETYNHLVSLGIPFSKPKLITQLEQGEEPCREERKCLLDIHPGSTLE

SEQ ID NO: 16439 - protein, 81 aa, Otolemur garnettii
QESVTFKDVSVDFTQEEWHHIDTAQRSLYRDVMLENYSHLVSVGYQVSKPEVIFKLEQGEEPWISEGEIQRPFCPDWKTRP

SEQ ID NO: 16440 - protein, 81 aa, Otolemur garnettii
FQESVTFKDVIVDFTREEWKQLDPVQRDLFRDVTLENYTHLVSIGLQVSKPDVISQLEQGTEPWVIEPGFPVGTFADWETR

SEQ ID NO: 16441 - protein, 81 aa, Otolemur garnettii
LQDLVTFKDVAVEFTQEEWALLNPSQRTLYRDVMLENCRNLASLGCHVDKPNFLSHLEQEDKVMTEERKIIPSICPDVPTL

SEQ ID NO: 16442 - protein, 81 aa, Otolemur garnettii
FQSSVTFRDVAIDFSQEEWEFLDSAQRDLYRDVMWENYSNFISLGSSISKPDMITSLDEEGKEPGMLVREGARRYCPDLES

SEQ ID NO: 16443 - protein, 81 aa, Vulpes vulpes
SRSLENDGVCFSEQEWENLDDWQKEVYRNVMKSNYETLVSLKVLGQPEGEAELGAGMLGDLEEEGPGDIHPAEGVLIKQEI

SEQ ID NO: 16444 - protein, 81 aa, Vulpes vulpes
MRENCRNLASLGYHVDKPSLISQLEQEDKVMTEERGILQGTCSDLETVLKAKWLTPKKHVFRKEHSNGIKAERSHLGVKLN

SEQ ID NO: 16445 - protein, 81 aa, Otolemur garnettii
QEPVTFKDVIVEFSEEEWGHLDSAVKKMYRDVMLENYKNLNSLHKAHLLAKPAEIPKLENKIKRWIMEEEIPRTAVFDMKT

SEQ ID NO: 16446 - protein, 81 aa, Tursiops truncatus
SQLSVTFEDVAVLFTRDEWRKLAPSQRNLYQDVMLENYSNLVSLGLPFSKPEVISLLQQGEDPWKVVKESPGGSSLGRKNS

SEQ ID NO: 16447 - protein, 81 aa, Tursiops truncatus
FQEAVTFKDVAVTFTEEELGLLDSAQRKLYQDVMVENFRNLVSVGHLPFKPDMVSQLETEEKIWMMERETQRNGHSSENRK

SEQ ID NO: 16448 - protein, 81 aa, Acinonyx jubatus
MLENYANVASLAFLFTRPVLVSQLERGELPWGPEPWEPAGREVLGGICPELCSSETRAEKEESSPKEHIPEETESHRLTLG

SEQ ID NO: 16449 - protein, 81 aa, Tursiops truncatus
KTWGPLSFMDVFVDFTWEEWQLLDPAQKHLYRSVMLENYSNLVSLGYQHTKPNIIFQLEQEELWMMQIPSEGHMDEVWEID

SEQ ID NO: 16450 - protein, 81 aa, Tursiops truncatus
WKAWVKKPVTSEDVAVNFNQEEWECLDASQRVLYQDVMSETFRNLMSVDLIAKFEQEEKQWRAGLRPPNGEGLHSGGKREE

SEQ ID NO: 16451 - protein, 81 aa, Tursiops truncatus
SQDLVTFEEVAVDFSQEEWALLDPAQKILYRDVMLENFRNLASVGYHLCKHSLFTEVEQEELRPEQRRILQGAYRDQDTQL

SEQ ID NO: 16452 - protein, 81 aa, Tursiops truncatus
MDPTQRKLHKDVMLENYRNLVSLGLAVSKPDMISHLEDGKGPWVVVRETSKTRYSELETKPTTKNAIPTENISEECLSQET

SEQ ID NO: 16453 - protein, 81 aa, Rhinopithecus roxellana
QGLLTFRDVAIEFSQEEWKCLDPAQRTLYRDVMLENYRNLVSLDISSKCTMKDFSSTAQGNTEVIYTRTLERHHIGDFCFQ

SEQ ID NO: 16454 - protein, 81 aa, Leptonychotes weddellii
AHGMVMFKDVAIDVSQEEWECLNPTQRNLYKDVMLENYSNLVSLGLSISKPAVISSLEQGKEPWMVVREVTGGRCPAALYT

SEQ ID NO: 16455 - protein, 81 aa, Callithrix jacchus
LQGLVTFEDVAVEFTQEEWALLDPAQRTLYKDVMLENCRNLASLGCHVNKPRLISQWEQDKKVMTEERGILPSTCPDLETL

SEQ ID NO: 16456 - protein, 81 aa, Zalophus californianus
CEVSVSFEDVTVDFSREEWQHLDPAQRRLYRDVTLENYSHLRSVGYQVPKPEVIFKLEQGEGPWTLEGETPHQGCSDEATG

SEQ ID NO: 16457 - protein, 81 aa, Callithrix jacchus
CQESVTFEDVAVVFTDEEWSHLVPIQRDLYKEVMLENYKSVVSLGLPVPQPDMIFQLKRGEEPWMVDLHGSEEREWPESVS

SEQ ID NO: 16458 - protein, 81 aa, Acinonyx jubatus
AHRSVTFRDVAIYFSQQEWEYLDSVQKNLYRDVMMENYDNLVSLAEHSISKPDVITLLEQRKEPWMVVGEDTKRWCTDLES

SEQ ID NO: 16459 - protein, 81 aa, Rhinopithecus roxellana
RPRALKFVDVAVYFSPEEWGCLRPAQRALYRDVMRETYGHLGALGFPGPKPALISWMEQESEAWSPAAQDPEKGERLGGAR

SEQ ID NO: 16460 - protein, 81 aa, Rhinopithecus roxellana
PQGLVTFGDVAVDFSQEEWEWLNPNQRNLYRKVMLENYRNLASLGLCVSKPDVISSLEQGKEPWTVKRKMTRAGCPDLKTV

SEQ ID NO: 16461 - protein, 81 aa, Bison bison
MLENYSNLVSVGYQASKSAALSRLERGELWPVEDKVHSRICPEMRKDDCLLQENLQNQSCPKRMEQCHEHNALGNVYQSKN

SEQ ID NO: 16462 - protein, 81 aa, Bison bison
TFKEAVTFTDVAVTFTEEEFGLLDSAQKKLYQDVMLENFRNLVSVGCHPFRHDIFHLEKEKRLWVVKTATQREGKSEEKIQ

SEQ ID NO: 16463 - protein, 81 aa, Bison bison
QGSVTFEDVAVYFSWNEWCLLDEVQIRLYLDVMLENFALVCMLGSCHGVQHAETCSEQNVFAEGASQIRTLRAELSPENTQ

SEQ ID NO: 16464 - protein, 81 aa, Odocoileus virginianus
SQSLLTFEEVAIYFSQEEWELLDPTQKALYNDVMHENYETVISLALFVLPKPKVISCLDQGEEPYIQGSPVFKDNPGELLS

SEQ ID NO: 16465 - protein, 81 aa, Odocoileus virginianus
GQSRVTFEDVAVYFSQEEWCLLDEAQIQLYLDVMLENFALVCMLGSWPGAGDEETPFEQSRSVGVSQIGTPRADSSAEKVQ

SEQ ID NO: 16466 - protein, 81 aa, Odocoileus virginianus
SRESVTFEDIAVDFTQEEWALLDTSQRKLFRDVMLENISHLVSVGNQLYKSDVISHLEQGEQLSREELGFLQGQSPVISDR

SEQ ID NO: 16467 - protein, 81 aa, Cebus imitator
LGYSSFEKDVKIEFSLEEWQCLDTAQRNLYRDVMLENYRNLAFLGIAISKPDLITWLEQGKEPWNMKSHAMVAKPPGRSDS

SEQ ID NO: 16468 - protein, 81 aa, Cebus imitator
FEDVAVLFTRDEWRKLAPSQRNLYRDVMLENYRNLVSLGLPFTKPKVISLLQQGEDPWKVEKDCSGSSFLGCKSNPKMTKT

SEQ ID NO: 16469 - protein, 81 aa, Cebus imitator
LQGPLTFRDVAIQFSPEEWKCLDRAQRTLYRDVMLENYRNLVSVGESNFPPEAETCPWRFQRPRLVHDFGSGFRDQAGQHD

SEQ ID NO: 16470 - protein, 81 aa, Cebus imitator
MLENYFNLISVGCQVPKPEVIFNLEQEEPCMLNGGISSQSCPDGKIGFEPLQQRMSEEVSFQSERINLFTRDDPYSILEKL

SEQ ID NO: 16471 - protein, 81 aa, Cebus imitator
KPGAVSFADVAVYFSPEEWGCLRPAQRSLYRDVMRETYGHLGALGFPGPKPALISWMEQESEAWSSAAQDPEKGESLGGAQ

SEQ ID NO: 16472 - protein, 81 aa, Panthera pardus
AHHLVMFRDVAVDFSQEEWECLNSYQRNLYRDVILENYSNLVSVAGYTISKPDVITLLEQGKEPWMVVRDERRRRSLALRS

SEQ ID NO: 16473 - protein, 81 aa, Tursiops truncatus
PQKSVTFEDVAVYFTQTEWDGLSPAQRALYRDVMLENYGNVASLGFPLLKPTVISQLEGGGELEGPSPLASGTGTGPQGLW

SEQ ID NO: 16474 - protein, 81 aa, Acinonyx jubatus
SQEQVSFKDVCVDFTQEEWYLLDPAQKILYRDVILENYSHLVSVGYCFAKPEVVFKIEQGEEPWILEAGFPSHCHQEDWKV

SEQ ID NO: 16475 - protein, 81 aa, Acinonyx jubatus
TPDVVTFEDVAVCFSSGEWQCLTRAQRHLYTDVMLENYGNMLSAGLACPKPPLISHLEQGAVPCAEDLQDWGFLTCSFPVS

SEQ ID NO: 16476 - protein, 81 aa, Ursus arctos
PQEPVTFADVAVLFTPEEWMFLDSAQRSLYRDVMLENYRNLASVGDQLGKPSTFSHLEPGEERWPPERSSFPGTHPEPQHQ

SEQ ID NO: 16477 - protein, 81 aa, Leptonychotes weddellii
MKMHLPSPSEALSSDNLAHVLCHFPLTGLCVAKPEMIFKLERGEELWILEEESSGHGYPGSLSMLCGNNSVGGNAVRHDND

SEQ ID NO: 16478 - protein, 81 aa, Leptonychotes weddellii
MFPVTFSDVAIDFSHEEWGWLDSAQRDLYKDVMVQNYENLVSLAGLSIPKPYVISLLEDGKEPWMVEKKLSKGMFPDWESR

SEQ ID NO: 16479 - protein, 81 aa, Neophocaena asiaeorientalis
QAEVTFEDVAVLLSREEWGRLGPVQKGLYRDVMLETYRNLVSLGGGPAGPKPEVITQLERGDEPWVPDVQGRERLTIDGSA

SEQ ID NO: 16480 - protein, 81 aa, Odocoileus virginianus
WSQDLVTFEEVSVDFSQEEWALLAPAQKIMYRDVMLENFRNLASVGYHLCKHSLITEVAHEQPRPEGRGIFQSAYTDGATQ

SEQ ID NO: 16481 - protein, 81 aa, Odocoileus virginianus
LSQGLVTFKDVAVCFSQDQWSDLDPTQKEFYGEYVLEEDCGIVVSLSFPIPRLDEISYVREEPLVPDVPEPQEPEEPEILS

SEQ ID NO: 16482 - protein, 81 aa, Pongo abelii
SKAPVTFGDLAIYFSQEEWEWLSPIQKDLYEDVMLENYRNLVSLGLSFRRPNVITLLEKGKAPWMVEPVRRRRAPDSGSKC

SEQ ID NO: 16483 - protein, 81 aa, Pteropus vampyrus
FQASVSFKDVTVELTQEEWQQMGPLQRTLYRDVMLENYNNLVSVGSCIYKPEVIFKLEQGEEPWLLEEEFSNQSYQVLEHY

SEQ ID NO: 16484 - protein, 81 aa, Pteropus vampyrus
QDLVTFEEVVVDFSQEEWALLDPAQKILYRDVMLENLRNLASVGAGYHLCKHSLITELEQEELRTEDRSLRDARSDWDTQL

SEQ ID NO: 16485 - protein, 81 aa, Panthera pardus
SQDLVTFKDVAIDFSQEEWEWLNPAQRSLYKNMMLENYRNLVSLGLCLSKPYVISSLEQGGEPWEKKNEMTESPDLESMYE

SEQ ID NO: 16486 - protein, 81 aa, Panthera pardus
MAEGFKFKDVAIYFSQKEWECLHPSQKGLYRDVMLENYSNLISLGLSDSKPNVISLLEQGKEPWMVNSKETKEWCPDWESR

SEQ ID NO: 16487 - protein, 81 aa, Panthera pardus
TFKEAVTFKDVAVVFTEEELGLLDPTQRKLYREVMLENFGNLVSVGHQPFKRDMVQLVREGKFWMMKLATQGKGNSGDKIQ

SEQ ID NO: 16488 - protein, 81 aa, Panthera pardus
FQDFVSFKDVAVNFTEEEWRELDPVQRVLYRDVMLENYRNLVSLGFPFSKPDIISQLEQAVNPRMQEGEVLRSSCTHLETR

SEQ ID NO: 16489 - protein, 81 aa, Ursus arctos
LLTFRDVAVEFSAEEWECLDPAQRALYRDVMLENYRNLVSLDISVRSMIKELSPKEDINKEELFQRLMLERHKRNDIKNFG

SEQ ID NO: 16490 - protein, 81 aa, Sus scrofa
PKVPVTFDDVAVYFSEQEWGKLDEWQKELYKHVMRGNYETLVSLDYAISKPDILSRMERGEEPCPEGAWGREEGRQSEEAR

SEQ ID NO: 16491 - protein, 81 aa, Sus scrofa
AAVRFADVAVYFSPEEWGCLRPAQRALYRDVMRETYGHLGALGDAANQKEDEPEAGPGAKGPRKTSGKERPEELVKHTPDS

SEQ ID NO: 16492 - protein, 81 aa, Leptonychotes weddellii
SQASVSFKDVTVEFTQEEWRQMGPIQRTLYRDVMLENYNNLVSVGNCIFKPAVIFKLEQGEEPWFLEEEISNQSHREDYRD

SEQ ID NO: 16493 - protein, 81 aa, Neophocaena asiaeorientalis
FQDPVTFEDVAVVFTDEEWRCLVPTQRDLYKEVMLENYKSIVSLGLPVPGPDVIFQLKRGDEPWIVELHGSEGKECAENVS

SEQ ID NO: 16494 - protein, 81 aa, Vicugna pacos
VPLTFKDVAIRFSQEEQEFLDPAQRALYRDVMLETCRNLLTVDLSQMHVIKKLQVKANTDRGDVLQIVMLGGCERNEMKHF

SEQ ID NO: 16495 - protein, 81 aa, Neophocaena asiaeorientalis
SQDSVTFEEVAVDFSQEEWALLDPAQKILYRDVMLENFRNLASVGHHLCKHSLFTEVEQEELRPEQRRILQGAYRDQDTQL

SEQ ID NO: 16496 - protein, 81 aa, Phascolarctos cinereus
AQESLTFKDVAVNFTREEWRHLDLRQRDLYREVMLENYRNLVSLGHHISKPNMISQLEKGKEPWMVESGTSRCTCSNRETR

SEQ ID NO: 16497 - protein, 81 aa, Neomonachus schauinslandi
PQDLMTFEDVAVEFTQWEWGQLDLAQKDLYRAVMLENFKNLASLGLPVSKPYVISQMEEGKEPYVLEGEISTDWEKRPKAK

SEQ ID NO: 16498 - protein, 81 aa, Phascolarctos cinereus
LKETVTFKNVAVDFTQEEWGLLDLPQKELYKGVMLENAWNLLSLGLAVPREDVISYFEQREAPWMLEQEDLRSRCPEEEIR

SEQ ID NO: 16499 - protein, 81 aa, Phascolarctos cinereus
SQGLVTFEDVAVYFSLEEWGRLNEAQKDLYKEVMQENYGILVSLGYPIPKPDVISRMERGEELWVPDSPVPEEGDIVTGVY

SEQ ID NO: 16500 - protein, 81 aa, Macaca nemestrina
QGLLTFRDVAIEFSQEEWKCLDPAQRTLYRDVMLENYRNLVSLDISSKCMLKTLSSTGQGNTEVILIGTLQRQASHHTGEF

SEQ ID NO: 16501 - protein, 81 aa, Tursiops truncatus
SQGLVTFRDVALNFSQEEWEWLDSSQKDLYRDVMLENYRNLVWLGLSVSKPNMISLLEQGKDPCMVEREMSDGQYAEWDSL

SEQ ID NO: 16502 - protein, 81 aa, Acinonyx jubatus
AQESLTFDDVAVNFTWEEWQLLAPAQKNLYRDVMLENYRNLVSLGFYPRKPDVLTKLDQGKPTGTVEDDIPFRTCSEIWKL

SEQ ID NO: 16503 - protein, 81 aa, Tursiops truncatus
GSVSFTDVTVDFTQEEWEQLDPSQRILYMDVMLENYSNLLSVEVWKADDQMERDHRNPDEQARPFIIFKNQTPIEERDNLF

SEQ ID NO: 16504 - protein, 81 aa, Tursiops truncatus
GWVPALFDEVAIYFSDEEWDVLTEQQKALYREVMRMNYETVLSLEFPFPKPDMITRLEREEESQNSDEWQFQGGTFAENEE

SEQ ID NO: 16505 - protein, 81 aa, Acinonyx jubatus
HQEVVTFEDVAVYFSGTEWTGLSPGQKALYRSVMLENYGNLTSLGYQVPRPALISLLEAGNLPWGLEAQDNLSAERTKDIC

SEQ ID NO: 16506 - protein, 81 aa, Cercocebus atys
LQGLVSFEEVAVHFTWEEWQDLDDAQRTLYRDVMLETYSSLVSLGHCITKPEVIFKLEQGAEPWLGEEWANQCLSGVQTVD

SEQ ID NO: 16507 - protein, 81 aa, Sus scrofa
KEAVTFKDVAVAFTEEELGLLDSAQRKLYQEVMVENFRNLVSVGHQPFKRDTSCKERREALDDEFSNPGENSQNQSELRAI

SEQ ID NO: 16508 - protein, 81 aa, Odocoileus virginianus
DPEQVTFEDVVVDFTQEEWGHLEPAQRTLYRDVMLETFRLLVSVGHWLPKPDVISLLEQEAELWAADEGGPQGVCPDLETR

SEQ ID NO: 16509 - protein, 81 aa, Macaca fascicularis
QGRLTFRDVAIEFSLAEWKCLNPAQRALYREVMLENYRNLESVDISSKCMMKEILSTGQGNTEVFHTGTLQRHESHHIGDF

SEQ ID NO: 16510 - protein, 81 aa, Leptonychotes weddellii
PQKSVTFEDVAVYFTQTEWDGLSPAQRALYRDVMLENYGNVASLGFSLLKPAVISQLEGAGELGGPSPLVDGTETGPQGLW

SEQ ID NO: 16511 - protein, 81 aa, Leptonychotes weddellii
PLESVTFEDVVVDFTKEEWALLDISQRKLFRDVMLENIRHLVSLGYQHCKSDVIFPLEQGEELWREGTGFLQGQSPGRESA

SEQ ID NO: 16512 - protein, 81 aa, Odocoileus virginianus
PQAKVTFEDVAVFLSQDEWDRLGPAQRGLYRHVMMETYGNVVSVGIPGSKPEVISQLERGEEPWVLDKQGSEQLRGWGISR

SEQ ID NO: 16513 - protein, 81 aa, Neophocaena asiaeorientalis
WSQMPVTFEDVAVYLSREEWGRLDHTQQSFYRDILQKRNGLSLAGFPFSRPFWASQVQGKGEASGSCQQMGDEEEEKRGAV

SEQ ID NO: 16514 - protein, 81 aa, Odocoileus virginianus
LQDLVTFKDVTVEFNQEEWALLDSSQQKLYRDVMLENYGNLASLGYHVDKPSLISQLEQEDKVMTEEEGILPGTCPDLEMV

SEQ ID NO: 16515 - protein, 81 aa, Phascolarctos cinereus
PQEWVTFKDVAVDFTPEEWGHLSLSQKELYRDVMLENFRNLVCLGLAMSKPDVISQLERGEAPWMPEGNGLRCRLGNKTEN

SEQ ID NO: 16516 - protein, 81 aa, Cercocebus atys
PLSFKDVAVVFTEEELGLLDSTQRQLYRDVMLENFRNLLSVGDKNGRDMEYIQDEELRLFSHEELSSCKIWEEVVGELPGS

SEQ ID NO: 16517 - protein, 81 aa, Ursus arctos
FKETVTFKDVAVVFTEEELGLLDPAQRKLYRDVMLENFRNLISVGGKIQSKMKMILEAEPPEELSCWRIWQQIASDLTRCQ

SEQ ID NO: 16518 - protein, 81 aa, Sus scrofa
KEAVTFKDVAVVFTEEELGLLDLTQRKLYQEVMLENFRNLVSVGGKIQHETETVPEAGPHEELSCWQIWQHIARDLTRCQD

SEQ ID NO: 16519 - protein, 81 aa, Ursus arctos
PLESVTFEDVAIDFTKEEWALLDTSQRKLFRDVMLENIRHLVSLGYQHCKSDVIFQLEQGEELWREGPGFLRGPSPGRESA

SEQ ID NO: 16520 - protein, 81 aa, Ursus arctos
GSVSFTDVTVDFTQEEWEQLDPSQRILYMDVMLENYSNLLSVEVWKADDQVERDRSNPDEQARPFIIFKNQTPIEERGNLF

SEQ ID NO: 16521 - protein, 81 aa, Ursus arctos
LQGQVNFEDVAVYFSQEEWGLLDETQRLLYRDVMLENLALMASLGCWHGMEDEEIAFEQNVSVGVSQVRTPKAGPSTQKAR

SEQ ID NO: 16522 - protein, 81 aa, Ursus arctos
AQESLTFGDVFVDFTLEEWQQLDSAQKNLYRDVTLENYSHLVSVGYLVPKPDEVLRLGRGEEARRAEGEPPTRSYPELGQG

SEQ ID NO: 16523 - protein, 81 aa, Sus scrofa
SQGLLTFEDVAIDFSPEEWECLDLGQRHLYRDVMLEICRHLVSLEYVISKPDLVRLLEQKTDPWDVKGMETVAIQPALSSH

SEQ ID NO: 16524 - protein, 81 aa, Vicugna pacos
FQGSVTFRDVAIAFSQQEWESLDSAQRDLYRDVMLENYSNVVSLAGHSRSKPHVITLLEQCKEPWMVVKKDQRRQYTDFQP

SEQ ID NO: 16525 - protein, 81 aa, Pan troglodytes
MAFEDVAVYFSQEEWGLLDTAQRALYRRVMLDNFALVASLGLSTSRPRVVIQLERGEEPWVPSGKDMTLARNTYGRLNSGS

SEQ ID NO: 16526 - protein, 81 aa, Sapajus apella
MGVLTFRDVAIEFSPEEWECLDSAQQHLYRDVMLENYRNLVSLGLAIFKPDLITCLEQRKEPWNLKKQETVAKYPAGSFLF

SEQ ID NO: 16527 - protein, 81 aa, Rhinolophus ferrumequinum
VTFEDVALYLSREEWGRLDHTQQSFYRDVLQKRNRLALGFPFSRTFWASQVQSKGEASSSCQQTGDEEKRGALEVGKEETP

SEQ ID NO: 16528 - protein, 81 aa, Camelus dromedarius
LQELVTFKDVTVDFTQEEWEHLDPSQRHLYSEVMLENYGNLISVAGHLLSKPEMISHFEQDDVWLELKIPRSSYSGEKLHH

SEQ ID NO: 16529 - protein, 81 aa, Camelus dromedarius
ESVTFRDVAVFFSRDEWLHLNSAQRALYREVMLDNYSALVSLETLRLDLSARVSPHVCTVDSFSFLLMNRDSVFQTKGYPP

SEQ ID NO: 16530 - protein, 81 aa, Ursus maritimus
FQESVTFKDVIVDFTQEEWKQLDPVQRDLFRDVTLENYTHLVSIGLQVSKPDVISQLEQGTEPWIVEPGIPVGTVGDCATR

SEQ ID NO: 16531 - protein, 81 aa, Acinonyx jubatus
KEAVTFKDVAVVFSEEELGLLDPAQKKLYGDVMLENFRNLLSLGGKIQNKMKTVLETEPHKELSCWQIWQQIASDLTQCEG

SEQ ID NO: 16532 - protein, 81 aa, Rhinopithecus roxellana
GLVTFEDVAVDFTQEEWQYLNSPQRTLYRDVMLETYSNLVFVGQQVTKPNLILKLEVEECPAEGKIPFWNFPEVCQVGEQI

SEQ ID NO: 16533 - protein, 81 aa, Acinonyx jubatus
SLESDLFRDVAVVFSQEEWERLAPAQRDLYRDVMLETYSNLVSLGLAISKPDVISFLEQGKEPWMVEKAAAGGLCPGLTLP

SEQ ID NO: 16534 - protein, 81 aa, Acinonyx jubatus
PGALSFADVAVYFSSEEWGCLRPAQRALYRDVMRETYGHLGALESKKKKNEPSSRIRAKELEDPPVKNGPLMKARLVPGFR

SEQ ID NO: 16535 - protein, 81 aa, Rhinopithecus roxellana
QDSVAFEDVAVNFTQEEWSLLDPSQKNLYREVMQETLRNLASLGAKWKDENIEDQYKTPRNNLRSLLGERVNENTEENHCG

SEQ ID NO: 16536 - protein, 81 aa, Rhinopithecus roxellana
QQGYVTFEDVAVYFSQEEWRLLDEAQRLLCRNVMLENFSLLASLGLASSKTHEITQLESWEEPFMPAWEVMTSAIPRGCWH

SEQ ID NO: 16537 - protein, 81 aa, Rhinopithecus roxellana
CYQDSVTFDDLAVDFTPEEWTLLDPTQRNLYRDVMLENYKNLATVGCQLFKPSLISWLEQEESRTVQRGDFQASEWKVQLK

SEQ ID NO: 16538 - protein, 81 aa, Rhinopithecus roxellana
LKGLVTFEDVAVEFTQEEWALLDPAQRTLYRDVMLENFRNLASLGNQVDKPGLISQLEQEDKVMTEERGIFPGACPDVENP

SEQ ID NO: 16539 - protein, 81 aa, Acinonyx jubatus
DPVQVNFEDVAVYFSREEWGLLDEAQRLLYRDVMLENLALTASLGYESSMSLGVASLELGGKPWVSDWADVTPARTREAQG

SEQ ID NO: 16540 - protein, 81 aa, Rhinopithecus roxellana
PQGHLTFMDVAIEFSQDEWKCLDPGQRALYRDVMLENYRNLVSLGICLPDLSIISMLKQRREPLTLQSEVKIVKNPDGREC

SEQ ID NO: 16541 - protein, 81 aa, Bison bison
ESGSLTFADVYIEFSQEEWECLDPAQRTLYRDVMLETYRNLLSSSMTNFNSPSVMFSTHVRFELAILESKLRFCIVYCSLF

SEQ ID NO: 16542 - protein, 81 aa, Bison bison
PQDLVTFKDVAIDFSQEEWEWLSPAQRSLYRSMMLENYQSLVSLGLCISKPYVISLLEQGKEPWMVMENEMRSPFPDWESI

SEQ ID NO: 16543 - protein, 81 aa, Bison bison
EKTVSRSLENDGVCFSEQEWENLEDWQKELYANVMKSNYETLVSLKVLGQPEGEMELGAEMPGDLEEEESRSVHPGEWLQN

SEQ ID NO: 16544 - protein, 81 aa, Bison bison
TELTVEDVDIKFTPEKWECLDPAQRALYWDVMEETYRNNLLSVAEEDLWIVENEVQMSGNQMSCKGVHTGEKPYKYYVCGK

SEQ ID NO: 16545 - protein, 81 aa, Odocoileus virginianus
FQEPVTFEDVAVYFTQNQWASLDSAQRALYREVMLENYANVASLVSPFPRPDLISQLERGEAPWDPNPWEAEDLRGICPGE

SEQ ID NO: 16546 - protein, 81 aa, Odocoileus virginianus
EPVTFEDVAVDFTQEEWQQLWQYPGGVGQKTLRRDVMLEIYSHLVSVGCSDLKLDIISKLEHGKDPWIIESELSRWTYSEE

SEQ ID NO: 16547 - protein, 81 aa, Odocoileus virginianus
MLENYGNLVSLGFPIFKPDGISQLEQDLQVFDLETKNREVLRDDCSDGETREENKLLIPKQKIPEEVHSYKVRVGRFKKDI

SEQ ID NO: 16548 - protein, 81 aa, Odocoileus virginianus
CSGLLSFTDISMQFSWEEWQLLDSVQKHLYRDVTLENYSNLVAIGYHGNKPDLIFKLEQGEEPWIINSKVSHQSCPDGWEE

SEQ ID NO: 16549 - protein, 81 aa, Cebus imitator
FQESVTFQDVAVDFTPEEWQLLDCAERTLYWDVMLENYRNLISVGCPVTKTKVTLKVEQGQEPWMVEGVNPHQSSPESDCP

SEQ ID NO: 16550 - protein, 81 aa, Cebus imitator
QVTFSDVALDFSHEEWGWLDSAQRDLYKDVMVQNYENLVSLAGLSITKPHVITLLEDGKEPWMVEEKLSKECLHILFLIVS

SEQ ID NO: 16551 - protein, 81 aa, Cebus imitator
EGPLTFRDVAIEFSLEEWQCLDTAQQNLYRHVMLENYRNLVFLANIVYCTLDDRERPCYQKKKKKKKKKPLFVCSQDLWPK

SEQ ID NO: 16552 - protein, 81 aa, Macaca mulatta
EPGIVSFADVAVYFCREEWGCLRPAQRALYRDVMRETYGHLGALGIGGNKPALISWVEEEAELWGPAARDPETKCPTETDP

SEQ ID NO: 16553 - protein, 81 aa, Callithrix jacchus
CEASVSFEDVTMAFSREEWQQLDPAQKRLYQDVMLELYSHLFSVGYQIPNPDVVFRRLKEKEPCTEEAELSHQRCQEGEFG

SEQ ID NO: 16554 - protein, 81 aa, Callithrix jacchus
EPGLLTFRDVAIEFSLEEWQCLDAAQRNLYKNVILENYRNLVFLGIAVSKPDLIACLEQEKEPLIMKRDEMADEPPVMCSH

SEQ ID NO: 16555 - protein, 81 aa, Callithrix jacchus
SVASEDVAVNFTLEEWALLDPSQKKLYRDVMRETFRNLACVGKKWEDQSIEDWYKNQGRILSNHVEVGLSESKEHDQCGEA

SEQ ID NO: 16556 - protein, 81 aa, Callithrix jacchus
RWKTEEAVTFKDVAVVFTEEELGLLGPAQRKLYRDVMLENFRNLLSVGHQPFHRDTFHLQREEKFWMMETATQREGNSGPL

SEQ ID NO: 16557 - protein, 81 aa, Macaca mulatta
LTFQDVTIEFSLEEWQCLDTAQQTLYRDVMLENYRNLVFLGIAVSKLDLIACLKQGKESWNMKRHEMKNFKGFMYYYFNIS

SEQ ID NO: 16558 - protein, 81 aa, Monodon monoceros
MRNQSHGLKAPLTGLSITKPAVISSLEQGKEPWMVMREVIGDQFPDLVSKCEAKKLSPERNIYETESSQWAIMEPFKSHSP

SEQ ID NO: 16559 - protein, 81 aa, Callithrix jacchus
WSQNSVSFQEVAVDFSQEEWALLDLAQKNLYKDVMLENFRNLTSVGYELCRHNLISKVDQEELKTDERGILESDCAEWETQ

SEQ ID NO: 16560 - protein, 81 aa, Callithrix jacchus
TCTGCGPPERQEMEEWALLDPSQKTLYRDVMQENFRNLASVGKKWKAQNIYVEYKNLRRNLRNLMGKRLFESKEDHQHGEI

SEQ ID NO: 16561 - protein, 81 aa, Callithrix jacchus
SCVTFEDVFVYFSREEWELLEEAQRFLYRDVMLENFALVATLGFWCETENEEAPSEQSISLEGVSQVRTAESGLFQAHPCE

SEQ ID NO: 16562 - protein, 81 aa, Macaca mulatta
VHGSVTFRDVAIDFSQEEWECLQPDQRTLYRNVMLENYSHLISLGSSISKPDVITLLEQEKEPWIVVRKETSRWYSDLESK

SEQ ID NO: 16563 - protein, 81 aa, Acinonyx jubatus
MMSQGLMAFEDVAVYFSQEEWELLDAAHVMLENFALVSSLGLSASRPRVVLQLERGEEPWVLSGTVVTPARNAQRKPSPGP

SEQ ID NO: 16564 - protein, 81 aa, Rhinopithecus roxellana
VMFDDVAVEFTPEEWVLLDTTQKYLYRDVMLENYMNLASVDFFFCLTSEWEIQPRTKRSSLQQGFLKNQIFTGIQMQTRSY

SEQ ID NO: 16565 - protein, 81 aa, Rhinopithecus roxellana
TAHSLKKVTFEDVWNFLLMDTSNRKLYRDVMLENISHLVSLRYQISKSYIILQLEHGKELWREGREFLQGQSPYRESALRK

SEQ ID NO: 16566 - protein, 81 aa, Rhinopithecus roxellana
YQTPVSFKDVVVGFTQEEWHRLSPAQRALYRDVMLETYSNLVSVGYEGTKPDVILRLEQEEAPWIGGAARPGCHCWEDIWQ

SEQ ID NO: 16567 - protein, 81 aa, Rhinopithecus roxellana
GCAFVAFRDVAVDFTQEEWRLLSPAQRTLHREVMLETYNHLVSLEIPSSKPRLIAQLERGEEPWREERKCSLDLCPESKPE

SEQ ID NO: 16568 - protein, 81 aa, Bison bison
SGMTLSQTQLTVEDVDIKFTPEEWECLDPAQRALYWDVMEETYRNLLSVAGSLPLSHKEVPKACSFTCILELMNRMCLIYI

SEQ ID NO: 16569 - protein, 81 aa, Bison bison
WKGLLSFEDVVLYFTREEWDMLDWAQKALYRDVMLDNYRHVVSLDSEARFQTKELTPKENTSEDLMLWKMSALKQKTAKEP

SEQ ID NO: 16570 - protein, 81 aa, Bison bison
PLKLVTFEDVAVDFTQEEWSLLDKSQKNLFRNVMMETIHHLVSVGYQISKSDVISQLEQGKELWSKAAGGFQGQRPGEHQG

SEQ ID NO: 16571 - protein, 81 aa, Odocoileus virginianus
GRLTFQNVAIDFTQEECECQDLSQRDLYRDVILENYRNLACLGLVVTGLNLVTFLEQLNNPRTIRRIETTAIYPGVSPQDT

SEQ ID NO: 16572 - protein, 81 aa, Odocoileus virginianus
PQGCVTFEDVAVYFSQEEWGLLDEAQRHLYHKVMLENFALTASMVCLHETETKEIPSEQNVSLEALSQVRTPKNSQWREAF

SEQ ID NO: 16573 - protein, 81 aa, Odocoileus virginianus
SEDPVTFQEVSVDFSREEWAQLAPAQKILYQDVMLENYRNLTSVGYHLRKPCLLTQGELRTRKRRLLQDTCADQNSQLKTK

SEQ ID NO: 16574 - protein, 81 aa, Odocoileus virginianus
DPVAFEDVAVNFTLEEWALLGPSQKKLYRDVMRETLSNLALISKDDDIPSLREQVPPAHQCCSQIWNGEREIFGDKWEDHY

SEQ ID NO: 16575 - protein, 81 aa, Odocoileus virginianus
MFQESVTFKDVAVDITQEDWELMRPVQKELYKTVTLQNYWNMVSLGLTVYRPTVIPMLEEPWMVLKEILEGPSPEWETKAQ

SEQ ID NO: 16576 - protein, 81 aa, Cebus imitator
PGSLEMGPLTFMDVAIEFSLEEWQCLDTAQKNLYRTVMLENYRNLVFLDLITCLEKGKEPWNMKMGAKPQVLSYFPKDLWL

SEQ ID NO: 16577 - protein, 81 aa, Cebus imitator
TQGQVTFRDVAIEFSQEEWTCLNPAQRSLYRDVMLENYRNLASLAGISCFDLSIISMLEQRKEPFTLESQVQIAGNPDGWE

SEQ ID NO: 16578 - protein, 81 aa, Cebus imitator
QGHLTFKDVAIEFSLEEWKCLTPSQRALYREVMLENYRNLESVDISSKCMMKKFSLTAQGNTEMFHTGTLETHESHHIGVF

SEQ ID NO: 16579 - protein, 81 aa, Cebus imitator
SPGSVTFTDVAIDFSQDEWEWLNLAQRSLYKKVMLENYRNLVSVGLCISKPDVIFLLEQEKDPWVIKGETTRGLCSDILKM

SEQ ID NO: 16580 - protein, 81 aa, Cebus imitator
MTFEDVAVEFTQWEWGQLNPAQKNLYREVMLENFRNLTLLGFLVSKPYVICQLEEGGEPFMVKREISIGAHSDWERRSKSK

SEQ ID NO: 16581 - protein, 81 aa, Cebus imitator
FQGVLTFRDVAIELSRKEWQCLDTAQQNLYRTVMLENYRNLVFLGIAASKPDLITCLEQGKEPWNVKRHEMVAESPVACSY

SEQ ID NO: 16582 - protein, 81 aa, Macaca mulatta
SQHLVTFEDVAVDFTQEEWTLLDQTQRDLYRDVMLENYKNLIILGSEFCKPSLMSELEQMEELRTGVTGVLQELDLQLKTK

SEQ ID NO: 16583 - protein, 81 aa, Callithrix jacchus
MLMFRDVAIDFSQEEWEGLDLKQRDLYRDVMLENYSNMVSLGFCVYQPDVFSLLEKGKEPWKILRDETRGPCPDMQSRCPN

SEQ ID NO: 16584 - protein, 81 aa, Callithrix jacchus
LPGLLTFRDVAIEFSLEEWQCLDTAQRNLYKNVILENYRNLVFLGIAVSKPDLIACLEQEKEPLIMKRDEMRSSTLTTHKR

SEQ ID NO: 16585 - protein, 81 aa, Macaca mulatta
MLENYRNLVSLGVAISNPDLVTCLEQRKEPYNVKIRKIVARPPAVRSHFTQDRWPVQGIEDSFHNLILRRYEKCRHENLQL

SEQ ID NO: 16586 - protein, 81 aa, Callithrix jacchus
ENGILTFRDVAVEFSPEEWKCLDSAQQHLYRNVMLENYRNLVYLGIAMSKPDLNNHLEERKKPWNVKKQESRTEGDRNTKK

SEQ ID NO: 16587 - protein, 81 aa, Macaca mulatta
CEASVSFEDVTVDFSREEWQHLDPAQRRLYWDVTLENYSHLLSVGYQVPKSEAAFKLEQGEGPWMLAGEAPHQSCSGEAIE

SEQ ID NO: 16588 - protein, 81 aa, Callithrix jacchus
ALALVSFEDVVVTFTGEEWGHLDLAQRTLYQEVMLETFRLLISLGHPVPKPEMIYLLEHGQEPWTEKRGLSQSTCAGEKAK

SEQ ID NO: 16589 - protein, 81 aa, Callithrix jacchus
GSVSFTDVTVDFTQEEWEQLDPSQRILYMDVMLENYSNLLSVEVWKADDQMERDHRNPDEQPRQFIILKNQTPMEERGDLF

SEQ ID NO: 16590 - protein, 81 aa, Macaca mulatta
FQVQLTFRDVTVEFSLEEWQCLDTVQQNLYRDVMLENYRNLVFLGIAVSKPDLVTCLEQGKEPWNMKRHEMVATPPGRFSH

SEQ ID NO: 16591 - protein, 81 aa, Macaca mulatta
QDLVTFDDVAWYLTTGEWFKLDPEQRVLAYYRNVTSVGVPVLNPALVPHLAQGQVLLVSDPSPNTDPAKYSENTSATRHQT

SEQ ID NO: 16592 - protein, 81 aa, Macaca mulatta
VFLGIAVSKPDLITWLEQGKEPWNMKRREMVDKTPVMCSHFTQDVWPEQSIKDSFQKVILRTCGKYGHENLQLRKDHKSVD

SEQ ID NO: 16593 - protein, 81 aa, Macaca mulatta
EKGPLTFRDVAIEFSLEEWQCLDTAQQGLYRKVMLENYRNLVFLAGIAVTKPDLITCLEQRKEPWNIKRHEMVAKPSVICS

SEQ ID NO: 16594 - protein, 81 aa, Macaca mulatta
QGLLTFRDVAVEFSLEEWQCLDTAQRNLYKNVILENYRNLVFLGIAVSKPDLITCLEQEKEPLTMQRHEVVDEPPVMCSHF

SEQ ID NO: 16595 - protein, 81 aa, Macaca mulatta
VTFDDVAVEFTPEEWVLLDTTQKYLYRDVMLENYMNLASVDFFFCLTSEWEIQPRTKRSSLQQGFLKNQIFTGIQMQTRNY

SEQ ID NO: 16596 - protein, 81 aa, Callithrix jacchus
SQGPLTFIDVAIEFSQEEWKCLDPAQRTLYKDVMLENYRNLVSLGVDLPDLSFISMLEQKREPWTLQSEEKIARNPDGREC

SEQ ID NO: 16597 - protein, 81 aa, Callithrix jacchus
TQGQVTFRDVAIEFSQEEWTCLDPAQRSLYRDVMLENYRNLASLAGISCFDLSIISMLEQGKGPFALESQVQRAGNPDGWE

SEQ ID NO: 16598 - protein, 81 aa, Macaca mulatta
SMTFEDVAVNFTPEEWALLDPSQKNLYQEVMQETLRNLASIGKKWKDQNIENEYKNPRSNQRGLMEERLFESEGHQPGEIL

SEQ ID NO: 16599 - protein, 81 aa, Ursus maritimus
CEGSLSFEDVTMDFSREEWQQLDPAQRRLYQDVMGEVYSHLLSLEGVFGLKTSQQKMFEKASCHNDKESEVTRGGPWCSIS

SEQ ID NO: 16600 - protein, 81 aa, Camelus dromedarius
SQGQLTFKDVAIEFSQEEWECLDAAQRALYRDVMLETCRNLLSLGISVSDLNSNPILKQENEPWTVKSDMKISKNQVAGSM

SEQ ID NO: 16601 - protein, 81 aa, Acinonyx jubatus
AQELLTLEDVAVDFSREEWQLLAPAQKDLYRDVMLENYRNLVSVGCQATKRDALSVLEHRDEAWMKAEDEIQGRTRAGIGK

SEQ ID NO: 16602 - protein, 81 aa, Acinonyx jubatus
NPQELLTFNDVAIEFSQEEWGFLNHSQRELYRDVMLENYGHLLLLGLVSKPDLVNFLEQKKEAWDVNGKGTVATHLSAVSS

SEQ ID NO: 16603 - protein, 81 aa, Rhinopithecus roxellana
QGLLTFRDVAIELSQEEWKCLDPAQRTLYRDVMLENYRNLVSLDISSRCVMKTLSSTGQRNTEVIHKGTLQRQASHHIGEC

SEQ ID NO: 16604 - protein, 81 aa, Acinonyx jubatus
FQGWLTFRDVAIEFSQEEWECLDPAQRALYRDVMLENYRNLVSLGEDNFSPEVVPEAKCVKWIHSAVLRLDMPAVYFPQVF

SEQ ID NO: 16605 - protein, 80 aa, Rhinopithecus roxellana
MTVSQGLFTFKDVAIEFSQEEWECLDPAQRALYRDVMLENYRNLLSLDEDNVPPENVFYPVQELRETLVFLISYSSKIYL

SEQ ID NO: 16606 - protein, 81 aa, Acinonyx jubatus
SQSSLTFEEVAMYFSQEEWEFLDPTQEALYNDVMRENYETVISLALFVLPKPKVISYLEQGEEPWVQGSTELKDSPGELPT

SEQ ID NO: 16607 - protein, 81 aa, Rhinopithecus roxellana
NKGPVTLKDVIVEFTKEEWKLLTPAQRTLYKDVMLENYSHLVSVGYHVNKPNAVFKLKQGRKPWILEVEYPHRGFSEDLWS

SEQ ID NO: 16608 - protein, 81 aa, Rhinopithecus roxellana
GLLTFRDVAIEFSQEEWKCLDPAQRTLYRAVMLENYRNLVSLDISSKCKMKEFLSTAQSNREVLHTWTLQRHESHQIGDYC

SEQ ID NO: 16609 - protein, 81 aa, Rhinopithecus roxellana
RVTFKDVAVVFTKEELALLDKAQINLYQDVMLENFRNLISVGDGIKNNILNLQEKGLSYLSQEVLHCWQIWKQRIWDLTVN

SEQ ID NO: 16610 - protein, 81 aa, Rhinopithecus roxellana
IWGPLSFMDVFVDFTWEEWQLLDSAQKCLYRNVMLENYSNLVSLGYQHTKPDIIFKLEQGEELCVVQAQIPNQSCPILKAG

SEQ ID NO: 16611 - protein, 81 aa, Acinonyx jubatus
MLETYRNLVSLGLQRSKPDVISRLEKGEEPWAPRSLRIEESWIRNHRSGSFESLMEKKELTPKQEISKAGESQRAKPEEHA

SEQ ID NO: 16612 - protein, 81 aa, Rhinopithecus roxellana
PQGLLTFRDVAIEFSQEEWKCLDPAQRTLYRDVMLENYRNLVSLAISSKCRMKMFSSTAQGNSEVIHTGALQRHASHHIGE

SEQ ID NO: 16613 - protein, 81 aa, Rhinopithecus roxellana
RNMIPQDNENPPQQGEANQNDLMAFEDVAVNFTPEEWALLDPSQKNLYREVMQETLRNLASIEFLQKRDYLKVKVISVEKF

SEQ ID NO: 16614 - protein, 81 aa, Rhinopithecus roxellana
DSVAFEDVAINFTCEEWALLGPSQKSLYRDVMQETIRNLDCIGMIWQNHNIEEDQYKDLRRNLRCHMVERSCEIKDNSQCG

SEQ ID NO: 16615 - protein, 81 aa, Rhinopithecus roxellana
PQDTVAYEDLCVDYTQKKWKGPALSQRALQWNMMPGNDRIMASLGENMMKGSELTPKQEIFKGSESSNRMGLFGVVPRGAE

SEQ ID NO: 16616 - protein, 81 aa, Rhinopithecus roxellana
RAEEAVTFKDVAVVFTEEELGLLDPAQRKLYQDVMLENFRNLLSVGHQPFHGDTFHFLREEKFWVMETTSQREGNSGKSQT

SEQ ID NO: 16617 - protein, 81 aa, Rhinopithecus roxellana
EMGLLTFRDVAIEFSLEEWQHLDIAQQNLYRNVMLENYRNLAFLGIAVSKPDLITCLEQGKEPWNMIRHEMADESPGICPH

SEQ ID NO: 16618 - protein, 81 aa, Acinonyx jubatus
MLFEDLAVFFSQEECVCLHSVQRSLSRDTTQECFEEMALMGGKGKTEITQQLNLDSMGVEELAPENSSIAVPLVYYPEKSS

SEQ ID NO: 16619 - protein, 81 aa, Rhinopithecus roxellana
PQGLLTFRDVAIEFSQEEWKCLDAAQRTLYRDVMLENYRNLVSLDISSKCMLKTLSSTGEGNREVILTRTLQRQANHHTGD

SEQ ID NO: 16620 - protein, 81 aa, Rhinopithecus roxellana
KVPVTFVDIAVYFSEDEWKNLDEWQKELYNNLVKENYKTLMSLDAEGPVPKPDAPAHPEPREEPCVWEQRHPEEREISMDP

SEQ ID NO: 16621 - protein, 81 aa, Bison bison
MLENYSHLVSVGYCFTKPELIFMLEQGEDPWLLEKEFINRSSPEEFQPDELLEESLENQGKRLRQVLFINKSLTMEQEISG

SEQ ID NO: 16622 - protein, 81 aa, Bison bison
KLQEALTFKDVAVTFTEEELGLLDLAQRKLYRDVMLENFRNLLSVGHQSSKPDMISELEREEFWMTEIQPQRGGCSGGGNH

SEQ ID NO: 16623 - protein, 81 aa, Odocoileus virginianus
QGLFTFRDVAIEFSQEEWECLAPSQRALYRDVMLDTYRNLVSLDDLIGILSAGFAINKLSPRENTNVGELYGNENRGIKDF

SEQ ID NO: 16624 - protein, 81 aa, Odocoileus virginianus
QGGVTFPDVAVCFSQREWRLLDETQRRLYLDVMLENYTLISSLGCCCGAEGEETPCEKTVPVGVSWTGSPTAAPFSQKTHP

SEQ ID NO: 16625 - protein, 81 aa, Cebus imitator
VVFEDVAVDFTLEEWALLDSAQRNLYRDVMLETFRNLASVDDETPCKADRSVSQQDMYGGNISQEQTILNFTRNNSCAYAL

SEQ ID NO: 16626 - protein, 81 aa, Cebus imitator
SKAPITFGDLAIYFSQEEWEWLSPIQKDLYEDVMLENYRNLVSLGLSFRRPNVITLLEKGKAPWMVEPARRRRGPDSGSKV

SEQ ID NO: 16627 - protein, 81 aa, Cebus imitator
ALALVSFEDVIVTFTGEEWGHLDLAQRTLYQEVMLETCRLLISLGQPVPKPELIYLLEHGQELWTVKRGLSQSTCAASFSL

SEQ ID NO: 16628 - protein, 81 aa, Cebus imitator
RESGKAPVTFDDITVYLLQEEWVLLSQQQKELCGSDKLVPPLGPTVANPELFCKFRRGPQPWLGSVQDQRSLLEHHPGKKQ

SEQ ID NO: 16629 - protein, 81 aa, Cebus imitator
GLLTFRDVAIEFSMEEWEHLDSNQKNLYGDVMLENYRNLVCLGLAVSKPDLITFLEQRKEPWNVKSAETVAIQPDVFSHDT

SEQ ID NO: 16630 - protein, 81 aa, Macaca mulatta
GMEPLQFRDVAIEFSLEEWHCLDTAQQNLYRDVMLENYGNLVFLGIVVSKPDLITRLEQGENPLTVKRHEMTANPSVMCSH

SEQ ID NO: 16631 - protein, 81 aa, Macaca mulatta
ARDLVMFRDVAVDFSQEEWECLNSYQRNLYRDVILENYSNLVSLAGCSISKPDVITLLEQGKEPWMVMRDEKRRWTLDLES

SEQ ID NO: 16632 - protein, 81 aa, Macaca mulatta
KSLVTFEDVAVYFSQEEWELLDAAQRHLYHSVMLENLELVTSLGCWHGVEGEEAHPKQNISVEEVLPVRIPNADSSTKKAN

SEQ ID NO: 16633 - protein, 81 aa, Macaca mulatta
MGLLTFMDVAVEFSLEEWQCLDTAQQNLYRNVMLENYRNLVFLAMCSHFAKDLRPEQYIKNSFQQVILRRYGKCGYQNLQL

SEQ ID NO: 16634 - protein, 81 aa, Macaca mulatta
MGLLTFRDVAIEFSQEEWEHLDSDQKLLYGDVMLENYRNLVSLGLLVSKPDLITFLEQRKEPWNVKREETVAVQPDVFSHY

SEQ ID NO: 16635 - protein, 81 aa, Callithrix jacchus
MAATGPCSEAPVQGCDAGELQQLGLCGVPDVQRSWSKFCNFPLTGYHVSKPDVIFKLEQGEEPWIVEEFSNQNYPEVDDAL

SEQ ID NO: 16636 - protein, 81 aa, Macaca mulatta
RESGKAPVTVDDITVYLLQEEWVLLSQQQKELCGSDKLVAPLGPTVANPELFCKFGPGPEPWLGSVQGQRSHLEHHPGKKQ

SEQ ID NO: 16637 - protein, 81 aa, Macaca mulatta
MGPLTFTDVAVEFSLEEWQCLDTAQQNLYRNVMLENYRNLVFLVICSHFAEDFWPEQDIKDSFKKVTLRRYDKCGPENLQL

SEQ ID NO: 16638 - protein, 81 aa, Callithrix jacchus
RPRALKFVDVAVYFSSEEWGCLRPAQRALYRDVMRETYGHLGALGVEGSKPALISWVEEEAELWGPAAQDPEVAKRPTEAD

SEQ ID NO: 16639 - protein, 81 aa, Callithrix jacchus
PQGPLTFRDVAIEFSQEEWRCLDPTQKALYKDVMLENYRNLVFLDLTFKELTILTEREAQKRKKKEKESGMALTQGSLTFK

SEQ ID NO: 16640 - protein, 81 aa, Callithrix jacchus
EMGLLTFRDVAVEFSLEEWQCLNHAQQNLYRDVMFENYRNLVTLGIAVSKPELITCLEGNKESWNIKRNEMVAKHPVTYSY

SEQ ID NO: 16641 - protein, 81 aa, Callithrix jacchus
MSQVTFSDVAIDFSHEEWEWLDSAQRDLYKDVMVQNYENLASLAGLSITKPHVITLLEDGKEPWMVEEKLSKDWESRWTNK

SEQ ID NO: 16642 - protein, 81 aa, Sapajus apella
QGSVTFRDVAIDFSQEEWEFLDPAQRDLYRDVMWENYSNFISLAGPSISKTDVITLLDEEGKEPGMVVREGIRRYCPDLDS

SEQ ID NO: 16643 - protein, 81 aa, Ailuropoda melanoleuca
QESLTFDDVAVDFTWEEWQLLVPAQKELYRDVMLENYRNLVSVGSHTSKPDMLSRFDQGEPSWTVEDDIACRTRSEIWKLD

SEQ ID NO: 16644 - protein, 81 aa, Balaenoptera acutorostrata
FQDPVTFEDVAVVFTDEEWRRLVPTQRDLYKEVMLENYKSIVSLGLPVPGPDVIFQLKRGDEPWIVELHGSEGKECAENVS

SEQ ID NO: 16645 - protein, 81 aa, Balaenoptera acutorostrata
MLENFALIASLGLTSFRSHVVAQLEMGAEPWVPDQVDMTSAMARGAYRGPGSDFCHGTEGEESPAELSVSVEVSQDMNPKV

SEQ ID NO: 16646 - protein, 81 aa, Balaenoptera acutorostrata
QAEVTFEDVAVLLSREEWGRLGPVQKGLYRDVMLETYRNLVSLGAGPTGPKPEVITQLERGDEPWVLDVQGREGPTIDGSA

SEQ ID NO: 16647 - protein, 81 aa, Vulpes vulpes
FQEVVTFKDVAVVFTIEELGLLDSTQRKLYRDVMVENFKNLVSVGRLPFKPDMVSQLEAEEKLWMMERETQRNGYSSEDHV

SEQ ID NO: 16648 - protein, 81 aa, Rhinolophus ferrumequinum
QDQESVTLEDVAVDFTWEEWQLLAPEQKDLHRDVMLENYSNLVSVGYQVSKPDALSRLERGEPWAIEGEAYSQICSEIKKD

SEQ ID NO: 16649 - protein, 81 aa, Rhinolophus ferrumequinum
MSQELLTFRDVFVDFTLEEWQQLDSTQKSLYRDVMLENYSHLVSVGYLVAKPDVIFRLGHGEEAGRADGEPTMQSSPGQSP

SEQ ID NO: 16650 - protein, 81 aa, Acinonyx jubatus
PPVSLTFEDVAVLFTRDEWRKLGPSQRNLYQDVMLENYSNLVSLGLLFSKPKVISLLQQGEDPWKVEKESPGGPSLGYKSS

SEQ ID NO: 16651 - protein, 81 aa, Acinonyx jubatus
AAGSVTFKDVTMAFTQKEWEQLDPVQRNLYKDVMLENYSNLASMGYQAPKPDMISKLEKGEEPWLGKGKTPRQGGPSEIAR

SEQ ID NO: 16652 - protein, 81 aa, Acinonyx jubatus
YLLQGLLTFRDVAIEFSQEEWGCLSHSQQELYRDVMLENYGHLLFLGLVLSKPDLVIFLEQKELWDVKRNHTVASHPGRWE

SEQ ID NO: 16653 - protein, 81 aa, Rhinopithecus roxellana
PQGLLTFRDVAIEFSQEEWKCLDPAQRTLYRDVMLENYRNLVSLDISSKCMLKTLSSTGEGNREVILTRTLQRQANHHTGD

SEQ ID NO: 16654 - protein, 81 aa, Odocoileus virginianus
MFQVTFSDVAIDFSHEEWRWLSSTQRNLYKDVMVQNYENLVSLGLSVPKPYVIALLEDGKEPWMVEEKLSKDMVPDCKSRW

SEQ ID NO: 16655 - protein, 81 aa, Cebus imitator
SQGLVTFGDVAIDFSQEEWEWLSPIQRNLYRKVMLENYRNLASLGLCVSKPDVISLLEQGKEPWTVKRRMTRARCPDTQHL

SEQ ID NO: 16656 - protein, 81 aa, Cebus imitator
PKVPVSFEDVSVYFTKTEWKLLDLRQKVLYKRVMLENYSHLVSLGFSFSKPHLISQLERGEGPWVADIPRTWATKGLLIGD

SEQ ID NO: 16657 - protein, 81 aa, Cebus imitator
VTFEDVVVDFTQEEWGQLEPAQRTLYCDVMLDTFRLLVTVGKATPVFILPLPISPQTLFQTISSKQGISEEISNSVILVER

SEQ ID NO: 16658 - protein, 81 aa, Callithrix jacchus
LTFRDVAIEFSLEEWQCLDTAQRNLYKNVILENYRNLVFLVRTHGHRWKASHTGVCWQRLGEGQQEVWRFRRDNMGRNGRY

SEQ ID NO: 16659 - protein, 81 aa, Callithrix jacchus
FQEAVTFKDVAVAFTEEELGLLDSAQRKLYRDVMLENFRNLVSVGRQSFKPDMISQLEREEKLWMKEFQTQRGRHSGDRNQ

SEQ ID NO: 16660 - protein, 81 aa, Callithrix jacchus
RPRALKFVDVAVYFSSEEWGCLRPAQRALYRDVMRETYGHLGALESKTRKKNGEKEVFPPKEAPRKGKRGRRPSKPRLIPR

SEQ ID NO: 16661 - protein, 81 aa, Callithrix jacchus
TQESLTLEDVAVDFTREEWQLLGPAQKDLYRDVMLENYSNLVAVGYPASKPDALLKLERGEEPCCTTEDEIYTQICSEIRK

SEQ ID NO: 16662 - protein, 81 aa, Callithrix jacchus
KEAFVAFRDVAVDFTQEEWRLLSPAQRTLHREVMLETYNHLVSLEIPSSKPKLIVQLKRGEEPWREERKCSLDLRPAGSKP

SEQ ID NO: 16663 - protein, 81 aa, Macaca mulatta
EMGLLTYRDIAIEFSLAEWQCLDRAQRNLYRDVMLENYRNLVSLGIAVSKPDLIACLEQNKEPRNIKRNEMVSKHPVMCSH

SEQ ID NO: 16664 - protein, 81 aa, Callithrix jacchus
QDSVAFEDVAVNFTHEEWALLGPTQKNLYRDVMQETIRNLNCIGMKWENQNTDDWYQNLRRNLRCDVVERFGKSKDGSQCG

SEQ ID NO: 16665 - protein, 81 aa, Macaca mulatta
MLENYRNLGFLGLCLPDLNIISMLEQGKEPWTVVSQVKIARNPNWGECMKGVITGIYPKRVIKELPPIQNNNTGEKFQTVM

SEQ ID NO: 16666 - protein, 81 aa, Macaca mulatta
MGSLRFRDVAIEFSVEEWQCLDTAQRNLYRNVMLENYRNLVFLGIAVSKLDLIACLKQGKESWNMKRHEMVTKPPVTRSHF

SEQ ID NO: 16667 - protein, 81 aa, Callithrix jacchus
KTGPLTFRDVAIEFSLEEWQCLNPAQQDLYRKVMLENYRNLVFLGIAVSKADLITCLQEEKDPWNMKRHSMAATPPDGISP

SEQ ID NO: 16668 - protein, 81 aa, Callithrix jacchus
MELLTFRDVAIEFSSEEWKCLDPAQQNLYRDVMLENYRNLVSLGVALSNPDLVTCLEQRKEPYNVKIHQTVARSPAMCSPF

SEQ ID NO: 16669 - protein, 81 aa, Ursus maritimus
RLTFRDVAIEFSQEEWECLDPAQRELYRDVMLENYRNLVSLDVSPTHVIKKLQPKENSNTREVFQTAMLERHEGHEIKDFY

SEQ ID NO: 16670 - protein, 81 aa, Ursus maritimus
WSQDSVTFEEVAVDFSQEEWALLDAAQKILYRDVMLENYRNLASVGYPLCKHSLITEVKQEALGTEEGGILQGACTDWDIQ

SEQ ID NO: 16671 - protein, 81 aa, Rhinopithecus roxellana
FQGPLTFRDVTVEFSLEEWQCLDTVQQNLYRNVMLENYRNLVFLGIAVSKPDLITCLEQGKEPWNMNRYEMVAKPPVMCSH

SEQ ID NO: 16672 - protein, 81 aa, Rhinopithecus roxellana
SQTLVTFKDVFVDFTREEWKLLDTAQQSVYRNVMLENYKNLVSLGYQLTKPDVILRLEKGEEPWLVERGIHQEAHPDSETA

SEQ ID NO: 16673 - protein, 81 aa, Rhinopithecus roxellana
MESVTLEDVAVEFIQEWALLGSARRSLCRYGMLDQCRTLTSRGTPPCKPSRVSQLGPRAEPRATERGILHATGVAWESQLK

SEQ ID NO: 16674 - protein, 81 aa, Rhinopithecus roxellana
FQEAVTFKDVAVVFSREELRLLNLTQRKLYRDVMVENFKNLVAVGHLPFQPDMVSQLEAEEKLWMMETETQRSSQHQNKME

SEQ ID NO: 16675 - protein, 81 aa, Rhinopithecus roxellana
MFQEAVTFNDVAVAFTEEELGLLGPAQRKLYRDVMVENFRNLLSVGHQPFKQDVSPIERNEQLWMTTATQRQRNLDTLLVK

SEQ ID NO: 16676 - protein, 81 aa, Rhinopithecus roxellana
AQGSVTFEDVAVYFSWEEWDLLDEAQKRLYFDVMLENFALTSSLGLTSSWSHVVAQLGLGKVSSVLHRMFMTPASARWDQR

SEQ ID NO: 16677 - protein, 81 aa, Rhinopithecus roxellana
TQGHLTFRDVAIEFSQEEWKCLDPAQRALYKDVMLENYRNLVSLGISLPDLNINSMLEQRREPWSGEREVKIAKNSDGKGH

SEQ ID NO: 16678 - protein, 81 aa, Acinonyx jubatus
PAATSFHPPRIQEEWGLLDRSQKELYWDAMLEKYGTVVSLAGLPAPLPEARVESEPGVLRSGTEGQRSLHPGECFSMRSEP

SEQ ID NO: 16679 - protein, 81 aa, Bison bison
TQLTVEDVDIKFTPEEWECLDPAQRALYWDVMEETYRNLLSVDVSHIHMTKKLQAKGNSGKGKNFQTVMFGRAETHEIKDF

SEQ ID NO: 16680 - protein, 81 aa, Bison bison
MDPTQRDLHKDVMLENYRNLVSLGLAISKPDMISHLENGKGPWVVVREISRTPFSELETKPTTKNTIPTEDFSKKHLSQDA

SEQ ID NO: 16681 - protein, 81 aa, Bison bison
ESVTFKDVAVLFTQDEWAQLSPAQRALYRDVMLENYSNLVSLDWVITPTNKKSILKADIPEGELGQWMIKERFTRDSCWKY

SEQ ID NO: 16682 - protein, 81 aa, Bison bison
LLTFEEVAMYFSQEEWELLDPTQKALYNDVMQENYETVISLAVPAHQLLAFPKQTNTSEWTVAPELILPESQSLLTFEEVA

SEQ ID NO: 16683 - protein, 81 aa, Bison bison
ETLTFRDVFVDFTQEEWQQLDAAQKNLHRDVMLENYSHPVSVGYLVAQPHGIFRLGQGEEEAGMAAGESPLWSCPGKPMSG

SEQ ID NO: 16684 - protein, 81 aa, Cebus imitator
GSVTFEDVAVYFSWEEWDLLDETQKHLYFDVMLENFVLTSSMGYWRGLEHEEAPSSSRISVKGVPQFRTSEGSSSQNAYSC

SEQ ID NO: 16685 - protein, 81 aa, Cebus imitator
GSCRASVSFEDVTMDFSREEWQQLDPAQKRLYQDLYSHLFSVGYQIPNPDVIFRRLKEKEPCMEEAEFSHQRCQGLAQLGP

SEQ ID NO: 16686 - protein, 81 aa, Cebus imitator
PARGMTFEDVAIYFSQEEWELLDEAQRFLYCDVMLENFAHVTSLGYCHGTENEAIASEQSVSLQVRTSQGDTPTQKTHLSE

SEQ ID NO: 16687 - protein, 81 aa, Cebus imitator
DSVAFEDVAINFTCEEWALLGPSQKSLYRDVMQETIRNLDCIGMKWQNLNIEEDKYKNPGRNLRCFMVERSCEIKDNSQCG

SEQ ID NO: 16688 - protein, 81 aa, Cebus imitator
TSQESLTLEDVAVEFTLEEWQLLGPSQKDLYRDVMLENYSNLVSVGYQASKPDVLSMLEQGEPWTTENEIHSQICPEIKKV

SEQ ID NO: 16689 - protein, 81 aa, Macaca mulatta
GTATFQDMAVNFPQKKWSLLSEVRRCLYRDVMLENLALISSLGCWCGVEDEEGPSKQSIYIQRETQIRIPMAGVSLKKAHP

SEQ ID NO: 16690 - protein, 81 aa, Callithrix jacchus
PKVPVTFDDVAVHFSEQEWGNLSEWQKELYKNVMRGNYESLVSMDYAISKPDLMSQMERGERPTMQEQEDSEEGEAPTDPS

SEQ ID NO: 16691 - protein, 81 aa, Callithrix jacchus
MLVSFKDVAVTFTQEEWRQLDPAQRTLYQEVMLETCGLLVSLGDKAQVQTREPTTYPPVLSERAFLRGSLTLECSSDSRLG

SEQ ID NO: 16692 - protein, 81 aa, Monodon monoceros
MLENYRNLASLRHQLSKPPLITQMEQEDEMETVERRIHQDTCSDELILLKAKQPQQKQGILEKYTLNGKKEQTLGGNPIQC

SEQ ID NO: 16693 - protein, 81 aa, Macaca mulatta
QEEWALLDPAQKNLYKDVMLENFRNLASVGYQLCRHSLISKVDQEELKTDERGILQGDCADWETRLKSKDAIAVQNIPGGK

SEQ ID NO: 16694 - protein, 81 aa, Callithrix jacchus
IQGLLTFGDVAVAFTRIEWRHLDAAQRALYRDVMLENYGNLVSVGLLSSKPKLIAQLEQGAEPWMEVREAPSGTRAVPDYW

SEQ ID NO: 16695 - protein, 81 aa, Callithrix jacchus
EMEPLTFRDVAIEFSPEEWQCLDTAQQNFYRNVILENYRNLPFLDRQATSSSSSLTPQSGKSTKMGKKQHKKDETIKDQNT

SEQ ID NO: 16696 - protein, 81 aa, Callithrix jacchus
FQELVTFRDVAIDFSGQEWEYLDPHQRDLYRDVMLENYRNLVSLGHSISKPVLVDLLEQGKEPWMILREETQFPGKEDRGH

SEQ ID NO: 16697 - protein, 81 aa, Aotus trivirgatus
TSQESLTLEDVAVEFTWEEWQLLGPSQKDLYRDVMSENYSNLVSVGYQASKPDALSKLEQGEPWTIENEIHSRICPEIKKV

SEQ ID NO: 16698 - protein, 81 aa, Sapajus apella
AQESLTLEDVTVEFTWEEWQLLDPFQKDLYRDVMLEIYSNLVSVGFQVSKPDALSKLEQGEEPWIIEDERHSRICPENNKV

SEQ ID NO: 16699 - protein, 81 aa, Balaenoptera acutorostrata
SQVSVTFEDVAVLFTRDEWRKLAPSQRNLYQDVMLENYSNLVSLGLPFSKPKVISLLQQGEDPWKVEKESPGGSSLGWKNS

SEQ ID NO: 16700 - protein, 81 aa, Callorhinus ursinus
PQEPVTFEDVAVYFTQNQWASLDPMQRALYREVMLENYASVASLAFPFPKPDLVSQLERGEAPWSPDPWEAEVLKGTCPGG

SEQ ID NO: 16701 - protein, 81 aa, Callorhinus ursinus
KDQESLTLEDVAVDFTWEEWQLLAPTQKDLYRDVMLENYRNLVSVGYVARKPDALSRLEQGELWTTEHEIPSRICPEIKKD

SEQ ID NO: 16702 - protein, 81 aa, Callorhinus ursinus
MLENYRNLLSLGLCISKPDVIALLEQGKEPWMMKGEMTGGLCPDLEYIWMTKELSPNQGIYEEKLSQAMIMESLPSCDLKC

SEQ ID NO: 16703 - protein, 81 aa, Vulpes vulpes
LQEPVTFADVAVLFTPEEWMFLDSAQRNLYRDVMLENYRNLASVGDQLGKPSMFSHLEPGEELWPTERRIFPGTHPEPPIQ

SEQ ID NO: 16704 - protein, 81 aa, Callorhinus ursinus
GLVTFSDVAIDFSQEEWACLDSTQRDLYWDVMLENYSNLVSLDLESPYGTKSLPTEKGIYEINLSKWNSDGKSKSLGLDWM

SEQ ID NO: 16705 - protein, 81 aa, Callorhinus ursinus
IQEPVTFKDVAVDFTQEEWGRLDPVQRTLYRDVMLETYRHLLSVGNQIAKPEVISLLEQGEEPWSVEQAYPQSTCPAVDTE

SEQ ID NO: 16706 - protein, 81 aa, Callorhinus ursinus
SHTLVTFKDILVNFTREEWKLLDTAQQIMYKDVMLENYKNLISLGHQLPKPDVILQLEKGEEPWLVERGIHRETHPDLETA

SEQ ID NO: 16707 - protein, 81 aa, Rhinolophus ferrumequinum
GSVTFRDVAIDFSQEEWECLDPAQRALYMDVMLENYSNLVSLDLESTYETKNTCSGKNIFEIKFSQWEIKERNKTLGLEAS

SEQ ID NO: 16708 - protein, 81 aa, Ursus maritimus
CEVSVSFEDVTVDFSREEWQQLDPAQRRLYQDVTLENYSHLLSVGYQVPKPEVIFKLEQGEGPWTLEGETPHQSCSDEGIG

SEQ ID NO: 16709 - protein, 81 aa, Colobus angolensis
MGPLTFRDVKIEFSLEEWQCLDAAQRNLYRDVMLENYRNLVFLGIAVSKPDLITWLEQGKEPWNMKRREMVDKTPVMCSHF

SEQ ID NO: 16710 - protein, 81 aa, Phyllostomus discolor
SQGLVSFKDVAVDFTQEEWQQLDPAQRTLYRDVMLENYSHLVSMGHPVSKPDVIAKLEQGEDPWIIKRDISNWLFPDRKHR

SEQ ID NO: 16711 - protein, 81 aa, Acinonyx jubatus
MLENYSNLVSLGLLFSKPKVISLLQQGEDPWKVEKESPGGPSLGWKGSHKTTKSTQTQDSSFQELIMRRSKRNGPWDFKSE

SEQ ID NO: 16712 - protein, 81 aa, Rhinopithecus roxellana
EKETLTFRDVAIEFSLEEWECLNPAQQNLYMNVMLENYKNLVFLAGIAVSKQDPVTCLEQEKEPWNTKRHEMVDEPPAMCS

SEQ ID NO: 16713 - protein, 81 aa, Rhinopithecus roxellana
VTFKDVAVTFTQEEWRQLDLTQRTLYREVMLETCGLLVSLGDRTQVHTREPTTYPPVLSERAFLRGSLTLESSTSSDSRLG

SEQ ID NO: 16714 - protein, 81 aa, Bison bison
HLTFKDVAIEFSQEEWEYLHPAQRALYRDVMLETYRNLLSVAVCHIHVIKKLKPKANSDTGVFQRVMLGRYKSQEVRDFYF

SEQ ID NO: 16715 - protein, 81 aa, Bison bison
EVLKDPSEGSITFEDVAVYFSSEEWALLDEAQKLLYCDVMLENFALTASLEDKPVTGFLFALISFEDVAITFTGEEWRHLD

SEQ ID NO: 16716 - protein, 81 aa, Bison bison
HQEVVTFEDVAIYFTRTEWAGLSPAQRALYRSVMLEIYRSLTSLGYPVPKPALISLLERGDLPVGLETQDNPPAQGTRDIY

SEQ ID NO: 16717 - protein, 81 aa, Bison bison
SVTFEDVAVYFSWEEWRLLAEAQRSVYLDVMLENYALIASLGCCCGTEKAEAPSEQITSLGVSQARTSKAALSSQKIHPCE

SEQ ID NO: 16718 - protein, 81 aa, Odocoileus virginianus
TSEPVSFADVAVYFSPEEWACLRPAQRALYRDVMRETYGHLGALGFRGTKPALISWVEEEAELWGPDAGPPEMGECLTEAD

SEQ ID NO: 16719 - protein, 81 aa, Odocoileus virginianus
MDPTQRDLHKDVMLENYRNLVSLGLAISKPDMISHLEDGKGPWVVVREISRTPFSELETKPTTKNTIPMEDFSKRQLSQEA

SEQ ID NO: 16720 - protein, 81 aa, Cebus imitator
GTVTFEDVAVHFSWEEWGLLDEAQRCLYRDVMLENLALLTSLDVHYQKQHLREKHFRSNVDRALFVKTCIFHVSGETSTCK

SEQ ID NO: 16721 - protein, 81 aa, Cebus imitator
MGLLTFRDVAIEFSVEEWEHLEPAQKNLYWDVMLENYRNLVSLGLAVSKPDLITFLEQRKEPWNAKSAETVAIQPDMFSHY

SEQ ID NO: 16722 - protein, 81 aa, Cebus imitator
EPGAVSFGDVAVYFSREEWGCLRPAQRALYRDVMRETYSHLGALGVGGSKPALISWMEEEAELWVPAAQDPEVAKCPTEAD

SEQ ID NO: 16723 - protein, 81 aa, Cebus imitator
SQTLVTFKDIFVDFTREEWKLLDTAQQIVYRNVMLENYKNLVSLGYQITKPDVILRLEKGEEPWVVERGILQETHPDSETA

SEQ ID NO: 16724 - protein, 81 aa, Cebus imitator
ESVAFEDVAVYFTQNQWGSLDPAQRALYREVMLENYANVASLVAFPFPKPALISHLEKGEAPWGPDPWDAEIPSGISQGGE

SEQ ID NO: 16725 - protein, 81 aa, Callithrix jacchus
ETLTFRDVAIEFSLEEWQCLDTAQQSLYRNVMLENYRNLVFLGIAVSKQNPVTCLEQGKEPQNMIRYEIMAKPTVLCSHFG

SEQ ID NO: 16726 - protein, 81 aa, Callithrix jacchus
ISFEDVAVDFTLEEWQLLNPTQKNLYREVMLENYSNLVFLEVWLDNPKMWLQDNQDNLKSMERGNKYGVFGNIFKSSINFV

SEQ ID NO: 16727 - protein, 81 aa, Macaca mulatta
QEQVSFEDVCVDFTQEEWYLLDPAQKILYRDVILENYSNLVSVGYCITKPEVVFKIEQGEEPWILEKGFPSQCHPERKWKV

SEQ ID NO: 16728 - protein, 81 aa, Callithrix jacchus
QCLDTAQRNLYKNVILENYRNLVFLGIAVSKPDLIACLEQEKEPLIMKRDEMAGEPPVMCSHFAQEFWPEQNIQDSSQNMT

SEQ ID NO: 16729 - protein, 81 aa, Callithrix jacchus
SYEGSVSFRDVAIDFSREEWRHLDPSQRNLYRDVMLETYSHLLSVGYQVPEAEVVMLEQGNEPWALQGERPHQSCPGEKLW

SEQ ID NO: 16730 - protein, 81 aa, Pan troglodytes
SVAFEDVAVNFTQEEWALLSPSQKNLYRDVTLETFRNLTSVGIQWKDQDIENLYQNLGIKLRSLVERLCGRKEGNEHRETF

SEQ ID NO: 16731 - protein, 81 aa, Pan troglodytes
WSQMPVTFEDVALYLSREEWGRLDHTQQNFYRDVLQKKNRLSLGFPFSRPFWAPQAHGKGEASGSSRQAGDEEEWRGACTG

SEQ ID NO: 16732 - protein, 81 aa, Bos taurus
DSLLPQEIIIKVEGEDARSLAVPSQEGVNFKIVTVDFTQEEEGTLSSAQRTLDRDVILENHGDSWDLVHKSFWPLPLNHEF

SEQ ID NO: 16733 - protein, 81 aa, Vulpes vulpes
MNSSQEEWYLLDPAQKILYRDVILENYSHFVSVGYCITKPEVVFKIEQGEEPWILEAGFPSHCHQEDWKVADLIESSQNNE

SEQ ID NO: 16734 - protein, 81 aa, Rhinopithecus roxellana
MLENYRNLLSLGIAVSKPDLITCLEQRNEPWNVKKHETIGRHPAVSSHFTQDLLPEHSIKDSFQKVILGRYGSCGTENLHL

SEQ ID NO: 16735 - protein, 81 aa, Acinonyx jubatus
AQDSVSFEDVAVYFSWEEWRLLDEAQRCLYHNVMLENFALISSLGCCCGAEDAEAPLEQSVSVGVSQASTPKAALSSRKTH

SEQ ID NO: 16736 - protein, 81 aa, Rhinopithecus roxellana
TEGLVMFEDVAVYFSREEWGLLNVTQKGLYQDVMLENFALVSSLGLAPSRSPVFSQLENDEQSWVPSWVDVTPVSRAEARR

SEQ ID NO: 16737 - protein, 81 aa, Rhinopithecus roxellana
GLLTFRDVAIEFSQEEWKCLDPAQRTLYRDVMVENYRNLVSLDISSKCKMKEFLSTAQSNREVLHTWTLQRHESHQIGDYC

SEQ ID NO: 16738 - protein, 81 aa, Bison bison
VTFRDVAVFFSRDEWLCLDSAQRTLYQEVMLENYSTLFSLGWESLFETRISEEENQEVMNQLLGDGPFDFRLGKIYINEET

SEQ ID NO: 16739 - protein, 81 aa, Odocoileus virginianus
AQGCVTFEDVTIYFSQEEWGLLDKAQRLLYCDVMLENFALIASLGLTSFRSHIVAQLEMGAEPWVPDQVDMTSSMARGVYR

SEQ ID NO: 16740 - protein, 81 aa, Odocoileus virginianus
MLENYSNLVLLGYQVIKPEMIFKLEQEKPWLLDEEILSQNFSEKVWLDNDLKMWHQDNQDKLKSLERGHEYDIFERMFHLG

SEQ ID NO: 16741 - protein, 81 aa, Odocoileus virginianus
RLTFKDVAIEFTPEEWECLDPAQRALYREVMVETLRNLLSVDTSPRRVMKGSAPKQSSHTGGILQTALSERHKSHDTKDHG

SEQ ID NO: 16742 - protein, 81 aa, Odocoileus virginianus
TARSQASVTFKDVAMDFTPEEWGRLDPAQRDVMLENYRNLVSLWLPVSKPENHSLENGKEQLLLERKAPKSSCSDSETSPR

SEQ ID NO: 16743 - protein, 81 aa, Cebus imitator
IMEEAVTFKDVAVFFTEEELGLLDLAQRKLYRDVMLENFRNLLSVGHQPFQDVFHFLRGEKFWMMETATQREGNSGGKIQT

SEQ ID NO: 16744 - protein, 81 aa, Cebus imitator
KKKPVTFEDVAVNFTQEEWDFLDASQRVLYQDVMSETFKNLASVARMFLHKPELITKLEQQEKQWRVFLHLPNTEGLSEGK

SEQ ID NO: 16745 - protein, 81 aa, Cebus imitator
DSMTFEDIVVDFTREEWALLDTSQRKLFRDVMLENISHLVSIGKEGDIKHQEIPFIQHIDQKDTSTISTMRSHTQDDPFLC

SEQ ID NO: 16746 - protein, 80 aa, Cebus imitator
LCGPFGLKMGVLTFRDVATEFCLEEWQCLDTAENVMLENYRNLVFLGIAASKPDLITYLEQGKEPWNVKRCEMVVEPPAF

SEQ ID NO: 16747 - protein, 81 aa, Callithrix jacchus
TMGVLTFRDVAIEFSRKEWQCLDTAQRNLYRNVMLENYRKLVFLGIAASMPDLITCLDQTPSCIFLFCPRSLAKAGFLHIK

SEQ ID NO: 16748 - protein, 81 aa, Macaca mulatta
DSVTFDDVAVDFTQEEWTLLDPTQRSLYSDVMLENYKNLATVGWEMQLETQWSTLQQDSLTGQTSIGMQLEGKHNGGELCD

SEQ ID NO: 16749 - protein, 81 aa, Macaca mulatta
PGIVSFADVAVYFCREEWGCLRPAQRALYRDVMRETYGHLSALADSRNKEEERQREGMEALEKPVPVATGSPGLKAPQAPL

SEQ ID NO: 16750 - protein, 81 aa, Callithrix jacchus
FQESVAFEDVAVYFTQNQWASLDPAQRALYREVMLENYANVTSLVAFPFPKPALISHLEKGEAPWGPDPWDAEIPRGISQG

SEQ ID NO: 16751 - protein, 81 aa, Zalophus californianus
SVAFQDLAVRFSEEEWQLLGEGQRALYRDVMRENYETLRSLGTDELLPLSAFLSPTEPGGATEGRSYAGEGQEPPRGGGPL

SEQ ID NO: 16752 - protein, 81 aa, Zalophus californianus
MLETYRNLVSLGAGPAGPKPGVITQLERGDEPWVLDAQGAKGKERLRVSISGHGTRTEYKELSSGEMLDEEELDQLQRAVP

SEQ ID NO: 16753 - protein, 81 aa, Delphinapterus leucas
QAEVTFEDVAVLLSREEWGRLGPVQKGLYRDVMLETYRNLVSLGAGPAGPKPEVITQLERGDEPWVPDVQGRERPNIDGSA

SEQ ID NO: 16754 - protein, 81 aa, Zalophus californianus
FQELVTFRDVAIDFSRQEWEYLDPIQRDLYRDVMLENYRNLVSLGHSISKPDVVDLLEQGKEPWMILREETQGEYTDLDLH

SEQ ID NO: 16755 - protein, 81 aa, Pan troglodytes
SLGSVTFTDVAIDFSQDEWEWLNLAQRSLYKKVMLENYRNLVSVGLCISKPVVISLLEQEKDPWVIKGGMNRGLCPDLECV

SEQ ID NO: 16756 - protein, 81 aa, Pan troglodytes
PQGLLTFRDVAIEFSQEEWKCLDPAQRTLYRDVMLENYRNLVFLDTSSKCMMKMFSSTGQGNTEVVHTGTLQIHASHHIGD

SEQ ID NO: 16757 - protein, 81 aa, Sapajus apella
MAFEDVAVYFSQEEWGLLDTAQRALYRRVMLDNFALVASLGLSTSRPRVVIQLERGEEPWVPSGTDMTMSRNTHRRRNSGF

SEQ ID NO: 16758 - protein, 81 aa, Pan troglodytes
QFHGVTFEDVAVDFTQEEWQQLNPTQKTLHRDVMVETYNHLVSMGCSGIKPDVIFKLEHGKDPWIIESELSRWIYPDRVKG

SEQ ID NO: 16759 - protein, 81 aa, Muntiacus muntjak
TLKEAVTFTDVAVTFTEEELGLLDLAQKKLYQDVMLENFRNLVSVGCHPFRHDIFHLEKEKRLWVVKTATQSEGKSEEKIQ

SEQ ID NO: 16760 - protein, 81 aa, Ovis aries
PQESVTLKDIAVDFTKEEWALLDASQRKLFREVMQESISHLVSVGYELCKSDVISQLEQGAELWKEEKGFPQCPSSDRKSD

SEQ ID NO: 16761 - protein, 81 aa, Ovis aries
LQDLVTFEDVTVEFTQEEWALLDSSQRKLYRDVMLENCRNLAWLGYHVDKRSLISQLEQEDKVITEEGGILPGTCPDLETV

SEQ ID NO: 16762 - protein, 81 aa, Ovis aries
AQLTFKDVAIEFTQEEWECLDPAQRALYRDVMVETLRNLVSLDISHILVIKKLQLNEKTDRGEEFQTVILGRHERNKIKNF

SEQ ID NO: 16763 - protein, 81 aa, Callorhinus ursinus
LQDTFSFEDLSVDFTQKEWQLLDPSQKDLYKDVMLENYSSLVSLGYEVMKPDVIFKLEQGEEPWIGDGEVPSSDRPEQVLQ

SEQ ID NO: 16764 - protein, 81 aa, Rhinolophus ferrumequinum
GWGTFEDVAVFFSQEEWELLDEAQRCLYHNVMLENLALVASLGCWCGAEETRPEQGVSIQGMLQFRTPEAGLSTQKVNPCD

SEQ ID NO: 16765 - protein, 81 aa, Acinonyx jubatus
QVSVTFDDVAVTFTQEEWGQLDPAQKTLYQEVMLENCGLLVSLGPGSSAGTREAVRVVLLGGWQFCPQEPFGNVCGHSGLS

SEQ ID NO: 16766 - protein, 81 aa, Rhinopithecus roxellana
EMGPLTFRDVAIEFSLEEWQCLDTSQQNLYRNVMLDNYRNLVFLGIAVSKPDLIICLEQGKEPCNMKRHAMVVKPPVVCSH

SEQ ID NO: 16767 - protein, 81 aa, Rhinopithecus roxellana
QRGSLSFEDVAVDFTREEWQSLDWSQKVLYKEVMLENYSNLVSVGYQGTKPDSLFKLEQGEPPWIVEGAAHSQTCPGFVIQ

SEQ ID NO: 16768 - protein, 81 aa, Bison bison
SLEEIATLKDIAMDFTSENWEQLGQGQGDLFWDTALDNYWNLFLLNPPGPNLTFHPDGGEKLEALVKESPESTDTGIAETS

SEQ ID NO: 16769 - protein, 81 aa, Bison bison
CVTFEDVTIYFSPEEWGLLDEAQRLLYCDVMLENFALIASLDFYCGTESEESPAELSVSVEVSQNMNSKAVPSTQKGYPCN

SEQ ID NO: 16770 - protein, 81 aa, Odocoileus virginianus
LQELVTFKDVAVDFTEEEWEHLDPSQRHLYREVMLENFGNLISLAGHLLSEPEMIFHFEQEDDVWMEETISRSSYSGVRDE

SEQ ID NO: 16771 - protein, 81 aa, Odocoileus virginianus
PKVPVTFDDVAVYFSELEWGKLDEWQKELYKHVMRGNYEMLVSLDYAISKPDILTRMEKGEEPCPEGPWGGEEGNEREEAC

SEQ ID NO: 16772 - protein, 81 aa, Odocoileus virginianus
MSQESLTFQDVAVDFTREEWDQLYPAQKNLYRDVMLENYRNLVALGHQLCKPEVITQLEQEERWMMGRVSPPDTHPDGENR

SEQ ID NO: 16773 - protein, 81 aa, Cebus imitator
EDALMGFWDVAVAFTQKEWKLLSSAQRTLYREVMLEESKHLLDLLGIAFSKPKLITQLEQGDEPWREENKHLLDLCPEPRT

SEQ ID NO: 16774 - protein, 81 aa, Cebus imitator
IQGLLTFGDVAVAFTRIEWRHLDAAQRALYRDVMLENYGNLVSVGLLSSKPKLIAQLEQGAEPWMEMREAPSGTRAVPDYW

SEQ ID NO: 16775 - protein, 81 aa, Cebus imitator
PQGHLTFTDVAIEFSQEEWKCLDPAQRALYKDVMLENYRNLVSLGISLPDLNINSMLEQRRELWSGESEVKIAKSSDRREC

SEQ ID NO: 16776 - protein, 81 aa, Cebus imitator
SLEMGVLTFMDVAIESSLEEWQCLDAAQQNLYMDVMLENYRNLVFLGIAASKPDLITCLEQGKEPWNVTRHETVAELPGLQ

SEQ ID NO: 16777 - protein, 81 aa, Cebus imitator
QVPVTFVDIAVYFSEDEWKNLDEWQKELYNNLVKENYKTLMSLDADGPVPKPDAPAQAEPREEPCVWEQRHPEEREIPMDP

SEQ ID NO: 16778 - protein, 81 aa, Cebus imitator
QYLIAFEDVAVNFTQEEWALLGPSQKSLYRDVMWETIRNLDYIGFTQEEWALLDTNTEDQHKNPRRSLRCHIVERFRESSQ

SEQ ID NO: 16779 - protein, 81 aa, Cebus imitator
PRGSTSFSSVTAAFAQEGWRCLVSTPRDRFKEGIPEKSRNLVLLGLPVSQPGMNSQLELREGAWILEGKDLRNPSPNWKIV

SEQ ID NO: 16780 - protein, 81 aa, Macaca mulatta
MLFIFNKTGIAVSNLDLITCLEQGKEPWNMKRHEMVAKPPAMCSHFAKDLRPEQYIKNSFQQVILRRYGKCGYQNLQLRKG

SEQ ID NO: 16781 - protein, 81 aa, Macaca mulatta
MLETYGLLVSLGCPLFEPELIYQLDRREELWIVKKDLSQSSYPGDNTKPKTTEPSFFHLALPEEVLLRERLTQGVSKDSQL

SEQ ID NO: 16782 - protein, 81 aa, Callithrix jacchus
PQVSLTFEDVAVLFTRDEWRKLAPSQRNLYRDVMLENYRNLVSLGLPFTKPKVISLLQQGEDPWKVEKGSSGSPCLGLKSS

SEQ ID NO: 16783 - protein, 81 aa, Callithrix jacchus
ETLTFRDVAIEFSLEEWQCLNPAQQDLYRNVMLENYRNLVFLGITVCKENPITCLVQGKEPCNVKRHEMVARPNAMCSYFP

SEQ ID NO: 16784 - protein, 81 aa, Delphinapterus leucas
AQESLTYDDVTMKFTWEEWQLLDPDQKDLYRDVMLENYSNLLSVGYQASKPDAVSRLERGEQLWPVEDDSHGRICPEIRKV

SEQ ID NO: 16785 - protein, 81 aa, Delphinapterus leucas
TARSQASVTFKDVAMDFTPEEWGRLDPAQRDVMLENYRNLVSLWLPVSKPENHNLENGKEPLMLERKAPKSSCSDSETRPG

SEQ ID NO: 16786 - protein, 81 aa, Ailuropoda melanoleuca
MAVTFEDVTVIFTWEEWKFLDSSQKKLYREVMWENYTNVMSVGNWKESYKPQEERFRYLEHENCLSWQGWRNASAQIYENR

SEQ ID NO: 16787 - protein, 81 aa, Vulpes vulpes
SQGLVSFKDVAVDFTQEEWQQLDPAQRTLYKDVMLENFSHLVSMGYPVSKPDVISKLEQGEDPWIIKRDIPNWIYPDENQA

SEQ ID NO: 16788 - protein, 81 aa, Callorhinus ursinus
FQDSVTFEDVAVRFSSGEWQCLTRAQRHLYADVMLENYWNVISVGFAVPKPPLISHLEQGAEPCVQDLQDGGFLSCSFPVS

SEQ ID NO: 16789 - protein, 81 aa, Callorhinus ursinus
RPIAVSFADVAVYFSPEEWGCLRPAQRALYRDVMRETYGHLGALESKKKNEPSSKIGAEELEEAPVRNAPAVQARLVPSFR

SEQ ID NO: 16790 - protein, 81 aa, Rhinopithecus bieti
VQESVTFRDVAVFFSQDEWLHLDSAQRALYREVMLENYSSLVSLGILFSKPKVISQLEQGEDPWMVESGVPQGTHLGWESL

SEQ ID NO: 16791 - protein, 81 aa, Cebus imitator
QTEVTFEDVAVLLSREEWGRLGPAQRDLYRDVMLETYGNLVSLGVGPAGPKPGVISQLERGDEPWVLDVQGTSGREYLRVN

SEQ ID NO: 16792 - protein, 81 aa, Cebus imitator
MGPLTFRDVAIEFSLEEWQCLDTAQRNLYRNVMLENYRNLVFLGIAVCKPDLIICLEQEKEVWSRKSQEIMVAKPPVMRSH

SEQ ID NO: 16793 - protein, 81 aa, Cebus imitator
CEVSVSFEDVTVDFSREEWQQLDSTQRRLYQDVMLENYSHLLSVGFEVPKPEVIFKLEQGEGPWTWEGETPHHSCSDGKFG

SEQ ID NO: 16794 - protein, 81 aa, Cebus imitator
MRPLTFMDVAIEFSPEEWQCLDTTQQNLYRNVMLENYRNMVFLGIAVSKPDLITCLEQGKEPWNMKRQEMVAKLPGMCSYF

SEQ ID NO: 16795 - protein, 81 aa, Macaca mulatta
GSVSFSDVALGFTQEEWQHLDPAQRTPYRDVMLENYNLLLCTGYCITKPVVICKLEHGEVLWILEEESPSQSHLDCCIDDN

SEQ ID NO: 16796 - protein, 81 aa, Macaca mulatta
MLENYSNLVSVGYCVHKPEVISRLEQGEEPWRLEEEFPSQSFPEVWTADHLKERSQENQSKHLWEVVFINNEMLTKEQGDV

SEQ ID NO: 16797 - protein, 81 aa, Callithrix jacchus
MDVAIEFSLEEWQFLDTTQQNLYRNVMLENYRNLVFLGIAIPKPDLIACLEQGKELWNMRRHETVAKPPGKRVNTMDNIDE

SEQ ID NO: 16798 - protein, 81 aa, Macaca mulatta
LQESVTFKDVAVLFTQEEWGQLSPAQRALYRDVMLENYSNLVSLGILFSKPKVISQLEQGEDPWMVESGVPQGAHLGWESL

SEQ ID NO: 16799 - protein, 81 aa, Callithrix jacchus
MGPLTFRDVAIEFSLEEWQCLDTAQRNLYRKVMFENYRNLVFLVMCSHVAEDLWPEHRIKDSFQKMILRGYGKCGHENLQL

SEQ ID NO: 16800 - protein, 81 aa, Callithrix jacchus
WSQMPVTFEDVALYLSREEWGRLDHTQQSFYREVLQKRNGLSLGFPFSRPFWAPQVPGKGEASGSSRQTGDEKEDWRGACT

SEQ ID NO: 16801 - protein, 81 aa, Callithrix jacchus
GRLTFKDVSVEFSSAEWKCLTPAQRALYRDVMLENYRNLESVGEENVPPDTRNPSLFIWALPGGEGCSEPRSCHCSKHQIN

SEQ ID NO: 16802 - protein, 81 aa, Macaca mulatta
MDVFVDFTWEEWQLLDPAQKCLYRNVMLENYSNLVSLGYQHTKPDIIFKLEQGEELCVVQAQIPNQSCPNTVWKIDDLMEW

SEQ ID NO: 16803 - protein, 81 aa, Callithrix jacchus
GPLTFMDVAIEFSLEEWQCLDTAQQNLYRNVMLENYRNLVFLAFSWSSNLTKHKIIHTGEKPYKCEECGKAFKQSSTLIIH

SEQ ID NO: 16804 - protein, 81 aa, Macaca mulatta
RQAFLAFGDVTVDFTQKEWRLLNPAQRALYREVTLENYSHLVSLGILHSKPELIRRLEQGEAPWGEERRCRPGPRAGIYAE

SEQ ID NO: 16805 - protein, 81 aa, Callithrix jacchus
VEGVLTFRDVAIEFSQKEWQCLDTAQRNLYRNVMLENYGNLVYLGIATSKPDLITCLEQGQEPWNVKRHEFEAKLPGSLSC

SEQ ID NO: 16806 - protein, 81 aa, Cebus imitator
SQGHVTFEDIAVYFSQEEWGLLDEAQRCLYHDVMLENFSLMTSVAGLSQNNHKDSCLQWKVPVSMNNVAQCSPDEVHYTPM

SEQ ID NO: 16807 - protein, 81 aa, Cebus imitator
ARDLVMFRDVAVDFSQEEWECLNSYQRNLYRDVILENYSNLVSLGCSISKPDVITLLEQGKEPWLVVRDEKRRWSLGPTFK

SEQ ID NO: 16808 - protein, 81 aa, Cebus imitator
MDSVTFDDVAVDFTQEEWTLLDPTQRSLYSDVMLENYKNLATVGGQIIKPSLISWLEQEESRTVQGGVLQGWELQLETQWS

SEQ ID NO: 16809 - protein, 81 aa, Macaca mulatta
DSISLEDVAVNFTLEEWALLDPGQRNIYRDVMRATFKNLACIGEKWKDQDVEDDPKNQGRKPSSPMVETLCENKEDRPCGK

SEQ ID NO: 16810 - protein, 81 aa, Callithrix jacchus
ETRSLTFRDVVIEFSLKEWQCLYTTQWNLYRNVMLGNYRKMVSLGIAVSKSDLITCLEKNKKPWNMKRHEMVAKPPRPLAR

SEQ ID NO: 16811 - protein, 81 aa, Callithrix jacchus
RSQESLTFQDVAVDFTREEWDRLYPAQKDLYRDVMLENYRNLVALGHQLYKPEVIAQLELEEEWVIERGSLLDPCPDGENR

SEQ ID NO: 16812 - protein, 81 aa, Macaca mulatta
PQGLVTFGDVAVDFSQEEWEWLNPNQRTLYRKVMLENYKNLASLGLCVSKPDVISSLEQGKEPWTVKRKMTRAWCPDLKIV

SEQ ID NO: 16813 - protein, 81 aa, Macaca mulatta
IVSLQASVSFEDVTVDFSREEWQHLDPAQRRLYWDVTLENYSHLLSVGEAIEKMQQQGIPGEIFFHCERFDQPIGEDSLCS

SEQ ID NO: 16814 - protein, 81 aa, Callithrix jacchus
FQGRLTFKDVSVEFSSAEWKCLTPAQRALYRDVMLENYRNLESVGEENVPPDTRNPLHTGEKPYKCNECGKTFSQMSSLTY

SEQ ID NO: 16815 - protein, 81 aa, Macaca mulatta
MLENYKNLIILAGSEFCKPSLMSELEQMEELRTGVTGVLQELDLQLKTKGSPLLQDISAERSSNGIQLERSNTAEKLYDSN

SEQ ID NO: 16816 - protein, 81 aa, Bos taurus
SQGRLTFQDIAIDFTQEEWECLDLGQRELYKDVMLENYGNLASLGLVISKPDLVTFLEQMKDPWDTRRMETPAVHPAVSSH

SEQ ID NO: 16817 - protein, 81 aa, Bos taurus
TKDQIKLRRDVAIDFTQEEWECLDLSQRELYRDVMLENYGNLASLGLVSNLDLVTFLEPLKDPRNIRRMGTTEPESSNKDS

SEQ ID NO: 16818 - protein, 81 aa, Bos taurus
SQGRLTFQDVAIDFTQEEWECLDLGQRELYRDVMLENYGNLASLGLVISKPDLVTFLEQMKDPWDTRRMETPAVHPAVSSH

SEQ ID NO: 16819 - protein, 81 aa, Bos taurus
MGIMVSVSFEDMTVDFRREEWQHLDSAQSHLLSLGYEVPKPEVIFKLEQGEEPWALKEKTLHHSCSDGKFGIKTLQKRISG

SEQ ID NO: 16820 - protein, 81 aa, Bos taurus
MYFSWEEWCLLDEAQIQLYLDVMLENFALVCMLGSWRGVQDKETPSEEIKPAGVLQFRTPRAGLSPEKTQPCAMCIPVLRD

SEQ ID NO: 16821 - protein, 81 aa, Ovis aries
QGGVTFPDVAVHFSQREWRLLDETQRRLYLDVMLENYTLVSSLGCCCGAEGEETPCEKTVPVGVSWTGSPTAAPFSQKTHP

SEQ ID NO: 16822 - protein, 81 aa, Ovis aries
VTESVTFRDIAVLFSRDEWLHLDAAQRTLYREVMLENYSTLVSLGIPFSMPKLICQLQQGEDPCMVEREIPQDACLGFKTW

SEQ ID NO: 16823 - protein, 81 aa, Ovis aries
AQELVTFEDVAVYFIRKEWKRLEPAQRDLYRDVMLENYGNVFSLDGETRTEPDSEISEDRGSHGVLLGRFQKDISQGLKFE

SEQ ID NO: 16824 - protein, 81 aa, Ovis aries
SQQSLTFRDVAIDFSQEEWGFLDPAQRELYTAVMLETYQNLVWLGISVAEPNIAFLLEQGPQPWVIREEDAGAPGAGESGT

SEQ ID NO: 16825 - protein, 81 aa, Ovis aries
MLENYRNLASLGLMVSKPDLVTFLEQMKNPWDVRRLETPAVYTGWKPFKYTKCGNTSSQNSELSQDQQIHTGKKPYECKEC

SEQ ID NO: 16826 - protein, 81 aa, Ovis aries
SLDAVTFMDVAVDFSQDEWEWLTLAQRTLYKKVMLENYSNLASLGLCISKPDVISFLEQDKEPWMMKGELTRGLCPGLEYV

SEQ ID NO: 16827 - protein, 81 aa, Ovis aries
WKGLLSFEDVALYFTREEWDTLDWAQKALYRDVMLDNYRHVVSLDSEARFQTKELTPKENTSEDLMLWKMSAVKQKTAKEP

SEQ ID NO: 16828 - protein, 81 aa, Ovis aries
VTFEDVFIRFTREEWDLLTESQKRLYHKTMVDNFALVMSVGLESSRYRLISPPEPESAPEVPARIGIAAAVEEVSQESPAP

SEQ ID NO: 16829 - protein, 81 aa, Ovis aries
QMGWLTFRDVAIDFTQEEWECLDLGQRELYRDVMVENYRNLACLGLVVSKPDLVTFLEQMKDLRNIRRMETVGVYPAMSPQ

SEQ ID NO: 16830 - protein, 81 aa, Ovis aries
MAVRCLPTMVQDEWAQLSPAQRALYRDVMLENYSNVVSLGLLGPKPDMFSQLGKGEEWMPEDSLGGFCLDWVITPMNKKSI

SEQ ID NO: 16831 - protein, 81 aa, Ovis aries
WQGNVTFEDVFVSFSQEEWGLLDEAQRLLYHEVMLENYALMASLGCWHGMEEEEIRFEQSISVKRVSKGMIPKMIPSSQKA

SEQ ID NO: 16832 - protein, 81 aa, Otolemur garnettii
GAEVTFEDVVVLLSQEEWGHLGPAQRGLYRDVMLETYGNLVSLGVGPAGPKPGVISQLERGDVPWVLDVQSVSGTPLGTCP

SEQ ID NO: 16833 - protein, 81 aa, Vulpes vulpes
LQGPVSFRDVAVDFTQEEWQQLEPDEKTTYRDVMLENYSHLVSVGYDSTKPKVILKLEQGEEPWVAEGELPCQSHLEVWKV

SEQ ID NO: 16834 - protein, 81 aa, Otolemur garnettii
QNLVTFGDVAVNFSQEEWEWLNPAQRNLYRKVMLENYKSLVSLAGVSVSKPDVISLLEQGKEPWMVKKEGARGISPGLGIH

SEQ ID NO: 16835 - protein, 81 aa, Otolemur garnettii
LQESFSFEDLSVDFTQKEWQLLDPYQKNLYKDVMLENYSSLVSLGYKVMKPDVIFKLEQGEEPWIGDREIPHSCSLEEAWQ

SEQ ID NO: 16836 - protein, 81 aa, Otolemur garnettii
FQESVKFRDVGVVFSPDEWHHLNPEQRNLYKDVMLDNCDYLVSLGNWTYKAKVMSSLKEGKEPWEMEKEVTSVPCPGTCNK

SEQ ID NO: 16837 - protein, 81 aa, Otolemur garnettii
LQGSVSFKDVTVDFSREEWQQLDLAQKSLYRDVMLENYFNLISVGYQVPKPEVIFSLEQGEEPCEVDDRPPCQSYSGPGWI

SEQ ID NO: 16838 - protein, 81 aa, Otolemur garnettii
MDSVTFEDMAVNFTLDKWACWILPNKRKSVYRNVMQETFRNLATIERLFERKEGSPFGETFRTHPNKKTSPGVNPCESSVC

SEQ ID NO: 16839 - protein, 81 aa, Otolemur garnettii
FQGPLSFEDVIVGFTQEEWQHLDPAQRTLYKDVMLENYSHLVSVGCCIPKPEVIFKLEQGEQPWILQEEPTNQSYPEYFKY

SEQ ID NO: 16840 - protein, 81 aa, Otolemur garnettii
CENSVSFEDVAVDFSREEWQQLDPAQRHLYQDVMLEIYNHLFSVGCHIPSPEVIFRIVKGQELWMERAELPPQKDHEGKFV

SEQ ID NO: 16841 - protein, 81 aa, Vulpes vulpes
SKDLVTFGDVAVDFSQEEWEWLNPGQRNLYRKVMLENYRSLVSLGVSVSKPDVISLLEQGKEPWMVKKEGTRGPCPDWEYI

SEQ ID NO: 16842 - protein, 81 aa, Enhydra lutris
SPGAVSFADVAVYFSREEWRCLQPAQRALYRDVMRETYGYLGALGFSGPKPAFISWVEGEVEAWSPEAQDPEGETPAAVIR

SEQ ID NO: 16843 - protein, 81 aa, Pongo abelii
SKDLVTFGDVAVSFSQEEWEWLNPAQRNLYRKVMLENYRSLVSLGVSVSKPDVISLLEQGKEPWMVKKEGTRGPCPDWEYV

SEQ ID NO: 16844 - protein, 81 aa, Pongo abelii
SVQDVTVEFTQEEWQHLGLVERTMYRDVVLENYSHLISVVLSFSPPFYSPRLECNGAILAHCNLHLLCSKTESRSVAQAGV

SEQ ID NO: 16845 - protein, 81 aa, Pongo abelii
GPQAKLTFEDVAVLLSDEWDRLCPAQRGLYRNVMMETYGNVVSLGLPGSKPDIISQLERGEDPWVLDRKGAKKSQGLWSDY

SEQ ID NO: 16846 - protein, 81 aa, Pongo abelii
SLELVSFEEVAVHFIWEEWQDLDDTQRTLYRDVMLETYSSLVSLGHHITKPEMIFKLEQGAEPWIVEAPDLRLSGGSRKRV

SEQ ID NO: 16847 - protein, 81 aa, Pongo abelii
PQEAVVFEDVAVYFTRIEWSCLAPDQQALYRDVMLENYGNLASLGFLVAKPALISLLEQGEEPGALILQGAEQSVAKASLC

SEQ ID NO: 16848 - protein, 81 aa, Cebus imitator
MELLTFRDVTIEFSLEEWEFLKPAQQNLYRNVMLENYRNLVSLGLTVSKPELISCLEQRQEPWSVKRPKTVAKPPAMSCHY

SEQ ID NO: 16849 - protein, 81 aa, Cebus imitator
AQESMTFRDVAVFFSQDEWLHLDSAQRALYREVMLENYSTLVSLGIPFSMPKVIHQLQQGQDPCMVEGEVASDTCLGFKAW

SEQ ID NO: 16850 - protein, 81 aa, Cebus imitator
ISFEDVAVDFTLEEWQLLNPTQKNLYRDVMLENYSNLVFLEVWLDNPKTWLQDNQDNLKSTERGRKYGVFGKIFKSSINFV

SEQ ID NO: 16851 - protein, 81 aa, Callithrix jacchus
LRLPLTFEDVAIYFSEQEWQDLQAWEKELYKRVVRSNYETLISLDDGLPKPELIAWIEQGEEPFRNWRESQKSGNIICSSV

SEQ ID NO: 16852 - protein, 81 aa, Callithrix jacchus
FQGLVTFRDVAIEFSLEEWKCLEPAQRDLYREVTLENFGHLVSLGLSIPKPDVISLLEQGKEPWIIANDVTGPWCPDLESR

SEQ ID NO: 16853 - protein, 81 aa, Callithrix jacchus
TSQESLTLEDVAVEFTWEEWQLLGPSQKDLYRDVMLENYSNLVSVGYQASKPDALSKLEQGEPWTIENEIHSQVCPENKKV

SEQ ID NO: 16854 - protein, 81 aa, Macaca mulatta
MLENFQNLASLGYLLHTPHLICQWEQEEDLQTVKRELIQVIFMGEHQEGFETQLKTNESVAPQDICGEKISNEQKIVRFKR

SEQ ID NO: 16855 - protein, 81 aa, Callithrix jacchus
YQDSVTFDDVAVDFTQEEWTLLDPTQRSLYSDVMLENYKNLATVGGQIIKPSLISWLEQEEESRTVQGGVLQGWELQLETQ

SEQ ID NO: 16856 - protein, 81 aa, Callithrix jacchus
AHDLVMFRDVAVDFSQEEWECLNSYQRNLYRDVILENYSNLVSLAGCSISKPDVITLLEQGKEPWLVERDEKRRWSLDLES

SEQ ID NO: 16857 - protein, 81 aa, Callithrix jacchus
YQDSVTFDDLAVDFTPEEWTLLDPTQRNLYRDVMLENYKNLATVGCQLFKPSLISWLEQEESRTVQRGDFQEWKVQLKTKQ

SEQ ID NO: 16858 - protein, 81 aa, Monodon monoceros
YDSTKPNVILKLEQGEEPWVADGEFPRQFHPEEVWKVDDLMERAQENKDECSRQAVSINSRTLTEEREVAFDKTYNMEISL

SEQ ID NO: 16859 - protein, 81 aa, Callithrix jacchus
LQGPVSFKDVAVDFTQEEWQQLDPDEKIIYRDVMLENYSHLVSVGCDITKPNVIIKLEQGEEPWIMEDEFPCQHSPEVWKV

SEQ ID NO: 16860 - protein, 81 aa, Callithrix jacchus
AMSQESLIHVFVDFTLEEWQQLDSAQKNLCRDLMLENNSHLVSVGHLVAKSDVIFRLGPEEESWMAHGGILVTTCAEVWQV

SEQ ID NO: 16861 - protein, 81 aa, Macaca mulatta
VNFTQEEWALLDPSQKNLYRDVMQETFRNLASIGNKGKDQSIEDQYKNSSRNLSSFQMHQRNHTGEKPYECMECGKALGFS

SEQ ID NO: 16862 - protein, 81 aa, Monodon monoceros
YCVNKPNAVFKLKQGKEPWILEVEFPRQKYPGKLEIITCEEKTYGILMTKEQDTRKAKLKIQGKNGELTKHQKTHTNEKSY

SEQ ID NO: 16863 - protein, 81 aa, Macaca mulatta
SVAFEDVAVTFTQEEWALLDPSQKTLYRDVMQETFRNLASVGKKWKAQNMYVEYENLKRNLRTFVGERLFESKEGHQHGEI

SEQ ID NO: 16864 - protein, 81 aa, Callithrix jacchus
FQKPVTFEDLAVNFTQEEWDCLDASQRVLYQDVMSETFKNLASVARMFLHKPELITKLEHQEKQWRVTRVLQASRGGPPFF

SEQ ID NO: 16865 - protein, 81 aa, Callithrix jacchus
LSLPGLLTFRDVTIEFSQEEWRCLDPEGRMLHPEVLLEVRLTGKTPLMKGLLSTAQGNTEGFHTGILDRHESHHIGDFCFQ

SEQ ID NO: 16866 - protein, 81 aa, Macaca mulatta
LDPAQRTLYRDVMLENYWNLVSLGLCHFDMNIISMLEEGKEPWTVKNCVKIARKPRMRECVKGVITDIPPKCTTKDLLPEE

SEQ ID NO: 16867 - protein, 81 aa, Callithrix jacchus
AQEQVTFWDVAIYFSREEWECLEPSQRALYRDVMLDTFSNVAALGFCSPRPDLISRLEQWEEPWVEDRERPELQAVQRGPS

SEQ ID NO: 16868 - protein, 81 aa, Callithrix jacchus
GKGLFCFKACLSSFKNSETQGGNPSCELVVCLAPWPHFYVVFLLTGCPVTKTKVIIKAEQGQEPWMVERVNPHQSSPESDC

SEQ ID NO: 16869 - protein, 81 aa, Bos taurus
MSKPDVITLLDEGKEPWMVVREGTGKHHPDLESRYSANILSSEKDIYEIYSFQWEIMERIKSCSLQDSIFRNDWECKSKIE

SEQ ID NO: 16870 - protein, 81 aa, Bos taurus
KGPYFADVAVYFSPEEWGYLRPAQRALYRDVMRETYGHLGALGEAPPARLCSHPRPPRPASGSCTWSGRPQEVGTLGGGLP

SEQ ID NO: 16871 - protein, 81 aa, Bos taurus
TARSQASVTFKDVAMDFTPEWGRLDPTQRDVMLENYRNLVSLWLPVSKPENHSLENGKEPLLLERKAPKSSCSDSETSPRS

SEQ ID NO: 16872 - protein, 81 aa, Ovis aries
PRESVTFEDVAVNFSHEEWQCLTHSQRHLYKDVMLENYGNMVSLGFSFSKPPLISCLEQGAESYVQDQQDWEFLSCSYPVS

SEQ ID NO: 16873 - protein, 81 aa, Ovis aries
ERLTSEDVAIKFTQEWEFLDPAQRALYRDVMLETYRNLLSVDVSQIHMIKKLQQMETVVKKFFEEWCLEEPKAMKSKIISS

SEQ ID NO: 16874 - protein, 81 aa, Ovis aries
GQSRVTFEDVAVYFSQEEWCLLDEAQIQLYLDVMLENFALVCMLGSWPGVGDEETPFEQSKSAGVSQIGTPRTDSSAEKVQ

SEQ ID NO: 16875 - protein, 81 aa, Ovis aries
EVEDFRFKDVVIYFSQKEWECLHSAQKNLYQDVMLENYNNLISLGFTSFKPGVISLLEQGKEPWMVKGKETEEWCPDWECR

SEQ ID NO: 16876 - protein, 81 aa, Ovis aries
SQGRLTFQDVALDFTQEEWECLDLGQRELYRDVMLENYRNLVSLAGLVVSKPDLVTFLEQMKTPWDVRRLAMPAIYTAVSS

SEQ ID NO: 16877 - protein, 81 aa, Ovis aries
SQGLVSFKDVAVDFTQEEWQQLDPAQKTLYRDVMLENYSHLVSMGHPVSKPDVISKLEQGEDPWIIKTDIPNWICPYEGQA

SEQ ID NO: 16878 - protein, 81 aa, Ovis aries
QAEVTFEDVAVFLSQEEWGLLGPAQKGLYREVMLETYRNLVSLGAGLAGPKPEVIVHLERGDELWVLDMRGAEQPSVDGSA

SEQ ID NO: 16879 - protein, 81 aa, Vulpes vulpes
AQGGVTFEDVAVYFSREEWDLLDEAQRLLYHDVMLENFVLISSLGCCCGVEDAEALFEQSISVGVSQPWTQKEPRSPQKTH

SEQ ID NO: 16880 - protein, 81 aa, Vulpes vulpes
QKESLTFRDVCVDFTLEEWQQLDSAQKNLYRDVMLENYSHLVSVGYLGAKPDVVLRLGRGEEAGLTEGETPTWKYPEFWQV

SEQ ID NO: 16881 - protein, 81 aa, Vulpes vulpes
SQGSVLFEDISMDFTQKEWQLLDPAQRLLYRDVMLENYRHLVSLGHCVTKPELIFKLEQGEEPWVPKKELPRQSRPEVQEA

SEQ ID NO: 16882 - protein, 81 aa, Otolemur garnettii
SISFKDITIDFCRQEWEYLDLVQRTLYREVMMENYGNLVSMAGHSMSKPDIITLLEQRKEPWMLVREETRRECTGQCESAV

SEQ ID NO: 16883 - protein, 81 aa, Otolemur garnettii
KELPSVFEDVAVYFTREEWGMLDKRQKELYRDVMRMNYELLASLGPAAAKPDLISKLERRAAPWIKDPNGPKWGEGHPPGK

SEQ ID NO: 16884 - protein, 81 aa, Otolemur garnettii
FQALLTFRDVSIEFSMDEWACLDPAQQNLYRDVMLETYRNLVFLGEIVVSKENTIFCLQHSIQNVNVRRWSILRDNPPANS

SEQ ID NO: 16885 - protein, 81 aa, Otolemur garnettii
PKVPVTFDDVAVYFSEVEWGKLEDWQKELYKHVMRGNYETLVSLDYAISKPDILTRIERGEQPCPGDQWDQEKGNEEEAAC

SEQ ID NO: 16886 - protein, 81 aa, Vulpes vulpes
SQDPVTFQDVAVEFTQEEWEHLGTTQRALYREVMLENYRSLASLGCQDFKPDVISQLEQGRSPWMVWRDIPRDPSPDQETR

SEQ ID NO: 16887 - protein, 81 aa, Otolemur garnettii
PKLPLTFEDVAIYFSEQEWQNLEAWQKELYKHVMRTNYEMLISLDDGLPKPELICWIEQEREPFRNLKQSQTLENIIRSSA

SEQ ID NO: 16888 - protein, 81 aa, Otolemur garnettii
SGSLENDGICFSEQEWENLEDWQKELYKNVMESNYETLVSLKVLGQPEGEAELGTEMLGDLEEEGLVGAHPADGAMIKQEL

SEQ ID NO: 16889 - protein, 81 aa, Odocoileus virginianus
QGCVTFEDVAVYFSQEEWGLLDEAQRHLYHKVMLENFALTASMVCLHETETKEIPSEQNVSLEALSQVRTPKVGPFTENAH

SEQ ID NO: 16890 - protein, 81 aa, Odocoileus virginianus
MVENFRNLVSVGHVPFKADMVSQLETEGKLWTVERETQRNGHSSEIHSAVTSGNKNPNEMETLGKVMLKYLSCEELSCWQI

SEQ ID NO: 16891 - protein, 81 aa, Odocoileus virginianus
RESGKAPVTFDDITVYLLQEEWVLLSQQQKDICGSDKMVAPLGPSIASPELLYKFERGPEPWLASVQGQRSHLSPNPGKNK

SEQ ID NO: 16892 - protein, 81 aa, Cebus imitator
SKGSVMFRDVSIDFSQEEWEYLDSGQMNLYKEVMLENFSNLVSVGLSSSKPAMISLLEQGREPWLVDRELTRGLCSDLESM

SEQ ID NO: 16893 - protein, 81 aa, Callithrix jacchus
MQSGLTDVSVEFSSAEWKCLTPAQRALYRDVMLENYRNLESVGEENVPPDTRNPSLFIWIMPLQSAGNLNCSSLLKKHQIN

SEQ ID NO: 16894 - protein, 81 aa, Callithrix jacchus
KKKPVTFEDLAVNFTQEEWDCLDASQRVLYQDVMSETFKNLASVARMFLHKPELITKLEHQEKQWRVFLQLPNTEGLSEGK

SEQ ID NO: 16895 - protein, 81 aa, Macaca mulatta
IQGLLTFGDVAVAFTRIEWRHLDAAQRALYRDVMLENYGNLVSVVQDYWFETKMSALKQSTSAGSVVGERRKSVMMEKGLD

SEQ ID NO: 16896 - protein, 81 aa, Macaca mulatta
IQGQVNFEDVFVYFSQEEWVLLDEAQRLLYRDVMLENFALMASLGHTSFMSHIVASLVMGSEPWLPDWVDMTLPVATETLG

SEQ ID NO: 16897 - protein, 81 aa, Callithrix jacchus
AHELVMFRDVAIDVSQEEWECLNPAQRNLYKDVMLENYSNLVSLGLSVSKPAIISSLEQGKEPWMVVREESGRWCPDLASR

SEQ ID NO: 16898 - protein, 81 aa, Monodon monoceros
MTVELVKAIPQPYVISLLEQGKEPWEMKSEMRRTPFPDWESVYETQELPLKQFVCDDVLMERIISYGLECPTFGEDWKCED

SEQ ID NO: 16899 - protein, 81 aa, Callithrix jacchus
EMGVLTSRDVAIEHCLEEWQCLDTAQQNLYRNVMLENYRNLAFLGIASSKPHLITCLEQGKEPWNVKRHGLVAGPPDSLTV

SEQ ID NO: 16900 - protein, 81 aa, Macaca mulatta
VKESVTFKDVAIDFTLEEWRLMDPTQRNLHKDVMLENYRNLVSLGLAVSKPDMISHLENGKEPWVTMTEISRIPYPDMEPK

SEQ ID NO: 16901 - protein, 81 aa, Callithrix jacchus
LVTFEDVAVYFSQEEWGLLDVAQRHLYHNVMVENFELITSLGLLPRSPVEAKVGDDTESCSVSSIQVSLKKKNQQSLGPLL

SEQ ID NO: 16902 - protein, 81 aa, Callithrix jacchus
FQEQVSFKDVCVDFTEEEWYLLDPAQKMLYRDVILENYSNLVSVGYCITKPEVIFKIEQGEEPWILEKGFPSQCHPERKWK

SEQ ID NO: 16903 - protein, 81 aa, Monodon monoceros
MQLTQVLKYFPFTGYCFTKPELIFMLEQGEDPWLLEKEFVNRSSPEESQPDELLQESLENQGKHLRQVLFVNKSLTTEQEI

SEQ ID NO: 16904 - protein, 81 aa, Macaca mulatta
MLENYRNLVSVGLCLSKPDVISLLEQEKDPWVIKGEMTRSLCPDLECVWVTKSLSLNQDIYEEKLPPAIIMERLTSCDLEC

SEQ ID NO: 16905 - protein, 81 aa, Callithrix jacchus
SQGSVLFEDVSVYFTQEEWQLLDPAQRFLYRDVMLENYRHLVSLGHCATKPELIVKLKQGDEPWILKRELPSQSHSEVQKV

SEQ ID NO: 16906 - protein, 81 aa, Callithrix jacchus
LQGPLTFMDVAIEFSLEEWQCLDTAQQNLYRNVMLENYRNLVFLGIAVSKPDLITFLDQEKKPWNIKRREMVPKPSVICSH

SEQ ID NO: 16907 - protein, 81 aa, Callithrix jacchus
QPLPPGFRDVAIEFSLEEWQCLDAAQRNLYKNVILENYRNLVFLGIAVSKPDLIACLEQEKEPLIMKRDEMADEPPVMCSH

SEQ ID NO: 16908 - protein, 81 aa, Callithrix jacchus
LDTAQRDLYRNVLLENYRNLVFLGIAVSKPYLITCLEQKKEPWNMKRCEMVAKPPVMCFHFAQDLWSEQNMKDSFQNVTLR

SEQ ID NO: 16909 - protein, 81 aa, Bos taurus
LDLKTIDFTQEEWECLDLGQRELYRDTMLENYGNLASLGEDNCLQNPLSTHWVMVPAFPECLLESSASYNRVSDPCFLGKE

SEQ ID NO: 16910 - protein, 81 aa, Bos taurus
HQEVVTFEDVAVYFTRTEWAGLSPAQRALYRSVMLEIYRSLTSLDSRTHMDSELTPTWGISEERDLMMSHGPQKNVLNKSS

SEQ ID NO: 16911 - protein, 81 aa, Bos taurus
ALPGVTFSDVAIDFSHEEWRWLNSTQRNLYKDVMVQNYENLVSLGNPNPKGEYIILVMYGCEIWTVKKELSQNTCLITRGK

SEQ ID NO: 16912 - protein, 81 aa, Bos taurus
SLETVTFKDVAVDLTQEEWQQMKPAQRNLYRDVMLENYSNLVTVGCQVTKPDVIFKLEHEEEPWVVEEEMLGRHCPDFRLN

SEQ ID NO: 16913 - protein, 81 aa, Ovis aries
QGSLSFEHVTVGFTQEEWQKLDPAQRTLYRDVMLENYSHLISVGYCIPKPELIFKLDQGEQLWVLEAESPSQSYPGELGIV

SEQ ID NO: 16914 - protein, 81 aa, Otolemur garnettii
TARSQETVTFKDVAMDFTPEEWGKLDPIQRDVMLENYRNLVSLWLPVSKSENYSLENGKEPLKLERRAPISTCSDVEARPK

SEQ ID NO: 16915 - protein, 81 aa, Otolemur garnettii
AQESMMFEDVAVKFTSREWQYLSYDQRHLYKDVMLENYGNMISLGFSFPKPHLISHLEQGAEPCVQDLQDREFLSCSYPVS

SEQ ID NO: 16916 - protein, 81 aa, Vulpes vulpes
RPGAVSFADVAVYFSPEEWGCLQAAQRALYRDVMRETYGHLGALGFADAKPVLISWLERKAEVWTPEAEDPEEGARHPGSG

SEQ ID NO: 16917 - protein, 81 aa, Vulpes vulpes
WWKAWVQKPITFEDVAVNFTQEEWMCLDASQRALYQDVMSETFRNLMSVDLIIKLGQEESQQRAEFQLCLLNGEGLLSGEH

SEQ ID NO: 16918 - protein, 81 aa, Otolemur garnettii
LTFQDVSVEFSMDEWACLDPAQQTLYRDVMLENYRHLVFLGLTLSKPDVITCLEQSKAPWKVKAQQTVVKPPDMCTHTISN

SEQ ID NO: 16919 - protein, 81 aa, Otolemur garnettii
MAFEDVAVYFSQEEWGLLDTAQRALYRHVMLENFTLVSSLGLSTSRPRVVVQLERGEEPWVPSRIDSTPARNAQGRRNPGS

SEQ ID NO: 16920 - protein, 81 aa, Otolemur garnettii
VTFEDVAVNFTQEEWACLDVSQRVLYQDVMSETFENLASVARFFLHKPDLISKLEQEEEQWRIYLHLSNREGLLSGKNCKR

SEQ ID NO: 16921 - protein, 81 aa, Otolemur garnettii
SEGHVTFEDVAVCFSREEWKLLDEAQRLLYRSVMLENFAVMASLGLASSRTCEIIQLELWGELFMPAWGLKAPAIPKGYYH

SEQ ID NO: 16922 - protein, 81 aa, Otolemur garnettii
FQELLTFGDVTIEFSPEEWACLDPAWWNLYRDVMLENYRNLASLGLTASKPALITCLEQRKEPWNVKRHKKVAEHSGRWEA

SEQ ID NO: 16923 - protein, 81 aa, Otolemur garnettii
MTFEDVAVYFSQEEWRLLDTAQKALYHHVMLENFTLVSSLGLSTSRPRVVVQLERGEEPWVPSRIDSTPARNAQGRRNPGE

SEQ ID NO: 16924 - protein, 81 aa, Vulpes vulpes
TQDCVISEDVFVYFSWEEWMLLDDSQRLLYQDVMLENFALLASLGIASSRSHLVTQLNPRKDPQMPEQVNMNPATEREAQK

SEQ ID NO: 16925 - protein, 81 aa, Otolemur garnettii
SQGLVTFEDVAVYFSLEEWEKLDVDQRSLYQEVMQENYGILGSLGYPIPKPDLIFRLEQGEEPWVPDSPRPEEGDIVTGVY

SEQ ID NO: 16926 - protein, 81 aa, Otolemur garnettii
LQVPVSFEDVTVDFSREEWQHLDSAQRRLYRDVTLENYSHLLSVGYRVPKPEAIFLLEQGEGPWTLDGEAPHQSGSVQPSL

SEQ ID NO: 16927 - protein, 81 aa, Cebus imitator
WQESVTFQDVAVGFTPEEWQLLDCADRTLYWDVMLENYRNLFSVGCPVTKTKVILKAEQEQEPWMVEGVNPHHSSPESDCP

SEQ ID NO: 16928 - protein, 81 aa, Macaca mulatta
GRPLEMAVSEPETSAAKEWKQLDPAQRNVYHDVMLENYSNQASMGYQAPKPDLISKLEKGEAPWLGKGKRPSQGCPSKIAR

SEQ ID NO: 16929 - protein, 81 aa, Callithrix jacchus
PSPPPRLDVAIEFSQEEWRCLDPAQKTLHRDVMLENYRNLVSLGEDVMLENYRNLESVGEEPVPPDTRNLPLSILALPGMY

SEQ ID NO: 16930 - protein, 81 aa, Callithrix jacchus
LFQVTFSDVAIDFSHEEWEWLDSAQRDLYKDVMVQNYENLASLAGLSITKPHVITLLEDGKEPWMVEEKMSKGVTPDWESR

SEQ ID NO: 16931 - protein, 81 aa, Callithrix jacchus
SQGLVSFKDVAVDFTQEEWQQLDPAQRTLYRDVMLENYSHLVSMGYPVSKPDVICKLEQGEEPWILKTDISNWIYPDEYQA

SEQ ID NO: 16932 - protein, 81 aa, Callithrix jacchus
YQDSVTFDDVAVAFTQEEWTLLDPSQRDLYRDVMLENYENLASVGHHLFKPSVICWLEEEGPSRAGQRGVLQEWRLKSKGS

SEQ ID NO: 16933 - protein, 81 aa, Macaca mulatta
SHELLTFKDISVDFTQEEWGQLAPAYQNLYREVMLENYSNLVSVAGYQLSKPSVISQLEKGEEPWMAEKEGPGDPSSDLKS

SEQ ID NO: 16934 - protein, 81 aa, Callithrix jacchus
TVGVLTFRDVAIEFCLEEWQCLDTAQQNLYRNVMLENYRNLVFLGIAALKPDLITCLEQGKEPWNVKRHEMVAELPGCSAM

SEQ ID NO: 16935 - protein, 81 aa, Callithrix jacchus
RRGHLTFRDVAIEFSQEEWKCLEPAQRALYRDVMLENYRNLVSLGICPYDLSIISTLEQSGGPWNLQSEVKIANTPDGREC

SEQ ID NO: 16936 - protein, 81 aa, Macaca mulatta
VAFEDVAVNFTREEWALLDIFQKNLYREVMLETFRNLTSIGKSWKDQNIEYEYQNPRRNFRSLIEEKVNEIKEDSHCGETV

SEQ ID NO: 16937 - protein, 81 aa, Callithrix jacchus
PLTFMDVTVEFSLEEWQCLDIAQQNLYRDVMLENYRNLVFLIMCSHFAEDLWLEEGIKVLFQKVILRRYDKYGHENLQLRK

SEQ ID NO: 16938 - protein, 81 aa, Monodon monoceros
WFQDLKFKDVAIYFTQKEWECLHSAQKDLYRDVMLENYNTLISLGFSDSKPDVISLLEQGKEPWMVNSKETKEWCPDWESR

SEQ ID NO: 16939 - protein, 81 aa, Macaca mulatta
GQVNFEDVFVYFSQEEWVLLDEAQRLLYRDVMLENFALMASLGCWHGMEDEEIPFEQSFSIGMSQIRISKGGPSTQKAYPC

SEQ ID NO: 16940 - protein, 81 aa, Bos taurus
FKEAVTFKDVAVVFTEEEMGLLDLAQRKLYQEVMLENFRNLLSVGHQSFTPDVPSQLEREEKLQMIRTAAQSCCSSGESPV

SEQ ID NO: 16941 - protein, 81 aa, Ovis aries
SCPQDVDLFACNGLEPHTSTSVEPSQESVTFQDVAVDFTEKEWPLLDSTQRKLYKDVMLENYSNLASVGKAGVISSLLVHP

SEQ ID NO: 16942 - protein, 81 aa, Ovis aries
TSQSPLTFGDVAVEFSGEEWAWLDSAQRSLHRSVMLENYRNLASLGKVSKPEMISSLEQRKEPWAVTRKTTGGECADSQTL

SEQ ID NO: 16943 - protein, 81 aa, Ovis aries
APVPLTFSDVSIDFSQEEWECLDSDQKNLYKDVMLETYTNLVSLDFDFTTENNKLSSEKRSFEVNSYHWETIKSKTFNLMG

SEQ ID NO: 16944 - protein, 81 aa, Ovis aries
DYQKVTFSDVAIDFSHEEWRWLSSTQRDLYKDVMVQNYENLVSLAGLSIPKPYVIALLEDGKEPWMVEEKLSKDMFSDCKS

SEQ ID NO: 16945 - protein, 81 aa, Ovis aries
SQEPLTFKDIIVDFTQEEWGHLATAHQNLYREAMLENYGNLVSVGYQLSKPGVISQLEKGEEPWLMKREVSGGPSPDLEDE

SEQ ID NO: 16946 - protein, 81 aa, Ovis aries
PQDSVTFEDVAVYFSWNEWCLLDEVQIRLYLDVMLENFALVCMLGSCGVQDAETCSEQNVSAERASQIRTPRAELSPENTQ

SEQ ID NO: 16947 - protein, 81 aa, Vulpes vulpes
SQGSLSFRDVTVGFTQEEWQHLNLAQRTLYRDVMLENYSHLVSVGYSIDKPEVILKLEQGEESWILEEAFPSQSDPELINS

SEQ ID NO: 16948 - protein, 81 aa, Otolemur garnettii
SCEPVTFEDVTLGFTGEEWGLLDLEQKSLYREVMLENYSNLVSVAEHQLSKPDVVSQLEEAEEFWPLERGIPQDTLPAEYL

SEQ ID NO: 16949 - protein, 81 aa, Otolemur garnettii
FQGVLTFKDVSIEFSMEEWACLDPAQKHLYQEVMLETYRNLVFLGLAVSKPDLITCLEQSKDPWKLKTQQTLLKPPALPNH

SEQ ID NO: 16950 - protein, 81 aa, Otolemur garnettii
QELLTFRDVGIEFSPEEWEYLDPAQRHLYRDVMSEISRHLDFVGLIISFFDLGIRVEVRTQPRPAKQQMTTASPPERRIYS

SEQ ID NO: 16951 - protein, 81 aa, Otolemur garnettii
FQGLVMFEDVAVYFSREEWGLLNVTQKSLYHDVMLENFALISSLGLAPSRSHVSTQLEDGEESWVVPSRVKVIPVSRMEAK

SEQ ID NO: 16952 - protein, 81 aa, Vulpes vulpes
MYFTQNEWQLLEPAQKDLYRDVMLENYGHLASLGHWFFKPKLITRLEQGDEPCVKERDIPPAPQRGSAGISGSCISTDKKR

SEQ ID NO: 16953 - protein, 81 aa, Otolemur garnettii
SQGLVTFGDVAVDFSQEEWAWLSTTQRTLYRKVTLENYRNLASLGLCVSKPAVISLLEQGKEPWIVKRKMTRGGCPDLNAV

SEQ ID NO: 16954 - protein, 81 aa, Otolemur garnettii
ESVSFMDVTVDFTQEEWEQLDPSQRILYMDVMLENYSNLLSVEVWKADDQMERDHGNPEEQARQFVILKNQTPIEERDNLF

SEQ ID NO: 16955 - protein, 81 aa, Enhydra lutris
LGSAAYQFLSVDYTERKWKGPALSQRAVYRSIMPENCCSVASMAGETRMQHSELPAKQEVSKEPLLPDGTSGGLCGVVSEE

SEQ ID NO: 16956 - protein, 81 aa, Enhydra lutris
SSVTFEDVAVYFSQEEWRFLNKAQRHLYRDVMLEVFALVSSLGGGRGALEAAAPSEQNMSGGGSQKAYTQDCSLDSEGDLQ

SEQ ID NO: 16957 - protein, 81 aa, Macaca mulatta
MGLLTFRDVAVEFSLEEWEHLEPAQKTLYQDVMLENYRNLVSLDVFSHYNKDLLTEQCTEASFQKVVSRRHGNCHLENLHL

SEQ ID NO: 16958 - protein, 81 aa, Callithrix jacchus
AQESMTFRDVAVFFSQDEWLHLDSAQRALYREVMLENYSTLVSLGIPFSMPKVIHQLQQGQDPCTVEGDVPSNTCLGFKTW

SEQ ID NO: 16959 - protein, 81 aa, Callithrix jacchus
PLTFRDVAIEFSQEEWRCLDPTQKALYKDVMLENYRNLVFLGISPKCMIKELPPTENSNTRERCQTVTLERHQSYNLENLY

SEQ ID NO: 16960 - protein, 81 aa, Macaca mulatta
SCEPVNFEDVTLGFTPEEWGLLDLKQKSLYREVMLENYRNLVAVEHQLSKPDVVSQLEEAEDFWPVERGIPQDTIPEYSEL

SEQ ID NO: 16961 - protein, 81 aa, Callithrix jacchus
EMGPLTFRDVKIEFSLEEWQCLDTVQRNLYRDVMLENYRNLVFLGIAVSKPDLITWLEQGKEPWNMKSHAMVAKPPVICSH

SEQ ID NO: 16962 - protein, 81 aa, Callithrix jacchus
PQGRLTFKDVSVEFSSAEWKCLTPAQRALYRDVMLENYRNLESVGEENVPPDTRQGNTEVFHTGTLARQESHHIGEFCFQE

SEQ ID NO: 16963 - protein, 81 aa, Macaca mulatta
MLENYRNLVFLGITVSKPDLITCLEKEKEPWNMKRYEMVDEPPVICSHFAEDFWPEQDIKDSFKKVTLRRYDKCGPENLQL

SEQ ID NO: 16964 - protein, 81 aa, Macaca mulatta
EEWKCLDPAQQNLYRDVMLENYRNLVSLGFVISNPDLVTCLEQIKEPYNLKIHETAAKPPAMCSPFSQDLSPVQGIEDSFQ

SEQ ID NO: 16965 - protein, 81 aa, Monodon monoceros
AVENEHSSGYCIIKPQVIFKLEHGEEPWPSEEEFLNQKYPGCYRIDVHIEENQEKQEKPLWQVVFTDNKILSKEEQKALEK

SEQ ID NO: 16966 - protein, 81 aa, Callithrix jacchus
VHGSVTFRDVAIDFSQEEWECLQPAQKTLYRDVMLENYSHLISLAGSSVSKPDVITLLEQEKEPWMVIWSQNVDLRKYLWK

SEQ ID NO: 16967 - protein, 81 aa, Macaca mulatta
PQGRLTFRDVAIEFSQEEWKCLDPAQRALYRDVMLENYRNLVSLDISSKCMMKEFSSTAQGNTEVIHRGTIQRHERHHIGD

SEQ ID NO: 16968 - protein, 81 aa, Bos taurus
VEELSCQTDVTIDFTLEEWECLDLDQQELYRNVMLENYGNLASLGLVVSKPDLVTFLEQMKNPWDIRRTDTTATYPFAVWE

SEQ ID NO: 16969 - protein, 81 aa, Bos taurus
TQLTFKDVFIDFTPEEWECLDPAQRTLYKDVMVETLRILLSVVNSDKGEVFHTVMLGRPESREITDFFLREIQENLHEFEC

SEQ ID NO: 16970 - protein, 81 aa, Bos taurus
SLTFQDVAIDFSQEEWGFLDPAQRELYTAVMLETYQNLVWLGKCTQPLVHICLPKRINGETYHHERVMKKTSSTGREYGKA

SEQ ID NO: 16971 - protein, 81 aa, Bos taurus
NRNFWILRLPPGSKGEPEWGKLDEWQKELYKHVMRGNYEMLVSLDYAISKPDILTRMERGEEPCPEGPWGREEGNEREEVC

SEQ ID NO: 16972 - protein, 81 aa, Ovis aries
CQDPVTFEDVAIVFTDEEWRSLVPTQRDLYKEVMLENYKSIVSLAGLPIPGPDVIFQLKRGDEPWLVEFHEFEGKEGAENV

SEQ ID NO: 16973 - protein, 81 aa, Ovis aries
FQEPVSFRDVAVVFTEEELGLLDSAQRKLYQEVMLENFRNLLSVGNQPFKPELIFQLEREERLMMETQRDGCSGTKSPHNM

SEQ ID NO: 16974 - protein, 81 aa, Ovis aries
AKQLTIFRDVAVDFSQEEWECLDLEQRHQYRDVMLENYSNLVSLGLCIYQPEVFFLLEKGREPWMALADETCPDMQSRYQT

SEQ ID NO: 16975 - protein, 81 aa, Ovis aries
WQGNVTFEDVFVSFSQEEWGLLDEAQRLLYHEVMLENYALMASLGYASSMSHGVSPQELGREPWVFDWANTTPALTREAQS

SEQ ID NO: 16976 - protein, 81 aa, Ovis aries
MLETYSNLVSVGYEGTKPYVILQLEQEEAPWICEAACSGCHCQENIWQVNIHRKRRQDTLLRQGPFISRKTFPKERSHECN

SEQ ID NO: 16977 - protein, 81 aa, Ovis aries
NQESLTFKDVAVNFTQEEWHHVDAAQRRLYRDVMLENYSHLVFLGYQVSKPEVIFKLEQGEEPWIAEGEIQRPVYPDWKTR

SEQ ID NO: 16978 - protein, 81 aa, Ovis aries
MLENYRNLASLGLVVSKPNLVTFLEQMKNPWDVRRLETPQIHTGKKPYECKECDKAFMCYSNLSQHKRIHTGERPYKCTEC

SEQ ID NO: 16979 - protein, 81 aa, Otolemur garnettii
QGVLTFKDVAIEFSVEEWACLDPAQQHLYQEVMLETYRNLVFLGLAVSKPDLITCLEQSKEPWKVKTQQTLLKPPVLSNHS

SEQ ID NO: 16980 - protein, 81 aa, Vulpes vulpes
MMLENYRNLVSVGYQASKPDALSKLERGGELSMIEDEIHSRICPEIRKADDPLQCHLQNRSIQKSVEQCYEHNTFANILNQ

SEQ ID NO: 16981 - protein, 81 aa, Vulpes vulpes
HQELVSFKDVAVYFTQTEWAGLSPAQKALYRSVMLENYGNLTSLGYPVPRPALVSLLEGGNLPWGLEAQNNPSAERSKGIC

SEQ ID NO: 16982 - protein, 81 aa, Vulpes vulpes
CWGLLSFKDISMEFTWEEWQLLDSAQKYLYRDVILENYSHLVSLGYHGTKPDLIFKLEQGEEPWMINARVSRQSYPEGWKE

SEQ ID NO: 16983 - protein, 81 aa, Vulpes vulpes
MLENYHNFVSVGYLIKKPAVIFKLEEGKEPWIVEEELLYQNYQEDNKVHYLTERIQKYQDKYLPQLLFSNKKLSSEKVYAL

SEQ ID NO: 16984 - protein, 81 aa, Vulpes vulpes
MFKDVAIDVSQEEWECLNPTQRNLYKDVMLENYSNLVSLGLSISKPAVISSLEQGKEPWMVEREVTGGWCTDLVSRYEAKK

SEQ ID NO: 16985 - protein, 81 aa, Otolemur garnettii
QEGVNFKIVTVDFTQEEEGTWNPAQKTLDRDVILENHRDLVSWDLATTLRRRESASKWSGFDDEPFHGVKIEKLTRDDPWL

SEQ ID NO: 16986 - protein, 81 aa, Otolemur garnettii
QELVSFKDVAVDFTQEEWHQLDPAQKTLYRDVMLENYSHLVSMGYPVSKPDVISKLEQGEDPWIIKGDIPSCIYPDENQAD

SEQ ID NO: 16987 - protein, 81 aa, Odocoileus virginianus
HQGSVTFEDVAMYFSWEEWCLLDEAQIQLYLDVMLENFALVCMLGSWRGVQDKETPSEEIKPAGVLQFCTPRAGLSPEKTH

SEQ ID NO: 16988 - protein, 81 aa, Cebus imitator
YQDSVTFDDLAVDFTPEEWMLLDPTQRNLYRDVMLENYKNLATVGCQLLKPSLISWLEQEESRTVQRGDFHEWKVQLKTKE

SEQ ID NO: 16989 - protein, 81 aa, Cebus imitator
AQGCVTFEDVTIYFSKEEWGLLDEAQRLLYCDVMLENFALIASLGLISFRSHIVSQLEMGKEPWVPDSMDMTSAMARGVYG

SEQ ID NO: 16990 - protein, 81 aa, Cebus imitator
MNSVSFEDVAVNFTLEEWALLDSSQKKLYKDVMRETFKNLVCLGKRWEDQDVEDDHRNLGRNRRGHMVERLCESRKGSKCR

SEQ ID NO: 16991 - protein, 81 aa, Cebus imitator
MFKEAVTFKDVAVVFTEEELGLLGPAQRKLYRDVMLENFRNLLSVGQQAFDRDIFQFLREEKVWMMKTATQREGNSGGKIQ

SEQ ID NO: 16992 - protein, 81 aa, Macaca mulatta
LQASVSFEDVTVDFSREEWQHLDPAQRCLYWDVTLENYSHLLSVGYQVPKSEAAFKLEQGEGPWTLAGEAPHQSCSGEAIE

SEQ ID NO: 16993 - protein, 81 aa, Callithrix jacchus
TEGVLKFRDVAIEFSWKEWQYLDTAQQNLYRNVMLENYRNLVFLGIAASNSDLITCLEQGKEPWNVKRHEFEAKLPGRSGM

SEQ ID NO: 16994 - protein, 81 aa, Callithrix jacchus
GLLDPVQRNLYRDVMLENFRNLLSVAPSFHISEFSVLTADKIQSEMEAGPHEELSWGQIWKQIASDLVKYEDSMINISQFP

SEQ ID NO: 16995 - protein, 81 aa, Macaca mulatta
WDLLDEAQKHLYFDVMLENFALTSSLGCWHGVEHEETPSEQRISVEGVPQFRTSKEGSSSQNAYSCEICGLVLRDILHLAE

SEQ ID NO: 16996 - protein, 81 aa, Macaca mulatta
QGLLTFRDVAIEFSQEEWKCLDPAQRTLYRAVMLENYRNLVSLAISSKCMMKEFSSTAQGNREVLHTGTLQRHESHHIGDF

SEQ ID NO: 16997 - protein, 81 aa, Callithrix jacchus
QASVALEDVAVNFTREEWALLGPCQKNLYKDVMQETIRNLDCVGMKWKDQNIEDQYTYLRKNLRCYMLERFGESKDGRQCG

SEQ ID NO: 16998 - protein, 81 aa, Callithrix jacchus
SYEGSVSFRDVAINFSREEWRHLDLSQRNLYWDVMLETYSHLLSVGYQFPKPEVVMLEQGNEPWALQGERPRHSCPGEKLW

SEQ ID NO: 16999 - protein, 81 aa, Macaca mulatta
VQESVTFRDVAVFFSQDEWLHLDSAQRALYREVMLENYSSLVSLGILFSKPKVISQLEQGEDPWMVESGVPQGAHLGWESL

SEQ ID NO: 17000 - protein, 81 aa, Macaca mulatta
QGLLTFRDVAIEFSQEEWKCLDPAQRTLYRDVMLENYRNLVSLAISSKCMMKEFSSTAQGNREVLHTGTLQRHESHHIGDF

SEQ ID NO: 17001 - protein, 81 aa, Callithrix jacchus
GKEPLTFRDVAIEFSLEEWQCLDTAQRDLYRNVLLENYRNLVFLGIAVSKPYLITCLEQKKEPWNMKRCEMVAKPPVMCFH

SEQ ID NO: 17002 - protein, 81 aa, Macaca mulatta
MLENYKNLATVGYQLFKPSLISWLEQEESRTVERGDFQASEWKVQLKTKESALQQDFLGEPNSSGIQMIGSYNGGEANDVK

SEQ ID NO: 17003 - protein, 81 aa, Callithrix jacchus
DSVAFEDVAINFTCEEWALLGPSQKSLYRDVMQETIRNLDCIGMKWQNLDIEEDKYRNPGRNLRYYMVKRAREIKDNSQCG

SEQ ID NO: 17004 - protein, 81 aa, Bos taurus
WEGSMMFRDVSINFSQEEWECLDSGQMNLYKEVMLENFSNLVSVGLSSSKPAVISLLEQGKEPWMIDRELTRGLCSGKQEM

SEQ ID NO: 17005 - protein, 81 aa, Bos taurus
LTLQVVVTFKDVAVTFTREEWGQLDLGQRTLFREVMLETCGLLVSLGDRPKCQPRDSSSSQPVLSEEALLQGSLTLGSSWD

SEQ ID NO: 17006 - protein, 81 aa, Bos taurus
GIALSQLTFKDVFIDFTPEEWECLDPAQRTLYKDVMVETLRILLWVRITSFRSGGILWGTSACSVCVSWEPLFFLLRSKPC

SEQ ID NO: 17007 - protein, 81 aa, Ovis aries
ARLSVTFDDVAVTFTQEEWGHLEPAQRTLYREVMLENCGLLVSLGCPVPRPELIYQLEHGQELWTVKRDLSRSTCPGDKGK

SEQ ID NO: 17008 - protein, 81 aa, Ovis aries
QEAAELEFLSVNYTLKKWKGTALSQRALYWNIMLENCCSLAPLGENRMASSQLSPKQDISEESKSADRTSGILCRLILGGP

SEQ ID NO: 17009 - protein, 81 aa, Ovis aries
LQETLTFRDVFVDFTQEEWQQLDAAQKNLHRVVMLENYSHLVSVGYLVAQPHGIFRLGQGEEEARMAAGESVMWSCPGKPT

SEQ ID NO: 17010 - protein, 81 aa, Ovis aries
PQGSVTFEDVAVYFSWEEWALLDEAQRCLYHDVMLENFALTSSLGCWHGVEDKEAPSEQSICIGVSQIRTLKADSSPQKGQ

SEQ ID NO: 17011 - protein, 81 aa, Ovis aries
SCEVSVSLRDVAVDFSREEWQQLDLDQKNLYRDVMLETCSHLLSIGYQVPEIEVFMLEQGKEPWALQGEGPYQSCPEELWQ

SEQ ID NO: 17012 - protein, 81 aa, Otolemur garnettii
QALLTFRDVSVEFSMDEWACLEPAQQNLYRDVMLETYRHLVFLGEDNLHTQFIVIFKENISSWHRKKTHQTVVKHPVISNH

SEQ ID NO: 17013 - protein, 81 aa, Otolemur garnettii
ASVTVAFDDVALYFTEQEWDILEKWQKEMYKQVMKTNYETLDSLGCAFSKPDLITWMEQGRMLLIGDQKCLEKRLTISPSN

SEQ ID NO: 17014 - protein, 81 aa, Otolemur garnettii
MLETYGHLLSVGLGNQITKPEVISLLEQGEEPWSVEQACPQSTCPEWMRNIESKALIPTQTIFEEEQSPGMKLERYIWDDP

SEQ ID NO: 17015 - protein, 81 aa, Vulpes vulpes
ARELVTYEDVAVDFTQEEWQHLDPAQKTLHRDVMLEIYSHLVSVGCSGIKPGIIFKLEYEEDPWIIKSELSRWIHSDREES

SEQ ID NO: 17016 - protein, 81 aa, Enhydra lutris
LQEPVTFRDVAVDFTQEEWGQLGPAQRTLYRDVMLETFGHLLSVGPELPKPEVISQLEQGAELWATERGIAQGYCPGRESG

SEQ ID NO: 17017 - protein, 81 aa, Enhydra lutris
PQDLMTFEDVAVEFTQWEWGQLDPAQKDLYRVVMLENFKNLASLGFPVAKPYVISQLEKGKEPCVLEGEISTGEFSDWEKR

SEQ ID NO: 17018 - protein, 81 aa, Enhydra lutris
GPVTMTFDDVALYFSEQEWEILEKWQKEMYQQVMKTNYETLDSLGGIFSKPNLITWIEQGRMLLIRDRGPLEKNMTLSPST

SEQ ID NO: 17019 - protein, 81 aa, Enhydra lutris
QDTVVFADVAVNFTPEEWALLDRGQRRLYRDVMLETCRNLASLDRCTQVNPCGSGIQLNILENELSSEDKIVTFTRNDSWA

SEQ ID NO: 17020 - protein, 81 aa, Enhydra lutris
ILLPLTFEDVAIYFSEQEWQNLEAWQKELYKHVMRTNYEILVSLDNGLPKPELISWIEQEREFFQNWQETQKSGTIICSSA

SEQ ID NO: 17021 - protein, 81 aa, Enhydra lutris
RPGAVSFADVAVYFSPEEWGCLRPAQRALYRDVMREIYCHLGALGFRGTKPALISWVEEEADLWGPAARDPEVGECLPEAD

SEQ ID NO: 17022 - protein, 81 aa, Enhydra lutris
PLESVTFEDVAIDFTKEEWDLLDISQRKLFRDVMLENIRHLVSLGYQHCKSDLIFQLEQGQELWSEGTRFLQGQSPGRGNA

SEQ ID NO: 17023 - protein, 81 aa, Enhydra lutris
LRGSVSFEDVAVDFTRQEWHSLDPAQRTMHKDVMLENYSNLASVGLCVAKPEMIFKLERGEELWILEEESPGPGYPGSLSL

SEQ ID NO: 17024 - protein, 81 aa, Pongo abelii
FQNSVAFEDVAVSFTQEEWALLDPSQKSLYRDVMQETFKNLTSVGKTWKVQNIEDEFKNPRRNLSLMREKLCESKESHHCG

SEQ ID NO: 17025 - protein, 81 aa, Pongo abelii
MELLTFRDVAVEFSPEEWKCLDPAQQNLYRDVMLENYRNLVSLGVAISNPDLVIYLEQRKEPYKMKIHETVAKHPDRSPFK

SEQ ID NO: 17026 - protein, 81 aa, Pongo abelii
QEGVNFKIVTVDFTQEEQGTWNPAQRTLDRDVILENHRDLVSWDLATAVGKKDSTSKQRIFDEELANGVKIERFTRDDPWL

SEQ ID NO: 17027 - protein, 81 aa, Pongo abelii
MLENFRNLVFLGIVVSKPDLITCLEQGKKSLTMKRHEMIANPPVMCFHFAQDLCPEQSLKDSFQKVILRRYEKREYGNLEL

SEQ ID NO: 17028 - protein, 81 aa, Pongo abelii
TVAYEDLSEDYTQKKWKGVALSQRALHWNMMLENDRSMTSLGRNMMESSELTPKQEIFKVSESSNSTSGGFFGVVPGETET

SEQ ID NO: 17029 - protein, 81 aa, Pongo abelii
LKGLVTFEDVAVEFTQEEWALLDPAQRTLYRDVMLENFRNLASSLGNQVDKPSLISQLEQEDKVMTEERGILSGTCPDVEN

SEQ ID NO: 17030 - protein, 81 aa, Pongo abelii
PRLPLTFEDVAIYFSEQEWQDLEAWQKELYKHVMRSNYETLISLDDGLPKPELISWIEHGGEPFRKWRESQKSGNIICSSV

SEQ ID NO: 17031 - protein, 81 aa, Cebus imitator
MTLLDVAIEFSLEEWKFLDPAQQNLYRDVMLENYRNLFSIGLTVSKPGLITCLEQRKAPWNLKRREAVDGHPEIGFCHVVQ

SEQ ID NO: 17032 - protein, 81 aa, Cebus imitator
MESVTFEDVAVEFIQEWALLDSARRNLCRYGMLDKCRSLASRESPWESQLKPKELPSMRDILEEASSRDMQMGPGLFLRMQ

SEQ ID NO: 17033 - protein, 81 aa, Callithrix jacchus
FQVPVTLKDVIVEFTKEEWKLLTPAQRTLYKDVMLENYSHLVSVGYRVNKPNVVFKLKQGKEPWMLEVEFPHRGLPEDLWN

SEQ ID NO: 17034 - protein, 81 aa, Callithrix jacchus
AQGCVTFEDVTIYFSKEEWGLLDEAQRLLYCDVMLENFALIASLGLISFRSHIVSQLEMGKEPWVPDSMDMTSAVARGAYG

SEQ ID NO: 17035 - protein, 81 aa, Callithrix jacchus
AQMLVSFKDVAVTFTQEEWRQLDPAQRTLYQEVMLETCGLLVSLGYWVPKAELVHLLEHGQELWTVKSGRSHPTCVGDKAQ

SEQ ID NO: 17036 - protein, 81 aa, Monodon monoceros
MGGKHGLCISKPDVISLLEQDKEPWMMKGEITRGLPPDLEYVWMRKELSPNQDIYEEKLSQAMIMERLTGCDLKCSTLGEN

SEQ ID NO: 17037 - protein, 81 aa, Macaca mulatta
DSVTFDDVAVEFTPEEWVLLDTTQKYLYRDVMLENYMNLASVGFFSREPVCPFEEKTKAERMVEDYLANSYQDSVTFDDVA

SEQ ID NO: 17038 - protein, 81 aa, Bos taurus
FQPTVSFKDVAVTFTWVKWGHVDLAQRTVYREVVLETCSRLVSLVKAVATHHQTQGVAHFRHAWTGPEEKGILPGNFAGFL

SEQ ID NO: 17039 - protein, 81 aa, Bos taurus
DLTFFSRWFTDVAVVFSPDLWAHLSLEERELYRDVMLDTCAQLVLLGRWTYKAEVISSLRQGRDLRMLEGEATSAAWPEPQ

SEQ ID NO: 17040 - protein, 81 aa, Ovis aries
FQVPVTYEDVAVTFTQEEWGHLGPVQRMLYWEVMLETCRLLVSLGCPLPEPELISPAEPGPESQTSRRGPTPGSCSGDNTK

SEQ ID NO: 17041 - protein, 81 aa, Ovis aries
AQETLSFKDVAVDFTWEEWQLLAPAQKTLYRDVMLENYSNLVSVGYRVSKSDVLSKLKQGKERWMTEDEIHSRTWPETGNI

SEQ ID NO: 17042 - protein, 81 aa, Ovis aries
VTFGDVAVHFSREEWQCLDPGQRALYKEVMLENHSSVAGLDATVGTDAEQACEDMDSLKSESGGVMVKTLPQDFPQSPGFG

SEQ ID NO: 17043 - protein, 81 aa, Ovis aries
QAQETLTFDDVAMDFTWEEWQLLTPVQKALYRHVMLENYSNLVSAGFQASISEVLSKLDQGEPWMMDDEIHCQTRSEVWKV

SEQ ID NO: 17044 - protein, 81 aa, Ovis aries
QGGVTFPDVAVRFSQREWRLLDETQRRLYLDVMLENYTLVSSLGCCCGAEGEETPCEKTVPVGVSWTGSPTAAPFSQKTHP

SEQ ID NO: 17045 - protein, 81 aa, Ovis aries
MAGQDLAVRFSKDEWRLLGEGQRALYLDVMQENYDTLASLGTAELLPLSAFLSPSEPGGAVGARSRAGDRQELPQGGGPLG

SEQ ID NO: 17046 - protein, 81 aa, Ovis aries
QEPVTFEDVAVDFTQEEWQQLAPAQKTLHRDVMLEIYSHLVSAGCSDLKLDIISKLEHGKDPWITESELSRRTYSGKEQSS

SEQ ID NO: 17047 - protein, 81 aa, Ovis aries
MFKDVAIDVSQEEWECLNPAQRNLYKDVMLENYSNLVSLGLSISKPAVITSLEQGKEPWMVMREVTRERCPDLVSKCEPKK

SEQ ID NO: 17048 - protein, 81 aa, Ovis aries
MLENYSSLVSLGYEVMKPGVILKLEQGEEPWTGDGEIPSSDSLDQVFQVNGHMTWHKDNKKFKNMKQDHECDALGKKFNLS

SEQ ID NO: 17049 - protein, 81 aa, Ovis aries
SKGSMMFRDVSVNFSQEEWECLDSGQMNLYKEVMLENFSNLVSVGLSSSKPAVISLLEQGKEPWMIDRELTRGLCSDLESM

SEQ ID NO: 17050 - protein, 81 aa, Ovis aries
HQEVVTFEDVAVYFTQTEWAGLSPAQRALYRSVMLEIYGNLTSLGYPVPKPELVSLLERGDLPVGLETQDNPPAQGTRDIY

SEQ ID NO: 17051 - protein, 81 aa, Otolemur garnettii
HFELLTFRDVTIEFSPEEWACLDPAQWNLYRDVMLENYRNLVSLGLAASKPDLITCLEQRKGPWNVKRHEVVTEHPAMSSH

SEQ ID NO: 17052 - protein, 81 aa, Vulpes vulpes
TQGRVTFEDVAVYFSWEEWGLLDEAQRCLYQDVMLENLALITSLGCWLGAEDEEAPEQRVSVQGVSQVRILKAVVSPQEAH

SEQ ID NO: 17053 - protein, 81 aa, Vulpes vulpes
MNFEDVAIDFSQEEWGLLDETQRLLYCDVMLENFALVASLDLHQQQRHDSGEKPWERDVHRASWVTSCNFGVSGQSFTCRK

SEQ ID NO: 17054 - protein, 81 aa, Vulpes vulpes
FKEMVTFKDVAVIFTEEELGLLDPAQRKLYGDVMLENFRNLLSVGHQPFTPDVMLQLERGEKLRMVKTAAWGPSASGDKNL

SEQ ID NO: 17055 - protein, 81 aa, Otolemur garnettii
ISFEDVAVDFTWEEWQLLNPTQKNLYRDVMLENYSHLIFLGYQIIKPAGIFKLEQEEAWIMDEEILSQNFSGWGDRDPGSM

SEQ ID NO: 17056 - protein, 81 aa, Otolemur garnettii
RPRAVKFVDVAVYFSPEEWGYLRPGQRALYRDVMRETYGHLGALGCAGPKPALISWLERNTDDWEPAALDPQENGRGVTVQ

SEQ ID NO: 17057 - protein, 81 aa, Vulpes vulpes
SQHLVTFEDVAVDFTQEEWTLLDQAQRDLYRDVMLENYQNLITLGYESCHPDLNSTMEVAEELRTGGRGVLQELELQLKTK

SEQ ID NO: 17058 - protein, 81 aa, Enhydra lutris
SQGSVSFEDISVDFTQKEWQLLDPAQRLLYREVMLENYRQLVSLGHCVTTPELILKLEQGEEPWVPKRELPSPSHPEVQKT

SEQ ID NO: 17059 - protein, 81 aa, Enhydra lutris
FEELVTFEDVAVYFSENEWTSLAPTQRVLYRDVMLENYGAVASLAAFPFPKPALISQLERGEAPWCKAPQGALDGEGPRGI

SEQ ID NO: 17060 - protein, 81 aa, Enhydra lutris
SQHLVTFEDVAVTFTQEEWTLLDQTQRDLYRDVMLENYQNLIILGYESCKPDLNSLMGGAEELRTGGRGILQELDLLKTKG

SEQ ID NO: 17061 - protein, 81 aa, Pongo abelii
IMEEAVTFKDVAVFFTEEELGLLDPAQRKLYRDVMLENFRNLLSMGHQPFHQDTFHFLKEETFWMMGTATQREGNSGGKIQ

SEQ ID NO: 17062 - protein, 81 aa, Pongo abelii
VASEDVAVNFTLEEWALLDPSQKKLYRDVMRETFRNLACVGKKWEDQSIEDWYKNQGRILSNHMEEGLNESKEYDQCGEAF

SEQ ID NO: 17063 - protein, 81 aa, Pongo abelii
RVQSCVTFEDVFVYFSREEWELLEEAQRFLYRDVMLENFALVATLAFIFPVPCSGAVGGGRKPWVPDRAHITAATVKETYR

SEQ ID NO: 17064 - protein, 81 aa, Macaca mulatta
ESITFGDVAIDFSHQEWEYLDLVQKTLYQEVMMENYDNLVSLAGHSISKPDLITLLEQGKEPWMIVGEETRGECTDLDSRY

SEQ ID NO: 17065 - protein, 81 aa, Callithrix jacchus
PQVSLTFEDVAVLFTRDEWRKLAPSQRNLYRDVMLENYRNLVSLGLPFTKPKVISLLQQGEDPWKVEKDSSGSPCLGLKSS

SEQ ID NO: 17066 - protein, 81 aa, Callithrix jacchus
MERFWDVAIEFSLEEWQCLDTAQRNLYKNVILENYRNLVFLGIAVSKPDLIACLEQEKEPLIMKRDEMCLPTTQSKMFLCD

SEQ ID NO: 17067 - protein, 81 aa, Macaca mulatta
TQGHLTFRDVAIEFSQEEWKCLDPVQKALYRDVMLENYRNLVSLGICLPDLSIISMLEQRRDPRNLQSEVKIANNPDGREC

SEQ ID NO: 17068 - protein, 81 aa, Macaca mulatta
MLENYCHFVSVGFHMTKPDMIRKLEQGEELWTQRIFPSYSYLEEDGKTEDVLVKFKEYQDRHSRSLIFINHKKLIKERSNI

SEQ ID NO: 17069 - protein, 81 aa, Callithrix jacchus
SQGLLIFRDVAIEFSPEEWSYLNPAQQNLYRDVMLENYRNLVSLGIAISKPDLITCLEQRNEPWSVKKCETVAKQPAISSH

SEQ ID NO: 17070 - protein, 81 aa, Bos taurus
ELVTFRDVVISFSQEEWEYLDSAQRDLYWDVMMENYSNLVSLDLESKYDTKTLSVDKVIIEKNNSQWEVIENSKLVGLQNS

SEQ ID NO: 17071 - protein, 81 aa, Bos taurus
MPGRMTFQDVAIDFTQEKWECLDLDQRELYRDVMLEKYGNLASLGLVVSKVDLVTFLEQMKDPRNISRMETMAMYPGTSTL

SEQ ID NO: 17072 - protein, 81 aa, Bos taurus
MTHSEGRLMFQDVAIDFTQEEWECLDPGQRKLYRDVMVENYRNLASLGEDNCLPESLIYPLRFCSVISRMSSELFCLPQYF

SEQ ID NO: 17073 - protein, 81 aa, Bos taurus
LQETLTFRDVFVDFTQEEWQQLDAAQKNLHRDVMLENYSHLVSVGYLVAQPHGIFRLGQGEEEARIAAGESVIWSCPEFWK

SEQ ID NO: 17074 - protein, 81 aa, Bos taurus
PAGALTQQAAFPQVPVTLEDVAVYLSQEEWGCLDLAQQDHSCDVLLEDAGAVGRPCQTPRCSWASTSSSVDGTVTAPSHRP

SEQ ID NO: 17075 - protein, 81 aa, Bos taurus
FQEPVTFEDVAVYFTQNQWASLDSAQRALYREVMLENYANVASLVSPFPRPDLISQLERGEAPWDPDPWEAEDLRGICPGG

SEQ ID NO: 17076 - protein, 81 aa, Ovis aries
ARGPITFRDVVIEFFLHEWEFLNPLQKKLYCIVMMENYSNVVSIGHFISKPDIIVLLEEERDPWMVVKEETRRWNTDLDSS

SEQ ID NO: 17077 - protein, 81 aa, Vulpes vulpes
MPQEEWQQLDPTQKALYRDVMLENYCHLISVGFHMTKPDMIRKLEQGEELWTTERIFPSQSYLEEDGKTEDVLVKFKEYQD

SEQ ID NO: 17078 - protein, 81 aa, Otolemur garnettii
SQVSLMFEDVAVLFSRDEWRKLEPSQRNLYRDVMLENYSNLISLAGLLFTKPKVISLLQQGEDPWKVEKESPPGSSLGFKS

SEQ ID NO: 17079 - protein, 81 aa, Vulpes vulpes
MLENYSNLVSLGLLFSKPKVISLLQRGEDPWKVEKESPGGPSLGWKSSHKTTKSTQTQDSSFQELIMRRSKRHGPWDFKSE

SEQ ID NO: 17080 - protein, 81 aa, Vulpes vulpes
MDFSREEWQQLDPAQRCLYQDVMLEIYSHLLFVGYNIPNPEIISRMEKGEEPWMREVQLPHQRHRERAFGLKTSQHKMFEK

SEQ ID NO: 17081 - protein, 81 aa, Vulpes vulpes
SFEGSVSFRDVAVDFSREEWQHLDLAQRNLYRDVMLETYSHLLSVGYEVPQPEVFMLEQGKEPWALQGESPHQNCTGEKLW

SEQ ID NO: 17082 - protein, 81 aa, Vulpes vulpes
MLENYGHLLFLGLIVSKPDLVSFLEQNTETWSVKRKKRVTIHPAVSSRDTQSMLSKPSIKASFQRVSMGRLKNNAIKNLHF

SEQ ID NO: 17083 - protein, 81 aa, Otolemur garnettii
MASPSPSPEPKEEWDYLDPAQRSLYKDVMMENYGNLVALDVLNRDKDEEPTVKQEIEEIEQEVEPQGVIVTRIKSEIDQDP

SEQ ID NO: 17084 - protein, 81 aa, Otolemur garnettii
GTVTFQDVAVYFSWEEWGLLDEAQRCLYRDVMLENLALITSLDVCQHQKQHFGEKYFRSIVGRTLFVKSYKFHVSGETFTC

SEQ ID NO: 17085 - protein, 81 aa, Enhydra lutris
WLQVPVTVKDVAVEFTQEEWMMLDSGQRRIYRDVMLENYANLTSLEYQLWKFIVISLSGQEEIRTMKKIILQDTYTDAEIQ

SEQ ID NO: 17086 - protein, 81 aa, Enhydra lutris
SLGPVSFRDVAVDFTQEEWQQLEPEQKTTYRDVMLENYSHLISVGCHIIKPEVIIKLEQGEEPWIVEGEFLPQSYPEEVWK

SEQ ID NO: 17087 - protein, 81 aa, Enhydra lutris
LQGSVTFQDVAVDFTPEEWQLLDCDQRTLYWDVMLENFRNLISVGGPGTKTKGIFKAEQGQEPWLGEGENPRWRCPEADCL

SEQ ID NO: 17088 - protein, 81 aa, Enhydra lutris
FTGPVSFKDVAVDFTQEEWQYLDLPQRDLYRDVMLENYINLISVGYQTTKPSVIHKLEQGEEPWMMEREIPSWSHAEEVWH

SEQ ID NO: 17089 - protein, 81 aa, Enhydra lutris
SQGSLSFRDVTVGFTQEEWQHLDPAQRTLYRDVMLENYSHLVSVGYSIPKPEVILKLEQGEEPWILEEFLSQNDPELINNS

SEQ ID NO: 17090 - protein, 81 aa, Enhydra lutris
GGAGQLNFRDVAIEFSEEEWGRLTHTQRQLYRDVMLENYGHLVFLGLITSKPDFVSFLEQKKQLWDVIRKETVVIHPGRWE

SEQ ID NO: 17091 - protein, 81 aa, Enhydra lutris
FQEAVTFKDVAVVFSEEELGLLDSTQRKLYRDVMLENFRNLVSVGHSSSKPDMISQLEREEEKLYVKEICTERGRHSDKNC

SEQ ID NO: 17092 - protein, 81 aa, Callithrix jacchus
CEVSVSFEDVTVDFSREEWQQLDSTQRRLYQDVMLENYSHLLSVGFEVPKPEVIFKLEQGEGPWTLEGETPRHSCSDGKFG

SEQ ID NO: 17093 - protein, 81 aa, Callithrix jacchus
MGPLTFMDVTVEFSLEEWQCLDIAQQNLYRDVMLENYRNLVFLNMITCLEQGIEPWNIKRYEMVAKPPVMCSHFAEDLWLE

SEQ ID NO: 17094 - protein, 81 aa, Macaca mulatta
PQAKLTFEDVAVLLSQDEWDRLCPAQRGLYRNVMMETYGNVVSLDNLKCDHTTACTQDSLSCPWECETKGENQNTDLSPKP

SEQ ID NO: 17095 - protein, 81 aa, Macaca mulatta
MLFIFNKTGIAVSKPDLITCLEQGKEPWNMERHEMVAKPPGMCCYFAQDLWPEQSIKASFQRIIPRKYEKCGHHNLQLKKG

SEQ ID NO: 17096 - protein, 81 aa, Callithrix jacchus
SYEGSVSFRDVAINFSREEWRHLDLSQRNLYWDVMLETYSHLLSVGYQVPEAEVVMLEQGNEPWALQGERPRHSCPGEKLW

SEQ ID NO: 17097 - protein, 81 aa, Macaca mulatta
NSIYTRYFDVCVDFTQEEWYLLDPAQKILYRDVILENYSNLVSVGYCITKPEVVFKIEQGEEPWILEKGFPSQCHPERKWK

SEQ ID NO: 17098 - protein, 81 aa, Macaca mulatta
WLQEPMTFKDVAVEFTQDEWMMLDSAQRSLYRDVMLENYRNLTSLEYQLCKLTVISPLDQEEIRNMEKRIPQGICPDQKIL

SEQ ID NO: 17099 - protein, 81 aa, Callithrix jacchus
KPGAVSFADVAVYFSPEEWGCLRPAQRALYRDVMRETYGHLGALGFSGPKSAFISWVEGEMEAWSPEVQDPEGESPGTVSG

SEQ ID NO: 17100 - protein, 81 aa, Macaca mulatta
GLLIFRDVAIEFSPEEWSYLDPAQQNLYRDVMLENYRNLVSLGLLVSKPDLITFLEQRKEPWNVKREETVAVQPDVFSHYN

SEQ ID NO: 17101 - protein, 81 aa, Bos taurus
MMFRDVSINFSQEEWECLDSGQMNLYKEVMLENFSNLVSHMPFCFLSDLESMCETKLLSLKKRHFSQPTFLIPHQKTINEE

SEQ ID NO: 17102 - protein, 81 aa, Bos taurus
PHGTPDVAIDFTQEKWECLDLDQRELYRDVMLEKYGNLASLGEDNCLPESLIYPLGFSSIMSRMSSEIFSNLGIYQIFHLR

SEQ ID NO: 17103 - protein, 81 aa, Bos taurus
PQDLMTFEDVAVEFTWWEWGQLDPTQKDLYWEVMLENFKNLASLGFPVSKPYMICQLEEGEEPCILEREISTGVHSDWERR

SEQ ID NO: 17104 - protein, 81 aa, Bos taurus
KESVTFKDVAVDFTLEEWRLMDPTQRDLHKDVMLENYRNLVSLELETKPTTKNTIPTEDFSKKHLSQDAIVEKLTENGLWD

SEQ ID NO: 17105 - protein, 81 aa, Bos taurus
ESVTFQDVAVDFTQEEWALLDTSQRTLFREVMLENISHLVSVVISDREDDPKKQEMLSMQHICKKDAPLISAMQWSHTQED

SEQ ID NO: 17106 - protein, 81 aa, Ovis aries
VQESVTFKDVAVLFTQDEWAQLSPAQRALYRDVMLENYSNVVSLGLLGPKPDMFSQLGKGEEWMPEDSLGGFCLDWVITPM

SEQ ID NO: 17107 - protein, 81 aa, Ovis aries
MNKSQEEWEQLEPSQRILYMDVMLENYSNLLSVEVWKADDQMETDHRNPDEQARPLVIFKDQTPTEERDNNLFGKTFNLST

SEQ ID NO: 17108 - protein, 81 aa, Ovis aries
PAQLTFKDVFIDFTPEEWDCMNPAQRTLYKDVMVETLRNLLSVDVSQIRMIKKLQTKGDSGKEEIFQRVVFGRAESHDIED

SEQ ID NO: 17109 - protein, 81 aa, Ovis aries
CSGLLSFTDISMEFSWEEWQLLDSVQKHLYRDVTLENYSNLVSVGYHGTKPDLIFKLEQGEEPWIINLEVSHQSCPDGWEK

SEQ ID NO: 17110 - protein, 81 aa, Vulpes vulpes
PLTFKDVAVVFTEEELKLLDPTQRKLYRDVMLENFRNLLSVGDKNEKVMEYIQERELKCLSYRELSYWKIWEQVSGELTGS

SEQ ID NO: 17111 - protein, 81 aa, Otolemur garnettii
FQGPLSFMDVFVDFTWEEWRLLDPAQKHLYRSVMLENYSNLVSVVWVAPMAQLSFILYSKSSWMLLSGKPRQSGKKCCESN

SEQ ID NO: 17112 - protein, 81 aa, Otolemur garnettii
LVTFRDVAINFSQEEWECLDHAQRDLYLDVMLENYSNLVSLDWESTTYETKKLFSEKDVFDINFSQWDIKEKSKTLGLEES

SEQ ID NO: 17113 - protein, 81 aa, Otolemur garnettii
LCEVPVSFEDVTVDFSREEWQHLDSTQRCLCQDVTLENYATCFQWGTVPKPEAIFQLEQGEGPWTLDGEAPHQSSSEEPWQ

SEQ ID NO: 17114 - protein, 81 aa, Otolemur garnettii
SQELLTFNDISIDFSQDEWGQLAPAHQDLYREVMLENYRNLVSVGYQLSKPSVISHLEKGEEPWMTEKEGPADPSSGLKSK

SEQ ID NO: 17115 - protein, 81 aa, Enhydra lutris
FQEAVTFKDVAVVFTREELGLLDPIQRKLYQDVMLENFRNLLSVGCEPFRSDTTLSLGREEKLWMREAETQGGGHSGFRNR

SEQ ID NO: 17116 - protein, 81 aa, Enhydra lutris
PDSVVFEDVVVDFTQEEWAMLNPSQRKLYRDVMLETFRNLVSVDDETQFKTIGSISQQDSFGEKLSNEQKIARFTKNDFWT

SEQ ID NO: 17117 - protein, 81 aa, Enhydra lutris
SQGTVTFKDVAIDFTQEEWQQLDPAQRNLYRNVMLENYNNLITVGCPFTKPDVIFKLEQEEEPWVVEEEVLRRHYPGEMWG

SEQ ID NO: 17118 - protein, 81 aa, Enhydra lutris
RDGLLSFKDISMEFTWEEWQLLDSTQKYLYRDVILENYSHLVSVGYHGTKPDLIFKLEQGEEPWIINAQVSRQSCPEGWKE

SEQ ID NO: 17119 - protein, 81 aa, Enhydra lutris
YKGPLSFEDVAIAFTKEEWQQLDRAQRTLYRDVMLENFSHLVSLGHPMSKPDVISKLEQGQEPWIVKRDIPSWIYPERETR

SEQ ID NO: 17120 - protein, 81 aa, Enhydra lutris
SSQGLLTFRDVAIEFSEEEWGLLTHTQRQLYRDVMLESYGHLLFLGLLPKPDLIMFLEQEKHLWDVKRKETRGFHSAVSSH

SEQ ID NO: 17121 - protein, 81 aa, Enhydra lutris
GGLTFEDVAVYFSQEEWRLLNEAQRRLYRDVMLENFTLLSSLGCSCRAEAAEAPFEQSISVGVSQARTPKEPRSSQKTHPC

SEQ ID NO: 17122 - protein, 81 aa, Pongo abelii
MSQVTFSDVAIDFSHEEWACLDSAQRDLYKDVMVQNYENLVSVGLSITKPYVIMLLEDGKEPWMMEKKLSKDMIPDWESRW

SEQ ID NO: 17123 - protein, 81 aa, Pongo abelii
KSQESLTLEDVAVEFTWEEWQLLGPAQKDLYRDVMLENYSNLVSVGYQASKPDALFKLDQGEPWTVENEIHSQICPEIKKV

SEQ ID NO: 17124 - protein, 81 aa, Pongo abelii
SQGLVSFKDVAVDFTQEEWQQLDPSQRTLYRDVMLENYSHLVSMGYPVSKPDVISRLEQGEEPWIIKGDISNWIYPDDYQA

SEQ ID NO: 17125 - protein, 81 aa, Pongo abelii
QGTVTFEDVAVNFTWEEWNLLSEAQRCLYRDVTLENLALISSLGCWCGVEDEEAPSKQTIYIQRETQVRTPMAGVSPKKAH

SEQ ID NO: 17126 - protein, 81 aa, Pongo abelii
FQGSVSFKDVTVGFTQEEWQHLDPSQRALYRDVMLENYSNLVSVGYCVHKPEVIFRLEQGEEPWKLEEEFPSQSFPEFICW

SEQ ID NO: 17127 - protein, 81 aa, Pongo abelii
ACGSITFRDVAIDFSHQEWEYLNLVQKTLYQEVMMENYDNLVLLAGHSKSKPDLITLLEQGKEPWMIVREETRGECTDLDS

SEQ ID NO: 17128 - protein, 81 aa, Zalophus californianus
AYGSLSFGEVAISFSQEEWECLDPAQRALYRDVMLETYSNLVSLAGSSISKPDVITLLEQEKEPWVVVRRETSRWYPDLES

SEQ ID NO: 17129 - protein, 81 aa, Carlito syrichta
QGLFTFKDVAIEFSQEEWDCLDLTQRALYRDVMLENYRNLLSLGEDNFPPEIDIFAGFANKELLPNEDINKAELCHLVILD

SEQ ID NO: 17130 - protein, 81 aa, Delphinapterus leucas
PQVLVSFEEVAVLLSQEEWGHLGPAQKRLYRDVMLETYGNLVSLGLQGSKPDVISKLEQGEEPWAPHSPRIEGSWIWRRRR

SEQ ID NO: 17131 - protein, 81 aa, Pan troglodytes
SVMGSVTFQDVAIDFSKEEWGFLNPAQRDLYTTVMLENYQNLVWLGLSISKSVISLLEKRKLPWIMAKEEIRGPLPGYFKV

SEQ ID NO: 17132 - protein, 81 aa, Zalophus californianus
SHGPLSFEDVAIAFTKEEWQQLDPAQRTLYRDVMLENFSHLVSLGHPVSKPDIISKLEQGEEPWIIKRDISDWICPERETR

SEQ ID NO: 17133 - protein, 81 aa, Balaenoptera acutorostrata
FQEPVSFKDVAVVFTEEELGLLDSAQRKLYRDVMLENFRNLLSVGNQPFKPELIFQLEREEELLMMETETQRDGCSGTKSQ

SEQ ID NO: 17134 - protein, 81 aa, Balaenoptera acutorostrata
SQGSMSFRDVTVGFTQEEWQHLDPAQRMLYRDVMLENYHNLVSVGYFITKPKVIFKLEQGEEPWILEEEFLYRSFPEDCKT

SEQ ID NO: 17135 - protein, 81 aa, Balaenoptera acutorostrata
PQGSVSFKDVTVDFTQEEWQQLDPAQKALYRDVMLENYCHLISVGFHMTKPDMIHKLEQGKELWTTEKIFPSQSYLEEDWK

SEQ ID NO: 17136 - protein, 81 aa, Ovis aries
PLTFEDVALYFSEEEWLIMDPNQRTLYLDVMQELYENVTSLGLKLKNDTGNDPPVSLPTLEIQPSGCEVVRKATMKDAETT

SEQ ID NO: 17137 - protein, 81 aa, Callorhinus ursinus
SKGSMMFRDVSINFSQEEWECLDSGQMNLYKEVMLENFSNLVSVGLSVSKPAVISLLEQGKEPWMVERALTRGLCSDLESM

SEQ ID NO: 17138 - protein, 81 aa, Callorhinus ursinus
SQSLLTFEEVAMYFSQEEWELLDPTQKALYNDVMRENYETVISLALFVLPKPKVISYLEQGEDPWVQGPLELKNSPGELPS

SEQ ID NO: 17139 - protein, 81 aa, Phyllostomus discolor
AQGLVTFRDVAIEFSQEEWKCLKPAQRDLYRDVTLENFGNLVSLGLSFSKPDVISLLEQGKEPWMITNDITGPWCPDLESR

SEQ ID NO: 17140 - protein, 81 aa, Camelus dromedarius
LPSSKVPAFSDKDSLGDEMLAAALLKAKAQELVTFEDVAVYFIRKEWKRLEPAQRDLYRDVMLENYGNVFSLDLQIDTLQV

SEQ ID NO: 17141 - protein, 81 aa, Ursus maritimus
MLENYGAVASLAAFPFPKPALISQLERGEAPWCKAPQGALDGEGPRGISSGCPFLKPAGISHLEQVEEPLNPKLQGEVPSL

SEQ ID NO: 17142 - protein, 81 aa, Rhinopithecus bieti
AHALVTFRDVAIDFSQKEWECLDTTQRKLYRDVMLENYSNLVSLGYSGSKPDVITLLEQGKEPCVAVRDVTGTQYPGLLSR

SEQ ID NO: 17143 - protein, 81 aa, Acinonyx jubatus
SQGLLIFRDVAIEFSQEEWGCLNHSQREVYRDVMLENYGHLLFLGHIVSKLDLVIILEQKKESWNVKQKERVATHLGRWRI

SEQ ID NO: 17144 - protein, 81 aa, Rhinopithecus roxellana
MEGLVMFQDLFIDFSQEEWECLDAAQKDLYRDVMMENYSSLVSLDSEFRCKTKDSCLLKEIYEVTSSQWMRMEKCHSLVGS

SEQ ID NO: 17145 - protein, 81 aa, Rhinopithecus roxellana
YQDLVIFEDTTVDFTQEEWTLLDPVQRNLYRDVMLENYENVAKVGFQLLKPSVISWLEEEELRTLQQGVLQDWAIKHQTSV

SEQ ID NO: 17146 - protein, 81 aa, Rhinopithecus roxellana
SLLTFSDVAIEFSQEEWKCLDPVQRTLYRDVMLENYRNLVSLDISSKCMLKTSSTGKDNTEVIHTGTLQRQASHHTGEFCL

SEQ ID NO: 17147 - protein, 81 aa, Rhinopithecus roxellana
IQGPLKFTDVAVEFSQEEWKCLDPVQRTLYRDVMLENYRNLVSLGICLPDLSVISMLEQKKDPWILQSEEKIANNPDGREC

SEQ ID NO: 17148 - protein, 81 aa, Rhinopithecus roxellana
PLTFKDVAIEFSQEEWKCLDPVQKALYKDVMLENYRNLVFLGISPKCVIKELPPTENSNTGERFQTVALERHQSYDIENLY

SEQ ID NO: 17149 - protein, 81 aa, Rhinopithecus roxellana
MDPTQRNLHKDVMLENYRNLVSLGLAVSKPDMISHLENGKGPWVTMREISRIPYPDIEPKRATKNTTQTKDTSEDLSQEAV

SEQ ID NO: 17150 - protein, 81 aa, Acinonyx jubatus
PKVPVTFDDISIYFSTPEWEKLEEWQKELYKNIMKGNYESLISMDYAMNQPDVLSQIQPEGEHNTEEQAGPEESEIPTDPS

SEQ ID NO: 17151 - protein, 81 aa, Cebus imitator
NAQESLTLEDVTVEFTWEEWQLLDPFQKDLYRDVMLEIYSNLVSVGFQVSKPDALSKLGQGEPWIIEDERHSRICPENNKV

SEQ ID NO: 17152 - protein, 81 aa, Cebus imitator
GTVTFEDVAVNFTWEEWNLLSEAQRCLYRDVMLENLALTSSLGCWCGVEDEEAPSKQSIYVQRETQVRTPTAGVSSKKAHP

SEQ ID NO: 17153 - protein, 81 aa, Callithrix jacchus
KESVSFRDVAVDFTQEEWGQLDSPQRALYRDVMLENYQNLLALGAGPPLHKPDVISHLERGEEPWCVQRDVPGGPCPEWEM

SEQ ID NO: 17154 - protein, 81 aa, Macaca mulatta
PQGLVTFGDVAVDFSQEEWEWLNPNQRNLYRKVMLENYKNLASLGKGDCISPDVISSLEQGKEPWTVKRKMTRAWCPDLKI

SEQ ID NO: 17155 - protein, 81 aa, Callithrix jacchus
WLQEPMTFKDIAVEFTQEEWIMLDSSQRSLYKDVMLENYRNLTSVEYQLCKLTVISPLHQEEIRSMNKINPQAICPDQKIQ

SEQ ID NO: 17156 - protein, 81 aa, Callithrix jacchus
MNKIHVIFNKTGIAASKPDLITCLEQGQEPWNVKRHEFEAKLPVASSYFAQDFWPKQDIKNHFQKLILRRYKKCGHENFQL

SEQ ID NO: 17157 - protein, 81 aa, Macaca mulatta
MLENYSNLVFLGIVVSKPDLITRLEQGKKPLTVKRHEMVAKPPVMCSHFAQDLWPEQNMKDSFQKMIPRRYEKRGHENVQL

SEQ ID NO: 17158 - protein, 81 aa, Callithrix jacchus
NMTQVTFEDVVVDFTQEEWGQLEPAQRTLYYDVILGTFRLLVAVGHWLPKLNIISLLEQEAELRAVDPGVPQGVYQDLESR

SEQ ID NO: 17159 - protein, 81 aa, Macaca mulatta
MLFIFNKAGIDVSKPNLITCLEQGKYPWNMKRHSMVVKPPVICSHFAEDLCPGPGIKDSFQKVILREYVKCGHKDLQLRKG

SEQ ID NO: 17160 - protein, 81 aa, Macaca mulatta
SLKKVTFEDVAIDFTQEEWAMMDTSKRKLYRDVILENVSHLVSLGYQISKSYITLQLEQGKELWREGREFLQGQNLDKESA

SEQ ID NO: 17161 - protein, 81 aa, Macaca mulatta
EMGLLTFRDIAIEFSLEEWQCLDRAQRNLYRDVMLENYRNLVSLGIAVSKPDLIACLEQNKEPRNIKRNEMVSKHPVTCSH

SEQ ID NO: 17162 - protein, 81 aa, Macaca mulatta
MTFKDVAVVFTEEELALLDLAQRKLYQDVMLENFRNLLSVGEDRHQAFHRDTFHFLREEKIWMMKTATQREGDSGDKIQTE

SEQ ID NO: 17163 - protein, 81 aa, Callithrix jacchus
PSGSQGVLTFMDVAIEFCLEEWQCLDTAQHDLYRNVMLENYRNLIFLGIAASKPDLITCLEQGKLPWNVKRHEMVAEPPGS

SEQ ID NO: 17164 - protein, 81 aa, Monodon monoceros
MTRHSISKPDVISFLEQGKEPWLVDRELTRDQWPVLESRCETKKLFLKKEIYEIESAQWEIMERLTRHDLQCSSFRDDWEC

SEQ ID NO: 17165 - protein, 81 aa, Macaca mulatta
FQGSISFKDVTVGFTQEEWQHLDPSQRALYRDVMLENYSNLVSVEVWTADHLKERSQENQSKHLWEVVFINNEMLTKEQGD

SEQ ID NO: 17166 - protein, 81 aa, Macaca mulatta
EAVTFNDVAVAFTEEELGLLGPAQRKLYRDVMVENFRNLLSVGHQPFKQDVSPVERNEQLWIVTTATQRQRNLGEKNQSKL

SEQ ID NO: 17167 - protein, 81 aa, Monodon monoceros
CPQDSTWCVEKTPEERRRAPRLPTAQAQVSETFVSQPHLFVSTAGNKIAKPEVISLLEQGEEPWSVEQAYPPQGACPEWVR

SEQ ID NO: 17168 - protein, 81 aa, Bos taurus
PQAKVTFEDVAVFLSQDEWDRLGPAQRGLYRHVMMETYGNVVSVGIPGSKPEVISQLERGEEPWVLDKQGNEHKGSHHSKK

SEQ ID NO: 17169 - protein, 81 aa, Ovis aries
PLESVTFEDVAVDFTQEEWSLLDKSQKNLFRNVMLETVTHLVSVGYQISKSDVIFQLEQGKELWPEAAGGLQGQSPDEVTP

SEQ ID NO: 17170 - protein, 81 aa, Ovis aries
MLENYRNLASLGLVVSKPDLVTFLEQMKNPWDVRRLETPAQIHTGKKPYECKECEKAFMCYSNLSRHQRIHTGERPYECTE

SEQ ID NO: 17171 - protein, 81 aa, Ovis aries
SLGSVSFRDVAVDFTQEEWQHLDPEQKTTYRDVMLENYSHFISVGCHIIKPEVITKLEQGEEPWVVEGEFLLQSHSEVWKV

SEQ ID NO: 17172 - protein, 81 aa, Ovis aries
MLENYTNITSLAFPFPKSDLIFWLERGEEPGRLDPWTLVGREHPRGTCRGRETKTENGGQTAELSISKGPESHKLITEVLL

SEQ ID NO: 17173 - protein, 81 aa, Ovis aries
LSQAQLTFKDVFLDFTPEEWECLDPAQRTLYKDVMVEILRNLLSVVSTSAECLRRSLEEGRKRVRNGSFLGNVLHPLTALQ

SEQ ID NO: 17174 - protein, 81 aa, Ovis aries
ARGPVTFRGMVIEFFPHEWEFLDSLQKKLYRDVMMENYSNLVSLGHSISKPDIIVLLEEGRNPWMVVRKETRSWNTDLDSS

SEQ ID NO: 17175 - protein, 81 aa, Ovis aries
QGSLSFRDVAVGFTRKEWQELDPTQRTLYRDVMLENYSHLVSVGTGCQVTKPAVISRLEQGQEPWMEEEEILRWSFPGKIS

SEQ ID NO: 17176 - protein, 81 aa, Ovis aries
QLTFEDVAIEFTQEEWEFLDRAQRALYRDVMLETYRNLLSVDISPTYVIKHLQPKANSDKQETFQTLMPGRPESCEIKHFH

SEQ ID NO: 17177 - protein, 81 aa, Vulpes vulpes
ERGSVTFKDVTMAFTQKEWEQLDPAQRSLYKDVMLENYSNLASMGYQAPKPDMISKLEKGEEPWLGKGKRLQQSGPGEIAR

SEQ ID NO: 17178 - protein, 81 aa, Bos indicus x Bos taurus
RHLSFVFQGRLTFQDVAIDFTQEEWECLDLSQRELYRDVMLENYRNLASLGEDNCLPESLIYPHGFGSCISRMSPRMFCFL

SEQ ID NO: 17179 - protein, 81 aa, Cebus imitator
PARGMTFEDVAIYFSQEEWELLDEAQRFLYCDVMLENFAHITSLGYCHGTENEAIASEQSVSVGGKLQVRTSQGDTPTQKT

SEQ ID NO: 17180 - protein, 81 aa, Macaca mulatta
EAVTFKDVVVVFTEEELGLLDLAQRKLYRDVMLEIFRNLLSVGHQPFHRDTFHFLREEKFWMMDIATQREGNSGGKIQPEM

SEQ ID NO: 17181 - protein, 81 aa, Callithrix jacchus
SLGSVTFTDVAIDFSQDEWQWLNLAQRSLYKKVMLENYRNLVSVGLCISKPDVISLLEQEKDPWVIKGELTRGLCSDLEYV

SEQ ID NO: 17182 - protein, 81 aa, Macaca mulatta
ACESITFGDVAIDFSHQEWEYLNLVQKTLYQEVMMENYDNLVSLGHSISKPDLITLLEQGKEPWMIVGEETRGECTDLDSR

SEQ ID NO: 17183 - protein, 81 aa, Macaca mulatta
GSVTFEDVAVYFSWEEWDLLDEAQKHLYFDVMLENFALTSSLGCWHGVEHEETPSEQRISVEGVPQFRTSKEGSSSQHAYS

SEQ ID NO: 17184 - protein, 81 aa, Callithrix jacchus
RLSAQGTVTFEDVAVNFTWEEWNLLSEAQRCLYRDVMLENLALTSSLETGFHHVEQVWISPRDPPVSAPQSAGIIGTSHCA

SEQ ID NO: 17185 - protein, 81 aa, Callithrix jacchus
EGLLTFRDVAIEFSLEEWQCLDAAQRNLYKNVILENYRNLVFLVMCSHFAQEFWPEQNIKDSSQNMTLRRYEQCGNENFQL

SEQ ID NO: 17186 - protein, 81 aa, Bos taurus
NKGSLSFEDVTVGSTQEEWQKLDPAQRTLYRDVMLENYSHLISVGYCIPKPELIFKLEQGEQPWVLEAGSPSQSYPEVCRI

SEQ ID NO: 17187 - protein, 81 aa, Bos taurus
QEGVNFKIVTVDFTQEEEGTLSSAQRTLDRDVILENHGDSWDLATALGRRESRLKQSVFDDKLSHSVKIEKLTRDDPWLSS

SEQ ID NO: 17188 - protein, 81 aa, Bos taurus
EQGLMAFEDVAVHFSQEEWGLLDTAQRALYRRVMLENFALLASLGLSVSRPRVVTQLECGNEPWVLSGADVTLAWDAQRRP

SEQ ID NO: 17189 - protein, 81 aa, Ovis aries
MLETYNHLVSLDILFSKLELICQLEQGEKPWIEERQRSLGLCPAGSKLEIAPCLTCRLAFSCQQALIQHVWFSHLPQLFSS

SEQ ID NO: 17190 - protein, 81 aa, Ovis aries
MKKFCEWQKLDPAQRTLYRDVMLENYSHLISVGYCIPKPELIFKLEQGEQPWVLETESPSQSYPEVCRIVNQLEQSQEMHN

SEQ ID NO: 17191 - protein, 81 aa, Ovis aries
PRVPVTFDDVAVYFSEPEWGKLDEWQKELYKHVMRGNYETLVSLDYAISKPDILTRMERGEEPCPEGPWGREEGNEREEAC

SEQ ID NO: 17192 - protein, 81 aa, Vulpes vulpes
SQESVTFADVAVDFTQEEWTLLDRSQRQLFRDVMLENISHLVSIGKQLYKSDTISHLEPGVKLSKEGISLLQCQSLDKEDG

SEQ ID NO: 17193 - protein, 81 aa, Otolemur garnettii
SLGCLTFRDVAIEFSQEEWQCLDPAQRALYRAVMLENYRNLVSLGLLLPDLTVLSMLKEGKEPWTVETKVKTPRNSNKGEW

SEQ ID NO: 17194 - protein, 81 aa, Vulpes vulpes
QLTFKDVAIKFSEEEWECLDSAQRALYRDVMLENYRNLVSLDSSASFMIKELLPKKEINNRRLCQPVVLGRQESHDLEDFD

SEQ ID NO: 17195 - protein, 81 aa, Otolemur garnettii
PKVPVAFDDVSIYFSAPEWEKLEEWQKELYKNIMKGNYESLISMDYAMNQPDVLSQIQPEGGQNTVDQAGPEESEIPADPS

SEQ ID NO: 17196 - protein, 81 aa, Otolemur garnettii
MGMLTFKDVWIEFSMEEWACLDPAQQHLYQEVMLETYRILVFLGLAVSKPDLIPCLEQSKEPWKVKTPQTLLNYPALSKHS

SEQ ID NO: 17197 - protein, 81 aa, Otolemur garnettii
QNLLTFWDVAIEFSPEEWARLDIAQRNLYRDVMIENYRNLVSLGLAASKPDLIRCLEQSKEPWNVKRVEATAKHPEMSSHY

SEQ ID NO: 17198 - protein, 81 aa, Otolemur garnettii
QGLLTFKDVSIEFSMDEWACLDPAQQTLYRDVMLENYRHLVFLGLTLSKPDLITCLEQSKQPWKVKTHQTVVKHTAISYHS

SEQ ID NO: 17199 - protein, 81 aa, Vulpes vulpes
WKELLSFDDVAMYFTREEWNRLDWAQKDLYRDVMLENYRNMILLGFQFPKPEVICLLEQWEEPWILDLPRAGTRKATSSTC

SEQ ID NO: 17200 - protein, 81 aa, Vulpes vulpes
SLDSVTFTDVAIDFSQDEWEWLNLAQRILYKRVMLENYRNLVSLGLCISKPDIISLLEQGKEPWMMKGEMTRDLYPDLKYV

SEQ ID NO: 17201 - protein, 81 aa, Otolemur garnettii
QVLMAFRDVAVAFTLKEWKLLSPAQRSLYREVMLENYSHLVSLGIAFSKPKLIIQLEQGDEPWREENECHLDLYLGEWEAL

SEQ ID NO: 17202 - protein, 81 aa, Vulpes vulpes
PKVPVTFDDVAVYLSEQEWGKLDEWQKELYKHVMRGNYETLVSLDYAISKPEVLSQTEQGKEPCSWRRPGPKVPDVPVDPS

SEQ ID NO: 17203 - protein, 81 aa, Enhydra lutris
SQVSVTFEDVAVLFTRDEWRKLGPSQRNVYQEVMLENYSNLVSLGLLFSKPRVISLLQEGEDPWKVEKESPGGPSLGWNSS

SEQ ID NO: 17204 - protein, 81 aa, Macaca mulatta
QEPLSFKDVAVVFTEEELGLLDSTQRQLYRDVMLENFRNLLSVGERNPPGDKNGRDMEYIQDEELRLFSHKELSSCKIWEE

SEQ ID NO: 17205 - protein, 81 aa, Callithrix jacchus
MGQLTFNDVIIEFSLEEWQCLDKTQQNFYRDVMLENYRNLVFVGIAVSKPDLITCLKEGKEPWSMRRHEMVTKPPAMCSHF

SEQ ID NO: 17206 - protein, 81 aa, Callithrix jacchus
GKELLSFEDVAMYFTREEWGHLDWSQKDLYRDVMLENYRNMVFLGFQFPKPEVICQLENWDEQWILDLPRAGNRKASGSAC

SEQ ID NO: 17207 - protein, 81 aa, Macaca mulatta
SYEGSVSFRDVAINFSREEWQHLDLSQRNLYRDVMLETYSHLLSVGYQVPKPEVVMLEQGKEPWALQGERPRQSCPGEKLW

SEQ ID NO: 17208 - protein, 81 aa, Macaca mulatta
VHGSVTFRDVAIDFSQEEWECLQPDQRTLYRDVMLENYSHLISLDLESKHGPEKISPENDIFEINLPKRVIKQISKTLGLE

SEQ ID NO: 17209 - protein, 81 aa, Bos taurus
AGLPFSKPEVISLLQQGEDPWKVEKESPGDSSLECKSSPKTTKATQTQDSSFSGLIRKTLKKDEPWNFISENPCIYEDRIK

SEQ ID NO: 17210 - protein, 81 aa, Bos taurus
PQEPVTFEDVAVYFTQNQWASLDSAQRALYREVMLENYENVASLVSPFPRPDLISQLERGEAPWDPDPWEAEDLRGICPGG

SEQ ID NO: 17211 - protein, 81 aa, Ovis aries
PKVPVSFEDVAMYFTKTEWKLLDHRQRKLYKQVMLENYHHLVSLGCLSSKPQLVIQLEQGEKPWVADVHRMRITTGMQAGD

SEQ ID NO: 17212 - protein, 81 aa, Ovis aries
EAPKVPFDDVAVYFSEQEWGKLDEWQKELYKHVMRGNYETLVSLDYAISKPEVLTQTEQGKEPCWRRAGPKVPDVPVDPSP

SEQ ID NO: 17213 - protein, 81 aa, Otolemur garnettii
VLEELVTFEDVAVYFTLTEWAGLSPSQRALYRSVMLENYENLTTVGYPLPKPVLISLLEEGPWDLEAQVEPIAEGTRDICK

SEQ ID NO: 17214 - protein, 81 aa, Otolemur garnettii
TQGRLTFRDVTIEFSQEEWQCLDPAQRALYRAVMLENYKNLVSLGLLLPDLTVLSMLEEGKEPWTVETKVKTRNSNKGEWI

SEQ ID NO: 17215 - protein, 81 aa, Vulpes vulpes
RESGKAPVTFDDITVYLLQEEWMLLSQQQKEICGSDKLVAQLGPTIANPELFYKFERGPEPWLGNVQGQRTLLSHHPGKNK

SEQ ID NO: 17216 - protein, 81 aa, Vulpes vulpes
GTVTFEDIAMYFSWEEWDLLDEAQRHLYQDVMLENLALITSLGCEHGAEDEKAPSEQSISVEGISQVRIPKTGLLSQKANP

SEQ ID NO: 17217 - protein, 81 aa, Enhydra lutris
MFKDVAIDFTLEEWRLMDPSQRKRKLHKDVILENYRNLFSLGLAVSKPDMISHLEAGKGPWVVVREIARTPYPELETKPAT

SEQ ID NO: 17218 - protein, 81 aa, Enhydra lutris
LRAGQLTFMDVAIEFSEEEWGCLTHTQRELYRVVMLENYRHFCFLGLIGSKPDLVSFLEQNKFWDVTRKETVAFHPAVSSH

SEQ ID NO: 17219 - protein, 81 aa, Enhydra lutris
WSQMPVTFEDVALYLSREEWGRLDHAQQSFYRDVLQKRNGLSLGFPFSRPLWGSQGQGKGEASSSCQQMGDDKEKAGVCRG

SEQ ID NO: 17220 - protein, 81 aa, Enhydra lutris
KPGAVNFADVAVYFSPEEWGCLRPAQRALYRDVMRETYGHLGALGFPGPKPALISWMEQESEAWSPAAQDPEEGESLGGAL

SEQ ID NO: 17221 - protein, 81 aa, Enhydra lutris
YRRSLSFRDVAVGFTRKEWQQLDPTQRMLYRDVMLENYSHLVSVGYQVTKPAVISRLEQGQEPWMEEEEILRWSFPEEILQ

SEQ ID NO: 17222 - protein, 81 aa, Pongo abelii
DPEQVTFEDVVVDFSQEEWGQLKPAQRTLYRDVMLDTFRLLVSVGHWLPKPNVISLLEQEAELWAVDSGLPQGVYPEIKGH

SEQ ID NO: 17223 - protein, 81 aa, Pongo abelii
EMGPLTFRDVAIEFSLEEWQCLDTAQRNLYRKVMFENYRNLVFLGIAVSKPHLITCLERGKEPWNRKRQEMVAKPPVIYSH

SEQ ID NO: 17224 - protein, 81 aa, Pongo abelii
QEVLTFRDVAIELSLEEWQCLDTAQRNLYRKMMLENYRNLVFLGIAASKPDLITCLEQGKEPWNVKRHEMVAEPPVVCSYF

SEQ ID NO: 17225 - protein, 81 aa, Pongo abelii
MAVSEPEASAAKEWKQLDPAQRNLYNDVMLENYSNQASMGCQAPKPDMISKLEKGEAPWLGKGKRPSQGCPSKIARSKQKE

SEQ ID NO: 17226 - protein, 81 aa, Pongo abelii
PQKSVTFEDVAVYFTQAEWDGLSPAQRTLHRDVMLENYGNVASLGFPLLKPAVISQLEGGGELGGPSPLAAGRGLQGLRTV

SEQ ID NO: 17227 - protein, 81 aa, Pongo abelii
IYFSQEELELLDYTQKTLYNDVMQENYKTIISLALFVLPKPKVISCLEQGEEPWVQVSPEFKDSAGKSPTGLKLKNDTENH

SEQ ID NO: 17228 - protein, 81 aa, Callithrix jacchus
SKDLVTFGDVAVNFSQEEWEWLNPAQRNLYRKVMLENYRTLVSLGVSVSKPDVISLLEQGKEPWMVKKEGTRSSCPDWEYV

SEQ ID NO: 17229 - protein, 81 aa, Macaca mulatta
QEEWALLDPAQRTLYRDVMLENCRNLASLGCRVNKPSLISQLEQDKKVMTEERGILPSTCPDLETLLKVKWLTPKKHVFRK

SEQ ID NO: 17230 - protein, 81 aa, Macaca mulatta
AVDFTQEEWQYLNPPQRTLYRDVMLETYSNLVFVGQQVTKPNLILKLEVEEYPAEGKIPFWNFPEVCQVDEQIERQHQDDQ

SEQ ID NO: 17231 - protein, 81 aa, Bos taurus
IGRLTFQDVAIDFTQEEWECLDLDQRELYRDVMLQNYGNLLACLGDDRFLPESLVYPLGFGSIISRMFLKFLIIHYAGKLF

SEQ ID NO: 17232 - protein, 81 aa, Bos taurus
RMTFQDVAIDFTQEKWECLDLDQRELYRDVMLEKYGNLASLGEDNCLPESLIYPLGFISTANTHSDNSEHRLRCENSQSKQ

SEQ ID NO: 17233 - protein, 81 aa, Bos taurus
AWLEAKVTFEDVAVFLSQDEWDRLGPAQRGLYRHVMMETYGNVVSVGSKPEVISQLERGEEPWVLDKTWVPWTEKVCPPQR

SEQ ID NO: 17234 - protein, 81 aa, Bos taurus
VQGSVSFEDVAVGFSQEEWQILGPSQKALYWDVMLENYCNLVSVGYQAPTPNSLFQLEQGGPPWTVEGAALSSTCSGYQAT

SEQ ID NO: 17235 - protein, 81 aa, Ovis aries
CQDPVTFEDVAIVFTDEEWRSLVPTQRDLYKEVMLENYKSIVSLGLPIPGPDVIFQLKRGDEPWLVEFHEFEGKEGAENVS

SEQ ID NO: 17236 - protein, 81 aa, Ovis aries
LQGPMSFKDVAVEFTQEEWMMLDSAQRSMYRDVMLENYINLTLVEYQLCKPVISLLGQEDIRTVISRIPQGTCSDWEIQFK

SEQ ID NO: 17237 - protein, 81 aa, Bos taurus
QAQETLTFDDVAVGFTWEEWQLLAPAQKALYRDVMLENYSNLVSAGFQASTPEVVSKLDQGEPWMMDDETHCQTRSEVWKF

SEQ ID NO: 17238 - protein, 81 aa, Ovis aries
SQESVKFRDVAVVFSPDQWAHLSPKKRELYRDVMLETCDHLVSLGHWAYKAEVMSSLRQGKEPWILEKEVTSAPCPACQPA

SEQ ID NO: 17239 - protein, 81 aa, Ovis aries
QGGVTFEDVAVDFTQEEWQQLSPEQRGLYRDVTLENYRNLASMGTGGEDFAKPEVILRLENGEEPWMVETQVLRSCGPAEK

SEQ ID NO: 17240 - protein, 81 aa, Ovis aries
GFGRLTFRDVAIDFAQEEWECLDLGQRELYRDVMLENYRNLASLGLVVSKLDLVTFLENIRRMETIPVYTAASSLHTQCVM

SEQ ID NO: 17241 - protein, 81 aa, Ovis aries
FQGFLTFGDVAVHFTQEEGACLDAGQRTLYRDVMLETYRNLVSLGVPGSKSDLISQLEQGREPWGSDLLGAQEAEPARDAG

SEQ ID NO: 17242 - protein, 81 aa, Ovis aries
LQGGVTFEDVAVDFTQEEWQQLSPEQRGLYRDVTLENYRNLASMGGEDFAKPEVILRLENGEEPWMVETQVLRSCGPAEKD

SEQ ID NO: 17243 - protein, 80 aa, Vulpes vulpes
MASSQGLLTFRDVAIEFSQEEWGCLNHTQRELYRDVMLENYGHLLFLGLVWKPDFIIFLVEEKQLWDVKRKETVPFHPGR

SEQ ID NO: 17244 - protein, 81 aa, Vulpes vulpes
GQGSVSFRDVTVEFTRDEWLQLTGTQKTLYRDVMLENYSHLVSVGCHLTKPEVIFRLEQGEDLWPSEGEFPDQGDQDRSEE

SEQ ID NO: 17245 - protein, 81 aa, Otolemur garnettii
TKFAVTFKDVAVIFTKEELGLLDTIQRKLYQDVMLENFRNVISVGYPSFKPDGISQLEREEKLWMMKMATQSHHSLGGKNL

SEQ ID NO: 17246 - protein, 81 aa, Otolemur garnettii
SQELLTFKDISVDFTQEEWRQLAPAHRNLYREVMLENYGNLVSVAGYQLSKPGVISQLEKGKEPWLMEGQNVGCLSSGLKN

SEQ ID NO: 17247 - protein, 81 aa, Otolemur garnettii
QALLTFRDVSIEFSMDEWACLDPAQQNLYRDVMLETYRHLVFLETGLAVSKPDLITCLEQSKEPWKVKTQQTVVKHPVILN

SEQ ID NO: 17248 - protein, 81 aa, Otolemur garnettii
KPGSLRFADVAVYFSLEEWGCLRPAQRALYRDVMRETYGHLGALGFLGPKPALISWMEQESEAWSPAAQDPEEGESLGGAR

SEQ ID NO: 17249 - protein, 81 aa, Otolemur garnettii
SQTLVTFEDVLVDFTREEWKLLDAAQQIMYKDVMLENYKNLLSLGHQLPKPDVILQLEKGEEPLLVERGIHQETHPDLETT

SEQ ID NO: 17250 - protein, 81 aa, Otolemur garnettii
FQDLVMFRDVAVDFSQEEWECLNSYQRNLYRDVILENYSNLVSLAGCSISKPDVITLLEQGKEPWMVVRDEKRRWSLDLDS

SEQ ID NO: 17251 - protein, 81 aa, Otolemur garnettii
QALVSFEDVAVTFTGEEWGHLDLAQRTLYQEVMLETCRLLVSLGTGHPVPKAELIYLLEHGQELWTVQRGLPPSTCPGEKQ

SEQ ID NO: 17252 - protein, 81 aa, Otolemur garnettii
NFWILRLPPGNKGEAPKEWGKLEDWQKELYKHVMRGNYETLVSLDYAISKPEVLSQIEQGKEPCSWRRTGPKIPDVPVDPS

SEQ ID NO: 17253 - protein, 81 aa, Vulpes vulpes
AQASLSFEDVAVSFSWEEWQLLTLSQKDLYWDVMLENYNNLVSLGYQASKQDSLFQLEQGGLPWTVEGVAHSQTCPEEIWE

SEQ ID NO: 17254 - protein, 81 aa, Enhydra lutris
RPELVTFEDVAVYFSENEWTSLAPTQRVLYRDVMLENYGAVASLAFPFPKPALISQLERGEAPWCKAPQGALDGEGPRGIS

SEQ ID NO: 17255 - protein, 81 aa, Enhydra lutris
GLLTFRDVAIEFSEEELGRLTHTQRQLYRDVMLENYGHLHFLGLLLSKPDLIMFLEQEKQLWDVKRKETGGFHPALSSHDT

SEQ ID NO: 17256 - protein, 81 aa, Enhydra lutris
CEVSVSFEDVTVDFSKEEWQQLDPAQRRLYRDVTLENYSHLRSVGCLVPKPEVIFKLEQGEGPWTLEGETPHQSWSDEDIG

SEQ ID NO: 17257 - protein, 81 aa, Enhydra lutris
FQEAVTFKDVAVVFSEEELGLLDSTQRKLYRDVMLENFRNLVSVGHSSSKPDMISQLEREEEKLYVKEICTERGGRNPNEV

SEQ ID NO: 17258 - protein, 81 aa, Enhydra lutris
MLENYSNLVSLGYQDSKPDIIFTLEQEEPWMMLAQIPSQGHPEKVGEIDRMEWHQENQGKLESMAKGYECTTFGKLCLLST

SEQ ID NO: 17259 - protein, 81 aa, Enhydra lutris
QDSVTFEEVAVDFSQEEWALLDPAQKTLYRDVMLENYRNLASVGYPLCKPSLIMEVEQEVLGTEEGAILQGACTDWDIQLK

SEQ ID NO: 17260 - protein, 81 aa, Enhydra lutris
FQEAVTFGDVAVHFSREEWQCLDPGQRALYKEVMLENHSSVAGLGFLVFKPELISRLEQGQEPWVLDLKGVEGREGARTFL

SEQ ID NO: 17261 - protein, 81 aa, Pongo abelii
ANVSLAFRDVSIDLSQEEWECLDPVQRDLYKDVMLENYSNLVSLGYTIPKPDVITLLEQEKEPWIVMREGTRNWYTDLEYK

SEQ ID NO: 17262 - protein, 81 aa, Pongo abelii
QGLLTFRDVAIEFSQEEWKCLDPAQRTLYRDVMLENYKNLVSLDISFKCMVKEFSSIGKGNTEVFHTRTLQRLASHHIGEC

SEQ ID NO: 17263 - protein, 81 aa, Pongo abelii
LVMFQDLSIDFSQEEWECLDTAQKDLYRDVMMENYSSLVSLDSKFRCKTKDSCLPKEIYEVISSQWVRMEKCHSLVGSSVR

SEQ ID NO: 17264 - protein, 81 aa, Pongo abelii
PQVSLTFDDVAVLFTRDEWRKLAPSQRNLYRDVMLENYRNLVSLGLSFTKPKVISLLQQGEDPWKVEKDSSGNSSLGSKSS

SEQ ID NO: 17265 - protein, 81 aa, Pongo abelii
EMGPLTFMDVAIEFCLEEWQCLDTAQQNLYRNVMLENYRNLVFLGIAVSKPDLITCLEQEKETWEPMRRHEMVAKPPVMCS

SEQ ID NO: 17266 - protein, 81 aa, Pongo abelii
ARGKSKSKAPVTFGDLAIYFSQEEWEWLSPIQKDLYEDVMLENYRNLVSLGLSFRRPNVITLLEKGKAPWMVEPVRRRRAP

SEQ ID NO: 17267 - protein, 81 aa, Pongo abelii
QQGYVTFEDVAVYFSQEEWRLLDEAQRLLYCNVMLENFTLLASLGLASSKTHEITQLESWEKPFMPTWEVVTSATWRGCWH

SEQ ID NO: 17268 - protein, 81 aa, Pongo abelii
PQESVAFEDVAVYFTTKEWAIMVPAERALYRDVMLENYEAVAFVVSPTSKPALVSHLEQGKESCFTRPQGVLSRNDWRAGL

SEQ ID NO: 17269 - protein, 81 aa, Pongo abelii
SQESLTFKDVFVDFTLEEWQQLDSAQKNLYRDVMLENYSHLVSVGYLVAKPDVIFRLGPGEESWMADGGTPLRTCAGEDRP

SEQ ID NO: 17270 - protein, 81 aa, Pongo abelii
QGRLTFRDVAIEFSLAEWKYLNPAQRALYREVMLENYRNLEAVDISSKCMMKEVLSTGQGNSEVFYTGTLQRHESHRIGDF

SEQ ID NO: 17271 - protein, 81 aa, Pongo abelii
PHLLVTFRDVAIDFTQEEWECLDPAQRDLYRDVMLENYSNLISLEPARTHEEQHNLPVPKAGSVNLAAGFGHSRSQTGCGS

SEQ ID NO: 17272 - protein, 81 aa, Callithrix jacchus
RRGPLTFRDVAIEFSQEEWKCLDPAQRTLYRDVMLENYRNLVSLGMCLPDLSIISMMKQRTEPWTVESEMKVAKYPARWEG

SEQ ID NO: 17273 - protein, 81 aa, Monodon monoceros
YQVSKPEVIFKLEQGEEPWIAEGEIQRPFCPDWRTRPEAKSSNQQSISEVSLSTDDPSCATLEDTWDVNGQLERHKENWKR

SEQ ID NO: 17274 - protein, 81 aa, Callithrix jacchus
MAGPPRPQSGRKSAGRGAADASGGGPFPAASRVCEPRVVLREAGFLVFKPELISRLEQGQEPWVLDLQGAEGTEAPKTFKT

SEQ ID NO: 17275 - protein, 81 aa, Callithrix jacchus
TESFMAFGDVTVDFTQKEWRLLSPAQRALYREVTLENYSHLISLGILHSKPELIRRLEQGEAPWGEERRHQPGPHAGIYAE

SEQ ID NO: 17276 - protein, 81 aa, Bos taurus
SLGSDLFRDVAVVFSQEEWEQLAPTQRDLYRDVMLETYSNLVSLGLAISKPDVISFLEQGKEPWTVEEVVTEGLCPVLKSR

SEQ ID NO: 17277 - protein, 81 aa, Bos taurus
KGSVTLQDVAVEFTPEEWQLLDCDQRTLYWDVMLENFRNLISVGTGCPVTETTVIFKVEQGQGPWMVEGENSRWSSPEADC

SEQ ID NO: 17278 - protein, 81 aa, Ovis aries
LQGLMTFEDVAVDFTQEEWQYLNPPQRTLYRDVMLETYSNLVSVGYHVTKPDLILKLEVEEQCLPEGKIPIWSFPDMGPQT

SEQ ID NO: 17279 - protein, 81 aa, Ovis aries
QAQLTFKDVAIEFTQEEWECLDPAQRALYRDVMVETLRNLVSLENSIGSTNIYLLCELRDFQKKLVMLDGMKCPRDEERNY

SEQ ID NO: 17280 - protein, 81 aa, Ovis aries
AQLTFKDVFLDFTPEEWECLDPAQRTLYQDVMEETLRNLLSVDMSPIEMIKKLQAKADSSKGEIFQRVMFGRAESLESKDF

SEQ ID NO: 17281 - protein, 81 aa, Ovis aries
IQGLVTFRDVAVEFSQEEWKCLEPAQRDLYREVTLENFGNLVSLGLTISKPDVVSLLEQGKEPWMVVNDMTGPWCPDLESR

SEQ ID NO: 17282 - protein, 81 aa, Ovis aries
QEGVNFKIVTVDFTQEEEGTLSSAQRTLDRDVILENHRDSWDSATALGRRESRLKQSIFDDKLSHSVKIEKLTRDDPWLSS

SEQ ID NO: 17283 - protein, 81 aa, Otolemur garnettii
MIKIIASVSFKDVNVEFTQDEWWNLYRDVILENYNNLVSVGYCIFKPKVIFRLEHGEAPWSSEEEFSNQSHPKGHLWGEHL

SEQ ID NO: 17284 - protein, 81 aa, Otolemur garnettii
FQGPLTFRDVAIEFSQEEWTSLDPAQRALYRDVMLENYRNLVSVVGVSLPDQTIISILEQGKEPWTVESQVKIVRNSNRGK

SEQ ID NO: 17285 - protein, 81 aa, Vulpes vulpes
KDQELLTLEDVAVDFTWEEWQLLAPAQKNLYRDVMLENYSNLVSVGYVASKPDAFFRLEQGEPWATEDEIRSQIHPEIKKD

SEQ ID NO: 17286 - protein, 81 aa, Enhydra lutris
VWGSMSFEDVIVEFTQDEWQYMSPAQRTLYRDVMLENYSHLISVGCCTTKPEMIFKLEQGEEPWSLEEEFLNQRYPGYFSV

SEQ ID NO: 17287 - protein, 81 aa, Pongo abelii
VTFEDVAVNFSQEEWSLLSEAQRCLYRDVMLENLALISSLSCWCGSKDEEVPCKQRISLQRESQSRTPRTVISPKAHPCEM

SEQ ID NO: 17288 - protein, 81 aa, Pongo abelii
AEGLVMFEDVTVYFSRDEWGLLNVTQKGLYRDVMLENFALVSSLGLASSRSPVFTQLEDDEQSWVPSWVDVTPVSRAEARR

SEQ ID NO: 17289 - protein, 81 aa, Pongo abelii
ASGSVTFEDVAVYFSWEEWDLLDETQKHLYFNVMLENFALTSSLGLTSSWSHVVAQLGLGEVPSVLHRMFMTPASASWDQR

SEQ ID NO: 17290 - protein, 81 aa, Pongo abelii
PQMLVTFKDVAVTFTREEWRQLDLAQRTLYREVMLETCGLLVSLGHRVPKPELVHLLEHGQELWTVKRGLSHPTCAGQEPR

SEQ ID NO: 17291 - protein, 81 aa, Pongo abelii
MLENYGAVASLAAFPFPKPALISQLERGETPWCSVPQGALDGEAPRGISSGEIPKLPGATIWSLRIKPIPKKTVTKQRETR

SEQ ID NO: 17292 - protein, 81 aa, Pongo abelii
PLETVTFKDVAVDLTQEEWEQMKPAQRNLYRDVMLENYSNLVTVGCQVTKPDVIFRLEQEEEPWVMEEEMFGRHCPEVWEV

SEQ ID NO: 17293 - protein, 81 aa, Pongo abelii
QGLLTFRDVAIEFSQEEWKCLDPAQRTLYRDVMLENYRNLVSLDISSKCMMKEVSSTAQGNTEVIHTGTLQRHERHHIGDF

SEQ ID NO: 17294 - protein, 81 aa, Pongo abelii
SQEPVTFEDVAVDFTQEEWQQLNPAQKTLHRDVMLETYNHLVSMGCSGIKPDVIFKLEHGKDPWIIESELSRWTYPGIFGL

SEQ ID NO: 17295 - protein, 81 aa, Pongo abelii
VTFEDVAVYLSQEEWGRLGPAQRGLYRDVMLETYGNLVSLALGTRTEYKELTSRETFGEEDPQGSEPVEACDHIRKSEGSL

SEQ ID NO: 17296 - protein, 81 aa, Callithrix jacchus
EGPLAEMDPVQDRVVFEDVAIYFSQEEWGHLDEAQRLLYRDVMLENLALLSSLGKALTLAQCPGLGWVMPVHPKAALRFPQ

SEQ ID NO: 17297 - protein, 81 aa, Callithrix jacchus
DVTFSDVAIDFSHEEWEWLDSAQRDLYKDVMVQNYENLSETPSHTLTHKNYVFSGDWESRWENKELSTKKDIYDEDSPQTV

SEQ ID NO: 17298 - protein, 81 aa, Callithrix jacchus
EPVTFEDVAVYFTQNEWTSLDPVQRALYREVMLENYANVASLAFPFTTPVLVSQLEQGERPWGLDPWEPVGREALRGVCPG

SEQ ID NO: 17299 - protein, 81 aa, Macaca mulatta
GLVMFEDVAVYFSREEWGLLNVTQKGLYRDVMLENFALVSSLGVSHLQLLVTDSSLLSDGLCRVEDERARPKHLKSYRVIQ

SEQ ID NO: 17300 - protein, 81 aa, Bos taurus
GSVTFPDVAVYFSWEEWRLLDEAQRRLYLDVMLENYALISSLGKTFSLPTDLGWPLYPASRPRRCSVLTWCRHCLLPQCSG

SEQ ID NO: 17301 - protein, 81 aa, Bos taurus
VALPTGQLTFKDVAIKFTPEAWECLNPVQRALYRDVMIETLRNMLSVVKDNLPLKFGDLPWGDKLETFQTLMLGRPESCEI

SEQ ID NO: 17302 - protein, 81 aa, Bos taurus
WKGLLSFEDVALYFTREEWDMLDWAQKALYRDVMLDNYRDVVSLGFQFPKPEVICQLEQWEEPWILDLPRAGTRKASGSAC

SEQ ID NO: 17303 - protein, 81 aa, Ovis aries
QPQGTMTFKDVEVTFSQDEWGLLDASQRNLYRDVMLENYGNMASVVGPFTKPALISWLEAREPWGLNVQGVQLKGNPGAAP

SEQ ID NO: 17304 - protein, 81 aa, Ovis aries
FEGSVSFEDVAVDFTRQEWHRLDLAQRTMHRDVMLENYSNLASVGLCVAKPEMIFKLERGEELWILEEESSDHGYTGSFSL

SEQ ID NO: 17305 - protein, 81 aa, Ovis aries
MFQVTFSDVAIDFSHEEWRWLSSTQRDLYKDVMVQNYENLVSLGLSIPKPYVIALLEDGKEPWMVEEKLSKDMFSDCKSRW

SEQ ID NO: 17306 - protein, 81 aa, Ovis aries
MESVTLEDVAMELIQEWTLLDDAGRNLCRHVLQDNCRTPAARAAGTPPCKASLVSQVESREELKAAEHGVLYATGVDWESQ

SEQ ID NO: 17307 - protein, 81 aa, Otolemur garnettii
LQESVTFRDVAVLFSQDEWLHLDSAQRTLYREVMLENYNNLASLGIPFSMPKVICQLQQGEDPCTVEGEVPSDSCIDAKGQ

SEQ ID NO: 17308 - protein, 81 aa, Enhydra lutris
KLKSVTFEDVAVYFTQTEWDGLSPAQRALYRDVMLENYGNVASLGFSLLKPAVISQLEGAVEIDIQTDNNLTKEVYEEKHN

SEQ ID NO: 17309 - protein, 81 aa, Enhydra lutris
GSVSFTDVTVDFTQEEWEQLDPSQRILYMDVMLENYSNLLSVEVWKADDQMERDRSSPDEPARPFIIFKNQTPMEERGNLF

SEQ ID NO: 17310 - protein, 81 aa, Enhydra lutris
HGSTAFNSVTVAFTQDGWRPLVAAPRGTPRFKEGLPENTRNLVLLGLPVSQPSVNSQLDQREDGPWALQGGGLRSTCPDWK

SEQ ID NO: 17311 - protein, 81 aa, Pongo abelii
EKETLTFRDVAIEFSLEEWECLNPAQQNLYMNVMLENYKNLVFLGIAVSKQDPVTCLEQEKEPWNMKRHEMVDEPSAMCSY

SEQ ID NO: 17312 - protein, 81 aa, Pongo abelii
MLENYRNLVFLGIAVSKPDLITCLEQGKEPCNMKRHAMVAKPPVVCSHFAQDLWPKQGLKDSFQKVILRRYGKYGHENLQL

SEQ ID NO: 17313 - protein, 81 aa, Pongo abelii
QLTFRDVAIEFSQEEWTCLNPAQKTLYRDVMLENYRNLVSLDISCKCINKDLPPKGKNNMGEAFYTVKLERLESHDTEGLS

SEQ ID NO: 17314 - protein, 81 aa, Pongo abelii
EMGPLTFRDVAIEFSLEEWQCLDTAQRDLYRKVMFENYRNLVFLGIAVSKPHLITCLERGKEPWNRKRQEMVAKPPVIYSH

SEQ ID NO: 17315 - protein, 81 aa, Pongo abelii
GLLTFRDVAIEFSQEEWKCLDPAQRTLYRDVMLENYRNLVSLVVVSVFVYRQGLPVLLKLVLVSWAQEILLGLLSSWDYRR

SEQ ID NO: 17316 - protein, 81 aa, Pongo abelii
QAEVTFEDVAVYLSQEEWGRLGPAQRGLYRDVMLETYGNLVSLGVGPAGPKPGVISQLERGDEPWVLDVQGTSGKEHLRVN

SEQ ID NO: 17317 - protein, 81 aa, Pongo abelii
LQASVSFEDVTVDFSREEWQHLDPAQRRLYWDVTLENYSHLLSVGYQVPKSEAAFKLEQGEGPWTLEGKAPHQSCSGEAIG

SEQ ID NO: 17318 - protein, 81 aa, Pongo abelii
EKGPLTFRDVAIEFSLEEWQCLDTDQQGLYRKVMLENYRNLVFLGIALTKPDLITCLEQGKEPWNIKRHEMVAKPPVICSH

SEQ ID NO: 17319 - protein, 81 aa, Pongo abelii
TQGPLKFRDVAIEFSQEEWKCLDPAQRTLYRDVMLENYRNLVSLGICLPDLSVTSMLEQNKDPWTLQSEEKIANNPDGREC

SEQ ID NO: 17320 - protein, 81 aa, Pongo abelii
AQESVSFEDVAVNFTNREWQCLTYAQRHLYKDVMLENYGNMVSLGFPFPKPPLISHLEREVDPCVQDPQDRESLSCSYPVS

SEQ ID NO: 17321 - protein, 81 aa, Pongo abelii
LQEPVTFRDVAVDFTQEEWGQLDPNQRILYRDVMLETFGHLLSIGPELPKPEVISQLEQGTELWVAERGTTQGCHPGWEPR

SEQ ID NO: 17322 - protein, 81 aa, Macaca mulatta
KPVTFEDVAVNFTQEEWDCLDASQRVLYQDVMSEIFKNLASVEGKKKELREQHPSLRDEGTSDDKVFLACRGAGQCPLSAP

SEQ ID NO: 17323 - protein, 81 aa, Callithrix jacchus
ILENYRNLVFLGIAVSKPDLIACLEQEKEPLIMKRDEMADEPPVMCSHFAQEFWPEQNIKDSSQSMTLRRYEKCGNENFQL

SEQ ID NO: 17324 - protein, 81 aa, Callithrix jacchus
MELLTFRDVAIEFSPEEWRCLDPAQQNLYRDVMLENYRNLVSLGVALSNPDLVTCLEQRKEPYNVKIHQTVARSPAMCSPF

SEQ ID NO: 17325 - protein, 81 aa, Callithrix jacchus
SQGLVTIKDVSLCFSQEEWRSLDPSQTDFYGEYVMQENCGIVVSLRFPIPKLDMLSQLEGGEEQWVPDTQDLEERDILRVT

SEQ ID NO: 17326 - protein, 81 aa, Macaca mulatta
FQGSVTFEDVAIAFSQQEWESLDSSQRGLYRDVMLENYRNLVSMGHSLSKPHVIALLERWKEPKVTERKDGRRWCTDLQLE

SEQ ID NO: 17327 - protein, 81 aa, Monodon monoceros
VPGSKPDLISQLEQGKEPWGSDLLGAQEGETVGDPSTDSSRGSLRKQVMARVKMTQASEPPEASGRFSGGGPPTLVCREAA

SEQ ID NO: 17328 - protein, 81 aa, Bos taurus
MLENHSSVAGLAGFLVFKPELISRLEQGQDPWVLDLQGAEGREEARTTRTDSTVGTDGEQDMDSFKSESGGVMVKTLPQNF

SEQ ID NO: 17329 - protein, 81 aa, Bos taurus
VEQTSTFRDVAIHFSQQEWECLNPVQKNLYQDVMMENYDNLVSLGHSISKPDVITLLEQGKEPWMVVREETRRWCAGQYKQ

SEQ ID NO: 17330 - protein, 81 aa, Bos taurus
RLQSMGSLRDVAIDFTQEEWECLDLSQRELYRDVMLENYGNLASLGLVSNLDLVTFLEPLKDPRNIRRMGTTVIYPDSNLM

SEQ ID NO: 17331 - protein, 81 aa, Ovis aries
MLENYSHLVFLGYQVSKPEVIFKLEQGEEPWIAEGEIQRPVYPDWKTRPEAKSSHLQQSISKVSLSTDELSHTTGEDAWDL

SEQ ID NO: 17332 - protein, 81 aa, Ovis aries
SRSLENDGICFSEQEWENLEDWQKELYASVMKSNYEALASLKVLGQPEGEMELGAEMPGDLEEEESRGVHPAEEVVAKQET

SEQ ID NO: 17333 - protein, 81 aa, Ovis aries
ELVTFRDVVISFSQEEWEYLDSVQRDLYWDVMMENYSNLVSLGKESKYDTKTLSVEDILEKNNSQWEVIENSKLVGLQNSI

SEQ ID NO: 17334 - protein, 81 aa, Ovis aries
QESVTFEDVAVDFTQEEWALLDTSQRKLFRDVMLENISHLVFVGTGYQHCKLDVIFQLEQGEELWIEGRGFFQSHSPGGES

SEQ ID NO: 17335 - protein, 81 aa, Ovis aries
AFQKIATLDDIAMDFTLENWEQLGQGQGDLFWDTALDNYQNLFLLNPPRPNLTFHLDGGEKLEALAKESPESTDAGITETS

SEQ ID NO: 17336 - protein, 81 aa, Vulpes vulpes
MLENFSHLVSLGHPVSKPDVISKLEQGEEPWIIKRDIPNWIYPGKNLAESENRLENPQLNMLGGVSFHKEILESVTRDHSL

SEQ ID NO: 17337 - protein, 81 aa, Otolemur garnettii
LSFKDVAVSFTWEEWQLLDPSQKNLYQAVMLENYNNLVSVGYQVTEADAFFQLAQEKPWIIEEEIQNEIHLQDAWQVNDRT

SEQ ID NO: 17338 - protein, 81 aa, Vulpes vulpes
LLTFKDVVIEFSQEEWECLAPAQRALYRDVMLENYRNLVSLDIPTICVRKELPPKDDLNNGELLQTLILERHLSHQFDDFD

SEQ ID NO: 17339 - protein, 81 aa, Vulpes vulpes
MLENYSHLVSVGYLGAKPDVVLRLGRGEEAGLTEGETPTWKYPEFWQVGDQIDNHKESQDRLLWQTALVDKEAQKDQSGQE

SEQ ID NO: 17340 - protein, 81 aa, Vulpes vulpes
MLETYSHLLSVGYEVPQPEVFMLEQGKEPWALQGESPHQNCTEDLWQIGDQIESYQQKENKSLRDVAFIKKILTTKKDYEY

SEQ ID NO: 17341 - protein, 81 aa, Otolemur garnettii
AQGCVIFQDVFVYFSREEWELLDNAQRLLYHDVMLENFALLASLGIASSRSQVVMQVELGEEPDQVDVTIESPRGNQRPPR

SEQ ID NO: 17342 - protein, 81 aa, Otolemur garnettii
EMELLTFKDVSVEFSMDEWACLDPAQQTLYRDVMLENYRHLVFLGLTPSKPHLITCLEQSRESWKVKTHQTVVKHPAVSNH

SEQ ID NO: 17343 - protein, 81 aa, Enhydra lutris
VSRSLENDGVCFSEQEWENLEDWQKELYRNVMKSNYETLVSLKVLGQPEEEAELGAGMLGDLEEEGPGDVHPAEGVMIKPE

SEQ ID NO: 17344 - protein, 81 aa, Enhydra lutris
SQDLVTFKDVAIDFSQEEWEWLNPAQRNLYKNMMLENYQNLVSLGLCISKPYVISLLEQGKEPCEMKTEMTRSPFPDSGSI

SEQ ID NO: 17345 - protein, 81 aa, Pongo abelii
FQESVTFQDVAVDFTAEEWQLLDCAERTLYWDVMLENYRNLISVGFPITKTKVILKVEQGQEPWMVEGVNPHQSSPESDCP

SEQ ID NO: 17346 - protein, 81 aa, Pongo abelii
RRGHLTFRDVAIEFSQEEWKCLDPVQKALYRDVMLENYRNLVSLGICLPDLSIFSMMKQRTESWTVENEMKVANNPDRWEG

SEQ ID NO: 17347 - protein, 81 aa, Pongo abelii
FQGLLTFRDVAIEFSLEEWQCLDTAQQNLYRNVMLENYRNLVFLGIAFSKPDLITCLEQGKEPWNMKQHERVDEPPAIWEA

SEQ ID NO: 17348 - protein, 81 aa, Pongo abelii
AGRPLEMAVSEPEASAAEWKQLDPAQRNLYNDVMLENYSNQASMGCQAPKPDMISKLEKGEAPWLGKGKRPSQGCPSKIAR

SEQ ID NO: 17349 - protein, 81 aa, Pongo abelii
MLESYSNLTSLGYQVGKPSLISHLEQEEEPRTEERGAHQGACADWETPSKTKWSLLMEDIFGKETPSGVTMERASLGEKST

SEQ ID NO: 17350 - protein, 81 aa, Pongo abelii
QGRLTFRDVAIEFSLSEWKFLNPAQRALYREVMLENYRNLEAVDISSKCMMKEVLSTGQGNSEVFYTGTLQRHESHRIGDF

SEQ ID NO: 17351 - protein, 81 aa, Pongo abelii
FREAVTFKDVAVAFTEEELGLLDSAQKKLYRDVMLENFRNLVSVGHQSFKPDMISQLEMEEKLWMKELQTQRGKDSGDRNQ

SEQ ID NO: 17352 - protein, 81 aa, Pongo abelii
RVTFKDVAVVFTNEELALLDKAQINLYQDVMLENFRNLISVKDGIKNNILNLQAKGLSYLSQELLHCWQIWKQRIQDLTVS

SEQ ID NO: 17353 - protein, 81 aa, Pongo abelii
LLTFRDVAIEFSQEEWKCLDPAQRTLYRDVMLENYRNLVSLGIFSKCEIKELPPKKESNTGEIFQTVMLERQESHDIQDFC

SEQ ID NO: 17354 - protein, 81 aa, Pongo abelii
IWGPLSFMDVFVDFTWEEWQLLDPAQKCLYRSVMLENYSNLVSLGYQHTKPDIIFKLEQGEELCMVQAQVPNQSCPILKAG

SEQ ID NO: 17355 - protein, 81 aa, Pongo abelii
MPGPPRSLEMIAVSKPDLITSLEQGKEPWNMKRHEMVDEPSGIYPHFAQDLWPEQGMEDSFQKAILRRYEKYGHENLQLRK

SEQ ID NO: 17356 - protein, 81 aa, Pongo abelii
PKVPVAFDDVSIYFSTPEWEKLEEWQKELYKNIMKGNYESLISMDYAINQPDVLSQIQPEGEHNTEDQAGPGESEIPTDPS

SEQ ID NO: 17357 - protein, 81 aa, Pongo abelii
FQEPVTFEDVAVYFTQNEWASLHPTQRALYRGVMLENYANVTSLSAFPFPKPDLIFQLEQGEAAWGPDPWTLDGGEALRGM

SEQ ID NO: 17358 - protein, 81 aa, Pongo abelii
SVAFEDVAVTFTQEEWALLDPSQKNLYRDVMQETFRNLASIGKKWKAQNIYVEYENLRRNLRIVGERLFESKEGHQHGEIL

SEQ ID NO: 17359 - protein, 81 aa, Pongo abelii
FQEMVTFKDVAVVFTREEVGLLDVAQRKLYQDVMLENFRNLLSVGYQPFKLDVVLQLGKEDKLWMMETEIQGDGCSGHRNQ

SEQ ID NO: 17360 - protein, 81 aa, Pongo abelii
MSKEAVTFKDVAVVFTEEELGLLDLAQRKLYRDVMLENFRNLLSVGHQPFHRDTFYFLREEKFWMMDIATQREGNSGGSVQ

SEQ ID NO: 17361 - protein, 81 aa, Callithrix jacchus
DMEMLTFSDVAIGFCPEEWECLDSSQQHLYRNMMLENYRNLVFLGLGDSKSELITRLEQGKDPWNVKRQETVVKHPAKTWN

SEQ ID NO: 17362 - protein, 81 aa, Callithrix jacchus
FQGSVMFSDVSIDFSQEEWDCLDPVQRALYRDVMLENYSNLVLMGLHTPKPQVISLLEQGKEPWMVGRELTRGLCSDLESM

SEQ ID NO: 17363 - protein, 81 aa, Callithrix jacchus
AHALVTFRDVAINFSQKEWECLDPTQRKLYRDVMLENYSNLVSLGLLSRHKTKKLSSEKDIHEISFSKGNIIEKSKTLHLK

SEQ ID NO: 17364 - protein, 81 aa, Macaca mulatta
PQGLLTFRDVAIEFSQEEWKCLDPAQRTLYRDVMLENYRNLVSLDISSKCMMKEFSSTAQGNTEVIHRGTIQRHERHHIGD

SEQ ID NO: 17365 - protein, 81 aa, Macaca mulatta
ASVTVTFDDVALYFSEQEWEILEKWQKQMYKQEMKTNYQTLDSLGYAFSKPDLITWMEQGRMLFISEQGCLDKTRRTTSPP

SEQ ID NO: 17366 - protein, 81 aa, Callithrix jacchus
SRGGQITRDVAIEFSLEEWQCLDTAQRNLYKNVILENYRNLVFLGIAVSKPDLIACLEQEKEPLIMKRDEMADEPPVMCSH

SEQ ID NO: 17367 - protein, 81 aa, Bos taurus
TGHGTIDWDVAIHFSQQEWECLNPVQKNLYQDVMMENYDNLVSLAGHSISKPDVITLLEQGKEPWMVVREETRRWCAGQYK

SEQ ID NO: 17368 - protein, 81 aa, Bos taurus
WSQMPVTFEDMALYLSREEWGRLDHTQQSFYREVLQKRSGLSLGVVEVDKEELAASLGALGDAKSFKSRMGRAQGEAPRCG

SEQ ID NO: 17369 - protein, 81 aa, Bos taurus
MLENYRNLVWLGLSISKPNMISLLEQGKEPWMVEREMSDGQHADWESWYEIKALSPKWYTDEEEISQGVITKRLTSYSLEF

SEQ ID NO: 17370 - protein, 81 aa, Bos taurus
RRKQQMTVEDVAIKFTPEEWECLSPAQRTLYWDVMLETYRNLLSVDISPIHIIKKLQSKENTNSTDTLQTLTDRKDQRGRS

SEQ ID NO: 17371 - protein, 81 aa, Ovis aries
SLSPVTFEDVAVYFSQEEWRLLGEAQKFLYRDVMLETFALVVSLGCCHTAEDEQTPSEQNVSVEVPQRNTKKTDLSSQKVC

SEQ ID NO: 17372 - protein, 81 aa, Ovis aries
SQSPLTFGDVAVEFSGEEWAWLDSAQRSLHRSVMLENYRNLASLGLCLSKPEMISSLEQRKEPWAVKRKLTGGECPDSQTL

SEQ ID NO: 17373 - protein, 81 aa, Ovis aries
EQGLMAFEDVAVHFSQEEWGLLDTAQRALYRRVMLENFALLASLGLSVSRPRVVTQLERGDEPWVLSGADVTLARDAQRRP

SEQ ID NO: 17374 - protein, 81 aa, Ovis aries
LQEALTFKDVAVTFTEEELGLLDLAQRKLYRDVMLENFRNLLSVGHQSSKPDMISQLEREEKFCTIEIQPQRGGRSGGWNH

SEQ ID NO: 17375 - protein, 81 aa, Ovis aries
SQGLVTFEDVAVYFSLEEWERLDADQRELYKEVMRENYGILVSLGYPVPKPDLIFRLEQGEEPWVPDSPRPEEGDIVTGVY

SEQ ID NO: 17376 - protein, 81 aa, Ovis aries
VMFSDVSIDFSQEEWEFLNDDQRDLYRDVMLENYSNLVSMVLESRCETKKLFLKKEIYEIESAQWEIMDRLTRHNLQCSSF

SEQ ID NO: 17377 - protein, 81 aa, Ovis aries
AQLTFKDVFLDFTPEEWECLDPAQRTLYKDVMVEILRNLLSVDMSHIHMVKKLQAKAHSGKGEIFQRVMFGRAEILEIKDF

SEQ ID NO: 17378 - protein, 81 aa, Ovis aries
QLTFEDVAIEFTQEEWEFLDRAQRALYRDVMLETYRNLLSVDIAPTHVIKLLQPKVNSDKQTFQKLMQGRPESCEMKHFHL

SEQ ID NO: 17379 - protein, 81 aa, Ovis aries
FQESMTLEDMVIYFSENEWTALASIQRALYREVMLENYGAVASLACPFPTPALILQLEAGGTPWSLAPREGLNGESPRGIF

SEQ ID NO: 17380 - protein, 81 aa, Ovis aries
RLTSEDVAIEFTQEEWEFLDPTQRALYRDVMLETYRNLLSLDISPTHVMKHLQPKANSDKRETFQTLMLGSPESCEIKHFH

SEQ ID NO: 17381 - protein, 81 aa, Ovis aries
ALVSVTFRDVAVFFSRDEWLCLDSAQRTLYQEVMLENYSTLFSLGILFSKPKVILQLEQGEDPWMVENGVSQSTYLGWESL

SEQ ID NO: 17382 - protein, 81 aa, Otolemur garnettii
KVPVTFVDIAVYFSEDEWKNLDEWQKELYNNLVKENYKTLMSLDTEGPVPKTDAPAPAEPREEPCVWEQRHPEEREISMDP

SEQ ID NO: 17383 - protein, 81 aa, Vulpes vulpes
MLENYGAVAALAAFPFPKPALISQLERGEAPWCKAPQGALDGEGPRGISSGYPFLKPAGISHFEQVEEPLNLKLQGEGPSL

SEQ ID NO: 17384 - protein, 81 aa, Vulpes vulpes
IQGSLTFGDVAVAFTQFEWKYLDATQRALYKDVMLENYGNLLSVGFLSYKPKLITQLEQGAEPWMEVQQIPSDNYSVQEYW

SEQ ID NO: 17385 - protein, 81 aa, Otolemur garnettii
QELLTFKDVSVEFSMDEWACLDPAQQTLYQDVMLENYRHLVFLGLTLSKPDLITCLEQSKEPWKVKSHQTVVKHPAVSDPP

SEQ ID NO: 17386 - protein, 81 aa, Vulpes vulpes
LVKIEDVADVAVSFILEEWGHLDQSQKSLYRDDRKENYDSITYMDYESGNDNVELVVKQISDDAESHWMTAGSTERNIPQS

SEQ ID NO: 17387 - protein, 81 aa, Otolemur garnettii
QELLTFRDITIEFTAEEWEYLDPAQQNLYRDVMLENLRNLVSVGSTNLKCFLLNILQSLSENSASHIHLRWRVQIQPGPAK

SEQ ID NO: 17388 - protein, 81 aa, Vulpes vulpes
SQASISFKDVTVEFTQEEWQQMGPMQRTLYRDVMLENYNNLVSVGNCIFKPAVIFKLEQGEEPWLLEEEFSNQSHLEDYRD

SEQ ID NO: 17389 - protein, 81 aa, Vulpes vulpes
SEESVTFEDVAIYFSENEWTGLAPAQRVLYRDVMLENYGAVAALAFPFPKPALISQLERGEAPWCKAPQGALDGEGPRGIS

SEQ ID NO: 17390 - protein, 81 aa, Otolemur garnettii
LQGLVSFKDVAVDFTWEEWQGLDDAQRTLYKDVMLEIYSSLVSLGYCIMKPELILKLEQGAEPCVVSQCILTAVVVVWRAQ

SEQ ID NO: 17391 - protein, 81 aa, Vulpes vulpes
LLTFEDVAVFFSEEEWKLLNPTQKILYSDVMQENYETVISLGLKLKNDTGNDQPISLSTLELQASGCKVLRKAKVKVAQKT

SEQ ID NO: 17392 - protein, 81 aa, Otolemur garnettii
QERVSFKDICVDFTQEEWSLLDSTQKVLYRDVILENYGNLVSVAGHCVTKPEVIFKIEQGEEPWILEKGFPSQCYPERKWK

SEQ ID NO: 17393 - protein, 81 aa, Otolemur garnettii
FQGLMTFEDVTVEFTQWEWGQLDPAQKDLYREVMLENFRNLASLGLPLSKPYVICQLEEGQEPCMLEKEISVGTQSVGEAT

SEQ ID NO: 17394 - protein, 81 aa, Otolemur garnettii
QGPVSFRDVVVDFTWEEWQCLDFPQRDLYRDVMLENYINLISVGYQTTKPAVIHRKRAMDNRERNLTSGKCTKKNECNKCG

SEQ ID NO: 17395 - protein, 81 aa, Vulpes vulpes
QVSAAYEFLSVDYTERKWKGPAVGQRAVYRSIMPGNYCSVASLGDTRMRCSELPVKLAVSKGPESSDGTSRGLCAVVSGEP

SEQ ID NO: 17396 - protein, 81 aa, Vulpes vulpes
DPVTFDDVAVEFTQEEWTLLDQTQRRPYRDVVLENYKNLASTDWEICLNSKWSAPQQNILQGKTPSVVEMVCLLRTLSGKA

SEQ ID NO: 17397 - protein, 81 aa, Vulpes vulpes
PHWLVTFRDVAIDFSQEEWECLNSTQRDLYRDVMLENYSNVISLAGCSIPKPDVFSLLEQGKDPWMVMRAMTRKRSSDLES

SEQ ID NO: 17398 - protein, 81 aa, Vulpes vulpes
LQEPVTFRDVAVDFTQEEWGQLGPAQRTLYRDVMLETFGHLLSLGPELPKPEVISQLEQGAELWAAEREIAQGYCRGREPG

SEQ ID NO: 17399 - protein, 81 aa, Otolemur garnettii
QVTFSDVAVDFSHEEWGWLDSAQRDLYKDVMVQNYENLVSLVGLSITKPYVITLLEDGKEPWMVEKNLSKSVFPDWESRWE

SEQ ID NO: 17400 - protein, 81 aa, Otolemur garnettii
ASVTFEDVAVYFSWEEWDLLDEAQKHLYFDVMLENFALTSSMGCWREVEYQGAPSEQSIAIKGVSQIRTPKENSSSQNAYP

SEQ ID NO: 17401 - protein, 81 aa, Pongo abelii
QEMPLTFQDVAVYFSQAEGQQLGPQQRALYRDVMLENYGNVASLGFPIPKPELISQLEQGKELWVLNLLGAEEPDILKSCQ

SEQ ID NO: 17402 - protein, 81 aa, Pongo abelii
MLENYRNLFSIGLTVSKPGLITCLEQRKEPWNVKRQEAVDGHPEMGFHHTTQACLELLGSSDLPASASQSAGITGVNHRAQ

SEQ ID NO: 17403 - protein, 81 aa, Pongo abelii
DSVAFEDVAVNFTLEEWALLDPSQKNLYRDVMRETFRNLASIGKQWEDQNIEDPFKIPRRNISHIPERLCESKESGQGEET

SEQ ID NO: 17404 - protein, 81 aa, Pongo abelii
QGLLTFRDVAIEFSQEEWKCLDPAQRTLYRDVMLENYRNLVSLDMSSKCTMKEFLSTAQGNREVFHAGTLQRHESHHNGDF

SEQ ID NO: 17405 - protein, 81 aa, Pongo abelii
YQDSVTFDDVAVDFTPEEWALLDTTEKYLYRDVMLENYMNLASVEWEMQPRTKRSSLQQGFLKNQIFSGIQMQTRGYSGWK

SEQ ID NO: 17406 - protein, 81 aa, Pongo abelii
MESVTFEDVAVEFIQEWALLDSARRRLCRYRMLDQCRTLASRGTPPCKPSCVSQLGPRAEPRATEQGILHATGVAWESQLK

SEQ ID NO: 17407 - protein, 81 aa, Pongo abelii
TFKEAMTFKDVAVVFTEEELGLLDLAQRKLYRDVMLENFRNLLSVGHQAFHRDTFHFLKEEKIWMMKTATQREGNSGDKIQ

SEQ ID NO: 17408 - protein, 81 aa, Pongo abelii
SQELVTFEDVAVYFIRKEWKRLEPAQRDLYRDVMLENYGNVFSLDHETRTENDQEICEDTRSHGVLLGRFQKDISQGLKFK

SEQ ID NO: 17409 - protein, 81 aa, Pongo abelii
SPDSMTFEDIVVDFTQEEWALLDTSQRKLFQDVMLENISHLVSIGKQLCKSVVLSHLEQVEKLSTQRISLLQGRQVDIKHQ

SEQ ID NO: 17410 - protein, 81 aa, Pongo abelii
FQGPVTLKGVIVEFTKEEWKLLTPAQRTLYKDVMLENYSHLVSVGYHVNKPNAVFKLKQGKQPWILEVEFPHRGFPEDLWS

SEQ ID NO: 17411 - protein, 81 aa, Pan troglodytes
YQDSVTFDDVAVDFTPEEWALLDTTEKYLYRDVMLENYTNLASVEWEIQPRTKRSSLQQGFLKNQIFSGIQMTRGYSGWKL

SEQ ID NO: 17412 - protein, 81 aa, Sapajus apella
GPLTFRDVTIEFSHDEWKCLDPAQKALYKDVMLENYRNLVFLGIIPKCTTKELPPIGNNNTGEKFRTMTLERHECYDIEDI

SEQ ID NO: 17413 - protein, 81 aa, Sapajus apella
VHGSVTFRDVAIDFSQEEWECLQPAQRTLYRDVMLENYSHLISLGSSVSKPDVITLLEQEKEPWMVVRKETSRWYTDLESK

SEQ ID NO: 17414 - protein, 81 aa, Pan troglodytes
HLTFMDVAIEFSQEEWKSLDPGQRALYRDVMLENYRNLVFLGRSCVLGSNAENKPIKNQLGLTLESHLSELQLFQAGRKIY

SEQ ID NO: 17415 - protein, 81 aa, Zalophus californianus
AQVPLTFSDVAIDFSQEEWECLNSDQRDLYRDVMLENYTNLVSLDFDFTTGTNKLSSEKSSYEVNSYHRETMKRSKTFNLM

SEQ ID NO: 17416 - protein, 81 aa, Pan troglodytes
RVTFKDIAVIFTKEELAVLDKAQINLYQDVMLENFRNFISVDGIKNNILNLQGKGLSYLSQEELHCWQIWKQRIRDLSVSQ

SEQ ID NO: 17417 - protein, 81 aa, Pan troglodytes
QGRLTFRDVAIEFSLEEWKCLNPAQRALYRAVMLENYRNLEFVDSSLKSMMEFSSTRHSNTGEVIHTGTLQRHKSHHIGDF

SEQ ID NO: 17418 - protein, 81 aa, Balaenoptera acutorostrata
AHGSVTFRDVAIDFSQEEWEFLDSAQRDLYKDVMWENYSNFISLGPSISKPDVITLLDEGKEPWMVVRERTRRHHPDLESR

SEQ ID NO: 17419 - protein, 81 aa, Vulpes vulpes
SQELVTFEDVAVYFIRKEWKRLEPAQRDLYRDVMLENYGNVFSLDGETRTGHDQDISEDTGSRGVLLGRFQKDISQGLKFE

SEQ ID NO: 17420 - protein, 81 aa, Vulpes vulpes
PQGSVSFKDVTVDFTQEEWQQLDPTQKALYRDVMLENYCHLISVGFHMTKPDMIRKLEQGEELWTTERIFPSQSYLEEDGK

SEQ ID NO: 17421 - protein, 81 aa, Rhinolophus ferrumequinum
SRSLENDGVYFAEQEEENLEDWQKELYRNVMKSNYETLVSLKVLGEPEGEAELGTEMLGELEEEGPDGVHPAEGVMLKPEL

SEQ ID NO: 17422 - protein, 81 aa, Acinonyx jubatus
FQEAVTFKDVAVVFTEEELGLLDPAQRKLYREVMLENFWNLVSVGHSSSKPDVISQLEREEKLCMKEIHTQRGGHSGGRNQ

SEQ ID NO: 17423 - protein, 81 aa, Acinonyx jubatus
REESLTLEDVAVDFTWEEWQLLAPAQKDLYWNVMLENYRNLVSLGYQARQPDSFSELEQEPPPWIFKDEVQSQTHPEIERV

SEQ ID NO: 17424 - protein, 81 aa, Acinonyx jubatus
KVPVTFVDIAVYFSEDEWKNLDEWQKELYNNLVKENYKTLVSLDAEGAVPKPDAPSQAEPREEPCVWEQRDPEEREILMDP

SEQ ID NO: 17425 - protein, 81 aa, Rhinopithecus roxellana
DSVTFEDVAVDFTQEEWTLLDQTQRNLYRDVMLENYKNLVAVDWESHINTKRSAPQQNFLQGKTSSVVEMVRFRRYNLLPS

SEQ ID NO: 17426 - protein, 81 aa, Rhinopithecus roxellana
ARGCVVFEDVFVYFSREEWELLDDAQRLLYHDVMLENFALLASLGIAFSGSCAVIKLEQAEEPWVYDQVDMTSATEREAQR

SEQ ID NO: 17427 - protein, 81 aa, Bison bison
MFRDVTVDFSQEEWECLNSNQRNLYRDVILENYSNLVSLGGCSISKPDVITLLEQGKEPWMVVRDEKRRWRLDLESRYDTK

SEQ ID NO: 17428 - protein, 81 aa, Bison bison
PKVPVTFDDVAVHFSEQEWGNLSEWQKELYKHVMRGNYESLVSMDYAISKPDLMSQMERGERPAMQEQEDSEEGEAPADPS

SEQ ID NO: 17429 - protein, 81 aa, Bison bison
MLENYSNLVLLGYQVIKPEMIFKLEQENPWLLDEEILSQNFSEKVWLDNNLKMWHQDNQDKLKSLERGHEYDIFERMFHLG

SEQ ID NO: 17430 - protein, 81 aa, Vicugna pacos
AQGSVSFKDVTVDFSQEEWQHLDPAQKTLYMDVMLENYCHLISVAGCHMTKPDVILKLERGEEPWTSCTGHTCLEESWKAE

SEQ ID NO: 17431 - protein, 81 aa, Vicugna pacos
FKEAVTFKDVAVTFTEEELGLLDPAQRELYRDVMLENFRNLVSVGHQCFIPDVISQLEREEKLWMLRTAAQSRCSSGDKNL

SEQ ID NO: 17432 - protein, 81 aa, Vicugna pacos
VQGSLSFEDVAVGFTWEEWQLLDASQKDLYRDVMLENYHNLVSVGHQATKPDSLFQWERGQPPWRAEGAAPRHTCPGEKPH

SEQ ID NO: 17433 - protein, 81 aa, Odocoileus virginianus
SQEQVSFKDVCVDFTQEEWYLLGPAQKILYRDVILENYSHLVSVGNCTTKPEVVFKIEQGEEPWILEERFPKQCRSEDWKV

SEQ ID NO: 17434 - protein, 81 aa, Phascolarctos cinereus
LESVTFQDVAVTFTPEEWEQLGPPQKALYREVMLENYGNLVCLGPTLSPRVPEQVLRAEVSTWQGEVRGRPSVMGHSPPLL

SEQ ID NO: 17435 - protein, 81 aa, Phascolarctos cinereus
SQESLTFKDVAVYFTQEEWGQLDPGQKYLYRDVMLENYRNMVSLGYHISKPDVISHLEQGEEPWMIGREILRGNSPGGMTR

SEQ ID NO: 17436 - protein, 81 aa, Pongo abelii
MVENFKNLVAVGHLPFQPDMVSQLEAEEKLWMMETETQRSSKHQNKMEALQKFALKYLSNQELSCWEIWKQVASELTRCLQ

SEQ ID NO: 17437 - protein, 81 aa, Physeter macrocephalus
QAEVTFEDVAVLLSREEWGRLGPVQKGLYRDVMLETYRNLVSLGAGPAGPKPEVITQLERGDEPWVLDVQGRERPTIDGSA

SEQ ID NO: 17438 - protein, 81 aa, Physeter macrocephalus
LEDLVTFEDVAVEFTQEEWALLDPCQRTLYRDVMLENCRNLASLGYHVDKPRLISQLEQEDKVMTEERGILPGTCPDLETV

SEQ ID NO: 17439 - protein, 81 aa, Physeter macrocephalus
FQGSLSFRDVAVGFTRKEWQQLDPTQRTLYRDVMLENYSHLVSVGCQVTKPAVIFRLEQGQEPWMKEEEILRWSFPEVLQV

SEQ ID NO: 17440 - protein, 81 aa, Trichechus manatus
SVAVEDVAVDFTEEEWALLDLSQRQLYRDVMMEIFRSLASVASQNLIDGEKLSTENVIVRFMKNDTWFSMLEVCELHGTEE

SEQ ID NO: 17441 - protein, 81 aa, Trichechus manatus
SQEPVTFEDVAVVFTQEEWVFLDSAQRSLYREVMLENCRNLAAVGYQLCKPSVFSPWGQIEELWTTERGLFQGICPEPQLQ

SEQ ID NO: 17442 - protein, 81 aa, Trichechus manatus
PPESVTFEDVAVYFTQKEWASLMPAQKALYRDVMLENYEAVAFLAPATSKPALISQLEQGVEPSFSQAQGDLSMRDRGAGL

SEQ ID NO: 17443 - protein, 81 aa, Trichechus manatus
SWGPLSFKDVFVDFTWEEWRLLDPAQKSLYRTVMLENYSNLMSLGYQHTKPDIIFKFKQGEELRMIKAQIPNQSFPEKVRE

SEQ ID NO: 17444 - protein, 81 aa, Callorhinus ursinus
FQEAVTFKDVAVVFTMEELGLLDSTQRKLYRDVMLENFRNLLSVGYEPFRLDTTLLLGREEKLWMMETQAPGDGRSGLRNQ

SEQ ID NO: 17445 - protein, 81 aa, Equus caballus
AQDSMTFEDIAVYFSWEEWRLLDEAQRHLYLDVMLENFALISSLGYWNGAEDVESPFEHSIPVRVLQASTPKTSSTSQKIH

SEQ ID NO: 17446 - protein, 81 aa, Rhinolophus ferrumequinum
LQDSVSFEDLSIDFTQKEWQLLDACQKDLYKDVMLENYSSLVSLGYEVTKPDVIFKLEQGREPWTGGGALPSSGSLEQVLQ

SEQ ID NO: 17447 - protein, 81 aa, Rhinolophus ferrumequinum
QDCVTFDDVAVFFSQEEWWLLDEAQKHLYLNVMLENLALISSLVCWHAVENEETLPEQSVSVQALSQVRTPKAGPSTQKIH

SEQ ID NO: 17448 - protein, 81 aa, Rhinolophus ferrumequinum
SQVSVTFEDVAVLFTRDEWRKLRPFQRNLYQDVMLETYSNLVSLGLPFSKPKVISLLQQGEAPWKLEEGSPGGSWPGWKSS

SEQ ID NO: 17449 - protein, 81 aa, Rhinolophus ferrumequinum
SQGLVTFEDVAVYFSLEEWERLDPDQRDLYKEVMQENYGILVSLGYPIPKPELISRLEQGEEPWVPDSPRPEEGDIVTGVY

SEQ ID NO: 17450 - protein, 81 aa, Ursus maritimus
FQGPVSFKDVAVDFTQEEWQYLDLPQRDLYRDVMLENYINLISVGYQTTKPSVIHKLEQGEEPWMVEREIPSWSYAEEVWQ

SEQ ID NO: 17451 - protein, 81 aa, Ursus maritimus
MTFEDVAVEFTQWEWGQLDPAQQGLYREVMLENFKNLASLDWEKRPKAKESILNQGISKEELLQIVSVEKHIRDELCFCKL

SEQ ID NO: 17452 - protein, 81 aa, Ursus maritimus
SLELVSFEDVAVNFSWEEWQDLDDAQRTLYRVVMLETYSSLVSLGHCITKPEVIVKLEQGAEPWTVEEAPTQSLPDVQTSG

SEQ ID NO: 17453 - protein, 81 aa, Phyllostomus discolor
MEAVTFGDVAVHFSREEWQCLDPGQRALYKEVMLENHSSVAGLAGFLLFKPELISRLEQGEEPWVLDLQGTEGRELPRTPQ

SEQ ID NO: 17454 - protein, 81 aa, Acinonyx jubatus
AQGCVISEDVFVYFSWEEWMLLDDSQRLLYQDVMLENFALLASLGIAPSISCLVAQPKQREYPWVPDQVDVTPATEREAPK

SEQ ID NO: 17455 - protein, 81 aa, Acinonyx jubatus
KSPGLLSFKDVAVVFTWEEWQLLDPIQKHLYQDVMLENYSNLVSVGRQVTKADAFYQLEQGPPWITEEEIQSQIHPDDTWQ

SEQ ID NO: 17456 - protein, 81 aa, Sapajus apella
FQESVTFQDVAVDFTPEEWQLLDCAERTLYWDVMLENYRNLISVGCPVTKTKVTLKVEQGQEPWMVEGVNPQHSSPESDCP

SEQ ID NO: 17457 - protein, 81 aa, Callithrix jacchus
FQESVTFQDVAVDFTPEEWQLLDCAERTLYWDVMLENYRNFISVGCPVTKTKVIIKAEQGQEPWMVERVNPHQSSPESDCP

SEQ ID NO: 17458 - protein, 81 aa, Carlito syrichta
PLKPVTFEDIAINFTQEEWALLDTSGRTLYKDVMLENINHLISVGYQLQKSDVIFHLKQGEMLWMVEGIEFPQGQSPGRKS

SEQ ID NO: 17459 - protein, 81 aa, Ovis aries
PQKLVTFEDVAVYFTQTEWDGLSTAQRALYRDVMLENYGNVASLGFPLLKPAVISQLEGGGELEGPSSLASGAGTGPQGLW

SEQ ID NO: 17460 - protein, 81 aa, Callorhinus ursinus
FQEAVTFKDVAVVFTMEELGLLDSTQRKLYRDVMLENFKNLVSVGHLPFRPDMVSQLEAEEELWMMEGEPQRNGYSREDHV

SEQ ID NO: 17461 - protein, 81 aa, Callorhinus ursinus
PLESVTFEDVVVDFTKEEWALLDISQRKLFRDVMLENIRHLLSLGYQHCKSDVIFPLEQGEELWREGTGFLQGQSPVILGR

SEQ ID NO: 17462 - protein, 81 aa, Equus caballus
LTFRDVAIEFSQEEWESLDPAQRALYRDVMLENYRNLLSLGEESCPPEIGRLSAGFSIKELSPREDIEKRELYHLMISESN

SEQ ID NO: 17463 - protein, 81 aa, Rhinolophus ferrumequinum
KPRGLKFADVAVYFSPEEWGCLRPAQRALYRDVMRETYGHLGALGCAGHKPALISWLERNTDDWEPAALDPQDCPRGVTVQ

SEQ ID NO: 17464 - protein, 81 aa, Callorhinus ursinus
SFGREAENDQVSPFTKEEWQQLDPAQRTLYRDVMLENFSHLVSLGHPVSKPDIISKLEQGEEPWIIKRHISDWICPERETR

SEQ ID NO: 17465 - protein, 81 aa, Rhinolophus ferrumequinum
AQKLLTLEDVTVEFSWEEWQLLAPAQKDLYQDVMLENYNSLVSLGYQATKPELFSKLEYGEEPRIIKSEIQKRTCPGIGKV

SEQ ID NO: 17466 - protein, 81 aa, Rhinolophus ferrumequinum
GSVSFTDVTVDFSQEEWEQLDPSQRILYMDVMLENYSNLLSVEVWKADDQVEREPRNPDEQARPFVIFKNQTPIEERGDLF

SEQ ID NO: 17467 - protein, 81 aa, Acinonyx jubatus
EALMAFRDVAVAFTQKEWRLLSPAQRTLYRDVMLENYSHLVSLAGPGTEFQPCVHSCPVAFSSPQFLQQYVLCGHLPQIFP

SEQ ID NO: 17468 - protein, 81 aa, Acinonyx jubatus
RLTFRDVAIEFSQEEWECLDPAQRALYRDVMLENYRNLVSVGSLSAGFALMELSPGEDIYKEVFYHLVILERNESHGIKDF

SEQ ID NO: 17469 - protein, 81 aa, Rhinopithecus roxellana
MYGLLTFMDVAVEFSLEEWQCLDTAQQNLYRNVMLENYRNLVFLGIAVSKPDLITCLEQGKEPWNMKRHEMVAKPPAMCSH

SEQ ID NO: 17470 - protein, 81 aa, Acinonyx jubatus
SQSLLTFEEVAMYFSQEEWELLDPTQKALYNDVMRENYETVISLALFVLPKPKVISYLEQGEEPWVQGSTELKDSPGELPT

SEQ ID NO: 17471 - protein, 81 aa, Rhinopithecus roxellana
MGSVSFRDVTVGFTQEEWQHLDPAQRTLYRDVMLENYSHLVSVGYCIPKPEVILKLEKGEEPWILKEKFPSQRHLEIINTS

SEQ ID NO: 17472 - protein, 81 aa, Rhinopithecus roxellana
QAFLAFGDVTVDFTQKEWRLLNPAQRALYREVTLENYSHLVSLGIYAEHVLRPKNLGLAHQRQQQLQFSDQSFQSDTAEGQ

SEQ ID NO: 17473 - protein, 81 aa, Rhinopithecus roxellana
MTFEDVAVEFTQWEWGQLNPAQKDVYREVMLENFRNLAFLGLLVSKPYVICQLEEGGEPFIVERDISTGADSDWERRSKSK

SEQ ID NO: 17474 - protein, 81 aa, Bison bison
SQGWLTFQDVAIDFTQEEWECLDLGQRELYRDVMLQNYRNLASLGFVVSKPDLVTFLEQMKYPRNIRRVETTAIYTELIQK

SEQ ID NO: 17475 - protein, 81 aa, Bison bison
SVTFPDVAVYFSWEEWRLLDEAQRRLYLDVMLENYALISSLGCCCGTENAEAPSERITSLQVSQARTPKAALSTQKMNPCE

SEQ ID NO: 17476 - protein, 81 aa, Bison bison
GLLTFEDVAVFFTQEEWDYLDPAQRSLYKDVMMENYGNLVSLDVLNRDKDEEPTVKQEIEEIEEEMEPQGIILTRIKSEID

SEQ ID NO: 17477 - protein, 81 aa, Bison bison
GWLTFRDVAIDFTQEEWECLDLGQRELYRDVMIENYRNLACLGLVVSKPDLVTFLEQMKDLRNIRRMETIGIYPGRCEWME

SEQ ID NO: 17478 - protein, 81 aa, Acinonyx jubatus
SQEPVTFEDVAVYFTQNQWASLDPMQRALYREVMLENYTNMASLAFPFPKPVLVSHLERGEAPWGPDPWEAEVLRRICPGG

SEQ ID NO: 17479 - protein, 81 aa, Bison bison
MLETYSNLVSVGYEGTKPYVILRLEQEEAPWICEAACLGCHCWENIWQVKVHRKRRQDMLLRQGPFISRKMFPKERSHECN

SEQ ID NO: 17480 - protein, 81 aa, Bison bison
MLENYSSLVSLGYEVMKPGVILKLEQGEDPWTGDGEIPSSGSIDQVFQVNGHMTWHKDNKKFKNMKQDHECDALGKKFNLS

SEQ ID NO: 17481 - protein, 81 aa, Odocoileus virginianus
PQDLLTFEDVAVEFTWWEWGQLDPAQKDLYWEVMLENFKNLASLDWERRPQAKEAMLSQGLSKEELLQRASVEKHIRDELR

SEQ ID NO: 17482 - protein, 81 aa, Odocoileus virginianus
FQEPVTFEDVAVYFTQNQWASLDSAQRALYREVMLENYANVASLAAFPLPKPDLIFWLERGEEPGCLDPWTLVGGEDLRGI

SEQ ID NO: 17483 - protein, 81 aa, Odocoileus virginianus
SVTFEDIAVDFTQEEWALLDTSQRKLFRDVMLENISHLVSVVISDREDDLKKQEMLPMQHICKKNTPLISAMQSSHSQDDP

SEQ ID NO: 17484 - protein, 81 aa, Odocoileus virginianus
SQLTFKDVFIEFSPEEWECLDPAQRTLYKDVMVETLRNLLSVDMSHIHMIKKLHAKANSGKGEIFQRVMFGRTESLDIKDF

SEQ ID NO: 17485 - protein, 81 aa, Odocoileus virginianus
PQGSTPFGSLTVDYTQGGWRQLAPAPRDRFEEGMPEKSRNLVLLGLPVSQPGMNFQLEQREGSWMLKRDDLRNACPDWKII

SEQ ID NO: 17486 - protein, 81 aa, Odocoileus virginianus
SQVSVTFEDVAVLFTRDEWRKLAPSQRNLYQDVMLENYSNLVSLGLPFSKPEVISLLQQGEDPWKVEKEGPEGSSLECKSS

SEQ ID NO: 17487 - protein, 81 aa, Odocoileus virginianus
FQGSLSFRDVAVGFTRKEWQQLDPTQRTLYRDVMLENYSHLVSVGCQVTKPAVISRLEQGQEPWMEEEEILTWSFPEVSQV

SEQ ID NO: 17488 - protein, 81 aa, Odocoileus virginianus
ALALISFEDVAITFTGEEWRHLDLAQRTLYQEVMLETCGLLVSLGHPVPKAELIHLLEYGPGLWTVKRGLSRNTCTGEKAN

SEQ ID NO: 17489 - protein, 81 aa, Odocoileus virginianus
SQGSVTFRDVSIDFSREEWEWLQPAQRDLYRNVMLENYGHLVSLAGLNISKPDVVSLLEQGKEPWLGNGDVSRELFPASKP

SEQ ID NO: 17490 - protein, 81 aa, Odocoileus virginianus
AQGNVTFEDVFVSFSQEEWGLLDEAQRLLYREVMLENFALMASLGYTSSVAHGVSPQELGREPWVSDGADTTPALTREAQS

SEQ ID NO: 17491 - protein, 81 aa, Odocoileus virginianus
SRSPLTFGDVAVEFSGEEWARLDSAQRSLHRSVMLENYRNLASLGLCMSKPEMISSLEQRKEPWAVKRKSTRGRCPDSQTA

SEQ ID NO: 17492 - protein, 81 aa, Cebus imitator
MLENYRNLVSLGVVISNPDLVTYLEQRKEPYNLKIHETAAKPPATCSPFTQDLSPVQGTEDSFHKRILRRCEKCGHENLRL

SEQ ID NO: 17493 - protein, 81 aa, Callithrix jacchus
PRGSTSFSSVTVAFAQEGWRYLVSTSRDRFKDRIPEKSRNLVLLGLPVSQPGMNSQLELREGAWMLESEDLRNPSPNWKIV

SEQ ID NO: 17494 - protein, 81 aa, Callithrix jacchus
PCLPPRPHRPLCSRHLDLMAFEDVNVYFSPEECRLLDTAQRALYHHVMLENFTLVTSLGLSTSRPLWSSNLSVVRTPGFPV

SEQ ID NO: 17495 - protein, 81 aa, Macaca mulatta
CEVSVSFEDVTVDFSREEWQQLDSTQRRLYQDVMLENYSHLLSVGFEVPKPEVIFKLEQGEGPWMLAGEAPHQSCSGEAIE

SEQ ID NO: 17496 - protein, 81 aa, Macaca mulatta
EPVTFKDVAGVFSEEELRLLNLAQRKLYRDVMLENFRNVVSVGHQSTPDGLPQLEREEKLWMMKMATQRDNSSGGKNLKEM

SEQ ID NO: 17497 - protein, 81 aa, Callithrix jacchus
PQKSVTFEDVAVYFTQAEWDGLSPAQRTLYRDVMLENYGNVASLGFPLLKPAVISQLEGGGELGGPSPLAAGTGLHVLRTV

SEQ ID NO: 17498 - protein, 81 aa, Macaca mulatta
GSVSFTDVTVDFTQEEWEQLDPSQRILYMDVMLENYSNLLSVEVWKADDQMERDHRNPDEQARQFLILKNQTPVEERGDLF

SEQ ID NO: 17499 - protein, 81 aa, Macaca mulatta
SLGSELFRDVAIVFSQEEWQCLAPAQRDLYRDVMLETYNNLVSLGLAISKPDVISFLEQGKESWMVERVVSGGLCPVLESR

SEQ ID NO: 17500 - protein, 81 aa, Monodon monoceros
NCITKPEVIFKIEQGEEPWILEERFPKQCRSEDWKVDDLIESSQENEDEHFWQLAFTNQTLSTDSGDRVRKTLNLGTDSVP

SEQ ID NO: 17501 - protein, 81 aa, Pan troglodytes
CYQDSVTFDDLAVDFTPEEWTLLDPTQRNLYRDVMLENYKNLATVGYQLFKPSLISWLEQEESRTVQRGDFQASEGKVQLK

SEQ ID NO: 17502 - protein, 81 aa, Pan troglodytes
SQASVSFKDVTIEFTQEEWQQMAPVQKNLYRDVMLENYSNLVSVGYCRFKPEVIFKLEQGEEPWFSEEEFSNQSHPKDYRG

SEQ ID NO: 17503 - protein, 81 aa, Aotus trivirgatus
SQGLVSFKDVAVDFTQEEWQQLDPTQRTLYRDVMLENYSHLVSMGYPVSKPDVISKLEQGEEPWIVKRDISNWIYPDEYQA

SEQ ID NO: 17504 - protein, 81 aa, Papio anubis
PQGPLQFRDVAIEFSLEEWHCLDTAQRNLYRNVMLENYRNLVFLGIVVSKPDLITCLEQAEKPLTMKKHEMVANPSVLCSH

SEQ ID NO: 17505 - protein, 81 aa, Sapajus apella
TQGSLTFKDVAIEFSQEEWKCLDPLQKALYRDVMLENYRNLGFLGLCLPDLNIISMLEQGKEPWTVVSQVKITRNPNWGEC

SEQ ID NO: 17506 - protein, 81 aa, Vulpes vulpes
CQGSLSFRDVAVGFTRKEWQQLDPTQRMLYRDVMLENYSHLVSVGCQVTKPAVISRLEQGQEPWMEEEEILRWSFPEEILQ

SEQ ID NO: 17507 - protein, 81 aa, Vulpes vulpes
VFQGLSFKDVAVNFTEEEWRELDPAQRDLYRDVMLENYRNLISLGFPFSKPDIICQLEQAVNPWMQKAELLRSSCTHLETR

SEQ ID NO: 17508 - protein, 81 aa, Vulpes vulpes
TGGLRQRRDTHRTEQVLEWLFISQEQSKPTQSQGPLSFVDVFVDFTWEEWRLLDPAQKHLYRSVMLENYSHLVSLGRSSLQ

SEQ ID NO: 17509 - protein, 81 aa, Callorhinus ursinus
MDHELVTFRDVVINFSQEEWECLDSAQRDLYWDVMMENYSNLVSLDLESKYDTKTRKDITGSQWKVTESKFIGLESSVFRN

SEQ ID NO: 17510 - protein, 81 aa, Callorhinus ursinus
SQSPVTFEDVAVYFSKEEWGLLDASQRHLYHNVMLENFELMTSLGCWHGVEDEGAHSKQNTSVEGMSQVRIPSANPSTQKA

SEQ ID NO: 17511 - protein, 81 aa, Rhinolophus ferrumequinum
PAQVSVTFDDVAVTFTQEEWGHLDPAQKTLYQEVMLENCGLLVSLGCPVPRPELICQLEQELWTVKKDLSQSTCPDDKGKP

SEQ ID NO: 17512 - protein, 81 aa, Rhinolophus ferrumequinum
PKVPVTFDDISIYFSTPEWEKLEEWQKELYKNIMKGNYESLISMDYAMNQPDVLSQIQPEGEHNTEDQAGPEESEIPPDPS

SEQ ID NO: 17513 - protein, 81 aa, Rhinopithecus roxellana
GLLTFEDVAVFFTQEEWDYLDPAQRSLYKDVMMENYGNLVSLDVLNRDKDEEPTVKQEIEEIEEEVEPQSVIVTRIKSEID

SEQ ID NO: 17514 - protein, 81 aa, Rhinopithecus roxellana
FFSREPICPFEEKTKVEGMVEDYLANSYQDSVTFDDVAVDFTPEEWALLDTTQKYLYRDVMLENYMNLASVDKRLQWMETL

SEQ ID NO: 17515 - protein, 81 aa, Acinonyx jubatus
PVTFEDVAVLFTPEEWMFLDSAQRSLYRDVMLENYRNLASVEPSLPPQGSIPNQDIFAEISVGMERGRPQTGENLYEPSEL

SEQ ID NO: 17516 - protein, 81 aa, Rhinopithecus roxellana
CQESVTFEDVAVVFTDEEWSHLVPIQRDLYKEVMLENYNSIVSLGLPVPQPDVIFQLKRGDKPRVVDLHGSEERERPESVS

SEQ ID NO: 17517 - protein, 81 aa, Rhinopithecus roxellana
QAEVTFEDVAVFLSREEWGRLGPAQRGLYRDVMLETYGNLVSLGVGPAGPKPGVISQLERGDEPWVLDVQGTSEREHLRVN

SEQ ID NO: 17518 - protein, 81 aa, Rhinopithecus roxellana
FQRSVLFSDVSIDFSPEEWEYLDLEQKDLYRDVMLENYSNLVSLGCFISKPDVISLLEQGKEPWKVVRKGRRQYPDLETKY

SEQ ID NO: 17519 - protein, 81 aa, Rhinopithecus roxellana
AQVSVTFDDVAVTFTQEEWGQLDLAQRTLYQEVMLENCGLLVSLGCPVPRPELIYHLEHGQEPWTRKEDLFQDACPGDKGK

SEQ ID NO: 17520 - protein, 81 aa, Acinonyx jubatus
MLQVTFSDVAIDFSHEEWGWLDSAQRDLYKDVMVQNYENLVSLDWESRWENKELLMKEDIYDEDSPQMVIIEKITKQSHEF

SEQ ID NO: 17521 - protein, 81 aa, Rhinopithecus roxellana
PNRCLMYMLGEVYFSHEEWGWLDSAQRDLYKDVMVQNYENLVSVAGLSVTKPYVIMLLEDGKEPWMVEKKLSKGMIPDWEA

SEQ ID NO: 17522 - protein, 81 aa, Acinonyx jubatus
KLKSVTFEDVAVYFTQTEWNGLSPAQRALYRDVMLENYGNVASLGFSLLKPAVILQLEGAVDIESQTDNNLTKEIYKEKHN

SEQ ID NO: 17523 - protein, 81 aa, Bison bison
GLGFCTFTSTTVTGLIPPKCTSPVLLCLTLQVVVTFKDVAVTFTREEWGQLDLDQRTLFREVMLETCGLLVSLAWKQVADT

SEQ ID NO: 17524 - protein, 81 aa, Odocoileus virginianus
PQGSVTFEDVAVYFSWEEWCLLDEVQIHLYLDVMLENFALVCMLGSWRGVQDKETPSEEIKPAGVLQFCTPRAGLSPEKTH

SEQ ID NO: 17525 - protein, 81 aa, Odocoileus virginianus
SQDSVTFADVAVYFTQEEWTLLNPFQRKLYRNVMLENYKNLTTAGHQAFKPTLISWLEQEVLKTVEKGILQEWEMQLTSND

SEQ ID NO: 17526 - protein, 81 aa, Cebus imitator
PQVSLTFEDVAVLFTRDEWRKLAPSQRNLYRDVMLENYRNLVSLGLPFTKPKVISLLQQGEDPWKVEKDCSGSSFLGCKSN

SEQ ID NO: 17527 - protein, 80 aa, Cebus imitator
MGEPLEFRDVAIEFSLEEWHCLDTAQRNLYRDVMLENYRNLVFLGIAVSKPDLITWLEQGKKPLTVKGHEMIATPPGRCK

SEQ ID NO: 17528 - protein, 81 aa, Cebus imitator
GRLTFRDVAIEFSLAEWKCLTHAQRALYREVMLENYRNLESVDRFLKSMMKFSPAGQGSTREGIHTGTLGKYTSHHIGDFC

SEQ ID NO: 17529 - protein, 81 aa, Cebus imitator
CQESVTFEDVAVVFTDEEWSHLVPIQKDLYKEVMLENYKSVVSLGLPVPQPDMIFQLKRGDEPWMVDLHGSVETEWPKSVS

SEQ ID NO: 17530 - protein, 81 aa, Cebus imitator
QDSVAFEDVAVNFTHEEWALLGPSQKNLYRDVMQETIRNLNCIGMKWENQNTDDQYQNLRRNLRCDVVERFGKSKDGSQCG

SEQ ID NO: 17531 - protein, 81 aa, Macaca mulatta
PKVPVTFDDVAVYFSEQEWGKLEDWQKELYKHVMRGNYETLVSLDYAISKPEVLSQIEQGKEPCHWRRPGPKIPDVPVDPS

SEQ ID NO: 17532 - protein, 81 aa, Zalophus californianus
KDQESLTLEDVAVDFTWEEWQLLAPTQKDLYRDVMLENYSNLVSVGYVARKPDALSRLEQGELWTTEHEIPSRIRPEIKKD

SEQ ID NO: 17533 - protein, 81 aa, Sapajus apella
ACRSITFRDVAIDFSLQEWEYLNLVQKTLYQEVMMENYDHLVSLGHSISKPDLITLLEQGKEPWMIVREETRGECTDLDSR

SEQ ID NO: 17534 - protein, 81 aa, Saimiri boliviensis
SKDLVTFGDVAVNFSQEEWEWLNPAQRNLYRKVMLENYRTLVSLGVSVSKPDVISLLEQGKEPWMVKKEATRGVCPDWEYV

SEQ ID NO: 17535 - protein, 81 aa, Rhinolophus ferrumequinum
FKEPLTFKDVAVVFTEEELGLLDSTQRKLHQDVMLENFRNMVSVGHQPFTPDVVPPLEREEKLWMTKPASQSHGSLGDKNL

SEQ ID NO: 17536 - protein, 81 aa, Ursus maritimus
SPGFVSFADVAVYFSPEEWGCLRPAQRALYRDVMRETYGLLDALGFSGPKPAFISWVEGEVEAWSPESQDPEGESPAAVIR

SEQ ID NO: 17537 - protein, 81 aa, Acinonyx jubatus
SSQGLLTFRDVAVVFSLEEAGCLNQSQRELYRDVMLETYGHLLFLGLVTKPDLVLFLELKKEFWERKRKETVATHPAVSSN

SEQ ID NO: 17538 - protein, 81 aa, Bison bison
KGGLMAFEDVAVHFSQEEWGLLDTAQRALYRRVMLENFALLASLGLSVSRPRVVTQLERGNEPWVLSGADVTLAWDAQRRP

SEQ ID NO: 17539 - protein, 81 aa, Bison bison
AQELLTLEDVAVEFNWEEWQLLDSAQRDLYWDVMLENYNNLVSLGYQGTKPDMLSKLEHGREPCIIENEMRNRIFPGIRKG

SEQ ID NO: 17540 - protein, 81 aa, Odocoileus virginianus
LQGGVTFEDVAVAFTQEEWQRLSPEQRDLYRDVTLENFRNLVSVGGGEAAKPGVILRLENGEEPWTVETQVLRSCGPAEKD

SEQ ID NO: 17541 - protein, 81 aa, Odocoileus virginianus
MLETYSHLLSIGYQVPETEVFMLEQGNEPWPLQGEGPYQSCPEELWQIGDQIESYHQRENRSLRNVAFIKKVLTIQRDYAY

SEQ ID NO: 17542 - protein, 81 aa, Odocoileus virginianus
VSIAFQDLAVRFSEDEWRLLGEGQRALYLDVMRENYDTLASLGTAEPLPLSAFLSPSEPGGAVGAWSRAGDGQEPTQGGGP

SEQ ID NO: 17543 - protein, 81 aa, Odocoileus virginianus
EEGRVTFEDVAVYFSWEEWGLLDEAQRLLYHGVMLETFSLMASLGLTSFRTHDMTQLEQCGEPCVPSEGVSTTATPAGCCC

SEQ ID NO: 17544 - protein, 81 aa, Odocoileus virginianus
QLTFKDVAVEFSQEEWECLDPAQRAFYMDVMVETLRNLISVDISHIHVVKKLQPTASSDTGDAFQTVTLERQKSPEMKYFC

SEQ ID NO: 17545 - protein, 81 aa, Odocoileus virginianus
MLDNYRSLVSLGVSVSKPDVISLLEQGKEPWLMKEEGPRGARPDWEYAFKNKEFPSKQVIYEESSKIMMMGRSHLSYNLNC

SEQ ID NO: 17546 - protein, 81 aa, Odocoileus virginianus
LQGLMTFEDVAVDFTQEEWQYLNPPQRTLYRDVMLETYSNLVSVGHHVTKPDLILKLEVEERCLLEGKIPIWSFPEACQVD

SEQ ID NO: 17547 - protein, 81 aa, Odocoileus virginianus
MLENYGNLVSVAGCQLSKPSVISQLEKGEEPWMTEKEGAGDPSSDLKSKTETSASNAKYNILQEQLYHGMMMERFMRDDVI

SEQ ID NO: 17548 - protein, 81 aa, Odocoileus virginianus
VTFRDVAVFFSRDEWLCLDSAQRTLYQEVMLENYSTLFSLGWESLFETRVSEEENQEVMNQLLGDGHFDFKLGKIYINEET

SEQ ID NO: 17549 - protein, 81 aa, Odocoileus virginianus
PKVPVSFEDLAVYFTKAEWNLLDHRQKKLYKQVMLENYDNLESVGLSFSKPQLVIQLEQGEEPWVADVNRITTGMQAGDRM

SEQ ID NO: 17550 - protein, 81 aa, Odocoileus virginianus
SQETLTFRDVFVDFTQEEWQQLDAAQKNLHRDVMLENYSHLVSVGYLVAQPHGIFRLGQGEEEAGMAAGESLMWSCPELWK

SEQ ID NO: 17551 - protein, 81 aa, Odocoileus virginianus
MVTFKDVAVTFTREEWGQLDVDQRTLFREVMLETCGLLVSLGHPVPKPELIHLLEHGQKLWTGARGLPRSTGPGDRAKCQT

SEQ ID NO: 17552 - protein, 81 aa, Cebus imitator
SRSGAVSFADVVVYFSLEEWGCLWPAQRALYRDMMRETCGHLGVLGFSGPKSAFISVEEEVEAWSPEVQDPESESSGTVSR

SEQ ID NO: 17553 - protein, 81 aa, Cebus imitator
TQGSLTFKDVAIEFSQEEWKYLDPVQKALYRDVMLENYRNLGFLGLCLPDLNIISMLEQGKEPWTVVSQVKITRNPNWGEY

SEQ ID NO: 17554 - protein, 81 aa, Callithrix jacchus
LQGLVMFEDVAVYFSREEWGLLNVTQKGLYRDVMLENFALLSSLGLAPSRSPVFTQLVDDEQSCMTSWVDVTLVSRTEASR

SEQ ID NO: 17555 - protein, 81 aa, Macaca mulatta
EQGLVTFEDVAVDFTQEEWQDLNPPQRTLYRDVMLETYSNLVFVGQQVTKPNLILKLEVEEYPAEGKIPFWNFPEVCQVDE

SEQ ID NO: 17556 - protein, 81 aa, Macaca mulatta
RSQESLTFQDVAVDFTKEEWDQLYPAQKNLYRDVMLENYRNLVALGYQLYKPEVIAQLELEEEWVIERDSLLDTLPDGENR

SEQ ID NO: 17557 - protein, 81 aa, Ursus maritimus
AQASVSFKDVTVDFTREEWQHLDPAQKTLYMDVMLENYCHLISVGCHMTKPDVILKLERGEEPWTSFTGHTCLEKNWKEED

SEQ ID NO: 17558 - protein, 81 aa, Ursus maritimus
KSLGAVSFKDVTVDFSKEEWQQLDLAQKSLYRDVMLENYFNLISVGCQVPKPEVIFNLEQEEPRMLDGEISSQSCLDGDIG

SEQ ID NO: 17559 - protein, 81 aa, Camelus dromedarius
MDVRQGSVSFEDVTVEFTQDEWQYVDPAQRTLYRDVMLENYSHLISVGYCFPTPEVIVKLEQDEEPWSLEEESLNQRYPGE

SEQ ID NO: 17560 - protein, 81 aa, Rhinopithecus bieti
PQGLLTFRDVAIEFSLEEWQCLDIAQKNLYRNVMLENYRNLAFLGIAVSKPDLIICLEKEKEPWNMKRHEMVDEPPGICPH

SEQ ID NO: 17561 - protein, 81 aa, Acinonyx jubatus
AQESVMFSDVSIDFSQEEWECLNDDQKDLYRDVMLENYSHLVSMGHSVSKPDVISFLEQGKEPWLVDRELTRDQWPVLESR

SEQ ID NO: 17562 - protein, 81 aa, Rhinopithecus roxellana
MVHLMMFRDVAVDFCQEEWECLDLEQRDLYRDVMLENYSNMVSLGLCIYQPEVFSLLEKGKEPWKILKDETRGPCPDMQSR

SEQ ID NO: 17563 - protein, 81 aa, Acinonyx jubatus
FQASVVFEDVAVNFTPEEWALLNRGQRKLYRDVMLETCRNLSAVGKDGSIPSLVFSEKQKFHSSGDLTRMQEGLLRSPLVE

SEQ ID NO: 17564 - protein, 81 aa, Rhinopithecus roxellana
KKKPVTFEDVAVNFTQEEWDCLDASQRVLYEDVMSEIFKNLASVARIFLHKPELITKLEQEDEQRREFVHLPNTEGLSEGE

SEQ ID NO: 17565 - protein, 81 aa, Rhinopithecus roxellana
YNSVAFEDVAVNFTREEWALLGPSQKTLYRDVMWETIRNLDCIGMKWEDTDVEDQHKNPRRSLRCLIVERFSESSQIPGST

SEQ ID NO: 17566 - protein, 81 aa, Rhinopithecus roxellana
THGQLLFRDVAIEFSQEEWKCLNPGQKALYRDVMLENYRNLVSLGICLPDLSVISMLEQKRDPWTLQSDVKIANNPNGRKY

SEQ ID NO: 17567 - protein, 81 aa, Rhinopithecus roxellana
MFQEAVTFNDVAVAFTEEELGLLGPAQRKLYRDVMVENFRNLLSVGHQPFKQDVSPIERNEQLWMTTATQRQRNLGEKNQS

SEQ ID NO: 17568 - protein, 81 aa, Acinonyx jubatus
DEALMAFRDVAVAFTQKEWRLLSPAQRTLYRDVMLENYSHLVSLGPGTEFQPCVHSCPVAFSSPQFLQQYVLCGHLPQIFP

SEQ ID NO: 17569 - protein, 81 aa, Odocoileus virginianus
AQELLTLEDVAVEFNWEEWQLLDSAQKDLYWDVMLENYNNLVSLGYQGTKPDMLSKLEHGKEPCIIENEMQNRICPGIGKG

SEQ ID NO: 17570 - protein, 81 aa, Odocoileus virginianus
VSVTFEDVAVYFSWEEWGLLDDAQRCLYHSVMLENLSLVISLGCWHGAEDEEAPSEQNISIRGLSQVRIPKEGMFSQKAHF

SEQ ID NO: 17571 - protein, 81 aa, Odocoileus virginianus
AQGFVVFEDVAVYFSQEEWGLLDEAQRLLYCQVMLQNIALLSSIGCRHGTQDEVALSEQHDVAARSQVKTPKPGPCIQKPH

SEQ ID NO: 17572 - protein, 81 aa, Odocoileus virginianus
SQGRLTFRDVAIDFTQEEWECLDLGQRELYTDVMVENYRNLASLGLVVSKPDLVTFLEQRKDLRNIGRMQTTGIFPGCRIL

SEQ ID NO: 17573 - protein, 81 aa, Odocoileus virginianus
SVTFEDVAVYFSWEEWRLLDEAQRSVYLDVMLENYALISSLGCCCGTENAEAPSELITSLGVSQARTPKAALSSQKMHPCE

SEQ ID NO: 17574 - protein, 81 aa, Odocoileus virginianus
MFKDVAIDVSQEEWECLNPAQRNLYKDVMLENYSNLVSLGLSVSKPAVITSLEQGKEPWMVLREVTGERCPDLVSKCEPKK

SEQ ID NO: 17575 - protein, 81 aa, Cebus imitator
ACRSITFRDVAIDFSLQEWEYLNLVQKTLYQEVMMENYDHLVSLAGHSISKPDLITLLEQGKEPWMIVREETRGECTDLDS

SEQ ID NO: 17576 - protein, 81 aa, Cebus imitator
IQGQVNFEDVFVYFSQEEWVLLDEAQRLLYRDVMLENFALMASLGHTSFTSHIVASLVWVPDWMDVTPVVATGTLSGSGPG

SEQ ID NO: 17577 - protein, 81 aa, Cebus imitator
RKVSITFKDLAVRFSEEEWRLLEEGQREFYRDVMRENYETLVSVGTAELLPLSAFLSPPEPGGAVGGGSHTDEGQEPAGCG

SEQ ID NO: 17578 - protein, 81 aa, Cebus imitator
MELLTFRDVAIEFSPEEWTYLDPAQQNLYRDVMLENYRNLVSLGVAICNPDLVTCLEQRKEPCNVKIRKTVANPPAVCSHF

SEQ ID NO: 17579 - protein, 81 aa, Cebus imitator
ARGCVVFEDVFVYFSREEWELLDDAQRLLYHDVMLENFALLASLGIAFSRSDAVMKLEQGEEPWVYDQVDMTSATGRESQR

SEQ ID NO: 17580 - protein, 81 aa, Cebus imitator
AQESVTFEDVAVNFTDREWQCLTYAQRHLYKDVMLENYGNMVSVGFPFPKPPLISHLERGVELCVQDPQDRESLSCSCLVS

SEQ ID NO: 17581 - protein, 81 aa, Callithrix jacchus
VIGWLSFKDISMEFTWDEWQLLDSTQKYLYREVILENYHNLISVGYHGAKPDLIFKLEQGEDPWIVNAKISRESCPDGWEE

SEQ ID NO: 17582 - protein, 81 aa, Macaca mulatta
EAVTFKDVAVFFTEEELGLLDPAQRKLYQDVMLENFTNLLSVGHQPFHTFHFLREEKFWMMETATQREGSSGGRTVVEAGP

SEQ ID NO: 17583 - protein, 81 aa, Macaca mulatta
MSLLEKSGAGGVSARTRGCPPTTEPHAGFLVFKPELISRLEQGEEPWVLDLQGAEGTEAPRTSKTDSTIRTENEQSCEDMD

SEQ ID NO: 17584 - protein, 81 aa, Aotus trivirgatus
VQESVTFKDVAVLFTQEEWGQLSPAQRALYRDVMLENYSNLVSLGLLGPKPDIFSQLEKKEEWMPEDPSGGFCLDWMTMPV

SEQ ID NO: 17585 - protein, 81 aa, Pan troglodytes
MFKEAVTFKDVAVAFTEEELGLLGPAQRKLYRDVMVENFRNLLSVGHQPFKQDVSPIERNEQLWVMTTATRRQGNLGEKNQ

SEQ ID NO: 17586 - protein, 81 aa, Callorhinus ursinus
GWVPALFDEVAIYFSDEEWEVLTEQQKALYREVMRMNYETVLSLEFPFPKPDMITRLEGDEEFQNSDEWQLQGGTFAENEE

SEQ ID NO: 17587 - protein, 81 aa, Acinonyx jubatus
GLGSVSFKDVTVDFTRDEWLQLTGTQRTLYRDVMLENYSHLVSVGCHLTKPEVIFKLEQGEELWPSRGESPDQGDQDSLQS

SEQ ID NO: 17588 - protein, 81 aa, Acinonyx jubatus
THGSMPFSSVTVAFTQEGWRHLIPAPKDRFKEGIPENTRNLVLLGLPVSQPGMNSQLEQREEGPWMLEGGGLRSTCTDWKI

SEQ ID NO: 17589 - protein, 81 aa, Rhinopithecus roxellana
MGPLTFMDVAIEFSVEEWQCLDTAQQNLYRNVMLENYRNLVFLGIAVSKPDLITCLEQGKEPWNVERHEMVAKPTGMCCYF

SEQ ID NO: 17590 - protein, 81 aa, Acinonyx jubatus
FQHLVMFRDVAVDFSQEEWECLNSYQRNLYRDVILENYSNLVSVGCTISKPDVITLLEQGKEPWMVVRDERRRRSLDLEAR

SEQ ID NO: 17591 - protein, 81 aa, Rhinopithecus roxellana
FQKPVTFEDVAVNFTQEEWDCLDASQRVLYEDVMSEIFKNLASVARIFLHKPELITKLEQEDEQRRETQVLQASQGGPPFF

SEQ ID NO: 17592 - protein, 81 aa, Rhinopithecus roxellana
HGSVTFRDVAIDFSQEEWEFLDPAQRDLYRDVMWENYNNFISLAGPSISKPDVITLLDEEGKEPGMVVREGTRRYCPDLES

SEQ ID NO: 17593 - protein, 81 aa, Rhinopithecus roxellana
AATLRLSAQGTVTFEDVAVKFTWEEWNLLSEAQRCLYRDVMLENLALISSLDSVLDGSADNTQTGNLGQSVLPSHPEQKTA

SEQ ID NO: 17594 - protein, 81 aa, Rhinopithecus roxellana
AQGIVTFEDVAVYFSWKEWGLLDEAQKCLYHDVMLENLTLTTSLGGCGAGDEEAPYQQSTSSQWVSQVRLPKALPSPQKTN

SEQ ID NO: 17595 - protein, 81 aa, Rhinopithecus roxellana
GSLTFQDVAIEFSLEEWQCLDTAQQNLYRNVMLENYRNLVFLGIAVPKPDLIIFLEQGKEPWNMKKHEMAEEPPVVCSHFA

SEQ ID NO: 17596 - protein, 81 aa, Acinonyx jubatus
GFRTASCWDISMEFTWDEWQLLDSAQKYLYRDVILENYSHLVSVGYHGTKPDLIFKLEQGEEPWIINAKVSRQSCPEDWKE

SEQ ID NO: 17597 - protein, 81 aa, Rhinopithecus roxellana
MVSFEDVAVPLSQEEWNCLIPAQRGLYRDVMLETYGNLVSLGLQASKPDVISRLEQGDEPWTPHILRTQGSWSWRHKREGY

SEQ ID NO: 17598 - protein, 81 aa, Rhinopithecus roxellana
EMGLLTFRDIAIEFSLAEWQCLDHAQQNLYRDVMLENYRNLVSLGIAVSKPDLITCLEQNKEPRNIKRNEMVSKHPVTCSH

SEQ ID NO: 17599 - protein, 81 aa, Rhinopithecus roxellana
THGQLLFRDVAIEFSQEEWKCLNPGQKALYRDVMLENYRNLVSLDFSLLARDPHVFRVEAWRTPNFGGNESPLPSPRALLA

SEQ ID NO: 17600 - protein, 81 aa, Bison bison
AAGSVTFNDVTMAFTRKEWEQLDPAQKSLYKDVMLENYSNLASMGYQALKPDMISKLEKGEEPWLGKGKGSRQGGSSEIAR

SEQ ID NO: 17601 - protein, 81 aa, Bison bison
MVENFRNLVSVGQVPFKADMVSQLETEEKLWTMERETQRNGHSSEIHSAVTSGSKIPNEMETLGKVMFQYLSCEELSCWQI

SEQ ID NO: 17602 - protein, 81 aa, Bison bison
GMVTFRDVAIDFSQEEWEFLDPAQRDLYVDVMLENYSNLVSLDLESTYETKNTFSKKDIFEINFSQWKIKERSKTIELEAS

SEQ ID NO: 17603 - protein, 81 aa, Odocoileus virginianus
HQGSVTFEDVAMYFSWEEWCLLDEAQIQLYLDVMLENFALVCMLGSWHGVQDEETPSEQSKSARVSQFRTPRACLSPEKAQ

SEQ ID NO: 17604 - protein, 81 aa, Odocoileus virginianus
SQGRLTFQDVAIDFTQEEWECLDLGQRELYRDVMLESYGNLASLGLMVSKPDLVTFLEQMKNSWDVRRTHTTATYPALSSH

SEQ ID NO: 17605 - protein, 81 aa, Odocoileus virginianus
PQKSVTFEDVAVYFTQTEWDSLSTAQRALYRDVMLENYGNVASLGFPLLKPAVISQLEGGDIDIQTDNNLTEEMNEEKYNT

SEQ ID NO: 17606 - protein, 81 aa, Odocoileus virginianus
VTFEDVAVNFSWEEWGLLDESQKRLYHDVMLENLALISSLGLILTSLNSIPQCFFTLLLLQCCPTSAYTFCVIRLLAWRRG

SEQ ID NO: 17607 - protein, 81 aa, Odocoileus virginianus
GSVSFTDVTVDFTQEEWEQLDPSQRILYMDVMLENYSNLLSVEVWKADDQMETDHRSPDEQARPFIIFKDQTTIEERDNNL

SEQ ID NO: 17608 - protein, 81 aa, Odocoileus virginianus
AHGSLTFSDVAIGFSQQEWECLDPVQKTLYRDVMMENYGNLVSLGHSISKPNVITLLEQGKEPWLVVREETRSWCADLDSR

SEQ ID NO: 17609 - protein, 81 aa, Odocoileus virginianus
SQEPLTFKDIIVDFTQEEWGHLAPAHWHLYLEVMLENYGNLVSVGYQLSKRGVISQLEKGEELWLMETEVSGGPSPGKSKA

SEQ ID NO: 17610 - protein, 81 aa, Cebus imitator
EEALMGFWDVAVAFTQKEWKLLSSAQRTLYREVMLGNFYSEVVLGIAFSKPKLITQLERGDEPWREESKHLLDLCPALGRQ

SEQ ID NO: 17611 - protein, 81 aa, Pan troglodytes
KEAFVAFRDVAVDFTQEEWRLLSPAQRTLHREVMLETYNHLVSLEIPSSKPKLIAQLEQGEEPWREERKCPLDLCPESKPE

SEQ ID NO: 17612 - protein, 81 aa, Carlito syrichta
SQGLVTIKDVSLCFSQEEWRSLDPSQTDFYGEYVMQENCGIVVSLRFPIPKLDMLSQLEGGEEQWVPDPHDLEERDILRVT

SEQ ID NO: 17613 - protein, 81 aa, Delphinapterus leucas
DEALMAFKDVAVAFTQKEWKLLSPAQRTLYRDVMLENYSHMVSLGIAFPKPKLIIQLEQGDEPWREESDSLLDLCPAEPRT

SEQ ID NO: 17614 - protein, 81 aa, Zalophus californianus
FKETVTFKDVAVVFTEEELGLLDPAQRKLYGDVMLENFRNLLSVGHQPFTPDVILQFERGEKLRMIKTAAQGPWASGDKNL

SEQ ID NO: 17615 - protein, 81 aa, Delphinapterus leucas
FQEAVTFKDVAVTFTEEELGLLDSTQRKLYREVMLENFRNLLSVGHQSSKPDMISQLEREEKLWMTEVQTQRGGHSGARNH

SEQ ID NO: 17616 - protein, 81 aa, Sapajus apella
QGPLTFRDVTIEFSPEEWRCLDPAQRTLYRDVMLENYRNLVSLDISPKYKMKELLSTAQGDTEVFHAGILDRHESHHIGDF

SEQ ID NO: 17617 - protein, 81 aa, Balaenoptera acutorostrata
MDSVGFEDVAVNFTAEEWALLDPAQRKLYRDVMLETFRNLASVGSCSQVKTSRSSAHWDILETGLCSEEKVVRFTRNDSRS

SEQ ID NO: 17618 - protein, 81 aa, Balaenoptera acutorostrata
WKGLLAFEDVAVYFTREEWDALHWPQKALYRDVMLDNYRNVLSLGFQFPKPEVICQLEQWEEPWILDLPRAGTRKASGSAC

SEQ ID NO: 17619 - protein, 81 aa, Vulpes vulpes
AYGSLSFRDVAISFSQEEWECLDPAQRTLYRDVMLETYSNLVSLDLQSNYGAEKLSPENDICEINLPKQSIKKISKTLCLK

SEQ ID NO: 17620 - protein, 81 aa, Rhinolophus ferrumequinum
AALPLTFEDIAIYFSAQEWRTLEAWQKELYKHVMRTNYEILVSLDGGFPKPEVISQIEQGRELFRNLGERQKSENIICSSA

SEQ ID NO: 17621 - protein, 81 aa, Ursus maritimus
AQGLVTFGDVAIEFSQEEWKCLEPAQRDLYRDVTLENFSNLVSLGLSISKPDVISLLEQGREPWMITNDMTGPWCPELESR

SEQ ID NO: 17622 - protein, 81 aa, Phyllostomus discolor
LVKIEDVADVAVSFILEEWGHLDQSQKSLYRDGRKENYESITSMDYESRSNNMELIVKQISDEAKSHWMTSGCTERNVPQS

SEQ ID NO: 17623 - protein, 81 aa, Phyllostomus discolor
VMFRDVVIDFSQEEWECLDFAQRHLYRDVMLENYSNLVSLDLPSRCANKYLPPRKDTYETELSQWEMSNRLENYDLKESSS

SEQ ID NO: 17624 - protein, 81 aa, Acinonyx jubatus
FQEPVMFKDVAVVFSEEELGLLDPTQRKLYRDVMLENFRNLVSVGNQPFKPELISQLEREEKLLMMETETQRDGCLGAKSQ

SEQ ID NO: 17625 - protein, 81 aa, Odocoileus virginianus
MLENYFNLISVGCQVPKPEVIFNLEWGEEPFMWNDKTSSQSCLDQDIGFGTSQQGISEDVSVWFEGIRLFPRDDLYSILEE

SEQ ID NO: 17626 - protein, 81 aa, Odocoileus virginianus
QAEVTFEDVAVLLSQEEWGLLGPSQKGLYREVMLETYRNLLSLAHGTRTENQEVTSGEMLFGRELDALRGSVLQGPEPGEA

SEQ ID NO: 17627 - protein, 80 aa, Odocoileus virginianus
MAAAAALRDPPQDSVTFEDVAVNFSWEEWGLLDESQKRLYHDVMLENLALISSLDPRPASPCLAGMDPESGVSPPCLPSP

SEQ ID NO: 17628 - protein, 81 aa, Odocoileus virginianus
GQGHVTFEDVAVSFSQEEWGLLGEAQRLLYYDVMLENLSLIASLGCWRGGDTKEASSEQCVSAEQVTRDRNPQVDPCILKA

SEQ ID NO: 17629 - protein, 81 aa, Odocoileus virginianus
FQESVTFEDVAVHLTREEWGCLDPVQRALYREVMLENYGNLVSLGILLRLPTTRIHSVNSCPALSHTQASAFSGEALAILS

SEQ ID NO: 17630 - protein, 81 aa, Odocoileus virginianus
FQGRLTFQDVALDFTQEEWECLDLGQWELYRDVMLENYRNLASLGLVASKPDLLTFLEQMKNPWDVRRLEMPAIYTGRCEW

SEQ ID NO: 17631 - protein, 81 aa, Odocoileus virginianus
TQGLMAFEDVAVHFSQEEWGLLDTAQRSLYRRVMLENFALLASLGLSVSRPHVVTQLECGEEPWVLSGVDVTLPQDAQRRP

SEQ ID NO: 17632 - protein, 81 aa, Cebus imitator
AQVSVTFDDVAVTFTQEEWGQLDLAQRTLYQEVMLENCGLLVSLGCPVPRPELIYHLEHGQEPWTRKEDLSQGTHPGDKGK

SEQ ID NO: 17633 - protein, 81 aa, Cebus imitator
MFSDISIDFSPEEWEYLDLEQKDLYRDVMLENYSNLVSLGCFISKPDVISLLEQGKEPWKVVRKRRGQCPDLQTKYEAKKL

SEQ ID NO: 17634 - protein, 81 aa, Cebus imitator
SQESVSFKDVTIEFTQEEWQQMAPVERNLYRDVMLENYSHLVSVGYCLFKPEVIFKLERGAEPWLSEEEFSNKSHPKDYRG

SEQ ID NO: 17635 - protein, 81 aa, Macaca mulatta
RPESVTFEDVAVYFSENEWIGLGPAQRALYRDVMLENYGAVASLAAFPFPKPALISQLERGEAPWCSVPWGALDGEDPRSI

SEQ ID NO: 17636 - protein, 81 aa, Callithrix jacchus
EPGPVTFGDVAVYFSREEWGCLRPAQRALYRDVMRETYSHLGALGVEGSKPALISWVEEEAELWGPAAQDPEVAKRPTEAD

SEQ ID NO: 17637 - protein, 81 aa, Sapajus apella
MLENYRNLVSLGLAVSKPDLITFLEQRKEPWNAKSAETVAIQPDMFSHYNKDLLTEHCTEASFQKVIPRTHESCDLENLHI

SEQ ID NO: 17638 - protein, 81 aa, Balaenoptera acutorostrata
SKAPVTFGDLAIYFSQEEWEGLSPRQKDLYEDVMLENYQNLVSLGLSFRRPNVITLLEKGKAPWMVEPVKRRGGLDLGSKC

SEQ ID NO: 17639 - protein, 81 aa, Vombatus ursinus
MLENYGNLVCLGLAASKPDVICQLERGEAPGMTGGDVVPRSDRPNWKTRPEAKESIPKLDISMETSSQKKFTRWRGSLVYN

SEQ ID NO: 17640 - protein, 81 aa, Balaenoptera acutorostrata
SHTLVTFKDILVNFTREEWKLLDPAQQLMYKDVMLENYRNLMSLGHQLPKPEVILQLEKGEEPWLVERGIHQETHPGEDQT

SEQ ID NO: 17641 - protein, 81 aa, Balaenoptera acutorostrata
FQEAVTFKDVAVTFTEEELGLLDSAQRKLYREVMLENFRNLLSVGHQSSKPDMISQLEREEKLWMMEVQTQRGGHSGARNH

SEQ ID NO: 17642 - protein, 81 aa, Rhinolophus ferrumequinum
PQESVTFKDVAVDFTQDEWRHVDPAQRRLYRDVMLENYSNLVSLGYQVSKPEVIFKLEQGQEPWLSEGEIRRPFCPDWKTR

SEQ ID NO: 17643 - protein, 81 aa, Rhinopithecus bieti
QGLLTFRDVAIEFSQEEWKCLDPAQRTLYRDVMLENYRNLVSLDISSRCVMKTLSSTGQRNTEVIHKGTLQRQASHHIGEC

SEQ ID NO: 17644 - protein, 81 aa, Colobus angolensis
MLMMFRDVAVDFCQEEWECLDLEQRDLYRDVMLENYSNMVSLGLCIYQPEVFSLLEKGKEPWKILRDETRGPCPDMQSRCH

SEQ ID NO: 17645 - protein, 81 aa, Rhinopithecus bieti
SQGSVSFRDVTVGFTQEEWQHLDPAQRTLYRDVMLENYSHLVSVGYCIPKPEVILKLEKGEEPWILKEKFPSQSHLEIINT

SEQ ID NO: 17646 - protein, 81 aa, Camelus dromedarius
GKPKSKAPVTFGDLAIYFSQEEWEWLSPIQKDLYEDVMLENYQNLVSLGLSFRRPNVIALLEKGKAPWMVEPVKRRWGSGE

SEQ ID NO: 17647 - protein, 81 aa, Phyllostomus discolor
PQRPAPFGDVTVALTHKERGRPVPAPGPGSQEETPEQSRNSVLLGLPASQPGMNSQLEQRESPWMLRGEGPRSSCPDWKTV

SEQ ID NO: 17648 - protein, 81 aa, Acinonyx jubatus
QSCVTFEDVAVYFSQEEWGLLDEAQRFLYHDVMLETFALATSLDCWCGAENEEVPSEQSVSVERVSQVRTSKTGLSIQKTH

SEQ ID NO: 17649 - protein, 81 aa, Acinonyx jubatus
MDSVAFEDVTVKFTMEEWALLDPSQKKLYRDVMQETFRNLASIVCISEEKWEVYDSEDQDENHGTHLIQMVGRLCKCKECS

SEQ ID NO: 17650 - protein, 81 aa, Rhinopithecus roxellana
EKETLTFRDVAIEFSLEEWECLNPAQQNLYMNVMLENYKNLVFLGIAVSKQDPVTCLEQEKEPWNTKRHEMVDEPPGYMCR

SEQ ID NO: 17651 - protein, 81 aa, Rhinopithecus roxellana
EMGLLTFRDIAIEFSLVEWQCLDHAQQNLYRDVMLDNYRNLVFLGIADSKPDLITCLEQNKESWNIKRNEMVAKQPVMCSH

SEQ ID NO: 17652 - protein, 81 aa, Acinonyx jubatus
NPQELLTFNDVAIEFSQEEWGFLNHSQRELYRDVMLENYGHLLLLGLVSKPDLVNFLEQKKEAWDVNGKGTVATHPDFIFK

SEQ ID NO: 17653 - protein, 81 aa, Acinonyx jubatus
SHGPLSFEDVAVAFTKEEWQQLDPAQRTLYRDVMLENFSHVISLGHPVSKPDVISKLEQGEEPWIIKRDVSDWIYPERETR

SEQ ID NO: 17654 - protein, 81 aa, Acinonyx jubatus
AEGGVTFEDVAVYFSQEEWKLLDEAQKRLYHDVMLETFALISSLGCCCGAEDAEAPLEQSVSVGVSQASVPKAALSSRKTH

SEQ ID NO: 17655 - protein, 81 aa, Odocoileus virginianus
MMLENYQSLVSLGLCISKPYVISLLEQGKEPWTMMENEMRSPFPDWESIHETQELPLKQFVCDDMLMERIASYELECPTFG

SEQ ID NO: 17656 - protein, 81 aa, Odocoileus virginianus
SLGPVTFEDVAVYFSQEEWRILDETQRRLYCYVMLETFALVASLGLASSRSHVIVPLELGGEPWVQDRVDMTPGTARGAQS

SEQ ID NO: 17657 - protein, 81 aa, Odocoileus virginianus
PKVPVTFDDISIYFSTPEWEKLEEWQKELYKNIMKGNYESLISMDYAMNQPDVLSQIQPEGDRNAEDQAGPEESGIPTDPS

SEQ ID NO: 17658 - protein, 81 aa, Odocoileus virginianus
QGLFTFKDVAVEFTQEEWECLDPTQRALYRDVMLETYRNLLSLGSYSATFAIKELSSPKEDINKGELCHLMTLEKNETYGI

SEQ ID NO: 17659 - protein, 81 aa, Cebus imitator
MDSVAFEDVAVNFTQEEWALLSPSQKQLYRDVMLETFGNLASVSLVERLCGRKEGSDHRETFSQIPDCHLNKKSRTGVKPC

SEQ ID NO: 17660 - protein, 81 aa, Cebus imitator
QEGVNFKIVTVDFTQEEQGTWNPAQRSLGGDIILESHRDLVSWDLATAVGKEDSTSKQNIFDEEPANGVKTECFTRNDPWL

SEQ ID NO: 17661 - protein, 81 aa, Cebus imitator
AFPQGRLTFRDVAIEFSLAEWKCLTPAQRALYREVMLENYRNLESVGEENVPPDMRNLPLSILAFSAFVFSAVILLYTGSF

SEQ ID NO: 17662 - protein, 81 aa, Cebus imitator
MPHLLVTFRDVAIDFSQEEWECLDPAQRDLYRDVMLENYSNLISLDLESSREINKLSSEKEIYEMESLRWENMGKFINHHV

SEQ ID NO: 17663 - protein, 81 aa, Cebus imitator
AQESLTLEDVAVDFTWEEWQLLGPAQKDLYRDVMLENYSNLVAVGYQASKPDALFKLEQGQPPWTIKDGIHGRACSEIWKF

SEQ ID NO: 17664 - protein, 81 aa, Callithrix jacchus
VQESVTFKDVAVLFTQEEWGQLSPAQRALYRDVMLENYSNLVSLGLLGPKSDIFSQLEKREEWMPEDPSGGFCLDWMTMPV

SEQ ID NO: 17665 - protein, 81 aa, Callithrix jacchus
LQGSVSFKDVTVDFTQEEWQQLDPAQKALYRDVMLENYCHFISVGFHMAKPDMIRKLEQGEELWTQRIFPSYSYLEADGKT

SEQ ID NO: 17666 - protein, 81 aa, Saimiri boliviensis
DSVTFDDVAVDFTQEEWTLLDPTQRSLYSDVMLENYKNLATVGWELQLETQWSTLQQNCLRGQTSIGVQLEGNHNGRKLCD

SEQ ID NO: 17667 - protein, 81 aa, Equus caballus
AHGSVTFRDVAIDFSQEEWECLDSAQRDLYRDVMWENYSNFVSLAGPSISKPDTVTLLDEGKEPWMVVREGTRRHCPDLES

SEQ ID NO: 17668 - protein, 81 aa, Callorhinus ursinus
SVTFRDVTVDFTQEEWQQLEPAQKDLYRDVMLENYRNLVSLDLETRPETKESGPKEDSAEDRPSVGVVVEGPPRNGARGLA

SEQ ID NO: 17669 - protein, 81 aa, Callorhinus ursinus
MFQVTFSDVAIDFSHEEWGWLDSAQRDLYKDVMVQNYENLVSLAGLSIPKPYVISLLEDGKEPWMVEEKLSKDWESRWENK

SEQ ID NO: 17670 - protein, 81 aa, Callorhinus ursinus
QDSVTFEDIAVYFSWEEWRLLDEAQRCLYHDVMLENFTLISSLGCCCGAEDEAPFAQSTSVGVSQTRTPKAALSSRKTHPC

SEQ ID NO: 17671 - protein, 81 aa, Vulpes vulpes
MAFRDVAVNFSQEEWMLLSPAQRSLYREVMLENYSNLVSLGIPFSKPKLITQLEQGKESWREEGKCPPALCPAEPKPELHL

SEQ ID NO: 17672 - protein, 81 aa, Vulpes vulpes
MDFTLEDWEHLGLDQGDLFWDTALDNYQNLFLLNPSKPKLTSCPDGGEKLEVLVGASPESECPGTAGAKTCPLAEDYLEGL

SEQ ID NO: 17673 - protein, 81 aa, Callorhinus ursinus
SQHLVTFEDVAVNFTQEEWTLLDQTQRDLYRDVMLENYQNLIILAGCESCKPDLNSSVGGAEELRTGGRGILQELDLQLKT

SEQ ID NO: 17674 - protein, 81 aa, Acinonyx jubatus
TQVSVTFDDVAVTFTQEEWGQLDPAQKTLYQEVMLENCGLLVSLGCPVPRPELICQLERGQEPWTAKRGLSQNTYPGDNGK

SEQ ID NO: 17675 - protein, 81 aa, Rhinopithecus roxellana
AQESVTFEDVAVNFTNREWQSLTYAQRHLYKHVMLENYRNMVSLGFPFPKPPLISHLERGVEPCVQDPQDKESLSCSYPVS

SEQ ID NO: 17676 - protein, 81 aa, Bison bison
VMFSDVSIDFSQEEWEFLNDDQRDLYRDVMLENYSNLVSMVLESRCETKKLFLKKEIYEIESAQWELMDRLTRHDLQCSSF

SEQ ID NO: 17677 - protein, 81 aa, Bison bison
MLENYSNLVSVGYRVSKSDVLFKLEQGEERWMTEDEIHSHTWPETGNIGNHLQVDWENKKMLKGIEQYQERNTFGNPVLQS

SEQ ID NO: 17678 - protein, 81 aa, Bison bison
MESVTLEDVAMELIQEWTLLDDAGRNLCRHVLQDNCRTPAPRAAGTPPCKASLVSQVEPREELKAAEHGVLCATGVDWESQ

SEQ ID NO: 17679 - protein, 81 aa, Bison bison
SQGSVTFRDVSIDFSQEEWEWLQPAQRDLYRHVMLENYGHLVSLAGLNMSKPDVVSLLEQGKEPWLGNGDVSRELFPASKS

SEQ ID NO: 17680 - protein, 81 aa, Bison bison
RESGKAPVTFDNITVYLLQEEWVLLSQQQQDICGSDKLVAPLESTIASPELFYKFEQGPEPWLASVQGQRSHLSPNPGKTK

SEQ ID NO: 17681 - protein, 81 aa, Bison bison
YRGSVTFRDVAIDFSQEEWEFLDSAQRDLYRDVMWENYSNFISLAGPSMSKPDVITLLDEGKEPWMVVREGTGKHHPDLES

SEQ ID NO: 17682 - protein, 81 aa, Odocoileus virginianus
GVTFPDVAVYFSWEEWRLLDEAQRRLYLDVMLENYALISSLGCCCGTENAEAPSEQITSLEMSQARTTKAALSSQKMHPCE

SEQ ID NO: 17683 - protein, 81 aa, Odocoileus virginianus
MLETYSNLVSLGLAVSKPDVISFLEQGKEPWTVEEVAAGGLCPVLKSRYDATVFSPKQHSYEVQPPPWKIMKSLTNYGLEC

SEQ ID NO: 17684 - protein, 81 aa, Odocoileus virginianus
KPVTFEDVAVTFTQEEWKCLDASQRVLYQDVISETVRNLMSVGGKKEGCQEQSQSLGDEGTVDDKKASLDHRGSGPTSPPT

SEQ ID NO: 17685 - protein, 81 aa, Odocoileus virginianus
HQESLTFKDVAVNFTQEEWHHVDAAQRRLYKDVMLENYSHLVSLGYQVSKPEVIFKLEQGEEPWIAEGEIQRPVCPDWKTR

SEQ ID NO: 17686 - protein, 81 aa, Cebus imitator
MIQSQISFEDVAVDFTLEEWQLLNPTQKNLYRDVMLENYSNLVFLGYQIIKPDAISKWEQQDPWIMDQEILSQNFSEVWLD

SEQ ID NO: 17687 - protein, 81 aa, Cebus imitator
MLVTFKDVAVTFTQEEWRQLDLAQRTLYQEVMLETCGLLVSLGDKAQVQTREPTTYLPVLSERAFLQGSLTLECSSDSRLG

SEQ ID NO: 17688 - protein, 81 aa, Cebus imitator
EMGLLTFRDVAIEFSLEEWQCLNHAQQNLYRDVMFENYRNLVSLGIVVSKPELITCLEENKVPCNIKRNEMVAKHPVTYSY

SEQ ID NO: 17689 - protein, 81 aa, Cebus imitator
MLENYRHLVFLGIAVSKPDLIACLEQEKKPWNIKRNEMVAKPPVICSHFSQNLWEEEGIEDSFQKVVLRRYEKCGHDNLQL

SEQ ID NO: 17690 - protein, 81 aa, Cebus imitator
YQDSVTFDDVAVDFTQEEWTLLDPSQRDLYRDVMLENYENLASVGRHLFKPSVICWLEEEGQLRAGQRGVLQEWQLESKGS

SEQ ID NO: 17691 - protein, 81 aa, Cebus imitator
MSQVTFSDVALDFSHEEWGWLDSAQRDLYKDVMVQNYENLVSLGLSITKPHVITLLEDGKEPWMVEEKLSKGVTPDWESRW

SEQ ID NO: 17692 - protein, 81 aa, Cebus imitator
GTVTFEDVAVKFTWEEWNLLSEAQRCLYRDVMLENLALTSSLGCWCGVEDEEAPSKQSIYVQRETQVRTPTAGVSSKKAHP

SEQ ID NO: 17693 - protein, 81 aa, Macaca mulatta
QGSVPFRDVAIEFSQEEWECLPPDQRTLYRDVMLENYSHLISLAGSSISKPDVITLLEQEKEPWMVVRKETSRWYPDLESK

SEQ ID NO: 17694 - protein, 81 aa, Delphinapterus leucas
LLTFRDVAIEFSQEEWECLDPAQRALYRDVMLETYGNLLSLGEDNAPPEVGICPNISISFLTKELLKKKNINNRELYQPVV

SEQ ID NO: 17695 - protein, 81 aa, Pan troglodytes
SQESVSFKDVTVGFTQEEWQHLDPSQRALYRDVMLENYSNLVSVGYCVHKPEVIFRLQQGEEPWKLEEEFPSQSFPEVWTA

SEQ ID NO: 17696 - protein, 81 aa, Zalophus californianus
VMAHMAFRDVAVDFSQEEWMLLSPAQRSLYREVMLENYSNLVSLGIPFSKPKLISQLEQGKETWREERTCPPAARPVEPKP

SEQ ID NO: 17697 - protein, 81 aa, Sapajus apella
MLSHGSCLCIYQPDVFSLLEKGKEPWKILRDETRGPCPDMQSRCPIKKLLPKNGIFEREIAQLEIRKICKNHSLECLCFRG

SEQ ID NO: 17698 - protein, 81 aa, Delphinapterus leucas
PQEPVTFEDVAVYFTQNQWASLEPVQKALYREVMLENYANVASLEALPFPTPVLISQLERGEAPWGPDPWEAEILRGICPG

SEQ ID NO: 17699 - protein, 81 aa, Balaenoptera acutorostrata
MTFKDVAMDFTPEEWRRLDPAQRDVMLENYRNLVSLWLPVSKPENHNLENGKEPLMLERKAPKSSCSDSETRPGSKDSTSV

SEQ ID NO: 17700 - protein, 81 aa, Ovis aries
KSWGPLSFMDVFVDFTWEEWQLLDSAQKHLYRSVMLENYRNLVSLGYQYTKPSIIFQLEQEELWMMHSPSQGHSDEVWEID

SEQ ID NO: 17701 - protein, 81 aa, Rhinolophus ferrumequinum
MASPSPPLEPKEEWDYLDPAQRSLYKDVMMENYGNLVSLDVLNRDKDEEPTVKQEIEEIEEKVESQGIIVTRIKSEIDQDP

SEQ ID NO: 17702 - protein, 81 aa, Acinonyx jubatus
LLTFRDVAIEFSQEEWGCLNQSQRELYRDVMLETYGHLLFLAISSHGSQSFLPKPCIEASSQNVSLGTWKHHALENLHVMI

SEQ ID NO: 17703 - protein, 81 aa, Acinonyx jubatus
WLTFRDVAIEFSQEEWECLDPAQRALYRDVMLENYRNLVSLALSPKCVIKELPPKENSNTGEVLQTVILERHESRDAEDCG

SEQ ID NO: 17704 - protein, 81 aa, Rhinopithecus roxellana
SCEGSVSFRDVAINFSREEWQHLDLSQRNLYRDVMLETYSHLLSVGYQVPKPEVVMLEQGKEPWALQGDRPRQSCPGEKLW

SEQ ID NO: 17705 - protein, 81 aa, Rhinopithecus roxellana
MFKEAVTFKDVAVVFTEEELGLLDPAQKKLYRDVMLENFRNLLSVGHQPSYQDTFHFQREEKFWIVETATQRQGNSRGKIQ

SEQ ID NO: 17706 - protein, 81 aa, Acinonyx jubatus
MAFTQKEWEQLDPVQRNLYKDVMLENYSNLASMGYQAPKPDMISKLEKGEEPWLGKGKTPRQGGPSEIARPKQIGTNGKEV

SEQ ID NO: 17707 - protein, 81 aa, Acinonyx jubatus
LVLFKDVAIDFSQEEWECLDLEQKDLYRDVMLENYNNLVSLAWESRCETKKLFSTKGIYEIESSQWEIIEQLTRLKCDCKS

SEQ ID NO: 17708 - protein, 81 aa, Rhinopithecus roxellana
FETGPLTFRDVAIEFCLEEWQCLDTAQQDLYRKVMLENYRNLVLGIAVSKPNLITCLEQGKDPWNMKRHNMVVKPPDGVSL

SEQ ID NO: 17709 - protein, 81 aa, Rhinopithecus roxellana
PRGSTFFSSVTVAFAQEGWRCLVSTPRERYKEGIPEKSRNLVLLGLPVSQPGMNSQLEQREGTWMLEGEDLRSPSPGWKIV

SEQ ID NO: 17710 - protein, 81 aa, Rhinopithecus roxellana
RESGKAPVTFDDITVYLLQEEWVLLSQQQKELCGSDKLVAPLGPTVANPELFCKFGRGPEPWLGSVQGQRNHLEHHSGKKQ

SEQ ID NO: 17711 - protein, 81 aa, Rhinopithecus roxellana
MIQSQISFEDVAVDFTLEEWQLLNPTQKNLYRDVMLENYSNLIFLGYQILKPDAIFKLEQQDPWIIGQEILNQNFSEVWLD

SEQ ID NO: 17712 - protein, 81 aa, Cebus imitator
EMGVLTFRDVAIEYCLEEWQCLDIAQQNLYRNVMLENYKNLAFLGIASSKPHLITCLEQEKEPWNVKRHELVAEPPDITWF

SEQ ID NO: 17713 - protein, 81 aa, Cebus imitator
VAFEDVDVNFTQDEWALLDPSQKNLYRDVMQETFRNLASVGKKWKDQKIEDEYKNPRSNLRGLMGERLLESKKDHQLGEIL

SEQ ID NO: 17714 - protein, 81 aa, Cebus imitator
MGPLEFMDVAIEFSLEEWQCLDTAQRNLYRDVMLENYRNLVFLEFQKPFFQKLLRILELKNPQAGLSVIVAFVCNTRIFLG

SEQ ID NO: 17715 - protein, 81 aa, Cebus imitator
SKDLVTFGDVAVNFSQEEWEWLNPAQRNLYRKVMLENYRTLVSLGVSVSKPDVISLLEQGKEPWMVKKEGTRGACSDWEYV

SEQ ID NO: 17716 - protein, 81 aa, Cebus imitator
AQESVMFSDVSIDFSQEEWECLNDDQRDLYRDVMLENYSNLVSMAGHSISKPNVISYLEQGKEPWLVDREITSGQWPVLES

SEQ ID NO: 17717 - protein, 81 aa, Cebus imitator
MDVMLENYCHLMSVGCHMTKPDVILKLERGEEPWTSFAGHTRLEENWKAEDFLVKFREHQEKYSRSVVSINHKKLVKEKSK

SEQ ID NO: 17718 - protein, 81 aa, Cebus imitator
FQGPVTLKDVIVEFTKEEWKLLTPVQRTLYKDVMLENYSHLVSVGYRVNKPNVVFKLKQGKEPWMLEVEYPHRGLPEDLRN

SEQ ID NO: 17719 - protein, 81 aa, Cebus imitator
LLTFMDVAIEFSLEEWQCLNTAQRNLYRNVMLENYRNLVFLAVCSYFARDLWPKQGIKNCFQNVILRRYKKCGHKNLHLRK

SEQ ID NO: 17720 - protein, 81 aa, Callithrix jacchus
LQGLVMFEDVAVYFSREEWGLLNVTQKGLYRDVMLENFALLSSLGLAPSRSPVFTQLVDDEQSCVTSWVDVTLVSRTEASR

SEQ ID NO: 17721 - protein, 81 aa, Macaca mulatta
IMEEAVTFKDVAGFFTEEEPGLLDPAQRKLYRDVMLENFRNLLSAGHQPFHQDTFHFLREEKFWMMETVTQRERNSGSKIQ

SEQ ID NO: 17722 - protein, 81 aa, Callithrix jacchus
SQAPVTFEDMAMYLTREEWRPLDPAQRDLYRDVMQENYGNVVSLDFEIRSDSEVNPKQEISEDVQFGTASERPAENAEENP

SEQ ID NO: 17723 - protein, 81 aa, Pan troglodytes
QQGYVTFEDVAVYFSQEEWRLLDDAQRLLYRNVMLENFTLLASLGLASSKTHEITQLESWEEPFMPAWEVVTSAIRRVWLR

SEQ ID NO: 17724 - protein, 81 aa, Sapajus apella
PMPGLQEAVVFEDVAVYFTRIEWSCLAPDQQVLYRDVMLENYRNLASLALISLLEQGEEPGALILQVAEQRGAKTSLCTDS

SEQ ID NO: 17725 - protein, 81 aa, Zalophus californianus
SQGLVSFKDVAVHFTQEEWQQLDPAQRTLYRDVMLENFSHLVSMGYPVSKPDVISKLEQGEDPWIIKRDIPNWIFPNENQD

SEQ ID NO: 17726 - protein, 81 aa, Delphinapterus leucas
VQESLLFEDVAVEFTREEWRLLDPAQKDLYQNVMLENYSNLLSVGYQSPKPIQIFRLKQRDKPWLVKENIHGQNFPEVGEI

SEQ ID NO: 17727 - protein, 81 aa, Sapajus apella
DGLVTFRDVAIDFSQEEWECLDPAQRDLYVDVMLENYSNLVSLDLESTTYDTKKIFSEKDIFEINFSQWEMKEKSKTPGLE

SEQ ID NO: 17728 - protein, 81 aa, Pan troglodytes
AHALVTFRDVAIDFSQKEWECLDTTQRKLYRDVMLENYNNLVSLGYSGSKPDVITLLEQGKEPCVAAKDVTGRQCPGLLSR

SEQ ID NO: 17729 - protein, 81 aa, Pan troglodytes
SPDSMTFEDIIVDFTQEEWALLDTSQRKLFQDVMLENISHLVSIGKQLCKSVVLSQLEQVEKLSTQRISFLQGREVGIKHQ

SEQ ID NO: 17730 - protein, 81 aa, Papio anubis
MAFEDVAVYFSQEEWGLLDTAQRALYRHVMLENFTLVTSLGLSTSRPYVVIQLERGEEPWVPSGKDMTLARNTYRRLNAGS

SEQ ID NO: 17731 - protein, 81 aa, Carlito syrichta
PAQGVTFEDVAIYFSQEEWVLLDETQRLLYGDVMLDNFALITSLGYYHETENEMITSDGMSQVRTSKVGTPTQKTYLSEIE

SEQ ID NO: 17732 - protein, 81 aa, Balaenoptera acutorostrata
MAFRDVAVDFTQEEWMLLSPDQRSLYREVMLENYSNLVSLGIPFSKPKLITQLEQGKETWREERKCPPATGPEPKPELHLG

SEQ ID NO: 17733 - protein, 81 aa, Rhinolophus ferrumequinum
CEVSVSFEDVTVNFSREEWQHLKPAQRRLYRDVTLENYSHLLSVGYQVPKPEVIFKLEQGEGPWMLEGETPHQSCSDEDIE

SEQ ID NO: 17734 - protein, 81 aa, Phyllostomus discolor
MKPDVIFKLEQGEEPWIGDGEVPSSESPEQVLQVNSHMMWHQDNQEKLKNVKQDYECDTFGKNFNMNINLVPLRKSNGEGD

SEQ ID NO: 17735 - protein, 81 aa, Camelus dromedarius
PKVPVSFEDVSVYFTKTEWKLLDFRQRVLYKRVMLENYRHLVSLGFSSSKPHLVSQLERGEGPWVADVHRMGAVTGMQTGD

SEQ ID NO: 17736 - protein, 81 aa, Camelus dromedarius
PEEKETSRPSLMAGILPRLSDQAMDAVFLTAWWKESLSFEDVALYFTREEWSRLDWAQKDLYRDVMLENYRNMIVLGNGLA

SEQ ID NO: 17737 - protein, 81 aa, Ursus maritimus
HQDLVTFKDVAVYFTQTEWAGLSPAQKALYRSVMLENYGNLTSLGYPVPKPALISLLEGGNLPWGLEAQDNPSAERTKDIC

SEQ ID NO: 17738 - protein, 81 aa, Phyllostomus discolor
YQEFVTFEDVAVHLTREEWGCLDPVQRDLYREVMLENYGNVVSLGFPIFKPDGISQLEQDLQVFDLDAKNREALRDDCSDA

SEQ ID NO: 17739 - protein, 81 aa, Rhinopithecus roxellana
QGRLTFRDVAVEFSLAEWKCLNPAQRALYREVMLENYRNLESVDISSKCMMKEVLSTGQGNTEVFHTGTLQRHESHHIGDF

SEQ ID NO: 17740 - protein, 81 aa, Rhinopithecus roxellana
AQESVTFRDVAVFFSQDEWLHLDSAQRALYREVMLENYSSLVSLGSPFSMPKLIHQLQQGEDPCLVEREVPPDTCLGSKTW

SEQ ID NO: 17741 - protein, 81 aa, Odocoileus virginianus
PQGSVTFEDVAVYFSWEEWCLLDEVQIHLYLDVMLENFALVCMLGSCRGVQDAETCSEQNVSAEGASQIRAPRAELSPENT

SEQ ID NO: 17742 - protein, 81 aa, Odocoileus virginianus
MEAVTFKDVAVAFTEEELGLLDSAQRKLYQDVMVENFWNLVSVDENNQSELRAVQERGLHEELSCWQIWQQIANDLTRCQD

SEQ ID NO: 17743 - protein, 81 aa, Odocoileus virginianus
YRGPVTFKDVTVEFTQEEWKLLDTAQRTLYREVMQENYSHLISVGYCANRPNAIFKLKQGKEPWILEVQFPHQNKPEDICN

SEQ ID NO: 17744 - protein, 81 aa, Odocoileus virginianus
PLESVTFEDVAVDFTQEEWSLLDKSQKNLFRDVMMETITHLVSVGYPISKSDVIFQLEQGKELWTEAADLQGQSPGDHAGY

SEQ ID NO: 17745 - protein, 81 aa, Cebus imitator
WSQMPVTFEDVALYLSREEWGRLDHTQQNFYRDVLQKRNGLSLGFPFSRPFWAPQVQGKGEASGSSRQTGDQKEDWRGACT

SEQ ID NO: 17746 - protein, 81 aa, Cebus imitator
VQESVTFRDVAVFFSPDEWLHLDCAQRALYREVMLENYSSLVSLGILFSKPKVISHLEQGEDPWMVESGVPQGTHLGWESL

SEQ ID NO: 17747 - protein, 81 aa, Cebus imitator
QASVCFEDVAMAFTQEEWEQLDLAQRTLYREVTLETWEHLVSLDWKATLEKNRLNSEKDRVWDELSHHVEVKQCVQEEPPC

SEQ ID NO: 17748 - protein, 81 aa, Cebus imitator
SLGSELFRDVAIVFSQEEWQWLAPAQRDLYRDVMLETYSNLVSLGLAISKPDVISFLEQGREPWMVERVVAGGLCPVLESR

SEQ ID NO: 17749 - protein, 81 aa, Cebus imitator
FQEPVTFEDVAVYFTQNEWTSLQPSQRALFREVMLENYATVTSLSAFPFPKPDLIFRLEQGEAAWGPDPWTLAGEEALRGL

SEQ ID NO: 17750 - protein, 81 aa, Cebus imitator
AQEPVTFEDVAVYFTQNEWTSLDPARRALYREVMLENYANVASLAFPFTTPVLVSQLEQGEREGLRGVCPGDEMRTEKEGL

SEQ ID NO: 17751 - protein, 81 aa, Panthera pardus
QAQESLTFEDVAVGFSREEWRLLAPAQKDLYRDVMLENYRNLVSVGYLASKPDALSKLEGGELWTTEDEIDSRICPEIRKV

SEQ ID NO: 17752 - protein, 81 aa, Panthera pardus
MHKDVMLENYSNLASVGLCVAKPEMIFKLERGEELWILEEESSGQGFPGSLSLLCGKSSVGGGALRHDSDLQRQKSQAVDQ

SEQ ID NO: 17753 - protein, 81 aa, Panthera pardus
FQPPVSFKDVAVTFTREEWGQLDPAQRTLYRNVTLETCSHLAFLGLLLSKPAVICWLEQGQDPWRAEHGPPGDWKNTLEKE

SEQ ID NO: 17754 - protein, 81 aa, Panthera pardus
PEGGVTFEDIAIYFSWKEWRLLDEAQRRLYYDVMLENFTLISSLGCCCGAEDAEAPLEQSVSVGVSQASTPKAALSSRKTH

SEQ ID NO: 17755 - protein, 81 aa, Panthera pardus
AHRSVTFRDVAIHFSQQEWEYLDSVQKNLYRDVMMENYDNLVSLAEHSISKPDVIRLLEQRKEPWMVVREDTKRWCTDLES

SEQ ID NO: 17756 - protein, 81 aa, Panthera pardus
AVTFTDVAVNFTKEEWALLDPAQRNLYRDVMLENCRNLASVDSLNQRKTQNSTPRQDILAEKTPQGANRVCAVSHSSRPSP

SEQ ID NO: 17757 - protein, 81 aa, Macaca nemestrina
YQTPVSFKDVVVGFTQEEWHRLSPAQRALYRDVMLETYSNLLSVGYEGTKPDVILRLEQEEAPWIGEAACPGCHCWEDIWQ

SEQ ID NO: 17758 - protein, 81 aa, Enhydra lutris
WKELVSFEDVAMYFTREEWNKLDWAQKDLYRDVMLENYRNMILLGFQFPKPEVICLLEQWEEPWILDLPRAGTRKASSSAC

SEQ ID NO: 17759 - protein, 81 aa, Tursiops truncatus
SVTFRDVTVDFTQEEWQQLEPSQKDLYRDVMLENLQNLVSLDLEMRPEMKEPDLKEEISEDRPSGAWGSAVDGARTQGDRV

SEQ ID NO: 17760 - protein, 81 aa, Acinonyx jubatus
NSQGLLTFRDVAIEFSQKELGCLNHSQWELYRDVMFENYGHLLFLGLVVSKPDLVIFLEQKKDVWAVKRKETVATHPGRWN

SEQ ID NO: 17761 - protein, 81 aa, Leptonychotes weddellii
CQEPVTFEDVAVYFTQNEWVILDSSQRALYREVMLENYANVASLAFLFTRPVLVSQLERGELPWGLEPWEPAGREALRGIC

SEQ ID NO: 17762 - protein, 81 aa, Leptonychotes weddellii
PQGSVSFKDVTVDFTQEEWQQLDPGQKALYRDVTLENYCHLISVGFHMTKPDMIRKLEQGEELWTTEKIFPSQSYLEEDGK

SEQ ID NO: 17763 - protein, 81 aa, Leptonychotes weddellii
AQGSVVFSDVSIDFSQEEWECLDPGQRDLYRDVMLENYSNLLSMGLYIPKPQVISLLEQGKEPWMVGRELTRGLCSDLESM

SEQ ID NO: 17764 - protein, 81 aa, Pteropus vampyrus
KGSVTFEDVAVYFSQEEWRLLDEAQRLLYRDVMLEVFALAVSLGTWHGTESPSEQNGFEGESQENTSQACPWKLCGLALES

SEQ ID NO: 17765 - protein, 81 aa, Pteropus vampyrus
MGPLQRTLYRDVMLENYNNLVSVGSCIYKPEVIFKLEQGEEPWLLEEEFSNQSYQVLEHYRDDALIQGDKKIKAKHLQQVT

SEQ ID NO: 17766 - protein, 81 aa, Pteropus vampyrus
SQVSVTFEDVAVLFTRDEWRKLRPSQRSLYQDVMLENYGHLVSLGFPLSKPKVISLLQQGEEPWKVEEGSCRGSWLGWKSS

SEQ ID NO: 17767 - protein, 81 aa, Physeter macrocephalus
DEALMAFKDVAVAFTQKEWKLLSPAQRTLYRDVMLENYSHMVSLGIAFPKPKLITQLEQGEEPWREESESLLDLCPAEPRT

SEQ ID NO: 17768 - protein, 81 aa, Macaca mulatta
PQASVCFEDVAMAFTQEEWEQLDLAQRTLYREVTLETWEHIVSLGLFLSKSDVISQLEQEEDLCRAEQVVPRDWKTTLEEN

SEQ ID NO: 17769 - protein, 81 aa, Aotus trivirgatus
QGLLTFRDVAIEFSQEEWRCLDPAQRTLYRDVMLENYRNLVSLDISSKYNMKELLSTARGDTEVFYAGILDRRESHHFGDF

SEQ ID NO: 17770 - protein, 81 aa, Delphinapterus leucas
QAQETLTFEDVAVDFTWEEWQLLAPPQKDLYRDVMLENYSNLLSVGFQASKPNVLSKLGQGEPWTMEDEIHCQTRSEIWKV

SEQ ID NO: 17771 - protein, 81 aa, Pan troglodytes
VHGSVTFRDVAIDFSQEEWECLQPDQRTLYRDVMLENYSHLISLAGSSISKPDVITLLEQEKEPWMVVRKETSRWYPDLES

SEQ ID NO: 17772 - protein, 81 aa, Sapajus apella
MKPAQRNLYRDVMLENYSNLVTVGCQVTKPDVIFKLEQEEEPWVMEDEMFGRHCPEVWKVDEQIKKQQETLVRKVTSISKK

SEQ ID NO: 17773 - protein, 81 aa, Sapajus apella
FQKAVTFKDVAVVFSSEELRLLDLTQRTLYRDVMVENFKNLVAVGHLPFQPDMVSQLEAEEKLWMMEAETQRSRYSGENPA

SEQ ID NO: 17774 - protein, 81 aa, Sapajus apella
MYFTREEWGHLDWGQKDLYRDVMLENYRNMVLLGFQFPKPEVICQLENWDEQWILDLPRAGNRKASGSACPGSEARHKMKK

SEQ ID NO: 17775 - protein, 81 aa, Pan troglodytes
PQGSLTFRDVAIEFSQEEWKCLDPVQKALYRDVMLENYRNLGFLGLCLPDLNIISVLEQGKEPWTVVSQVKIARNPNCGEC

SEQ ID NO: 17776 - protein, 81 aa, Ursus arctos
SQESVTFEDVAVDFTQEEWTLLDRSQRRLFRDVMLENISHLVSIGRQLYKSDTISHLEPEEQLSKGIGLLQCQSLDREDDL

SEQ ID NO: 17777 - protein, 81 aa, Vicugna pacos
SQASVSFKDVTVEFTEEEWQQMGPVQKTLYRDVMLENYNNLVSVVNCIFKPEVIFKLEKGEEPWFSEEEFSNQSHRDYRDN

SEQ ID NO: 17778 - protein, 81 aa, Leptonychotes weddellii
PQEPVTFEDVAVYFTQNQWASLDPTQRALYREVMLENYASVASLVVFPFPKPDLVSQLEREEAPWGPDPWEAEVLRGICPG

SEQ ID NO: 17779 - protein, 81 aa, Leptonychotes weddellii
AQESVTFRDVAVFFSQDEWLRLDSAQRTLYREVMLENYGTLVSLGILFSKPKVIFQLQQGEDPWMVENGVSQGPCVGWERL

SEQ ID NO: 17780 - protein, 81 aa, Sus scrofa
PQESVTFKDVAVNFTQEEWHHVDPAQRRLYRDVMLENYSHLVSVGYQVSKPEVIFKLEQGEEPWIAEGEIQRPFCPDWKTR

SEQ ID NO: 17781 - protein, 81 aa, Leptonychotes weddellii
SLETVTFKDVAVDLTQEEWQQMKPAQRNLYRDVMLENYSNLVTVGYQVTKPDVIFKLEQEEEPWVVEEEMLGRHCPESRRG

SEQ ID NO: 17782 - protein, 81 aa, Vicugna pacos
TQGLVTFRDVAVEFSQEEWKCLEPAQRDLYRDVTLENFGNLVSLGLSISKPDVISLLEQGKEPWLIANDMTGPWCPDLESK

SEQ ID NO: 17783 - protein, 81 aa, Leptonychotes weddellii
SQEPVTFEDVAVYFTQNQWASLDPMQRALYLEVMLENYANITSLAALPFPKPDLILQLEQGEAPWDLDPWTPLEGEALEGV

SEQ ID NO: 17784 - protein, 81 aa, Odocoileus virginianus
APVPLTFSDVSIDFSQEEWECLNSDQKNLYRDVMLETYTNLVSLDFDFTTENNKLSSEKSSFEVNPYHWETVKSKTFNLMG

SEQ ID NO: 17785 - protein, 81 aa, Odocoileus virginianus
MFQVTFSDVAIDFSHEEWRWLSSTQRNLYKDVMVQNYENLVSLAGLSVPKPYVIALLEDGKEPWMVEEKLSKDMVPDCKSR

SEQ ID NO: 17786 - protein, 81 aa, Leptonychotes weddellii
FQETVTFKDVAVVFSEEELGLLDSTQRKLYRDVMLENFRNLVSVGNQPFKPELIFQLEREEKLLMMETETQRDGYLGTKSQ

SEQ ID NO: 17787 - protein, 81 aa, Phascolarctos cinereus
PQESVTFKDVAVDFTWEEWEELDVAQRDLYRDVMLENYRNIISLGTQVSKPEVIFLLEQGKEPWMVKREVPRVICPGERYH

SEQ ID NO: 17788 - protein, 81 aa, Vicugna pacos
MLENYRSLVSLAGVSVSKPDVISLLEQGKEPWKVKKEWTGGTRPDWEYVLKNNELSSKQVIYDESSKSVTVGGSHLSYRLD

SEQ ID NO: 17789 - protein, 81 aa, Odocoileus virginianus
WLQGPMSFKDVAVEFTQEEWMMLDSAQRSMYRDVMLENYINLTLVEYQLCKPVISLLGQEDIRTVKSRIPQDTCPDWEIQL

SEQ ID NO: 17790 - protein, 81 aa, Neomonachus schauinslandi
PLESVTFEDVVVDFTKEEWALLDISQRKLFRDVMLENIRHLVSLGYQHCKSDVIFPLEQGEELWREGTGFLQGQSSGRESA

SEQ ID NO: 17791 - protein, 81 aa, Phascolarctos cinereus
QKASVTFGDVAVDFTPEEWARLDLSQKELYREVMLENYRNLVCLGLAVSKPEVICQLEQGGEPWIPEGEGPRCMCADWKTQ

SEQ ID NO: 17792 - protein, 81 aa, Phascolarctos cinereus
SLESVTFQDVAVNFTQEEWGHLEPAQKDLYREVMLENYQNFVSLGLPFSKPHVISQLERGEAPWITERDVPRVSCQDFFIQ

SEQ ID NO: 17793 - protein, 81 aa, Cebus imitator
MLENYENLVFLGIAVSKPDLITCLEQEKELWNMKRHEMVDKPPVMCSHIIQDLLPEKNIEDSFHKVALRRDEKYEHTNFLL

SEQ ID NO: 17794 - protein, 81 aa, Pteropus vampyrus
GSVSFTDVTVDFTQEEWEQLDPSQRILYMDVMLENYSNLLSVEVWKADDQMEREHRSPDEQARPFIIFKNQTPIEERGDLF

SEQ ID NO: 17795 - protein, 81 aa, Pteropus vampyrus
AQGSVSFEDVTVEFTPDEWQYMGPAHRTLYRDVMLENCSHFVSMGYCITKPQVIFKLEQGEEPWSLEEEFPNQRFPAQSSL

SEQ ID NO: 17796 - protein, 81 aa, Pongo abelii
AQESVMFSDVSVDFSQEEWECLNDDQRDLYRDVMLENYSNLVSMGHSVSKPNVISYLEQGKEPWLVDRELTRGQWPVLESR

SEQ ID NO: 17797 - protein, 81 aa, Pongo abelii
QGTVTFEDVAVHFSWEEWGLLDEAQRCLYRDVMLENLALLTSLDVHHQKQHLGEKHFRSNVGRAMFVKTCTFHVSGEPSTC

SEQ ID NO: 17798 - protein, 81 aa, Bos indicus x Bos taurus
MLETFGLLVSVGHWLPKPDVISLLEQEAELWAADKGGPRGVCPDLETRPQSKLSTENQGVTEEIPNSALVERFLQESLWHS

SEQ ID NO: 17799 - protein, 81 aa, Trichechus manatus
DSVAVEDVAVDFTQEEWALLDLSQRKLYRDVMMETFRNLASVSRNLDDGEKLSTENIIVRFMKSDTWPSMVGGICKLHGIE

SEQ ID NO: 17800 - protein, 81 aa, Trichechus manatus
AHDLVMFTDVAVDFSQEEWECLDSYQKNLYRDVILENYNNLVSLAGCSISKPDVVTLLEQGKEPWLIGRDKKIRWSPDLES

SEQ ID NO: 17801 - protein, 81 aa, Carlito syrichta
SQEHVSFKDVCVDFTQEEWYLLDSAQKILYRDVILENYSNLVSLGCCVTKPEVIFKIEQGEEPWILEKGFPSKWHPEKKWK

SEQ ID NO: 17802 - protein, 81 aa, Pan troglodytes
AQESLTLEDVAVDFTWEEWQLLSPAQKDLYRDVMLENYSNLVSVGYQASKPDAFSKLERGEETCTTEDEIYSRICSDSGGA

SEQ ID NO: 17803 - protein, 81 aa, Papio anubis
SQASVSFQDVTVEFTQEEWQHLGPVERTLYRDVMLENYSHLISVGYCITKPKVISRLEQGEEPWSLEDEVLNQKHQGYFKV

SEQ ID NO: 17804 - protein, 81 aa, Zalophus californianus
MLENFSHLVSLGHPVSKPDIISKLEQGEEPWIIKRDISDWICPERETRLENPQLDILEGVSFPKEILEGVTRDHSLYSIFK

SEQ ID NO: 17805 - protein, 81 aa, Zalophus californianus
FEGSVSFEDVAVDFTRQEWHRLDPAQRTMHKDVMLENYSNLASVGLCVAKPEMIFKLERGEELWILEEESSGHGYPGSLSM

SEQ ID NO: 17806 - protein, 81 aa, Saimiri boliviensis
HLTFRDVAIEFSQEEWKCLNSAQRTLYRDVMLENYRNLVSLDLSHNGVIKELAPKQKSNMGEVFHTVALEQHETPDMQEFC

SEQ ID NO: 17807 - protein, 81 aa, Lipotes vexillifer
SQEQVSFKDVCVDFTREEWYLLDPAQKILYRDVILENYSHLVSVGNCITKPEVIFKIEQGEEPWILEERFPKQCCSERNWK

SEQ ID NO: 17808 - protein, 81 aa, Callorhinus ursinus
MAAPPSGRAQISVTFDDVAVTFTQEEWGQLDPAQRTLYQEVMLENCGLLVSLGLLGRFPHKSPGTPPDNRSSRSPHSAILE

SEQ ID NO: 17809 - protein, 81 aa, Callorhinus ursinus
SLLTFEEVAMYFSQEEWELLDPTQKALYNDVMRENYETVISLAMPVHQILAFSEKTNTKDWTVAPEFILPESQSLLTFEEV

SEQ ID NO: 17810 - protein, 81 aa, Callorhinus ursinus
VQGQVNFEDVAVYFSQEEWGLLDEAQRLLYRDVMLENLALMASLGYESSMSHGVASLELGSKLWRSDWADVTPGRTREAQG

SEQ ID NO: 17811 - protein, 81 aa, Callorhinus ursinus
TQKPVTFKDVAVDFTREEWGLLGPTQRILYRDVMLRNYSNLVSLGLPDCKPDVISKLEQWEDPWTVKRDVPRGPDSEPGPR

SEQ ID NO: 17812 - protein, 81 aa, Callorhinus ursinus
TARSQASVTFKDVAMDFTPEEWGKLDPAQREVMLENYRNLVSLWLPVSRPENYNLENGKEPLMLERKAPKSSYSDLETKPE

SEQ ID NO: 17813 - protein, 81 aa, Callorhinus ursinus
SYGSFSFEDVTVGFTQEEWQHLGPAQRILYRDVMLENYSHLVSVGCCIPKPEVILKLEQGEQPWILEEESPSQSYPGLPTD

SEQ ID NO: 17814 - protein, 81 aa, Callorhinus ursinus
AHHLVMFRDVAVDFSKEEWECLNSYQRNLYRDVILENYSNLVSVAGCSISKPDVITLLEQGKEPWMVVRDERRRRSLDLES

SEQ ID NO: 17815 - protein, 81 aa, Tursiops truncatus
HQEVVTFEDVAVYFTQTEWAGLSPAQRALYRSVMLEIYGNLTSLGYPVPKPALVSLLERGDLPWGLETRDDPPAQGTKDIC

SEQ ID NO: 17816 - protein, 81 aa, Acinonyx jubatus
QAQESLTFEDVAVGFSREEWQLLAPAQKDLYRDVMLENYRNLVSVGYLTSKPDALSKLEGGELWTTEDEIDSRICPEIRKV

SEQ ID NO: 17817 - protein, 81 aa, Sus scrofa
FKEAVTFKDVAVVFTEEELGLLDLAQRKLYQEVMLENFRNLVSVGRHSFTPDIISQVEREEKLWMIKSATPSYCSSGDKNL

SEQ ID NO: 17818 - protein, 81 aa, Vicugna pacos
VADCVRNRPQDSVTFADVAVGFTQEEWILLDSFQRNLYRDVMLENYKNLTTAGYQWFKPTLISWLEQEELRTEERGAVQGE

SEQ ID NO: 17819 - protein, 81 aa, Phascolarctos cinereus
MMWLGTSGRSGLSGPCPENPLQGCHPAGLEEWALHGISRPTVISQLEQKEEPWVLDLQSLEEGEILREAHTDFENQVEKLN

SEQ ID NO: 17820 - protein, 81 aa, Vicugna pacos
CKGLVLFKDVSIHFSQEEWECLDSDQRDLYRNVILENYNNLISVGLSIPKPDVVSLLEEGEDPWMVDRELTRDLLPDCGSR

SEQ ID NO: 17821 - protein, 81 aa, Neomonachus schauinslandi
ARESLTFRDVFVDFTLEEWQQLDSAQKNLYRDVTLENYSHLVSVGYLVASPDEVLRSGRGEEARRAEGGPSAWTYPEFWQV

SEQ ID NO: 17822 - protein, 81 aa, Phascolarctos cinereus
CQETLTFKDVAVDFTREEWGHLGPAQRDLYKEVMLDNYRNLVSLGLQVSKPDVIFQLERGESPSMLEGKDSSDPCPEFLSQ

SEQ ID NO: 17823 - protein, 81 aa, Nomascus leucogenys
AQGRVVFEDVAIYFSQEEWGHLDEDQRLLYRDVMLENLALLSSLGCCHGAEDEEAPLEPGVSVGVSQVMAPKPCLSTWKTQ

SEQ ID NO: 17824 - protein, 81 aa, Phascolarctos cinereus
MLENYRNLVSLGFPVSKPDVIYQLERREASWMPEADISGSSCPGSREFTGDKPPECNECGKAFKSKAALTAHQKIHTEEKP

SEQ ID NO: 17825 - protein, 81 aa, Pteropus vampyrus
MFRDVSINFSQEEWECLDPGQMNLYKEVMLENFSNLVSVGLSSAKPVVISLLEEGKEPWMVEREVKRGLCSDLESMCETKI

SEQ ID NO: 17826 - protein, 81 aa, Pongo abelii
SRSLENDGVCFTEQEWENLEDWQKELYRNVMESNYETLVSLKVLGQTEGEAELGTQMLGDLEEEGPGGAHPAGGVMIKQEL

SEQ ID NO: 17827 - protein, 81 aa, Bos indicus
MLENYGNMASLGFPLLKPAVISQLEGGGELEGPSPLASAAGTGPQGLWTDIDIQTNNNLTEEMYEEKYNISYELQRNSFKE

SEQ ID NO: 17828 - protein, 81 aa, Pteropus vampyrus
FQEPLTFKDVAVVFTEEELGLLDAAQRKLYRDVTLENFRNLVSVGQQPCKPGKMSHLEQDRETWVTERGTLRGAHSGDNNE

SEQ ID NO: 17829 - protein, 81 aa, Pongo abelii
TQGQLSFRDVAIEFSQEEWKCLDPGQKALYRDVMLENYRNLVSLGICLPGLSVTSMLEQKRDPCTLQSEVKIANNPDGREC

SEQ ID NO: 17830 - protein, 81 aa, Physeter macrocephalus
LQGSVTFQDVAVDFTLEEWQLLGCAQRKLYWDVMLENFRNLISVGCPVTKTKVIFKVEQGQEPWMMEGENARWHSPEVICL

SEQ ID NO: 17831 - protein, 81 aa, Trichechus manatus
FQESVTFKDVIVDFTQEEWKQLDPVQRDLFRDVTLENYTHLVSIGLQVSKPDVISQLEQGTEPWTVEPGVPVGTSRDWETR

SEQ ID NO: 17832 - protein, 81 aa, Carlito syrichta
TARSQETVTFKDVAMDFTPEEWGKLDPAQRDVMLENYRNLVALWLPVSETENYKLENGKEALKLERKAPKRSYSDLETRRE

SEQ ID NO: 17833 - protein, 81 aa, Macaca mulatta
WLQEPMTFKDVAVEFTQDEWMMLDSAQRSLYRDVMLENYRNLTSVEYQLCKLTVISPLDQEEIRNMEKRIPQGICPDQKIL

SEQ ID NO: 17834 - protein, 81 aa, Sapajus apella
MDVAIEFSLEEWQCLDTAQKNLYRTVMLENYRNLVFLDLITCLEKGKEPWNMKRYKMGAKPQVLSYFPKDLWLEQNIKNSF

SEQ ID NO: 17835 - protein, 81 aa, Panthera pardus
IQETVTFKDVAVDLTQEEWQQLKPAQRNLYRDVMLENYSNLVTVGYQVTKPDVIFKLEQEEDPWVVEEEMLGRHCPEVWEV

SEQ ID NO: 17836 - protein, 81 aa, Panthera pardus
FQGSVTFRDVAIDFSQEEWEWLQPTQRDLYRHVMLENYSHLVSLAGLNISKPYVVSLLEQGKEPWLEKRGVRRDLFSEPNR

SEQ ID NO: 17837 - protein, 81 aa, Panthera pardus
FQESLTFRDVFVDFTLEEWRCLDSAQKNLYRDVMLENYSHLVSVGQLVPKPDVVIRLGQGGEARTAEGETPTRNPPEFWQV

SEQ ID NO: 17838 - protein, 81 aa, Panthera pardus
VQEPVTFKDVAVDFTQEEWGQLDSIQRTLYRDVMLETYGHLLSVGNQIAKPEVISLLEQGEEPWSVEQAYPQSTCPVPEIL

SEQ ID NO: 17839 - protein, 81 aa, Panthera pardus
PQGLVTFEDVAVDFTHEEWQYLNPSQKSLYREVMLETYSNLVSVAGQQVTKPDLILKLEVEEPCLAETKISIWDFPEAYQV

SEQ ID NO: 17840 - protein, 81 aa, Panthera pardus
QESVTFKDVAVDFTLEEWGWLGPGQRELYRDVMLENYQNLLSLGAGPPGFKPDVISRLERGEEPRMEKREGWQMTCPDSET

SEQ ID NO: 17841 - protein, 81 aa, Capra hircus
YRGPVTFKDITVEFTREEWKLLDTAQRTLYREVMQENYSHLISVGYCANRPNAIFKLKQGKEPWILEVQFPRQNNPEDLCN

SEQ ID NO: 17842 - protein, 81 aa, Tursiops truncatus
LQGSVTLQDVAVEFTPEEWQLLDCDQRTLYWDVMLENFRNLISMGCPVTKTIVIFKVEQGQEPWMVEGENPRWRSPEADCP

SEQ ID NO: 17843 - protein, 81 aa, Cercocebus atys
MFKEAVTFKDVAVVFTEEELGLLDPAQKKLYRDVMLENFRNLLSVGHQLSYQDTFHFQREEKLWIMETATQKEGNSGGKIQ

SEQ ID NO: 17844 - protein, 81 aa, Bison bison
MFQVTFSDVAIDFSHEEWRWLNSTQRNLYKDVMVQNYENLVSLAGLSIPKPYVIALLEDGKEPCMVEEKLSKDTFPDCKTR

SEQ ID NO: 17845 - protein, 81 aa, Ursus arctos
TARSQASVTFKDVAMDFTPEEWGKLDPTQREVMLENYRNLVSLWLPVSRPENYNLENGKEPLMLERKAPKSSYPDLETKPE

SEQ ID NO: 17846 - protein, 81 aa, Ursus arctos
MAFEDVAVYFSQEEWELLDAAQRALYCHVMLENFALVASLGLSASRPRVVIQLERGEDPWVLSGTVVTPARNAHRKPSPGS

SEQ ID NO: 17847 - protein, 81 aa, Ursus arctos
FQGSVTFQDVAVDFTPEEWQLLDCDQRTLYWNVMLENFRNLISVGGPVTKTKVIFKAEQGQEPWVGERENPRWRYPEADCL

SEQ ID NO: 17848 - protein, 81 aa, Ursus arctos
MEGIPENARNLVLLGLPVSQPDMNSQLEQREEGPWMLEGGGLRSTCPDWKIMSESPPEHDISEDSFQDTSVELPPGESEHR

SEQ ID NO: 17849 - protein, 81 aa, Ursus arctos
SHTLVTFEDVLVDFTREEWELLDAAQQVTYKDVMLENYKNLVSLGHQLPKPDVILQLEKGEEPWLVERGIHRETHPDLETT

SEQ ID NO: 17850 - protein, 81 aa, Ursus arctos
SKVPVTFGDLAIYFSQEEWEWLSPIQKDLYEDVMLENYQNLVSLGLSFRRPNVITLLEKGKAPWMVEPARKRRGVDSGSKC

SEQ ID NO: 17851 - protein, 81 aa, Leptonychotes weddellii
MAFEDVAVYFSHEEWELLDTAQRALYCHVMLENFALVASLGLSASRPRVVVQLERGEEPWVLGGTAATPARTAHRKPSPAP

SEQ ID NO: 17852 - protein, 81 aa, Phascolarctos cinereus
IQESVTFRDVAVDFTGEEWSCLDAAQRALYRDVVWETYESLVFLGIPVCPLDVIFLLAGRRSTREVQGRSSQRPLSRCCGD

SEQ ID NO: 17853 - protein, 81 aa, Leptonychotes weddellii
PQVLVSFEDVAVFLSREEWGCLGPAQRGLYSNVMLETYRNLISLGLQGSKPDVISRLEKGEEPWAPYSPKIEEGWIRSHRS

SEQ ID NO: 17854 - protein, 81 aa, Odocoileus virginianus
LQEPVTFRDVAVDFTQEEWGQLGPAQRTLYRDVMLETFGHLLSVGPELPKPDVISQLEQGAELWVVEGGLAQGCRPGQETG

SEQ ID NO: 17855 - protein, 81 aa, Vicugna pacos
MAMYLTREEWRPLDPTQRDLYRDVMQENYGNVVSLDFEIRSDNEVNPKQEISEDVEFGTASERPVGNTAENPESEEAFEDR

SEQ ID NO: 17856 - protein, 81 aa, Physeter macrocephalus
AQEYLTYDDVTMKFTWEEWQLLAPDQKDLYRDVMLENYSNLVSVGYQASKPDAVSRLERGEQLWPVEDDSHGRIYPEIRKV

SEQ ID NO: 17857 - protein, 81 aa, Pan troglodytes
MAFEDVAVYFSQEEWGLLDTTQRALYRHVMLENFTLVTSLGLSTSRPHVVIQLERGEEPWVPSGTDTTLSRTTYRRRNPGS

SEQ ID NO: 17858 - protein, 81 aa, Delphinapterus leucas
MLENCRNLASLGYHVDKPSLISQLEQEDKVMTEERGILPGTCPDLETVLKAKWLTPKKHVFRKEHSNGVKVERSHLGVKLN

SEQ ID NO: 17859 - protein, 81 aa, Delphinapterus leucas
MDPTQRKLHKDVMLENYRNLVSLGLAVSKPDMISHLEDGKGPWVVVRETSKTPYSELETKPTTKNALPTENISEECLSQET

SEQ ID NO: 17860 - protein, 81 aa, Aotus trivirgatus
SQGSVTFRDVAIDFSQEEWKWLQPAQRDLYRCVMLENYGHLVSLGLSISKPDVVSLLEQGKEPWLGKRDVKTDLFSVSEST

SEQ ID NO: 17861 - protein, 81 aa, Panthera pardus
GSVSFTDVTVDFTQEEWEQLDPSQRILYMDVMLENYSNLLSVEVWKADDQMERDPSNPDEQARPFIIFKNQTPIEERGNLF

SEQ ID NO: 17862 - protein, 81 aa, Panthera pardus
ERTGSVSFKDVMVDFSREEWQRLDLAQKSLYRDVMLENYFNLISVGCQVPRPEVIFNSEQEEPCVLDGDISSLNCLNGDIG

SEQ ID NO: 17863 - protein, 81 aa, Enhydra lutris
QAEVTFEDVAVLFSREEWGRLGPAQRGLYRDVMLETYRNLVSLGAGPAGPKPGVITQLERGDEPWVLDAQGTEGKERLRVS

SEQ ID NO: 17864 - protein, 81 aa, Acinonyx jubatus
MLENYSHLVAVGCCVPKPDVIFRLEQGQQPWLVEEESLDQSCPEVCRVDNQLEQNQEIQHRHFWQSPFINNKTLTVHRGNV

SEQ ID NO: 17865 - protein, 81 aa, Tursiops truncatus
SQGPVSFEDVAIDFTQEEWQQLDPAQRTLYRDVMLENYSHLVSVGYPVSKPGVISKLEQGEEPWIMKRDISNWIYPDRETR

SEQ ID NO: 17866 - protein, 81 aa, Bison bison
GWVPALFDEVAIYFSDEEWEVLTEQQKALYREVMRMNYETVLSLEFPFPKPDMITRLEREEESQNSEEWQLQGGTFAEKEE

SEQ ID NO: 17867 - protein, 81 aa, Physeter macrocephalus
MLENYFNLISVGCQVPKPEVIFNLEWEEEPCMLDGEISSQSYLDQGIGFETSQQGMSEGVSIQLERINLFTRDDLYSILEE

SEQ ID NO: 17868 - protein, 81 aa, Physeter macrocephalus
RKVPVSFEDVSVYFTKTEWKLLDLRQRMLYKRVMLENYHHLVSLGFSSSKPHLVSRLERGEGPWVADVHRMGTTTGMQAGD

SEQ ID NO: 17869 - protein, 81 aa, Trichechus manatus
SVVIEDVAVDFTQEEWALLDLAQRKLYIDVMLETFINLASVVSRNLSDGKTFSSEHTIVRFMKNDSWSSVLGDIYELHGIE

SEQ ID NO: 17870 - protein, 81 aa, Trichechus manatus
APESVTFKDVALDFTQEEWSLLDTTQRNLFRDVMKENINHLVFIGNHLCKSDVISQLEQGEELWREGVGFLQDESLVISVR

SEQ ID NO: 17871 - protein, 81 aa, Rhinolophus ferrumequinum
SQESVTFQDVAVDFTEKEWPLLDSSQRKLYKDVMLENYSNLASVGCQVGKPSLISHLEEEEELRTEETGLHGGTCSDWETP

SEQ ID NO: 17872 - protein, 81 aa, Leptonychotes weddellii
KSLGSVSFKDVTVDFSREEWQQLDLAQKSLYRDVMLENYFNLISVGCQVPKAEVIFSLEQEEPCLLDGEISSHSCLDGDIG

SEQ ID NO: 17873 - protein, 81 aa, Odocoileus virginianus
LQNSITFEDVAINFTQKEWALLNSSQRRLYKDVMLENYRNLASVGYQLSKPPLITHLEQEDEMKIVERRIHQDTCSCEHQA

SEQ ID NO: 17874 - protein, 81 aa, Phascolarctos cinereus
PQVSVMFEDVAIYLTQDEWGHLGPAQRGLYKDVMLENYENLVSLGFPGSKPEVISQLEQGEEPWILDMKRTENREILEDGE

SEQ ID NO: 17875 - protein, 81 aa, Phascolarctos cinereus
CQEPVTFQDVVVVFTREQWAYLDPSQKELYRDVMLETYRNLLCLGLAMSKPQVIRQLERREAPWIPERRIPESSCPDLETK

SEQ ID NO: 17876 - protein, 81 aa, Pteropus vampyrus
PDIISYMICSPLKRKQEEWQQLDPAQRTLYRDVMLENFSHLVSMGHPVSKPDVISKLEQGEDPWIIKRNISNWIYPDRKSN

SEQ ID NO: 17877 - protein, 81 aa, Pteropus vampyrus
MDPTQRDLHKDVMLENYRNLVSLGLAVSKPDMIAHLEDGQGPWVVVREISRTSNPELETKLAIKNAITTEDITEDLSQDTI

SEQ ID NO: 17878 - protein, 81 aa, Pteropus vampyrus
MQPLESVMFEDVAIDFTQEEWALLDTSQRKLFRDVMLETISHLVSLGYHHAIFQLEQGEELWSEGIGFLQSQSSGRESAIK

SEQ ID NO: 17879 - protein, 81 aa, Pongo abelii
AQELLTLEDVTVEFTWEEWQLLDPFQKDLYRDVTLEIYSNLVSMGYQVSKPDALSKLEQGEEPWTMEDERHSRICPENNKV

SEQ ID NO: 17880 - protein, 81 aa, Pteropus vampyrus
PVGLVSFKDVAVDFTQEEWQQLDPAQRTLYRDVMLENFSHLVSMGHPVSKPDVISKLEQGEDPWIIKRNISNWIYPDRKSN

SEQ ID NO: 17881 - protein, 81 aa, Physeter macrocephalus
LQGSVSFKDVTVDFTQEEWQQLAPAQKALYRDVMLENYCHLISVGFHMTKPDMIHKLEQGKELWTTEKIFPSQSYLEEDWK

SEQ ID NO: 17882 - protein, 81 aa, Monodelphis domestica
AQVLVTFQDVAVDFTQEEWRLLDLGQKELYKEVMLENVQNMLFLGLPVPREDWISHFDQGRAPWMLEGEGPSNSRLDGQRR

SEQ ID NO: 17883 - protein, 81 aa, Physeter macrocephalus
GSVSFEDVTVEFTQDEWQYVGPAQRTLYKDVTLENYSHLVSLVVTFAGYCIIKPQVIFKLEHGEEPWSSEEEFLNQKYPGY

SEQ ID NO: 17884 - protein, 81 aa, Physeter macrocephalus
MSFEDVAVDFTLEEWQLLNPTQKTLYRDVMLENYSNLVFLGYQMIKPEAIFKLEQEEPWILGEEILSQNFPEEVWLDNNLK

SEQ ID NO: 17885 - protein, 81 aa, Trichechus manatus
ALGSVSFEDVAVDFTQEEWQQLDTVQKTIYKDVMLENYSHLISLGHPIIKPDVITKLEQGEEPWIVEGEFLLQSYPEEAYK

SEQ ID NO: 17886 - protein, 81 aa, Pan troglodytes
YQIPVSFKDVVVGFTQEEWHQLSPAQRALYRDVMLETYSNLVSVGYEGTKPDVILRLEQEEAPWIGEAACPGCHCWEDIWR

SEQ ID NO: 17887 - protein, 81 aa, Delphinapterus leucas
MDPVAFEDVAVNFTLEEWALLGPSQKKLYRDVMRETLRNLASIGEKWEDRNTEDQYKNQGRNLRSHTLRRCCESEEGSQCG

SEQ ID NO: 17888 - protein, 81 aa, Papio anubis
GMEPLQFRDVAIEFSLEEWHCLDTAQQNLYRDVMLENYRNLVFVGIVVSKPDLITRLEQGEKPLTVKRHKMTANPSVVCSH

SEQ ID NO: 17889 - protein, 81 aa, Balaenoptera acutorostrata
MAEDLKFKDVAIYFSQKEWECLHSAQKDLYRDVMLENYNTLISLGFSDSKPDVISLLEQGKEPWMVNSKETKEWCPDWESR

SEQ ID NO: 17890 - protein, 81 aa, Saimiri boliviensis
FQEPVTFEDVVVYFTQNEWTSLQPSQRALYREVMLENYATVTSLSAFPFSKPDLIFRLEQGEAAWGSDPWTLAGEEAPRGL

SEQ ID NO: 17891 - protein, 81 aa, Saimiri boliviensis
PLTFRDVTVEFSQEEWKCLDPTQKALYKDVMLENYRNLVFLGISPKCMIKELPPTENSNTRKRFQTVTLERHQSHDLENLY

SEQ ID NO: 17892 - protein, 81 aa, Balaenoptera acutorostrata
HQEVVTFEDVAVYFTQTEWAGLSPAQRALYRSVMLEIYGNLTSLGYPVPKPALVSLLERGDLPWGLETRDDRPAQGTKDIC

SEQ ID NO: 17893 - protein, 81 aa, Balaenoptera acutorostrata
AHQLMMFRDVAVDFSQEEWECLDLEQRALYRDVMLENYSNMVSLGLCLYQPDVFSLLEKGKEPWMVLKDETRGPCPDMQSR

SEQ ID NO: 17894 - protein, 81 aa, Ovis aries
MLENISHLVFVGYQHCKLDVIFQLEQGEELWIEGRGFFQSHSPGGESAFKEELLATQHISKKDTSTIIPMQTFHTPEDPCE

SEQ ID NO: 17895 - protein, 81 aa, Callorhinus ursinus
ARASLSFEDVAVGFSWEEWQLLAPSQKDLYRDVMLENYRNLVSVGYEASKPDSVFQLEQGEPPWMVEGAAQSQTCQEEIWE

SEQ ID NO: 17896 - protein, 81 aa, Vicugna pacos
TFQEAVTFKDVAVAFTEEELGLLDSTQRKLYQDVMVENFRNLVSVGHQPFKRDTSHIEREERLWMMNTASQMERNFGEDHA

SEQ ID NO: 17897 - protein, 81 aa, Vicugna pacos
PQDRTPFSSVAVAFTQEGWRLSVPALRDRFMEGIPEESRNLVLLGLPVSQPVMNSQLEQREGSWMLEREGLRSTCPDWKPE

SEQ ID NO: 17898 - protein, 81 aa, Vicugna pacos
GLTFKDVAIEFSQEEWECLDPAQRALYRDVMLETCRNLLSLDLSPMHVVKHLQPKANSDIEEVFQTVMLGSPESRESKHFT

SEQ ID NO: 17899 - protein, 81 aa, Phascolarctos cinereus
GKESVTFKDVAVEFTQEEWVQLNPSQKKLYRDVMLENYRNLVSLGFAVSKPNVIYQLERKEASSLPETDIPRSSCPESIEF

SEQ ID NO: 17900 - protein, 81 aa, Phascolarctos cinereus
AQELVTFQDVAVDFTEEEWVLLDQLQKELYKEVMLENAQNLVSLGLPVPREDLMSYFEEKEAPWLLEHEGLRSCYPEGEIR

SEQ ID NO: 17901 - protein, 81 aa, Pteropus vampyrus
MPQDVTVDFTQEEWQQLDSDQKALYRDVMLENYCHLISVGFHMTKPDMIRKLEEGEELWTTERIFPSQSYLESPAVYCSSF

SEQ ID NO: 17902 - protein, 81 aa, Pteropus vampyrus
CWGLLSFKDVSMEFTWEEWQLLDPTQRYLYREVILENYHNLVSVGYHGTKPDLIFKLEQGEEPWILSARISHESCAASSQL

SEQ ID NO: 17903 - protein, 81 aa, Cebus imitator
LQGPVSFKDVAVDFTQEEWQQLDPDEKITYRDVMLENYSHLVSVGCDITKPNVIIKLEQGEEPWITEDEFPCQHSPEVWKV

SEQ ID NO: 17904 - protein, 81 aa, Pteropus vampyrus
RLRTASCWDVSMEFTWEEWQLLDPTQRYLYREVILENYHNLVSVGYHGTKPDLIFKLEQGEEPWILSARISHESCAEGWKE

SEQ ID NO: 17905 - protein, 81 aa, Pteropus vampyrus
MAQVPLTFSDVAIDFSPEEWECLNSDQRDLYRDVMLENYTNLVSLDFDFTTEINKLSSGKSNYEVNSYHQETTKRSKTFNF

SEQ ID NO: 17906 - protein, 81 aa, Physeter macrocephalus
RSQESLTFQDVAVDFTREEWDQLYPAQKNLYRDVMLENYRNLVALGHQLYKPEVITQLEQEEQWMMEIDSPPDTHPDGENS

SEQ ID NO: 17907 - protein, 81 aa, Trichechus manatus
QESVAFEDVAVDFTPEEWVLLDRSQRTLYREVMLETYRNLASLDWRTQLKTKESTSKQDIFGESMFKGMKMQAPTHPGKRP

SEQ ID NO: 17908 - protein, 81 aa, Bos indicus x Bos taurus
MLENYSNLVSAGFQASTPEVLSKLDQGEPWMMDDEIHCRTHSEVWKVDGHLLEHLQKKRVEKRLEQWLEQNPLDNSGHQSR

SEQ ID NO: 17909 - protein, 81 aa, Trichechus manatus
HQEPVTFEDVAVIFTEEEWRHLVPIQRDLYKEVMLENYRSIVSLGLPVPQPDVIFQLKRGEEAWIVDLRGSEERECPENIS

SEQ ID NO: 17910 - protein, 81 aa, Aotus trivirgatus
QGTVTFEDVAVYFSREEWGLLDEAEKHLYHNVMLENLALITSLDCWCETEDEEVPSEQSVSVERLSQVRVPTLSSHIKQAH

SEQ ID NO: 17911 - protein, 81 aa, Delphinapterus leucas
SQGSLSFRDVTVGFTQEEWQHLDPAQRTLYRDVMLENYSHLISVGFCIPKPEVILKLEQGEEPWILEEESPSQSVPELINS

SEQ ID NO: 17912 - protein, 81 aa, Sapajus apella
MDVAIEFCLEEWQCLDTAQQNLYRNVMLENYRNLVFLGIAVSKPDLITCLEQEKEPWNMKRHEMVAKSSVTCSHFAQDFWP

SEQ ID NO: 17913 - protein, 81 aa, Bos taurus
GRLMFQDVAIDFTQEEWESLDPSQRKLYRDVMVENYRNLASLGEDICLPESLIYPLHFCSVISRMSSEIFCFPQYFQICAL

SEQ ID NO: 17914 - protein, 81 aa, Gorilla gorilla
VTFEDVAVYFSWKEWGLLDEAQKCLYHDVMLENLTLTTSLGGSGAGDEEAPYQRSTSPQRVSQVRIPKALPSPQKTSPCEI

SEQ ID NO: 17915 - protein, 81 aa, Saimiri boliviensis
SWGPLSFMDVFVDFTREEWQLLDPAQKCLYRSVMLENYSNLVSLGYQHTKPDIIFRLEQEELCMVQTPIPNQCCPDKVWKI

SEQ ID NO: 17916 - protein, 81 aa, Neophocaena asiaeorientalis
GWVPLTFSDVAIDFSQEEWECLNSDQRNLYRDVMLENYTNLISLDIDFTSESNKLSSEKSSYEVNSYRRETMNRSKTFNFM

SEQ ID NO: 17917 - protein, 81 aa, Neophocaena asiaeorientalis
MLENYSHLVSMGHPVSKPDVIFKLEQGEDPWIIKRDIPNWIYPYEDQADGRQDRKSNLDNTQSCILGSVSFHNKILKGVTK

SEQ ID NO: 17918 - protein, 81 aa, Physeter macrocephalus
LQESFSFEDLSVDFTQKEWQLLAPYQKDLYKDVMLENYSSLVSLGYEVMKPGVILKLEHGEEPWTGDGEIPGSDSPEQVLQ

SEQ ID NO: 17919 - protein, 81 aa, Physeter macrocephalus
TDGLVTFRDVAINFSQEEWEFLDPAQRDLYVDVMLENYSNLISLDLESTYETKNTFAKKDIFEINFPQQEIKERSKTLGFE

SEQ ID NO: 17920 - protein, 81 aa, Physeter macrocephalus
PEGGVSFEDIALYFSWEEWKLLDEAQKLLYHDVMLENFALISSLGFWSGEEYVEASFEQSVSVVMSQVRTSKEPSSSQKTH

SEQ ID NO: 17921 - protein, 81 aa, Bos indicus x Bos taurus
MTKPDMIRKLEQGKELWTTEKFFQSQSYLEEDWKAEDVLVKFKEYQDRHSRSIISINHKRLIKERSNIWGKTFTIDKNHII

SEQ ID NO: 17922 - protein, 81 aa, Zalophus californianus
QGPMLFEDLAVYFSQEEYVSLHPVQRSLSRDTTQECFEDMALMGGEGKTEISQQLNLESTGFEELAPENSSITVPLIYYPE

SEQ ID NO: 17923 - protein, 81 aa, Macaca mulatta
VHGSVTFRDVAIDFSQEEWECLQPDQRTLYRDVMLENYSHLISLAGSSISKPDVITLLEQEKEPWIVVRKETSRWYPDLES

SEQ ID NO: 17924 - protein, 81 aa, Pan troglodytes
TLKEAVTFKDVAVVFTEEELRLLDLAQRKLYREVMLENFRNLLSVGHQSLHRDTFYFLKEEKFWMMEIATQREGNLGGKIQ

SEQ ID NO: 17925 - protein, 81 aa, Sapajus apella
MVSFEDVAVLLSQEEWDCLIPAQRGLYRDVMLETYGNLVSLGLQASKPDVISRLEQGDEPWTTHTLRMQGSWSWRHKREGC

SEQ ID NO: 17926 - protein, 81 aa, Muntiacus muntjak
TLKEAVTFTDVAVTFTEEELGLLDLAQKKLYQDVMLENFRNLISVGCHPFRHDIFHLEKEKRLWVVKTATQSEGKSEEKIQ

SEQ ID NO: 17927 - protein, 81 aa, Delphinapterus leucas
QEAVTFKDVAVAFTEEELGLLDSAQRKLYQDVMVENFRNLVSVEENNQSELRAVQDRGSREELSCWQIWQQIANDLTRCQD

SEQ ID NO: 17928 - protein, 81 aa, Delphinapterus leucas
KDQGSLTLEDVAVDFTWEEWQLLAPAQKDLYRDVMLENYSNLLSIGYQASKPDALSRLERGEPWPVEDEIHSQICPEMRKD

SEQ ID NO: 17929 - protein, 81 aa, Bos taurus
YQEFVTFEDVAVHLTREEWGCLDPVQRALYREVMLENYGNLVSLGILLRLPTTRIHSVNSCPALSHTQASAFSGETLAILS

SEQ ID NO: 17930 - protein, 81 aa, Balaenoptera acutorostrata
PQASVSFKDVTVEFTQEEWWQMDSAQRTLYRDVMLENYSHLVSVGYCFTKPELIFMLEQGEDPWLLEKEFVNRSSPEESQP

SEQ ID NO: 17931 - protein, 81 aa, Balaenoptera acutorostrata
SQDPVTFQEVAVDFSQEEWALLAPAQKILYRDVMLENYRNLASVGYHLRKPSLLTQEELRTKKRRIFQDTCADQNSQLKTK

SEQ ID NO: 17932 - protein, 81 aa, Balaenoptera acutorostrata
PQAKVTFEDVAVLLSQEEWDRLGPAQRGLYRHVMMETYGNVVSVGIPGSKPEVISQLERGEEPWVLDKQGNEGRRGLGIGR

SEQ ID NO: 17933 - protein, 81 aa, Balaenoptera acutorostrata
EEVPVVFEDVAVYFTREEWGALDKRQKELYRDVMRTNYELLASLGPAAAKPDLISKLERRAAPWIKDPDGPKWEKGRPPGK

SEQ ID NO: 17934 - protein, 81 aa, Callorhinus ursinus
PKVPVTFDDVAVHFSEQEWGNLSEWQKELYKNVMRGNYESLVSMDYAISKPDLMSQMERGERPTVQEQEDSEEGDTPADPS

SEQ ID NO: 17935 - protein, 81 aa, Rhinolophus ferrumequinum
NFWVLRLPPGSKGEVPKEWGKLDEWQKELYKHVMRGNYETLVSLDYAISKPEVLSQTEHGKEPCSWRRAGPKVPDVPVDPS

SEQ ID NO: 17936 - protein, 81 aa, Sus scrofa
PKVPVSFEDVSVYFTKTEWKLLDLRQRMLYKQVMLENYRHLVSLGFSFSKPHLVSQLERGEGPWVASHRMGAAAGMQAGDK

SEQ ID NO: 17937 - protein, 81 aa, Enhydra lutris
MAFRDVAVDFSQEEWMLLSPAQRSLYREVMLENYSNLVSLGIPFSKPKLIIQLEQGKETWREERTCPPATCPAEPKPELHL

SEQ ID NO: 17938 - protein, 81 aa, Enhydra lutris
YQEFVTFEDVAVHLTREEWGCLDPVQRDLYREVMLENYGNVVSLGFPLSKPDGISLREQDLQVFDLETKNREVLRDDCSDG

SEQ ID NO: 17939 - protein, 81 aa, Sus scrofa
PQDLVTFKDVAVDFSQEEWKWLNPAQRNLYRSMMLENYQSLVSLGLCISKPYVISLLEQGKEPWVMKSERTSSPFPDWESI

SEQ ID NO: 17940 - protein, 81 aa, Sus scrofa
LMEAVTFGDVAVHFSREEWQCLDPGQRALYKEVMLENHSSVAGLAGFLVFKPELISRLEQGQEPWVLDLQGTEGREAPRPS

SEQ ID NO: 17941 - protein, 81 aa, Ursus arctos
CWGLLSFKDISMEFTWEEWQLLDSTQKYLYRDVILENYSHLVSVGYHGTKPDLIFKLEQGEEPWIINAKVSRQSYPEGWKE

SEQ ID NO: 17942 - protein, 81 aa, Sus scrofa
MLENYSNLVSVGLSIPKPDVISLLEQGKEPWGVFDSEMTRGLNQDCGSRCETKEFSSKKDIYGIESCQWFSLGHLTKHGLD

SEQ ID NO: 17943 - protein, 81 aa, Neophocaena asiaeorientalis
SQGSLSFRDVTVGFTQEEWQHLDPAQRMLYRDVMLENYSHLISVGFCIPKPEVILKLEQGEEPWILEEESPSQSVPELIGS

SEQ ID NO: 17944 - protein, 81 aa, Vicugna pacos
GLTFKDVAIKFSQEEWECLDPAQRALYRDVMLETCRNLLSLAISHIHVIKKLKPKANSDIGEEFQTVMLGRHKSCEIRDFY

SEQ ID NO: 17945 - protein, 81 aa, Neophocaena asiaeorientalis
MTEEFATLEDVAMDFTLEDWEQLGLDQGDLFWDTALDNYQNLFLLNPPRPNLTSHPDDEEELAALAKGSPESTGPDTAEAK

SEQ ID NO: 17946 - protein, 81 aa, Phascolarctos cinereus
MLENYQNLLCLGLAVSKPEVICQLEQGEAPWRPEGRVPGSSHPDGEVRPETKESPPELGISVEQSSGQDRLRRHGLCVSSW

SEQ ID NO: 17947 - protein, 81 aa, Pongo abelii
IQGPLTFGDVAVAFTRIEWRHLDAAQRALYRDVMLENYGNLVSVGLLSSKPKLITQLEQGAEPWTEVREAPSGTHTVQDYW

SEQ ID NO: 17948 - protein, 81 aa, Pteropus vampyrus
MPFSNVTVAFTHEQWRHLVPAPRDKFKEGIPDKSRNLVLLGLPVSQPGMNSQLEQREGPWILEGNGLRTTCPDRKIVSQSP

SEQ ID NO: 17949 - protein, 81 aa, Pongo abelii
AQGLVTFRDVAIEFSLEEWKCLEPAQRDLYREVTLENFGHLASLGLSISKPDVVSLLEQGKEPWMIANDVTGPWYPDLESR

SEQ ID NO: 17950 - protein, 81 aa, Physeter macrocephalus
AQETMSFKDVAVDFTWEEWQLLAPLQKDLYRDVMLENYSNLLSVGYRVSKPDALSKLERGEEPWTIEDEIHSQTCPETGNV

SEQ ID NO: 17951 - protein, 81 aa, Pteropus vampyrus
AQGSVSFKDVTVDFTREEWQHLDPAQKTLYMDVMLENYCHLVSVGCRMTKPDVILKLERGEEPWTSFTGHTCLEETWKAED

SEQ ID NO: 17952 - protein, 81 aa, Pan troglodytes
FQELVTFRDVAIDFSRQEWEYLDPNQRDLYRDVMLENYRNLVSLEMRSRCVARVGLKLLVSSDPPTSTFQNAGIIGVSHRA

SEQ ID NO: 17953 - protein, 81 aa, Zalophus californianus
PLGLLSFKDISVEFTWEEWQLLDSTQKYLYRDVILENYSHLVSVGYHGTKPDLIFKLEQGEEPWIINAKVSRQSCPEGWKE

SEQ ID NO: 17954 - protein, 81 aa, Delphinapterus leucas
LQGSFSFEDLSVDFTQKEWQLLAPCQKDLYKDVMLENYSSLVSLGYEVMKPGVILKLEHGEEPWTGDGEIPGSDSSEQVLQ

SEQ ID NO: 17955 - protein, 81 aa, Ailuropoda melanoleuca
RESLTLEDVAVDFTWEEWQLLAPTQKNLYRDVMLENYRNLVSVGYVASKPDALSRLEQEEPWTTEDEIHSRFHPEIKKDDG

SEQ ID NO: 17956 - protein, 81 aa, Saimiri boliviensis
AQESLTLEDVTVEFTWEEWQLLDPCQKDLYRDVMLEIYSNLVSMGFQVSKPDALSKLERGEEPWTLEDERHSRICPENNKV

SEQ ID NO: 17957 - protein, 81 aa, Balaenoptera acutorostrata
SQGPVSFKDVAVDFTQEEWQQLDPDEKTTYRDVMLENYSHLVSVGYDSTKPNVILKLEQGEEPWVADGEFPRQFHSEEVWK

SEQ ID NO: 17958 - protein, 81 aa, Callorhinus ursinus
MDPAPEEWRLLNEAQRHLYRDVMLEVFALVASLGCGRGTEDEAAPSEQNVSVGGSQINSTQKAYTQEHGLDSESDLYSPSP

SEQ ID NO: 17959 - protein, 81 aa, Callorhinus ursinus
AQISVTFDDVAVTFTQEEWGQLDPAQRTLYQEVMLENCGLLVSLGCPVPRPELIYQLEHGQELWTWKRHLSQSAYPGRSQD

SEQ ID NO: 17960 - protein, 81 aa, Equus caballus
GQLTFRDVAIEFSQEEWESLDPAQRALYRDVMLENYRNLLSLGSISAEFAINKLSPREDIDKGKLYHLVILERNERHGVKD

SEQ ID NO: 17961 - protein, 81 aa, Callorhinus ursinus
EKPVTFDDVAVNFTQEEWVCLDASQRVLYQNVMSETFRNLMSVAPVRIFLSNPDLIIELEQEEKQWRAELQLHPPNGEGLP

SEQ ID NO: 17962 - protein, 81 aa, Erinaceus europaeus
GSVSFTDVTVDFTQEEWEQLDPSQRILYMDVMLENYSNLLSVEVWKADDQIEKEQRDPDEQAKQFVTFNNQTSTEERGNIS

SEQ ID NO: 17963 - protein, 81 aa, Tursiops truncatus
AQESLTYDDVTMKFTWEEWQLLDTDQKDLYRDVMLENYSNLLSIGYRASKPDALSRLERGEQLWPVEDDSHGRICPEIRKV

SEQ ID NO: 17964 - protein, 81 aa, Enhydra lutris
SQESVTFEDVAVDFTQEEWTLLDRSQRKLFRDVMLENISHLVSIGRQLYKSDTISHLEPGEHLSQEGLGLLQCQSLDREDD

SEQ ID NO: 17965 - protein, 81 aa, Vicugna pacos
YQEFVTFEDVAVHLTREEWGCLDPVQRDLYREVMLENYGNLVSLGYPVSKPDGIFQLEQDLQVFDLETKNREVLRDDYSDG

SEQ ID NO: 17966 - protein, 81 aa, Vicugna pacos
MFQVTFSDVAIDFSHEEWGWLDSAQRDLYKDVMVQNYENLVSLAGLSIPKPNVIALLEEGKDPWMVERKLSTGMFPDWDSR

SEQ ID NO: 17967 - protein, 81 aa, Leptonychotes weddellii
AQVCVISEDVFVFFSREEWMLLDDSQRLLYQDVMLENFALLASLGIVSSRSHAVTQLEQKEDPQMPDQVAMTPVTEREARR

SEQ ID NO: 17968 - protein, 81 aa, Odocoileus virginianus
MVQESVTFKDVAVLFTRDEWAQLSPAQRALYRDVMLENYSNLLSLGLLGSKPDMFSQLGKGEAWMPEDSLGGFCLDWVITP

SEQ ID NO: 17969 - protein, 81 aa, Pteropus vampyrus
KREAVTFKDVAVVFTEEELGLLDSAQRKLYRDVTLENFRNLVSVGHQSSKPDVISQLEREEKLRTTEASQAEAGGNENEME

SEQ ID NO: 17970 - protein, 81 aa, Pan troglodytes
PRGSTFFSSVTVAFAQGGWRCLVSTPRERFKEGIPGKSRSLVLLGLPVSQPGMNSQLEQREGAWMLEGEDLRSPSPGWKII

SEQ ID NO: 17971 - protein, 81 aa, Zalophus californianus
PQGLVTFGDVVVDFTPEEWQYLNPPQKTLYREVMLETYSNLVSVAGPQVTKPDLILKLEVEEPCPAETKISFWSFPEAACQ

SEQ ID NO: 17972 - protein, 81 aa, Vombatus ursinus
MLENYRNLVSLGHQISKPDVISQLEQGEEPWLVERKIPRDTFPDWESMPEISTSTLKQAISEKQSSQEVTMERFTRDFFCY

SEQ ID NO: 17973 - protein, 81 aa, Balaenoptera acutorostrata
YQELVTFRDVAVDFSREEWDCLNSSQRHLYSNVMLENYRILVSLGLCFSKPSVILLLEQGKEPWMVKRELTKDLCSDWESV

SEQ ID NO: 17974 - protein, 81 aa, Ursus maritimus
DEALMAFRDVAVAFTQKEWKLLSPAQRTLYRDVMLENYSHLVSLGIAFSKPRLITQLEQGDEPWREESECLLDLCPAEPGT

SEQ ID NO: 17975 - protein, 81 aa, Ursus maritimus
ARASLSFEDVAVGFSWEEWQLLAPSQKDLYRDVMLENYRNLVSVGYQASKLDSLFQSEQGGPPWTVEGAAQSQTCPEEIWE

SEQ ID NO: 17976 - protein, 81 aa, Ursus maritimus
RQKSLKFKDVAVKFSKDEWKRLVPTQRALYREVMLENYQGFISLGLLVPKPDVIFQLKRGEEPWKLDFQEDEKSEVPGSTF

SEQ ID NO: 17977 - protein, 81 aa, Phyllostomus discolor
MKFEDVAIAFSQEEWGLLDEAQRLLYCDVMWEIFNLVTSVGCLHKMEGDEIPSEQSVSIDGESQVSSSKIVPATQKTHPCE

SEQ ID NO: 17978 - protein, 81 aa, Rhinopithecus bieti
TSKEAVTFKDVVVFFTEEELRLLDSAQRKLYRDVMLENFRNLLSVGHQPFHRDTFHFLREEKFWMIDIATQREGNSGGRIQ

SEQ ID NO: 17979 - protein, 81 aa, Pan troglodytes
TQGQLSFSDVAIEFSQEEWKCLDPGQKALYRDVMLENYRNLISLGICLPDLSVTSMLEQKRDPWTLQSEVKIVNNPDGREC

SEQ ID NO: 17980 - protein, 81 aa, Pan troglodytes
CEASVSFEDVTVDFSREEWQQLDPAQRCLYRDVMLELYSHLFSVGYHIPNPEVIFRMPKEKEPRVEEAEVSHQRCQEREFG

SEQ ID NO: 17981 - protein, 81 aa, Sapajus apella
SPGSVTFTDVAIDFSQDEWEWLNLAQRSLYKKVMLENYRNLVSVGLCISKPDVISLLEQEKDPWVIKGEMTRGLCSDLEYV

SEQ ID NO: 17982 - protein, 81 aa, Delphinapterus leucas
AQGSVSFKDVTVDFSQEEWQHLDPAQKMLYMDVMLENYCHLVSVGCHMTKPDVILKLERGEEPWTSFTGHTCLEEKWKAED

SEQ ID NO: 17983 - protein, 81 aa, Sapajus apella
VHGSVTFRDVAIDFSQEEWECLQPAQRTLYRDVMLENYSHLISLAGSSVSKPDVITLLEQEKEPWMVVRKETSRWYTDLES

SEQ ID NO: 17984 - protein, 81 aa, Papio anubis
MVSFEDVAVLLSQEEWDCLIPAQRGLYRDVMLETYGNLVSLGLQASKPDVISRLEQGDEPWTPHILRTQRSWSWRHKRECY

SEQ ID NO: 17985 - protein, 81 aa, Aotus trivirgatus
MGPLTFRDVAIEFSLEEWQCLDTAQQNLYRHVMLENYRNLLFLGIAVCKPDLITCLEQGKEPWNMKRHAMVAKPPVVCSQD

SEQ ID NO: 17986 - protein, 81 aa, Zalophus californianus
SQESVTFEDVAVDFTQEEWTLLDRSQRKLFRDVMLENISHLVSIGRQLYKSDTISHLEPGEHLSKEGRGLLQCQSLDREDD

SEQ ID NO: 17987 - protein, 81 aa, Carlito syrichta
FQESVTFKDVIVDFTQEEWKQLDPVQRDLFRDVTLENYTHLVSIGLQVSKPDVISQLEQGTEPWIMEPGIPVGTFADWETR

SEQ ID NO: 17988 - protein, 81 aa, Zalophus californianus
MLETYRHLLSVGNQIAKPEVISLLEQGEEPWSVEQAYPQSTCPEWMRNLESKALIPTQSIFEEEQSHSMKLERYIWDDPWF

SEQ ID NO: 17989 - protein, 81 aa, Balaenoptera acutorostrata
MLETYSSLVSLGHCITKPEVIIKLEQGAAPWTVKETPDQGFPDVQIVDDLIETSQENHGRRLWQVVITSNKTSTKGTTDLG

SEQ ID NO: 17990 - protein, 81 aa, Vombatus ursinus
MISQLEQGEEPWILEREISRCIYSDRETRPEIEESTTKQVISTEELSQEKCKRDGCQDFKLGKTWGYEVMLEKQQGNQERP

SEQ ID NO: 17991 - protein, 81 aa, Balaenoptera acutorostrata
MLETYSNLVSVGYEGTKPYVILRLEQEEAPWICEASCSGCHCFENIWQGNVQKKRQQDMLLRQGTFISKKTLPKERSHECN

SEQ ID NO: 17992 - protein, 81 aa, Callorhinus ursinus
WSQMPVTFEDVALYLSREEWGRLDHAQQSFYRDVLQKRNGLSLGFPFSRPFWASQGQGKGEASSSCRQMGDEEEKPGATEM

SEQ ID NO: 17993 - protein, 81 aa, Callorhinus ursinus
QSRGPLSFVDVFVDFTWEEWRLLDPTQKHLYRSVMLENYSNLVSLGYQDSKPDIIFKLEQEELWMMQAQIPSQGHPEKVWE

SEQ ID NO: 17994 - protein, 81 aa, Callorhinus ursinus
FKETVTFKDVAVVFTEEELGLLDPAQRKLYGDVMLENFRNLISVGGKIQSKMKTIIEAEPPEELSCWRIWQQIASDLTRCQ

SEQ ID NO: 17995 - protein, 81 aa, Callorhinus ursinus
LQKSVTFEDVAVYFTQTEWDGLSPAQRALYRDVMLENYGNVASLGFSLFKPAVISQLEGAGELGGPSPLVDGTETGPQGLW

SEQ ID NO: 17996 - protein, 81 aa, Rhinolophus ferrumequinum
SQSLVTFGDVAVDFSQEEWERLNSAQRGLYRDVMLENYRSLVSLGLCFSKPDMISSLEQRKEPWMPKRKLMRGQCPGWKAV

SEQ ID NO: 17997 - protein, 81 aa, Phyllostomus discolor
MAEGLKFKDVAIFFSQKEWECLHSAQKDLYRAVMLENYNNLILLGLSDSKPDVISLLEQGKEPWIVKRKETKEWCPDWESR

SEQ ID NO: 17998 - protein, 81 aa, Ursus maritimus
QGPMLFEDLAVYFSQEEYVSLHPAQRSFSRDTTQECFEDMALMGGEGKTEISQQLNLESTGFEELAPESSSITVPLVYYPK

SEQ ID NO: 17999 - protein, 81 aa, Camelus dromedarius
RLTFEDVAIEFSQEEWECLDPAQRALYGEVMLETYRNLVSLGLTSKDSCSLRRKPRRGWRDQKRTREWPLLRFVIASSFNS

SEQ ID NO: 18000 - protein, 81 aa, Acinonyx jubatus
SVAFEDVTVNFTLEEWALLNPSQKKLYRDVMQETFRNLASVGDKWEDRNSKSLYEHETNRRRVVESPCHSKEGSQRGDPRR

SEQ ID NO: 18001 - protein, 81 aa, Acinonyx jubatus
SQEPVTFEDVAVYFTQNQWTSLDPMQRALYREVMLENYANMTSLGAFPFPKPELILQLERGEAPRGLDPWTPMGGEAPGDV

SEQ ID NO: 18002 - protein, 81 aa, Odocoileus virginianus
LEEEETEQESEMALSQAQLTFKDVAIEFTQEEWECLDPAQRALYRDVMVETLRNLVSLGEDDFPLKLGSALGYHCISHCVI

SEQ ID NO: 18003 - protein, 81 aa, Odocoileus virginianus
QLTSEDVAIEFTQEEWEFLDPAQRALYRDVMMETYRNLLSVDISPTHVIKRLQPKANSDKREPFQTLMLGRSESCEIKHFH

SEQ ID NO: 18004 - protein, 81 aa, Cebus imitator
FQELVTFRDVAIDFSRQEWEYLDPHQRDLYRDVMLENYRNLVSLGGHSISKPVLVDLLEQGKEPWMILREETQFPDLDLQC

SEQ ID NO: 18005 - protein, 81 aa, Cebus imitator
PQESVAFDDVAVYFTKKEWGMMVPDQRALYRDVMLENCEAVVLVAVPPTSKPALGSHLEQGKEPCSTQPQGVLSRRDWRAG

SEQ ID NO: 18006 - protein, 81 aa, Callithrix jacchus
MEPLGFRDVAIEFSLEEWHCLDTVQRNLYWDVMLENYRNLVFLGIFVSNPDLTTAPVMHSHFAQDLWPEQGIKDSFQKMIL

SEQ ID NO: 18007 - protein, 81 aa, Zalophus californianus
MYFSQEEWELLDPTQKALYNDVMRENYETVISLAVPAHQILAFPEQIITKDWTVAPELVLPESQSLLTFEEVAMYFSQEEW

SEQ ID NO: 18008 - protein, 81 aa, Zalophus californianus
VFKEAVTFKDVAVAFTEEELGLLDSAQRKLYQDVMLENFRNLVSVGHQPFKRDKWHIEREERPWLMKTATPIERNVGGSNQ

SEQ ID NO: 18009 - protein, 81 aa, Delphinapterus leucas
AQELVTFEDVAVYFIRKEWKRLEPAQRDLYRDVMLENYGNVFSLDGETRTEHDPEISEDTGSHGVLLGRFQKDISQGLKFE

SEQ ID NO: 18010 - protein, 81 aa, Phyllostomus discolor
AQEFLTFHDVAVDFTLEEWQLLDSDQKDLYRDVMLENYSNLVSVGYESSNPDVFSKLDHGETPWTEEGEIHCGNHSEIWKL

SEQ ID NO: 18011 - protein, 81 aa, Phyllostomus discolor
AHESVTFNDVFIVFSQEEWEYLDLQHRDLYRDVMLENYSNLVSLGCFIAKPDVISLLEQGKEPWKVVRKERTLYSDLGTKC

SEQ ID NO: 18012 - protein, 81 aa, Acinonyx jubatus
WSQMPVTFEDVALYLSREEWGRLDHAQQNFYRDVLQKRNGLSLGFPFSRPFWASQGQGKGEASGSCRQMGDEEKTGAIEVG

SEQ ID NO: 18013 - protein, 81 aa, Rhinopithecus roxellana
FQAKLTFEDVAVLLSQDEWDRLCPAQRGLYRNVMMETYGNVVSLGLPGSKPDIISQLERGEDPWVLDRKGTKKSQGLWSDY

SEQ ID NO: 18014 - protein, 81 aa, Bison bison
HQGSVTFEDVAMYFSWEEWCLLDEAQIQLYLDVMLENFALVCMLGSWRGVQDKETPSEEIKPAGVLQFRTPRAGLSPEKTQ

SEQ ID NO: 18015 - protein, 81 aa, Bison bison
SQGRLTFQDVAIDFTQEEWECLDLGQRELYRDVMLENYRNLASLGLVVSKLDLVTFLEQMKNPWDVRRLEPPAIYTGCRIL

SEQ ID NO: 18016 - protein, 81 aa, Bison bison
MDPVAFEDVAVNFTLEEWALLGPSQKKLYRDVMRETLSNLALIRDKWEDHNTEDQYKNQERNLRSHILQRLCESKEGSQGG

SEQ ID NO: 18017 - protein, 81 aa, Bison bison
KEAFVTLRDVAGGFTQEEWKLLSPAERTLHTEVMLEAYNHLVSLDILFSKLQLICQLEQGEEPWIEERQRSLGLCPAGSKL

SEQ ID NO: 18018 - protein, 81 aa, Odocoileus virginianus
LQELVTFKDVAVDFTEEEWEHLDPSQRHLYREVMLENFGNLISLGHLLSEPEMIFHFEQEDDVWMEETISRSSYSGVRDEN

SEQ ID NO: 18019 - protein, 81 aa, Odocoileus virginianus
HQGSVTFEDVAMYFSWEEWCLLDEAQIQLYLDVMLENFALVCMLGFWCGTQDGETPSEQSESAGVSQISTPRAGSSPENVQ

SEQ ID NO: 18020 - protein, 81 aa, Odocoileus virginianus
AQELVTFEDVAVYFIRKEWKRLEPAQRDLYRDVMLENYGNVFSLDGETRTEPDSEISEDTGSHRVLLGRFQKDISQGLKFE

SEQ ID NO: 18021 - protein, 81 aa, Odocoileus virginianus
QESVTFKDVAVDFTLEEWGRLGPGQRELYRDVMLENYQNLLSLGAGFPGAKPDVISRLERGEEPRMERRETQQVTCPDLET

SEQ ID NO: 18022 - protein, 81 aa, Cebus imitator
RREQVTFEDVVVDFTQEEWGQLEPAQRTLYCDVMLDTFRLLVTVGHWLPKPNIISLLEQEAELWAVDPGVPQGVYQDLESR

SEQ ID NO: 18023 - protein, 81 aa, Cebus imitator
RSLGSLEMEPLTFGDVAIEFSLEEWKCLNPAQRNLYRNVMLENCRNLAFLGIAISKPYLITYIEKAKEHWNMKHGMVDEPP

SEQ ID NO: 18024 - protein, 81 aa, Cebus imitator
HLTFMDVAIEFSQEEWKCLDPAQQALYRDVMLENYRNLVSLGRSCILRSNAGNKRIKNQLGLTLESHLSELQLFQAARKIY

SEQ ID NO: 18025 - protein, 81 aa, Sapajus apella
MDVMLENYCHLMSVGCHMTKPDVILKLERGEEPWTSFADHTRLEENWKAEDFLVKFREHREKYSRSVVSINHKKLVKEKSK

SEQ ID NO: 18026 - protein, 81 aa, Papio anubis
PQGLLTFRDVAIEFSQEEWKCLDPSQRTLYRDVMLENYRNLVSLDISSKCMMKTLSSTGQGNTEVILKGTLQRQASHHIGE

SEQ ID NO: 18027 - protein, 81 aa, Delphinapterus leucas
SQSLLTFEEVAIYFSQEEWELLDPTQKALYNDVMQENYETVISLALFVLPKTKVICCLEQGEEPWVQRSPIFKDSPGELFS

SEQ ID NO: 18028 - protein, 81 aa, Equus caballus
SQESVTFEDVAVVFTQEEWALLDTSQRKLFRDVMLENISHLVSIGSQFYKSDVISHLEQGEQLSREGICFLQGQSPDWEGD

SEQ ID NO: 18029 - protein, 81 aa, Ovis aries
GSVSFTDVTVDFTQEEWEQLEPSQRILYMDVMLENYSNLLSVEVWKADDQMETDHRNPDEQARPLVIFKDQTPTEERDNNL

SEQ ID NO: 18030 - protein, 81 aa, Vulpes vulpes
QGPLLFEDLAVYFSQEECVSLYPAQRSLSRDITLECFKDMALMGGEGKTEIPQQLNLESTGFEELSPENSIAVPLVYYPEK

SEQ ID NO: 18031 - protein, 81 aa, Vulpes vulpes
PLESVTFEDVAIDFSKEEWALLDMSQRKLFRDVMLENIRHLVSLGYQHCKSDVVFQLEQGEELWSEGTGFLQGQSPGRESA

SEQ ID NO: 18032 - protein, 81 aa, Acinonyx jubatus
GRLTFRDVAIEFSQEEWECLDPAQRALYRDVMLENYRNLVSLGSPSAGFVIKELSPIEDINKGELCHLVILERNESHDIQD

SEQ ID NO: 18033 - protein, 81 aa, Bison bison
CEGSVSFRDVAVDFSREEWQQLDLDQKNLYRDVMLETCSHLLSIEELWQIGDQIESYHQRENRSLRNVAFIKKVLTIQRDY

SEQ ID NO: 18034 - protein, 81 aa, Bison bison
FQESVTFEDVAVNFSHEEWQCLTHAQRHLYKDVMLENYGNMVSLGFSFSKPPLISHLEQGAEPYVQDRQDWEFLSCSYPVS

SEQ ID NO: 18035 - protein, 81 aa, Bison bison
QSQLTLNDVAIHFSPEEWECLDPAQRALYVDVMLDTFRNLLSVDISHLHIWKLQLKSHTDRGGVCRTVIWGRNEIPETKHF

SEQ ID NO: 18036 - protein, 81 aa, Bison bison
CQDPVTFEDVAVVFTDEEWRRLVPTQRDLYKEVMLENYNSIVSLGLPVPGPDVIFQLKRGDEPWLVEFHGFEGKEGAENVS

SEQ ID NO: 18037 - protein, 81 aa, Bison bison
MSKPDVVSLLEQGKEPWLGNGDVSRELFPASKSNGEIKEFSPKNVIFEDDSSQYLIMERFLSQGSEYSSFKEGWKCEGDTE

SEQ ID NO: 18038 - protein, 81 aa, Bison bison
VTAAQAGMKFEDVAIDFSQEEWGLLDEAQRLLYYSVMLENFALVASLDFHWQHRDDSGEKPWERDVERVSFVRSCHLFVSG

SEQ ID NO: 18039 - protein, 81 aa, Odocoileus virginianus
AWSQMPVTFDDVALYLSREEWGRLDHTQQSYREVLQKRSGLSLGFPFSRPFWASQVQGKGEAPGSSRQLGHEEEEKRGLPW

SEQ ID NO: 18040 - protein, 81 aa, Odocoileus virginianus
SLAFEDVAVNFTLDEWVLLDSSQRKLYRDVMRENFRNVVSVEAKQEDHDIEDQDKNQERKLRNPKAERHSEKRDINSSEES

SEQ ID NO: 18041 - protein, 81 aa, Odocoileus virginianus
SLGSVSFRDVAVDFTQEEWQHLDPEQKTTYRDVMLENYSHLISVGCHIIKPEVITKLEQGEEPWVVEGEFLLHSRPEEVWK

SEQ ID NO: 18042 - protein, 81 aa, Cebus imitator
FQASVSFKDVTVEFTQEEWQHMGPVERTLYRDVMLENYSHLISVGYCFTKPELIFTLEQGEDPWLLEKEKGFLSRTSPEDS

SEQ ID NO: 18043 - protein, 81 aa, Cebus imitator
WLQEPMTFKDVAIEFTQEEWIMLDSAQRSLYKDVMLENYQNLTSVEYQLCKLTVISPLHQKEIRNMKKRNLQGLCPDQKIQ

SEQ ID NO: 18044 - protein, 81 aa, Macaca mulatta
FMGSLSFEDVTVGFTQEEWQHLDPAQRTLYRDVMIENYSHLVSVGYCIPKQEVIFKLEQGEQPWILEEELPGQRYPDELAC

SEQ ID NO: 18045 - protein, 81 aa, Vulpes vulpes
SQGLLSFSDVSVDFTWEEWQLLDTVQRNLYRDVMLENYSNLISLGYQATRPEAMVYLEEGEQGVVEREFLSQCSPERPLQC

SEQ ID NO: 18046 - protein, 81 aa, Rhinolophus ferrumequinum
PQVKVTFEDVAVFLSQEEWDHLCPAQRGLYRHVMMETYGNVVSLGLPGTKPNVISQLERGEEPWVLDGQGTAESRGLGSGH

SEQ ID NO: 18047 - protein, 81 aa, Camelus dromedarius
KDQGSLTLEDVAVDFTWEEWQLLAPAQKALYRDVMLENYSHLVSVGYQASKTDVLSRLGRGELWTVEDEICGQICPGELEI

SEQ ID NO: 18048 - protein, 81 aa, Ursus maritimus
CQGSLSFRDVAVGFTRKEWQQLEPAQRTLYRDVMLENYSHLVSVGCQVTKPAVISRLEQGQEPWMEEEEILRWSFPEEILQ

SEQ ID NO: 18049 - protein, 81 aa, Ursus maritimus
MLENYHNFVSVGYLIKKPALIFKLEEGKEPWILEEEFLYQNYPEDSKAYYLTERMQRNQDKYVPQVLFNNKTVTSEKVYAL

SEQ ID NO: 18050 - protein, 81 aa, Phyllostomus discolor
FQGSLTFQDVAVDFTSEEWQLLDCDQRTLYWDVMLENFRNLISLGAPVTKPKAVFKVEQGPELQVVEAESPHWSHLEADCP

SEQ ID NO: 18051 - protein, 81 aa, Phyllostomus discolor
MAVTFEDVTVIFTWEEWKFLDFSQKKLYREVMYENYTNVMSLGNWKESYKPPKERLRYLEHENLFRWQGWRNVSPQSYENQ

SEQ ID NO: 18052 - protein, 81 aa, Phyllostomus discolor
PQVKVTFEDVAVLLSQEEWDQLGPAQRGLYRHVMMETYGNVVSLGLPGTKPNVISQLERGEEPWVLDGHGAKESKGLGSSG

SEQ ID NO: 18053 - protein, 81 aa, Rhinopithecus roxellana
MASVALGDVAVNFTREEWALLGPCQKNLYKDVMQETIRNLNCVGMKWKDQNIEDQYKYSRKNLRCRMLERFGENKDGSKWG

SEQ ID NO: 18054 - protein, 81 aa, Acinonyx jubatus
LLTFRDVAIEFSQDEWGCLNQSQRELYRDVMLETCGHLLFLAISSHGTQNLLPKPCIETSSQNVSLGTGKHHAFENLHLMI

SEQ ID NO: 18055 - protein, 81 aa, Rhinopithecus roxellana
LKDLVTFKDVAIDFSQEEWQWMNPAQKHLYRSMMLENYQSLVSLGLCISKPYVISLLEQGREPWEMTSEMTRSPFSDWESI

SEQ ID NO: 18056 - protein, 81 aa, Rhinopithecus roxellana
LLKKVTFEDVAIDFTQEDWAMMDTSKRKLYRDVMLENVSHLVSRGYQTSKSYVILQLERGKEPWREGREFLQGQNLDKESA

SEQ ID NO: 18057 - protein, 81 aa, Acinonyx jubatus
SVGLLTFRDVAIEFSQEEWGCLNQSQRELYRDVMLETYGHLLFLGLIVSKPHLVIFLEQKRELWDVKRKKTVASPAAIASH

SEQ ID NO: 18058 - protein, 81 aa, Rhinopithecus roxellana
EDVAVNFSQEEWSLLSEVQRCLYHDVMLENWVLISSLGYWCGSEDEEAPSKQSISIQRVRSLRLSAQAGVSRSQLTAASAS

SEQ ID NO: 18059 - protein, 81 aa, Rhinopithecus roxellana
TCELVMFRDVAIDVSQEEWECLNPAQRNLYKEVMLENYSNLVSLGLSVSKPAIISSLEQGKEPWMVVREETGRWCPGTWKT

SEQ ID NO: 18060 - protein, 81 aa, Bison bison
MYKDVMLENYRNLVSLGHQLPKPDVILRLEKGEEPWLVEREIHQETQPDLETSVEIKSTSSKSISNDKYSCDVKMERMPKS

SEQ ID NO: 18061 - protein, 81 aa, Bison bison
FTFKDVAVEFTQEEWECLDPIQRALYRDVMLETYRNLLSLVKELSSPKEDISKGELCHLMTLEKNETYGIKDFDLKEICEN

SEQ ID NO: 18062 - protein, 81 aa, Odocoileus virginianus
CEGLVSFEDVTMDFSREEWQQLDPAQRHLYQDVMLEIYSHFFSVGYHIPNPEVIFRIEEGKEPWVRETELPCQRYHEGEFG

SEQ ID NO: 18063 - protein, 81 aa, Odocoileus virginianus
TFKEAVTFTDVAVTFTEEELGLLDLAQKKLYQDVMLENFRNLVSVGCYRFRYHIFHLEEEKRLWVVKTATQREGKSEEKIQ

SEQ ID NO: 18064 - protein, 81 aa, Odocoileus virginianus
GEIESISFEDVAVNFTLEEWQLLNPTQKILYRDVMLENYSNLVLLGYQVIKPEMIFKLEQEKPWLLDEEILSQNFSEKVWL

SEQ ID NO: 18065 - protein, 81 aa, Cebus imitator
DAVVFEDLLVEFTLDEWALLNPAQRKLYRDVMLETFQNLASVGTVPSFLPLSGVSEQSGQHGETLNPRVERPRKSGKGSKR

SEQ ID NO: 18066 - protein, 81 aa, Cebus imitator
RVTFKDVAVVFTNEELALLDKTQINLYQDVMLENFRNLISVGDKIENNILNLQEKGLSYLSQEGLHCWQIWKQRIWDLTVS

SEQ ID NO: 18067 - protein, 81 aa, Balaenoptera acutorostrata
SQGLVTFRDVALNFSQEEWEWLDSSQKDLYRDVMLENYRNLVWLGLSISKPNMISLLEQGKDPCMVERETSDGQYAEGDSL

SEQ ID NO: 18068 - protein, 81 aa, Vombatus ursinus
FQGSVTFRDVAVTFSHEEWGHLDPSQKALYCEVMLENYRNMVCLGLAASQPNVMDQLERGEAPWTPEGDGAWSSFADWETR

SEQ ID NO: 18069 - protein, 81 aa, Ovis aries
YQEFVTFEDVAVHLTREEWGCLDPVQRALYREVMLENYGNLVSLGFPIFKPGGISQLEQDLQVFDLETKNREVLRDDCSDG

SEQ ID NO: 18070 - protein, 81 aa, Callorhinus ursinus
YQGPVTFKDVIVEFSREEWQLLSAAQRTLYREVMQENYGLLISVGYRVKKPNAVFKLKQGKEPWILEVEFPHRNYPEDLWK

SEQ ID NO: 18071 - protein, 81 aa, Callorhinus ursinus
MEELGLLDSTQRKLYRDVMLENFRNLLSVGYEPFRLDTTLLLGREEKLWMMETQAPGDGRSGLRNQNEIETFQKVGLRYLL

SEQ ID NO: 18072 - protein, 81 aa, Callorhinus ursinus
SQSLVTFGDVAVDFSQEEWEWLNSAQRNLYRSVMLENYRNLVSLGLCVSKPDMISSLEQRKEPWMVKRKLTRGRCPDLKTV

SEQ ID NO: 18073 - protein, 81 aa, Rhinolophus ferrumequinum
CEVSVSFEDVTVDFSREEWQQLDSNQRRLYQEVTLENYSHLLSVGYEVPKPEFIFKLEQGEEPWILEGETPHQSCLDGKFG

SEQ ID NO: 18074 - protein, 81 aa, Rhinolophus ferrumequinum
MAFRDVAVDFTQEEWMLLSPAQRSLYREVMLENYSNLVSLGIPFSKPKLITQLEQGKETWREERKCLPATCPAEPKQELHF

SEQ ID NO: 18075 - protein, 81 aa, Rhinolophus ferrumequinum
ESVTLRDVTVDFTQEEWQQLEPAQKDLYRDVMLETYRNLVSLDLETKPDVKESDLKEGISESRPSAGVVVEGPTRNGAWRS

SEQ ID NO: 18076 - protein, 81 aa, Callorhinus ursinus
MYFTREEWNKLEWAQKDLYRDVMLENYRNMILLGFQFPKPEVICLLEQWEEPWILDLPRAGTRKASSSACPGSEARCKMKK

SEQ ID NO: 18077 - protein, 81 aa, Ursus maritimus
SQGLLTFGDVAIEFSQEEWRCLSHTQRELYRDVMLENYGHLLFLGLIVSKPDLVSFLEQTKEPWDVKRRKTVVFDPAMISP

SEQ ID NO: 18078 - protein, 81 aa, Rhinopithecus roxellana
EKGPLTFRDVAIEFSLEEWQCLDTAQQDLYRKVMLENYRNLVFLAGIAVSNPDLITCLEQGKEPWNMKRHAMADEPPVIYS

SEQ ID NO: 18079 - protein, 81 aa, Acinonyx jubatus
TQASVSFKDVTVEFTQEEWQQIGPIQRTLYRDVMLENYNNLVSVGNCIFKPAVIFKLEQGEEPWFLEEEFLNQSHQEDYRD

SEQ ID NO: 18080 - protein, 81 aa, Rhinopithecus roxellana
AQGTVTFEDVAVHFSWEEWGLLDEAQRCLYRDVMLENLALLTSLDVHHRKQHLGEKHFRGNVDRALFVKTCTFHVSGEPST

SEQ ID NO: 18081 - protein, 81 aa, Rhinopithecus roxellana
GLVTFGDVAVDFSQEEWEWLNPNQRNLYRKVMLENYRNLASLGKGDCISVWTPDVISSLEQGKEPWTVKRKMTRAGCPDLK

SEQ ID NO: 18082 - protein, 81 aa, Bison bison
HQEVVTFEDVAIYFTRTEWAGLSPAQRALYRSVMLEIYRSLTSLDSRTHMDSELTPTWGISEERDLMMSHGPQKNVLNKSS

SEQ ID NO: 18083 - protein, 81 aa, Odocoileus virginianus
IQASVSFKDVTVEFTREEWHQMDSAQRTLYRDVMLENYSHLVSVGYCFTKPELIFMLEQGEDPWLLEKEFINRSSPEESQP

SEQ ID NO: 18084 - protein, 81 aa, Odocoileus virginianus
MPEKSRNLVLLGLPVSQPGMNFQLEQREGSWMLKRDDLRNACPDWKIISESPPEQDISEESFQDPSVEMPSGEPEHRNSEL

SEQ ID NO: 18085 - protein, 81 aa, Odocoileus virginianus
MTESVTFRDVAVVFSRDEWLHLDAAQRSLYREVMLENYSTLVSLGIPFSMPKLICQLQQGEDPCMVEREIPQDTCLGFKTW

SEQ ID NO: 18086 - protein, 81 aa, Odocoileus virginianus
LQELVTFKDVAVDFTEEEWEHLDPSQRHLYREVMLENFGNLISLAGHLLSEPEMIFHFEQEDDVWMEETISRSSYSVRDEN

SEQ ID NO: 18087 - protein, 81 aa, Odocoileus virginianus
LQEPVTFRDVAVDFTQEEWGQLGPAQRTLYRDVMLETFGHLLSVGPELPKPDVISQLEQGAELWVVEGGLAQGCHPLWETG

SEQ ID NO: 18088 - protein, 81 aa, Odocoileus virginianus
SQEAVTFKDVAVVFTEEELGLLDSAQRKLYQDVMVENFRNLVSVGHVPFKADMVSQLETEGKLWTVERETQRNGHSSEIHS

SEQ ID NO: 18089 - protein, 81 aa, Sapajus apella
TQGSLTFKDVAIEFSQEEWKCLDPLQKALYRDVMLENYRNLGFLAGLCLPDLNIISMLEQGKEPWTVVSQVKITRNPNWGE

SEQ ID NO: 18090 - protein, 81 aa, Sapajus apella
FQGPVTLKDVIVEFTKEEWKLLTPAQRTLYKDVMLENYSHLVSVGYRVNKPNVVFKLKQGKEPWMLEVEYPHRGLPEDLRN

SEQ ID NO: 18091 - protein, 81 aa, Delphinapterus leucas
MAFRDVAVDFTQEEWMLLSPAQRSLYREVMLENYSNLVSLGIPFSKPKLITQLEQGKETWREERKCPPATGPAEPKPELHL

SEQ ID NO: 18092 - protein, 81 aa, Delphinapterus leucas
HQEVVTFEDVAVYFTQTEWAGLSPAQRALYRSVMLEIYGNLTSLGYPVPKPALVSLLERGDLPWGLETQDDPPAQGTKHIC

SEQ ID NO: 18093 - protein, 81 aa, Sapajus apella
AQGSVSFNDVTVDFTQEEWQHLDHAQKTLYMDVMLENYCHLMSVGCHMTKPDVILKLERGEEPWTSFADHTRLEENWKAED

SEQ ID NO: 18094 - protein, 81 aa, Sapajus apella
MLENYRNLAFLGIAVSKPDLITCLEKEKGPWNMKRHEMVDEPPGICPHFAQDLWLQQGMEDSFQKVILRRYEKSGRDNLQL

SEQ ID NO: 18095 - protein, 81 aa, Ovis aries
SQGLVTFKDVAVCFSQDQWSDLDPTQKEFYGEYVLEEDCGIVVSLSFPIPRLDELSHVREEEPLVPEPQEPEEPEILSFTY

SEQ ID NO: 18096 - protein, 81 aa, Callorhinus ursinus
AQESLTFDDVAVDFTWEEWRLLAPAQKDLYRDVMLENYRNLVSVGFHTSKQDVLSKLDQGEPTWTVEDDIPCQSHSETWKL

SEQ ID NO: 18097 - protein, 81 aa, Callorhinus ursinus
PLTFRDVAVVFTEEELRLLDCAQRKLYQDVMLENFRNLLSVGDKNEKEMEYIQERELKCLSSRELSYWKIWEQVTGELTGS

SEQ ID NO: 18098 - protein, 81 aa, Callorhinus ursinus
AQVLVTFKDVAVTFTQEEWGQLDLDQRALYQEVMLETCGLLGSLGHPVPKPELTHLLEHGQELWTGKRGLSRSTCSGDSAK

SEQ ID NO: 18099 - protein, 81 aa, Rhinolophus ferrumequinum
KVPVTFVDIAVYFSEDEWKNLDEWQKELYNNLVKENYKTLMSLDAEGPVPKPDAPPQVEPREEPCVWEQRDPEEREILMDP

SEQ ID NO: 18100 - protein, 81 aa, Phyllostomus discolor
QAKVTFEDVAVLLSPEEWGHLGPAQRGLYRDVMLETYRNLVSLGAGPAGPKPGVITQLEQWDEPWVLDTQGAEGRERLGVD

SEQ ID NO: 18101 - protein, 81 aa, Acinonyx jubatus
EQESVTLKDIAVDFTQEEWALMDTSQRTLYRDVMLENISHLVSVGCHFFRSDVISPWEQRGELWREERGPPQGWSPGMKKS

SEQ ID NO: 18102 - protein, 81 aa, Rhinopithecus roxellana
FSDSMTFEDIVVDFTREEWALLDTSQRKLFQDVMLENISHLVSIGKQLCKSVVLSHLEQVEKLSTQGISLLQGREGDIKHQ

SEQ ID NO: 18103 - protein, 81 aa, Rhinopithecus roxellana
WSQMPVTFEDVALYLSREEWGRLDHMQQNFYRDVLQKRNGLSLGFPFSRPFWAPQAQGKGEASGSSRQTGDEKEEWRGAYT

SEQ ID NO: 18104 - protein, 81 aa, Rhinopithecus roxellana
GQLTFKDVTIEFSQEEWKCLDPAQKTLYRDVMLENYRNLVSLDISCKCVNEDLPPKGKNNMGEAFHMVKLERLESRDEVLS

SEQ ID NO: 18105 - protein, 81 aa, Rhinopithecus roxellana
ESRPGTVSFADVAVYFSPEEWGCLRPAQKVLYRDVMRNTFGHLGALGFSGPKPAFISGVEAWSPEAQDPEGESPAAVSRGQ

SEQ ID NO: 18106 - protein, 81 aa, Rhinopithecus roxellana
SKAPITFGDLAIYFSQEEWEWLSPIQKDLYEDVMLENYRNLVSLGLSFRRPNVITLLEKGKAPWMVEPVRRRRAPVLTKAS

SEQ ID NO: 18107 - protein, 81 aa, Rhinopithecus roxellana
GLEMEALTFRDVAIEFSLEEWQCLDIEQRNLYRHVMLDNYRNLVFLDIAVSKPDLITCLEQEKEPWNVRMHDMVAKPPGLQ

SEQ ID NO: 18108 - protein, 81 aa, Bison bison
MKPAQRNLYRDVMLENYSNLVTVGCQVTKPDVIFKLEQEEEPWVVEEEMLGRHCPEVWKVDEQIKKQQETLVRNVTSISKK

SEQ ID NO: 18109 - protein, 81 aa, Odocoileus virginianus
SQGSLSFRDVTVGFTQEEWQHLDPAQRMLYRDVMLENYSHLISVGYCIPKPEVILKLEQGEEPWILEEEYSRQSVPELINS

SEQ ID NO: 18110 - protein, 81 aa, Odocoileus virginianus
MLENYGHLVSLAGLNISKPDVVSLLEQGKEPWLGNGDVSRELFPASKPNGEIKEFSPKNVIFEDNSSQYLIMERFLSQGSE

SEQ ID NO: 18111 - protein, 81 aa, Odocoileus virginianus
HQAVVTFEDVAVYFTRTEWAGLSPAQRALYRSVMLEICGNLMSLGYPIPKPTLVSLLERGDLLAGLETQDNPPAQGTEEIY

SEQ ID NO: 18112 - protein, 81 aa, Odocoileus virginianus
QGPVTFEDVAVYFSREEWGLLNLTQRSLYCHVMLENFALIGSLGCLCRLQDEDAPRELGESCRVRLPEKPSLCGTSGRAFP

SEQ ID NO: 18113 - protein, 81 aa, Odocoileus virginianus
RPRAVKFGDVALYFSREEWGCLRPAQRALYRDVMQETYGHLGALGCAGPKPALISWLERNTDDWEPAALDPQECPKGVAVQ

SEQ ID NO: 18114 - protein, 81 aa, Cebus imitator
GPLEFMDVAIEFSLEEWQCLDTAQRNLYRDVMLENYRNLVFLEFQKPFFQKLLRIFMCSHFAKELWPEQSTKDSFQKVILR

SEQ ID NO: 18115 - protein, 81 aa, Aotus trivirgatus
AQESVTFKDVSLDFSWEEWIQPDCAQRMTAYGNVMLENYRNLVSLGNNLSKSNVTSQLEREELNLMKKELPEGGFPDWETR

SEQ ID NO: 18116 - protein, 81 aa, Zalophus californianus
MTKPDMIRKLEQGEELWTTEKIFPSQSYLGEDGKTEDVLVKFKEYQDRHSRSVIFINHKRLIKERSNIFGKTVTVGKNRII

SEQ ID NO: 18117 - protein, 81 aa, Balaenoptera acutorostrata
FQESVTFKDVIVDFTQEEWKQLDPVQRDLFRDVTLENYTHLVSIGLQVSKPDVISQLEQGTEPWTVEPSIPVGALGDWETR

SEQ ID NO: 18118 - protein, 81 aa, Ovis aries
MTVDFSREEWQDLDSAQRCLYQDVTLETYSHLCTVGNQVPKPAVIFKLEQGEGPWTLEEETPHHSCSDYIMRNAGLEETQA

SEQ ID NO: 18119 - protein, 81 aa, Ovis aries
MLENYGNLVSVAGCQLSKPSVISQLEKGEEPWMTEKEGPGDPSSDLESKTETSASNAKYNILQKQLYHGMMMERLMRDDVI

SEQ ID NO: 18120 - protein, 81 aa, Rhinolophus ferrumequinum
SEDLVTFRDVAVDFSQEEWEQLNSAQRGLYRDVMLENYRSLVSLGVSVSKPDVISLLEQGKEPWVVKEGTRGTYSDWKYAF

SEQ ID NO: 18121 - protein, 81 aa, Rhinolophus ferrumequinum
DEALMAFRDVAVAFTRKEWKLLSPAQRILYRDVMLENYSHLVSLGIAFSKPKLITQLEQGDEPWREESECLLDLCVAEPRK

SEQ ID NO: 18122 - protein, 81 aa, Ursus maritimus
SKGSMMFRDVSINFSQEEWECLDSGQMNLYKEVMLENFSNLVSVGLSNSKPAVISLLEEGKEPWMVERELTRGLCSDLESM

SEQ ID NO: 18123 - protein, 81 aa, Phyllostomus discolor
GSVAFRDVIVDFSQEEWQQLKPEQKDLYRDVMMEVYWNLISLGLETEQNMNEPDPEKESWEDRPSIAMVVGGLMKNGARGY

SEQ ID NO: 18124 - protein, 81 aa, Acinonyx jubatus
MLENYSHLVSVGSCATKPEVIFRLEQGEEPWISEEEFPSQSLPEVWETDHKKGRRQENQHKPVREVAFISKKTLTKERGNV

SEQ ID NO: 18125 - protein, 81 aa, Acinonyx jubatus
LPHSVTFEDVAVEFTPEEWALLDPCQRTLYRDVMQENRRNLASLGCHVDKRSLTSQLEQEDKVMTQEQGILPGTCPGLETV

SEQ ID NO: 18126 - protein, 81 aa, Acinonyx jubatus
MLENYRNLASLGLCVSKPDMISSLEQRKEPWMVKRRLTRGRGPDLEAGPETKELPAKKDICKEKLSQVVIMERLTNHSLEC

SEQ ID NO: 18127 - protein, 81 aa, Acinonyx jubatus
PKVPVTFDDVAVYFSEPEWGKLDEWQKELYKHVMRGNYETLVSLDYAISKPDILTQMERGEEPCPESLWGHEEGSKREAAH

SEQ ID NO: 18128 - protein, 81 aa, Rhinopithecus roxellana
DTVTFEDVAVNFSQEEWSLLSEVQRCLYRDVMLENLALISSLDCWCGSKDKGAPSKQSISVQRESQNTTPRAAVSPKKAHP

SEQ ID NO: 18129 - protein, 81 aa, Rhinopithecus roxellana
YQDSVTFDDVAVDFTQEEWTLLDPSQRDLYRDVMLENYENLASVGRDLFKPSVICWLEEEEELRAGQRRVLQEWRLKTKGP

SEQ ID NO: 18130 - protein, 81 aa, Rhinopithecus roxellana
FQDSVAFEDVAVSFTQEEWALLDPSQKNLYRDVMQETFRNLTSVGKTWKVQNMEDKYKNPRRNLSLMREKLFESKESHHCG

SEQ ID NO: 18131 - protein, 81 aa, Rhinopithecus roxellana
TFKEAVTFKDVAVVFTEDELGLLDSAQRKLYRDVMLENFRNLLSVGNQPFHQDTFHFLRKEKLWMMKTTSQREGNSGGKIQ

SEQ ID NO: 18132 - protein, 81 aa, Rhinopithecus roxellana
AVTFKDVAVVFSREELRLLNLTQRKLYRDVMVENFKNLVAVGSQHQNKMETLQKFALKYLSNQELSCWQIWKQVARELTRC

SEQ ID NO: 18133 - protein, 81 aa, Acinonyx jubatus
SQGSLSFRDVAVGFTRKEWQHLDPTQRTLYRDVMLENYSHLVSVGCQVTKPAVISRLERGQEPWMEEEELVRWSFPEAILQ

SEQ ID NO: 18134 - protein, 81 aa, Bison bison
MALSQEEWECLASSQRALYRDVMLETYRNLVSLGDDNFSPEDYLIGILSAGFAINKLSPRENINLVELYGNENHGIKDFDL

SEQ ID NO: 18135 - protein, 81 aa, Bison bison
QAQETLTFDDVAVDFTWEEWQLLAPAQKALYRDVMLENYSNLVSAGEDGSTPEVVSKLDQGEPWMMDDETHCQTRSEVWKV

SEQ ID NO: 18136 - protein, 81 aa, Bison bison
PQGSVTFEDVAVYFSWEEWALLDEAQRCLYHDVMLENFALTSSLGYWHGVEDKEAPSEQSVCIGVSQIRTLKVDSSPHKGQ

SEQ ID NO: 18137 - protein, 81 aa, Bison bison
MKGKRDVTVDFTQEEWEQLDPSQRILYMDVMLENYSNLLSVEVWKADDQMETDPRNPDEQARPFVIFKDQTPTEERDNNLF

SEQ ID NO: 18138 - protein, 81 aa, Odocoileus virginianus
SVTFEDVVVYFSWEEWGLLDENQRCLYHDVMLENFALVTSLGCWYGMEEAVAFSVESVPVEQTSRGKTVIPDPSIEKTQPC

SEQ ID NO: 18139 - protein, 81 aa, Odocoileus virginianus
ELVTFRDVVISFSQEEWEYLDSAQRDLYWDVMMENYSNLVSLDLESKYDTKTLSVEKDILEKNNSQWEVIENSKLVGLQNS

SEQ ID NO: 18140 - protein, 81 aa, Odocoileus virginianus
KERRQSFKDVAVTFTKEALGLLDLAQRKLYHEVMLENFWNLVSMGYQPFTLDIILQLGREEQLWVMEPETRGDECSGHRNQ

SEQ ID NO: 18141 - protein, 81 aa, Odocoileus virginianus
KDQGSLTLEDVAVDFTWEEWQLLAPAQKALYRDVMLENYGNLVSVGYQASKPAALSRLERGELWPVEDEVHSRLCPDLCWE

SEQ ID NO: 18142 - protein, 81 aa, Sapajus apella
SQEPVTFADVAVVFTPEEWVFLDSTQRSLYRDVMLENYRNLASVAGDQLRKPNASSDLEQRGEQWNTERGVISDTCPEPQL

SEQ ID NO: 18143 - protein, 81 aa, Callithrix jacchus
AQDRVVFEDVAIYFSQEEWGHLDEAQRLLYRDVMLENLALLSSLGCCHGAEDEEAPFQQGVSSGVLQAMAPKPRLSTQKSQ

SEQ ID NO: 18144 - protein, 81 aa, Balaenoptera acutorostrata
SLGPVSFKDVAVDFTQDEWQQLDPEQKTTYRDVMLENYSHLVSLGCHIIKPEVITKLEKGEEPWIVGGEFLLQSYPEEDWE

SEQ ID NO: 18145 - protein, 81 aa, Balaenoptera acutorostrata
WSQMPVTFEDVAVYLSREEWGRLDHTQQSFYRDVLQKRNGLSLGFPFSRPFWASQVQGKGEASGSCQQMGDEEEEKRGAVE

SEQ ID NO: 18146 - protein, 81 aa, Balaenoptera acutorostrata
PQVLVSFEEVAVLLSQEEWGRLSPAQKGLYRDVMMETYGNLVSLGLQGSKPDVISKLEQGKEPWAPHSPRIEGSWIWRRRR

SEQ ID NO: 18147 - protein, 81 aa, Balaenoptera acutorostrata
SVTFRDVTVDFTQEEWQQLEPAQKDLYRDVMLENLQNLVSLDLEMRPEMKEPDLKEEISEDRPSGAWGSAVDGARTQGGRV

SEQ ID NO: 18148 - protein, 81 aa, Vulpes vulpes
WAGSVTFRDVAIDFSQEEWEFLDSAQRDLYRDVMWENYSNFISLAEPSISKPDVITLLDEGKEPWMVVREETKRHCSDLDS

SEQ ID NO: 18149 - protein, 81 aa, Vulpes vulpes
ELVTFRDVVINFSQEEWEYLDSAQRDLYWDVMMENYSNLVSLDLESKYDTKCLSTGKDVENNGSQGKVTENKFIGLESCIF

SEQ ID NO: 18150 - protein, 81 aa, Callorhinus ursinus
FQETVTFKDVAVVFSEEELGLLDSTQKKLYRDVMLENFRNLVSVGHSSSKPDMISQLEREEKLCIKEIHTERGGRNQNEVE

SEQ ID NO: 18151 - protein, 81 aa, Callorhinus ursinus
RQGSLSFGDVAVDFSQEEWQHLDPAQRTLYKDVMLENYHNFVSVGYLIKKPSVILKLEEGKEPWILEEESLYQNYPEDSKA

SEQ ID NO: 18152 - protein, 81 aa, Vulpes vulpes
MLETYSNLVSVGYEGTKPYVILKLEQEEAPWICEAACSGCHCQENICQVNVQRKRQDMILKQGAFISKKTLPKERSHENSK

SEQ ID NO: 18153 - protein, 81 aa, Rhinolophus ferrumequinum
PLESVMFEDVAIDFTQEEWALLDTFQRKLFRDVMLETISHLVSLGYQHCKSDVIFQLEQGEELWREETGFLQSQSPGRQST

SEQ ID NO: 18154 - protein, 81 aa, Rhinolophus ferrumequinum
GPVTMTFDDVALYFSKQEWEILENWQKEMYQQVMKTNYEILNSLGCISSKPDLITWMEQERMLLIGDQGRFEKIRMTLSHC

SEQ ID NO: 18155 - protein, 81 aa, Rhinolophus ferrumequinum
YWGLLSFKDISMEFTWEEWQLLNSAQKYLYRDVILENYSNLVSVGYHGNKPDLIFKLEQGEEPWTVNAKVSHQSCAESWKE

SEQ ID NO: 18156 - protein, 81 aa, Rhinolophus ferrumequinum
SHTLVTFTDVLVSFTREEWQLLEPAQQGLYKDVTLENYENLVSLGHQCAKPDVILQLEKGDEPWLVDRGSPQNAHPDWDTA

SEQ ID NO: 18157 - protein, 81 aa, Rhinolophus ferrumequinum
MTEEFKTVKDVAMDFTLEDWAPLGLDPGNMFWDTALDNYQDLFLLNSPRSNLTSYPDGGEELEALVRGSPEVAGPDMDQAK

SEQ ID NO: 18158 - protein, 81 aa, Ursus maritimus
YQGPVTFKDVIVEFSREEWQLLNAAQRTLYREVMQENYGLLISVGYRVNKPNAVFKLKQGKEPWILEVEFPHRNYPEDLWK

SEQ ID NO: 18159 - protein, 81 aa, Acinonyx jubatus
EGTVTFEDVAVYFSREEWGLLEEAQRRLYQDVMLENLALVTSLGCQHGAENEEAPSEQSVSVEGVSHVRTPKAGLSPQKAS

SEQ ID NO: 18160 - protein, 81 aa, Rhinopithecus roxellana
PQGSLTFRDVAIEFSQEEWKCLDPIQKALYRDVMLENYRNLGFLGLCLPDLNIISMLEEGKEPWTVVSQVKIARNPNWGEC

SEQ ID NO: 18161 - protein, 81 aa, Acinonyx jubatus
AHRSVTFRDVAIYFSQQEWEYLDSVQKNLYRDVMMENYDNLVSLEHSISKPDVITLLEQRKEPWMVVGEDTKRWCTDLESK

SEQ ID NO: 18162 - protein, 81 aa, Acinonyx jubatus
MLGSVSFEDVVVEFTQDEWQYMSPAQRTLYRDVMLENYSHLISVGYCLTKPKMIFRLEQEEEPWSLEEEFLNQRYPGYFSI

SEQ ID NO: 18163 - protein, 81 aa, Acinonyx jubatus
SVVFEDVVVDFTQEEWALLKPAQKKLYKDVMLETFRNLVTVDDENQLRTNGSTSQQVIFGEKLSNEQKIARFTKNDSWTSL

SEQ ID NO: 18164 - protein, 81 aa, Rhinopithecus roxellana
KSLVTFEDVAVYFSQEEWELLDAAQRHLYHSVMLENLELVTSLGCWHAVEGEEAHPKQNISVEEVLPVRIPSADSSTKKAN

SEQ ID NO: 18165 - protein, 81 aa, Acinonyx jubatus
RPRAVKFADVAVYFSTEEWGCLRPAQRALYRDVMQETYGHLGALETRTRKKNGDKEVFPPKEAPRKGKRGRRPSKPRLIPR

SEQ ID NO: 18166 - protein, 81 aa, Bison bison
TQLTVEDVDIKFTPEEWECLDPAQRALYRDVMVETYKNLLSVDVSRIDMTMKLQAKGNSGKGEIFQRVIFGRAETSEIKDF

SEQ ID NO: 18167 - protein, 81 aa, Bison bison
PAPVILKDVVVTFTRQEWKLLDLTQRTLYQEVVLETSRLLVSLVFCVGITNRPHLYIGFPSDDKAKTKTTETAASQQALFK

SEQ ID NO: 18168 - protein, 81 aa, Bison bison
MASPSPPPQPKEEWDYLDPAQRSLYKDVMMENYGNLVSLDVLNRDKDEEPTVKQEIEEIEEEMEPQGIILTRIKSEIDQDP

SEQ ID NO: 18169 - protein, 81 aa, Bison bison
MEAVTFKDVAVAFTEEELGLLDSAQRKLYQDVMVENFRNLVSVEENNQSELSAVQERGLHEELSCWQIWQQIANDLTRCQD

SEQ ID NO: 18170 - protein, 81 aa, Odocoileus virginianus
WSQMPVTFDDVALYLSREEWGRLDHTQQSYREVLQKRSGLSLAGFPFSRPFWASQVQGKGEAPGSSRQLGHEEEEKRGAVE

SEQ ID NO: 18171 - protein, 81 aa, Odocoileus virginianus
MSKPDVITLLDEGKEPWMVVREGTGRHHPDLESRYSANILSPEKDIYEIYSFQWEIMERIKSYSLQDSIFRSDWECKSKIE

SEQ ID NO: 18172 - protein, 81 aa, Delphinapterus leucas
SLDSVSFTDIAIDFSQDEWEWLNLAQRTLYKKVMLENYRNLASLGLCISKPDVISLLEQDKEPWMMKGEITRGLPPDLKYV

SEQ ID NO: 18173 - protein, 81 aa, Carlito syrichta
SFEGSVSFRDVAIDFSREEWQHLDPSQRNLYQDVMLETYNHLLSVGYQVPEPEVFMLEQGKEPWTLQRESPHQSCPGEKLW

SEQ ID NO: 18174 - protein, 81 aa, Saimiri boliviensis
METLTFRDVAIEFSLEEWQCLNPAQQNLYRNVMLENYRNLVFLAGIAVSKQNPVTCLEQGKEPWNMKRDEIIAKPTAMCSY

SEQ ID NO: 18175 - protein, 81 aa, Saimiri boliviensis
FQEMVTFKDVAVVFTEEELGLLDSVQRKLYRDVMLENFRNLVLVAHQPFKPDLISQLEREEKLLMAETETPRDGCSGRKNQ

SEQ ID NO: 18176 - protein, 81 aa, Ovis aries
MLENYGNVASLGFPLLKPAVISQLEGGGELEGPSSLASGAGTGPQGLWTDIDIQTDNNLTEEMYEEKYNISHELQRNSFQE

SEQ ID NO: 18177 - protein, 81 aa, Vulpes vulpes
LQEALSFEDLFVDFTQKEWQLLDGRQKDLYKDVMLENYSSLVSLGYEVVKPDVIFRLEQGEEPWIGAGELSSLDCPEQVLQ

SEQ ID NO: 18178 - protein, 81 aa, Camelus dromedarius
QGSVTFEDVVVYFSWEEWGLLDETQRCLYHDVMLENFALVTSLGCWYGMEDEEAFSVQKVSVEQISPGKSLHPDPSIQKTQ

SEQ ID NO: 18179 - protein, 81 aa, Rhinopithecus roxellana
SQASVSFQDVTVEFTQEEWQHLGPVERTLYRDVMLENYSHLISVGYCITKPKVISKLEQGEEPWSLEDEFLNQRYQGYFKV

SEQ ID NO: 18180 - protein, 81 aa, Rhinopithecus roxellana
VTFEDVAVYFIRKEWKRLEPAQRDLYRDVMLENYGNVFSLAWIHISLTMQKVMLAWFTGTLSVGKGLCSSELASVEPPDTF

SEQ ID NO: 18181 - protein, 81 aa, Rhinopithecus roxellana
VHGSVTFRDVAIDFSQEEWECLQPEQRTLYRDVMLENYSHLISLGSSISKPDVITLLEQEKEPWMVVRKETSRWYPDLESK

SEQ ID NO: 18182 - protein, 81 aa, Rhinopithecus roxellana
AQVSVTFDDVAVTFTQEEWGQLDLAQRTLYQEVMLENCGLLVSLGCPIPRPELIYHLQHGQEPWTRKEDPSQDTCSGDKGK

SEQ ID NO: 18183 - protein, 81 aa, Rhinopithecus roxellana
MTEEFVTLKDVGMDFTLEDWEQLGLEQGDMFWDTALDNCQDLFLLDPPRPNLTSHPDGGEDLEPLPGGSPEAAGPDVTETK

SEQ ID NO: 18184 - protein, 81 aa, Rhinopithecus roxellana
GLLTFRDVAIEFSQEEWKCLDPAQRTLYRDVMLENYRNLVSLGIFSKYEIKELPTKKESNTGEIFQTVTLERHESHDIEDF

SEQ ID NO: 18185 - protein, 81 aa, Rhinopithecus roxellana
RREQVTFEDVVVDFSQEEWGQLKPAQRTLYRDVMLDTFRLLVSVGHWLPKPNVVSLLEQEAEPRAVDSGVPPGVYPEIKGH

SEQ ID NO: 18186 - protein, 81 aa, Bison bison
AVGLLSFRDVTAGFTQEEWQHLDPAQRMLYRDVMLENYSHRISVGYCIPKPEVILKLEQGAEPWILEEESPSEDHLELINN

SEQ ID NO: 18187 - protein, 81 aa, Odocoileus virginianus
HTLVTFKDVLVNFTREEWKLLDTAQQIMYKDVMLENYRNLVSLAILVWIMLPMADFTWGRAARTPASDPSALVGTMASQAQ

SEQ ID NO: 18188 - protein, 81 aa, Sapajus apella
AHALVTFRDVAIDFSQKEWECLDPTQRKLYRDVMLENYGNLVSLAGYSGSKPDVITLLEQGKEPCVAVRDMAGRQYPGLLS

SEQ ID NO: 18189 - protein, 81 aa, Balaenoptera acutorostrata
GWVPALFDEVAIYFSDEEWEVLTEQQKALYREVMRMNYETVLSLEFPFPKPDMITRLEREEESQNSDEWQFQGGTFAENEE

SEQ ID NO: 18190 - protein, 81 aa, Balaenoptera acutorostrata
SLGLVSFEDVAVNFTWEEWQDLDDAQRTLYRDVMLETYSSLVSLGHCITKPEVIIKLEQGAAPWTVKETPDQGFPDVQIVD

SEQ ID NO: 18191 - protein, 81 aa, Balaenoptera acutorostrata
PEGGVTFEDIALYFSWEEWKLLDEAQRRLYHDVMLENFALVSSLGFWSGEENVEASFEQSVSVVMSQVRTSKETSSSQKTH

SEQ ID NO: 18192 - protein, 81 aa, Balaenoptera acutorostrata
FRGPVTFKDVTVEFTQEEWQLLDAAQRTLYREVMQENYRHLISVGYCVNKPNAVFKLKQGKEPWILEVEFPRRNYPEDLWN

SEQ ID NO: 18193 - protein, 81 aa, Saimiri boliviensis
MRGNHEMLVSLDYAISKPEVLSQIEQGKEPCSWRRPGPKIPDVPVDPSPGSGPPVPAPDLLMQIKQEGELQLQEQQALGVE

SEQ ID NO: 18194 - protein, 81 aa, Saimiri boliviensis
QGRLTFSDVAVEFSLAEWKCLTPEQRALYREVMSENYRNLKSVANCSLNCSSFLRKQIKHLGKKQYVCDVCGKVFNDRRCL

SEQ ID NO: 18195 - protein, 81 aa, Ursus maritimus
MPLAGCPVPRPELIYQLEHGRELWTVKRDLSQSAYPGDKGKPKTTELSTCAPALSEGALFQELRQGDPGNFQLVQTTDQSG

SEQ ID NO: 18196 - protein, 81 aa, Acinonyx jubatus
AQVLVTFKDVAVTFTQEEWGQLELDQRALYQEVMLETCGLLVSLGHAVPEAELTHLLEHGRELWTGKGGLLWSTCPGDSTR

SEQ ID NO: 18197 - protein, 81 aa, Acinonyx jubatus
MLENYGNLLSVAGYQLSKPSVISQLEKGQEPWMTEKEGPGDPSSDLKNKTETSTSASKNEILQEHLYHGIMMEGFLRDDVI

SEQ ID NO: 18198 - protein, 81 aa, Rhinopithecus roxellana
IMEEAVTFKDVAVVFTEEELGLLDSAQRKLYRDVMLENFRNLLSAGHQPFHQDTFHFLREEKFWMMETVTQREGNSGGKIQ

SEQ ID NO: 18199 - protein, 81 aa, Rhinopithecus roxellana
GPLVMAEPDPTQGRVVFEDVAIYFSQEEWGHLDEAQRLLYRDVMLENLALLSSLGNALTLAQCPGLGCVTFYPKVVLRFPQ

SEQ ID NO: 18200 - protein, 81 aa, Acinonyx jubatus
SLTFQDVAVDFTREEWDQLYPAQKNLYRDVMLENYRNLVALGGENRPDIRKSIPNQNISDENQNHDMIMERLTGDSFWYSI

SEQ ID NO: 18201 - protein, 81 aa, Acinonyx jubatus
SQDLVTFKDVAIDFSQEEWEWLNPAQRSLYKNMMLENYRNLVSLGLCLSKPYVISSLEQGGEPWEIKNEMTESPDLESMYE

SEQ ID NO: 18202 - protein, 81 aa, Rhinopithecus roxellana
ACESITFRDVAIDFSHQEWEYLNLVQKTLYQEVMMENYDNLVSLAGHSISKPDLITLLEQGKEPWMIVREETGGECTDLDS

SEQ ID NO: 18203 - protein, 81 aa, Rhinopithecus roxellana
RRGHLTFRDVAIEFSQEEWKCLDPAQRTLYREVMLENYRNLVFLGICLPDLSIISMLEQRRDPRNLQSEVKIANNPDGREC

SEQ ID NO: 18204 - protein, 81 aa, Rhinopithecus roxellana
MLENYRSLVSLGVSVSKPDVISLLEQGKEPWMVKKEGTRGTCPDWEYVFKNSEFSSKQETYEESSTVVTVGTRHLSYSLDY

SEQ ID NO: 18205 - protein, 81 aa, Rhinopithecus roxellana
MDSVVFEDVAVDFTLEEWALLDSAQRNLYREVMLETFRNLASVDNKTQFKANGSVSQQDMYGEEKSKERTVPNFTRKNSCA

SEQ ID NO: 18206 - protein, 81 aa, Bison bison
LAVRFADVAVYFSPEEWGYLRPAQRALYRDVMQETYGHLGALGATPNKKEEEPEAGLGTKSPRKAPGKERPEELVKHNPGT

SEQ ID NO: 18207 - protein, 81 aa, Bison bison
QGPVTFEDVAVYFSLEEWGLLNLTQKSLYRDVMLENFGLIGSLGCLRRLQDEDALLELGESCRVLLSEKPSLCGTSGQVFP

SEQ ID NO: 18208 - protein, 81 aa, Odocoileus virginianus
AQLTFKDVFIDFTPEEWECLDPAQRTLYKDVMVETLRNLLSVDMSHIDQIKKLQAKGNSGKGEIFQRVMFGRAESLDIKDF

SEQ ID NO: 18209 - protein, 81 aa, Odocoileus virginianus
SQGRLTFQDVAIDFTQEEWECLDLGQRELYRDVMLENYGNLASLGLVVSKPDLVTFLEQMKNPWDVRRMDTTATYPAISLQ

SEQ ID NO: 18210 - protein, 81 aa, Odobenus rosmarus
PKVPVTFDDVAVHFSEQEWGNLSEWQKELYKNVMRGNYESLVSMDYAISKPDLMSQMERGERPSMQEQEDSEEGETPADPS

SEQ ID NO: 18211 - protein, 81 aa, Phascolarctos cinereus
MLENYRNLVSLGLPISKPDVIFQLEQGKEPWLLGLPRAEERELPNNSSLDWKSHETQKSTPKQKITEEVESSGTLTVDSAR

SEQ ID NO: 18212 - protein, 81 aa, Bos indicus
VRESVTFKDVAVLFTQDEWAQLSPAQRALYRDVMLENYSNLVSLGLLGPKPDMFSQLGKGEEWMPEDSLGGFCLDWVITPM

SEQ ID NO: 18213 - protein, 81 aa, Pongo abelii
AQVSVTFDDVAVTFTKEEWGQLDLAQRTLYQEVMLENCGLLVSLGCPVPRPELIYHLEHEQEPWTRKEDLSQGTCPGDKGK

SEQ ID NO: 18214 - protein, 81 aa, Phascolarctos cinereus
SQKSLTFQDVAVDFTQEEWGLLEPSQKDLFRDVMLENYENFVSLGLTESKAAVISQLERRQSLELPDGKVPGSIFVDFLHE

SEQ ID NO: 18215 - protein, 81 aa, Physeter macrocephalus
MFQVTFSDVAIDFSHEEWGWLDPAQRNLYKDVMVQNYENLVSLAGLSIPKPYVIALLEDGKEPWMVEKKLSKSLFPDWKSR

SEQ ID NO: 18216 - protein, 81 aa, Physeter macrocephalus
MDLTQRKLHKDVMLENYRNLVSLGLAVSKPDMISHLEDEKGPWVVVRETSKTPYSELETKPTTKNAIPTENISEECLSQET

SEQ ID NO: 18217 - protein, 81 aa, Trichechus manatus
SSEQVSFKDVCVDFTQEEWYLLDPAQKILYRDVILENYSHIVSVGYCVTKPEVIFKIEQGEEPWILEEGFSSLRHPEDWKV

SEQ ID NO: 18218 - protein, 81 aa, Bos indicus x Bos taurus
PQGSVTFPDVAVYFSWEEWRLLDEAQRRLYLDVMLENYALISSLGFWSGEEKVETSFEQSVSVAVSQARTSKEPSSSQKTH

SEQ ID NO: 18219 - protein, 81 aa, Bos indicus x Bos taurus
MGLLDLAQRKLYQEVMLENFRNLLSVGHQSFTPDVPSQLEREEKLQMIRTAAQSCCSSGNQNLNGIETLQEVGLRYLPHEE

SEQ ID NO: 18220 - protein, 81 aa, Macaca mulatta
GRVTFRDVAIEFSLAEWKCLNPAQRALYREVMLENYRNLESVDISSKCIMKEFSSTGQCNTEVIHTGTLQRHESHHIRDFC

SEQ ID NO: 18221 - protein, 81 aa, Pan troglodytes
PKVPVTFDDVAVYFSELEWGKLEDWQKELYKHVMRGNYEMLVSLDYAISKPDILTRIERGEEPCLDRWGQEKGNEVEVGRP

SEQ ID NO: 18222 - protein, 81 aa, Macaca mulatta
MLENYRNLVLAGIDVSKPNLITCLEQGKYPWNMKRHSMVVKPPVICSHFAEDLCPGPGIKDSFQKVILREYVKCGHKDLQL

SEQ ID NO: 18223 - protein, 81 aa, Sapajus apella
SKDLVTFGDVAVNFSQEEWEWLNPAQRNLYRKVMLENYRTLVSLGVSVSKPDVISLLEQGKEPWMVKKEGTRGACPDWEYV

SEQ ID NO: 18224 - protein, 81 aa, Macaca mulatta
VHGSVTFRDVAIDFSQEEWECLQPDQRNLYRDVMLENYSHLISLGSSISKPDVITLLEQEKEPWIVVRKETSRWYPDLESK

SEQ ID NO: 18225 - protein, 81 aa, Vulpes vulpes
TFKEAVTFKDVAVVFTEEELGLLDPAQRKLYRDVMLENFGNLVSVGHQPFKRDMIHLVREEKFWMVKLATQRKGNSGDKVQ

SEQ ID NO: 18226 - protein, 81 aa, Ursus maritimus
SQGSISFEDVTVNFTQEEWGQLDPDQRTLYRDVMLENYSIFISLEELKVDGMIESKENQDRHLWQDAFVNNKKVITEKENV

SEQ ID NO: 18227 - protein, 81 aa, Phyllostomus discolor
MAASQESLTFKDVSVDFSLEEWECLDPAQRKLYSDVMLENYSNLVSLGLVVSKPGLVTFLEQMQEVWDVSRKKSISTPPGR

SEQ ID NO: 18228 - protein, 81 aa, Rhinopithecus roxellana
PQVSLTFEDVAVLFTRDEWRKLAPSQRNLYRDVMLENYRNLVSLGFPSTKPKVISLLQQGEDPWKVEKDSSGDSSLGCKSM

SEQ ID NO: 18229 - protein, 81 aa, Acinonyx jubatus
CEVSVSFEDVTMDFSREEWEQLGPAQRCLYWDVMLEICSHLLSLGYPIPRPEMIFRMEKEEEPWIREAQLPHQWRPKGEFG

SEQ ID NO: 18230 - protein, 81 aa, Leptonychotes weddellii
AQSSVSFKDVTVDFTREEWQHLDPAQKTLYMDVMLENYCHLISVGCHMTKPDVILKLERGEEPWTSFTGHACLEENWKEED

SEQ ID NO: 18231 - protein, 81 aa, Physeter macrocephalus
IVGPVSFEDVAIDFTQEEWQQLDPAQRTLYRDVMLENYSHLVSVGYPVSKPGVISKLEQGEEPWIMKRDISYWIYPDRETR

SEQ ID NO: 18232 - protein, 81 aa, Trichechus manatus
MLENYSNLVSVGYQVSKPDALSRLERGEPPWSIEDKIHTRTFSGERPYICSECGKCFIRKLSLFVHHRTHRQLSYACIDCG

SEQ ID NO: 18233 - protein, 81 aa, Bos indicus x Bos taurus
CSELLSFTDISMEFSWEEWQLLDSVQKHLYRDVTLENYSNLVSVGHQLPKPDVILRLEKGEEPWLVEREIHQETQPDLETS

SEQ ID NO: 18234 - protein, 81 aa, Trichechus manatus
EAQESLTFSDVAVKFTWEEWQLLDPAQKDLYRDVMLENCRNLVSVGCQVNKPDALSRLKREQPWTVLDENHSGIFSEIMNI

SEQ ID NO: 18235 - protein, 81 aa, Trichechus manatus
MFSDVSIDFSQEEWECLNEDQRDLYRDVMLENYSNLVSMAGCSFSKPDVISFLEQGKEPWLVDRELTRGQWPDLESRCETK

SEQ ID NO: 18236 - protein, 81 aa, Trichechus manatus
LTFSDVAVKFTWEEWQLLDSAQKDLYQDVMLENYKNLVSLEIWKVDDHLLGPWQNESRMDGMEQCDEHNILENIVHQHKSL

SEQ ID NO: 18237 - protein, 81 aa, Sapajus apella
SQAPVTFEDMAMYLTREEWRPLDPAQRDLYRDVMQENYGNVVSLDFEIRSESEVNPKQEISEDVQFGTTSERPVENAEENP

SEQ ID NO: 18238 - protein, 81 aa, Pan troglodytes
SQASVSFQDVTVEFTREEWQHLGPVERTLYRDVMLENYSHLVSVGYCITKPKVISKLEKGEEPWSLEDEFLNQRYPGYFKV

SEQ ID NO: 18239 - protein, 81 aa, Papio anubis
MELLTFRDVAIEFSPEEWKCLDPSQQNLYKDVMLENYRNLVSLGFVISNPDLVTCLEQIKEPYNLKIHETAAKPPAMCSPF

SEQ ID NO: 18240 - protein, 81 aa, Sapajus apella
PKVPVSFEDVSVYFTKTEWKLLDLRQRVLYKRVMLENYSHLVSLGFSFSKPHLISQLERGEGPWVADIPRTWATKGLLIGD

SEQ ID NO: 18241 - protein, 81 aa, Balaenoptera acutorostrata
ELVTFRDVVISFSEEEWEYLDSAQRDLYWDVMMENYSNLVSLDLESKYDKKTLSTEKDIIEKNDSQWEVIESSKLVGLENS

SEQ ID NO: 18242 - protein, 81 aa, Rhinolophus ferrumequinum
AQGLVTFRDVAIEFSQEEWKCLEPAQRDLYRDVTLENFGNLVSLGLSVSKPDVISLLEQRKEPWMIANDITGLWCPDLESS

SEQ ID NO: 18243 - protein, 81 aa, Rhinolophus ferrumequinum
SLDSVTFTDVAIDFSQDEWQWLNLAQRTLYKKVMLENYRNLVSVGLCIFKPDVISLLEQDKEPWVTNEEMKGVLCPDMEYV

SEQ ID NO: 18244 - protein, 81 aa, Ursus maritimus
CEGSLSFEDVTMDFSREEWQQLDPAQRRLYQDVMGEVYSHLLSLGYHIPNPEIISRMEKGEKLWLREAQLPHQRQGEGVFG

SEQ ID NO: 18245 - protein, 81 aa, Phyllostomus discolor
MLENYGHLVALAGLNMSKPDVVSLLEQGKEPWLGKDVRTDFFSVSGSNGVIREFSPNNVIYENDSSQHLIKERILNYSPEH

SEQ ID NO: 18246 - protein, 81 aa, Colobus angolensis
MESVTLEDVAVEFIQEWALLDSARRSLCRYGMLDQCRTLTSRETPPCKPSRVSQLRPRAEPRATEQGILHATGVAWESQLK

SEQ ID NO: 18247 - protein, 81 aa, Phyllostomus discolor
FQGPVTFKDVIVEFTQEEWQLLDTAQRTLYREVMQENYGHLVSVGYCVNKPNALFKLKQGKEPWILEVEFPHQNYPDLWNI

SEQ ID NO: 18248 - protein, 81 aa, Acinonyx jubatus
SQGLLTFEDVAIEFSQEELIYLNYSQRELYRDVMLENYGHLLFLGLVVSKPDLVNFLEHKKGVWAVERKETVAIHPAVFSP

SEQ ID NO: 18249 - protein, 81 aa, Panthera pardus
AHGSVTFRDVAIDFSQEEWEFLDSAQRDLYRDVMWENYSNFISLAEPSISKPDVITLLDEGKEPWMVIREGTRRHYPDLES

SEQ ID NO: 18250 - protein, 81 aa, Panthera pardus
LPHSVTFEDVAVEFTQEEWALLDPSQRTLYRDVMQENCRNLASLGNQVGKPGVVSRLEQKGKVVTEETGILPGSFPDLETL

SEQ ID NO: 18251 - protein, 81 aa, Panthera pardus
SQGSLSFRDVAVGFTCKEWQHLDPAQRTLYRDVMLENYSHLVSVGCQVTKPAVISRLERGQEPWMEEEELVRWSFPEAILQ

SEQ ID NO: 18252 - protein, 81 aa, Panthera pardus
SQESVTFEDVAVDFTQDEWTLLDWSQRKLFRDVMLENISHLVSVGKQLYKSDTIFHLEQGEQLSTEGIGLLQCQSLDREDD

SEQ ID NO: 18253 - protein, 81 aa, Panthera pardus
AQESLTLEDVAVDFSREEWRLLAPAQKDLYRDVMLENFRNLVSVGHQASKPDVLAKLERGEEPWAIEEEVRSGTSPETGKV

SEQ ID NO: 18254 - protein, 81 aa, Panthera pardus
KSQGLLSFSDVAVDFTWEEWELLDTVQKNLYRDVMLENYSNLMSLGYHAPWPEATVHVERGVQGLVEREFPSSCGPERPLQ

SEQ ID NO: 18255 - protein, 81 aa, Capra hircus
YRESVTFEDVAVDFTQEEWALLDTSQRKLFRDVMLENISHLVFVGYQHCKLDVIFQLEQGEELWIEGRGIFQSHSPGGESA

SEQ ID NO: 18256 - protein, 81 aa, Tursiops truncatus
EQLTFKDVAIEFSQEEWECLDPAQRALYRDVMLETYRNLVSLDICHIYVMKKLQPKVNSDGGEIFQTVMLETCESREIRDF

SEQ ID NO: 18257 - protein, 81 aa, Ursus arctos
QESVTFKDVAVDFTLEEWGQLGPGQRKLYWDVMLENYQNLLSLGAGPPGSKPDVISRLERGEEPRMEKREAKQAACPDLDT

SEQ ID NO: 18258 - protein, 81 aa, Ursus arctos
PQKSVTFEDVAVYFTQTEWDGLSPAQRALYRDVMLENYGNVASLGFSLLKPAVISQLEGAGELEGPSPLVAGTEIGPQGLW

SEQ ID NO: 18259 - protein, 81 aa, Leptonychotes weddellii
IQGSLTFGDVAVAFTQFEWKHLDATQQALYRDVMLENYRNLVSVGLLSSKPKLITQLEQGAEPWMEVQQIPSDTCSVQEYW

SEQ ID NO: 18260 - protein, 81 aa, Physeter macrocephalus
MLENFRNLISMGCPVTKTKVIFKVEQGQEPWMVEGENPRWRSPEADCPLIDESDKHQESKDNFLNSVFFMFNKILTVKRLH

SEQ ID NO: 18261 - protein, 81 aa, Trichechus manatus
GLVTFRDVAIAFSQEEWECLDPAQRDLYVDVMLENYSNLVSLDLESIYETKNTFSEKDIFEINFSQWEIKEKSKTLGLEAS

SEQ ID NO: 18262 - protein, 81 aa, Bos indicus x Bos taurus
FKEAVTFKDVAVVFTEEELGLLDSAQRKLYQDVMVENFRNLVSVGHVPFKADMVSQLETEEKLWTTERETQRNGHSSEIHS

SEQ ID NO: 18263 - protein, 81 aa, Trichechus manatus
SQESVTFQDVAVDFTEKEWPLLDSSQRKLYKDVMLENYSNLTSVGYQLGKPSLISHLEQEELLRTEERGSHQGTCPDWEIP

SEQ ID NO: 18264 - protein, 81 aa, Trichechus manatus
LQKLVTFKDVAVDFTQEEWECLDSSQRHLHREVMLENFENLVSLGHLLSKPEMIFHFERLDDVWMEEEMPRSSCSGVRDEK

SEQ ID NO: 18265 - protein, 81 aa, Ursus maritimus
MLENYSHLVSVGYLVPKPDEVLRLGRGEEARRAEGEPPTRSYPEFWQVDDQVDNHKESQDQLLWQTALVDKETQKDLSGRE

SEQ ID NO: 18266 - protein, 81 aa, Lynx canadensis
GRLTFRDVAIEFSQEEWECLDPAQRALYRDVMLENYRNLVSLGSTSAGFAIKELSPTEDINKGEFYHLVLLERNESHGIKD

SEQ ID NO: 18267 - protein, 81 aa, Acinonyx jubatus
AQGLVTFRDVAIEFSQEEWKCLEPAQRNLYRDVTLENFSNLVSLGLSVSKPDLISLLEQGREPWMIANDMTGPWCPELESR

SEQ ID NO: 18268 - protein, 81 aa, Capra hircus
RLTSEDVAIEFTQEEWEFLDPAQRALYRDVMLETYRNLLSVDISPTHVIKLLQPKANRDKLETFQTLMLGRPESCEIKHVH

SEQ ID NO: 18269 - protein, 81 aa, Panthera pardus
MQNELLQAMSKEEWECLDSGQMNLYKEVMLENFSNLVSVGLSNSKPAVISLLEQGKEPWMVERELTRGLCSDLESMCETKI

SEQ ID NO: 18270 - protein, 81 aa, Acinonyx jubatus
SKDLVTFGDVAVDFSQEEWEWLNPAQRNLYRKVMLENYRSLVSLAGVSVSKPDVISLLEQGKEPWMVKKEGTRGTYPDWEY

SEQ ID NO: 18271 - protein, 81 aa, Sus scrofa
ESVTFEDVAVDFTQEEWALLNSSQRKLFRDVMLENISHLVSIVISGREDDLKKQEMISMQHICKKDTSLICAMRSHTQEDP

SEQ ID NO: 18272 - protein, 81 aa, Ursus arctos
LLTFEDVAVSFSEEEWKLLDPSQKILYNDVMQENYETVISLGLKLKNDTGNDQPISLSALEIQASGGKVLRKARMKVAQKT

SEQ ID NO: 18273 - protein, 81 aa, Ursus arctos
YDSVVFEDVAVDFTLDEWALLDSMQKNLYRDVMLETFQNLVSVDYETLFKASGLVSQQDRHEEKNASEQKMAKFTRNHSCA

SEQ ID NO: 18274 - protein, 81 aa, Vicugna pacos
GWVPALFDEVAIYFSDEEWEVLTEQQKALYREVMRMNYETVLSLEFPFPKPDMITRLEGEEESHHSDDWQLQGGTFAENED

SEQ ID NO: 18275 - protein, 81 aa, Neophocaena asiaeorientalis
RSQESLTFQDVAVEFTREEWDQLYPAQKNLYRDVMLENYRNLVALGHQLYKPEVITQLEREEQWMMERDCPPDSHPDGENS

SEQ ID NO: 18276 - protein, 81 aa, Neomonachus schauinslandi
MLETYGHLLSVGNQIAKPEVISLLEQGEEPWSVEQAYPQSTCPEWMRNLESKALIPTQSIFEEEQSHSMKLERYIWDDPWF

SEQ ID NO: 18277 - protein, 81 aa, Pteropus vampyrus
SQGQLTLSDVFIEFSQEEWECLSPAQRALYRDVMLESYRNLLFLGISVSDLYIVSILEQGKAPWTLESDWKTAASPNRWER

SEQ ID NO: 18278 - protein, 81 aa, Bos indicus
SQGLVAFKDVAVCFSQDAWSDLDPTQKEFYGEYVLEDDCGIVVSLSFPIPRLDEISHVREEEPLVPDVPEPQEPEEPEILS

SEQ ID NO: 18279 - protein, 81 aa, Pongo abelii
PQGHLTFMDVAIEFSQEEWKSLDPGQRALYRDVMLENYRNLVSLGICLPDRSIISMLRQRREPLVLQSQVKIVKNTDGREC

SEQ ID NO: 18280 - protein, 81 aa, Physeter macrocephalus
MAFTKKEWEQLDPAQKSLYKDVMLENYSNLASMGYQALKPHMISKLGKEEPWLGKGKRPRQGGLSEIARPKGIGANGKEVQ

SEQ ID NO: 18281 - protein, 81 aa, Monodelphis domestica
LIKFKDVAVDFTQEEWCLLDHSEKELFLEVMLENVQNLLFVEAETNFEAKEISSKLILFVEESGPQIFINEGPCDFILREI

SEQ ID NO: 18282 - protein, 81 aa, Physeter macrocephalus
KTWGPLSFMDVFVDFTWEEWQLLDPAQKHLYRSVMLENYSNLVSLGYQHTKPNIIFQLEQEELWMMQIPSEGHLDEVWEID

SEQ ID NO: 18283 - protein, 81 aa, Delphinapterus leucas
TQEPVVFEDVAVDFTQEEWALLDLAQRNLYRDVMLENFRNLASLGYPLHTPYLISQWKQEEDLEIAERGPTQGEHQEGFET

SEQ ID NO: 18284 - protein, 81 aa, Delphinapterus leucas
AQEPVTFKDVAVDFTQEEWGQLDPVQRTLYRDVMLETYGHLLSVGNKIAKPEVISLLEQGEEPWSVEQAYPPQGACPEWVR

SEQ ID NO: 18285 - protein, 81 aa, Ursus maritimus
AQESLTFDDVAVAFTWEEWQLLAPAQKELYRDVMVENYRNLVSVGFHTSKPDTLSRLDQGEPTWTVEDDFPCRTCSEIWKL

SEQ ID NO: 18286 - protein, 81 aa, Ursus maritimus
AHHLVMFRDVAVDFSQEEWECLNPYQRNLYRDVILENYSNLVSVAGCSISKPDVITLLEQGKEPWMVVRDERRRSLDLESR

SEQ ID NO: 18287 - protein, 81 aa, Camelus dromedarius
DPEQVTFEDVAVDFTWEEWGQLEPAQRTLYRDVMLETFGLLVSVGHWLPKLDVISLPEQEVELWTVDKGVPQGVCPEQTDY

SEQ ID NO: 18288 - protein, 81 aa, Phyllostomus discolor
KSQGFVSFKDVTVDFTQEEWQQLDSAQRNLYRDVMLENYSNLVAVGYQSLKSDEIFLWKEGEPWMAEGEISSWAYPAFEIR

SEQ ID NO: 18289 - protein, 81 aa, Leptonychotes weddellii
SQDLVTFKDVAIDFSQEEWEWLNPAQRNLYKNMMLENYQNLVSLGLCISKPYMISLLEQGKEPWEMKTEMTRSPFPDLGSI

SEQ ID NO: 18290 - protein, 81 aa, Ursus americanus
MLENIRHLVSLGYQHCKSDVIFQLEQGEELWREGPGFLRGPSPGRESALKEQEMIATQHISRKDTSTIMPVQKSHTPEDPF

SEQ ID NO: 18291 - protein, 81 aa, Phascolarctos cinereus
AQESVSFKDVAVDFSREEWCFLDASQKKLYKEVMLENYRNLVSLGLPVGKADVIFQLERGQVLGVLEREDLAASRPDWELR

SEQ ID NO: 18292 - protein, 81 aa, Pteropus vampyrus
PEDLVTFGDVAVDFSQEEWARLNPAQRDLYRHVMLENYRNLVSLAGVSVSKPDVISLLEQGKEPWMVKKEGSRGKCYDWEY

SEQ ID NO: 18293 - protein, 81 aa, Pteropus vampyrus
FLGSVSFEDVTVEFTPDEWQYMGPAHRTVYRDVMLENCSHFVSMGYCITKPQVIFKLEQGEEPWSLEEEFPNQRCPGYYKV

SEQ ID NO: 18294 - protein, 81 aa, Cebus imitator
PQASVCFEDVAMAFTQEEWEQLDLAQRTLYREVTLETWEHLVSLGLLLSKPDVISQLEQEEDLCRAEQVALQDWKATLEKN

SEQ ID NO: 18295 - protein, 81 aa, Monodelphis domestica
SQVSITFHDVAVGFTQEEWDLLDDSQKELYLEVLLDNVQNLLSVGLPVPREIFISCLWQGKAPWMLEQKGPRNSCPETDTN

SEQ ID NO: 18296 - protein, 81 aa, Physeter macrocephalus
VQESVTFKDVAVLFTQDEWAQLSPAQRALYRDVMLENYSNLVSLGLLGPKPDVFSQLGKGEEWMPEDSLGGFCLDWMTTPV

SEQ ID NO: 18297 - protein, 81 aa, Pan troglodytes
AQEPVTFRDVAVFFSQDEWLHLDSAQRALYREVMLENYGSLVSLGIPFSMPKLIHQLQQGEDPCMVEREVPSDTCLGFKTW

SEQ ID NO: 18298 - protein, 81 aa, Sapajus apella
MAEEFVTLKDVAMDFTLEDWEQFGLDQGDLFWDTALDNYQNLFLLNPPRPNPTSRPDGSEDLEPLARGSPEAVGPDLAETT

SEQ ID NO: 18299 - protein, 81 aa, Zalophus californianus
FQDSVTFEDVAVRFSSGEWQCLTRAQRHLYADVMLENYGNMISVGFAVPKPPLISHLEQGAEPCVQDLQDGGFLSCSFPVS

SEQ ID NO: 18300 - protein, 81 aa, Carlito syrichta
MLVTFKDVAVTFTREEWRQLDLAQRTLYQEVMLETCRLLVSLGHRVPKPELIHLLEHGQELWTVKRGLSHSTCAGDRAQLQ

SEQ ID NO: 18301 - protein, 81 aa, Saimiri boliviensis
SQGLVTIKDVSLCFSQEEWRSLDPSQTDFYGEYVMQENCGIVVSLRFPIPKLDLLSQLEGGEEQWVPDPQDLEERDILRVT

SEQ ID NO: 18302 - protein, 81 aa, Saimiri boliviensis
FQGPVTLKDVTVEFTKEEWKLLTPAQRTLYKDVMLENYSHLVSVGYRVNKPNVVFKLKQGKEPWMLEVEYPHRGLLEDLRN

SEQ ID NO: 18303 - protein, 81 aa, Vulpes vulpes
RAKKPVTFKDVAIDFIQEEWGLLDPTQRILYCDVMLTNYSNSVSLGLHDCKPDMISKLEQREDPWIMEKDILRSPDSEPRH

SEQ ID NO: 18304 - protein, 81 aa, Vulpes vulpes
PKVLVSFEDVSVYFTKTEWKLLDLQQRILYKRVMLENYGHLESLGFLSSKPHLVSWLEQGEGPWGADMCGTPAAAGMQTDD

SEQ ID NO: 18305 - protein, 81 aa, Equus caballus
DSVTFGDVAVYFSWEEWRLLGEAQRDLYHDVMLENFALISSLDCWSATEDAKAPFEHSISVGVSQATTPKTGLISQNTHTC

SEQ ID NO: 18306 - protein, 81 aa, Rhinolophus ferrumequinum
FKESVSFEDVAVDFTRQEWHRLDPAQRTMHKDVMLENYSNLASVGLCVAKPEMIFKLERGEELWVLEEESPGHGYTGSLSL

SEQ ID NO: 18307 - protein, 81 aa, Rhinolophus ferrumequinum
VQESVTFRDVAVLFSQDEWLCLDPAQRALYREVMLENYSSLVSLGILFAKPKVIFQLQRGEDPWMVENGASRGTCLGWESF

SEQ ID NO: 18308 - protein, 81 aa, Rhinolophus ferrumequinum
QSPVTFEDVAVYFSKEEWGLLDVTQRHLYHDVMLENFELMTSLGCWHGMEHEEACSKQNASVEGVSQVRIPSAHSFTQKTD

SEQ ID NO: 18309 - protein, 81 aa, Rhinolophus ferrumequinum
PSQISFEDVAVAFTLDEWQLLSPTQKSLYRDVMLENYSNFVFLEELWLDNNLKMWHQNNQDKLQSTESNHGYDVFGKILHS

SEQ ID NO: 18310 - protein, 81 aa, Rhinolophus ferrumequinum
VTFQDVAVDFTEKEWPLLDSSQRKLYKDVMLENYSNLASVDWETPSKTKWSILMEDILGKETSRDVTMERTRLGEKSTDYA

SEQ ID NO: 18311 - protein, 81 aa, Ursus maritimus
ALVTMTFDDVALYFSEQEWEILEKWQKEMYQQVMKTNYETLDSLGGVFSKPDLITWIEQGRMLLIRDQGPLEKNMTLSPST

SEQ ID NO: 18312 - protein, 81 aa, Ursus maritimus
MLENYINLISVGYQTTKPSVIHKLEQGEEPWMVEREIPSWSYAEEVWQLDDHLERHQGNQETLLKHVAFIDQETVTKEKGN

SEQ ID NO: 18313 - protein, 81 aa, Ursus maritimus
MASPSPPPEPKEEWDYLDPAQRSLYKDVMMENYGNLVSLDVLNRDKDEEPTVKQEMEEIEEEVEPQGVIVTRIKSEIDQDP

SEQ ID NO: 18314 - protein, 81 aa, Ursus maritimus
SQEPVTFEDVAVYFTQNQWANLDFTQRALYREVMLENYANVASLAFPFPKPDLVSQLERGEAPWGPDPWEAEVLRGVCPGG

SEQ ID NO: 18315 - protein, 81 aa, Camelus dromedarius
SCEGSVSFRDVAVDFSREEWQQLDLDQKNLYRDVMLETYSHLLSVGYQVPEPEVFMLEQGKEPWAMQSESLRQSCPADDLG

SEQ ID NO: 18316 - protein, 81 aa, Phyllostomus discolor
KTLGSVAFRDVIVDFTQEEWQQLKPAQKDLYRDVMMEVYWNLISLDVETRPDTKELDPQEDNWEDRPSVVVVTEGPMKNGA

SEQ ID NO: 18317 - protein, 81 aa, Phyllostomus discolor
SKDLVTFGDVAIDFSQEEWEWLNLAQRNLYRKVMLENYRNLVLLAGVSVSKPEVISLLEQGKEPWMVKEVETGGTYSDWEY

SEQ ID NO: 18318 - protein, 81 aa, Bison bison
IQGLVTFRDVAIEFSQEEWKYLEPAQRDLYREVTLENFGNLVSLGLSISKPDVVSLLEQGKEPWMVVNDMTGPWCPDLESR

SEQ ID NO: 18319 - protein, 81 aa, Bison bison
SLGSDLFRDVAVVFSQEEWEQLAPTQRDLYRDVMLETYSNLVSLGLAISKPDVISFLEQGKEPWTVEEVVTGGLCPVLKSR

SEQ ID NO: 18320 - protein, 81 aa, Sus scrofa
GVNFEDIAVYFSWEEWRLLDEAQRRLYLDVMLDNYALISSLGCCCGAEGSEAPFEQIDSLGVSQARISEAALSSQETHPCG

SEQ ID NO: 18321 - protein, 81 aa, Ursus arctos
TQGSLSFRDVTVGFTQEEWQHLDPAQRSLYRDVMLENYSHLVSLGYSISKPEVILKLEQGEEPWILEEEFPSQSDLELIKS

SEQ ID NO: 18322 - protein, 81 aa, Sus scrofa
QEPAEYEFLSVDYTQKKWKGPALSQRALYRNIVPENCHSLASLAGENGMECSDLPPKQESSKESEASDRTSGVLYEVIPGG

SEQ ID NO: 18323 - protein, 81 aa, Pteropus vampyrus
PQESVTFKDVAVDFTQEEWRHVDPAQRRLYRDVMLENYSNLVSLAGYQVSKPEVIFKLEQGEEPWLSEGEIQRPFFPDWKT

SEQ ID NO: 18324 - protein, 81 aa, Pteropus vampyrus
MLETFGHLLSVGKHTAKPEVISLLEQGEEPWLVEHAPPQRICPEMMKNLENKALIPTQSIFEEEQSRSMKLERYVWDDPWF

SEQ ID NO: 18325 - protein, 81 aa, Pteropus vampyrus
AHGSVIFSDVSIAFSQEEWEYLDLEQRDLYRDVMLENYSNLVSLGCFISKPNVISLLEQGKEPWKVVRKERRYPDMGIRYE

SEQ ID NO: 18326 - protein, 81 aa, Trichechus manatus
WSQMPVTFEDVALYLSREEWGRLDHTQQNFYREALQKRKGLSLGFPFRRPFWASQVQAKGEASSSGQQTGEEEDEEKTAVC

SEQ ID NO: 18327 - protein, 81 aa, Zalophus californianus
MAEGFTFKDVAIYFSQKEWECLHSAQKDLYRDVMLENYNNLISLGLSDSKPDVISLLEQGKEPWMVKSQETKEWCPDWESR

SEQ ID NO: 18328 - protein, 81 aa, Zalophus californianus
CQESVTFEDVAVIFTDEEWRHLVPIQRDLYKEVMLENYKSIVSLGLPVPQPDVIFQLKRGDEPWIVDLHGSEERECPENVS

SEQ ID NO: 18329 - protein, 81 aa, Phyllostomus discolor
KFEEELTFKDVAVVFTEEELGLLDSIQRKLYRDVMLENFQNVVSVGCHSFKHDIVHLEKEKRVWMMTAAQREGESGGKIQG

SEQ ID NO: 18330 - protein, 81 aa, Ursus maritimus
SQHLVTFEDVAVNFTWEEWTLLDQTQRDLYRDVMLENYQNLIILAGYESCGPDLNSPVGGAEELRTGGRGILQELDLQLKT

SEQ ID NO: 18331 - protein, 81 aa, Phyllostomus discolor
KALGSVAFRDVIVDFTQEEWLQLKPAQKDLYRDVMMENYWNLVSLDLETSPEMKELDPQKDIWKDRPSIAVVAEGPTRNGA

SEQ ID NO: 18332 - protein, 81 aa, Acinonyx jubatus
KSQGSLALEDVAVNFTRDEWQLLDSAQKNLYRNVMLENVSSLVSLGFQLIKPDVIFKLEREQPWIIGEEVPSQSLSEYWKV

SEQ ID NO: 18333 - protein, 81 aa, Tursiops truncatus
MLENYGNVASLGFPLLKPTVISQLEGGGELEGPSPLASGTGTGPQGLWTVNIDIQTDNNLTEEMYEEKHNTSFELQRNSSQ

SEQ ID NO: 18334 - protein, 81 aa, Acinonyx jubatus
MLENYGVVASLAFPFPKPALISQLERGEAPWCKAPQGALDGECPRGVSTGYPFLKPAAISHLEQVEEPLNLKLQGEGPSLI

SEQ ID NO: 18335 - protein, 81 aa, Tursiops truncatus
SRDSVTFADVAVDFTQEEWTLLDPIQRKLYRDVMLENYKNLTTAGYQSLKPTLISWWEQEDDLRTAERKGVLQASCFFLQT

SEQ ID NO: 18336 - protein, 81 aa, Bison bison
AQEILSFKDVAVDFTWEEWQLLTPAQKTLYRDVMLENYSNLVSVGYRVSKSDVLFKLEQGEERWMTEDEIHSHTWPETGNI

SEQ ID NO: 18337 - protein, 81 aa, Sus scrofa
LTLEDVAVDFTWEEWQLLTPDQKDLYQDVMLENYGNLVAVETEKVEDCVQWHCQKQNTLRRIEEGYEQSVFENITHQSKRS

SEQ ID NO: 18338 - protein, 81 aa, Sus scrofa
ELVTFRDVVITFSQEEWEYLDSAQRDLYWDVMMENYSNLVSLDLESNYHTKTLSIEKDSIGKSDSQWEVIESSKLVDFENS

SEQ ID NO: 18339 - protein, 81 aa, Leptonychotes weddellii
MIKSQISFEDVAVGFTSEEWQLLNPSQKSLYREVMLENYSNLVFLGYQIIKPDAIFKLEHKEPWIIDEEVLNQNFSEEVWL

SEQ ID NO: 18340 - protein, 81 aa, Phascolarctos cinereus
AHQALVTFKDVAVDFTQEEWGRLCPSQKELYRDVMLENYRNLVWLGQRFSPKVPGQLPADTKRSVLLGTCSFQTRCDLPVG

SEQ ID NO: 18341 - protein, 81 aa, Pongo abelii
PQESVTFKDVSVDFTQEEWYHVDPAQRSLYRDVMLENYSHLVSLGYQVSKPEVIFKLEKGEEPWISEGEIQRPFYPDWKTR

SEQ ID NO: 18342 - protein, 81 aa, Pongo abelii
TFKEAVTFKDVAVVFTEEELGLLDPAQRKLYRDVMLENFRNLLSVGNQQFHQDTFHFLRKEKFWMMKTTSQREGNSEGKIQ

SEQ ID NO: 18343 - protein, 81 aa, Pteropus vampyrus
YQELVTFRDVAVDFSQEEWDCLNSSQRHLYSNVMLENYRILVSLGLCFSKPNVILLLEEGKEPWSVKRELAKGLCSGWEST

SEQ ID NO: 18344 - protein, 81 aa, Pteropus vampyrus
VVTFEDVAVDLSQEEWELFDETQRLLYRDVMLENFALVSSLGFWFQMEAEKAASQGVSHLRIPKAGLTTQKAYSCGTCGPV

SEQ ID NO: 18345 - protein, 81 aa, Pongo abelii
WSQMPVTFEDVALYLSREEWGRLDHTQQNFYRDVLQKKNGLSLGFPFSRPFWAPQAHGKGEASGSSRQTGDEKEWRGACTG

SEQ ID NO: 18346 - protein, 81 aa, Pteropus vampyrus
SRTLVTFKDVVVNFTREEWQLLDTAQQILYKDVTLENYKNLLSLGHQLPKPDVILHLEKGEEPWLVERGVRRHTHPDWDTA

SEQ ID NO: 18347 - protein, 81 aa, Pteropus vampyrus
SKETVTFKDVAVTFTKEELRLLNSAQRKLYQDVMLENFRNLVSVGGKIQSEIKTIPEAGPCEELFCWQIWQQIASDLTRHQ

SEQ ID NO: 18348 - protein, 81 aa, Pongo abelii
CYQDSVTFDDVAVDFTQEEWTLLDSTQRSLYSDVMLENYKNLATVGGQIIKPSLISWLEQEESKTVQGGVLQGWETQLETQ

SEQ ID NO: 18349 - protein, 81 aa, Trichechus manatus
MHKDVMLENYSNLASVGLCVAKPEMIFKLERGEELWILEEESSGHNYSGSLSLLCGNNSVEGNALLLDKDILQHQKIQTLD

SEQ ID NO: 18350 - protein, 81 aa, Carlito syrichta
CEVSVSFEDVTVDFSKEEWQLLDPAQRRLYWDVTLENYSHLLSVGFEVPKPEVIFKLEQGEGLWTLQGEAPHQSRSDGKFG

SEQ ID NO: 18351 - protein, 81 aa, Trichechus manatus
SQASVTFMDVAVRFTRREWEQLAPTQRVLYRDVMLETYGNLLSVGCQYTKPDVIFKLEQGEEPWTEEGAPPRRSCREKFWK

SEQ ID NO: 18352 - protein, 81 aa, Zalophus californianus
MLEIYSHLVSVGCSGIKPGVIFKLEHEEDPWIIKTELSRWIHSDREKSLDSSQQIISEELSFQKEILEKTPKDNSLYPLLK

SEQ ID NO: 18353 - protein, 81 aa, Delphinapterus leucas
PENGVTFEDIALYFSWEEWKLLDEAQRRLYHDVMLENFALISSLGVWSGEENVEASFEQSVSVVMSQVRTSKEPSSSQKTH

SEQ ID NO: 18354 - protein, 81 aa, Lipotes vexillifer
AQESVMFSDVSIDFSQEEWEYLNDDQRDLYREVMLENYSNLVSMGHSISKPDVISFLEQGKEPWLVDRELTRDQWPVLESR

SEQ ID NO: 18355 - protein, 81 aa, Rhinolophus ferrumequinum
WKEELSFEDVAVNFTREEWNKLDWTQRDLYRDVMLENYRNMILLGFQFPKPEVICQLEQWEDPWILDLPRAGTRKASSNAC

SEQ ID NO: 18356 - protein, 81 aa, Delphinapterus leucas
SVCEVSFKDVTVDFSREEWQHLDPAQRLLYRDVTLENYSHLRSVGYQVPKPEVIFKLEQGEGPWTLEEETPHQSCSDEDNG

SEQ ID NO: 18357 - protein, 81 aa, Delphinapterus leucas
PQAKVTFEDVAVLLSQEEWDRLGPAQRGLYRHVMMETYGNVVSVGIPGSKPEVISQLERGEEPWVVDKQGNEGRRGLGTGR

SEQ ID NO: 18358 - protein, 81 aa, Aotus trivirgatus
MFKEAVTFKDVAVVFTEEELGLLDPAQKKLYRDVMLENFRNLLSVGQQAFDRDTFQFLREEKVWMMKTATQREGNSGGKIQ

SEQ ID NO: 18359 - protein, 81 aa, Aotus trivirgatus
TQGSLTFKDVAIEFSQEEWKCLDPVQKALYRDVMLENYRNLGFLGLCLPDLNIISMLEQGKEPWTVVSQVKITRNPNWGER

SEQ ID NO: 18360 - protein, 81 aa, Muntiacus muntjak
MGRLMFQDVAIDFTQEEWECLDLSQRDLYRDVMLETYGNLASLGLVVSKPDLVTFLEQMKNPWDVRRTDTKATYPAVSSHN

SEQ ID NO: 18361 - protein, 81 aa, Carlito syrichta
VPVTFRDVALIFTEAEWKSLSLEQRNLYKEVMLENYWNLLSLETKPGTYPCSSCLLVSCLQVLSQHMLQVFWGLCAENHSH

SEQ ID NO: 18362 - protein, 81 aa, Sapajus apella
MPHLLVTFRDVAIDFSQEEWECLDPAQRDLYRDVMLENYSNLISLDLESSREINKLSSEKEIYEMESLQWENMGKFINHHV

SEQ ID NO: 18363 - protein, 81 aa, Pan troglodytes
AQVSVTFDDVAVTFTKEEWGQLDLAQRTLYQEVMLENCGLLVSLGCPVPKAELICHLEHGQEPWTRKEDLSQDTSPGDKGK

SEQ ID NO: 18364 - protein, 81 aa, Balaenoptera acutorostrata
TCTQGAPVTFDDITVYLLQEEWMLLSQQQKELCGSDELVAPLGPTIANPELFYKFERGPEPWLANVQGQRNLLSLHRGRNK

SEQ ID NO: 18365 - protein, 81 aa, Rhinolophus ferrumequinum
FQEAVTFKDVAVVFTEEELGLLDSAQRKLYRDVMLENFRNLLSLGHPSSKPDVISQLEREEKLWMMEIQTQRGGSSENEMD

SEQ ID NO: 18366 - protein, 81 aa, Ursus maritimus
AQEFLTFDDVAVDFTWEEWQLLAPAQKDLYRDMMLENYRNLVSVGYQASKPDALSKLERGEELWTIEDEIHSRICPELRKV

SEQ ID NO: 18367 - protein, 81 aa, Ursus maritimus
AQESLTFGDVFVDFTLEEWQQLDSAQKYLYRDVMLENYSHLVSVGYLVPKPDEVLRLGRGEEARRAEGEPPTRSYPEFWQV

SEQ ID NO: 18368 - protein, 81 aa, Phyllostomus discolor
GLVAFRDVIVDFTQEEWQQLKPAQKDLYRDVMMENYWNLVSLDLEKRPVMKDTDPQDNISENRPPIAVVAEGPTKNGSQSC

SEQ ID NO: 18369 - protein, 81 aa, Acinonyx jubatus
MLQVTFSDVAIDFSHEEWGWLDSAQRDLYKDVMVQNYENLVSLGLSIPKPYVISLLEDGKEPWMVEKKLSKDWESRWENKE

SEQ ID NO: 18370 - protein, 81 aa, Tursiops truncatus
SLDSVSFTDIAIDFSKDEWEWLNLGQRTLYKKVMLENYRNLASLGLCISKPDVISLLEQDKEPWMLKGEITRGLPPDLEYV

SEQ ID NO: 18371 - protein, 81 aa, Tursiops truncatus
MLENHSSVAGLAGFLVFKPELISRLEQGQEPWVLDLQGAEGREAARTSQADSTIGTESEQACEDIDRLKSESHVVMVKTPS

SEQ ID NO: 18372 - protein, 81 aa, Tursiops truncatus
QVTFEDVAITFSREEWECLDPAQRALYRDVMLETYGNLLSLAVSHIHVIKKLKPKANSDRGEVFQTVMLGRHESHEIRDFY

SEQ ID NO: 18373 - protein, 81 aa, Sus scrofa
SQVSVTFEDVAVLFSRDEWRRLGPSQKNLYQDVMLENYSNLVSLGLPFSKPKVISLLQQGEDPWKVEKESPGSFSPGCKSS

SEQ ID NO: 18374 - protein, 81 aa, Tursiops truncatus
AHGSVTFRDVAIDFSQEEWEFLDSAQRDLYRDVMWENYSNFISLGPSISKPDVTTLLDEGKEPWMVVREGTRRHHPDLESR

SEQ ID NO: 18375 - protein, 81 aa, Sus scrofa
PLESVTFEDVAIDFSQEEWALLDTSQRKLFRDVMLENINHLVSLGYHHSKSDVIFHLEQGEELWFEGRGFFQSHSPGRESA

SEQ ID NO: 18376 - protein, 81 aa, Sus scrofa
SQDPVTFQEVAVDFTQEEWALLAPAQKILYRDVMLENYRNLASVGYHLRKPSLLTQEELRVKKKRILQDTCADQISQLKTK

SEQ ID NO: 18377 - protein, 81 aa, Sus scrofa
MFSDVSVDFSQEEWEFLDPAQRDLYKDVMLENYSNLVSMGLCMPKPQVISLLEQGKEPWMVGRELTKGLCSDLESMCETKL

SEQ ID NO: 18378 - protein, 81 aa, Ursus arctos
SQGLVSFKDVAVDFTQEEWQQLDPAQRTLYRDVMLENFSHLVSMGYPVSKPDVISKLEQGEDPWTIKRDIPNWIYPDENQA

SEQ ID NO: 18379 - protein, 81 aa, Ursus arctos
MFKDVAIDVSQEEWECLNSTQRDLYKDVMLENYSNLVSLGLSISKPAVISSLEQGKEPWMVVREVAGGRCPDLVSRCEAKK

SEQ ID NO: 18380 - protein, 81 aa, Vicugna pacos
MAFRDVSVDFTQEEWRLLSPAQRTLYRDVMLENYRNLVSLGIPFSKPKLITQLEQGRETWKEERKGPPAPCPAEPKPDLHL

SEQ ID NO: 18381 - protein, 81 aa, Leptonychotes weddellii
SQESVTFEDVAVDFTQEEWTLLDRSQRKLFRDVMLENISHLVSIGRQLYKSDTISHLEPGEHLSKEERGLLQCQSPDREDD

SEQ ID NO: 18382 - protein, 81 aa, Leptonychotes weddellii
WKELLSFEDVAMYFTREEWNKLERAQKDLYRDVMLENYRNMILLGFQFPKPEVICLLEQWEEPWILDLPRAGTRKASSSAC

SEQ ID NO: 18383 - protein, 81 aa, Vicugna pacos
CEVSVSFEDVTVDFSREEWQHLDPAQRRLYRDVTLENYSHLCSVGYQVPKPEVIFKLEQGEGPWTLEEETPHQSCSDEDMG

SEQ ID NO: 18384 - protein, 81 aa, Trichechus manatus
PLESVTFKDVAVDFTLEEWALLDTSQRKLFRDVMMENIDHLVFVGNHLCKSDVISQLEQGEELWRGGIGFLQDQSPGGETG

SEQ ID NO: 18385 - protein, 81 aa, Pan troglodytes
MLETYSHLLSVGYQVPEAEVVMLQQGKEPWALQGERPRHSCPGEKLWDHNQCRKILSYKQVSSQPQKMYPGEKAYECAEFE

SEQ ID NO: 18386 - protein, 81 aa, Callithrix jacchus
LQEPVTFRDVAVDFTQEEWGQLDPTQRILYRDVMLETFGHLLSIGPELPKPEVISHLEQGTEPWVTERGTTQGCYPGWEPR

SEQ ID NO: 18387 - protein, 81 aa, Pan troglodytes
TARSQETVTFKDVAMDFTPEEWGKLDPAQRDVMLENYRNLVSLWLPVSKPENYNLENGKEPLKLERKAPKSSYSDMETRPQ

SEQ ID NO: 18388 - protein, 81 aa, Delphinapterus leucas
FQESVTFKDVIVDFTQEEWKQLDPVQRDLFRDVTLENYTHLVSIGLQVSKPDVISQLEQGTEPWIVEPSIPVGALGDWETR

SEQ ID NO: 18389 - protein, 81 aa, Pan troglodytes
AQEPVTFRDVAIYFSREEWACLEPSQRTLYRDVMLDNFSSVAALGFCSPRPDLVSRLEQWEEPWVEDRERPELQAVRRGPR

SEQ ID NO: 18390 - protein, 81 aa, Rhinopithecus roxellana
RSCLSLLSNVAIELSLVEWQCLDRAQQNLYRDVMLENYKNLVSLGIAVSKPDLITHLEQNKEPRNIKKNEMLAKHPPQQGI

SEQ ID NO: 18391 - protein, 81 aa, Panthera pardus
MAFRDVAVAFTQKEWRLLSPAQRTLYRDVMLENYSHLVSLGIAFSKPKLITQLEQGDEPWKEESECLLDLCPAEPGTEFQP

SEQ ID NO: 18392 - protein, 81 aa, Panthera pardus
AQESLTFDDVAVNFTWEEWQLLAPAQKNLYRDVMLENYRNLVSLGFYPRKPDVLTKLAQGKPTGTVEDDIPFRTCSEIWKL

SEQ ID NO: 18393 - protein, 81 aa, Tursiops truncatus
SQSLLTFEEVAIYFSQEEWELLDPTQKALYNDVMQENYETVISLALFVLPKTKVICCLEQGEEPWVQGPPIFKDSPEELFS

SEQ ID NO: 18394 - protein, 81 aa, Tursiops truncatus
SQGLVSFKDVAVDFTQEEWQQLDPAQKTLYRDVMLENYSHLVSMGHPVSKPDVISKLEQGEDPWIIKRDIPNWIYPYEDQA

SEQ ID NO: 18395 - protein, 81 aa, Cercocebus atys
PLTFKDVAIEFSQEEWKSLDPVQKALYKDVMLENYRNLVFLGISPKCVIKELPPTENSNTRERFQTVALERHQSCDIENLY

SEQ ID NO: 18396 - protein, 81 aa, Sus scrofa
KFQAVTFTDVCVVFTEEELGLLDLAQRKLYRDVMLENFQNLLSVGHQSSKPDVIAQLEREERLWGTELQTQRGRLAGGRNQ

SEQ ID NO: 18397 - protein, 81 aa, Tursiops truncatus
SKAPVTFGDLAIYFSQEEWEWLSPIQKDLYEDVMLENYQNLVSLGLSFRRPNVITLLEKGKAPWMVEPVKRRRGLDLGSKC

SEQ ID NO: 18398 - protein, 81 aa, Bison bison
KPLAVRFADVAVYFSPEEWGYLRPAQRALYRDVMQETYGHLGALGFPGPKPALISWMEQESEAWSPAAQDPEEGENLGGAL

SEQ ID NO: 18399 - protein, 81 aa, Sus scrofa
VTFDDVAVTFTQEEWAQLDPAQRTLYQEVMLENFRLLVSLGERYRLEGGLEVFQPRSFRVFSSSLPPRIDVWPSVPEESST

SEQ ID NO: 18400 - protein, 81 aa, Ursus arctos
QEPVTFKDVIVEFNEEEWGQLDPAVKTLYRDVMLENYRNLNSLHQEQLLFKPVEISKLESKERRWTVEQETPSTSVSDREI

SEQ ID NO: 18401 - protein, 81 aa, Odocoileus virginianus
MDFTLENWEQLGQGQGDLFWDTALDNYQSLFLLNPPRPNLTFHPDGGEKLEALAKESPESTDADIAETFPLPQDFLEEGLF

SEQ ID NO: 18402 - protein, 81 aa, Odocoileus virginianus
QGLFTFRDVAIEFSQEEWECLAPSQRALYRDVMLDTYRNLVSLGEDNFSPEVDDLIGILSAGFAINKLSPRENTNVGELYG

SEQ ID NO: 18403 - protein, 81 aa, Muntiacus reevesi
HFKEAVIFTDVAVTFTEEELGLLDLAQKKLYQDVMLENFRNLVSVGCHPFRHDIFHLEKEKRLWVVKTATQSEGKSGNQNL

SEQ ID NO: 18404 - protein, 81 aa, Pteropus vampyrus
EVPGDGIHSVLTNTPVEEWQQLDPAQRTLYRDVMLENFSHLVSMGHPVSKPDVISKLEQGEDPWIIKRNISNWIYPDRKSN

SEQ ID NO: 18405 - protein, 81 aa, Pongo abelii
QGRLTFRDVAIEFSLAEWKFLNPAQRALYREVMLENYRNLEAVDISSKCMKKEVLSTGQGNTEVFHTGTLQRHESHHVGDF

SEQ ID NO: 18406 - protein, 81 aa, Monodelphis domestica
SQESITFKDVAVDFNQEEWGLLDHSQKELFREVMLENVQNVLIVGLPVPREIFISCFQQGKAPWLLEQKGPRNSCPEAESN

SEQ ID NO: 18407 - protein, 81 aa, Trichechus manatus
FMESVTFKDVAVVFTEEELGLLDPAQKKLYQDVMVETFRNLVSVGGKNPRQVELAPQAEPHEELSSLHIWQQIASDLTRCQ

SEQ ID NO: 18408 - protein, 81 aa, Bos indicus x Bos taurus
KDQRSLTLEDVAVDFTWEEWQLLAPPQKALYRDVMLENYSNLVSVGYQASKPAALSRLERGELWPVEDKVHSRICPEMRKD

SEQ ID NO: 18409 - protein, 81 aa, Sapajus apella
MLENYRNLVSLGLPFTKPKVISLLQQGEDPWKVEKDCSGSSSLGCKSNPKMTKTTQTQDSFQELMRKRLKRDEPWNFISER

SEQ ID NO: 18410 - protein, 81 aa, Trichechus manatus
CEVSVSFEDVTVDFSREEWRHLDSAQRRLYRDVTLENYSHLLSVGYQVPKPEVIFKLEQGEEPWTLEAETLHQSYSDSKFG

SEQ ID NO: 18411 - protein, 81 aa, Trichechus manatus
MLENYSHLVSVGYCISKPEVILKLEQGEEPLILEEEFSNLSYPDTFRWCFLSKDRETELINDSRNYSRKKTNEYNRGRKWH

SEQ ID NO: 18412 - protein, 81 aa, Trichechus manatus
KFQGSMTFKDVLVEFTQEEWRLLNPAQRTLYRDVMLENYSHLVSVGYVTKPSKVFKLKQGKEPWILEVESPRQGYPEGLWD

SEQ ID NO: 18413 - protein, 81 aa, Carlito syrichta
SKAPVTFGDLAIYFSQEEWEWLSPIQKDLYKDVMLENYENLVSLGLSSRKPNAITLLEKGKVPWMVEPARRRRGPDPRVKH

SEQ ID NO: 18414 - protein, 81 aa, Delphinapterus leucas
MAITFEDVTVNFTWEEWKFLDSSQKKLYREVMWENYTNVTSVGDWKESYRLQEERFRYFEHEHLSCWQGWRNASTQIYDNQ

SEQ ID NO: 18415 - protein, 81 aa, Carlito syrichta
AQGSVSFKDVTVDFTQEEWQHLDPAQKTLYMDVMLENYCHLISVGCHMTKPDVILKLERGEEPWTSFAGHTCLEENWKTED

SEQ ID NO: 18416 - protein, 81 aa, Rhinolophus ferrumequinum
MAVTFEDVTVIFTWEEWKFLDFSQKKLYREVMWENYTNVMSVGNWKKSYKPQKERFRYLEHENLSCWRGWRNASTQIYENR

SEQ ID NO: 18417 - protein, 81 aa, Colletotrichum gloeosporioides
LPRREVPVEFRREYWAKIQKEKRKSRRQVLEEERVKAVCGKVSVENEDVDNFADEEDNVTTEEERERKWTKKRKRIQLSRS

SEQ ID NO: 18418 - protein, 81 aa, Scylla olivacea
MLSPIEETDAQTYFTPAEWNCMVTIEKNRVTNMLRNYKCLLAQGIDAKPPDFVLRYENRKKQQLKMTEMYKSQMSFMKSPA

SEQ ID NO: 18419 - protein, 81 aa, Limnohabitans sp. Hippo4
LTFQESASLWTGRFWRGLKTFVADIARGFVNISHHSFALLGLMAVLISMLALARPEIRIQTVQSIQGWLYTRLHISDAEDE

SEQ ID NO: 18420 - protein, 81 aa, Fusobacterium varium
IGCGLDFRNRRLEIKDKVWYNLDLSEVIDYRNEMISSYPNEYNISGNILEADFWEKFPKGRAIFIFEGILMFFEKEEVYNT

SEQ ID NO: 18421 - protein, 81 aa, Gordonia sp. 852002-50816_SCH5313054-a
VDEAFADLTVDAVTGEREPESVASMRADDVVVIRSVTKTFGLAGLRAGYLLASPEIVERLSRGRRPWPLSTPALAALAECV

SEQ ID NO: 18422 - protein, 81 aa, Halomonas chromatireducens
VTVVVDEAFIDFVDEPGEALTPLLARFDNLILLRSLTKLYTLPGLRLGYLLAGAQTIRRLQAGQPPWSVNHLSAALVAPLL

SEQ ID NO: 18423 - protein, 81 aa, Callithrix jacchus
YQDSVTFDDVAVDFTQEEWTLLDPTQRSLYSDVMLENYKNLATVGGQIIKPSLISWLEQEEESRTVQGGVLQGRKPQWRET

SEQ ID NO: 18424 - protein, 81 aa, Macaca mulatta
VMFRDVAIDFSQEEWECLDSAQRDLYRDVMLENYSNLVSLDLPSRCASKDLSPEKNTYETKLSQWEMSDRLENCDLEESKS

SEQ ID NO: 18425 - protein, 81 aa, Bos taurus
MTKPDVILKLERGEEPWTSFKGHTCLEENWKAEDFLLKFKEQQDKYSRSVILINHKKLVNENRSTCEKTLTLSKNPINSKK

SEQ ID NO: 18426 - protein, 81 aa, Bos taurus
MIFYIFLFQEQLTFKDVAVEFSQEEWECLDPAQRAFYMDVMVETLRNLISVGEDHFASEIGICPWVSLHFPSVPLGSPCFA

SEQ ID NO: 18427 - protein, 81 aa, Ovis aries
MDFTLENWEQLGQGQGDLFWDTALDNYQNLFLLNPPRPNLTFHLDGGEKLEALAKESPESTDAGIAETSPLPQDFMEEGLF

SEQ ID NO: 18428 - protein, 81 aa, Otolemur garnettii
SLGHLTFRDVAIEFSQEEWKCLDPAQRALYRAVMLENYRNLVSLAGIFFPDLTVHSIWEEGNEPWSVEHEVKTATNSIQGE

SEQ ID NO: 18429 - protein, 81 aa, Otolemur garnettii
MLENYSNLVSVGYQASKPDALSRLEQGEPWTTEDEMYSRICPSKKIVDQNKSTKPNSTKSQVNKHQRTHDIEKTHVCSQCG

SEQ ID NO: 18430 - protein, 81 aa, Otolemur garnettii
SQRSTFFSNVTVAFAQEGWRHLVSTPRDRFKEGIPGKSRNLVLLGLSVSQSGMNSQLEQREGAWMLEGEDLRSTCPDWKIS

SEQ ID NO: 18431 - protein, 81 aa, Otolemur garnettii
SLVTVTFKDVAVDLTKEEWQQMKPAERILYRDVMLENYSNLVTVGCQVTKPAVIFKLEQEEEPWVMEEEMFGRHCPEVWEV

SEQ ID NO: 18432 - protein, 81 aa, Vulpes vulpes
FQGSVTFQDVAVDFTPDEWQLLDCDQRTLYWDVMLENFRNLISVGDPVTKTKVIFKAEQGQEPWMAEGEQPCWRYPEADYL

SEQ ID NO: 18433 - protein, 81 aa, Vulpes vulpes
PLTSLTFEDVAVRFSSPEWRCLNRTQRLLYTDVMLENYGNMLAVGSAFPKPPLISQLEQGAEPCLPDQGFLSCFPVSPDKS

SEQ ID NO: 18434 - protein, 81 aa, Otolemur garnettii
SVTFEDVAIYFSQEEWGLLDEAQRLLYHDVMLENFALITSLVCWHGTENEETSAPSIEGLSRVGSLKAGPSTENTHPCEMC

SEQ ID NO: 18435 - protein, 81 aa, Otolemur garnettii
SQGLVTFRDVSLNFSQEEWEWLDPSQKDLYRDVMLENYRNLVWLGLSISKPNMISLLEQGKDPWMVGTEISHSNYTDWETW

SEQ ID NO: 18436 - protein, 81 aa, Otolemur garnettii
SQASVSFKDVNVEFTQDEWQQMGPAQRNLYRDVMLENYSNLVSVGYCIFKPKVIFRLEQGEEPWSSEEEFSSQRRPKNYRD

SEQ ID NO: 18437 - protein, 81 aa, Vulpes vulpes
MFNDVSIVFSQEEWEYLDLEQKDLYRDVMLENYSNLVSLGCFISKPDVISLLEQGKEPWKVVRKGRRRYLDLENRYETKKL

SEQ ID NO: 18438 - protein, 81 aa, Otolemur garnettii
QGMLTFRDVAIEFSMEEWARLDPAQWNLYRDVMLENYRNLVSLGLAASKPDLITFLEQRKEPWNVKRHEIVAKHSVGIYIY

SEQ ID NO: 18439 - protein, 81 aa, Pan troglodytes
FEDVAVYFSQEEWRLLDDAQRLLYRNVMLENFTLLASLGLASSKTHEINSESASMPSWRAVAWISLWLRNRSANLLTQIFF

SEQ ID NO: 18440 - protein, 81 aa, Pan troglodytes
YQDSVTFDDVAVDFTPEEWALLDTTEKYLYRDVMLENYTNLASVEWEIQPRTKRSSLQQGFLKNQIFTGIQMQTRSYSGWK

SEQ ID NO: 18441 - protein, 81 aa, Pan troglodytes
LVTFADVAIDFSQEEWACLNSAQRDLYWDVMLENYSNLVSLDLESAYENKSLPTEKNIHEIRASKRNSDRRSKSLGRNWIC

SEQ ID NO: 18442 - protein, 81 aa, Pan troglodytes
FINVDQSARTRGRCVCGKTPSCGDRKSCVNSSFVTWYCFTKPELIFTLEQGEDPWLLEKEKGFLSRNSPEDSQPDEISEKS

SEQ ID NO: 18443 - protein, 81 aa, Pan troglodytes
CYQDSVTFDDVAVDFTQEEWTLLDSTQRSLYSDVMLENYKNLATVGGQIIKPSLISWLEQEESRTVQGGVLQGRKTQWRGT

SEQ ID NO: 18444 - protein, 81 aa, Pan troglodytes
RPGAVSFADVAVYFSPEEWECLRPAQRALYRDVMRETFGHLGALGFSGPKPAFISWVEGEVEAWSPEAQDPDGSRDGNEEK

SEQ ID NO: 18445 - protein, 81 aa, Pan troglodytes
PQGHLTFRDVAIEFSQAEWKCLDPAQRALYKDVMLENYRNLVSLGISLPDLNINSMLEQRREPWSGENEVKIAKNSDGREC

SEQ ID NO: 18446 - protein, 81 aa, Pan troglodytes
FQESVTFQDVAVDFTAEEWQLLDCAERTLYWDVMLENYRNLISVGCPITKTKVILKVEQGQEPWMVEEVNPHESSPGWSAV

SEQ ID NO: 18447 - protein, 81 aa, Pan troglodytes
LPQPPEDVAIEFSLEEWQCLDTAQQDLYRKVMLENYRNLVFLGIAVSKPDLVTCLEQGKDPWNMKRHSTVVKPPVICSHFA

SEQ ID NO: 18448 - protein, 81 aa, Pan troglodytes
KQGYVTFEDVAVYFSQEEWRLLDDAQRLLYRNVMLENFTLLASLGKVLIPHPSILSWSVESLHAALGIVTSAIPRGSCWQG

SEQ ID NO: 18449 - protein, 81 aa, Pan troglodytes
TVTFEDVAVKFTQEEWNLLSEAQRCLYRDVTLENLALMSSLGKFQHQRLLPREECYVCCECGKSFSKYVSFSNHQRVHTVK

SEQ ID NO: 18450 - protein, 81 aa, Camelus dromedarius
LQNSITFEDVAMDFTQEEWTLLNSSQRKLYRDVMLENYRNLASLGHQLSKPPLITQMEQEDDMEAAERRTHQDSCPGEPWL

SEQ ID NO: 18451 - protein, 81 aa, Camelus dromedarius
ALGTVTFEEVAVYFSQDEWRLLDEAQRLLYRDVMLENFVLVASLGLASSRSHVVVQLELGGEPWVVGTEQRTRRRLVCKKF

SEQ ID NO: 18452 - protein, 81 aa, Camelus dromedarius
AQETVTFKDVAVDFTQEEWGQLDPVQRTLYRDVMLETYGHLLSVGNQIAKPEVISLLEQGEEPWSMDRVYPPQRTCPEWMR

SEQ ID NO: 18453 - protein, 81 aa, Cercocebus atys
PLETVTFKDVAVDLTQEEWEQMKPAQRNLYRDVMLENYSNLVTVGCQVTKPDVIFKLEQEEEPWVMEEEMFGRNRNCCLWG

SEQ ID NO: 18454 - protein, 81 aa, Cercocebus atys
TARSQETVTFKDVAMDFTPEEWGKLDPAQRDVMLENYRNLVSLWLPVSKPENYNLENGKEPLKLERRTPKSSYSDVETRPQ

SEQ ID NO: 18455 - protein, 81 aa, Cercocebus atys
DSVTFEDVAVDFTQEEWTLLDQTQRNLYRDVMLENYKNLVAVDWESHINTKWSAPQQNFLQGKTSSVVEMGFALSPRPECS

SEQ ID NO: 18456 - protein, 81 aa, Cercocebus atys
MNSVSFEDVAVNFTLEEWALLDSSQKKLYEDVMQETFKHLVCLGKKWEDQDIEDDHRNRGGNRRGHMVERLCESRKGSKCG

SEQ ID NO: 18457 - protein, 81 aa, Leptonychotes weddellii
FEESVTFEDVAVYFSENEWTGLAPAQRVLYRDVMLENYGAVASLGCPFLKPAGISHLEQVEEPLNLKLRGEGPSLSCTEGV

SEQ ID NO: 18458 - protein, 81 aa, Leptonychotes weddellii
MLETYRNLVSLGAGPAGPKPGVITQLEQGDEPWVLDAQGAKGKERLRVSISGHGTRTEYKELSSREMLDGEELDQLQRAVP

SEQ ID NO: 18459 - protein, 81 aa, Leptonychotes weddellii
ARASLSFEDVAVGFSWEEWQLLAPSQKDLYREVMLENYRNLVSVGYQASKPDSLFHLEQGEPPWTVVGAAQSQTCQEIWEI

SEQ ID NO: 18460 - protein, 81 aa, Felis catus
PQASVSFKDITVEFTQEEWRQMDSAQRTLYRDVMLENYSHLVSVGNCIFKPAVIFKLEQGEEPWFLEEEFLNQSHQEDYRD

SEQ ID NO: 18461 - protein, 81 aa, Felis catus
AQGLMAFEDVAVYFSQEEWELLDAAQRALYCHVMLENFALVSSLGLSASRPWVVLQLERGEEPWVLSGTVVTPARNAQRKP

SEQ ID NO: 18462 - protein, 81 aa, Monodelphis domestica
SQGSITFKDVTMDFTQEEWMLLDHSQKGLYLEVMLENVQNLHSVGLLVPRENFISCFQQGEAPWLLEQDCPRRSCPEAKTN

SEQ ID NO: 18463 - protein, 81 aa, Enhydra lutris
MFKEAVTFKDVAVAFTEEELGLLDSAQRKLYQDVMLENFRNLVSVGHQPFKRDKWRTEREERLWLTKTAPQIERNVGGNSQ

SEQ ID NO: 18464 - protein, 81 aa, Pongo abelii
MDFTPEEWGKLDPAQRDVMLENYRNLVSLWLPVSKPENYNLENGKEPLKLERRAPKSSYSDVETRPQSKDSTSVQDFSKAE

SEQ ID NO: 18465 - protein, 81 aa, Pongo abelii
QGSVTFEDVAVYFSWEEWDLLDETQKHLYFNVMLENFALTSSLGCWRGVEHEETPSEQRISVERVPQFRTSKEGSSSQNAD

SEQ ID NO: 18466 - protein, 81 aa, Pongo abelii
EMGPLTFRDVAIEFSLEEWQCLDTAQQNLYRNVMLENYRNLVFLGIAVSKPDLITCLEQGKEPCNMKRHAMVAKPPVVCSH

SEQ ID NO: 18467 - protein, 81 aa, Pongo abelii
RESGKAPVTFDDITVYLLQEEWVLLSQQQKELCGSDKLVAPLGPTVANPELFCKFGRGPEPWLGSVQGQRSLLEHHPGKKQ

SEQ ID NO: 18468 - protein, 81 aa, Pongo abelii
EMGLLTFMDVAIEFSLEEWQHLDIAQQNLYRNVMLENYRNLAFLGIAVSKPDLITSLEQGKEPWNMKRHEMVDEPSGIYPH

SEQ ID NO: 18469 - protein, 81 aa, Pongo abelii
MLENYRNLVFLGIAVSKPDLITCLEQGKEAWSMKRHEIMVAKPTVMCSHFAQDLWPEQNIKDSFQKATLKRYGKCRHENLP

SEQ ID NO: 18470 - protein, 81 aa, Pongo abelii
PQVLLTFRDVAIEFSQEEWKCLDPAQRTLYRDVMLENYRNLVSLDISSKCMMKIFSTGQGNTEVFHTGTLQRQANHHVGDF

SEQ ID NO: 18471 - protein, 81 aa, Bos indicus x Bos taurus
MLENYRNLASLAGLVVSKLDLVTFLEQMKNPWDVRRLEPPAIYTAVSSHNTRGLMSKNPRLENLIQKANLGIYERAHLGNE

SEQ ID NO: 18472 - protein, 81 aa, Bos indicus x Bos taurus
AAVAICSDFGPPKIKSITVSIVSPSTCLVISKPDLVTFLEQMKDPWDTQRMETPAVHPAVSSHDTQGLRTQKPGLEDLFPT

SEQ ID NO: 18473 - protein, 81 aa, Bos indicus x Bos taurus
MGRLTFQDVAIDFTQEEWECLDLGQRELYRDVMLENYGNLASLGLVISKPDLVTFLEQMKDPWDIRRMETPAVHPGMCLWM

SEQ ID NO: 18474 - protein, 81 aa, Bos indicus x Bos taurus
GERCSLPAYLSPSWQGGVTFEDVFVYFSREEWELLEEAQRLLYRDVMLENFALVSSLGLAVSRSHGATQLEPEGSLGCLRR

SEQ ID NO: 18475 - protein, 81 aa, Bos indicus x Bos taurus
MTDLEAQQPSSSSLLYLLTGCHIIKPEVITKLEQGEEPWVVEGEFLLQSHPEEVWKVHDLMEGSQENEDKHSRQTESINNK

SEQ ID NO: 18476 - protein, 81 aa, Bos indicus x Bos taurus
VTFEDVAVSFSQEEWGLLGEAQRLLYYDVMLENLSLIASLGCWRGGDTEEARSDQCVSVERVTRDRNPQVDSSVLKAVTPT

SEQ ID NO: 18477 - protein, 81 aa, Bos indicus x Bos taurus
SQSPLTFGDVAVEFSGEEWAWLDSAQRSLHRSVMLENYRNLASLGLCLSKPEMISSLEQRKEPWAVKRKSTRGMHPDSQTL

SEQ ID NO: 18478 - protein, 81 aa, Pan troglodytes
YQDTVTFDDVAVDFTQEEWTLLDPSQRDLYRDVMLENYENLASVGHHLFKPSVIYWLEQEEELRAGRRAVLQEWRLKTKGP

SEQ ID NO: 18479 - protein, 81 aa, Pan troglodytes
SLKKVTFEDVAIDFTQEEWAMMDTSKRKLYRDVMLENISHLVSLRYQISISYIILQLEQGKELWREGREFLQDQNPDRESA

SEQ ID NO: 18480 - protein, 81 aa, Pan troglodytes
SYEGSVSFRDVAIDFSREEWRHLDPSQRNLYRDVMLETYSHLLSVGYQVPEAEVVMLQQGKEPWALQGERPRHSCPAPCLV

SEQ ID NO: 18481 - protein, 81 aa, Pan troglodytes
PQASVCFEDVAMAFTQEEWEHLDLAQRTLYREVTLETWEHIVSLDWKLTLEENRLNSEKRLRELVEVHGSSPQRAYRFRLS

SEQ ID NO: 18482 - protein, 81 aa, Pan troglodytes
PAQGIVTFEDVAVYFSWKEWGLLDEAQKCLYHDVMLENLTLTTSLGGSGAGDEEAPYEQSTSPQRVSQVRIPKALPSPQKT

SEQ ID NO: 18483 - protein, 81 aa, Pan troglodytes
HLTFKDVAIEFSQEEWKCLEPMQKALYKDVMLENYRNLVFLGISPKCVIKELPPTENSNTGERFQTVPLERHQSYDIENLY

SEQ ID NO: 18484 - protein, 81 aa, Camelus dromedarius
PCLRISVIKDVTVDFTQEEWQQLDSAQKALYRDVMLENYCHFVSVGFHMTKPDMIHKLEQGKELWTTGRIFPSRSYLGESV

SEQ ID NO: 18485 - protein, 81 aa, Camelus dromedarius
TLLSYSHFIPRLLPPPGSSPKDLTTDSPPRLHSESVTFRDVTVDFTQEEWQHLEPAQRDLYRDVMLENFRNLVSLGKGQLC

SEQ ID NO: 18486 - protein, 81 aa, Camelus dromedarius
LKGLVSFEDLSPTFTWEEWQDLDDTQRTLYRDVMLETCSSLVSLGVHIMGDLTETSQENHGRPLWQIVITSNKTSTKRTSD

SEQ ID NO: 18487 - protein, 81 aa, Camelus dromedarius
QNEGSLSFRDVAVVFTWEEWQLLDLVQKNLYQDVMLENYSNLVSVGYQDTRADAFCQLEQGKPWIAEEETHSQIHPGEWKP

SEQ ID NO: 18488 - protein, 81 aa, Myotis davidii
SQESLTFRDVFVDFTLEEWQQLDFSQKNLYRDVMLENYGHVVSVGYLVDTPDVIFRFGQGDEARREDGEPIIQSCPEFWKV

SEQ ID NO: 18489 - protein, 81 aa, Myotis davidii
WSQMPVTFEDVALYLSREEWGQLDHSQQSFYRDVLQKRNGLALGFPFSRTFWASQVQGKGEASSSCRQMGDEEEKRGAVEV

SEQ ID NO: 18490 - protein, 81 aa, Myotis davidii
LTFHDVAVDFSWEEWQLLGPEQKDLYRDVMLETYSHLVSLDPQLNLVCLSLLLFFMSRVSRQQTRHTLQVGTRGRTVGSTA

SEQ ID NO: 18491 - protein, 81 aa, Myotis davidii
FQDSVTFQDVAVDFTEKEWPLLDSSQRKLYKDVMLENYSNLASVGCQVGKPSLIFHLEQEEEPRTEERGLPQGTCPEKSTE

SEQ ID NO: 18492 - protein, 81 aa, Myotis davidii
FQEAVTFEDVAVHFTQAEWAGLSSTQRALYRSVMLENCGNLTSLGYTVPSSALISLLEGRDLPWGLEAQDDPPAERSTHVC

SEQ ID NO: 18493 - protein, 81 aa, Cercocebus atys
GEACMGGDVTFSDVAIDFSHEEDLYKDVMVQNYKNLVSVTGLSVTKPYVITLLEDGREPWMVEKKLSFGMIPDWESRWENK

SEQ ID NO: 18494 - protein, 81 aa, Cercocebus atys
YPVYFQVSVTLCEDVEWGQLDAAQRTFLSSNLTPCVLFRSPCTGCPLFEPELIYQLDRREELWIVKKDLSQSSYPDDNTKP

SEQ ID NO: 18495 - protein, 81 aa, Cercocebus atys
GSDSVAFEDVAVNFTHEKWALLDSSQKILYREVMQETCRNLASVGNKWKDQNIENHFEKPGSQYGQVVSQIPNLDLNENIS

SEQ ID NO: 18496 - protein, 81 aa, Cercocebus atys
GLTFRDVAIEFSQEEWKCLNSTQRTLYRDVMLENYRNLVSLDLSRNCMIKELAPQWESDREEVFHTVTLEQHEKHDIEEFC

SEQ ID NO: 18497 - protein, 81 aa, Cercocebus atys
QESVTLEDVAVDFTWEEWQLLGPAQKDLYRDVMLENYSNLVAVGYQASKPDVFFKLEQGEPSWTIEDGIHSGACSEIWKVD

SEQ ID NO: 18498 - protein, 81 aa, Cercocebus atys
TFKEAVTFKDVAVFFTEEELGLLDPAQRKLYQDVMLENFTNLLSVGHQPFKQDVSPLERNEQLWIVTTATQRQRNLGEKNQ

SEQ ID NO: 18499 - protein, 81 aa, Cercocebus atys
TQESLTLEDVAVEFSWEEWQLLDTAQKNLYRDVMVENYNHLVSLGYQTSKPDVLSKLAHGQEPWITAAKIQNKNCPGIGKV

SEQ ID NO: 18500 - protein, 81 aa, Leptonychotes weddellii
LQELVSFEDVVVNFSWEEWQDLDDAQQTLYRVVMLETYSSLVSLGHCITKPEVIVKLEQGAEPWTVEEAPTQSLPDVQTAD

SEQ ID NO: 18501 - protein, 81 aa, Leptonychotes weddellii
SSQGLLTFRDVAIEFSQEEWGCLNHTQRELYRDVMLENYGHLLFLGLIVSKPDLVSFLEQKKDPWDVKRKKTVAFHPGRWE

SEQ ID NO: 18502 - protein, 81 aa, Leptonychotes weddellii
PQESVTFKDIAVDFTQEEWALLDTSQRKLYRDVMLENISHLVSVGYHLCKSDVISQLEQGVELWREGRGFPQGLNPDRKSG

SEQ ID NO: 18503 - protein, 81 aa, Leptonychotes weddellii
MLENYSHLVSVGCCIPKPEVILKLEQGEQPWILEEESPSQSYPEVCKVDNQLEKNQETQDRHFCQPPFINNKTLTMHRGNV

SEQ ID NO: 18504 - protein, 81 aa, Leptonychotes weddellii
SQGLVTFEDVAVYFSLEEWERLDADQRDLYKDVMQENYGILVSLGYPIPKPDLIFRLEQGEEPWVPDSPRPDEGDIVTGVY

SEQ ID NO: 18505 - protein, 81 aa, Leptonychotes weddellii
APGLVTFEDVAVYFSREEWGLLNLTQRSLYRDVMLENFALIGSLGFAPSRSHVVAQLESEEELWVPNMVDLTLGSRAEVRK

SEQ ID NO: 18506 - protein, 81 aa, Felis catus
SQVSLTFEDVAVLFTRDEWRKLGPFQRNLYQDVMLENYSNLVSLGLLFSKPKVISLLQQGDDPWKVEKESPGGPSLGWKGS

SEQ ID NO: 18507 - protein, 81 aa, Leptonychotes weddellii
TQDSVAFEDVTVKFTMEEWALLDPSQKKLYRDVMQETFRNLASIVCISEEKWEIHDSEDQNENRGTDLSQMVERLCKSKEC

SEQ ID NO: 18508 - protein, 81 aa, Felis catus
YLLQGLLTFRDVAVEFSQEEWGCLNHSQQELYWDVMLETYGHLLFLGLVSKPDLVIFLEQKRELWDVKREETVATHPGRWE

SEQ ID NO: 18509 - protein, 81 aa, Leptonychotes weddellii
NFWILRLPPGSKGEAPKEWGKLDEWQKELYKHVMRGNYETLVSLDYAISKPEVLSQTEQGKEPCSWRRTGPKVPDVPVDPS

SEQ ID NO: 18510 - protein, 81 aa, Leptonychotes weddellii
QDSVTFEEVAVDFSQEEWALLDPAQKILYRDVMLENYRNLASVGYPLCKHSLIMEVEQEVLGTEEGAVLQGAYTDWDIQLK

SEQ ID NO: 18511 - protein, 81 aa, Neomonachus schauinslandi
SRVSVTFEDVAVLFTRDEWRKLGPSQRNVYQEVMLENYSNLVSLGLLFSKPKVISLLQQGEDPWRVEKESPGGPSLGWKSS

SEQ ID NO: 18512 - protein, 81 aa, Felis catus
MAEGFKFKDVAIYFSQKEWECLHPSQKGLYRDVMLENYNNLISLGLSDSKPNVISLLEQGKEPWMVKSKETKEWCPDWESR

SEQ ID NO: 18513 - protein, 81 aa, Neomonachus schauinslandi
SQSLLTFEEVAMYFSQEEWELLDPTQKALYNDVMRENYETIISLAVPIHQILAFSEKTNTKDWTVAPEFVLPESQSLSLTF

SEQ ID NO: 18514 - protein, 81 aa, Neomonachus schauinslandi
LMEAVTFGDVAVHFSREEWQCLDPGQRALYKEVMLENHSSVAGLAGFLVFKPELISRLEQGQEPWVIDLKGVEGREGARTC

SEQ ID NO: 18515 - protein, 81 aa, Neomonachus schauinslandi
FQGSVTFRDVAIDFSQEEWEWLQPAQRDLYRHVMLENYGHLVSLAGLNISKPYVVSLLEQGREPWLEKGDVRRDLFSESNG

SEQ ID NO: 18516 - protein, 81 aa, Cebus imitator
LVMFQDLSIDFSQEEWECLNPAQKDLYRDVMMENYNSLLSLDLKFRCKTKYSCLPKEIYEVTSSQWVRMEKRHSLVGSSIR

SEQ ID NO: 18517 - protein, 81 aa, Cebus imitator
MLENYGNLTAMGYPVPKPALISLLEGGDVAWDLEAQDDPLAEGTKNICKDAETNTDGESALTQKISEERDGMMSHGQLRSV

SEQ ID NO: 18518 - protein, 81 aa, Cebus imitator
AQEQVTFWDVAVYFSREEWECLEPSQRALYRDVMLDNFSNVAALGFCSPRPDLLSRLEQWEEPWVEDQERPELQAVQRGPH

SEQ ID NO: 18519 - protein, 81 aa, Cebus imitator
FQKPVTFEDVAVNFTQEEWDFLDASQRVLYQDVMSETFKNLASVARMFLHKPELITKLEQQEKQWRVTRVLQASRGGPPFF

SEQ ID NO: 18520 - protein, 81 aa, Macaca mulatta
LQASVSFQDVTVEFTQEEWQHLGPLERTLYRDVMLENYSHLISVGYCITKPKVISRLEQGEEPWSLEDEFLNQKHQGYFKV

SEQ ID NO: 18521 - protein, 81 aa, Callithrix jacchus
FQGRLTFKDVSVEFSSAEWKCLTPAQRALYRDVMLENYRNLESVGEENVPPDTRNPLHTGEKPYKCNECGKTFSQNSSLVM

SEQ ID NO: 18522 - protein, 81 aa, Monodon monoceros
VMFQVTFSDVAIDFSHEEWGWLDPTQRNLYKDVMVQNYENLVSLGLSIPKPYVIALLEDGKEPWMVEKKLSKSLFPDWKSR

SEQ ID NO: 18523 - protein, 81 aa, Callithrix jacchus
FQETLTFRDVAIEFSLEEWQCLDTAQQSLYRNVMLENYRNLVFLGENNFNTQFLIYSKTMCYFPKNLWPEQDMKGSSKQVI

SEQ ID NO: 18524 - protein, 81 aa, Macaca mulatta
EMGLLTFRDVAIEFSLEEWQHLDIAQQNLYRNVMLENYRNLAFLGIAVSKPDLIICLEQGKEPWNMTQHEMVDESPGICPR

SEQ ID NO: 18525 - protein, 81 aa, Callithrix jacchus
MGPLTFMDVAIEFSLEEWQLLDTAQQNLYRDVMLENYRNLVFLGTAFSKPDLITYLEQGKEPWNMKRHETVAKPPAMCSYF

SEQ ID NO: 18526 - protein, 81 aa, Macaca mulatta
MGVLTFRDVAIEFSLEEWQCLDTAQQNLYRNVMLENYRNLVFLGIGVPKPDLITCLEQGKEPWNMKRHKMVAKPPVVYSHF

SEQ ID NO: 18527 - protein, 81 aa, Bos taurus
GISVSKPDVISLLEQGKEPWMVKEEGPRGACPGWEYTFKNKEFPSKQVIYEESSKVMMMGRSHLSYNLNCSSWRGDSKSKD

SEQ ID NO: 18528 - protein, 81 aa, Bos taurus
MKVILNLLLFHVTLYFFPSVQDVSFLFFFFFLGCFISKPDVISLLEQGKEPWKVVRKGRRQYPDLETNYEIKKLSSENDIY

SEQ ID NO: 18529 - protein, 81 aa, Ovis aries
SQDSVTFADVAVYFTQEEWTLLNPFQRKLYRNVMLENYKNLTTAGYQAFKPTLVSWLEQDVLKTVERGILQEWEMQPISND

SEQ ID NO: 18530 - protein, 81 aa, Ovis aries
PVTFKDVAVDFSQEEWGQLGSPQRALYRDVMLENYQNLLSLGPPVCKPDVISHLERGEEPWRAPRFLPEPGREPGPEAEET

SEQ ID NO: 18531 - protein, 81 aa, Ovis aries
SQSPLTFGDVAVEFSGEEWAWLDSAQRSLHRSVMLENYRNLASLGLCLSKPEMISSLEQRKEPWAVKRKSTGGECADSQTL

SEQ ID NO: 18532 - protein, 81 aa, Ovis aries
QQRPVSFKDVVVGFTQEEWHGLNPAQRALYRDVMLETYSNLVSVGYKGTKPYVILQLEQEEAPWICEAACSGCHCQENIWQ

SEQ ID NO: 18533 - protein, 81 aa, Ovis aries
FQGRLTFQDVAIDFTEEEWECLDLGQRELYRDVMLENYRNLASLGLVVSKPDLVTVLEQMKTPWDVRRLETPAVYTGRGQW

SEQ ID NO: 18534 - protein, 81 aa, Otolemur garnettii
PVTIEDVVVDFTQEEWQHLDPARKTLHRDVMLDTCCHLVSVGCSGIKPVLVFRIICGELSCQREIMQRSPKDNLLYSILKA

SEQ ID NO: 18535 - protein, 81 aa, Otolemur garnettii
KQGVLTFKDVSIEFSVEEWACLDPAQQHLYREVMLETYRHLVFLDLAVSKPDLITCLEQSKEPWKVKTQQTLVKHPDTSMS

SEQ ID NO: 18536 - protein, 81 aa, Otolemur garnettii
FQESLTFRDVVINFSRHEWNYLSIAQKTLYRDVMMENYGNLVSLAGPSMSKPHIITLLEQGKEPWMVVREETRRECTGKSK

SEQ ID NO: 18537 - protein, 81 aa, Vulpes vulpes
MLENYSHLVSLGLNISKPYVVSLLEQGKGPWLEKGDLRRDLFSESHGEIKEFSPNNVICEYDSSQYLVVERILNQDPDHSS

SEQ ID NO: 18538 - protein, 81 aa, Vulpes vulpes
PQGPVTFEDVAVYFPQSQWTSLDPMQRALYREVMLENYANITSLAAFPFPKPDLIFQLERGEAPWGLDPWIPTEGEALGGV

SEQ ID NO: 18539 - protein, 81 aa, Otolemur garnettii
VTFRDVVISFSQEEWEYLDSDQRDLYWDVMMENYSNLVSLDLESRNETKSLSGGKDVIKNHDCRCEIMESSKLFSLKSSIF

SEQ ID NO: 18540 - protein, 81 aa, Vulpes vulpes
AQESVMFSDVSIDFSQEEWECLNDDQRDLYRDVMLENYSHLVSMGHSVSKPDVISFLEQGKEPWLVDRELTRDQWPVLESR

SEQ ID NO: 18541 - protein, 81 aa, Enhydra lutris
LPDLVTFEDVAVEFTQEEWALLDPSQRTLYRDVMQENCRNLASLGYHVDKPSLISQLEQEDKVVTEERGILPGSCPDLDTV

SEQ ID NO: 18542 - protein, 81 aa, Enhydra lutris
LLQGLLTFRDVAIEFSQEEWGRLTHTQWELYRDVMLENYGNLLSLSLVVSKPDLVIFLEQKRELWDVKGKETVAIHPGRWE

SEQ ID NO: 18543 - protein, 81 aa, Pongo abelii
RPGAVSFADVAVYFSPEEWGCLRPAQRALYRDVMRETFGHLGALGFSGPKPAFISWVEGEVEAWSPEAQDPDGSRDGNEEK

SEQ ID NO: 18544 - protein, 81 aa, Pongo abelii
MLETYNHLVSLEIPSSKPKLIAQLERGEEPWGEERKCPLDLCPESKPEIQLCLSRPLIFSSQQALSQHVWLSHLSQLFSSL

SEQ ID NO: 18545 - protein, 81 aa, Pongo abelii
SKESVSFKDVAVDFTQEEWGQLDSPQRALYRDVMLENYQNLLALGPPLHKPDVISHLERGEEPWSMQREVPGGPCLEWELK

SEQ ID NO: 18546 - protein, 81 aa, Pongo abelii
FQGPVTLKDVIVEFTKEEWKLLTPAQRTLYKDVMLENYSHLVSVGYHVNKPNAVFKLKQGKQPWILEVEFPHRGFPEDLWS

SEQ ID NO: 18547 - protein, 81 aa, Pongo abelii
TLKEAVTFKDVAVVFTEEELRLLDLAQRKLYQEVMLENFRNLLSVGHQPLHRDTFHFLKEEKFWMMETATQREGNLGGKIQ

SEQ ID NO: 18548 - protein, 81 aa, Pongo abelii
TGEDVTFSDVAIDFSHEEWGWLNSAQRDLYKDVMVQNYENLVSVGLSVTKPHVIMLLEDGKEPWMMEKKLSKGMIPDWESR

SEQ ID NO: 18549 - protein, 81 aa, Pongo abelii
MFKEAVTFKDVAVAFTEEELGLLGPAQRKLYRDVMVENFRNLLSVGHQPFKQDVSPIERNEQLWIVTTATRRQGNLGEKNQ

SEQ ID NO: 18550 - protein, 81 aa, Vulpes vulpes
SVGPVSFKDIAVDFTQEEWQQLDPEQKTTYRDVMLENYDHLVSVGCHIIKPEVIIKLEQGEEPWIVGGEFLPQSYPEEVWK

SEQ ID NO: 18551 - protein, 81 aa, Otolemur garnettii
LQELLTFKDVSVEFSVDEWACLDPAQQTLYRDVMLENYRHLVFLGLTPSKPHLITCLEQSKEPWKVKAYQTVVKHPAVSNH

SEQ ID NO: 18552 - protein, 81 aa, Otolemur garnettii
THELVLFRDVAIDVSQEEWECLNPAQKNLYKDVMLENYSNLVSLGKTLSQKKKKKKSVLREDSWLSAYSSVGLWPHTLGLE

SEQ ID NO: 18553 - protein, 81 aa, Vulpes vulpes
VQGSMSFEDVIVVFTQDEWQYVSPAQRTLYRDVMLENYSHLISVGYCTTKPKIIFKLEQGEESASLGEEFLNQRYLGYFSV

SEQ ID NO: 18554 - protein, 81 aa, Otolemur garnettii
LQGPVSFKDVAVDFTQEEWHQLDPEQKIIYRDVMLENYSNLVSVGYHIIKPDVIMKLEQGEEPWIVEGEFLLQSYPDFFLG

SEQ ID NO: 18555 - protein, 81 aa, Otolemur garnettii
FQGMLTFKDVSIEFSMDEWACLDPAQQNVYRDVMLENYRHLVFLGLAVSKPDLISCLEQSKEPWKVKSYQTVVKHPGRFEG

SEQ ID NO: 18556 - protein, 81 aa, Otolemur garnettii
SELFRDVAILFSQEEWQWLVPAQRDLYRDVMLETYSNLVSLVLESGCDAKVLSPKQHIYEVESPQWEIVESLTGYSLECSS

SEQ ID NO: 18557 - protein, 81 aa, Otolemur garnettii
AHDLMMFRHVAVDFSQEKWECLNSYQRNLYRDVILENYSNLVSLDCSISKPDVITLLEQGKEPWMVVRDEKRRWSLDLGSK

SEQ ID NO: 18558 - protein, 81 aa, Otolemur garnettii
LQGTVTFKDVAINFTQEEWKQLDPAQRNLYRNVMLENYKNLIIVGCPFTKPDVIFKLEQEEEPWVLEEEVLRRHCPGEIWG

SEQ ID NO: 18559 - protein, 81 aa, Otolemur garnettii
QGSVSFKDVAIDFSREEWQHLDPSQRNLYWDVMLETYSHLLSVGYQLPKGEAGMLEQGKEPWALQGENPHQSCPGEKLLDH

SEQ ID NO: 18560 - protein, 81 aa, Otolemur garnettii
MYFSQEEWELLDPTQKALYNDVMQENYETIISLALFVLPKPKVISCLEQGEDPWVQVSLEFKDSAGESSTGLMLQNDTENH

SEQ ID NO: 18561 - protein, 81 aa, Vulpes vulpes
MAAAAALGDPAQEEWGLLDEAQRLLYCDVMLENFALIASLGLTSFRSYIVAQLQMGAEPWVPDRVDMTSAMARGAYSGPIS

SEQ ID NO: 18562 - protein, 81 aa, Otolemur garnettii
QESVSFEDVTVEFTQEEWQHLGPAQRTLYRDVMLENYSHLVSLGYCITKPKVIFKLEQGEEPWSLEDEFLSQKYPGYYKID

SEQ ID NO: 18563 - protein, 81 aa, Pan troglodytes
QEGVNFKIVTVDFTQEEQGTWNPAQRTLDRDVILENHRDLVSWDLATAVGKKDSTSKQRIFDEEPANGVKIERFTRDDPWL

SEQ ID NO: 18564 - protein, 81 aa, Pan troglodytes
PQVSLTFEDVAVLFTRDEWRKLAPSQRNLYRDVMLENYRNLVSLGLPFTKPKVISLLQQGEDPWEVEKDSSGVSSLGSKSS

SEQ ID NO: 18565 - protein, 81 aa, Pan troglodytes
QDSVTFDDVAVDFTPEEWALLDTTEKYLYRDVMLENYMNLASVDFFFCLTSEWEIQPRTKRSSLQQGFLKNQIFSGIQMTR

SEQ ID NO: 18566 - protein, 81 aa, Pan troglodytes
EKGPLTFRDVAIEFSLEEWQCLDSAQQSLYRKVMLENYRNLVFLAGIALTKPDLITCLEQGKEPWNIKRHEMVAKPPVICS

SEQ ID NO: 18567 - protein, 81 aa, Myotis davidii
CGESLSFKDIVMGFTWEEWQLLDPAQKCLYRDVILENYRNLVSIGYHGTKPDLIFKLEQGEEPWIGNAKSSHQSCPEDWKE

SEQ ID NO: 18568 - protein, 81 aa, Myotis davidii
VIFEDIALYFSREEWSLLDEGQRQLYLNVMLENFEIISSLGCCCRAGNVEAQLEENIAVRVSQAKNPKLALSSQKSHHPCE

SEQ ID NO: 18569 - protein, 81 aa, Myotis davidii
VTFEDIALYFSREEWSLLDEGQRQLYLDVMLENFELLSSLGCCCGGESVEETTEQKVSVRLSQTRNPKLALSSQKSHPCES

SEQ ID NO: 18570 - protein, 81 aa, Cercocebus atys
PQGLLTFRDVAIEFSQEEWKCLDPAQRTLYRDVMLENYRNLVSLEFQSVTQAKVQCDLGSLQPPLPRFKQFSCLSLPSSWD

SEQ ID NO: 18571 - protein, 81 aa, Cercocebus atys
DSVTFDDVAVDFTQEEWTLLDPTQRSLYSDVMLENYKNLAIVGWEMQLETQWSALQQDSLTGQTSIGMQLEGKHNGGELCD

SEQ ID NO: 18572 - protein, 81 aa, Myotis davidii
AVTFQDVAVVFTEEELGLLDPSQRKLYQDVMLENFRNLVSVGYRNQNEIETLQQVGLRDLFQEDLVCWPIWEQIMSKLTRN

SEQ ID NO: 18573 - protein, 81 aa, Cercocebus atys
MGPLTFRDVTVEFSLEEWQCLDTAQRNLYRDVMLENYRNLVFLGIAVSKPDLITCLEQGKEPWNMKRHEMVDKPPVMCSHI

SEQ ID NO: 18574 - protein, 81 aa, Cercocebus atys
QGRLTFRDVAIEFSLAEWKCLNPAQRALYREVMLENYRNLESVDISSKCMMKEILSTGQGNTEVLHTGTLQRHESHHIGDF

SEQ ID NO: 18575 - protein, 81 aa, Cercocebus atys
LQELLTLEDVTVEFTWEEWQLLDPFQKDLYRDVMLEIYSNLVSMGYQVSKPDALSRLERGEEPWTMEDERHSQICPENNKV

SEQ ID NO: 18576 - protein, 81 aa, Leptonychotes weddellii
HGSPPFSNVTVAFTQDGWRHLIPAPRGTPRFKEGIPENARNLVLLGLPVSQPGMNSQLEQREEGPWMLEGGGLRSTCPDWK

SEQ ID NO: 18577 - protein, 81 aa, Leptonychotes weddellii
AQISVTFDDVAVTFTQEEWGQLDPAQRTLYQEVMLENCGLLVSLGCPVPRPELIYQLEHGQELWTVKRDLSQITYPGDKGK

SEQ ID NO: 18578 - protein, 81 aa, Felis catus
REESLTLEDVAVDFTWEEWRLLAPAQKDLYWNVMLENYRNLVSLGYQARQPDSLSELEQEEPPWIFKDEVQSQTHPEIERV

SEQ ID NO: 18579 - protein, 81 aa, Felis catus
MLVTFDDVAVTFTQEEWGQLDAAQRTLYQEVMLETCRLLVSLGCSLPKPEQIYPLERSPELWTLQRGLSSSNCPGDNIKPE

SEQ ID NO: 18580 - protein, 81 aa, Felis catus
APDSMSFEDVAVYFSWEEWRLLDEAQRCLYHDVMLENFALISSLGCCCGAEDAEAPLEQSVSVGVSQASTPKAALSSRKTH

SEQ ID NO: 18581 - protein, 81 aa, Felis catus
MVQESVTFKDVVVLFTQDEWAQLSPTQRALYRDVMLENYSNLVSLGLLGSQPDVLSQLGKGEEWMLEDTSAGFCLDWMTMP

SEQ ID NO: 18582 - protein, 81 aa, Felis catus
GRLTFRDVAIEFSQEEWECLDPCSEGLYRDVMLENYRNLVSLGIPSDGFAIKELSPTEDINKGEFYHLVILERNESYGIKD

SEQ ID NO: 18583 - protein, 81 aa, Neomonachus schauinslandi
SQESVTFQDVAVDFTEKEWPLLDSSQRKLYKDVMLENYSNLASVGYQVGKPSLISHLEQEEELRTEERALHRATSPDWETP

SEQ ID NO: 18584 - protein, 81 aa, Neomonachus schauinslandi
MAHLMMFRDVAVDFSQEEWECLGLEQRHLYRDVMLENYSNMISLGLCIYQPDVFSLLEKGKEPWMVLQDETRGPCPDMQSR

SEQ ID NO: 18585 - protein, 81 aa, Neomonachus schauinslandi
MYFTREEWNKLERAQKDLYRDVMLENYRNMILLGFQFPKPEVICLLEQWEEPWILDLPRAGTRKASSSACPGSEARCKTKK

SEQ ID NO: 18586 - protein, 81 aa, Neomonachus schauinslandi
AGRPAEMAVSEPGGSAAEWEQLDPAQRNLYKDVMLENYSNLASMGYQAPKPDMISKLEKGEEPWLGKGKRPRQGGPSEIAR

SEQ ID NO: 18587 - protein, 81 aa, Neomonachus schauinslandi
MFRDVAIDFSQEEWEYLDSAQRDLYRDVMLENYSNLVSLVDLPSRSANKDLSPKKDTYETELSQWEMSARLENCDLEESSS

SEQ ID NO: 18588 - protein, 81 aa, Neomonachus schauinslandi
TARSQASVTFKDVAMDFTPEEWGKLDPAQREVMLENYRNLVSLWLPVSKPENYNLENGKEPLMLERKAPKSSYSDLETKPE

SEQ ID NO: 18589 - protein, 81 aa, Neomonachus schauinslandi
MDSVVFEDVVVDFTQEEWALLNPAQRKLYKDVMLETFRNLVSVDDETQLKTNGSISQQDIFGEKLSNEQKIAMFTKNDFWT

SEQ ID NO: 18590 - protein, 81 aa, Neomonachus schauinslandi
FQESVTFKDVIVDFTQEEWKQLDPVQRDLFRDVTLENYTHLVSIGLQVSKPDVISQLEQGTEPWIVEPGIPVGASGDCETR

SEQ ID NO: 18591 - protein, 81 aa, Neomonachus schauinslandi
MFKETVTFKDVAVAFTEEELGLLDSAQRKLYQDVMLENFRNLVSVGHQPFKQDQWHIEREERLWLMKTATQIERNVGGNNQ

SEQ ID NO: 18592 - protein, 81 aa, Neomonachus schauinslandi
SLDSVTFTDVAIDFSQDEWEWLNLAQRSLYKKVMLENYRNLLSLGLCISKPDVIALLEQGKEPWMMKGEMTGGLCPDLEYI

SEQ ID NO: 18593 - protein, 81 aa, Monodelphis domestica
QVPVTFEDLAVRFSAEEWHLLEEWQREFHRDVMRENYEMLVSLGTAQLLPLSAFLSLTEPQEDMGDNGCSDGEWERPGGGL

SEQ ID NO: 18594 - protein, 81 aa, Monodelphis domestica
MLQRTIRMNTEKKSSGIPVSKPNVITLLEQGKEPWILEKELPRDTSAGLPIPKPKLISRTEQGKEPRMLEKEVPGSTSADI

SEQ ID NO: 18595 - protein, 81 aa, Camelus dromedarius
MLLQISFEDVAVDFTLEEWQLLNPTQKNLYREVTLENYSNLMFLGYQIFKPDAIFRLEREKPWVADEETLSQGFSALTQDE

SEQ ID NO: 18596 - protein, 81 aa, Camelus dromedarius
PQGRVTFEDVAVYFSWDEWGLLDETQRLLYRSVMLENFALMASLGFTSSRTCEITELERWEEPFLPPPGVRAAAVPRDHPV

SEQ ID NO: 18597 - protein, 81 aa, Cercocebus atys
TCDEAVTFKDVAVVFTEEELELLDPAQRKLYQDVMLENFRNLLSVGHQPFHGDTFHFLREEKFWVMETTSQREGTPGTILL

SEQ ID NO: 18598 - protein, 81 aa, Cercocebus atys
FQGMVTFKDVAVVFTREELGLLDLAQRKLYQDVMLENFRNLLSVGYHPFKLDVILQLGREDKLWLTETEIQGDGCSGENHA

SEQ ID NO: 18599 - protein, 81 aa, Cercocebus atys
GGLLTFRDVAIEFSQEEWKCLDPAQRTLYRDVMLENYRNLVSLDVSSKCMLKTLSSTGRGNTEVILIGTLQTQASHHTGEF

SEQ ID NO: 18600 - protein, 81 aa, Cercocebus atys
MESVTLEDVAVEFIQEWALLDSARRSLCTYGMLDQCRTLTSRGTPPCKPSRVSQLGPRAEPRATERGILHATGVAWESQLK

SEQ ID NO: 18601 - protein, 81 aa, Cercocebus atys
PQGLLTFRDVAIEFSQEEWKCLDSAQRTLYREVMLENYRNLVSLDISSKCMMEFLSTAQSNREVIHTGTLERHESHHIGDF

SEQ ID NO: 18602 - protein, 81 aa, Cercocebus atys
MEGLVMFQDLFIDFSQEEWECLDTAQKDLYRDVMMENYSSLVSLGLCIPKPDVISLLEQGKEPWMVSRDVLGGWCPDSEFR

SEQ ID NO: 18603 - protein, 81 aa, Leptonychotes weddellii
PQDLMTFEDVAVEFTQWEWGQLDLAQKDLYRAVMLENFKNLASLGLPVSKPYVISQMEEGKEPYVLEGEISTEWEQGCDLW

SEQ ID NO: 18604 - protein, 81 aa, Felis catus
MLENYGTLVSLGIPSSTPKVICRLQQGKDPCVVERETPQDACLGFKTWPEMEASPPRQDISIEETSQGIIKKKSIKFGHWD

SEQ ID NO: 18605 - protein, 81 aa, Leptonychotes weddellii
AQASVSFKDVTVEFTQEEWRQMNSAQRALYRDVMLENYSHLVSVGYCFTKPELIFTLEQGEDPWLLKKEFLRKSSPEDSQP

SEQ ID NO: 18606 - protein, 81 aa, Leptonychotes weddellii
AREPVTYEDVAVDFTQEEWQHLDPAQKTLHRDVMLEIYSHLVSVGCSGIKPGIIFKLEHEEDPWIIKSELSRWIHSDREKS

SEQ ID NO: 18607 - protein, 81 aa, Leptonychotes weddellii
SQSPVTFEDVAVYFSKEEWGLLDETQRRLYHHVMLENFELMTSLGCWHGVEDEGAHSKQNTSVEGMSQVRIPSANPSTQKA

SEQ ID NO: 18608 - protein, 81 aa, Felis catus
TQVSVTFDDVAVTFTQEEWGQLDPAQRTLYQEVMLENCGLLVSLGCPVPRPELICQLERGQEPWTAKRGLSQNIYPGDKDK

SEQ ID NO: 18609 - protein, 81 aa, Felis catus
PHWLVTFRDVAIDFSQEEWECLNSTQRDLYRDVMLENYSNLISLAGCAIPKPDVFSLLEQGKDPWMVTRAMTRRWSSDLES

SEQ ID NO: 18610 - protein, 81 aa, Neomonachus schauinslandi
GQGSVSFKDVTVDFTQDEWLQLTGTQRTLYRDVMLENYSHLVSVGCHLTKPDVIFRLEQGEELWPSEGEFPDQGDQGEKPS

SEQ ID NO: 18611 - protein, 81 aa, Neomonachus schauinslandi
MLENYRNLVSVGYMASKPDALSRLEQGELWTTEHEIPSRIRPEIKKDDGHLQGHLQNQRCPKRMKQCHEHNAFGNVIHQSK

SEQ ID NO: 18612 - protein, 81 aa, Neomonachus schauinslandi
AQVPLTFSDVAIDFSQEEWECLNSDQRDLYRDVMLENYTNLVSLDIDFTTETNKLSSEKSSYEVNSYHRETMKKSKTFNLM

SEQ ID NO: 18613 - protein, 81 aa, Neomonachus schauinslandi
QGSVTFEDVVVYFSWEEWGLLDETQRCLYHDVMLENFALVISLGCWYGMEDEEAVSVQEMALSKTPSPDSSVWRAQPCEKC

SEQ ID NO: 18614 - protein, 81 aa, Neomonachus schauinslandi
PQEPVTFEDVAVYFTQNQWASLDPTQRALYREVMLENYASVASLVFPFPKPDLVSQLERGEAPWGPDPWEAEVLRGICPGG

SEQ ID NO: 18615 - protein, 81 aa, Monodelphis domestica
SQASVTFQDVAVNFSRDEWKRLNEAQRALYKEVMLENYQNMVSLGLPVSEEEVKVLFERAEAPRRSKRRASGTLTPDSISQ

SEQ ID NO: 18616 - protein, 81 aa, Monodelphis domestica
AQEVVSFKDVAVDFTREEWRLLSPPQKELYKEVMLENARNLLSVGLPAPSEEVISYLEQREAPWILEQEGLRNCCSEGEIR

SEQ ID NO: 18617 - protein, 81 aa, Monodelphis domestica
FQASLMFEDLAVYFSREECVSLDPSQNSLYWESVPKNCKDLSPFGDNSEKEEENFHQENGELEAVSSEWYKRDISLLPKLG

SEQ ID NO: 18618 - protein, 81 aa, Monodelphis domestica
PQRPVTFGDVSVDFSRDEWRRLSPAQRLLYRDVMLENFGNLVLLGLAVSKPELIRRLERGEAPWLPGRGASRAASPGSARS

SEQ ID NO: 18619 - protein, 81 aa, Physeter macrocephalus
QVSMAFQDLAVRFSKDEWRLLGQGQRALYLDVMRENYETLASLGTVELLPLSAFLSPSEPGGAMGGGSCAGDGQEPPRGGG

SEQ ID NO: 18620 - protein, 81 aa, Monodelphis domestica
SVTFKDVAVNFTQEEWQQLNPAQRDLYRDVMLENYRNLISLGKESKPEAQGSTPKQKISEEVESSGMLMERFTREVPVSED

SEQ ID NO: 18621 - protein, 81 aa, Monodelphis domestica
RQESMTFKDVAVEFTWEEWRYLNPSQKKLYRDVMLENYRNLVFLGFAISKPEVIHHLERKEAFWRPESDIPRNNCPESKEF

SEQ ID NO: 18622 - protein, 81 aa, Physeter macrocephalus
NFWVLRLPPGSKGEAPKEWGKLDECQRELYKHVMRGNYETLVSLDYAISKPEVLSQIEQGKEACSWRRAGPKVPDVPVDPS

SEQ ID NO: 18623 - protein, 81 aa, Monodelphis domestica
MAVMLENAQNFFFLGLLFPRESNISCFQPGEAPWMQESEGPRNSCPEIKFKVKEMGTKLSIFAEESHHEKSIGHASCDFSL

SEQ ID NO: 18624 - protein, 81 aa, Monodelphis domestica
PAQEVVTFQDVAVDFTRGEWRLLSPPQKELYKEVMLENAWNLLSVGLAVPRDVISYVEPREAPWRLEQEGLRSCSPGEIRP

SEQ ID NO: 18625 - protein, 81 aa, Monodelphis domestica
AQEVVTFKDVAVNFTREEWRLLTPPQKRLFKEVMLENAQNLLSVGLPGPPEEVISYLEQREAPWMLEQEDPRSPEGEIRLE

SEQ ID NO: 18626 - protein, 81 aa, Monodelphis domestica
PGQVVTFKDVAVDFTWEEWCLLSPPQKELYKEVMLENAHNLLSVGLPAPPEGVLSYLEQREAPWMLEQEGLRSCCPEGEIR

SEQ ID NO: 18627 - protein, 81 aa, Monodelphis domestica
FQGFITFKDVTVDFTQEEWHLLDHSQKDLYREVMLENVQNLLSVGLPVSREDFISSFQRREGTWLLEQKRLKSSYPGAQTN

SEQ ID NO: 18628 - protein, 81 aa, Physeter macrocephalus
YQGLVSFEDVAVNFTWEEWQDLDAAQRTLYRDVMLENYSSLVSLGHCITKPEVIIKLEQGAAPWTVKETPDQGSPDVQIVD

SEQ ID NO: 18629 - protein, 81 aa, Monodelphis domestica
QVVTFKDVAVEFTREEWCLLSPPQKELYKEVMLENSQNLLSMGEIIPEMKVNPTEMIPPVEEMDIQRFMSVGPNIFASREF

SEQ ID NO: 18630 - protein, 81 aa, Monodelphis domestica
FITFKDVTVDFMQEEWCLLDHSQKDFYGEVMLENVQNLLSVGLKEEEINYLNNPISEKEIEQAIKELPKEKKPQIQMDSQR

SEQ ID NO: 18631 - protein, 81 aa, Monodelphis domestica
PAQVVTFKDVAMEFTREEWCLLSPPQKELYKEVMLENARNLLSIGLPVPSEDILSYLEQREAPWMLEQEGLRCFCPGEIIP

SEQ ID NO: 18632 - protein, 81 aa, Monodelphis domestica
VVTFQDVAVDFTREEWRLLSPPQKELYKEVMLENVRNLLSVEGEIRPEMKVNPTEVILPVEDMNLQRFMSDGPDKFASKEF

SEQ ID NO: 18633 - protein, 81 aa, Physeter macrocephalus
EEDSVTCEDVAVNFTLEDWALLNPTQKKLYRDMMQETFRNWVCILGTKWDDDDIEEQYKNQGGKPRNHMVVRFSERKDHSP

SEQ ID NO: 18634 - protein, 81 aa, Monodelphis domestica
AQEVVTFKDVSVEFTREEWHLLSPPQKELYKEVILENAWNLLSVGFPVPSEDILSYLEQKEAPWMLEQKGLRSCCPGEEGE

SEQ ID NO: 18635 - protein, 81 aa, Monodelphis domestica
SQGSITFKDVAVDFTQEEWCLLDHSQKALHLEVMLENVQNLLSVGLPVPRENFISCFQQGKAPYLLQQNDPKSSSPEAETN

SEQ ID NO: 18636 - protein, 81 aa, Monodelphis domestica
AQEVVTFKDVAVEFTREEWCLLSPPQKELYKEVMLENVQNLHSVGLPAPPEDMIYYVEQRDSSWMLEQEGLRSCCPGKIRR

SEQ ID NO: 18637 - protein, 81 aa, Papio anubis
AQESVTFRDVAVFFSQDEWLHLDSAQRALYREVMLENYSSLVSLGIPFSMPKLIHQLQQGEDPCLEEREVPSDTCVGFKTW

SEQ ID NO: 18638 - protein, 81 aa, Aotus trivirgatus
METLTFRDVAIEFSLEEWQCLNPAQQNLYRNVMLENYRNLVFLAGIAVSKQNPITCLEKGKEPWNMKRYEIMAKPTAMCSY

SEQ ID NO: 18639 - protein, 81 aa, Aotus trivirgatus
PQGLLTFRDVAIEFSPEEWRCLDPAQRTLYRDVMLENYRNLVSLGKDNFPPEAGTCPCVCSYFPLLPPGSHILAGLKWKPY

SEQ ID NO: 18640 - protein, 81 aa, Camelus dromedarius
ELVTFRDVVISFSQEEWEYLDSAQRDLYWDVMMENYSNLVSLDLESKYDTKTLPIEKDIIEKNDFQWEVIESSTSAGLENS

SEQ ID NO: 18641 - protein, 81 aa, Camelus dromedarius
AQLTVAFDDVALYFLEQVWDILEKWQKEMYQQEMKTNYETLDSLGCAFSKPNLITWMEQGRMLFIRDQERLEKTRVTLRPS

SEQ ID NO: 18642 - protein, 81 aa, Camelus dromedarius
PQGPVTFGDVAVHFTQEEGARLHPGQRALYRDVMLETYRNLASLGGPGSKPDLISQLEQGKEPWGLEMLETKERETPGDPG

SEQ ID NO: 18643 - protein, 81 aa, Camelus dromedarius
NQDPVTFQEVAVDFSQEEWALLAPAQKILHRDVMLENYRNLASVGYHLRKPSLLTPEDLRAKKGRVLQDTCADQTSQLKTQ

SEQ ID NO: 18644 - protein, 81 aa, Myotis davidii
SMGSDLFRDVAVVFSREEWERLAPAQRDLYRDVMLETYSHLRSLDLAISKPDVIAFLEQGEEPWRAEEAARDGLCPVDWEC

SEQ ID NO: 18645 - protein, 81 aa, Myotis davidii
RDSVSFEDVAVNFSLEEWALLDSSQKKLYRDVMRETFWNLASIGNKWEDLDMEDQYKNQKRKQRSRMLERACDGKMVSQCG

SEQ ID NO: 18646 - protein, 81 aa, Myotis davidii
VNFEDVAIAFSEEEWVMLDEAQRLLYYDVMLEVFALVSSVGCWHKMEDEEACSDQHVCIQGESQVRTSKTALATHKNHLCK

SEQ ID NO: 18647 - protein, 81 aa, Cercocebus atys
KSLESVSFKDVTVDFSRDEWQQLDLAQKSLYREVMLENYFNLISVGCQVPKPEVIFSLEQEEPCMLDGEISSQSHPDGDIG

SEQ ID NO: 18648 - protein, 81 aa, Cercocebus atys
GTVTFEDVAVNFSQEEWSLLSEAQRCLYHDVMLENLALISSLGCWYGAKDETPSKQTLSIQQESPLRTHWTGVCTKKVHLW

SEQ ID NO: 18649 - protein, 81 aa, Cercocebus atys
EALPAKDSAWPWEGKPRYLGPVTFEDVAVLFTEAEWKRLNLEQRNLFKEVMLENLRNLVSLRLGSLRSGLLHLDMNLDLWL

SEQ ID NO: 18650 - protein, 81 aa, Cercocebus atys
KSLVTFEDVAVYFSQEEWELLDAAQRHLYHSVMLENLELVTSLGCWHGVEGEEAHPKQNISVEEVLPVRIPNTDSSTKKAN

SEQ ID NO: 18651 - protein, 81 aa, Cercocebus atys
MEHLTFRDVAIEFSPEEWKCLDPAQQNLYRDVMLENYRNLVSLGVAISNPDLVTFLQRKEPYNVKIHETVAKHPAMCSHFT

SEQ ID NO: 18652 - protein, 81 aa, Cercocebus atys
MNKAGYSMDVIVEFTKEEWKLLTFAQRTLYKDVMLENYSHLVSVGYHVNKPTAVFKLKQGKEPWILEVEFPHRVLPYLWSI

SEQ ID NO: 18653 - protein, 81 aa, Cercocebus atys
SQGSVSFKDVTVDFTQEEWQQLDPAQKALYRDVMLENYCHFVSVGFHMTKPDMIRKLEQGEELWTQRIFPSYSYLAEDGKT

SEQ ID NO: 18654 - protein, 81 aa, Cercocebus atys
LVTFRDVAIDFSQEEWECLDPAQRDLYRDVMLENYSNLISLDLESSRATKELSPEKEIYEMESLQWENMGELINHHLQYNG

SEQ ID NO: 18655 - protein, 81 aa, Leptonychotes weddellii
PLTFRDVAVVFTEEELRLLDRTQRKLYRDVMLENFRNLLSVGDKNEKEMEYIQERELKCLSSRELSYWKIWEQVTGELTGS

SEQ ID NO: 18656 - protein, 81 aa, Felis catus
SQGSLSFKDVTVGFTQEEWQCLDSSQRSLYRDVMLENYSHLVSVGSCATKPEVIFRLEQGEEPWISEEEFPSQSLPEDIEE

SEQ ID NO: 18657 - protein, 81 aa, Leptonychotes weddellii
SQGPVSFKDVAVDFTQEEWQYLDLPQRDLYRDVMLENYINLISVGYQTTKPSVIHKLEQGEEPWMVEREIPNWNYAEEVWQ

SEQ ID NO: 18658 - protein, 81 aa, Leptonychotes weddellii
LLQGLLTFRDVAIEFSQEEQGCLNHTQRELYRDVMLENYGHLLFLDLVVSKPDLVTFLEQKKELWDVKRKESIATHPGRWK

SEQ ID NO: 18659 - protein, 81 aa, Felis catus
RLGCVTFEDVAVRFSWEEWGLLDEAQRLLYRDVMLENFALMASLGLASSRSHEITQLEWWRQPSLPPRGVMTAAMPRGTWR

SEQ ID NO: 18660 - protein, 81 aa, Felis catus
SRGPLSFVDVFVDFTWEEWRLLDPAQKHLYRSVMLENYSHLVSLGYQDAKPDIIFKLEQGEELWMLQAQMPSQGHPEKVLE

SEQ ID NO: 18661 - protein, 81 aa, Leptonychotes weddellii
SYEGSVSFRDVAVDFSRDEWQHLDLAQRNLYRDVMLETYSHLLSVGYEVPQPEVFMLEQGKEPWALQGESPHQSCPGEKLW

SEQ ID NO: 18662 - protein, 81 aa, Felis catus
GSGTLLTFRDVAIEFSQEEWGCLNHSQRELYRDVMLETYGHLLFLGLTVSKPDLVIVLKQEKELWGVKRKETVASHSGRWK

SEQ ID NO: 18663 - protein, 81 aa, Felis catus
ESLSFEDVAVYVTREEWDKLDWAQKDLYRDVMLENYRNMILLGSEARWKMKKPTPGQKIFKDLESCKTSAIKQQAANGPSE

SEQ ID NO: 18664 - protein, 81 aa, Leptonychotes weddellii
QGPMLFEDLAVYFSQEEYVSLHPAQRSLSRDTTQECFEDMALMGGEGKTEISQQLNLESAGFEELAPENSSITVPLIYYPE

SEQ ID NO: 18665 - protein, 81 aa, Neomonachus schauinslandi
MTFRDVAIDFSQQEWEYLDSLQKNLYRDVMMENYDNLVSLGHSISKPDVITLLEQGKDPWMVVREDTRRWCTDLESRYEII

SEQ ID NO: 18666 - protein, 81 aa, Neomonachus schauinslandi
FEESVTFEDVAVYFSENEWTGLAPAQRVLYRDVMLENYGAVASLAFPFPKPALISQLERGEAPWCKAPQGALDGGGPRGIS

SEQ ID NO: 18667 - protein, 81 aa, Neomonachus schauinslandi
VQGSMSFEDVIVEFTQDEWQYMSPAQRILYRDVMLENYSHLISVGYCTTKPEMIFKLEQGEEPWSLEEEFLNQRYPGYFSV

SEQ ID NO: 18668 - protein, 81 aa, Neomonachus schauinslandi
DNVTLEDVAVYFSWEEWGLLDEAQRRLYHDVMLENLALITSLDCLCGIENEEVPSGQNVSLGRMPQIRSSEPNPSTEKVHF

SEQ ID NO: 18669 - protein, 81 aa, Neomonachus schauinslandi
GQGCVTFEDVTIYFSQEEWGLLDEAQRLLYCDVMLENFALIASLGLTSFRSHIVAQLQIGAEPWVPDRVDMTSAMARGAYS

SEQ ID NO: 18670 - protein, 81 aa, Monodelphis domestica
AQEVVAFKDVAVDFTKEEWCLLTPPQKELYKEVMLENAQNLLSVGLAVSRGDVISYFEQREAPWMLEQEDLGIGCPEGKIR

SEQ ID NO: 18671 - protein, 81 aa, Monodelphis domestica
CRESVTFQDVAVEFTWEEWGHLNPSQKKLYRDVMLENYKNLVSLGFAVSKPDVIYQLERNEASWTPEADISRSHCPENKEF

SEQ ID NO: 18672 - protein, 81 aa, Monodelphis domestica
AQEGLTFKDVAVDFTREEWCLLSPPQKELYKEVMLENAQNLLSVGLPGPPEDVISYLKQRKDPWMLEQEGLRSCCPEGEIR

SEQ ID NO: 18673 - protein, 81 aa, Monodelphis domestica
AQEVVTFQDVAVDFTRGEWRLLSPPQKELYKEVMLENAWNLLSVGLPALPEDVISYLEQREAPWMLEREGPRSCCPVCLEC

SEQ ID NO: 18674 - protein, 81 aa, Monodelphis domestica
GVLAARFQDVAVEFTWEEWRHLDPAQRTLHRNVMLENYENLVSIGIPISKLDLLFLLKREDVQNQEGEAGTGTCIEGKIRL

SEQ ID NO: 18675 - protein, 81 aa, Monodelphis domestica
SQESVTFKDVAVNFTQEEWQRLSPAQRDLYRDVMLENYRNLISLGLPISKPDMIFQLEQGEEPWRLDLQGNEEKAGPRNIS

SEQ ID NO: 18676 - protein, 81 aa, Physeter macrocephalus
ARMLVTYEDVAVTFTQEEWGQLDPAQRTLYQEVMLETCGLLVSLGYPLPKPELIHPLEHSPELQTSKRGLSPSSCPVRESG

SEQ ID NO: 18677 - protein, 81 aa, Monodelphis domestica
SQGSITFKDVAVDFTQEEWYLLDRSQKELYLGVMLENVQNLLSVEAELNFDVKDITKLSLFVEGYNPQRCMNEGPHDFILR

SEQ ID NO: 18678 - protein, 81 aa, Monodelphis domestica
GQVLVTFKDVAVDFTQEEWRLLDHSQKELYREVMLENAWNLHSVGLPISRDHVISRFEQGEAPWILEREGPSSSCPDGETR

SEQ ID NO: 18679 - protein, 81 aa, Monodelphis domestica
SQELITFKDVVLDFTKEESYLLDCSYKDLCMEVMLENVQNLLSVGLAVPRENFITSLQKGESPWLPEKKGQWSFYKEAETN

SEQ ID NO: 18680 - protein, 81 aa, Monodelphis domestica
GSITFKDVAVDFTQEEWCLLDPSQKELYRRVMLENVQNLLSVEAETNFEVKMSPKLSLLVERSDLPRGMNKDPCDFFLREI

SEQ ID NO: 18681 - protein, 81 aa, Monodelphis domestica
RQESIRFKDVAVYFTKSVWQLLDPSRKKLYKDVMLDNFRTLVSLGLEDDDTAVIDSLERGDALWIPEEEKRGIRCRDNEWR

SEQ ID NO: 18682 - protein, 81 aa, Monodelphis domestica
SQGSITLKDVAVDFTQEEWGLLDHSQKDLCLEVMLENIQNLLSVGLPMLREKFISCFQQGEAPWLLDKKDPRSSCSEAETT

SEQ ID NO: 18683 - protein, 81 aa, Aotus trivirgatus
SLESVSFKDVTVDFSRDEWQQLNVAQKSLYRDVMLENYFNLISVGCQVPKPEVIFNLEQEEPCMLNGGNSSQSCPDGKIGF

SEQ ID NO: 18684 - protein, 81 aa, Camelus dromedarius
FQESVTFEDVAIYFSENEWTGLAPAQRALYRDVMLENYGAVASLGYPFLKPAGVSHLEEVEEPLKRKLQGEGPSLICTEGV

SEQ ID NO: 18685 - protein, 81 aa, Camelus dromedarius
LSQAEVTFEDVAVLLSREEWGRLGPAQKGLYRDVMLETYRNLVSLGEAPCWDAAQGTALGTEGSAGAGLGASPPVPRDGHP

SEQ ID NO: 18686 - protein, 81 aa, Myotis davidii
MLENISHLVSLGYWICKSDVTFQLEQGEELWSEGTGFLQGQSAGYRICTSGVTFQLKPGEELRSEGTGFLQGQTAGMRDPF

SEQ ID NO: 18687 - protein, 81 aa, Myotis davidii
LQALVTFKDVLVNFTREEWRLLDAAQQVMYRDVMLENYRNLVSLGHRLPKPDVILQLEKGEEPWLVERGTRQDAHPDWDTA

SEQ ID NO: 18688 - protein, 81 aa, Cercocebus atys
KDVAVVFSEEELRLLNLAQRKLYRDVMLENFRNVVSVGEDRHSLTEHCKNLKEMETLQEVGLRYLSHEEFFCSQIWQQITR

SEQ ID NO: 18689 - protein, 81 aa, Cercocebus atys
FQGSISFKDVTVDFSQEEWQHLNPSQRALYRDVMLENYSNLVSVGYCVHKPEVISRLEQGEEPWRLEEEFPSQSFSEVWTA

SEQ ID NO: 18690 - protein, 81 aa, Cercocebus atys
EEALMAFRDVAVAFTRKEWKLLSSAQRTLYREVMLENYSHLVSLGIAFSKPKLIEQLEQGNEPWREENEHLLDLCPAQTAS

SEQ ID NO: 18691 - protein, 81 aa, Cercocebus atys
SHELLTFKDISVDFTQEEWGQLAPAYQNLYREVMLENYSNLVSVGYQLSKPSVISQLEKGEEPWMTEKEGPGDPSSDLKSK

SEQ ID NO: 18692 - protein, 81 aa, Cercocebus atys
RVTFKDVAVVFTKEELALLDKAQINLYQDVMLENFRNLISVGDGIKNNILNLQEKGLSYLSQEVLCCWQIWKQRIRDLTVS

SEQ ID NO: 18693 - protein, 81 aa, Cercocebus atys
MAQVTFSDVAIDFSHEEWAWLDSAQRDLYKDVMVQNYENLVSVGLSVTKPYVITLLEDGKEPWMVEKKLSKGMIPDWESRW

SEQ ID NO: 18694 - protein, 81 aa, Cercocebus atys
MLETYNHLVSLEIPSSKPKLIAQLERGEEPWREERKYSLDLCPDGVSLCCLGWSAVVLSRLTATSTSWVQAVLCLSLPRSW

SEQ ID NO: 18695 - protein, 81 aa, Leptonychotes weddellii
PQKSVTFEDVAVYFTQTEWDGLSPAQRALYRDVMLENYGNVASLGFSLLKPAVISQLEGADIDVQTDNNLIKEMYEEKHNT

SEQ ID NO: 18696 - protein, 81 aa, Leptonychotes weddellii
SVMFEDVAIDFTKEEWALLDISQQKLFRDVMLENISHLNSSPYTLFPPQTWNKICKRSFQLEQGKELWSEGQDFSKARVQH

SEQ ID NO: 18697 - protein, 81 aa, Leptonychotes weddellii
SSQGLLTFRDVAIEFSQEEWGCLNHTQRELYRDVMLENYGHLLFLGLIVWKPDLVIFLEQEKQLWDVKRKETVAFYPGRWE

SEQ ID NO: 18698 - protein, 81 aa, Leptonychotes weddellii
VSVAFQDLAVRFSEEEWQLLGEGQRTLYRDVMRENYETLRSLAAVTVETCPLQGLLGCLPNTPTGWPHLATTSSSGSSSSS

SEQ ID NO: 18699 - protein, 81 aa, Leptonychotes weddellii
FQETVTFKDVAVVFSEEELGLLDSTQRKLYRDVMLENFRNLVSVGHSSSKPDMISQLEREEKLCMKEIHTERGGRNQNEVE

SEQ ID NO: 18700 - protein, 81 aa, Felis catus
AQELLTLEDVAVDFSREEWQLLAPAQKDLYRDVMLENYRNLVSVGCQATKRDALSVLEHRDEAWMKAEDEIQDRTHAGIGK

SEQ ID NO: 18701 - protein, 81 aa, Neomonachus schauinslandi
YKGSVVFSDVSIDFSQEEWECLDPGQRALYRDVMLENYGNLLSMGLYIPKPQVISLLEQGKEPWMVGRELTRGLCSDLESM

SEQ ID NO: 18702 - protein, 81 aa, Neomonachus schauinslandi
VRMPVTFDDVAVTFTQEEWGQLDPAQRTLYQEVMLETCGLLVSLGCPLPKPELFYPLDHSPELQTLKRGLSPDSCPGDSTK

SEQ ID NO: 18703 - protein, 81 aa, Monodelphis domestica
PKVPVTFDDVSIYFSTPEWEKLEEWQKELYKNIMKGNYESLISMDYAMTQPEVLSQTQPEVEHNTENQVRPDGSEMTAEPS

SEQ ID NO: 18704 - protein, 81 aa, Monodelphis domestica
HKENQGPIPASVTFRVVVVDFSHHEWRRLGVAQRNVYRDGMLENYKNLVSLGKPTICRTLGKSPHLVCPHFFICEMSWRKK

SEQ ID NO: 18705 - protein, 81 aa, Physeter macrocephalus
AQEPVTFKDVAVDFTQEEWGQLDPVQRTLYRDVMLETYGHLLSVGNQIAKPEVISLLEQGEEPWSVEQAYPPQGTCPEWMR

SEQ ID NO: 18706 - protein, 81 aa, Monodelphis domestica
SQGSIAFKDVAVDFTQEEWCLLNHSQKTLYLEVMLENVQNLLSVGVPVPTENVISCFQQGKAPWLQEQKGPRTSYPEAETN

SEQ ID NO: 18707 - protein, 81 aa, Monodelphis domestica
SQGSIAFKDVAVDFTQEEWCLLDHSQKELYLEVMLENVQNLLSVGLPVPRENFISHIQQRKTSWLLEQKGPRSSSLDFEVK

SEQ ID NO: 18708 - protein, 81 aa, Physeter macrocephalus
VLLTFRDVAIEFSQEEWEWLDPAQRALYRDVMLETYRNLLSLDISTRCVIKELSPKENINKGELFRTLMLGRHKRNDIKDF

SEQ ID NO: 18709 - protein, 81 aa, Monodelphis domestica
AQEVVTFKDVAVDFTREEWCLLSPPQKGLYKEVMLENTRNLLSVGLLALPEKVISYLEQMDVPWMLDQEGLRIWYPAGEIS

SEQ ID NO: 18710 - protein, 81 aa, Monodelphis domestica
MLENYKNLVSLGLQTIKPDVISRLEQGEVPWIPTSHVPKDSSHHKTISRTKKSAPKQDLSVRESSKKRVTKDDSQKDSKLR

SEQ ID NO: 18711 - protein, 81 aa, Monodelphis domestica
FQESVTFRDVAVDFTQEEWRCLEPAQRALYMDVMLENYKNLISLGIPVSNLDVVSLLEKRAAVWTQDGEDPRDTCLDFFRE

SEQ ID NO: 18712 - protein, 81 aa, Physeter macrocephalus
CWGLSSFKDISMEFTWEEWQLLDSAQKHLYRDVTLENYNNLVSLGYHGTKPDLIFKLEQGEEPWIINAEVSHQSCPEGWKE

SEQ ID NO: 18713 - protein, 81 aa, Monodelphis domestica
SQGSITFKDVAVDFTREEWRLLDHSQKELYMEVMLENVQNLLSVGLLVPGEDLLPSFQQGESPWLLEQKGTRSSCSDAETN

SEQ ID NO: 18714 - protein, 81 aa, Monodelphis domestica
SQGFITFKDVTVDFTQEEWCLLDHSQKDLYREVMLENVQNLLSVGLPVSREDFISSFQRREGTWLLEQKGSKNSCPGAQTN

SEQ ID NO: 18715 - protein, 81 aa, Papio anubis
NCYQDSVTFDDVAVDFTQEEWTLLDPSQRDLYRDVMLENYENLASVEWRLKTKGPALWQDRSWFRTSNETQTARSHNGGQL

SEQ ID NO: 18716 - protein, 81 aa, Otolemur garnettii
QALLTFRDVSIEFSVDEWACLDPAQRNLYRDVMLETYKNLVFLETGLAVSKPDLITCLEQRKEPWKVKTHQTVVKHPVYSE

SEQ ID NO: 18717 - protein, 81 aa, Otolemur garnettii
EAVTFKDVAVVFTKEELGLLDPAQRKLYQDVMLENFRNLLSVGYQPFKLDTLLQLEREEKLWMMETETQGDGCSGHQNQNE

SEQ ID NO: 18718 - protein, 81 aa, Otolemur garnettii
KLQESLTLEDVALEFTWEEWQLLGPTQKDLYRDVMLENYSNLVSVGYQASKSDPFSKLERGELWTVTDEIHNQIYPEIKKV

SEQ ID NO: 18719 - protein, 81 aa, Vulpes vulpes
CQESVTFEDVAVIFTDEEWRHLVPIQRDLYKEVMLENYRSIVSLGLPVPRPEVIFQLKRGDEPWIVDLHGSEERECPENIS

SEQ ID NO: 18720 - protein, 81 aa, Vulpes vulpes
NHTAEGLPSPATDGLQEKEGKPQMLVPVTLRDVAVVFTDAEWKGLSSEQRNLYKEVLLENYRNLLSLDCGQEQQDAAAHRL

SEQ ID NO: 18721 - protein, 81 aa, Vulpes vulpes
MLENYRNLVSLGLCVSKPDMISSLEQRKEPWMVKRKLTRGRCPDLKAVLETKELPAKKDISKEKLSQAVIVERLTNYSLEC

SEQ ID NO: 18722 - protein, 81 aa, Myotis davidii
QMLLTFRDVDTEICQQEWECLNPAQRGLVQGVMLENSGACAPGGGYLCRCVAHELSPKEESNKGRFSQTVMGRHKSNDIKD

SEQ ID NO: 18723 - protein, 81 aa, Cercocebus atys
WLQEPMTFKDVAVEFTQDEWMMLDSAQRSLYRDVMLENYRNLTSVEYQLCKLTVISPLDQEEIRNMEKRIPRGICPDQKIL

SEQ ID NO: 18724 - protein, 81 aa, Cercocebus atys
MAQVTFSDVAIDFSHEEWGWLDSAQRDLYKDVMVQNYENLVSVGLSVTKPYVITLLEDGKEPWMVEKKLSKGMIPDWESRW

SEQ ID NO: 18725 - protein, 81 aa, Cercocebus atys
EMGLLTFRDVAIEFSLGEWQCLDGAQQNLYRDVMLENYKNLVSLGIAVSKSDLITHLEQNKEPRNIKKNEMLAKHPVMCSH

SEQ ID NO: 18726 - protein, 81 aa, Leptonychotes weddellii
SQGPVSFRDVAVDFTQEEWQQLEPDEKTTYRDVMLENYSHLVSVGYDSTKPKVILKLEQGEEPWIAEGDLPCQSHPEIVWK

SEQ ID NO: 18727 - protein, 81 aa, Leptonychotes weddellii
MLENYSSLVSLGYEVMKPDVIFKLEQGEEPWIGDGEVPSSDRPEQVLQVDGHMTWHQDNQEKLRNMKQDHECDTFGKKFNL

SEQ ID NO: 18728 - protein, 81 aa, Leptonychotes weddellii
PKVPVSFEDVSVYFTKTEWKLLDLRQRILYKRVMLENYRHLVSLGFLSSKPHLVSWLEQGEGPRAADTCRTRAAAGMQTGD

SEQ ID NO: 18729 - protein, 81 aa, Leptonychotes weddellii
FQESVTFKDVAVDFTQEEWGQLDSPQRALYRDVMLENYQNLLSLGPPVCKPDVISHLERGEEPWQMPREVPGGACSEGEPG

SEQ ID NO: 18730 - protein, 81 aa, Leptonychotes weddellii
MMWTWASETEWTRLECPEKALYTDVTLKNYGNAMALRFSVYKTEVISHLESGEALCIWAGQRTIARVWRVVQEGKGEKEVH

SEQ ID NO: 18731 - protein, 81 aa, Leptonychotes weddellii
APLPLTFEDVAIYFSEQEWQNLEAWQKELYKHVMRTNYEILVSLDDGLPKPELISWIEQGKEFFKNWGESQKSGNIICSSA

SEQ ID NO: 18732 - protein, 81 aa, Felis catus
MWLWISPKRSGSNWTPAQRTLYRDVMLENFSHVISLGYPVSKPDVISKLEQGEDPWIIKRDVSNWIYTDENQADGRQDRKS

SEQ ID NO: 18733 - protein, 81 aa, Leptonychotes weddellii
AQDSVTFEDVAVSFSWEEWGLLDEAQRRLYLNVMLENLALVTALGCWHGAEDGKAPSEQAASIGVSQVRTHHAGPYPQKAP

SEQ ID NO: 18734 - protein, 81 aa, Leptonychotes weddellii
SQVLLTFRDVAIEFSQEEWECLDPAQRALYKDVMLENYRNLVSLGEDNVDLNVISILEQGTEPRAVEGEVKVEKKPSGWDY

SEQ ID NO: 18735 - protein, 81 aa, Felis catus
SQHLVTFEYVAVDFTQEEWTLLDQTQIALYRDVMLENYQNLITLAGYKSCKPDPSSALEGAELLRTGGRGVLQGEKQCGKT

SEQ ID NO: 18736 - protein, 81 aa, Neomonachus schauinslandi
TRNIVTFEDVCIYFSPEEWELLDEAQKRLYCNVILENFLLVTSLGLAISRYHLIPQPLPVREPVVPANVAIAPAGAAMVLG

SEQ ID NO: 18737 - protein, 81 aa, Neomonachus schauinslandi
MWEAVTFKDVAVVFTEEELGLLDPAQRKLYGDVMLENFRNLLSVGHQPFTPDVILQFEREEKLRMIKTATQGHCASGDKNL

SEQ ID NO: 18738 - protein, 81 aa, Monodelphis domestica
DQEVVTFKDVSVEFTQEEWRLLSPPQKELYKEVMLENARNLLSVGFPVPSEDILSYLEQKEAPWMLEQKGLRSCCPGEIIP

SEQ ID NO: 18739 - protein, 81 aa, Neomonachus schauinslandi
RHAFVAFRDVAVDFTQEEWRLLSPAQRTLHREVMLETYNHLVSLEIPFSKPKLISQLEQGEEPWIKERQHPLGFCPAGSKL

SEQ ID NO: 18740 - protein, 81 aa, Monodelphis domestica
LKESVTFKDVTVDFTQEEWKHLDPSQKELYRDVMLENYRNLVFLGYPVSKPDVISQLEQRKTPWMLEREDSRNPCMDWETK

SEQ ID NO: 18741 - protein, 81 aa, Monodelphis domestica
SQGLITFKDVAVDLNLEEWCLLDHSQKELYLEVMLENVQNLLSVGLPVPREDFLSCFQQGEARWLLEQKGPMGSCPETNLE

SEQ ID NO: 18742 - protein, 81 aa, Monodelphis domestica
SQHPVTFKDVAVDFTREEWRHLGPAQRDLYRDVMLENYHNFASLGLPVFKPDVISQLERGEGPWMPEAEVPQVTFPESLIQ

SEQ ID NO: 18743 - protein, 81 aa, Physeter macrocephalus
QGHVIFEDVAVSFSQEEWGLLNDAQRLLYCDVMLENLSLIASLGCWRAVGTEEASSDQCVSVELVTQDRNPNPDPSILKTL

SEQ ID NO: 18744 - protein, 81 aa, Monodelphis domestica
ESIRFKDVAVYFTKSVWQLLDPSRKKLYKDVMLDNFRTLVSLDNEWREEGSQNDQLRNDERNSGERSYQCNECGRSFVSKW

SEQ ID NO: 18745 - protein, 81 aa, Monodelphis domestica
RQEVVTFQDVAVDFTREEWRLLSPPQKELYKEVMLENAQNLHSVGLPTPPEDVFSSLEQREVPWILEQEALRNCCPEGEIR

SEQ ID NO: 18746 - protein, 81 aa, Monodelphis domestica
PKESVTFKDVAVDFTWEEWEQLDIGQRVLYRDVMLENYRNIISLGTQVSKPELIFLLEQGKEPWMVKREISKDSCPGERHN

SEQ ID NO: 18747 - protein, 81 aa, Monodelphis domestica
FQASVTFKDVAVDFTWEEWRLLDPPQKELFWEVMLENYRNLVCLGLADSNKDVRISELELREPHWIPTGGVLRSCWPGWEL

SEQ ID NO: 18748 - protein, 81 aa, Physeter macrocephalus
EEGRVTFEDVAVYFSQEEWGLLDEAQRLLYRSVMLENFSLMASLGLTSSRTHEVTQLEQWGEPFVPACGVVITATPRGCWC

SEQ ID NO: 18749 - protein, 81 aa, Monodelphis domestica
GQEEVTFKDVAVDFTQEEWCLLSSPQKELYKEVMLENAQNLLSVGLPAPPQDMISYLEQMEAPWMLEKEGLRHYCPEGVIR

SEQ ID NO: 18750 - protein, 81 aa, Monodelphis domestica
LITFKDVAVDFTQEEWCLLDHAEKELFLEVMQENVQNLLFVEAEVNFELKGISSKLSLFVEESGPQRVINEDPCDFILREI

SEQ ID NO: 18751 - protein, 81 aa, Monodelphis domestica
PQAAMTFQDVAVDFTREEWRLLEPPQKELYWEVMLENYRNLVCLGLTVSKPDVISQLEQGEAPWRLEGGSARGRCLDWGMR

SEQ ID NO: 18752 - protein, 81 aa, Monodelphis domestica
RNKLPSQESITFKDVDSQKELCKEVMPENVQNLLSVGLTVPRENFITCFQQGESPPRLEKKGQWSSCPEAETNFEVKEICA

SEQ ID NO: 18753 - protein, 81 aa, Monodelphis domestica
MDVAVDFTQEEWCLLDHSQKELYLEVLLENVQNLLSVGLPVPRENFISCFQQGKTPCLVEEKDPRSFFPVEDVEVKEMSIK

SEQ ID NO: 18754 - protein, 81 aa, Physeter macrocephalus
SVTFEDIAVYFSWEEWRLLDETQRRLYLDVMLENFALISSLGCCCGAEDAEAPFEQIASLGVSQARTPKAALSSQNTHPCE

SEQ ID NO: 18755 - protein, 81 aa, Papio anubis
ALALVSFEDVVVTFTGEEWGHLDLAQRTLYQEVMLETCRLLASLGHPVPKPELIYLLEHGQDLWTVKRGLCQSTCAGEKAK

SEQ ID NO: 18756 - protein, 81 aa, Papio anubis
DSVTFEDVAVDFTQEEWTLLDQTQRNLYRDVMLENYKNLVAVDWESHVNTKWSAPQQNCLQGKTSSVVEMERNHFGEELFD

SEQ ID NO: 18757 - protein, 81 aa, Camelus dromedarius
PQDLVSFKDVAVDFSQEEWEWLSPAQRRLYRRMMMENYQNLLSLGLCTSKPYVISLLEQGKEPWGMKSEVRNSFSDTCSTT

SEQ ID NO: 18758 - protein, 81 aa, Myotis davidii
MYFTREEWNKLDWAQKDLYRDVMLENYRNMILLGFQIPKPEVICQLEQWEDPWILDLPKAGTRRASSSACPVGWLISRALS

SEQ ID NO: 18759 - protein, 81 aa, Myotis davidii
QSLLTFEEVAVYFSPEEWELLDPSQKALYHDVMQENYETVISLGKGSPLCVEVEWGQMLNAGAALWWSVSSHMEKLCSAIS

SEQ ID NO: 18760 - protein, 81 aa, Cercocebus atys
RGTVTFEDVAVHFSWEEWGLLDEAQRCLYRDVMLENLALLTSLDVHHWKQHLGEKHFRSNVGTALFVKTCTFHVSGEPSTC

SEQ ID NO: 18761 - protein, 81 aa, Cercocebus atys
DRNLLGPLTFMDVAIEFSLKEWQCLDTAQQSLYRDVMLENYRNLVFLGIAFSKPDLITYLEQGKEPWNMKRHETVAKPLGM

SEQ ID NO: 18762 - protein, 81 aa, Cercocebus atys
MGPLTFRDVTVEFSLEEWQCLDIAQQNLYRDVMLENYRNLVFLGIAVSKPDLITCLEQEKEPWEPMRRHEMVAKPSVMCSH

SEQ ID NO: 18763 - protein, 81 aa, Cercocebus atys
SLNKVTFEDVAIDFTQEEWAMMDTSKRKLYRDVMLENVCHLVSLGYQISKSYITLQLEQGKELWREGREFLQGQNLGKEQG

SEQ ID NO: 18764 - protein, 81 aa, Cercocebus atys
MEREVTFSDVAIDFSHEEWGWLDSAQRDLYKDVMVQNYENLVSVAGLSVTKPYVITLLEDGKEPWMVEKKLSKGMIPDWES

SEQ ID NO: 18765 - protein, 81 aa, Leptonychotes weddellii
SQGLVSFKDVAVDFTQEEWQQLDPAQRTLYRDVMLENFSHLVSMGYPVSKPDVISKLEQGEDPWIIKRDIPNWILPDENQA

SEQ ID NO: 18766 - protein, 81 aa, Felis catus
SQGLVTFRDVALDFSQEEWEWLDPSQKDLYRDVMLENYRNLVWLGLSISKPNMISLLEQGKEPWMVEKEVSDGQYADWESW

SEQ ID NO: 18767 - protein, 81 aa, Felis catus
MLENYGHLLLLGLMSKPDLVNFLEQKKEAWDVNGKGTEATLHSAVSSHGTLSFLPKSCIEASFQNKSMGRCKHSTLENLHL

SEQ ID NO: 18768 - protein, 81 aa, Felis catus
GLGSVSFKDVTVDFTRDEWLQLTGTQRTLYRDVMLENYSHLVSVGYDSTKPKVILKLEQGEEPWVVEGDLPCRSRPEVWKV

SEQ ID NO: 18769 - protein, 81 aa, Felis catus
PAPGLLTFRDVAIEFSQEEWGCLNQSQELYRDVMLETYGHLLFLGLVSKPDLVIVLEQKKELWGVKRKETVASHPGRKMDL

SEQ ID NO: 18770 - protein, 81 aa, Neomonachus schauinslandi
AQASVSFKDVTVEFTQEEWRQMDSAQRTLYRDVMLENYSHLVSVGYCFTKPELIFTLEQGEDPWLLKKEFLRKSSPEDSQP

SEQ ID NO: 18771 - protein, 81 aa, Neomonachus schauinslandi
HQALLTFRDVAIEFSQEEWGCLNHTQRELYRDVMLENYGHLLFLGLIVSKPDLVIFLEQKKEPWDVKRKKTVAIHRGNHYE

SEQ ID NO: 18772 - protein, 81 aa, Neomonachus schauinslandi
PKVPVTFDDVAVYFSEPEWGKLDNWQKELYKHVMRGNYETLVSLDYAISKPDILTRMERGEEPCPEGPWGQEEGSKREAAH

SEQ ID NO: 18773 - protein, 81 aa, Monodelphis domestica
AQEVVTFKDVAVEFTQEEWCLLSPPQKELYKEVMLENVQNLHSVGLPAPPEDMIYYVEQRDSSWMLEQEGLRSCCPGKIRR

SEQ ID NO: 18774 - protein, 81 aa, Monodelphis domestica
MAEPLTFRDVSVDFTPEEWAQLDPAQRALYRDVMLENYENLLFLGLPVAKPDVVCQLERGEAPSFPEQPEFFAGACPDSLA

SEQ ID NO: 18775 - protein, 81 aa, Monodelphis domestica
SITFKDVAVDFTQEEWCLLDPSQKELYREVVLENVQNLLFVEAETNVEVKEMSTKLSLFVEGSGPPRGMSKDPCDFILSKI

SEQ ID NO: 18776 - protein, 81 aa, Monodelphis domestica
FQESVTFRDVAVDFTPEEWGFLAPFQRELYREVMLENFWNLVCLGFEVSKPDVIYQLERGEAPQIPKAVPGSCSQDWGAGP

SEQ ID NO: 18777 - protein, 81 aa, Monodelphis domestica
PQELVTFQDVAVYFTPEEVRYLDSYQKALYKDVMLENYGNMASLGFPLSKPVLISQLERGEEPWAMDPLVAKERKTRRGTS

SEQ ID NO: 18778 - protein, 81 aa, Monodelphis domestica
GWVPALFDEVAIYFSDEEWEVLTEQQKALYREVMRMNYETVLSLEFPFPKPDVISQLEAEEGPWVPYPQNSEEWKLQGGSF

SEQ ID NO: 18779 - protein, 81 aa, Physeter macrocephalus
PQGSVTFEDVAVYFSWEEWCLLDEVQIHLYLDVMLENFAVVCMLGSFSAVEDEEMPSEQSVSAGVSQMRTSRAGSSPAKAQ

SEQ ID NO: 18780 - protein, 81 aa, Monodelphis domestica
QLSNMDVAVDFTREEWCLLSPPQKELYKEVMLENAQNLVIYVYSCCIYFSVHTAEKYSESNQCRKMFMHSISLAGYQRIHT

SEQ ID NO: 18781 - protein, 81 aa, Monodelphis domestica
AQEAVTFKDVAVDFTREEWRLLSPPQKELYKEVMLENAQNLLTVGLPAPPENVISALGAEGSPVDARGRRPEGACCPGEII

SEQ ID NO: 18782 - protein, 81 aa, Monodelphis domestica
PKALVTFVDVAVNLTQEEWHLLGPDQRSLYRDVMLENYGNIVSLGFQVTKPDVISQLERGEEPWILDTQGAEEKKVLRGDC

SEQ ID NO: 18783 - protein, 81 aa, Monodelphis domestica
MLENVQNLLSVGIPAAPEDMISYLEQREALWTLEQEGLRSYCPEGENRPKIKANPTEVNLPVDEMDLPRFMSDDPDNIAFR

SEQ ID NO: 18784 - protein, 81 aa, Physeter macrocephalus
AQSLVTFEDVAVHFSKEEWGLLDAAQRQLYHSVMLENLELMTSLGCWHGVEDEEVRSKQDASVDVVSQVRIFSAHPSTQKA

SEQ ID NO: 18785 - protein, 81 aa, Monodelphis domestica
FQEPVTFKDVAVEFTWEEWRQLDPTQRALFRDVMLENYRNLVSLGLAVTKPDVIFQLESGEVPWMLEREVPRSSPTECLNL

SEQ ID NO: 18786 - protein, 81 aa, Monodelphis domestica
SQGSIAFKDIVVDFTQEEWCLLDHSQKVLYLKVMLENVQNLLSVGLPVPRKNFIFCFQQGKAPWLLEQKGSRSSCPEAETN

SEQ ID NO: 18787 - protein, 81 aa, Monodelphis domestica
MLENAQNLLSVGIPAAPEDMISYLEQREALWTLEQEGLRSYCPEGENRPKIKANPTEVNLPVDEMDLPRFMSDDPDNIAFR

SEQ ID NO: 18788 - protein, 81 aa, Monodelphis domestica
SLEVVTFRDVAVDFTQEEWGCLEPWQKQLYREVTLDNYRNLLSLAGLPGPGADVISQVERGETPGELPGGGTDWEARPETI

SEQ ID NO: 18789 - protein, 81 aa, Physeter macrocephalus
KPQGLMTFEDVAVDFTQEEWQYLNPPQRNLYRDVMLETYSNLVSVGQQVTKPDLILKLEVEEPCLPEGKIPIWSFPEEACQ

SEQ ID NO: 18790 - protein, 81 aa, Monodelphis domestica
LQASVTFEDVAVDFSAEEWRRLRPLQRELYREVMLENYRSLAWLGLAASKPGVICRLERGEAPREPDPDGPQSGWADCGTG

SEQ ID NO: 18791 - protein, 81 aa, Monodelphis domestica
MLEISQSLLSLGLPVPKANVISQVDQAETPWMLKQVDSRSSSPDGESKPKTRETTQKLSISCDLKSRQILDSDIRLGKKQD

SEQ ID NO: 18792 - protein, 81 aa, Monodelphis domestica
SITFKDVTVDFTQEEWYLLDHAQKKLYREVMLENVQNLIFVEAETNFEAEMSIKKLNFFIEGYGPPKAMNKGPCDSILREI

SEQ ID NO: 18793 - protein, 81 aa, Monodelphis domestica
PHASVTFKDVAVDFTWEEWRLLDPPQKELFWEVMLENYRNLVCLGLADSNKDVRISELESGEPHWIPTGGVLRSCWPGWES

SEQ ID NO: 18794 - protein, 81 aa, Physeter macrocephalus
QGFVSFKDVTVDFTQEEWQQLDSAQRNLYKDVMLENYSNLVSVEFEIRTKMKELAPQKSISEEVILHNMIVYSVFEAWKLE

SEQ ID NO: 18795 - protein, 81 aa, Monodelphis domestica
AQESVTFKDVAVNFTQEEWEQLNPAQRNLYKDVMLENYQNLISLGLPISKPDVIFKLEQGKEPWILNLQEAREREVPRNFS

SEQ ID NO: 18796 - protein, 81 aa, Papio anubis
FREMVTFKDVAVVFTREELGLLDLAQRKLYQDVMLENFRNWLSVGYHPFKLDVILQLGREDKLWLTETEIQGDGCSGHRNQ

SEQ ID NO: 18797 - protein, 81 aa, Aotus trivirgatus
QGHLTFKDVAVEFSLEEWKCLTPAQRALYREVMSENYRNLQFVDISSKYNMKELLSTARGDTEVFYAGILDRRESHHFGDF

SEQ ID NO: 18798 - protein, 81 aa, Papio anubis
QQGYVTFEDVAVYFSQEEWRLLDETQRLLYRNVMLENFSLLASLGLASSKTHDITQLESWEEPFMPASEVVTSAIPRGCWH

SEQ ID NO: 18799 - protein, 81 aa, Papio anubis
PRSWDYRDVAIEFSQEEWKCLDPAQRTLYRAVMLENYRNLVSLAISSKCMMKEFSSTAQGNREVLHTGTLQRHESHHIGDF

SEQ ID NO: 18800 - protein, 81 aa, Aotus trivirgatus
MLFHSKTPGPPGSLEMGPLTFRDVQNLYRNVMLENYGNQVFLGKIRSKPDLITCLEQENEPWNMKRHEMVDKPPGRLLEFS

SEQ ID NO: 18801 - protein, 81 aa, Pan troglodytes
EMGPLTFRDVAIEFSLEEWQCLNTAQRNLYRKVMFENYRNLVFLGIAVSKPHLITCLEQGKEPWNRKRQEMVAKPPVIYSY

SEQ ID NO: 18802 - protein, 81 aa, Camelus dromedarius
ESVTFEDVAVDFTQEEWALLDTSQRKLFRDVMLENISHLVSVVISDREDDLKKQEMISMQRINKKDAPLIRTVVSFMGVNV

SEQ ID NO: 18803 - protein, 81 aa, Camelus dromedarius
QAVSKGSMMFKDVSVNFSQEEWECLDSGQMNLYKEVMLENFSNLVSVGLSNSKPAVISLLEQGKEPWMVDRELTRGLCSGK

SEQ ID NO: 18804 - protein, 81 aa, Camelus dromedarius
PQVLVSFEDVAVLLSREEWGHLGPAQKGLYRDVMLETYRNLVSLGLQGSKPDVISRLEQGEEPWAPHSPRFEGSWVWRHRS

SEQ ID NO: 18805 - protein, 81 aa, Camelus dromedarius
LQEAVTFKDVAVVFTEEELGLLDSAQRELYQDVMLENFRNLVSVGHLPFKPNMVSQLEAEEELWMTERETQRNGCSGENRA

SEQ ID NO: 18806 - protein, 81 aa, Myotis davidii
MDFEDVAIVFSEEEWGLLDEPQRLLYCDVMLEVFALVSSAGCWHKTDDEEACSEQSECVQGESQVRASETEPETQGTHVCK

SEQ ID NO: 18807 - protein, 81 aa, Myotis davidii
MNFEDVAIVFSEEEWGILDEAQKLLYCDVMLQVFTLVSSAGCWHKTDDEEACSEQNVFARGESQVRASKTEPATQTTHVCK

SEQ ID NO: 18808 - protein, 81 aa, Cercocebus atys
MAFEDVAVYFSQEEWGLLDTAQRALYRRVMLENFTLVTSLGLSTSRPHVVIQLERGEEPWVPSGKDMTLARNTYRRLNAGE

SEQ ID NO: 18809 - protein, 81 aa, Cercocebus atys
MFKEAVTFNDVAVAFTEEELGLLGPAQRKLYRDVMVENFRNLLSVGHQPFKQDVSPLERNEQLWIVTTATQRQRNLGEKNQ

SEQ ID NO: 18810 - protein, 81 aa, Cercocebus atys
TVTFEDVAVNFSQEEWSLLSEVQRCLYRDVMLENLALISSLDCWCGSKDKEAPSKQSISVQRESQNRTPRAVVSPKKAHPC

SEQ ID NO: 18811 - protein, 81 aa, Cercocebus atys
ASVALGDVAVNFTREEWALLGPCQKNLYRDVMQETIRNLDCVGMKWKDQLLFKDQIEDQYKYPRKNLRCRMLERFGESKDG

SEQ ID NO: 18812 - protein, 81 aa, Cercocebus atys
HGSVTFRDVAIDFSQEEWEFLDPAQRDLYRDVMWENYSNFISLAGPSISKPDVITLLDEEGKEPGMVVREGTRRYCPDLES

SEQ ID NO: 18813 - protein, 81 aa, Leptonychotes weddellii
AQESLTLEDVAVDFTWEEWQLLAPAQKDLYRDVMLENYSNLVSVGYQASKPDALSKLERGEEPWAKQEEVPSGTRPEPSKV

SEQ ID NO: 18814 - protein, 81 aa, Leptonychotes weddellii
SRVSVTFEDVAVLFTRDEWRKLDPSQRNVYQEVMLENYSNLVSLGLLFSKPKVISLLQQGEDPWRVEKESPGGPSLGCKSS

SEQ ID NO: 18815 - protein, 81 aa, Leptonychotes weddellii
AQESVVFSDVSIDFSQEEWECLNDDQRDLYRDVMLENYSHLVSMGHSVSKPDVISVLEQGKEPWLVDRELTREQWPVLESR

SEQ ID NO: 18816 - protein, 81 aa, Leptonychotes weddellii
NSQGFVSLKDVTVDFTWEEWQYLDSAQRNLYRDVMLENYSNLVSVGCQSLKSDVISLKRGEPWMKEEEISSWAYSELKSEV

SEQ ID NO: 18817 - protein, 81 aa, Leptonychotes weddellii
AQVLVTFKDVAVTFTQEEWGQLDLDQRALYQEVMLETCGLLVSLGHPVPKPELTHLLEHGQELWTGKRGLSRSTCSGDGAK

SEQ ID NO: 18818 - protein, 80 aa, Leptonychotes weddellii
MMKAQESLTLEDVAVDFTWEEWQLLAPAQEELYWDVMLENYRNLVSVGYQASQPDALSELEQGEPLWILEDEVQSQTHPH

SEQ ID NO: 18819 - protein, 81 aa, Felis catus
SQVLLTFRDVAIEFSQEEWECLDPAQRALYREVMLENYRNLVSLGVDKVRPDVGICPNISVRSVIKELSTKEDINKEELFQ

SEQ ID NO: 18820 - protein, 81 aa, Neomonachus schauinslandi
RTALITFKDVAVTFTGEEWRHLDLAQRTLYREVMLETCGLLVSLGYPVPKPELTYLVEHGQELWTVKRGLSKSTYTGEKAK

SEQ ID NO: 18821 - protein, 81 aa, Neomonachus schauinslandi
AAGSVTFKDVTMAFTQKEWEQLDPAQRNLYKDVMLENYSNLASMGYQAPKPDMISKLEKGEEPWLGKGKRPRQGGPSEIAR

SEQ ID NO: 18822 - protein, 81 aa, Neomonachus schauinslandi
MKPAQRNLYRDVMLENYSNLVTVGYQVTKPDVIFKLEQEEEPWVVEEEMLGRHCPEVWEVDEQIKKQQETLVRKVTSISKK

SEQ ID NO: 18823 - protein, 81 aa, Neomonachus schauinslandi
ARASLSFEDVAVGFSWEEWQLLAPSQKDLYREVMLENYRNLVSVGYQASKPDSLFQLEQGEPPWTVVGAAQSQTCQEEIWE

SEQ ID NO: 18824 - protein, 81 aa, Neomonachus schauinslandi
VVESLTFDDVAVDFTWEEWQLLAPAQKDLYRDMMLENYRNLVSVGYQASKPDALSKLEQGEELWMIEDEIHSRICPEIRKV

SEQ ID NO: 18825 - protein, 81 aa, Monodelphis domestica
RGSITFKDVAVDFTQEEWCLLDPSQKELYREVMLENVQNLLSVEAETNFEVKEMITKLSRRTKLSLRKCFPEEVRLTELPK

SEQ ID NO: 18826 - protein, 81 aa, Monodelphis domestica
AQGLLTFEDVAVIFSQDEWKHLDCAQRALYKDVMWENYQNLESVGFSFPKPELILCLERGEEPWLPDCLGSPERRRILFFC

SEQ ID NO: 18827 - protein, 81 aa, Monodelphis domestica
MEVITFKDVAVDFTREEWHLLAPPQKELYKEVMLENAWNLLSVGLAVSREDVISYFEQREAAWMLEEIDLRNSCQEKEMKP

SEQ ID NO: 18828 - protein, 81 aa, Monodelphis domestica
AQEVVTFQDVAVDFTREEWCLLSPPQKELYREVMLENVRNLLSVGLPAPPKDVLSYLEQRDAPRMLEQESLRSCHPEGEVK

SEQ ID NO: 18829 - protein, 81 aa, Monodelphis domestica
HQESMTFKNVAVAFGQEEWGQLDPTQKDVYRDVILEKYRHLVSMGLPISKPDVISQLERKEDPWMLEREVSRDAYPDWETK

SEQ ID NO: 18830 - protein, 81 aa, Monodelphis domestica
SLESVTFQDVTIDFTQREWRQLTHAQKSLYREVMLENYENFVSVGFPGSKPELISQLECGKGPWMLLEEEVRSRCRGCHRN

SEQ ID NO: 18831 - protein, 81 aa, Monodelphis domestica
FKESITFKDVAVNFTQEEWCLLDHSQKELYLEVVLENMQNLFSVGLPVSMEHFISCFQQGKAPWLLEQKGPRSSCPGLRDI

SEQ ID NO: 18832 - protein, 81 aa, Physeter macrocephalus
CEGSVSFEDVTIDFSREEWQQLDPAQRRLYQDVMLEIYSHLFSVGCHIPDPEIIFRMEKGKEQWMAEAELPRQRYHEGEFG

SEQ ID NO: 18833 - protein, 81 aa, Monodelphis domestica
FQGLVTFQDVAVIFSLDEWGHLDPAQRELYREVMLENYQTLACLGLAVSKPDVIAQLEQGGAPWKLEKDIPASPCPGEQYV

SEQ ID NO: 18834 - protein, 81 aa, Monodelphis domestica
GQETVTFKDVAVDFTREEWRLLSPSQKELYKEVMLENAQNLLSVGLPASPEDMLSYLEQRDALWILEQEGLWSCCAGEIRP

SEQ ID NO: 18835 - protein, 81 aa, Monodelphis domestica
TAAPVTLRDVAVEFTWEEWRHMEPAQRDLYRDVMLDNYENLVFIGIPVSKLDIISLLVRGEAPWMPARKGHRIFYEDSLSV

SEQ ID NO: 18836 - protein, 81 aa, Physeter macrocephalus
AHVSLSFRDVAIDLSQEEWECLDPVQRALYRDVMLENYSNLVSLGCSSPKPDVITLLEQEKEPWTVMREGTRSWYTDLESK

SEQ ID NO: 18837 - protein, 81 aa, Physeter macrocephalus
QESVTFKDVAVDFTLEEWGQLGPGQRELYRDVMLENYQNLLSLGAGLPGSKPDVISRLERGEEPRMETRAAPRVTCSDLET

SEQ ID NO: 18838 - protein, 81 aa, Monodelphis domestica
VVTFKDVAVEFTREEWHLLSSPQKELFKEVMLENAWNLLFVEGEIRPEMKVNPTEVSFSLEEMNLQCFMSDCPNFAFREFC

SEQ ID NO: 18839 - protein, 81 aa, Monodelphis domestica
AQEAVTFKEVAVDFTWEEWRLLSPPQKELYKEVMLENARNLLSVGLPASREDMHSYLEQREAPWMLEQECLRSCCSEGEIR

SEQ ID NO: 18840 - protein, 81 aa, Physeter macrocephalus
QEPVVFEDVAVDFTQEEWALLDLAQRNLYRDVMLENLQNLASLGFETQLKTNELVASQDIYGEKISSEQNVVRFKRSASSL

SEQ ID NO: 18841 - protein, 81 aa, Physeter macrocephalus
LQGSVTFQDVAVDFTLEEWQLLGCAQRKLYWDVMLENFRNLISVEVICLLDDELEGQEGEGSKDNFLNQGMFTFKKTLTNE

SEQ ID NO: 18842 - protein, 81 aa, Monodelphis domestica
SQGSITVKDVTVDFTQEEWALLDHSQQQLYLEVMLENVQNLLSVGLLVPRENVISCFQQGEAPCLLEQDCPRSSCPEAKTC

SEQ ID NO: 18843 - protein, 81 aa, Monodelphis domestica
SEKSLTFQDVAVDFTREEWGQLDPAQKNMYRDVMLENYENFISLGLPVPKADVISHLEKREASWTLRGKFLKNPSLDSLVL

SEQ ID NO: 18844 - protein, 81 aa, Physeter macrocephalus
AAVSFSDVAVYFSLEEWGCLRPAQRALYRDVMRETYGHLGALGDTPNKKEEEPERGPGAKGSKKTPRKERPEELVKNNLDS

SEQ ID NO: 18845 - protein, 81 aa, Monodelphis domestica
EERSGEEARDKHRRQNVLDRLVNKQEENRKGTSPDRGENKRLPISKPDVIFKLEQGKEPWILNLQEAREREVPRNFSPGWE

SEQ ID NO: 18846 - protein, 81 aa, Physeter macrocephalus
SDSVVFEDVAVNFTVEEWALLDPAQRKLYRDVMLETFRNLASVGFCSQVKTSRSSAHWDILETGLCSEEKVVRFTRNDSRS

SEQ ID NO: 18847 - protein, 81 aa, Monodelphis domestica
GPQGSVTFRDVAVDFSPDEWECLGPAQRELYQEVMLENYRSLAWLGLAVSCPEVVCQLERGPWVPEPEVVAGPAGWETKAP

SEQ ID NO: 18848 - protein, 81 aa, Papio anubis
GRLTFRDVAIEFSLAEWKCLDPVQRALYTAVMLENYRNLEFVDSFLKFVMEFSSTGHSNTREGFHTGTLERHKSYPIGDFC

SEQ ID NO: 18849 - protein, 81 aa, Pan troglodytes
MLENYRNLVFLGIAAFKPDLIIFLEQGKEPWNMKRHDMVEEPPVICSHFSQEFWPEQGIEDSFQKMILRRYDKCGHENLHL

SEQ ID NO: 18850 - protein, 81 aa, Pan troglodytes
KEALMAFWDVAVAFTQKEWKLLSSAQRTLYREVMLENYSHLVSLGIAFSKPKLIEQLEQGDEPWREENEHLLDLCPGEWEA

SEQ ID NO: 18851 - protein, 81 aa, Pan troglodytes
MAKPREWRHLDPSQRNLYRDVMLETYSHLLSVGYQVPEAEVVMLQQGKEPWALQGERPRHSCPGEKLWDHNQCRKILSYKQ

SEQ ID NO: 18852 - protein, 81 aa, Pan troglodytes
MEPLTFKDVAIEFSLEEWQCLDTAQRDLYRNVLLENYRNLVFLGIAVSKPDLITCLEQGKEPCNMKRHAMVAKPPVVCSHF

SEQ ID NO: 18853 - protein, 81 aa, Camelus dromedarius
AHGSLTFSDVAIGFSQQEWECLDPVQKTLYRDVMMENYDNLVSLGHSISKPDIITLLEQGKDPWMVVMEEKRNWCTEWLAS

SEQ ID NO: 18854 - protein, 81 aa, Camelus dromedarius
EQLTFEDVAITFSQEEWECLVPAQRTLYRDVMLETCRNLLSVDMSHILVIKKLQVKANMDKKLLQTVITERHVRTERKQFD

SEQ ID NO: 18855 - protein, 81 aa, Camelus dromedarius
SQGLVTFEDVAVYFSLEEWERLDMEQRALYKEVMQENYGILVSLGYPIPKPDLIFRLEQGEEPWVPDSPRPEEGDIVTGVY

SEQ ID NO: 18856 - protein, 81 aa, Camelus dromedarius
ELREQVSFRDVCVDFTQEEWYLLDPTQKILYRDVILENYSHLVSVGNCITKPEVIFKIEQGEEPWIPEERFPKQYLSDIFY

SEQ ID NO: 18857 - protein, 81 aa, Myotis davidii
GLVSFKDVTVDFTQEEWQHLDPAQKTLYMDVMLENYCHLISVGCHMAKPDVILKLERGEEPWTSLTGQTCLEKKWKAEDFI

SEQ ID NO: 18858 - protein, 81 aa, Myotis davidii
RQDPVTFDDVAVYFSRRQWRLLDEAQRRQYHEVMLENLALASSLGGCCGAEDADAPCEQSVSGGVSPSSPSKASLSSVKTH

SEQ ID NO: 18859 - protein, 81 aa, Cercocebus atys
FQELVTFRDVAIDFSQQEWEYLDPNQKDLYRDVMLENYRNLVSLGGHSISKPVVVDLLEQGKEPWMILREETQFTDLDLQC

SEQ ID NO: 18860 - protein, 81 aa, Cercocebus atys
MGPLTFTDVAIEFSLEEWQCLDTAQQNLYRNVMLENYRNLVFLGITVSKPDLITCLEKEKEPWNMKRHEMVDEPPGGVSLL

SEQ ID NO: 18861 - protein, 81 aa, Cercocebus atys
MLENYSNLVFLGIVVSKPDLITRLEQGKKPLTMKRHEMVAKSPVVCSHFAQDLWPEQNMKDSFQKMIPRRYEKRGHGNVQL

SEQ ID NO: 18862 - protein, 81 aa, Cercocebus atys
EKGPLTFRDVVIEFSQEEWQCLDTAQQDLYRKVMLENFRNLVFLGIDVSKPDLITCLEQGKDPWNMKRHSMAATPPGVFFV

SEQ ID NO: 18863 - protein, 81 aa, Cercocebus atys
VTLRDVVINFSQEEWEYLDSAQRNLYWDVMMENYSNLLSLDLESRSETKHLSVGKDIIKNTGSQWEVMECSKLRGLESSIC

SEQ ID NO: 18864 - protein, 81 aa, Cercocebus atys
AATLRLSAQGTVTFEDVAVKFTQEEWKLLSEAQRCLYRDVMLENLALISSLDPALDGSADNTQTSNLGQSVLPSHPEQKTV

SEQ ID NO: 18865 - protein, 81 aa, Cercocebus atys
PQGLVTFGDVAVDFSQEEWEWLNPNQRNLYRKVMLENYRNLASLGLCVSKPDVISSLEQGKEPWTVKRKMTRAWCPDLKIV

SEQ ID NO: 18866 - protein, 81 aa, Felis catus
MGSFGLLTFRDVAIEFSQEERGFLNHSQWALYRDVMLETYGHLLFLGLVVSKPDLVIFLEQKESWNVKGKETVATHPDRWE

SEQ ID NO: 18867 - protein, 81 aa, Leptonychotes weddellii
LQEAIVFEDVAVYFTRIEWSCLAPHQRALYRDVMLENYGHMASLGFLVAKPALISLLEQGEEPGALILQGTEEQGSTASLC

SEQ ID NO: 18868 - protein, 81 aa, Felis catus
MTKPDMIRKLEQGEELWTTERIFPSQSYLEEDGKAEDVLVKFKEYQDRHSRSVIFNHKRLIKERSNIFGKTLTIGKNRIIS

SEQ ID NO: 18869 - protein, 81 aa, Felis catus
GGAARAGFPELLTFRDVAIEFSQEERECLDPAQRAWYRDVMLENYRTLVSLGEDSFPAEVGKCSRLPLCFFWEALESPCPV

SEQ ID NO: 18870 - protein, 81 aa, Felis catus
SQGLVSFKDVAVDFTQEEWQQLDPSQRTLYRDVMLENFSHVISLGYPVSKPDVISKLEQGEDPWIIKRDVSNWIYTDENQA

SEQ ID NO: 18871 - protein, 81 aa, Leptonychotes weddellii
SQEPVTFEDVAVYFTQNQWASLDPMQRALYLEVMLENYANITSLALPFPKPDLILQLEQGEAPWDLDPWTPLEGEALEGVH

SEQ ID NO: 18872 - protein, 81 aa, Leptonychotes weddellii
VKIEDVADVAVSFILEEWGHLDQSQKSLYRDDRKENYGSITSMDYESGHDNVELAVKQISNDAEPHWMTSGSPERNVPQSQ

SEQ ID NO: 18873 - protein, 81 aa, Felis catus
FQESVTFEDVAVDFTQEEWALLDASQRKLFRDVMLENIRHLVSLGYQHCQSDVIFQLEQGEELWAEGSGALQSQGPGGESA

SEQ ID NO: 18874 - protein, 81 aa, Leptonychotes weddellii
VQDPVTFQDVAVEFTQEEWEHLGTAQRALYREVMLENYRSLASLGCQDFKPDVISRLEQGGSAWMAWRDIPRDPSPDQETR

SEQ ID NO: 18875 - protein, 81 aa, Leptonychotes weddellii
SLDSVTFTDVAIDFSQDEWEWLNLAQRTLYKKVMLENYRNLLSLGLCISKPDVIALLEQGKEPWMMKGEMTGGLCPDLEYT

SEQ ID NO: 18876 - protein, 81 aa, Felis catus
MDFTPEEWGKLDPAQREVMLENYRNLVSLWLPVSKSENYSLESGKEPLMLERKAPKSSYSDLEAKPEGKDSTSAQDISKEE

SEQ ID NO: 18877 - protein, 81 aa, Felis catus
SISFEDVTVNFTQEEWGQLDPDQRTLYRDVMLENYGIFISLGKQSFSEQQHHACPSVVTKLEQEASWILEEEFASQCYLRE

SEQ ID NO: 18878 - protein, 81 aa, Felis catus
FQEAVTFKDVAVVFTEEELGLLDPPQRKLYREVMLENFRNLVSVGHSSSKPDVISQLEREEKLCVKEIHTQRGRHSGGRNQ

SEQ ID NO: 18879 - protein, 81 aa, Neomonachus schauinslandi
SYGSLSFEDVTVGFTQEEWQHLDPAQRILYRDVMLENYSHLVSVGCCIPKPEVILKLEQGEQPWILEEESPSQSYPEVCKV

SEQ ID NO: 18880 - protein, 81 aa, Ovis aries
QTELTVEDVDIKFTPEEWECLDPAQRALYQDMVEETYRNLLSVDMSQIHMVKKLQAKRNSAKREITQKVMFGRAESHEIKD

SEQ ID NO: 18881 - protein, 81 aa, Otolemur garnettii
LQESLTFKDVFVDFTLEEWQQLDSAQKNLYRDVMLENYSHLVSVGYLVTKPDGIFRLGPGEESWVTNRETPMRSCPGELLP

SEQ ID NO: 18882 - protein, 81 aa, Otolemur garnettii
FQGVLTFKNMSIEFSVEEWACLDPAQQHLYWEVMLETYRTLVFLDLAVSKPDFITYLEQSKEPWKVKTHQTLVKPPELPSH

SEQ ID NO: 18883 - protein, 81 aa, Pan troglodytes
SLELVSFEEVAVHFTWEEWQDLDDAQRTLYRDVMLETYSSLVSLGHCITKPEMIFKLEQGAEPWIVEETPNLRLSGGSRKQ

SEQ ID NO: 18884 - protein, 81 aa, Pan troglodytes
GPVSFKDVAVDFAQEEWQQLDPDEKTTYGDVMLENYSHLVSVGYDYHQAKHHHGVEVKEVEQGEEPWIMEGEFPCQHSPGK

SEQ ID NO: 18885 - protein, 81 aa, Pan troglodytes
ANVSLAFRDVSIDLSQEEWECLDTVQRDLYKDVMLENYSNLVSLGYTIPKPDVITLLEQEKEPWIVMREGTRNWFTESRSV

SEQ ID NO: 18886 - protein, 81 aa, Pan troglodytes
SVAFEDVAVTFTQEEWALLDPSQKNLYRDVMQETFRNLASIGKKWKPQNIYVEYENLRRNLRIVGERLFESKEGHQHGEIL

SEQ ID NO: 18887 - protein, 81 aa, Pan troglodytes
MFSDVSIDFSPEEWEYLDLEQKDLYRDVMLENYSNLVSLGCFISKPDVISSLEQGKEPWKVVRKGRRQYPDLETKYETKKL

SEQ ID NO: 18888 - protein, 81 aa, Pan troglodytes
RPGAVSFADVAVYFSPEEWECLRPAQRALYRDVMRETFGHLGALGFSGPKPAFISWVEGEVEAWSPEAQDPDGESSAAFSR

SEQ ID NO: 18889 - protein, 81 aa, Camelus dromedarius
FQESVKFRDVAVVFSPDQWVHLSPEERQLYMDVMLDNCDYLVSLGHWTYKAEVISSLKRGKEPWMVGREMTSAPCPACQPA

SEQ ID NO: 18890 - protein, 81 aa, Camelus dromedarius
SSQESLTFQDVAVNFTREEWDQLYPAQKNLYRDVMLENYRNLVALGHQLYKPEVITQLEQEEQWMMERDSPLDTHPEILFL

SEQ ID NO: 18891 - protein, 81 aa, Camelus dromedarius
LQGPVKDVCMARGFSYKKSVHQIPAPRDLYQDIRKESVGNMVSLGSTVSTSNKIARLEQRKEPWTIGVHSSNKRTVLQSNY

SEQ ID NO: 18892 - protein, 81 aa, Camelus dromedarius
VPVAFQDLAVRFSEDEWRLLGEKQRALFLDVMQENYETLVSLGGAPQHSLHLTALVQLVKEIPEFLFGEVSPQSGGAGLDG

SEQ ID NO: 18893 - protein, 81 aa, Camelus dromedarius
ALRDPPQGGVSFLDVAVRFSGKEWRLLDEAQRRLYLDVMLKNYALVSSLALVPAVLNPHGEGLEVSCLAVRLMDAPWFPFP

SEQ ID NO: 18894 - protein, 81 aa, Camelus dromedarius
MPQGSVSFKDVTVDFTQEEWQQLDSAQKALYRDVMLENYCHFVSVGFHMTKPDMIHKLEQGKELWTTGRIFPSRSYLGESV

SEQ ID NO: 18895 - protein, 81 aa, Camelus dromedarius
KVPVTFVDIAVYFSEDEWKNLDEWQKELYNNLVKENYKTLMSLDAEGPVPKPDAPSQAEPREEPCVWEQRDPEEREVLMDP

SEQ ID NO: 18896 - protein, 81 aa, Camelus dromedarius
MESVTLEDVAVGLMQEWALLDDARRKLCRYVLLDNCRTLAPRGTSPCKPSLVSQGALREELRAVERGILCTTGEDWESQLK

SEQ ID NO: 18897 - protein, 81 aa, Myotis davidii
MFQESLTFQDVAVDFTGEEWDQLCPAQKNLYRDVMLENYRNLVALGHQLYKPEVITQLEQEEQWMMERDGPLDTHPENKPE

SEQ ID NO: 18898 - protein, 81 aa, Cercocebus atys
YQDSVTFDDVAVEFTPEEWALLDTAEKYLYRDVMLENYMNLASVEWEIQPRIKGSSLQQGFLKNPIFNGIQMTRNYSGWKL

SEQ ID NO: 18899 - protein, 81 aa, Cercocebus atys
EKGPLTFRDVAIEFSLEEWQCLDTAQQDLYRKVMLENYRNLVFLAGIAVSNPDLITCLEQGKEPWNMKKHVMADEPPVIYS

SEQ ID NO: 18900 - protein, 81 aa, Leptonychotes weddellii
VLQGLSFKDVAVNFTEEEWRELDPAQRDLYRDVMLENYRNLVSLGFPFSKPDIISQLEQAGNPWMQEREVLRSSCTHLETR

SEQ ID NO: 18901 - protein, 81 aa, Felis catus
ILLPLTFEDVAIYFSEQEWQNLDAWQKELYKHVMRTNYEILVSLDDGLPKPELISRIEQGKEFFKNWGESQKSGNIICSSA

SEQ ID NO: 18902 - protein, 81 aa, Leptonychotes weddellii
AHHLVMFRDVAVDFSQEEWECLNSYQRNLYRDVILENYSNLVSVAGCSISKPDVITLLEQGKEPWMVVRDERRRRSLDLES

SEQ ID NO: 18903 - protein, 81 aa, Leptonychotes weddellii
VVFEDVAIYFSQEEWGLLDEAQRFLYHAVMLENFALLSSLGCWHGAQDEEAPSEQDVSVGGSQVRTPKPGPSIQKSQLWEM

SEQ ID NO: 18904 - protein, 81 aa, Enhydra lutris
TKGLVTFEDVAVDFTPEEWQYLNPPQKTLYREVMLETYSNLVSVAGPQGTKPDLILKLEVKEPCLGETKISFWSFPEAVCQ

SEQ ID NO: 18905 - protein, 81 aa, Enhydra lutris
VTFEDVAVYFPWKEWRLLDEAQRRLYHHVMLENFALVSSLGCCYGAEDEEAPFAQSASVGVSQTGTPRATLSSRKTHPCEM

SEQ ID NO: 18906 - protein, 81 aa, Enhydra lutris
AYGSLSFGDVAISFSQEEWEYLNPAQKALYRDVMLETYSNLVSLESSISKPDMITLLEQEKEPWMVLRRETSGWYPDLESN

SEQ ID NO: 18907 - protein, 81 aa, Enhydra lutris
TQVLVTFKDVAVTFTQEEWGHLDLDQRALYQEVMLETCRLLVSLGHPVPKAEFAHLLEHGQELWTGKGGLSRSTCSGDSVR

SEQ ID NO: 18908 - protein, 81 aa, Enhydra lutris
NFWILRLPPGSKGEAPKDWGKLDERQKELYKHVMRGNCETLVSLDYAISKPEVLSQTEPGKEPCSWRRPGPKVPDVPVDPS

SEQ ID NO: 18909 - protein, 81 aa, Enhydra lutris
SQGLVTFEDVAVYFSLEEWERLDADQRDLYKDVMQENYGILVSLGYPIPKPDLIFRLEQGEEPWVPDSPRPEEGDIVTGVY

SEQ ID NO: 18910 - protein, 81 aa, Enhydra lutris
SQGSISFEDVTVNFTQEEWGQLDSDQRTLYRDVMLENYNIFLSLEESKVDGIIESKENQDKHLWQHAFINNKKVTTEKENV

SEQ ID NO: 18911 - protein, 81 aa, Pongo abelii
IGVTVTFDDVALYFSEQEWEILEKWQKQMYKQEMKTNYETLDSLGYAFSKPDLITWMEQGRMLLISEHGCLAKTRRTSSPP

SEQ ID NO: 18912 - protein, 81 aa, Pongo abelii
AHALVTFRDVTIDFSQKEWECLDTTQRKLYRDVMLENYNNLVSLAGYSGSKPDVITLLEQGKEPCVAARDVTGRQYPGLLS

SEQ ID NO: 18913 - protein, 81 aa, Pongo abelii
EMGLLTFRDIAIEFSLEEWQCLDCAQRNLYRDVMLENYRNLVSLGIAVSKPDLITCLEQHKEFQNIKRNEMVVKHPVTCSH

SEQ ID NO: 18914 - protein, 81 aa, Pongo abelii
MGLLTFRDIAIEFSLEEWQCLDCAQRNLYRDVILENYRNLVSLGIAVTKPDFITCLEQNKESQNIKRNEMVAKHSVTCSHS

SEQ ID NO: 18915 - protein, 81 aa, Pongo abelii
QGTVTFEDVAVKFTQEEWNLLSEAQRCLYHDVTLENLALISSLGCWCGVEDEEAPSKQTIYIREIQVRTPMAGVSPKKAHP

SEQ ID NO: 18916 - protein, 81 aa, Pongo abelii
AGGSVSFSDVAVGFTQEEWQHLDPAQRTLYRDVMLENYSLLLSVGYCITKPEVVCKLERGEVLWILEEESPSQSHLDCCID

SEQ ID NO: 18917 - protein, 81 aa, Pongo abelii
VQEPVTFKDVAVDFTQEEWGQLDLVQRTLYRDVMLETYGHLLSVGNQIAKPEVISLLEQGEEPWSVEQACPQRTCSEWVRN

SEQ ID NO: 18918 - protein, 81 aa, Pongo abelii
SQGSVSFRDVTMGFTQEEWQHLDPAQRTLYRNVMLENYSHLVSVGYCIPKPEVILKLEKELINTSRNYSRMKFNEFNKGGK

SEQ ID NO: 18919 - protein, 81 aa, Pongo abelii
LVTFTDVAVNFTKEEWTLLDPAQRNLYRDVMLENSRNLAFIDWATPCKTKDATPQPDILPKRTFPEANRVCLKSISSQLST

SEQ ID NO: 18920 - protein, 81 aa, Pongo abelii
EPGAVSFADVAVYFCREEWGCLRPAQRALYRDVMRETYGHLSALGIGGNKPALISWVEEEAELWDPAAQDPEVAKCQTEAD

SEQ ID NO: 18921 - protein, 81 aa, Pongo abelii
PQASVCFEDVAMAFTQEEWEQLDLAQRTLYREVTLETWEHIVSLGLFLSKSDVISQLEQEEDLCRAEQDAPRDWKATLEEN

SEQ ID NO: 18922 - protein, 81 aa, Pongo abelii
GRPLEMAVSEPEASAAKEWKQLDPAQRNLYNDVMLENYSNQASMGCQAPKPDMISKLEKGEAPWLGKGKRPSQGCPSKIAR

SEQ ID NO: 18923 - protein, 81 aa, Pongo abelii
MFKEAVTFKDVAVAFTEEELGLLGPAQRKLYRDVMVENFRNLLSVGHQPFKQDVSPIERNQQLWIVTTATRRQGNLGEKNQ

SEQ ID NO: 18924 - protein, 81 aa, Pongo abelii
AQVSVTFEDVAVTFTQEEWGQLDAAQRTLYQEVMLETCGLLVSLGCPLFKPELIYQLDHRQELWMVTKDLSQSSYPGDNTK

SEQ ID NO: 18925 - protein, 81 aa, Pongo abelii
CEASVSFEDVTVDFSREEWQQLDPAQRRLYQDVMLELYSHLFSVGYHIPNPDVIFRMLKEKEPRVEEAELSHQRCQEGEFG

SEQ ID NO: 18926 - protein, 81 aa, Pongo abelii
MEPLTFRDVAIEFSPEEWKCLDPAQQNLYRDVMLENYRNLVSLAMCSHFTQDHWPVQGIEDSFHKLILRRYEKCGHDNLQL

SEQ ID NO: 18927 - protein, 81 aa, Bos indicus x Bos taurus
HSEGRLTFQDVAIDFTQEEWECLDLDQRELYRDVMLQNYGNLASLGLVSKVDLVTFLELLKDPRNMRRMETTAIYPAMSPQ

SEQ ID NO: 18928 - protein, 81 aa, Pan troglodytes
QYREDGLLTFRDVAIEFSPEEWQCLDTAQQNLYRNVMLENYRNLAFLPDLITCLEQGKEPWNMKQHEMVDEPTGSLLMSLS

SEQ ID NO: 18929 - protein, 81 aa, Pan troglodytes
SQKSLTFKDVFVDFTLEEWQQLDSAQKNLYRDVMLENYGHLVSVGHLVGKPDVIFRLGPGEESWMADGGTPVRTCAVEMGF

SEQ ID NO: 18930 - protein, 81 aa, Pan troglodytes
QDSVAFEDVAVNFTHEEWALLSPSQKNLYRDVMRETIRNLNCIGMKWENQNIDDQYQNLRRNPRCDVVERFGKSKDGSQCG

SEQ ID NO: 18931 - protein, 81 aa, Pan troglodytes
IGGDVTFNDVAIDFSHEEWGWLNSAQRDLYKDVMVQNYENLVSVAGLSITKPYVITLLEDGKEPWMMEKKLSKGMIPHWES

SEQ ID NO: 18932 - protein, 81 aa, Pan troglodytes
GQLTFKDVAIEFSQEEWTCLDPAQKTLYRDVMLENYRNLVSLDISCKCVNTDLPPKGKNNMGEAFYTVKLERLESCDIAGL

SEQ ID NO: 18933 - protein, 81 aa, Camelus dromedarius
FKGSVTLQDVAVEFTPEEWQLLDCDQRTLYWDVMLENFRNLISVGCPDTKTKVIFKVEQGQEPWMVEGENPRWRTPGESAK

SEQ ID NO: 18934 - protein, 81 aa, Myotis davidii
TDGLVTFSDVAIHFSQEEWECLSPTQRDLYMDVMLENYSNLISLGIKSETWACALTRNQTDDLSVHGTTLNQLSHTSQGTD

SEQ ID NO: 18935 - protein, 81 aa, Cercocebus atys
GSVTFEDVAIYFSQEEWGLLDEAQRLLYRDVMLENFALITALVCCHGMEDEETPEQSVSVERVPQVRTPEASPSTQKTQSC

SEQ ID NO: 18936 - protein, 81 aa, Leptonychotes weddellii
GLVTFRDVAIDFSQEEWECLDPAQRDLYMDVMLENYSNLVSLDLESTYETKNTISEKDIFEINFSQWEMKERSKTLGLEAS

SEQ ID NO: 18937 - protein, 81 aa, Leptonychotes weddellii
AQGFVTFRDVAIEFSQEEWKCLEPAQRDLYRDVTLENFSNLVSLGLSISKPDVISLLEQGREPWMITNGMTGPWCPELESR

SEQ ID NO: 18938 - protein, 81 aa, Felis catus
WKESLSFEDVAVYVTREEWDKLDWAQKDLYRDVMLENYRNMILLGFQFPKPEVICLLEQWEEPWILDLPRTGTRKASSSAC

SEQ ID NO: 18939 - protein, 81 aa, Leptonychotes weddellii
VRMPVTFNDVAVTFTQEEWGQLDPAQRTLYQEVMLETCGLLVSLGCPLPKPELFYPLDHSPELQTLKRGLSPDSCPGDSTK

SEQ ID NO: 18940 - protein, 81 aa, Leptonychotes weddellii
DSVAFEDVTVKFTMEEWALLDPSQKKLYRDVMQETFRNLASIEKKWKDHDTEDRYNTQGRRLRSHMVEKRCESKEGHQCGE

SEQ ID NO: 18941 - protein, 81 aa, Felis catus
ALALVSFEDVAVTFTGEEWRQLDLAQRTLYQEVMLETCGLLVSLGHPVPKPELIYPLEPGQELWTGKRGVSKSTCTGEKAK

SEQ ID NO: 18942 - protein, 81 aa, Pongo abelii
AAVSVTFKHVTMAFTQKEWKQLDPAQRNLYNDVMLENYSNQASMGCQAPKPDMISKLEKGEAPWLGKGKRPSQGCPSKIAR

SEQ ID NO: 18943 - protein, 81 aa, Pongo abelii
DSVAFEDVAVNFTLEEWALLDPSQKNLYRDVMRETFRNLASIGKQWEDQNIEDPFKIPRRNISHIPERLCESKEGGQGEET

SEQ ID NO: 18944 - protein, 81 aa, Pongo abelii
KTGLLAFSDVVIEFSPEEWACLDPAQRNLYRNVMFENYRNLVSLAILSYSIQDLLPEQDMKDLCQKVTLTRHRSWGLDNLH

SEQ ID NO: 18945 - protein, 81 aa, Pongo abelii
MGVLTFRDVAVEFSPEEWECLDSAQQDLYRDVMLENYGNLVSLGLAIFMPDLMTCLEQRKEPWKVKRQKTVAKHPRIHTGE

SEQ ID NO: 18946 - protein, 81 aa, Pongo abelii
KVPVTFVDIAVYFSEDEWKNLDEWQKELYNNLVKENYKTLMSLDAEGSVPKPDAPAQAEPREEPCVWEQRHPEEREIPMDP

SEQ ID NO: 18947 - protein, 81 aa, Pongo abelii
MLETCRLLVSLGHPVPKPELIYLLEHGQELWTVKRGLSQSTCAGEKAKPKTTEPTASQLAFSEESSFKELLAQRSSRDYRL

SEQ ID NO: 18948 - protein, 81 aa, Pongo abelii
MLVTFKDVAVTFTREEWRQLDLAQRTLYREVMLETCGLLVSLGDRAQVHTREPTTYLPVLSERAFLRGSLTLESLTSSDSR

SEQ ID NO: 18949 - protein, 81 aa, Pongo abelii
SLGLVSFEDVAVHFTWEEWQDLDDVQRTLYRDVMLETCSSLVSLGHCITKPEMIFKLEQGAEPWIVEEAPNLRLSAVQILD

SEQ ID NO: 18950 - protein, 81 aa, Pan troglodytes
EMGPLTFRDVAIEFSLEEWQCLDTAQQDLYRKVMLENYRNLVFLAGIAVSKPDLVTCLEQGKDPWNMKRHSTVVKPPGFLP

SEQ ID NO: 18951 - protein, 81 aa, Pan troglodytes
QGLLTFRDVAIEFSQEEWKCLDPAQRTLYRDVMLENYRNLVSLGEDNFPPEMEFCSCCPGWSAVAQSRLTTTSASRVQLEL

SEQ ID NO: 18952 - protein, 81 aa, Pan troglodytes
PHLLVTFRDVAIDFSQEEWECLDPAQRDLYRDVMLENYSNLISLEPARTHEEQHNLPVPKAGSVNLAAGFGHSRSQTGCGS

SEQ ID NO: 18953 - protein, 81 aa, Pan troglodytes
SVAFEDVAVNFTHEEWALLSPSQKNLYRDVMRETIRNLNCIGMKWENQNIDDQYQNLRRNPRLSETWLQNFILIHYGHLVA

SEQ ID NO: 18954 - protein, 81 aa, Pan troglodytes
MWLSWNTAQKDLYQDVMVENPNHLVSLGYQTSKPDALSKLAHGWEPLKTDAKVQNKNCPGIRKVDSHLQEHSPNHMQQCSG

SEQ ID NO: 18955 - protein, 81 aa, Pan troglodytes
SVAFEDVAVNFTPDEWALLDPSQKNLYREVMQETLRNLASIGKKWKDQNTEKEYKNPRSNLRGLMEERLFESEGHQHGEIL

SEQ ID NO: 18956 - protein, 81 aa, Myotis davidii
EEGQLSFRDVAIDFSQEEWECLDPVQQKLYMDVMLENYSNLVSLATLSEDKQAMLQKAEMEDLFPKIILGPLTFRDVAIDF

SEQ ID NO: 18957 - protein, 81 aa, Cercocebus atys
KKKPVTFEDVAVNFTQEEWDCLDASQRVLYQDVMSEIFKNLASVARILLHKPERITKLEQQEEQWREFVHLPNTEGLSEGK

SEQ ID NO: 18958 - protein, 81 aa, Leptonychotes weddellii
KSQGSLSFKDVAVVFTWEEWQLLDPVQKNLYQDVMLENYSNLVSVGYQVTKADAFYQLEHGTPWITEEEIQSQIHPEDTWQ

SEQ ID NO: 18959 - protein, 81 aa, Leptonychotes weddellii
KVPVTFDDVAVHFSEQEWGNLSEWQKELYKNVMRGNYESLVSMAKASSLEKMNKTMSEGGHRAQWRVGHHADYKTAAKTSC

SEQ ID NO: 18960 - protein, 81 aa, Leptonychotes weddellii
NQESLTFDDVAVDFTWEEWQLLAPAQKDLYRDVMLDNYRNLVSVGFHTSKPDVLSKFDEGEPTWTVEDGIPCQTRSGIKEV

SEQ ID NO: 18961 - protein, 81 aa, Leptonychotes weddellii
HAMALSFQELMAFQDVVVDFSQEEWGQLSPGQKALYWDVMLENYRNLVSLGICSFENFISDWGTGPNNRTPSKHNISEKSP

SEQ ID NO: 18962 - protein, 81 aa, Leptonychotes weddellii
MLRNYSNLVSLGLPDCKPDVISKLEQWEDPWTVKRDVPRGPDSEPEPRAAWLPLEKGALSQGQMTVGLSGQDFWHTIQKEV

SEQ ID NO: 18963 - protein, 81 aa, Felis catus
PRSLENDGGCFSEQEWENLEDWQKELYRNVMKSNYEALVSLKVLGPPEEEAELGTGMLGDLEEEGPGDVLPAEGVMIKQEI

SEQ ID NO: 18964 - protein, 81 aa, Leptonychotes weddellii
TQDSVVFEDVAVDFTQEEWALLDFAQRSLYRDVMLENFQNLASLGYPLHTPYLISRWKQEEDLETVESGPIQGEHQEGFEI

SEQ ID NO: 18965 - protein, 81 aa, Enhydra lutris
FQGSLSFGDVTVDFSQEEWQHLDPAQRTLYRDVMLENYHNFVSVGYPIKKPEVIFKLEEGKEPWILEEEFLYQNYPVWSAD

SEQ ID NO: 18966 - protein, 81 aa, Pongo abelii
EEAQKRKAKESGMALPQGHLTFMDVAIEFSQEEWKSLDPGQRALYRDVMLENYRNLVSLGICLPDRSIISMLRQRREPLVL

SEQ ID NO: 18967 - protein, 81 aa, Pongo abelii
VSLTFDDVAVLFTRDEWRKLAPSQRNLYRDVMLENYRNLVSLALRNLLELPVSTTTCKRLGSHHPYPYKKKLVKLKISDFY

SEQ ID NO: 18968 - protein, 81 aa, Pongo abelii
MNSVAFEDVAVNFTQEEWALLDPSQKNLYRDVMQETFRNLASIGNKGEDQSIEDQYKNSSRNLSSFQIHQRNHTGEKPYEC

SEQ ID NO: 18969 - protein, 81 aa, Pongo abelii
RRGHLTFRDVAIEFSQEEWKCLDPVQKALYRDVMLENYRNLVSLGICLPDLSIFSMMNQRTEPWTVENEMKVANNPDRWEG

SEQ ID NO: 18970 - protein, 81 aa, Bos indicus x Bos taurus
DLMTFEDVAVEFTWWEWGQLDPTQKDLYWEVMLENFKNLASLDWERRPQAKKPMLSQGLSKEELFQRASVEKHIRDEFRSS

SEQ ID NO: 18971 - protein, 81 aa, Bos indicus x Bos taurus
AQLTFKDVFIDFTPEEWECLDPAQRTLYKDVMVETLGNLLSVDMSQIDMIKKLQAKADSGKGEIFQRVMFERAESLESKDF

SEQ ID NO: 18972 - protein, 81 aa, Bos indicus x Bos taurus
HSEGRLMFQDVAIDFTQEEWECLDPGQRKLYRDVMVENYRNLASLGLVSKVDLVTFLELLKDPRNMRRMETTAIYPAMSPQ

SEQ ID NO: 18973 - protein, 81 aa, Bos indicus x Bos taurus
SQGRLMFQDVTIDFTLEEWECLDLDQQELYRNVMLENYGNLASLGLVVSKPDLVTFLEQMKNPWDIRRTDTTNSGLISVAV

SEQ ID NO: 18974 - protein, 81 aa, Bos indicus x Bos taurus
AAPMTFEDVAVDFTQEEWSLLDKSQKNLFRNVMLETVSHLVSVGESVNRDVPAPVSILFIHSLNKHLEQLPCVPLSCFLIL

SEQ ID NO: 18975 - protein, 81 aa, Pan troglodytes
MVPLTFSDVAIDFSQEEDLYRDVMLENYTNLVSLEFDFTTESDKLSSEKRNYEVNAYHQETWKRNKTFNLMRFIFRTDPQY

SEQ ID NO: 18976 - protein, 81 aa, Pan troglodytes
RRGHLTFRDVAIEFSQEEWKCLDPAQRTLYREVMVENYRNLVFLGICLPDLSVISMLEQRRDPRNLQSEVKIANNPGSCSV

SEQ ID NO: 18977 - protein, 81 aa, Pan troglodytes
AGRPLEMAVSEPEASAAEWKQLDPAPRNLYNDVMLENYSNQASMGCQAPKPDMISKLEKGEAPWLGKGKRPSQGCPSKIAR

SEQ ID NO: 18978 - protein, 81 aa, Pan troglodytes
SLKKVTFEDVAIDFTQEEWAMMDTSKRKLYRDVMLENISHLLSLGYQISKSYIILQLEQGEELWREGREFLQDQNPDRESA

SEQ ID NO: 18979 - protein, 81 aa, Pan troglodytes
SQDSVTFEDVAVDFTQEEWTLLDQTQRNLYRDVMLENYKNLVAVSSVVEMSLTVSPRLECSGTISAHCSFHLPGSSSSCAS

SEQ ID NO: 18980 - protein, 81 aa, Pan troglodytes
DSVTFEDVAVDFTQEEWTLLDQTQRNLYRDVMLENYKNLVAVGKERNHFGEELFDFNQCEKALSEHSCLKTHRRTYFRKKT

SEQ ID NO: 18981 - protein, 81 aa, Pan troglodytes
QGRLTFRDVAIEFSLAEWKFLNPAQRALYREVMLENYRNLEAVDISSKRMMREVLSTGQGNTEVIHTGMLQRHESYHTGDF

SEQ ID NO: 18982 - protein, 81 aa, Pan troglodytes
MLENYRNLVFLGVGVSKPDLITCLEQGEEPWKRHKMVSKPPVVCSHFAQDLWPEQGIKDSFQKVILRSYGKYGHDNLQLRK

SEQ ID NO: 18983 - protein, 81 aa, Pan troglodytes
VVFEDVAVDFTLEEWALLDSAQRDLYRDVMLETFRNLASVGCEMWERANGSVSLQDMYGQEKSKEQTIPNFTGNNSCAYTL

SEQ ID NO: 18984 - protein, 81 aa, Pan troglodytes
AQESLTLEDVAVDFTWEEWQFLSPAQKDLYRDVMLENYSNLVSVGYQASKPDAFSKLERGEETCTTEDEIYSRICSDSGGA

SEQ ID NO: 18985 - protein, 81 aa, Myotis davidii
MAIRGRSCTRLQVSKPDVISQLEQGTEPWTVDSGIPVGGSGDWVAGPETNMSVPEPDTSEEPSPEAEVEKHKSDESWSSNS

SEQ ID NO: 18986 - protein, 81 aa, Cercocebus atys
EQGYVTFEDVAVYFSQEEWRLLDETQRLLCRNVMLENFSLLASLGLASSKTHDITQLESWEEPFMPAWEVVTSGLPKGCWH

SEQ ID NO: 18987 - protein, 81 aa, Cercocebus atys
QDTVAYEDLCVDYTQKKWKCPALSQRALQWNMMPENDHSMASLGRNMMESSELIPKQEIFKGSESSNSTSGGLFGVVPGAA

SEQ ID NO: 18988 - protein, 81 aa, Cercocebus atys
MTEEFVTLKDVGMDFTLEDWEQLGLEQGDMFWDTALDNCQDLLLLDPPRPNLTSHPDGGEDLEPLPGGSPEATGSDATETK

SEQ ID NO: 18989 - protein, 81 aa, Cercocebus atys
KTGLLAFSDVVIEFSPEEWTCLDPAQRNLYRDVMFENYRNLVSLAILSYAIQDLLPEQDMKDLCQKVTLTRHRSWSLDNLH

SEQ ID NO: 18990 - protein, 81 aa, Leptonychotes weddellii
AHGSVMFNDVSIVFSQEEWEYLDLEQRDLYRDVMLENYSNLVSLGCFISKPDVISLLEQGKEPWKVVRKGRRRYPDLETRY

SEQ ID NO: 18991 - protein, 81 aa, Leptonychotes weddellii
MLENYSNLLSMGLYIPKPQVISLLEQGKEPWMVGRELTRGLCSDLESMCETKLLSLKKEVYEIESCQREIMGLTKHGLEYS

SEQ ID NO: 18992 - protein, 81 aa, Leptonychotes weddellii
QAEVTFEDVAVLFSREEWGRLGPAQRGLYRDVMLETYRNLVSLGAGPAGPKPGVITQLEQGDEPWVLDAQGAKGKERLRVS

SEQ ID NO: 18993 - protein, 81 aa, Pongo abelii
RRGHLTFRDVAIEFSQEEWKCLDPAQRTLYREVMLENYRNLVFLGICLPDLSIISMLEQRRDPRNLQSEMKMANNPGGREC

SEQ ID NO: 18994 - protein, 81 aa, Pongo abelii
MLETYSSLVSLGHHITKPEMIFKLEQGAEPWIVEAPDLRLSAVQILDDLIERSHESHDRFFWQIVITNSNTSTQERVELGK

SEQ ID NO: 18995 - protein, 81 aa, Pongo abelii
QESVTFQDVAVDFTEKEWPLLDSSQRKLYKDVMLENYSNLTSLDWETPSKTKWSLLMEDIFGKETPSGVTMERASLGEKST

SEQ ID NO: 18996 - protein, 81 aa, Pongo abelii
QGLLTFRDVAIEFSQEEWKCLDPAQRTLYRDVMLENFRNLVSLDISFKCMVKEFSSIGKGNTEVFHTRTLQRLASHHIGEC

SEQ ID NO: 18997 - protein, 81 aa, Pongo abelii
GHLTFRDVAIEFSLEEWKCLDTAQRALYRAVMLENYRNLHSVDISSKCMMKKFSSTGQGNIEVDTGTLERHESHHIGDFCF

SEQ ID NO: 18998 - protein, 81 aa, Pongo abelii
SVYEKGPLTFRDVAIEFSLEEWQCLDTAQQDLYRKVMLENYRNLVFLGIAVSKPDLITCLEQGKEPWNMKRHAMVDEPPGR

SEQ ID NO: 18999 - protein, 81 aa, Bos indicus x Bos taurus
WLQGPMSFKDVAVEFTQEEWMMLDSAQRSMYRDVMLENYINLTLVEYQLCKPVISLSGQEDIRTVKSRIRQGTCPDWEIQF

SEQ ID NO: 19000 - protein, 81 aa, Bos indicus x Bos taurus
MGRLTFQDVAIDFTQEEWECLDLGQRELYRDVMLENYGNLASLGLVSKLDLVTFLEQLKDSRNIRRMETTAIYPAMSPQDT

SEQ ID NO: 19001 - protein, 81 aa, Bos indicus x Bos taurus
FPPSWQGSVTFEDVVVYFSWEEWGLLDENQRCLYHDVMLENFALVTSLGKALTPAPVPCTQLCSLQTQVLPPFPSCLAGRH

SEQ ID NO: 19002 - protein, 81 aa, Bos indicus x Bos taurus
PLESVTFGDVAIDFTQEEWSLLDKSQKNLFRNVMLETVTHLVSVGYQISKSDVVFQLEQGKELWTQAAGGFQGQSPGSESL

SEQ ID NO: 19003 - protein, 81 aa, Bos indicus x Bos taurus
VFQGRLTFQDVAIDFTQEEWECLDPGQRKLYRDVMVENYRNLASLGLVSKVDLVTFLELLKDPRNMRRMETTAIYPAMSPQ

SEQ ID NO: 19004 - protein, 81 aa, Bos indicus x Bos taurus
MYFSWEEWCLLDEAQIQLYLDVMLENFALVCMLGSWHGVQDEETPSEQSKSARVSQFCTPRTCLSPEKTQPCKMCIPVLRD

SEQ ID NO: 19005 - protein, 81 aa, Pan troglodytes
PQVSLTFEDVAVLFTWDEWRKLAPSQRNLYRDVMLENYRNLVSLGLPFTKPKVISLLQQGEDPWEVEKDSSGVSSLGSKSS

SEQ ID NO: 19006 - protein, 81 aa, Pan troglodytes
PQASVCFEDVAMAFTQEEWEHLDLAQRTLYREVTLETWEHIVSLGLFLSKSDVISQLEQEEDLCRAEQEAPRDGISLLLPR

SEQ ID NO: 19007 - protein, 81 aa, Pan troglodytes
MLETYNHLVSLEIPSSKPKLIAQLEQGEEPWREERKCPLDLCPDRALLCRQAGIQWCYIGSLQPLPPGFKQFLCLSLLSSW

SEQ ID NO: 19008 - protein, 81 aa, Cercocebus atys
KGPLTFRDVAIEFSLEEWQCLDTAQQDLYRKVMLENYRNLVFLVIYSHFAQDLWPEQGIKDSFQEVILRRYGKCGHEDLQL

SEQ ID NO: 19009 - protein, 81 aa, Cercocebus atys
RLESVTFEDVAVYFTQNQWASLDPAQRALYGEVMLENYANVASLVAFPFPKPALISHLERGEAPWGPDPWDTKIPRGISQG

SEQ ID NO: 19010 - protein, 81 aa, Leptonychotes weddellii
ARDSVTFEDVAVHFSSGEWQCLTRAQRHLYADVMLENYGNVISVGFAVPKPPLISHLEQGNEPCVQDLQDGGFLSCSFPVS

SEQ ID NO: 19011 - protein, 81 aa, Felis catus
ISFEDVAVDFTLEEWRLLNPTQKNLYRDVMLENYSNLVFLEVWLDNNLKMWHQDNQDELRSMERGDECDVFRKIFHSSINF

SEQ ID NO: 19012 - protein, 81 aa, Felis catus
FQDLVTFGDVAVDFSQEEWEWLNPAQRNLYRKVMLENYRSLVSLGVSVSKPDVISLLEQGKEPWMMKKEGTRGTYPDWEYA

SEQ ID NO: 19013 - protein, 81 aa, Leptonychotes weddellii
SQHLVTFEDVAVNFTQEEWTLLDQTQRDLYRDVMLENYQNLIILGYESCKPDLNSSMGGAGELRTGGRGILQELDLQLKTK

SEQ ID NO: 19014 - protein, 81 aa, Leptonychotes weddellii
FQGSVSFKDVTVDFTQEEWQHLDPAQRSLYRDVMLENYSNLVSLGYCVTKPEVIFRLEQGEEPWILEEEFPSQSFPEIWKT

SEQ ID NO: 19015 - protein, 81 aa, Leptonychotes weddellii
QLTFRDVAIEFSQEEWECLDPAQRELYKGVMLENYKNLVSLDVSLTHVIKKLAPKENSNTGEVFQTVMLERHEGLEIKDFY

SEQ ID NO: 19016 - protein, 81 aa, Leptonychotes weddellii
SKVPVTFGDLAIYFSQEEWEWLSPIQKDLYEDVMLENYQNLVSLGLCFRRPNVITSLEKGKAPWIVEPVRKRRGVDSGSKS

SEQ ID NO: 19017 - protein, 81 aa, Enhydra lutris
QEPVTFADVAVLFTPEEWMFLDSAQRSLYRDVMLENYRNLASVGAGDQLGKPSMLSLSEPGEELWAPERRTFPGTRPEPQH

SEQ ID NO: 19018 - protein, 81 aa, Enhydra lutris
QQCRVVLEDVAICFSQEEWGLLDEAQRFLYHAVMLETCALLSSMGCWHGAQDEESPSEQGDSVGGSQVRTLNPGPPTQKSQ

SEQ ID NO: 19019 - protein, 81 aa, Enhydra lutris
TFKEVVTFKDVAVVFTEEELGLLDPFQRKLYRDVMLENFRNLVSVGHQPSKRDGVHLVREEKFWMMKLATQRKGILGYKVQ

SEQ ID NO: 19020 - protein, 81 aa, Enhydra lutris
TVTFRDVAVVFTEEELALLDRAQINLYQDVMLENFRNVVSVGYRIKNNTSPLQGKVLSYLSQGVLYCWQSLKQTINELTVS

SEQ ID NO: 19021 - protein, 81 aa, Pongo abelii
SQELVTFEDVAVYFIRKEWKRLEHAQRDLYRDVMLENYGNVFSLDHETRTENDQEICEDTRSHGVLLGRFQKDISQGLKFK

SEQ ID NO: 19022 - protein, 81 aa, Pongo abelii
EMGLLTFRDIAIEFSLAEWQCLDHAQRNLYRDVMLENYRNLVSLGIAVSKPDLITCLEQNKEPRNIKRNEMVAKHPGREKS

SEQ ID NO: 19023 - protein, 81 aa, Pongo abelii
PLSFKDVAVVFTEEELELLDSTQRQLYQDVMQENFRNLLSVGDKNGKDMEYIQDEELRFFSHKELSSWKIWEEVAGELPGS

SEQ ID NO: 19024 - protein, 81 aa, Pan troglodytes
EMGLLTFRDIAIEFSLEEWQCLDCAQRNLYRDVMLENYRNLVSLGIAVSKPDLITCLEQNKESQNIKRNKMVAKHPVMHSH

SEQ ID NO: 19025 - protein, 81 aa, Pan troglodytes
QESITLEDVAVDFTWEEWQFLSPAQKDLYRDVMLENYSNLVAVGYQASKPDALFKLEQGEQPWTIEDGIHSGACSDIWKVD

SEQ ID NO: 19026 - protein, 81 aa, Camelus dromedarius
KGQESVTFRDVAVDFTLEEWGRLGPGQRELYRDVMLENYQNLLSLGAGFPGSKPDVISRLERGEEPRMEAREDWQVTCSGG

SEQ ID NO: 19027 - protein, 81 aa, Camelus dromedarius
LPNSFAFEDLSVDFTQKEWQLLEPNQKDLYRDVMLENYSSLVSLGYRVTKPGVILKLERGEEPWVGDGGAPRTDAVGECEN

SEQ ID NO: 19028 - protein, 81 aa, Camelus dromedarius
MLENLSHLVSVGYQHCKSDVIFQLEQGEELWTEGGGFLQSHSPGIEGALRKEVLATQHIRREDMSTVIPGKQVSHSPEGPF

SEQ ID NO: 19029 - protein, 81 aa, Cercocebus atys
VGVSLTFEDVAVLFTRDEWRKLAPSQRNLYRDVMLENYRNLVALGLPFTKPKVISLLQKDLGQGNRSKSSHKTTKSTQTQD

SEQ ID NO: 19030 - protein, 81 aa, Cercocebus atys
MCGPLQFRDVAIEFSLEEWHCLDTAQRNLYKNVMLENYSNLVFLGIVVSKPDLITRLEQGKKPLTMKRHEMVAKSPVVCSH

SEQ ID NO: 19031 - protein, 81 aa, Cercocebus atys
QGRLTFRDVAIEFSLAEWKCLNPAQRALYREVMLENYRNLESVDISSKCMMKEVLSTGQGNTEVFYPGTLQRPESHHIGDF

SEQ ID NO: 19032 - protein, 81 aa, Cercocebus atys
EDVAVDFTLEEWALLDSAQRDLYRDVISVSRFEMWERTKTQFKANGSVSQQDTYREEKSKEQTIPNFTRNNSCAYTLEKTC

SEQ ID NO: 19033 - protein, 81 aa, Cercocebus atys
FQKPVTFEDVAVNFTQEEWDCLDASQRVLYQDVMSEIFKNLASVARILLHKPERITKLEQQEEQWRETQVLQASQARPPFF

SEQ ID NO: 19034 - protein, 81 aa, Leptonychotes weddellii
SHGPLSFEDVAIAFTKEEWQQLDPAQRTLYRDVMLENFSHLVSLGHPVSKPDVISKLEQGEEPWIIKRDISNWICPERETR

SEQ ID NO: 19035 - protein, 81 aa, Felis catus
SCSDFSGFCASPIEEPHGLLISSCNSRTMTDGLVTFRDVAIDFSQEEWECLDPAQRDLYVDVMLENYSNLVSLGKVICLKY

SEQ ID NO: 19036 - protein, 81 aa, Felis catus
TGQCDFGGRGRVFSWEEWGLLDEVQRRLYHNVMLENLALITSLGCQHGAENEEAPSEQSVSIEGVSHVRTPKAGLSPQKAS

SEQ ID NO: 19037 - protein, 81 aa, Leptonychotes weddellii
MDHELVTFRDVVINFSQEEWEYLDSAQRDLYWDVMMENYSNLVSLDLESKYDTKTRRDITGSQWKVTESKFIGLESSIFRN

SEQ ID NO: 19038 - protein, 81 aa, Otolemur garnettii
QALLTFRDVSIEFSMDEWACLDPAQQNLYRDVMLETYRHLVFLDLITCLEQRKEPWKVKTHQAVVKRQGSLVFSDVLSSLH

SEQ ID NO: 19039 - protein, 81 aa, Otolemur garnettii
GWVPALFDEVAIYFSDEEWEVLTEQQKALYREVMRMNYETVLSLEFPFPKPDMITRLEGEEESQNSDEWQLQGGGTFAENE

SEQ ID NO: 19040 - protein, 81 aa, Otolemur garnettii
PKGSVSFEDVAVDFTRQEWYRLDPAQRTMHKDVMLETYSNLASVGFCMAKPEMIFKLERGEELWILEEESSSHGYSGDKQM

SEQ ID NO: 19041 - protein, 81 aa, Otolemur garnettii
KKELLTFKDVTIEFSPEEWACLNPTQRDLYRDVTLENYRNLFTLGLTLSKPDLITCLEQRKEPWKVKTQQTVAEQPGRNMG

SEQ ID NO: 19042 - protein, 81 aa, Otolemur garnettii
FQGMVTFSDVAIDFSQEEWACLDSAQRDLYWDVMLENYSNLVSLDLESATYEAKGLATEKNIPGRNFPKKNSDEKSKSLGL

SEQ ID NO: 19043 - protein, 81 aa, Vulpes vulpes
PCRLVLFKDVAVDFSQEEWECLDLEQKDLYRDVMLENYSNLVSLAGFSISKADVLSLLKQGKEPWKVVQEVTRSQSSALVT

SEQ ID NO: 19044 - protein, 81 aa, Otolemur garnettii
LPDSLTFTDVAIDFSQDEWEWLSLAQRSLYRKVMLENYMNLVSVGLCISKPDVISLLEQEKEPWMVTEQITRGLCADLEYM

SEQ ID NO: 19045 - protein, 81 aa, Vulpes vulpes
RPGVVSFADVAVYFSPEEWGCLRPAQRALYRDVMQKTYGLLGALGFSGPKPAFISWVEREVEAWSPEAQDPEAVIRDRGKI

SEQ ID NO: 19046 - protein, 81 aa, Otolemur garnettii
FQESLTLDDVAVEFTWEEWQLLGPAQKDLYRDVMLENYSNLVSVGCEASKPDALSKLKQGEPQWTREDEIHCAARSEIGRV

SEQ ID NO: 19047 - protein, 81 aa, Otolemur garnettii
QESVTFNDVVVDFTLEEWGQLEPGQRELYRDVMLENYQNLLSLRAGLLRSKPDIISRLERGEAPKMEEREAQRVTCPGEEW

SEQ ID NO: 19048 - protein, 81 aa, Vulpes vulpes
KPRAVSFADVAVYFSPEEWGCLQAAQRALYRDVMRETYGHLGALGFPGPKPALISWMEQESEAWSPAAQDPEEGESLGGAL

SEQ ID NO: 19049 - protein, 81 aa, Enhydra lutris
VVFADVAVNFTPEEWALLDRGQRRLYRDVMLETCRNLASLVDTSQDKRSASRTQRNVQNELPSEGKTVLLARNDSCSVFGA

SEQ ID NO: 19050 - protein, 81 aa, Pan troglodytes
KPGAVSFADVAVYFSREEWGCLRPAHRALYRDVMRETYGHLGALGVGGSKPALISWVEEKAELWDPAAQDPEVAKCPTEAD

SEQ ID NO: 19051 - protein, 81 aa, Pan troglodytes
MLETYSSLVSLGHCITKPEMIFKLEQGAEPWIVEEAPNLRLSAVQIIDDLIERSHESHDGFFWQIVITNSNKSTQERVELG

SEQ ID NO: 19052 - protein, 80 aa, Pan troglodytes
MCGPLQFRDVAIEFSLEEWHCLDTAQRNLYKDVMLENYRNLIFLGITVSKPDLITCLEQGRKPLTMKRNEMIAKPSGRCE

SEQ ID NO: 19053 - protein, 81 aa, Pan troglodytes
PRLPLTFEDVAIYFSEQEWQDLEAWQKELYKHVMRSNYETLVSLDDGLPKPELISWIEHGGEPFRKWRESQKSGNTICSSV

SEQ ID NO: 19054 - protein, 81 aa, Camelus dromedarius
GRVVFEDVAIFFSQEEWGLLDEAQRHLYHAVMTENLALLSSLVVVEVLMTYTDEQTMSQLLSHPSGHPDDLGTPGCVVFED

SEQ ID NO: 19055 - protein, 81 aa, Camelus dromedarius
ILWRVTFSDVAIDFSHEEWGWLDSAQRDLYKDVMVQNYENLVSLAGLSIPKPYVIALLEEGKDPWMVERKLSTGFSGLSAA

SEQ ID NO: 19056 - protein, 80 aa, Camelus dromedarius
MILWRVTFSDVAIDFSHEEWGWLDSAQRDLYKDVMVQNYENLVSLGLSIPKPYVIALLEEGKDPWMVERKLSTGMFPGKS

SEQ ID NO: 19057 - protein, 81 aa, Camelus dromedarius
FQDSVVFEDVAVDFTVEEWALLDSAQKELYRDVMLENFRNLASVETLWWRDSVKVLTSVGKASVSKLRSDGIISTLVDFQH

SEQ ID NO: 19058 - protein, 81 aa, Camelus dromedarius
MSVTFEDVAVLFTRDEWRKLGPSQRSLYQDVMLENYSNLLSLGLPFSKPKVISLLQQGEDPWKVERDSPGGASLVKAELEA

SEQ ID NO: 19059 - protein, 81 aa, Myotis davidii
QAEDMDFEDVAIAFSQEEWGLLDEAQRLLYCKVMLENFALVASVGCWHKSEDEETSSKQSVSVTAESLVKASKIALPTQKT

SEQ ID NO: 19060 - protein, 81 aa, Myotis davidii
MNFEDVAIAFSQEEWGLLDDAQRHLYCDVMLEVFALVSFVGHWHKMDDVEAYSEHSVSVGDSLVRASKTAAATQRTHLCKP

SEQ ID NO: 19061 - protein, 81 aa, Myotis davidii
VGVSFEDIALYFSREEWSLLDEGQRQLYLNVMRENFELISSQAFMNMEKSLTNAVNVGNLLRRCIAFIVIRDFTLEKGLMS

SEQ ID NO: 19062 - protein, 81 aa, Myotis davidii
SAEDMNFEDMAVAFSEDEWGLLDEPQRLLYCDVMLEVFALVSSAGCWHKTDDAEACSEQSVSEQEESQDSASKTEPATQRS

SEQ ID NO: 19063 - protein, 81 aa, Myotis davidii
MKFEDVAIAFSQEQWVLLEVQRLLYHDVMLEVFTLVSIYRENMQDGLKGGLALLKATWGESCWHKMDDEESNSDQSVSVQG

SEQ ID NO: 19064 - protein, 81 aa, Myotis davidii
MLENYSHLISVGYHLVKPEVIIKLEQGEEPWRVEEVLLHSRPEVWKVDLIERVQESEDKHSRQTLSINNKTLIEERGDVLG

SEQ ID NO: 19065 - protein, 81 aa, Cercocebus atys
SQASVSFEDVTIEFTQEEWQQMAPVQKNLYRDVMLENYSNLVSVGYCHFKPEVIFKLEQGEEPWFSEEEFSNQSHPKDYRG

SEQ ID NO: 19066 - protein, 81 aa, Cercocebus atys
AQTLLTFRDVAIEFSLEEWKCLDPAQQNLYRDVMLENYRNLFSIGLTVSKPGLITCLEQREEPWNVKRQEAVDGHPALSSH

SEQ ID NO: 19067 - protein, 81 aa, Cercocebus atys
IMEEAVTFKDVAVFFTEEELGLLDPAQRKLYRDVMLENFRNLLSAGHQPFHQETFHFLREEKFWMMETVTQREGNSGGKIQ

SEQ ID NO: 19068 - protein, 81 aa, Cercocebus atys
QGPLTFRDVAIEFSQEEWKSLDPVQKALYWDVMLENYRNLVFLGKHNFALEVKICPCAFLCFLSWEPFHHLTETEALLTHR

SEQ ID NO: 19069 - protein, 81 aa, Leptonychotes weddellii
AQESLTFDDVAVDFTWEEWQLLAPAQKDLYRDMMLENYRNLVSVGCQTSKPDALSKLERGEELWMIEDEIHSRICPEIRKV

SEQ ID NO: 19070 - protein, 81 aa, Leptonychotes weddellii
MPLAGCPVPRPELIYQLEHGQELWMVKRDLSQSACPGDKGKPKTTELSPCAPALSEGALFQELGQGDPGNFQLGQTKDQSG

SEQ ID NO: 19071 - protein, 81 aa, Leptonychotes weddellii
MFPVTFSDVAIDFSHEEWGWLDSAQRDLYKDVMVQNYENLVSLGLSIPKPYVISLLEDGKEPWMVEKKLSKGMFPDWESRW

SEQ ID NO: 19072 - protein, 81 aa, Leptonychotes weddellii
TQDSVAFEDVTVKFTMEEWALLDPSQKKLYRDVMQETFRNLASIVCISEEKWEIHDSEDQNENRGTDLSSQMVERLCKSKE

SEQ ID NO: 19073 - protein, 81 aa, Callithrix jacchus
LTFRDVAIEFSLEECQCLDTAQQNLYRNVMLENYRNLAFLGRQATSSSSSQTPQPGKSTKMEKNKHKKDETIKDQNTSSPS

SEQ ID NO: 19074 - protein, 81 aa, Macaca mulatta
RNLLVYSFYEKGPLTFRDVVIEFSQEEWQCLDTAQQDLYRKVMLENFRNLVFLGIDVSKPDLITCLEQGKDPWNMKRHSMV

SEQ ID NO: 19075 - protein, 81 aa, Monodon monoceros
RQAEAEAEDADAEAVVAEERSPASGTQERLSCGGDAESPGLQEKGYPIPKPDLIFRLEQGEEPWVPDSPRPEEGDIVTGVY

SEQ ID NO: 19076 - protein, 81 aa, Macaca mulatta
PLQFRDVAIEFSLEEWHCLDTAQRNLYKNVMLENYSNLVFLVMCSHFAQDLWPEQNMKDSFQKMIPRRYEKRGHENVQLIK

SEQ ID NO: 19077 - protein, 81 aa, Ovis aries
MGMAGLISEGFVPRCHVGELQELGLSISKPNMISLLEQGKEPWMVEREMSDSQHADWESWCEIKALSPKWYTDEEEMSQGV

SEQ ID NO: 19078 - protein, 81 aa, Ovis aries
SKGCVTFEDVAIYFSQEEWGLLDEAQRHLYHKVMLENFALTASMVCLHETETKETSSEQNVSLEALSQIRIPKVGPVTENA

SEQ ID NO: 19079 - protein, 81 aa, Ovis aries
AQLTFKDVAIQFSPEEWECLDPAQKTLYRDVMVETLKNLLSVAIFHIHMIKKSQLKSNIDIGERFQIVMLENHESHEIKHF

SEQ ID NO: 19080 - protein, 81 aa, Ovis aries
QGSLSFRDVAVGFTRKEWQELDPTQRTLYRDVMLENYSHLVSVGKADVTVTPSAYLARRRFEYDAQGNLFLYSKLDAPHAG

SEQ ID NO: 19081 - protein, 81 aa, Ovis aries
GSVTFEDVAVYFSWEEWSLLDDAQRCLYHNVMLENLALIISLGCWHGAEDEEAPSEQNISVHGMSQVRIPKAGMFSQKAHF

SEQ ID NO: 19082 - protein, 81 aa, Ovis aries
NVSGLALSQTQLTVEDVDIKFTPEEWECLDPAQRALYWDVMEETYRNLLSVDSSDQVKTHIYPEGQSKIFIIHVPLLPQSI

SEQ ID NO: 19083 - protein, 81 aa, Otolemur garnettii
FQGLLTFKDVSIEFSMDEWACLDPAQQHLYREVMLETYRNLVFLVLPFFEPDLITCLEQSKEPRKVKTQQTLLKHPVSWQL

SEQ ID NO: 19084 - protein, 81 aa, Otolemur garnettii
QGPVTLKDVTVEFTKEEWKLLTPAQKTLYKDVMLENYGHLVSIGYRANKSNAFLKLKQGKEPWILELEFPRRNLPVSWGTD

SEQ ID NO: 19085 - protein, 81 aa, Vulpes vulpes
AQESVTFRDVAVFFSQDEWLHLDSAQRMLYREVMLENYGTLVSLGILFSKPKVIFQLQQGEDPWMVENGVSQSPCVGWENL

SEQ ID NO: 19086 - protein, 81 aa, Otolemur garnettii
LQEALTFKDVAVVFTKEELRLLDSVERKLYRDVMRENFRNLLLVGHKAFHQDALHFIKEEKFWTMKTAIQREENSGGKVQT

SEQ ID NO: 19087 - protein, 81 aa, Otolemur garnettii
AHVSLAFRDVAIDLSQEEWECLDPAQRDLYKDVMLENYNNLISLGYTIPKPDVITLLEQDKEPWVVMREGTRSWYTDLECK

SEQ ID NO: 19088 - protein, 81 aa, Vulpes vulpes
FQESVTFRDVAIDFSQEEWEWLQPAQRDLYRHVMLENYSHLVSLGLNISKPYVVSLLEQGKGPWLEKGDLRRDLFSESHGE

SEQ ID NO: 19089 - protein, 81 aa, Otolemur garnettii
LQESVTFQDVAVDFTLEEWQLLDCAKRTLYWDVMLENYRNLISVGCPVTKTKVIFKVEQGQEPWRAERGKPHWSHPEADYL

SEQ ID NO: 19090 - protein, 81 aa, Pan troglodytes
GTVTFEDVAVNFSQEEWSLLSEAQRCLYHDVMLENLTLISSLGCWYEAKDETPSKQTLSIQQESPLRTHWTGVCTKKVHLW

SEQ ID NO: 19091 - protein, 81 aa, Myotis davidii
DETDMDFEDVAIVFSEEEWGLLDEAQRLLYCNVMLEVFALVSSVGCWHKTTDEEEVCPEQIVSVQGESQFRAPKTAPATQR

SEQ ID NO: 19092 - protein, 81 aa, Myotis davidii
RRWGPVTFEDVALHFSREEWRLLAEAQRRLYLDVMLENFALVSSQGCCCGTKNVEAPSEQARTSRESQSSQKTHPCEMCGP

SEQ ID NO: 19093 - protein, 81 aa, Cercocebus atys
GPLQFRDVAIEFSLEEWHCLDTAQRNLYRNVMLENYKNLVFLGIPVSKPDLITCLEQGKKPLTMKRHEMVAKSPVIYSHFA

SEQ ID NO: 19094 - protein, 81 aa, Cercocebus atys
YQDSVTFDDVAVDFTQEEWTLLDPSQRDLYRDVMLENYENLASVGHDLFKPSVICWLEEELRAEQRGVLQEWRLKTKGPAL

SEQ ID NO: 19095 - protein, 81 aa, Cercocebus atys
AQGVVTFEDVAVYFSWKEWGLLDEAQKCLYHDVMLENLTLTTSLGGCGAGDEEASYQQSTSSQWVSQVRLPKAVPSPQKTN

SEQ ID NO: 19096 - protein, 81 aa, Cercocebus atys
MDSVVFEDVAVDFTLEEWALLDSAQRDLYRDVMLETFQNLASVDDETQFKASGSVSQEDIYGEKIPKESKIAAFTRNVSWA

SEQ ID NO: 19097 - protein, 81 aa, Cercocebus atys
IYFSQEEWELLEYTQKALYNDVMQENYETVISLALFVLPKPKVISCLEQGEEPWVQVSREFKDSAGKSPTGLKLKNDTENH

SEQ ID NO: 19098 - protein, 81 aa, Cercocebus atys
GRLTFRDVAIEFSLAEWKCLDPVQRALYTAVMLENYRNLEFVDSFLKFMMEFSSTGHSNTREGFHTGTLERRKSHPIGDFC

SEQ ID NO: 19099 - protein, 81 aa, Leptonychotes weddellii
WVTFQGQVTFDDVAVDFTQEEWGLLGPAQRTLYHDVMLETLRHPVPVGPWNLKPDIVAHLELGVEQRMMDRGLSQDSCLAL

SEQ ID NO: 19100 - protein, 81 aa, Enhydra lutris
KLKSVTFEDVAVYFTQTEWDGLSPAQRALYRDVMLENYGNVASLGFSLLKPAVISQLEGAEIDIQTDNNLTKEVYEEKHNT

SEQ ID NO: 19101 - protein, 81 aa, Enhydra lutris
RKGLLTFRDVAIEFSEEEWGCLTHTQRQLYLDMMLENYGHLLFLGLLLSKPDLIMFLEQEKQLWDVKRKETGGFHSAVSSH

SEQ ID NO: 19102 - protein, 81 aa, Enhydra lutris
QERLTFRDVAIEFSREEWECLNPAQRALYRDVMVENYRNLISLGEDSFPTEDNISTRCMNKELPPKDNINNGELFQTLILK

SEQ ID NO: 19103 - protein, 81 aa, Enhydra lutris
MQGSLTFGDVAVTFTQFEWKHLDTTQQTLYRDVMLENYGNLVSVGLLSSKPKLITQLEQGAEPWMEVQQIPSNTCSVQEYC

SEQ ID NO: 19104 - protein, 81 aa, Enhydra lutris
AYGSLSFGDVAISFSQEEWEYLNPAQKALYRDVMLETYSNLVSLAESSISKPDMITLLEQEKEPWMVLRRETSGWYPDLES

SEQ ID NO: 19105 - protein, 81 aa, Enhydra lutris
STEPVIFRDVAMYFTQKEWQLLKPAQKDLYKEVMLENYGNLASLGYRFFKPKLITRLEQGDEPCVKERDVPQEPQHSSAGV

SEQ ID NO: 19106 - protein, 81 aa, Enhydra lutris
AEDHVTFEDVAVHFSWEEWGLLDEAQRLLYRDVMLENFALMASLGLASSSAHAVTQLQWWREPFVPPCAVLTAVAPRGWRH

SEQ ID NO: 19107 - protein, 81 aa, Pongo abelii
MEPLTFRDVAIEFSPEEWKCLDPAQQNLYRDVMLENYRNLVSLAMCSHFTQDHWPVQGIEDSFHKLILRRYEKFSLLVSSC

SEQ ID NO: 19108 - protein, 81 aa, Pongo abelii
FQESVTFKDVSIDFSWEEWIQADSAQRMTVYEEVMLENYRNLVSLGNHLSKPSGTSQLEREELSLTQKEPPEGGFRDFLGY

SEQ ID NO: 19109 - protein, 81 aa, Bos indicus x Bos taurus
QESVTFQDVAVDFTEKEWPLLDSTQRKLYKDVMLENYSNLASVDWAMPSKTKWSILMEDIFGKETSNGVTVEKVLGEESAE

SEQ ID NO: 19110 - protein, 81 aa, Bos indicus x Bos taurus
MLDNYRSLVSLGVSVSKPDVISLLEQGKEPWMVKEEGPRGACPGWEYTFKNKEFPSKQVIYEESSKVMMMGRSHLSYNLNC

SEQ ID NO: 19111 - protein, 81 aa, Pan troglodytes
LVMFQDLSIDFSQEEWECLDAAQKDLYRDVMMENYSSLVSLDSEFRCKTKDSCLPKEIYEVTSSQWVRMEKCHSLVGSSVR

SEQ ID NO: 19112 - protein, 81 aa, Pan troglodytes
ELTSSCGSKTMANVSLAFRDVSIDLSQEEWECLDTVQRDLYKDVMLENYSNLVSLGYTIPKPDVITLLEQEKEPWIVMREG

SEQ ID NO: 19113 - protein, 81 aa, Pan troglodytes
NCYQDTVTFDDVAVDFTQEEWTLLDPSQRDLYRDVMLENYENLASVEWRLKTKGPALRQDGSWFRASNETQMARSHNGGQL

SEQ ID NO: 19114 - protein, 81 aa, Pan troglodytes
PMPGPQEAVVLEDVAVYFTRIEWSCLAPDQQALYRDVMLENYGNLASLALISLLEQGEEPGALILQVAEQSVAKASLCTDS

SEQ ID NO: 19115 - protein, 81 aa, Pan troglodytes
TQVRLTFRDVAIEFSQEEWKCLGPAQRILYRDVMLENYWNLVSLGLCHFDMNIISMLEEGKEPWTVKSCVKIARKPRMQEC

SEQ ID NO: 19116 - protein, 81 aa, Pan troglodytes
EKETLTFRDVAIEFSLEEWECLNPAQQNLYMNVMLENYKNLVFLGVAVSKQDPVTCLEQEKEPWNMKRHEMVDEPSAMCSY

SEQ ID NO: 19117 - protein, 81 aa, Pan troglodytes
ARGCVVFEDVFVYFSREEWELLDDAQRLLYHDVMLENFALLASLGIAFSRSRAVMKLQRGEEPWVYDQVDMTSATEREAQR

SEQ ID NO: 19118 - protein, 81 aa, Pan troglodytes
PQEAVVLEDVAVYFTRIEWSCLAPDQQALYRDVMLENYGNLASLGFLVAKPALISLLEQGEEPGALILQVAEQSVAKASLC

SEQ ID NO: 19119 - protein, 81 aa, Camelus dromedarius
PQDLMTFEDVAVEFTWWEWGQLDAAQKDLYREVMLENFRNLASLGFPVSKPHVICQLEKGEEPCMMEREVSTGAHPGHLWS

SEQ ID NO: 19120 - protein, 81 aa, Cercocebus atys
AQGLVTFADVAIDFSQEEWACLNSAQRDLYWDVMLENYSNLVSLDLESAYENKSLPTEKNIHELRASKRNSDRRSKSLGRN

SEQ ID NO: 19121 - protein, 81 aa, Cercocebus atys
PQGLLTFRDVAIEFSQEEWKCLDPAQRTLYRDVMLENYRNLVSLDISSKCMMNTLSSTGQGNTEVFHTGTLQRQASYHIGA

SEQ ID NO: 19122 - protein, 81 aa, Cercocebus atys
GCLTFRDVAIEFSFMEWKCLNPAQRALYREVMLENYRNLEFVDSSLKSMMEFSSHEHSNTGEGFYTGTLERHKSYHIGDFC

SEQ ID NO: 19123 - protein, 81 aa, Cercocebus atys
GTVTFEDVAVKFTQEEWKLLSEAQRCLYRDVMLENLALISSLGCWCGVEDEEAPSKQSIYIQRETQVRIPMAGVSLKKAHP

SEQ ID NO: 19124 - protein, 81 aa, Cercocebus atys
VHGSVTFRDVAIDFSQEEWECLQPDQRTLYRDVMLENYSNLISLGSSISKPDVITLLEQEKEPWIVVRKETSRWYPDLESK

SEQ ID NO: 19125 - protein, 81 aa, Leptonychotes weddellii
HGGSLSFEDVTVGFTQEEWQRLDPAQRILYRDVMLENYSHLVSVGCCIPKPEVILKLEQGEQPWILEEESPSQSYPEVCKV

SEQ ID NO: 19126 - protein, 81 aa, Camelus dromedarius
VQGLMAFEDVAVYFSREEWGLLDAAQRALYRRVMLENFALLASLGLSVSRPRVVIQLERGEEPWVLSATDVTLARSAQRRP

SEQ ID NO: 19127 - protein, 81 aa, Camelus dromedarius
QVLVTFKDVAVTFTQEEWGQLDLDQRTLYREVMLETCGLLVSLGAVDDGLASSSQSRADAPAGAWAKGMDSHEGPLMEHMS

SEQ ID NO: 19128 - protein, 81 aa, Camelus dromedarius
EICLIWTLKFSSREVLKRTDQFLKFKTMAHGSVTFRDVAIDFSQEEWEFLDSAQRDLYRDVMWENYSNFISLGKAVYPKLY

SEQ ID NO: 19129 - protein, 81 aa, Myotis davidii
SQGLVTFEDVAVYFSLEEWERLAAAQRALYREVMQENYGILVSLGYPIPKPDLIFRLEQGEDPWVPDSPRPEEGDIVTGVY

SEQ ID NO: 19130 - protein, 81 aa, Myotis davidii
MNFEDVAIAFSQEEWGLLDEAQRHLYCDVMLEVFALVSFVDCWHKMDDEEACSEHSESVQGESQVRASETEPGTQRTHVCK

SEQ ID NO: 19131 - protein, 81 aa, Myotis davidii
LVTKESMTFRDVAVDITQEDWELMRPVQKELYKTVTLQNYWNMVSLGLTVYRPTVIPILEEPWMVMKEILEGPTPGWETEA

SEQ ID NO: 19132 - protein, 81 aa, Myotis davidii
MNFEAVAIGFSQDEWGILDEAQRHLYCDVMLEVFALVSSVGCRHKTDEEACCEQSVSEQEESHGRVPKTEPATQSTHLCKW

SEQ ID NO: 19133 - protein, 81 aa, Myotis davidii
PPDAVTFPDVAVDFSRAEWECLNLAQRTLYRKVMLENYRTLVSVGLCVSKPDVISLLEQGEEPWVTDGERAGGLCPRENWK

SEQ ID NO: 19134 - protein, 81 aa, Myotis davidii
AASQGPLTFRDVAIDFSEEERECLDPAQQKLYMDVILENYSNLVSVAMSPEDAQAFLPKPRIQDLFSEIILSTYNGNTSYQ

SEQ ID NO: 19135 - protein, 81 aa, Cercocebus atys
EMGPLTFRDVAIEFSLEEWQCLDSAQQDLYRKVMLENYRNLVLAGIDVSKPNLITCLEQGKDPWNMKRHSMVVKPPVICSH

SEQ ID NO: 19136 - protein, 81 aa, Cercocebus atys
LTFRDVAIEFSQEEWKCLDPAQRTLYRDVMLENYRNLVSLAISSKCMMKKFSSTGQGNTEVIHTGTLQRQASHHIGESCFQ

SEQ ID NO: 19137 - protein, 81 aa, Cercocebus atys
GRVTFEDVTVNFTKGEWQRLNLEQRNLYRDVMLENYSNLVFVGREETTKPDVILSLEQGKEPWLVEEEVPGSGRPEKNGDV

SEQ ID NO: 19138 - protein, 81 aa, Leptonychotes weddellii
LQESLTFRDVFVDFTLEEWQQLDSAQKNLYRDVTLENYSHLVSVGYLVASPDEVLRSGRGEEARRAEGGPSAWNYPVSPSG

SEQ ID NO: 19139 - protein, 81 aa, Leptonychotes weddellii
MDFTEEEWGQLDPVQRALYKEVMLEIYGNLVLVGKKLYDCAACGKSFSRSTDPRYHQRIHTGEKPFICDTCDKAFSYNTNL

SEQ ID NO: 19140 - protein, 81 aa, Leptonychotes weddellii
MVQNYENLVSLAGLSIPKPYVISLLEDGKEPWMVEKKLSKGMFPDWESRWGNKKLLTKEDIYDEDSPQTVIIEKIIKQSHE

SEQ ID NO: 19141 - protein, 81 aa, Leptonychotes weddellii
MHKDVMLENYSNLASVGLCVAKPEMIFKLERGEELWILEEESSGHGYPGSLSMLCGNNSVGGNAVRHDNDLRHQRIQTLDQ

SEQ ID NO: 19142 - protein, 81 aa, Leptonychotes weddellii
KEAFVAFRDVAVDFTQEEWRLLSPAQRTLHREVMLETYNHLVSLEIPFSKPKLISQLEQGEEPWIKERQHPLGLCPAGSKL

SEQ ID NO: 19143 - protein, 81 aa, Leptonychotes weddellii
PGELVTFKDVAVDFAQEEWEHLDASQSHLYGEVMLENYENLISLAGHLLSKPEMIFYFEQEDGVWMEEEMPRSSYSGVRDE

SEQ ID NO: 19144 - protein, 81 aa, Leptonychotes weddellii
QGSAAYQFLSVDYTERKWKGPALSQRAVYRSIVPENYCSMASLAGETRMRRSELPAKQEVSKGSASSDGTSGGLCGVVSGE

SEQ ID NO: 19145 - protein, 81 aa, Felis catus
HQELVTFEDVAIYFTGTEWTGLSPGQKALYRSVMLENYGNLTSLGYQVPRPALISLLEAGNLPWGLEAQDNLSAERTKDIC

SEQ ID NO: 19146 - protein, 81 aa, Leptonychotes weddellii
DPVTFEDVAVEFTQEAWILLDQTQRRLCRDVMLENYKSLAAIDWEICLNTKWSAPQQNILQGKTPSVVEMERSHTGEELFN

SEQ ID NO: 19147 - protein, 81 aa, Felis catus
SQGSVTFRDVAIDFSQEEWEWLQPTQRDLYRHVMLENYSHLVSLGYQDAKPDIIFKLEQGEELWMLQAQMPSQGHPEKVLE

SEQ ID NO: 19148 - protein, 81 aa, Neomonachus schauinslandi
SPGAVSFADVAVYFSPEEWGCLRPTQRALYRDVMRETYGLLGALGFSGPKPAFISWVEGEVEAWSSEAQDPEGETPAAVIR

SEQ ID NO: 19149 - protein, 81 aa, Neomonachus schauinslandi
EQESVTFKDVAIDLTQEEWTLMDRSQRKMYIDVMLENITHLVSVGCQFFQSDVISQWEQGGVLWREDRGLAQGWSPGLENS

SEQ ID NO: 19150 - protein, 81 aa, Neomonachus schauinslandi
MDFTLEDWEHLELDQGDLFWDTALDNYQNLFLLNPSKPKLTSHPDGTEELKVLVRESPESAGPDTAEVKNCLLAHDFLEEG

SEQ ID NO: 19151 - protein, 81 aa, Neomonachus schauinslandi
AQVLVTFKDVAVTFTQEEWGQLDLDQRALYQEVMLETCGLLVSLGHPIPKPELTHLLEHGRELWTGKRGLFRSTCSGDSAK

SEQ ID NO: 19152 - protein, 81 aa, Monodelphis domestica
LAEPLKFRDVAVEFTQEEWGQLNSSQKNLFRDVMLENYKNFVYLGLPVSMPAMILLLERGEASWMSEEEAPGGILSDSISH

SEQ ID NO: 19153 - protein, 81 aa, Physeter macrocephalus
VTFDDVAVTFTQEEWRQLDPAQRTLYQEVMLENCRLLVSLVAVAGQTMPSIPTMRRLTIDDFEIGRPLGKGKFGNVYLARL

SEQ ID NO: 19154 - protein, 81 aa, Monodelphis domestica
AQEAVTFKDVAVDFTREEWRLLSPPQKELYKEVMLENAQNLLSVGLPAPPKDVMSYLEQRKTPWMLEQESLRNCCPEREIR

SEQ ID NO: 19155 - protein, 81 aa, Monodelphis domestica
GQEEVTFKDVAVDFTQEEWCLLSPPQKELYKEVMLENARNLLSVGLPVPPEDVISYLEQREASWMQEQEGLKSFCPEGENR

SEQ ID NO: 19156 - protein, 81 aa, Monodelphis domestica
SQGSITFKDVAVDFTQEEWCLLDHSQKELYLEVMLENVQNLLSVGLPVPRENFISCFQQGKTPCLVEEKDPRSFFPVEDVE

SEQ ID NO: 19157 - protein, 81 aa, Monodelphis domestica
QKSLVTFKDVAVDFTKEEWRNLDPSQKELYRDVMLENYRNLVFLGLTVWKPDVISHLEEGEAPWMPDRELPKSNYSGWKTR

SEQ ID NO: 19158 - protein, 81 aa, Monodelphis domestica
RAPEVVTFQDVAVDFTRGEWRLLSPPQKELYREVMLENARNLLSVGLAVPRDVISYVEPREAPWRLEQEGLRSCSPGEIRP

SEQ ID NO: 19159 - protein, 81 aa, Physeter macrocephalus
ELVTFRDVVISFSQEEWEYLDSAQRDLYWDVMMENYSNLVSLDLESKYDKKTLFTEKYIIEKNDSQWEVIESSKLVGLENS

SEQ ID NO: 19160 - protein, 81 aa, Physeter macrocephalus
MPEKSRNLVLLGLPVSQPGMNSQLEQREGSWMLEREGLRSTCPDWKIVSESPPEQDISEESFQDPSVEMPSGESDHRNSEL

SEQ ID NO: 19161 - protein, 81 aa, Physeter macrocephalus
SQESVTFKDVAVDFTQEEWALLDTSQRKLFRDVMLENISHLVSVGNQLDKSDVISHLEQGEQLSRGGLGFLQGQSPVISGR

SEQ ID NO: 19162 - protein, 81 aa, Monodelphis domestica
TRARQEPVTFQDVAVVFTPEQWASLDPSQKELYRDVMLETFSNLLCLGLAVSKPRVIHQLERGEAPWRPEGRVPGSSHPGE

SEQ ID NO: 19163 - protein, 81 aa, Monodelphis domestica
GYQRPLTFGDVAVDLSLEEWRRLSPAQRGLYREVMLENYEHLVCVGLSGSKPSVISRLEQAAPWVPEGECPGGPPPDSFHQ

SEQ ID NO: 19164 - protein, 81 aa, Papio anubis
MLENYSYLVSVGYCIPKPEVILKLEKGEEPWILEEKFPSQRHLELINTSRNYSRMKFNEFNKGGKCLCDEKHEIIHSEEEP

SEQ ID NO: 19165 - protein, 81 aa, Papio anubis
WSQNSVTFQEVAVDFSQEEWALLDPAQKNLYKDVMLENFRNLASVGYQLCRHSLISKVDQEELKTDDRGILQGDCADWETQ

SEQ ID NO: 19166 - protein, 81 aa, Papio anubis
DGLVTFRDVAIYFSQEEWECLDPAQRDLYVDVMLENYSNLVSLDLESTTYETKKIFSEKDIFEINFSQWEMKEKSKTLGLE

SEQ ID NO: 19167 - protein, 81 aa, Aotus trivirgatus
AQKVLTFRDVAIEFSLEEWKFLDPAQQNLYRDVMLENYRNLFSIGLTVSKPGLITCLEQRKAPWNLKRREAVDGHIFFAEY

SEQ ID NO: 19168 - protein, 81 aa, Aotus trivirgatus
WWGLLSFKDISMEFTWDEWQLLDSTQKYLYREVTLENYHNLISVGYHGAKPDLIFKLEQGEDPWIINAKISRESCPDGWEE

SEQ ID NO: 19169 - protein, 81 aa, Pan troglodytes
FLVFKPELISRLEQGEEPWVLDLQGAEGTEAPRTSKTDSTIRTENEQACEDMDILESESYGTVVRISPQDFPQNPGFGDVS

SEQ ID NO: 19170 - protein, 81 aa, Camelus dromedarius
PESVTFEDVAIYFSENEWTGLAPAQRALYRDVMLENYGAVASLEGVLKSKKKDFILKNIFEEAQDHMVLSSGPQWYDSQEF

SEQ ID NO: 19171 - protein, 81 aa, Camelus dromedarius
FWPPVSFKDVAVTFTWEEWGQLDPAQRTLYRDVTLETCSHLVSLGLLLSKPDVICRLEQGEDPWRVQRGPPRDVTFWPTCT

SEQ ID NO: 19172 - protein, 81 aa, Cercocebus atys
AQVSVTFDDVAVTFTQEEWGQLDLAQRTLYQEVMLENCGLLVSLGCPIPRPELIYHLEHGQEPWTRKEDLSQDTCPGDKAK

SEQ ID NO: 19173 - protein, 81 aa, Cercocebus atys
PRGSTFFGSVTVAFAQEGWRCLVSTPRERYKEGIPEKSRNLVLLGLPVSQPGMNSQLEQREGTWMLEGKDVRSPSPGWKIV

SEQ ID NO: 19174 - protein, 81 aa, Cercocebus atys
TDVAIEFSLEEWQCLDTAQQNLYRNVMLENYRNLVFLGITVSKPDLITCLEKEKEPWNMKRHEMVDEPPVICSHFAEDFWP

SEQ ID NO: 19175 - protein, 81 aa, Cercocebus atys
MEFTWDEWQLLDSTQKYLYRDVILENYHNLLSVGYHGTKPDLIFKLEQGEDPWIINAKISRQSCPDGWDEWYQNNQDELES

SEQ ID NO: 19176 - protein, 81 aa, Cercocebus atys
EMETLTFRDVAIEFSLEEWECLNPAQQNLYRDVMLENYKNLVFLAGIDISKQDPITSLEQEKEPWNMKRHEMVDESPAMCS

SEQ ID NO: 19177 - protein, 81 aa, Leptonychotes weddellii
MLENYGAVASLAFPFPKPALISQLERGEAPWCKAPQGALDGGGPRGISSGCPFLKPAGISHLEQVEEPLNLKLRGEGPSLS

SEQ ID NO: 19178 - protein, 81 aa, Leptonychotes weddellii
RSFENDGVCFSEQEWENLEDWQKELYRNVMKSNYETLVSLILVFSFSAAEGVMIKQEIQYAQEGSADLPGEFSGIAEEQAF

SEQ ID NO: 19179 - protein, 81 aa, Leptonychotes weddellii
TEQAVMFRDVAVDFSQEEWEFLDLKQRNLYRDVMLENYSHLVSLGLSLPKPTLISFLEQDNEPWIVEKESPKSLYPDVKSQ

SEQ ID NO: 19180 - protein, 81 aa, Leptonychotes weddellii
MLETYSSLVSVGPQVTKPDLILKLEVEEPCLAETKISFWSFPEAACQIDEQIERQHQDDQDRYLLMQAGFPDKKTILTKTG

SEQ ID NO: 19181 - protein, 81 aa, Felis catus
MFSDVSIDFSQEEWECLNDDQKDLYRDVMLENYSHLVSMGHSVSKPDVISFLEQGKEPWLVDRDLTRDQWPGKDCTFEVLS

SEQ ID NO: 19182 - protein, 81 aa, Neomonachus schauinslandi
TFKETVTFKDVAVVFTEEELGLLDPAQRKLYRDVMLENFGNLVSVGHQPFKRDVAHLVREEKFWMVKLATQRKGSSGEKVQ

SEQ ID NO: 19183 - protein, 81 aa, Monodelphis domestica
MQGSLTFKDVAVDFTQEEWCLLDHSQKELYLEVMLENVQNLLSVGLPVPREYLTSCFQQGEAPWLLEQEVPRSSCPEAETN

SEQ ID NO: 19184 - protein, 81 aa, Physeter macrocephalus
AHGSLTFSDVAIGFSQQEWECLDLIQKTLYRDVMMENYGNLVSLGHSISKPNVITLLEQGKEPWMVMREKTRSWCTDLDSR

SEQ ID NO: 19185 - protein, 81 aa, Monodelphis domestica
MTFKDVAVDFTRAEWEHLDSAQKDLYRDVMLENYKNLVSLGRLCQKIRGKSKDTTPKQCNYISSKKRLTVNSNECAEALRK

SEQ ID NO: 19186 - protein, 81 aa, Physeter macrocephalus
LQEPVTFRDVAVDFTQEEWGQLGPAQRTLYRDVMLETFGHLLSVGPELPKPEVISQLEQGAELWVAERGIAQGCCPGWEPG

SEQ ID NO: 19187 - protein, 81 aa, Monodelphis domestica
SQESITFKDVAVDFNQEEWCLLDHSQKELYMEVMLENVQSLLSVGLPIPRENVLSCFQQGEAPWLLEQKDPRSFCPETENN

SEQ ID NO: 19188 - protein, 81 aa, Monodelphis domestica
SLTFKDVAVDFTQAEWCLLDHSQKELYLEVMLENVQNLLSVEAETNFEVKEMSTKLRIFVQESDPKRWMNDGSHDFVLREI

SEQ ID NO: 19189 - protein, 81 aa, Monodelphis domestica
QGSITFKDVAVDFTQEEWWLLDHSQKELYREVMLENVQNLLSVEAETNFEVKEMSTKLNLFLEGSGPQSGLNQGSCDFILR

SEQ ID NO: 19190 - protein, 81 aa, Monodelphis domestica
AQEAVMFQDVAVDFTREEWRLLSPPQKELYKEVMLENARNLLFVGLPAPPQEVISYLEQREVQCMLKPEGLQSCCPEGEIR

SEQ ID NO: 19191 - protein, 81 aa, Monodelphis domestica
TQEVVTFKDVAVDFTREEWRLLSPPQKELYKEVMLENAWNLLSVGLPAPPEDVISSLEQREAPWMLEQEGLRSCCPGEGGK

SEQ ID NO: 19192 - protein, 81 aa, Monodelphis domestica
MLENARNLLSVGLQAPPEDVISSLEQRATLWMLEQEDPGSSFPEREIKLEMKANPTDMSPSVLEMGLQRFISDGPDNFAFG

SEQ ID NO: 19193 - protein, 81 aa, Monodelphis domestica
FQGSVTFRDVAVDFTWEEWRRLGPAQKELYREVMLETYRTLVCLGLAASKPDVISQLERRDAPWVATEFEMLPETREPTLK

SEQ ID NO: 19194 - protein, 81 aa, Physeter macrocephalus
CEVSVSFEDVTVNFSREEWEQLDSAQRRLYQDVMLENYSHLLSLGCEIPKPEVIFKLEQGEEPWTLEEETTHQSCSDGKFG

SEQ ID NO: 19195 - protein, 81 aa, Monodelphis domestica
AQEAVTFHDVAVDFTREEWRLLTPPQKELFKEVMLDNAWNLLSAGLAVSRGDVISYFEQREAPWMLEQEDLGIGCPGEIRP

SEQ ID NO: 19196 - protein, 81 aa, Monodelphis domestica
SQKSLTFQDVAVEFTQEEWGLLEPAQKDLFREVMLENYENFVSLGLPVSKPDVTCHLERRETFRPPEEEVPRSTYLDFLRE

SEQ ID NO: 19197 - protein, 81 aa, Monodelphis domestica
PQGPITFKDVAVNFTQEEWRLLDPAQRDHYREVMLENYRNLVSLGLVLVKPKVISRLERWGEPWRPDGGGRSSGASEMKTA

SEQ ID NO: 19198 - protein, 81 aa, Physeter macrocephalus
EQLTFKDIDIEFSQEEWECLEPAQRALYRDVMLETYRNLLSLDISHIHVIKKLQLKVNTGRGEVLQTVMLGRHERNKMKHF

SEQ ID NO: 19199 - protein, 81 aa, Monodelphis domestica
FKELVTFRDVAVDFTREEWRLLSPSQKELYREVMLENVRNLLSVGKEPLPEDVISSLEQREAPWMLEQEDLRSCSPGEIRP

SEQ ID NO: 19200 - protein, 81 aa, Monodelphis domestica
APAFLTFDDVAVYFSEQEWGNLEKWQKEIYKHVMRTNYETLVSLDHAIPKPDLISWIEQGKEPFIKDQMDLEEREIVVICG

SEQ ID NO: 19201 - protein, 81 aa, Papio anubis
MGPLTFRDVTVEFSLEEWQCLDTAQQNLYRDVMLENYRNLVFLGIAVSKPDLITCLEQGKEPWNMNRHEMVAKPPAFYLMG

SEQ ID NO: 19202 - protein, 81 aa, Papio anubis
FQGSVSFKDVTVGFSQEEWQHLDPSQRALYRDVMLENYSNLVSVGYCVHKPEVIFRLEQGEEPWRLEEEFPSQSFPEVWTA

SEQ ID NO: 19203 - protein, 81 aa, Papio anubis
ADVSLAFRDVSIDLSQEEWECLDPAQRDLYKDVMLENYSNLVSLGYTIPKPDVITLLEQQQEPWIVMREGTRSWYTDLEYK

SEQ ID NO: 19204 - protein, 81 aa, Papio anubis
FQGSVSFRDVTVGFTQEKWQHLDPAQRTLYRDVMLENYSYLVSVGYCIPKPEVILKLEKGEEPWILEEKFPSQRHLELINT

SEQ ID NO: 19205 - protein, 81 aa, Aotus trivirgatus
EQGYVTFEDVAVYFSQEEWRLLDEAQRLLYRNVMLENFSLMASLGLASSKTHEITQLESWEEPFVPAWDVMTSAIPRGCWH

SEQ ID NO: 19206 - protein, 81 aa, Aotus trivirgatus
VVFEDVAVDFTLEEWALLDSAQRDLYRDVMLETFRNLASVDDETPCKADRSVSQQDMYGAKISQEQTIPNFTRNNSCAYAL

SEQ ID NO: 19207 - protein, 81 aa, Aotus trivirgatus
MEFTWDEWQLLDSTQKYLYREVTLENYHNLISVGYHGAKPDLIFKLEQGEDPWIINAKISRESCPDGWEEWYQKNQDELES

SEQ ID NO: 19208 - protein, 81 aa, Papio anubis
QDSVTFDDVAVDFTPEEWALLDTAEKYLYRDVMLENYMNLASVDKSNITLLEWEIQPRIKGSSLQQGFLKNPIFSGIQMQT

SEQ ID NO: 19209 - protein, 81 aa, Aotus trivirgatus
MASVALEDVAVNFTREEWALLGPCQKNLYKDVMQETIRNLDCVGMKWKDQNIEDCYMLERFGESKGGGSQCGETSSQIQDS

SEQ ID NO: 19210 - protein, 81 aa, Aotus trivirgatus
RSQNSVTFQEVAVDFSQEEWALLDLAQKNLYKDVMLENFRNLTSVGYQLCRHNLISKVDQEELKTDERGILQSDCAEWETQ

SEQ ID NO: 19211 - protein, 81 aa, Papio anubis
PQASVCFEDVAMAFTQEEWEQLDLAQRTLYREVTLETWEHIVSLGLFLSKSDVISQLEQEEDLCRAEQVAPRGVRSSKEQR

SEQ ID NO: 19212 - protein, 81 aa, Aotus trivirgatus
LTFRDVAIEFSQEEWRCLDPAQRTLYRDVMLENYRNLVSLDLSHNAVIKELAPKQKSNMGEVFHTVALEQHQTPDMQEFCF

SEQ ID NO: 19213 - protein, 81 aa, Aotus trivirgatus
DSVAFEDVAINFTCEEWALLGPSQKSLYRDVMQETIRNLDCIGMKWQNLDVEEDKYKNPGRNLRCYMVERSCEIKDNSQCG

SEQ ID NO: 19214 - protein, 81 aa, Aotus trivirgatus
MHGPLTFRDVTVEFSLEEWQFLDAAQQNLYKDVMLENYRNLVFLNIVVSKPDMICLEQGIEPWNIKRHEMVAKAPVMCSHF

SEQ ID NO: 19215 - protein, 81 aa, Leptonychotes weddellii
QMPVTFEDVALYLSREEWGRLDHAQQSFYRDVLQKRNGLSLGATELGKEEPAPSLASLAALGDVKSFRSRVGRAQGDILQC

SEQ ID NO: 19216 - protein, 81 aa, Leptonychotes weddellii
VVFADVAVYFTPEEWALLDRGQRRLYREVMLETCRNLASLVCLSQDKRSASRTQQNILQNELPSEEKIVIFARNDSCSVFG

SEQ ID NO: 19217 - protein, 81 aa, Felis catus
RFTLLTFRDVAIEFSQEEWGCLNHSQRELYRDVMLETYGHLLFLDYLSPLPLPLHCLHDLSFTVSSQCTQNFLPKPCLEPS

SEQ ID NO: 19218 - protein, 81 aa, Felis catus
THGSMPFSSVTVAFTQDGWRHLIPAPKDRFKEGIPENTRNLVLLGLPVSQPGMNSQLEQREEGPWMLEGGGLRSTCTDWKI

SEQ ID NO: 19219 - protein, 81 aa, Neomonachus schauinslandi
AQGHVTFEDVAVYFSWEEWGLLDEAQRLLYRDVMLENFSLMASLGLASSMTHEITQLEWWREPFLPPCGVMTAAMPRDGRQ

SEQ ID NO: 19220 - protein, 81 aa, Neomonachus schauinslandi
LQDTFSFEDLSVDFTQKEWQLLDPSQKDLYKDVMLENYSSLVSLGYEVMKPDVIFKLEQGEEPWIRDGEVPSSDHPEQVLQ

SEQ ID NO: 19221 - protein, 81 aa, Neomonachus schauinslandi
WLQVPVTFRDVAVAFTQEEWMMLDSGQRRIYRDVMLENYMTLTSMEYQLWKPTVISPLGQEEIRTMKRRLLAGTYPDWEIQ

SEQ ID NO: 19222 - protein, 81 aa, Monodelphis domestica
PQGSVTFRDVAVNFSQDEWGRLDPSQKELYREVMLENYHNLVCLGLAASKPDVIDQLERGEAPWMPGIGCPDQKIRSDTQE

SEQ ID NO: 19223 - protein, 81 aa, Physeter macrocephalus
SQEWLNFKDVVIEFSQEEWECLDPAQRALYRDVMLETYRNLISVGISFSDLNIISIFGARGRAQDSDICLIHVVKQLQPKG

SEQ ID NO: 19224 - protein, 81 aa, Monodelphis domestica
ERVVVTFKDVAVDFTQEEWRLLTPPQKELYREVMLENVRNLLSVGLAVPRVDVISYLERREAPWMLEEEGLRSSCTEDEIR

SEQ ID NO: 19225 - protein, 81 aa, Monodelphis domestica
GQEEVTFKDVSVDFTWEEWRLLSPPQKELYKEVMVENARNLLSVGLPAPPQDMISYLEQMEAPWMLEKEGLRHYCPEGVIR

SEQ ID NO: 19226 - protein, 81 aa, Physeter macrocephalus
GSVSFTDVTVDFTQEEWEQLDPSQRILYMDVMLENYSNLLSVEVWKADDQMERDHRNPDEQARPFIVFKNQTPVEERDNLF

SEQ ID NO: 19227 - protein, 81 aa, Papio anubis
QGRVTFRDVAIEFSLAEWKCLNPAQRALYREVMLENYRNLESVDISSKCMMKEILSTGQGNTEVFHTGTLQRHESHHIGDF

SEQ ID NO: 19228 - protein, 81 aa, Papio anubis
GLTFRDVAIEFSQEEWKCLNSTQRTLYRDVMLENYRNLVSLDLSRNCMIKELAPQRESDREEVFHTVTLEQHEKHDIEEFC

SEQ ID NO: 19229 - protein, 81 aa, Aotus trivirgatus
SCEPVTFEDVTLGFNPEEWGLLDLKQKSLYREVMLENYRNLVSVEHQLSKPDVVSQLEEAEDFWPVEKGIPQDTIPEYSEL

SEQ ID NO: 19230 - protein, 81 aa, Papio anubis
PAQGMTFEDVAIYFSQEEWELLDESQRFLYCDVMLENFAHVTSLGYCHGMENEVIASEQSVSTQVRTSKGDTPTQKSLSEI

SEQ ID NO: 19231 - protein, 81 aa, Aotus trivirgatus
MAPVQRNLYRDVMLENYSHLVSVGYCLFKPEVIFKLEQGAEPWFSEEEFSNKSHPKDYRGDDLIKQNKNIKDKPLQQVICI

SEQ ID NO: 19232 - protein, 81 aa, Papio anubis
VTFSDVAIDFSHEEWAWLDSAQRDLYKDVMVQNYENLVSVAGLSVTKPYVIMLLEDGKEPWMVEKKLSKDWESRWENKELS

SEQ ID NO: 19233 - protein, 81 aa, Aotus trivirgatus
PLGLVTFEDVAVAFTQEEWQYLNPLQRTLYRDVMLETYSNLVFVGQQVTKPDLILKLEVEECPVEGKLPFWSFPEVCQVNE

SEQ ID NO: 19234 - protein, 81 aa, Aotus trivirgatus
MKLLTFRDVTIEFSPEEWKCLDPAQQNLYRDVMLENYRNLVSLGVAISNPDLVTSLEQRKEPYNVKMHKTVARPPALCSSF

SEQ ID NO: 19235 - protein, 81 aa, Aotus trivirgatus
GEGSLSLEDVAVDFTREEWQFLDLSQKVLYKEVMLENYRTLVSVGYQGTKPVEGAAHSQTCPGFVIQSRRYAGKYCDAFGG

SEQ ID NO: 19236 - protein, 81 aa, Aotus trivirgatus
MLENYRNLVFLGIVVSKPDLITCLEQGKKPLTMKKHGMIAKPPVMCSHLAQDLWPEQSIKDSFQKVRLRRYEKYEHDNLQF

SEQ ID NO: 19237 - protein, 81 aa, Papio anubis
EMGLLRFRDVAIEFSLAEWQCLDRAQQNLYRDVMLENYKNLVSLGIAVSKPDLITHLEQNKEPRNIKKNEMLAKHPVMCSH

SEQ ID NO: 19238 - protein, 81 aa, Sarcophilus harrisii
PQASVTFEDVAVYFTQKEWESLAPNQRALYRDVMLENYGNLISLAFLFPKPAIISQLEKGEEPWVLDPQRPLDKKGTCYKG

SEQ ID NO: 19239 - protein, 81 aa, Sarcophilus harrisii
LVTFKDIVVDFTEEEWGLLDLSQKELYKEVTLENVQNLLCLGTETGLEVNKMTTKLSILVEECGLQRFMIDDPSDFNWREI

SEQ ID NO: 19240 - protein, 81 aa, Pan paniscus
MTVSKPDLIACLEQNKEPQNIKRNEMAAKHPVTCSHFNQDLQPEQGIKDSLQKVIPRTYGKCGHENLQLKKCCKRVDECEV

SEQ ID NO: 19241 - protein, 81 aa, Felis catus
QVSVTFDDVAVTFTQEEWGQLDPAQRTLYQEVMLENCGLLVSLGPGSSAGTREAVRVVLLGGWQCCPQEPFGIVCGHSGLS

SEQ ID NO: 19242 - protein, 81 aa, Leptonychotes weddellii
SQGPVKDVHMARGFSYKKSVHQIPAHRDLYRDIRKESVGNMVSLGSTVSVSNKIARLEQRKEPWTLGLHSSNKRNIILRSH

SEQ ID NO: 19243 - protein, 81 aa, Leptonychotes weddellii
LQGGVTFEDIAVYFSWKEWRLLDEAQRRLYHHVMLENFTLISSLGCCCGAEDEEAPFAQSTSVGVSQTRTPKAAQSSRKTH

SEQ ID NO: 19244 - protein, 81 aa, Neomonachus schauinslandi
FQEAVTFGDVAVHFSREEWQCLDPGQRALYKEVMLENHSSVAGLGFLVFKPELISRLEQGQEPWVIDLKGVEGREGARTCL

SEQ ID NO: 19245 - protein, 81 aa, Neomonachus schauinslandi
MLENYGNVISVGFAVPKPPLISHLEQGNEPCVQDLQDGGFLSCSFPVSVDRTWPGTEKASSEQEVFESGEVCWVHVKSLLK

SEQ ID NO: 19246 - protein, 81 aa, Neomonachus schauinslandi
VLQGLSFKDVAVNFTEEEWRELDPAQRDLYRDVMLENYRNLVSLGFPFSKPDIISQLEQAGNPWMQEREVGVGTQHGEKPY

SEQ ID NO: 19247 - protein, 81 aa, Neomonachus schauinslandi
SKVPVTFGDLAIYFSQEEWEWLSPIQKDLYEDVMLENYQNLVSLGLCFRRPNVITLLEKGKAPWIVEPVRKRRGVDSGSKS

SEQ ID NO: 19248 - protein, 81 aa, Monodelphis domestica
SQGSITFKDVAVDFTQEEWCLLDHSQKALHLEVMLENVQNLLSLGIPVPRENFISCFQQGTAPYLLERNGPSSCCPEAETN

SEQ ID NO: 19249 - protein, 81 aa, Monodelphis domestica
SQGSIAFKDVAVDFTQEEWCLLDHSQKELYLEVMLENVQNLLSVGLPVTREHLISCFQQGKAPWLLEQKDPRSSSPDFEVK

SEQ ID NO: 19250 - protein, 81 aa, Physeter macrocephalus
MLQNYRSLVSLGVSVSKPDVISLLEQGKEPWMVKKEGTRGACPDWEYAFKNNEFSSKQVIYEESSKVRTMGRSHLSYNLDC

SEQ ID NO: 19251 - protein, 81 aa, Physeter macrocephalus
FQEAVTFKDVAVAFTEEELGLLDSAQRKLYQDVMVENFRNLVSVAARKRDSCIFRTFHLLLESLEQLSEEAVTFKDVAVTF

SEQ ID NO: 19252 - protein, 81 aa, Physeter macrocephalus
PHSLVSFKDVAIDFSQEEWECLDLEQKHLYRDVMLENYSNLVSLGFSISKPDVLSLLEQGKDPWKVVWDVTRGLSPDWESR

SEQ ID NO: 19253 - protein, 81 aa, Monodelphis domestica
SQGSVKFKDIAVDFTKEEWGLLDYSQKELYKEVMLENVQNLLFAGLPVPRENFIFCFLQRKSPCLLEQKSPRSFCPDGITK

SEQ ID NO: 19254 - protein, 81 aa, Monodelphis domestica
AQVVVTFKDVAVDFTQEEWRLLTPPQKVLYREVMLENAQNLLSVGLALPRADVISYLEQKEAPWMLEEEGLKSSCTEEEIR

SEQ ID NO: 19255 - protein, 81 aa, Monodelphis domestica
IQESVTFKDVSVDFTWEEWRHLDPAQRDLYRNVMLENYENLVSVGISVSTVDMISLLEKRDGPWMPEGEVSGAICPDSLNE

SEQ ID NO: 19256 - protein, 81 aa, Monodelphis domestica
AQVLVTFQDVAVDFTQEEWRLLDPGQKELYKEVMLENVQNVLSLGLPVPREDWISHFDQGRAPWMLEGEGPSNSCLGRERR

SEQ ID NO: 19257 - protein, 81 aa, Monodelphis domestica
QEMVTFQDVAVEFTWEEWHLLSPPQKELYKDVMLENARNLLSVEGEFRPEMKENPTEMSLSVEEMELQRFMSDSPSKFPFR

SEQ ID NO: 19258 - protein, 81 aa, Monodelphis domestica
LAQESITFKDVDSQKELCKEVMPENVQNLLSVGLTVPRENFITCFQQGESPPRLEKKGQWMKEICANPKKFSQYSVLNQNM

SEQ ID NO: 19259 - protein, 81 aa, Monodelphis domestica
CQQLMTFKDVTVDFTQEEWDHLGPAQRDLYKDVMLENYQNFLFLGFPISKPEVISQLEIDEARWLMLVKEIPRNFSPDPLC

SEQ ID NO: 19260 - protein, 81 aa, Monodelphis domestica
QVLTFKDVAVEFTREEWRLLSPPQKELYKEVMLENAGNLLSVGEIIPEMKVNPTEVSPPVEEMDLQRFMSVSPNNFASREF

SEQ ID NO: 19261 - protein, 81 aa, Monodelphis domestica
EVVKFQDVAVDFTQEEWHLLSPPQKELYKEVMLENARNLLSVGEIRPEMKVNPTEVSLSLEEMDLQRFMSDGLDNFASVKF

SEQ ID NO: 19262 - protein, 81 aa, Papio anubis
EKETLTFRDVAIEFSLEEWECLNPAQQNLYRNVMLENYKNLVFLGIDISKQGPLTSLEQEKEPWNMKRHEMVDESPAMCSY

SEQ ID NO: 19263 - protein, 81 aa, Papio anubis
RVQSCVTFEDVFVYFSREEWELLEEAQRFLYRDVMLENFALVATLAFIFPVPCSCPVGGGRKPWVPDRADTTAATVKETYR

SEQ ID NO: 19264 - protein, 81 aa, Papio anubis
SVTFEDVAVVFTDEEWSHLVPIQRDLYKEVMLENYNSIVSLETKPEIHDASDEKSEGSLRECLGRQSPLCPKFEVYAPNGR

SEQ ID NO: 19265 - protein, 81 aa, Papio anubis
TVTFDDVALYFSEQEWEILEKWQKQMYKQEMKTNYQTLDSLGKMDKTRRTTSPPTDEQLDMKDTGKLPCFDHEGTLRTKEE

SEQ ID NO: 19266 - protein, 81 aa, Papio anubis
MEPLTFKDVAIEFSLEEWQCLDTAQRDLYRNVLLENYRNLVFLVMSFHFAQDLWPKQNIKDSFQKVTLRRYGRCEYENLQL

SEQ ID NO: 19267 - protein, 81 aa, Aotus trivirgatus
MAFGDVTVDFTPKEWRLLSPAQRALYREVTLENYSHLISLGILHSKPELIRRLEQGDAPWGEERRRQPGPHAGIYAECVLP

SEQ ID NO: 19268 - protein, 81 aa, Papio anubis
MEPLKFRDVAIEFSLEEWQCLDTIQQNLYRNVMLENYRNLVFLGIAVSKPDLITCLEQEKEPWTRKRHRMVAKPVTCSHFA

SEQ ID NO: 19269 - protein, 81 aa, Aotus trivirgatus
GRLTFKDVSIEFSLAEWKCLTPAQRALCREVMLENYRNLESVDSFLKSMLKFSPAGQGSTREGFHTGTLEKYTSHHIGDSC

SEQ ID NO: 19270 - protein, 81 aa, Aotus trivirgatus
VMFRDVAIDFSQEEWECLDAAQRDLYRDVMLENYSNLVSLDLPSRCARKDLSPEKNTYETELPQWEMSDRLEKCDLEESNS

SEQ ID NO: 19271 - protein, 81 aa, Aotus trivirgatus
MGVLTFRDVAIKFSPEEWECLDSAQQCLYRDVMLENYRNLVFLGLAVTKPDLITHLEQEKELWNVKRQETVAKYPEILPKQ

SEQ ID NO: 19272 - protein, 81 aa, Aotus trivirgatus
SGAFVAFRDVAVDFTQEEWRLLSPAQRTLHREVMLETYNHLVSLEIPSSKPKLIAQLERGEEPWREERKCSLDLRPGSKPE

SEQ ID NO: 19273 - protein, 81 aa, Aotus trivirgatus
KSEEAVTFKDVAVVFSDEELRLLDLTQRKLYRDVMLENFRNVVSVGHQSIPGGLPQSEREEKLWMMKTATQRDNSSGGKHL

SEQ ID NO: 19274 - protein, 81 aa, Sarcophilus harrisii
FQESLTFKDVAVDFTYEEWQQLNPDQRYLYRDVMLENYKNLVFLGHQISKPDVISQLEQGKEPWPIEREIFTYSCRDWETK

SEQ ID NO: 19275 - protein, 81 aa, Camelus dromedarius
MTEQFSTLKDTAMDFTLDDWEQLGLDQGDLFWDTALDNYQSLFLLDPLRPNLVSHPEAGEALESLVKGSPESTAPDMAEAK

SEQ ID NO: 19276 - protein, 81 aa, Myotis davidii
SQELVTFEDVAVYFIRKEWKRLEPAQRDLYRDVMLENYGNVFSLDGETRTEHDQDISEDTESDGVLLGRFQKDISQGLKFE

SEQ ID NO: 19277 - protein, 81 aa, Myotis davidii
LQEPVSFRDVAVDFTQEEWQQLGPEQKTTYRDVMLENYSHLISVGYDSTKPSVIVRLEQGEEPWVAEGGSPCQGCPEKIKK

SEQ ID NO: 19278 - protein, 81 aa, Myotis davidii
MFSDVSIDFSQEEWECLNDDQRDLYRDVMLENYNNLVSMGHSISKPDVISFLEQGKEPWLVDREVTGSQYPDLTRHQRIHT

SEQ ID NO: 19279 - protein, 81 aa, Cercocebus atys
QDSVTFDDVAVEFTPEEWALLDTAEKYLYRDVMLENYMNLASVGKSNITLLEWEIQPRIKGSSLQQGFLKNPIFNGIQMQT

SEQ ID NO: 19280 - protein, 81 aa, Cercocebus atys
FQGSVTFTDVAIDFSQEEWRWLQPAQRDLYRCVMLENYGHLVSLGLSISKPDVVSLLEQGKEPWLGKRNVNRDLFSVSESR

SEQ ID NO: 19281 - protein, 81 aa, Leptonychotes weddellii
MLLDDSQRLLYQDVMLENFALLASLGIVSSRSHAVTQLEQKEDPQMPDQVAMTPVTEREARRGPGLGGWCAVEDEAPSPEQ

SEQ ID NO: 19282 - protein, 81 aa, Leptonychotes weddellii
GSVSFTDVTVDFTQEEWEQLDPSQRILYMDVMLENYSNLLSVEVWKADDQTEKDHSNPDEQARPFIIFKNQTPIEERGNLF

SEQ ID NO: 19283 - protein, 81 aa, Leptonychotes weddellii
IQGQVNFEDVAVYFSQEEWGLLDEAQRLLYRDVMLENLALMASLGYESSMSHGVASLELGSKPWGSDWADVTPGGTREAQG

SEQ ID NO: 19284 - protein, 81 aa, Leptonychotes weddellii
CEVSVSFEDVTVDFSREEWQHLDPAQRRLYRDVTLENYSHLRSVGYEVPKPEVIFKLEQGEEPWILERKTPHQSCSDGRFG

SEQ ID NO: 19285 - protein, 81 aa, Leptonychotes weddellii
PDWGTFEDVAVYFSREEWELLDETQRHLYHNVMLENLALVASLGCWCGVEEAPLEQSVSVEGALHFRTPKACPSTQKANTC

SEQ ID NO: 19286 - protein, 81 aa, Leptonychotes weddellii
SRGSLSFGDVAISFSQGEWECLDPAQRALYRDVMLETYSNLVSLGSSISKPDVITLLEQEKEPWVVVRRETSRCFPGLTKI

SEQ ID NO: 19287 - protein, 81 aa, Felis catus
FQRSVTFGDVAIHFSQQEWEYLDSVQKNLYRDVMMENYDNLVSLAEHSISKPDVITLLEQRKEPWMVVREDTKRWCTDLES

SEQ ID NO: 19288 - protein, 81 aa, Monodelphis domestica
LALERVTFQDVAVDFTEEEWRLLGHSQKELYKEVMLENVQNLLSVGLPVAREDMIYFQEGETPWILEQKGPRNSHPVAVTS

SEQ ID NO: 19289 - protein, 81 aa, Monodelphis domestica
QAQEAVTFQDVAVDFTRGEWRLLSPPQKELYKEVMLENARNLLSVGLAVPRDVISYVEQREAPWRLEQEGLRSCSPGEIRP

SEQ ID NO: 19290 - protein, 81 aa, Monodelphis domestica
AGLAVNKPGIIFHLERGGPSWILKRSVLGGTFPEHLSPGTRCATTETTAEFPISVGETFQNPGDAKFAEVWEYNSNLEQQT

SEQ ID NO: 19291 - protein, 81 aa, Monodelphis domestica
SQGSITFKDVAVDFTQEEWCLLGHSQKELYLEVMLENVQNLLSVGLPVPRKYCTSCFQQGNAPWLLEQKGPRTSCPEAEAN

SEQ ID NO: 19292 - protein, 81 aa, Monodelphis domestica
SQGLMNFKDVAVDFTEEEWCLLDHSQKELHLEVMLENMQNLLSVGLLVPREDIVSCFQQGEAPWLLEQRGPRSSCPEAETN

SEQ ID NO: 19293 - protein, 81 aa, Monodelphis domestica
SITFKDVAVDFTQEEWWLLDHSQKELYREVMLENVQNLLSVVYKEEISPPRGSHPPVRPQSDPSRDPGVRGNCFWDLEAPI

SEQ ID NO: 19294 - protein, 81 aa, Monodelphis domestica
SQGPITFKDVAVDFTHEEWCLLDHFQKQLYLEVMLENVQTLLSVGLPVPRENFISYFQQGESPWLLEQKGPRNSCPEAEAN

SEQ ID NO: 19295 - protein, 81 aa, Monodelphis domestica
AQEMVTFQDVAVDFTREEWCLLSPPQKELYKEVMLENAWNLLSVGLPAPPEYVISYLEKREAPWMLEREGPRSCCPEGEIR

SEQ ID NO: 19296 - protein, 81 aa, Monodelphis domestica
MMWLGTSGRSGLSGPCPENPLQGCHPAGLEEWALNGISRPSVISQLEQKEEPWVLDLQSLEEGEILREAHTDFENQVEKLN

SEQ ID NO: 19297 - protein, 81 aa, Physeter macrocephalus
PKVPVTFDDISIYFSTPEWEKLEEWQKELYKNIMKGNYESLISMDYAMNQPDVLSQIQPEGDHNTEDRAGPEESEIPTDPS

SEQ ID NO: 19298 - protein, 81 aa, Monodelphis domestica
LFGSITVKDVTVDITQEEWVLLDHSQQQLYLEVMLENVQNLLSVGLLVPRENFISCFQQGEAPCLLEQDCPRSFCPEAKTH

SEQ ID NO: 19299 - protein, 81 aa, Monodelphis domestica
QSQILTFQDVTVDFTWEEWRLLDSFQKDLFRDVMLENYENFAFLAGHPVFKPKVISQLERIETPWKPEEEATFFFEDSFIQ

SEQ ID NO: 19300 - protein, 81 aa, Physeter macrocephalus
SQSLVTFGDVAVEFSPEEWEWLDSAQRSLYRSVMLENYRSLVSLGLCVSKPKMISSLEQRKEPWAAKRTLTRGGCSDSRAL

SEQ ID NO: 19301 - protein, 81 aa, Monodelphis domestica
FQKSLTFQDVAVDFTQEEWGLLEPAQKDMYRDVMLENYENFISLGLMEPKASTISLLERGEAPPGLSEGRAPRSIFVDFLH

SEQ ID NO: 19302 - protein, 81 aa, Physeter macrocephalus
WKGLLSFEDVALYFTREEWDTLDWARKDLYRDVMLDNYRNVLSLGVQFPKPEVICQLEQWEEPWIPDLPRAGATRASGGAS

SEQ ID NO: 19303 - protein, 81 aa, Papio anubis
MGLLTFRDVAIEFSLEEWQRLDTAQQNLYRNVMLENYRNLAFLGIAVSKPDLITCLEQGKEPWNMERHEMVAKPPGMCCYF

SEQ ID NO: 19304 - protein, 81 aa, Aotus trivirgatus
MATSQESVIHVFVDFTLEEWQQLDSNYSHLVSVGYLVAKSDVIFRLGPEEESWMAHGGILVQTCAEVWQADEQIDCCKKGQ

SEQ ID NO: 19305 - protein, 81 aa, Papio anubis
SVAFEDVAVNFTQEEWILLDSSQKILCREVMQETCRNLASYRDCVKAKKVVNMMDKLTFLLDENNVNAVFVEKSLYVIPSL

SEQ ID NO: 19306 - protein, 81 aa, Aotus trivirgatus
VAFEDVDVNFTQDEWALLDPSQKNLYRDVMQETFRNLASVGKKWKDQKIEDEYKNPRSNLRGLMGERLLESKKDHQLEEIL

SEQ ID NO: 19307 - protein, 81 aa, Papio anubis
GTVTFEDVAVKFTQEEWNLLSEAQRCLYRDVTLENLALISSLGCWCGVEDEAPSKQSIYIQRETQVRIPMAGVSPKKAHPC

SEQ ID NO: 19308 - protein, 81 aa, Aotus trivirgatus
AQGPVSFRDVTVGFTQEEWQHLDPAQRTLYRDVMIENYSHLVSVGYCIPKPEVILKLEKGEEPWISEEKFPSQSHLELINA

SEQ ID NO: 19309 - protein, 81 aa, Aotus trivirgatus
MTTVSSTARPQEWAIMVPDQRALYRDVMLENYEAVAFVAVPPTSKPALVSHLEQGKEPCFTQPQGVLSRRDWRAAFIGRSE

SEQ ID NO: 19310 - protein, 81 aa, Leptonychotes weddellii
QELVTFKDVAVDFTQEEWQQREPAQRDLYRDVMLETLQNLSSLGSRACRSVPGLALEELGGSRLWRSGAGEAQGPPGGAPA

SEQ ID NO: 19311 - protein, 81 aa, Leptonychotes weddellii
MAQESVVFSDVSIDFSQEEWECLNDDQRDLYRDVMLENYSHLVSMDVISVLEQGKEPWLVDRELTREQWPVLESRCETKKL

SEQ ID NO: 19312 - protein, 81 aa, Leptonychotes weddellii
SQPPVSFKDVAVTFTQEEWGQLDLAQRRLYRNVTLETCSHLVSLGLLLSKPDVISWLEQGQDPWRAGQGPPRDWKNTFEKK

SEQ ID NO: 19313 - protein, 81 aa, Leptonychotes weddellii
AEGHVTFEDVAVYFSWEEWGLLDEAQRLLYRDVMLENFSLMASLGLASSRTHEITQLEWWREPFLPPCGVMTAAMPRGWWR

SEQ ID NO: 19314 - protein, 81 aa, Felis catus
RCLTDYSQDLVIHEDVAVEFTQEEWTLLDPTQRNLYRDVMLGNHKNLVAVDWEICLNTKWSAPQQNILQGKTPNVEMNSRQ

SEQ ID NO: 19315 - protein, 81 aa, Leptonychotes weddellii
GLLSFKDISMEFTWEEWQLLDSTQKYLYRDVILENYSHLVSVEGWKEWYQKNQDEFENIEGSYTFGAFGKRHLSRTHVPSR

SEQ ID NO: 19316 - protein, 81 aa, Leptonychotes weddellii
QDAVVFADVAVYFTPEEWALLDRGQRRLYREVMLETCRNLASLDCCIQVKPCGSGTQLNILENELSSEDKIVRLIRNDSWA

SEQ ID NO: 19317 - protein, 81 aa, Leptonychotes weddellii
NSQGLLTFRDVAIEFSQEEWGCLNLVQRELYRDVMLENYGNLLFLGLVVSKPDLVIFLEQKRELWDVKGKETVAIHPGRWE

SEQ ID NO: 19318 - protein, 81 aa, Felis catus
QAQESLTFEDVAVGFSREEWRLLVPAQKDLYRDVMLENFRNLVSVGYLASKPDALSKLEGGELWTTEDEIDSRICPEIRKV

SEQ ID NO: 19319 - protein, 81 aa, Felis catus
SVAFQDLAVRFSEDEWQLLGEGQRALYQDVMRENYETLLSLGTAELLPLSAFLSPTEPAGTMEGRSYAVEGQEPPQGGGPL

SEQ ID NO: 19320 - protein, 81 aa, Neomonachus schauinslandi
GRPAEMAVSEPGGSAAKEWEQLDPAQRNLYKDVMLENYSNLASMGYQAPKPDMISKLEKGEEPWLGKGKRPRQGGPSEIAR

SEQ ID NO: 19321 - protein, 81 aa, Monodelphis domestica
MLETFENLVSLGLPMSKPQVICQLERGEAPCLPETEAPDPLYSRTKYEINDWIPKPGLFMGASFKESTMTKNGSWHSKMVE

SEQ ID NO: 19322 - protein, 81 aa, Monodelphis domestica
AQVLVTFQDVAVDFTQEEWRLLDPGQKELYKEVMLDNAQNMLFLGLPVPREDWFSHFHEGGASWMLEGEDPSNSGLDGERR

SEQ ID NO: 19323 - protein, 81 aa, Monodelphis domestica
SQGPVRFEDVAIYLSKKEWELMDSTQKRLYRQVMLETYENVLSVGTPHDKPAMIVHLEQEETAWSPALQRPRKKKKKKKKK

SEQ ID NO: 19324 - protein, 81 aa, Monodelphis domestica
AQVLVTFQDVAVDFTQEEWRLLDPGQKELYKEVMVENAQNVFSLGLPVLREDWISYFDQGETVWILDGEGPSNSCLDGERR

SEQ ID NO: 19325 - protein, 81 aa, Monodelphis domestica
PQGLVTFRDVAVDFTREEWRLLSPRQKELYKEVMLENAGNLLSLGLPVPREDVISYFEQKDVPWMLEQKALRSFCPGGPVK

SEQ ID NO: 19326 - protein, 81 aa, Physeter macrocephalus
SQDPVTFQEVAVDFSQEEWALLAPAQKILYRHVMLENYRNLASVGYHLRKPSLLTQEELRTKKRRILQDACAGKKILYLRS

SEQ ID NO: 19327 - protein, 81 aa, Monodelphis domestica
IQGSLTFRDVTVDFTQEEWCLLDHSQKELYVEVMLENVQNLLSVGLPVPREYYTSYFQQEKAPWLLVQKGPRNSSPEAETN

SEQ ID NO: 19328 - protein, 81 aa, Monodelphis domestica
GLAARFQDVAVEFTWEEWRHLDSAQRALHRNVMLENVCCLFLSEGKIRLEMKEMTAELSLSGDETQRQRCIGDGACDSTWR

SEQ ID NO: 19329 - protein, 81 aa, Monodelphis domestica
MLENVQNLRSVGLPVPRENFISCFQKRESLWLLEQKGPEAETNFEVKEISTKLSLFVEGSGPQRCMNEDPHDVLLRKIHVS

SEQ ID NO: 19330 - protein, 81 aa, Monodelphis domestica
FQDLVTFKNVAVHFTAEEWQLLELSQKELYQQVMLENFRNLVWLGLVVSKPDVIYQLEQGEASWKLGGEGQRSNCSDWETL

SEQ ID NO: 19331 - protein, 81 aa, Monodelphis domestica
MLENYQNLFCLGLAATKPEVIYQLERGEAPWRPEERGTEGSHPDWESRPETYKLTPNLDISAGQVLQDRLTKGGLWISYLR

SEQ ID NO: 19332 - protein, 81 aa, Monodelphis domestica
MYFSQEEWEILGPIQKDLYKDVMQETYGNMISVALFMIPKPELISCLEQEKEPCVTNSKESKEIPKDSNTEMTDSSICPNG

SEQ ID NO: 19333 - protein, 81 aa, Physeter macrocephalus
APLPLTFEDVAVYFSEQEWRNLEAWQKELYKQVMRTNYEILVSLDDGLPKPELISWLEQGRELFKNWGESQKSGNIICFSA

SEQ ID NO: 19334 - protein, 81 aa, Monodelphis domestica
IQGSLTFKDVTVDFTEEEWCHLDHSQKELYLEVMLENVQNLLSVGLPVPREYCTSYFQQEKARWLLEQKCPRSSSPEAETN

SEQ ID NO: 19335 - protein, 81 aa, Physeter macrocephalus
RVVFEDVAVYFSQEEWGLLDEAQRHLYHAVMTENFALVTSLGCWHGAQYEEAPSEQSVSVGMSEVGTPKPDPSTKKAQPYE

SEQ ID NO: 19336 - protein, 81 aa, Monodelphis domestica
PQAPVTFRDVAVDFTAEEWRRLGPAQKELYREVMLENYRSLVCLGLVASRPAVIGQLLRGEAPWMAAPELRAASGPDEDTR

SEQ ID NO: 19337 - protein, 81 aa, Monodelphis domestica
FQESLAFKDVAVEFTCEEWRRLEPAQRDLYRQVMMENYKSFVSLGLPVSKLDVMSLLERGEAPWMPKGEVLRRYSRGSCTQ

SEQ ID NO: 19338 - protein, 81 aa, Papio anubis
LKGLVTFEDVAVEFTQEEWALLDPAQRTLYRDVMLENFRNVASLGDQVDKPGLIAQLEQEDKVMTEERGILPDVENPLKAK

SEQ ID NO: 19339 - protein, 81 aa, Papio anubis
MDSVAFEDVAVNFTHEEWALLGPSQKNLYRDVMRETIRNLNCVGMKWENQNIDDQYQNLRRNPRCDVGERFGKSKDGSQCE

SEQ ID NO: 19340 - protein, 81 aa, Papio anubis
MENLKSGVYPLKEANGCPGAERNLLVYSFYEKGIAVSNPDLITCLEQGKEPWNMKRHVMADEPPVIYSHFAQDLWPEQGIK

SEQ ID NO: 19341 - protein, 81 aa, Papio anubis
EEALMAFRDVAVAFTQKEWKLLSSAQRTLYREVMLENYSHLVSLGIAFSKPKLIEQLEQGNEPWREENEHLLDPCPAQTPS

SEQ ID NO: 19342 - protein, 81 aa, Aotus trivirgatus
IKGSLTFRDVAIEFSLEEWQCLDTAQQDLYRQVMLENYTNLAFLGIAVSKADLITCLQQEKDPWNMKRHSIVAKPPVLCSH

SEQ ID NO: 19343 - protein, 81 aa, Papio anubis
AQESVTFEDVAVNFTNREWQSLTYAQRHLYKHVMLENYGNMVSLGFPFPKPPLISHLERGVEPCVQDPQDRESLSYSYPVS

SEQ ID NO: 19344 - protein, 81 aa, Papio anubis
AQESLTLRDVAVEFTWEEWQLLGPAQKHLYQDVMLENYSNLVSVGFQASKPDALTKLEQGEPLWALEDEIHSPTHPEIEKA

SEQ ID NO: 19345 - protein, 81 aa, Papio anubis
VTFKDVAVTFTQEEWRQLDLTQRTLYREVMLETCGLLVSLGDRTQVHTREPTTYPPVLSEQAFVRGSLTVESSTSSDSRLG

SEQ ID NO: 19346 - protein, 81 aa, Aotus trivirgatus
SQGLVTFGDVAIDFSQEEWEWLSPIQRNLYRKVMLENYRNLASLGLCVSKPDVISLLEQGKEPWTVKRKMTRAGCPDLKAV

SEQ ID NO: 19347 - protein, 81 aa, Sarcophilus harrisii
HPESVTFKDIVVEFTRTEWQYLTSSQKELYRDVMLENYGNLVYLGLAVSKPDVISQLEQREAPWMPGGAQKSNCPDWEATP

SEQ ID NO: 19348 - protein, 81 aa, Camelus dromedarius
AQESVTFEDVAVNFSNGEWQCLTHAQRHLYKDVMLENYGNVVSLGFPFPKPPLISRLEQGAEPWVLDPQDGEFLSCPSPDS

SEQ ID NO: 19349 - protein, 81 aa, Camelus dromedarius
LQASVSFKDVTVELTQEEWQQMGPVQKTLYRDVMLENYNNLVSVVNCIFKPEVIFKLEKGEEPWFSEEEVSNQSHRDYRDN

SEQ ID NO: 19350 - protein, 81 aa, Camelus dromedarius
EQLTFEDVAITFLQEEWECLVPAQRALYRDVMLETCRNLLSVDMSRIHVMKKLQLKANIDRELSQTVITERHVRTERKQFD

SEQ ID NO: 19351 - protein, 81 aa, Myotis davidii
LHGLVAFEDVSLGFDPEEWELLDPEQKSLYRQVVLENYRNLASVEYQLSKPEVVSRLEEEEELWSVERGVPQDTFSGRPEA

SEQ ID NO: 19352 - protein, 81 aa, Myotis davidii
MDTVTFEDVALNFTKEEWALLAPEQRALYQDVMLENIRNLASVGEVFGQKTEDAASGQDILAENTVREADRVCLRSNNPTP

SEQ ID NO: 19353 - protein, 81 aa, Cercocebus atys
MAFTQEEWEQLDLAQRTLYREVTLETWEHIVSLGLFLSKSDVISQLEQEEDLCRAEQVAPRDWKTTLEENRLNSEKDRARE

SEQ ID NO: 19354 - protein, 81 aa, Cercocebus atys
PKVPMTFDDVAVYFSEQEWGKLEDWQKELYKHVMRGNYETLVSLDYAISKPDILTRIERGEEPCLDGWGQEKQNEVEVGHS

SEQ ID NO: 19355 - protein, 81 aa, Cercocebus atys
RVQSCVTFEDVFVYFSREEWELLEEAQRFLYRDVMLENFALVATLAFIFPVPRSCPVGGGRKPWAPDRADTTAATVKETYR

SEQ ID NO: 19356 - protein, 81 aa, Cercocebus atys
CYQDSVTFDDLAVDFTPEEWTLLDPTQRNLYRDVMLENYKNLATVGCQLFKPSLISWLEQEESRTVQRGDFQASERKVQLK

SEQ ID NO: 19357 - protein, 81 aa, Leptonychotes weddellii
SSQGLLTFRDVAIEFSQEEWGCLNHTQRESYRDVMLENYGNLLFLGLIVSKPDLVSFLEQKKDPWDAKRKKTVAFHPDRWE

SEQ ID NO: 19358 - protein, 81 aa, Leptonychotes weddellii
MRRKWKHILNVVPSQEEWGQLDLAQRRLYRNVTLETCSHLVSLGLLLSKPDVISWLEQGQDPWRAGQGPPRDWKNTFEKKE

SEQ ID NO: 19359 - protein, 81 aa, Felis catus
AEGGVTFEDIAIYFSWKEWRLLDEAQRRLYYDVMLENFTLISSLGCCCGAEDAEAPLEQSISVGVSQASVPKAALSSRKTH

SEQ ID NO: 19360 - protein, 81 aa, Leptonychotes weddellii
AHHLVMFRDVAVDFSQEEWECLNSYQRNLYRDVILENYSNLVSVGCSISKPDVITLLEQGKEPWMVVRDERRRRSLDLESR

SEQ ID NO: 19361 - protein, 81 aa, Leptonychotes weddellii
SPGAVSFADVAVYFSPEEWGCLRPAQRALYRDVMRETYGLLGALGFSGPKPAFISWVEGEVEAWSAEAQDPEGETPAAVIR

SEQ ID NO: 19362 - protein, 81 aa, Felis catus
AQESLTLEDVAVDFSREEWRLLAPAQKDLYRDVMLENYRNLVSVGHQASKPDVLARLERGEEPWAIEEEVRSGTSPETGKV

SEQ ID NO: 19363 - protein, 81 aa, Leptonychotes weddellii
PQEPVTFEDVAVYFTQNQWASLDPTQRALYREVMLENYASVASLVFPFPKPDLVSQLEREEAPWGPDPWEAEVLRGICPGG

SEQ ID NO: 19364 - protein, 81 aa, Felis catus
GHGLLTFRDVAIEFSQKELRCLNHSQWELYRDVMLENYGHLLFLGLVVSKPDLVIFLEHKKDVWTVKRKETVATHPGRILL

SEQ ID NO: 19365 - protein, 81 aa, Neomonachus schauinslandi
MFRDVAVDFSQEEWEFLDLKQRNLYRDVMLENYSHLVSLGLSLPKPTLISFLEQDNEPWIVEKESPKSLYPDVKSQCATKE

SEQ ID NO: 19366 - protein, 81 aa, Neomonachus schauinslandi
AQESLTLEDVAVDFTWEEWQLLDPAQKDLYRDVMLENYSNLVSVGCQATKPDALSKLEYRDEPWITEDEIQNRTHLGFGKL

SEQ ID NO: 19367 - protein, 81 aa, Monodelphis domestica
SLATLTFQDVAVAFSQEEWRCLDPVQKSLYREVMLENYRHLVFLGLPVSKPELISQLECGEGPWMLLEEELRSRCPDQNNS

SEQ ID NO: 19368 - protein, 81 aa, Physeter macrocephalus
TQVSVTFDDVAVTFTQEEWRQLDPAQRTLYQEVMLENCRLLVSLGCPVPRLELIYQLEQGQKLWTVKKDLSRSTCPVAVAG

SEQ ID NO: 19369 - protein, 81 aa, Monodelphis domestica
ELEAVTFKDVTVDFTQEEWCLLSPPQKELYKEVMLENAQNLISVEREIRPEMKVNPIEMNLPLEKMDLERFVSDGPDNFDF

SEQ ID NO: 19370 - protein, 81 aa, Monodelphis domestica
MEVVTFKDVAVDFTREEWHLLAPPQKELYKEVMLENAWNLLSVGFPTSPEDVISYLEQREAQWMLEQEGLRSCCPEGKIRP

SEQ ID NO: 19371 - protein, 81 aa, Monodelphis domestica
SQGSITFKDVAVDFTQEEWCLLDHSQKALHLEVMLENVQNLLSVGLPVPRENFISCFQQGKAPYLLQRNGPKSSSPEAENN

SEQ ID NO: 19372 - protein, 81 aa, Monodelphis domestica
SVTFKDVAVDFTQEEWCLLDHSQKELYKEVVLENVQNLLFVEAETNFEVKEMSTKMRLFVEGSNSPRGMKRNPCDFLFREI

SEQ ID NO: 19373 - protein, 81 aa, Physeter macrocephalus
YEELVTFKDVAVDFTQEEWGQLDSPQRALYRDVMLENYQNLLALGPPVCKPDVISHLERGEEPWWAPRAVPGRAGPEPELE

SEQ ID NO: 19374 - protein, 81 aa, Monodelphis domestica
PGQVVTFKDVAVDFTQEEWRLLSPPQKELYNEVMLENAQNLLSVGLPVPPEDMISYSEQREAPWMLEPEGLSTCCPEGEIR

SEQ ID NO: 19375 - protein, 81 aa, Monodelphis domestica
SQGLITFKDVAMNFTQEEWCLLDHSQKELYTEVMLENVQNLHSVGLPVPREDFISCFQQREAPWLLEKKVPRNSCPEAETN

SEQ ID NO: 19376 - protein, 81 aa, Monodelphis domestica
SQGSITLRDVVVDFTQEEWRLLDHSQKELYKEVMLENVQNLQSVGVRVPREKFGTCFQQGQSPSLLEQKDQWGCCPEAETN

SEQ ID NO: 19377 - protein, 81 aa, Physeter macrocephalus
KEAFVAFGDVAVDFTQEEWRLLSPAQRTLHREVMLETYNHLVSLEIPFSKPKLISQLERGEEPWIEERQRPLGLCPASRPT

SEQ ID NO: 19378 - protein, 81 aa, Monodelphis domestica
PQELVTFHDVAVDFTPEQWGLLDHPQKLLYKEVMLENAQNLLSLGLPVPREYLLSCFEQEGLKNSCQDAETRFGVKKISEK

SEQ ID NO: 19379 - protein, 81 aa, Monodelphis domestica
AQELVTFQDVAVDFTQEEWHLLDHSKKELYMEVMLENAQNSLLLGLLVPRESLISCFQPGEAPWMQESEGPRNSCPEVKFK

SEQ ID NO: 19380 - protein, 81 aa, Monodelphis domestica
MQGSLTFKDIAVDFTQEEWCLLDHTQKELYLEVMLENVQNLFSVGLPVPREYCTSCFQQGKVPWQLEPKGPRSSCPEAETN

SEQ ID NO: 19381 - protein, 81 aa, Monodelphis domestica
FQESVTFQDVAVEFTWEEWRYLNPSQKKLYKDVMLENYQSLISLGFEVSKPDVIHQLERKETSWMPEADVSQSSYPGDYIK

SEQ ID NO: 19382 - protein, 81 aa, Monodelphis domestica
AQKLVTFQDVAVDFTQEEWGLLDHSHKELYMEVMLENAQNSLFLGLLVPRHSLISCFQQGESQWIRESKGPRNSCPEIKFN

SEQ ID NO: 19383 - protein, 81 aa, Monodelphis domestica
SQESVTFKDVAVNFTREEWGQLDPSQRDLYRDVMLENYGNLVSIGLPVSKPDVISQLERGNAPWIPEEEFARSTCLDSFSL

SEQ ID NO: 19384 - protein, 81 aa, Monodelphis domestica
FQTPVIFEDVAVYLTRGEWDCLDPAQKSLYRDVMLENYENMISLGFPVSKPDVISQLERGEEPWIVHTQEKVTLKGDCSGE

SEQ ID NO: 19385 - protein, 81 aa, Aotus trivirgatus
WLQEPMTFKDVAVEFTQEEWIMLDSAQRSLYKDVMLENYRNLTSVEYQLCRHTVISPLHQEEIRNMKKRNPQGICPDQKIQ

SEQ ID NO: 19386 - protein, 81 aa, Felis catus
EHESVTFKDIAVDFTQEEWALLDASQRKLYRDVMLENIGHLVSVGESVNTDKFIQQVSSFHLIPPLSALIQILSWFLTLFG

SEQ ID NO: 19387 - protein, 81 aa, Leptonychotes weddellii
TRNIITFEDVCIYFSPEEWELLDEAQKRLYCNVILENFLLVTSLGLAISRYHLIPQPLPVREPVVPANVAIAPAGAAMVLG

SEQ ID NO: 19388 - protein, 81 aa, Neomonachus schauinslandi
MQENYGLLISVGYRVKKPNAVFKLKQGKEPWILEVEFPHRNYPEDLWKIHDLGAKYQESRAENSRNGELTEHQQTQAREKI

SEQ ID NO: 19389 - protein, 81 aa, Neomonachus schauinslandi
MVHLVTFEDVAVNFTQEEWTLLDQTQRDLYRDVMLENYQNLIILAGYESCKPDLNSSMGGAEELRTGGRGILQELDLQLKT

SEQ ID NO: 19390 - protein, 81 aa, Neomonachus schauinslandi
SQGLVTFEDVAVYFSLEEWERLDTDQRDLYKDVMQENYGILVSLGYPIPRPDLIFRLEQGEEPWVPDSPRPDEGDIVTGVY

SEQ ID NO: 19391 - protein, 81 aa, Neomonachus schauinslandi
SLESDVFTDVAIVFSQEEWEQLAPAQRDLYRDVMLETYSNLVSLGLAIAKPDVISFLEEGKEPWVVEKTSRGGLCPVLESR

SEQ ID NO: 19392 - protein, 81 aa, Monodelphis domestica
VQDVVTFKDVAVEFTQEEWCLLSPPQKELYKEVMLENVQNLYSVGLPAPPEDMTSYMEQRESSWMLEQEVLRSCCPGKIRR

SEQ ID NO: 19393 - protein, 81 aa, Monodelphis domestica
APVPMTFDDVTLYFTEQEWRTLEEWQKELYKDVVKNNFETLVSLGYAIPKPDLITQIEQGEEPFIRDQGPLKTLKLAIGSS

SEQ ID NO: 19394 - protein, 81 aa, Monodelphis domestica
SQDLLTFKDIAVDFTQEEWCLLDHSQKELYLEVMLENVQNLLSVGLPVPREYCAFCFQQGKAPWQLEPKGPRSSCPEAETN

SEQ ID NO: 19395 - protein, 81 aa, Monodelphis domestica
MESVTFQDVAVDFTHEEWGRLEPAQKDLYRDVMLENYQNFVSLGGLPAPKPHVISQLERGETPCLAEREAPRVISICQDSF

SEQ ID NO: 19396 - protein, 81 aa, Physeter macrocephalus
PHGLLTFGDVAVHFTQEEGARLDPGQRALYRDVMLETYRNLASLGVPGSKPDLISQLEQGKEPWGSDLLRAQEGETAGDPS

SEQ ID NO: 19397 - protein, 81 aa, Physeter macrocephalus
QAQLTFKDVAIEFSQEEWECLDPAQRALYRDVMLETYRNLLSLDICHIYVMKKLQPKVNSDGGEVFQTVMVETRESREIRD

SEQ ID NO: 19398 - protein, 81 aa, Monodelphis domestica
SREWMTFKDVAVDFTREEWRLLDHSQKELYREVMLENVQNLLSVGLPVPREDLISSFLQGEAPWLLEPKSPRSSCPGAETR

SEQ ID NO: 19399 - protein, 81 aa, Monodelphis domestica
PQASVTFKDVAVDFTWEEWRLLDPPQKELYWEVMLENYRNLVCLGLAVSNLNMISQLESGESHWIPRGSILRTIWPDEFMS

SEQ ID NO: 19400 - protein, 81 aa, Monodelphis domestica
QRPLTFGDVAVDLSLEEWRRLSPAQRGLYREVMLENYENLVSVAAGLPVTKPDVISQLERGETPWTLEAELPRAIYPDSPQ

SEQ ID NO: 19401 - protein, 81 aa, Physeter macrocephalus
RESGKAPVTFDDITVYLLQEEWTLLSQQQKEICGSDELVAPLGPTIANPELFYKFERGPEPWLASVQGQRKLLSLHRGKNR

SEQ ID NO: 19402 - protein, 81 aa, Monodelphis domestica
ARSHELVTFKDVAMDFTPEEWGQLDPAQRDVMLENYRNLVSLWLPVSKPDGSSNFDQGENQWMMERKVPRGTRPDWDTRSE

SEQ ID NO: 19403 - protein, 81 aa, Monodelphis domestica
SSSSLTFKDVAVDFTQEEWCLLDHSQKELYLKVMLENVQNLFSVGLPVPREYFTSCFQQGKATWLLEQKSLRNSCPEAETN

SEQ ID NO: 19404 - protein, 81 aa, Physeter macrocephalus
MFQVTFSDVAIDFSHEEWGWLDPAQRNLYKDVMVQNYENLVSLGLSIPKPYVIALLEDGKEPWMVEKKLSKSLFPDWKSRW

SEQ ID NO: 19405 - protein, 81 aa, Monodelphis domestica
AQVLVTFQDVAVDFTQEEWRLLDPGQKELYKEVMQENAQNMLSLGLPVPREDLISHFDQGRAPWMLEGEGPSNSCLDGEKS

SEQ ID NO: 19406 - protein, 81 aa, Monodelphis domestica
PKEMVTLQDVAVDFTREEWRLLSPPQKELYREVMLENARNLLSVGLPAPLEDVLSYLEQRKGPWMLEQKRLRSCCPGEIRL

SEQ ID NO: 19407 - protein, 81 aa, Papio anubis
EMGLLTFRDIAIEFSLAEWQCLDRAQRNLYRDVMLENYRNLVSLGITVPKLDLITSLEQNKEPQNMKRSEMVAKHPVTCSH

SEQ ID NO: 19408 - protein, 81 aa, Papio anubis
GFMEFVTLKDVGMDFTLEDWEQLGLEQGDMFWDTALDKCQDILLLDPPRPNLTSHPDGGEDLEPLPGGSPEATGSDATETK

SEQ ID NO: 19409 - protein, 81 aa, Aotus trivirgatus
VAGARAVSFADVACYFSPEEWAVCGRRRGLYRDVMRETYGHLARFGPKPALISWMEQRGEGWSRVPLYPNWFSRAFKAPME

SEQ ID NO: 19410 - protein, 81 aa, Aotus trivirgatus
MGPLTFRDVKIEFSLEEWQCLDTAQRNLYRDVMLENYRNLVFLDLITWLEQGKEPWNMKSHEMVAKPPAMCSHFTQNCWLE

SEQ ID NO: 19411 - protein, 81 aa, Papio anubis
PLVMAETDPTQGRVVFEDVAIYFSQEEWGHLDEAQRLLYRDVMLENLALLSSLGKALTLAQCPGLGCVIPFYPKAALRFPQ

SEQ ID NO: 19412 - protein, 81 aa, Papio anubis
RRGHLTFRDVAIEFSQEEWKCLDPAQRTLYREVMLENYRNLVFLGICLPDLSIISMLEQRRDPRNLQSEVKIADNPDGREC

SEQ ID NO: 19413 - protein, 81 aa, Sarcophilus harrisii
AQELVSFRDVAIYFTQEEWSYLHSTQKHLYWDVMLENYENFISLGLPVSKLDMLSLLKREKSSWKPGEDNLQVSCPDSFSE

SEQ ID NO: 19414 - protein, 81 aa, Sarcophilus harrisii
SQELVTFEDVAVYFIRKEWKRLDPAQRDLYRDVMLENYGNVFSLGFPFPNPEIISHLDGEEEPWVLDLNRAESQGLQSASC

SEQ ID NO: 19415 - protein, 81 aa, Felis catus
LQGLVTFEDVAVYFSREEWGLLNLTQRSLYRDVMLENFALIGSLGFASSRCHVVAQLESEEEFWVPSMVDLTLVSRVEARR

SEQ ID NO: 19416 - protein, 81 aa, Neomonachus schauinslandi
FQGSVTFRDVAIDFSQEEWEWLQPAQRDLYRHVMLENYGHLVSLGLNISKPYVVSLLEQGREPWLEKGDVRRDLFSESNGD

SEQ ID NO: 19417 - protein, 81 aa, Neomonachus schauinslandi
PQVPVAAAAPTDPAQVPMNSEVTMDPIQGQVNFEDVAVYFSQEEWGLLDEAQRLLYRDVMLENLALMASLGKIIILSDPFL

SEQ ID NO: 19418 - protein, 81 aa, Monodelphis domestica
MVTFQDVAVDFTREEWCLLSPPQKELYKEVMLENAWNLLSVGLPALPEDVISYLEQREAPWMLEREGPRSCCPGEILLEMK

SEQ ID NO: 19419 - protein, 81 aa, Monodelphis domestica
TCHPVTFRDVSVDFSLEEWRCLSPAQRALHREVMLENYEHLVSVGLTASKPDVISLLERGEAPWMALAGVLRSPYPDCPNC

SEQ ID NO: 19420 - protein, 81 aa, Monodelphis domestica
QESLTFKDVAVEFTWEEWRHLDPAQRALHRNVMLENYENLVSIEGKIRLEMKEMTAELSLSGEETQRQRCIADGACDSTWR

SEQ ID NO: 19421 - protein, 81 aa, Monodelphis domestica
AQVLVTFQDVAVDFTQEEWRLLDSGQKELYKEVMVENAQNVLSLGLPVPREDWISHFDQGRAPWMLEGEGPSNSCLGRERR

SEQ ID NO: 19422 - protein, 81 aa, Monodelphis domestica
AQEVVTFQDVAVDFTREEWRLLSPPQKELYKEVMLENARNLLSVGLPAPPDDVVSYLEQREGPSMLDQEDLRTCGPEGEIR

SEQ ID NO: 19423 - protein, 81 aa, Physeter macrocephalus
SHTLVTFKDILVNFTREEWKLLDPAQQLMYKDVMLENYRNLMSLGHQLPKPEVILQLEKGEEPWLVERGIHQETHSGEDQT

SEQ ID NO: 19424 - protein, 81 aa, Physeter macrocephalus
QGSVTFEDVALYFSWEEWALLDEAQRCLYHDVMLENFALTSSLGCWHEVEDKETCPEQSISVEGVSQIRTLKAISSPQKAQ

SEQ ID NO: 19425 - protein, 81 aa, Physeter macrocephalus
TSETSVSFKDVTVEFTLEEWQCMSSAERTLYRDVMLENYSHLVSLGYYFTKPDVIIKLEQDDPLLLEEEFLNKSHADSKLG

SEQ ID NO: 19426 - protein, 81 aa, Monodelphis domestica
QGPMTFEDMAMYLTREEWRPLDPTQRDLYRDVMQENYGNVVSLDFDIRSENETNPKVISEDIEFGNISGRPLESAHQNPEC

SEQ ID NO: 19427 - protein, 81 aa, Physeter macrocephalus
MGSVSFKDVTVDFSREEWQQLDLAQKSLYRNVMLENYFNLISVGCQVPKPEVIFNLEWEEEPCMLDGEISSQSYLDQGIGF

SEQ ID NO: 19428 - protein, 81 aa, Physeter macrocephalus
QDHVIFEDVAVSFSQEEWGLLNDAQRLLYCDVMLENLSLIASLGCWHGVEAEEAVSEQCVSVELVTEDRNPNLEPSILKPL

SEQ ID NO: 19429 - protein, 81 aa, Monodelphis domestica
MQENVQNLLSVGLPVTREHLISCFQEGKAPWLPEQKGPKSSSPDFEVNVMCTNLSLFVEGSGPQRCMKEVSHDFILREICD

SEQ ID NO: 19430 - protein, 81 aa, Monodelphis domestica
GQEEVTFKDVAVDFTQEEWRLLSPPQKELYKEVMLENAQNLLSVGLPAPPEVVLSYLEQSEAPWMLEEEGLRTYCPGKGRE

SEQ ID NO: 19431 - protein, 81 aa, Monodelphis domestica
IQGSLTFKDVAVDFTQEEWCLLDHSQKELYLEVMLENVQNLLSVGLPVPREYCTSYFQQEKARWLLEQKCPRSSSPEAETN

SEQ ID NO: 19432 - protein, 81 aa, Monodelphis domestica
SQKSTEFRDVAVDFTLEEWDLLDSAQRDLYRDVMLENYRNLVSLGLSIPKPDVVTQLEQSQAPVMLEKEVSRCSSPDKKTP

SEQ ID NO: 19433 - protein, 81 aa, Physeter macrocephalus
QIQGSLTFGDVAVAFTQIEGRYADAAQRALYRDVLLENYGNLVFVGLLSSKPKLITQLDAEEPWMEVAEVPSGTYAVQEYI

SEQ ID NO: 19434 - protein, 81 aa, Physeter macrocephalus
SLGSDLFRDVAVVFSQEEWERLVPAQRDLYRDVMLEIYSNLVSLGFAMSKPDVISFLEQGREPWMVEKVATGGQCPELQGN

SEQ ID NO: 19435 - protein, 81 aa, Physeter macrocephalus
GTQGPVMAAAPTHQTQEEWRQLDPAQRTLYQEVMLENCRLLVSLGCPVPRLELIYQLEQGQKLWTVKKDLSRSTCPGKRYR

SEQ ID NO: 19436 - protein, 81 aa, Monodelphis domestica
QVVTFKDVAVEFTKEEWCLLSPPQKLLYKEVMLENAQNLLSIGEIIPEMKVNPREVNPPVEMDPQRFMSVRPNNFASREFC

SEQ ID NO: 19437 - protein, 81 aa, Physeter macrocephalus
TVTFKDVAVVFTEEELALLDSTQINLYQDVMLENFRNLVSVGDRIKNNISNLQEKGLTYLSPEVLYFWQIWKRRISELSVS

SEQ ID NO: 19438 - protein, 81 aa, Monodelphis domestica
VQEVVTFQDVAVDFTREEWRLLSPSQKELYKEVMLENARNLLTVGLSAPPEKVVSYLEQRDVLWMLEQEGLRIWYPGENRP

SEQ ID NO: 19439 - protein, 81 aa, Monodelphis domestica
SQESIAFKDVAVDFTQEEWCLLDHSQKELYLEVMLENVQNLLSVGLPVPTETFISCFQQRKAPCLVEQKVPRNFFPVEDFE

SEQ ID NO: 19440 - protein, 81 aa, Physeter macrocephalus
VLLQVSFEDVTVDFSREEWQHLDPAQKLLYRDVTLENYSHLRSVGYQVPKPEVIFKLEQGEGPWTLEEETPHQSCSDEDNG

SEQ ID NO: 19441 - protein, 81 aa, Monodelphis domestica
WEQSVTFKDVAVDFTQEEWDYLDPSQKELYREVMQENYKNLVCLGLAVSQPDVIYHLEQGRVPWRAEEGILRWSCPVLITK

SEQ ID NO: 19442 - protein, 81 aa, Monodelphis domestica
PQESVTFEDVAVYFTQKEWEGLAPAQRALYRDVMLENYGNLVSLAFLFPKPAVISQLEQGEKPWIQTPQRPLDKKKTYKGC

SEQ ID NO: 19443 - protein, 81 aa, Monodelphis domestica
VTFKDMAVDFTWEEWCLLTPPQKELYKEVMLENARNLLSVVFLSGEIRPEMRVTPIDTSLYVEESDRQRFMNDGPDKLCWR

SEQ ID NO: 19444 - protein, 81 aa, Monodelphis domestica
SQGSITFKDVAVDFTQEEWCLLDPSQKELYREVMLENVQNLLFVETNFEVKEISTKQSLFVEGSGPPRGKNKGPCDFLLRE

SEQ ID NO: 19445 - protein, 81 aa, Papio anubis
KKKPVTFEDVAVNFTEEEWDCLDASQRVLYQDVMSEIFKNLASVARIFLHKPERITQLEQQEEQWREFVHLPNTEGPSEGK

SEQ ID NO: 19446 - protein, 81 aa, Papio anubis
MEGLVMFQDLFIDFSQEEWECLDADQKDLYRDVMMENYSSLVSLGLCIPKPDVISLLEQGKEPWMVSRDVLGGWCPDRLKK

SEQ ID NO: 19447 - protein, 81 aa, Papio anubis
ARGCVVFEDVFVYFSREEWELLDDAQRLLYHDVMLENFALLASLGIALSRSCAVIKLEQAEEPWVYDQVDMTSATEREAQS

SEQ ID NO: 19448 - protein, 81 aa, Aotus trivirgatus
MAHLMLFRDVAVDFSQEEWEGLDLKQRDLYRDVMLENYSNMVSLGLCIYQPDVFSLLEKGKEPWKILRDETRGPCPDVQSR

SEQ ID NO: 19449 - protein, 81 aa, Monodelphis domestica
SQGSITLKDVTVDFTQEEWVLLDHSQQGLYLEVMLENVQNLHSVGLLVPREKFISCFQQRETPCLLEQECPRSPYPGAKSN

SEQ ID NO: 19450 - protein, 81 aa, Monodelphis domestica
GRFQESVTFEDVAVEFTWEEWRHLDPAQRALHRNVMLENYENLVSIGIPVSKTNLIFWFKSEYVQNQGGEVGTSTCPNSFT

SEQ ID NO: 19451 - protein, 81 aa, Monodelphis domestica
NLEAVTFQDVAVEFTCEEWRHLAPPQKELYRDVMLENYKNLVRLGLAVSKPDVISQLERREAPWMPGGIQRSRCPDWEASC

SEQ ID NO: 19452 - protein, 81 aa, Monodelphis domestica
QGSITFKDVAVDFTQEEWCLLDHAEKELFLEVMLENVQNLLFVEAETNFEVKEISSKLRLFVEESGPQRFINGGPCDFNLR

SEQ ID NO: 19453 - protein, 81 aa, Monodelphis domestica
ASQELVTLKDVAVDFTQEEWRVLNPSQKELYREVMLENVLNMLSVGLPVLRDFISSFQQMEALWMAEHEPPGSSCPVNTSS

SEQ ID NO: 19454 - protein, 81 aa, Physeter macrocephalus
RSQGPVSFEDATMDFTQEEWQPLDPAQRTLDRDVALENYSHLISVGYCVTKPEVVAQQGEEPWMLEEESQSQSHRDFCIVD

SEQ ID NO: 19455 - protein, 81 aa, Monodelphis domestica
SKELITFKDVVVDFTKEEWCLLDCSQKELCKEVMLENVQNLLSVGLTLPREYFITCLQQGESPWLPEKKCQWSFCLEEETN

SEQ ID NO: 19456 - protein, 81 aa, Monodelphis domestica
EPDLITFKDVVVDFTKEEWCLLDCSQKELCKEVMLENVQNLLSVGLTFPKENFITCFQQGESPWLPEKKGQWSFCPEAEDI

SEQ ID NO: 19457 - protein, 81 aa, Monodelphis domestica
SQGSIKFKDVAVDFTQEEWGLLDYSQKELFREVMLENVQNLLSVGLPVPREIFISCFQPGKTPWLLEQKGPRNSCAEAETN

SEQ ID NO: 19458 - protein, 81 aa, Monodelphis domestica
FQGLITFKDVAVDFTQEEWCLLDHSQKELYLEVMLENVQNVLSVGLPVPRENLIYCFQPGKTPWLLEQKGPRISHSEAETN

SEQ ID NO: 19459 - protein, 81 aa, Physeter macrocephalus
PQGSTPFSSVTVAFTQKGWRQLAPTPRDRFKEGMPEKSRNLVLLGLPVSQPGMNSQLEQREGSWMLEREGLRSTCPDWKIV

SEQ ID NO: 19460 - protein, 81 aa, Monodelphis domestica
AQEAVMFQDVAVDFTREEWRLLSPPQKELYKEVMLENARNLLFVGLPAPPQEVISYLEQREVQCMLKPEGLQSRCPEGEIR

SEQ ID NO: 19461 - protein, 81 aa, Physeter macrocephalus
QLTLNDVVIEFSPEEWECLDPAQRALYRDVMLETYRNLISVDISHIHVIRKLQLKSNIDKGGVFQTVILGRHEIQEIKPFY

SEQ ID NO: 19462 - protein, 81 aa, Monodelphis domestica
LREAVTFGDVAVDFDQEEWGYLRPPQKELYREVMLENYRNLVSLGHLHPKPDLISWLEEREEPWSQGLQEGTSRRARVREE

SEQ ID NO: 19463 - protein, 81 aa, Physeter macrocephalus
VQESLLFEDVAVEFTREEWRLLDPAQKNLYQDVMLENYSNLLSVGYQSPKPIQIFKLKQRDKPWLEKENIHGQNFPVGEIG

SEQ ID NO: 19464 - protein, 81 aa, Monodelphis domestica
SQGSITFKDVAVDFTQEEWCLLDHSQKELYLEVMLENVQNLLSVGLPVPRENFISCLQQGKAPWLLAQKDSRNSCLEAKTN

SEQ ID NO: 19465 - protein, 81 aa, Monodelphis domestica
KEELVRFKDVSVDFTQEEWHLLDHSQKELYKDVMLENAQNLLSLGLPVPSEYLISFEQEGLRNSCPDTRSDVKKAAAKLKM

SEQ ID NO: 19466 - protein, 81 aa, Physeter macrocephalus
AQGSVSFKDVTVDFSQEEWQHLDPAQKMLYMDVMLENYCHLVSVGCHMTKPDVILKLERGEEPWTSFTGHTCLEKWKAEDF

SEQ ID NO: 19467 - protein, 81 aa, Monodelphis domestica
HTESVTFKAVAVDFTQEEWGRLDSDKWDLYLTVLLENYRNLVFLGLPVSKPELIFHMDQREEPRILERQVSKGGSNYLSQR

SEQ ID NO: 19468 - protein, 81 aa, Monodelphis domestica
AEEVVTFQDVAVDFTWEEWSLLSPPQKELYREVMLENARNLLSVEREMRPEMKLTTTEVSLSVEEMNLQRFMSDCPDNFAF

SEQ ID NO: 19469 - protein, 81 aa, Monodelphis domestica
RGSITFKDVAVDFTQEEWCLLDHSQKELYREVMLENVQNLLSVEAETNFEKPPEFPLYQGNLRAMSFDSRLDLIRHPKCKS

SEQ ID NO: 19470 - protein, 81 aa, Monodelphis domestica
MAFKDVAVDFTQEEWCLLDHSQKALYLEVMLENVQNLLSVGLPVPRENLISCFQQGESPWLLEQKDPRRSCSEAETNFEVK

SEQ ID NO: 19471 - protein, 81 aa, Monodelphis domestica
AQEVVTFKDVAVDFTREEWRLLSPPQKELYKEVMLENARNLLSVGLPAPPEDMITSLEQTEDPWMLEQESLRTCCPDGEIR

SEQ ID NO: 19472 - protein, 81 aa, Physeter macrocephalus
QAQETLTFEDVAVDFTWEEWQLLAPPQKDLYRDVMLENYSNLLSVGFQASKPNVLSKLGQGEPWTMEDEIHCQTHSEIWKV

SEQ ID NO: 19473 - protein, 81 aa, Monodelphis domestica
PAQVLVTFQDVAVDFTQEEWRLLDPGQKELYKEVILENAQNVLSLGLPVPRDLVSHFKQVEAPWMLEEEGSSNSCLDGERR

SEQ ID NO: 19474 - protein, 81 aa, Monodelphis domestica
SQGSITLRDVVMDFTQEEWCLLDHAQKELYREVMLENVWNLQSVGVRVPREKFGTCFQQGQSPSLLEQKDQWGCCPEAETN

SEQ ID NO: 19475 - protein, 81 aa, Monodelphis domestica
IQGSLTFKDVAVDFTQDEWCLLDNSQKELYLEVMLENVQNLLSVGLPVPREYLTSCFQQGEAPWLLEQEVPRSSCPEAETN

SEQ ID NO: 19476 - protein, 81 aa, Monodelphis domestica
SLQRPLTFGDVAVIFSGEEWRRLSPAQRDLYREVMLENYEHLVCVGLSGSKPSVISRLEQAAPWVPEGECPGGPPPDSFHQ

SEQ ID NO: 19477 - protein, 81 aa, Papio anubis
SVVFEDVAVDFTLEEWALLDSAQRNLYRDVMLETFRNLASVDKTQFKANGSVSQQDTYRKEKSKEQTIPNFTRNNSCAYTL

SEQ ID NO: 19478 - protein, 81 aa, Aotus trivirgatus
DHELVTFRDVLINFSQEEWEYLDSAQRNLYWDVMMENYSNLLSLDLESKYETKLLSVETDIIKNTCSQWEVMESSNLCGLE

SEQ ID NO: 19479 - protein, 81 aa, Aotus trivirgatus
CQETVTFRDVAVYFTKTEWTGLSPAQRALYRSVMLENYGNLTAVGYPVPKPALISLLEGGDMAWGLEAQDDPLAEGTKNIC

SEQ ID NO: 19480 - protein, 81 aa, Aotus trivirgatus
SREMNSVAFEDVAVNFTQEEWALLDLSQKNLYRDVMQETFRNLASIGNKGEDQRFEDRYKKSWRNLRHIISHSGNNPHRCE

SEQ ID NO: 19481 - protein, 81 aa, Papio anubis
FLLWLCSFQPFPRAAENEQVPGYHVNKPNAVFKLKQGREPWILEVEYPHRGFPEDLWSIHDLEARYRESQAGNSRNGELTK

SEQ ID NO: 19482 - protein, 81 aa, Aotus trivirgatus
MEPLTFKDVAIEFSLEEWQCLDTAQQNLYRNVMLENYRNLVFLGIAVSKPDLITCLEQGKVPWIMKRHEMVAKPPALYVIG

SEQ ID NO: 19483 - protein, 81 aa, Aotus trivirgatus
AQESLTLEDVTVEFTWEEWQLLDPFQKDLYRDVMLEIYSNLVSMGFQVSKPDALSKLEQGEEPWTIEDERHSRICPENNKV

SEQ ID NO: 19484 - protein, 81 aa, Aotus trivirgatus
ASVTVTFDDVALYFSEQEWEILEKWQKQMYKQEMKTNYETLDSLGYAFSKPDLITWMEQGRMLLISDQGCLHKTKRTTGPP

SEQ ID NO: 19485 - protein, 81 aa, Sarcophilus harrisii
QESVMFADMAIYLTPEEWGQSDPTEGALYRDMMLESCGNDVLLGDGSETENMESLSNLEASEDVESEEKLSSEFPIALPQG

SEQ ID NO: 19486 - protein, 81 aa, Pan paniscus
EMGVLTFRDVAIEFSLEEWHCLDTAQQNLYRNVMLENYRNLVFLGIAASKPDLITCLEQGKEPWNVKRHEMVAEPPVVYFT

SEQ ID NO: 19487 - protein, 81 aa, Camelus dromedarius
NMLFQGPVTFKDITVEFTREEWQLLDAAQRTLYREVMQENYRHLISVGYRVNRPNAVFKLKQGKEPWILEVEFPRRNYPGK

SEQ ID NO: 19488 - protein, 81 aa, Camelus dromedarius
FQEPVTFEDVAVYFTQDQWVSLAPAQQALYREVMLENYANVVSLAAFPFPKPDLVFQLERGGAPWGLDAWTAIRAEALRGV

SEQ ID NO: 19489 - protein, 81 aa, Camelus dromedarius
GEGLVLFKDVSIDFSQEEWECLDSDQRDLYRNVILENYNNLVSVGLSIPKPDVVSLLEEGEDPWMVDRELTRDLLPGDWEC

SEQ ID NO: 19490 - protein, 81 aa, Camelus dromedarius
WSQMPVTFEDVALYLSREEWGQLDHTQQSFYRDVLQKRNGLSFGFPFSRPFWACQVQGKGEASSSSRQTGDEERRGAMEVG

SEQ ID NO: 19491 - protein, 81 aa, Camelus dromedarius
SHALVTFQDILVHFTREEWELLDAAQQLMYRDVMLENCRNLVSLGHQLPKPDVILRLEKGEEPWLLERGVHPEAHPGETRL

SEQ ID NO: 19492 - protein, 81 aa, Camelus dromedarius
TMAHGSVTFRDVAIDFSQEEWEFLDSAQRDLYRDVMWENYSNFISLAGPSVSKPDEITLLDEGKEPWMVVREGTRRLHRGE

SEQ ID NO: 19493 - protein, 81 aa, Camelus dromedarius
LQEATVFKDVAVYFTRIEWSCLAPDQRALYRDMMLENCRHVASLGFLVAKPALISLLEQGEEPGALILQVAEERGTKASLA

SEQ ID NO: 19494 - protein, 81 aa, Cercocebus atys
NCYQDSVTFDDVAVDFTQEEWTLLDPSQRDLYRDVMLENYENLASVEWRLKTKGPALRQDRSWLRTSNETQTARSHNGGQL

SEQ ID NO: 19495 - protein, 81 aa, Cercocebus atys
EKGPLTFRDVAIEFSLEEWQCLDTAQQGLYRKVMLENYRNLVSLAGIAVTKPDLITCLEQGKEPWNIKRHEMVAKPSVICS

SEQ ID NO: 19496 - protein, 81 aa, Cercocebus atys
PGMAVPQGCLTFRDVAIEFSFMEWKCLNPAQRALYREVMLENYRNLEFVGEENVPSDVRNLLLSILALSGFICSFEILTCF

SEQ ID NO: 19497 - protein, 81 aa, Cercocebus atys
ERNLLGPLTFQDVTIEFSLEEWQCLDTAQQTLYRDVMLENYRNLVFLGIAVSKLDLIACLKQGKEPWNMKRHEMVTKPPGM

SEQ ID NO: 19498 - protein, 81 aa, Leptonychotes weddellii
AMALNACYQEVVTFKDVAVYFTQTEWAGLSPAQRALYREVMLTNHGNLTSLGAKTPKPSGPEDIRQGWREKSEDTQFADLP

SEQ ID NO: 19499 - protein, 81 aa, Leptonychotes weddellii
QQIAVTFQDVAVDFTQEEWLLLDLTQRNLYRNVMLENYQNLVAVEYQLSKPKLIAWLEQQELRTVEKGVFQEWETQPQTKG

SEQ ID NO: 19500 - protein, 81 aa, Felis catus
MILLKDCPRNGHSISKPDVVDLLEQGKEPWMILREETQRQYTDLDLHCEVISYVEMPTYEKDVSSTQHQSIYNREKLYEYK

SEQ ID NO: 19501 - protein, 81 aa, Leptonychotes weddellii
VTFTDVAVNFTREEWALLDSAQRILYRDVMLENCRNLASVDLVTQHKMKNSTPQQDILAKKTPDEANRVCAVSHSSQPSPL

SEQ ID NO: 19502 - protein, 81 aa, Leptonychotes weddellii
RESGKAPVTFDDITVYLLQEEWMLLSQQQREICGSDKLVAPLGPAAAKPDLISKLERRAAPWIKDPNGPKWGKGRPPGKKK

SEQ ID NO: 19503 - protein, 81 aa, Neomonachus schauinslandi
FQGFVLFRDVSIDFSQEEWECLDSTQRNLYKYVMLENYSNLVSVGLCIPKPDVISLLEQGKEPWSVFDSELTRGLYLEYKS

SEQ ID NO: 19504 - protein, 81 aa, Neomonachus schauinslandi
SQGLVTFRDVALDFSQEEWEWLDPSQKDLYRDVMLENYRNLVWLGLSISKPNMISLLEQGKEPWMVEKEMSDGQCADWESW

SEQ ID NO: 19505 - protein, 81 aa, Neomonachus schauinslandi
CQGRMTFRDVAIEFSQEEWECLNPAQRALYRDVMVENYRNLVSLGIPLPDLNIIFILEQGKEPQTVESKVKTVKKPILPLQ

SEQ ID NO: 19506 - protein, 81 aa, Neomonachus schauinslandi
MDSVTFEDVAVNFSLEEWALLDSSQKKLYRDVMRETFRNLASIGKDDDILTKLRQLENKSHMVEKRCESKEGHQCGETITQ

SEQ ID NO: 19507 - protein, 81 aa, Neomonachus schauinslandi
WGAWLEKPVTFDDVAVNFTQEEWVCLDASQRVLYQDVMSETFRNLMSVDLIIELEQEEKQWRAELQLRSPNGEGLPSGGRK

SEQ ID NO: 19508 - protein, 81 aa, Neomonachus schauinslandi
MVMFKDVAIDVSQEEWECLNPTQRNLYKDVMLENYSNLVSLDLVSRCEAKKLSPKRDIYETETSRWAIMEQFKSHNPEKSI

SEQ ID NO: 19509 - protein, 81 aa, Neomonachus schauinslandi
AGSMPQRSPPVWGLVAWGWKVGATLQSAEAPRALHKDMKWGKPAGFLVFKPELISRLEQGQEPWVIDLKGVEGREGARTCL

SEQ ID NO: 19510 - protein, 81 aa, Monodelphis domestica
VVTFKDVAVDFTREEWCLLSPPQKGLYKEVMLENTRNLLSVAGEISPEIQVNPTEVSFPVEEMNLQKSISDGPDNFASTEF

SEQ ID NO: 19511 - protein, 81 aa, Monodelphis domestica
MLENYENVVSLGFPVSKPDLISQLEQGEVPCLPDLPRTEVPEIHGARSSVTEKETSIPQQEVGEEVKTQGILSAGSPQGIH

SEQ ID NO: 19512 - protein, 81 aa, Physeter macrocephalus
AQGSVMFSDVSIDFSQEEWEFLDPAQRDLYRDVMLENYSNLVSVGLYIPKPQVISLLEQGKEPWMIGRELTRGLCSDLESM

SEQ ID NO: 19513 - protein, 81 aa, Monodelphis domestica
MLENVQNLLSVGLRIPRENFISSFQQGKAQWLLEQEDPRRSCSEAETNFEVKELSTRLRLMDGSGREGNMNEASHDFILRD

SEQ ID NO: 19514 - protein, 81 aa, Monodelphis domestica
QQEAVTFKDVAVDLTWEEWCLLSSPQKELYKEVMLENARNLLSLGVPTPQEDVLSHLEQREALCMVEQEGLRSCCPEGEIR

SEQ ID NO: 19515 - protein, 81 aa, Monodelphis domestica
TPELVTFKDVAVEFTQEEWGHLKLAQRALYRDVMLENYENLVSLGLPVSKLDVISLLVRGEALWRPEGGGPKSSYKGTLSQ

SEQ ID NO: 19516 - protein, 81 aa, Monodelphis domestica
MLENYRSLAWLGLEVCKPHVIQRLECGEAPWTPQGGVPGSCAPDWEATLETMDSYRKLDLSREDSFPERLRRDGVAAFKLR

SEQ ID NO: 19517 - protein, 81 aa, Monodelphis domestica
AQASVTFKDVAVDFTWEEWRLLDPPQKELYWEVMLENYRNLVCLGLADSNKDVMISELESGEPHWNPTGVVLRSCWPGWES

SEQ ID NO: 19518 - protein, 81 aa, Monodelphis domestica
FQESLTFKDVAVDFTQEEWGQLDHDQRYLYKDVMLENYRNLVSVGKCVYKPNLISQLEQGEEPWIVDGEVPRDAFPGKLIW

SEQ ID NO: 19519 - protein, 81 aa, Monodelphis domestica
DQEVMTFKDVAVDFTREEWCLLSPPQKELYREVMLENAWNLLFVGLPASPEDILSYLEQRDAPWMLKQEGLKNCCPEGEIR

SEQ ID NO: 19520 - protein, 81 aa, Monodelphis domestica
DRGSVTFRDVAVDFSPDEWGRLGPAQRELYREVMLENYRSLAWLGLAGSCPEVVCQLERGAGPWLLEGDGLASGGPEGPES

SEQ ID NO: 19521 - protein, 81 aa, Monodelphis domestica
FQESLTFKDVAVDFTQEEWGKLDSGQKYLYRDVMLENYRNLVSLGHQGSKPYVISQLEQGQEPWIVEREISRNDHKDWGTR

SEQ ID NO: 19522 - protein, 81 aa, Physeter macrocephalus
SQASVSFKDITVELTQEEWQQMGPIQKTLYRDVMLENYNNLVSVGYCIFKPEVIFKLEQGEEPWFLEEEFSNQSHKEDYRD

SEQ ID NO: 19523 - protein, 81 aa, Monodelphis domestica
LPAQMTFKDVAVEFTQEEWRLLSPPQKELYKEVMLENVQNLYCVGLPAPPEDMISYMEQRDSSWMLEQEVLRSCCPEGKIR

SEQ ID NO: 19524 - protein, 81 aa, Aotus trivirgatus
PQVSLTFEDVAVLFTRDEWRKLAPSQRNLYRDVMLENYRNLVSLGLPFTKPKVISLLQQGEDPWKVEKDCSGGSSPGCKSN

SEQ ID NO: 19525 - protein, 81 aa, Pan troglodytes
TDVAIEFSLEEWQCLDTAQQNLYRNVMLENYRNLVFLGIAVSKPDLITCLEKEKEPCKMKRHEMVDEPPVVCSHFAEDFWP

SEQ ID NO: 19526 - protein, 81 aa, Camelus dromedarius
VQGKVNFEDVFVYFSQEEWGLLDEAQRLLYREVMLENFALMVSLGYVSSMPHGVAPRELGSEPWGSDWADMTPAVTREAQG

SEQ ID NO: 19527 - protein, 81 aa, Camelus dromedarius
VKELVTFKDVAIDFTLEEWRLMDPTQRNLHKDVMLENYRNLVSLGLAVSKPDMISHLEDGKGPWVVVREISRTPYPELETK

SEQ ID NO: 19528 - protein, 81 aa, Myotis davidii
VQEPLTFHDVAVEFTWEEWQLLDPEQKDLYRDVMMETYSHLVSLGYQASKPDALSKLERGEELWTVQRGRHCPVSPEFKKV

SEQ ID NO: 19529 - protein, 81 aa, Cercocebus atys
CVTFEDVFVYFSREEWELLEEAQRFLYRDVMLENFALVATLGFWCEAENEEAPSEQSVSVEGVSQVRTAEPGLFQKAPPCE

SEQ ID NO: 19530 - protein, 81 aa, Cercocebus atys
RNMIPQDNENPPQQGEANQNDSMTFEDVAVNFTPEEWALLDPSQKNLYQEVMQETLRNLASIEVLWKRDYLKVKVISVEKF

SEQ ID NO: 19531 - protein, 81 aa, Cercocebus atys
KPTPLGLLTFRDVAIEFSVEEWQCLDTAQQNLYRNVMLENYRNLVFLGIAASKPDLITCLEQGKEPWNVKRHETVAKHPGR

SEQ ID NO: 19532 - protein, 81 aa, Leptonychotes weddellii
VTESVTFRDVAVFFSQDEWLRLDSAQRTLYREVMLENYGTLVSLGIPFSRPKVICQLQEGEDPCLVDGELPRDACLGTSVS

SEQ ID NO: 19533 - protein, 81 aa, Felis catus
LGLLDPTQRKLYREVMLENFGNLVSVGHQPFKRDMVHLVREGKFWMMKLATQGKGNSGKIQTIPKVEPHEELSCWQIWQHI

SEQ ID NO: 19534 - protein, 81 aa, Neomonachus schauinslandi
FQETVTFKDVAVVFSEEELGLLDSTQRKLYRDVMLENFRNLVSVGHSSSKPDMISQLEREEKLCMKEIHTERGRHSGGRNQ

SEQ ID NO: 19535 - protein, 81 aa, Neomonachus schauinslandi
QSRGPLSFVDVFVDFTWEEWQLLDPTQKHLYRTVTLENYSNLVSLGYQDSKPDIIFKLEQEELWMMQAQIPSQGHPEKVWE

SEQ ID NO: 19536 - protein, 81 aa, Neomonachus schauinslandi
SQGSVLFEEISVDFSQKEWQLLDPAQRLLYREVMLENHRLLVSLGCCVTKPELIRKLEQEEEPWAPKRELPGQSHPGELLC

SEQ ID NO: 19537 - protein, 81 aa, Neomonachus schauinslandi
MEPVTFRDVAVDFTQEEWGQLGPAQRTLYRDVMLETFGHLLSVGPELPKPEVISQLEQGAELWAAERGIGQGYCPGWEPGP

SEQ ID NO: 19538 - protein, 81 aa, Monodelphis domestica
MVTFHDVTVDITRKEWHLLSPPQKELYKEVMLENARNLLSVGLPAPSEEVISYLEQREAPWILEQEGLRNCCSEGEIRPEM

SEQ ID NO: 19539 - protein, 81 aa, Monodelphis domestica
FVESVTFKDVAIDFTQEEWVHLDFAQKEFYRDVMLENYRNLVCLGLASSKPYVICQLERREAPWIPEGDIQRISHPDWETK

SEQ ID NO: 19540 - protein, 81 aa, Physeter macrocephalus
QGSVTFEDVVVYFSWEEWGLLDEAQRCLYHDVMLENFALVTSLGCWYGMEDEEAFSVQSVSVEQMSLGKTPTPDPSIQKTH

SEQ ID NO: 19541 - protein, 81 aa, Monodelphis domestica
PQVLVTFKDVAVDFTQEEWRLLDHSQKELYKEVMLENVQNLLSVGLPAPKEELISHFEQGKVPWMLEREDPRKSCPDGETR

SEQ ID NO: 19542 - protein, 81 aa, Physeter macrocephalus
PQEAVTFEDVAVNFSKEEWQCLTHAQRHLYKDVMLENYGNVVSLGFPFPKPPLISHLEQEAELCVQDRQDREFLNCSYPVS

SEQ ID NO: 19543 - protein, 81 aa, Physeter macrocephalus
EEVPVVFEDVAVYFTREEWAALDKRQKELYRDVMRTNYELLASLGPAAAKPDLISKLERRAAPWIRDPDGPEWGKGRPPGK

SEQ ID NO: 19544 - protein, 81 aa, Monodelphis domestica
VVTFQDVAVDFTREEWRLLSPPQKELYREVMLENVRNLLSVEGEIRPEMKVNPTEVILPVEDMNLQRFMSDGPDKFASKEF

SEQ ID NO: 19545 - protein, 81 aa, Physeter macrocephalus
FQELVSFKDVTVGFTQEEWQHLDPTQRSLYRDVMLENYSNLVSVGYCVTKPEVIFRLEQGEEPWILEEEFPRQSFPEVWKI

SEQ ID NO: 19546 - protein, 81 aa, Monodelphis domestica
QQGAVTFRDVTVDFSPDEWGHLGPAQKELYCKVMLENYQTLVCLELKVCKPHVIQQLECGEAPWMPQGGVPGSCGIRGTWS

SEQ ID NO: 19547 - protein, 81 aa, Physeter macrocephalus
MAFRDVAVDFTQEEWMLLSPAQRSLYREVMLENYSNLVSLGIPFSKPKLITQLEQGKETWREERKCPPANGPPEPKPELHL

SEQ ID NO: 19548 - protein, 81 aa, Monodelphis domestica
AQEVVTFKDVVVEFTQEEWCLLSPAQKELFKEVMLENAWNLHSLGLPAPPEDMISYLELKETPWMLEQEDLKSFCPEGEIR

SEQ ID NO: 19549 - protein, 81 aa, Monodelphis domestica
SWEAVTFKEVTVDFTREEWEHLDPLQRDLYRDVMLENYRNLVSLGLMDSKPVMISWLEDWEELQQGNEKEIILTGINPDWE

SEQ ID NO: 19550 - protein, 81 aa, Papio anubis
LQELLTLEDITVEFTWEEWQLLDPFQKDLYRDVMLEIYSNLVSMGYQVSKPDALSRLERGEEPWTMEGERHSQICPENNKV

SEQ ID NO: 19551 - protein, 81 aa, Papio anubis
SQGLVTFRDVALDFSPEEWEWLKPSQKDLYRDVMLENYRNLVWLGLSISKPNMISLLEQGKEPWMVERKMSQGHCADWESW

SEQ ID NO: 19552 - protein, 81 aa, Aotus trivirgatus
EPGTVSFGDVAVYFSREEWGCLRPAQRALYRDVMRETYSHLGALGVGGSKPALISWVEEEAELWGPAAQDPEVAKRPTEAD

SEQ ID NO: 19553 - protein, 81 aa, Pan troglodytes
KSQESLALEDVAVEFTWEEWQLLGPAQKDLYRDVMLENYSNLVSVGYQASKPDALFKLEQGEPWTVENEIHSQICPEIKKV

SEQ ID NO: 19554 - protein, 81 aa, Pan troglodytes
EKGPLTFKDVAIEFSLEEWQCLDTAQQDLYRKVMLENYRNLVSLAGIAVSKPDLITCLEQGKEPWNMKRHAMVDEPPESVF

SEQ ID NO: 19555 - protein, 81 aa, Pan troglodytes
QGRLTFRDVAIEFSLAEWKFLNPSQRALYREVMLENYRNLEAVDISSKRMMKEVLSTGQGNTEVIHTGTLQRHRSYHIGDF

SEQ ID NO: 19556 - protein, 81 aa, Cercocebus atys
FLNKVTFEDVAIDFTQEEWAMMDTSKRKLYRDVMLENNSHLVSLGYQISKSYITLQLEQGKELWREGREFLQGQNLDKESA

SEQ ID NO: 19557 - protein, 81 aa, Cercocebus atys
FQGSVSFKDVTVGFTQEKWQHLDPAQRTLSRDVMLENYSHFVSVGYCIPKPEVILKLEKGEEPWILEEKFPFQSHLELINT

SEQ ID NO: 19558 - protein, 81 aa, Leptonychotes weddellii
FQEAVTFKDVAVVFTMEELGLLDSTQRKLYRDVMVENFKNLVSVGHLPFKPDMVSQLEAEEELWMMEGEPQRNGYSREDHV

SEQ ID NO: 19559 - protein, 81 aa, Leptonychotes weddellii
MTFDDVALYFSEQEWEILEKWQKEMYQQVMKTNYETLDSLGGVFSKPDLISWIEQGRMLLIRDQGPLEKNMTLSPSTDEQW

SEQ ID NO: 19560 - protein, 81 aa, Felis catus
AQAPLSFEDVAVSFSREEWRLLVPAQKDLYRDVMLENYRNLVSVGYQASEPGSLFQLEHAGPLRAVEGAAPRPPCPEEIWE

SEQ ID NO: 19561 - protein, 81 aa, Felis catus
KEEEMASSQGLLTFRDVAIEFSQEEWGCLNHSQREVYRDVMLENYGHLLFLGEDNSFQTSQTTLGVLFLPLKTVSWNFLFA

SEQ ID NO: 19562 - protein, 81 aa, Monodelphis domestica
LNKTPVTFKDVTVDFTEEEWRQLNPTQKQLYRDVMLENYRNLLFLGLPVFKPVSSCLERGEEPWTVERKVPGSPRADWEIN

SEQ ID NO: 19563 - protein, 81 aa, Monodelphis domestica
SQESVTFKDVSVDFTQGEWGQLDLSQKNLYRDVMLENYRNLVSLGLQVFKPEVICRLERGEAPWVLEREISRGPSLDWPET

SEQ ID NO: 19564 - protein, 81 aa, Monodelphis domestica
QVFLTFEDVAITFSQEEWGMLAAWQQKLYWDVMKENYESLSSLSAAGRLGALPDLFWTLGQVFETWEDQQNSLRRDNSESS

SEQ ID NO: 19565 - protein, 81 aa, Monodelphis domestica
PGQEVVTFKDMAVDFTWEEWCLLTPPQKELYKEVMLENARNLLSVGLAVPRDVISYLEQREAPWLLEQEGLRSCSPVFLSG

SEQ ID NO: 19566 - protein, 81 aa, Monodelphis domestica
AQEAVTFKEVAVDFTQEEWRLLSPPQKELYKEVMLENARNLLSVGLPGTPEDMISSLEQREAPWILEQEGLRNCCPEGEIR

SEQ ID NO: 19567 - protein, 81 aa, Monodelphis domestica
AVTFKDVAVNFSQEEWMCLDSSQKEFYRDVMLENYRNLVFLDWETQEESKEPTPKLSISMEQSSKEILQRDSLLFSPLRES

SEQ ID NO: 19568 - protein, 81 aa, Monodelphis domestica
SQGSITFRDVVVNFIKEEWCLLDHSQKEPYKEVMLENVQNLQSVGLTVPRENFVTYFQQGELPWLLEQKGQWKCTVWKGFH

SEQ ID NO: 19569 - protein, 81 aa, Monodelphis domestica
AQVLVTFQDVAVDFTQEEWRLLDPGQKTLYKEVMVENAQNVFSLGLPVLREDWISYFDQGETVWILDGEGPSNSCLDGERR

SEQ ID NO: 19570 - protein, 81 aa, Monodelphis domestica
AQASVTFKDVAVDFTWEEWRLLDPPQKELYWEVMLENYRNLVCLGLADSNKDVMISELESGEPHWIPTGVVLRSCWPGWES

SEQ ID NO: 19571 - protein, 81 aa, Monodelphis domestica
SLTFEDVAVEFTQEEWGHLDSAQRNLFRDVMLENYRNLVSLDCPSWEPRYEATEEVPLWGISMGQSSKKRLKKDCSRNSKL

SEQ ID NO: 19572 - protein, 81 aa, Monodelphis domestica
QKELVTFKDVAVEFTQEEWGSLDPFQKKLYKDVMLENYRNLVFLGLTVWKPAVISQLEEGEAPWTEDREVPKAISPNLETR

SEQ ID NO: 19573 - protein, 81 aa, Physeter macrocephalus
MRPVQKELYKTVTLQNYWNMVSLGLTVYRPTVIPILEEPWMVIKEILEGPSPEWETEAQECTPVENVSKLTKDGTKTIKLE

SEQ ID NO: 19574 - protein, 81 aa, Physeter macrocephalus
NFWILRLPPGSKGEAPKEWGKLDECQRELYKHVMRGNYETLVSLDYAISKPDILTRMERGEEPCPEGPRGREEGSDREEAR

SEQ ID NO: 19575 - protein, 81 aa, Monodelphis domestica
KFQIQNFEAVTFKDVAVEFTQEEWHLLTPYQKELYKEVILENAWNLLPVGIPAPPEELFSYLKQTEAWWMLEQEGLRSYCP

SEQ ID NO: 19576 - protein, 81 aa, Physeter macrocephalus
LQELVTFQDVAVDFTQEEWEHLDPSQRHLYREVMLENYGNLISLGHLLSKPEMISHFEQGDDVWMEEKIPRSSYLGDKPYR

SEQ ID NO: 19577 - protein, 81 aa, Monodelphis domestica
MLFQELVTFKDVAVDFTQEEWKCLAPSQKELYREVMLENYRNLVSLGRAVSKPELIHQLERGETPWRPKGDGWRNSLRPGE

SEQ ID NO: 19578 - protein, 81 aa, Monodelphis domestica
GQEEVAFKDVAVDFTREEWRLLSPPQKELYKEVMLENIRNLLSVGLPAPPEDMISYLEQREAPWMLEQEGLRSYSPGEEIR

SEQ ID NO: 19579 - protein, 81 aa, Monodelphis domestica
PKVPVTFDDVAVYFSEKEWGNLDKWQKELYKHVMTGNYEMLVSLDYALSKPEFLTRIEQGEEPCTQNQLDSEETEIAANPD

SEQ ID NO: 19580 - protein, 81 aa, Physeter macrocephalus
LGPVTFEDVAVYFSHEECRLLGEAQRLLYHDVTLETSALVASLGCWYGVEVKETPSEQNDSVEVPQINTSKTNLSTQKGCP

SEQ ID NO: 19581 - protein, 81 aa, Pan troglodytes
ASGSVTFEDVAVYFSWEEWDLLDEAQKHLYFDVMLENFALTSSLGLTLSWSHVVAQLGLGEVPSVLHRMFMTPASARWDQR

SEQ ID NO: 19582 - protein, 81 aa, Camelus dromedarius
RAYGEPVTFEDVAVDFTQEVWQQLDLAQKTLHRDVMLEICSHLVSVGIKPDIISKLEHGEDKWIMENREESPDSSQQIISG

SEQ ID NO: 19583 - protein, 81 aa, Camelus dromedarius
PKVPMTFDDMAMYFSEQEWGKLDEWQKELYKHVMRGNYETLVSLDYAISKPEVLSQIEQGKEPCSWRRPGPKVPDVPVDPS

SEQ ID NO: 19584 - protein, 81 aa, Camelus dromedarius
SQESVTFQDVAVDFTEKEWPLLDSSQRKLYKDVMLENYSNLASVGCQVGKPSLISHLEQEEELRTEERELHRGTCPDWEPP

SEQ ID NO: 19585 - protein, 81 aa, Camelus dromedarius
SQGSLSFRDVAVDFTWEEWQLLDTVQKNLFRDVMLENYSNLLSLGYQVSKPEALVPLEEGREQGIVEREFPSQCSPGECNQ

SEQ ID NO: 19586 - protein, 81 aa, Myotis davidii
YQESVTFMDVAVTFTDEEWRHLIPIQRDLYKEVMLENYQSIISVGLPVPQPDVIFQFNREDKPWIIDLHGPDEGRWPENIS

SEQ ID NO: 19587 - protein, 81 aa, Myotis davidii
FQLPVSFKDVLVSFTHEEWGQLDLVQRTLYHDVTLETCDHLVSLGLLLPTVDVISCLERGAGPWRAEQEPPPGEWKTSLEK

SEQ ID NO: 19588 - protein, 81 aa, Myotis davidii
APQGQLTFSDVAIEFSQEEWACLDPAQRKLFRDVMLQNYRNLVFLGLTVSKPDLTFLEQMEETWELEEEKTVVIHPAISSQ

SEQ ID NO: 19589 - protein, 81 aa, Cercocebus atys
AQESVTFEDVAVNFTNREWQSLTYAQRHLYKHVMLENYGNMVSLGFPFPKPPLISHLEQGVEPCVQDPQNRESLSCSYPVS

SEQ ID NO: 19590 - protein, 81 aa, Cercocebus atys
MFQESLTFQDVAVDFTKEEWDQLYPAQKNLYRDVMLENYRNLVALGYQLYKPEVIAQLELEEEWVIEGDSLLDTHPDGENR

SEQ ID NO: 19591 - protein, 81 aa, Leptonychotes weddellii
GRGHARNPAQIPMTREALTDCGKGCVTFEDIAVYFSREEWGLLDEAQRHLNCTMMLENLALIASLAPAKAPLSSLLAWDGG

SEQ ID NO: 19592 - protein, 81 aa, Leptonychotes weddellii
PQKSVTFEDVAVYFTQTEWDGLSPAQRALYRDVMLENYGNVASLGFSLLKPAVISQLEGAVDIDVQTDNNLIKEMYEEKHN

SEQ ID NO: 19593 - protein, 81 aa, Leptonychotes weddellii
MLENYGHLLFLGLVVWKPDLVIFLEQEKQLWDVKRKETVAFHPAVSSNGTQSFLPTLCIEASFQNVAVRRYKHTALENLHF

SEQ ID NO: 19594 - protein, 81 aa, Leptonychotes weddellii
MYKDVMLENYKNLISLGHQLPKPDVILQLEKGEEPWLVERGIHRETHPDLETAVEIKSSISSKSISKNKQSYGIKMEGIAK

SEQ ID NO: 19595 - protein, 81 aa, Felis catus
SYEGSVSFRDVAVDFSREEWQHLDLAQRNLYRDVMLETYSHLLSVGYEVPQPEVFMLEQGKEPWALQGESPHRSCSGEKLW

SEQ ID NO: 19596 - protein, 81 aa, Leptonychotes weddellii
CWGLLSFKDISMEFTWEEWQLLDSTQKYLYRDVILENYSHLVSVGYHGTKPDLIFKLEQGEEPWIINAKVSRQSCPEGWKE

SEQ ID NO: 19597 - protein, 81 aa, Neomonachus schauinslandi
LPELVTFKDVAVYFTGTEWAGLSPAQKALYRSVMLENYGNLTSLGYPVPKPALISLLEGGNLPWGLEAQDNPSAERTKDIC

SEQ ID NO: 19598 - protein, 81 aa, Monodelphis domestica
LLELLTFKDVAVDFTQEEWCLLDHSQKELYKEVMLENSHNLLSLGIPVLKEDLISHFEEREASWILDQKSLRNSCPGAVTK

SEQ ID NO: 19599 - protein, 81 aa, Physeter macrocephalus
FREPVTFEDVTLGFTPDEWGMLDLEQKSLYREVLLENYRNLVSVEHQLSKPDVVSQLEEEEELWSVERGIPQDTFSECPEA

SEQ ID NO: 19600 - protein, 81 aa, Monodelphis domestica
SQGSITIKDVTVDFTQEEWMLLDHSQQELYLEVMLENVQNLHSVGLLVPRENFISCFQQGEAPWLLEQDCPRRSCPEAKTN

SEQ ID NO: 19601 - protein, 81 aa, Physeter macrocephalus
SYESLSFEDVTLDFTQEEWQQLDPAQRTLYRDVMLENYSHLVSVGYCIPKPELIFRLEQGEQPWVLEEESPSQSYPEVCKV

SEQ ID NO: 19602 - protein, 81 aa, Monodelphis domestica
GQEEVTFKDVAVDFTREEWRLLSPPQKELYKEVMVENARNLLSVGLPAPTKDVLSYLKKRGAPVMLEQEGLRNYFPEGEIR

SEQ ID NO: 19603 - protein, 81 aa, Monodelphis domestica
LWVSITFHDVAVGFTQEEWDLLDDSQKELYLEVLLDNVQNLLSVGLPVPREIFISCFQPGKTPWLLEQKGPRNSCAEAETN

SEQ ID NO: 19604 - protein, 81 aa, Monodelphis domestica
FQESVTFKDVTVNFTQEEWEQLNPAQRELYRDVMLENYRNLISLGLPISKPDVIFQLEQGQEPWMLDVQGTERQAVPRSTS

SEQ ID NO: 19605 - protein, 81 aa, Physeter macrocephalus
EQSESVTFEDVAIYFSENEWTGLTPSQRALYRNVMLEDYGAVASLAFPFPKPALIFKLADEAPWSLAPQGALDGEGPRGIS

SEQ ID NO: 19606 - protein, 81 aa, Physeter macrocephalus
MLETYGNLVSLGLQGSKPDVISKLEQGEEPWAPHSPRIEGSWIWRHRHAGYVSRKEKKELTPKQEISEEMESQRTKLEEHV

SEQ ID NO: 19607 - protein, 81 aa, Physeter macrocephalus
AHGLVMFKDVAIDVSQEEWECLNPAQRNLYKDVMLENYSNLVSLGLSISKPAVISSLEQGKEPWMVMREVIGEQFPDLVSK

SEQ ID NO: 19608 - protein, 81 aa, Aotus trivirgatus
VTFEDVAVVFTDEEWSHLIPIQRDLYKEVMLENYKSVVSLDWETKPEIYDASEEKAERSLRESLGRQSPLCPKFEVRAPDG

SEQ ID NO: 19609 - protein, 81 aa, Papio anubis
EMGLLTFRDVAIEFSLEEWQHLDIAQQNLYRNVMLENYRNLAFLGIAVSKPDLITCLEQGKEPWNMTRHEMVDESPGICPL

SEQ ID NO: 19610 - protein, 81 aa, Papio anubis
QGRVTFRDVAIEFSLAEWKCLNPAQRALYREVMLENYRNLESVDISSKCIMKEFSSTGQCNTEVFHTGTLQRHESHHIRDF

SEQ ID NO: 19611 - protein, 81 aa, Aotus trivirgatus
FQGSISFKDVTVGFTQEEWQHLDLSQRALYRDVMLENYSNLVSVGYCLHKPEVIFRLEQGEEPWRLEEEFPCQSFPEVWTA

SEQ ID NO: 19612 - protein, 81 aa, Aotus trivirgatus
AHALVTFRDVAIDFSQKEWECLDPTQRKLYRDVMLENYSNLVSLGYSGSKPDVITLLEQGKEPCMAVRDMTGRQYPGLLSR

SEQ ID NO: 19613 - protein, 81 aa, Aotus trivirgatus
VQGLVMFEDVAVYFSREEWGLLNVTQKGLYRDVMLENFALLSSLGLAPSRSPVFTQLVDDEQSFVPSWVDVTLVSRTEASR

SEQ ID NO: 19614 - protein, 81 aa, Aotus trivirgatus
MTSFQEAMTFKDVTVVFTEEELGLLDLLYRDVMLENFRNLLSVGHQLFHQDVFHFLREEKFWVMETATQREGNSGGKIQTE

SEQ ID NO: 19615 - protein, 81 aa, Aotus trivirgatus
LQGPVSFKDVAVDFTQEEWQQLDPDEKITYRDVMLENYSHLVSVGCDITKPNVIIKLEQGEEPWIMEDEFPCQHSPEVWKV

SEQ ID NO: 19616 - protein, 81 aa, Aotus trivirgatus
RPQESVAFDDVAVYFTKKEWAMMVPDRRAVYRDVMLENYEAVAAPPTSKPAWVSHLEQGKEPCFTQPQGVLSRRDWRAAKA

SEQ ID NO: 19617 - protein, 81 aa, Aotus trivirgatus
VAFEDVAVNFTQEEWALLDPSQKNLYREVMQETLRNLASIGQRWSNQNAEDKHQNPRRNLRRLIGERLFQSKESHQHVEVL

SEQ ID NO: 19618 - protein, 81 aa, Aotus trivirgatus
TKGCVTFEDIAIYFSQEEWGRLDEAQRLLYLEVMLENFALVASLGCGHGTEDEKTPSEQNVSIGVSQSKAGSSTQKTQPCE

SEQ ID NO: 19619 - protein, 81 aa, Camelus dromedarius
QGRVVFEDVAIFFSQEEWGLLDEAQRHLYHAVMTENLALLSSLGKVPTLTPRAGLALFFPFSQGRFRPPVMRPQVLLPVLV

SEQ ID NO: 19620 - protein, 81 aa, Camelus dromedarius
SHGLVSFKDVAVDFTQEEWQQLDPAQRTLYRDVMLENYSHLLSVGHPVSKPDVISKLEQGEDPWIIKRNMPNWVYPGENQA

SEQ ID NO: 19621 - protein, 81 aa, Myotis davidii
MVFEDVAVYFSREEWGLLDSAQRALYRQVMLENFALVASLGLSASRPRIVLQLERGEEPWVLSGLDVALARDAQRRPGPGE

SEQ ID NO: 19622 - protein, 81 aa, Myotis davidii
FQEPVTFRDVAVDFSPEEWGRLGPAQRTLYRDVMLETFGHLLSVGPELPKPEVISQLERGAELWVVEHGLAQGCCPGWDPG

SEQ ID NO: 19623 - protein, 81 aa, Cercocebus atys
EELPVVFEDVAVYFTREEWGMLDKRQKELYRDVMRMNYELLASLGPAAAKPDLISKLERRAAPWIKDPNGPKWGKGRPPGN

SEQ ID NO: 19624 - protein, 81 aa, Cercocebus atys
SVAFEDVAVNFTQEDWALLSPSQKNLYRDVMLETFRNLASVGIQWKDQDTENLYQNLGIKLRSLVERLCGRKEGSEHRETF

SEQ ID NO: 19625 - protein, 81 aa, Cercocebus atys
VAFEDVAIHFSQEEWELLDEMQRLLYHDVMLENFAVMASLGCWCGAEDEGAPSAESISVAELSQGRTPKADTSTDKSHPCE

SEQ ID NO: 19626 - protein, 81 aa, Cercocebus atys
FQELLTFRDVAIEFSPEEWKCLDPAQQNLYKDVMLENYRNLVSLGFVISNPDLVTCLEQIKEPYNLKLHETAAKPPAMCSP

SEQ ID NO: 19627 - protein, 81 aa, Leptonychotes weddellii
LREPVTFADVAVLFTPEEWMFLDSAQRSLYRDVMLENYRNLASVGDQLGKPSTFSHLEPGEELWPPERRSFPGTCPEPQHQ

SEQ ID NO: 19628 - protein, 81 aa, Neomonachus schauinslandi
FQGSVSFKDVTVGFTQEEWQHLDPAQRSLYRDVMLENYSNLVSLGYCVTKPEVIFRLEQGEEPWILEEEFPSQSFPEIWKT

SEQ ID NO: 19629 - protein, 81 aa, Neomonachus schauinslandi
FQETVTFKDVAVVFTREELRLLDSTQRKLYRDVMLENFRNLLSVGYEPFRLDTTLPLGREEKLWMMETQTPGDGRSGLRNQ

SEQ ID NO: 19630 - protein, 81 aa, Monodelphis domestica
QESLTFKDVAVEFTWEEWRHLDPAQRALHRNVMLENYENLVSIEGKIRLEMKEMTAELSLSGEETQKQRCIGDGACDSTWR

SEQ ID NO: 19631 - protein, 81 aa, Physeter macrocephalus
TGDWEMAAALLAAGSQEEWRSLDPSQTDFYGEYVMQENCGIVVSLRFPIPKLDMLSQLEGGEEQWVPDPQDLEERDILKVT

SEQ ID NO: 19632 - protein, 81 aa, Monodelphis domestica
QGSITFKDVTVDITQEEWCLLDHAEKELFLEVMLENVQNLLFVEAGTNFDVKEISSKLRLFVEESGPQRFINEGPCDFILG

SEQ ID NO: 19633 - protein, 81 aa, Monodelphis domestica
SPKFQESLMFKDVAVDFTPEEWRHLDPTQRTLFRDVMLENYENLVSLGLPVSKLDVISLLERGEAPWRLEERGSQCFCPGE

SEQ ID NO: 19634 - protein, 81 aa, Physeter macrocephalus
QGHVIFEDVAVSFSQEEWGLLNDAQRLLYCDVMLENLSLIASLGCWRAVGTEEATSEQCVSVEQVTQDRNPNPDLSILKTL

SEQ ID NO: 19635 - protein, 81 aa, Physeter macrocephalus
SVTFEDVAVYFSQEEWRLLDEAQRFLYRDVMLETFALVASLGCWHGAEVKETPSEQNVFVEVPRINTSKTKLSTQEAYPWE

SEQ ID NO: 19636 - protein, 81 aa, Monodelphis domestica
SQGSITFKDVAVDFTQEEWRLLEPSQKEQYREVMLENAWNLHSVGLPVPREDILSSFQQGESPWLLEEKSPRNSCPVFSWV

SEQ ID NO: 19637 - protein, 81 aa, Monodelphis domestica
QELVTFEDVAVYFTEEEWDRLHPAQRTLYRDVMLENYVNVTSLGDGIKMENEEEPIPKPEMSEEVASQWTLLAGFPWAIPQ

SEQ ID NO: 19638 - protein, 81 aa, Monodelphis domestica
AQEVMTFKDVAVDFTREEWRLLSPPQKELYKEVMLENAWNLLFVGLPAPPEDVISSLEQREVPLMLVQEDLRSCCPEEEIR

SEQ ID NO: 19639 - protein, 81 aa, Monodelphis domestica
SLKSLTFQDVAVDFTQEEWRLLDPAQKDMYRDVMLENYENFVSLGLPDSKADVISQLERRERPGLPEGEVPRSPSLGSQGE

SEQ ID NO: 19640 - protein, 81 aa, Monodelphis domestica
SQGSITFKDVAVDFTQEEWYLLDHSQKELYLEVMLENVQNLLSVGLPVPGENFISCFQQGKALCLVEQKDPRSFFQVEDFE

SEQ ID NO: 19641 - protein, 81 aa, Physeter macrocephalus
MRESGGALSLCGLPDSKPDVIPKLEQWEDPWTVERDVPRGPEKEALCAETWCHQVQLFRNCVSLLSFSMKTLLKSAATVMP

SEQ ID NO: 19642 - protein, 81 aa, Physeter macrocephalus
FQEPVTFEDVAVYFTQNQWASLEPVQKALYREVMLENYANVASLALPFPTPVLISQLERGEAPWGPDPWEAEILRGICPGG

SEQ ID NO: 19643 - protein, 81 aa, Monodelphis domestica
FQETLTFKDVAVEFTWEEWRHLDPAQRALHRNVMLENYENLVSIGIPVSKLDLLFLLKREDVQNQEGESGTGTCIGELLKN

SEQ ID NO: 19644 - protein, 81 aa, Monodelphis domestica
GPGSVTFRDVAVDFTWEEWRRLGPAQKELYREVMLETYRTLVCLGLAVPKPGVSAQLDGGERRASARGRPGWKNRSDTEES

SEQ ID NO: 19645 - protein, 81 aa, Physeter macrocephalus
VTFEDVAINFTQEEWALLDTSQKTLFRNVMLENITHLVSVGESVYMDVSHTQRDPVGWTDLSDEFTPRSSPQHSPIPLRRK

SEQ ID NO: 19646 - protein, 81 aa, Aotus trivirgatus
SNETLTFRDVAIEFSLEEWQCLNPAQQNLYRNVMLENYRNLVFLADIAVSKQNPITCLEQKKEPCNIKRHEMVARPNAMCS

SEQ ID NO: 19647 - protein, 81 aa, Papio anubis
QDSVTFDDVAVEFTPEEWVLLDTTQKYLYRDVMLENYMNLASVDFFFCLTSEWEIQPRTKRSSLQQGFLKNQIFTGIQMTR

SEQ ID NO: 19648 - protein, 81 aa, Aotus trivirgatus
QVTFSDVAIDFSHEEWGWLDSAQRDLYKDVMVQNYENLVSLAGLSITKPYVITLLEDGKEPWMNAFHILFLIVSFFCILFY

SEQ ID NO: 19649 - protein, 81 aa, Aotus trivirgatus
VKESVTFKDVAIDFTLEEWRLMDPTQRNLHKDVMLENYRNLVFVGLAVSKPDMISHLENGKGPWVTVREISRISYPDLETK

SEQ ID NO: 19650 - protein, 81 aa, Sarcophilus harrisii
QVLVTFKDIVVDFTEEEWGLLNHSQKELYKEVMLDNVQNLLSLVVETRIEVNEMSRKLRILMEESNVQRFLSDPFSDFTLS

SEQ ID NO: 19651 - protein, 81 aa, Sarcophilus harrisii
MVDFTEEEWGLLDPSQKKLYKEVILENVQNLLFLDVKTGFTVNEISKKLEIFMEEHDLQRFIDDDPFDFNLKELHDFILKE

SEQ ID NO: 19652 - protein, 81 aa, Camelus dromedarius
PVTFEDVAVYFSQEEWGLLSDAQRLLYHDVMLDTLSLLASLGFSNMMHFIYCTCLCVMFFERCMFTYVVLKHWVARDAAMA

SEQ ID NO: 19653 - protein, 81 aa, Camelus dromedarius
FQKSVTFEDVAVYFTQTEWDGLSPAQRALYRDVMLENYGNVASLGFPLLKPAVISQLEGGGELGGPSPLASGTGTGPQGLW

SEQ ID NO: 19654 - protein, 81 aa, Camelus dromedarius
VQGRVVFEDVAIFFSQEEWGLLDEAQRHLYHAVMTENLALLSSLGKVPTLTPRAGLALFFPFSQGRFRPPGCVVFEDVAVH

SEQ ID NO: 19655 - protein, 81 aa, Camelus dromedarius
WKESLSFEDVALYFTREEWSRLDWAQKDLYRDVMLENYRNMIVLGFQFPKPEVICQLEQWEEPWILDLPRAGTRKASGSAC

SEQ ID NO: 19656 - protein, 81 aa, Camelus dromedarius
ARQVPVAFQDLAVRFSEDEWRLLGEKQRALFLDVMQENYETLVSLGTAELPPLSAFLSPTEPGGPMEDGSCSGDRQERPRG

SEQ ID NO: 19657 - protein, 81 aa, Myotis davidii
AEVGVTYEDIALYFSREEWSLLDEGQRQLYLNVMLENFELPSSLGCCCGAENVEALTEQNVSVKVSQARNVKVALSSQKSH

SEQ ID NO: 19658 - protein, 81 aa, Myotis davidii
SQDLVTFGDVAIDFSQDEWEWLNLAQRNLYRKVMLENYRNLESLGVSVSKPEVISLLEQGREPWMATKARTEGTCSDWEYA

SEQ ID NO: 19659 - protein, 81 aa, Myotis davidii
YQEFVTFEDVAVHLTREEWGCLDPVQRDLYREVMLENYGNVVSLGFPIFKPDGISQLEQDLQVFDLETKNREVLRDDCSDG

SEQ ID NO: 19660 - protein, 81 aa, Myotis davidii
MLENYSHLLSVGYEVPKPEVIFKLEQGEEPWILEGETPHQSCSDGKFGIKTSQKRISGKASFHSEMEGEDIRDDSLYSILE

SEQ ID NO: 19661 - protein, 81 aa, Cercocebus atys
PQGLLTFRDVAIEFSQEEWKCLDPAQRTLYRDVMLENYRNLVSLAISSKCMMKMFSSTGQGNTEVIHTGTLQRQASHHIGD

SEQ ID NO: 19662 - protein, 81 aa, Cercocebus atys
VLFQISFEDVAVDFTLEEWQLLNPTQKNLYRDVMLENYSNLIFLEVWLDNPKMCSEIIQDNLKSMERGMRSHNVAQEKKFE

SEQ ID NO: 19663 - protein, 81 aa, Leptonychotes weddellii
MDFTPEEWGKLDPAQREVMLENYRNLVSLWLPVSKPENYNLENGKEPLMLERKAPKSSYSDLETKPEGKDSTSVQGISKEE

SEQ ID NO: 19664 - protein, 81 aa, Leptonychotes weddellii
MDFTLEDWEHLGLDQGDLFWDTALDNYQNLFLLNPSKPKLTSHPDGTEELKVLVRESPESAGPDTAEVKNCLLAHDFLEEG

SEQ ID NO: 19665 - protein, 81 aa, Leptonychotes weddellii
WLVTFKDVAIDFSQEEWECLNSTQRDLYRDVMLENYSNLISLDLESSCETKKSSPEKGAYEMESLQWESMRKPISHNLDYS

SEQ ID NO: 19666 - protein, 81 aa, Leptonychotes weddellii
MLENYSNLVSVGLCIPKPDVISLLEQGKEPWSVFDSELTRGLYLEYKSRCENKKLSLKKGNYKIDSSQWVIMEGCTKHGLK

SEQ ID NO: 19667 - protein, 81 aa, Felis catus
IQGSLTFGDVAVAFTQIEWKHLDAAQRALYKDVMLENYGNLVSVGLLSSKPKLITQLEQGSEPWMEVQQVPSGTCSVQEYW

SEQ ID NO: 19668 - protein, 81 aa, Felis catus
PQASVSFKDITVEFTQEEWRQMDSAQRTLYRDVMLENYSHLVSVEEYQPNQLSEKSLENQGKYLWQVLFTNRSLTTEEEFS

SEQ ID NO: 19669 - protein, 81 aa, Felis catus
VEDVAIEFSQEEWGCLNHSQRELYRDVMLETYGHLLFLGLVSKPDLVIVLEQKKELWGVKRKETVASHPAVSSQCTQNFLP

SEQ ID NO: 19670 - protein, 81 aa, Felis catus
MFSISMKDCIWPLKLRFLCSSKALKPMGLAQLPCRFPFTGCCVPKPDVIFRLEQGQQPWLIEEESLDQSCPEVCKVDNQLE

SEQ ID NO: 19671 - protein, 81 aa, Neomonachus schauinslandi
CEGSVSFEDVTMDFSREEWQQLDPAQRCLYWDVMLEIYSHLLSVGYHIPNPEIISRMEKGEKSWVRGAQLPHQRHREGVFG

SEQ ID NO: 19672 - protein, 81 aa, Neomonachus schauinslandi
QGTVTFEDVAVYFSWEEWGLLDEAQRCLYHDVMLENLALITSLGKHHKQQIEEKHFRSNMGRASLLEKCKFHMSEKPFTYE

SEQ ID NO: 19673 - protein, 81 aa, Neomonachus schauinslandi
MDAVVFADVAVDFTPEEWALLDRGQRRLYRDVMLETCRNLASLDCCIQVKPCGSGTQLNILENELSSEDKIVRFTRNDSWA

SEQ ID NO: 19674 - protein, 81 aa, Monodelphis domestica
TEEVLTFKDVAVDFTREEWHLLSPLKKELYKEVMLENTRNLLSMGLLAHPEALLFYLEQREAPQMLEEEDLRSCCPGGEIR

SEQ ID NO: 19675 - protein, 81 aa, Monodelphis domestica
CQETVTFQDVAVEFTWEEWGHLNPSQKKLYSDVMLENYKNLVSLESKEHPEEKPYKCSKCGKAFKNKTQLIMHQRIHSGKI

SEQ ID NO: 19676 - protein, 81 aa, Monodelphis domestica
AQEAVMFKDVAVDFTREEWRLLSPPQKLLYKEVMLENARNLLSVGLPGPPEDVISSLEQREAPWILEQEGLRSCCPGEIIP

SEQ ID NO: 19677 - protein, 81 aa, Monodelphis domestica
LVTFKDVAVDFTQEEWRLLDHSQKELYREVMLENAWNLHSVDGETRLEMWPTTAKLSSSVKESEQQRLMTGGHFNLNLGEI

SEQ ID NO: 19678 - protein, 81 aa, Monodelphis domestica
TAQVVTFKDVAVEFTKEEWCLLSPPQKLLYKEVMLENAQNLLSIGLPVPSEDILSYLEQREAPWMLEQEGLRCFCPGEIIP

SEQ ID NO: 19679 - protein, 81 aa, Aotus trivirgatus
TQVRLTFRDVAVEFSQEEWKCLEPTQRALYRDVMLENYWSLVSLGLCHFDMNIISMLEEGKEPWTVKSCMKIARKPRMRQC

SEQ ID NO: 19680 - protein, 81 aa, Aotus trivirgatus
PVTFRDVTVIFTEAEWKRLSPEQRNLYKEVRITGIFSHWAWQQNILCPKTREKSPAALLRTVGKSSKMLPHIDYRMRCILQ

SEQ ID NO: 19681 - protein, 81 aa, Aotus trivirgatus
FQVSVTFEDVAVTFTQEEWGQLDATQRTLYQEVMLEICGLLVSLGCPLSKPELIYQLDHRQELWMAKKDLSQSSYPGDSTK

SEQ ID NO: 19682 - protein, 81 aa, Aotus trivirgatus
IQGQVNFEDVFVYFSQEEWVLLDEAQRLLYRDVMLENFALMASLGHTSFTSHTVASLVMGPDWVDVTPAVATGTLSGSGPG

SEQ ID NO: 19683 - protein, 81 aa, Papio anubis
MELLTFRDVTIEFSLEEWEFLKPAQQNLYRKVTLENYRNLVSLGLTVSKPELISCLEQRQEPWNVKRHETIAKPSAVSSSH

SEQ ID NO: 19684 - protein, 81 aa, Papio anubis
PQETLTFRDVAIEFSLEEWECLNPAQQNLYMNVMLENYKNLVFLAGIAVSKQDPVTCLEQEKEPWNMKRHEMVDEPPAMCS

SEQ ID NO: 19685 - protein, 81 aa, Aotus trivirgatus
MFENYSNLVSLGYTIPKPDVITLLEQEKEPWIVMREGTRSWYTDLEYKYITKNLLPEKNVCKTYLSQLQTGEKSKNTIHED

SEQ ID NO: 19686 - protein, 81 aa, Aotus trivirgatus
TVTFKDVAIDFTQEEWKRLDPAQRNLYRNVMLENYNNLITVGEIWGIDEHQKSQDRLLRQVEEKFQKTVTEEKGNECYKKF

SEQ ID NO: 19687 - protein, 81 aa, Aotus trivirgatus
MLENYRNLVFLGIAVCKPDLITWLEQGKEPWNMKRHAMVAKPPVICSHFAQDLWPEESIKDSFQKGILRTYGKYGHESLQL

SEQ ID NO: 19688 - protein, 81 aa, Aotus trivirgatus
SYEGSVSFRDVAINFSREEWRHLDLSQRNLYRDVMLETYSHLLSVGYQFPKPEVVMLEQGKEPWTLQGERPRHSCPGEKLW

SEQ ID NO: 19689 - protein, 81 aa, Pan troglodytes
GQVNFEDVFVYFSQEEWVLLDEAQRLLYRDVMLENFALMASLGCWHGMEDEEIPFEPSFSIGMSQIRIPKGGPSTQKAYPC

SEQ ID NO: 19690 - protein, 81 aa, Pan troglodytes
TQGHLTFRDVAIEFSQEEWKCLDPVQKALYRDVMLENYRNLVSLGICLPDLSIISMMKQRTEPWAVENEMKVAKNPDRWEG

SEQ ID NO: 19691 - protein, 81 aa, Pan troglodytes
MLDNFSSVAALGFCSPRPDLVSRLEQWEEPWVEDRERPELQAVRRGPRPGARKSADPKRHCDHPAWAHKKTHVRRERAREG

SEQ ID NO: 19692 - protein, 81 aa, Myotis davidii
MDFEDVAIAFSEEEWGLLDEAQRLLYCDVMLEVFALVSSVGCWHKMDDAEACSEESLSVQGESQVRASKTEPATQRTHLCK

SEQ ID NO: 19693 - protein, 81 aa, Myotis davidii
RNDSVAFEDVAVNFTQEEWALLNPSQKKLHRDVMRETFRNVAFLGKKWEDDDIEENEGRKQKSLMLEKLGEGENGSQCGEN

SEQ ID NO: 19694 - protein, 81 aa, Myotis davidii
QELPLVFEEVAVYFTREEWGVLGQPQKELYRDVMRVNYELLASLGPVATKPDLISKLEHRAAPWIKDPKGAKWGKGRFPGK

SEQ ID NO: 19695 - protein, 81 aa, Myotis davidii
AQGRVVFEDVAVRFSREEWGLLDEAQRCLYHNVMLENVALLCSVGSWHGARGEETPLEQGGSVGESQVRTPKPDPSTHKAR

SEQ ID NO: 19696 - protein, 81 aa, Cercocebus atys
AAVSVTFKHVTMTFTQKEWKQLDPAQRNVYHDVMLENYSNQASVGYQAPKPDLISKLEKGEAPWLGKGKRPSQGCPSKIAR

SEQ ID NO: 19697 - protein, 81 aa, Cercocebus atys
RPRALKFVDVAVYFSPEEWGCLRPAQRALYRDVMRETYGHLGALGVGGSKPALISWVEEEAELWDPAARDPEVTKCPTETD

SEQ ID NO: 19698 - protein, 81 aa, Cercocebus atys
GEACMGGDVTFSDVAIDFSHEEDLYKDVMVQNYKNLVSVTGLSVTKPYVITLLEDGREPWMVEKKLSFDWESRWENKELST

SEQ ID NO: 19699 - protein, 81 aa, Cercocebus atys
SQESVAFEDVAVYFTTKEWAIMVPAERALYRDVMLENYEAVAFVVPPTSKPALISHLEQGKESCFIRPQGVLSRSDWRAGL

SEQ ID NO: 19700 - protein, 81 aa, Leptonychotes weddellii
MLENYGHLLFLGLIVSKPDLVIYLEQKKEPWDVKRKKTVAIHRAISSHDIQSFMPKPSIEASFQKVSMGRHKNSDIEDLHL

SEQ ID NO: 19701 - protein, 81 aa, Leptonychotes weddellii
PCRLVLFKDVAVDFSQEEWECLDLEQKDLYRDVMLENYSNLVSLAGFSISKADVLSLLKQGKETWKVVQDVTRSQSSDWES

SEQ ID NO: 19702 - protein, 81 aa, Leptonychotes weddellii
PKVPVTFDDVAVYFSEPEWGKLDNWQKELYKHVMQGNYETLVSLDYAISKPDILTRMERGEEPCPEGPWGQEEGSKREAAR

SEQ ID NO: 19703 - protein, 81 aa, Leptonychotes weddellii
MLENIRHLVSLGYQHCKSDVIFPLEQGEELWREGTGFLQGQSPGRESALKEQELIATQHISRKDTSTIMPVQKSHTPEDPF

SEQ ID NO: 19704 - protein, 81 aa, Neomonachus schauinslandi
MAQESVVFSDVSIDFSQEEWECLNDDQRDLYRDVMLENYSHLVSMDVISFLEQGKEPWLVDRELTREQWPVLESRCETKKL

SEQ ID NO: 19705 - protein, 81 aa, Neomonachus schauinslandi
MDHELVTFRDVVINFSQEEWEYLDSAQRDLYWDVMMENYSNLVSLDLESKYDTKTRKDITGSQWKVTESKFIGLESSIFRN

SEQ ID NO: 19706 - protein, 81 aa, Neomonachus schauinslandi
GLEVVTFEDVAVYFTRTEWAGLSPAQRALYREVMLTNHGNLTSLGYPVCRLALTSLLEGGDLPWGLEPQDDLPAGNTSDVS

SEQ ID NO: 19707 - protein, 81 aa, Neomonachus schauinslandi
MGPIQRTLYRDVMLENYNNLVSVGNCIFKPAVIFKLEQGEEPWFLEEEISNQSHREDYRDDDLMKRNKKIQDKHLQEIIFI

SEQ ID NO: 19708 - protein, 81 aa, Neomonachus schauinslandi
QPREAVTFKDVEVTFSQDEWGWLDPAQRNLYRDVMLENYGNVVSLVGPFTKPVLISWLEAREPWGLNVQGAQPKGKPGVAP

SEQ ID NO: 19709 - protein, 81 aa, Neomonachus schauinslandi
VSRSFENDGVCFSEQEWENLEDWQKELYRNVMKSNYETLVSLKVLGQTEGEAELGAGMLGDLEEEGPGDVHPAEGVMIKQE

SEQ ID NO: 19710 - protein, 81 aa, Monodelphis domestica
AQEMVTFQDVAVDFTQEEWRLLEPPQKELYREVMLDNARNLLSLGLPVPREDLISYLEQREAPWMLGQEGLRSCCAEGKIR

SEQ ID NO: 19711 - protein, 81 aa, Monodelphis domestica
TTRGSVTFRDVAVDFSPDEWGRLGPAQRELYREVMLENYRSLAWLGEARRPPVVCQLERGAGPWLLEGDGLASGGPEAGES

SEQ ID NO: 19712 - protein, 81 aa, Monodelphis domestica
FQQLMAFEDVAVVFTQEEWGQLDSVQRELYRDVMLENYENFLSLGFPVPKPDIISQLERRKEAWIQDIQGPEEREFIQNAY

SEQ ID NO: 19713 - protein, 81 aa, Monodelphis domestica
AQVLVTFQDVAVDFTQEEWRLLDPGQKELYKEVMLENAENMLFLGLPVPREDWFFHFHEGGDPWMLEGKGPSISRLDEERH

SEQ ID NO: 19714 - protein, 81 aa, Monodelphis domestica
FQKSLTFKDVAVDFTQEEWQQLNSDQRYLYRDVMLENYRNLVSLGHQFSKPNVISQLEQGEEPWIVEKEVSAHSFLEWETR

SEQ ID NO: 19715 - protein, 81 aa, Monodelphis domestica
AGLTFADVTVSFSWEEWRHLEPRQKELYRDVLWESYGHLGALGLTRNNLKKKENGGLSKRKGAKGGAARRKGREFRETGIP

SEQ ID NO: 19716 - protein, 81 aa, Monodelphis domestica
CRESVTFKDVAVEFTWEEWIYLNPSQKKLYKDVMLENYRNLISLGFALSKPDVIYHLERKEASWMPEADVPRSSCSESKEF

SEQ ID NO: 19717 - protein, 81 aa, Monodelphis domestica
SQKSLTFKDMAVEFSQEEWEQLDPAQRNLYRDVMLERYRNLVLLGLPISKPDVISQLERGKEPWLLEREDSKGGCLDWGIR

SEQ ID NO: 19718 - protein, 81 aa, Camelus dromedarius
FQMPVTYEDVAVTFTREEWGHLDPAQKTLYQEVMLETCGLLASLGCSLPKPELVYPLEHSPGSRTSKTGLSPGLCAALLYR

SEQ ID NO: 19719 - protein, 81 aa, Camelus dromedarius
FQESVTFKDVIVDFTREEWKQLDPVQRDLFRDVTLENYTHLVSIAGLQVSKPDVISQLEQGTEPWIVEPSIPVGTFGGFIP

SEQ ID NO: 19720 - protein, 81 aa, Camelus dromedarius
DSVVLEDVAVAFSPEEWALLDVAQRSLYRDVMLETFRNLASIGEGHRSFTSSAERKYPQAAERVSGLGLNGGNLLLRKADR

SEQ ID NO: 19721 - protein, 81 aa, Cercocebus atys
MGSSVTFEDVAVNFSLEEWSLLNEAQRCLYHDVMLETLTLISSLGGVPPHRLPPTGACGPQVPSSRIRPSPGHCPRPSLYL

SEQ ID NO: 19722 - protein, 81 aa, Cercocebus atys
GLLTFRDVAIEFSQEEWKCLDPAQRTLYRNVMLENYRNLVSLGIFSKYEIKELPTKKESNTGEIFQTVMLERHESHDIEDF

SEQ ID NO: 19723 - protein, 81 aa, Cercocebus atys
MELLTFRDVTIEFSLEEWEFLKPAQQNLYRKVTLENYRNLVSLGLTVSKPELISCLEQRQEPWKVKRHETIAKPSDYSLTI

SEQ ID NO: 19724 - protein, 81 aa, Leptonychotes weddellii
SQPPVSFKDVAVTFTQEEWGQLDLAQRRLYRNVTLETCSHLVSLGLLLSKPDVISWLEQGQDPWRAGQGPPRASSIWMGAK

SEQ ID NO: 19725 - protein, 81 aa, Felis catus
YVGLPSQGSVTFRDVAVAFSQQKWESLNSAQRDLYRDVMLENCSNLVSLGHSLSKPHVLTLSEWKEPWMIVREDQRGPRTG

SEQ ID NO: 19726 - protein, 81 aa, Neomonachus schauinslandi
LQVSVSFEDVTVDFSREEWLHLDPAQRRLYRDVTLENYSHLRSVGYEVPKPEVIFKLEQGEEPWILERKTPHQSCSGEFGI

SEQ ID NO: 19727 - protein, 81 aa, Neomonachus schauinslandi
AREPVTYEDVAVDFTQEEWQHLDPAQKTLHRDVMLEIYSHLVSVGCSGIKPGIILKLEHEEDPWIIKSELSRWIHSDREKS

SEQ ID NO: 19728 - protein, 81 aa, Monodelphis domestica
AHGVLTFKDVAMDFTQEEEHLLTPPQKELYREVMLQNTQNLLSVRLPAPLQDAVSYLEQREAQWMLEQEGLRSCCPEGEIT

SEQ ID NO: 19729 - protein, 81 aa, Monodelphis domestica
SQGSITFKDVTVDLTQEEWCLLDHSQKELYLEVMLEMVQNLLSVGLPVPREYCTSCFQQGKTPWLREQKDSCPEPNFEVKE

SEQ ID NO: 19730 - protein, 81 aa, Monodelphis domestica
AQESLTFEDVAVEFTQEEWGHLDSAQRNLFRDVMLENYRNLVSLGLTVTKPDLLFHLERGEAPWAPQRQVPGGGASDCPSW

SEQ ID NO: 19731 - protein, 81 aa, Physeter macrocephalus
PALGSVTFEDVAVYFSQEEWKLLDEAQRFLYRDVMLETFALVASLGLSSSRSHVVQLELRGEPRVHDRVDMTPDRARGAQI

SEQ ID NO: 19732 - protein, 81 aa, Monodelphis domestica
AQEVVTFKDVAVDFTQKEWRLLSPAQKELYKEVMLENAQNLLSMGLPGPPEDMISYLEQKEFPWMLEHEDLRSFCPEGEIR

SEQ ID NO: 19733 - protein, 81 aa, Physeter macrocephalus
SQGLVTFEDVAVYFSLEEWERLDADQRELYKEVMQENYGILVSLGYPIPKPDLIFRLEQGEEPWVPDGPRPEEGDIVTGVY

SEQ ID NO: 19734 - protein, 81 aa, Monodelphis domestica
AQEVVTFKDVAVDFTKEEWCLLTPPQKVLYKEVMLENARNLVSVGLAVSRGDVISYFEQREAPWMLEQEDLGIGCPDSEIR

SEQ ID NO: 19735 - protein, 81 aa, Monodelphis domestica
PKEAVTFKEVAVDFTWEEWRLLSPPQKELYKEVMLENAQNLLSVGLPGPPEDVISSLEQREAPWILEQESLRSCCPEGEIR

SEQ ID NO: 19736 - protein, 81 aa, Monodelphis domestica
QCVRTVPGRRPSSSEFCLFPRKNYQRERNGYCVPDNQSSGLPISKPDVIFKLEQGKEPWILNLQEAREREVPRNFSPGWES

SEQ ID NO: 19737 - protein, 81 aa, Physeter macrocephalus
AQGLVLFEDVSVDFTQKEWQLLDRTQRLLYRDVMLENYGHLVSLGHCVSKPELILKLEQEEEPWILKGQLASESHPEVQRT

SEQ ID NO: 19738 - protein, 81 aa, Monodelphis domestica
QEPVTFRDVAVDFSREEWQHLTPAQRGLYRAVMLENYEHLVSLGLSVHVSKLDLISLLERGGSLLGPAGGDPDNTCPVVCY

SEQ ID NO: 19739 - protein, 81 aa, Monodelphis domestica
WGELVAFKDMTVDFTPEEWGHLHPSQKELYRDMMLENYQNLVWMGLAVSKPDMIYQLEFIYALLIKTLPGKHYLLFKKLIY

SEQ ID NO: 19740 - protein, 81 aa, Monodelphis domestica
FWGSITFHDVAVDFTEEEWDLLDHSQKELYREVMLENVQNLLSMGLLVPGENFIPCFQQGEAPWLLEQKGPRNSCPETETN

SEQ ID NO: 19741 - protein, 81 aa, Monodelphis domestica
EIKESLTFKDVAVEFTWEEWRHLDPTQRALYRDVMLENYENLVSIGIPVSRPDLTFLLKRKDIWNQEEEVRTGISPDSLIE

SEQ ID NO: 19742 - protein, 81 aa, Physeter macrocephalus
MDFTPEEWGRLDPAQRDVMLENYRNLVSLWLPVSKPENHNLENGKEPLMLERRAPKSSCSDSETRPGSRDSTSVQDFSKEE

SEQ ID NO: 19743 - protein, 81 aa, Physeter macrocephalus
PQACVTFEDVAIYFSQEEWGLLDEAQRFLYHDVMLENFALTTSLDCQCGAEDEEIPSEQSVSGGESQVRTSQSFPSTQKTH

SEQ ID NO: 19744 - protein, 81 aa, Pan troglodytes
AQVSVTFDDVAVTFTQEEWGQLDLAQRTLYQEVMLENCGLLVSLGCPVPRPELICHLEHEQEPWTRKEDLSQGTCPGDKGK

SEQ ID NO: 19745 - protein, 81 aa, Pan troglodytes
VTLKDVGMDFTLGDWEQLGLEQGDTFWDTALDNCQDLFLLGEFPHGSPLWETFALALSDVTETKNSPLMEDFFEEGFSQEI

SEQ ID NO: 19746 - protein, 81 aa, Pan troglodytes
YQDSVTFEDTAVDFTQEEWTLLDPVQRNLYRDVMLENYENVAKVGFQLLKPSVISWLEEEELRTLQQGVLQDWAIKHQTSV

SEQ ID NO: 19747 - protein, 81 aa, Camelus dromedarius
ALGTVTFEEVAVYFSQDEWRLLDEAQRLLYRDVMLENFVLVASLGLASSRSHVVVQLELGGEPWVHGRVDMTPGTARGAQS

SEQ ID NO: 19748 - protein, 81 aa, Camelus dromedarius
SVTLEDVAVGLMQEWALLDDARRKLCRYVLLDNCRTLAPRGFDVHWLPRDNSSMDFTMQTQSGLPGGTERRAEGSGTRHSL

SEQ ID NO: 19749 - protein, 81 aa, Camelus dromedarius
AQGSVSFKDVTVDFSQEEWQHLDPAQKTLYMDVMLENYCHLISVGCHMTKPDVILKLERGEEPWTSCTGHTCLEESWKAED

SEQ ID NO: 19750 - protein, 81 aa, Camelus dromedarius
PKVPVTFDDVAVYFSEPEWGKLDEWQKELYKHVMRGNYEMLVSLDYAISKPDILTRMERGEEPCPEGPWGQEEGNEREEAC

SEQ ID NO: 19751 - protein, 81 aa, Camelus dromedarius
MAFRDVSVDFTQEEWRLLSPAQRTLYRDVMLENYRNLVSLGIPFSKPKLITQLEQGRETWKEERKGPPGPCPEEPVQPGSL

SEQ ID NO: 19752 - protein, 81 aa, Myotis davidii
MLENCRLLASLGCPVPRPELICQPEPGWELWMVKTDLSRGTCPGDKEKFKTTESTACEPALSERFSVQEQLTQKVPADFQG

SEQ ID NO: 19753 - protein, 81 aa, Myotis davidii
DMNFEDLAIAFSQEEWNLLDEDQRLLYCEEMLEVFALVSSVGCWHKMDEEEVPPEQRVSVGESQVGASKTAPATQKTYLCK

SEQ ID NO: 19754 - protein, 81 aa, Myotis davidii
RQEDMNFEDVAIAFSQEEWGLLDEDQRHLYCDVMLEVFALVSSVGCWHKTEKEDACSAESVSVQGESKFMASKTATATQRT

SEQ ID NO: 19755 - protein, 81 aa, Myotis davidii
SLTSVTLKDVAVTFTQDEWEQLDLAQRTLYREVMLEICRLLVSLGYPVPKSELVHLTEHRQELWIVKRGLSQSACAGAREK

SEQ ID NO: 19756 - protein, 81 aa, Myotis davidii
VQEPLTFHDVAVDFTWEEWQLLDPEQKDLYRDVMMETYGHLVSVGYEASKPDILSKLDHGEAPWTVAGEIHCVTRSGGGAE

SEQ ID NO: 19757 - protein, 81 aa, Cercocebus atys
MLFIFNKAGIDISKQDPITSLEQEKEPWNMKRHEMVDESPAMCSYFTKDLWPEQDIKDSFQQVILRRYGKCEHENLQLRKG

SEQ ID NO: 19758 - protein, 81 aa, Cercocebus atys
DGGLLTFRDVAIEFSQEEWKCLDPAQRTLYRDVMLENYRNLVSLDISSKCMMKTLSSTRQGNTEVIHKGTLQRQASHHIGE

SEQ ID NO: 19759 - protein, 81 aa, Felis catus
QVVTFEDVVVDFTQEEWGQLEPAQRTLYRDVMLETFRLLVSVGKATLDWDRSSLGRLKVEQMGGREGVGNTNVYSAGLPLG

SEQ ID NO: 19760 - protein, 81 aa, Physeter macrocephalus
LLTFRDVAIEFSQEEWEWLDPAQRALYKDVMLETYRNLLSLGEDNAPPEVGICPNISISFMTKELLKKKNINNRELYQPMV

SEQ ID NO: 19761 - protein, 81 aa, Monodelphis domestica
RLGSITFKDVVMDFTKEEWCLLDISEKELYKEVMLENVQNLLSVGLIVPKENFITCFQQGESPWLLKQKGQWSSCPEAETN

SEQ ID NO: 19762 - protein, 81 aa, Monodelphis domestica
QRELVTFKDVTVDFTQEEWGNLDTSQKELYRDVMLENYKNLVFLGLTVWKPDVISHLEEGEAPWMPDRELPKSNYSGWKTR

SEQ ID NO: 19763 - protein, 81 aa, Monodelphis domestica
VPKVPGTFENDGVYFSEQEWENLDDWQKELYRNVMKSNFETLVSLDCAISNPEILAHQEEESGTEELGDLAGVSPGGPHLA

SEQ ID NO: 19764 - protein, 81 aa, Monodelphis domestica
FQGLITFKDVAVNFNQEEWCLLDHSQKELYVEIILENVQNLLSVGLPVPREDFLTCFQQGEAWCLLEQKGPRSSYPETEIN

SEQ ID NO: 19765 - protein, 81 aa, Monodelphis domestica
VKEVVTLQDVAVDFTWEEWRLLSPPQKELYREVMLENAQNLLSVGLPAPLEDVLSYLEQRKGPWMLEQKRLRSCCPGEIRL

SEQ ID NO: 19766 - protein, 81 aa, Aotus trivirgatus
QDSVAFEDVAVNFTHEEWALLGPSQKNLYRDVMQETIRNLNCIGMKWENQNADDQYQNLRRNLRCDVVERFGKSKDGSQCG

SEQ ID NO: 19767 - protein, 81 aa, Aotus trivirgatus
EMETLTFRDVAIEFSLEEWQCLNPAQQNLYRNVMLENYRNLVFLAGIAVSKADLITCLQQGKDPWNMKRHSIVAKPPVLCS

SEQ ID NO: 19768 - protein, 81 aa, Aotus trivirgatus
EYTPVSFKDVVVGFTQEEWHRLNPTQRALYRDVMLETYSNLVSVGYEGTKPDVILRLEQEEAPWIGEAACLGCHCWGKCDK

SEQ ID NO: 19769 - protein, 81 aa, Aotus trivirgatus
MSQVTFSDVAIDFSHEEWGWLDSAQRDLYKDVMVQNYENLVSLGLSITKPYVITLLEDGKEPWMVEEKLSKGVTPDWDSRW

SEQ ID NO: 19770 - protein, 81 aa, Aotus trivirgatus
SQDSMTLEDIVVDFTREEWALLDTSQRKLFRDVMLENISHLVSIGNQFCKSVVFSHLEQVEKVSTQGISLLQGKEGDIKHQ

SEQ ID NO: 19771 - protein, 81 aa, Aotus trivirgatus
TIKEAVTFKDVAVVFTEEELELLDPAQRKLYRDIMLENFRNLLSIGNQPFHQDTFHFLRKKKFWMMKTTSQREGNLGGKIQ

SEQ ID NO: 19772 - protein, 81 aa, Papio anubis
AGRPLEMAVSEPEASAAEWKQLDPAQRNLYHDVMLENYSNQASMGYQAPKPDLISKLEKGEAPWLGKGKRPSQGCPSKIAR

SEQ ID NO: 19773 - protein, 81 aa, Sarcophilus harrisii
GWVPALFDEVAIYFSDEEWEVLTEQQKALYREVMRMNYETVLSLEFPFPKPDMISQLEAEESPWVPYPQNSEEWKLQGGSF

SEQ ID NO: 19774 - protein, 81 aa, Pan troglodytes
EMGLLTFRDIAIEFSLAEWQCLDLAQQNLYRDVMLENYRNLVSLGIAVSKPDLITCLEQNKEPQNIKRNEMVAKHPVTCSH

SEQ ID NO: 19775 - protein, 81 aa, Pan troglodytes
LELLDYTQKALYNDVMQENCKTVISLALFVLPKPKVISCLEQGEEPWVQVSPEFKDSAGKSPTGLKLKNDTENRQPVSLSD

SEQ ID NO: 19776 - protein, 81 aa, Camelus dromedarius
TVTFKDVAVVFTEEELALLDKAQINLYQDVMLENFQNLVSVGDRIKNNISNLQEKGLSYLSQEVLYFWQIWKQRISEFTVS

SEQ ID NO: 19777 - protein, 81 aa, Camelus dromedarius
MGPVSFKDVAVDFTQEEWQQLDSNEKTTYRDVMLENYSHLVSVGYDSTKPNVIVKLEQGEEPWTVAGELPRPAHPGTLVGA

SEQ ID NO: 19778 - protein, 81 aa, Myotis davidii
MDFEDVAVAFSEEEWGLLDEAQRLLYCDVMLEVFALLSSVGCWHETDEEACFEQSISIQGESQVRTSKTEPATQRAHLCER

SEQ ID NO: 19779 - protein, 81 aa, Myotis davidii
SQGLVSFKDVAVDFTQEEWQQLDPAQRTLYRDVMLENYSHLVSMGHPVSKPDVISKLEQGEDPWIIKRDISNWIYPDRKSN

SEQ ID NO: 19780 - protein, 81 aa, Cercocebus atys
FQEAVTFKDVAVVFSREELRLLDLTQRKLYRDVMVENFKNLVAVGHLPFQPDMVSQLEAEEKLWMMETETQKSSKHQNKME

SEQ ID NO: 19781 - protein, 81 aa, Cercocebus atys
TQGHLTFRDVAIEFSQEEWKCLDPVQKALYRDVMLENYRNLVSLGICLPDLSIISMMKQRTEPWTVENEMKVAKNAVRWEG

SEQ ID NO: 19782 - protein, 81 aa, Leptonychotes weddellii
MFPVTFSDVAIDFSHEEWGWLDSAQRDLYKDVMVQNYENLVSLAGLSIPKPYVISLLEDGKEPWMVEKKLSKDWESRWGNK

SEQ ID NO: 19783 - protein, 81 aa, Leptonychotes weddellii
LQEPVTFWDVAVDFTQEEWGQLGPAQRTLYRDVMLETFGHLLSVGPELPKPEVISQLEQGAELWAAERGIGQGYCPGEMLP

SEQ ID NO: 19784 - protein, 81 aa, Leptonychotes weddellii
QVSVAFQDLAVRFSEEEWQLLGEGQRTLYRDVMRENYETLRSLGTDELLPLSAFLSPTEPGGAMEGRNYAGEGQEPPRGGG

SEQ ID NO: 19785 - protein, 81 aa, Leptonychotes weddellii
SQGLLTFKDVSVDFTQEEWGQLAPAHRNLYREVMLENYGNLVSVGYQLSKPGVISQLEKGEEPWLIEREISGSPSSDLENK

SEQ ID NO: 19786 - protein, 81 aa, Neomonachus schauinslandi
SSQALLTFRDVAIEFSQEEWGCLNLVQRELYRDVMLENYGHLLFLGLIVSKPDLVSFLEQKKDPWDVKRKKTVAFHPGRWE

SEQ ID NO: 19787 - protein, 81 aa, Neomonachus schauinslandi
MTLFQISFEDVAVGFTSEEWQLLNPSQKSLYREVMLENYSNLVFLGYQIIKPDAIFKLEHEEPWIIDEEVLNQNFSEVWLD

SEQ ID NO: 19788 - protein, 81 aa, Neomonachus schauinslandi
LPDLVTFEDVAVEFTQEEWALLDPSQRTLYRDVMRENCRNLASLGDQVDKPGLVSELEQEDKVITEEIRILPGNCPDLETL

SEQ ID NO: 19789 - protein, 81 aa, Neomonachus schauinslandi
LQVSVSFEDVTVDFSREEWQHLDPAQRRLYRDVTLENYSHLHSVGYQVPKPEVIFKLEQGEGPWTLEGETPHQGCSDEAIG

SEQ ID NO: 19790 - protein, 81 aa, Monodelphis domestica
AQEVVTFKDVAVEFTQEEWCLLSPPQKELYKEVMLENVQNLHSVGLPAPPEDMTSYMEQRESSWMLEQEVLRSCCPGKIRR

SEQ ID NO: 19791 - protein, 81 aa, Monodelphis domestica
SVTFKDVAVDFTQEEWCLLDHSQKELYKEVVLENVQNLLFVEAETYFEVKEMSTKMRLFVEGSNSPRGMNKSPCDFFLRDS

SEQ ID NO: 19792 - protein, 81 aa, Monodelphis domestica
SIAFKDIVVDFTQEEWCLLDHSQKVLYLKVMLENVQNLLSVEAETNFEVKEMSTKLSLLVEESGPQGCMNEDPCDFILREI

SEQ ID NO: 19793 - protein, 81 aa, Monodelphis domestica
MQGSLTFKDVAVDFTQEEWCLLDHSQKELYLEVMLENVQNLLCVGLPVPREYFTSCFQQGKAPWLLEQKSLRSSCPEAETN

SEQ ID NO: 19794 - protein, 81 aa, Physeter macrocephalus
MESVVFEDVAVDFTPEEWALLDPAQRNLYRDVMLETFRNLASVGENWKCRSIEDQHKNQGTYLRWCVVEIPSENNESSQCG

SEQ ID NO: 19795 - protein, 81 aa, Monodelphis domestica
APQELVTFQDVAVDFTPEEWGCLALPQKELYREVMLENYGNLVCLGLEIKPDMIGRLERREAPWRPGREESGGSWADWETR

SEQ ID NO: 19796 - protein, 81 aa, Monodelphis domestica
FQASVTFKDVAVDFTWEEWRLLDPPQKELFWEVMLENYRNLVCLGLADSNKDVMISELESGEPHWIPTGGVLRSCWPGWES

SEQ ID NO: 19797 - protein, 81 aa, Physeter macrocephalus
GCVTFADVAVNFSAEEWGLLDEAQRCLYHDVMLEDLALTTSLGCWHAEEDGEALSEQSVSDQGSPQIRIVKAGLSPQKANL

SEQ ID NO: 19798 - protein, 81 aa, Monodelphis domestica
SQGSITFKDVAVDFSQEEWCLLDHSQKALYLEVMLENVQNLLSVGLPVPRENFISCFQQGKAPWLLEQKDTRNSCLEAETN

SEQ ID NO: 19799 - protein, 81 aa, Physeter macrocephalus
LQGTLTFRDVTVDFNLEEWQQLDATQRNLCRDVMLENYSHLVSVGFLMAQPVRIFRLGQGEEEARMAAGESPTRRCPGEPA

SEQ ID NO: 19800 - protein, 81 aa, Monodelphis domestica
SQGALTFKDVAVDFTQEEWCLLDHSQKELYLEVMLENVQNLLSVGLQVPRENFISSFHQGKAPWLLEQKGPKSSFPETETN

SEQ ID NO: 19801 - protein, 81 aa, Physeter macrocephalus
SQESVTFQDVAVDFTEKEWPLLDSSQRKLYKDVMLENYSNLASVGCQVGKPSLISHLEQEEELRTEEQELHQGPCPDWETP

SEQ ID NO: 19802 - protein, 81 aa, Monodelphis domestica
QGSITFKDVAVDFTQEEWRLLDPSQKELFREVMLENVQNLLSVDAETNFEAKEMSTKLNFFVEGSGFPRGMNKGPCDFLLR

SEQ ID NO: 19803 - protein, 81 aa, Monodelphis domestica
AQEAVTFKEVAVDFTWEEWRLLSPPQKELYKEVMLENAQNLLSVGLPGPPEDVISSLEQREAPWILEQEGLRSCCPGEIIP

SEQ ID NO: 19804 - protein, 81 aa, Monodelphis domestica
QEEVVTFQDVAVDFTGEEWRLLSPPQKELYKEVMLENARNLLSVGLPGPPEEVISSLEQKETPWILEQEDLRSCCSEMRPE

SEQ ID NO: 19805 - protein, 81 aa, Pan troglodytes
VTFEDVAVYLSREEWGRLGPAQRGLYRDVMLETYGNLVSLALGTRTEYKELTSQETFGEEDPQGSEPVEACDHIRKSEGSL

SEQ ID NO: 19806 - protein, 81 aa, Pan troglodytes
YQDTVTFDDVAVDFTQEEWTLLDPSQRDLYRDVMLENYENLASVGHHLFKPSVIYWLEQEEELRAGWRAVLQEWRLKTKGP

SEQ ID NO: 19807 - protein, 81 aa, Pan troglodytes
GFLVFKPELISRLEQGEEPWVLDLQGAEGTEAPRTSKTDSTIRTENEQACEDMDILESESYGTVVRISPQDFPQNPGFGDV

SEQ ID NO: 19808 - protein, 81 aa, Pan troglodytes
EKGPLTFRDVAIEFSLEEWQCLDSAQQSLYRKVMLENYRNLVFLGIALTKPDLITCLEQGKEPWNIKRHEMVAKPPVICSH

SEQ ID NO: 19809 - protein, 81 aa, Pan troglodytes
GTVTFEDVAVNFTWEEWNLLSEAQRCLYRDVTLENLALISSLGCWCGVEDEAAPSKQSIYIQRETQVRTPMTGVSPKKAHP

SEQ ID NO: 19810 - protein, 81 aa, Pan troglodytes
QDSVTFDDVAVEFTPEEWALLDTTEKCLYRDVMLENYVNLASVGKSNIILLEWEIQPRTKWSSLQLGFLRNPIFNRIQMQT

SEQ ID NO: 19811 - protein, 81 aa, Camelus dromedarius
QGSVTFEDVAVYFSWEEWDLLDEAQRCLYHNVMLENLALITSLALAYVTLLLKAFQERLQGFVVLIYSLDAVTSCRRYCIV

SEQ ID NO: 19812 - protein, 81 aa, Camelus dromedarius
GQESVSFKDVTVDFTWDEWLQLTGMQRTLYRDVMLENYSHLVSVGCCITKPEVIFKLEQGEEPWPREGELPGRRDPDRSQE

SEQ ID NO: 19813 - protein, 81 aa, Camelus dromedarius
AVSSLQNLVTFEDVAVRFCKEEWGLLDAAQRHLYHSVMLENLELVTSLGNEPPPRWWKALRDVQFGPGKMHVPHGHRKLCM

SEQ ID NO: 19814 - protein, 81 aa, Camelus dromedarius
FQGSVTFQDVAMDFTLEEWQLLGCAQRKLYWDVMLENFRNCISVGCPDTKTKVIFKVEQGQEPWMVEGENPRWRTPGESAK

SEQ ID NO: 19815 - protein, 81 aa, Myotis davidii
PQGSVSFKDVTVDFTQEEWQQLDTDQKALYRDVMLENYYHLISVGFHMTKPDMIRKLEEGKELWTTERIFSSQSYLEEDGK

SEQ ID NO: 19816 - protein, 81 aa, Cercocebus atys
HLKKKEKNIEFSQAEKKNKKTAQRALYKKKIKKNYRNLKKMILFLQTGKKIKKLNINSMLEKKKKNWSGESEVKKKKKTDG

SEQ ID NO: 19817 - protein, 81 aa, Felis catus
FQESVTFEDVAVYFSENEWIGLAPAQRVLYRDVMLENYGVVASLAFPFPKPALISQLERGEAPWCKAPQGAVDGECPRGVS

SEQ ID NO: 19818 - protein, 81 aa, Leptonychotes weddellii
AQVPLTFSDVAIDFSQEEWECLNSDQRDLYRDVMLENYTNLVSLDIDFTTETNKLSSEKSSYEVNSYHRETMKRSKTFNLT

SEQ ID NO: 19819 - protein, 81 aa, Leptonychotes weddellii
GWVPALFDEVAIYFSDEEWEVLTEQQKALYREVMRMNYETVLSLEFPFPKPDMITRLEGDEESQNSDEWQLQGGTFAENEE

SEQ ID NO: 19820 - protein, 81 aa, Felis catus
QSCVTFEDVAVYFSQEEWGLLDEAQRFLYHDVMLETFALATSLDCWCGAENEEVPSEQSVSVERVSQVRTSKTGSSIQKTH

SEQ ID NO: 19821 - protein, 81 aa, Felis catus
WSSHDGYIDFFQGLAVFKDVAIDFTQGEWNYLGAAQKDLSRDVMLENYHNLVSVGKDVYLQIIRYLPCGISASFHVDFWIV

SEQ ID NO: 19822 - protein, 81 aa, Neomonachus schauinslandi
AVTFKDVAVVFTEEELALLDKAQINLYQDVMLENFRNLVSVGDRIKNNISHLQGKGLSYRSQEVLYCWQIWKQRISELTVS

SEQ ID NO: 19823 - protein, 81 aa, Neomonachus schauinslandi
LFQGSLSFKDVAVVFTWEEWQLLDPVQKNLYQDVMLENYSSLVSVGYQVTKADAFYQLEHGTPWITEEEIQSQIHPAQRSH

SEQ ID NO: 19824 - protein, 81 aa, Monodelphis domestica
APVPVTFDDVTMYFTAQEWGILEEWQKELYKHVVMTNYETLFSLGYSIPKPDLITQIERGEEPFIRDQGPLKTLELAIGSS

SEQ ID NO: 19825 - protein, 81 aa, Physeter macrocephalus
ELALVSFEDVAVTFTGEEWRHLDLAQRTLYQEVMLETCGLLVSLGHPVPKPELIPLLEHGQELRTVKRGLSRSTCTGEKAK

SEQ ID NO: 19826 - protein, 81 aa, Monodelphis domestica
SKGSITFKEVAVDFNQEEWCLLDHSQKELYLEVMLDNVQNLLSVGFPVPREDFISCFQQGKAPWLLEQKGPRISCPEAETN

SEQ ID NO: 19827 - protein, 81 aa, Monodelphis domestica
ERQIQEPLTFQDVAVYFTQEEWCLLEPPQKELYKEVMLENALNLLSLGLPVPREDLISYLEQREAPWMLGQEEFPTAQQIC

SEQ ID NO: 19828 - protein, 81 aa, Monodelphis domestica
YQESVTFSDVAVDFTQEEWRYLGPSEKKLYRDVMLENYGHLVDLGLTVSKPDVICHLEQGEPLWRPENQVTRTSFPGTLHE

SEQ ID NO: 19829 - protein, 81 aa, Monodelphis domestica
SQGFITFKDVVVDFTQEEWCLLEHSQKELYREVMLENVQNLLSLGLLVPKEDFISSFQQGDGSWLLQQKDSKTKNKQKGSR

SEQ ID NO: 19830 - protein, 81 aa, Vulpes vulpes
FQEAVTFKDVAVVFSEEELGLLDPTQRKLYRDVMLENFRNLVSLGHSSSKPDVISQLEREEKLCTKEFHTQGGGRNQKEME

SEQ ID NO: 19831 - protein, 81 aa, Otolemur garnettii
QGVLTFKDVAIEFSMEEWACLDPAQQHLYREVMLETYRNLVFLGLAVSKPDLITCLEQSKEPWKVKTQQTLLKPPALSNHS

SEQ ID NO: 19832 - protein, 81 aa, Otolemur garnettii
SCVTFEDVAIYFSQDEWDLLDEAQRLLYFNVMLENFALTASLGKALTPSSVSWSLSLLFTLKGSIWVAEVLQSAEWISPSS

SEQ ID NO: 19833 - protein, 81 aa, Otolemur garnettii
QGLVTFRDVAIEFSQEEWKCLEPAQRDLYRDVTLENFSNLVSLETGLSISKPDVISLLEQGKEPWMIANDMTGPWCSDLES

SEQ ID NO: 19834 - protein, 81 aa, Otolemur garnettii
QAPLTFRDVSIEFSMDEWAYLDPAQQNLYRDVMLETYRHLVFLETGLAVSKPDLITCLEQSKEPWKVKTQQTVVKHPVISN

SEQ ID NO: 19835 - protein, 81 aa, Vulpes vulpes
SQSLLTFEEVAMYFSQEEWELLDPTQKALYNDVMRENYETVISLALFVLPKPKVISYLEQEEEPWVQGPLEFKDNPGELPT

SEQ ID NO: 19836 - protein, 81 aa, Pongo abelii
AHGSVTFRDVAIDFSQEEWEFLDPAQRDLYRDVMWENYSNFISLGPSISKPDVITLLDEERKEPEMVVREGTRRYCPDLES

SEQ ID NO: 19837 - protein, 81 aa, Pongo abelii
THSLKKVTFEDVAIDFTQEDWAMMDTSRRKLYRNVMLENISHLVSLQISKYCITLLEQGKELWQEGREFLQDQNPDRESAL

SEQ ID NO: 19838 - protein, 81 aa, Pongo abelii
QGLLTFRDVAIEFSQEEWKCLDPAQRTLYRDVMLENYRNLVSLDISSKCTMKEFSSTAQGNREVFHAGTLQRHESHHIGDF

SEQ ID NO: 19839 - protein, 81 aa, Pan troglodytes
SSFKKRPLTFRDVAIEFSLEEWQCLNTAQQNLYRNVMLENYGNLVFLGIAVSKPDLITCLEKEKYPWNMKRHKMVDESPGR

SEQ ID NO: 19840 - protein, 81 aa, Pan troglodytes
MLETYSSLVSLGHCITKPEMIFKLEQGAEPWIVEETPNLRLSAVQIIDDLIERSHESHDRFFWQIVITNSNTSTQERVELG

SEQ ID NO: 19841 - protein, 81 aa, Pan troglodytes
KRKGKEPGMALPQGRLTFRDVAIEFSLAEWKFLNPAQRALYREVMLENYRNLEAVESHFVTQAGVQWCDPGSLQPLPPRFK

SEQ ID NO: 19842 - protein, 81 aa, Pan troglodytes
MVHSSISKPDVITLLEQEKEPWIVVSKETSRWYPDLESKYGPEKISPENDIFEINLPKHVIKQISKTLGLKAFYFRNDSEY

SEQ ID NO: 19843 - protein, 81 aa, Pan troglodytes
FQEPVTFEDVAVYFTQNEWASLHPMQRALHREVMLENYANVTSLSAFPFPKPDLIFQLEQGEAAWGPDPWTLAGGETLRGM

SEQ ID NO: 19844 - protein, 81 aa, Myotis davidii
TWGRVSFEDVVLYFSWEEWGLLDETQRCLYHDVMLENFALVTSLGCWYRAEAEAEAAAEEEEQEQEQEEEDEEEPSVQGVT

SEQ ID NO: 19845 - protein, 81 aa, Myotis davidii
PNALVTFQDVFVDFSPEELASLSAAQRRLHREVTLENYRNLVSLGYQFPRPDIITQLEEEESSAMEEDSNTKTGPDWETGP

SEQ ID NO: 19846 - protein, 81 aa, Cercocebus atys
GPLVMAETDPTQGRVVFEDVAIYFSQEEWGHLDEAQRLLYRDVMLENLALLSSLGKALTLAQCPLGCVVPFYPNAALRFPQ

SEQ ID NO: 19847 - protein, 81 aa, Cercocebus atys
VTFKDVAVTFTQEEWRQLDLTQRTLYREVMLETCGLLVSLGDRTQVHTREPTTYPPVLSERAFVRGSLTVESSTSSDSRLG

SEQ ID NO: 19848 - protein, 81 aa, Cercocebus atys
SQHLVTFEDVAVDFTQEEWTLLDQTQRDLYRDVMLENYKNLIILAGSELCKPSLMSGLEQMEELRTGVTGVLQERSNTVEK

SEQ ID NO: 19849 - protein, 81 aa, Cercocebus atys
MAKPIREEWRHLDPSQRNLYRDVMLETYSHLLSVGYQVPEAEVVMLEQGKEPWALQGERPRQSCPGEKLWDHNQCRKILTY

SEQ ID NO: 19850 - protein, 81 aa, Felis catus
TLESLTLEDVAVDFTQEEWRLLAPAQKDLYRDVMLENFRNLVSVGHQASKPDVLARLERGEEPWAIEEEVRSGTSPETGKV

SEQ ID NO: 19851 - protein, 81 aa, Leptonychotes weddellii
VKDSVTFKDVAIDFTLEEWRLMDPSQRNLHKDVMLENYRNLVSLGLAVSKPDMISHLEDGKGPWVVVREIARTPYPELETK

SEQ ID NO: 19852 - protein, 81 aa, Monodelphis domestica
TPVLVSFADVAVYFSPEEWGRLRPEQRALYRDVMRETYGHLGALGFPGPKPALISWMEEAAWDSEASFPEEPVIKRLEDVG

SEQ ID NO: 19853 - protein, 81 aa, Monodelphis domestica
PGQEVVTFKDMAVDFTREEWRLLTPPQKELYKEVMLENARNLLSVGFAVPGDVISYLEQREAPWLLEQEGLRSCSPGDISP

SEQ ID NO: 19854 - protein, 81 aa, Pan troglodytes
GPVSFKDVAVDFTQEEWQQLDPDEKIAYGDVMLENYSHLVSVGYDYHQAKHHHGVEVKEVEQGEEPWIMEGEFPCQHSPGK

SEQ ID NO: 19855 - protein, 81 aa, Pan troglodytes
SQHLVTFEDVAVDFTQEEWTLLDQAQRDLYRDVMLENYKNLIILGSELFKRSLMSGLEQMEELRTGVTGVLQELDLQLKTK

SEQ ID NO: 19856 - protein, 81 aa, Pan troglodytes
QDSVTFDDVAVEFTPEEWALLDTTQKYLYRDVMLENYMNLASVDFFFCLTSEWEIQPRTKRSSLQQGFLKNQIFSGIQMTR

SEQ ID NO: 19857 - protein, 81 aa, Pan troglodytes
GTVTFEDVAVKFTQEEWNLLSEAQRCLYRDVTLENLALMSSLGCWCGVEDEVAPSKQSIYIQRETQVRTPMASVSPKKAHP

SEQ ID NO: 19858 - protein, 81 aa, Pan troglodytes
VVFEDVDVNFTQEEWALLDPSQKNLYRDVMQETFRNLASVGKKWKDQKIEDEYKNPRRNLRGLMGERLLESKKDHQHGEIL

SEQ ID NO: 19859 - protein, 81 aa, Myotis davidii
CKRQVGVTFEDIALYFSREEWSLLDEGQRQLYLNVMLENFELISSLGKTLTVTSDLDLALRFPRAQPPMCALSSHVDCGTA

SEQ ID NO: 19860 - protein, 81 aa, Myotis davidii
SALGQLTFSDVAIEFSQEEWACLDPAQRKLFRDVMLQNYRNLVFLGVSKPDLLTFLEHMKEPWELKRKKKIPIQPGRWESR

SEQ ID NO: 19861 - protein, 81 aa, Cercocebus atys
FQASVSFKDVTVEFTQEEWQHMGPVERTLYRDVMLENYSHLVSVGYCHFKPEVIFKLEQGEEPWFSEEEFSNQSHPKDYRG

SEQ ID NO: 19862 - protein, 81 aa, Cercocebus atys
MLENYRNLVSLGIAVSKPDLITCLEQRNEPWNVKKLETIGRHPAVSSHFTQDLLPEHGIKDSFQKVILERYGSCGTENLDL

SEQ ID NO: 19863 - protein, 80 aa, Felis catus
LAVSFLGRLTFKDVAIEFSQEEWECLDPTQRALYRDVMLENYRNLVSLGEDNVCSEVGICPWVSLHFSLVCLLGAPALLA

SEQ ID NO: 19864 - protein, 81 aa, Felis catus
WLVTFRDVAIDFSQEEWECLNSTQRDLYRDVMLENYSNLISLDLESSCETKKSSPEKGAYEMESLQWENRRKPISHNFDYN

SEQ ID NO: 19865 - protein, 81 aa, Neomonachus schauinslandi
FQETVTFKDVAVVFSEEELGLLDSTQRKLYRDVMLENFRNLVSVGNQPFKPELIFQLEREEKLLMMETETQRDGKSQHIME

SEQ ID NO: 19866 - protein, 81 aa, Neomonachus schauinslandi
AQESLTFDDVAVDFTWEEWQLLAPAQKDLYRDVMLDNYRNLVSVGFHISKQDVLSKLDQREPTWTVEEDIPCQTHSETWKL

SEQ ID NO: 19867 - protein, 81 aa, Neomonachus schauinslandi
VTFEDVAVYFSWEEWGLLDEAQRLLYRDVMLENFSLMASLGKCCAHGAEVEEAPHEQSVYIEGVLKAKVQHQKLHCGEKPL

SEQ ID NO: 19868 - protein, 81 aa, Neomonachus schauinslandi
MDFSREEWQQLDPAQRCLYWDVMLEIYSHLLSVGYHIPNPEIISRMEKGEKSWVRGAQLPHQRHREGVFGLKTSQQKIFEK

SEQ ID NO: 19869 - protein, 81 aa, Neomonachus schauinslandi
GSVSFTDVTVDFTQEEWEQLDPSQRILYMDVMLENYSNLLSVEVWKADDQTERDHSNPDEQARPFIIFKNQTPIEERGNLF

SEQ ID NO: 19870 - protein, 81 aa, Neomonachus schauinslandi
QMGYVTFEDVAVSFSWEEWGLLDEAQRRLYLNVMLENLALVASLGCWHGAEDGKAPSEQAASIGVSQHQKVHTGERPYNCN

SEQ ID NO: 19871 - protein, 81 aa, Monodelphis domestica
APAPVSFRDVAVDFTRQEWQLLAPAQRALYREVMLENYRNVASLGHPVSKPNVIFQLEQSEAPWMPEGEAARSLPPDWEAR

SEQ ID NO: 19872 - protein, 81 aa, Monodelphis domestica
SITFKDVVVDFTQEEWCLLDPSQKELYREVMLENVQNLFFVEAETNFEVKEMSTKMRLFVEGSNSPRGMKRNPCDFLFREI

SEQ ID NO: 19873 - protein, 81 aa, Monodelphis domestica
IQGSLTFKDVAVDFTQDEWCLLDNSQKELYLEVMLENVQNLLSVGLPVPRKYCTSCFQQGNAPWLLEQKGPRTSCPEAEAN

SEQ ID NO: 19874 - protein, 81 aa, Bos indicus x Bos taurus
MLENYANVASLVSPFPRPDLISQLERGEAPWDPDPWEAEDLRGICPGGERGIKTEEPAVAQQASEGTEAHSRPVGGLLTNV

SEQ ID NO: 19875 - protein, 81 aa, Bos indicus x Bos taurus
MLENISHLVSVGNQLYKSDVISHLEQGEQLSREGLGFLQGQSPVISDREDDPKKQEMLSMQHICKKDAPLISAMQWSHTQE

SEQ ID NO: 19876 - protein, 81 aa, Bos indicus x Bos taurus
SLDAVTFTDVAVNFSQDEWEWLTLAQRTLYKKVMLENYSSLASLGLCISKPDVISLLEQDKEPWMMKGELTRALCPDLEYV

SEQ ID NO: 19877 - protein, 81 aa, Bos indicus x Bos taurus
MLENYSHLVSVGYLVAQPHGIFRLGQGEEEARIAAGESVIWSCPEFWKVNDQTDNHKESQDKLLWQAASINKETLKDKSGQ

SEQ ID NO: 19878 - protein, 81 aa, Bos indicus x Bos taurus
SLGPVTFEDVAVYFSQEEWRLIDEVQRLLYHDVMLENFALVASLGCWHAAEDEQTPSEQNVSVEVPQRNTKKTDLSSQKVC

SEQ ID NO: 19879 - protein, 81 aa, Pan troglodytes
ALRSVMFSDVSIDFSPEEWEYLDLEQKDLYRDVMLENYSNLVSLAGCFISKPDVISSLEQGKEPWKVVRKGRRQYPDLETK

SEQ ID NO: 19880 - protein, 81 aa, Myotis davidii
MNFEDVAVAFSQEESGLLDEVQRHLYCDVMLEVFALVASVGCCHKMDNEEAYSDQSVSVQGESRVRASKTAPATQKSHSST

SEQ ID NO: 19881 - protein, 81 aa, Myotis davidii
VVFEDVALDFSQEEWALLDAAQRELYRDVMLETFRNLASVEDETQFRSNGSVSQQDLYVNKMSEEDKIAEFTRQSWASILG

SEQ ID NO: 19882 - protein, 81 aa, Myotis davidii
MDFEDVAIVFSQEEWGLLDEAQRHLYCDVMLEVFALVSSVGCWHQTDDEEACSEQSVSEQGESQVGASETEPATQRTHVCK

SEQ ID NO: 19883 - protein, 81 aa, Cercocebus atys
GCASVAFRDVAVDFTQEEWRLLSPAQRTLHRDVMLETYNHLVSLEIPSSKPKLIAQLERGEEPWREERKYSLDLCPESKPE

SEQ ID NO: 19884 - protein, 81 aa, Cercocebus atys
QGRLTFRDVAIEFSQEEWKCLDPAQRALYRDVMLENYRNLVSLDISSKCTMKEFSSTAQGNTEVIHRETMQRHERHHIGDF

SEQ ID NO: 19885 - protein, 81 aa, Neomonachus schauinslandi
LPDLVTFEDVAVEFTQEEWALLDPSQRTLYRDVMRENCRNLASLGYHIGKPSLISHLEQEDKVMTEERGILPGTCPDLETV

SEQ ID NO: 19886 - protein, 81 aa, Neomonachus schauinslandi
LQGSVTFPDVAVDFTPEEWQLLDCEQRTLYWDVMLENFRNLISVGGPVTQTKAIFKAEQGQEPWMGEGENPRWRHPEVICL

SEQ ID NO: 19887 - protein, 81 aa, Neomonachus schauinslandi
MAVTFEDVTVIFTWEEWKFLDSSQKKLYREVMWENYTNVMSVGNWKESYKLQEERFRYLEHENLPCWQAWKNASAQIYENR

SEQ ID NO: 19888 - protein, 81 aa, Neomonachus schauinslandi
HGSTPFSNVTVAFTQDGWRHLIPAPRGTPRFKEGIPENARNLVLLGLPVSQPGMNSQLEQREEGPWMLEGGGLRSTCPDWK

SEQ ID NO: 19889 - protein, 81 aa, Monodelphis domestica
SQEVVTFKDVAVDFTWEEWCLLAPPQKEMYKEVMLENAWNLLFVGLAVSREDVISYFEQREAAWMLEEIDLRNSCQEKEMK

SEQ ID NO: 19890 - protein, 81 aa, Monodelphis domestica
FQASMMFEDIAVYLTQEEWGLLEPAQRNLYRNVMMENYRNIVSLGFLVPKPDVISRLEQGEEPWVLDMQELEGTKTLRANP

SEQ ID NO: 19891 - protein, 81 aa, Physeter macrocephalus
FRGPVTFKDVTVEFTQEEWQLLDAAQRTLYREVMQENYRHLISVGYCVNKPNAVFKLKQGKQPWILEVEFPRRNYPEDLWN

SEQ ID NO: 19892 - protein, 81 aa, Monodelphis domestica
AQDLVTFQDVTVDFTQEEWSLLDQSQKELYMEVMLENAQNSLFLGLLVPRHSLISCFQQGESQWIRESKGPRNSCPEIKFN

SEQ ID NO: 19893 - protein, 81 aa, Pan troglodytes
MGLLIFRDVAIEFSPEEWSYLDPAQQNLYRDVMLENYRNLVSLGIAVSKPDLITCLEQRNEPWNVKKHETVARHPAVSSHF

SEQ ID NO: 19894 - protein, 81 aa, Pan troglodytes
QDTVAYEDLSEDYTQKKWKGLTLSQRALHWNMMLENDRSMASLGRNMMESSELTPKQEIFKGSESSNSTSGGLFGVVPGGT

SEQ ID NO: 19895 - protein, 81 aa, Camelus dromedarius
LDVGALAQANPCGCLKDPVDFEDVAVNFTAEEWALLDPAQRRLYRDVMLETFRNLASVGEAGVTPPPSLQGTDTLTVVLSY

SEQ ID NO: 19896 - protein, 81 aa, Myotis davidii
MSFEDVTIAFSQEEWGLLDAAERLLYCEVMLEICTLVASVGYWHKPAEEEAPCEQTVSVEAESQVGASEPAPAAEKTHSCE

SEQ ID NO: 19897 - protein, 81 aa, Cercocebus atys
MLENYGNVASLGFPLLKPAVISQLEGGDELGGPSPLAAGTGLWGLRTGKEVDIQTDNDLTKEMYEGKEKVSFELQRDFSQE

SEQ ID NO: 19898 - protein, 81 aa, Cercocebus atys
TQGCVTFEDIAIYFSQEEWGLLDEAQRRLYLEVMLENFALVASLGCSHGTEDEETPSEQNVSVRVSQSKAGSSTQKTQSCE

SEQ ID NO: 19899 - protein, 81 aa, Cercocebus atys
LYEAVTFKDVAVVFTEEELELLDPAQRKLYQDVMLENFRNLLSVGKIQTEMETVPEAGTHEEFSCKQIWEQIASDLTRSQD

SEQ ID NO: 19900 - protein, 81 aa, Cercocebus atys
EKGPLTFRDVAIEFSLEEWQCLDTAQQDLYRKVMLENYRNLVFLGIAVSNPDLITCLEQGKEPWNMKKHVMADEPPVIYSH

SEQ ID NO: 19901 - protein, 81 aa, Cercocebus atys
VAFEDVDVNFTQDEWALLDPSQKNLYRDVMQETFRNLASVGKKWKDQKIEDEYKNPRRNLRGLMGERLLESKKDHQHGEVL

SEQ ID NO: 19902 - protein, 81 aa, Leptonychotes weddellii
QGSVTFRDVAIDFSQEEWEWLQPAQRDLYRHVMLENYGHLVSLGKLLSLFVLSLIEKARSGFTLVNTGRKKKFALFFLFSE

SEQ ID NO: 19903 - protein, 81 aa, Leptonychotes weddellii
LLTFRDVAIEFSQEEWECLDPAQRALYKDVMLENYRNLVSLDISVRSMIKELSPKEDINKEELFQTLMLERHKRNDIKDLG

SEQ ID NO: 19904 - protein, 81 aa, Leptonychotes weddellii
LLTFEDVAVSFSEEEWKLLDPTQKILYNDVMQENYETVISLGLKLKNDTGNDQPISLSALEIQASGCKVLRKARMKVAQKT

SEQ ID NO: 19905 - protein, 81 aa, Felis catus
MLENYHNFVSLGFLINKPEVIFRLEEGEEPWIVKEEFLYQNHPEDNKAHYLTERIQENQDKYLPQVAFKNKTLASEKVHAL

SEQ ID NO: 19906 - protein, 81 aa, Felis catus
GSVSFTDVTVDFTQEEWEQLDPSQRILYMDVMLENYSNLLSVEVWKADDQMEQDPSNPDEQARPFIIFKNQTPIEERGNLF

SEQ ID NO: 19907 - protein, 81 aa, Neomonachus schauinslandi
SHVVFEDVAIYFSQEEWGLLDEAQRFLYHAVMLENFALLSSLGCWHGAQDEEAPSEQDVSVGESQVRTPKPGPSIRKSQLW

SEQ ID NO: 19908 - protein, 81 aa, Monodelphis domestica
QRELVTFKDVTVDFTQEEWGNLDTSQKELYRDVMLENYKNLVFLGLTVWKPDVISHLEEGETPWIQDPEVPWSTCPDWDTG

SEQ ID NO: 19909 - protein, 81 aa, Monodelphis domestica
QESVMFEDMAMYLTPEEWGQADPTQRTLYRDMMLESYRNDISLDDESETENMESLSNLEASDNAESGEKLSSEFPVALPQG

SEQ ID NO: 19910 - protein, 81 aa, Monodelphis domestica
SRKSMSFKDVSVDFTQGEWGQLDPSQRDLYRDVMLENYRNLVSLELQVIKPEVISRLERGEAPCMLEREGLIGSCPDNDTR

SEQ ID NO: 19911 - protein, 81 aa, Physeter macrocephalus
DPAQVPMVAAFMVPGQGHVIFEDVAVSFSQEEWGLLNDAQRLLYCDVMLENLSLIASLDAGKASLLREQIHIWAFASIPHL

SEQ ID NO: 19912 - protein, 81 aa, Monodelphis domestica
SQGSITLRDVVMDFTQEEWCLLDHAQKELYREVMLENVWNLQSVGLTVPRENFVTCFQQWESPWLLGQKEQRSSCLEAETN

SEQ ID NO: 19913 - protein, 81 aa, Monodelphis domestica
SRAPVTFKDVAVDFTQDEWGQLDPSQRSLYRDVMLENYENLVSLGLPVSKPDVISQLERGRGPWRLAGDFPRALRADSFIQ

SEQ ID NO: 19914 - protein, 81 aa, Monodelphis domestica
MLENVQNLLAVGLPVPRENFISCFQQGEAPWLLKQECARSSCPEADTNFEVKEMSKKPNHFVEGCDPQRFMTEFPWDFILK

SEQ ID NO: 19915 - protein, 81 aa, Monodelphis domestica
ASQGSITFQDVTVAFTQEEWRLLQPSQKELYREVMLEISQSLLSVGLPVAREDLIYFQEGKAPWILEQKGPRNSYSDAVTR

SEQ ID NO: 19916 - protein, 81 aa, Physeter macrocephalus
QGSVTFEDVAVYFSWEEWCLLDEVQIHLYLDVMLENFALVCMLGSWHRVEDEETPSEQSVSPEGVSQIRTPSAGSSPEKAQ

SEQ ID NO: 19917 - protein, 81 aa, Monodelphis domestica
AQEAVTFQDVAVEFTWEEWCLLSPPQKELYKEVMLENTRNLHSVGLPAPPEDMISYMEQREFSWMLEQDGLSSCCPEGKIR

SEQ ID NO: 19918 - protein, 81 aa, Physeter macrocephalus
PGVPSLSLLPARAVGPQGRGEDVVRTESGAEMDSVVFEDVAVNFTAEEWALLDPAQRKLYRDVMLETFRNLASVDTETTTR

SEQ ID NO: 19919 - protein, 81 aa, Monodelphis domestica
ALQESLTFRDVAVLFTWDEWRRLGPAQRSLYREVMLETFEHLVALGEAQHPPRGDLGREGESAWGGGSQEPGKVSAHPGGV

SEQ ID NO: 19920 - protein, 81 aa, Monodelphis domestica
KCLPFLKRNVAVSLTLEERVQLDLHQKDLYRNVMLENYENSVLLGLSFPKPAIISHMEQRKDLWLLDIPGAEKRESWENSS

SEQ ID NO: 19921 - protein, 81 aa, Monodelphis domestica
SQGSITFKDVAVNFTQEEWCLLDHSQKELYREVMLENVQNLLSMELPVHREDFISCFQQKESLWLLEHKGPKSSCPEAEAN

SEQ ID NO: 19922 - protein, 81 aa, Monodelphis domestica
QGSITFKDVAVDFTQEEWRLLDHSQKELYREVMLENVQNLLSVEAETYFEMKEMSTKLSLFVEGSGPPRGMNRSTCNFILR

SEQ ID NO: 19923 - protein, 81 aa, Pan troglodytes
KKKPVTFEDVAVNFTQEEWDCLDASQRVLYQDVMSETFKNLISVARIFLHKPELITKLEQEEEQWREFVHLPNTEGLSEGK

SEQ ID NO: 19924 - protein, 81 aa, Camelus dromedarius
WLTFKDVAIEFSPEEWECLDPAQRTLYRDVMLETYRNLISVDTAPKCVIKEPPPKESHNTGETLHTASLESQEHRATQEDG

SEQ ID NO: 19925 - protein, 81 aa, Camelus dromedarius
CEESVTFKDVAVDFTQEEWGQLDSPQRALYRDVMLENYQNLLALGPPVCKPDVISHLERGEEPWRVPREVPGGVRPERGPR

SEQ ID NO: 19926 - protein, 81 aa, Myotis davidii
GLLTFEDVAVFFTQEEWDYLDPAQRSLYKDVMMENYGNLVSLDVLNRDKDEEPTVKQEIEEIEEEMESKGIIVTRIKSETD

SEQ ID NO: 19927 - protein, 81 aa, Myotis davidii
MDFTLEGWEQLGLDQGDLFWDTALDNYQNLFLLNPLRPNQAAAAAAAAAAAAREILERGSPEVTGPDTAEAKISPLPQEFS

SEQ ID NO: 19928 - protein, 81 aa, Cercocebus atys
MGPLTFTDVAIEFSLEEWQCLDTAQQNLYRNVMLENYRNLVFLVICSHFAEDFWPEQDIKDSFKKVTLRRYDKCGPENLQL

SEQ ID NO: 19929 - protein, 81 aa, Cercocebus atys
KRNVPLQEIMTFNRTWFGVQQLDSAQRTSTRMFMPENYSHLGVCGYLVAKPDFDDSLHFLLEVWQIDEQTDHYKESQDKLL

SEQ ID NO: 19930 - protein, 81 aa, Felis catus
MSERYHFLPFSGYQVPRPALISLLEAGNLPWGLEAQDNLSAERTKDICEDTETNINSESTSTQGISEERDVMLSHGLQKSV

SEQ ID NO: 19931 - protein, 81 aa, Felis catus
LQGCVISEDVFVYFSWEEWMLLDDSQRLLYQDVMLENFALLASLGIAPSTSRLVTQPKQREDPWVPDQVDVTPATEREAPK

SEQ ID NO: 19932 - protein, 81 aa, Neomonachus schauinslandi
AQGFVTFRDVAIEFSQEEWKCLEPAQRDLYRDVTLENFSNLVSLGLSISKPDVISLLEQGREPWMITNDMTGPWYPELESR

SEQ ID NO: 19933 - protein, 81 aa, Neomonachus schauinslandi
VFEELPVVFEDVAVYFTREEWGMLVKRQKELYRDVMRMNYELLASLGKKKMVAIREADTQALAVESAVLPATSMETCSSYC

SEQ ID NO: 19934 - protein, 81 aa, Neomonachus schauinslandi
SSQALLTFRDVAIEFSQEEWGCLNHTQRELYRDVMLENYGHLLFLGLIVWKPDLVIFLEQEKQLWDVKRKETVAIHPGRWE

SEQ ID NO: 19935 - protein, 81 aa, Monodelphis domestica
SLESVTFQDVAVDFTHEEWGRLEPAQKDLYRDVMLENYQNFVSLDFFILKTSFKTKESVANKSISMGNLSKKKFSRNGFWN

SEQ ID NO: 19936 - protein, 81 aa, Monodelphis domestica
GARVLVSFADVAVYFSPEEWGRLRPEQRALYRDVMRETYGHLGALGFPGPKPALISWMEEAAWDSEAKPVIKRLEDVGQPP

SEQ ID NO: 19937 - protein, 81 aa, Monodelphis domestica
LQTSLMFKDVAVYLTREEWDCLGPAQRSLYRDVMLENYRNLVSLDCETKTKKTELSSIQKISEKMELQGIMLGRFKGPEFG

SEQ ID NO: 19938 - protein, 81 aa, Monodelphis domestica
SQGSITFKDVAVDFTQEEWHLLEPSQKEQYREVMLENAWNLHSVGLPVPREDILSSFQQGESPWLLEEKSPRNSCPGAHRG

SEQ ID NO: 19939 - protein, 81 aa, Physeter macrocephalus
MLENFRNLISMGCPVTKTKVIFKVEQGQEPWMMEGENARWHSPEVICLLDDELEGQEGEGSKDNFLNQGMFTFKKTLTNET

SEQ ID NO: 19940 - protein, 81 aa, Physeter macrocephalus
SVTFRDVTVDFTQEEWQQLEPAQKDLYRDVMLENLQNLVSLDLEMRPEMKEPDLKEEISEDRPSGAWGTAVDGARTQGDRV

SEQ ID NO: 19941 - protein, 81 aa, Physeter macrocephalus
VTFRDVAVFFSRDEWLHLDSAQRTLYQEVMLENYSTLFSLGWESLFETTVSEEENQEVMNQLIGDGPFDFKLGEIYINEEK

SEQ ID NO: 19942 - protein, 81 aa, Physeter macrocephalus
AQVLVTFKDVAVTFTREEWGQLDLDQRTLYQEVMLEICGLLVSLGHPVPKPELIRLLEHGQELWMGMRGLPRSTCPGDRAK

SEQ ID NO: 19943 - protein, 81 aa, Monodelphis domestica
MQGSLSFKDVAVDFTQEEWCLLDHSQKEFYLEVMLENVQNLLSVGLPVPREYFTSCFQQGKAPLLLEQKGPRSCCPEAETN

SEQ ID NO: 19944 - protein, 81 aa, Monodelphis domestica
PQESVTFRDVAVSFSQEEWRELDAAQRDLYWDVMLENYENLVFLAGLPVPKPGALAHLERGGAPWMPDAQFPGGLFPDSLS

SEQ ID NO: 19945 - protein, 81 aa, Monodelphis domestica
PCQESVTFKDVAVDFTQEEWCLLDPSQKALYKDVMLETSQNLLSLGLPGAKADLISQLNQEEAWMLKEEDPRNSSLCGETR

SEQ ID NO: 19946 - protein, 81 aa, Monodelphis domestica
AKEAMTFKDVAVDFTREEWRLLSPPQKELYKEVMLENAQNLLSVGLPAPPEDVMSYLEQRKTPWMLEQESLRSCCPEREIR

SEQ ID NO: 19947 - protein, 81 aa, Physeter macrocephalus
DPEQVTFEDVVVEFTWEEWGQLEPAQRTLYRDVMLETFGLLASVGHWLPKPDVISLLEHEAELWVVDKGAPRGVCTDFETR

SEQ ID NO: 19948 - protein, 81 aa, Monodelphis domestica
MLENAWNLLSVGIMDQLRNRIGTNEDLLSRPVEEAETPQMKSSQGLTVAREDVISYFEQREVPWMLEQEDLRNCGPEGGIR

SEQ ID NO: 19949 - protein, 81 aa, Monodelphis domestica
RQERVTFGDVAVDFTLDEWVCLDSAQKALYRDVMLENYGHLVCLGLAGAKPAVIQRLERGEAAWCPGVPGSRLPDWETRLE

SEQ ID NO: 19950 - protein, 81 aa, Physeter macrocephalus
MLEIYGNLTSLGYPVPKPALVSLLERGELPWGLETRDDPPAQGTKDICKNARTNVDDELTPTWGVSEERDMMMSHGPQKNV

SEQ ID NO: 19951 - protein, 81 aa, Monodelphis domestica
GQEVVTFKDVAVDFTQEEWHLLSPDEKELYKEVMLENAQNLLSVGIPAAPEDMISYLEQRKALWMLEQEGLRSCCPEGENR

SEQ ID NO: 19952 - protein, 81 aa, Camelus dromedarius
SQAPVTFEDMAMYLTREEWRPLDPTQRDLYRDVMQENYGNVVSLDFEIRSDNEVNPKQEISEDVEFGTASERPVGNTEENP

SEQ ID NO: 19953 - protein, 81 aa, Camelus dromedarius
PKVPVTFDDVAVHFSEQEWGNLSEWQKELYKNVMRGNYESLVSMDYAISKPDLMSQMERGERPVMQEQEDSEEGETPADPS

SEQ ID NO: 19954 - protein, 81 aa, Camelus dromedarius
PLETVTFGDVVLDFTQEEWALLDTSQKKLFRDVMLENIHHLVSVGYQISKSDVILQLEQGKELWREGEGRPQGRGPGSESP

SEQ ID NO: 19955 - protein, 81 aa, Camelus dromedarius
VQESVTFRDVAVLFTQEEWAELSPAQRALHRDVMLETCSNLVSLGLLGPKPDTLSQLGRGEEWTLEDSLGGFCLELNSLWF

SEQ ID NO: 19956 - protein, 81 aa, Cercocebus atys
SVAFEDVAVTFTQEEWALLDPSQKTLYRDVMQETFRNLASVGKKWKAQNIYVEYENLKRNLRTFVGERLFESKEGHQHGEI

SEQ ID NO: 19957 - protein, 81 aa, Cercocebus atys
SLGSVTFTDVAIDFSQDEWEWLNLAQRSLYKKVMLENYRNLVSVGLCLSKPDVISLLEQEKDPWVVKGEMTRSLCPNLECV

SEQ ID NO: 19958 - protein, 81 aa, Cercocebus atys
YQDLLIFEDTAVDFTQEEWTLLDPVQRNLYRDVMLENYENVAKVGFQLLKPSVISWLEEEELRTLQQGVLQDWAMKHQTSV

SEQ ID NO: 19959 - protein, 81 aa, Cercocebus atys
QEPLSFKDVAVVFTEEELGLLDSTQRQLYRDVMLENFRNLLSVGERNPLGDKNGRDMEYIQDEELRLFSHEELSSCKIWEE

SEQ ID NO: 19960 - protein, 81 aa, Felis catus
NIRRLTFRDVAIEFSQEEWECLDPAQRALYKDVMLENYRNLVSVGEDNLPPEVGNYFLSVCCAFSIESPCFDHKSSNSLFL

SEQ ID NO: 19961 - protein, 81 aa, Leptonychotes weddellii
PQGSAAYQFLSVDYTERKWKGPALSQRAVYRSIVPENYCSMASLGETRMRRSELPAKQEVSKGSASSDGTSGGLCGVVSGE

SEQ ID NO: 19962 - protein, 81 aa, Neomonachus schauinslandi
LLQALLTFRDVAIEFSQEEWGCLNLVQRELYRDVMLENYGHLLFLGLILSKPDLIMFLEQEKQLWDVKRTETVAFHPGRWE

SEQ ID NO: 19963 - protein, 81 aa, Neomonachus schauinslandi
TQDSVVFEDVAVDFTQEEWALLDFAQRSLYRDVMLENFQNLASLGYPLHTPYLISRWKQEEDLETVERGPIQGEHQEGFEI

SEQ ID NO: 19964 - protein, 81 aa, Neomonachus schauinslandi
ALYRDVMVENYRNLVSLAISSKYVIKELPPKETSNTGEVLQTVILERHKSRDTDDYAFRAIQKNIPDFECQWGDGERNYKA

SEQ ID NO: 19965 - protein, 81 aa, Monodelphis domestica
LQESLTFRDVAVDFTQEEWRRLAPAQRALFRDVMLDNYENLVSLGLPASRLDVVSLLKRGQAPWRSEGGGWHDSLSWHSVF

SEQ ID NO: 19966 - protein, 81 aa, Monodelphis domestica
SQKRLTFKDVAVDFTQEEWKQLNVAQRELYRDVMLENYKNLVLLGLLVFQPDVIHQLENGEVPWIPEGELTRSPHSDSLVQ

SEQ ID NO: 19967 - protein, 81 aa, Monodelphis domestica
VKVSVTFDDVAVYFSKNEWKKLEWSQKELYKYVMRTNYETLVSLDYTIPKPDLICQIEQGKEPVFKNLANLETSVRIIQSG

SEQ ID NO: 19968 - protein, 81 aa, Physeter macrocephalus
AQGSVTFEDVAVYFSCEEWCLLDEVQIHLYLDVMLENFALVCMLGSWRGVDEETSSEENICVEGVSQIRTPRAGSSPEKAQ

SEQ ID NO: 19969 - protein, 81 aa, Enhydra lutris
SQSLLTFEEVAMYFSQEEWELLDPTQKALYNDVMRENYETVISLALFVLPKPKVISYLEHGEEPWVQGSLEFKNSPGELPS

SEQ ID NO: 19970 - protein, 81 aa, Enhydra lutris
ALALVSFQDVAMTFTGEEWRHLDLAQGTLYREVMLETCGLLVSLRRPVPKAELISLVEQGQELWAVKRGLSKSAYTGEKAK

SEQ ID NO: 19971 - protein, 81 aa, Enhydra lutris
SCESLSFADVTVGFTQEEWQHLDPAQRTLYREVMLENYSHLVSVGCCIPKPEVILKLEQGEQPWMLEEESPGQSYPEVCKV

SEQ ID NO: 19972 - protein, 81 aa, Enhydra lutris
KSQGLLSFSDVAVDFTWEEWQLLDTVQRNLYRDVMLENYSNLMSLGYQVTRPEAMVHLEKEQGVLEREFPSPSGPERPRQC

SEQ ID NO: 19973 - protein, 81 aa, Enhydra lutris
RSQGLLTFRDVAIEFSQEEWGRLTHTQRELYRDVMLENYGHLLFLGLVVWKPDLVIFLEQEKQLWDVKRKESVAFHPGMWE

SEQ ID NO: 19974 - protein, 81 aa, Enhydra lutris
AHGLVMFKDVAVDVSQEEWECLNPTQRNLYKDVMLENYSNLVSLGLSISKPAVISSLEQGKEPWMVVREVTGRWCPELVSR

SEQ ID NO: 19975 - protein, 80 aa, Pongo abelii
RDVAIEFSQEEWKCLDPAQRTLYRDVMLENYRNLVSLGICLPDLSVTSMLEQNKDPWTLQSEEKIANNPDGRECIKGVNT

SEQ ID NO: 19976 - protein, 81 aa, Pongo abelii
IQSQISFEDVAVDFTLEEWQLLNPTQKNLYRDVMLENYSNLVFLEVWLDNPKMWLRDNQDNLKNMERGHKYDVFGKIFNSS

SEQ ID NO: 19977 - protein, 81 aa, Pongo abelii
YSGPLKFRDVAIEFSQEEWKCLDPAQRTLYRDVMLENYRNLVSLGICLPDLSVNSMLEQNKDPWTLQSEEKIANNPDGREC

SEQ ID NO: 19978 - protein, 81 aa, Pongo abelii
TLFSCLSLLSSWDCSSGFSGFCASPIEESHGALISSCNSRTMTDGLVTFRDVAIDFSQEEWECLDPAQRDFFLHWKLQGCL

SEQ ID NO: 19979 - protein, 81 aa, Pongo abelii
VQESVTFRDVAVFFSQDEWLHLDSAQRALYREVMLENYSILVSLGILFSKPKVISQLEQGEDAWMVESGVPQGAHLGWESL

SEQ ID NO: 19980 - protein, 81 aa, Pongo abelii
SLGLVSFEDVAVHFTWEEWQDLDDVQRTLYWDVMLETYSSLVSLGHCITKPEMIFKLEQGAEPWIVEEAPNLRLSAVQILD

SEQ ID NO: 19981 - protein, 81 aa, Pongo abelii
EMGLLTFRDIAIEFSLEEWQCLDCAQQNLYRDVMLENYRNLVSLGIAVSKPDLITCLEQHKEFQNIKRNEMVVKHPVTCSH

SEQ ID NO: 19982 - protein, 80 aa, Pongo abelii
MELLTFRDVAIEFSPEEWKCLDPAQQNLYRDVMLENYRNLVSLGFVISNPDLVTCLEQIKEPCDLKIHETAAKPPVVQHF

SEQ ID NO: 19983 - protein, 81 aa, Pongo abelii
QQGYVTFEDVAVYFSQEEWRLLDEAQRLLYCNVMLENFSLLASLGLASSKTHEITQLESWEKPFMPTWEVVTSATWRGCWH

SEQ ID NO: 19984 - protein, 81 aa, Pongo abelii
RKRKAKESGMALPQGLLTFRDVSIEFSQEEWKCLDPAQRTLYRDVMLENYRNLVSLDISSKCMMQMFSSTGQGNTEVIHTG

SEQ ID NO: 19985 - protein, 81 aa, Pongo abelii
YQASVSFQDVTVEFTQEEWQHLGPVERTLYRDVMLENYSHLISVGYCITKPKVISKLEKGEEPWSLEDEFLNQRYPGYFKV

SEQ ID NO: 19986 - protein, 81 aa, Pan troglodytes
EEAQKRKAKESGMALPQGHLTFMDVAIEFSQEEWKSLDPGQRALYRDVMLENYRNLVFLGICLPDLSIISMLKQRREPLIL

SEQ ID NO: 19987 - protein, 81 aa, Pan troglodytes
AVLTDRAQVSVTFDDVAVTFTKEEWGQLDLAQRTLYQEVMLENCGLLVSLAPSQTHPGSVRCILQSNQVDTLIKIPEHTEH

SEQ ID NO: 19988 - protein, 81 aa, Pan troglodytes
LEWLFISQEQPKITKSWEWQLLDPAQKCLYRSVMLENYSNLVSLGYQHTKPDIIFKLEQGEELCMVQAQVPNQTCPILKAG

SEQ ID NO: 19989 - protein, 81 aa, Pan troglodytes
QDTVAYEDLSVDYTQKKWKGLTLSQRALQWNMMPENHHSMASLGENMMKGSELTPKQEIFKGSESSNRTSGGLFGVVPGAA

SEQ ID NO: 19990 - protein, 81 aa, Pan troglodytes
DSMTFEDIIVDFTQEEWALLDTSQRKLFQDVMLENISHLVSIGREVGIKHQEIPFIQHIYQKGTSTISTMRSHTQEDPFLC

SEQ ID NO: 19991 - protein, 81 aa, Camelus dromedarius
MWLTFEDVAIEFSQEEWECLDPAQRALYRDVMLETCRNLLSLDMSEVHVIKKLQLKASTDRGELFQTAMLAGHERNKIKHF

SEQ ID NO: 19992 - protein, 81 aa, Camelus dromedarius
FQESVTFEDVAIYFSENEWTGLAPAQRALYRDVMLENYGAVASLAAFPFPKPALIFQLEQGEAPWSSAPQGALDGEGPRGI

SEQ ID NO: 19993 - protein, 81 aa, Camelus dromedarius
DVSVDFTQKDWQLLDPAQRLLYRDVMLDNCQHLVSLRHCVTKPELILKLEQGEEPWTLEGKLPSSSHPSELMRSHVRKNTD

SEQ ID NO: 19994 - protein, 81 aa, Myotis davidii
QIPNHNEKKETPTEVPVAFEDVAVNFSLEEWALLEPSQKKLYRDVMRETFRNLASIVTFEDVAVNFTLEEWALMDTSQKKL

SEQ ID NO: 19995 - protein, 81 aa, Myotis davidii
MDRVTFDDVAVYFSREEWGLLDDLDEAQRRQYHEVMLEDLALASSLGPCCGAEDADAPCEQSASVGGSPSSPSKAAVSSLK

SEQ ID NO: 19996 - protein, 81 aa, Leptonychotes weddellii
MRENCRNLASLGYHIGKPSLISHLEQEDKVMTEERGILPGTCPDLETVLKAKWLTPKKHDFRKEHSNGIKAERNHLGVKLN

SEQ ID NO: 19997 - protein, 81 aa, Neomonachus schauinslandi
TQGTVIFEDIAVSFSWEEWDLLDEAQRRLYQDVMLENWALITSLGCWHGAEDEEAPSEQNVSVVSHVRTPKTGLFPQKANP

SEQ ID NO: 19998 - protein, 81 aa, Neomonachus schauinslandi
AYGSLSFGDVAISFSQGEWECLDPAQRALYRDVMLETYSNLVSLDLESNYGAEKLSPENDIHEINLPKQSIKQISKTLDLK

SEQ ID NO: 19999 - protein, 81 aa, Ovis aries
RPRAVKFGDVALYFSREEWGCLRPAQRALYRDVMQETYGHLGALGFPGPKPALISWMEQESEAWSPAAQDPEEGESLGGAL

SEQ ID NO: 20000 - protein, 81 aa, Otolemur garnettii
QGLLSFRDVAIEFSPEEWEYLDTAQRNLYGDVMSEISRHLDFVVFLFLKSFLIVFFRYGSFSWRRKGKRMISKLPIILCLH

SEQ ID NO: 20001 - protein, 81 aa, Otolemur garnettii
EEVLMAFRDVAVAFTLKEWKLLSPAQRSLYREVMLENYSHLVSLGIAFSKPKLIIQLEQGDEPWREDFPVLWLCEGIHIGE

SEQ ID NO: 20002 - protein, 81 aa, Otolemur garnettii
QGLLTFKDVSIEFSMDEWACLDPAQQHLYREVMLETYRHLVFLGLAVSKPDLIIFLEQSKEPWKVKTQQTLLKPPALSNHS

SEQ ID NO: 20003 - protein, 81 aa, Vulpes vulpes
MLENYSHLLSVGYEVPKPEIIFKLEQGEEPWILERKTPHQSCSDGRFGIKTPQKRISGKASFHNEMEGEDTRDDSLYSILE

SEQ ID NO: 20004 - protein, 81 aa, Pongo abelii
YVNRVSPFKDMILCFSEEDWSLLDPAQTGFYGEFIIGEDYGVSMPPNDLAAQPDLSQGEENEPRVPELQDLQGKEVPQVSY

SEQ ID NO: 20005 - protein, 81 aa, Pongo abelii
AQEPVMFRDVAVFFSQDEWLHLDSAQRALYREVMLENYSSLVSLGIPFSMPKLIHQLQQGEDPCMMEREVPADTCLGFKTW

SEQ ID NO: 20006 - protein, 81 aa, Pongo abelii
AATLRLSAQGTVTFEDVAVNFTWEEWNLLSEAQRCLYRDVTLENLALISSLDPALDGSADNTQTGNLGQSVLPAHPEQKTA

SEQ ID NO: 20007 - protein, 81 aa, Pongo abelii
QLTFRDVAIEFSQDEWKCLNSTQRTLYRDVMLENYRNLVSLDLSRNCVIKELAPQQESNTGEVFQTVTLEQHEKHDIEEFC

SEQ ID NO: 20008 - protein, 81 aa, Pongo abelii
AQGSVSFNDVTVDFTQEEWQHLDHAQKTLYMDVMLENYCHLISVGCHMTKPDVILKLERGEEPWTSFAGHICLEENWKAED

SEQ ID NO: 20009 - protein, 81 aa, Pongo abelii
SQTLVTFKDVFVDFTREEWKLLDTAQQIVYRNVMLENYKNLVSLGYQLTKPDVIIRLEKGEEPWLVERGIHQETHPDSETA

SEQ ID NO: 20010 - protein, 81 aa, Pongo abelii
SKAPVTFGDLAIYFSQEEWEWLSPIQKDLYEDVMLENYRNLVSLGLSFRRPNVITLLEKGKAPWMVEPVRRRRAPGWTTMM

SEQ ID NO: 20011 - protein, 81 aa, Bos indicus x Bos taurus
GIALSQLTFKDVFIDCTPEEWECLDPAQRTLYKDVMVETLRILLWVRITSFRSGGILWGTSACSLCVSWEPLFFLLRSKPC

SEQ ID NO: 20012 - protein, 81 aa, Bos indicus x Bos taurus
VTFEDVAVSFSQEEWGLLGEAQRLLYYDVMLENLSLIASLGCWHGGDTEEARSDQCVSVERVTRDRNPQVDSSVLKAVTPT

SEQ ID NO: 20013 - protein, 81 aa, Bos indicus x Bos taurus
PQGLMTFEDVAVDFTQEEWQYLNPPQRTLYRDVMLETYSNLVSVGHHVTKPDLILKLEVEEKCLPEGKIPIWSFPEEACQV

SEQ ID NO: 20014 - protein, 81 aa, Bos indicus x Bos taurus
GVTFPDIAVRFSQREWRLLDETQRLLYLDVMLENYTLISSLGCCCGTENAEAPSERITSLQVSQARTPKAALSTQKMNPCE

SEQ ID NO: 20015 - protein, 81 aa, Bos indicus x Bos taurus
QLTFKDVAVEFSQEEWECLDPAQRAFYMDVMVETLRNLISVGEDHFASEIGICPWVSLHFFCAPWEPLFCLIDLKSLLIQT

SEQ ID NO: 20016 - protein, 81 aa, Pan troglodytes
RRGHLTFRDVAIEFSQEEWKCLDPAQRTLYREVMVENYRNLVFLGICLPDLSVISMLEQRRDPWNLQSEVKIANNPGGREC

SEQ ID NO: 20017 - protein, 81 aa, Pan troglodytes
CALHWEEWQDLDDAQRKLYRDVMLETYSSLVSLGHCITKPEMIFKLEQGAEPWIVEEAPNLRLSAVQIIDDLIERSHESHD

SEQ ID NO: 20018 - protein, 81 aa, Pan troglodytes
GEGSLSFEDVAVGFTREEWQFLDQSQKVLYREVMLENYSNLVSIGYQGTKPDSLFKLEQGEPPGIVEGAAHSQICPDADFL

SEQ ID NO: 20019 - protein, 81 aa, Pan troglodytes
QGTVTFEDVAVHFSWEEWGLLDEAQRCLYHEVMLENLALLTSLDVHHQKQHLGEKHFRSNVGRALFVKTCTFHVSGEPSTC

SEQ ID NO: 20020 - protein, 81 aa, Pan troglodytes
VTFEDVAVKFTQEEWNLLSEAQRCLYRDVTLENLALMSSLGNGTEPRHTKTNCVRKGPKKPNHLCECSWPIQYQGTHHKQK

SEQ ID NO: 20021 - protein, 81 aa, Pan troglodytes
AQVPLTFSDVAIDFSQEEWEYLNSDQRDLYRDVMLENYTNLVSLEFDFTTESDKLSSEKRNYEVNAYHQETWKRNKTFNLM

SEQ ID NO: 20022 - protein, 81 aa, Pan troglodytes
DVAIDFSHEEWACLDSAQRDLYKDVMVQNYENLVSVAGLSVTKPYVIMLLEDGKEPWMMEKKLSKAYPFPLSHSVPASVNF

SEQ ID NO: 20023 - protein, 81 aa, Pan troglodytes
GKELLSFEDVAMYFTREEWGHLNWGQKDLYRDVMLENYRNMVLLGFQFPKPEMICQLENWDEQWILDLPRAGNRKASGSAC

SEQ ID NO: 20024 - protein, 81 aa, Camelus dromedarius
SQDAVTFGDVAVNFTQEEWTLLDLSQRNLYRDVMLENYKNLITTGYKSFKPALISWLEQGEFRTVERGALQEWEMNQKVKD

SEQ ID NO: 20025 - protein, 81 aa, Enhydra lutris
EGSVTFEDVVVYFSWEEWGLLDETQRCLYHDVMLENFALVISLGCWYGMEEEEEALSVQQVSMGRTSSPAPSVWRAQPCDK

SEQ ID NO: 20026 - protein, 81 aa, Enhydra lutris
PDEAVTFKDVAVVFSEEELGLLDPAQRKLYRDVMLENFRNLVSVGNQPFKPDLIFQLEREEKLLMMETETQRDGYLGAKSQ

SEQ ID NO: 20027 - protein, 81 aa, Enhydra lutris
ERLTFRDVAIEFSREEWECLDPAQSALYRDVMVENYQNLEPDSSARFMIKELLPKKEIDNRELCQPVVLGRHESHGLEDFD

SEQ ID NO: 20028 - protein, 81 aa, Enhydra lutris
FKEAVTFKDVAVVFTEEELGLLDPAQRKLYGDVMLENFRNLLSVGHQPFTPHVILQCERGEKLQMRKTATQGRGIAGDKNL

SEQ ID NO: 20029 - protein, 81 aa, Pongo abelii
SQHLVTFEDVAVDFTQEEWTLLDQTQRDLYRDVMLENYKNLIILAGSELCKPSLMSGLEQMEELRTGVTGVLQELDLQLKT

SEQ ID NO: 20030 - protein, 81 aa, Pongo abelii
VAFEDVDVNFTQDEWALLDPSQKNLYRDVMQETFRNLASVGKKWKDQKIEDEYKNPRRNLRGLMGERLLESKKDHQHGEIL

SEQ ID NO: 20031 - protein, 81 aa, Pongo abelii
SVAFEDVAVNFTPEEWALLDPSQKNLYREVMQETLRNLASIGKKWKDQNIENEYKNPRSNLRGLMEERLFESEGHQHGEIL

SEQ ID NO: 20032 - protein, 81 aa, Bos indicus x Bos taurus
RLTSEDVAIEFTQEEWEFLDPAQRALYRDVMLETYRNLLSVDISPTHVIKHLQPKGNSYKRETFQTLMLGRPESCDIKHFH

SEQ ID NO: 20033 - protein, 81 aa, Bos indicus x Bos taurus
FQGRLMFQDVTIDFTLEEWECLDLDQRELYRNVMLENYGNLASLGLVVSKPDLVTFLEQMKNPWDIRRTDTTGYFNVSLFF

SEQ ID NO: 20034 - protein, 81 aa, Bos indicus x Bos taurus
VQDSVTFADVAVNFTQEEWTLLNRFQRKLYRDVMLENYKNLTTAGYQVFKPTLISWLEEEELSTVERGVLQGDTYYPGEEN

SEQ ID NO: 20035 - protein, 81 aa, Bos indicus x Bos taurus
FQGRLTFQDVAIDFTQEEWECLDLDQQELYRDVMLENYRNLASLGLVVSKLDLVTFLEQMKNPWDVRSLESPAIYTGRCEW

SEQ ID NO: 20036 - protein, 81 aa, Pan troglodytes
MLDTFRLLVSVGHWLPKPNVISLLEQEAELWAVDSGLPQGVYPDLETRPKVKLSVLKQGISEEISNNVILVERFLWDGLWY

SEQ ID NO: 20037 - protein, 81 aa, Pan troglodytes
RLIRDQDLGASLLPAAPQWRHLDSTQKEQYWDLMLETYGKMVSGGISHPKSDLTNSIEFGEELAGLYLHVNEKIPRPTCIG

SEQ ID NO: 20038 - protein, 81 aa, Pan troglodytes
EMGPLTFRDVAIEFSLEEWQCLDTAQQDLYRKVMLENYRNLVFLGIAVSKPDLVTCLEQGKDPWNMKRHSTVVKPPGFLPP

SEQ ID NO: 20039 - protein, 81 aa, Pan troglodytes
VTLRDVVINFSQEEWEYLDSAQRNLYWDVMMENYSNLLSLDLESRNETKHLSVGKDIKNTGSQWEVMESSKLCGLEGSIFR

SEQ ID NO: 20040 - protein, 81 aa, Pan troglodytes
GTVTFEDVAVNFSQEEWSLLSEAQRCLYHDVMLENLTLISSLGCWYEAKDETPSKQTLSIQQKSPLRTHWTGVCTKKVHLW

SEQ ID NO: 20041 - protein, 81 aa, Callithrix jacchus
PQDLMTFEDVAVEFTQWEWGQLNPAQKDLYREVMLENFRNLTLLGLLVSKPYVICQLEEGGEPFMVKREISIGVHSDWERR

SEQ ID NO: 20042 - protein, 81 aa, Callithrix jacchus
ASGTLTFDDVALYFSEQEWEILEKWQKQMYKQEMKTNYETLDSLGYAFSKPDLITWMEKGRMLLISDQGRLHKTKRTAGPP

SEQ ID NO: 20043 - protein, 81 aa, Bos taurus
TGRLTFQDVAIDFTQEEWECLDPGQRKLYRDVMVENYRNLASLGEDICLPESLIYPLQLCQPLLSVSSRDSSQLQSSISAE

SEQ ID NO: 20044 - protein, 81 aa, Bos taurus
YALSFLFDVTIDFTLEEWECLDLDQRELYRNVMLENYGNLASLGGFLTTGPPGKLLCMFHFPIYSLINSQSICDVSHMIWG

SEQ ID NO: 20045 - protein, 81 aa, Bos taurus
MSYMDVAIHFSQQEWECLNPVQKNLYQDVMMENYDNLVSLGHSISKPDVITLLEQGKEPWMVVREETRRWCAGQYKQVKLW

SEQ ID NO: 20046 - protein, 81 aa, Ovis aries
MLENYRNLASLGLVVSKPDLVTFLEQMKTPWDVTRLKTPAVYTGWKPFKYTECGNTSKQNSELSQDQQIHTGKKPYECKEC

SEQ ID NO: 20047 - protein, 81 aa, Ovis aries
MTFEDVAVDFTQEEWQYLNPPQRTLYRDVMLETYSNLVSVAGYHVTKPDLILKLEVEEQCLPEGKIPIWSFPEEACQVDEQ

SEQ ID NO: 20048 - protein, 81 aa, Ovis aries
TRVPVTYEDVAVTFTQEEWGHLGPVQRMLYWEVMLETCRLLVSLGCPLPEPELISPAEPSPESQTSRRGPTPGSCSGDNTK

SEQ ID NO: 20049 - protein, 81 aa, Ovis aries
VQDCVVFEDVAVYFSQEEWGLLDEAQRHLYHAVMTENLALVTSLGCWHGAPGEEASSEQGVSIGMSEVRTAKPDPASRKAQ

SEQ ID NO: 20050 - protein, 81 aa, Ovis aries
LQEALTFKDVAVTFTEEELGLLDLAQRKLYRDVMLENFRNLLSVGHQSSKPDMISQLEREEKFWTIEIQPQRGGRSGGWNH

SEQ ID NO: 20051 - protein, 81 aa, Ovis aries
SQGLLTFEEVAIYFSQEEWELLNPTQKALYNDVMHENYETVISLAVFVLPKPKVISYLEQGKDPYIQGSPVFKDNPEELLS

SEQ ID NO: 20052 - protein, 81 aa, Ovis aries
SQERLTSEDVAIEFTQEEWEFLDPTQRALYRDVMLETYRNLLSLGILQFTRYSVQFPELYDISPTHVMKHLQPKANSDKRE

SEQ ID NO: 20053 - protein, 81 aa, Ovis aries
QAQSTFKDVFLDFTPEKWECLDPAQRTLYKDMIVETLRNLLSVAGISDSDLNYNSIFVAKKDPWIVDNEVLIAENQMSGKG

SEQ ID NO: 20054 - protein, 81 aa, Ovis aries
HQEVVTFEDVAVYFTQTEWAGLSPAQRALYRSVMLEIYGNLTSLGYPVPKPALVSLLERGDLPVGLETQDNPPAQGTRDIY

SEQ ID NO: 20055 - protein, 81 aa, Ovis aries
AHGSVTFRDVAIDFSQEEWEFLDSAQRDLYRDVMWENYSNFISLAGPSMSKPDVITLLDEGKEPWMVVREGIGRHHPDLES

SEQ ID NO: 20056 - protein, 81 aa, Ovis aries
EQGLMAFEDVAVHFSQEEWGLLDTAQRALYRRVMLENFALLASLGALSVSRPRVVTQLERGDEPWVLSGADVTLARDAQRR

SEQ ID NO: 20057 - protein, 81 aa, Otolemur garnettii
EILTFRDVAIEFTPGEWACLDPAQRSLYRDVMLENYRNLVSLELAISKLDLITFMKLVEEPWNVKREETVARHPEHKASPF

SEQ ID NO: 20058 - protein, 81 aa, Otolemur garnettii
SQESVTFQDVAVDFTEKEWPLLDSSQRKLYKDVMLENYSNLTSLGYQVGKPSLISHLEQEEELRMEEMGTQQGPGPDWETP

SEQ ID NO: 20059 - protein, 81 aa, Enhydra lutris
SQALVSFKDVAVDFTQEEWQQLDPAQRTLYRDVMLENFSHLVSMGYPVSKPDVISKLEQGEDPWIIKRDIPNWIYPDENQA

SEQ ID NO: 20060 - protein, 81 aa, Enhydra lutris
WETWLQEPVTFDDVAVNFTQEEWVCLDTSQRLLYQNVMAETFRNLLSVDLIIKLEQEEKQWRAELPLRPPSGEGLPSGSGK

SEQ ID NO: 20061 - protein, 81 aa, Enhydra lutris
GPKVSRSLENDGVCFSEQEWENLEDWQKELYRNVMKSNYETLVSLKVLGQPEEEAELGAGMLGDLEEEGPGDVHPEGVMIK

SEQ ID NO: 20062 - protein, 81 aa, Enhydra lutris
CEVSVSFEDVTVDFSKEEWQQLDPAQRRLYRDVTLENYSHLRSVGYEVPKPEVIFKLEQGEEPWILERKTPHQSHTDGKFG

SEQ ID NO: 20063 - protein, 81 aa, Enhydra lutris
WSQMPVTFEDVALYLSREEWGRLDHAQQSFYRDVLQKRNGLSLAGFPFSRPLWGSQGQGKGEASSSCQQMGDDKEKAGAIE

SEQ ID NO: 20064 - protein, 81 aa, Enhydra lutris
FQELVTFRDVAIDFSRQEWECLDPIQRDLYRDVMLENYRNLVSLAGHSVSKPDVVDLLEQGKEPWIILREETQRQYTDLDL

SEQ ID NO: 20065 - protein, 81 aa, Enhydra lutris
AQESVTFRDVAVFFSQDEWLRLDSTQRTLYREVMLENYGTLVSLGILFSKPKVIFQLQQGEDPWMVENGVSQGPCVGWERL

SEQ ID NO: 20066 - protein, 81 aa, Enhydra lutris
HQGLLTFRDVAVEFSLEEWGRLTHTQRQLYRDVMLENYGHLLFLGLIVSKPDLVSFLEQKKEPWNLKRKKTVAFHPAISSH

SEQ ID NO: 20067 - protein, 81 aa, Enhydra lutris
CQESVTFEDVAVIFTDEEWRHLVPNQRDLYKEVMLENYKIIVSLGLPVPQPDVIFQLKRGDEPWVVDLHGSEERECPENVS

SEQ ID NO: 20068 - protein, 81 aa, Pongo abelii
GKELLSFEDVAMYFTREEWGHLSWGQKDLYRDVMLENYRNMVLLGFQFPKPEVICQLENWDEQWILDLPRAGNRKASGSAC

SEQ ID NO: 20069 - protein, 81 aa, Pongo abelii
ARGCVVFEDVFVYFSQEEWELLDDAQRLLYHDVMLENFALLASLGIAFSRSRAVMQLERGEEPWVYDQVDMTSATEREAQR

SEQ ID NO: 20070 - protein, 81 aa, Pongo abelii
SLGLVSFEDVAVHFTWEEWQDLDDVQRTLYRDVMLETCSSLVSLGHCITKPEMIFKLEQGAEPWIVEEAPNLRLSDGVSLL

SEQ ID NO: 20071 - protein, 81 aa, Pongo abelii
GPLQFRDVAIEFSLEESHCLDTEQRNLYKDVMLENYRNLIFLGITVSKPDLITCLEQGKKPLTMKRNEMIAKPSVSFLQVH

SEQ ID NO: 20072 - protein, 81 aa, Pongo abelii
VTFEDVAVNFTWEEWNLLSEAQRCLYRDVTLENLALISSLGMRFLHVCQALVSLPQVIPTLASQSAGITESHSVVQVRVRW

SEQ ID NO: 20073 - protein, 81 aa, Pongo abelii
FQGSVSFKDVTVGFTQEEWQHLDPSQRALYRDVMLENYSNLVSVGYCAHKPEVIFRLEQGEEPWRLEEEFPSWSFPEVWTA

SEQ ID NO: 20074 - protein, 81 aa, Bos indicus x Bos taurus
LQPTVSFKDVAVTFTWVKWGHVDLAQRTVYREVVLETCSRLVSLVKAVATHHQTQGVAHFRHAWTAPEEKGILPGNFAGFL

SEQ ID NO: 20075 - protein, 81 aa, Bos indicus x Bos taurus
DRVVVTFKDVAVTFTSEEWGQLDLGQRTLFREVMLETCGLLVSLGHPIPKPELIHLLEHGQKLWTGTRGLPHSTSPGDRPK

SEQ ID NO: 20076 - protein, 81 aa, Bos indicus x Bos taurus
MLENYSNLVSVAPAQFSGTKSSIISHKRYRVSKSDVLFKLEQGEERWMTEDEIHSHTWPETGNIGNHLQVDWENKKMLKGI

SEQ ID NO: 20077 - protein, 81 aa, Callithrix jacchus
GTVTFEDVAVHFSWEEWGLLDEAQRCLYRDVMLENLALLTSLDVHYQKENLGEKHFRSNVDQALFVNTCIFHVSGETSTCV

SEQ ID NO: 20078 - protein, 81 aa, Macaca mulatta
VMFSDVSIDFSQEEWECLNDDQRDLYRDVMLENYSNLVSMVLESRCETKKLFLKKEIYEIESTQWEIMEKLTRHDFQCSSF

SEQ ID NO: 20079 - protein, 81 aa, Macaca mulatta
VAFEDVAVNFTREEWALLDIFQKNLYREVMLETFRNLTSIGKSWKDQNIEYEYQNPRRNFRSLIEEKVNEIKEDSHCGETF

SEQ ID NO: 20080 - protein, 81 aa, Bos taurus
MKPAQRNLYRDVMLENYSNLVTVGCQVTKPDVIFKLEHEEEPWVVEEEMLGRHCPEVWKVDEQIKKQQETLVRNVTSISKK

SEQ ID NO: 20081 - protein, 81 aa, Bos taurus
AGYQVSKPEVIFKLEQGEEPWIAEGEIQRPVCPDWKTRPEAKSSHLQQSISKVSLSTDELSHTTGEDAWDLSGQLERHKEN

SEQ ID NO: 20082 - protein, 81 aa, Ovis aries
FTFKDVAIEFSQEEWECLAPSERALYRDVMLETYRNLVSLGDDNFSPEAGILSAGFAINKLSPRENTNLGELYGNENHGIK

SEQ ID NO: 20083 - protein, 81 aa, Vulpes vulpes
MEFTWEEWQLLDSAQKYLYRDVILENYSHLVSLGYHGTKPDLIFKLEQGEEPWMINARVSRQSYPEGWKEWYQKSQDEFEN

SEQ ID NO: 20084 - protein, 81 aa, Otolemur garnettii
PLQDSVSFRDVAVDFSREEWQHLDPSQRNLYWDVMLETYSHLLSVGYHGPKEEVVMLEQGKEPWTLPDESLHQSCLGDLRI

SEQ ID NO: 20085 - protein, 81 aa, Vulpes vulpes
WKESVTFKDVIVDFTQEEWKQLDPFQRDLFRDVTLENYTHLVSIGLQVSKPDVISQLEQGTEPWIVEPGIPIGTFGDCETR

SEQ ID NO: 20086 - protein, 81 aa, Vulpes vulpes
KEAFVAFRDVAVDFTQEEWRLLSPAQRTLHREVMLETYNHLVSLEIPFSKPKLISQLEQGEEPWIEERQHPLGLCPGSKLN

SEQ ID NO: 20087 - protein, 81 aa, Otolemur garnettii
MDSVTFEDMAVNFTLDKWACWILPNKRKSVYRNVMQETFRNLATIKSYERDSLKVWRNLQRNSRTHPNKKTSPGVNPCESS

SEQ ID NO: 20088 - protein, 81 aa, Enhydra lutris
IQEPVTFKDVAVDFTQEEWGQLDPVQRTLYRDVMLETYGHLLSVGNHIAKPEVISLLEQGEEPWSVEQAYPQSTCPAVDTE

SEQ ID NO: 20089 - protein, 81 aa, Enhydra lutris
FQGSVSFKDVTVGFTQEEWQHLDSAQRSLYRDVMLENYSNLVSLGCCVTKPEVIFRLERGEEPWILEEEFPSQSFPEIWKT

SEQ ID NO: 20090 - protein, 81 aa, Enhydra lutris
RPGAVSFADVAVYFSPEEWGCLRPAQRALYRDVMRETYGHLGALGFAGSKPALISWLERKKEVWSPEAEDPEDGARHPGSG

SEQ ID NO: 20091 - protein, 81 aa, Enhydra lutris
SQESVTFEDVAVDFTQEEWTLLDRSQRKLFRDVMLENISHLVSIGRQLYKSDTISHLEPGEHLSQEGLGLLQCQSPIISDR

SEQ ID NO: 20092 - protein, 81 aa, Enhydra lutris
PKVPVTFDDVAVYFSEPEWDKLDEWQKELYKHVMRGNYETLVSLDYAISKPDILTRMERGEEPCAGGPWGQEEGSRREAAQ

SEQ ID NO: 20093 - protein, 81 aa, Enhydra lutris
LQEQVSFKDVCVDFTQEEWYLLDPAQKTLYRDVILENYSHFVSVGYCITKPEVVFKIEQGEEPWILEAGFPSHCHQEDWKV

SEQ ID NO: 20094 - protein, 81 aa, Pongo abelii
LTFRDVAIEFSQEEWKCLDPAQRTLYRDVMLENYRNLVSLEFCNSPASAFQVAGTTDISSKCMLKTLSSTGQGNTEVFCAP

SEQ ID NO: 20095 - protein, 81 aa, Pongo abelii
MGPLTFRDVAIEFSQEEWQCLDTAQQDLYRKVMLENYRNLVFLAGIAVSKPDLVTCLEQGKDPWNMKRHSMVVKPPVICSH

SEQ ID NO: 20096 - protein, 81 aa, Pongo abelii
SKAPVTFGDLAIYFSQEEWEWLSPIQKDLYEDVMLENYRNLVSLGLSFRRPNVITLLEKGKAPWMVEPVRRRRAPELTEAS

SEQ ID NO: 20097 - protein, 81 aa, Pongo abelii
AVTFKDVAVVFSREELRLLDLTQRKLYRDVMVENFKNLVAVGSKHQNKMEALQKFALKYLSNQELSCWEIWKQVASELTRC

SEQ ID NO: 20098 - protein, 81 aa, Pongo abelii
CYQDSVTFDDVAVDFTQEEWTLLDSTQRSLYSDVMLENYKNLATVGGQIIKPSLISWLEQEESKTVQGGVLQGRKTQWRGT

SEQ ID NO: 20099 - protein, 81 aa, Pongo abelii
FREAVTFKDVAVAFTEEELGLLDSAQKKLYRDVMLENFRNLVSVGHQSFKPVMISQLEMEEKLWMKELQTQRGDRNQNEMA

SEQ ID NO: 20100 - protein, 81 aa, Pongo abelii
FINVDQSARTRGRCVCGKTSSCGDRKSCVNSSFVTWYCFTKPELIFTLEQGEDPWLLEKEKGFLSRNSPEDSQPDEISEKS

SEQ ID NO: 20101 - protein, 81 aa, Pongo abelii
QGLLTFRDVAIEFSQEEWKCLDPAQRTLYRDVMLENYRNLVSLVGVSLLLPKLECNGTILAHQNFCLPGSSDSPASASKVA

SEQ ID NO: 20102 - protein, 81 aa, Callithrix jacchus
MFKEAVTFKDVAVAFTEEELGLLGPAQRKLYQEVMVENFRNLLSVGHQPFKRDVSPIERKEQLCIMKTATQRQRNLGKNTV

SEQ ID NO: 20103 - protein, 81 aa, Macaca mulatta
QGLLTFKDVAIEFSQEEWKCLDPAQRTLYRDVMLENYRNLVSLDISSKCMLKTLSSTGQGNTEVILIGTLQRQASHHTGEF

SEQ ID NO: 20104 - protein, 81 aa, Macaca mulatta
EMGLLAFRDVALEFSPEEWECLDPAQRNLYRDVMLENYRNLFSLGLAMSKPELIIYLEARKEPWNVNTEKTAKHSALSSYL

SEQ ID NO: 20105 - protein, 81 aa, Macaca mulatta
MLENYSHLISLGSSISKPDVITLLEQEKEPWIVVRKETSRWYPDLESKHGPEKISPENDIFEINLPKRVIKQISKTLGLEA

SEQ ID NO: 20106 - protein, 81 aa, Macaca mulatta
MLENYRNLVSLGLAIFKPDLMTCLEQRKEPWKVKRQEAVVKHPAGSFHFTAEILPEHDIKDSFQKVILRKYGSCDLNNLHL

SEQ ID NO: 20107 - protein, 81 aa, Bos taurus
EIATLKDIAMDFTSENWEQLGQGQGDLFWDMALDNYWNLFLLNPPGPNLTFHPDGGEKLEALVKESPESTDTAETSPLPQD

SEQ ID NO: 20108 - protein, 81 aa, Bos taurus
HQGSVTFEDVAMYFSWEEWCLLDEAQIQLYLDVMLENFALVCMLGSWRGVRDKETPSEEIKPAGVLQFRTPRAGLSPEKTQ

SEQ ID NO: 20109 - protein, 81 aa, Bos taurus
EEGQVTFEDVAVYFSWEEWGLLDEAQRLLYCGVMLETFSLMASLGLTPSRTHAITQLEQRGEPCVPTGGVSTTATPAGCWC

SEQ ID NO: 20110 - protein, 81 aa, Bos taurus
QGLFTFKDVAVEFTQEEWECLDPIQRALYRDVMLETYRNQLSLGSYSATFAVKELSSPKEDISKGELCHLMTLEKNETYGI

SEQ ID NO: 20111 - protein, 81 aa, Ovis aries
MAHLTIFRDVAVDFSQEEWECLDLEQRHQYRDVMLENYSNLVSLGLCIYQPEVFFLLEKGREPWMALKKNSMNLSSYLSDM

SEQ ID NO: 20112 - protein, 81 aa, Ovis aries
FQGSVSFKDVTVGFTQEEWQHLNSTQRSLYRDVMLENYRNLVSVGYCITKPEVIFRLEQGEEPWILEEEFPSQSFSEVWKT

SEQ ID NO: 20113 - protein, 80 aa, Ovis aries
MMKFQEPVSFRDVAVVFTEEELGLLDSAQRKLYQEVMLENFRNLLSVGNQPFKPELIFQLEREERLMMETQRDGCSALTS

SEQ ID NO: 20114 - protein, 81 aa, Ovis aries
HAEGRLTFQDVAIDFTQEEWECLDLGQRELYRDVMLENYRNLASLGLVSMLDLVTFLEQLKDPRNIRRMETTAIYPAVSPQ

SEQ ID NO: 20115 - protein, 81 aa, Ovis aries
MKRKKRQLMFQDVTTEEWECLDLGQQELYRDVMLENYRNLATLGLVVSKPDLVTFLEQMKEPRNKRRMKTVAIYPALSPHD

SEQ ID NO: 20116 - protein, 81 aa, Vulpes vulpes
GLLSFKDISMEFTWEEWQLLDSAQKYLYRDVILENYSHLVSLEGWKEWYQKSQDEFENVERNYACGAFGKRHLSRIHVSSR

SEQ ID NO: 20117 - protein, 81 aa, Vulpes vulpes
PKVPVTFDDISIYFSTPEWEKLEEWQKELYKNIMKGNYESLISMDYAMNQPDVLSQIQPEREHTTEDQAGPEESEIPTDPS

SEQ ID NO: 20118 - protein, 81 aa, Vulpes vulpes
AHGSLTFSDVAIGFSQQEWECLDPVQKSLYRDVMMENYGNLVSLGYSISKPDIITLLEQGKEPWMVLREETKRWDTDLESR

SEQ ID NO: 20119 - protein, 81 aa, Enhydra lutris
MLENYSHLISVGCHIIKPEVIIKLEQGEEPWIVEGEFLPQSYPEEVWKADVLGERVQENESKYSRQAVSINNKTLIEERGN

SEQ ID NO: 20120 - protein, 80 aa, Enhydra lutris
MNKAAELVSFEDVAVNFSWEEWQDLDDAQRTLYRAVMLETYSSLVSLGHCISKPEVIVKLEQGAEPWAVGEAPTQRLPGQ

SEQ ID NO: 20121 - protein, 81 aa, Enhydra lutris
GSVTFEDVALYFSWEEWDLLDEDQRCLYHDVMLENFALTSSLDANLQQYRGQRTGEIPFRNSVDRASFIKNYTVQVSGKPF

SEQ ID NO: 20122 - protein, 81 aa, Enhydra lutris
MFKSQISFEDVAVDFTSEEWQLLNPTQKSLYRDVMLENYSNLVFLGYQIIRPDAVFKPEPEEPWVIEAAPRRTSAEEVWLD

SEQ ID NO: 20123 - protein, 81 aa, Enhydra lutris
TARSQASVTFKDVAMDFTPEEWGKLDPAQREVMLENYKNLVSLWLPVSKPENYNLENGKEPLVLERKAPKSSYSGELAKWG

SEQ ID NO: 20124 - protein, 81 aa, Enhydra lutris
SQSLVTFGDVAVDFSREEWEWLSSAQRTLYRTVMLENYRNLVSLGLCISKPDMISSLEQRKEPWMAKRKLTRGRCPDLKIV

SEQ ID NO: 20125 - protein, 81 aa, Enhydra lutris
TWVPLTFSDVAIDFSQEEWECLNSDQRDLYRDVMLENYTNLVSLDFDFTTETNKLSSEKSSYQVNSYHRETMKRSRTFNLT

SEQ ID NO: 20126 - protein, 81 aa, Enhydra lutris
PLDSVTFTDVAIDFSQDEWEWLNLAQRALYKKVMLENYRNLLSLGLCLSKPDVISLLEQGREPWMMEGEMTRGLCSDLEYV

SEQ ID NO: 20127 - protein, 81 aa, Enhydra lutris
AAGSVTFKDVTMAFTQKEWEQLDPAQRDLYKDVMLENYSNLASMGFQAPKPDMISKLEKGEEPWLGKGKRPRQGGPSEIGR

SEQ ID NO: 20128 - protein, 81 aa, Enhydra lutris
PRDSVTFEDVAVRFSGGEWRRLTRAQRRLYAAVMLDNYGLVVSLGFAGPKPPLISCLERGAEPRVRDLQDWGLLSCSFPVS

SEQ ID NO: 20129 - protein, 81 aa, Pongo abelii
QGSLTFRDVTIEFSLEEWQCLDTAQQNLYRDVMLENYRNMVFLGITVSKLDLITCLKQGKEPWNMKRHEMVTKPSVISSHF

SEQ ID NO: 20130 - protein, 81 aa, Bos indicus x Bos taurus
VQDSVTFADVAVNFTQEEWTLLNRFQRKLYRDVMLENYKNLTTAGYQVFKPTLISWLEEEKLSTVERGVLQGDTYYPGEEN

SEQ ID NO: 20131 - protein, 81 aa, Macaca mulatta
AGRPLEMAVSEPETSAAEWKQLDPAQRNVYHDVMLENYSNQASMGYQAPKPDLISKLEKGEAPWLGKGKRPSQGCPSKIAR

SEQ ID NO: 20132 - protein, 81 aa, Macaca mulatta
MLLIFNKTGIAVSKPDLVTCLEQGKEPWNMKRHEMVAKTPVMCSHIAEDLWPERDIKDFFQKVILRRYDKCGRDNLQLRLG

SEQ ID NO: 20133 - protein, 81 aa, Callithrix jacchus
SKGSVMFRDVSIDFSQEEWECLDSGQMNLYKEVMLENFSNLVSVGLSSSKPAVISLLEQGREPWMVDRELTRGLCSDLESM

SEQ ID NO: 20134 - protein, 81 aa, Macaca mulatta
MAFTQEEWEQLDLAQRTLYREVTLETWEHIVSLGLFLSKSDVISQLEQEEDLCRAEQVVPRDWKTTLEENRLNSEKDQARE

SEQ ID NO: 20135 - protein, 81 aa, Ovis aries
AKAPVTFGDLAIYFSQEEWEWLSPIQKDLYEDVMLENYQNLVSLGLSFRRPNVISLLEKGKAPWMVDPVKRRRGLALGMIL

SEQ ID NO: 20136 - protein, 81 aa, Ovis aries
PLESVTFEDVAIDFTQEEWSLLDKSQKNLFRNVMLETVTHLVSVGYQISKSDVISQLEQGKELWPEAAGGLQSQSPGKKVS

SEQ ID NO: 20137 - protein, 81 aa, Ovis aries
QEGVNFKIVTVDFTQEEEGTLNSAQRTLDRDVILENHRDSWDSATALGRRESRLKQSIFDDKLSHSVKIEKLTRDDPWLSS

SEQ ID NO: 20138 - protein, 81 aa, Ovis aries
PHRLVLFKDVAIDFSQEEWAYLDLEQKDLYRDVMLENYSNLVSVGVSISKLDVLSLLEQGKEPWKVVQDVTRDLSPDWESR

SEQ ID NO: 20139 - protein, 81 aa, Vulpes vulpes
SQGLLTFRDVAIEFSQEEWGCLNHTQRELYRDVMLENYGHLLFLGLVVWKPDLVIFLEQEKELWDVKRKETVDFHPAVSSS

SEQ ID NO: 20140 - protein, 81 aa, Vulpes vulpes
AQSLMAFEDVAVYFSQEEWELLDAAQRALYCHVMLENFALVASLGLSASRPRVVMQLERGEEPWVLSGTVVMPARNAQRKA

SEQ ID NO: 20141 - protein, 81 aa, Vulpes vulpes
AQGCVTFEDVTIYFSQEEWGLLDEAQRLLYCDVMLENFALIASLGLTSFRSYIVAQLQMGAEPWVPDRVDMTSAMARGAYS

SEQ ID NO: 20142 - protein, 81 aa, Vulpes vulpes
CELSVSFEDVTVDFSREEWQQLDSTQRRLYQDVMLENYSHLLSVGYEVPKPEIIFKLEQGEEPWILERKTPHQSCSDGRFG

SEQ ID NO: 20143 - protein, 81 aa, Vulpes vulpes
QSPVTFEDVAVYFSKEEWKLLDAGQRHLYYSVMLENFELMTSLGCWYGVEDEGARSKQNASVEGMSQVRIPSVNRSTQKAD

SEQ ID NO: 20144 - protein, 81 aa, Enhydra lutris
YQGPVTFKDVTVEFSREEWQLMNDAQRTLYREVMQENYGLLVSVGYRVNKSNAVFKLKQGKEPWILEVEFPHRNYPDLWKI

SEQ ID NO: 20145 - protein, 81 aa, Pongo abelii
VTLRDVVINFSQEEWEYLDSAQRNLYWDVMMENYSNLLSLDLESRNETKHLSVGKDIIKNTGSQWEVMESSKLHGLESSIF

SEQ ID NO: 20146 - protein, 81 aa, Pongo abelii
LEWLFVSQEQPKITKSWEWQLLDPAQKCLYRSVMLENYSNLVSLGYQHTKPDIIFKLEQGEELCMVQAQVPNQSCPILKAG

SEQ ID NO: 20147 - protein, 81 aa, Pongo abelii
ACGSITFRDVAIDFSHQEWEYLNLVQKTLYQEVMMENYDNLVLLGHSKSKPDLITLLEQGKEPWMIVREETRGECTAELQS

SEQ ID NO: 20148 - protein, 81 aa, Pongo abelii
RQVSITFKDLAVRFSEEEWRLLEEGQREFYRDVMRENYETLVSVGTAELLPLSAFLSPSEPGRAVGGGSHADEGQEPAGCG

SEQ ID NO: 20149 - protein, 81 aa, Pongo abelii
PQGHLTFRDVAIEFSQAEWKCLDPSQRALYKDVMLENYRNLVSLGISLPDLNINSMLEQRREPWSGESEVKIAKNSDEREC

SEQ ID NO: 20150 - protein, 81 aa, Pongo abelii
SQGLVSFKDVAVDFTQEEWQQLDPSQRTLYRDVMLENYSHLVSMGYPVSKPDVISRLEQGEEPWIIKGDISTWIYPDDYQA

SEQ ID NO: 20151 - protein, 81 aa, Pongo abelii
GCVTFEDVAIYFSQEEWGLLDEAQRLLYRDVMLENFALITALVCWHGMEDEETPEQSVSVEGVPQVRTPEASPSTQKTQSC

SEQ ID NO: 20152 - protein, 81 aa, Pongo abelii
FQRPVSFQDLTVNFTQEEWQQLDPAQRLLYRDVMLENYSNLVSVGYHVSKPDVIFKLEQGEAPWIVEEFSNQNYPEVDAAL

SEQ ID NO: 20153 - protein, 81 aa, Bos indicus x Bos taurus
DQPKAKKSWGPLSFMDVFVDFTWEEWQLLDSAQKHLYRSVMLENFRNLVSLGYQYTKPSIIFQLEQEELWMMHSPSQGHSE

SEQ ID NO: 20154 - protein, 81 aa, Bos indicus x Bos taurus
DPVAFEDVAVNFTLEEWALLGPSQKKLYRDVMRETLSNLALIRDEWEDHNTEDQYKNQERNLRSHILQRLCESKEGSQGGE

SEQ ID NO: 20155 - protein, 81 aa, Bos indicus x Bos taurus
MAASQGWLTFQDIAIDFTQEEWECLDLGQRELYRDTMLENYGNLASLGLVSKPDLVTFLERMKDSRNISSMETTPIYPGMS

SEQ ID NO: 20156 - protein, 81 aa, Bos indicus x Bos taurus
VVFEDVAIYFSQEEWGLLDEAQRLLYCQVMVQNIALLSSVGCRHATQDEEALSEQHDVAARSQVKTPKPGPCIQKPHPSKT

SEQ ID NO: 20157 - protein, 81 aa, Pan troglodytes
FQGSLSFGDVAVGFTRKEWQQLDLEQRALYQDVMLENYSHLLSVGCQVSKPAVISSLEQGKEPWMEEEEIRTWSFPEEVWQ

SEQ ID NO: 20158 - protein, 81 aa, Callithrix jacchus
LFQVTFSDVAIDFSHEEWEWLDSAQRDLYKDVMVQNYENLASLGLSITKPHVITLLEDGKEPWMVEEKMSKDWESRLGNKE

SEQ ID NO: 20159 - protein, 81 aa, Macaca mulatta
QEEWKCLDPVQKALYRDVMLENYRNLVSLGICLPDLSIISMMKQRTEPWTVENEMKVAKNPVRWEGIKDINTGRCCAMRSK

SEQ ID NO: 20160 - protein, 81 aa, Bos taurus
RLTFKDVAIEFTPEEWECLDLAQRALYREVMVETLRNLLSVDTSPKRVLKGSAPKQSSHTGGILQTMLSGRHKSHDTKDQG

SEQ ID NO: 20161 - protein, 81 aa, Ovis aries
MGLLDLAQRKLYQEVMLENFQNLLSVGHQSFTPDVPSQLEREEKLQMIKTAAQSCCSSGNQNLNGIETLQEVGLRYLPHEE

SEQ ID NO: 20162 - protein, 81 aa, Ovis aries
PKVPVSFEDVAMYFTKTEWKLLDHRQRKLYKQVMLENYHHLVSLGFSFAKPQLVIQLEQGEKPWVADVHRMRITTGMQAER

SEQ ID NO: 20163 - protein, 81 aa, Ovis aries
VKKPVTFEDVAVNFTQEEWKCLDASQKVLYQDVISETVRNLMSVDGIFLSNLDLIAKLEQEEKQWEADLCSPNGEGFHSGG

SEQ ID NO: 20164 - protein, 81 aa, Ovis aries
SLAFEDVAVNFTLDEWVLLDSSQRKLYRDVMRENFRNIVSVEAKQEDHDIEDQDKNQERKLRNPKAERHSEKKDINSSEES

SEQ ID NO: 20165 - protein, 81 aa, Ovis aries
AQLTFKDVFLDFTPEEWECLDPAQRTLYKDVMVEILRNLLSVDMSHIHMVKKLQAKANSGKGEIFQRVMFGRAEILEIKDF

SEQ ID NO: 20166 - protein, 81 aa, Pongo abelii
VAFEDVAVNFTQEEWTLLDISQKNLFREVMLETFWNLTSIGKKWKDQNIEYEYQNPRRSFRSLIEEKVSEIKDNSHCGETF

SEQ ID NO: 20167 - protein, 81 aa, Pongo abelii
PRGSTFFSSVTVAFAQEGWRCLVSTPQDRFKEGIPGKSRNLVLLGLPVSQPGMNSQLEQREGAWMLEGEDLRSPSPGWKII

SEQ ID NO: 20168 - protein, 81 aa, Pongo abelii
LEEHVTFEDMVVDFSQEEWRQLEPAQRTLYHDVILDTFRLLVSVGHWLPKPNITSLLEQEAEPWAVDSGVPQGMYLGEVAE

SEQ ID NO: 20169 - protein, 81 aa, Pongo abelii
RNMIPQDNENPPQQGEANQNDSVAFEDVAVNFTPEEWALLDPSQKNLYREVMQETLRNLASIEVLWKRDSLKVKVISMEKF

SEQ ID NO: 20170 - protein, 81 aa, Pongo abelii
VMFRDVAIDFSQEEWECLDSAQRDLYRDVMLENYSNLVSLDLPSRCANKDLSPEKNTYETELSQWEMSDRLENCDLEESNS

SEQ ID NO: 20171 - protein, 81 aa, Pongo abelii
QGPLTFMDVAIEFSLEEWQCLDTAQQNLYRNVMLENYRNLAFLGIAVSKPDLITCLEQGKEPWNMERHEMVAKPPGMCCYF

SEQ ID NO: 20172 - protein, 81 aa, Pongo abelii
WLQEPMTFKDVAVEFTQEEWMLLDSAQRSLYRDVMLENYRNLTSVEYQLCGLTVTSPLDQEEIRNMKKRIPQAICPDQKIQ

SEQ ID NO: 20173 - protein, 81 aa, Bos indicus x Bos taurus
QVSIAFQDLAVRFSEDEWRLLGEGQRALYLDVMRENYDTLASLGTAEPLPLSAFLSPSEPGGAVGARSRAGGRQEPPQGGG

SEQ ID NO: 20174 - protein, 81 aa, Bos indicus x Bos taurus
GRLMFQDVTIDFTLEEWECLDLDQRELYRNVMLENYGNLASLGEDNCLVVSKPDLVTFLEQMKNPWDIRRTDTTATYPCRC

SEQ ID NO: 20175 - protein, 81 aa, Bos indicus x Bos taurus
HQEVVTFEDVAVYFTRTEWAGLSPAQRALYRSVMLEIYGSLTSLGYPVPKPALISLLERGDLPVGLETQDNPPAQGTRDIY

SEQ ID NO: 20176 - protein, 81 aa, Pan troglodytes
LKGLVTFEDVAVEFTQEEWALLDPAQRTLYRDVMLENCRNLASLGCRVNKPSLISQLEQDKRVITEERGILPSTCPDLETL

SEQ ID NO: 20177 - protein, 81 aa, Odocoileus virginianus
FQGLLTFEDVAVHFTQEEGARLDAGQRTLYRDVMLETYRNLVSLEVPGSKPDLISQLEQGREPWGSDLLGAQEAETVGDAG

SEQ ID NO: 20178 - protein, 81 aa, Cebus imitator
PKVPVTFDDVAVYFSEQEWGKLEDWQKELYKHVMRGNYETLVSLDYAISKPDILTQIERGEEPCLDQWSQKKGSEVEVAHS

SEQ ID NO: 20179 - protein, 81 aa, Cebus imitator
MKPEVISHAPDTVVPAAFPFPKPDLIFRLEQGEAAWGPDPWTLAGEEALRGLCTGGKTKTKTEEQTARLNIFKESESHRLI

SEQ ID NO: 20180 - protein, 81 aa, Callithrix jacchus
LSQTSDFKDVAVEFSLAEWKCLTPAQRAVYRDVMLENYRNLESVDSFLKSMMEFSSTGQGSTREGIHTGTLGKCTSHHIGD

SEQ ID NO: 20181 - protein, 81 aa, Callithrix jacchus
GLLTFRDVAIEFSQEEWRCLDPAQKTLHRDVMLENYRNLVSLDISSICMMKEFSSTGPGNTDVFHTGTLQRHEIHQTGDFC

SEQ ID NO: 20182 - protein, 81 aa, Macaca mulatta
RLTFRDVAIEFSQEEWKCLDPAQRTLYRDVMLENYWNLVSLDIPPKCTTKDLLPEEKSSTEAVFHTVMLERHESPDIEDFS

SEQ ID NO: 20183 - protein, 81 aa, Callithrix jacchus
PLTFRDVTIQFSQEEWRCLDPAQKALYKDVMLENYRNLVFLGIIPKCTTKELPPTGNSNTGEKFRTMTLERHECCDIEDIY

SEQ ID NO: 20184 - protein, 81 aa, Callithrix jacchus
MDTVALEDVAVNFTQEEWVLLGPSQKKLYRDVMQETIRNLDCIKMISEDQNIEDQYKNPKKNLRCRMAERLSESKDNSQCG

SEQ ID NO: 20185 - protein, 81 aa, Macaca mulatta
SLGPVSFKDVAVDFTQEEWQQLDPEQKITYRDVMLENYSNLVSVDEVWQADDLIERIQEGENKPSRQTVFTETLIEERGNV

SEQ ID NO: 20186 - protein, 81 aa, Enhydra lutris
QGQLTFRDVAIEFSEEEWGRLTHTQRQLYRDVMLENYGHLLFLAVSSHDTKSFLLQWSIEGSFQNGSMQRYKDSAFEILHL

SEQ ID NO: 20187 - protein, 81 aa, Enhydra lutris
SQDLVTFKDVAIDFSQEEWEWLNPAQRNLYKNMMLENYQNLVSLGLCISKPYVISLLEQGKEPCEMKTEMTRSPCSNSGSI

SEQ ID NO: 20188 - protein, 81 aa, Enhydra lutris
MLETYSHLVSLDVPFSKPKLISQLEQGEEPWKEERQHPLGLCPAEAKQNIPPCPHCPLAFASQQGLSQHVWFCHFPQLFSS

SEQ ID NO: 20189 - protein, 81 aa, Enhydra lutris
LQSPVTFEDVAVYFSREEWGILNVSQRHLYHSVMLENFELMTSLGCWHGVEDEGAHSKQNTSVEGMSQVRIPSANPSTQKA

SEQ ID NO: 20190 - protein, 81 aa, Bos indicus x Bos taurus
AAGSVTFNDVTMAFTRKEWEQLDPAQKSLYKDVMLENYSNLASMGYQALKPDMISKLEKGEEPWLGKGKRCRQGGSSEIAR

SEQ ID NO: 20191 - protein, 81 aa, Vulpes vulpes
FQGSVSFKDVTVGFTLEEWQHLDSTQRSLYRDVMLENYSNLVSLGYCVTKPEVIFRLEQGEEPWILEEEFPSQSFPESWET

SEQ ID NO: 20192 - protein, 81 aa, Vulpes vulpes
LQGPVTFTDVAVEFTHEEWMMLDSSQRRIYRDVVLENYINLTSVEHQLWKTIVISLLGQEELGSKLAFSKRVSTSKHCHKC

SEQ ID NO: 20193 - protein, 81 aa, Vulpes vulpes
MGMAGSISEGFIQRRHVGELQELGLSISKPNMISLLEQGKEPWMVEKEMSDDWESWYEIKELSPKWYIDEEEISQGMVMER

SEQ ID NO: 20194 - protein, 81 aa, Otolemur garnettii
ESVTFKDVAMDFSQEEWELLDPAQRNLYREVMLENYRNLVSLDWETKLKNQESTSKKVVLGEEPTSVKKYIYTQRDKDWTE

SEQ ID NO: 20195 - protein, 81 aa, Otolemur garnettii
VSFKDVTVDFTQEEWQHLDPAQKTLYMDVMLENYCHLISVGCHMTKPDVILRLERGEEPWASFAGHTCLDLCSVPSPSSHF

SEQ ID NO: 20196 - protein, 81 aa, Otolemur garnettii
SWAHMAFRDVAVDFSQEEWRLLSPAQRTLYREVMLENYSNLLSLGIPFSKPKLITQLEQGKETWREEKKCLPATCPVVICK

SEQ ID NO: 20197 - protein, 81 aa, Vulpes vulpes
MLENYGNLVSVGYQLSKPGVISQLEKGEEPWLIEREISGSPSSDLENKTETSESSLKNGISWEGLHHGLMMEQSTRGNTLY

SEQ ID NO: 20198 - protein, 81 aa, Otolemur garnettii
SVMFNDISIVFSQEEWEYLDLEQKDLYKDVMLENYGNLVSLGCFIAKPDVISLLEQGKEPWKVIRKGRRGYPDLETRYETK

SEQ ID NO: 20199 - protein, 81 aa, Enhydra lutris
SQESVTFQDVAVDFTEKEWPLLDSSQRKLYKDVMLENYSNLTSVGYQVGKPSLISHLEQEEEPRTEERTLHRASSPDWETP

SEQ ID NO: 20200 - protein, 81 aa, Enhydra lutris
LQEAFSFEDLSVDFTQKEWQLLDPSQKDLYKDVMLENYSSLVSLGYEVVKPEVIFKLEQGEEPWIGDGEVPSSDGPEQVLQ

SEQ ID NO: 20201 - protein, 81 aa, Enhydra lutris
SHTLVTFRDILVNFTREEWKLLDSAQQIMYKDVMLENYKNLVSLGHQLPKPHVILQLEKGEEPWLVERGIHRETQPDLETA

SEQ ID NO: 20202 - protein, 81 aa, Enhydra lutris
PQDLMTFEDVAVEFTQWEWGQLDPAQKDLYRVVMLENFKNLASLGFPVAKPYVISQLEKGKEPCVLEGEISTGNLRVPDEP

SEQ ID NO: 20203 - protein, 81 aa, Pongo abelii
PQDLVTFKDVAIDFSQEEWQWMNPAQKCLYRSMMLENYQSLVSLGLCISKPYVISLLEQGREPWEMTSEMTRSPFSEFILV

SEQ ID NO: 20204 - protein, 81 aa, Pongo abelii
SVAFEDVAVNFTHEEWALLGPSQKNLYRDVMRETIRNLNFIGMKWENQNIDDQYQNLRRNSRLSETWLQNFILIHYGHLVA

SEQ ID NO: 20205 - protein, 81 aa, Pongo abelii
MDVAIEFSLEEWQCLDTSQQNLYRHVMLENYRNLVFLGIAISKPDLITCLEQGKEPWNMKRHEMVVAKHSALCSHFAQDLW

SEQ ID NO: 20206 - protein, 81 aa, Bos indicus x Bos taurus
HSEGRLMFQDVAIDFTQEEWECLDPGQRKLYRDVMVENYRNLASLGLVSKVDLVTFLELLKDPRNIKRMKTTAIYPAVSPQ

SEQ ID NO: 20207 - protein, 81 aa, Bos indicus x Bos taurus
PQEAAELEFLSVNYTLKNWKGTALSQRALYWNIMLENCCSLAPLGENRMASSQLSPKQDISEESKSADRTSGILCGLILRG

SEQ ID NO: 20208 - protein, 81 aa, Pan troglodytes
GRPLEMAVSEPEASAAKEWKQLDPAPRNLYNDVMLENYSNQASMGCQAPKPDMISKLEKGEAPWLGKGKRPSQGCPSKIAR

SEQ ID NO: 20209 - protein, 81 aa, Otolemur garnettii
MAITFEDVTIIFTWEEWKFLDLSQKKLYREVMWENYTNVMSVGNWNVSFKPQEERFRYLEYENFSCWKGWRNADTPIYEDQ

SEQ ID NO: 20210 - protein, 81 aa, Otolemur garnettii
QGVLTFKDVSIEFSMDEWACLDPAQQHLYREVMLETYRHLVFLVSSMTEYQVLVSMENATGAEPFITLSCVRMSKNSRFIK

SEQ ID NO: 20211 - protein, 81 aa, Vulpes vulpes
AWVPLTFSDVAIDFSQEEWECLNSDQRDLYRDVMLENYTNLVSLDIDFTTETNKLSSGESSYEVNSYHRETMKRSKTFNLM

SEQ ID NO: 20212 - protein, 81 aa, Otolemur garnettii
RLGLLTFKDVSIEFSMDEWACLDSAQRNLYWDVMFKNYRNLVFLSFAVSKPDLITCLEQSKEPWKVKTHETVVKHPGLQPS

SEQ ID NO: 20213 - protein, 81 aa, Otolemur garnettii
FQEMLTFRDVTIELSLEEWACLNPAQRNLYRDVTLENYRNLVSLGLAASKPDLITYLEQWKKSWNVKRHETVAKHPDMLPC

SEQ ID NO: 20214 - protein, 81 aa, Vulpes vulpes
APLPLTFEDVAIYFSEHEWPNLDAWQKELYKHVMRTNYEILVSLDGRLPKPELISWIEQGREFFKNWGESQKSGNIICPSA

SEQ ID NO: 20215 - protein, 81 aa, Otolemur garnettii
SQEPVTFADVAVVFTPEEWAFLDSTQKSLYRDVMLENYRNLASVASEQLYKPCTLSHLEQRDELWTKERGVISDTCPDPQL

SEQ ID NO: 20216 - protein, 81 aa, Otolemur garnettii
WLQEPVTFRDVAVDFTQEEWVMLDSAQRSLYQDVMLENYRNLTSVEYQLCKLTVMSSLDQEDLRTMKKKIAQGIFPDQKIL

SEQ ID NO: 20217 - protein, 81 aa, Enhydra lutris
ARDWGTFEDMAMYFFQEEWELLDETQRRLYHNVRLETLALVASMGCWCGVEEAPLEQGVSVEGAYHFRTPKAYPSTLKANT

SEQ ID NO: 20218 - protein, 81 aa, Enhydra lutris
AREPVTYEDVAVDFTQEEWQHLDAAQKTLHRDVMLEIYGHLVSVGCSSIKPGIIFKLEHEEDPWIIKSELSTWIHSDREKS

SEQ ID NO: 20219 - protein, 81 aa, Enhydra lutris
TKGLVTFEDVAVDFTPEEWQYLNPPQKTLYREVMLETYSNLVSVGPQGTKPDLILKLEVKEPCLGETKISFWSFPAVCQIG

SEQ ID NO: 20220 - protein, 81 aa, Enhydra lutris
QSRGPLSFVDVFVDFTWEEWRLLDPSQKHLYRSVMLENYSNLVSLGYQDSKPDIIFTLEQEEPWMMLAQIPSQGHPEKVGE

SEQ ID NO: 20221 - protein, 81 aa, Enhydra lutris
AQGLMAFEDVAVYFSQEEWELLDAAQKALYCHVMLENFALVASLGLSASRPRVVIQLERGEEPWVLSGTVVTPVRNAPRKP

SEQ ID NO: 20222 - protein, 81 aa, Pongo abelii
AHALVTFRDVTIDFSQKEWECLDTTQRKLYRDVMLENYNNLVSLGLLSRHKTKKLSSEKDIHDISLSKGSKIEKSKTLHLK

SEQ ID NO: 20223 - protein, 81 aa, Pseudorca crassidens
MLENYGNVVSLGFPFPKPPLISHLDQEAELCVQDGQDREFLSCPHPVSAAKTRPENEKASSEQAVFENGEVCWVKFKSLLK

SEQ ID NO: 20224 - protein, 81 aa, Pongo abelii
EMGLLTFRDIAIEFSPEEWQCLDCAQRNLYRDVMLENYRNLVSLGIAVSKPDLITCLEQNKESQNIKRNEMVAKHPVMHSH

SEQ ID NO: 20225 - protein, 81 aa, Pongo abelii
GQLTFRDVAIEFSQEEWTCLNPAQKTLYRDVMLENYRNLVSLDISCKCINKDLPPKGKNNMGEAFYMVKLERLESHDTEGL

SEQ ID NO: 20226 - protein, 81 aa, Pongo abelii
SRSLENDGVCFTEQEWENLEDWQKELYRNVMESNYETLVSLSSSDSPASASRVAEITEVLGQTEGEAELGTQMLGDLEEEG

SEQ ID NO: 20227 - protein, 81 aa, Pongo abelii
QDTVVYEDLSVDYTQKKWKGLTLSQRALQWNMMPENDHSMASLGENMMKGSELTPKQKIFKGSESSNRTSGGLFGVVPGAA

SEQ ID NO: 20228 - protein, 81 aa, Pongo abelii
DSVAFKDVSVSFSQEEWALLAPSQKKLYRDVMQETFKNLASIATWEAEVGESLEAGRWRLQSHMGERLCEGKEGSQCAETF

SEQ ID NO: 20229 - protein, 81 aa, Bos indicus x Bos taurus
AQAQLTFKDLAIEFFQEEWECLDLAQRALYRHVMVEISCGIYTCQFLKNRKSFVKNLLKIKNVEKSIKTCSSILSLQRFPP

SEQ ID NO: 20230 - protein, 81 aa, Bos indicus x Bos taurus
MTLKDVAVTFSRGEWRKLEPSQKEIYKEVLLENYKNLELLGFPVSKLDLVSQLKWAGLPRLLQKEVSKGCRPECELGGGLK

SEQ ID NO: 20231 - protein, 81 aa, Bos indicus x Bos taurus
FQEPVTFEDVAVYFTQNQWASLDSAQRALYREVMLENYKNVASLVSPFPRPDLISQLERGEAPWDPDPWEAEDLRGICPGG

SEQ ID NO: 20232 - protein, 81 aa, Bos indicus x Bos taurus
MLETYRNLVSLGAGLAGPKPEVIAQLEQGDELWVLDMHGAEQPSVDGSAHGTRTENQEVTSGEMLFGRELDPLRGSVLRGP

SEQ ID NO: 20233 - protein, 81 aa, Pan troglodytes
QLSFSDVAIEFSQEEWKCLDPGQKALYRDVMLENYRNLISLDFSPLAWDARVSRVEAWRASGGAEEPTDPNFVGNDSPLPS

SEQ ID NO: 20234 - protein, 81 aa, Vulpes vulpes
WAGSVTFRDVAIDFSQEEWEFLDSAQRDLYRDVMWENYSNFISLEPSISKPDVITLLDEGKEPWMVVREETKRHCSDLDSR

SEQ ID NO: 20235 - protein, 81 aa, Otolemur garnettii
SQVSLMFEDVAVLFSRDEWRKLDPSQRNLYRDVMLENYSNLVSLAGLPFTKPKVISLLQQGEDPWMVEKESPTGSSLGWKN

SEQ ID NO: 20236 - protein, 80 aa, Otolemur garnettii
IVLLQESLTFKDVFVDFTLEEWQQLDSAQKNLYRDVMLENYSHLVSVGYLVTKPDGIFRLGPEESGMTDRGTPVLSCPGE

SEQ ID NO: 20237 - protein, 81 aa, Otolemur garnettii
MVTFKDVAVVFTEEELGLLDSAQRRLYRDVMLENFKNLLLVAHQPFKPDLIAQLENLKGNKNQQKMESIQEVRLSCLSPKE

SEQ ID NO: 20238 - protein, 81 aa, Vulpes vulpes
KSQELVAFEDVLVDFTPEEWQYLNSSQKTLYREVMLETYSNLVSVGQQDTKPDLILKLELEGPCLAERKISVWSFPEEACQ

SEQ ID NO: 20239 - protein, 81 aa, Otolemur garnettii
LTFQDVSIDFSVDEWACLDPAQQTLYRDVMLENYRHLVFLGLTLSKPDLITCLEQSKEPWKGKAHQTVVKHPDFMCTHTTI

SEQ ID NO: 20240 - protein, 81 aa, Otolemur garnettii
AQGCVTFEDVTIYFSQEEWGLLDEAQRLLYCDVMLENFALIASLGLTSFRSHVVAQLEMGKEPWVPDCVDMTSAMTRGACG

SEQ ID NO: 20241 - protein, 81 aa, Otolemur garnettii
MVENFKNLVAVGHLPFKPDMVSQLEVEEKLWVTETETQRNGGKNQDNMETFQKFALKYLSHEELSCWQIWKQVANELTKCL

SEQ ID NO: 20242 - protein, 81 aa, Otolemur garnettii
EHAPVTFRDVAVIFTEAEWKRLSMEQKNLYKEVMLENYSNLLSLGLDPAAPALVRALSELPKGKPKPTSQQIFLGLCADHH

SEQ ID NO: 20243 - protein, 81 aa, Vulpes vulpes
WLTFRDVAIEFSEEEWECLDPAQRALYRDVMLENYRNLVSLAITPKCMIKELPPQDNSNIGEVLQAVILERHKSCDTEDYI

SEQ ID NO: 20244 - protein, 81 aa, Otolemur garnettii
GTVVFSDVSVDFSQEEWECLDPVQRDLYREVMLENYSNLVSVGAGPYIPKPQVISLLEQGKEPWMVGRELTRGLCSDLESM

SEQ ID NO: 20245 - protein, 81 aa, Otolemur garnettii
FQASVSFKDVTVGFSQEEWQHLDPTQKTLYRDVMLENYSNLVSVGYCVAKPEVIFRLEQGEEPWIMEEESPHQSHPDIWKA

SEQ ID NO: 20246 - protein, 81 aa, Enhydra lutris
GWVPALFDEVAIYFSDEEWEVLTEQQKALYREVMRMNYETVLSLEFPFPKPDMITRLEGDKESQNSDEWQLQGGPLAETEE

SEQ ID NO: 20247 - protein, 81 aa, Enhydra lutris
MLENYGHLCFLGLLLSKPDLIMFLEQEKQLWDVKRKETGGFHPAVSSHDTQSFLLKQSIEDSFQTVSVHRYKHSAVEILHL

SEQ ID NO: 20248 - protein, 81 aa, Enhydra lutris
QGPVLFEDLAVYFSQEEYVSLHPAQRSLSRDTTQECFKDMVLMGGEGKTETSQQLNLESTGFEELAAENSSIPVPLVYYPE

SEQ ID NO: 20249 - protein, 81 aa, Enhydra lutris
GAPEQVTFEDVVVDFTREEWGQLEPAQRTLYRDVMLETFRLLVSVECWLPRPDVISPLEQEELWVADAGVPQHVYPNLETR

SEQ ID NO: 20250 - protein, 81 aa, Enhydra lutris
MGMAGPVSEGFVPRCHVGELQELGLSISKPNMISLLEQGKEPWMVEKEMSDGQYADWESWYEIKELSPKWYIGEEEISQGM

SEQ ID NO: 20251 - protein, 81 aa, Enhydra lutris
GCPAEMAVPKPTGSAAKEWEQLDPAQRDLYKDVMLENYSNLASMGFQAPKPDMISKLEKGEEPWLGKGKRPRQGGPSEIGR

SEQ ID NO: 20252 - protein, 81 aa, Enhydra lutris
PKVPVTFDDISIYFSTPEWEKLEEWQKELYKNIMKGNYESLISMDYAMNQPDVLSQIQPEGEHNTEEQPGPEESEIPTDPS

SEQ ID NO: 20253 - protein, 81 aa, Pongo abelii
EMGPLTFRDVTIEFSLEEWQCLDMAQQNLYRDVMLENYRNLVFLGIAVFKPDLITCLKQGKEPWNMKRHEMVTKPPVMHSH

SEQ ID NO: 20254 - protein, 81 aa, Pongo abelii
GEGSLSFEDVAVGFTREEWQFLDQSQKVLYKEVMLENYSNLVSVGYQGTKPDSLFKLEQGEPPWIVEGAAHSQICPGFVIQ

SEQ ID NO: 20255 - protein, 81 aa, Bos indicus x Bos taurus
MLETYSHLVSLDILFSKLELICQLEQGEEPWIKERQRSLGLCPASPHPACVVQSSPSVILKLRCRKSSPFRETLFRRSQTA

SEQ ID NO: 20256 - protein, 81 aa, Bos indicus x Bos taurus
VVFEDVAIYFSQEEWGLLDEAQRLLYCQVMVQNVALLSSVGCRHATQDEEALSEQHDVAARSQVKTPKPGPCIQKPHPSKT

SEQ ID NO: 20257 - protein, 81 aa, Pan troglodytes
GLLTFRDVAIEFSQEEWKCLDPAQRTLYRDVMLENYRNLVSLGHDLILFFLFLRWSFALVAQAGVQWHNLGSPQPPPPGFK

SEQ ID NO: 20258 - protein, 81 aa, Pan troglodytes
PPTGDILIQGTVTFEDVAVNFTWEEWNLLSEAQRCLYRDVTLENLALISSLDPALDGSADNTQTGNLGQSLLPSHPQQKTA

SEQ ID NO: 20259 - protein, 81 aa, Zalophus californianus
FQESVTFKDVIVDFTQEEWKQLDPVQRDLFRDVTLENYTHLVSIGLQVSKPDVISQLEQGTEPWIVEPGIPVGSLGDCETR

SEQ ID NO: 20260 - protein, 81 aa, Zalophus californianus
SKDLVTFGDVAVDFSQEEWEWLNPAQRNLYRKVMLENYRSLVSLAGVSVSKPDVISLLEQGKEPWMVKKEGTRGTCPDWEY

SEQ ID NO: 20261 - protein, 81 aa, Zalophus californianus
AQESLTFRDVFVDFTLEEWQQLDSAQKSLYRDVTLENYSHLVSVGYLVAGPDEVSRLGRGEEARRADRGPSAPNFPEFWQV

SEQ ID NO: 20262 - protein, 81 aa, Callithrix jacchus
CQETVTFEDVAVHFTKTEWTGLSPAQRALYRSVMLENYGNLTAMGYLVPKPALISLLEGGDMAWGLEAQDDPLAEGTKNIC

SEQ ID NO: 20263 - protein, 81 aa, Saimiri boliviensis
SQGSVLFEDVYVYFTQKEWQLLDPAQRLLYRDVMLENYRHVVSLGHCVTKPELIVKLEQGDEPWILKRDPPSQSHSEVQKA

SEQ ID NO: 20264 - protein, 81 aa, Balaenoptera acutorostrata
MYKDVMLENYRNLMSLGHQLPKPEVILQLEKGEEPWLVERGIHQETHPGEDQTARSGQESLARVVTSSPHFEDLETAVEVK

SEQ ID NO: 20265 - protein, 81 aa, Ovis aries
ELVTFRDVVISFSQEEWEYLDSVQRDLYWDVMMENYSNLVSLDLESKYDTKTLSVEDILEKNNSQWEVIENSKLVGLQNSI

SEQ ID NO: 20266 - protein, 81 aa, Callorhinus ursinus
AYGSLSFGEVAISFSQEEWECLDPAQRALYRDVMLETYSNLVSLGSSISKPDVITLLEQEKEPWVVVRRETSRWYPDLESN

SEQ ID NO: 20267 - protein, 81 aa, Rhinolophus ferrumequinum
PHGSMPFSTMTVAFTHEEWSYSGPALRDRSKEGRPDKARNLVLLGLPVSQPGMNSQLEQREGPWMLEGKGLRSTCPDWKTV

SEQ ID NO: 20268 - protein, 81 aa, Ursus maritimus
SQGPVSFRDVAVDFTQEEWQQLEPDEKTTYRDVMLENYSHLVSVGYDSTKPKVILKLEQGEEPWVAEGELPCQNHPEEVWK

SEQ ID NO: 20269 - protein, 81 aa, Ursus maritimus
VQESVTFKDVVVLFTRDEWAQLSAAQRALYRDVMLENYSHLVSLGLLGSQPDVFSQLGKGEDWMLEDASGGLCLDWMTMLV

SEQ ID NO: 20270 - protein, 81 aa, Rhinopithecus roxellana
MEGLVMFQDLFIDFSQEEWECLDAAQKDLYRDVMMENYSSLVSLGLCSPKPDVISLLEQGKEPWMVSRDVLGGWCPDSEFR

SEQ ID NO: 20271 - protein, 81 aa, Rhinopithecus roxellana
MLENYKNLATVGCQLFKPSLISWLEQEESRTVQRGDFQASEWKVQLKTKESALQQDFLGEPNSSGIQMIGSHNEGEVNDVK

SEQ ID NO: 20272 - protein, 81 aa, Rhinopithecus roxellana
NFWILRLPPGSKGEAPKEWGKLEDWQKELYKHVMRGNYETLVSLDYAISKPEVLSQIEQGKEPCNWRRPGPKIPDVPVDPS

SEQ ID NO: 20273 - protein, 81 aa, Rhinopithecus roxellana
AQSSVTFEDVAVNFSLEEWSLLNEAQRCLYRDVMLETLTLISSLGCWHGGEDEAAPSKQSTCLHINKDQGGHSGERPYECG

SEQ ID NO: 20274 - protein, 81 aa, Rhinopithecus roxellana
TQGQVTFKDVAIEFSQEEWTCLDPAQRTLYRDVMLENYRNLASLAGISCFDLSIISMLEQGKEPFTVESQVQIARNPDGWE

SEQ ID NO: 20275 - protein, 81 aa, Rhinopithecus roxellana
GPLTFRDVAIEFSQEEWQCLDPVQKALYWDVMLENYRNLVFLGILPKCMTKELPPIGNSNTGEKFQTVMLERHECYDIENF

SEQ ID NO: 20276 - protein, 81 aa, Rhinopithecus roxellana
PVTFRDVAVIFTEAEWKRLSPEQRNLYKEVMLENYRNLLSLAEPKPETYPCSSCLLAFSCQQFLSQHVLQIFLGLCAENHF

SEQ ID NO: 20277 - protein, 81 aa, Callithrix jacchus
MGSLTFRDVAIEFSLEEWQCLDTAQQDLYRKVMLENYANLAFLGIAVSKADLITFLEQGKDLWNIKRHSIVAKPPVLCSHF

SEQ ID NO: 20278 - protein, 81 aa, Macaca mulatta
QGSVTFEDVAVYFSWEEWDLLDEAQKHLYFDVMLENFALTSSLGKALILTLVPCTRLCVSPFPQEQLCPHIWTIGTASFPS

SEQ ID NO: 20279 - protein, 81 aa, Callithrix jacchus
TLKETVTFKDVAVVFTEEELRLLDPAQKKLYQDVMLENFRNLLSVGHQPFHGDTFHFPREEKFWMVETATQREGNLGGKIQ

SEQ ID NO: 20280 - protein, 81 aa, Macaca mulatta
KPGAVSFADVAVYFSPEEWGCLRPAQRALYRDVMRETYGHLGALGVGGSKPALISWVEEEAELWDPAARDPEVTKCPTETD

SEQ ID NO: 20281 - protein, 81 aa, Macaca mulatta
EKGPLTFRDVVIEFSQEEWQCLDTAQQDLYRKVMLENFRNLVFLAGIDVSKPNLITCLEQGKYPWNMKRHSMVVKPPVICS

SEQ ID NO: 20282 - protein, 81 aa, Monodon monoceros
FQEAAVFEFLSVDYTQQKWKGLALSQRALYWNIMLENCCSLASLGENRMESSELPPKQELSKVLKSSDRTSVVLCGMIPGG

SEQ ID NO: 20283 - protein, 81 aa, Callithrix jacchus
DGLVTFRDVAIDFSQEEWECLDPAQRDLYVDVMLENYSNLVSLDLESTTYDAKKIFSEKDIFEINFSQWEMKEKSKIPGRE

SEQ ID NO: 20284 - protein, 81 aa, Macaca mulatta
YLGPVTFEDVAVLFTEAEWKRLNLEQRNLFKEVMLENLRNLVSLAILGARPGSPFSFGKGSSVNLPRGDTTHCPVGGLRDG

SEQ ID NO: 20285 - protein, 81 aa, Ovis aries
AQGSVTFPDVAVYFSWEEWRLLDEAQRRLYLDVMLENYALISSLGFWSGEEKVETSFAQSVSVAVSQARTSKEASSSQKTH

SEQ ID NO: 20286 - protein, 81 aa, Ovis aries
GLVTFGDVAIDFSQEEWEFLNPAQRDLYVDVMLENYSNLVSLDLESTYETKNTFSKKDIFEINFSQWKIKERSKTIELEAS

SEQ ID NO: 20287 - protein, 81 aa, Ovis aries
PQGGVTFEDIALSFSWKEWKLLDAAQRRLYHDVMLENYALISSLGFWSGEEKVETSFAQSVSVAVSQARTSKEASSSQKTH

SEQ ID NO: 20288 - protein, 81 aa, Ovis aries
QGHLTFKDVAIEFSQEEWECLDPAQRALYRDVMLETYRNLLSVGGFLTTGPPGKLLCMFLFSNMFSTVLSLTFVNKFSKHM

SEQ ID NO: 20289 - protein, 81 aa, Ovis aries
REGLVSFEDVTMDFSREEWQQLDPAQRHLYQDVMLEIYSHFFSVGYHIPNPEIIFRIEEGKEPWMRETEVPCQRYHEGEFG

SEQ ID NO: 20290 - protein, 81 aa, Ovis aries
WQACVTFEDVAIYFFQDWRLLNETQRFLYCDVMLENFALITSLDCSCEMEEDEVIPSEQSLSVGESQVRTSRSGPSTQKSH

SEQ ID NO: 20291 - protein, 81 aa, Ovis aries
PKVPVTFDDISIYFSTPEWEKLEEWQKELYKNIMKGNYESLISMVDYAMNQPDVLSQIQPEGDRNTEDQAGPEESGIPTDP

SEQ ID NO: 20292 - protein, 81 aa, Otolemur garnettii
DSVAFEDVAVNFTQEEWALLDHHQKKLYRDVMQETFINLASIGKNEIISLLSQLENKFGMWKGNAFINKSDIIAAQHRRKK

SEQ ID NO: 20293 - protein, 81 aa, Otolemur garnettii
QALLTFRDVSVEFSMDEWAYLDPAQQNLYRDVMLETYGNLVFLETGLDVSKPDLITCLEQRKEPWKVKTHKTVVKHPVILN

SEQ ID NO: 20294 - protein, 81 aa, Vulpes vulpes
AQDSVTFEDIAVYFSWEEWRLLDEAQRFLYHDVMLENFALISSLGCCCGAEDVEAPCEQSISVGVSQDRTPRAALTFRKTH

SEQ ID NO: 20295 - protein, 81 aa, Vulpes vulpes
FKETVTFKDVAVVFTEEELGLLDPAQRKLYGDVMLENFRNLISVGGKIQSKMKTVLEAEPPEEHSCWRIWQQIASDLSRCQ

SEQ ID NO: 20296 - protein, 81 aa, Otolemur garnettii
TSVSFKDLTVDFTQEEWQHLDPAQRFLYRDVMLENYSYLVTIQFPFQCLRPTLLSQKSYFPFPFQFMQVLEFLCHCQKLNR

SEQ ID NO: 20297 - protein, 81 aa, Vulpes vulpes
VSTFSQDPQKMNTPQASVSFKDVTVEFTQEEWRQMDSAQRTLYRDVMLENYSHLVSVGEQTLLCDSLLTACSSFSFFFLKC

SEQ ID NO: 20298 - protein, 81 aa, Otolemur garnettii
QVSVTFDDIAVTFTKEEWGQLDPAQRTLYQEVMLENCRLLMSLGCPIPRPVLIYQLEHGQTPWTVRKDLFQGPCSGEKEKL

SEQ ID NO: 20299 - protein, 81 aa, Pan troglodytes
EPGAVSFADVAVYFCREEWGCLRPAQRALYRDVMRETFGHLGALGFSGPKPAFISWVEGEVEAWSPEAQDPDGESSAAFSR

SEQ ID NO: 20300 - protein, 81 aa, Camelus dromedarius
FRRSFAFEDVYISFTGEEWEILDENQKRLYCNLMMETFAQVMSLGLAVSRNRIMSQREPEREPVIPNRADMAPTEADVIRE

SEQ ID NO: 20301 - protein, 81 aa, Camelus dromedarius
LALVSFEDVAITFTGEEWRHLDLAQRTLYQEVMLETCGLLVSLGKASSLFQGVPSASFIPPSLSAWLVEKTPGTCLPFSPQ

SEQ ID NO: 20302 - protein, 81 aa, Camelus dromedarius
RPRAVKFADVAVYFSPEEWECLRPAQRALYRDVMQETYGHLGALGCAGPKPALISWLERNTDDWELAALDPQECPRQITVQ

SEQ ID NO: 20303 - protein, 81 aa, Camelus dromedarius
MAAADPSSEHLYRSVMLENYNNLASLGHQHTNPSAIFQLEQEELWMKQIPSQGHAGGEQDTECFSSVPRPGLSSDVTLPSG

SEQ ID NO: 20304 - protein, 81 aa, Camelus dromedarius
GLLSFTDVSMEFTWEEWQLLDSTQKHLYRDVTLENYSNLLSVDANECFPVVAPDPSVPKKVGKNGTRKMMNLKVLREAMLV

SEQ ID NO: 20305 - protein, 81 aa, Camelus dromedarius
FTSFQGLVTFGDVAVDFSQEEWEWLSPSQRTLYRRVMLENYRSLVSLGVSVSKPDVISLLEQGKEPWKVKKEWTGGTRPGE

SEQ ID NO: 20306 - protein, 81 aa, Pongo abelii
KSLVTFEDVAVYFSQEEWELLDAAQRHLYHRVMLENLELVTSLGCWHGVEGEEAHPKQNVSVEVLQVRIPNADPSTKKANS

SEQ ID NO: 20307 - protein, 81 aa, Pongo abelii
QEVLTFRDVAIEFSLEEWQCQDTAQQNLYRNMMLENYRNLVFLGIAASKPDLITCLEQGKEPWNVKRHEMVAEPPVVWSYF

SEQ ID NO: 20308 - protein, 81 aa, Pongo abelii
GPVSFKDAAVDFTQEEWRQLDPDEKITYGDVMLENYSHLVSMGEDSLLSECSQPNVIIKLEQGEEPWIMGGEFPCQHSPEP

SEQ ID NO: 20309 - protein, 81 aa, Pongo abelii
RTKEAVTFKDVAVVFTEEELGLLDPAQRKLYRDVMLENFRNLLSVGHQPFHGDTFHFLREEKFWVMETTSQREGNSGGKIQ

SEQ ID NO: 20310 - protein, 81 aa, Pongo abelii
SPPESVSFKDVTVDFSRDEWQQLDLAQKSLYREVMLENYFNLISVGCQVPKPEVIFSLEQEEPCMLDGEIPSQSLPDGDIG

SEQ ID NO: 20311 - protein, 81 aa, Bos indicus x Bos taurus
QLTFKDVAVEFSQEEWECLDPAQRAFYMDVMVETLRNLISVGEDHFASEIRISPWVSLHFFCAPWEPLFCLIDLKSLLIQT

SEQ ID NO: 20312 - protein, 81 aa, Bos indicus x Bos taurus
QACVTFEDVAIYFSQDEWRLLNETQRFLYCDVMLENFALTTSLGCWHGVDKEEAASEQSVSVAVSHIHASRADSLTQMAHP

SEQ ID NO: 20313 - protein, 81 aa, Bos indicus x Bos taurus
RSCSGFSGLCASPIEELYGALISSWDSRTMTDGMVTFRDVAIDFSQEEWEFLDPAQRDLYVDVMLENYSNLVSLGKVICLK

SEQ ID NO: 20314 - protein, 81 aa, Bos indicus x Bos taurus
FQGRLTFQDVAIDFTQEEWECLDLDQQELYRDVMLENYRNLASLGLVVSKLDLVTFLEQMKNPWDVRRLEPPAIYTGRCEW

SEQ ID NO: 20315 - protein, 81 aa, Bos indicus x Bos taurus
LQGGVTFPDIAVRFSQREWRLLDETQRLLYLDVMLENYTLISSLGFWSGEEKVETSFEQSVSVAVSQARTSKEPSSSQKTH

SEQ ID NO: 20316 - protein, 81 aa, Bos indicus x Bos taurus
HSEGRLTFQDVAIDFTQEEWECLDLDQRELYRDVMLQNYGNLASLGLVSKLDLVTFLEQLKDSRNIRRMETTAIYPAVSPQ

SEQ ID NO: 20317 - protein, 81 aa, Camelus dromedarius
TEKESGMALSQGQLTFEDVAIKFSQEEWECLDAAQRALYRDVMLETYRNLLSLAEQRAGIPEKTQYFAFLPSDEQEFLFLI

SEQ ID NO: 20318 - protein, 81 aa, Camelus dromedarius
CPQDSVTFADVAVGFTQEEWTLLDSFQRNLYRDVMLENCKNLTTAGYQWFKPTLISWLEQEELRTEERGAVQGISVRTLVR

SEQ ID NO: 20319 - protein, 81 aa, Myotis davidii
FEESLTFDDVAVEFTSEEWQLLDPDQKDLYRDVMMENYSHLMALGYQAPKPDVLSKLERGEELWIVQDELHCPVFPELNQV

SEQ ID NO: 20320 - protein, 81 aa, Myotis davidii
VTFGDVAVDFSQEEWDCLNSSQRHLYSNVMLENYRILVSLGWESVCESEELTPKQDICEAQSSQKIIVKFKSCGLEYSNLR

SEQ ID NO: 20321 - protein, 81 aa, Myotis davidii
VSFEDVAVNFSLEEWALLDPSQKKLYRDVMLETFRNLVSIVIFEYMKQLTLKRNPMNVRNAERPSDLTVPYNHTEEFTKER

SEQ ID NO: 20322 - protein, 81 aa, Myotis davidii
EESAVTFGDVDVAFSPEEWGRLSCAQKALYRDVMLENYRNLVSLGLCCSKPEVISSLEQRTEPCMAESGLTGGQHPGQQSV

SEQ ID NO: 20323 - protein, 81 aa, Cercocebus atys
FEELVTFEDVFVDFSPEELSSLSAAQRNLYREVMLENYRNLVSLRYQFSKPDIISRLEAEESRAMETDSRHTVICQGEAHD

SEQ ID NO: 20324 - protein, 81 aa, Cercocebus atys
YDSVAFEDVAVNFTREEWALLGPSQKTLYRDVMWETIRNLDCIGMKWEDTDVEDQHKNPRRSLRCLIVERFSESNQIPGST

SEQ ID NO: 20325 - protein, 81 aa, Cercocebus atys
PQELVMFEEVSVCFTSEEWACLGPIQRALYWDVMLENYGNVTSLEWETMTENEEVTSKPSSSQRADSHKGTSKRLQGSVPQ

SEQ ID NO: 20326 - protein, 81 aa, Enhydra lutris
PQDLMTFEDVAVEFTQWEWGQLDPAQKDLYRVVMLENFKNLASLGFPVAKPYVISQLEKGKEPCVLEGEISTDWEKRPKAK

SEQ ID NO: 20327 - protein, 81 aa, Pongo abelii
MEGLVMFQDLSIDFSQEEWECLDTAQKDLYRDVMMENYSSLVSLGLSISKPDVISLLEQGKEPWMVSRDVLGGWCPGYFSD

SEQ ID NO: 20328 - protein, 81 aa, Pongo abelii
QGLLTFRDVAIEFSQEEWKCLDPAQRTLYRDVMLENYRNLVSLDTGFLLFHLADLKLPPSGDPPTSASETAAITDISSKCM

SEQ ID NO: 20329 - protein, 81 aa, Pongo abelii
MFKEAVTFKDVAVVFTEEELGLLDLAQRKLYRDVMLENFRNLLSVGHQTSHRDAFHFRREEKFWMMETATQREGNSGGKIQ

SEQ ID NO: 20330 - protein, 81 aa, Pongo abelii
PKPGPQEAVVFEDVAVYFTRIEWSCLAPDQQALYRDVMLENYGNLASLALISLLEQGEEPGALILQGAEQSVAKASLCTDS

SEQ ID NO: 20331 - protein, 81 aa, Pongo abelii
MDSVAFKDVSVSFSQEEWALLAPSQKKLYRDVMQETFKNLASISHMGERLCEGKEGSQCAETFSPNLSVTKKTAGVKPYEC

SEQ ID NO: 20332 - protein, 81 aa, Pongo abelii
VHGSVTFRDVAIDFSQEEWECLQPNQRTLYRDVMLENYSHLISLAGSSISKPDVITLLEQEKEPWIVIWSQNMDLRKYLQK

SEQ ID NO: 20333 - protein, 81 aa, Bos indicus x Bos taurus
THELLTFEDVAVDFTQEEWSLLDKSQKNLFRNVMMETIHHLVSVGESISKSDVISLLEQGKELWSKAAGGFQGQRPGEHQG

SEQ ID NO: 20334 - protein, 81 aa, Pan troglodytes
MGALTFRDVAIEFSLEEWQCLDTEQQNLYRNVMLENYRNLVFLGIAVSKPDLITCLEQEKEPWNLKTHDMVAKPPVICSHI

SEQ ID NO: 20335 - protein, 81 aa, Pan troglodytes
AQMLVTFKDVAVTFTREEWRQLDLAQRTLYREVMLETCGLLVSVGHRVPKPELVHLLEHGQELWIVKRGLSHATCAGQEPR

SEQ ID NO: 20336 - protein, 81 aa, Pan troglodytes
MAFEDVAVYFSQEEWGLLDTTQRALYRHVMLENFTLVTSLGLSTSRPHVVIQLERGEEPWVPSGKDMTLARNTYGRLNSGS

SEQ ID NO: 20337 - protein, 81 aa, Pan troglodytes
QVTFNDVAIDFTHEEWGWLNSAQRGLYKDVMVQNYENLVSVAGLSITKPYVITLLEDGKEPWTVEKKLSKVSFFSYTVLSI

SEQ ID NO: 20338 - protein, 81 aa, Camelus dromedarius
NVDFVISEDTAHSVAHLDIDCHSEQLIFEDVAIRFSQEEWECLVPAQRALYRDVMLETYRNLLSVVESSLGKQKFIFVENS

SEQ ID NO: 20339 - protein, 81 aa, Camelus dromedarius
TPEPVRFADVAVYFSLEEWGCLQPAQRALYRDVMRETYGHLGALGFRGTKPALISWVEKEAELWGPDARDPEVGECLTEAD

SEQ ID NO: 20340 - protein, 81 aa, Camelus dromedarius
PQGLVTFGDVAVDFSQEEWEWLDCAQRTLYRSVMLENYRSLVSLGLCVSKPEMISSLEQRKEPWTVKRKCTRGQCPDSEAV

SEQ ID NO: 20341 - protein, 81 aa, Myotis davidii
NLVGVTFEDVALYFSGTEWQLLDEAQRGLYLDVMLENFALLSSLGCCCGTRDLEASLEQNVSVRVSQAKKTKIPLSSQNSH

SEQ ID NO: 20342 - protein, 81 aa, Cercocebus atys
QGHVTFEDIAVYFSQEEWGLLDEAQRCLYHDVMLENFSLMASVAQLSESNHKDSCSQQKVTVSLNNCVAQCSPDDGHYTPK

SEQ ID NO: 20343 - protein, 81 aa, Cercocebus atys
EMGLLTFRDVAIEFSLEEWQHLDIAQRNLYRNVMLENYRNLAFLGIAVSKPDLITCLEQGKEPWNMTRHEMVDESPGICPL

SEQ ID NO: 20344 - protein, 81 aa, Enhydra lutris
QVSVAFQDLAVRFSEEEWQLLGEGQRALYRDVMRENYETLRSLGTDGLLPLSAFLSPAEPGGAMEGRRYAGEGQETPRGGG

SEQ ID NO: 20345 - protein, 81 aa, Enhydra lutris
SQDLVTFKDVAIDFSQEEWEWLNPAQRNLYKNMMLENYQNLVSLDSGSIYETQELFLKQFMYDDVLMERITDYGLECSTYR

SEQ ID NO: 20346 - protein, 81 aa, Enhydra lutris
MFQVTFSDVAIDFSHEEWGWLDSAQRDLYKDVMIQNYENLVSLAGLSIPKPYVITLLEDGKEPWMVEKKDWESRWENKELV

SEQ ID NO: 20347 - protein, 81 aa, Enhydra lutris
TGCPAEMAVPKPTGSAAEWEQLDPAQRDLYKDVMLENYSNLASMGFQAPKPDMISKLEKGEEPWLGKGKRPRQGGPSEIGR

SEQ ID NO: 20348 - protein, 81 aa, Enhydra lutris
VFQGSLSFEDVTVDFSREEWRLLDLAQKSLYRDVMLENYFNLISVGCQVPKQEVLFSLEQEEPRMLDGEISSHNCLGGDIG

SEQ ID NO: 20349 - protein, 81 aa, Enhydra lutris
PKVPVTFDDVAVHFSEQEWGNLSEWQKELYKNVMRGNYESLVSMDYAISKPDLMSQMERGERPTVQEQEDSEEGETPADPS

SEQ ID NO: 20350 - protein, 81 aa, Enhydra lutris
FTALFVLPKPKVISCLEQGEEPWVQGPLEFKNSSGELPSGLKVKSDTENHQPVCLSDLEIQVPGDIVSKKTRVKVPQKTTG

SEQ ID NO: 20351 - protein, 81 aa, Pongo abelii
RSQESLTFQDVAVDFTREEWDQLYPAQKNLYRDVMLENYRNLVALGYQLYKPEVIAQLELEEEWVIERDSLLDTHLDGENR

SEQ ID NO: 20352 - protein, 81 aa, Pongo abelii
LLTFRDVAIEFSQEEWKCLDPAQRTLYRDVMLENYRNLVSLVRRSEVCCIDIWAEVIVADISSKCMLKTLSSTGQGNTEVF

SEQ ID NO: 20353 - protein, 81 aa, Pongo abelii
FQELVTFRDVAIDFSRQEWEYLDPNQRDLYRDVMLENYRNLVSLGGHSISKPVVVDLLERGKEPWMILREETQFTEMGVSL

SEQ ID NO: 20354 - protein, 81 aa, Pongo abelii
SQGLVTFRDVAIDFSQEEWKWLQPAQRDLYRCVMLENYGHLVSLAGLSISKPDVVSLLEQGKEPWLGKREVKRDLFSVRVK

SEQ ID NO: 20355 - protein, 81 aa, Pongo abelii
VTFSDVAMDFFHKEWGWLDSAQRDLYKDVMVQNYKNLVSVAGLSVTKPHVITLLEDGKEPWMMEKKLSKGMIPEWESRWEK

SEQ ID NO: 20356 - protein, 81 aa, Pongo abelii
FQESVTFQDVAVDFTVEEWQLLDCAERTLYWDVMLENYRNLISVGFPITKTKVILKVEQGQEPWMVEGVNPHQSSPESRSV

SEQ ID NO: 20357 - protein, 81 aa, Pongo abelii
MGPLQFRDVAIEFSLEEWHCLDTAQRNLYRDVMLENYRNLVFLGIVVSKPDLITCLEQGKKPLIMKKHEMVANPSGPVLHI

SEQ ID NO: 20358 - protein, 81 aa, Pan troglodytes
QGLLTFRDVAIEFSQEEWKCLDPAQRTLYRDVMLENYRNLVSLDISSKCMMKEVLSTAQGNREVIHTGTLQRHESHHTGDF

SEQ ID NO: 20359 - protein, 81 aa, Pan troglodytes
YQDSVTFDDVAVEFTPEEWALLDTTQKYLYRDVMLENYTNLASVEWEIQPRTKRSSLQQGFLKNQIFTGIQMQTRSYSGWK

SEQ ID NO: 20360 - protein, 81 aa, Pan troglodytes
SLEKVTFEDVAIDFTQEEWAMMDTSKRKLYRDVMLENISHLVPLGYQISKSYIILQLEQGKELWREGREFLQDQNPDRESA

SEQ ID NO: 20361 - protein, 81 aa, Camelus dromedarius
EEEEEEIQSRELEDGPTDMQKVRICSEGGWVPALFDEVAIYFSDEEWEVLTEQQKALYREVMRMNYETVLSLGKALFSFVS

SEQ ID NO: 20362 - protein, 81 aa, Camelus dromedarius
VTVKDEEMDFTHVEEEQLNSAQRFVGMDMKVENCGSLVFWDSDAIPETKVSLSKQDAYEEIPPEQELIIQRLEKDDAWECG

SEQ ID NO: 20363 - protein, 81 aa, Myotis davidii
LGDPVAIEDVAVNFTLEEWALLDPPQKKLYRDVMKETFRNLDSIGQNWEDHYIEDLYKSQGRKLRCVTRKTSAAKSPQLGS

SEQ ID NO: 20364 - protein, 81 aa, Cercocebus atys
TGGDVTFSDVAIDFSHEEWAWLDSAQRDLYKDVMVQNYENLVSVGLSVTKPYVIMLLEDGKEPWMVEKKLSKDWESRWENK

SEQ ID NO: 20365 - protein, 81 aa, Cercocebus atys
PQGHLTFMDVAIEFSQEEWKCLDPGQRALYRDVMLENYRNLVSLGICLPDLSIISMLKQRREPLTVQSEVKIVKNPDGREC

SEQ ID NO: 20366 - protein, 81 aa, Cercocebus atys
KSLVTFEDVAVYFSQEEWELLDAAQRHLYHSVMLENLELVTSLGNTLSQHGDDQLMPCNISVEEVLPVRIPNTDSSTKKAN

SEQ ID NO: 20367 - protein, 81 aa, Cercocebus atys
VLGLQGSLTFRDVAVEFSLEEWQFLDTAQQNLYRNVMLENYRNLVFLGIAVSKPDLIIFLEQGKEPWNMKRHEMAEEPPGR

SEQ ID NO: 20368 - protein, 81 aa, Cercocebus atys
NCSGLKFKDVVIYFSQKEWECLQSAQKDLYQDVMLENYSNLVLLGLSDTKPNVISLLEQKSEPWLVKRNETKEWCPDWEFG

SEQ ID NO: 20369 - protein, 81 aa, Vulpes vulpes
LLTFRDVAIEFSEEEWECLDAAQRALYRDVMLENYRNLVSLDFSTRCMSKELPPKDDINNGELFQTLILERHRSHDFDLRE

SEQ ID NO: 20370 - protein, 81 aa, Vulpes vulpes
SEESVTFEDVAIYFSENEWTGLAPAQRVLYRDVMLENYGAVAALGYPFLKPAGISHFEQVEEPLNLKLQGEGPSLTCTEGV

SEQ ID NO: 20371 - protein, 81 aa, Otolemur garnettii
LQESVTFQDVAMDFTLEEWQLLDCAKRTLYWDVMLENYRNLISVGCPVTKTKVIFKVEQGQEPWRAERGKPHWSHPEADYL

SEQ ID NO: 20372 - protein, 81 aa, Otolemur garnettii
LQGSVTFKDVTMAFTQKEWERLDPTQKNLYKDVMLENYSNLASMAGFQAPKPDMISKLEKGEEPWLGKGKRPNQGHSNKIA

SEQ ID NO: 20373 - protein, 81 aa, Otolemur garnettii
WSQMPVTFEDVALYLSREEWGRLDHTQQNFYRDILQRRNGLSLGFPFSRPFWAAQVQGKDEASSSSQQTGDEPAERGMSTG

SEQ ID NO: 20374 - protein, 81 aa, Otolemur garnettii
FLELLTFQDVSIEFSVDEWACLDPAQQTLYQDVMLENYRHLVFLAGLTLSKPDIITCLEQSKEPWKVKAQQTVVKPPVQPS

SEQ ID NO: 20375 - protein, 81 aa, Vulpes vulpes
SQGLLTFRDVTIEFSQEEWGCLNHTQRELYRDVMLENYGNLLFLGLVVSKPDLIIFLEQKRELWDVKGKETVAFHPDLVVS

SEQ ID NO: 20376 - protein, 81 aa, Otolemur garnettii
YQDSVTFNDVAVDFTQEEWVLLAQTQKILHKDVMLENYKNLATVGYQLIKPSLISWLEQEEELRTVQGGDLQDWEILLKTN

SEQ ID NO: 20377 - protein, 81 aa, Bos indicus x Bos taurus
PTVSFKDVAVTFTWVKWGHVDLAQRTVYREVVLETYPHHLCLSLFPGPELPKPDVISQLEQGAELWVAERGLAQGCRPGES

SEQ ID NO: 20378 - protein, 81 aa, Pan troglodytes
VTFDDVAVDFTPEEWALLDTTEKYLYRDVMLENYMNLASVDFFFCLTSEWEIQPRTKRSSLQQGFLKNQIFTGIQMQTRSY

SEQ ID NO: 20379 - protein, 81 aa, Pan troglodytes
AQESVMFSDVSVDFSQEEWECLNDDQRDLYRDVMLENYSNLVSMAGHSISKPNVISYLEQGKEPWLVDRELTRGQWPVLES

SEQ ID NO: 20380 - protein, 81 aa, Pan troglodytes
SQGRVTFEDVTVNFTQGEWQRLNPEQRNLYRDVMLENYSNLVSVGQRETTKPDVILRLEQGKEPWSEEEEVLGSGRAEKNG

SEQ ID NO: 20381 - protein, 81 aa, Camelus dromedarius
AQGCVTFEDVTIYFSQEEWGLLDEAQRLLYCDVMLENFALIASLGLTSFRSHIVAQLEMGAEPWVPDQVDMTSAMARGAYK

SEQ ID NO: 20382 - protein, 81 aa, Camelus dromedarius
TQGPVVFEDVAVDFTQEEWALLDLAQRNLYRDVMLENFQNLVSLGYPLHTPSLISQWKQEEEPVTVKKGPTQEEHQEGFET

SEQ ID NO: 20383 - protein, 81 aa, Camelus dromedarius
APLPLTFEDVAIYFSEQEWRGLEAWQKELYKQVMRTNYEILVSLDDGLPKPELISWIEQGRELFRNWGESQRSGNVICPSA

SEQ ID NO: 20384 - protein, 81 aa, Myotis davidii
MAEALVQWRQLNPPQADVPQKHRNLVLLGLPISKPDVISQLESGEKPEREASKTTSPDGEIRPEGKELTREQDVSEEESAP

SEQ ID NO: 20385 - protein, 81 aa, Cercocebus atys
MESVTLEDVAVEFIQEWALLDSARRSLCTYGMLDQCRTLTSRGAGAVPEDAAGALYRSEGDATDSRGPASSPGAALVSGMH

SEQ ID NO: 20386 - protein, 81 aa, Cercocebus atys
LVMFQDLFIDFSQEEWECLDTAQKDLYRDVMMENYSSLVSLDSEFRCKTKDSCLPKEIYEVTSSQWVRMEKCHSLVGSSVR

SEQ ID NO: 20387 - protein, 81 aa, Otolemur garnettii
SVMFKDVAIDFSQEEWEYLDSAQRDLYRDVMLENYNNLVSLDLPLMYANKDLSPKKDIYEIELSQWEMSNRLENSDIEEPN

SEQ ID NO: 20388 - protein, 81 aa, Otolemur garnettii
SLGSELFRDVAILFSQEEWQWLVPAQRDLYRDVMLETYSNLVSLGLPISKPDVISFLEQGKEPWIVERVTTGDLCPVLESG

SEQ ID NO: 20389 - protein, 81 aa, Otolemur garnettii
QSFVTFEDVAIYFSQEEWELLDDVQRHRYQHVMQENLALIAFQVCWCLVIVPEPGAALSFPQLAPGVRDPKAHPSNLKTLL

SEQ ID NO: 20390 - protein, 81 aa, Otolemur garnettii
QGHVVFEDVAIYFSQEEWGHLDEAQRSLYRDVMLENMALLSSLGCWQETPGAEAPSEQGVSVVLSQVITPVPCVSSQKIQP

SEQ ID NO: 20391 - protein, 81 aa, Enhydra lutris
VQGQVNFEDVAVYFSQEEWGLLDEAQRRLYRDVMLETFALVASLRDESSMSHGVPSLELGSKPWGSDWADVTPARTREAQG

SEQ ID NO: 20392 - protein, 81 aa, Enhydra lutris
GLVSFEDVAMDFSREEWQQLDPAQRSLYRDVMLEIYSHLLSVERALGLKTSQQKIFEKASFHNKESEVTRGGPWCSISEDL

SEQ ID NO: 20393 - protein, 81 aa, Enhydra lutris
QESLTFKDVAVDFTLEEWGQLGPGQRELYRDVMLENYRNLLSLGAGPPGSKPDVISRLERGEEPRMEKREAQLAACPALDT

SEQ ID NO: 20394 - protein, 81 aa, Enhydra lutris
AGSQGQLTFRDVAIEFSLEEWGRLTHMQQELYRDVMLENYRHLLFLGLVSKPDLVTFLEQKKEPWEVKRKESIATHPGRWE

SEQ ID NO: 20395 - protein, 81 aa, Pongo abelii
VTFEDVAVVFTDEEWSHLVPTQRDLYKEVMLENYNSIVSLDWETKPEIHDASNEKSEGSLRECLGRQSPLCPKFEVHTPDG

SEQ ID NO: 20396 - protein, 81 aa, Pongo abelii
MGPLTFMDVAIEFSLEEWQCLDPAQQNLYRHVMLENYRNLVFLGIAVSKPDLITCLEQGKEPWNMKRHEMVAKHLVMFYYF

SEQ ID NO: 20397 - protein, 81 aa, Pongo abelii
RQAFLAFGDVTVDFTQKEWRLLSPTQRALYREVTLENYSHLVSLGILHSKPELIRRLEQGEAPWGEERRRRPGPCTGIYAE

SEQ ID NO: 20398 - protein, 81 aa, Pongo abelii
MFKEAVTFKDVAVAFTEEELGLLGPAQRKLYRDVMVENFRNLLSVGHQPFKQDVSPIERNEQLWIVTTATRRQRNLGEKNQ

SEQ ID NO: 20399 - protein, 81 aa, Pongo abelii
PQVSLTFDDVAVLFTRDEWRKLAPSQRNLYRDVMLENYRNLVLTRLSFTKPKVISLLQQGEDPWKVEKDSSGNSSLGSKSS

SEQ ID NO: 20400 - protein, 81 aa, Pongo abelii
YLGPVTFEDVAVLFNEAEWKRLSLEQRNLYKEVMLENLRNLVSLESKPEVHTCPSCPLAFGSQQFLSQDELHNHPIPGFHA

SEQ ID NO: 20401 - protein, 81 aa, Pongo abelii
QGHVTFEDIAVYFSQEEWGLLDEAQRCLYHDVMLENFLLMASVAGLSQSNHKDSCSQQKVPVSLNNCAAQCSPDDGHYTPT

SEQ ID NO: 20402 - protein, 81 aa, Pongo abelii
QGLVTFRDVALDFSQEEWEWLKPSQKDLYRDVMLENYRNLVWLGDGCSCHSTLRTTATAEASSSSSSIQASFHSLALPLMS

SEQ ID NO: 20403 - protein, 81 aa, Pongo abelii
EKGPLTFRDVVIEFSQEEWQCLDRDQQDLYRKVMLENFRNLVFLGIDVSKPDLITCLEQGKDPWNMKRHSMVATPPGVFFV

SEQ ID NO: 20404 - protein, 81 aa, Pongo abelii
MKPGVISHAPDSVVPAAFPFPKPDLIFQLEQGEAAWGPDPWTLDGGEALRGMCTGGKTKTKNEEQTAQLNISKESESHRLI

SEQ ID NO: 20405 - protein, 81 aa, Pongo abelii
SYEGSVSFRDVAIDFSREEWRHLDPSQRNLYRDVMLETYSHLLSVGYQVPKPEVVMLEQGKEPWALQGERPRHSCPGEKLW

SEQ ID NO: 20406 - protein, 81 aa, Bos indicus x Bos taurus
DPVAFEDVAVNFTLEEWALLGPSQKKLYRDVMRETLTNLALIRDEWEDHNTEDQYKNQERNLRSHILQRLCESKEGSQGGE

SEQ ID NO: 20407 - protein, 81 aa, Bos indicus x Bos taurus
LCLQVSVSFEDMTVDFRREEWQHLDSAQRFLYQDMTLKTTATSSHWVWNQVPKPEVIFKLEQGEGPWTLEEETPHQSCSDV

SEQ ID NO: 20408 - protein, 81 aa, Bos indicus x Bos taurus
LTPLSSSVFCDNKNSSHGPFLKCVSLLEQLTFKDVAIEFTQEEWECLDPAQRALYRDMMWEIYRNLVSVVGTPIRMLQYNY

SEQ ID NO: 20409 - protein, 81 aa, Pan troglodytes
AAVSVTFKHVTMAFTQKEWKQLDPAPRNLYNDVMLENYSNQASMGCQAPKPDMISKLEKGEAPWLGKGKRPSQGCPSKIAR

SEQ ID NO: 20410 - protein, 81 aa, Pan troglodytes
QGLLTFRDVAIEFSQEEWKCLDPAQRTLYRDVMLENYRNLVSLGISSKCTMKEFSSTAQGNREVIHTGTLQRHESHHIGDF

SEQ ID NO: 20411 - protein, 81 aa, Pan troglodytes
PQGLLTFRDVAIEFSQEEWKCLDPAQRTLYRDVMLENYRNLVSLDISSKCMMKEFSSIGKGNTEVIHTGTLQRLASHHIGE

SEQ ID NO: 20412 - protein, 81 aa, Camelus dromedarius
AAGSVTFKDVTMAFTKKEWEQLDPAQRSLYKDVMLENYSNLASMVGYQALKPDMICKLEKGEELWLGKGKSPKRGGLSETA

SEQ ID NO: 20413 - protein, 81 aa, Camelus dromedarius
MFSDVSIDFSQEEWECLNDDQRDLYRDVMLENYSNLVSMGHCISKPDVISFLEQGKEPWLVDREPTRYQWPVNFYGLYEIK

SEQ ID NO: 20414 - protein, 81 aa, Camelus dromedarius
KVMSQGLVTFKDVALDFSQEEWEWLDSSQKDLYRDVMLENYRNLVWLGLSISKPNMISLLEQGKEPWLVEREMSDDQYAGE

SEQ ID NO: 20415 - protein, 81 aa, Myotis davidii
ERESVTFKDVAVDFTQEEWHHMAPAQRRLYRDVMLENYSNLVSLAGYQVSKPEVIFKLEQGEEPWLSEGEIQRSVCPDWKT

SEQ ID NO: 20416 - protein, 81 aa, Myotis davidii
QDSVVFEDVAVDFSQEEWTLLDRAQRSLYREVMLENFRNLASLGLETQLKSNESVTSQDIYGEKASNQQRKEKLKKDDSWS

SEQ ID NO: 20417 - protein, 81 aa, Myotis davidii
VQEPVTFADVTVLFTPEEWMFLDSAQRSLYRDVMLENYRNLASVEPQPQPQESILNQDTFAKIVSIGIERCERIYAGGNCP

SEQ ID NO: 20418 - protein, 81 aa, Myotis davidii
EPVTFKDVAVVFSEEELGLLDSVQRKLYRDVTLENFRNLVSVGHLFSKPDVISQLEREEQLWMTEIQTQRGGHSAENCAAR

SEQ ID NO: 20419 - protein, 81 aa, Enhydra lutris
VLQGLSFKDVAVNFTEEEWRELDPAQRDLYRDVMLENYRNLVSLGFPFSKPDIISQLEKAENRWMQEREVPRSSCIYLETR

SEQ ID NO: 20420 - protein, 81 aa, Enhydra lutris
SQGLVTFKDVAVCFSQDQWSDLDPAQKEFYGEYVLEEDCGIVVSLSFPIPRLDEISHVREEEPLVPDIPEPQEPQEPEILS

SEQ ID NO: 20421 - protein, 81 aa, Enhydra lutris
SYEGSVSFRDVAVDFSREEWQHLDLAQRNLYRDVMLETYSHLLSVGYEVPQPEVFMLEQGQEPWALQRDPHESCPEELWQI

SEQ ID NO: 20422 - protein, 81 aa, Enhydra lutris
DSVTFEDIAVYFSWEEWRLLDEAQRCLYHDVMLENFTLVSSLGCCCGAEDEEAPFAQSASVGVSQTWTPRAALSSRKTHPC

SEQ ID NO: 20423 - protein, 81 aa, Enhydra lutris
PQAKVTFEDVAVLLSQEEWDRLGPAQRGLYRHVMMETYGNVVSLGLPGSKPNVISQLERGEEPWVLDGQGAEETRGLGSGR

SEQ ID NO: 20424 - protein, 81 aa, Enhydra lutris
GQGSVSFRDVTVDFTRDEWLQLTGTQRTLYRDVMLENYSHLVSVGCHLTKPEVISRLEQGEELWPSEAEFPDQGDQDRNQE

SEQ ID NO: 20425 - protein, 81 aa, Pongo abelii
LTFRDVAIEFSQEEWKSLDPVQKALYWDVMLENYRNLVFLGKDNFALEVKICPCVFLYFLCCLSWEPFHYLTETEVLLTHR

SEQ ID NO: 20426 - protein, 81 aa, Pongo abelii
THARVVFEDVAIYFSQEEWGHLDEAQRLLYRDVMLENLALLSSLGSWHGAEDEEAPSQQGFSVGVSEVTTSRPCLSSQKVH

SEQ ID NO: 20427 - protein, 81 aa, Pongo abelii
QAMVKIEDMAVSLILEEWGCQNLARRNLSRDNKQENYGSAFPQGGENRNENEESTSKAETAEDSASHGETAGRFQKEFGEK

SEQ ID NO: 20428 - protein, 81 aa, Pongo abelii
IAVSKPDLITSLEQGKEPWNMKRHEMVDEPSGIYPHFAQDLWPEQGMEDSFQKAILRRYEKYGHENLQLRKGCKSVDECKV

SEQ ID NO: 20429 - protein, 81 aa, Pongo abelii
AQVSVTFDDVAVTFTKEEWGQLDLAQRTLYQEVMLENCGLLVSLGCPVPRPELIYHLEHEQETWTRKEDLSQGTCPGDKGK

SEQ ID NO: 20430 - protein, 81 aa, Pongo abelii
VTFEDVAVYFIRKEWKRLEPAQRDLYRDVMLENYGNVFSLDWTHVSLTTQKVMLAWLTGTLSVGKGLCSSELASVEPPDTF

SEQ ID NO: 20431 - protein, 81 aa, Pongo abelii
PAQGIVTFEDVAVYFSWKEWGLLDEAQKCLYHDVMLENLTLTTSLGGSGAGDEEACYQQSTSPQRMSQVRIPKALPSPQKT

SEQ ID NO: 20432 - protein, 81 aa, Pongo abelii
SQGLLIFRDVAIEFSPEEWSYLDPAQQNLYRDVMLENYRNLVSLGIAVSKPDLITCLEQRNEPWDVKKHETVARHPAVSSH

SEQ ID NO: 20433 - protein, 81 aa, Pan troglodytes
LPAKDSAWPWEEKPRYLGPVTFEDVAVLFTEAEWKRLSLEQRNLYKEVMLENLRNLVSLVLELGSPRSGLLPLDLNLDLWL

SEQ ID NO: 20434 - protein, 81 aa, Pan troglodytes
LLTFRDVAIEFSQEEWKCLDPAQRTLYRDVMLENYRNLVSLVLRSEVCCTDIWAEVIVADISSKCMLKTLSSTGQGNTEVI

SEQ ID NO: 20435 - protein, 81 aa, Pan troglodytes
QGRLTFRDVAIEFSLAEWKCLNPSQRALYREVMLENYRNLEAVDISSKRMMKEVLSTGQGNTEVIHTGTLQRHQSYHIGDF

SEQ ID NO: 20436 - protein, 81 aa, Camelus dromedarius
LQALMAFRDVAVAFTQKEWKLLSPAQRILYRDVMLENYSHMVSLGIAFPKPKLITQLEQGDEPWREESEYLPDLCPGENIS

SEQ ID NO: 20437 - protein, 81 aa, Camelus dromedarius
SLSFEDVAVDFTRQEWHRLDPAQRTMHKDVMLENYSNLASVEALKLRQLGPRPVPFPINRPLRGQTRDDLQVGTRGRTVDI

SEQ ID NO: 20438 - protein, 81 aa, Vulpes vulpes
WSQMPVTFEDVALYLSREEWGRLDHTQQSFYRDILQKRNGLALGFPFSRPFWTSQGQGKGEASSSCQQMGDEEEEKTGAFE

SEQ ID NO: 20439 - protein, 81 aa, Otolemur garnettii
QQGQVNFEDVFVYFSEDEWVLLDDTQRLLYRDVMLENFALTASLGCQGMEPEKISFEQTVSVEGLSQMRPPKGDPSGKVHS

SEQ ID NO: 20440 - protein, 81 aa, Vulpes vulpes
SLELVSFEDVAVNFTWEEWQDLDHAQRTLCKVVMLETYSSLASLDVQTANDLMETQQEHQSRRLWQFGFSNQETSTEERTD

SEQ ID NO: 20441 - protein, 81 aa, Otolemur garnettii
EELVTFKDVAVDFTQEEWGQLDSPQRALYRDVMLENYQNLLALGAGPPVCKPDVISHLERGEEPWQVQTEVPGGPCPEWEP

SEQ ID NO: 20442 - protein, 81 aa, Otolemur garnettii
QKLLTFQDVAIEFSPEEWTLLDPAQRNLYRNVMIENYRNLVSLGLAASKPDLITCLEQSKEPWNMKREEVTAKHPEMSSHY

SEQ ID NO: 20443 - protein, 81 aa, Vulpes vulpes
LYLELVILRDVAMDFTLEDWEHLGLDQGDLFWDTALDNYQNLFLLNPSKPKLTSCPDGGEKLEVLVGASPESECPGTAGAK

SEQ ID NO: 20444 - protein, 81 aa, Otolemur garnettii
KPGAVSFADVAVYFSPEEWGCLRPAQRTLYRDVMRETYGHLGALGVGGTKPALISWVEEEAELWGPDAQDPEVARCTTDAD

SEQ ID NO: 20445 - protein, 81 aa, Pongo abelii
SLELVSFEEVAVHFIWEEWQDLDDTQRTLYRDVMLETYSSLVSLGHHITKPEMIFKLEQGAEPWIVEAPDLRLSAVQILDD

SEQ ID NO: 20446 - protein, 81 aa, Pongo abelii
SASQVAKTTGNHPHSRDLVTFTDVAVNFTKEEWTLLDPAQRNLYRDVMLENSRNLAFIDWATPCKTKDATPQPDILPKRTF

SEQ ID NO: 20447 - protein, 81 aa, Bos indicus x Bos taurus
MLENYGNLASLGLVSKLDLVTFLEQLEDPRNIRRMGTTAIYPAMSPQDTQDLMPKNPALEGLFPKANVRIYQTFHLGNLNL

SEQ ID NO: 20448 - protein, 81 aa, Bos indicus x Bos taurus
SQGPVTFEDVAVYFSQEEWRILDETQRRLYSYVMLETFALVASLGLASSRSYVVVPLELGGEPWVQDRVDMTPGTARGAQS

SEQ ID NO: 20449 - protein, 81 aa, Bos indicus x Bos taurus
LQGPVTFEDVAVYFSLEEWGLLNLTQKSLYRDVMLENFGLIGSLGFAPSRSSKVAQMEGEEEAWVPNMVDSVVSRAEARKG

SEQ ID NO: 20450 - protein, 81 aa, Bos indicus x Bos taurus
MFQDVAIDFTQEEWECLDLSQRELYRDVMLENYGNLASLGLVSKVDLVTFLELLKDPRNMRRMETTAIYPAMSPQDTQDLM

SEQ ID NO: 20451 - protein, 81 aa, Pan troglodytes
LSFSHFLDVAIEFSQEEWKCLDPAQRTLYRDVMLENYRNLVSLDISSKCTMKEFLSTAQGNREVFHAGTLQIHESHHNGDF

SEQ ID NO: 20452 - protein, 81 aa, Camelus dromedarius
QEVVTFEDVAVYFSWEEWELLDPAQRRLYRDVMQETCRNLASVAQAERPLGHAALARAQRAVRGPWHAPLRSAVPVRRRRA

SEQ ID NO: 20453 - protein, 81 aa, Camelus dromedarius
FQGSLSFEDVTVGFTQEEWQQLDPAQRTLYRDVMLENYSHLISVGYCISKPELIFKLEQGEQPWMLEKESPSQDYPDKTGL

SEQ ID NO: 20454 - protein, 81 aa, Camelus dromedarius
AALRDPPQDVFVYFSQEEWGLLDEAQRRLYWDVMLESLALLASLSITSSNSHSVTQLQQGGEPWVPGQLNLIPATEKEAQP

SEQ ID NO: 20455 - protein, 81 aa, Camelus dromedarius
LQGPVSFKDVAVDFTQEEWQQLDPEQKTTYRDVMLENYSHLVSIGCHVIKPEVITKLEQGEEPWMVEGGFLLQSYPGVLMR

SEQ ID NO: 20456 - protein, 81 aa, Camelus dromedarius
VKKPVSFEDVAVNFTQEEWECLNASQRVLYQDVMSETFRNLVSVARIFLSNPDLITKLEQEEKQWRADLCPSNGGLHSGGK

SEQ ID NO: 20457 - protein, 81 aa, Camelus dromedarius
REQLTFEDVAITFSQEEWECLVPAQRALYRDVMLETCRNLLSVDMSHIHVIKKLQLKANIDRELFQTVMTEIHERTERKHF

SEQ ID NO: 20458 - protein, 81 aa, Camelus dromedarius
TDLSRCLQGCVVFEDVAVHFSQEEWGLLDEVQRLLYRDVMLQNIALLSSVDIVGLDTTFYSLLTGHQQPGLVESHLQRRKL

SEQ ID NO: 20459 - protein, 81 aa, Myotis davidii
FQGSVTFRDVAIDFSPEEWEFLDSAQRDLYRDVMWENYRNFISLAGHSISAPDVITLLDDGKEPWMLMRERIRRHYLEKDI

SEQ ID NO: 20460 - protein, 81 aa, Myotis davidii
SLLDMNFEDVAIAFPQEEWGLLDDAQRRLYCDFKGGGVVCSSRSPDGCLGRQEVESRVVHGSTAESAKPTLERSGRGYGYT

SEQ ID NO: 20461 - protein, 81 aa, Vulpes vulpes
MLENYSNLISLGYQATRPEAMVYLEEGEQGVVEREFLSQCSPERPLQCFSRGECLKQKSDSKFQSKNYAEMNSDQSNGHGK

SEQ ID NO: 20462 - protein, 81 aa, Vulpes vulpes
MLETYNHLVSLEIPFSKPKLISQLEQGEEPWIEERQHPLGLCPGSKLNIQLCPHCPLAFTSQQGLSQHMWFSHLPQLFSSL

SEQ ID NO: 20463 - protein, 81 aa, Otolemur garnettii
QESLTFQDVAVDFTREEWDQLYPAQKSLYRDVMLENYRNLVALGIGHQLYKPEVIAQLEQEEQWMLEKNSPLDTHPDGKNQ

SEQ ID NO: 20464 - protein, 81 aa, Otolemur garnettii
LQVPVSFEDVTVDFSQEEWQQLDSTQRRLYQDVMLENYSHLLSVGFEVPKPEVIFKLEQGEEPWMLEEGAPHQSSSDGKFG

SEQ ID NO: 20465 - protein, 81 aa, Otolemur garnettii
FQGSVSFKDVAVNFTEEEWKELNPAQRVLYRDVMLENYRNLVSLVGFPFSKPNIISQLEQVVNPQRQTEEEELPRSSCCPS

SEQ ID NO: 20466 - protein, 81 aa, Enhydra lutris
DRVPLSFEDVAVGFSWEEWQLLAPSQKDLYRDVMLENYRNLVSVGYQASKPDSLFQSLQGEPPWTVEGAARSQSCPEEIWE

SEQ ID NO: 20467 - protein, 81 aa, Enhydra lutris
FQGSVTFRDVAIDFSQEEWEWLQPAQRDLYRHVMLENYSHLVSLGLNISKPYVVSLLEQGRDPWLEKGDVRRDLFLESKGE

SEQ ID NO: 20468 - protein, 81 aa, Enhydra lutris
SQGSLTFEDVAVNFTREEWNQLYPAQKILYRDVMLENYRNLVALGHQLYKPEVISQLEKEEQRGMESYSTLDAHADGESRP

SEQ ID NO: 20469 - protein, 81 aa, Pongo abelii
RLIRDQDLGASLLPAAPQWRHLDSTQKEQYWDLMLETYGKMVSGGISHPKSDLTNSIEFGDEPAGLYLHVNEKIPRPTCIG

SEQ ID NO: 20470 - protein, 81 aa, Pongo abelii
YEEMVTFEDVAVHFTKTEWTGLSPAQRALYRSVMLENFGNLTALGYPVPKPALISLLEGGDMAWGLEAQDDPLAEMTKNVC

SEQ ID NO: 20471 - protein, 81 aa, Pongo abelii
QDSVTFDDVAVDFTQEEWTLLDPSQRDLYRDVMLENYENLASVGHHLFKPSVIYWLEEEEEMRAGWRVLQEWRLKTKGPAL

SEQ ID NO: 20472 - protein, 81 aa, Pongo abelii
DSVTFEDVAVDFTQEEWTLLDQTQRNLYRDVMLENYKNLVAVDWESHINTKWSAPQQNFLQGKTSSVVEMSLTLSPRLECS

SEQ ID NO: 20473 - protein, 81 aa, Pongo abelii
QGLLIFRDVAIEFCPEECQYLDAAQQNLYNDVMLENYRNPVFLGIVFSKPDVVTCLEQRKKPWSMKHPGHVANLCSHFTQD

SEQ ID NO: 20474 - protein, 81 aa, Pongo abelii
RPGAVSFADVAVYFSPEEWGCLRPAQRALYRDVMRETFGHLGALGFSGPKPAFISWVEGEVEAWSPEAQDPDGESSAAFSR

SEQ ID NO: 20475 - protein, 81 aa, Bos indicus x Bos taurus
TFKEAVTFTDVAVTFTEEEFRLLDSAQKKLYQDVMLENFRNLVSVGCHPFRHDIFHLEKEKRLWVVKTATQREGKSEEKIQ

SEQ ID NO: 20476 - protein, 81 aa, Bos indicus x Bos taurus
MTFEDVAVEFTWWEWGQLDPTQKDLYWEVMLENFKNLASLGFPVSKPYMICLEEGEEPCILEREISTGVHSDWERRPQAKK

SEQ ID NO: 20477 - protein, 81 aa, Pan troglodytes
SAQGTVTFEDVAVNFTWEEWNLLSEAQRCLYRDVTLENLALISSLGMTFLHVCQALDSLRQVIPTSASQSAGITGVSHCAW

SEQ ID NO: 20478 - protein, 81 aa, Pan troglodytes
GPVSFKDVAVDFTQEEWQQLDPDEKIAYGDVMLENYSHLVSVGYDYHQAKHHHGVEVKEVEQGEEPWIMESEFPCQHSPAF

SEQ ID NO: 20479 - protein, 81 aa, Pan troglodytes
AHALVTFRDVAIDFSQKEWECLDTTQRKLYRDVMLENYNNLVSLAGYSGSKPDVITLLEQGKEPCVAAKDVTGRQCPGLLS

SEQ ID NO: 20480 - protein, 81 aa, Camelus dromedarius
ALALVSFEDVAITFTGEEWRHLDLAQRTLYQEVMLETCGLLVSLGHPVPKPELIHLPEHGQELWTVKRGLSRSTYSGEKAK

SEQ ID NO: 20481 - protein, 81 aa, Camelus dromedarius
CQDPVTFEDVAVVFTDEEWRRLVPIQRDLYKEVMLENYKSVVSLGLPVPGPDVIFQLKRGDAPWIMELHGSEGTECAENVC

SEQ ID NO: 20482 - protein, 81 aa, Camelus dromedarius
SQGLLSFTDVSMEFTWEEWQLLDSTQKHLYRDVTLENYSNLLSVGYHGSKPDLIFKLEQGEEPWIINARLSRQSCPEGWKE

SEQ ID NO: 20483 - protein, 81 aa, Callithrix jacchus
GWLTNYSQDSVTFEDVAVDFTPEEWTLLDQTQRNLYGDVMLENYKNLIAVDWESHINTKWTAPQQNFFQEKTFSMVEMNSE

SEQ ID NO: 20484 - protein, 81 aa, Monodon monoceros
FPVAFDDVALYFLEREWEILEKWQKDMYQQEMKTNYESLDSLGCISSKPDLITWMEQGRMLLIRDQGHLEKTQMILSLSGD

SEQ ID NO: 20485 - protein, 81 aa, Callithrix jacchus
MEPLGFRDVAIEFSLEEWHCLDTAQRNLYWDVMLENYRNLVFLGIFVSNQDLMNCVEQEKKSLTVKSHEMIATSPVMHSHF

SEQ ID NO: 20486 - protein, 81 aa, Macaca mulatta
VTFEDVAVLFTEAEWKRLNLEQRNLFKEVMLENLRNLVSLEWLRSARESTRRRAKLSQSTGAQDSAIGWGVRHLPLHTVSP

SEQ ID NO: 20487 - protein, 81 aa, Callithrix jacchus
LTFRDVTIEFSQEEWRCLDPAQKTLYRDVMLENYRNLFVSISSKCMMKAFSCTGPGNTDVFHTGSLERYESHHIGDFCLQE

SEQ ID NO: 20488 - protein, 81 aa, Monodon monoceros
FSISKPDVLSLLEQGKDPWKVVRDVTRGLSPDWESRCETKKLSSKREIYELEASQWEIVEQLTSRKWECKSFQDDKECRDQ

SEQ ID NO: 20489 - protein, 81 aa, Bos taurus
WDRLGPAQRGLYRHVMMETYGNVVSVGSKPEVISQLERGEEPWVLDKQGNEQLRGWGISRSYEPEQSFCPSPSPARPLEGQ

SEQ ID NO: 20490 - protein, 81 aa, Bos taurus
ALALISFEDVAITFTGEEWRHLDLAQRTLYQEVMLETCGLLVSLGNPVPKAELIHLLEYGPELWTVKRGLSRNTCTGMRRS

SEQ ID NO: 20491 - protein, 81 aa, Ovis aries
VVFEDVAVDFTQEEWALLNLTQRNLYRDVMLENFRNLASLGFEIQLKINESVAPQDTYGKISNEQDVVGFKRSDSSLSILH

SEQ ID NO: 20492 - protein, 81 aa, Ovis aries
SEDLVTFGDVAVNFSQEEWEWLNPAQRSLYRTVMLDNYRSLVSLGVSVSKPDVISLLEQGKAPWMVEEEEPRGACPDWEYA

SEQ ID NO: 20493 - protein, 81 aa, Ovis aries
MDPMQRDLHKDVMLENYRNLVSLGLAISKPDMISHLEDGKGPWVVVREISRTSFSELETKPTTKNIIPTEDFSKKHLSQNA

SEQ ID NO: 20494 - protein, 81 aa, Ovis aries
QLTIEDVAIEFTPEEWECLAPAQRTLYWDVMLETYRNLLSVDISPIHIIKNLQPKENTNSTDTFQTVILGRHESPGVKDFY

SEQ ID NO: 20495 - protein, 81 aa, Ovis aries
LSQERLTSEDVAIEFTQEEWEFLDPAQRALYRDVMLETYRNLLSVGEDDFLPELPLGICIFPVCPLGGPDVFNLRVLVTQP

SEQ ID NO: 20496 - protein, 81 aa, Vulpes vulpes
AQGQVNFEDVAVYFSPEEWGLLDEAQRLLYHDVMLENLALMASLGYESSMSHGFASLELGSKPWGSDWADVTPARTRDTQG

SEQ ID NO: 20497 - protein, 81 aa, Otolemur garnettii
FQVEVTFEDVAVLLSQEEWDRLGPAQRGLYRNVMMETYGNVVSLAGLPGAKPEVISQLERGEEPWVLDRKGAKSQGLGSGH

SEQ ID NO: 20498 - protein, 81 aa, Otolemur garnettii
LQGPVSFKDVAVHFTREEWQCLDAPQRELYREVMLENYINLISVGCQTTKPAIIHKLEQGEEPWIKEKETSRRSNPGELGS

SEQ ID NO: 20499 - protein, 81 aa, Otolemur garnettii
GLLSFMDVSVEFTWEEWQLLDPTQKYLYRDVILENYNNLVSVGYHDTKPDLVFKLEQGEEPWIVNTKVSCQSCPEGWEEWY

SEQ ID NO: 20500 - protein, 81 aa, Pan troglodytes
MMTFRDVAIDFSQEEWKWLQPAQRDLYRCVMLENYGHLVSLGLSISKPDVVSLLEQGKEPWLGKREVKRDLFSVSESSGEI

SEQ ID NO: 20501 - protein, 81 aa, Pan troglodytes
VIFKDMAVVFTKEELALLDKAQINLYQDVMLENFRNLMSVSEDGIKNNILNLQEKGLSYLLQEVLHCWQILKQRIQDLTGS

SEQ ID NO: 20502 - protein, 81 aa, Pan troglodytes
QGLLTFRDVAIEFSQEEWKCLDPAQRTLYRDVMLENYRNLVSLGISSKCTMKEFSSTAQGNTEVIHTGTLQRHESHHIGDF

SEQ ID NO: 20503 - protein, 81 aa, Monodelphis domestica
APVPVKFDDVAIYFSEQEWNILDDWQKDLYKHVMRANYSTLVSLDYTIPKPDLIFQIELGEVLFDGNWGDLEQAEIGVSLS

SEQ ID NO: 20504 - protein, 81 aa, Monodelphis domestica
AQEMVTFQDVAVDFTREEWCLLSPPQKELYKEVMLENARNLLSVGLPALPEDVISYLEQREAPWMLEREGPRSCCPGEILL

SEQ ID NO: 20505 - protein, 81 aa, Monodelphis domestica
PLWVLVSFADVAVYFSPEEWGRLRPEQRALYRDVMRETYGHLGALGFPGPKPALISWMEEAAWDSEASFPEGEKEKRAINF

SEQ ID NO: 20506 - protein, 81 aa, Monodelphis domestica
EELPVVFEDVAVYFTREEWAMLDKRQKELYRDVMRMNYELLASLGPAAPKPDLILKLERRAAPWIKDPNGPKWGKGRPPGK

SEQ ID NO: 20507 - protein, 81 aa, Physeter macrocephalus
MTFEDVAVEFTRWEWGQLDPTQKDVYREVMLENFKNLASLGFPMSKPYVICRLEEGEEPCILEREISTGAPADWERRRQAK

SEQ ID NO: 20508 - protein, 81 aa, Monodelphis domestica
RQAAVSFRDVVVDFTEEEWGRLSPAQWQLYKEVMLENYRNLVSLGLIEDKPGLIFRLEQGEEPPASDTQGEAPKSPHTWEG

SEQ ID NO: 20509 - protein, 81 aa, Monodelphis domestica
GQESVSFEEVAVDFSQEEWCFLNAAQKELYKEVMLENYRNLVSLGLPVCKPDVIAQLEQGEAPWMLEREGPPRASLADWEP

SEQ ID NO: 20510 - protein, 81 aa, Physeter macrocephalus
SQGPVSFTDVAVDFTQEEWQQLDPDEKTTYRDVMLENYSHLVSVGYDSTKPNVILKLEQGEEPWAADGEFPRQSHPEEVWK

SEQ ID NO: 20511 - protein, 81 aa, Monodelphis domestica
VVTFQDVAVDFTREEWRLLSPPQKKLYKEVMLENAQNLLSVEGEIRPEMKATPTEMVPLVEETDQQRLMSDIPHNTACREF

SEQ ID NO: 20512 - protein, 81 aa, Monodelphis domestica
MLENAQNMLFVGLPGPPEDMISYLEQKEFPWMLEHEDLRSFCPEGEIRLEMKANPTEVSLPVEEMDLQSFMNDGLDNFAFR

SEQ ID NO: 20513 - protein, 81 aa, Physeter macrocephalus
MLENYGHLVSLAGLNISKPDVVSLLEQGKEPWLGKDASRGLFSASESNGEIKEFSPKNVIYEDDSSQYLIMERFLSQGLEY

SEQ ID NO: 20514 - protein, 81 aa, Physeter macrocephalus
KAWVKKPVTSEDVAVNFNQEEWECLDASQRVLYQDVMSETFRNLMSVAVDLIAKFEQEEKQWRADLRPPNGEGLHSGGKRE

SEQ ID NO: 20515 - protein, 81 aa, Monodelphis domestica
SGSVTFQDVTMDFTQEEWRLLDHSQKELYLEVMLENVQNLLSVEAKTDFEVKDMSTKLSLFVEGSGSQRCVNEGLCHFILK

SEQ ID NO: 20516 - protein, 81 aa, Physeter macrocephalus
KSQGSLSFKDVAVVFTWEEWQLLDRVQRNLYQDVMLENYINLVSVGYQVTKADAFYRLEQETPWIIEEESQSQIHPEDTWQ

SEQ ID NO: 20517 - protein, 81 aa, Physeter macrocephalus
AQGSLTLKDVAVDFTWEEWQLLAPDQKDLYRDVMLENYSNLLSVGYQVSKPDILSKLEQGEPLWTLEDEVHSHPHPEIEKV

SEQ ID NO: 20518 - protein, 81 aa, Monodelphis domestica
AQEVVTFKDVVVEFTQEEWCLLSPAQKELFKEVMLENAWNLHSLGLPAPLEDMISYLKLKEPPWMLEQEGLRSFFPEGKIR

SEQ ID NO: 20519 - protein, 81 aa, Physeter macrocephalus
SQDSVTFADVAVDFTQEEWTLLDPIQRKLYRDVMLENYKNLTTAGYQLLKPTLISWLEQEDDLRTVERRGVLQGSAIQQDN

SEQ ID NO: 20520 - protein, 81 aa, Physeter macrocephalus
RPEPVTFEDVAMYFTQNEWVILDPAQRALYREVLLENYANVASLAFSFTRPVLVSQLEPGELPWGLDPWEPVGREALRGVC

SEQ ID NO: 20521 - protein, 81 aa, Monodelphis domestica
GQEVVTFKDVAVDFTWEEWRLLSPPQKLLYKEVMLENTRTLLSVGLPAPPEDMISYLEQREAPWMLDQEDLRRCYPEGKLT

SEQ ID NO: 20522 - protein, 81 aa, Monodelphis domestica
VQEAVMFKDVSVDFTREEWCLLSPPQKELYKEVMLENARNLLSVGLPAPHEDVISSLEQREGPWMLKQEGLRSCCLEREIS

SEQ ID NO: 20523 - protein, 81 aa, Monodelphis domestica
IQGSLTFKDVAMNFTQEEWCLLDHSQKELYLEVMLENVQNLLSVGLPVPREYYTSYFQQEKAPWLLVQKGPRNSSPEAETN

SEQ ID NO: 20524 - protein, 81 aa, Papio anubis
REDPGTSESQEMEEWALLDIFQKNLYREVMLETFRNLTSIGKSWKDQNIEYEYQNPRRNFRSLIEEKVNEIKEDSHCGETF

SEQ ID NO: 20525 - protein, 81 aa, Papio anubis
PQGLLTFRDVAIEFSQEEWKCLNPAQRTLYRDVMLENYRNLVSLAISSKCRMKMFSSTGQGNTEVIHTGTLQRQASHHIGD

SEQ ID NO: 20526 - protein, 81 aa, Papio anubis
IDVAIEFSLEEWHCLDTAQRNLYRNVMLENYKNLVFLGIPVSKPDLITCLEQGKKSWTMKRHEMVAKSPVIYSHFAQDLWP

SEQ ID NO: 20527 - protein, 81 aa, Papio anubis
ASVALGDVAVNFTREEWALLGPCQKNLYKDVMQETIRNLDCVGMKWKDQFLFKDQIEHQYKYPRKNLRCRMLERFGESKDG

SEQ ID NO: 20528 - protein, 81 aa, Aotus trivirgatus
RPGLVAGARAVSFADVACYFSPEEWAVCGRRRGLYRDVMRETYGHLARFGPKPALISWMEQRGEGWSRVPLYPNWPHFQHP

SEQ ID NO: 20529 - protein, 81 aa, Papio anubis
AATLRLSAQGTVTFEDVAVKFTQEEWNLLSEAQRCLYRDVTLENLALISSLDPALDGSADNTQTGNLGQSVLPSHPEQKTA

SEQ ID NO: 20530 - protein, 81 aa, Aotus trivirgatus
VREMLTFRDVAIGFCPEEWECLDSSQQHLYRDVMLENYRNLVFLGLGDSKPELITHLEQGKDPWNVKRQETVVKHPEVLPK

SEQ ID NO: 20531 - protein, 81 aa, Aotus trivirgatus
MGLLTFRDVAIEFSLEEWEHLDSDQKNLYGDVMLENYRNLVCLDIFSYDTQALLRKKRIEASFQKVILDGYGSCGLQNLHL

SEQ ID NO: 20532 - protein, 81 aa, Aotus trivirgatus
MGPLAFMDVAIEFSLEEWQCLDTAQQNLYRDVMLENYRNLVFLGAAFSKPDLITYPEPGKEPWNMKRHETVAKILAMCSCF

SEQ ID NO: 20533 - protein, 81 aa, Aotus trivirgatus
AQESLTLEDVAVDFTWEEWQLLGPAQKDLYRDVMLENYSNLVAVGYQASKPDALFKLEQGQPPWTIKDGIHSGACSEIWKF

SEQ ID NO: 20534 - protein, 81 aa, Pan paniscus
IGGDVTFNDVAIDFTHEEWGWLNSAQRGLYKDVMVQNYENLVSVAGLSITKPYVITLLEDGKEPWMVEKKLSKGMIPGEWE

SEQ ID NO: 20535 - protein, 81 aa, Lipotes vexillifer
MLENFNNLLSLGYQATKPDTLSKLEHGKEPCIIENKIQNRTRPGIRKVDSHLPEHSQDQRFPKSLQQCSEQNAFRNSVHLS

SEQ ID NO: 20536 - protein, 81 aa, Lipotes vexillifer
KTWGPLSFMDVFVDFTWEEWQLLDPAQKHLYRSVMLENYSNLVSLGYQHTKPSIIFQLEQEELWMMQIPSEGHMDEVWEID

SEQ ID NO: 20537 - protein, 81 aa, Leptonychotes weddellii
ALALITFKDVAVTFTGEEWRHLDLAQKTLYREVMLETCGLLVSLGYPVPKPELTYLVEHGQELWTVKRGLSKSTYTASSSG

SEQ ID NO: 20538 - protein, 81 aa, Leptonychotes weddellii
FQGSVSFTDVTVDFTQEEWEQLDPSQRILYMDVMLENYSNLLSVGKDLFRRCGRLTTRRRRTTATQMSRRGHLSFLRTKPQ

SEQ ID NO: 20539 - protein, 81 aa, Monodelphis domestica
SQGSITLRDVAVDFTQEEWRLLDHAQKELYREVMLENVWNLQSVGLMVSRENFVTCFQQEESPWPMVKRKDGQWSFCPEAE

SEQ ID NO: 20540 - protein, 81 aa, Monodelphis domestica
SQASITFKDVAVDFTQEEWCLLDHSQKALHQKVMLENVQNLLSVGIPVSRGNVISCFQQGKAPWLLEQKGPRSSCPEAEIN

SEQ ID NO: 20541 - protein, 81 aa, Physeter macrocephalus
FQEAVTFKDVAVTFTEEELGLLDSAQRKLYQDVMVENFQNLVSVGHLPFKPDMVSQLETEEKLWMMERETQRNGHSSENRK

SEQ ID NO: 20542 - protein, 81 aa, Monodelphis domestica
PPRQERVTFGDVAVDFTLDEWVCLDSAQKALYRDVMLENYGHLVCLGLAGAKPAVIQRLERGEAAWCPGVPGSRLPGLFFF

SEQ ID NO: 20543 - protein, 81 aa, Monodelphis domestica
FQESVTFKDVAVDFTQEEWKQLDPAQRDLYRDVMLENYRNLVSLGLPVFKPDVISQLERGEAPWIPEVPRSICQGEVVRTR

SEQ ID NO: 20544 - protein, 81 aa, Monodelphis domestica
GSITFKDVAVDFTQEEWCLLDPSQKELYREVMLENVQNLLSVEAKTNFDVKMSTKLSFFVEGSGPIGGMNKDPCDFILRET

SEQ ID NO: 20545 - protein, 81 aa, Monodelphis domestica
ARFQESLTFKDVAVEFTWEDWRHLDPAQRALHRNVMLENYENLVSIGIPVSKLDLLFLFKRGDVQNEEGEAGTGACIGELL

SEQ ID NO: 20546 - protein, 81 aa, Monodelphis domestica
SQGLITLKDVTVDFTQEEWVLLDHSQKELYLEIMLENVQNLLSVGLLVPRENCISCFQQWEAPWLLDQEFPRSSCPEGKSN

SEQ ID NO: 20547 - protein, 81 aa, Monodelphis domestica
SQESITFKDVAVDFSQEEWCLLDHSQKELYVEVMMANVKNLLSVGLPVSRVDFLSCFQQGEAQCLLEQKGPRSSCPETETN

SEQ ID NO: 20548 - protein, 81 aa, Physeter macrocephalus
QLTFRDVAIEFSQEEWEWLDPAQRALYRDVMLETYRNLLSLDMSTRCEIKEFSPKEDINNGDLFQTLVFERLVSHDFDDFD

SEQ ID NO: 20549 - protein, 81 aa, Monodelphis domestica
PQELVAFKDVAVDFTQDEWGLLDHSQKELYKDVMLENVQNFISLGLPVLREYLVSHYEQEGLRSSFPETGFDVKKFPAMLK

SEQ ID NO: 20550 - protein, 81 aa, Physeter macrocephalus
QAMVKIEDMAVSLILEEWGCQNLARRNLNRDTRQENYGNVISQGCENRNENEESTSKAEIAEDSASHGETTGKFQKDFGEK

SEQ ID NO: 20551 - protein, 81 aa, Monodelphis domestica
FPVVTFRDVAVDFTQAEWALLAPPQKELYKEVMQENAQNLLSVGKEENSQIIKYPSQIHTGEKPYECRQCGKAFNRIYNLT

SEQ ID NO: 20552 - protein, 81 aa, Papio anubis
MELLTFRDVAIEFSPEEWKCLDPSQQNLYKDVMLENYRNLVSLAMCSPFSQDLSPVQGIEDSFQKLVLRRYEKCGYENLQL

SEQ ID NO: 20553 - protein, 81 aa, Aotus trivirgatus
EKGPLTFRDVAIEFSLEEWQCLDTAQQDLYRKVMLENYRNLAFLAGIAVSKPDLITCLEQGKEPWNMKRQEMVDETPVIYS

SEQ ID NO: 20554 - protein, 81 aa, Papio anubis
MGPLTFRDVKIEFSLEEWQCLDTAQRNLYRDVMLENYRNLVFLGIAVSKPDLITWLEQEKEPWNMKRREMVDKTPVMCSHF

SEQ ID NO: 20555 - protein, 81 aa, Papio anubis
TVTFEDVAVKFSQEEWSLLSEVQRCLYRDVMLENLALISSLDCWCGSKDKEAPSKQSISVQRESQNRTPRAVVSPKKAHPC

SEQ ID NO: 20556 - protein, 81 aa, Aotus trivirgatus
METLTFRDVAIEFSLEEWQCLDIAQQDLYRKVMLENYRNLAFLGIALTKPDLITCLEQRKVPWNMKRHEMADEPPVLCSNF

SEQ ID NO: 20557 - protein, 81 aa, Papio anubis
GEGSLSFEDVAVDFTREEWQFLDWSQKVLYKEVMLENYSNLVSVGYQGTKPDSLFKLEQGEPPWIVEGAAPSQTCPGFVIR

SEQ ID NO: 20558 - protein, 81 aa, Aotus trivirgatus
SVGFEDVAVNFTQEEWALLSPSRKQLYRDVMLETCRNLASVGIQWKDQDIENLYQHLGIKLRSLVERLCGRKEGSDHRETF

SEQ ID NO: 20559 - protein, 81 aa, Aotus trivirgatus
LFQVTFSDVILLRDLYKDVMVQNYENLVSLAGLSITNNVITLLEDGKEPWMVEQKLSKGVTPDWESKLENKELSTKKDIYE

SEQ ID NO: 20560 - protein, 81 aa, Aotus trivirgatus
ALALISFEDVVVTFTGEEWGHLDLAQRTLYQEVMLETCRLLISLGHPVPKPELIYLLEHGQEPWTVKRGLSQSTCAASFSL

SEQ ID NO: 20561 - protein, 81 aa, Pan paniscus
VTFEDVTIIFTWEEWKFLDSSQKRLYREVMWENYTNVMSVENWNESYKSQEEKFRYLEYENFSCWQGWWNAGAQMYENQND

SEQ ID NO: 20562 - protein, 81 aa, Physeter macrocephalus
MLENYSNLVSLGLPFSKPEVISLLQQGEDPWKVEKESPGGSSVGCKSSPKTTKSTQTQDSSFWGPVRKRLKKNEPWNFISE

SEQ ID NO: 20563 - protein, 81 aa, Physeter macrocephalus
MAEDLKFRDVAIYFTQKEWECLHSAQKDLYRGVMLENYNTLISLGFSDSKPDVIFLLEQGKEPWMVNSKETKEWCPDWESR

SEQ ID NO: 20564 - protein, 81 aa, Monodelphis domestica
PQASVTFKDVAVDFTWEEWRLLDPSQKELFWEVMLENYRNLVCLGLADSNKDVRISELESGEPHWIPTGGVLRSCWPGWES

SEQ ID NO: 20565 - protein, 81 aa, Monodelphis domestica
GESGQMLVTFDDITVYLLQEEWMLLGEQQKEICGSDNLVSPLGSPIANPELFCKLEREVEPWLGDASGQRKPLNRHLGKNK

SEQ ID NO: 20566 - protein, 81 aa, Monodelphis domestica
PAQVLVTFKDVAVDFTQEEWRLLDPHQKELYKEVTLENAWNMLSMGLPVPRDLVSHFKQVEAPWMLEEEGSSNSCLDGERR

SEQ ID NO: 20567 - protein, 81 aa, Monodelphis domestica
APEVVTFQDVAVDFTRGEWRLLSPPQKELYKEVMLENAWNLLSVGLPASPEDVLSSLEQREGPWMLEQEGLRSFSPVLSLN

SEQ ID NO: 20568 - protein, 81 aa, Monodelphis domestica
VVKFQDVAVDFTWEEWSLMSPPQKELYREVMLENARNLLTVEREIRPEMKLTATDLSLSVEEMNLQRFMSDCPDNFAFREF

SEQ ID NO: 20569 - protein, 81 aa, Physeter macrocephalus
AHGSVIFRDMAISFSQEEWEHLDPAQRDLYRDVMLENYLTLVSLGSSTSKPDVITLLKQEKEPWIVVRKEISGWYTDLESN

SEQ ID NO: 20570 - protein, 81 aa, Monodelphis domestica
CSIQESLTFKDVAVEFTWEEWRHLDPAQRTLHRNVMLENYENLVSIGIPISKLDLLFLLKREDVQNQEGEAGTGTCIDSQA

SEQ ID NO: 20571 - protein, 81 aa, Monodelphis domestica
LQTSLMFKDVAVYLTREEWDCLGPAQRSLYRDVMLENYRNLVSLGFSVSKPDVISHLEKGEEPWVLDKQGAREREILKSDF

SEQ ID NO: 20572 - protein, 81 aa, Monodelphis domestica
SQGSITYKDVTVDFTQEEWCLLNHFQKALYLEVMLENVKNLRSVGLPVPRENFISCFKQGRASGLLEQKDPRSSCPAVDFE

SEQ ID NO: 20573 - protein, 81 aa, Monodelphis domestica
SQGSITFKDVAVNFTQEEWCLLDHSQKALHLEVMLENVQNLRSVGLPVPRENFISCFQQGKAPWLLEQKGPRSSCPEAETK

SEQ ID NO: 20574 - protein, 81 aa, Monodelphis domestica
SRGSITFKDVAVDFTREEWRLLDHSQKELYTEVMLENVQNLLSVGLPVLRENFISCFQQGEAPWQLEQKDPRSSCPESETT

SEQ ID NO: 20575 - protein, 81 aa, Monodelphis domestica
MLENVQNLLSVGLPVPRENFISCFQQGESSWLLEQKGLRHSCPEAETNFEVKEMTTKLSLIVEGSGPQKCMSEGLYDFIVR

SEQ ID NO: 20576 - protein, 81 aa, Monodelphis domestica
SQESLTFKDMSVNFTQDEWGHLDSAQKGLYRDVMLENYRNLASLGHPGSKPDVISQLEHGKSPWVKKGIPKSRCLGTPLVK

SEQ ID NO: 20577 - protein, 81 aa, Physeter macrocephalus
SQGLLSFNDVAVDFTWEEWQLLDIVQKNLYRDVMLENYSNLMSLGYQVTKPEQVMHLEKGKEKEKAAVEREFPSQCGPERP

SEQ ID NO: 20578 - protein, 81 aa, Monodelphis domestica
PPSEGPITFQDVAVDLTQEEWRLLDHSQRGLYLEVMLENAQNVLSVAAREDLISHFQQEAAPWMADPKGTRSFCPDAETSF

SEQ ID NO: 20579 - protein, 81 aa, Monodelphis domestica
FQASVTFKDVAVDFTWEEWRLLDPPQKELFWEVMLENYRNLVCLGLADSNKDVMMSKLESGEPHWIPTGGVLRSCWPGWES

SEQ ID NO: 20580 - protein, 81 aa, Physeter macrocephalus
SQDSVTFEEVAVDFSQEEWALLDPAQKILYRDVMLENFRNLASVEYHLCKHSLITEVEQEELRPEQRGILQCAYRDRDTQL

SEQ ID NO: 20581 - protein, 81 aa, Monodelphis domestica
GQEVMTFKDVAVDLTWEEWRLLSPPQKELYKEVMLENARNLLSVGLPAPPEDVLTYLEQREALLMLKQKGLRSYYPDGKIR

SEQ ID NO: 20582 - protein, 81 aa, Physeter macrocephalus
AQGLMAFEDVAVYFSREEWALLDAAQRALYRRVMLENFTLLASLGLSVSRPRVVIQLECGEEPWVLNGTDVTLARNAQRRP

SEQ ID NO: 20583 - protein, 81 aa, Papio anubis
MGPLTFRDVAIEFSLKEWQCLDTAQRNLYRNVMLENYRNLVFLVIYSHFAQDLWPEQNVKDSFQKATLKRYGTCRHENLPL

SEQ ID NO: 20584 - protein, 81 aa, Papio anubis
GWLTSYSQDSVTFEDVAVDFTQEEWTLLDQTQRNLYRDVMLENYKNLVAVDWESHVNTKWSAPQQNCLQGKTSSVVEMNSE

SEQ ID NO: 20585 - protein, 81 aa, Aotus trivirgatus
LQEAVVFEDVAVYFTRIEWSCLAPEQQVLYRDVMLENYRNLASLGFLVAKPALISLLEQGEEPGALILQVAEQRGAKTSLC

SEQ ID NO: 20586 - protein, 81 aa, Aotus trivirgatus
LLDQMAFEDVAVYFSQEEWGLLDTAQRALYRRVMLDNFALVASLGLSTSRPRVVIQLEHGEEPWVPSGTDMTMSRNTHRRC

SEQ ID NO: 20587 - protein, 81 aa, Aotus trivirgatus
MDPVAFEDVDVNFTQEEWTLLSPSQKQLYRDVMLETFKKLASVDHRETFSQIPDCHLNKKSDTAVKPRKCSVCEKVFLHYS

SEQ ID NO: 20588 - protein, 81 aa, Aotus trivirgatus
SYTGSVSFRDVAIDFSREEWRHLDLSQRNLYRDVMLETYSHLLSVGYQVPEAEVVMLEQGNEPWSLQGERPHQSCPGEKLW

SEQ ID NO: 20589 - protein, 81 aa, Aotus trivirgatus
AGWLTNYSQDSVTFEDVAVDFTPEEWTLLDQTQRNLYRDVMLENYKNLVAVDEIHISTKWTAPQQNFFQEKTSSMVKMNSE

SEQ ID NO: 20590 - protein, 81 aa, Papio anubis
LFQVTFSDVAIDFSHEEDLYKDVMVQNYKNLVSVTGLSVTKPYVITLLEDGREPWMVEKKLSKGVIPDWESRWESKELSTK

SEQ ID NO: 20591 - protein, 81 aa, Aotus trivirgatus
VTFEDVAIYFSQEEWGLLDEAQRLLYRDVMLENFALLTSLVCWHGMEDEETPEQSVSVKGVPQGRTPEASPSIQKTQACDT

SEQ ID NO: 20592 - protein, 81 aa, Aotus trivirgatus
PGSVTFEDVAVYFSWEEWDLLDETQKHLYFDVMLENFVLTSSLGKDLTSSWSHVVAQLGLGEVSSVLHRMFMTPASREEAP

SEQ ID NO: 20593 - protein, 81 aa, Aotus trivirgatus
KESVSFKDVAVDFTQEEWGQLDSPQRALYWDVMLENYQNLLALGAGPPLHKPDVISHLERGEEPWCVQRDVPGGPCPEWEM

SEQ ID NO: 20594 - protein, 81 aa, Aotus trivirgatus
ERHLLGPLTFMDVAIEFSLEEWQCLDTAQQNLYRNVMLENYRNFVFLGIAVSNLDLITCLEQGKEPWKMKTHEMVAKSPGR

SEQ ID NO: 20595 - protein, 81 aa, Aotus trivirgatus
KPGAVSFADVAVYFSPEEWGCLRPAQRALYRDVMRETYGHLGALGFPGPKPALISWMEQESEAWSSAAQDPEKGENLGGAR

SEQ ID NO: 20596 - protein, 81 aa, Sarcophilus harrisii
PVTFRDVAVDFTLEEWGRLGPAQKQLYRDVMLETYRNLVSLGWETRNKTQEKGSKGNVPAEEATRERTVESLGACAHHSVL

SEQ ID NO: 20597 - protein, 81 aa, Sarcophilus harrisii
FQESVTFKDVAVEFTWEEWKHLDPAQRNLFRDVMLENYGNLVSLGLAVTKPDVIFQLERGDAPWRLEIEVPRSTPTECLNL

SEQ ID NO: 20598 - protein, 80 aa, Pan paniscus
MCLITLNNSYRMFESCSGFSGFCASPIEESHGALISSRSSRTMTDGLVTFRDVAIDFSQEEWECLDPAQRDFRDEVSPCW

SEQ ID NO: 20599 - protein, 81 aa, Felis catus
SQGLLTFRDVAIEFSQKELRCLNHSQWELYRDVMLENYRHLLFLGLVVSKPDLVIFLEQKKDVWAVKRKETVATHPGRWEG

SEQ ID NO: 20600 - protein, 81 aa, Felis catus
VTFKDVAVVFTEEELGLLDPAQKKLYGDVMLENFRNLLSLEHRLFKHDTFRLEKVTLWMMLASHRREKSGKSQAGGSPRRC

SEQ ID NO: 20601 - protein, 81 aa, Felis catus
SQGSLSFRDVAVGFTHKEWQHLDAAQRTLYRDVMLENYSHLVSVGCQVTKPAVISRLERGQEPWMEEEELVRWSFPGERGA

SEQ ID NO: 20602 - protein, 81 aa, Neomonachus schauinslandi
MLENYQNLLSLGVGPLGCKPDVISRLERGEEPRMEKKEARQATCPALHTSSAAPWESFLKKRVSEEATSPETVCGGRGLGC

SEQ ID NO: 20603 - protein, 81 aa, Neomonachus schauinslandi
PLTFRDVAVVFTEEELRLLDRAQRKLYRDVMLENFRNLLFVGDKNEKEMEYIQERELKCLSSRELSYWKIWEQVTGELTGS

SEQ ID NO: 20604 - protein, 81 aa, Neomonachus schauinslandi
SQGLLTFRDVAIEFSQEEWGCLNLVQRELYRDVMLENYGHLLFLGLIVSKPDLIMFLEQEKQLWDVKRKETVAFHPVISSH

SEQ ID NO: 20605 - protein, 81 aa, Monodelphis domestica
AVTFKDVAVDFTREEWRLLAPPQKELYKEVMLENVWNLLSVEGEIRPDMKVTPTEVSFSVEETEKQKFMSDGPDNLTWREF

SEQ ID NO: 20606 - protein, 81 aa, Monodelphis domestica
PQELVTFRDVAVDFTPEEWGQLGPAQKELYQEVMLENYRNLVCLGLTVSKPDVISQLEQGEAPWRLEGGSARGRCLDWGMR

SEQ ID NO: 20607 - protein, 81 aa, Monodelphis domestica
EVVTFRDVAVDFTQEEWSLLSPPQKELYKDVMLENVRNLLSVVETRSEMKVNPTEVSLLLEEMDLQRFKSDGLDKFASGQF

SEQ ID NO: 20608 - protein, 81 aa, Physeter macrocephalus
FQGLVTFRDVAIEFSQEEWKWLEPAQKDLYKDVTLENFSNLVSLGLSLSKPDVVSLLEQGKEPWMVVNDMTGPWCPDLESR

SEQ ID NO: 20609 - protein, 81 aa, Physeter macrocephalus
VTESVTFRDIAVLFSRNEWLHLDSAQRTLYREVMLENYSTLVSLGIPFSMPKLICQLQHGEDPCMVERESPQDTYLGFKTW

SEQ ID NO: 20610 - protein, 81 aa, Monodelphis domestica
PQEAVTFKDVAVNFSQEEWMCLDSSQKEFYRDVMLENYRNLVFLGLAFSKPYVIYQLERRETPWMPEGDIPRIRHADWETQ

SEQ ID NO: 20611 - protein, 81 aa, Monodelphis domestica
SPMRSGLVTFQDVAVIFSLDEWGHLDPAQRELYREVMLENYQTLACLGLAISKPDVISQLEQGEAPWMPKREGLRLFCGND

SEQ ID NO: 20612 - protein, 81 aa, Monodelphis domestica
SQGSITFKDVAVDFTQEEWYLLDRSQKELYLGVMLENVQNLLSVGLPVPRENFISCFQQGESPWLLEQKGLWSSYPEAELN

SEQ ID NO: 20613 - protein, 81 aa, Monodelphis domestica
SPTPLMFQDVAVDFTWEEWGLLEPSQKDMYWDVMLENYENFVSLGSLPISIPDVISQMERIEAPWMAEKGVLISTFLDSLS

SEQ ID NO: 20614 - protein, 81 aa, Monodelphis domestica
FQVSVTFEDVAVEFTWEEWRYLDLGQRTLYRDVMLENYENLVSIGIPVSKPDLLFLLKRDVQNQEGKVRSGIYSDPVFEEN

SEQ ID NO: 20615 - protein, 81 aa, Monodelphis domestica
MISKLQQGEEPWIMEREIPKGTSPDWETSSGIKKATIKQEEELTQEAMVGKFTRNSLWYSKLGKPFEWVNQLGWHKESQEK

SEQ ID NO: 20616 - protein, 81 aa, Monodelphis domestica
CQETLTFKDVAVDFTREEWGQLGPAQRDLYKEVMLDNYRNLISLGLQGSKPDVIFWLERGQSPWTLKRRKSRDCCPEFHLH

SEQ ID NO: 20617 - protein, 81 aa, Aotus trivirgatus
MDVAIEFSLEEWQCLDTAQQNLYRDVMLENYRNLVFLGTAFSKPDLITYLEQGKEPWNMKRHETVAKPPAICSYFAQDLWP

SEQ ID NO: 20618 - protein, 81 aa, Aotus trivirgatus
PKVPVTFDDVAVYFSELEWGKLEDWQKELYKHVMRGNYETLVSLDYAISKPDILTRIERGEEPCLDQWGQEKGSEVEVAHS

SEQ ID NO: 20619 - protein, 81 aa, Aotus trivirgatus
CEASMSFEDVTMDFSREEWQQLDPAQKRLYQDVMLELYSHLFSVGYQIPNPDVIFRRLKEKEPCMEEAELSHRRCEEGEFG

SEQ ID NO: 20620 - protein, 81 aa, Papio anubis
MGLLTFMDVAVEFSLEEWQCLDTAQQNLYRNVMLENYRNLVFLALCSHFAKDLRPEQYIKNSFQQVILRRYGKCGYQNLQL

SEQ ID NO: 20621 - protein, 81 aa, Papio anubis
MLENFRNLVFLAGIDVSKPDLITCLEQGKDPWNMKRDSMVATPPVKCSHFAQDLWPQPGIKDSFQKAILREYGKYGHKDLQ

SEQ ID NO: 20622 - protein, 81 aa, Aotus trivirgatus
MGPLTFRDVKIEFSLEEWQCLDTAQRNLYRDVMLENYRNLVFLGIAVCKPDLITWLEQGKEPWNMKRHAMVAKPPVICSHF

SEQ ID NO: 20623 - protein, 81 aa, Aotus trivirgatus
VKIEDMAVSLILEEWGCQNLARRNLSRDNRQENYGSAFPQGGENRNENEESTSKAETVKDSASRGETAGRFQKEFGEKRDQ

SEQ ID NO: 20624 - protein, 81 aa, Aotus trivirgatus
PQGHLTFTDVAIEFSQEEWKCLDPAQRALYKDVMLENYRNLVSLGISLPDLNINSMLEQRRELWSGESEVRIAKSADRRER

SEQ ID NO: 20625 - protein, 81 aa, Papio anubis
RLTFRDVAIEFSQEEWKCLNSTQRTLYRDVMLENYRNLVSLGEDYFLPEHRKEPWTMESQVQIARKPKGWEWIKGVKIAQS

SEQ ID NO: 20626 - protein, 81 aa, Papio anubis
GAIEMGVLTFRDVAIEFSLEEWQCLDTAQQNLYRDVMLENYRNLVFLGIAVSKPDLITCLEQGKEPWNVKRHEMGAEPPGR

SEQ ID NO: 20627 - protein, 81 aa, Sarcophilus harrisii
SQEPVTFQDVAVDFSQEEWGQLDPAQRDLYRDVMLENYGNLVSLGLVVSDPSVIYHLEQKKEPWKLDLQGTDKTKVLRGTW

SEQ ID NO: 20628 - protein, 81 aa, Pan paniscus
ELLTFRDVAIEFSPEEWKCLDPDQQNLYRDVMLENYRNLVSLGVAISNPDLVIYLEQRKEPYKVKIHETVAKHPVISLQVY

SEQ ID NO: 20629 - protein, 81 aa, Pan paniscus
SAQGTVTFEDVAVNFTWEEWNLLSEAQRCLYRDVTLENLALISSLGMTFLHVCQALDSLRQVPPTSASQNAGITGVSHCAW

SEQ ID NO: 20630 - protein, 81 aa, Lipotes vexillifer
VPAFSDKDSLGDEMLAAALLKAKAQELVTFEDVAVYFIRKEWKRLEPAQRDLYRDVMLENYGNVFSLGFPFLNFDMISGLQ

SEQ ID NO: 20631 - protein, 81 aa, Pan paniscus
QEPLSFKDVAVVFTEEELELLDSTQRQLYQDVMQENFRNLLSVGERNPLGDKNGKDMEYIQDEELRFFSHKGLSSCKIWEE

SEQ ID NO: 20632 - protein, 81 aa, Lipotes vexillifer
DSLAIEDVVVNFTLEEWALLDPSQKKLYRDVMQEIFWNLASVGKTWEYHDIGDQYRNQGGNLRSPMVERLSERKDSSSCGE

SEQ ID NO: 20633 - protein, 81 aa, Monodelphis domestica
QESLTFKDVAVEFTWEEWRHLDPAQRALHRNVMLENYENLVSIEGKIRLEMKEMTAELSLSGEETQRQRCIGDGACDSTWR

SEQ ID NO: 20634 - protein, 81 aa, Monodelphis domestica
PQERMTFKDVAVDFTREEWRLLDHSQKELYREVMLENVQNLISLGFSVPRAHLISNLQQREAPWLLEQKSPRSSFSETRFE

SEQ ID NO: 20635 - protein, 81 aa, Monodelphis domestica
MLENAQNLLSLGLPVPREIFLSCFQQGEAPWLLEQKGPRSSCPKAETTFDVEMSTKLSLFVEGCGPQRCMNEGPCDFISRE

SEQ ID NO: 20636 - protein, 81 aa, Monodelphis domestica
PQELVTFEDVAVYLTKEEWEHLGPAQRRLYRDVMLENYENVVSLGFPVSKPDLISQLEQGEVPCLPDLPRTEVPEIHGGPL

SEQ ID NO: 20637 - protein, 81 aa, Monodelphis domestica
MLENARNLLSVGLQAPQEDVISSLEQREAPWMLEQEGLMSCCPGEIIPEMKENPTEMSPSLEEMELQRFINDSPNKFAFRE

SEQ ID NO: 20638 - protein, 81 aa, Monodelphis domestica
LWGSLTFKDVAVEFTQDEWCLLDHSQKELYLEVMLENAQNLLSVGLPVPREYCASYFQQGKAPWLLELKGPRSSFPEAETN

SEQ ID NO: 20639 - protein, 81 aa, Monodelphis domestica
SQGSITFKDVAVDFTQEEWCLLDHSQKELYLEVMQENMQNLLSVGLPVPRENFMSCFQQGKAPWLLEQKGPRSSCPEAKTI

SEQ ID NO: 20640 - protein, 81 aa, Monodelphis domestica
SQEAVTFRDVALDFTWEEWRCLSLAQRELYRDVMLENYRNLVSLGLLGPKPDLISWLEQREETEIWDPLGWATVGTCSCEG

SEQ ID NO: 20641 - protein, 81 aa, Monodelphis domestica
SQESVTFKDVAVNFTREEWCLLDHSQKELYTEVMLENVQNLLSVETSFEAKKISTKLSLFLEGSAHQKFMNESSYDLILRE

SEQ ID NO: 20642 - protein, 81 aa, Monodelphis domestica
SQGLVTFEDVAVYFSLEEWGRLNESQKDLYREVMQENYGILVSLGYPIPKPDVISRMERGEELWVPESPGPEEGDILTGVY

SEQ ID NO: 20643 - protein, 81 aa, Physeter macrocephalus
SRGSVTFRDVAVDFSREEWEWLQPAQRDLYRHVMLENYGHLVSLGLNISKPDVVSLLEQGKEPWLGKDASRGLFSASESNG

SEQ ID NO: 20644 - protein, 81 aa, Monodelphis domestica
NFWILRLPPSSKGEVPKEWGKLDEWQKDLYKHVMRGNYETLVSLDYAISKPEVLSRIEQGKEPCGWRRAGPKNPDIHTDPN

SEQ ID NO: 20645 - protein, 81 aa, Physeter macrocephalus
GQGSVSFKDVTVDFTWDEWLQLTCMQRTLYRDVMLENYSHLVSVGYCISKPEVIFKLEQGEEPWPLERAFPCRSDPVTLLK

SEQ ID NO: 20646 - protein, 81 aa, Monodelphis domestica
SITFKDMAVDFTQEEWCLLDPSQKELYREVMLESVQNLLSLEAETNLEVKEISPKLSIFVKGSRPQRGINKGCCDFILREI

SEQ ID NO: 20647 - protein, 81 aa, Monodelphis domestica
DSQGSLTFKDVTVDFTQEEWYLLDHSQKELYLEVMLENVQNLLSVGLPVPREYFTSCFQQGKAPWLLKKESLRSSCGVGEM

SEQ ID NO: 20648 - protein, 81 aa, Monodelphis domestica
SQELVTFEDVAVYFIRKEWKRLDPAQRDLYRDVMLENYGNVFSLGFPFPNPEIISHMDGEEESWVLDLKAAESQELQSGSC

SEQ ID NO: 20649 - protein, 81 aa, Papio anubis
MAKPVREEWRHLDPSQRNLYRDVMLETYSHLLSVGYQVPEAEVDMLEQGKEPWALQGERPRQSCPGEKLWDHNQCRKILTY

SEQ ID NO: 20650 - protein, 81 aa, Papio anubis
RDVAIEFSLEEWHCLDTAQRNLYKNVMLENYSNLVFLGIVVSKPDLITRLEQGKKPLTMKRHEMVAKPPVMCSHFAQDLWP

SEQ ID NO: 20651 - protein, 81 aa, Aotus trivirgatus
QVASVSFQDVAVEFTQEEWQHLGPVEWTLYRDVMLENYRHLVSVGYCITKPKVISQLEQGEEPWSLEDEFLNQKYPGHFEV

SEQ ID NO: 20652 - protein, 81 aa, Papio anubis
FQGSVTFRDVAIDFSQEEWKWLQPAQRDLYRCVMLENYGHLVSLGLSISKPDVVSLLEQGKEPWLGKRNVNRDLQALCIPI

SEQ ID NO: 20653 - protein, 81 aa, Papio anubis
KSLVTFEDVAVYFSQEEWELLDAAQRHLYHSVMLENLKLVTSLGNTLSQHGDDQLMPCNISVEEVLPVRIPNADSSTKKAN

SEQ ID NO: 20654 - protein, 81 aa, Aotus trivirgatus
MFKEAVTFKDVAVVFTEEELGLLGPAQRKLYRDVMLENFRNLLSVGHQPFHRDTFHLQTEEKFWMMETATRREGNSGGKIQ

SEQ ID NO: 20655 - protein, 81 aa, Aotus trivirgatus
TLKEALTFKDVAVVFTEEELGLLDPAQRKLYRDVMLENFRNLLSVGHQPLHGDTFHFPREEKFWMVKTATQREGNLGPAFQ

SEQ ID NO: 20656 - protein, 81 aa, Pan paniscus
MGLLTFRDVAIEFSLEEWQCLDTAQKNLYRNVMLENYRNLAFLGIAVSKPDLLICLEKEKEPWNMKRDEMVDEPPGICPHF

SEQ ID NO: 20657 - protein, 81 aa, Pan paniscus
VDESVTFRDVAVFFSQDEWLHLDSAQRALYREVMLENYSILVSLGILFSKPKVISQLEQGEDPWMVESGVPQGTHLGWESL

SEQ ID NO: 20658 - protein, 81 aa, Pan paniscus
PQASVCFEDVAMAFTQEEWEHLDLAQRTLYREVTLETWEHIVSLGLFLSKSDVISQLEQEEDLCRAEQEAPREKGMLPGSF

SEQ ID NO: 20659 - protein, 81 aa, Lipotes vexillifer
WFQGPVSFEDVTVEFTQEEWVMLDSAQRSMYRDVMLENYMNLTLVEYQLCKPVISLSGQEDIRTVKRRIPQSTCLDWEIQL

SEQ ID NO: 20660 - protein, 81 aa, Lipotes vexillifer
FQEPVSFKDVAVTFTKEELGLLNSTQRKLYQDVMLENFWNLVSVGYLPVKLDMILQLGRKKKLWVMEPVAQGAGCSGHGNQ

SEQ ID NO: 20661 - protein, 81 aa, Monodelphis domestica
DRSSASPGAGPSPGKEPRAGRRNGLCRPVRESPGFPVFKPDVISQLERGEGPWTSETEVPQVICPDSIIDKRRCENLDWIP

SEQ ID NO: 20662 - protein, 81 aa, Monodelphis domestica
NKESLTFKDVAVHFTYEEWKHLDPSQKDLYREVMLENYRNVVFLGIPVSKPNVITLLEQGKEPWILEKELPRDTSAGLPIP

SEQ ID NO: 20663 - protein, 81 aa, Monodelphis domestica
SALHLDPPVPMRVTFADMAVYFGDVMWESYRNLISLGFPIPKPELITHLEQEAEPWGPGPQESEERDPRDPYPSVRTKEEE

SEQ ID NO: 20664 - protein, 81 aa, Monodelphis domestica
RETQGSVTFQDVAVDFTQEEWRLLDHSQKELYLEVMLENVQNLLSMGLPVPREIFISCFQQEEALEQKGLRSSYPEAETNF

SEQ ID NO: 20665 - protein, 81 aa, Physeter macrocephalus
GVTFEDIAVYFSWEEWRLLDEAQIRLYLDVMLESYALISSLGCCCGAEDAEAPFEQIASLGVSQARTPKAALSSQKTHPCE

SEQ ID NO: 20666 - protein, 81 aa, Monodelphis domestica
PAHVVTFKDVAVDFTREEWCLLSPPQKELYKEVMLENAWNLLSVGLPVPPKDILSYLKQREAPWILEQEVLRSCCPEGEIR

SEQ ID NO: 20667 - protein, 81 aa, Physeter macrocephalus
VMESVTLEDVAVGLIQEWALLDDAQRNLCRYVLLDNCRTLAPWAGTPPCKACLVSQVGPREELVTAERGILCATGVDWESQ

SEQ ID NO: 20668 - protein, 81 aa, Monodelphis domestica
QGSITFKDVAVDFTQEEWRLLEPSQKEQYREVMLENAWNLHSVEVETNFEVKEMSTNLTLFVEECGSQRCMNEGLFDFIFR

SEQ ID NO: 20669 - protein, 81 aa, Monodelphis domestica
GQEEVTFKDVAVDFTREEWCLLSPPQKELFKEVMLENIRNLLSVGVPAPPQDVLSFLEQREAPWMLDQEVLRSYYPGEIRP

SEQ ID NO: 20670 - protein, 81 aa, Physeter macrocephalus
MLENYSNLLSVGYQARKPDILSKLDQGEPWTMEDEIHCRTHSGYQASKPDAVSRLERGELWPVEDDSHVQICPEIRKVDDL

SEQ ID NO: 20671 - protein, 81 aa, Monodelphis domestica
CQASVTFKDVAIDFTPEEWRRLDASQKELYREVMLENYSNLVCLGLAASRPALISRLKQGKAPWAAKKHLQAGLWPGIPQA

SEQ ID NO: 20672 - protein, 81 aa, Papio anubis
MDVAIEFSLEEWQFLDTAQQNLYRNVMLENYRNLVFLGIAVSKPDLITCLEQEKEPWEPMRRHEMVAKPSVMCSHVAPDFW

SEQ ID NO: 20673 - protein, 81 aa, Papio anubis
MHESVTLEDVAVEFIQEWALLDSARRSLCRYGMLDRCRTLTSRGTPPCKPSRVSQLGPRAEPRATERGILHATGVAWESQL

SEQ ID NO: 20674 - protein, 81 aa, Aotus trivirgatus
AQVSVTFDDVAVTFTKEEWGQLDLGQRTLYQEVMLENCGLLVSLGCPVPRPELIYHLEHGQEPWTRKEDLSQGTRPGDKGK

SEQ ID NO: 20675 - protein, 81 aa, Aotus trivirgatus
FQESVTFKDVIVDFTQEEWKQLDPGQRDLFRDVTLENYTHLVSIGLQVSKPDVISQLEQGTEPWIMEPGIPVGTSADWKTR

SEQ ID NO: 20676 - protein, 81 aa, Aotus trivirgatus
ACRSITFRDVAIDFSHQEWEYLNLVQKTLYQEVMMENYDNLVSLAGHSISKPDLITLLEQGKEPWMIVREDTRGEYTDLDS

SEQ ID NO: 20677 - protein, 81 aa, Aotus trivirgatus
ISFEDVAVDFTLEEWQLLSPTQKSLYRDVMLENYSNLVFLEVWLDNPKMWLQDNQDNLKSMERGHKYGVFGKIFKSSINFV

SEQ ID NO: 20678 - protein, 81 aa, Aotus trivirgatus
RPQESVAFDDVAVYFTKKEWAMLVPDRRAVYRDVMLENYEAVAAPPTSKPAWVSHLEQGKEPCFTQPQGVLSRRDWRAAKA

SEQ ID NO: 20679 - protein, 81 aa, Aotus trivirgatus
MELLTFRDVAIEFSLEEWQCLDTAQQNLYRNVMLENYRNLVFLGIAVSKPDLITCLEKEKEPWNMKRYEMVDEPPGLCLHF

SEQ ID NO: 20680 - protein, 81 aa, Aotus trivirgatus
MGPLTFRDVAIEFSLEEWQCLDTAQRNLYRNVMLENYRNLVFLGIAVCKPELIICLEQEKEVWSRKRQEIMVAKPPVMHSH

SEQ ID NO: 20681 - protein, 81 aa, Papio anubis
QDTVAYEDLCVDYTQKKWKCPALSQRALQWNMMPENDRSMASLGENMMKGSELTPKQEIFKGSESSNKTSGGLFGMVPGGA

SEQ ID NO: 20682 - protein, 81 aa, Papio anubis
AQMLVTFKDVAVTFTQEEWRQLDLTQRTLYREVMLETCGLLVSLGHRVPKPELVHLLEHGQELWTVKRGLSDPTCAGDRTQ

SEQ ID NO: 20683 - protein, 81 aa, Felis catus
SQGSVTFRDVAIDFSQEEWEWLQPTQRDLYRHVMLENYSHLVSLGLNISKPYVVSLLEQGKEPWLEKRGVRRDLFSVLKEA

SEQ ID NO: 20684 - protein, 81 aa, Leptonychotes weddellii
MAVTFEDVTVIFTWEEWKFLDSSQKKLYREVMWENYTNVMSVGNWKESYKPQEERFRYLEHENLPCWQAWKNASAQIYENR

SEQ ID NO: 20685 - protein, 81 aa, Neomonachus schauinslandi
APEQVTFEDVVVDFTQEEWGQLEPAQRTLYRDVMLETFRLLVSVAGCWLPELDVISLLEQEEELWAVDEGVPRGVCSDLET

SEQ ID NO: 20686 - protein, 81 aa, Neomonachus schauinslandi
MEFTWEEWQLLDSTQKYLYRDVILENYSHLVSVGYHGTKPDLIFKLEQGEEPWIINAKVSRQSCPGWKEWYQKNQDEFENI

SEQ ID NO: 20687 - protein, 81 aa, Neomonachus schauinslandi
SMGSLSFRDVTVGFTQEEWQHLDPAQRTLYRDVMLENYSHLVSVGCSIPKPEVILKLEQGEEPWILEEEIPSQSDPGLGLK

SEQ ID NO: 20688 - protein, 81 aa, Neomonachus schauinslandi
KVPVTFVDIAVYFSEDEWKNLDEWQKELYNNLVKENYKTLMSLDMEGAVPKPDAPSQVEPREEPCVWEQRDPEEREILMDP

SEQ ID NO: 20689 - protein, 81 aa, Neomonachus schauinslandi
FQGSVTFRDVAVAFSQPEWESANPAQRHLHRDVMLENYSNLVSLAGHSISKPHLITLLEQWKEPWMIVRKDQRRQYTDFQL

SEQ ID NO: 20690 - protein, 81 aa, Monodelphis domestica
MLENARNLLTVGLSAPPEKVVSYLEQRDVLWMLEQEGLRIWYPGENRPEIMVNPTEVSFPVEEVNLQRSISDGPDNFASRE

SEQ ID NO: 20691 - protein, 81 aa, Monodelphis domestica
AQEVVTFKDVAVDFTREEWRLLSPPQKELYKEVMLENAQNLLSVGLLAPPAYVLSYLEQREAPWMVEQKGLRNCCPEGEIR

SEQ ID NO: 20692 - protein, 81 aa, Monodelphis domestica
GQEAVTFQDVAVDFTREEWRLLSPPQKELYREVMLENAWNLLSVGLPASPEDVLSSLEQREAPWMLEQEGLRSCCPEGEIR

SEQ ID NO: 20693 - protein, 81 aa, Monodelphis domestica
IQSSLTFKDVAVDFTQEEWCLLDHSQKELYLEVMLENVQNLFSVGLPVPREYCTSCFQQGKVPWQLEPKSPRSSCPEAETN

SEQ ID NO: 20694 - protein, 81 aa, Monodelphis domestica
AQEAVTFKDVAVDFTQEEWCLLTSPQKELYKEVMLENAWNLLSVGLAVPREDVISSSEQRAAPWILEQEGLRNCHPEGEIR

SEQ ID NO: 20695 - protein, 81 aa, Monodelphis domestica
SITFKDVAVDFTKEEWCLLDYSQKELYREIMLENVQNLLFVEAETDFEVKKMSTKLSLFVEGSGPPGGINKGCCDFILREI

SEQ ID NO: 20696 - protein, 81 aa, Physeter macrocephalus
TQGQLTFEDVAITFSHEEWECLDPAQRALYRDVMLETYGNLRSLVRISVSVVTIISILEQGKELWALESEVKNSKKSNEWE

SEQ ID NO: 20697 - protein, 81 aa, Monodelphis domestica
LQGLVTIKDVSLCFSQEEWRSLDPSQTDFYGEYIMEENCGIVVSLKFPIPKVDMISQLEGEEQWVPDPTQDLEERDIPRIT

SEQ ID NO: 20698 - protein, 81 aa, Physeter macrocephalus
SEESVTFEDVAINFTQKEWALLDTSQKTLFRNVMLENITHLVSVGYQISKSEVISQLEQGKELWSEVTGCLLGQSPDGENP

SEQ ID NO: 20699 - protein, 81 aa, Monodelphis domestica
MELVTFEDVAVYFTRKEWGWLDPAQRDLYRDVMLENYGNFVSMGLPFSKPDVISQLEQGEESWVEDLQECEEGEFSPVVHS

SEQ ID NO: 20700 - protein, 81 aa, Monodelphis domestica
PEGSVMFRDVAVLFSPDEWGRLGQGQRELYWEVMLENYQTLVWLGLAVTKPDVISLLERGRTPWMPAPGGPRSSCPDWNTR

SEQ ID NO: 20701 - protein, 81 aa, Physeter macrocephalus
FKEAVTFKDVAVVFTEEELGLLDSAQKKLYQEVMLENFQNLVSVGHQSFTPDVISQLKREEKLWMIKIATQSRRSSGDKNL

SEQ ID NO: 20702 - protein, 81 aa, Physeter macrocephalus
VAAFMVPGQGHVIFEDVAVSFSQEEWGLLNDAQRLLYCDVMLENLSLIASLDTVSALTDAGKASLLREQIHIWAFASIPHL

SEQ ID NO: 20703 - protein, 81 aa, Monodelphis domestica
IQGSLTFKDVAMNFTQEEWCLLDHSQKELYLEVMLENVQNLLSVGLPVPREYCASYFQQGKAPWLLELKGPRSSFPEAETN

SEQ ID NO: 20704 - protein, 81 aa, Monodelphis domestica
AWEVVTFQDVAVDFTREEWRLLSPPQKELYKEVMLENVRNLLSVGLPAPPDDVVSYLEQREGPSMLDQEDLRTCGPEGEIR

SEQ ID NO: 20705 - protein, 81 aa, Aotus trivirgatus
ELKLLTFRDVTIEFSPEEWKCLDPAQQNLYRDVMLENYRNLVSLGVAISNPDLVTSLEQRKEPYNVKMHKTVNFFHIHANK

SEQ ID NO: 20706 - protein, 81 aa, Aotus trivirgatus
MGVLTFRDVAIEFSPEEWECLDSAQQHLYRDVMLENYRNLVSLGLAIFKPDLITCLEQRKEPWNLKKQETLAKYPASSFHF

SEQ ID NO: 20707 - protein, 81 aa, Aotus trivirgatus
YQESVTFEDVSVDFTQEEWTLLDPLQRNFYRDVMLENYENLAKVGFQLLKPSLISWLEEEEELRTLQQEVLQEWAIKLHTN

SEQ ID NO: 20708 - protein, 81 aa, Papio anubis
DSISLEDVAVNFTLEEWALLDPGQRNIYRDVMRATFKNLACIGEKWKDQDVEDDPKNQGRKPSSPVVETLCENKEDRPCGK

SEQ ID NO: 20709 - protein, 81 aa, Aotus trivirgatus
VVFEDVAVDFTREEWALLDSAQRDLYRDVMLETFQNLASVDDETPCKADRSVSQQDMYGAKISQEQTIPNFTRNNSCAYAL

SEQ ID NO: 20710 - protein, 81 aa, Pan paniscus
SQGRLTFRDVAIEFSQEEWKYLDSAQRALYRDVMLENYRNLVSLGEDNAPPEAGICSAVSLHVPCVPLGSPCIAQLRLKLC

SEQ ID NO: 20711 - protein, 81 aa, Lipotes vexillifer
VKESVTFKDVAIDFTLEEWRLMDPTQRKLHKDVMLENYRNLVSLGLAVSKPDMISHLEDGKGPWVVVRETSKNPYSELETK

SEQ ID NO: 20712 - protein, 81 aa, Monodelphis domestica
MAFKDVAVDFTREEWCLLSPPQKELYKEVMLENARNLFSVGLAVSRGDVISYFEQREAPWMLEQEDLGIGCPGEGITKKPL

SEQ ID NO: 20713 - protein, 81 aa, Physeter macrocephalus
EPLMDTALGSVTFEDVAVYFSQEEWRLLDEAQRFLYRDVMLETFALVASLGLAFSRSHVVQEELGGEPWVYDSRHNMRGSK

SEQ ID NO: 20714 - protein, 81 aa, Monodelphis domestica
MFEDVAVYFRKEEWAGLAPTQRALYKDVMLENYGNVASLVPCPKPRVISKLEQSGDLQGSLFRGHRIPRVGGKARLEKEKV

SEQ ID NO: 20715 - protein, 81 aa, Monodelphis domestica
QLGSVAFEDVAVDFTQEEWGYLAPAQRDLHREVMLENYRNLVFLGLVASKPDVICHLEQRKEPWSLRGIEKRKALRGTCPD

SEQ ID NO: 20716 - protein, 81 aa, Monodelphis domestica
AQVLVTFQDVAVDFTQEEWRLLDPGQKELYKEVMLENVQNVLSLGLPVPREDWFFHFHEGGDPWMLEGKGPSISRLDEERH

SEQ ID NO: 20717 - protein, 81 aa, Monodelphis domestica
PAQEVVTFRDVAVDFTREEWRLLSPPQKELYKEVMLENVRNLLSVGLPAPPKDMILEQREAPWMLEQEGLRCYCPGEIRSE

SEQ ID NO: 20718 - protein, 81 aa, Monodelphis domestica
AQEVVTFKDVVVEFTREEWCLLSPAQKELFKEVMLENAWNLHSLGLPAPLEDMISYLKLKEPPWMLEQEGLRSFFPEGKIR

SEQ ID NO: 20719 - protein, 81 aa, Monodelphis domestica
SQVSLTFRDVAVDFSQEEWGLLEPAQKDMYRDVMLENYENFLSLGLPISKPNMISQLKRREAPSWIAEGKVSLSTYLGTLR

SEQ ID NO: 20720 - protein, 81 aa, Monodelphis domestica
SQESLTFKDVAVDFTQEEWRQLDPGQRYLYRDVMLENYSNLVSLGHQISKPDVISQLEQGEEPWLVKGEIPRDTFPDWETM

SEQ ID NO: 20721 - protein, 81 aa, Physeter macrocephalus
FQEPVSFKDVSVVFTEEELGLLDSAQRKLYRDVMLENFQNLLSVGNQPFKPELIFQLEREEELLMMETETQRDGCSGTKSQ

SEQ ID NO: 20722 - protein, 81 aa, Monodelphis domestica
SQGSITFKDVAVDFTQEEWCLLDHSQKELYLEVMLENVQNLFSVGLPVPRENFISFFQQGESSWLLEQKGLWSSCPEAEAN

SEQ ID NO: 20723 - protein, 81 aa, Physeter macrocephalus
PLTFKDVAIEFSREEWECLDPAQKAFYVDVMLETYSNLLSLDISHIHVIKKLQPRANSDRGEVFQTVMLERQESHEMKHFY

SEQ ID NO: 20724 - protein, 81 aa, Papio anubis
SVTFRDVAIDFSQEEWEFLDPAQRDLYRDVMWENYSNFISLGKFPGMVVRACSPNLESRYRTNTLSPEKDIYEIYSFQWDI

SEQ ID NO: 20725 - protein, 81 aa, Papio anubis
DSMTFEDIVVDFTREEWALLDTSQRKLFQDVMLENISHLVSIGGEGDIKHQEIPFIQHTYQKGTSTISTMRSHTQEDPFLC

SEQ ID NO: 20726 - protein, 81 aa, Papio anubis
ERNFLGPLTFTDVAIEFSLEEWQCLDTAQQNLYRNVMLENYRNLVFLGITVSKPDLITCLEKEKESWNMKRHEMVDEPPGR

SEQ ID NO: 20727 - protein, 81 aa, Aotus trivirgatus
EMETLTFRDVAIEFSLEEWQCLNPAQQNLYRNVMLENYRNLVFLGIAVSKADLITCLQQEKDPWNMKRHSIVAKPPVLCSH

SEQ ID NO: 20728 - protein, 81 aa, Sarcophilus harrisii
AKESITFKDVSMDFTREEWGQLNPAQKNLYRDVMLENYRNLVSLGLQVFKPDVIARLERAEAPWTLENKVLRHSCSDWEMK

SEQ ID NO: 20729 - protein, 81 aa, Lipotes vexillifer
PKVPVTFDDVAVYFSEPEWGKLDEWQKELYKHVMRGNYETLVSLDYAISKPDILTRMERGEEPCPEGPRGQEEGSDREEAR

SEQ ID NO: 20730 - protein, 81 aa, Lipotes vexillifer
SLGSDLFRDVAVVFSQEEWEQLAPAQRDLYRDVMLEIYSNLVSLGFAISKPDVISFLEQGREPWMVEKVVTGGQCPVLESR

SEQ ID NO: 20731 - protein, 81 aa, Lipotes vexillifer
AQESLTYDDVTMKFTWEEWQLLDPDQKDLYRDVMLENYSNLLSVGYQASKPDALFRLERGEQLWPVEDDSHGRICPEIRKV

SEQ ID NO: 20732 - protein, 81 aa, Pongo abelii
GLLTFRDVAIEFSQEEWKCLDPAQRTLYRDVMLENYRNLVSLEFRSVTQAKVQWCHLSSLQPPLPRFKQFSCLSLPSSWDY

SEQ ID NO: 20733 - protein, 81 aa, Pongo abelii
KRKGKEPSMALPQGRLTFRDVAIEFSLAEWKFLNPAQRALYREVMLENYRNLEAVESHFVTQAGVQWCDLGSLQPLPPKFK

SEQ ID NO: 20734 - protein, 81 aa, Pongo abelii
EMGPLQFRDVAIEFSLEEWHCLDTTQRNLYRDVMLENYRNLVFLGIVVSKPDLITCLEQGIKPLTMKRHEMIANTPGPGMV

SEQ ID NO: 20735 - protein, 81 aa, Bos indicus x Bos taurus
YEFDVTIDFTLEEWECLDLDQQELYRNVMLENYGNLASLGLVVSKPDLVTFLEQMKNPWDIRRTDTTATYPCRCEWLELMT

SEQ ID NO: 20736 - protein, 81 aa, Bos indicus x Bos taurus
MESVTLEDVAMELIQEWTLLDDAGRNLCRHVLQDNCRTPAPRGTPPCKASLVSQVEPREELKAAEHGVLCATGVDWESQFT

SEQ ID NO: 20737 - protein, 81 aa, Pan troglodytes
VQGLLTFRDVAIEFSQEEWKCLDPAQRTLYRDVMLENYRNLVSLEFWSVTPAKVQWCHLRSLQPLLPRFKQFSCLSLPSTW

SEQ ID NO: 20738 - protein, 81 aa, Pan troglodytes
HLVTFEDVAVDFTQEEWTLLDQAQRDLYRDVMLENYKNLIILELDLQLKTKGFPLLQDISAERSPNGVQLERSNTAEKLYD

SEQ ID NO: 20739 - protein, 81 aa, Pan troglodytes
EMGLLTFRDIAIEFSLEEWQCLDCAQQNLYRDVMLENYRNLVSLGIAVSKPDLITCLEQNKESQNIKRNEMVAKHPVTRSH

SEQ ID NO: 20740 - protein, 81 aa, Pan troglodytes
QGRLTFRDVAIEFSLAEWKFLNPAQRALYREVMLENYRNLEAVDISSKHMMKEVLSTGQGNTEVIHTGTLQRHQSYHIGDF

SEQ ID NO: 20741 - protein, 81 aa, Monodelphis domestica
IQGSLTFKDVAVDFTQAEWCLLDHSQKELYLEVMLENVQNLLSVGLPVPREYCASCFQQGKTPWLLEQKGLRSACPEAETN

SEQ ID NO: 20742 - protein, 81 aa, Monodelphis domestica
FQESLTFKDVAVEFTWEEWRHLGPAQRALHTNVMLENYENLVSIGIPVSKLDLLLLLKREDVQIQEGEAGTGTSTEGKIRL

SEQ ID NO: 20743 - protein, 81 aa, Monodelphis domestica
AQKSLTFKDVAVDFTKEEWRQLNPSQRDMYRDVMLENYKNLVFLGLLGSQPDVISQLEKGEVPWMPEGEISRNPSLDSIIQ

SEQ ID NO: 20744 - protein, 81 aa, Monodelphis domestica
VVTFQDVAVNFTREEWRLLSPPQKELYREVMLENARNLLSVEEDIRLEIKAIPTEESLSVKERDQQRFMRGGPYNCVVSQN

SEQ ID NO: 20745 - protein, 81 aa, Physeter macrocephalus
MDSVTFEDVSVKFTTEEWALLDLSQKKLYRDVMQETFKNLTSIGEKWEDPETEDQYENPGTNLRHMTSRTTPKPREYQEYE

SEQ ID NO: 20746 - protein, 81 aa, Monodelphis domestica
APEESVTFNDVAVDFTQDEWRHLDPSQKELYRDVMLENYKNLVSLGLPISKPDVISQLEQGETPWILENERFKSSYPVAMQ

SEQ ID NO: 20747 - protein, 81 aa, Monodelphis domestica
VLTARFQDVAVEFTWEDWRHLDPAQRALHRNVMLENYENLVSIEGKIRLEMKEMTAELSLSGEETQKQRCIGDGACDSTWK

SEQ ID NO: 20748 - protein, 81 aa, Monodelphis domestica
SEETVTFKDVAVDFTWEEWKQLTPVQRDLYRDVMLENYQNLVSLGLPVFQSDLISQLERGEVPWIPEGETFRGPCPGSINQ

SEQ ID NO: 20749 - protein, 81 aa, Monodelphis domestica
SQGSITFKDVAVDFTQEEWCLLDHSQKELYLEVLLENVQNLLSVGLPVPRENFISHIQQRKTSWLLEQKGPRSSSLDFEVK

SEQ ID NO: 20750 - protein, 81 aa, Physeter macrocephalus
MDVFVDFTWEEWQLLDPAQKHLYRSVMLENYSNLVSLGYQHTKPNIIFQLEQEELWMMQIPSEGHLDEVWEIDGRMEWHKE

SEQ ID NO: 20751 - protein, 81 aa, Monodelphis domestica
MESVTFQDVAVDFTHDEWGRLEPAQKDLYRDVMLENYQNFVSLGGLPAPKPHVISQLERGETPCPAEREAPRAICQDSIIW

SEQ ID NO: 20752 - protein, 81 aa, Monodelphis domestica
MLENVRNLLSVGLQAPQEDVISSLEQREAPWMLEQEGLMSCCPGEIIPEMKENPTEMSPSLEEMELQRFINDSPNKFAFRE

SEQ ID NO: 20753 - protein, 81 aa, Monodelphis domestica
GSVTFRDVAVDFSGDEWGFLSPAQRELYWDMMLENSGAFRALPHGTHRECCFRRQWTRLCHTGSSDFPWSRNSTQRWRMWE

SEQ ID NO: 20754 - protein, 81 aa, Physeter macrocephalus
MITSQEEWQHLDSAQRTLYRDVMLENYSHLISVGFCIPKPEVILKLEQGEEPWILEEESPSQCVPELINSSRNYSRKKFDE

SEQ ID NO: 20755 - protein, 81 aa, Aotus trivirgatus
MQRPLQFRDVAIEFSLEEWHCLDAAQRNLYRDVMLENYRNLVFLGIVVSEPDLITCLEKGKKPLTVKRHEMIATPPVMCSH

SEQ ID NO: 20756 - protein, 81 aa, Aotus trivirgatus
AHVSLAFRDVSIDLSQEEWECLDPAQRDLYKDVMFENYSNLVSLGYTIPKPDVITLLEQEKEPWIVMREGTRSWYTDLEYK

SEQ ID NO: 20757 - protein, 81 aa, Papio anubis
MDVAIEFSQEEWKCLEPAQRTLYRDVMLENYRNLVSLGEDNVASEQKKDPWILQSEEKIANNPDGRECIKGVNTEPSLCPQ

SEQ ID NO: 20758 - protein, 81 aa, Aotus trivirgatus
LEPRAPVTFDDITVYLLQEEWVLLSKQQKELCGSDKLVPPLGPTVANPELFCKFGRGPEPWLGSMQGQRSLLEHQPGKKQM

SEQ ID NO: 20759 - protein, 81 aa, Aotus trivirgatus
GLSFQGLVMFQDLSIDFSQEEWECLNPTQKDLYRDVMMENYSNLLSLGLSIPKPDVISLLEQGKEPWMVSRDVLGGWCPGE

SEQ ID NO: 20760 - protein, 81 aa, Aotus trivirgatus
VHGSVTFRDVAIDFSQEEWECLQPAQRTLYRDVMLENYSHLISLGSSISKPDVITLLEQEKEPWMVIRKETNRWYPDLESK

SEQ ID NO: 20761 - protein, 81 aa, Pan paniscus
PKPPKGLLTFRDVAIEFSLEEWQYLDTAQKNLYRKMMLENYRNLAFLGIAFSKPDLITCLEQGKEPWNMKRHVMVDEPPGR

SEQ ID NO: 20762 - protein, 81 aa, Lipotes vexillifer
VLLQVSFKDVTVDFSREEWQHLDPAQRLLYRDVTLENYSHLCSVGYQVPKPEVIFKLEQGEGPWTLEEETPHQSCSDEDNG

SEQ ID NO: 20763 - protein, 81 aa, Lipotes vexillifer
RSQGPASFEDVSMGFTQEAWQHLDPAQRTLYREVMLENYSHLISVGYSVIKPEVIFKLPQEEPWMLEEKSQSQSHPDFCIV

SEQ ID NO: 20764 - protein, 81 aa, Pan paniscus
AQESLTLEDVAVDFTWEEWQFLSPAQKDLYQDVMLENYSNLVAVGYQASKPDAFSKLERGEETCTTEDEIYSRICSEIRKI

SEQ ID NO: 20765 - protein, 81 aa, Callithrix jacchus
GSVTFEDVAVYFSWEEWDLLDETQKHLYFDVMLENFVLTSSLGYWCGLEHEEAPSLQRISLKGAPQFRTSKEGSSSQNAYS

SEQ ID NO: 20766 - protein, 81 aa, Callithrix jacchus
RNVLLENYRNLVFLGIAVSKPYLITCLEQKKEPWNMKRCEMVAKPPVMCFHFAQDLWSEQNMKDSFQNVTLRRCGKCGHEN

SEQ ID NO: 20767 - protein, 81 aa, Bos taurus
TTGPMTFEDVALGFTPDEWGKLDLEQKSLYREVMLENYRNLVSVEHQLSKPDVVSQLEEEEELWSVERGIPQDTFSECPEA

SEQ ID NO: 20768 - protein, 81 aa, Ovis aries
MLENFALIASLGLASFRSHIVAQLEMGAEPWVPDRVDMTSAMARGMYRGLGSDFYCGTEGEKSPAELSVSVEVSQNMKSKA

SEQ ID NO: 20769 - protein, 81 aa, Ovis aries
SQTQLTVEDVDIKFTPEEWECLDPAQRALYWDVMEETYRNLLSVVFCLSVMSITSWLTKEEKKSERFMEIGFQRKKSQRNY

SEQ ID NO: 20770 - protein, 81 aa, Bos indicus x Bos taurus
SQESVKFRDVAVVFSPDQWAHLSPEKRELYRDVMLDTCDHLVSLGHWAYKAEVMSSLRQGKEPWMLEKEVTSAPCPACQPA

SEQ ID NO: 20771 - protein, 81 aa, Bos indicus x Bos taurus
VTFEDVAMSFSQEEWGLLGEAQRLLYYDVMLENLSLIASLGKNCICTHRSFVVNTRLFFQDSPQGSPNKSFFPEACHFPEV

SEQ ID NO: 20772 - protein, 81 aa, Bos indicus x Bos taurus
MAASQGWLTFQDIAIDFTQEEWECLDLGQRELYRDMMLENYGNLASLGLVSKPDLVTFLEQRKDSRNIRRVETTPIYPGMS

SEQ ID NO: 20773 - protein, 81 aa, Bos indicus x Bos taurus
MSLYRDVMLENYRNLVSVGFCITKPEVIFRLEQGEEPWILEEEFLSQSFSEVWKTDHMKERSHENQPKHVWEVVLINNKRL

SEQ ID NO: 20774 - protein, 81 aa, Pan troglodytes
KPGAVSFADVAVYFSREEWGCLRPAHRALYRDVMRETYGHLGALGCAGPKPALISWLERNTDDWEPAALDPQEYPRGLTVQ

SEQ ID NO: 20775 - protein, 81 aa, Pan troglodytes
RKRKAKESGMALPQGLLTFRDVAIEFSQEEWKCLDPAQRTLYRDVMLENYRNLVFLDTSSKCMMKMFSSTGQGNTEVVHTG

SEQ ID NO: 20776 - protein, 81 aa, Pan troglodytes
AQGTVTFEDVAVNFTWEEWNLLSEAQRCLYRDVTLENLALISSLGMTFLHVCQALDSLRQVIPTSASQSAGITGSHSIPQA

SEQ ID NO: 20777 - protein, 81 aa, Pan troglodytes
SFYEKGPLTFKDVAIEFSLEEWQCLDTAQQDLYRKVMLENYRNLVSLGIAVSKPDLITCLEQGKEPWNMKRHAMVDEPPGR

SEQ ID NO: 20778 - protein, 81 aa, Callithrix jacchus
AHALVTFRDVAINFSQKEWECLDPTQRKLYRDVMLENYSNLVSLGYSGSKPDVITLLEQGKEPCVAVRDMTGRQYPGLLSR

SEQ ID NO: 20779 - protein, 81 aa, Callithrix jacchus
VTFEDVAVVFTDEEWSHLVPIQRDLYKEVMLENYKSVVSLDWETKPEIYDASEEKAEGSLRESLGKQSPLCPKFEVHAPDG

SEQ ID NO: 20780 - protein, 81 aa, Macaca mulatta
FRGMVTFKDVAVVFTREELGLLDLAQRKLYQDVMLENFRNLLSVGYHPFKLDVILQLGREDKLWLMETEIQRDGCSGHRNQ

SEQ ID NO: 20781 - protein, 81 aa, Monodon monoceros
PLESVTFKDVAIDFTWEEWRLMDPTQRKLHKDVMLENYRNLVSLGLAVSKPDMISHLEDGKGPWVVVRETSKTPYSELETK

SEQ ID NO: 20782 - protein, 81 aa, Macaca mulatta
MGPLQFRDVAIEFSLEEWHCLDTAQRNLYRDVMLENYRNLVFLGIVVSKPDLITRLEQGKKPLTVKRHEMVAKPPVMCSHF

SEQ ID NO: 20783 - protein, 81 aa, Monodon monoceros
SAALPSEDLCPLQDSFSRYEEEMEAYPQQILSQKIGITGVTSGLLLSKPDVIARLEQGEDPWRVEPGSPRDWKTTLEKKES

SEQ ID NO: 20784 - protein, 81 aa, Macaca mulatta
MQRALYREVMLENYANVTSLSAFPFSKPDLIFQLEQGEAAWGPDPWTLAGGEALRGMCTGGKTKTKNEEQTAQLNISKESE

SEQ ID NO: 20785 - protein, 81 aa, Callithrix jacchus
TEDRVVFEDVAIYFSQEEWGHLDEAQRLLYRDVMLENLALLSSLGCWHGAEDEVAPSQQGFSAGVSEVTTSESCMFTQKVY

SEQ ID NO: 20786 - protein, 81 aa, Bos taurus
STLAESVRASNYWLLILLGCPVPRPELIYQQEHGQELWTVKRDLSRSTCAVDEGKPKTTEPTSCEPTLSKGASLQELMQGG

SEQ ID NO: 20787 - protein, 81 aa, Bos taurus
MTTGKTIGWLTFQDVAIDFTQEEWECLDLGQRELYRDVMLENYGNLASLGEDNCLPESLIYPLGFSCVMSRMSSEMFCFLQ

SEQ ID NO: 20788 - protein, 81 aa, Ovis aries
PQGSTPFSSVTVDFTHGGWRQLAPAPRDRFEEGMPEKSRNLVLLGLPVSQPGMNSQLEQREGSWMLKGDGLRNACPDWKII

SEQ ID NO: 20789 - protein, 81 aa, Ovis aries
YGRWKQLLHIVKKERLTSEDVAIEFTQEEWEFLDPAQRALYRDVMLETYRNLLSVGAEYAKLLLSIVSLFARPVDYKSNKT

SEQ ID NO: 20790 - protein, 81 aa, Ovis aries
LMEAVTFGDVAVHFSREEWQCLDPGQRALYKEVMLENHSSVAGLGFLVFKPELISRLEQGQDPWVLDLQGAEGREAARTTR

SEQ ID NO: 20791 - protein, 81 aa, Ovis aries
SQGRLTFQDVAIDFTEEEWECLDLGQRELYRDVMLENYRNLASLGLVISKPDLVTFLEQMKNPWDVRRLETPAVYTGWKPF

SEQ ID NO: 20792 - protein, 81 aa, Ovis aries
EQVTSEDVAIEFTQEEWEFLDRAQRALYRDVMLETYRNLLSVGISPTLVIKHLQCKVNSDKQETFQTLMLGSPESCEIKRV

SEQ ID NO: 20793 - protein, 81 aa, Ovis aries
EEWECLDPAQRTLYRDVMLETYRNLLSVEMTILPVVKKLQLKTNSDRGEVFQLWILGRPERNEMDRFYLRVIQENIYNFQS

SEQ ID NO: 20794 - protein, 81 aa, Otolemur garnettii
LQVLVSFKDVTVGFNQEEWQHLDPDQKALYRDVMLENYSHLVSLGCCFTKPEVVFKLEQGQEPWIVEEESPYQSHPEFWNA

SEQ ID NO: 20795 - protein, 81 aa, Vulpes vulpes
QDSVVFEDVIVDFTREEWTLLNPAQRKLYKDVMLETFRNLVSIDDETQLKINGSISQQDIFGEKLSNEQKIARFIKNDSWT

SEQ ID NO: 20796 - protein, 81 aa, Otolemur garnettii
LQESLTFDDVSVKFTWEEWQLLGSAQKDLYRDIMLENYSNLVSVGTGYQASKSDILSKLEPGELWMTEDEIHRQICFEIRN

SEQ ID NO: 20797 - protein, 81 aa, Otolemur garnettii
FQGVMSFSDVAVDFTWEEWQLLDPLQKTLYRDVMLENYSNLLSLGYQATRPQIVVQLENREEGLIERDFSSQCSPEAVWQV

SEQ ID NO: 20798 - protein, 81 aa, Otolemur garnettii
DQNCVNLEDWFVHFTPEEWEILDERQKCMYCDVMQENFALVISLGPQAFAPRLVVNLLPDRMPILPVRVNTALAKGMMRGV

SEQ ID NO: 20799 - protein, 81 aa, Pan troglodytes
PVTSEDVAVLFIEAEWKRLRLEQRNLYKEVMLENLTESKPEVHTCPCCPLAFGSPQFLSQDELHNHPIPGFHAGNQLHPGN

SEQ ID NO: 20800 - protein, 81 aa, Pan troglodytes
QGLLTFRDVAIEFSQEEWKCLDPAQRTLYRDVMLENYRNLVSLDISSKCMMKTFFSTGQGNTEVIHTGTLQRQASHHTGDF

SEQ ID NO: 20801 - protein, 81 aa, Pan troglodytes
SMVTFEDVAVYFSQEEWELLDAAQRHLYHSVMLENLELVTSLGNALSQHVLLCSSVEADLPNCFPNWLHHFTSLSAVYKCS

SEQ ID NO: 20802 - protein, 81 aa, Otolemur garnettii
SLGPVSFKDVAVDFTQEEWQQLDPDEKITYRDVMLENYSNLVSVGYDITKPNVIIKLEQGEEPWIIEGELSCQSHLEEVWK

SEQ ID NO: 20803 - protein, 81 aa, Otolemur garnettii
PKVPVSFEDVSVYFTKSEWKLLDLRQRILYKRVMLENYSHLVSLGKISPQIPHSSQASLQTKPWVADNHRTGVTTRLHTGD

SEQ ID NO: 20804 - protein, 81 aa, Otolemur garnettii
FQGQLTFRDVAIEFSQEEWQCLDSAQRALYRAVMLENYRNLVSLAGLLLPDLTVLSMLEEGKAPWTVETEVKTPKNSNWEV

SEQ ID NO: 20805 - protein, 81 aa, Otolemur garnettii
SQELVTFEDVAVYFIRKEWKRLEPAQRDLYRDVMLENYGNVFSLDGETRTENDQEISEDTGSRGVLLERFQKDISQGLKFE

SEQ ID NO: 20806 - protein, 81 aa, Enhydra lutris
QAEVTFEDVAVLFSREEWGRLGPAQRGLYRDVMLETYRNLVSLGHGTRTEYKELSSGEMLDGEELDQLQKAVPQGPDPGET

SEQ ID NO: 20807 - protein, 81 aa, Bos indicus x Bos taurus
NKGSLSFEDVTVGSTQEEWQKLDPAQRTLYRDMMLENYSNLISVGYCIPKPELIFKLEQGEQPWVLEAESPSQSYPEVCRI

SEQ ID NO: 20808 - protein, 81 aa, Bos indicus x Bos taurus
FQPTVSFKDVAVTFTWVKWGHVDLAQRTVYREVVLETCSRLVSLVKAVATHHQTQGVAHFRHAWTGPEGAGNFETGNKKPY

SEQ ID NO: 20809 - protein, 81 aa, Bos indicus x Bos taurus
MLENYSNLVSLGLPFSKPEVISLLQQGEDPWKVEKESPGDSSLECKSSPKTTKATQTQDSSFSGLIRKTLKKDEPWNFISE

SEQ ID NO: 20810 - protein, 81 aa, Ovis aries
QEQLTSEDVAIKFTQEEWEFLDPAQRALYRDVMLETYRNLLSVDISPTHVMKHLQPTANSDKLETFHTLMLASPESCEIKL

SEQ ID NO: 20811 - protein, 81 aa, Ovis aries
MDFSREEWQQLDPAQRHLYQDVMLEIYSHFFSVGYHIPNPEIIFRIEEGKEPWMRETEVPCQRYHEGEFGLETPQQEISEE

SEQ ID NO: 20812 - protein, 81 aa, Ovis aries
SQGSVTFTDVSIDFSREEWEWLQPAQRDLYRHVMLENYGHLVSLAGLNISKPDVVSLLEQGKEPWLGNGDVSRELFPASKS

SEQ ID NO: 20813 - protein, 81 aa, Ovis aries
SLGWLTFWDVAIDFTQEEWECLDLGQRELYRDVMVENYRNLACLGLVVSKPDLVTFLEQMKDLRNIRRMETVGIYPAMSPQ

SEQ ID NO: 20814 - protein, 81 aa, Vulpes vulpes
RLRKASCWDISMEFTWEEWQLLDSAQKYLYRDVILENYSHLVSLGYHGTKPDLIFKLEQGEEPWMINARVSRQSYPEGWKE

SEQ ID NO: 20815 - protein, 81 aa, Vulpes vulpes
MFRDVAIDFSQEEWEYLDSAQRDLYRDVMLENYSNLVSLVDLPSRSVNKDLSPKKDIYETELSQWQMSARHQNCDFEESSS

SEQ ID NO: 20816 - protein, 81 aa, Otolemur garnettii
HLTFRDVAIEFSQEEWKFLDPAQRALYREVMLENYRNLVSLDIFPKCVIKKLPPTEKSRTGDTLHTLMLERHERHPSGDFC

SEQ ID NO: 20817 - protein, 81 aa, Vulpes vulpes
MIKSQISFEDVAVDFTLEEWQLLNPTQKNLYRDVMLENYSNLVFLGYHIIRPDAVFKREQEEPWMVEKEVLSQSFAEEVWL

SEQ ID NO: 20818 - protein, 81 aa, Otolemur garnettii
LQGSVSFKDVTVDFTQEEWQQLDPAQKALYRDVMLENYCHFVSVGFHMTKPDMIRRLEQGEELWTERIFPGQSYLEEDGKA

SEQ ID NO: 20819 - protein, 81 aa, Vulpes vulpes
EEVPVVFEDVAVYFTREEWGMLVKRQKELYRDVMRMNYELLASLGPAAAKPDLILKLERRAAPWIKDPDGPRWGQGRPPGK

SEQ ID NO: 20820 - protein, 81 aa, Otolemur garnettii
VQGSVSFKDVTVNFTRDEWLRLNGTQRTLYRDVMLENYSHLVSVGCCITKPDMIFKLEQGEEPWTLDGEFPGRGYPQVQKL

SEQ ID NO: 20821 - protein, 81 aa, Vulpes vulpes
VDVVNLLTGLCSEQGRGRLWVLQGGVTFEDIAVYFSWKEWRLLDEAQRRLYHHVMLENFTLISSLVPVPCVLNPEGDIGGQ

SEQ ID NO: 20822 - protein, 81 aa, Otolemur garnettii
CEGCLTFRDVAIEFSQEEWQCLAPAQRALYRAVMLENYRNLVSLGLLPPEVTVLSTLEEGKEPWTMKSEMNPAKNPNMGKW

SEQ ID NO: 20823 - protein, 81 aa, Otolemur garnettii
MQLLTLRDVSIEFSMDEWACLDPQQTLYRDVMLETYRNLVLLGLAVSKPDLITCLDQSNEPWKGKTHQTVVKHPAMHGEIY

SEQ ID NO: 20824 - protein, 81 aa, Otolemur garnettii
QDSLTFEDVTVNFTFTLEEWTLLDPSQKSLYRNVMQEIFRNLDTIGKPISESHRTSLECGKPFISLTGFRNHMVIHSGDGP

SEQ ID NO: 20825 - protein, 81 aa, Otolemur garnettii
QGWLTFRDVTIEFTPEEWECLDPVQRNLHRDVMLENYRNLVSVDFQVSFETLFQCLKKKKNTTNVPMGQGAVKEVSYISPS

SEQ ID NO: 20826 - protein, 81 aa, Otolemur garnettii
FQEFVTLKDVAMDFTLDDWKELGLDQGDLFWDTALDNYQNLFLLNPPRPNLTTHLGGKEELEALQPSLLFGGSGLYIVNQE

SEQ ID NO: 20827 - protein, 81 aa, Bos indicus x Bos taurus
TQVSVTFDDVAVTFTQEEWGHLDPAQRTLYREVMLETCRLLVSLGCPVPRPELIYRLEHGQELWTVKRDLSRSTCAVDEGK

SEQ ID NO: 20828 - protein, 81 aa, Bos indicus x Bos taurus
MHFSREEWELLDEAQRQLYHTVMLETLELVTSLGCWPVVEDEEVPSEKNASGEVVSQVKTPSVPPSMQKADSCDTCEPLLK

SEQ ID NO: 20829 - protein, 81 aa, Bos indicus x Bos taurus
ALSQLTFKDVFIDCTPEEWECLDPAQRTLYKDVMVETLRILLWIDDDISSCPGIISSNLELQSLKSHPRNGHTAWDVFPIE

SEQ ID NO: 20830 - protein, 81 aa, Bos indicus x Bos taurus
QESVTFQDVAVDFTEKEWPLLDSTQRKLYKDVMLENYSNLASVDWATPSKTKWSILMEDIFGKETSNGVTVEKVLGEESAE

SEQ ID NO: 20831 - protein, 81 aa, Bos indicus x Bos taurus
MLENYQNLLSLGAGFPGAKPDVISRLERGEEPRTERRETQQVTCPDLETSSATNQEMLLKKNISEEVASPMAKMEGILRAV

SEQ ID NO: 20832 - protein, 81 aa, Pan troglodytes
EPGAVSFADVAVYFSPEEWECLRPAQRALYRDVMRETYGHLGALGFPGPKPALISWMEQESEAWSPAAQDPEKGERLGGAR

SEQ ID NO: 20833 - protein, 81 aa, Callithrix jacchus
GPLTFRDVAIEFSLEEWQCLDTAQQDLYRKVMLENYRNLVFLDTGESILERSPTNVKNLLSSLQLLLHIREFTLERNPTNV

SEQ ID NO: 20834 - protein, 81 aa, Callithrix jacchus
QGLLTFRDVTIEFSQDEWRCLHPAQKTLYRDVMLENYRNLVSLDISSKYKMKGLLSTAQGDTDGFHTGILDRHESHHMGDF

SEQ ID NO: 20835 - protein, 81 aa, Ovis aries
FQGWLTFQDVAINFTQEEWECLDFSQRELYRDVMLENYRNLASLAGLVVSKPDLVTFLQIKNPWDVRRLETPAIYTAVSSH

SEQ ID NO: 20836 - protein, 81 aa, Ovis aries
LSQERLTSEDVAIEFTPEEWEFLDPAQRALYRDVMLETYRNLLSVGEDDFLPELPLGICIFPVCPLGGPDVFHVRVLVTGA

SEQ ID NO: 20837 - protein, 81 aa, Ovis aries
EQLTFKDVAVEFSQEEWECLDPAQRAFYMDVMVETLRNLISVDISHIHVVKKLQPIASSDRGDAFQTVTLERQESPEMKYF

SEQ ID NO: 20838 - protein, 81 aa, Ovis aries
VTECLRNCSQDSVTFADVAVNFTQEEWTLLNCFQRKLYRDVMLENYKNLTTAGYQVFKPTLISWLEEEELSTVEKGVLQGE

SEQ ID NO: 20839 - protein, 81 aa, Otolemur garnettii
VQDSVIFEDVAVNFTQEEWALLDISQKNLYRDVMLENFWNLASLGYPLHTSHLVSQWEQEEHLQTTKRGLIQDICTVEQQE

SEQ ID NO: 20840 - protein, 81 aa, Otolemur garnettii
FQGPVTFRDVAIDFSQEEWKWLQPAQRDLYRCVMLENYGHLVSLGLSISKPDVVSLLEQGKEPWLEQGDVRRNLFSVSQSN

SEQ ID NO: 20841 - protein, 81 aa, Otolemur garnettii
QTPVSFKDVVVGFTQEEWHGLNPAQRTLYRDVMLETYSNLVSVGYEGTKPDVILRLEQEEAPWICEVACPGCHCWEDIWQV

SEQ ID NO: 20842 - protein, 81 aa, Vulpes vulpes
AQVLVTFKDVAVTFTREEWGQLDLDQKALYQEVMLETYGLLVSLGHPVPKPELTHLLKCGQELWTGKRGLSRSTCSGDGTK

SEQ ID NO: 20843 - protein, 81 aa, Enhydra lutris
AQGCVTFEDVTIDFSQEEWGLLDEAQRLLYCDVMLENFALIASLGLTSFRSHIVAQLQMGAEPWVPDRVDMTSAMARGAYT

SEQ ID NO: 20844 - protein, 81 aa, Pan troglodytes
QGLLTFRDVAIEFSQEEWKCLDPAQRTLYRDVMLENYRNLVSLDTGFLLFCLANLKLLPSGDPSTSASKTAAITDISSKCM

SEQ ID NO: 20845 - protein, 81 aa, Pan troglodytes
AQVSVTFQDVAVTFTQEEWGQLDAAQRTLYQEVMLETCGLLMSLGCPLFKPELIYQLDHRQELWMATKDLSQSSYPGDNTK

SEQ ID NO: 20846 - protein, 81 aa, Pan troglodytes
PQASVCFEDVAMAFTQEEWEHLDLAQRTLYREVTLETWEHIVSLGLFLSKSDVISQLEQEEDLCRAEQEAPRGTRASKKQR

SEQ ID NO: 20847 - protein, 81 aa, Enhydra lutris
SQESVQLRDVAVTFSPEQWAYLSSEERQLYTDVMLDNLDYLVSLGHWTYKAEVVSALRQGKDLWMVEKEVTSAPCPACQPA

SEQ ID NO: 20848 - protein, 81 aa, Enhydra lutris
SKESVTFKDVAVDFTQEEWGQLDSPQRALYRDVMLENYQNLLALGPPVCKPDVISHLERGEEPWWMPREVPGGACPEGEPG

SEQ ID NO: 20849 - protein, 81 aa, Enhydra lutris
HQELVTFKDVAVYFTRTEWAGLSPTQKALYRSVMLENYGNLTSLGYPVPKPALISLLEGENLPWGLEAQENPSAEGTKDIC

SEQ ID NO: 20850 - protein, 81 aa, Pongo abelii
ALTQGQLSFRDVAIEFSQEEWKCLDPGQKALYRDVMLENYRNLVSLDFSLLAWDARVFRVEAWRTSGGAEEPTSPNFGGND

SEQ ID NO: 20851 - protein, 81 aa, Pongo abelii
IQGQVNFEDVFVYFSQEEWVLLDEAQRLLYRDVMLENFALMASLGHTSFMSHIGASLVMGSEPWVPDWVDMILAVATETPG

SEQ ID NO: 20852 - protein, 81 aa, Pongo abelii
EMELLTFRDIAIEFSLEEWQCLDHAQQNLYRDVMLENYRNLVSLGITVSKPDLITCLEQNKEPRNIKRNEMVAKHPVTCSH

SEQ ID NO: 20853 - protein, 81 aa, Pongo abelii
AQVSVTFDDVAVTFTQEEWGQLDLAQRTLYQEVMLENCGLLVSLGCPVPRPELIYHLEHEQETWTRKEDLSQGTCPGDKGK

SEQ ID NO: 20854 - protein, 81 aa, Pongo abelii
EKGPLTFRDVAIEFSLEEWQCLDTDQQGLYRKVMLENYRNLVFLAGIALTKPDLITCLEQGKEPWNIKRHEMVAKPPDGVS

SEQ ID NO: 20855 - protein, 81 aa, Pongo abelii
TVTFEDVAVNFSQEEWCLLSEAQRCLYRDVMLENLALISSLGCWCGSKDEEAPCKQRISLQRESQSRTPRTVISPKKAHPC

SEQ ID NO: 20856 - protein, 81 aa, Bos indicus x Bos taurus
MTQRPITYTDVIIEFFYMRGNSLTFVQKKLYPDVMMEKCSNLVSVDHSIPKPDIIVLKQGKEPWMVVREEKRSWSIDLDSR

SEQ ID NO: 20857 - protein, 81 aa, Bos indicus x Bos taurus
WHMNFVFQGWLTFQDVAIDFTQEEWECLDLGQRELYRDVMLEKYGNLASLGEDNCLPESLIHPPGYGSCISRMSPGIFCFL

SEQ ID NO: 20858 - protein, 81 aa, Bos indicus x Bos taurus
VRGWEVSWGPGESCCVWAQLSPLWQGGVTFEDVFMYFSREEWELLEEAQRLLYRDVMLENFAHVAALGESLLSRAWALLDP

SEQ ID NO: 20859 - protein, 81 aa, Bos indicus x Bos taurus
SQESVKFRDVAVVFSPDQWAHLSPEKRELYRDVMLDTCDHLVSLGRWAYKAEVMSSLRQGKEPWMLEKEVTSAPCPACQPA

SEQ ID NO: 20860 - protein, 81 aa, Bos indicus x Bos taurus
ASQGWMTFQDVAIDFTQEEWECLDLSQRELYRDVMLENYGNLASLGLVSKLDLVTFLEQLKDSRNIRRMETTAIYPAMSPQ

SEQ ID NO: 20861 - protein, 81 aa, Pan troglodytes
VGGSVSFSDVAVGFTQEEWQHLDPAQRTPYRDVMLENYSLLLSVGYCITKPEVFCKLEHGQVLWILEEESPSQSHLDCCID

SEQ ID NO: 20862 - protein, 81 aa, Bos indicus x Bos taurus
LSKGWLTFQDVAIDFTQEEWECLDLGQRELYRDVMLENYGNLASLGLVSKVDLVTFLELLKDPRNMRRMETTAIYPAMSPQ

SEQ ID NO: 20863 - protein, 81 aa, Pan troglodytes
VTFEDVAVYFIRKEWKRLEPAQRDLYRDVMLENYGNVFSLDWIHVSLTTQKVMLAWLTGTLSVAKGLCSSELASVEPPDTF

SEQ ID NO: 20864 - protein, 81 aa, Pan troglodytes
LTQGQLSFSDVAIEFSQEEWKCLDPGQKALYRDVMLENYRNLISLDFSPLAWDALARVSRVEAWRASGGAEEPTDPNFVGN

SEQ ID NO: 20865 - protein, 81 aa, Pan troglodytes
MTFEDVAVYFSQEEWGLLDTAQRALYRRVMLDNFALVASLGLSTSRPRVVIQLERGEEPWVPSGKDMTLARNTYGRLNSGS

SEQ ID NO: 20866 - protein, 81 aa, Pan troglodytes
VTFEDVAVVFTDEEWSRLVPIQRDLYKEVMLENYNSIVSLDWETKPEIHDASDKKSEGSLRECLGRQSPLCPKFEVHTPNG

SEQ ID NO: 20867 - protein, 81 aa, Pan troglodytes
KNGSLTFRDVTIEFSLEEWQCLDTAQQNLYRNVMLENYRNLYVFITFILYSSESSNSHFTQDFWPDQSIKYSFQEIILRTY

SEQ ID NO: 20868 - protein, 81 aa, Enhydra lutris
SQGPVSFRDVAVDFTQEEWQQLEPDEKTTYRDVMLENYSHLVSVGYDSTKPKVILKLEQGEEPWVAEGEVPCQSRPEEVWK

SEQ ID NO: 20869 - protein, 81 aa, Enhydra lutris
MVAGLLMDSSQEEWTLLDQTQRDLYRDVMLENYQNLIILGYESCKPDLNSLMGGAEELRTGGRGILQELDLLKTKGFTALQ

SEQ ID NO: 20870 - protein, 81 aa, Enhydra lutris
PKVPVSFEDVSVYFTKTEWKLLDVQQRILYKTVMLENYRHLVSLGFLSTKPHLVSWLEQGEGPWATDVWRTLATAEMQTGD

SEQ ID NO: 20871 - protein, 81 aa, Pongo abelii
AQESVMFSDVSVDFSQEEWECLNDDQRDLYRDVMLENYSNLVSMAGHSVSKPNVISYLEQGKEPWLVDRELTRGQWPVLES

SEQ ID NO: 20872 - protein, 81 aa, Pongo abelii
LVTFRDVAIDFTQEEWECLDPAQRDLYRDVMLENYSNLISLDLESSCATKKLSPEKEIYEMESLQWENMGNLINHHLQYGL

SEQ ID NO: 20873 - protein, 81 aa, Pongo abelii
SPDSMTFEDIVVDFTQEEWALLDTSQRKLFQDVMLENISHLVSIGKQLCKSVMLSHLEQVEKLSTQRISLLQGRQVDIKHQ

SEQ ID NO: 20874 - protein, 81 aa, Pongo abelii
PQGLLTFRDVSIEFSQEEWKCLDPAQRTLYRDVMLENYRNLVSLDISSKCMMQMFSSTGQGNTEVIHTGTLQIHASHHIGD

SEQ ID NO: 20875 - protein, 81 aa, Pongo abelii
TQGCVTFEDVAIYFSQEEWGLLDEAQRLLYRDVMLENFALITALEDQKHHRAEKPLESDTDKASFMQCCLFHESGMPFTSS

SEQ ID NO: 20876 - protein, 81 aa, Pan troglodytes
EMGVLTFRDVAIEFSLEEWHCLDTAQQNLYRNVMLENCRNLVFLGIAASKPDLITCLEQGKEPWNVKRHEMVAEPPVVLAQ

SEQ ID NO: 20877 - protein, 81 aa, Pan troglodytes
VTFKDVAVTFTREEWRQLDLAQRTLYREVMLETCGLLVSVGDRAQVHTREPTTFPPVLSERAFLRGSLTLESSTSSDSRLG

SEQ ID NO: 20878 - protein, 81 aa, Enhydra lutris
SQEPVTFEDVAMYFPQNQWASLDPTQRALYREVMLENYANITSLAALPFPKPDLILQLERGEAPWSLDPWTPLKGGALGGA

SEQ ID NO: 20879 - protein, 81 aa, Enhydra lutris
DLQGSLSLKDVAVVFTWEEWQLLDPVQKILYQDVMLENYSNLISVGYQVTKADAFYQLEHGTQWITEEEIQSRIHPAQRSR

SEQ ID NO: 20880 - protein, 81 aa, Enhydra lutris
AQGLVVFTDVAIHFSREEWGLLDEAQRSLYHSVMLETLALLSSLGCWHGAQDEKVPSEQGDSVGGSQVRTPKPGPPTEKSQ

SEQ ID NO: 20881 - protein, 81 aa, Enhydra lutris
TDGLVTFRDVAIDFSQEEWECLDPAQRDLYVDVMLENYSNLVSLDLESTYEIKNIISEKDIFEINFSQWEMKERSKTFGLE

SEQ ID NO: 20882 - protein, 81 aa, Enhydra lutris
QQIAVTFEDVAVDFTQEEWLLLDLTQRNLYRNVMLENYQNLVAVEYQLSKPKLIAWLEQQELRTVEKGVFQEWETQPQTKG

SEQ ID NO: 20883 - protein, 81 aa, Pongo abelii
MGPLTFMDVAIEFSLEEWQCLDTSQQNLYRHVMLENYRNLVFLGIAISKPDLITCLEQGKEPWNMKRHEMVVAKHSALCSH

SEQ ID NO: 20884 - protein, 81 aa, Pongo abelii
SQHLVTFEDVAVDFTQEEWTLLDQTQRDLYRDVMLENYKNLIILGSELCKPSLMSGLEQMEELRTGVTGVLQELDLQLKTK

SEQ ID NO: 20885 - protein, 81 aa, Pongo abelii
LPAKDSAWPWEEKPRYLGPVTFEDVAVLFNEAEWKRLSLEQRNLYKEVMLENLRNLVSLVLELGSPRLGLLPLDLNLDLWL

SEQ ID NO: 20886 - protein, 81 aa, Pongo abelii
VAFEDVAVNFTQEEWTLLDISQKNLFREVMLETFWNLTSIGKKWKDQNIEYEYQNPRRSFRSLIEEKVNEIKDNSHCGETF

SEQ ID NO: 20887 - protein, 81 aa, Pongo abelii
EMRLLTFRDIAIEFSLVEWQYLDHAQQNLYRDVMLENYRNLVSLGIADSKPDLITFLEQNKESWNIKRNEMVAKHPVTCSH

SEQ ID NO: 20888 - protein, 81 aa, Pongo abelii
AQEPVTFRDVAIYFSREEWACLEPSQRALYRDVMLDNFSSVAALEGFCSPRPDLVSRLEQWEEPWVEDRERPELQAVQRGP

SEQ ID NO: 20889 - protein, 81 aa, Pongo abelii
VALEDVAVNFTQEEWALLGPCQKNLYKDVMQETIRNLDCVGMKWKDQNIEDQYRYPRKNLRCRMLERFVESKHGSQCGETS

SEQ ID NO: 20890 - protein, 81 aa, Bos indicus x Bos taurus
PQDLVTFKDVAIDFSQEEWEWLSPAQRSLYRSMMLENYQSLVSLGLCISKPYVISLLEQGKEPWMVLENEMRSPFPDWESI

SEQ ID NO: 20891 - protein, 81 aa, Bos indicus x Bos taurus
MLENYSNLVSAGFQASTPEVVSKLDQGEPWMMDDETHCQTRSVWKFDDHLLEYLQNESMEKRLEQWHEQNPLENAVHQSIT

SEQ ID NO: 20892 - protein, 81 aa, Enhydra lutris
LPDLVTFEDVAVEFTQEEWALLDPSQRTLYRDVMRENCRNLASLGNEDDKPGLVSELEQEDKVTTEEITILPGNCPDLETL

SEQ ID NO: 20893 - protein, 81 aa, Enhydra lutris
MLETYSSLVSLGHCISKPEVIVKLEQGAEPWAVGEAPTQRLPDVQSAGDLIEACQEHQSRHVGQVGFSSNKRSATKRTALD

SEQ ID NO: 20894 - protein, 81 aa, Enhydra lutris
VWIPVTFDDVAVTFTREEWRQLDPAQRTLYQEVMLETCGLLVSLGCPLPKPELICALDHSPELRTLKRGLSPNSCPGDTTK

SEQ ID NO: 20895 - protein, 81 aa, Enhydra lutris
LQEPVTFADVAVLFTPEEWMFLDSAQRSLYRDVMLENYRNLASVGDQLGKPSMLSLSEPGEELWAPERRTFPGTRPEPQHQ

SEQ ID NO: 20896 - protein, 81 aa, Pongo abelii
RRESVTFEDVAVYFSENEWIGLGPAQRALYRDVMLENYGAVASLAFPFPKPALISQLERGETPWCSVPQGALDGEAPRGIS

SEQ ID NO: 20897 - protein, 81 aa, Pongo abelii
EGGWVPALFDEVAIYFSDEEWELTEQQKLYREVMRMNYEVLSLEFPFPKPDMITRLEGEEESQNSDEWQLQGGTSAENEES

SEQ ID NO: 20898 - protein, 81 aa, Pongo abelii
TFKEAMTFKDVAVVFTEEELGLLDLAQRKLYRDVMLENFRNLLSVGHQAFHRDTFHFLREEKFWMMETATQREGNLGGKIQ

SEQ ID NO: 20899 - protein, 81 aa, Pongo abelii
MVTFEDVAVHFTKTEWTGLSPAQRALYRSVMLENFGNLTALGYPVPKPALISLLEGGDMAWGLEAQDDPLAETTKNVCKDV

SEQ ID NO: 20900 - protein, 81 aa, Pongo abelii
VHGSVTFRDVAIDFSQEEWECLQPNQRTLYRDVMLENYSHLISLGSSISKPDVITLLEQEKEPWIVVSKETSRWYPDLESK

SEQ ID NO: 20901 - protein, 81 aa, Pongo abelii
MLENYRNLVFLGICLPDLSIISMLEQRRDPRNLQSEMKMANNPGGRECINGVNTESSSKLGSNAGNKSLKNQLGLTFQLHL

SEQ ID NO: 20902 - protein, 81 aa, Pongo abelii
LKSLVTFEDVAVYFSQEEWELLDAAQRHLYHRVMLENLELVTSLGNALSQHDVFTCSVGADLPNCFPNWLHHFTSLSAVYK

SEQ ID NO: 20903 - protein, 81 aa, Pongo abelii
ELTSSCGSKTMANVSLAFRDVSIDLSQEEWECLDPVQRDLYKDVMLENYSNLVSLGYTIPKPDVITLLEQEKEPWIVMREG

SEQ ID NO: 20904 - protein, 81 aa, Bos indicus x Bos taurus
MFQDVAIDFTQEEWECLDLSQRELYRDVMLENYGNLASLGLVSNLDLVTFLEPLKDPRNIRRMGTTVIYPAVSPQDTQDLM

SEQ ID NO: 20905 - protein, 81 aa, Pan troglodytes
FEELVTFEDVLVDFSPEELSSLSAAQRNLYREVMLENYRNLVSLGHQFSKPDVISRLEEEESHAMETDSRHTVICPGESHD

SEQ ID NO: 20906 - protein, 81 aa, Enhydra lutris
MASSQGQLAFRDVAIKFSEEEWGLLTHTQRQLYRDVMLENYGHLLFLGLIVSKPDLVSFLEQKKDPWDVTRKKTVVFDPGR

SEQ ID NO: 20907 - protein, 81 aa, Enhydra lutris
RPRAVKFADVAVYFSPEEWGCLRPAQRALYRDVMRETYGHLSALGCSGPKPALISWLERNTDDWEPAALDPQECPRGLTVQ

SEQ ID NO: 20908 - protein, 81 aa, Enhydra lutris
VKDPVTFKDVAIDFTLEEWRLMDPSQRKLHKDVMLENYRNLVSLGLAVSKPDMISHLEAGKGPWVVVREIARTPYPELETK

SEQ ID NO: 20909 - protein, 81 aa, Pongo abelii
SQMPVTFEDVALYLSREEWGRLDHTQQNFYRDVLQKKNGLSLGAVEVGQRVPTSSVAALGDVKPFRPRAGSVQGGVLQCAQ

SEQ ID NO: 20910 - protein, 81 aa, Pongo abelii
AQESLTLKDVAVDFTWEEWQLLGPAQKRLYRDVMLENYSNLVSVGYQASKPDALTKLEQGEPLWTLEDEIHSPAHPEIEKA

SEQ ID NO: 20911 - protein, 81 aa, Pongo abelii
AHASMTFRDVAIDFSQQEWECLDPVQKTLYRDVMMESCSNLLGSGHDFSKPDVITSLEQGKEPWMIVREEKGRWCTGSHSI

SEQ ID NO: 20912 - protein, 81 aa, Bos indicus x Bos taurus
PQEATELEFLSVNYTLKNWKGTALSQRALYWNIMLENCCSLAPLGENRMASSQLSPKQDISEESKSADRTSGILCGLILRG

SEQ ID NO: 20913 - protein, 81 aa, Bos indicus x Bos taurus
PHFPFDVAIEFTPEEWECLDLAQRALYREVMVETLRNLLSVDTSPKRVLKGSAPKQSSHTGGILQTMLSGRHKSHDTKDQG

SEQ ID NO: 20914 - protein, 81 aa, Pan troglodytes
PQASVCFEDVAMAFTQEEWEHLDLAQRTLYREVTLETWEHIVSLGLFLSKSDVISQLEQEEDLCRAEQEAPRDWKLTLEEN

SEQ ID NO: 20915 - protein, 81 aa, Pan troglodytes
PLSFKDVAVVFTEEELELLDSTQRQLYQDVMQENFRNLLSVGDKNGKDMEYIQDEELRFFSHKELSSCKIWEEVVGELPGS

SEQ ID NO: 20916 - protein, 81 aa, Pan troglodytes
LFQLLVTFRDVAIDFSQEEWECLDPAQRDLYRDVMLENYSNLISLDLESSCVTKKLSPEKEIYEMESLQWENMGKLTNHHL

SEQ ID NO: 20917 - protein, 81 aa, Pan troglodytes
AQESITLEDVAVDFTWEEWQFLSPAQKDLYRDVMLENYSNLVSVGYQASKPDAFSKLERGEETCTTEDEIYSRICSDSGGA

SEQ ID NO: 20918 - protein, 81 aa, Pan troglodytes
DSVAFEDVAVNFTLEEWALLDPSQKNLYRDVMRETFRNLASVGKQWEEQNIEDPFKIPRRNISHIPERLCESKEGGQGEET

SEQ ID NO: 20919 - protein, 81 aa, Zalophus californianus
SLESDLFRDVAIVFSQEEWEQLAPAQRDLYRDVMLETYSNLVSLGLAIAKPDVISFLEQGKEPWVVEKMSRGGLCPVLESR

SEQ ID NO: 20920 - protein, 81 aa, Zalophus californianus
GQGSVSFRDVTVDFTRDEWLQLTGTQRTLYRDVMLENYSHLVSVGCHLTKPEVIFRLEQGEELWPSGGEFPDQGDQDKSQE

SEQ ID NO: 20921 - protein, 81 aa, Carlito syrichta
SLGSELFRDVAIVFSQEEWQQLVPAQRDLYRDVMLETYSNLVSLGLAISKPDVISFLEQGREPWMVEEVVPGLCPVLESGC

SEQ ID NO: 20922 - protein, 81 aa, Saimiri boliviensis
FQEAVTFKDVAVAFTEEELGLLDSAQRKLYRDVMLENFRNLVSVGRQSFKPDMISQLEREEKLWMKEFQTQRDRHSGDRNQ

SEQ ID NO: 20923 - protein, 81 aa, Callorhinus ursinus
QAEVTFEDVAVLFSREEWGRLGPAQRGLYRDVMLETYRNLVSLGAGPAGPKPGVITQLERGDEPWVLDAQGAKGKERLRVS

SEQ ID NO: 20924 - protein, 81 aa, Rhinolophus ferrumequinum
SQGLVTFRDVALDFSQEEWEWLDPSQKDLYRDVMLENYRNLVCLGLSISKPNMISLLEQGKEPWMVQREMSDDPYTDWESW

SEQ ID NO: 20925 - protein, 81 aa, Ursus maritimus
SQGLLSFSDVAVDFTWEEWQLLDTVQRNLYWEVMLENYSNLMSLGYQATRPEATIHLEKEQRMVEREFPSQRSPERPLQCF

SEQ ID NO: 20926 - protein, 81 aa, Rhinopithecus roxellana
AQVSVTFEDVAVTFTQEEWAQLDAAQKTLYQEVMLETCGLLVSLGCPLFEPELIYQLDRREELWIVKKDLSQSSCPGDNTK

SEQ ID NO: 20927 - protein, 81 aa, Rhinopithecus roxellana
DGLVTFRDVAIDFSQEEWECLDPAQRDLYVDVMLENYSNLVSLDLESTTYETTKIFSEKDIFEINFSQWEMKEKSKTLGLE

SEQ ID NO: 20928 - protein, 81 aa, Rhinopithecus roxellana
IYFPQAEWELLEYTQKALYNDVMQENYETVISLALFVLPKPKVISCLEQGEEPWVQVSPEFKDTFVPFFKKSLNFSFYSWL

SEQ ID NO: 20929 - protein, 81 aa, Bos indicus x Bos taurus
MLENYRNLASLGLVSKVDLVTFLELLKDPRNIKRMKTTAIYPAVSPQDTQGLMPKNPALEDLFPKANEGMYQIFHLRNLNL

SEQ ID NO: 20930 - protein, 81 aa, Trichechus manatus
TQVSLELDDVAVKFTWEEWQLLNRAQKDLYWDVMLENYNNLVSLGYQVSKPDVLSRLERGEPPWSLEDEIHSGNFSELQKI

SEQ ID NO: 20931 - protein, 81 aa, Delphinapterus leucas
SQGLVTFRDVALNFSQEEWEWLDSSQKDLYRDVMLENYRNLVWLGLSISKPNMISLLEQGKDPCMVEREMSDGQYAEWDSL

SEQ ID NO: 20932 - protein, 81 aa, Zalophus californianus
VKIEDVADVAVSFILEEWGHLDQSQKSLYRDDRKENYGSITSVDYESGHDNVELAVKQISDDAEPHWMTSGSPERNVPQSQ

SEQ ID NO: 20933 - protein, 81 aa, Aotus trivirgatus
CEISVSFEDVTVDFSKEEWQHLDPAQRRLYWDVTLENYSHLLSVGYQVPKSEATFKLEQGEGPWTLEGEAPHQSYSGESIG

SEQ ID NO: 20934 - protein, 81 aa, Rhinolophus ferrumequinum
CKKPVSFAEVAVYFSPEEWGCLRPAQRALYRDVMRETYGHLGALGDAPNKKEEAPEKGPGAKGPRKTPGKARPGELIKRNP

SEQ ID NO: 20935 - protein, 81 aa, Ursus maritimus
WSQMPVTFEDVALYLSREEWGRLDHAQQNFYRDVLQKRNGLSLGFPFSRPFWASQGQGKGETSSSCRQMGDEEEMTGAIEV

SEQ ID NO: 20936 - protein, 81 aa, Acinonyx jubatus
DLVILEDVAVEFTQEEWTLLDPTQRNLYRDVMLENHRNLVAVDWEICLNTKWSALQQNILQGKTPNGQRRGSLNVIKLENF

SEQ ID NO: 20937 - protein, 81 aa, Rhinopithecus roxellana
EMVTFKDVAVVFTEEELGLLDSAQRKLYRDVMLENFRNLLLVAHQPFKPDLISQLEREEKLLMVEMETPKDGCSGRKNQQK

SEQ ID NO: 20938 - protein, 81 aa, Acinonyx jubatus
LQGPVTFKDVIVEFTREEWQLLDAAQRTLYKEVMRENYGHLVSVGYCVNKPNAVFKLKQGKEPWTLEVEFPRRNYPEDLWK

SEQ ID NO: 20939 - protein, 81 aa, Acinonyx jubatus
KLKSVTFEDVAVYFTQTEWNGLSPAQRALYRDVMLENYGNVASLGFSLLKPAVILQLEGADIESQTDNNLTKEIYKEKHNT

SEQ ID NO: 20940 - protein, 81 aa, Rhinopithecus roxellana
VQEPVTFKDVAVDFTQEEWGQLDLVQRTLYRDVMLETYGHLLSVGNQIAKPEVISLLEQGEEPWSMEQACPQRTCPEWMRN

SEQ ID NO: 20941 - protein, 81 aa, Rhinopithecus roxellana
QDSVMFDDVAVEFTPEEWVLLDTTQKYLYRDVMLENYMNLASVDFFFCLTSEWEIQPRTKRSSLQQGFLKNQIFTGIQMTR

SEQ ID NO: 20942 - protein, 81 aa, Rhinopithecus roxellana
SQHLVTFEDVAVDFTQEEWTLLDQTQRDLYRDVMLENYKNLIILAGSELCKPSLMSGLEQMEELRTGVTGVLQEQKQYCRE

SEQ ID NO: 20943 - protein, 81 aa, Rhinopithecus roxellana
MAQVTFSDVAIDFSHEEWAWLDSAQRDLYKDVMVQNYENLVSVAGLSVTKPYVIMLLEDGKEPWMVEKKLSKDWKSRWENK

SEQ ID NO: 20944 - protein, 81 aa, Rhinopithecus roxellana
PKVPVAFDDVSIYFSTPEWEKLEEWQKELYKNIMKGNYESLISMDYAINQPDVLSQIQPEGEHNTEDQTGPEESEIPADPS

SEQ ID NO: 20945 - protein, 81 aa, Bison bison
KDQGSLTLEDVAVDFTWEEWQLLAPPQKALYRDVMLENYSNLVSVGYQASKSAALSRLERGELWPVEDKVHSRICPEMRKD

SEQ ID NO: 20946 - protein, 81 aa, Vicugna pacos
SQVPLTFSDVAIDFSQEEWECLNSDQKNLYRDVMLENYTNLVSLDIDFTTESKGLSSEKSSYEVNSYHCEPMKRSKPSTFN

SEQ ID NO: 20947 - protein, 81 aa, Vicugna pacos
PHRLVLFKDVAIDFSREEWECLDLEQKDLYRDVMLENYNNLVSLAGISISKPDVLSLLEQGKEPWKVVQDETRGQSPDWES

SEQ ID NO: 20948 - protein, 81 aa, Vicugna pacos
DSWGPLSFMDVFVDFTWEEWRLLDPAQKHLYRSVMLENYNNLASLGHQHTKPSVVFQLEQEELWMMQIPSQGRADEVQEID

SEQ ID NO: 20949 - protein, 81 aa, Phascolarctos cinereus
ARESVTFKDVAVNFTQEEWGQLSPAQRNLYKDVMLENYRNLISLGFPISKPDVIFKLEQGKEPWMFSLQKAREREVPRNSP

SEQ ID NO: 20950 - protein, 81 aa, Monodelphis domestica
PAQEVVTFQDVAVDFTQEEWRLLSPLQKELYKEVMLENARNLLSVGLPAPPEDMILEQREAPWMLEQEGLRCYYPGEFRFE

SEQ ID NO: 20951 - protein, 81 aa, Bos indicus x Bos taurus
QTQLTFKDVFIDFTPEEWECLDPAQRTLYKDVMVETLRILLSVDISPTHVIKHLQLKANSEKLETFQTSMLGRPESCEIKH

SEQ ID NO: 20952 - protein, 81 aa, Trichechus manatus
VQASLTFSDVAVEFTWQEWQLLDTAQKDLYRDVMLENYGNLVSVGYEVSKPDALSRLERGEQPWTVLDESHSRTFSDMCKI

SEQ ID NO: 20953 - protein, 81 aa, Delphinapterus leucas
LHGSVTFQDVAVDFTLEEWQLLGYSQRKLYWDVMLENFRNLISVGCPVTKTKVIFKVEQGQEPWMVEGENPHWRSPEVICL

SEQ ID NO: 20954 - protein, 81 aa, Saimiri boliviensis
TQDRVVFEDVAIYFSQEEWGHLDEAQRLLYRDVMLENLALLSSLGCWHGPEDEVAPSRQGFSAGVSEVTTSPKSCMFTQKI

SEQ ID NO: 20955 - protein, 81 aa, Balaenoptera acutorostrata
SLETVTFKDVAVDLTQEEWQQMKPAQRDLYRDVMLENYSNLVTVGCQVTKPDVIFRLEQEEEPWVVEEEMLGRPCPEVWED

SEQ ID NO: 20956 - protein, 81 aa, Rhinopithecus bieti
TQVRLTFRDVAIEFSQEEWKCLDPAQRTLYRDVMLENYWNLVSLGLCHFDMNIISMLEEGKEPWTVKSCVKIVRKPRMREC

SEQ ID NO: 20957 - protein, 81 aa, Acinonyx jubatus
IQETVTFKDVAVDLTQEEWQQLKPAQRNLYRDVMLENYSNLVTVGYQVTKPDVIFKLEQEEEPWVIEDEMLGRHCPEVWEV

SEQ ID NO: 20958 - protein, 81 aa, Rhinopithecus roxellana
MESLTLRDVAVDFTWEEWQLLGPAQKHLYQDVMLENYSNLVSVGFQASKPDALTKLEQGEPLWALEDEIYSPTHPEIEKAD

SEQ ID NO: 20959 - protein, 81 aa, Delphinapterus leucas
QLTFEDVAITFSREEWECLDPAQRALYRDVMLETYGNLLSLAVSHIHVIKKLKPKANSDTGEVFQTVTLGRHESHEIRDFY

SEQ ID NO: 20960 - protein, 81 aa, Sapajus apella
SKAPITFGDLAIYFSQEEWEWLSPIQKDLYEDVMLENYQNLVSLGLSFRRPNVITLLEKGKAPWMVEPARRRRGPDSGSKV

SEQ ID NO: 20961 - protein, 81 aa, Zalophus californianus
MLENYRNLVALGHQLYKPEVISHLEQEEQWVMERESPLDTHTDGESRPEIKKSTPNQNISDENQNHDMIMERLTGDSFWYS

SEQ ID NO: 20962 - protein, 81 aa, Sapajus apella
CEVSVSFEDVTVDFSREEWQQLDSTQRRLYQDVMLENYSHLLSVGFEVPKPEVIFKLEQGEGPWTLEGETPHHSCSDGKFG

SEQ ID NO: 20963 - protein, 81 aa, Delphinapterus leucas
MVKSQVSFEDVAVDFTLEEWQLLDPTQKTLYRDVTLENYSNLVFLGYQMIKPEVIFKLEQEEPWILGEEILSQNFPEEVWL

SEQ ID NO: 20964 - protein, 81 aa, Balaenoptera acutorostrata
MAEEFATLKDVAMDFTLEDWEQLGLDQGDLFWDTALDNYQDLFLLNPPRPNLTSHPDDGEELAALAKGSPESTGPDTAEGK

SEQ ID NO: 20965 - protein, 81 aa, Rhinolophus ferrumequinum
FQESVTFEDVAVYFTQNQWASLEPVQRALYREVMLENYANVASLAAFPFSKPDLIFQLERGEAPRDLDPWTPGEAEALRSV

SEQ ID NO: 20966 - protein, 81 aa, Rhinolophus ferrumequinum
GQESLTFDDVAVDFTWEEWQLLVPEQKDLYRNVMLENYSHLVSLGYQACKPDMLSKLDRGESPWTMADEVHYWTRSEIWKD

SEQ ID NO: 20967 - protein, 81 aa, Rhinolophus ferrumequinum
SQGSVTFRDVAVDFSQEEWEWLQPAQRDLYRHVMLENYDHLVSLGLTISKPDVVSLLEQRKEPWLQRGDGRRDLFSVSESN

SEQ ID NO: 20968 - protein, 81 aa, Rhinolophus ferrumequinum
FQGSVTFQDVVVDFTPEEWQLLDCDQRTLYWDVMLENFRNLISVGGPVTKTKVIFKVQQGQEPHMVEGENPHWSHTEAECP

SEQ ID NO: 20969 - protein, 81 aa, Ursus maritimus
LLWESLTLEDVAVDFTWEEWQLLAPAQKNLYRDVMLENYRNLVSVGYVASKPDALSRLEQEELWTTEDEIHSRFHPELKKD

SEQ ID NO: 20970 - protein, 81 aa, Ursus maritimus
CQESVTFEDVAVIFTDEEWRHLVPIQRDLYKEVMLENYKIIVSLGLPVPRPDVIFQLKRGDEPWIVDLHRSEERECPENVS

SEQ ID NO: 20971 - protein, 81 aa, Phyllostomus discolor
MLENYGNVASLGFPILKPAVISQLEGGGELGIPSLLAAGVGSDPPGLWTVDIDIQTDNDITKELYKEKYNASFVLQENSFQ

SEQ ID NO: 20972 - protein, 81 aa, Phyllostomus discolor
KALGSVAFRDVIVDFTQEEWQQLKPAQKDLYRDVMMENYWNLVSLDLEARPDMKELDPQEDKWEDRPSVVVVVEGPKRNGA

SEQ ID NO: 20973 - protein, 81 aa, Phyllostomus discolor
REVSVSFEDVTVDFSREEWQQLDSTQRRLYQEVTLENYSHLLSVGYGVPKPEVIFKLEQGEDPWMLEGETPYESCSDGKFG

SEQ ID NO: 20974 - protein, 81 aa, Acinonyx jubatus
QDFVSFNDVSVNFTEEEWRELDPVQRVLYRDVMLENYRNLVSLDLETRKLSPKNVFSEEESYQGISMERNTEADASLKEAW

SEQ ID NO: 20975 - protein, 81 aa, Rhinopithecus roxellana
LYEAVTFKDVAVVFTEEELGLLDPAQRKLYQDVMLENFRNLLSVGKSQTEMETVPEAGTHEEFSCKQIWEQIASDLTRSQD

SEQ ID NO: 20976 - protein, 81 aa, Rhinopithecus roxellana
GRVVFEDVAIYFSQEEWGHLDEAQRLLYRDVMLENLALLSSLGCCHGAEDEEAPLEPCVSIGVSQVMAPKPCLSTQKTQPC

SEQ ID NO: 20977 - protein, 81 aa, Acinonyx jubatus
MLETCGLLVSLGHPVPKPELIYPLEPGQELWTGKRGVSKSTYTGEKAKPETTEFTASQLAFTEEAPFEEQMTQGASRDSRL

SEQ ID NO: 20978 - protein, 81 aa, Acinonyx jubatus
QGSAAYEFLSVDYTERKWKGPALSQRAVYRSLMPENYRRVASLANETRMECPDLPAKQEVSKGLGSSDGTSGGLCGVVSGE

SEQ ID NO: 20979 - protein, 81 aa, Bison bison
KKPVTFEDVAVNFTQEEWKCLDVSQRVLYQDVISETVRNLMSVGGKKEESQEQSQSLGDEGTVDDKKASLAHRGLGPTSPP

SEQ ID NO: 20980 - protein, 81 aa, Bison bison
QEGVNFKIVTVDFTQEEEGTLSSAQRTLDRDVILENHGDSWDSATALGRRESRLKQSIFDDKLSHSVKIEKLTRDDPWLSS

SEQ ID NO: 20981 - protein, 81 aa, Bison bison
EEEEEMAASQDVAIDFTQEEWECLDLGQRELYRDMMLEKYGNLASLARPGHLSGANEGFQEYKQHGDNTHIPRCMTLGLSC

SEQ ID NO: 20982 - protein, 81 aa, Callithrix jacchus
ALGIVTFEDVAVYFSWKEWSLLDEAQKCLYHDVMLENLTLTTSLGGCGTEDEEAPYQQSTSPQRGSQVRIPKALPSPQKTN

SEQ ID NO: 20983 - protein, 81 aa, Delphinapterus leucas
LQDLVTFEDVTVEFTQEEWALLDPSQRTLYRDVMLENCRNLASLGYHVDKPSLISQLEQEDKVMTEERGILPGTCPDLETV

SEQ ID NO: 20984 - protein, 81 aa, Sapajus apella
SQTLVTFKDIFVDFTREEWKLLDTAQQIVYRNVMLENYKNLVSLGYQITKPDVILRLEKGEEPWVVERGIHQETHPDSETA

SEQ ID NO: 20985 - protein, 81 aa, Sapajus apella
SQGSVLFEDVSVYFTQKEWQLLDPAQRLLYRDVMLENYRHLVSLGHCVTKPELIVKLKQGDEPWILKREPPSQSHSGELKS

SEQ ID NO: 20986 - protein, 81 aa, Saimiri boliviensis
SQAPVTFEDMAMYLTREEWRPLDPAQRDLYRDVMQENYGNVVSLDFEIRSESEVNPKQEISEDAQFGTTSERPVENAEENP

SEQ ID NO: 20987 - protein, 81 aa, Saimiri boliviensis
FQEQVSFKDVCVDFTQEEWYLLNPAQKMLYRDVILENYSNLVSVGYCIPKPEVIFKIEQGEEPWILEKGFPSQCNPERKWK

SEQ ID NO: 20988 - protein, 81 aa, Callorhinus ursinus
CQGPLTFRDVAVEFSPEEWECLDPAQRALYRDVMVENYRNLVSLGEDSFPPEVGICPKSSARFMIKELLPKKENNRKLCQL

SEQ ID NO: 20989 - protein, 81 aa, Callorhinus ursinus
SQEQVSFKDVCVDFTQEEWYLLDPAQKILYRDVILENYSHFVSVGYCITKPEVVFKIEQGEEPWILEAGFPSQCHPEDWKV

SEQ ID NO: 20990 - protein, 81 aa, Vulpes vulpes
SQSLLTFEEVAMYFSQEEWELLDPTQKALYNDVMRENYETVISLVVPVHQIPAFCEKTNTKDWTVTPELILSESQSLLTFE

SEQ ID NO: 20991 - protein, 81 aa, Ursus maritimus
PVTFKDVIVEFSREEWQLLNAAQRTLYREVMQENYGLLISVGEKNFPICYRVNKPNAVFKLKQGKEPWILEVEFPHRNYPE

SEQ ID NO: 20992 - protein, 81 aa, Acinonyx jubatus
LVIVKGCRDSLRAKTGVLVHAKEIKTVSVTFQDVAVDFTPEEWQLLDCDQRTLYWDVMLENFRNLTAVGTCYIQGCGHGLH

SEQ ID NO: 20993 - protein, 81 aa, Tursiops truncatus
SLGTVTFKDVAVDLTQEEWQQMKPAQRDLYRDVMLENYSNLVTVGCEVTKPDVIFKLEQEEEPWVIEEEMLGRPCPEVWED

SEQ ID NO: 20994 - protein, 81 aa, Tursiops truncatus
KSPGSVSFEDVTVNFTQEEWGQLDPDQRTLCRDVTLENYRILISLGHRIAKPEEIFKLEQEAPWILEEEFASHCYPGELKV

SEQ ID NO: 20995 - protein, 81 aa, Tursiops truncatus
KAQETLTFDDVAVDFTWEEWQFLAPPQKDLYRDVMLENYSNLLSVGFQASKPDILSKLDHGEPWMMEDEIHCRTHSEVWKV

SEQ ID NO: 20996 - protein, 81 aa, Acinonyx jubatus
MPQEEWQQLDPAQKTLYRDVMLENYCHLISVGFHMTKPDMIRKLEQGEELWTTERIFPSQSYLEEDGKAEDVLVKFKEYQD

SEQ ID NO: 20997 - protein, 81 aa, Leptonychotes weddellii
MLENCGLLVSLGCPVPRPELIYQLEHGQELWTVKRDLSQITYPGDKGKPKITESTASEPALSEGVSFQERLTQGVPGISQV

SEQ ID NO: 20998 - protein, 81 aa, Physeter macrocephalus
PQVFVSFEEVAVLLSQEEWGHLGPSQKGLYRDVMLETYGNLVSLGLQGSKPDVISKLEQGEEPWAPHSPRIEGSWIWRHRH

SEQ ID NO: 20999 - protein, 81 aa, Bos indicus x Bos taurus
MFKDVAIDVSQEEWECLNPAQRNLYKDVMLENYSNLVSLGLSISKPAVITSLEQGKEPWMVMREMTRERCPDLVSQCEPKK

SEQ ID NO: 21000 - protein, 81 aa, Trichechus manatus
RSQESVTFQDVAVDFTREEWDQLYPAQKSLYRDVMLENYRNLVALGHQLYKPEVITQLEQEEQWIMESKSLPDTHPDGENR

SEQ ID NO: 21001 - protein, 81 aa, Delphinapterus leucas
SVTFRDVTVDFTQEEWQQLEPSQKDLYRDVMLENLQNLVSLDLEMRPEMKEPDLKEEISEDKPSGAWGSAVDGARTQGDRV

SEQ ID NO: 21002 - protein, 81 aa, Zalophus californianus
PQESVTFKDIAVDFTQEEWALLDTSQRKLYRDVMLENISHLVSVGYHLCKSDVVSQLEQGVELWREGRGFPQGPNPDRKSG

SEQ ID NO: 21003 - protein, 81 aa, Phyllostomus discolor
CEGSVSVEDVTVDFSKAEWQQLNPAQRCLYLDVMLEIYSHLFSVGYHIPNPEVIFRMEKDKELWIGEAELPHQRHQEMKFV

SEQ ID NO: 21004 - protein, 81 aa, Rhinopithecus roxellana
SVAFEDVAVNFTQEEWALLSPSQKNLYRDVMLETFRNLASVGIQWKDQDTENLYQNLGIKLRSLVERLCGQKEGSEHRETF

SEQ ID NO: 21005 - protein, 81 aa, Panthera pardus
AQGSVVFSDVSVDFSQEEWECLDSGQRDLYRDVMLENYSNLLSMGFYIPKPPVISLLEQGKEPWMVGRELTKGLCSDLESM

SEQ ID NO: 21006 - protein, 81 aa, Panthera pardus
EQESVTYKDVAVDFTQEEWALMDTSQRTLYRDVTLENISHLVSVGCHFFRSDVISQWEQRGELWREERGPPQGWSPGMKNS

SEQ ID NO: 21007 - protein, 81 aa, Panthera pardus
ESCVTFEDVAVYFSQEEWGLLDEAQRFLYHDVMLETFVLTTSLDCWCGAENEEVPSEQSVSVERVSQVRTSKTGSSIQKTH

SEQ ID NO: 21008 - protein, 81 aa, Vicugna pacos
SKAPVTFGDLAIYFSQEEWEWLSPIQKDLYEDVMLENYQNLVSLGLSFRRPNVIALLEKGKAPWMVEPVKRRRGLDSGSKC

SEQ ID NO: 21009 - protein, 81 aa, Carlito syrichta
KEGVNFKIVTVDFTQEEQNTWNHAQRTLDRDLILENHRDLVSWDLATALGKRESPSNWSTFDEEPSHGVKIERFSRNDPWL

SEQ ID NO: 21010 - protein, 81 aa, Zalophus californianus
ARASLSFEDVAVGFSWEEWQLLAPSQKDLYRDVMLENYRNLVSVGYQASKPDSVFQLEQGEPPWMVEGAAQSQTCQGYPAT

SEQ ID NO: 21011 - protein, 81 aa, Ursus maritimus
VQSHVVFEDVAIYFSQEEWGLLDEAQRFLYHAVMLENFALLSSLGCWHGAQDEQALSEQGVSVGGSQVRTPKPAPSIQKSQ

SEQ ID NO: 21012 - protein, 81 aa, Ursus maritimus
IQGSLTFGDVAVSFTQFEWKHLDATQQALYRDVMLENYGNLVSVGLLSSKPKLITQLEQGAEPWMEVQQIPSDTCSVQEYW

SEQ ID NO: 21013 - protein, 81 aa, Acinonyx jubatus
HQISVTFDDVALDFTQEEWILLDLSQRNLYRNVMLENYQNLVTVEYQLSKPKLIAWLERQELRAVEQGILQEWETGLQTKG

SEQ ID NO: 21014 - protein, 81 aa, Acinonyx jubatus
TQGCVTFEDVAIDFSQEEWGLLDEAQRRLYHDAMLENLALIASLVCWHGMEDEGTPFEQSVSIEVLSQVRIPKASASIQKT

SEQ ID NO: 21015 - protein, 81 aa, Ovis aries
TQLTVEDVDIKFTPEEWECLDPAQRALYWDVMEETYRNLLSVDVSHIHMTKKLQAKANSGKGEILQTVMFGRAETHEIKDF

SEQ ID NO: 21016 - protein, 81 aa, Ovis aries
EQLTSEDVAIEFTQEEWEFLDPAQRALYRDVMLETYRNLLSVDISPTHVIKHLQPTANSDKLEKFQTLMLRSPESCEIKHV

SEQ ID NO: 21017 - protein, 81 aa, Callorhinus ursinus
CVTFEDVAVYFSQEEWGLLDEAQRLLYHSVMLENLAFNNIRGTCFIRVPFSYTTGSLGSTLLASQGEHGRMVSEEAWPCSV

SEQ ID NO: 21018 - protein, 81 aa, Ursus maritimus
FREPVTFEDVTLGFTSEEWGLLDLEQKSLYREMMLENYRNLVSVEHQLSKPDVVSQLEEEEALWSVERGIPQDTFSEYPTA

SEQ ID NO: 21019 - protein, 81 aa, Phyllostomus discolor
VTFEDVAVFFSRMEWPLLTEAQKHLYLEVMRENFALISSSGCCCGAENVEAPVEENVSVRASQAENPHVALSSQKSHPCER

SEQ ID NO: 21020 - protein, 81 aa, Rhinopithecus roxellana
GTVTFEDVAVNFSQEEWSLLSEAQRCLYHDVMLENLALISSLGCWYGAKDETPSKQTLSIQQESPLRTHWTSVCTKKVHLW

SEQ ID NO: 21021 - protein, 81 aa, Acinonyx jubatus
MAAAAALRDPAQEEWGLLDEAQRLLYCDVMLENFALIASLGLTSFRSHIVARLEMGAEPWVPDRVDMTSAMARGAYSGPGS

SEQ ID NO: 21022 - protein, 81 aa, Rhinopithecus roxellana
MEPLTFKDVAIEFSLEEWQCLDTEQRDLYRNVLLENYRNLVFLGIAVSKPYLITCLEQKKEPWNIKRHEMVARPPVMSFHF

SEQ ID NO: 21023 - protein, 81 aa, Rhinopithecus roxellana
LRGLVTFEDVAVEFTQEEWALLDPTQRTLYRDVMLENCRNLASLGCRVNKPSLISQLEQDKKVMTEERGILPSTCPDLETL

SEQ ID NO: 21024 - protein, 81 aa, Rhinopithecus roxellana
VAFEDVDVNFTQDEWALLDPSQKNLYRDVMQETFRNLASVGKKWKDQKIEDECKNPRRNLRGLMGERLLESKKDHQHGEIL

SEQ ID NO: 21025 - protein, 81 aa, Rhinopithecus roxellana
YVGLQFQGSVTFEDVAIAFSQQEWESLDCSQRGLYRDVMLENYRNLMSMGHSLSKPHVIALLEQWKEPEVTVRTDERRWCT

SEQ ID NO: 21026 - protein, 81 aa, Rhinopithecus roxellana
YLGPVTFEDVAVLFTEAEWKRLNLEQRNLFEEVMLENLRNLVSLESKPEVHTCPSCPLAFGSQQFLSQDELHDHPIPGFHL

SEQ ID NO: 21027 - protein, 81 aa, Rhinopithecus roxellana
MEPLTFKDVAIEFSLEEWQCLDTEQRDLYRNVLLENYRNLVFLVMSFHFAQDLWPEQNIKDSFQKVTLRRYGRCEYENLQL

SEQ ID NO: 21028 - protein, 81 aa, Rhinopithecus roxellana
VTLRDVVINFSQEEWEYLDSAQRNLYWDVMMENYSNLLSLDLESRNETKHLSVGKHSIKNTGSQWEVMESSRLHGLESSIF

SEQ ID NO: 21029 - protein, 81 aa, Rhinopithecus roxellana
TQGHLTFRDVAIEFSQEEWKCLDPVQKALYRDVMLENYRNLVSLGICLPDLSVISMLEQKKDPWILQSEEKIANNPDGREC

SEQ ID NO: 21030 - protein, 81 aa, Bison bison
LQGSVTFEDVAVYFSWEEWSLLDDAQRRLYHNVMLENLALTISLGCWHGAEDEEASSEQNISVHGMSQVRIPKAGMFSQKA

SEQ ID NO: 21031 - protein, 81 aa, Zalophus californianus
SQPPVSFKDVAVTFTQEEWGQLDLAQRRLYRSVTLETCSHLVSLGLLLSKPAVISWLEQGQDPWRAGQGPPRDWKNTFEKK

SEQ ID NO: 21032 - protein, 81 aa, Macaca mulatta
QGRVTFRDVAIEFSLAEWKCLNPAQRALYREVMLENYRNLESVDISSKCMMKEVLSTGQGNTEVFYPGTLQRPESHHIGDF

SEQ ID NO: 21033 - protein, 81 aa, Delphinapterus leucas
PGSISFEDVTVNFTQEEWGQLDPDQRTLCRDVTLENYRILISLDKQSFSKALHYQTGGDLQVRARSTMDIRGRICKPLLPR

SEQ ID NO: 21034 - protein, 81 aa, Sapajus apella
MLETYSNLVSVGYEGTKPDVILRLEQEEAPWIGEAACLGCHCWEDTWQVNIQRKRQQDMILRQGAAISKKTLAKEKSRDYS

SEQ ID NO: 21035 - protein, 81 aa, Zalophus californianus
MLENYINLISVGYQTTKPSVIHKLEQGEEPWMVEREIPNWNYAEVWQLDDPLERHQENQETLLKHVAFIDQETVTAEKGNK

SEQ ID NO: 21036 - protein, 81 aa, Muntiacus muntjak
FQDVAIDFTQEEWECLDLGQRDLYRDVMLETYGNLASLAGLVVSKPDLVTFLEQMKNPWDVRRTDTKSAFVLWLGKTCSSG

SEQ ID NO: 21037 - protein, 81 aa, Pan troglodytes
MVQESVTFKDVAILFTQEEWGQLSPAQRALYRDVMLENYSNLVSLGLLGPKPDTFSQLEKREAWMPEDTPGGFCLDWMTMP

SEQ ID NO: 21038 - protein, 81 aa, Balaenoptera acutorostrata
SQESVTFKDVAVDFTQEEWALLDTSQKKLFRDVMLENISHLVSVGNQLYKSDVISHLEQGEQLSREGLGFLQGQSPVISGR

SEQ ID NO: 21039 - protein, 81 aa, Ailuropoda melanoleuca
TMVTFNDILVDFTREEWKLLDTAQQIMYKDVMLENYKNLVSLGHQLPKPDVILQLEKGEEPWLVERGIHRETHAEEVWKCE

SEQ ID NO: 21040 - protein, 81 aa, Callorhinus ursinus
SHGPLSFEDVAIAFTKEEWQQLDPAQRTLYRDVMLENFSHLVSLGHPVSKPDIISKLEQGEEPWIIKRHISDWICPERETR

SEQ ID NO: 21041 - protein, 81 aa, Ursus maritimus
LQEALSFEDLSVDFTQKEWQLLDPGQKDLYKDVMLENYSSLVSLGYEVMKPDVIFKLEQGEEPWIGDGEVASSECPEQVLQ

SEQ ID NO: 21042 - protein, 81 aa, Ursus maritimus
VQGSMSFEDVIVEFTQDEWQYMSPAQRTLYRDVMLENYSHLISVGYCTTKPVMIFKLEQGEEPWSLEEEFLNQMYPGYFSV

SEQ ID NO: 21043 - protein, 81 aa, Phyllostomus discolor
FREAVTFMDVAVVFTEEELGLLDSVQRKLYRDVTLENFRNLVLVGHQSCKPDVISQLEREEKLWMTEIQTQRGRHSTESSA

SEQ ID NO: 21044 - protein, 81 aa, Acinonyx jubatus
LQGPVSFKDVAVNFTQEEWQYLDLPQRHLYKDVMLENYINLISVGYQTTKPSVIHKLEQGEKPWMVEREIPNWSYAEETWQ

SEQ ID NO: 21045 - protein, 81 aa, Rhinopithecus roxellana
PQGLLTFRDVAIEFSQEEWKCLDPAQRTLYRDVMLENYRNLVSLAISSKCRMKKFSSTGQGNTGVIHTGALQRQASHHIGE

SEQ ID NO: 21046 - protein, 81 aa, Rhinopithecus roxellana
EPGIVSFADVAVYFCREEWGCLRPAQRALYRDVMRETYGHLSALGIGGNKPALISWVEEEAELWGPAARDPEVMKCPTETD

SEQ ID NO: 21047 - protein, 81 aa, Acinonyx jubatus
VTFKDVAVDFTQEEWGQLDSPQRALYRDVMLENYQNLLALEGEPGHEVKDESCQQQGVHKEEPYQEPITEPLVKSSIHSPG

SEQ ID NO: 21048 - protein, 81 aa, Acinonyx jubatus
MFKDVAVVFSEEELGLLDPTQRKLYRDVMLENFRNLVSVGNQPFKPELISQLEREEKLLMMETETQRDGCLGAKSQHNMES

SEQ ID NO: 21049 - protein, 81 aa, Rhinopithecus roxellana
FQGGVTFEDVTVNFTKGEWQRLNPEQRNLYRDVMLENYSNLVSVGRVETTKPDVILRLEQGKEPWLVEEEVLRNGRPEKNG

SEQ ID NO: 21050 - protein, 81 aa, Rhinopithecus roxellana
ICNEAVTFKDVAVVFTEEELGLLDPAQRKLYQDVMLENFRNLLSVGHQPSYQDTFHFQREEKFWIVETATQRQGNSRGKIQ

SEQ ID NO: 21051 - protein, 81 aa, Rhinopithecus roxellana
MEFTWDEWQLLDSTQKYLYRDVILENYHNLLSVGYHGTKPDLIFKLEQGEDPWIINAKISRQSHPDGWEEWYQNNQDELES

SEQ ID NO: 21052 - protein, 81 aa, Rhinopithecus roxellana
QAEVTFEDVAVFLSREEWGRLGPAQRGLYRDVMLETYGNLVSLVLGIRTEYKELTSRETFGEEELGQPRGIFPRASEPVEA

SEQ ID NO: 21053 - protein, 81 aa, Rhinopithecus roxellana
QVLLTFRDVAIEFSQEEWKCLDPAQRTLYRDVMLENYRNLVSLDISSKCTMKEVLSTAQGNTEVFHTGTLQRHESHHFGDF

SEQ ID NO: 21054 - protein, 81 aa, Muntiacus reevesi
TSQGRLTFRDVAIDFTQEEWECLDLGQRELYTDVMLENYGNLASLGLVSKLELVAFLEQLKDPMNIRRMETTAIYPVFCIR

SEQ ID NO: 21055 - protein, 81 aa, Phascolarctos cinereus
SQESLTFKDVAVDFTKEEWGWLDPAQRGLYRDVMLENYGNLVSLGHQVSKPDMISQLEQGKEPWKVERKTSRDICSDLETV

SEQ ID NO: 21056 - protein, 81 aa, Phascolarctos cinereus
HQSSVTFRDVAVNFTPEEWGQLGPAQKELYREVMLENYQNLVCLGLAASKPDVIYQLERGEAPRMAGGDVVPRSDCPNWKA

SEQ ID NO: 21057 - protein, 81 aa, Pteropus vampyrus
PQDLVTFKDVAIDFSQEEWDWLNSAQRSLYRSMMLENYQSLVSLGLCISKPYVITLLEQGKEPWRMKSDMTSPFSDWESGC

SEQ ID NO: 21058 - protein, 81 aa, Pteropus vampyrus
SQELVTFEDVAVYFIRKEWKRLEPAQRDLYRDVMLENYGNVFSLDGETRTGHDQDISEETGSHGMLLGRFQKDISQDLKFE

SEQ ID NO: 21059 - protein, 81 aa, Pteropus vampyrus
MSVFQGFVLFKDMAVNFTEEEWRELDSAQRVLYRDVMLENYRNLVFLGFPFSKPDIVSQLEQVVNPQMQEGEVLSSSCTYE

SEQ ID NO: 21060 - protein, 81 aa, Bos indicus x Bos taurus
LSQKRLTSEDVAIEFTQEEWEFLDPAQRALYRDVMLETYRNLLSVGEDDFLPELPLGICIFPVCPLGGPDVFHLRVLVTWA

SEQ ID NO: 21061 - protein, 81 aa, Physeter macrocephalus
YQELVTFRDVAVDFSQEEWDCLNSSQRHLYSNVMLENYRILVSLGLCFSKPSVILLLEQGKEPWMVKTELTKDLCSDWESV

SEQ ID NO: 21062 - protein, 81 aa, Sapajus apella
GQGLLSFEDVAVDFTREEWQFLDPSQKVLYKEVMSENYRNLVSVGYQGTKPDSLFKLERGEPPWIVEGAAHCQTCLGFVIQ

SEQ ID NO: 21063 - protein, 81 aa, Zalophus californianus
SQEPVTFEDVAVYFTQNQWASLDPMQRALYLEVMLENYANITSLAALPFPKPDLILQLEQGGAPWGLDPWTPLEGEALGGV

SEQ ID NO: 21064 - protein, 81 aa, Sapajus apella
CQEMVTFEDVAVHFTKTEWTGLSPAQRALYRSVMLENYGNLTAMGYPVPKPALISLLEGGDMAWDLEAQDDPLAEGTKNIC

SEQ ID NO: 21065 - protein, 81 aa, Sapajus apella
LTFRDVAVEFSPEEWKCLDSAQRTLYRDVMLENYRNLVSLGISSKCMMKEFSSTGPGNTEVLHTGTLETHESHHIENFCFQ

SEQ ID NO: 21066 - protein, 81 aa, Pan paniscus
MLMMFRDVAVDFSQEEWECLDLEQRGLYRDVMLENYSNMVSLGLCIYQPEAFSLLEKGKEPWKILRDETRGPCPDMQSRCQ

SEQ ID NO: 21067 - protein, 81 aa, Vulpes vulpes
MTFEDVAVEFTQWEWGQLDPAQKDLYSEVMLENFKNLACLGLPVSKPYVISQLEEGKEPCVLEGEISTDWEKKSKVKESVL

SEQ ID NO: 21068 - protein, 81 aa, Callorhinus ursinus
AEGHVTFEDVAVYFSWEEWGLLDEAQRLLYRDVMLENLALMASLGLASSRTHEITQLEWWREPFLPPCGVVTAAMPRGWRR

SEQ ID NO: 21069 - protein, 81 aa, Rhinolophus ferrumequinum
EVVPLTFQDVAVYFSREEGQQLGPDQRALYRDVMLENYGHVASLGPPFPKPELISQLEQGEELWVLGLVGAEEPEALSSCG

SEQ ID NO: 21070 - protein, 81 aa, Acinonyx jubatus
PQASVSFKDITVEFTQEEWRQMDSAQRTLYRDVMLENYSHLVSLGYCFTKPELIFTLEQGEDPWLFKKEFPRKGSPEEYQP

SEQ ID NO: 21071 - protein, 81 aa, Rhinopithecus roxellana
RAQSCVTFEDVFVYFSREEWELLEEAQRFLYRDVMLENFALVATLAFIFPVPCSCPVGGGRKPWVPDRADITAATVKETCR

SEQ ID NO: 21072 - protein, 81 aa, Tursiops truncatus
GQVPLTFSDVAIDFSQEEWECLNSDQRNLYRDVMLENYTNLISLDIDFTSESNKLSSEKSSYEVTSYHRETMNRSKTFNVM

SEQ ID NO: 21073 - protein, 81 aa, Rhinopithecus roxellana
MCSEPLKQSYLAPVLCYFILTGYCITKPEVIFKIEQGEEPWILEKGFPSQCHPERKWKVDDMLESNQENEDDHFWELLFNN

SEQ ID NO: 21074 - protein, 81 aa, Sus scrofa
IKGSMTLQDVAVDFTPEEWQLLDCDQRTLYWDVMLENFRNLISVGCPVPKTKVIFRMEQGHDPWMVEGENPRWRCPEADYP

SEQ ID NO: 21075 - protein, 81 aa, Panthera pardus
ASGLLSFGDVTVGFTEEEWQRLDPAQRTLYRDVMLENYSHLVSVGLSIPKPEVILKLEQGEEPWILESPGQSDPELINSSR

SEQ ID NO: 21076 - protein, 81 aa, Sus scrofa
QGSLSFKDVAVVFTWEEWQLLDPIQKNLYQDVMLENYINLVSMEDAWQVDNHRDWHKGNHGNLETMENHQKENAFGKISSL

SEQ ID NO: 21077 - protein, 81 aa, Bison bison
SQGLLTFEEVAIYFSQEEWELLNPTQKALYNDVMHENYETVISLALFVLPKPKVMYLEQREEPYIQGSPVFKDNPGELLSE

SEQ ID NO: 21078 - protein, 81 aa, Sus scrofa
MDSVVFEDVAVDFTPEEWALLDLAQRNLYRDVMLETFRNLASVGENWKCHNTEEQHKNQGTHLRCHVMDISSESKETNQGG

SEQ ID NO: 21079 - protein, 81 aa, Ursus arctos
MAFEDVAVYFSQEEWELLDAAQGALYCHVMLENFALVASLGLSASRPRVVIQLERGEDPWVLSGTVVTPARNAHRKPSPGS

SEQ ID NO: 21080 - protein, 81 aa, Ursus arctos
PQDLMTFEDVAVEFTQWEWGQLDPAQQGLYREVMLENFKNLASLGLPVSKPYVITQLEEGKEPCVLDGEISTDWEKRPKAK

SEQ ID NO: 21081 - protein, 81 aa, Panthera pardus
KPGALSFADVAVYFSSEEWGCLRPAQRALYRDVMRETYGHLGALESKKKNEPSSRIRAKELEDPPVKNGPLMKARLVPGFR

SEQ ID NO: 21082 - protein, 81 aa, Capra hircus
AQLTFKDVFIDFTPEEWECLDPAQRTLYKDVMVEILRNLLSVDMSHIHMIKKLQAKANSGKGAIFQRVMFGRAEILEIKDF

SEQ ID NO: 21083 - protein, 81 aa, Panthera pardus
MLENYRNLVALGHQLYKPEVICQLEQEEQWMMERGSSGDIRAGGENRPDIKKSIPNQNISDENQNHDMIMERLTGDSFWYS

SEQ ID NO: 21084 - protein, 81 aa, Capra hircus
MARSQASVTFKDVAMDFTPEEWGRLDPTQRDVMLENYRNLVSLWLPVSKPENHSLENGKEPLLLERKAPRSSCSDSETSPR

SEQ ID NO: 21085 - protein, 81 aa, Macaca nemestrina
DSVAFEDVAINFTCEEWALLGPSQKSLYRDVMQETIRNLDCIGMIWQNHDIEEDQYKDLRRNLRCHMVERSCEIEDNSQCG

SEQ ID NO: 21086 - protein, 81 aa, Tursiops truncatus
QAEVTFEDVAVLLSREEWGRLGPVQKGLYRDVMLETYRNLVSLGAGPAGPKPEVITQLERGDEPWVPDVQGRERPTIDGSA

SEQ ID NO: 21087 - protein, 81 aa, Tursiops truncatus
EEVPVVFEDVAVYFTREEWGTLDKRQKELYRDVMRMNYELLASLGPAAAKPALISKLERRAAPWIQDPNGPKWGKGRPPGK

SEQ ID NO: 21088 - protein, 81 aa, Tursiops truncatus
SQASVSFKDITVELTQEEWQQMGPIQKTLYRDVMLENYNNLVSVGNCIFKPEVIFKLEQGEEPWFLEEEFSNQSHKEDYRD

SEQ ID NO: 21089 - protein, 81 aa, Rhinopithecus roxellana
VTFEDVTIIFTWEEWKFLDSSQKRLYREVMWENYTNVMSVENWNESYKSQEEKFRYLEYENFSCWQGWWNAGAQMCENQNY

SEQ ID NO: 21090 - protein, 81 aa, Bison bison
VEEDFRFKDVVIYFSWKEWECLHSAQKDLYQDVMLENYNNLISLGFANFKPDVISLLEQRKEPWMVKGKETEEWCPDWKSR

SEQ ID NO: 21091 - protein, 81 aa, Panthera pardus
MLENYGHVASLGFLVAKPALISLLEQGEEPGALILQVAEEQGTVANLCPDSRMEAGVKESSPGRVSSKQLGLLGTVWGRLP

SEQ ID NO: 21092 - protein, 81 aa, Acinonyx jubatus
PQVSVSFEDVAVLLSWEEWGCLGPAQKGLYRDVMLETYRNLVSLGLQRSKPDVISRLEKGEEPWAPRSLRIEESWIRNHRS

SEQ ID NO: 21093 - protein, 81 aa, Tursiops truncatus
MLENYGNLVSLGFPISKPDGISQLEQDLQVFDLETKNREVLRDDCSDGETREENKLLIPKQKIPEEVHSYKVRVGRLKKDI

SEQ ID NO: 21094 - protein, 81 aa, Acinonyx jubatus
LQGLLSFSDVAVDFTCEEWELLDTVQKNLYRDVMLENYSNLMSLGYHAPWPEATVPVEKGVQGLVEREFPSLCSPGRPLQC

SEQ ID NO: 21095 - protein, 81 aa, Sus scrofa
SQAPVTFEDMAMYLTREEWRPLDPTQRDLYRDVMQENYGNVVSLDFEIRSENEVNPKQEISEDVEFGTVSERPVGNTEENP

SEQ ID NO: 21096 - protein, 81 aa, Panthera pardus
FQEAVTFKDVAVVFTIEELGLLDSAQRKLYRDVMVENFENLLSVGHLPFKPDMMSQLEAEEKLWMMERETQRNGYSSENHV

SEQ ID NO: 21097 - protein, 81 aa, Capra hircus
FQEPVSFKDVAVVFTEEELGLLDSAQRKLYQEVMLENFRNLLSVGNQPFKPELIFQLEREERLMMETQRDGCSGTKSLHNM

SEQ ID NO: 21098 - protein, 81 aa, Tursiops truncatus
MLENYGNLVSVVGCQLSKPSVISQLEKGEAPWMTEKEGPGNPSSDLKSKTETAASTAKNDVLQEQFYHGMMMERFMRDDVI

SEQ ID NO: 21099 - protein, 81 aa, Tursiops truncatus
PWLPLTFEDVAVYFSEQEWRDLEPWQKELYKQVMRTNYEILVSLDDGLPKPELISWLEQGRELFRIWGESQKSGNIICTSA

SEQ ID NO: 21100 - protein, 81 aa, Enhydra lutris
DQESVTFKDVAIDLTQEEWTLMDRSQRKLYIDVMLENITHLVSVGCQFFQADVISQWEQGGELWREDRGLAQGWNPGLENS

SEQ ID NO: 21101 - protein, 81 aa, Acinonyx jubatus
AVTFTDVAVNFTKEEWALLDPAQRNLYRDVMLKKCRNLASVDSLNQRKTQNSTPRQDILAEKTPRGANRVCAVSRSSRPSP

SEQ ID NO: 21102 - protein, 81 aa, Acinonyx jubatus
MVQESVTFRDVVVLFTQDEWAQLSPTQRALYRDVMLENYSNLVSLGLLGPQPDVLSQLGKGEEWMLEDTSAGFCLDWMTMP

SEQ ID NO: 21103 - protein, 81 aa, Acinonyx jubatus
PQAKVTFEDVAVLLSQEEWDRLGPAQRGLYRHVMMETYGNVVSLGLPGSKPNVICQLERGEEPWVLEGQGAKETGGLGIGH

SEQ ID NO: 21104 - protein, 81 aa, Sus scrofa
ESVTFRDVTVDFTREEWRQLKPAQKDLYRDVMLENLRNLVSLDLETRPEMKEPDPKEEISGDKPSVEVVAEGHAGSAGWGS

SEQ ID NO: 21105 - protein, 81 aa, Sus scrofa
SQGLLTVEDVAIDFSPEEWECLDLGQRHLYRDVMLEICRHLVSLEYVISKPDLVRLLEQKTDPWDVKGMETVAIQPALSSH

SEQ ID NO: 21106 - protein, 81 aa, Ursus arctos
AQGSVTFEDVALYFSWEEWDLLDEDQRCLYHDVMLENFALTSSLGCRSSRSHKVAQLGLGEESPVLHRMDRIPVSTRWAQR

SEQ ID NO: 21107 - protein, 81 aa, Sus scrofa
MASPSPPTEPKEEWDYLDPAQRSLYKDVMMENYGNLVSLDVLNRDKDEAPTVKQEIEEIEEEVEPQSVIVTRIKSEIDQDP

SEQ ID NO: 21108 - protein, 81 aa, Acinonyx jubatus
YQEFVTFEDVAVHLTREEWGCLDPVQRNLYREVMLENYGNVVSVGFPFPKPDGISQLEQDLQVFDLETKNREVLRDDCSDG

SEQ ID NO: 21109 - protein, 81 aa, Panthera pardus
PQEPVTFEDVAVYFTQNQWASLDPMQRALYREVMLENYTNMASLAFPFPKPVLVSHLERGEAPWGPDPWEAEVLRGICPGG

SEQ ID NO: 21110 - protein, 81 aa, Panthera pardus
LFQGRLTFRDVAIEFSQEEWECLDPAQRALYRDVMLENYRNLVSLGEDNFPPEVILEAKCVKWIHSAVLRLDMPAVYFPQV

SEQ ID NO: 21111 - protein, 81 aa, Panthera pardus
MLENYSHLVAVGCCVPKPDVIFRLEQGQQPWIVEEESLDQSCPEVCKVDNQLEQNQEIQHRHFWQAPFINNKTLTVHRGNV

SEQ ID NO: 21112 - protein, 81 aa, Tursiops truncatus
FQVLVSFEEVAVLLSQEEWGHLGPAQKRLYRDVMLETYGNLVSLGLQGSKPDVISKLEQGEEPWTPHSPRIEGSWIRRRRP

SEQ ID NO: 21113 - protein, 81 aa, Enhydra lutris
MLENYGNVVSLGFPLSKPDGISLREQDLQVFDLETKNREVLRDDCSDGETREENKLLIPKQEILEEVHSYKVRVGRLKKDI

SEQ ID NO: 21114 - protein, 81 aa, Sus scrofa
DSVVFEDVAVNFTLEEWALLDLSQKKLYRDVMRETLRNLALVGRKWEGHAIEDEYKNPGRKPRNLVVRRLCENREGSPPGE

SEQ ID NO: 21115 - protein, 81 aa, Enhydra lutris
AQESLTFRDVFVDFTLEEWQQLDSAQRNLYRDVTLENYSHLVSVGYLIAKPDEVLRLGQVEEAMGAEGEPPARNHPEFWQV

SEQ ID NO: 21116 - protein, 81 aa, Sus scrofa
AQGSLSFRDVAVDFTWEEWQLLTPAQKDLFRDVTLENYRNLVAVAGYQVSKPAALAKLERREEPWTRAEEAPSGTCEETGK

SEQ ID NO: 21117 - protein, 81 aa, Vicugna pacos
SHALVTFQDILVHFTREEWELLDAAQQLMYRDVTLENCRNLVSLGHQLPKPDVILRLEKGEEPWLLERGVHPEAHPDLEAA

SEQ ID NO: 21118 - protein, 81 aa, Odocoileus virginianus
VTFEDVAVLLSQEEWGLLGPSQKGLYREVMLETYRNLLSLGPVSFPGAGLADPKPEVIVQLERGDELWVLDMHGAEQPSVD

SEQ ID NO: 21119 - protein, 81 aa, Odocoileus virginianus
KSWGHLSFMDVFVDFTWEEWQLLDSAQKHLYRSVMLENYRNLVSLGYQYTKPSIIFQLEQEELWMMHSPSQDHSDEVWEID

SEQ ID NO: 21120 - protein, 81 aa, Sus scrofa
PGSVTFEDVAVYFSQEEWKLLHEAQRLLYRDVMLETFALVASLGCWPGVDDKETLSEQTISVEGPHINPSKADLSTQKAYA

SEQ ID NO: 21121 - protein, 81 aa, Ursus arctos
LRSPVTFEDVAVYFSKEEWGLLDASQRHLYHNVMLENFELMTSLGCWHGVEDEGDHSKQNTSVEGMSQVRIPSANPSTQKA

SEQ ID NO: 21122 - protein, 81 aa, Ursus arctos
MDFTLEDWEHLGLDQGDLFWDTALDNYQNLFLLNPSKPKLTSHPDGTEEPKVLVRESPESAGPDTAEVKNCLLAPDFLEED

SEQ ID NO: 21123 - protein, 81 aa, Ursus arctos
GEEAVVFEDVAVYFTRIEWSCLAPDQRALYRDVMLENYGHVASLGFLVAKPALISLLEQGEEPGALILQVTEERGFAASLC

SEQ ID NO: 21124 - protein, 81 aa, Capra hircus
AQLTFKDVAIQFSPEEWECLDPAQKTLYRDVMLETLRNLLSVAISHIHMIKKSQLKSNIDIGERFQTVMLENHESHEIKHF

SEQ ID NO: 21125 - protein, 81 aa, Tursiops truncatus
FREPVIFEDVTLGFTPDEWGMLDLEQKSLYREVLLENYRNLVSVEHQLSKPDVVSQLEEEEELWSVERGIPRDTFSECPEA

SEQ ID NO: 21126 - protein, 81 aa, Tursiops truncatus
YQEFVTFEDVAVHLTREEWGCLDPVQRALYREVMLENYGNLVSLGFPISKPDGISQLEQDLQVFDLETKNREVLRDDCSDG

SEQ ID NO: 21127 - protein, 81 aa, Ursus arctos
WLTFRDVAIEFSPEEWECLDPAQRALYRDVMVENYRNLVSLAISSKCMIKELPPKENSNTGEVLQTVILERHKSCDNEDYA

SEQ ID NO: 21128 - protein, 81 aa, Sus scrofa
FQESVTFKDVIVDFTQEEWKQLDPVQRDLFRDVTLENYTHLVSIGLQVSKPDVISQLEQGTEPWIVEPSIPVGTFGDWETR

SEQ ID NO: 21129 - protein, 81 aa, Sus scrofa
SRSLESDGVCFSEQDWENLEGWQKELYANVMKSNYEALVSLKVLGQPEGEAELGTEMLGDLEEGEGPGGDHPAEGRLMKQE

SEQ ID NO: 21130 - protein, 81 aa, Sus scrofa
SQGLLTVEDVAIDFSPEEWECLDLGQRHLYRDVMLEICTHLVSLEYVISKPDLVRLLEQKKDPWDVKGMETVAIQPALSSH

SEQ ID NO: 21131 - protein, 81 aa, Leptonychotes weddellii
AQESVVFSDVSIDFSQEEWECLNDDQRDLYRDVMLENYSHLVSMAGHSVSKPDVISVLEQGKEPWLVDRELTREQWPVLES

SEQ ID NO: 21132 - protein, 81 aa, Panthera pardus
MLENYSKLVSVGCLTIKPDVISQLERGEEPWIIEVMFSSQSLPAIHSTFSILSQKEQKKNKSRGSISFEDVTVNFTQEEWG

SEQ ID NO: 21133 - protein, 81 aa, Acinonyx jubatus
FQGSVTFQDVAVDFTPEEWQLLDCDQRTLYWDVMLENFRNLTAVGGPITKTKVIFKEEQGQESWMVEGENPCWRYPEADWL

SEQ ID NO: 21134 - protein, 81 aa, Tursiops truncatus
MLENYRNLNSLHKEHLLSKPVETSRLESKEKSWIMEQEILRTTVFDREIVSENQDLVPKQRISGEESSHAVIMTRLTENGH

SEQ ID NO: 21135 - protein, 81 aa, Acinonyx jubatus
MLENYSHLVSLGLNISKPYVVSLLEQGKEPWLEKRGVRRDLFSEPNREVKEFSQKNVIYEDDSPQCLVVERILSHGPEYSS

SEQ ID NO: 21136 - protein, 81 aa, Vicugna pacos
VQGSLLFEDVAVDFTWEEWQLLAPDQKALYRDVMLENYSHLVSVGLQSSKPTEIFKLKQGDQPWLEEENTPGQNSPEVGEV

SEQ ID NO: 21137 - protein, 81 aa, Bos indicus
MLENYSNLVSVGYQASKPAALSRLERGELWPVEDKVHSRICPEMRKDDCLLQENLQNQSCPKRMERCHEHNALGNVYQSKN

SEQ ID NO: 21138 - protein, 81 aa, Cebus imitator
AHVSLAFRDVSIDLSQEEWECLDPAQRDLYKDVMFENYSNLVSLGYTIPKPDVIALLEQEKEPWIVMKEGTRSWYTDLEYK

SEQ ID NO: 21139 - protein, 81 aa, Sus scrofa
TAGPVTVKDVTLAFTKKEWEQLDATQRSLYKDVMLENYSNLASTGCQTLKPDMISKLGKGEELWLGKGKKPKQGGLSEIAR

SEQ ID NO: 21140 - protein, 81 aa, Enhydra lutris
MDFTLDWEHLGLDQGNLFWDTALDNYQNLFLLNPSKPKLTSQPDGAEEQKVLEREGPESAGPNPAEIKNCFLGQDFLEEGL

SEQ ID NO: 21141 - protein, 81 aa, Physeter macrocephalus
QAQETLTFDDVTVDFTWEEWQLLIPPQKDLYQEVMLENYSNLLSVGYQARKPDILSKLDQGEPWTMEDEIHCRTHSGYQAS

SEQ ID NO: 21142 - protein, 81 aa, Physeter macrocephalus
KSAAVSFSDVAVYFSLEEWGCLRPAQRALYRDVMRETYGHLGALGFPGPKPALISWMEQESEAWSPAAQDPEEGESLGGAL

SEQ ID NO: 21143 - protein, 81 aa, Trichechus manatus
SVTGADVAVDFTQEEWALLDLSQRKLYREVMTETFRNLASVVSRNPNDGEKLSTENIIVRFMRNDIWSSMVGEIYKLHGVE

SEQ ID NO: 21144 - protein, 81 aa, Carlito syrichta
LQGSVSFKDVTVDFTQEEWHQLNPAQKALYRDVMLENYCHFISVGFHMTKPDMIRKLEQGEELWTERIFSRQSHLEEDGKA

SEQ ID NO: 21145 - protein, 81 aa, Zalophus californianus
MRRKWKNILNAVPSQEEWGQLDLAQRRLYRSVTLETCSHLVSLGLLLSKPAVISWLEQGQDPWRAGQGPPRDWKNTFEKKE

SEQ ID NO: 21146 - protein, 81 aa, Zalophus californianus
LPDLVTFEDVAVEFTREEWALLDPSQRTLYRDVMRENCRNLASLGYHIDKSSLISHLEQEDKVTTEERGILPGTCPDLETV

SEQ ID NO: 21147 - protein, 81 aa, Sapajus apella
IQDSVVFEDVAVNFTQEEWALLDLAQRNLYRDVMLENFQNLASLGYLLHTPHLISQWEQEEDLQTLKRELIQGICVREHQE

SEQ ID NO: 21148 - protein, 81 aa, Tursiops truncatus
LQEQVSFKDVCVDFTQEEWYLLDPAQKILYRDVILENYSHLVSVGNCITKPEVIFKIEQGEEPWILEERFPKQCCSEDWKV

SEQ ID NO: 21149 - protein, 81 aa, Tursiops truncatus
SQSLVTFGDVAVEFSPEEWEWLDSAQRSLYRSVMLENYRSLVSLGLCVSKPKMISSLEQRKEPWVAKRTLTRGGCPDSRAL

SEQ ID NO: 21150 - protein, 81 aa, Tursiops truncatus
MAHLMMFRDVAVDFSQEEWECLDLEQRALYRDVMLENYSNMVSLGLCLYQPDVFSLLEKGKEPWMVLKDETGGPCPDMQSR

SEQ ID NO: 21151 - protein, 81 aa, Rhinopithecus roxellana
QGLLTFRDVAIEFSQEEWKCLDPAQRTLYRAVMLENYRNLVSLAISSKCMTKEFSSAVQGNREVLHTGTLQRHESHHIGDF

SEQ ID NO: 21152 - protein, 81 aa, Sus scrofa
LTLEDVAVDFTWEEWQLLTPNQKDLYQDVMLENYGNLVAVETEKVEDCVQWHCQKQNTLRRIEEGYEQSVFENITHQSKRS

SEQ ID NO: 21153 - protein, 81 aa, Bison bison
MLETYSNLVSLGLAISKPDVISFLEQGKEPWTVEEVVTGGLCPVLKSRYDTKVFSPKQQSYEVQSPPWEIMESLTTYGLEC

SEQ ID NO: 21154 - protein, 81 aa, Sus scrofa
MTFEDVAVEFTQWEWEQLDTAQKELYREVMLENFKNLASLGFPVSKPYVICQLEEGEEPCTVEREISTGAHSDWERRPRAK

SEQ ID NO: 21155 - protein, 81 aa, Sus scrofa
LQEPVTFRDVAVDFTQEEWGQLDPVQRTLYRDVMLETYGHLLSVGHQMAKPEVISLLEQGEEPWSTEQPYSPPGTCPEWMR

SEQ ID NO: 21156 - protein, 81 aa, Ursus arctos
MLENYFNLISVGCQVPKPEVIFNLEQEEPRMLDGEISSQSCLDGDIGFETSQQGMSEEVSIQFERINLFTSDDPYSILELW

SEQ ID NO: 21157 - protein, 81 aa, Ursus arctos
MAAGFQFKDVAIYFSQKEWECLHSAQKALYRDVMLENYNNLISLGLSDSKPDVISLLEQGKEPWMVKSQETKECCPGRFLR

SEQ ID NO: 21158 - protein, 81 aa, Leptonychotes weddellii
SQGSLSFEDVAVDFTREEWQLLDSAQKTLYRNVMLENLSSLVSLGFQLIRPDVIFRLEQEKPRVISEDIPSESFSEYRKVD

SEQ ID NO: 21159 - protein, 81 aa, Phascolarctos cinereus
GKESVTFKDVAVEFTSEEWVQLNPTQKKLYRDVMLENYRNLVSLGFAVSKPDVIYQLEREEASWMPKADIPRSSCPESGEF

SEQ ID NO: 21160 - protein, 81 aa, Phascolarctos cinereus
MLENYRNLVSLGFAVSKPNVIYQLERKEASSLPETDIPRSSCPESIEFGGDKPLQCNGYGNAFWSKEHHAVCQIIHTGDNP

SEQ ID NO: 21161 - protein, 81 aa, Bos indicus x Bos taurus
PLTQLTFEDVAVDFTQEEWALLDTSQRKLFRDVMLENISHLVFVGYQHCKLDVIFQLEQGEELWIEGRGFFQSHSPGRESA

SEQ ID NO: 21162 - protein, 81 aa, Carlito syrichta
CEGSVSFEDVTMDFSREEWQQLDSAQRHLYQDVMLEIYSHLFSVGYHIPNPEVIFRLVKGKEAELPHQRYQEGKFGLETPQ

SEQ ID NO: 21163 - protein, 81 aa, Acinonyx jubatus
MLENYINLISVGYQTTKPSVIHKLEQGEKPWMVEREIPNWSYAEETWQLDDHMEQHQENQETLLKHAAFIDQETGTDEKGN

SEQ ID NO: 21164 - protein, 81 aa, Enhydra lutris
SVTFRDVTVDFTQEEWQQLEPAQKDLYRDVMLENYRNLVSLDLETRPEMKESGPQEDSAEDRPPAGVVAEGPPRHGAHGLA

SEQ ID NO: 21165 - protein, 81 aa, Bison bison
WKGLLSFEDVVLYFTREEWDMLDWAQKALYRDVMLDNYRHVVSLGFQFPKPEVICQLEQWEEPWILDLPRAGTRKASGSAC

SEQ ID NO: 21166 - protein, 81 aa, Bison bison
VVFEDVAVDFTQEEWALLNLAQRNLYRDVMLENFRNLASLGFEIQLKINESVAPQDAYGKISNEQDVAGFKNSDSSLSILH

SEQ ID NO: 21167 - protein, 81 aa, Sus scrofa
SLGSALFRDVAVVFTREEWEQLAPAQRDLYRDVMLETYGNLVSLGLAVSKPEVIAFLEQGREPWMVEEVVTGSLCPVLESR

SEQ ID NO: 21168 - protein, 81 aa, Sus scrofa
VTFEDDVAISFTREEWDCLDPAQRALYKDVMLETYRNLIAVDHHRIHTGEKPYKCVVCGKFFKQKSTLTVHQRIHTEEKAY

SEQ ID NO: 21169 - protein, 81 aa, Ursus arctos
WAGSVTFRDVAIDFSQEEWEFLDSAQRDLYRDVMWENYSNFISLAEPSISKPDVITLLDEGKEPWMVVREGTRRHYSDLES

SEQ ID NO: 21170 - protein, 81 aa, Macaca fascicularis
MGLLTFRDVAIEFSLEEWQRLDAAQQNLYRNVMLENYRNLAFLGIAVSKPDLITCLEQGKEPWNMKRHEMVDKPPAICPHF

SEQ ID NO: 21171 - protein, 81 aa, Vicugna pacos
WSQMPVTFEDVALYLSREEWGQLDHTQQSFYRDVLQKRNGLSFAGFPFSRPFWASQVQGKGEASSSSRQTGDEERRGAMEV

SEQ ID NO: 21172 - protein, 81 aa, Vicugna pacos
GSVSFTDVTVDFTQEEWEQLDPSQRILYMDVMLENYSNLLSVEVWKADDQMEGDPRNPDEQARPFVIFKNHIPIEEEEDDL

SEQ ID NO: 21173 - protein, 81 aa, Odocoileus virginianus
PTAWSEDPVTFQEVSVDFSREEWAQLAPAQKILYQDVMLENYRNLTSVGYHLRKPCLLTQGELRTRKRRLLQDTCAGYYKI

SEQ ID NO: 21174 - protein, 81 aa, Odocoileus virginianus
MQFSWEEWQLLDSVQKHLYRDVTLENYSNLVAIGYHGNKPDLIFKLEQGEEPWIINSKVSHQSCPDGWEEWYQKNHDELES

SEQ ID NO: 21175 - protein, 81 aa, Vicugna pacos
FQGLVTFRDVAVDFSQEEWEWLSPSQRTLYRRVMLENYRSLVSLAGVSVSKPDVISLLEQGKEPWKVKKEWTGGTRPDWEY

SEQ ID NO: 21176 - protein, 81 aa, Vicugna pacos
SQDSVTFEEVVVDFSQEEWALLDPAQKILYRDVMLENFQNLASVGYHLCKHSLITEEEQEELRPEGRRLLQGACREWDTQF

SEQ ID NO: 21177 - protein, 81 aa, Phascolarctos cinereus
MLENYRNLVSLGPESPGSRPQIISWLEQGEGREFPGSIPSDSKTQTEARWGISTEGEVWKMGSEGTTGDADQEPKWGAASG

SEQ ID NO: 21178 - protein, 81 aa, Phascolarctos cinereus
GRKSVTFKDVAVEFTREEWLHLNPSQKKLYRDVMLENYRSLVSLGFAVSKPDVIYQLERKEAFWMPETDIIPRSSCPGNKE

SEQ ID NO: 21179 - protein, 81 aa, Cebus imitator
AQGSVSFNDVTVDFTQEEWQHLDHAQKTLYMDVMLENYCHLMSVGCHMTKPDVILKLERGEEPWTSFAGHTRLEENWKAED

SEQ ID NO: 21180 - protein, 81 aa, Physeter macrocephalus
SQGLVSFKDVAVDFTQEEWQQLDPAQKTLYRDVMLENYSHLVSVGHPVSKPDVISKLEQGEDPWIIKRDIPNWIYPYEDQA

SEQ ID NO: 21181 - protein, 81 aa, Trichechus manatus
AQESLTFSDVAVGFTWEEWQLLNPAQKDLYQDVMLENYNNLVSVGYQVSKPDVLSRLERGEQPWTILDKNHTRNFSEIWKV

SEQ ID NO: 21182 - protein, 81 aa, Trichechus manatus
FQGSMTFQDVAVDFTPEEWQLLDCAQRNLYWDVMLENFRNLISVGCPVANPKVIFKLEQGQEPWMVEGEDPCWSYPEADCL

SEQ ID NO: 21183 - protein, 81 aa, Pan troglodytes
MLENYGAVASLAFPFPKPALISQLERGETPWCSVPRGALDGEAPRGISSGYPFLKPAGMSHPEQVEEPLNLKLQGEGPSLI

SEQ ID NO: 21184 - protein, 81 aa, Sapajus apella
MLENYRNLVSLGGHSISKPVLVDLLEQGKEPWMILREETQFPDLDLQCEIISYIEVPTYDTDISSTQHQSIYQREKLYECK

SEQ ID NO: 21185 - protein, 81 aa, Sapajus apella
MVENFKNLVAVGHLPFQPDMVSQLEAEEKLWMMEAETQRSRYSGENPAAILSGSKHQNKMETLQKFALKYLSNQELSCWQI

SEQ ID NO: 21186 - protein, 81 aa, Capra hircus
GSVSFTDVTVDFTQEEWEQLEPSQRILYMDVMLENYSNLLSVEVWKADDQMETDHRNPDEQARPFVIFKDQTPTEERDNNL

SEQ ID NO: 21187 - protein, 81 aa, Tursiops truncatus
MLENYRILVSLGLCFSKPSVILLLEQGKEPWMVKRELTKDLCSDWESVCETEELTPKQDIYQVRSSQKVIETLTSCGLEYS

SEQ ID NO: 21188 - protein, 81 aa, Tursiops truncatus
SQGLLSFNDVAVDFTWEEWQLLDIVQKNLYRDVMLENYSNLMSLGYQVTKPEPVMHLEKEEEKEKAVVEREFPSQCGPERP

SEQ ID NO: 21189 - protein, 81 aa, Sus scrofa
TQESVTFQDVAVDFTEKEWPLLDSSQRKLYKDVMLENYSNLASVGCQVGKPSLISHLEQEEELRTEERGLHRGGPCSDWET

SEQ ID NO: 21190 - protein, 81 aa, Bison bison
SEDPVTFEEVSVDFSQEEWAQLAPAQKILYQDVMLENYRNLTSVGYHLRKPRLLTQEELRTRKRRLLQDTCADQNSQLKTK

SEQ ID NO: 21191 - protein, 81 aa, Sus scrofa
SQGALSFRDVTVGFTQEEWQHLDPAQRTLYRDVMLENYSHLVSVGYCVPEPEVILKLEQGEEPWVLEEEFSSQSYPELINS

SEQ ID NO: 21192 - protein, 81 aa, Sus scrofa
QEYGLLQRRLENMENLLRNRNFWVLRLPPGSRGEAPKVSRSLESDGVCFSEQDWENLEGWQKELYANVMKSNYEALVSLSE

SEQ ID NO: 21193 - protein, 81 aa, Ursus arctos
ELVTFGDVVISFSQEEWEYLDSAQRDLYWDVMMENYSNLVSLDLESKYDTKCSSTRKDITKKSGSQWKVTESKFIGLARND

SEQ ID NO: 21194 - protein, 81 aa, Ursus arctos
PLTFRDVAVVFTEEELGLLDPAQRKLYRDVMLENFRNLLSVGDKNEKEMEYIQGRELKCLSYRELSYWKIWEHVAGELTEN

SEQ ID NO: 21195 - protein, 81 aa, Vicugna pacos
SLGSDLFRDVAVVFSQEEWGRLAPAQRDLYRDVMLETYGNLVSLGLAFSKPAVISFLEQGQEPWMVEKLATGGPCPGEWGK

SEQ ID NO: 21196 - protein, 81 aa, Leptonychotes weddellii
AQESLTFDDVAVDFTWEEWQLLAPAQKDLYWDVMLDNYRNLVSVGFHISKQDVLSKLDQREPTWTVEEDIPCQTRSETWKL

SEQ ID NO: 21197 - protein, 81 aa, Neophocaena asiaeorientalis
MLENYSHLVSLVVTFAGYCIIKPQVIFKLEHGEEPWPSEEEFLNQKYPGCYRVDVHIEENQEKQEKPLWQVVFTDNKILSK

SEQ ID NO: 21198 - protein, 81 aa, Odocoileus virginianus
QELVMFEEVSVCFTSEEWACLSPVQRALYWDVMLENYGNVTSLEWETMTENEEVTSKLSISQRADSQRGISNRFQGGVPQL

SEQ ID NO: 21199 - protein, 81 aa, Phascolarctos cinereus
GLESVTFQDVTVDFTQREWRQLTQAQKSLYRQVMLENYENFVSLGLPVSKPELISQLECGEGPWMLLEEEPRSPCADWETQ

SEQ ID NO: 21200 - protein, 81 aa, Pteropus vampyrus
MDVMLENYCHLVSVGCRMTKPDVILKLERGEEPWTSFTGHTCLEETWKAEDFLVKFKEHQDTYSRSIVFINHRKLTKENRN

SEQ ID NO: 21201 - protein, 81 aa, Pteropus vampyrus
PQESLTFEDVAVYFTEEEWASLVPAQRALYRDVMLENYGALAFLAAPSTTKPALIYQLEQEKELCFSESQEALSGRASLAG

SEQ ID NO: 21202 - protein, 81 aa, Pongo abelii
MLENYFNLISVGCQVPKPEVIFSLEQEEPCMLDGEIPSQSLPDGDIGFGPLQQRMSEEVSFQSEININLFTRDDPYSILEE

SEQ ID NO: 21203 - protein, 81 aa, Trichechus manatus
SHGSVSFKDLIVDFTQEEWQQLDPAQRLLYRDVMLENYSNLVSVGCHVSKPDVIFKLEQGEEPWMEEEFSSQNYSEVDGAL

SEQ ID NO: 21204 - protein, 81 aa, Callithrix jacchus
YEISVSFEDVTVDFSKEEWQHLDPAQRRLYWDVTLENYSHLLSVGYHIPKSEATFKLEQGEGPWTLEGEAPHQSCSGEAIG

SEQ ID NO: 21205 - protein, 81 aa, Carlito syrichta
SQAPVTFEDMAMYLTREEWRPLDPTQRDLYRDVMQENYGNVVSLDFEIRSENEVNPKQEISEEVEFGATSERPVENAEENP

SEQ ID NO: 21206 - protein, 81 aa, Sapajus apella
SQGLLIFRDVAIEFSPEEWSYLNPAQQNLYRDVMLENYRNLVSLGIAISKPDLITCLEQRNEPWSVKKRETVAKQPAISSH

SEQ ID NO: 21207 - protein, 81 aa, Delphinapterus leucas
WSQMPVTFEDVAVYLSREEWGRLDHTQQSFYRDILQKRHGLSLAGFPFSRPFWASQVQGKGEASGSCQQMGDEEEEKRGAV

SEQ ID NO: 21208 - protein, 81 aa, Panthera pardus
PQEPVTFEDVAVLFTPEEWMFLDSAQRSLYRDVMLENYRNVASVGDQLGKFSSFSHLEQGEEWWPTERRVFPGSCPEPSLP

SEQ ID NO: 21209 - protein, 81 aa, Acinonyx jubatus
ISLTFEEVAMYFSQEEWEFLDPTQKALYNDVMWENYETVISLAVPVHQILAFSEKTNTKDWTVAPELVLPKSQSSLTFEEV

SEQ ID NO: 21210 - protein, 81 aa, Neophocaena asiaeorientalis
MDVFVDFTWEEWQLLDPAQKHLYRSVMLENYSNLVSLGYQHTKPNIIFQLEQEELWMMQIPSESHMDEVWEIDGHMEWHKE

SEQ ID NO: 21211 - protein, 81 aa, Neophocaena asiaeorientalis
MVKSQISFEDVAVDFTVEEWQLLNPTQKTLYRDVTLENCSNLVFLGYQMIKPEAIIKLEQEEPWILGEETLSQNFPEEVWL

SEQ ID NO: 21212 - protein, 81 aa, Odocoileus virginianus
LHRLVLFKDVAVDFSREEWGYLDLEQKDLHRDVMLESYSNLVSLGVSTSKPDMLSLLEQGKEPWKVVQDVTRDLSPDWESR

SEQ ID NO: 21213 - protein, 81 aa, Phascolarctos cinereus
FWESVTFKDVAVDFTWEEWGQLGPSQKELYREVMLENYRNLVCLGLAVSKPDVICQLERGGAPWWPEVGVPGSSCADWDTR

SEQ ID NO: 21214 - protein, 81 aa, Phascolarctos cinereus
FQVSVTFQDVAVDFSRDEWKRLDDAQKALYRDVMLENYENLVSLGLPVSKLDVISLLERREAPRRAKERVPRDLPPDSISQ

SEQ ID NO: 21215 - protein, 81 aa, Phascolarctos cinereus
MDSVTFQDVAVEFTREEWCLLDFSQKVLYRDVMLEISQNLLSLGLPAPKANWISQLDQREVPWIQERQAPGDFCPDEETGP

SEQ ID NO: 21216 - protein, 81 aa, Physeter macrocephalus
QQRPVSFKDVVVGFTQEEWHRLNPAQRALYRDVMLETYSNLVSVGYEGSKPYVILRLEQEEAPWICEASCSGCHCWENIWQ

SEQ ID NO: 21217 - protein, 81 aa, Trichechus manatus
LLTFKDVAIEFSQEEWQSLDSAQKALYRDVMLENYRNLVSLDISSRCMLQELSPDENIIKGELFRTVMLERRVSHSLENFD

SEQ ID NO: 21218 - protein, 81 aa, Delphinapterus leucas
KTWGPLSFMDVFVDFTWEEWQLLDPAQKHLYRSVMLENYSNLVSLGYQHTKPNIIFQLEQEELWMMQIPTQGHLDEVWEID

SEQ ID NO: 21219 - protein, 81 aa, Zalophus californianus
MLENYKSIVSLGLPVPQPDVIFQLKRGDEPWIVDLHGSEERECPENVSLDWETKPEIHGASEEESEGTARGKLGGEVPVCP

SEQ ID NO: 21220 - protein, 81 aa, Acinonyx jubatus
FDDAVTFDDVALDFTQEEWILLDLAQRNLYRNVMLENYQNLVTVGYQQSKPSLVARLEQEELRTVEKGVFPEWQTQHQSKE

SEQ ID NO: 21221 - protein, 81 aa, Sus scrofa
AQESVSFKDVTVDFTQEEWQHLDPAQKTLYMDVMLENYCHLVSVGCHMTKPDVILKLERGEEPWTSFTGHTCLEENWKAED

SEQ ID NO: 21222 - protein, 81 aa, Sus scrofa
MTVSQAPLTLEDMAIEFSWEEWACLDPAQRALYRDVMLETCRNLLSLGEHRFPLGVGICPWVSLRFPSCASQETLLCLTVL

SEQ ID NO: 21223 - protein, 81 aa, Leptonychotes weddellii
GQGSVSFKDVTVDFTRDEWLQLTGTQRTLYRDVMLENYSHLVSVGCHLTKPDVIFRLEHGEELWPSEGEFPDQGDQDKSQE

SEQ ID NO: 21224 - protein, 81 aa, Vicugna pacos
VVQESVTFRDVAVLFTQEEWAELSPAQRALHRDVMLETCGNLVSLGLLGPKPDTLSQLGRGEGWTLEDSLGGFCLDWVTMP

SEQ ID NO: 21225 - protein, 81 aa, Leptonychotes weddellii
KDQESLTLEDVAVDFTWEEWQLLAPTQKDLYRDVMLENYRNLVSVGYMASKPDALSRLEQGELWTTEHEIPSRIRPEIKKD

SEQ ID NO: 21226 - protein, 81 aa, Vicugna pacos
MTKPDVILKLERGEEPWTSCTGHTCLEESWKAEDFLVKFKEQQDEYSRSVALINHKKLIKEKSNTYEKTFTLSKNPINSTN

SEQ ID NO: 21227 - protein, 81 aa, Neomonachus schauinslandi
AQGRVTFEDVAVHFSWEEWGLLDEAQRCLYQDVMLENLALITSLGCRHGAEDEEAPEQKVSAQGVSQVRTFKAVVSPQKAH

SEQ ID NO: 21228 - protein, 81 aa, Pteropus vampyrus
PQGSVSFKDVTVDFTQEEWQQLDSDQKALYRDVMLENYCHLISVGFHMTKPDMIRKLEEGEELWTTERIFPSQSYLESPAV

SEQ ID NO: 21229 - protein, 81 aa, Pteropus vampyrus
MAFRDVAVDFTQEEWMLLSPAQRSLYREVMLENYSNLVSLGIPFSKPKLITQLEQGKETWGEERKCLPVTCPAEPKPEFHL

SEQ ID NO: 21230 - protein, 81 aa, Bos indicus
PEKSVTFEDVAVYFTQTEWDGLSTAQRALYRDVMLENYGNMASLGFPLLKPAVISQLEGGGELEGPSPLASAAGTGPQGLW

SEQ ID NO: 21231 - protein, 81 aa, Bos indicus
SQDSVTFTDVAVYFNQEEWTLLNPFQRKLYRNVMLENYKNLTTAGYQAIKPTLISWLEQDVLKTVERGILQEWEMQLISND

SEQ ID NO: 21232 - protein, 81 aa, Physeter macrocephalus
KEAVTFKDVAVTFTEEELGLLDSTQRKLYQEVMLENFRNLVSVEGKIQSEMETVSEAGLHEELSSWHIWQHIASDFTRCQD

SEQ ID NO: 21233 - protein, 81 aa, Physeter macrocephalus
WSQMPVTFEDVAVYLSREEWGRLDHTQQSFYRDVLQKRNGLSLAGFPFSRPFWASQVQGKGEASGSCQQMGDEEEEKRGAV

SEQ ID NO: 21234 - protein, 81 aa, Physeter macrocephalus
HQEVVTFEDVAVYFTQTEWAGLSPAQRALYRSVMLEIYGNLTSLGYPVPKPALVSLLERGELPWGLETRDDPPAQGTKDIC

SEQ ID NO: 21235 - protein, 81 aa, Bos indicus x Bos taurus
MLENYSHLVSMGHPVSKPDVISKLEQGEDPWIIKRDIPNWICPYEGQADGRLDRKSNLDNPQSCILGSVSFHNKILKGVIK

SEQ ID NO: 21236 - protein, 81 aa, Trichechus manatus
SVAVEDVAVDFTQEEWALLDLSQRKLYRDVMMETFRNLASVVSRNLNDGEKLSTENIIIPFMKNYTWSSMVGEICELHGIE

SEQ ID NO: 21237 - protein, 81 aa, Delphinapterus leucas
RKVPVSFEDVSVYFTKTEWKLLDPRQRMLYKRVMLENYRHLVSLGFSSSKPHLVARLERGEGPWVADVHRMGTTTGTQAGD

SEQ ID NO: 21238 - protein, 81 aa, Zalophus californianus
SQGPVSFKDVAVDFTQEEWQQLEPDEKTTYRDVMLENYSHLVSVGYDSTKPKVILKLEQGEEPWIAEGDLPCQSHPEIVWK

SEQ ID NO: 21239 - protein, 81 aa, Panthera pardus
MDSSQEEWTLLDQTQIALYRDAMLENYQNLITLAGYKSCKPDLSSALEGAELLRTGGRGVLQDLRPSEVDRDSLEREADGH

SEQ ID NO: 21240 - protein, 81 aa, Panthera pardus
YQGPVTFKDVIVEFTREEWQLLDAAQRTLYKEVMRENYGHLVSVGYCVHKPNAVFKLKQGKEPWILEVEFPRRNYPEDLWK

SEQ ID NO: 21241 - protein, 81 aa, Acinonyx jubatus
MFKDVAIDVSQEEWECLNPTQRSLYKDVMLENYSNLVSLGLSISKPAVISSLEQGKEPWMVVREVTGEQCPDLVSRCEAKK

SEQ ID NO: 21242 - protein, 81 aa, Tursiops truncatus
MLENYFNLISVGCQVPKPEVIFNLEQGEQPCMLDGEISSQSYLDQGIGFETSQQGMSEEVSIQFERINLFTRDDLYSILEE

SEQ ID NO: 21243 - protein, 81 aa, Tursiops truncatus
SQELLTFKDISVDFTQEEWGQLAPAHRNLYREVMLENYGNLVSVAGYQLSKPGVISQLEKGEQPWLMEREISGGPSPDLED

SEQ ID NO: 21244 - protein, 81 aa, Enhydra lutris
MLENYHNFVSVGYPIKKPEVIFKLEEGKEPWILEEEFLYQNYPEDSRAYYVAERIQKNQDKYLPHVLFNNKKVTSKKVYAL

SEQ ID NO: 21245 - protein, 81 aa, Acinonyx jubatus
MVDFSREEWQRLDLAQKSLYRDVMLENYFNLISVGCQVPKPEVIFNLEQEEPCVLDGDISSHNCLNGDIGFKTLQQGTSKE

SEQ ID NO: 21246 - protein, 81 aa, Bison bison
MGLLDLAQRKLYQEVMLENFRNLLSVGHQSFTPDVPSQLEREEKLQMIKTAAQSCCSSGNQNLNGIETLQEVGLRYLPHEE

SEQ ID NO: 21247 - protein, 81 aa, Panthera pardus
PQESVTFKDIAVDFTQEEWALLDASQRKLYRDVMLENIGHLVSVGYQVCKSDVISQLQQGVELWREGRGFPQGVIPDMIAV

SEQ ID NO: 21248 - protein, 81 aa, Panthera pardus
MTFKDVAVEFTQWEWGQLDPAQKDLYREVMLENFKNLASLGLPVSKPHVICQLEEGEEPCVVEGEISTDWEKRPKAKESRL

SEQ ID NO: 21249 - protein, 81 aa, Macaca nemestrina
AEGSVMFSDVSIDFSQEEWDCLDPVQRDLYRDVMLENYSNLVSVGLYTPKPQVISLLEQGKEPWMVGRELTRGLCSDLESM

SEQ ID NO: 21250 - protein, 81 aa, Tursiops truncatus
MTFEDVAVELTRWEWGQLDPTQKDVYREVMLENFKNLASLGFPMSKPYVICRLEEGEEPCILEREISTGAPADWERRHQAK

SEQ ID NO: 21251 - protein, 81 aa, Acinonyx jubatus
MEEWALLDPSQKKLYRDVMQETFRNLASIVCISEEKWEVYDSEDQDENHGTHLISQMVGRLCKCKECSQYEGIFGQIPNQN

SEQ ID NO: 21252 - protein, 81 aa, Tursiops truncatus
MTEEFATLEDVAMDFTLEDWEQLGLDQGDLFWDTALDNYQNLFLLNSPRPNLTSHPDDGEELAALAKGSPESTGPDTAEAK

SEQ ID NO: 21253 - protein, 81 aa, Acinonyx jubatus
FQDFVSFNDVSVNFTEEEWRELDPVQRVLYRDVMLENYRNLVSLGFPFSKPDIISQLEQAVNPWMQEGEVLRGSCTHLETR

SEQ ID NO: 21254 - protein, 81 aa, Sus scrofa
GWVPALFDEVAIYFSDEEWEVLTEQQKALYREVMRMNYETVLSLEFPFPKPDMITRLEGEEESQNSDEWQLQGGTFAENEE

SEQ ID NO: 21255 - protein, 81 aa, Sus scrofa
FQEAVTFKDVAVTFTEEELGLLDSTQRKLYRDVMLENFRNLLLVGNQPFKPELIFQLEREEMLLMLETEIQRGTKSHHSLE

SEQ ID NO: 21256 - protein, 81 aa, Leptonychotes weddellii
QESVTFKDVAVDFTLEEWGQLGPGQRELYRDVMLENYQNLLSLGVGPLGCKPDVISRLERGEEPRMEKKEARQATCPALHT

SEQ ID NO: 21257 - protein, 81 aa, Leptonychotes weddellii
AQDSVTFEDIAVYFSWEEWRLLDEAQRCLYHDVMLENFTLISSLGCCCGADDTEASFEQSTSIGVSQTTTPKAAQSSRKTH

SEQ ID NO: 21258 - protein, 81 aa, Odocoileus virginianus
NFWILRLPPGSKGEAPKEWGKLDEWQKELYKHVMRGNYETLVSLDYAISKPEVLSQIEQGKEPCSWRRTGPKVPDVPVDPS

SEQ ID NO: 21259 - protein, 81 aa, Leptonychotes weddellii
MDVMLENYCHLISVGCHMTKPDVILKLERGEEPWTSFTGHACLEENWKEEDFLVKFKEHQDKFSRSVVFINHKKLIKENSN

SEQ ID NO: 21260 - protein, 81 aa, Odocoileus virginianus
KGSVTLQDVAVEFTPEEWQLLDCDQRTLYWDVMLENFRNLISVGTGCPVTETTVIFKVEQGQEPWMVEGENSRWSSPEADC

SEQ ID NO: 21261 - protein, 81 aa, Odocoileus virginianus
SQRSLTFRDVAIDFSQEEWGFLDPAQRELYTAVMSETYQNLVWLGVSVAEPNIAFLLERGPQPWVMREEDAEAPGAESEST

SEQ ID NO: 21262 - protein, 81 aa, Phascolarctos cinereus
FQESVMFKDVAVDFTQEEWSRLDPAQRALYRDVMLENYENLVSLGLPVSKLDVISLLERGEAPWRPEGGGPRCSCPDLCIE

SEQ ID NO: 21263 - protein, 81 aa, Phascolarctos cinereus
MLDTYEVLVSLGLLGCKPAVISRLERGEAPWRPERGGHQSCCPDFCKQMESCPTEELTPEENTSVRELSTQSFAKDGIWDS

SEQ ID NO: 21264 - protein, 81 aa, Pteropus vampyrus
LVKIEDVADVAVSFILEEWGHLDQSQKALYRDDRKENYESITSMDYESRNDNMELIVKQISDEAESHWMTSGSTERNVPQS

SEQ ID NO: 21265 - protein, 81 aa, Phascolarctos cinereus
TPEGPVTFQDVAVVFTREEWHYLDPSQKELYRDVMLENYSNLLYLGLVISKPDVIHQFEQEAPWRPDRRVPGSVCPAEETG

SEQ ID NO: 21266 - protein, 81 aa, Odocoileus virginianus
SKAPVTFGDLAIYFSQEEWEWLSPIQKDLYEDVMLENYQNLVSLGLCFRRPNVITLLEKGKAPWMVDPVKRRRGLDLGSKG

SEQ ID NO: 21267 - protein, 81 aa, Odocoileus virginianus
FQEALTFKDVAVTFTEEELGLLDLAQRKLYRDVMLENFRNLLSVGHQSSKPDMISQLEREEKLWTTGIQPQRGGRSGGRNH

SEQ ID NO: 21268 - protein, 81 aa, Leptonychotes weddellii
MFKETVTFKDVAVAFTEEELGLLDSAQRKLYQDVMLENFRNLVSVGHQPFKRDQWHIEREERLWLMKTAAQIERNVGGNNQ

SEQ ID NO: 21269 - protein, 81 aa, Phascolarctos cinereus
HQGAVSFKDVAVVFTWEEWGRLHPAQQDLYREVMLDTYEVLVSLGLLGCKPAVISRLERGEAPWRPERGGHQSCCPDFCKQ

SEQ ID NO: 21270 - protein, 81 aa, Pteropus vampyrus
MAEALTQWGQRHPPRGHMQEKHRNLVLLGLPISKPGVISQVEHGEELERKVPKATSPDWETRPESKELTPEQDVSEEESTP

SEQ ID NO: 21271 - protein, 81 aa, Bos indicus
QEGVNFKIVTVDFTQEEEGTLSSAQRTLDRDVILENHGDSWDAATALGRRESRLKQSVFDDKLSHSVKIEKLTRDDPWLSS

SEQ ID NO: 21272 - protein, 81 aa, Pteropus vampyrus
MDFTLEDWEQLGLDQGDVFWDTALDNYQNLFLLNPPGSDLPSPPDVAEEPEALVRGSPEATGPDIAEAKNCSPLQDFLEEG

SEQ ID NO: 21273 - protein, 81 aa, Pteropus vampyrus
MMKSQEEWQQLDPAQRTLYRDVMLENFSHLVSMGHPVSKPDVISKLEQGEDPWIIKRNISNWIYPDRKSNLDNPQSCILGS

SEQ ID NO: 21274 - protein, 81 aa, Pteropus vampyrus
FQWLLTFRDVAVDFSQEEWDYLNPAQRDLYRDVMMENYSNLVLLGLSISKPDVISLLEQGKEPWMISRNMAGGWCPDLEFR

SEQ ID NO: 21275 - protein, 81 aa, Physeter macrocephalus
PVLFEDLAVYFSQEECVSLHPAQRSRSRDTPQECLEDMALMGGEGKIEINQKLRLESMGLEELALEKYSIAVPLVYYPEKS

SEQ ID NO: 21276 - protein, 81 aa, Trichechus manatus
PHWLVTFRDVAIDFSQEEWEYLNPAQRELYRDVMLENYSNLLSLAGCSVPKPDVSSLLEQGKDPWMMVIAMTRRRSSDFES

SEQ ID NO: 21277 - protein, 81 aa, Trichechus manatus
SVVFEDVAVNFTQEEWALLNFAQRKFYRDVMMETFRNLASVVSQQVDKGQMVSTDHLIMRFIKNNFRYTMLGEACEFHGVK

SEQ ID NO: 21278 - protein, 81 aa, Capra hircus
QERLTSEDVAIKFTQEEWEFLDPAQRALYRDVMLETYRNLLSVDIPPTHVIKHLQPTANSDKLETFQTLMLGSPESCEIKL

SEQ ID NO: 21279 - protein, 81 aa, Panthera pardus
MLENYSHLVSVGQLVPKPDVVIRLGQGGEARTAEGETPTRNPPEFWQVHDQMDNHKESQDQRLWPTAFVDQETQKDQSGQE

SEQ ID NO: 21280 - protein, 81 aa, Panthera pardus
SLGLVSFEDVAVNFTWEEWQDLDDAQRTLYRVVMLETYSSLVSLGHCIPKPEVIVKLEQGAEPWTVEEPLEQSLPDVQTAG

SEQ ID NO: 21281 - protein, 81 aa, Capra hircus
SQGRLTFQDVALDFTQEEWECLDLSQRELYRDVMLENYRNLASLAGLVVSKPDLVTFLEQMKTPWDVRRLAMPAIYTAVSS

SEQ ID NO: 21282 - protein, 81 aa, Acinonyx jubatus
LPHSVTFEDVAVEFTPEEWALLDPCQRTLYRDVMQENRRNLASLGNQVGKPGVVSKLEQKDNVVTKETGILPGSFPDLETL

SEQ ID NO: 21283 - protein, 81 aa, Vicugna pacos
PQGLMTFEDVAVNFTQEEWQYLNPPQKTLYRDVMLETYSHLVSVAGQQITKPDLILKLEVEEPCLTEGKIPVWSFPEEAFQ

SEQ ID NO: 21284 - protein, 81 aa, Odocoileus virginianus
AQGSVMFTDVSIDFSQEEWEFLNPDQRDLYRDVMLENYSNLVSMGLYIPKPQVISLLEQGKEPWMIGRELTRGLCSALESM

SEQ ID NO: 21285 - protein, 81 aa, Neophocaena asiaeorientalis
SQGSVTFRDVAVDFSREEWEWLQPAQRDLYRHVMLENYGHLVSLAGLNISKPHVVSLLEQGKEPWLGKDASRGLFSASESN

SEQ ID NO: 21286 - protein, 81 aa, Pteropus vampyrus
GVRESVTFEDVAVGLVQEWALLDGARRNLCRYGILDNCSTLAPRGAPPCKPKLVSHVGPRGELSTAGQGILCAMGVDWESQ

SEQ ID NO: 21287 - protein, 81 aa, Pteropus vampyrus
PVTFEDMAMYLTREEWRPLDPTQRDIYRDVMQENYGNVVSLDFEIRSENEVNPKQEISENVEFGTTSERPVGNTEENPESE

SEQ ID NO: 21288 - protein, 81 aa, Pteropus vampyrus
CEVSVSFEDVTVEFSREEWQQLNSTQRHLYQEVMLENYSHLLSVGYEIPKPEVIFKLEQGEEPWVLERETPHQSCSDGKFG

SEQ ID NO: 21289 - protein, 81 aa, Physeter macrocephalus
FRGSVMFRDVSINFSQEEWECLDSSQMNLYKEVMLENFSNLVSVGLSSSKPTVISLLEQGKEPWMVDRELTRGLCSDLESM

SEQ ID NO: 21290 - protein, 81 aa, Trichechus manatus
ARESVVFSDVSIAFSQEEWAHLDLEQKDLYRDVMLENYSNLVSLAGCFVSKPDVISLLEQGKEPWKIVRKGRRRYPDLETR

SEQ ID NO: 21291 - protein, 81 aa, Trichechus manatus
MDSVVFEDVTVEFTQEEWALLDFSQRKLYTDVMMDTLRNLDSVFQQDNNGQMSTKNDSWSSMLGEICEFHGIEHPHNNQGK

SEQ ID NO: 21292 - protein, 81 aa, Panthera pardus
WSQDSVTFEEVAVDFSQEEWALLDPTQKILYRDVMLENYRNLASVGYPLCKHSLITEVGQEALSTEERGMLQGTCIGLDIQ

SEQ ID NO: 21293 - protein, 81 aa, Macaca nemestrina
PKVPVSFEDVSVYFTKTEWKLLDLRQKVLYKRVMLENYSHLVSLGFSFSKPHLISQLERGEAPWVADIPRTWTTAGLHIGD

SEQ ID NO: 21294 - protein, 81 aa, Acinonyx jubatus
SQGLVTFEDVAVYFSLEEWERLDTGERDLYKDVMQENYGILVSLGYPIPKPDLIFRLEQGEEPWVPDSPRPEEGDIVTGVY

SEQ ID NO: 21295 - protein, 81 aa, Tursiops truncatus
MGSVTFQDVAVDFTLEEWQLLGYSQRKLYWDVMLENFRNLISVGCPVTKTKVIFKVEQGQEPWMVEGENPRWRSPEVICLL

SEQ ID NO: 21296 - protein, 81 aa, Tursiops truncatus
SQGLVTFEDVAVYFSLEEWERLDADQRELYKEVMQENYGILVSLGYPIPKPDLIFRLEQGEEPWVPDSPRPEEGDIVTGVY

SEQ ID NO: 21297 - protein, 81 aa, Tursiops truncatus
WKGLLSFEDVALYFTREEWDTLDWAQKDLYRDVMLDNYRNVLSLVGVQFPKPEVICQLEQWEEPWILDLPRAGTRKASGSA

SEQ ID NO: 21298 - protein, 81 aa, Sus scrofa
MTEEFVTLQDVAMDFTLEDWEQLRLDQSNLFWDTALDNYQSLFLLNPPRPNVTSRPDGGKELEALAKGSPESTAPDTAETK

SEQ ID NO: 21299 - protein, 81 aa, Cercocebus atys
MGLLTFRDVAIEFSLEEWQRLDAAQQNLYRNVMLENYRNLAFLGIAVSKPDLITCLEQGKEPWNMTRHEMVDEPPDICPHF

SEQ ID NO: 21300 - protein, 81 aa, Sus scrofa
FKEAVTFKDVAVAFTEEELGLLDSAQRKLYQEVMVENFRNLVSVGENSQNQSELRAIQDRGSHEELSCWQIWQQIADDLTR

SEQ ID NO: 21301 - protein, 81 aa, Sus scrofa
SQGLLTVEDVAIDFSPEEWECLDLGQRHLYRDVMLEICTHLVSLALSSHDTQGLMPPNPGMELFLQTALLGEFESSPVGTF

SEQ ID NO: 21302 - protein, 81 aa, Vicugna pacos
PVTFEDMAMYLTREEWRPLDPTQRDLYRDVMQENYGNVVSLDFEIRSDNEVNPKQEISEDVEFGTASERPVGNTAENPESE

SEQ ID NO: 21303 - protein, 81 aa, Bos indicus
SQGLLTFEEVAIYFSQEEWELLNPTQKALYNDVMHENYETVISLALFVLPKPKVIYLEQGEEPYIQGSPMFKDNPGELLSE

SEQ ID NO: 21304 - protein, 81 aa, Bos indicus x Bos taurus
MIENYRNLACLGLVVSKPDLVTFLEQMKDLRNIRRMETIGIYPAISPQDTQDLMPKKPRVEDLFPKANLGIYERFHLRNLE

SEQ ID NO: 21305 - protein, 81 aa, Neophocaena asiaeorientalis
PEGGVTFEDIALYFSWEEWKLLDEAQRRLYHDVMLENFALISSLGVCSGEENVEASFEQSVSVVMSQVRTSKEPSSSQKTH

SEQ ID NO: 21306 - protein, 81 aa, Phascolarctos cinereus
QQASMMFEDIAVYLTQEEWGLLDPVQRDLYRNVMMENYGNIVSVGFLVPKPDMISRLEQGQEPWVLDEQEAKGREAWRADC

SEQ ID NO: 21307 - protein, 81 aa, Pteropus vampyrus
MAVTFEDVTVIFTWEEWTFLDFSQKKLYREVMWENYTNVMSVGNWKESYKSPKERFRYLEHENLSCWPGWKNASTQLFENR

SEQ ID NO: 21308 - protein, 81 aa, Pteropus vampyrus
WKESVTFKDVTVDFTQEEWKQLDPVQRDLFRDVTLENYTHLVSIGLQVSKPDVISQLEQGTEPWIVEPGMPVGGFGDWATR

SEQ ID NO: 21309 - protein, 81 aa, Pteropus vampyrus
AQGLVTFRDVAVEFSQEEWKCLEPTQRDLYKDVTLENFGNLVSLGLSISKPDVISLLEQGKEPWMIANDITGPWGSDLESR

SEQ ID NO: 21310 - protein, 81 aa, Bos indicus
HLTFKDVAIEFSQEEWEALHPAQRALYRDVMLETYRNLLSVAVCHIHVIKKLKPKANSDTGVFQRVMLGRYKSQEVRDFYF

SEQ ID NO: 21311 - protein, 81 aa, Pongo abelii
FQESVTFKDVIVDFTQEEWKQLDPGQRDLFRDVTLENYTHLVSIGLQVSKPDVISQLEQGTEPWIMEPSIPVGTFADWETR

SEQ ID NO: 21312 - protein, 81 aa, Pteropus vampyrus
AQESLTFDDVAVDFTWEEWRLLAPAQKDLYRDVMSENYSNLVSLGCQARKPDTLSRLDQGEPPWTLADRVYSRTRSGIRKV

SEQ ID NO: 21313 - protein, 81 aa, Trichechus manatus
AQDSLTFSDVAVEFTWEEWQLLDPAQKDLYRDVMLENFSNLVTVGYQASKQDALSMLERGEELWTIEDETHCQTHSEIGKV

SEQ ID NO: 21314 - protein, 81 aa, Trichechus manatus
DQASLTFSDVAVEFTWQEWQLLDPAQKDLYWDVMLENYGNLVSMGYEVSKPDALSRLERGEQPWTVLDESHSRTFSEIWIF

SEQ ID NO: 21315 - protein, 81 aa, Sus scrofa
RSQESLTFQDVAVDFTREEWDQLYPAQKNLYRDVMLENYRNLVALGHQLYKPEVITQLEQEEQRMMGRGSLLDTHSDGENR

SEQ ID NO: 21316 - protein, 81 aa, Sus scrofa
NFWILRLPPGSKGEAPKEWGKLDEWQKELYKHVMRGNYETLVSLDYAISKPDILSRMERGEEPCPEGAWGREEGRQSEEAR

SEQ ID NO: 21317 - protein, 81 aa, Ursus arctos
SYGSLSFEDVTVGFTQEEWQHLDPAQRSLYRDVMLENYSHLVSLGCCIPKPEVILKLEQGEQPWILEEESPSQSYPEVCKV

SEQ ID NO: 21318 - protein, 81 aa, Sus scrofa
AQGTLTLEDVAVDFTWEEWQLLTPAQKDLFRDVTLENYHNLVAVGYQASKADIHSRLDQGEQPGATEADTHSRTQSEIWKV

SEQ ID NO: 21319 - protein, 81 aa, Vicugna pacos
AHDLVMFRDVTVDFSQEEWECLNSNQRNLYRDVILENYSNFVSLGGCSISKPDVITLLEQGKEPWKVVRDEKRRWSLDLES

SEQ ID NO: 21320 - protein, 81 aa, Vicugna pacos
SQGLVTFKDVALDFSQEEWEWLDSSQKDLYRDVMLENYRNLVWLGLSISKPNMISLLEQGKEPWLVEREMSDGQYADWESW

SEQ ID NO: 21321 - protein, 81 aa, Neophocaena asiaeorientalis
SLDSVSFTDIAIDFSQDEWECLNLAQRTLYKKVMLENYRNLASLGLCISKPDVISLLEQDKEPWMMKGEITRRLPTDLEYV

SEQ ID NO: 21322 - protein, 81 aa, Odocoileus virginianus
RLTSEDVAIEFTQEEWKFLDPAQRALYRDVMLETYRNLLSVDISPIHVIKHLQPKANSDKQEPFQTLMLGRPESCEIKHFH

SEQ ID NO: 21323 - protein, 81 aa, Neophocaena asiaeorientalis
QGHVVFEDVAVSFSQEEWGLLNNAQRLLYCDVMLENLSLIASLGCWCAVGTEEAASEQCVSVQLVTQDRNPNPDPSILKTL

SEQ ID NO: 21324 - protein, 81 aa, Odocoileus virginianus
WKGLLSFEDVALYFTREEWDTLDWAQKALYRDVMLDNYRHIISLGFQFPKPEVICQLEQWEEPWILDLPRAGTRKASGSAC

SEQ ID NO: 21325 - protein, 81 aa, Phascolarctos cinereus
ARSHESVTFKDVAMDFTPEEWGQLDPAQRDVMLENYKNLVSLWLPVSKPDGSSNFDQGENQWMMERKVPRGTHPDQLRKVE

SEQ ID NO: 21326 - protein, 81 aa, Phascolarctos cinereus
MDFTPEEWGQLDPAQRDVMLENYKNLVSLWLPVSKPDGSSNFDQGENQWMMERKVPRGTHPDQLRKVEAHCLNCRDKLKLN

SEQ ID NO: 21327 - protein, 81 aa, Pteropus vampyrus
SQEPVSFLDVAVDFTQEEWQQLDPVQRTTYRDVMLENYSHLVALGYDSAKPNVIVKLEQGEEPWVAEGDLPCRSRPEEVWQ

SEQ ID NO: 21328 - protein, 81 aa, Pteropus vampyrus
SQHLVTFEDVAVNFTQEEWTLLDQTQRDLYRDVMLENYKNLITLAGYESCKPSVSSGLERAGELKTATGGVWQELDLQLKT

SEQ ID NO: 21329 - protein, 81 aa, Panthera pardus
MLENYSNLVTVGYQVTKPDVIFKLEQEEDPWVVEEEMLGRHCPEVWEVDEQQIKKQQEALVRKVTSISKKTLIKENVIECK

SEQ ID NO: 21330 - protein, 81 aa, Panthera pardus
TARSQASVTFKDVAMDFTPEEWGKLDPAQREVMLENYRNLVSLWLPVSKSENYNLESGKEPLMLERKAPKSSYSGLLQTFH

SEQ ID NO: 21331 - protein, 81 aa, Sus scrofa
PQDLVTFKDVAVDFSQEEWKWLNPAQRNLYRSMMLENYQSLVSLDWESIYETQELPLKQFVCDDVLMERITTCGLKCSTFG

SEQ ID NO: 21332 - protein, 81 aa, Ursus arctos
FQDSVTFEDVAVCFSGGEWQCLTRAQRHLYADVMLENYGNMISVGFAVPKPPLISHLEQGAEPFIQDLQDWGFLTCSFPVS

SEQ ID NO: 21333 - protein, 81 aa, Ursus arctos
SQELVTFEDVAVYFIRKEWKRLEPAQRDLYRDVMLENYGNVFSLDGETRPEHGQELSEDTGSHGVLLGRFQKDISQGLKFE

SEQ ID NO: 21334 - protein, 81 aa, Leptonychotes weddellii
MQRALYLEVMLENYANITSLAALPFPKPDLILQLEQGEAPWDLDPWTPLEGEALEGVHTGGKNKTESEEQSPRLNISKDSA

SEQ ID NO: 21335 - protein, 81 aa, Vicugna pacos
DEALMGFRDVAVAFTQKEWKLLSLAQRILYRDVMLENYSHMVSLGIAFPKPKLITQLEQGDEPWREESEYLPDLCPAEPRT

SEQ ID NO: 21336 - protein, 81 aa, Odocoileus virginianus
SEGSITFEDVAVYFSWEEWVLLDEAQKLLYCNVMLENFALMASLGYWHGGEDEEAPSGQSVSVEGMSQILMIFKYLAMTFT

SEQ ID NO: 21337 - protein, 81 aa, Bos indicus
SEDPVTFEEVSVDFSQEEWAQLAPAEKILYQDVMLENYRNLTSVGYHLRKPRLLTQEELRTAKRRLLQDACAGEPWGKGAP

SEQ ID NO: 21338 - protein, 81 aa, Pteropus vampyrus
RSQESLTFQDVAVDFTREEWDQLYPAQKKLYRDVMLENYRNLVTLGHQLYKPKVITQLEQEEQWMMERDSPLDIHPDGENK

SEQ ID NO: 21339 - protein, 81 aa, Pteropus vampyrus
SQESVTFQDVAVDFTEKEWPLLDSSQRKLYKDVMLENYSNLASVGCQVSKPSLISHLEQEEELRTEERECHRSTCPDWETP

SEQ ID NO: 21340 - protein, 81 aa, Bison bison
MDSVVFEDVAVNFTLEEWELLDPAQRKLYRDVMLETCRNLATVGSCPQVKVSVSSPQWDILETGLCIEREVVRLTRNDSRS

SEQ ID NO: 21341 - protein, 81 aa, Tursiops truncatus
QGHVIFEDVAVSFSQEEWDLLNDAQRLLYCDVMLENLSLIASLGCWCAVGTEEAASEQCVSVELVTQDRNPNPDRSILKTL

SEQ ID NO: 21342 - protein, 81 aa, Vicugna pacos
FQESVTFKDVIVDFTREEWKQLDPVQRDLFRDVTLENYTHLVSIGLQVSKPDVISQLEQGTEPWIVEPSIPVGTFGDWETR

SEQ ID NO: 21343 - protein, 81 aa, Neophocaena asiaeorientalis
SQGLVSFKDVAVDFTQEEWQQLDPAQKTLYRDVMLENYSHLVSMGHPVSKPDVIFKLEQGEDPWIIKRDIPNWIYPYEDQA

SEQ ID NO: 21344 - protein, 81 aa, Odocoileus virginianus
MVQNYENLVSLAGLSVPKPYVIALLEDGKEPWMVEEKLSKDMVPDCKSRWENKELSKKEDIYDEDLPQMVIKEKTIQQNLE

SEQ ID NO: 21345 - protein, 81 aa, Muntiacus reevesi
HFKEAVTFMDVAVTFTEEELGLLDLAQKKLYQDVMLENFRNLVSVGCHPFRHDIFHLEKEKRLWVVKTATQSEGKSGNQNL

SEQ ID NO: 21346 - protein, 81 aa, Phascolarctos cinereus
MPVTFEDVAVYFSQEEWAILDQQQKELYQDVMRGTYELVTSLGYPAAKPEVICKIEQEEEPWMRDSQNHRRHLNRHWGSRN

SEQ ID NO: 21347 - protein, 81 aa, Phascolarctos cinereus
PKALVTFVDVAVNLTQEEWHLLGPDQRSLYRDVMLENYGNIVSLGFQVTKPDVISQLERGEEPWVLDTQGAEEKKVLRGDC

SEQ ID NO: 21348 - protein, 81 aa, Pongo abelii
LGPVTFEDVAVLFNEAEWKRLSLEQRNLYKEVMLENLRNLVSLAESKPEVHTCPSCPLAFGSQQFLSQDELHNHPIPGFHA

SEQ ID NO: 21349 - protein, 81 aa, Pongo abelii
HLTFMDVAIEFSQEEWKSLDPGQRALYRDVMLENYRNLVSLGRSCILGSNAENKPIKNQLGLTLDSHLSELQLFQAGRKMY

SEQ ID NO: 21350 - protein, 81 aa, Pteropus vampyrus
GWVPALFDEVAIYFSDEEWDVLTEPQRALYREVMRMNYDTVLSLEFPFPKPDVISRLEGEGEAQDCDGWQLPGGTFPENED

SEQ ID NO: 21351 - protein, 81 aa, Pteropus vampyrus
PKVPVTFDDISIYFSTPEWEKLEEWQKELYKNIMKGNYESLISMDYAMNQPDVLSQIQPEGEHNTEDQTGPQESEIPTDPS

SEQ ID NO: 21352 - protein, 81 aa, Pteropus vampyrus
HVAFEDVAIHFSQEEWGLLDEAQRLLYHDVMMENVALLSSVGCWHRAQDEEVPSDQGDSVEESQVRTPKPDPSTQKAEPHE

SEQ ID NO: 21353 - protein, 81 aa, Physeter macrocephalus
MLENYSHLISVGFCIPKPEVILKLEQGEEPWILEEESPSQCVPELINSSRNYSRKKFDEFNKGRKWFHDNKHEGIHSEEKP

SEQ ID NO: 21354 - protein, 81 aa, Bos indicus x Bos taurus
RCQDPVTFEDVAVVFTDEEWRRLVPTQRDLYKEVMLENYKSIVSLDWETKPEIQGASEEEKSEGSLKENLGRKGPPSPKVE

SEQ ID NO: 21355 - protein, 81 aa, Pan troglodytes
KSKEAVTFKDVAVVFSEEELQLLDLAQRKLYQDVMLENFRNVVSVGHQSTPDGLPQLEREEKLWVMKMATQRDNSSGAKNL

SEQ ID NO: 21356 - protein, 81 aa, Panthera pardus
MLENYSHLVSLAGLNISKPYVVSLLEQGKEPWLEKRGVRRDLFSEPNREVKEFSRKNVIYEDDSPQCFVVGRILSHGPEYS

SEQ ID NO: 21357 - protein, 81 aa, Panthera pardus
RSQESLTFQDVAVDFTREEWDQLYPAQKNLYRDVMLENYRNLVALGHQLYKPEVICQLEQEEQWMMERGSSGDIRAGGENR

SEQ ID NO: 21358 - protein, 81 aa, Capra hircus
RLTSEDVAIEFTQEEWEFLNAAQRALYRDVMLETYRNLLSVDLSPTHVIKHLQPKATSDKRETFQTLMLGSPESCEIECFN

SEQ ID NO: 21359 - protein, 81 aa, Panthera pardus
MLENYQNLITLAGYKSCKPDLSSALEGAELLRTGGRGVLQDLRPSEVDRDSLEREADGHNGATQDHHRSLSGSGYNSPNEH

SEQ ID NO: 21360 - protein, 81 aa, Tursiops truncatus
SQLSVTFEDVAVLFTRDEWRKLAPSQRNLYQDVMLENYSNLVSLGLLFSKPAVISLLQQGEDPWKVEKESPGGSSVGCKSS

SEQ ID NO: 21361 - protein, 81 aa, Tursiops truncatus
MVKSQISFEDVAVDFTLEEWQLLNPTQKTLYRDVMLENYSNLVFLGYQMIKPEAIFKLEQEEPWILGEEILSQNFPEEVWL

SEQ ID NO: 21362 - protein, 81 aa, Acinonyx jubatus
MLENYCHLISVGFHMTKPDMIRKLEQGEELWTTERIFPSQSYLEEDGKAEDVLVKFKEYQDRHSRSVIFNHKRLIKERSNI

SEQ ID NO: 21363 - protein, 81 aa, Tursiops truncatus
LQNSITFEDVAVDFTQEEWALLNSSQRKLHRDVMLENYRNLVSLGHQLSKPPLITQMEQEDEMDIVERRIHQDTCSDELIL

SEQ ID NO: 21364 - protein, 81 aa, Cercocebus atys
KSKEPVTFKDVAVVFSEEELRLLNLAQRKLYRDVMLENFRNVVSVGHQSTPDGLTQLEREEKLWMMKMATQRDNSSGGKNL

SEQ ID NO: 21365 - protein, 81 aa, Sus scrofa
VMFRDVAIDFSQEEWEYLDSAQRDLYRDVMLENYSNFVSLDLPSRGTNKDLSPKKDTSETELSQWEMSARLDNCNLEESSS

SEQ ID NO: 21366 - protein, 81 aa, Ursus arctos
SRGPLSFVDVCVDFTWEEWRLLEPAQKHLYRSVMLENYSHLVSLGYQDSKPDIIFRLEQGEELWMMQAQIPRQAPPEEVWE

SEQ ID NO: 21367 - protein, 81 aa, Leptonychotes weddellii
MAEGFTFKDVAIYFSQKEWECLHSAQKDLYRDVMLENYNNLISLGLSDSKPDVISLLEQGKEPWVVKSQETKEWCPDWESR

SEQ ID NO: 21368 - protein, 81 aa, Vicugna pacos
SQHLVTFEDVAVNFTQEEWTLLDQTQRDLYRDVMLENYQNLMALAGSESCKPHVNSPLEGAEELRTRARRILQSEFMAESD

SEQ ID NO: 21369 - protein, 81 aa, Phascolarctos cinereus
PQELVTFEDVAVYLSKEEWGLLDPAQRRLYRDVMLENYGNVASLGLPVSKPDLISQLERTDLPLVPRLPQTEIEDLFDEKL

SEQ ID NO: 21370 - protein, 81 aa, Phascolarctos cinereus
PQELVTFEDVAVYLTKEEWGQLGPAQRKLYRDVMLENYENVISLAGFPVSKPDLISQLERGEVPCLPDVPRTEVPETHGAK

SEQ ID NO: 21371 - protein, 81 aa, Phascolarctos cinereus
MLENYRNLVSLGFAVSKPDVIYHLERKEASWMPKADVPRNSCPESREFSQDKPLDCNEYDYQKAFRNKKHCAVYQRLHTGD

SEQ ID NO: 21372 - protein, 81 aa, Neomonachus schauinslandi
SVGPVSFRDVAVDFTQEEWQQLEPEQKTTYRDVMLENYSHLVSVGCHIIKPEVIIKLEQGEEPWIVEGAFLPQGYPEEVWK

SEQ ID NO: 21373 - protein, 81 aa, Phascolarctos cinereus
GKESVTFKDVAVEFTSEEWVQLNPTQKKLYRDVMLENYRNLVSLGFAVSKPDVIYHLERKEASWMPKADVPRNSCPESREF

SEQ ID NO: 21374 - protein, 81 aa, Phascolarctos cinereus
SPPSPSFSSTLHLDPPPPMPVTFTDMAVYFGDVMWESYRNLISLGFPIPKPELITHLEQGAEPWGLGSQESEERGVPKDPY

SEQ ID NO: 21375 - protein, 81 aa, Pteropus vampyrus
AVTFKDVAVAFTEEELGLLDSAQRKLYQDVMLENFRNLVSVGDNSHSELRTVRDRGPHEELSCWEIWQQIANDLTRCRDSM

SEQ ID NO: 21376 - protein, 81 aa, Pteropus vampyrus
SQGSVTFRDVAIDFSREEWEWLRPAQRDLYRQVMLENYGHLVSLAGLNFSKPDLVSFLEQGKEPWLGRGNVRRDLCSVSES

SEQ ID NO: 21377 - protein, 81 aa, Physeter macrocephalus
AHGSVMFSDVSIDFSQEEWDYLDLEQRDLYRDVMLENYSNLVSLGCFVSKPDVISLLEQGKEPWKVVRKERRRYSDLETNY

SEQ ID NO: 21378 - protein, 81 aa, Papio anubis
MGLLTFRDVAIEFSLEEWQRLDTAQQNLYRNVMLENYRNLAFLGIAVSKPDLITCLEQGKEPWNMKRHEMVDKPPAICPHF

SEQ ID NO: 21379 - protein, 81 aa, Sapajus apella
SKGSVMFRDVSIDFSQEEWEYLDSGQMNLYKEVMLENFSNLVSVGLSSSKPAVISLLEQGREPWLVDRELTRGLCSDLESM

SEQ ID NO: 21380 - protein, 81 aa, Zalophus californianus
PQVLVSFEDVAVFLSQEEWGCLGPAQRGLYSNVMLETYRNLISLGLQDSKPDVISRLEKGEEPWAPYSSRIEEGWIRSHRS

SEQ ID NO: 21381 - protein, 81 aa, Sapajus apella
MLETYGNLVSLGVGPAGPKPGVISQLERGDEPWVLDVQGTSGREYLRVNSPAVGTSTEYKELTSWETFDEEELGQLKGIFP

SEQ ID NO: 21382 - protein, 81 aa, Sapajus apella
QEGVNFKIVTVDFTQEEQGTWNPAQRSLDGDIILESHRDLVSWDLATAVGKEDSTSKQNIFDEEPANGVKTECFTRNDPWL

SEQ ID NO: 21383 - protein, 81 aa, Sapajus apella
MLENYRNLVALGHQLYKPEVITQLELEEEWVIEGDSLLDTCPDGENRPEIKKSTTSQNISDEHQTQEMIMERLTGDSFWYS

SEQ ID NO: 21384 - protein, 81 aa, Delphinapterus leucas
GRVPLTFSDVAIDFSQEEWECLNSDQRNLYRDVMLENYTNLISLDIDFTSESNKLSSEESSYEVNSYHWETMNRSKTFNFM

SEQ ID NO: 21385 - protein, 81 aa, Bos taurus
GPTFSDKGGLGDEMLAAALLKAKAQELVTFEDVAVYFIRKEWKRLEPAQRDLYRDVMLENYGNVFSLGFPFLNFDVISGLD

SEQ ID NO: 21386 - protein, 81 aa, Bison bison
VKKPVTFEDVAVNFTQEEWKCLDVSQRVLYQDVISETVRNLMSVDGIFLSNLDLIAKLEQEEKQWEADLCSPNGEGFHSGG

SEQ ID NO: 21387 - protein, 81 aa, Ursus arctos
PQGLVTFEDVAVDFTPEEWQYLNPPQKTLYREVMLETYSNVVSVAGPQATKPDLVLKLEVEEPCPAETKISFWSFPEAACQ

SEQ ID NO: 21388 - protein, 81 aa, Ursus arctos
CEGSLSFEDVTMDFSREEWQQLDPAQRRLYQDVMGEVYSHLLSLGYHIPNPEIISRMEKGEKLWLREAQLPHQRHGEGVFG

SEQ ID NO: 21389 - protein, 81 aa, Ursus arctos
MGVAEPCSEESVQKGVSVSKPDVISLLEQGKEPWMVKKEGTRGTCPDWEYTLKKNEFSSKQVIYEETSKLVIMGRSHLSHS

SEQ ID NO: 21390 - protein, 81 aa, Vicugna pacos
SQGPVSFKDVAVDFTQEEWQQLDSNEKTTYRDVMLENYSHLVSVGYDSTKPNVIVKLEQGEEPWTAAGELPRQAHPEEVWK

SEQ ID NO: 21391 - protein, 81 aa, Phascolarctos cinereus
YQESLTFSDVAVDFTQKEWDHLDLSQKKLYRDVMLENYRNLVYLGLAVSKPDLICHLEQGKAPWIHKKEIPKITCTGWESR

SEQ ID NO: 21392 - protein, 81 aa, Phascolarctos cinereus
MYRDVMLENYENFISLGLPVSKLDVISHLEKREAPWLLGGKVLQSPQLDSLVLQTRYETKESITEQLVSIEKLPKEKLTKD

SEQ ID NO: 21393 - protein, 81 aa, Neomonachus schauinslandi
KSLGSVSFKDVTVDFSREEWQQLDLAQKSLYRDVMLENYFNLMSVGCQVPKAEVIFSLEREEPCLLDGEISSHSCLDGDIG

SEQ ID NO: 21394 - protein, 81 aa, Pongo abelii
FEELVTFEDVFVDFSPEELSSLSAAQRNLYREVMLENYWNLVSLGYQFSKPDIISRLEEEESRAMETDSRHTVICQRESHD

SEQ ID NO: 21395 - protein, 81 aa, Pongo abelii
FVAFEDVAIYFSQEEWELLDEMQRLLYRDVMLENFAVMASLGCWCGAEDEGAPSADSISVEELSQGRTPKADTSTDKSHPC

SEQ ID NO: 21396 - protein, 81 aa, Pongo abelii
PQGLLTFRDVAIEFSQEEWKCLDPAQRTLYRDVMLENYRNLVSLEFWSVTPAKVQWCHLGSLQPPLPRFKQFSCLSLPSSW

SEQ ID NO: 21397 - protein, 81 aa, Pteropus vampyrus
FKEEVTFKDVAVVFTEEELGLLDAAQRKLYRDVTLENFRNLVSVGHQPFPPDVIPQLEREEKVWMIKTATHSHSSSGDKDL

SEQ ID NO: 21398 - protein, 81 aa, Bos indicus
SQVSVTFEDVAVLFTRDEWRKLAPPQRNLYQDVMLENYNNLVSLGHLFPKPKVISLLQQGEDPWKVEKESPGASSLGWKNS

SEQ ID NO: 21399 - protein, 81 aa, Physeter macrocephalus
PKVPVTFDDVAVHFSEQEWGNLSEWQKELYKNVMRGNYESLVSMDYAISKPDLMSQMERGERPAMQEQEDSEEGDAPADPS

SEQ ID NO: 21400 - protein, 81 aa, Bos indicus x Bos taurus
WNVQKEISGLDGGQLTFKDVAIKFTPEAWECLNPVQRALYRDVMIETLRNMLSVVKDNLPLKFGVCPGGGSLHFLCISKPC

SEQ ID NO: 21401 - protein, 81 aa, Trichechus manatus
SPGSVSFKDVTVDFTREEWQQLDLAQKSLYRDVMLENYFNLVSVGYQISKPEVIFNLEQGEEPYMLDDGEISRRSCQDGDI

SEQ ID NO: 21402 - protein, 81 aa, Delphinapterus leucas
SQGLLTFKDVAITFSQEEWECLDPAQRALYRDVMLETYRNLLSLGEDNSSPEVGSLSAGFTIKELSPREGINKGELYHLVI

SEQ ID NO: 21403 - protein, 81 aa, Zalophus californianus
MLENYRNLVSVGYQASKPDSVFQLEQGEPPWMVEGAAQSQTCQGYPATKPDVILNFERGEESWSVEDEMQCQCISGKKRYG

SEQ ID NO: 21404 - protein, 81 aa, Balaenoptera acutorostrata
VQESVTFKDVAVLFTQDEWAQLSPAQRALYRDVMLENYSNLVYLGLLGPKPDTFSQLGKGEEWMPEDSLGGFCLDWMTTPV

SEQ ID NO: 21405 - protein, 81 aa, Balaenoptera acutorostrata
TFQEAVTFKDVAVAFTEEELGLLDSAQRKLYQDVMVENFRNLVSVEENNQSELRAVQDRGSREDLSCRQIWQQIASDLTRC

SEQ ID NO: 21406 - protein, 81 aa, Cercocebus atys
LKGLVTFEDVAVEFTQEEWALLDPAQRTLYRDVMLENFRNLASLGDQVDKPGLIAQLEQEDKVMTEERGILPGTCPDVENP

SEQ ID NO: 21407 - protein, 81 aa, Sus scrofa
MLENYFNLISVGCQVPKPEVIFNLEWGEEPCMLGGEVSSLSCVDQVIGFETLQQGKSEEDLIRFERINLFTRDDPYSILGE

SEQ ID NO: 21408 - protein, 81 aa, Vicugna pacos
QAEVTFEDVAVLLSREEWGRLGPAQKGLYRDVMLETYRNLVSLGAGPAGPKPGVIAQLERGDEPWVLDLPGAEGSKQPRVR

SEQ ID NO: 21409 - protein, 81 aa, Phascolarctos cinereus
FQQLVTFEDVAVYLSKEEWGQLDLAQRELYRDVMLENYENLLSLGFLVSKPDIISQLEQRKEAWIRDIQGPKEREFSQNAC

SEQ ID NO: 21410 - protein, 81 aa, Bos indicus x Bos taurus
AQLTFKDVAIEFTQEEWECLDAAQRALYRDVMVETLRNLVSLDISHILVIEKLQLNEKTDRGEEFQTVILGRHERNKIKDF

SEQ ID NO: 21411 - protein, 81 aa, Trichechus manatus
MDPTQRNLHKDVMLENYRNLVSLGLAVSKPDMISHLEDGKGPWVVVREISRAPYPELETKLATKDVVLTEDYSEEDLSQGT

SEQ ID NO: 21412 - protein, 81 aa, Trichechus manatus
PVVVEDVAVVFSQEEWALLNLTQRKLYRDVMIQTFRNLASVVSQNLKDGEKLSSEVIMVQYMKNNTWSSALGEISQSHGNK

SEQ ID NO: 21413 - protein, 81 aa, Trichechus manatus
SVVFEDVAVDFTQEEWALLDFAQRKLYRDVMMETFRNLASVVSQQVDKGQIVSSEHLVMRFVRNNSWYTVLGEICEFHGIE

SEQ ID NO: 21414 - protein, 81 aa, Zalophus californianus
QCGVTFEDIAVYFSWKEWRLLDEAQRRLYHHVMLENFTLISSLGCCCGAEDEAPFAQSTSVGVSQTRTPKAALSSRKTHPC

SEQ ID NO: 21415 - protein, 81 aa, Trichechus manatus
LQESVTFKDVAVDFTQEEWHHMDPAQRILYRDVMLENYSHLVSLGYQVSKPEVIFKLEQGEEPWISEEEIQRPFCPDWETP

SEQ ID NO: 21416 - protein, 81 aa, Zalophus californianus
MLENCGLLVSLGCPVPRPELIYQLEHGQELWTWKRHLSQSAYPGDKGKPKTTELSPCAPALSEGALFQELRQGDPGNFHLG

SEQ ID NO: 21417 - protein, 81 aa, Macaca mulatta
MLENYANVASLAFPFTTPVLVSQLEQGELPWGLDPWEPMGREALRGICPGDEARTEKERLTPKEHVSKETVSFRLMVGVLP

SEQ ID NO: 21418 - protein, 81 aa, Delphinapterus leucas
PLTFKDVAIEFSREEWECLDPDQKAFYVDVMLETYSNLISLDISHIHVIKKLQPRANSDRGEVFQTVMLERQKSHEMKHFY

SEQ ID NO: 21419 - protein, 81 aa, Carlito syrichta
FQGPVTLKDVIVEFTKEEWKLLTHAQRTLYKDVMLENYRHLVSVGYRVNKPNAIFKLKQGKEPWILEVEFPHQNFPEDLWD

SEQ ID NO: 21420 - protein, 81 aa, Zalophus californianus
SFGREAENDQVSPFTKEEWQQLDPAQRTLYRDVMLENFSHLVSLGHPVSKPDIISKLEQGEEPWIIKRDISDWICPERETR

SEQ ID NO: 21421 - protein, 81 aa, Saimiri boliviensis
PKVPVSFEDVSVYFTKTEWKLLDLRQKVLYKRVMLENYSHLVSLGFSFSKPHLISQLERGEGPWIADVPRTWATRGLLIGD

SEQ ID NO: 21422 - protein, 81 aa, Saimiri boliviensis
MAHLMFRDVVIDFSQEEWEGLDLKQRDLYRDVMLENYSNMVSLGLCIYQPDVFSSLEKGKEPWKILRNETRGRCPDMRSKC

SEQ ID NO: 21423 - protein, 81 aa, Ovis aries
ERLTSEDVAIEFTQEEWEFLDPAQRALYRDVMLETYRNLLSVDISPTYVIKHSEPKANSDKLETFQTLMLGNPESCEIKHF

SEQ ID NO: 21424 - protein, 81 aa, Ovis aries
RLTSEDVAIKFTQEEWEFLDPAQRALYRDVMLETYRNLLSVDISPTYVIKHLQPKANSDKQETFQTLMPGRPESCEIKHFH

SEQ ID NO: 21425 - protein, 81 aa, Callorhinus ursinus
RPIAVSFADVAVYFSPEEWGCLRPAQRALYRDVMRETYGHLGALGFAGPKPALISWLERKKEVWSPEAEDSEEGARHPGSG

SEQ ID NO: 21426 - protein, 81 aa, Panthera pardus
EGTVTFEDVAVYFSGEEWGLLEEAQRRLYQDVMLENLALVTSLGCQHGAENEEAPSEQSVSVEGVSHVRTPKAGLSPQKAS

SEQ ID NO: 21427 - protein, 81 aa, Panthera pardus
CKGFVIFRDVSIDFSQEEWECLDSTQRNLYKYVMLENYSNLVSVGLCIPKPDVISLLEQGKEPWSVFDSELTRDPYLEEET

SEQ ID NO: 21428 - protein, 81 aa, Panthera pardus
PVTFEDVAVNFTQEEWMYLDASQRALYQDVMSETVRNLMSVDLVTKLEEEQWRTELQLQPPNGEGLPSGSRKQELPEGSPS

SEQ ID NO: 21429 - protein, 81 aa, Neophocaena asiaeorientalis
MPQEEWQQLDPAQKALYRDVMLENYFHLISVGFHMTKPDMIHKLEQGKELWTTEKIFPSQSYLEEDWKAEDVLVKFKEYQD

SEQ ID NO: 21430 - protein, 81 aa, Bos indicus
MEAVTFKDVAVAFTEEELGLLDSAQRKLYQDVMVENFRNLVSVEENNQSELSAIQERGLHEELSCWQIWQQIANDLTRCQD

SEQ ID NO: 21431 - protein, 81 aa, Trichechus manatus
MKENINHLVFIGNHLCKSDVISQLEQGEELWREGVGFLQDESLVISVRESGRKKQEVISCRKNISTIMAMQRSLTEENPFE

SEQ ID NO: 21432 - protein, 81 aa, Trichechus manatus
SVVVEDVAVDFTQEEWVLLDVSQRKLYRDVMMETFRNLASVVSQNLNDGEKLSSEQIIVRLMKNSTSPSMLREIREFHGIE

SEQ ID NO: 21433 - protein, 81 aa, Bos indicus x Bos taurus
MLETCGLLVSLGHPVPKAELIHLLEYGPELWTVKRGLSRNTCTGEKANPKTTELTASQLALTEEAPFEEQVTHGTSRDSWL

SEQ ID NO: 21434 - protein, 81 aa, Trichechus manatus
GSVSFTDVTVDFTQEEWEQLDPSQRILYMDVMLENYSNLLSVEVWKADDQMERDHRNPDEQARQFLILQSQTPVEERGNLF

SEQ ID NO: 21435 - protein, 81 aa, Trichechus manatus
MLENYGHVASLGFPLLKPTMISQLEGGAELWGPLPVPTGVGTGPQGLWTDIDIQTDNNLTKEMCEEKDSTSFKLQRNFPQE

SEQ ID NO: 21436 - protein, 81 aa, Sapajus apella
KSKEAVTFKDVAVVFSDEELRLLDLTQRKLYRDVMLENFRNVVSVGHQSIPDGLPQSGREEKLWTMKTATQRGNSSGGKHL

SEQ ID NO: 21437 - protein, 81 aa, Callithrix jacchus
KPGAVSFADVAVYFSPEEWGCLRPAQRALYRDVMRETYGHLGALGFPGPKPALISWMEQESEAWSSAAQDPENGESLGGAR

SEQ ID NO: 21438 - protein, 81 aa, Zalophus californianus
RSQESLTFQDVAVNFTREEWDQLYPAQKNLYRDVMLENYRNLVALGHQLYKPEVISHLEQEEQWVMERESPLDTHTDGESR

SEQ ID NO: 21439 - protein, 81 aa, Zalophus californianus
AVTFEDVAVDFTQEEWLLLDLTQRNLYRNVMLENYQNLVAVGKAANIPEYQLSKPKLIAWLEQQELRTVEKGVFQEWETQP

SEQ ID NO: 21440 - protein, 81 aa, Sapajus apella
SQGPLTFMDVAIEFSQEEWKCLDLAQRTLYKDVMLENYRNLVSLGVGLPDLSVVSMLEQKREPWTLQSEEKIARNPDGREC

SEQ ID NO: 21441 - protein, 81 aa, Zalophus californianus
MLENYGHMASLGFLVAKPALISLLEQGEEPGALILQGTEEPGSTASLCPDSRMQAAIKESCLRRVSSKQLGPLGTVWGHLP

SEQ ID NO: 21442 - protein, 81 aa, Sapajus apella
MLENYWSLVSLGLCHFDMNIISMLEEGKEPWTVKSYLKIARKPRMRECVKGVVTDIPPKCIIKDLLPKEQSSTEAAFHTAM

SEQ ID NO: 21443 - protein, 81 aa, Cercocebus atys
MDSVVFEDVAVDFTLEEWALLDSAQRDLYRDVMLETFRNLASVDKTQFKANGSVSQQDTYREEKSKEQTIPNFTRNNSCAY

SEQ ID NO: 21444 - protein, 81 aa, Bison bison
FQEAVTFKDVAVVFTEEELGLLDSAQRKLYQDVMVENFRNLVSVGQVPFKADMVSQLETEEKLWTMERETQRNGHSSEIHS

SEQ ID NO: 21445 - protein, 81 aa, Neophocaena asiaeorientalis
SQLSVTFEDVAVLFTRDEWRKLAPSQRNLYQDVMLENYSNLVSLGLLFSKPEVISLLQQGEDPWKVEKESPGGSSLGCKSS

SEQ ID NO: 21446 - protein, 81 aa, Leptonychotes weddellii
MLENYSHLVSVGCSIPKPEVILKLEQGEEPWILEEEIPSQSDPELINNSRNYSRKKFNEFNKGRNWLHNDKYERIHSEEKP

SEQ ID NO: 21447 - protein, 81 aa, Bos indicus
MWLWTSHRAAWQQMKPAQRNLYRDVMLENYSNLVTVGCQVTKPDVIFKLEQEEEPWVVEEEMLGRHCPEVWKVDEQIKKQQ

SEQ ID NO: 21448 - protein, 81 aa, Physeter macrocephalus
SLDSVSFTDIAIDFSQDEWEWLNLAQRTLYKKVMLENYRNLTSLGLCISKPDVISLLEQDKEPWMMKGEITRGLPPDLEYV

SEQ ID NO: 21449 - protein, 81 aa, Delphinapterus leucas
SQLSVTFEDVAVLFTRDEWRKLAPSQRNLYQDVMLENYSNLVSLGLLFSKPEVISLLQQGEDPWKVEKESPGGSSVGCKSS

SEQ ID NO: 21450 - protein, 81 aa, Pan troglodytes
CEVSVSFEDVTVDFSREEWQQLDSTQRRLYQDVMLENYSHLLSVGYQVPKSEAAFKLEQGEGPWMLEGEAPHQSCSGEAIG

SEQ ID NO: 21451 - protein, 81 aa, Callithrix jacchus
EQEPVTFKDVAVDFTQEEWGQLDLVQRTLYRDVMLETYGHLLSVGNQTAKPEVISLLEQGEEPWSVEQTCPQRACPEWMRN

SEQ ID NO: 21452 - protein, 81 aa, Carlito syrichta
LKGSVSFEDVTVELTREEWRQMGPGERSLYRDMMLENYGHLVAVGCCITKPKVILKLEQREEPWSLEVKFLNQKYPGYYKI

SEQ ID NO: 21453 - protein, 81 aa, Carlito syrichta
AQESVMFSDVSIDFSQEEWEYLNDDQRDLYRDVMLENYSNLISMGHSISKPNVISFLEQGKEPWLVDRELTRGHWPVLKSR

SEQ ID NO: 21454 - protein, 81 aa, Panthera pardus
NQIAVTFDDVALDFTQEEWILLDLFQRNLYRNVMLENYQNLVTVGYQQSKPSLVARLEQEELRTVEKGVFPEWQTQHQSKE

SEQ ID NO: 21455 - protein, 81 aa, Panthera pardus
SQGTVSFKDVAVNFTQEEWQYLDLPQRDLYKDVMLENYTNLISVGYQTTKPSVIHKLEQGEEPWMVEREIPNWSYAEETWQ

SEQ ID NO: 21456 - protein, 81 aa, Tursiops truncatus
FKEVVTFKDVAVTFTEEELGLLDSTQRKLYQEVMLENFRNLVSVEGKIQSEMETVSEAGPHEELSSWQIWQHIASDFTRCQ

SEQ ID NO: 21457 - protein, 81 aa, Acinonyx jubatus
MLENYSHLVSVGCQVTKPAVISRLERGQEPWMEEEELVRWSFPEAILQVDGHAGRPREHQATLLRSGAFLDGREPTERGPR

SEQ ID NO: 21458 - protein, 81 aa, Sus scrofa
AQSLLTFEEVAIYFSQEEWELLDPTQKALYNDVMHENYETVISLALFVFPKPKVISCLEREEVPWIQGSPQFKDDSRDVLP

SEQ ID NO: 21459 - protein, 81 aa, Ursus arctos
EAVVFADVAVDFTPEEWALLDGGQRRLYRDVMLETCRNLASLVCPSQDKRSAPRPQWSVLQNELPSEEKTGLFARNDSCSV

SEQ ID NO: 21460 - protein, 81 aa, Leptonychotes weddellii
PQGSLSFGDVAVDFSQEEWQCLDPAQRTLYRDVMLENYSHLVSVGYLIKKPSVIFKLEEGKEPWILEEESLYQNYPEDSKA

SEQ ID NO: 21461 - protein, 81 aa, Leptonychotes weddellii
SQGLLSFSDVAVDFTWEEWQLLDTVQRNLYRDVMLENYSNLMSLGYQATRPEATVPLEKGEQGMLEREFPSQCSPERPLQC

SEQ ID NO: 21462 - protein, 81 aa, Neophocaena asiaeorientalis
LQELVTFQDVAVDFTQEEWEHLDPSQRHLYREVMLENYGNLISLAGRLLSKPEMISHFEQEDDVWMEKKIPRSSYSGDKPC

SEQ ID NO: 21463 - protein, 81 aa, Pteropus vampyrus
MDPALEEWRLLDEAQRLLYRDVMLEVFALAVSLGTWHGTESPSEQNGFEGESQENTSQACPWKLCGLALESDLHLADNLRT

SEQ ID NO: 21464 - protein, 81 aa, Cebus imitator
MVSFEDVAVLLSQEEWDCLIPAQRGLYRDVMLETYGNLVSLGLQASKPDVISRLEQGDEPWTTHTLRTQGSWSWRHKREGY

SEQ ID NO: 21465 - protein, 81 aa, Pteropus vampyrus
MLENYSNLVSLAGYQVSKPEVIFKLEQGEEPWLSEGEIQRPFFPDWKTRPEAKSSNLQQSISEVSFSTDELSHATLEDAWD

SEQ ID NO: 21466 - protein, 81 aa, Physeter macrocephalus
GRVPLTFSDVAIDFSQEEWECLNSDQRNLYRDVMLENYTNLISLDIDFTSESNKLSSEKSSYEVNSYHRETMNRSKTFNFM

SEQ ID NO: 21467 - protein, 81 aa, Trichechus manatus
SVMAEDVAVVFSQEEWALLDVAQRKLYRDVMMETFRNLASVVSLKFNDEEKLSSEHIVVQLMKNNTWSSMLGEVCDQLHGN

SEQ ID NO: 21468 - protein, 81 aa, Trichechus manatus
FQGSVSLKDVIVGFTQEEWQHLDPTQRSLYRDVMLENYSNLISVGYCVTKPEVIFRLEQGEEPWILEEEFPSQSFSEVWKA

SEQ ID NO: 21469 - protein, 81 aa, Pan troglodytes
GLLTFEDVAVFFTQEEWDYLDPAQRSLYKDVMMENYGNLVSLDVLNRDKDEKPTVKQEIEEIEEEVEPQGVIVTRIKSEID

SEQ ID NO: 21470 - protein, 81 aa, Panthera pardus
SQEPVTFEDVAVYFTRNQWTSLDPMQRALYREVMLENYANITSLGAFPFPKPELILQLERGEAPRGLDPWTPTGGEAPGDV

SEQ ID NO: 21471 - protein, 81 aa, Vicugna pacos
AQETVTFKDVAVDFTQEEWGQLDPVQRTLYRDVMLETYGHLLSVGNQIAKPEVISLLEQGEEPWSMERVYPPQRTCPEWMR

SEQ ID NO: 21472 - protein, 81 aa, Leptonychotes weddellii
IMKSLKFKDVAVKFSKDEWKQLVPTQRALYREVMLENYQGFVSLGVLVPKPDVIFQLKRGEEPWKLDFQEDEESEVPGSTF

SEQ ID NO: 21473 - protein, 81 aa, Neophocaena asiaeorientalis
QAQETLTFEDVAVDFTWEEWQLLAPPQKDLYRDVMLENYSNLLSVGFQARKPNVLSKLGQGEPWTMEDEIHCQTRSEIWKV

SEQ ID NO: 21474 - protein, 81 aa, Phascolarctos cinereus
NKKSVTFKDVAVDFTEDEWRQLNPTQRQLYRDVMLENYRNLIFLGFSVFTPVVISRLEGGEEPWTVEREIPGSPGADWETN

SEQ ID NO: 21475 - protein, 81 aa, Phascolarctos cinereus
LVTFQDVAVDFTQEEWGLLDHPQKELYKEVMLENAQNLLSLEREIRPEMKETTAKLSISVKETHQENFMSDGSCDFTGRQI

SEQ ID NO: 21476 - protein, 81 aa, Physeter macrocephalus
SQLSVTFEDVAVLFTRDEWRKLAPSQRNLYQDVMLENYSNLVSLGLPFSKPEVISLLQQGEDPWKVEKESPGGSSVGCKSS

SEQ ID NO: 21477 - protein, 81 aa, Pteropus vampyrus
PVTFEDVALYLSREEWGRLDHTQQSFYHDVLQKRNRLALGKGWRLHWGGSFLRPLMSEVFPSAELFGPPKFRARVRPQARA

SEQ ID NO: 21478 - protein, 81 aa, Pteropus vampyrus
SKASVTFADLAVYFSQEEWEGLSPIQKDLYEDVMLETYQNLVSVGLSCRRPSVITLLEKGKAPWTVEPARQRRGPDSGAKC

SEQ ID NO: 21479 - protein, 81 aa, Monodelphis domestica
HQESLTFRDVAVLFTWDEWRRLGPAQRSLYREVMLETFEHLVALGLPVMKPDVLSGPEKGEAPSDPQPGSLCQEQQHDIKD

SEQ ID NO: 21480 - protein, 81 aa, Physeter macrocephalus
MTEELAILKDVAMDFTLEDWEQLGLDQGDLFWDTALDNYQNLFLLNPPRPNLTSHPDDGEELASLAKGSPESTGPDTAEAK

SEQ ID NO: 21481 - protein, 81 aa, Trichechus manatus
FQESLTFKDVAVVFTEEELELLDSDQRKLYRDVMLESFRNLVSAGQQPFKSGKISHLEQDKETWVTEREAPADAYPGDKHE

SEQ ID NO: 21482 - protein, 81 aa, Trichechus manatus
SVVAEDVAVVFSKEEWALLNLTQRKLYREVMIETFRNLVSVVSQNLKDGDKLCSKHIMVRYMNSNTLFSMLGELSELYGSK

SEQ ID NO: 21483 - protein, 81 aa, Pan troglodytes
EPGAVSFADVAVYFCREEWGCLRPAQRALYRDVMRETYGHLGALGFPGPKPALISWMEQESEAWSPAAQDPEKGERLGGAR

SEQ ID NO: 21484 - protein, 81 aa, Trichechus manatus
FMKSVTFKDVAVVFNEEELELLNSFQRKLYREVMLENFRNLVSLGGKFPKEMETTSQTRQQEELFCWQIWQQIASDLTRCQ

SEQ ID NO: 21485 - protein, 81 aa, Macaca mulatta
MLENYSHLVSVGYDITKPNVIIKLEQGEEPWIMEGEFPCQHSPEVWKFDDLIERIQENEDKHSRQAACINSKTLTEEKENT

SEQ ID NO: 21486 - protein, 81 aa, Macaca mulatta
MESVTLEDVAVEFIQEWALLDSARRSLCRYGMLDQCRTLTSRGTPPCKPSRVAQLAPRAEPRATERGILHATGVAWESQLK

SEQ ID NO: 21487 - protein, 81 aa, Rhinopithecus roxellana
DSVMFDDVAVEFTPEEWVLLDTTQKYLYRDVMLENYMNLASVEWEIQPRIKRPSLQQGFLKNPIFNGIQMTRGYSGWKLCD

SEQ ID NO: 21488 - protein, 81 aa, Acinonyx jubatus
MDSVVFVDVAVNFTPEEWALLDSSQRNLYRDVMLETCKNLASVDYCIRVNTSGSSPQWDVLEDEPSHEEKIVRFARNDSWS

SEQ ID NO: 21489 - protein, 81 aa, Tursiops truncatus
LQEPVTFRDVAVDFTQEEWGQLGPAQRTLYRDVMLETFGHLLSVGPELPKPEVISQLEQGAELWVAERGIAQGRCPGWESG

SEQ ID NO: 21490 - protein, 81 aa, Ursus arctos
WKELLSFEDVAMYFTREEWNRLDWAQKDLYRDVMLENYRNMILLGFQFPKPEVICLLEQWEEPWILDLPRAGTRKASSSAC

SEQ ID NO: 21491 - protein, 81 aa, Sus scrofa
VTFEDVVVDFTQEEWGQLEPAQRTLYRDVMLETFGLLVSVDLEARPQTKLSTAKQDITEEIPSNALVKSFLWESLWHSKGE

SEQ ID NO: 21492 - protein, 81 aa, Sus scrofa
PQEPVTFEDVAVYFTQNQWASLAPVQKALYREVMLENYASVASLAFPFPKPVLISQLERGEAPWGPDPWEAEVLRGICPGG

SEQ ID NO: 21493 - protein, 81 aa, Ursus arctos
SSQGLLTFRDVAIEFSQEEWGCLSHTQRELYRDVMLENYGHLLFLGLTVWKPDLVIFLEQEKQLWDVKRKETVAFHPGRWD

SEQ ID NO: 21494 - protein, 81 aa, Ursus arctos
SRGLLTFGDVAIEFSQEEWRCLSHTQRELYRDVILENYGHLLFLGVIVSKPDLVSLLEQRKEPWGEKRNKAVLFDPAVSSH

SEQ ID NO: 21495 - protein, 81 aa, Zalophus californianus
QAQESLTFDDVAVDFTWEEWQLLVPAQKDLYRDMMLENYRNLVSVGYQASKPDALSKLERGELWTLEDEIHSRICPEIRKV

SEQ ID NO: 21496 - protein, 81 aa, Pan troglodytes
MALPQGRLTFRDVAIEFSLEEWKCLNPAQRALYRAVMLENYRNLEFVGEENVPPDMRNLHLSILALSGFIFSFVILPHTCF

SEQ ID NO: 21497 - protein, 81 aa, Callithrix jacchus
LQEPVTFRDVAVDFTQEEWGQLDPTQRILYRDVMLETFGHLLSIGPELPKPDVISHLEQGTEPWVTERGTTQGCYPGWEPR

SEQ ID NO: 21498 - protein, 81 aa, Sapajus apella
MAEAISEGFIQRCHVGELQELGLSISKPNMISLLEQGKEPWMVERKMSQGHCADWESWCEIKELSPKWFTDEDEISQEVVM

SEQ ID NO: 21499 - protein, 81 aa, Delphinapterus leucas
FKEVVTFKDVAVTFTEEELGLLDSTQRKLYQEVMLENFRNLVSVEGKIQSEMETVSEAGPHEELSSWQIWQHIAGDFTRCQ

SEQ ID NO: 21500 - protein, 81 aa, Saimiri boliviensis
ALRSVMFSDISIDFSPEEWEYLDLEQKNLYRDVMLENYSNLVSLGCFISKPVVISLLEQGKEPWKVVRKRRQYPDLETKYE

SEQ ID NO: 21501 - protein, 81 aa, Balaenoptera acutorostrata
CEGSVSFEDVTIDFSREEWQQLDPAQRRLYQDVMLEIYSHLFSVGYHIPNPEIIFRMEKGKEQWMGEAELPRQRYHEGEFG

SEQ ID NO: 21502 - protein, 81 aa, Balaenoptera acutorostrata
AHGSVTFRDVAIDFSQEEWEFLDSAQRDLYKDVMWENYSNFISLAGPSISKPDVITLLDEGKEPWMVVRERTRRHHPDLES

SEQ ID NO: 21503 - protein, 81 aa, Balaenoptera acutorostrata
IEESLTYDDVTMKFTWEEWQLLDPDQKDLYRDVMLENYSNLVSVGYQASKPDAVSRLERGEQLWPVEDDSHGRICPEIRKV

SEQ ID NO: 21504 - protein, 81 aa, Ovis aries
MKWVLLDSSQRKLYRDVMRENFRNIVSVEAKQEDHDIEDQDKNQERKLRNPKAERHSEKKDINSSEESFNLIPTPNVKRTR

SEQ ID NO: 21505 - protein, 81 aa, Vombatus ursinus
FTESVTFKDVAMEFTQEEWLHLNPSQKKLYTNVILENYRNLVFLGFAISNPDVIYHLGKRKHFGCQRQTSQGAAIQRAKNL

SEQ ID NO: 21506 - protein, 81 aa, Enhydra lutris
FQEAVTFKDVAVVFTVEELGLLDSTQRKLYRDVMLENFKNLVSVGYLPFKPEMVSHLEAEEELWMMEGEPQRSVTSEDPMA

SEQ ID NO: 21507 - protein, 81 aa, Tursiops truncatus
MAFGDVAVDFTQEEWRLLSPAQRTLHREVMLETYNHLVSLEIPFCKPKLISQLERGEEPWIEERQRPLSLCPAGSKLEIQP

SEQ ID NO: 21508 - protein, 81 aa, Odocoileus virginianus
MFSDVSIDFSLEEWEFLNLEQRDLYRDVMLENYSNLVSLGCFISKPDVISLLEQGKEPWKVVRQGRRQYPDLETNYEIKKL

SEQ ID NO: 21509 - protein, 81 aa, Vicugna pacos
YQELVTFRDVAVDFSREEWDCLNSSQRHLYSNVMLENYRILVSLGLCFSKPSVILLLEQGKEPWMVKRELTKGLCSDWDSM

SEQ ID NO: 21510 - protein, 81 aa, Leptonychotes weddellii
AQGPMLFEDLAVYFSQEEYVSLHPAQRSLSRDTTQECFEDMALMDQVLSAIPAVRPVIIWLLYAWQLYLDLSSRRGGEGKT

SEQ ID NO: 21511 - protein, 81 aa, Phascolarctos cinereus
MLENYRNLVSLGFAVSKPDVIYQLEREEASWMPKADIPRSSCPESGEFSQDKPLECNEYDYQKAFRSKKHCAVYQRLHTGD

SEQ ID NO: 21512 - protein, 81 aa, Phascolarctos cinereus
MLENYNNFASLGLPFFKPDMISQLERGEGPWTPEAEVPQVTCPESLVQKRRYETMNSTSKQGFSVGRSCKERLTKNGPRDS

SEQ ID NO: 21513 - protein, 81 aa, Phascolarctos cinereus
CQETLTFKDVVVDFTRGEWQHLDPAQKDLYKEVMLDNYKNLVSLGIQVSKPDVIFQLERGESPSMLEGKDPSDPCLEFLSQ

SEQ ID NO: 21514 - protein, 81 aa, Monodelphis domestica
FQESLTFKDVAVEFTWEEWRHLDPAQRALHTNVMLENYENLVSIGIPVSKLDLFFLLKREDVQNEEGEAGTGTCIEGKIRL

SEQ ID NO: 21515 - protein, 81 aa, Bos indicus
VKESVTFKDVAVDFTLEEWRLMDPTQRDLHKDVMLENYRNLVSLGLAISKPDMISHLENGKGPWVVVREASRTPFSELETK

SEQ ID NO: 21516 - protein, 81 aa, Pteropus vampyrus
EVTFKDVAVIFTGEELELLNSAQKKLYREVTLENFRNLVSVGHRNQNEIETLQEVGLRYILNEDLIYWQIWEQFISKLTTN

SEQ ID NO: 21517 - protein, 81 aa, Physeter macrocephalus
SQESVSFEDVAVYFTQNQWASLDSAQRTLYRKVMLENYANVTSLAAFPFPKPDLILQLEQGEAPGGLDPWTPIRREVRGVC

SEQ ID NO: 21518 - protein, 81 aa, Physeter macrocephalus
VQASLSFEDVAVGFTWEEWQLLDPSQKDLYRNVMLENYYNLVSVGYQTPKPDSLFQLEQGEPPWMVDGAGQSQTCPEEIWE

SEQ ID NO: 21519 - protein, 81 aa, Trichechus manatus
WKELLSFEDVAMFFTREEWENLDSAQKYLYRDVMLENYRNLIFLGFQFPKPEVISQLEDWEEPWILDLPSAGNRKASSSAC

SEQ ID NO: 21520 - protein, 81 aa, Bos indicus x Bos taurus
LFQTSTFRDVAIHFSQQEWECLNPVQKNLYQDVMMENYDNLVSLGHSISKPDVITLLEQGKEPWMVVREETRRWPEDEHER

SEQ ID NO: 21521 - protein, 81 aa, Trichechus manatus
VKGPVSFEDVTVDFSREEWQQLDPAQRHLYQEVMLENYSHFLSMGYDLPKPEVIFRLEKGKEPWVVELKLPYWSCRAEEFG

SEQ ID NO: 21522 - protein, 81 aa, Trichechus manatus
LLTFRDVAIEFSQEEWECLDTTQRALYRDVMLENYRNLVSLDISARFVVKELPPEKNINKEELYQPVIMEKQESYGIEYFY

SEQ ID NO: 21523 - protein, 81 aa, Bos taurus
QPKAKKSWGPLSFMDVFVDFTWEEWQLLDSAQKHLYRSVMLENFRNLVSLGYQYTKPSIIFQLEQEELWMMHSPSQGHSGE

SEQ ID NO: 21524 - protein, 81 aa, Ovis aries
QLTSEDVAIEFTQEEWEFLDPAQRALYRDVMLETYRNLLSVDISPTHVIKHLQPKVNSDKRETFQTLMLGSPENCEIKHFH

SEQ ID NO: 21525 - protein, 81 aa, Panthera pardus
SQGPVSFRDVAVDFTQEEWQQLEPEEKTTYRDVMLENYSHLVSVGYDSTKPKVILKLEQGEEPWVVEGDLPCRRRPEVWKV

SEQ ID NO: 21526 - protein, 81 aa, Panthera pardus
MQENCRNLASLGNQVGKPGVVSRLEQKGKVVTEETGILPGSFPDLETLLRAKVLTSKQHVFRQEQHKGVKMERNHLGVKVN

SEQ ID NO: 21527 - protein, 81 aa, Capra hircus
HAEGCLTFQDVAIDFTQEEWECLDLSQRELYRDVMLENYGNLASLGLISMLDLVTFPEQLKDPRNIRRMETTAIYPAMSPQ

SEQ ID NO: 21528 - protein, 81 aa, Rhinopithecus roxellana
MLETYSNLVSVGYEGTKPDVILRLEQEEAPWIGGAARPGCHCWEDIWQVNIQRKRRQDMLLRQGAAISKKTLPKERSREYS

SEQ ID NO: 21529 - protein, 81 aa, Sus scrofa
LIFEDVAVNFTPEEWALLDPAQRKLYRDVMLETFRNLAFVGSCLHVKTSGSSAQRDILENVLCSEEKIVRFKRNDSKSVLG

SEQ ID NO: 21530 - protein, 81 aa, Sus scrofa
VAFEDVAVNFTQEEWECLDAGQRVLYQEVMSETFRNLMSVDLTAKLEQEEKQWRVDLCPPKEEGLHPGSKKEELLEQSQSL

SEQ ID NO: 21531 - protein, 81 aa, Ursus arctos
FQAKLTFEDVAVLLSQEEWDRLGPAQRGLYRHVMMETYGNVVSLGLPGSKPNVISQLERGEEPWVLDGQGAEKTRGLGSGH

SEQ ID NO: 21532 - protein, 81 aa, Ursus arctos
VTESVTFRDVAVLFSRDEWLRLDSAQRTLYREVMLENYGTLVSLGIPFSTPKVICQLQQGEDPCVVDRELPRDACPGLKTQ

SEQ ID NO: 21533 - protein, 81 aa, Vicugna pacos
CQDPVTFEDVAVVFTDEEWRRLVPIQRDLYKEVMLENYKSVVSLGLPVPGPDVIFQLKRGDAPWITELHGSEGTECTENVS

SEQ ID NO: 21534 - protein, 81 aa, Pongo abelii
FQELVTFRDVAIDFSRQEWEYLDPNQRDLYRDVMLENYRNLVSLEMRSRCVAQVGLKLLVSSDPPTSTFQNAGITGVSHRT

SEQ ID NO: 21535 - protein, 81 aa, Monodelphis domestica
SITFKDVAVDFTQEEWCLLDHSQKELYKEVVLENVQNLLFVEAETYFEVKEMSTKMRLFVEGSNSPRGMNKSPCDFFLRDS

SEQ ID NO: 21536 - protein, 81 aa, Bos indicus
AQLTFKDVAIEFTQEEWECLDAAQRALYRDVMVETLRNLVSLDISHILVIEKLQLNEATDRGEEFQTVILGRHERNKIKDF

SEQ ID NO: 21537 - protein, 81 aa, Trichechus manatus
SQELVSFKDVAVNFTQEEWQQLDSDEKIIYRDVMLENYSHLISLGFDITKPDVIIKLEQGEEPWIVEDEFPCQICPEEAWK

SEQ ID NO: 21538 - protein, 81 aa, Trichechus manatus
AQESLTFSDVAVKFTWEEWQLLDPAQKDLYWDVMLENYSNLMSIGYQVSKPDALSRLEQGEQPWTTLDESHSGLFSEIRKV

SEQ ID NO: 21539 - protein, 81 aa, Delphinapterus leucas
SQGLVSFKDVAVHFTQEEWQQLDPAQKTLYRDVMLENYSHLVSMGHPVSKPDVISKLEQGEDPWIIKRDIPNWIYPYEDQA

SEQ ID NO: 21540 - protein, 81 aa, Carlito syrichta
PQEPVTFEDVAVYFTQNQWASLEPVQRALYKEVMLENYASVASLVAFPFPKPLLISQLERGEVPWSPDPWDTEVRRTITPG

SEQ ID NO: 21541 - protein, 81 aa, Zalophus californianus
VQGSMSFEDVIVRFTQDEWQYMSPAQRTLYRDVMLENYSHLISVGYCTAKPEMIFKLEQGEEPWSLEEEFLNRRYPGYFSV

SEQ ID NO: 21542 - protein, 81 aa, Capra hircus
ESVTFEDVAVDFTQEEWALLDTSQRKLFRDVMLENISHLASVVISDREDDLKKQKMSSMQHTCKKDAPLRRAVRSHTQEDP

SEQ ID NO: 21543 - protein, 81 aa, Suricata suricatta
VSVEPNGGFLFSKPKVISLLQQGEDPWKVEKDSPGGPSLGYKSSPKTTKSTQTQDSLFQELLRKRLKKDEPWNFVSEKPCA

SEQ ID NO: 21544 - protein, 81 aa, Chlorocebus sabaeus
MLENYRNLVFLGIAVSKPDLITWLEQGKEPWNMKRREMVDKTPVMCSHFTQDVWPEQSIKDSFQKVILRTCGKYGHENLQL

SEQ ID NO: 21545 - protein, 81 aa, Suricata suricatta
VPGPVTSQDVAVEFIQEEWEHLGSAQRALYREVMLENYRILASLGKSGPGPIICTGLGGRHQAAPWEGHGTQLPSAHVVCL

SEQ ID NO: 21546 - protein, 81 aa, Suricata suricatta
LDITRRDVAIEFSQEEWGCLNQSQRELYRDVILETYGHLVFLGEDHSFQNPKSHSGFFPFYEDSFLEDHHLHSEDLHKLRA

SEQ ID NO: 21547 - protein, 81 aa, Suricata suricatta
MDVAIEFSQEEWGCLSHSQRELYRDVMLENYGHLLFLDLVVLKPDLVTFLERKRELWDVKRKETVASYPGRQTLKCGLSRH

SEQ ID NO: 21548 - protein, 81 aa, Chlorocebus sabaeus
RESGKAPVTFDDITVYLLQEEWVLLSQQQKELCGSDKLVAPLGPTVANRELFCKFGPGPEPWLGSVQGQRSHLEHHPGKKQ

SEQ ID NO: 21549 - protein, 81 aa, Suricata suricatta
SQESVTFKDVAVDFTQEEWALMDTTQRTLYRDVTLENISHLVSVGCHFFRSDVISQWEQRGELETIYMSPMWKKNPHWRET

SEQ ID NO: 21550 - protein, 81 aa, Suricata suricatta
AAGSVTFKDVTMAFTQKEWEQLDPAQRNLYKDVMLENYSNLASMGYQAPKPDMISKLEKGEEPWSGKGRKPRQSGPSEGAR

SEQ ID NO: 21551 - protein, 81 aa, Suricata suricatta
AQASVSFKDVTVEFTHEEWQQMGPIQRTLYRDVMLENYNNLVSVGNCVFKPAVIFKLERGEEPSFLEEEFSIQSQREDYRD

SEQ ID NO: 21552 - protein, 81 aa, Suricata suricatta
LQGLLTFRDVAIEFSQEEWGYLSHSQRELYRDVMLENYGHLLFLGLVVLKPDLVIFLEQQREVLDMKRKETIASYPGTNLI

SEQ ID NO: 21553 - protein, 81 aa, Chlorocebus sabaeus
QGLLTFRDVAIEFSQEEWKCLDAAQRTLYRDVMLENYRNLVSLDISSKCMMNTLLSTGQGNTEVIHTGTLQRQASHHIGDI

SEQ ID NO: 21554 - protein, 81 aa, Suricata suricatta
LQGQLTFRDVAVEFSQDEWGCLNHSQRELYADVMLETYGHLLSLGLLVSKPDLVIFLEHEKEMRGVKRQETVASHPAISSP

SEQ ID NO: 21555 - protein, 81 aa, Sus scrofa
LVFEDVAINFTPEEWALLDPAQRRLYRDVMLETFKNLAFVGSCLHVKTSGSSAQRDILENVLCSEEKIVRFKRNDSKSVLG

SEQ ID NO: 21556 - protein, 81 aa, Mandrillus leucophaeus
LFQVTFSDVAIDFSHEEWAWLDSAQRDLYKDVMVQNYENLVSVGLSVTKPYVIMLLEDGKEPWMVEKKLSKGVIPDWESRW

SEQ ID NO: 21557 - protein, 81 aa, Mandrillus leucophaeus
LKGLVTFEDVAVEFTQEEWALLDPAQRTLYRDVMLENCRNLASLGDQVDKPGLIAQLEQEDKVMTEERGILPGTCPDVENP

SEQ ID NO: 21558 - protein, 81 aa, Sus scrofa
QVSVTFKDVAVTFTREEWGQLDLDQRTLYWEVMLETCGLLVSLGDRAKRQTEEPSTSQSVLSEGALLRGSLTLGSSRDSSW

SEQ ID NO: 21559 - protein, 81 aa, Sus scrofa
FQGPLTLEDMAVEFSPEEWACLDPAQRALRRGMTLETFRNLIDVGISVSLVNVLAMLGQEKGPGAVESAGNELGGCIRGNP

SEQ ID NO: 21560 - protein, 80 aa, Sus scrofa
MAHGSVTFRDVAIDFSQEEWEFLDAAQRDLYRDVMWENYSNFISLAGPSISKPDVITLLDEGKEPWMVVREGTRRHHPGE

SEQ ID NO: 21561 - protein, 81 aa, Sus scrofa
PQEQLTFRDVSVDFTQEEWGQLAPAHRHLYREVMLENYGNLVSVARYQLSKPSVISQLEKGEEPWMTEKEGPGDPSSGLTS

SEQ ID NO: 21562 - protein, 81 aa, Sus scrofa
MTFEDVAVDFTQEEWQYLNPLQRTLYRDVMLETYSNLVSVAGQHVTKPTLILKLEVEEPCLAEGKIPVWNFPEEACQVDEQ

SEQ ID NO: 21563 - protein, 81 aa, Sus scrofa
LGLWFKDVAIYFSQKEWECLHFAQKDLYREVMFENYNNLIALGFSNSKPDVISLLEQGKEPWLVRSKEIKNGVQVSNGDSD

SEQ ID NO: 21564 - protein, 81 aa, Sus scrofa
ELVTFRDVVITFSQEEWEYLDSAQRDLYWDVMMENYSNLVSLDLESNYHTKTLSIEKDTIEKSDSQWEVIESSKLVDFENS

SEQ ID NO: 21565 - protein, 81 aa, Bos mutus
IMAAVVFSVGPLVLIGIQYLKVWKKTVLLFPNLGLQSRASLRYLWLAISKPDMISHLENGKGPWVVVREISRTPFSELETK

SEQ ID NO: 21566 - protein, 81 aa, Bos mutus
MKWRISCIRCCMFHSVPLSKIENYIILMCSLHETARDGHQVPDSFVFGYHGTKPDLIFKLEQGEEPWIINFEVSHQSCPDV

SEQ ID NO: 21567 - protein, 81 aa, Neophocaena asiaeorientalis
DPEQVTFEDVVVEFTWEEWGQLEPAQRTLYRDVMLETFGLLASVGHWLPKPDVISLLEHKAELWVVDKGAPRGVCTDFETR

SEQ ID NO: 21568 - protein, 81 aa, Bos mutus
QGGVTFEDVFVYFSREEWELLEEAQRLLYRDVMLENFALVSSLGALPPPVLVPRVGAVGAQAQPWWRPLPEQSDTCCTKPF

SEQ ID NO: 21569 - protein, 81 aa, Neophocaena asiaeorientalis
MLENYSHLVSVGFLVAQPGRISRLGQGGEEARMAAGESTTRRCPGEPMPGQLGQGKGTWWVREILASGVRPGVLLRNPRLG

SEQ ID NO: 21570 - protein, 81 aa, Neophocaena asiaeorientalis
GGVTFEDIALYFSWEEWKLLDEAQRRLYHDVMLENFALISSLGCCCGAEDAEAPFQRSISISMSQARTHREGSFSQKSHPC

SEQ ID NO: 21571 - protein, 81 aa, Bos mutus
PGGEDSGASREVYMKYDKASIKQQKMNKYRILRSLTLENSFVGYCANRPNAIFKLKQGKEPWILEVQFPRQNNPEDLCNTH

SEQ ID NO: 21572 - protein, 81 aa, Bos mutus
EVVVDADVEVDVTVEAALAGEQSPASGTQECPHGSRDTESPGLQEKGYPVPKPDLIFRLEQGEEPWVPDSPRPEDGDIVTG

SEQ ID NO: 21573 - protein, 81 aa, Neophocaena asiaeorientalis
MLETFRHLVIVVSWISKPAIVVQLELGVEPWIMDRGLSQDSCPAWKNRPKSQESPSTEAISGDRLPSSMNLERYTMGDSWC

SEQ ID NO: 21574 - protein, 81 aa, Nomascus leucogenys
MEGLVMFQDLSIDFSQEEWECLDAAQKDLYRDVMMENYSSLVSLGLSTPKPDVISLLEQGKEPWMVSRDVLGGWCPDRLKK

SEQ ID NO: 21575 - protein, 81 aa, Neophocaena asiaeorientalis
LQGSVTFQDVAVDFTLEEWQLLGYSQRKLYWDVILENFRNLISVGCPVTKTKVIFKVEQGQEPWMVEGENPRWRSPEVICL

SEQ ID NO: 21576 - protein, 81 aa, Neophocaena asiaeorientalis
MLYMDVMLENYCHLVSVGCHMTKPDVILKLERGEEPWTSFTGHTCLEEKWKAEDFLVKFKEQQDKISRSVVLINHKKLIKE

SEQ ID NO: 21577 - protein, 81 aa, Nomascus leucogenys
DGLVTFRDVAIDFSQEEWECLDPAQRDLYVDVMLENYSNLVSLDLESTTYETKKIFSEKDIFEISFSQWEMKEKSKTIGLE

SEQ ID NO: 21578 - protein, 81 aa, Nomascus leucogenys
MGPLQFRDVAIEFSLEEWHCLDTAQRNLYRDVMLENYSNLVFLGIVVSKPDLITCLEQGKKPLTMERHEMIAKPPVISSHF

SEQ ID NO: 21579 - protein, 81 aa, Trichechus manatus
ARVSVMFKDVAVTFTREEWGQLDLAQRTLYREVMLETCRLLISLGHPVPKPELTHLLEHGQELWRVKRGPSQSTGSGDRAK

SEQ ID NO: 21580 - protein, 81 aa, Trichechus manatus
MDSVVIEDVAVDFTLEEWALLDLAQRKLYRDVMMETFRNLASVGEICKLYGVEDHYKHQGRKVRKRAVENLCESNESNQCG

SEQ ID NO: 21581 - protein, 81 aa, Trichechus manatus
FQESVVFSDVSIAFSQEEWAHLDLEQKDLYRDVMLENYSNLVSLGCFVSKPDVISLLEQGKEPWKIVRKGRRRYPDLETRY

SEQ ID NO: 21582 - protein, 81 aa, Trichechus manatus
SLTFKDVAVVFTEEELGLLDPAQKKLYRDVMVENFRNLVSVGGKNPRQMETVPQAGAQEELSGSHIWQQVASDLTRCQDSV

SEQ ID NO: 21583 - protein, 81 aa, Trichechus manatus
MLENYNNLVSLGYRVSKPDALSRLEQGEQPWTILDESHNQNFSGKEQGTTHIRINLEARGTTQDTVLQSEIWEVDHLLGHS

SEQ ID NO: 21584 - protein, 81 aa, Trichechus manatus
TPKHEAKGLSSKDTDWPQEKRKPTMLEPVTFEDVTVVFTEAEWKRLSSEQKHLYKEVMLEIYRNLLSLGEDVLFSFPSLIQ

SEQ ID NO: 21585 - protein, 81 aa, Trichechus manatus
PQKLVTFEDVAVYFTQTEWDGLSPTQRALYRDVMLENYGHVASLGFPLLKPTMISQLEGGAELWGPLPVPTGVGTGPQGLW

SEQ ID NO: 21586 - protein, 81 aa, Equus caballus
AQESVTFSDVSVDFSQEEWECLDPAQRDLYRDVMLENYSNLVSMGFYIPKPQVISLLEQGKEPWMVGRELTRGLCSDLESM

SEQ ID NO: 21587 - protein, 81 aa, Equus caballus
AQECLTFKDVFVDFTLEEWQQLDGAQKNLYRDVMLENYSHLVSVGYLMAKPDVIFRLGQGEEAGMAGRETPMQSCPEFWQV

SEQ ID NO: 21588 - protein, 81 aa, Equus caballus
PPSLVTFGDVAIDFSQEEWEWLNSAQRTLYRNVMLENYRNLASLGLCGSKPDMISSLEQRREPWITKRKLTRGRCPDLKAV

SEQ ID NO: 21589 - protein, 81 aa, Equus caballus
PQEPVTFEDVTVDFTQEEWQQLYPAQRTLHREVMLEVYSHLVSVGYSGIKPDVIFKLQHGEDSWIIESELSRSNSDRDKSL

SEQ ID NO: 21590 - protein, 81 aa, Equus caballus
AQVPLTFSDVAIDFSQEEWECLNSAQRGLYRDVMLENYTNLASLDFDFTTETNKLSSENSSYEVNSCHRETMKRSKTFSLM

SEQ ID NO: 21591 - protein, 81 aa, Equus caballus
SKVELLTLEDVAVEFTWEEWQLLAPAQRNLYRDVMLENYSNLVSVGCQASKPDALSRLEQGEPWTTEDGIHRRTCPEIKKD

SEQ ID NO: 21592 - protein, 81 aa, Equus caballus
IAEGCEWSHCTLIELSSCGQGLVVFTDVAIHFSQEEWGLLDEVQRSLYRHVMLENFALLSSLGKALIPTPVSWTGSCSFLQ

SEQ ID NO: 21593 - protein, 81 aa, Equus caballus
MALEDVAVYFAQEEWELLDEAQRHLYRDVMLENLALVASLGCASSKSRVAAQLGEGKEPWVLDRVDVSPAIAREAGREPGS

SEQ ID NO: 21594 - protein, 81 aa, Neovison vison
EFAPLGDAAMDFTLDWEHLGLDQGDLFWDTALDNYQNIFLLNPSKPKLTSQQDGAEEQKVLERESAESAGPNPAEVKNCLL

SEQ ID NO: 21595 - protein, 81 aa, Capra hircus
FQELVTFEDVAVYFIRKEWKRLEPAQRDLYRDVMLENYGNVFSLDGETRTEPDSEISEDGGSHGVLLGRFQKDISQGLKFE

SEQ ID NO: 21596 - protein, 81 aa, Capra hircus
MAFTRKEWEQLDPAQKSLYKDVMLENYSNLASMGYQALKPDMISKLEKGEEPWLGKGKRPKQAGSSEIARTKEIGANGKVH

SEQ ID NO: 21597 - protein, 81 aa, Chrysochloris asiatica
LQGLLSFKDISMEFTWEEWQLLDSAQKYLYQDVILENYNNLVSVGYHGSKPDLIFKLEQGEEPWTLNGKLSRQNYSEGWEE

SEQ ID NO: 21598 - protein, 81 aa, Suricata suricatta
WSLLDEAQRRLYYDVMLENFTLVSSLGKALPVPRAGAYRKSPLCRIGWTVSVGVSQASVSTAALSSRKTHPCEMCGPVLRD

SEQ ID NO: 21599 - protein, 81 aa, Chrysochloris asiatica
MATPSPPPEPKEWDYLDPAQRSLYKDVMMENYGNLVSLDVLSKDNDEEPIVKQEIEEIEEVEPQSVIVTRIKSEIDQDPMS

SEQ ID NO: 21600 - protein, 81 aa, Chrysochloris asiatica
MDFTLEDWEQLVLDERDLFWDTALDNYQNLFLLNPTRSNVTSHPGDGEELEALGNESPKAMDPDTTESKHSPLKQDFLEEG

SEQ ID NO: 21601 - protein, 81 aa, Mandrillus leucophaeus
EQDYVTFEDVAVYFSQEEWRLLDETQRLLCRNVMLENFSLLASLGLASSKTHEITQLESWKEPFMPASEVVTSAIPRGTWV

SEQ ID NO: 21602 - protein, 81 aa, Mandrillus leucophaeus
AAVSVTFKHVTMTFTQKEWKQLDPAQRNVYHDVMLENYSNQASMGYQAPKPDLISKLEKGEAPWLGKGKRPSQGCPSKIAR

SEQ ID NO: 21603 - protein, 81 aa, Mandrillus leucophaeus
MRSNYETLVSLDDGLPKPELISWIEHGGEPFRNWRESQKSANIICSSGDLHFDPGFQEQLFWGSQQAVNSRKTKSHFQLEL

SEQ ID NO: 21604 - protein, 81 aa, Mandrillus leucophaeus
MLENYGAVASMAAFPFPKPALISQLERGEAPWCSVPWGALDGEDPRGISSGYPFLKPAGISHLQQVEEPLNLKLQEEGPSL

SEQ ID NO: 21605 - protein, 81 aa, Sus scrofa
AQVPLTFSDVAIDFSQEEWECLNSDQRNLYRDVMLENYTNLVSLDFDFTTESNKLSSEKSNYEVNSYHWETTKRSKTFNLM

SEQ ID NO: 21606 - protein, 81 aa, Mandrillus leucophaeus
EKGPLTFRDVVIEFSQEEWQCLDTAQQDLYRKVMLENFRNLVFLGIDVSKPDLITCLEQGKNPWNMKRHSMVATPPGVFFV

SEQ ID NO: 21607 - protein, 81 aa, Sus scrofa
NPGVVLIAREELTLEDVAIEFSPEEWACLDPAQRALYRDVMLETCRNLLSLGEHHFPPGVGICPWVSLRFPCVPLGSLCIA

SEQ ID NO: 21608 - protein, 81 aa, Neophocaena asiaeorientalis
SQEMLTIRDVFVDFTLEEWQQLDATQKNLCRDVMLENYSHLVSDSSWPNQVGSPGWDKEERRPGWQLEKAQHGGVQVSPCR

SEQ ID NO: 21609 - protein, 81 aa, Neophocaena asiaeorientalis
MYQQEMKTNYESLDSLGCISSKPDLITWMEQGRMLLIRDQGHLEKTQMTLSLSGDQGTLGAKEEECHLNGLQEQGFCAPLS

SEQ ID NO: 21610 - protein, 81 aa, Bos mutus
QGWLTFRDVAIDFTQEEWECLDLGQRELYRDVMIENYRNLACLGLVVSKPDLVTFLEQMKDVRNIRRMETIGIYPAISPQD

SEQ ID NO: 21611 - protein, 81 aa, Bos mutus
GLVMFKDVAIDVSQEEWECLNPAQRNLYKDVMLENYSNLVSLGLSISKPAVITSLEQGKEPWMVMREVTRERYPEPDFWDI

SEQ ID NO: 21612 - protein, 81 aa, Bos mutus
ATVNLLLNLRVPVPWENEERRRRAQEKPSDLVPYLVSAFPRPARKDHGPGCQVTKPAVISRLEQGQEPWMEEEEILRWSFP

SEQ ID NO: 21613 - protein, 81 aa, Bos mutus
FQDAVTFTDVAVDFSQDEWEWLTLAQRTLYKKVMLENYSSLASLGLCISKPDVISLLEQDKEPWMMKGELTRGLCPGKCRT

SEQ ID NO: 21614 - protein, 81 aa, Loxodonta africana
MAMYLTREEWRPLDPTQRDLYRDVMQENYGNVVSLDFEIRNENEVNPKQEISEDVDFGTTSERPVGNAEENPEIEEAFESG

SEQ ID NO: 21615 - protein, 81 aa, Capra hircus
AQGSVTFPDVAVYFSWEEWRLLDEAQRRLYLDVMLENYALISSLGFWSGEEKVETSFAQSVSEAVSQARTSKEASSSQKTH

SEQ ID NO: 21616 - protein, 81 aa, Chrysochloris asiatica
MKFTWEEWQLLDLAQKDLYWDVMLENYNNLVSVGYKVSKRDALSWLEQRGKAWFTLEKSRSRVCSVNQSRDDEIANLAELN

SEQ ID NO: 21617 - protein, 81 aa, Chrysochloris asiatica
MQKTLYREMMLENYRNLVSVEHQLSKPEVVSQLEEAEELWLKDRAIPQDTFTECYVAQLEPHESPLPCGGRGENPVVVEVL

SEQ ID NO: 21618 - protein, 81 aa, Chrysochloris asiatica
PQELVTFEDVAVYFTQSQWTSLEPAQRTLYREVMLENYATITSLVSFPALKPALISQLESGEAPWGPDPWEAKVLRDICSS

SEQ ID NO: 21619 - protein, 81 aa, Chrysochloris asiatica
IQESVTFEDIAVNFTDREWQCLTQAQRHLYKDVMLENYGNLVSLGFLFPKPSLIAHLERGTELWVQDLQDREFLSCSCPVS

SEQ ID NO: 21620 - protein, 81 aa, Chrysochloris asiatica
GLVTFEDVAIDFSQDEWACLDPSQRDLYWDVMLENYSNLVSLDWVSSFETESLSSVKDIYEMSFSQWNARRKRQSAAGRDW

SEQ ID NO: 21621 - protein, 81 aa, Suricata suricatta
PLDSVTFLDVAIDFSQDEWEWLDLAQRTLYKKVMLENYRNLASLGLCISKPDVISLLERGEDPWMVKGDVTGGLCPDVEYV

SEQ ID NO: 21622 - protein, 81 aa, Chlorocebus sabaeus
QGPLTFQDVTIEFSLEEWQCLDTAQQTLYRDVMLENYRNLVFLGIAVSKLDLIACLKQGKEPWNMKRHEMITKPPVMRSHF

SEQ ID NO: 21623 - protein, 81 aa, Chrysochloris asiatica
TVIIEDVVVVFTQEEWDLLDPPQKKLYRDVMMETLRNLASVVVLLHLWTRRLFAFVTLHVCHYGEMPYECKECGKTFRESS

SEQ ID NO: 21624 - protein, 81 aa, Chlorocebus sabaeus
SQESVAFEDVAVYFTTKEWAIMVPAERALYRDVMLENYEAVAFVAVPPTSKPALVSHLEQGKESCFIRPPGVLSRSDWRAG

SEQ ID NO: 21625 - protein, 81 aa, Suricata suricatta
TARSQASVTFKDVAMDFTPEEWGNLDPAQREVMLENYRNLVSFWLPASKPENYNLENGKEPLTLERKAPKSSSSDLETQPE

SEQ ID NO: 21626 - protein, 81 aa, Mandrillus leucophaeus
GRLTFRDVAIEFSLAEWKCLDPAQRALYREVMLENYRNLESVDSSLKSMMEFSSHEHSNTGEGFYTGTLERHKSYHIGDFC

SEQ ID NO: 21627 - protein, 81 aa, Sus scrofa
MGSVVFEDVAVNFTLEEWALLDPAQRRLYRDVMLETCRNLASVDYETLSKASESVAQQDTSEEKICHKQKIAKFTKYNSCA

SEQ ID NO: 21628 - protein, 81 aa, Sus scrofa
LQGSLLFEDVAVEFTWEEWRLLDPAQKDLYQDVMLENYSNLVAVGYQSTKPIEIFRLKQGDKPWIEKESIHGENFPEVGEV

SEQ ID NO: 21629 - protein, 81 aa, Mandrillus leucophaeus
PRLPLTFEDVAIYFSEQEWQDLEAWQKELYKHVMRSNYETLVSLDDGLPKPELISWIEHGGEPFRNWRESQKSANIICSSG

SEQ ID NO: 21630 - protein, 81 aa, Mandrillus leucophaeus
GHLTFRDVAIEFSQAEWKCLDPAQRALYKDVMLENYRNLVSLGSSYALGSNAKDKPTKKQLGVSFHLHLSELELFPDERVI

SEQ ID NO: 21631 - protein, 81 aa, Mandrillus leucophaeus
RNVMLENYKNLVFLGIDISKQDPITSLEQEKEPWNMKRHEMLDESPGQVWLTPVISALWEARAGGLLEPRSLRPAWSTWKN

SEQ ID NO: 21632 - protein, 81 aa, Mandrillus leucophaeus
DSVVFEDVAVDFTLEEWALLDSAQRNLYRDVMLETFQNLASVDDETQFKASGSVSQQDIYGEKIPKESKIAAFTRNVSWAS

SEQ ID NO: 21633 - protein, 81 aa, Mandrillus leucophaeus
LYEAVTFKDVAVVFTEEELELLDPAQRKLYRDVMLENFRNLLSVGKIQTEMETVPEAGTHEEFSCKQIWEQIASDLTRSQD

SEQ ID NO: 21634 - protein, 81 aa, Sus scrofa
KVPVTFVDIAVYFSEDEWKNLDEWQKELYHNLVKENYKTLMGPLNLPGLNGQPSYSHGVDQGVGRVASRREGARRTVRRAP

SEQ ID NO: 21635 - protein, 81 aa, Sus scrofa
MLENYSHLVSVGYQVSKPEVIFKLEQGEEPWIAEGEIQRPFCPDWKTRPEAKSSNLRQNISEVFPSTDDLSHATLEDAWDV

SEQ ID NO: 21636 - protein, 81 aa, Neophocaena asiaeorientalis
SQKSVTFQDVAVDFTEKEWPLLDSSQRKLYKDVMLENYSNLASVGCQVSKPSLISHLEQEEELGTEEQELHQGPCPDWETP

SEQ ID NO: 21637 - protein, 81 aa, Bos mutus
QTQLTFKDVFIDFTPEEWECLDPAQRTLYKDVMVETLRNLLSVDVSQIRMIKKLQAKGNSGKEESFQRVVFGTAESHEIED

SEQ ID NO: 21638 - protein, 81 aa, Neophocaena asiaeorientalis
FQGSLTFSDVAIGFSQQEWECLDLIQKTLYRDVMMENYGNLVSLAGHSISKPNVITLLEQGKEPWMFMREKTRSWCTDLDS

SEQ ID NO: 21639 - protein, 81 aa, Neophocaena asiaeorientalis
AAGSVTFKDVTMAFTKKEWEQLDPAQKSLYKDVMLENYSNLASMGYQALKPDMISKLGKGEEPWLGKGKRPRQGGLSEIAR

SEQ ID NO: 21640 - protein, 81 aa, Neophocaena asiaeorientalis
ELVTFRDVVISFSQEEWEYLDSAQRDLYWDVMMENYSNLVSLDLESKCDKETSSTEKDIIEKNDSHWEVTESSKLVGLENS

SEQ ID NO: 21641 - protein, 81 aa, Bos mutus
MLLPTLTFNYLFTFLSTLPVLSTAKSYQISKSDVVFQLEQGKELWTQAAGGLQGQSPGSESLFRQQEITLMQSVYWKHTSP

SEQ ID NO: 21642 - protein, 81 aa, Bos mutus
MSVVTKPVAPLSEKANAIEEGSRPSGRNHQAAVKRKQRARGAGHQLPKPDVILRLEKGEEPWLVEREIHQETQPDLETSVE

SEQ ID NO: 21643 - protein, 81 aa, Nomascus leucogenys
PQKSVTFEDVAVYFTQAEWDGLSPAQRTLYRDVMLENYGNVASLGFPLLKPAVISQLEGGGDLGGPSPLAAGTGLQGLRTV

SEQ ID NO: 21644 - protein, 81 aa, Nomascus leucogenys
RQVSITFKDLAVRFSEEEWRLLEEGQREFYRDVMRENYETLVSVGTAELLPLSAFLSPSDPGRAVGGGSHADEGQEAGCGG

SEQ ID NO: 21645 - protein, 81 aa, Nomascus leucogenys
QFHRVTFEDVAVDFTQEEWQQLNPAQKTLHRDVMLETYNHLVSVGCSGIKPDVIFKLEHGEDPWIIESELSRWIYPDRVKG

SEQ ID NO: 21646 - protein, 81 aa, Nomascus leucogenys
AHGSVTFRDVAIDFSQEEWEFLDPAQRDLYRDVMWENYSNFISLGPSISKPDLITLLDEEGKEPGMVVREGTRRYCPDLES

SEQ ID NO: 21647 - protein, 81 aa, Nomascus leucogenys
LYEAVTFKDVAVVFTEEELQLLDLAQRKLYRDVMLENFRNLLSVGGKIQTEMETVPEAGTHEEFSCKQIWEQIASDLTRSQ

SEQ ID NO: 21648 - protein, 81 aa, Capra hircus
CSLPGSSAHALFQARILEWVAISFSRESPRELTQKLSEVVSILSWYEVPKPEVIFKLEQGEEPWALKEKALHHSCSDGKFG

SEQ ID NO: 21649 - protein, 81 aa, Capra hircus
FQGWLTFQDVALDFTQEEWECLDLGQRELYRDVMLENYRNLASLAGLVVSKPDLVTFLEQMKTPWDVRRLETPAVYTAVSS

SEQ ID NO: 21650 - protein, 81 aa, Capra hircus
FCGSLSFEDVTVGFTQEEWQKLDPDQRTLYRDVMLENYSHLISVGYCIPKPELIFKLEQGEQPWVLEAESPSQSYPGQSEH

SEQ ID NO: 21651 - protein, 81 aa, Suricata suricatta
MLDTLDVAIEFSQEEWGCLNHRQQELYRDVMLENYGHLLFLGLIVSKPGLVIFLEQKKDVWDVRRKETEASCPGMGVKQMT

SEQ ID NO: 21652 - protein, 81 aa, Chrysochloris asiatica
SQGTVTFKDVAIDFTQAEWQHLDCDQRRLYRSVMLENYNNLITVGCPFTKPDVIFKLEQEEEPWVLEEEVLRRHSPGEIWG

SEQ ID NO: 21653 - protein, 81 aa, Chrysochloris asiatica
SQGLVSFKDVAVDFTQEEWQQLAPAQRTLYRDVMLENYSHLVSMGYPVSKPDVISKLEQGEDPWIIRKDISNWIYPVENQA

SEQ ID NO: 21654 - protein, 81 aa, Suricata suricatta
AGQLTFTDVAVEFSQEEWEWLDPAQRALYKDVMLETYRNLVSLDGFAAFMVKELLPKKDINDGELYQSMILGRSESHGLDD

SEQ ID NO: 21655 - protein, 81 aa, Suricata suricatta
MAVTFEDVTVIFTWEEWRFLDSSQKKLYREVMWENYTNVMSVGNWKESYKPQEERFRYLEHENLPCWQGWRNASNQIYKNR

SEQ ID NO: 21656 - protein, 81 aa, Chlorocebus sabaeus
KPGTVSFADVAVYFSREEWGCLRPAQRALYRDVMRETYGHLGALGVGGSKPALISWVEEAAELWDPAARDPEVTKCPTETD

SEQ ID NO: 21657 - protein, 81 aa, Chrysochloris asiatica
ITFEDVAIYFSQEEWGLLDEAQRILYNDVMLENFAVIASLGRWHEVEEEKASFEQSVSIEGLSQARTPQIVPATQKTHYWE

SEQ ID NO: 21658 - protein, 81 aa, Suricata suricatta
SQGLLSFRDVTVDFSQEEWQRLAPAQRTLYRDVMLENYSHLVSVGLSIPKPEVIRKLEQGEEPWILETRGQSDPELINSSR

SEQ ID NO: 21659 - protein, 81 aa, Mandrillus leucophaeus
VHGSVTFRDVAIDFSQEEWECLQPEQRTLYRDVMLENYSHLISLGSSVSKPDVITLLEQEKEPWIVVRKETSRWYPDLESK

SEQ ID NO: 21660 - protein, 81 aa, Mandrillus leucophaeus
KCLDPAQRTLYRDVMLENYRNLVSLAISSKCMMKMFSSTGQGNTEVIHTGTLQRQASHHIGDICFQEIGKDIHDFVFQWQE

SEQ ID NO: 21661 - protein, 81 aa, Mandrillus leucophaeus
ADVSLAFRDVSIDLSQEEWECLDPVQRDLYKDVMLENYSNLVSLGYTIPKPDVITLLEQQQEPWIVMREGTRSWYTDLEYK

SEQ ID NO: 21662 - protein, 81 aa, Sus scrofa
RPRAVKFADVAVYFSPEEWGCLRPAQRALYRDVMRETYGHLGSLGCAGPKPSLISWLERNTDDWEPAALDPQECPRGVTVQ

SEQ ID NO: 21663 - protein, 81 aa, Sus scrofa
QAMVKIEDMAVSLILEEWGCQNLARRNLSRDSRQENYGNVISQGGENRTEKEESTSKAESAEDAASHGETAGKFQKDFGEK

SEQ ID NO: 21664 - protein, 81 aa, Sus scrofa
CKESVIFKDVCVNFSLEEWECLDLTQRNLYRCVMLENYSNLVSVVGLSIPKPDVISLLEQGKEPWGVFDSEMTRGLNQDCG

SEQ ID NO: 21665 - protein, 81 aa, Neophocaena asiaeorientalis
PQEAAVFKFLSVDYTQQKWKGLALSQRALYWNIVLENCCSLASLGENRMESSELPPKQELSKVLKSSDRTSVVLCGMIPGG

SEQ ID NO: 21666 - protein, 81 aa, Neophocaena asiaeorientalis
PQGSTPFNSVTVAFTQKGWRQLAPTPRDRFKKGMPEKSRNLVLLGLPVSQPGMNSQLEQREGSWMLEREGLRSTCPDWKIV

SEQ ID NO: 21667 - protein, 81 aa, Bos mutus
LQDLVTFEDVTVEFTQEEWALLDSSQRKLYRDVMLENCRNLASLGYHVDKPSLISQLEQEDKVVTEEGGILPDTRPDLETV

SEQ ID NO: 21668 - protein, 81 aa, Bos mutus
MRTRVFPAGCQVTKPDVIFKLEQEEEPWVVEEEMLGGHCPEVWKVDEQIKKQQETLVRNVTSISKKTLNKENAVEYKNVAK

SEQ ID NO: 21669 - protein, 81 aa, Nomascus leucogenys
TEGDVTFSDVAIDFSHEEWACLDSAQRDLYKDVMVQNYENLVSVGLSITKPYVIMLLEDGKEPWTVEKKLSKDWESRWENK

SEQ ID NO: 21670 - protein, 81 aa, Neovison vison
SLDSVTFTDVAIDFSQDEWEWLNLAQRTLYKKVMLENYRNLLSLGLCLSKPDVISLLEQGREPWLMEGEMTRGFCSDLEYV

SEQ ID NO: 21671 - protein, 81 aa, Neovison vison
FSQEEWELLDAAQKALYCHVMLENFALVASLGLSASRPRVVIQLERGEEPWVLSGTVVTPVRNAPRKPSPGSRHLAYDRVV

SEQ ID NO: 21672 - protein, 81 aa, Loxodonta africana
HQEPVTFEDVAVTFTEEEWRHLVPIQRDLYKEVMLENYSSIVSLGLPVPQPDVIFQLKRGEEAWIVDPHGSEKRECPENIS

SEQ ID NO: 21673 - protein, 81 aa, Loxodonta africana
QEEWDYLDPAQRSLYKDVMMENYGNLVSLDVLNKDKDEEPTVKQEIEEIEEVEPQSVIVTRIKSEIDQDPMGRETFELVGR

SEQ ID NO: 21674 - protein, 81 aa, Capra hircus
EQGLIAFEDVAVHFSQEEWGLLDTAQRALYRRVMLENFALLASLGLSVSQPRVVTQLERGDEPWVLSGADVTLAQDAQRRP

SEQ ID NO: 21675 - protein, 81 aa, Capra hircus
QAEVTFKDVAVFLSQEEWGLLGPAQKGLYREVMLETYRNLVSLGAGLAGPKPEVIVHLERGDELWSLCVLSGKEGWRQAHG

SEQ ID NO: 21676 - protein, 81 aa, Capra hircus
ELVTFRDVVISFSQEEWEYLDSVQRDLYWDVMMENYSNLVSLDLESKYDTKTLSVEKDILEKNNSQWEVIENSKLVGLQNS

SEQ ID NO: 21677 - protein, 81 aa, Chrysochloris asiatica
KVPVTFVDIAVYFSEDEWKSLDGWQKELYNNLVKENYKTLMSLDAENPAPKQAAPPQVEPREEPCVWEQRNPEERDIPVDP

SEQ ID NO: 21678 - protein, 81 aa, Chlorocebus sabaeus
YQDLVIFEDTAVDFTQEEWTLLDPVQRNLYRDVMLENYENVAKVGFQLLKPSVISWLEEKELRTLQQGVLQDRAMKHQTSV

SEQ ID NO: 21679 - protein, 81 aa, Chrysochloris asiatica
MLENYSHLVSVGYQAGNPGALSMLEQGELWAIEDEIHSRICPEICKVHDHLQGPLESQQMLKTVEQYQEHNFYIKTLKSNL

SEQ ID NO: 21680 - protein, 81 aa, Chrysochloris asiatica
RREPVTFEDVAVYFSENEWSSLAPAQRALYRDVMLENYGAVASLAFSFPKPALISQLERGEAPWSLAPQGALDGEGSRGIS

SEQ ID NO: 21681 - protein, 81 aa, Chrysochloris asiatica
FQESVTFKDVIVDFTWEEWKQLDPVQRDLFRDVTLENYTHLVSIGLQVSKPDVISQLEQGTEPWMVEPGVPFGDWKTRPEN

SEQ ID NO: 21682 - protein, 81 aa, Suricata suricatta
MLENYGHLLLLGLVSKPDLVNFLEQKMEAWDVNRRGTVATHPAVSSHDMLSFLLKSCIEVSFQNKSMGGCKHNTLENLHLM

SEQ ID NO: 21683 - protein, 81 aa, Suricata suricatta
TLREFVIHRVIAMDFTLEDWEQLGLDQGDLFWDTALDNYQNLFLLNPCKPKLTSYPDGGKELEAVVRESPKSEGLAPYFSP

SEQ ID NO: 21684 - protein, 81 aa, Suricata suricatta
KPGAVSFADVAVYFSPEEWGCLRPAQRALYRDVMRETYGHLGALGFRGTKPALICWVEEEADLWGPEARDPEVGACLTEAD

SEQ ID NO: 21685 - protein, 81 aa, Chrysochloris asiatica
LLSPLQVSVIFEDVFLYFSQGEWRLLDESQRLLYRDVMLDNFALIASLGISQLVHGEEPRVPGPTRKAQREPGPGCLCAVE

SEQ ID NO: 21686 - protein, 81 aa, Suricata suricatta
AVDFTQEEWGQLDPLQRTLYRDVMLETYGHLLSVGNQIAKPEVICLLEQGEDPWSVEQAHPQSTCPEWMRNLESKALIPTQ

SEQ ID NO: 21687 - protein, 81 aa, Suricata suricatta
MLENYGHLLFLGLVVLKPDLVTFLERKRELWDVKRKETIASYPAVSSNANERLPPKIFIETTFQNVSVDSYKHSALENGPL

SEQ ID NO: 21688 - protein, 81 aa, Chlorocebus sabaeus
HELLTFKDISVDFTQEEWGQLAPAYQNLYREVMLENYSNLVSVEAGYQLSKPSVISQLEKGEEPWMAEKEGPGDPSSDLKS

SEQ ID NO: 21689 - protein, 81 aa, Sus scrofa
MSFEDVTVDFSREEWQHLDPAQRRLYQDVMLENYSHLLSLGYEIPKPEVILKLEQGEEPWMLERDTPHRRCSDGKFGIKTS

SEQ ID NO: 21690 - protein, 81 aa, Sus scrofa
MLETCGLLVSLGHPVPKPELIHLLEHGQELWTVKRGHSKSTCAGDKAKPKTTELTASQPALTEEAPFEERVTHGPSRHSRL

SEQ ID NO: 21691 - protein, 81 aa, Mandrillus leucophaeus
SVAFEDVAVTFTQEEWALLDPSQKTLYRDVMQETFRNLASVGKKWKAQNIYVEYENLKRNLRTFVGERFFESKEGYQHGEI

SEQ ID NO: 21692 - protein, 81 aa, Sus scrofa
SQEPVTFEDVAVYFTQNQWASLAPAQRALYREVMLENYVNLTSLAAFPFSKPDLIFQLERGEAPRGLDPWTPVGGEALRGV

SEQ ID NO: 21693 - protein, 81 aa, Mandrillus leucophaeus
IYFSQEEWELLEYTQKALCNDVMQENYETVISLALFVLPKPKVISCLEQGEEPWVQVSREFKDSAGKSPTGLKLKNDTENH

SEQ ID NO: 21694 - protein, 81 aa, Sus scrofa
LGSPSPVLSCPPAFASGQQGCMLTSMMFQSPVSFKDVAVTFTWEEWGQLDPAQRTLYREVTLETCSHLVSLGNVGVWDPIS

SEQ ID NO: 21695 - protein, 81 aa, Sus scrofa
MLEICTHLVSLEYVISKPDLVRLLEQKKDPWDVKGMETVAIQPALSSHDTQGLMPPNPGMELFLQTALLGEFESSPVGTFD

SEQ ID NO: 21696 - protein, 81 aa, Sus scrofa
QEDDLKFKDVAIYFSQKEWECLHFAQKDLYREVMFENYNNLIALGFSNSKPDVISLLEQGKEPWLVRSKEIKEWCPDWESR

SEQ ID NO: 21697 - protein, 81 aa, Neophocaena asiaeorientalis
MLENYFNLISVGCQVPKPEVIFNLERGEQPCMLDGEISSQSYLDQGIGFETSQQGMSEEVSIQFERINLFTRDDLYSILEE

SEQ ID NO: 21698 - protein, 81 aa, Neophocaena asiaeorientalis
QGSVTFEDVVVYFSWEEWGLLDEAQRCLYHDVMLENFALVTSLGCWYGMEDEEAFSVQSVSVEPMSLGKTPTPDPSIQKTH

SEQ ID NO: 21699 - protein, 81 aa, Loxodonta africana
QPVSFSAHPTAGVLVFKPELISRLEQGQEPWVLDLQGSEGRETPRTSQTESTIRTDNEQACEEMDILKSEDIPPSPGFADS

SEQ ID NO: 21700 - protein, 81 aa, Capra hircus
YACWVTFSDVAIDFSHEEWRWLNSTQRDLYKDVMVQNYENLVSLAGLSIPKPYVIALLEDGREPWMVEEKLSKDMFSDCKS

SEQ ID NO: 21701 - protein, 81 aa, Capra hircus
AQLTFKDVFIDFTPEEWECLDPAQRTLYKDVMVEILRNLLSVDMSHIHMVKKLQAKANCGKGEIFERVMFGRAEILEIKDF

SEQ ID NO: 21702 - protein, 81 aa, Capra hircus
RLTSEDVAIEFTPEEWEFLDPAQRALYRDVMLETYRNLLSVDISPTHVIKHLQPTANSDKLETFQTLMLGSPESCEIKHVH

SEQ ID NO: 21703 - protein, 81 aa, Capra hircus
AHMSLSFRDVAIDLSQEEWECLDPFQRALYRDVMLENYSNLVSLGCSTPKPDMITLLEQEKEPWMIMREGTGSWFTDLESK

SEQ ID NO: 21704 - protein, 81 aa, Capra hircus
QLTIEDVAIEFTPEEWECLAPAQRTLYWDVMLETYRNLLSVDISPIHIIKKLQPKENTNSTDTFQTVILGRHESPGVKDFY

SEQ ID NO: 21705 - protein, 81 aa, Capra hircus
VQDCVVFEDVAVYFSQEEWGLLDEAQRHLYHAVMAENLALVTSLGCWHGAPGEETSSEQGVSIVMSEVRTAKPDPSSRKAQ

SEQ ID NO: 21706 - protein, 81 aa, Capra hircus
QAQETFTFADVAVDFTWEEWQLLAPVQKALYRDVMLENYSNLVSVGFQASTPEVLSKLDQGEPWMMDDEIHCQTHSEVWKF

SEQ ID NO: 21707 - protein, 81 aa, Chrysochloris asiatica
SQAPVTFEDMAMYLTREEWRPLDPTQRDLYRDVMQENYGNVVSLDFEIRSENEVNPKQEISEDVKFGTTSERPVGNTEENP

SEQ ID NO: 21708 - protein, 81 aa, Chlorocebus sabaeus
PRGHLTFMDVAIEFSQEEWKCLDPGQRALYRDVMLENYRNLVSLGICLPDLSIISRLKQRREPLTLQSEVKIVKNPDGRQC

SEQ ID NO: 21709 - protein, 81 aa, Chrysochloris asiatica
FWTLVTFKDVLVDFTEEEWTLLSTAQQILYKRVMLENYKNLVFLGLQFPKPEVILRLEKDEAPWLMEIHQETIPGSETAVE

SEQ ID NO: 21710 - protein, 81 aa, Chrysochloris asiatica
SQASVSFMDVAVELTQEEWQHMGPAQRTLYRDVMLENYSHLVSLGYCLTKPEMIFKLEQGEDPWSLEEEFPAQCYSGYCKG

SEQ ID NO: 21711 - protein, 81 aa, Suricata suricatta
THGSTPFSSVAVAFTQDAWRHLIPAPRDRFKEGSPGNTRNLVLLGLPVSQPGMNSQLEQREEGPWVLEGGGLRSTCPDWKL

SEQ ID NO: 21712 - protein, 81 aa, Chlorocebus sabaeus
FQGSVTFRDVAIDFSQEEWKWLQPAQRDLYRGVMLENYGHLVSLAGLSISKPDVVSLLEQGKEPWLGKRNVKRDLFSVSES

SEQ ID NO: 21713 - protein, 81 aa, Suricata suricatta
MSFKGVTVDFTRDEWLQLTGTQRTLCRGVMLENYSHPAAVGGGARCKPFLIRQPSLHLRGLKQKRNPLIVQNTGAIPVTSQ

SEQ ID NO: 21714 - protein, 81 aa, Chlorocebus sabaeus
GCPIPRPELIYHLEHGQEPWTRKEDLSQDTCPGDKGKAKTTEPTTCEPALSEGISLQGQLTEGNSVDSQLGQAEDQDGLSE

SEQ ID NO: 21715 - protein, 81 aa, Suricata suricatta
SQGLVTFRDVALGFSQEEWEWLDPSQKDLYRDVMLENYRNLVWLGLSMSKPNMISLLEQGKEPWMVEKEMSDGPYADWESW

SEQ ID NO: 21716 - protein, 81 aa, Chrysochloris asiatica
SQELLTFRDVAVEFSQDEWDCLEPAQRALYRDVMLENYRNLVSLGEIGCSDLNSISILEQEREPAFMEMKIATKHKKTNGW

SEQ ID NO: 21717 - protein, 81 aa, Suricata suricatta
AQESVTFKDVAVDFTQEEWALMDTTQRTLYRDVTLENISHLVSVGCHFFRSDVISQWEQRGELWREERGPPQGWSPGMKNN

SEQ ID NO: 21718 - protein, 81 aa, Mandrillus leucophaeus
PKVPVTFDDVAVYFSEQEWGKLEDWQKELYKHVMRGNYETLVSLDYAISKPDILTRIERGEEPCLDGWGQEKQNEVEVGHP

SEQ ID NO: 21719 - protein, 81 aa, Mandrillus leucophaeus
ELLTFRDVAIEFSPEEWKCLDPAQQNLYRDVMLENYRNLVSVGVAISNPDLVTCLEQRKEPYNVKIRKIVARPPAVCSHFT

SEQ ID NO: 21720 - protein, 81 aa, Sus scrofa
SQVSVTFEDVAVLFSRDEWRRLGPSQKNLYQDVMLENYSNLVSLGLPFSKPKVISLLQQGEDPWKVEKESPGSFPGCKSSP

SEQ ID NO: 21721 - protein, 81 aa, Mandrillus leucophaeus
IQGLLTFGDVAVAFTRIEWRHLDAAQRALYRDVMLENYGNLVSVGLLSSKPKLITQLEEGAEPWMEVREAPSGPRAVQDYW

SEQ ID NO: 21722 - protein, 81 aa, Sus scrofa
SWGSVTFSDVAIDFSQEEWEWLQPAQRDLYRHVMLENYGHLVSLAGLNISKPDVVSLLEQGKEPWLGKGDVNRDLFSASES

SEQ ID NO: 21723 - protein, 81 aa, Sus scrofa
MLENYGHLVSLAGLNISKPDVVSLLEQGKEPWLGKGDVNRDLFSASESNGEIKEFSQKSIIYEDDSFQYLMVERFLSQGSE

SEQ ID NO: 21724 - protein, 81 aa, Sus scrofa
IKKLLTVEDVAINFSPEEWECLDLSQWDLYRDVMIEICRHLVSLEYVISKPDLVRLLEQKKDPWDVKGVETVREGGQKKYS

SEQ ID NO: 21725 - protein, 81 aa, Sus scrofa
SQEQVSFKDVCVDFTQEEWYLLDPAQKILYRDVILENYSHLVSVEDWKVDDLIESSQENQDEHFWQLAFTTNKTLSTESGD

SEQ ID NO: 21726 - protein, 81 aa, Sus scrofa
EMGLLTFEDVAIDFSPEEWECLDLGQRHLYRDVMLEICRHLVSLGEDPFLPEFLFSHWVKKHTGGKPDKCEESTSYSAFTR

SEQ ID NO: 21727 - protein, 81 aa, Sus scrofa
STGSLSFKDVAVGFTRKEWQQLDSAQRTLYREVMLENYSHLVSVGCQVTKPAVISRLEQGQEPWMKEEEILRWSTPQDSQQ

SEQ ID NO: 21728 - protein, 81 aa, Sus scrofa
MEAVTFGDVAVHFSREEWQCLDPGQRALYKEVMLENHSSVAGLGFLVFKPELISRLEQGQEPWVLDLQGTEGREAPRPSRT

SEQ ID NO: 21729 - protein, 81 aa, Neophocaena asiaeorientalis
MLENYSNLVSLGLLFSKPEVISLLQQGEDPWKVEKESPGGSSLGCKSSPKTTKSTQTQDSSFWGPVRKRLKKNEPWNFISE

SEQ ID NO: 21730 - protein, 81 aa, Pteropus vampyrus
PQAKVTFEDVAVLLSQEEWDHLCPAQRGLYRHVMMETYGNVVSLGLPGTKPNVISQLERGEEPWVLDGQGAEESRGLGGGR

SEQ ID NO: 21731 - protein, 81 aa, Trichechus manatus
AVTFKDVAVVFTEEELALLDKTQISLYQDVMLENFRNLVSVGDGIKSTISNLQEKGLSYLSQEVLYCWQIWKQRISDLTES

SEQ ID NO: 21732 - protein, 81 aa, Trichechus manatus
TFREAVTFKDVAVAFTEEELELLDPAQRKLYQDVMVENFRNLVSVGHQPFERDISHIERREKLWLMKIAIQRERNSGEKNQ

SEQ ID NO: 21733 - protein, 81 aa, Trichechus manatus
SVVVEDVAVDFTQEEWALLDHSQRQLYRDVMMEIFRSLTSVASQNLIDGDKLSTENIIVRFMKNDTWSSMVGEICELPGTE

SEQ ID NO: 21734 - protein, 81 aa, Trichechus manatus
NQESLTYRDVAVDFTWEEWQLLDTAQKDLYRDVMLENFSNLVSVGFQAGKPDALSKLERGEEPWTVEDEIQRQARSAYSDD

SEQ ID NO: 21735 - protein, 81 aa, Trichechus manatus
VCASVSFKDVAVELTQEEWQHMGPAQRTLYRDVMLENYSHLVSAGYCITKPEVIFKLERGEEPLSLEEFPSHGYRENCKAD

SEQ ID NO: 21736 - protein, 81 aa, Trichechus manatus
MLENYRNLVSLGLCISKPDVISLLEQGKEPWEVNRQMTRGLCPDLEYVWVTKELFPKQDIYEEKLSQEMLMEKLRSCGLEC

SEQ ID NO: 21737 - protein, 81 aa, Trichechus manatus
AQESLTFSDVAVKFTWEEWQLLDPTQKDLYWDVMLEDYSNLVSIGCQVSKPDALSRLERGKQPWTILDESHRVIFSEIMNI

SEQ ID NO: 21738 - protein, 81 aa, Trichechus manatus
PKVPVTFDDVAVYFSEQEWGQLDEWQKELYKHVMRGNYETLVSLDYAISKPEVLSQIEQGKEPCNWRRTGPKIPDVPVDPS

SEQ ID NO: 21739 - protein, 81 aa, Trichechus manatus
RQAAVTFEDVAVLLSQEEWDRLGPAQRGLYRNVMMETYGNVVSLGLPGSKPEVISQLERGEEPWVLDEQETEGREHLRNGH

SEQ ID NO: 21740 - protein, 81 aa, Trichechus manatus
SVVVEDVAVVFSQEEWALLDLPQRKLYRDVMMETFRNLDSIVSGTLNDGERLSTEPTMMQLMKNNTWSSMLVEISESHGNK

SEQ ID NO: 21741 - protein, 81 aa, Trichechus manatus
QESSVTFEDVVLTFTKEEWGLLSPAQRSLYQEVMLETWRLSISLGRPVPKPELIDLLEHRQELWVVKRGPSQGTCPGDRAK

SEQ ID NO: 21742 - protein, 81 aa, Trichechus manatus
MQGPVTFEDVAVYFSWDEWGILNVTQRLLYCDVMLENFALIGSLGCLCGSEDKTAVLEQVKSCWAHLSEQPFTCEECSKDF

SEQ ID NO: 21743 - protein, 81 aa, Trichechus manatus
AQESLTFSDVAVKFTWEEWQLLDPAQKDLYWDMMLENYSNLVSVGCQVNKPDALSKLERGEQPWTILDESHSGIFSEIQKV

SEQ ID NO: 21744 - protein, 81 aa, Trichechus manatus
DSVAFEDVAVDFTQEEWALLDLSQRQLYRDVMMEIFRSLASVGEICELHGIEDQDKNQKTHVSMLPVFNRRHMLENLCESN

SEQ ID NO: 21745 - protein, 81 aa, Trichechus manatus
SVVFEDVAVDFTEEEWALLNFAQRKLYRDVMMETFRNLASVVSQKVDKEQMVSTEHLIMRFMKNNFQYTILGETCEFHGFE

SEQ ID NO: 21746 - protein, 81 aa, Trichechus manatus
SLVVEDVAVVFSQEEWALLNLPQRKLYRDVMMETFRNLASVVSRNFDDEENLSSERIMVQFIKNKTWSSMLEFSKLHGNKD

SEQ ID NO: 21747 - protein, 81 aa, Equus caballus
PHWLVTFRDVAIDFSQEEWECLDPAQRDLYREVMLENYSNLVSLAGCSVPKPDVFSLLEQGKEPWMVVRAMARRRSSDLES

SEQ ID NO: 21748 - protein, 81 aa, Equus caballus
PRGRAGEDSVTFGDVAVYFSWEEWRLLDEAQRHLYHDVMLENFALISSLGKALSLPVTWTKLYPDSPPYLHPKDKSHLIIV

SEQ ID NO: 21749 - protein, 81 aa, Equus caballus
QESVTFEDVAVVFTQEEWALLDTSQRKLFRDVMLENISHLVSIDWEGDLKKQEVICMQHICKKDTSLISAMSSHTQEDSFE

SEQ ID NO: 21750 - protein, 81 aa, Equus caballus
SQGPVTFEEVVVDFSWEEWELLEPAQKILYRDMMLENFRNLTSGRYHLCKPNLRTQEKQEAGDQEEKNSPRTCADQKSQLE

SEQ ID NO: 21751 - protein, 81 aa, Equus caballus
LQGLVSFEDVAVHFTWEEWQDLDDAQRTLYKDVMLETYSSLASLGHCITKPEVIVKLEQDAEPWTVEAPPNQSLPGGSMRT

SEQ ID NO: 21752 - protein, 81 aa, Equus caballus
FQESVTFEDVAVYFSENEWTGLAPAQRSLYRDVMLENYGAVSSLGYPFLKPAGISHLEQVEEPLNLKLQGEGPSLICTEGV

SEQ ID NO: 21753 - protein, 81 aa, Equus caballus
MFQDVAIDVSQEEWECLNPAQRNLYKDVMLENYSNLVSLGLSVCKPAVISSLEQGKEPWMVVREVTGGRCPDLVSRCKPKK

SEQ ID NO: 21754 - protein, 81 aa, Equus caballus
DHGLVMFQDVAIDVSQEEWECLNPAQRNLYKDVMLENYSNLVSLGLSVCKPAVISSLEQGKEPWMVVREVTGGRCPDLVSR

SEQ ID NO: 21755 - protein, 81 aa, Neovison vison
REVMLENYANVASLAFPFPKPDLISQLESGEAPWGPDPWEAELLRGICPGGESWMKEEEPAVKQEASEQAEMSRMPGGGLL

SEQ ID NO: 21756 - protein, 81 aa, Neovison vison
EVIFKLEQGEEPWILERKTPHQSHTDGKFGIKTSQKRISGKASFHGEMEGEDTRDDSLYSILEELWQDSEQIKRYQEKQSK

SEQ ID NO: 21757 - protein, 81 aa, Mandrillus leucophaeus
VAFEDVAVNFTQEEWTLLDISQKNLFREVMLETFRNLTSIGKDDSFPFLSALVNQSLIEEKVNEIKEDSHCGETFTQVPDD

SEQ ID NO: 21758 - protein, 81 aa, Sus scrofa
SREGSVSFRDVAVDFSREEWQQLDLDQKNLYRDVMLETYSHLLSVGYQVPDPEVLKLEQGKDPWALQGESPHQSCLEELWQ

SEQ ID NO: 21759 - protein, 81 aa, Mandrillus leucophaeus
GRRAEEAVTFKDVAVVFTEEELELLDPAQRKLYRDVMLENFRNLLSVGHQPFHGDTFHFLREEKFWVMETASQREGTSGPL

SEQ ID NO: 21760 - protein, 81 aa, Mandrillus leucophaeus
MCGPLTFRDVKIEFSLEEWQCLDTAQRNLYRDVMLENYRNLVFLGIAVSKPDLITWLEQEKEPWNVKRREMVDKTPVMCSH

SEQ ID NO: 21761 - protein, 81 aa, Mandrillus leucophaeus
MARGCSISKPDVITLLEQGKEPWMVVRDEKRRWTLDLESRYDTKKLFQEKDIYEMNLSQWKVMERIKSCGLEGQESPHEVC

SEQ ID NO: 21762 - protein, 81 aa, Mandrillus leucophaeus
LEMGPLTFRDVAIEFSLEEWQCLDTAQQDLYRKVMLENYRNLVLGIDVSKPNLITCLEQGKDPWNMKRHSMVVKPPVICSH

SEQ ID NO: 21763 - protein, 81 aa, Sus scrofa
SLDSVTFTDIAIDFSHDEWEWLNPAQRTLYKKVTLENYGNLVSLGLCISKPDVISLLEQGKEPWMVTGETTGGLCPDLEYV

SEQ ID NO: 21764 - protein, 81 aa, Sus scrofa
FQEAVTFKDVAVTFTEEELGLLDSTQRKLYRDVMLENFRNLLLVGNQPFKPELIFQLEREEMLLMLETEIQRGRCSGTKSH

SEQ ID NO: 21765 - protein, 81 aa, Sus scrofa
TFKEAVTFKDVAVAFTEEELGLLDSAQRKLYQEVMVENFRNLVSVGHQPFKRDTSCKEKEKLWMMNLATQVNLDKNQMIMS

SEQ ID NO: 21766 - protein, 81 aa, Sus scrofa
MTSIFQLSLSGFIFSTSLIAAENEQIPGYCVNKPNAVFKLKQGKEPWILEVEFPRRNNPEDLWNIHDQGAKHKKSQAENSR

SEQ ID NO: 21767 - protein, 81 aa, Sus scrofa
FQGLLTVEDVAIDFSPEEWECLDLGQRHLYRDVMLEICRHLVSLEYVISKPDLVRLLEQKTDPWDMKGMETVAIQPALSSH

SEQ ID NO: 21768 - protein, 81 aa, Bos mutus
VRESVTFKDVAVLFTQDEWAQLSPAQRALYRDVMLENYSNLVSLGLLGPKPDMFSQLGEGEEWMPEDSLGGFCLDWVITPT

SEQ ID NO: 21769 - protein, 81 aa, Bos mutus
SVTFTDVAVYFNQEEWTLLNPFQRKLYRNVMLENYKNLTTAVNESKRSLNHHPSISPQTQSHNGQELYDCEHSWKDFSDSD

SEQ ID NO: 21770 - protein, 81 aa, Neophocaena asiaeorientalis
ISKTSVSFKDVTVEFTLEEWQCMSSAQKTLYRDVMLENYSLLVSSGYCLTKPDVIVKLEQDDPLLLEEEILSKSHADCKLD

SEQ ID NO: 21771 - protein, 81 aa, Neophocaena asiaeorientalis
SQGSVTFRDVAVDFSREEWEWLQPAQRDLYRHVMLENYGHLVSLGLNISKPHVVSLLEQGKEPWLGKDASRGLFSASESNG

SEQ ID NO: 21772 - protein, 81 aa, Bos mutus
SLEPLTFKDIIVDLTQEEWGHLAPAHQNLYREVMLENYGNLVSVGYQLSKPGVVSQLEKGEEPWLMKREVSGGPSPGKSKA

SEQ ID NO: 21773 - protein, 81 aa, Equus caballus
LQVLVSFEDVAVLLSQEEWGLLDPAQRGLYRDVMLETYRNLVSLGLQGSKSDVISRLEQGQEPWAPHSPRIEASWIWRLRS

SEQ ID NO: 21774 - protein, 81 aa, Neovison vison
ENYKNLVSLGHQLPKPHVILQLEKGEEPWLVERGIHQETQADLETAVEIKSISSKSISKNKQSCGIKMEGIAKSDLWYLSL

SEQ ID NO: 21775 - protein, 81 aa, Neovison vison
AVSPQDLAYICKSEVPPPSKDHSCSQDVELFARNGLERRVPAGVGSQESVTFQDVAVDFTEKEWPLLDSSQRKLYKDVMLE

SEQ ID NO: 21776 - protein, 81 aa, Loxodonta africana
SQSLISFSQMTTWFYPESWGKEHWLSKNVFLKEKISNFGNFFTLGLCISKPDIISLLEQGKEPWIMKRKMTQGQGPDLKPL

SEQ ID NO: 21777 - protein, 81 aa, Capra hircus
SHTLVTFKDILVNFTREEWKLLDTAQQIMYKDVMLENYRNLVSLGHQLPKPDVILRLEKGEEPWLVEREIHQETHPDLETS

SEQ ID NO: 21778 - protein, 81 aa, Capra hircus
MLENYGNVASLGFPLLKPAVISQLEGGGELEGPSPLASGAGTDIDIQTDNNLTEEMYEEKYNISHELQRNSFQETDFSETY

SEQ ID NO: 21779 - protein, 81 aa, Capra hircus
FQEPVTFRDVAVDFTQEEWGQLGPAQRTLYRDVMLETFGHLLSVGPELPKPDVISQLEQGAELWVAERGLAQGCQTPALLE

SEQ ID NO: 21780 - protein, 81 aa, Suricata suricatta
EEWGYLSHSQWELYRDVMLENYRHLLFLGYICKECGNVFNGHSALIQHQKVHTGENAYQCVEGDKTFNYGSSVNGHRLIHN

SEQ ID NO: 21781 - protein, 81 aa, Chrysochloris asiatica
QEPVTFEDIALYFTQSQWAILNLAQKALYREEIQKHYANVASLHKTSLLPAITCPSILEQGELPWGLDPCEPVDRGTLRAV

SEQ ID NO: 21782 - protein, 81 aa, Chlorocebus sabaeus
MLATGVSARTRGCPPTTEPHAGFLVFKPELISRLEQGEEPWVLDLQGAEGTEAPRTSKTDSMIRTENEQSCEDMDILKSES

SEQ ID NO: 21783 - protein, 81 aa, Chrysochloris asiatica
LFTFRDVAVEFSQEEWECLNPAQRALYRDVMLENYRNLVSLGEDNFPSKTLSPKEIINKGELCQTLFLEGPERYGIGDFDF

SEQ ID NO: 21784 - protein, 81 aa, Suricata suricatta
KSLGSVSFKDITVDFSREEWLHLDLAQKSLYRDVMLENYFNLISVGCHVPKPEVIFHLEQEEPCVLDGDIPSHRCLDGDVG

SEQ ID NO: 21785 - protein, 81 aa, Suricata suricatta
HQEPVTFEDVAVYFTQNEWVTLDPSQRALYREVMLENYANVASLAFLFARPALVSRLERGELPWGPGPWEPSGGHALGGVC

SEQ ID NO: 21786 - protein, 81 aa, Suricata suricatta
AHGSLMFSDVSIVFSQEEWECLDLEQRDLYRDVMLENYTNLVSLGCFISKPDVISLLEQGKEPWKVVRKRRGQYADLETRY

SEQ ID NO: 21787 - protein, 81 aa, Chlorocebus sabaeus
FQQLMMFRDVAVDFCQEEWECLDLEQRDLYRDVMLENYSNMVSLGLCIYQPEVFSLLEKGKEPWKILRDETRGPYPDMQSR

SEQ ID NO: 21788 - protein, 81 aa, Chlorocebus sabaeus
FQGFVSFKDVAVNFTDEEWKELDPAQRVLYRDVMLENCRNLVSLIGCPFSKPAIISQLEEVVNPRTHMQEGEVPRSSCTGK

SEQ ID NO: 21789 - protein, 81 aa, Chlorocebus sabaeus
QTLLTFRDVAIEFSLEEWKCLDPAQQNLYRDVMLENYRNLFSIGLTVSKPGLITCLEQSKEPWNVKRQEAADGHPEMGFHH

SEQ ID NO: 21790 - protein, 81 aa, Chlorocebus sabaeus
PQRSVSFQDLTVNFTQEEWQQLDPAQRLLYRDVMLENYSNLVSVGYHVSKPDVIFKLEQGEEPWIVEEFSNQNYPIDDALE

SEQ ID NO: 21791 - protein, 81 aa, Mandrillus leucophaeus
PQEAVMFEDVAVYFTRIEWSCLAPDQQALYRDVMLENYGNLASLGFLVAKPALISLLEQGEEPGALILQVAEQSVAKASLC

SEQ ID NO: 21792 - protein, 81 aa, Mandrillus leucophaeus
RVTFKDVAVVFTKEELALLDKAQINLYQDVMLENFRNLISVGDGIKNSILNLQEKGLSYLSQEVLRCWQIWKQRIRDLTVS

SEQ ID NO: 21793 - protein, 81 aa, Mandrillus leucophaeus
SKAPITFGDLAIYFSQEEWEWLSPIQKDLYEDVMLENYRNLVSLGLSFRRPNVITLLEKGKAPWMIEPVRRRRAPELTEAS

SEQ ID NO: 21794 - protein, 81 aa, Sus scrofa
RQVSVTFKDVAVTFTREEWGQLDLDQRTLYWEVMLETCGLLVSLGHPVPQPELTHLLEHRQEPWAVTRGRSRRTCTGDRAK

SEQ ID NO: 21795 - protein, 81 aa, Sus scrofa
MSFSAETVVPERSRSQVTDTCPAYTFRDFSIFPRPAKYEEILWYCIPKPELIFRLEQGEQPWILEEESPSQSYPGVCRVDN

SEQ ID NO: 21796 - protein, 81 aa, Sus scrofa
QGLLTFQVAATKFSQDEWEFTYIVQWELYRDMMLENYRNLVSLGRFWSSFRGIFLRQKSDPWDGKGMETTYPGSGTPPGEG

SEQ ID NO: 21797 - protein, 81 aa, Bos mutus
QAQLSFKDVFIDFTPEEWECLDPAQRSLYKDMMVETLRNLLSVDMSHIHMTKKLQTKASSGKGEIFQRVMFGRAESPEIKD

SEQ ID NO: 21798 - protein, 81 aa, Neophocaena asiaeorientalis
RQVGVTFEDIAVYFSWEEWRLLDEAQIRLYLDVMLENYALISSLGCCCGAEDAEAPFEQIASLGMTQARTPKAALCSQKMH

SEQ ID NO: 21799 - protein, 81 aa, Bos mutus
LTVEDVDIKFTPEEWECLDPAQRALYWDVMEETYRNNLLSVARISVSDLNLTSILVAEEDLWIVENEVQMSGNQMSYKSQI

SEQ ID NO: 21800 - protein, 81 aa, Bos mutus
TDSQVGQITAKDLSREEMVRRWSTHIRQAGQLQHGNMSSPPAGCQLSKPSVISQLEKGEEPWMTEKEGPGDPNSDLKSKTE

SEQ ID NO: 21801 - protein, 81 aa, Nomascus leucogenys
TTFKEAVTFKDVAVFFTEEELGLLDPAQRKLYQDVMLENFTNLLSVGHQPFHPFHFLREEKFWMMETATQRDGNSGGKTVA

SEQ ID NO: 21802 - protein, 81 aa, Equus caballus
RYSSMTFSDVAIDFSQQEWEGLDPVQKTLYQDVMVESYRNLVSLGIHSNSKPDVITLLEQGKEPWMVVREETRRCYTSKYE

SEQ ID NO: 21803 - protein, 81 aa, Equus caballus
SQGPVSFKDVAVDFTQEEWQQLDPDEKMTYRDVMLENYSHLVSLGYDSTKPNVIVKLEQGEEPWVAEGEFPCRGHAEIWKV

SEQ ID NO: 21804 - protein, 81 aa, Neovison vison
VMLENYGNLTSLGYPVPKPILISLLEGENLPWGLEAQENPSAEGTKDICKDTETSIGNESTSTQGLSEERDVILLHGLRKS

SEQ ID NO: 21805 - protein, 81 aa, Neovison vison
LLAPAQKNLYRDVMLENYRNLVSVGYKASKPDAISRWEQGELWTTEDEIHSQICPEIKKDDGHLQGHLQNQRCPKRMIQCH

SEQ ID NO: 21806 - protein, 81 aa, Capra hircus
ISQERLTSEDVAIEFTQEEWEFLDPAQRALYRDVMLETYGNLLSVGEDDFLPELPLGICIFPVCPLGGPDVFHLRVLVTGA

SEQ ID NO: 21807 - protein, 81 aa, Capra hircus
RLTSEDVAIEFTQEEWEFLDPAQRALYRDVMLETYRNLLSVDISPTHVIKHLQPKANSDKLETFQTLMLGNPESCEIKYFH

SEQ ID NO: 21808 - protein, 81 aa, Capra hircus
WKAWVKKPVTFEDVAVNFTQEEWKCLDASQKVLYQDVISETVRNLMSVDLIAKLEQEKKQWEADLCSPNGEGFHSGGEKEE

SEQ ID NO: 21809 - protein, 81 aa, Capra hircus
AQETLSFKDVAVDFTWEEWQLLAPAQKTLYRDVMLENYSNLVSVGYRVSKSDVLSKLEQGKERWMTEDEIHSRTWPETGNI

SEQ ID NO: 21810 - protein, 81 aa, Capra hircus
IAAAGPAEAAKEWEQLDPAQKSLYKDVMLENYSNLASMGYQALKPDMISKLEKGEEPWLGKGKRPKQAGSKVHQDDDQLKN

SEQ ID NO: 21811 - protein, 81 aa, Suricata suricatta
SLETVTFKDVAVDLTQEEWQQLKPAQRNLYRDVMLENYSNLVTVGYQVTKPDVIFRLEQEEEPWVVEEEMLGRHCSEVWEV

SEQ ID NO: 21812 - protein, 81 aa, Chrysochloris asiatica
SLATVTFTDVAVDFSQEEWQQMKPAQRNLYREVMLENYSNLVTVGCQVTKPDVIFKLEQEAEPWLVKETMFGRHWSGGGVL

SEQ ID NO: 21813 - protein, 81 aa, Chlorocebus sabaeus
MFRDVAIDVSQEEWECLNPAQRNLYKEVMLENYSNLVSLGLSVSKPAVISSLEEGKEPWMVVREETGRWCPDLASRDEPQK

SEQ ID NO: 21814 - protein, 81 aa, Chrysochloris asiatica
SQGLLTFRDVAVEFSQEEWDCLEPAQRALYRDVMLENYRNLVSLGISVSELNIISVLEQGTESWTVEWKEKRAKYPDVSEF

SEQ ID NO: 21815 - protein, 81 aa, Mandrillus leucophaeus
PQGLLTFRDVAIEFSQEEWKCLDPAQRTLYRDVMLENYRNLVSLEFRSVTQAKVQWCDLGSLQPPLPRFKQFSCLSLPSSW

SEQ ID NO: 21816 - protein, 81 aa, Suricata suricatta
MTFKDVAVEFTQWEWGQLDPSQKDLYREVMLENFKNLASLGLPVSKPYVICQLEEGEEPCVVEGEISTDWEKRPKTKESML

SEQ ID NO: 21817 - protein, 81 aa, Mandrillus leucophaeus
MLENYRNLVFLGIAVSKPDLITCLEQGKEPWNVKRHEMGAEPPVVCPYFAQHLWPKQGIKNYFQKVILRRYKKCGHENLQL

SEQ ID NO: 21818 - protein, 81 aa, Mandrillus leucophaeus
GVNKMSNEELVGQNHGMEGEACVGGDRDLYKDVMVQNYKNLVSVTGLSVTKPYVITVLEDGREPWMVEKKLSKGMIPDWES

SEQ ID NO: 21819 - protein, 81 aa, Sus scrofa
QGSCRCLDLTLQVSVTFDDVAVTFTQEEWGQLDPAQRTLYQEVMLENRGLSIHVATHMPCFSSWLLPLTLLPTLSFAPQHV

SEQ ID NO: 21820 - protein, 81 aa, Sus scrofa
VTFDDVAVTFTQEEWGQLDPAQRTLYQEVMLENRGLLVSLGERYRLEGGLEVFQPRSFRVFSSSLPPRIDVWPSVPEESST

SEQ ID NO: 21821 - protein, 81 aa, Sus scrofa
SQETSAFRDMFVDFTLEEWQQLDAAQKTLYRDVTLENYSHLLSVGYLVAQPEGIFSLGQAEGAGKADGEAPTITDIMVHIQ

SEQ ID NO: 21822 - protein, 81 aa, Trichechus manatus
MEDVAVVFSQEEWALLDLAQRKLYRDVMMETFRNLASIVSRNLNDEQKLSSEQIMARFMKNNTWSSMLGEISKSPRYKDQH

SEQ ID NO: 21823 - protein, 81 aa, Trichechus manatus
QERVNFKIVTVVYTQEEQGTLNSAQKILDRDVMLENHRDLVSWDLATAHDRRESVSKLSTFDEEPSHGVKIERLARGDPWL

SEQ ID NO: 21824 - protein, 81 aa, Zalophus californianus
MYFSQEEWELLDPTQEALYNDVMRENYETVISLALFVLPKPKVISYLEQGEDPWVQGPLELKNSPGELPSGLKVKTDNENH

SEQ ID NO: 21825 - protein, 81 aa, Zalophus californianus
MDAVVFADVAVYFTPEEWALLDRGQRRLYRDVMLETCRNLASLDCCIQVKPCGSGTQLNILENELSSEDKIVRFTRNDSWA

SEQ ID NO: 21826 - protein, 81 aa, Zalophus californianus
AAPALTFKDVAVTFTGEEWRHLDLAQRTLYREVMLETCGLLVSLGHPVPKPELTYLAEDGQELWTVRRGLSRSTYTGEKAK

SEQ ID NO: 21827 - protein, 81 aa, Zalophus californianus
PQGLVTFGDVVVDFTPEEWQYLNPPQKTLYREVMLETYSNLVSVAGPQVTKPDLILKLEVEEPCPAETKISFWSFPAACQI

SEQ ID NO: 21828 - protein, 81 aa, Equus caballus
FQESVTFEDVAVYFSENEWTGLAPAQRSLYRDVMLENYGAVSSLAFPFPKPALISQLERGEAPWCSAPQGVLDGEGPRGIS

SEQ ID NO: 21829 - protein, 81 aa, Equus caballus
HQEVVTFEDVAVCFTRAEWAGLSPAQRALYRSVMLENYGNLTSLGYPIPTPALISLLEGGDLSWGLEAQDDPPAERTTDIC

SEQ ID NO: 21830 - protein, 81 aa, Loxodonta africana
PKVPVTFDDISIFFSTPEWEKLEEWQKELYKNIMKGNYESLVSMDYAMNQPDVLSQIQPEGEHNPGGQAGPEESQIPTDPS

SEQ ID NO: 21831 - protein, 81 aa, Chlorocebus sabaeus
PRGSTFFSSVTVAFAREGWRCLVSTPRERYKEGIPEKSRNLVLLGLPVSQPGMNSQLEQREGTWMLEGKDVRSPSPGWKIV

SEQ ID NO: 21832 - protein, 81 aa, Suricata suricatta
KDQESLTLEDVAVDFSREEWQLLAPAQKDLYRDVMLENYRNLVSLGYVASKPEALSRLEPGGVWMTEGETHHRICPEIKKD

SEQ ID NO: 21833 - protein, 81 aa, Suricata suricatta
KIEGLVIVRDVAIDFSQEEWECLDPAQRDLYRDVMTENYSNALLGLSMPKPDVISLEQEKELWIVLRNRMGGWCPDRFKNV

SEQ ID NO: 21834 - protein, 81 aa, Suricata suricatta
FKEAVTFKDVAVVFSEEELGLLDPAQRKLYGDVMLENFRNLLSVGHGPFTPDVMPQFERGVALWMIKAAAPSQGSSGDKNL

SEQ ID NO: 21835 - protein, 81 aa, Suricata suricatta
QAEVTFEDVAVLFSREEWGRLGPAQRGLYRDVMLETYRNLASLGAGRAGSKPGVITQLERGDEPWVLDAQGAKGKGQPRVS

SEQ ID NO: 21836 - protein, 81 aa, Chrysochloris asiatica
QGGVTFEDVAIDFSQEEWGLLDEAQRLLYCDVMLETFAVTASLARPGLGSALLRAVYSLNSPNCAGKERQETSSRMQPPFL

SEQ ID NO: 21837 - protein, 81 aa, Chrysochloris asiatica
MPDLLTLEDVAVEFTREEWQLLAPAQKALYRDVMLENYSHLVSVGHQVSKPDALSQLQEEQPWTVLDNSCNRNFSEIWKVD

SEQ ID NO: 21838 - protein, 81 aa, Chrysochloris asiatica
FQEAVTFKDVAVVFSEEELRLLDFTQRTLYRDVMVENFKNLVSVGHHPFKLDMLFQLEAEEKLWMMETETQRSEYSRSRNP

SEQ ID NO: 21839 - protein, 81 aa, Chlorocebus sabaeus
MGLLTFRDVAIEFSLEEWQCLDTAQKNLYRNVMLENYRNLAFLGIAVSKPDLIICLEKEKEPWNMKQHEMVDEPPGICPHF

SEQ ID NO: 21840 - protein, 81 aa, Chrysochloris asiatica
GPVTFEDVTVVFTEAEWKRLSSEQKNLYREVMLEIYRSLLSLDKALKKLESSRFGAVSCGENGADCGLNSNFITNQKPVSR

SEQ ID NO: 21841 - protein, 81 aa, Suricata suricatta
MQPLMQHLGLRDLKGVQLAQACLRFSFTGYDSTKPKVILKLEQGEEPWVAEGELPCQSHPEARKADHMMEGIPENGDGLSR

SEQ ID NO: 21842 - protein, 81 aa, Chrysochloris asiatica
MGTVIIEDVAVVFTHEEWDLLDPAQRKLYRDVMMETLRNLASVGAVMESHGWKDHLDNQGRHLRIGTIKNLGERCEHNQCG

SEQ ID NO: 21843 - protein, 81 aa, Suricata suricatta
MSLGRRLFVDLALPVWQGHVNFEDVARLLYRDVMLENLTLMASLGYESSTSRTDASLELGTQPWVSDWAYLTPARTREAQG

SEQ ID NO: 21844 - protein, 81 aa, Chlorocebus sabaeus
MLFVFNKTGIVVSKPDLITSLEQGEKPLTMKKHEMVAKPPVLCSHFTQDLWPEQNIKDYFHKGILRRYEKCGHDNLQFKKG

SEQ ID NO: 21845 - protein, 81 aa, Sus scrofa
SQASVSFKDVTVEFTQEEWQQMGPIQKTLYRDVMLENYNNLVSVGNCIFKPEVIFKLEQGEEPWFLEEEFSNQNHKEDYRD

SEQ ID NO: 21846 - protein, 81 aa, Mandrillus leucophaeus
DSVVFEEVAVNFTPEEWALLDHAQRSLYRDVMLETCRNLASLDCCIYVRTCGSSSQRDVLGNGISNDEEIVKFTSDYWSIF

SEQ ID NO: 21847 - protein, 81 aa, Mandrillus leucophaeus
NGLLTFRDVAIEFSQEEWKCLDPAQRTLYRDVMLENYRNLVSLDISSKCTMKEFSSTAQGNTEVIHRETMQRRERHHIGDF

SEQ ID NO: 21848 - protein, 81 aa, Mandrillus leucophaeus
VHGSVTFRDVAIDFSQEEWECLQPDQRTLYRDVMLENYSHLISLGSSISKPDVITLLEQEQEPWMVVRKETNRWYPDLESK

SEQ ID NO: 21849 - protein, 81 aa, Sus scrofa
MFQVTFSDVAIDFSHEEWGWLDSAQRDLYKDVMVQNYENLVSLAGLSIPKPYVIALLEDGREPWMVEEKLSKSLFPDWESR

SEQ ID NO: 21850 - protein, 81 aa, Mandrillus leucophaeus
SQHLVTFKDVAVDFTQEEWTLLDQTQRDLYRDVMLENYKNLIILAGSELCKTSLMSGLEQMEELRTGVTGVLQERSNTAEK

SEQ ID NO: 21851 - protein, 81 aa, Sus scrofa
MAAPSPYDNRISRPSVISHLEQKEEPWILPLQNFEASKIQRESHTDFKNQVVKLNQDIISETAEPGGTSTERANKDISHMP

SEQ ID NO: 21852 - protein, 81 aa, Sus scrofa
NFWILRLPPGSKGEAPKEWGKLDEWQKELYKHVMRGNYETLVSLDYAISKPDILSRMERGEEPCPEGTWGREEGRQSEEAR

SEQ ID NO: 21853 - protein, 81 aa, Neophocaena asiaeorientalis
LQELVTFQDVAVDFTQEEWEHLDPSQRHLYREVMLENYGNLISLGRLLSKPEMISHFEQEDDVWMEKKIPRSSYSGDKPCR

SEQ ID NO: 21854 - protein, 81 aa, Loxodonta africana
LQEPVTFRDVAVDFTQEEWGQLDPAQRTLYRDVMLETFGHLVDVGPELPKPDVISQLEQGAELWVAESGLAQGCCPGWQTR

SEQ ID NO: 21855 - protein, 81 aa, Loxodonta africana
FQSSVTFGDVAIDFSQEEWECLDPAQRDLYRDVMWENYSNLASLDLESSYKTNNLSPEKDIYEIYSFQWEIMERIKSYSLQ

SEQ ID NO: 21856 - protein, 81 aa, Loxodonta africana
VSFKDVAVELTQEEWQHMGPAQRTLYRDVMLENYSHLVSVGYCITKPEVIFKLEQGEEPWSLEEESPNHSYLGEFLNPGRR

SEQ ID NO: 21857 - protein, 81 aa, Capra hircus
GQSRVTFEDVAVYFSQEEWCLLDEAQIQLYLDVMLENVALVCMLGSWPGVGDEETPFEQSKSAGVSQIGTPRTDSSAEKVQ

SEQ ID NO: 21858 - protein, 81 aa, Capra hircus
PGESLTFKDVAVNFTQEEWHHVDAAQRRLYRDVMLENYSHLVFLGYQVSKPEVIFKLEQGEEPWIAEGEIQRPVCPDWKTR

SEQ ID NO: 21859 - protein, 81 aa, Capra hircus
CQDPVTFEDVAVVFTDEEWRSLVPTQRDLYKEVMLENYKSIVSLGLPIPGPDVIFQLKRGDEPWLVECHEFEGKEGAENVS

SEQ ID NO: 21860 - protein, 81 aa, Capra hircus
RLTSEDVAIKFTQEEWEFLDPAQRALYRDVMLETYRNLLSVDISPTHVIKDLQPKVNSDKRETFQTLMLGRPKSCEIKHVH

SEQ ID NO: 21861 - protein, 81 aa, Capra hircus
MLENYANITSLAFPFPKSDLVFWLKRGEEPGRLDPWTLVGREHPRGTCRGRETKTENGGQTAELGISKGPESHKLITEVLL

SEQ ID NO: 21862 - protein, 81 aa, Capra hircus
WSQMPVTFEDVALYLSREEWGRLDHTQQSFYREVLQKRSGLSLGFPFNRPFWASQVQGKGEAPGSSRQLGHEEEKRGVVEA

SEQ ID NO: 21863 - protein, 81 aa, Chlorocebus sabaeus
MGVLTFRDVAIEFSPEEWECLDAAQQCLYRDVMLENYRNLVSLGLAIFKPDLMTCLEQRKEPWKVKRQEAVVKHPAGSFHF

SEQ ID NO: 21864 - protein, 81 aa, Chrysochloris asiatica
LQGPVTFKDITVEFTQEEWQLLSPAQKTLYRDVMLENYRHLISVGYRVNKPNAVFKLKQGKEPWMLEVEFPHQGYPGENGK

SEQ ID NO: 21865 - protein, 81 aa, Chrysochloris asiatica
LQEAVTFKDVAVVFSEEELGLLDSAQRTLYRDVMLETFQNLVSLGHQPFKPDVISQLEREEMLWMKGLQTGRGRCSGGRNQ

SEQ ID NO: 21866 - protein, 81 aa, Chrysochloris asiatica
MVQNYENLVSLGLSKPKPYVITLLEEGKEPWMVEKKPSEDMFSDWESRRENNELAAKERMYGDIPQNVIIEKSIKQDPGCS

SEQ ID NO: 21867 - protein, 81 aa, Suricata suricatta
MPANQTSPGPSVALAVGRCDDLCKGSVSFEDVTVDFSREEWQQLDSTQRRLYQDVMLENYSHLLSLGKQSHSKNLQGACYG

SEQ ID NO: 21868 - protein, 81 aa, Chrysochloris asiatica
VQVSVTFKDIAVLFTRAEWRTLDPSQRNLYRDVMLENYSNLVSLGPPFSKPKVISLLQQGEDPWKVEKENLGGSSLGWKNC

SEQ ID NO: 21869 - protein, 81 aa, Chlorocebus sabaeus
MLENYRNLVWLGLSISKPNMISLLEQGKEPWMVERKMSQGHCADWESWCEIKELSPKWFIDEDEISQEMIMERLTSHGLEC

SEQ ID NO: 21870 - protein, 81 aa, Chlorocebus sabaeus
DSVAFEDVAVNFTLEEWALLDPSQKNLYRDVMRETFRNLASIGKQWEDQNIEDPFKIPRRNIRSHIPERLCESKEGSQGEE

SEQ ID NO: 21871 - protein, 81 aa, Chlorocebus sabaeus
MLFISNKAGIAVTKPDLITCLEQGKEPWNIKRHEMVAKPSVICSHFAQDLWPEQDIKDSFQEAILKKYGNYEHDNLQLQKG

SEQ ID NO: 21872 - protein, 81 aa, Suricata suricatta
SYEGSVSFRDVAVDFSREEWQHLDVAQRNLYRDVMLETYSHLLSVGYDVPQPEVFMLEQGKEPWVLKGESPHQSCPGEKLW

SEQ ID NO: 21873 - protein, 81 aa, Suricata suricatta
KEAVTFKDVAVAFTEEELGLLDSAQRKLYQDVMLENFRNLVSVGHQPLKQDKWHLEREEKRSLMKTATQLERNVGGNSQSE

SEQ ID NO: 21874 - protein, 81 aa, Chrysochloris asiatica
GKATDSLTLEDVTVNFTPEEWALLDDSQKKLYKDVMMETFENLNSVFQQADYREKFSVNKDFWSSVLEFFQFSDVEDENND

SEQ ID NO: 21875 - protein, 81 aa, Suricata suricatta
NLSQRELYRDVMLENYGHLLFLGLVVSKPDLVIFLEQQRDLWDMQRKMTVASYPGSANLIHKSIHLEENPFKYNEYGKTLN

SEQ ID NO: 21876 - protein, 81 aa, Suricata suricatta
AQESLTLDDVAVNFSREEWQLLAPTQKSLYRDVMLENYRNLVSVGFHPSKPDVLPKLEQGKPAGTVEDGIPCRTRSEIWKL

SEQ ID NO: 21877 - protein, 81 aa, Suricata suricatta
MDPGDVTFKDVAVYFSQEEWGLLEEAQRLRDVMLENLTLMASLGYESSTSCRDASLELGIKPWVSDWADLTPARTREAQGC

SEQ ID NO: 21878 - protein, 81 aa, Chrysochloris asiatica
DAVAVEDVAVDFTQDEWALLDLPQRKLYRDVMMETFRNLASVEGSFVVWDLGKTLIVRIRDSRYDFTENRSHLPISREPEP

SEQ ID NO: 21879 - protein, 81 aa, Chlorocebus sabaeus
ILQDQISFEDVAVDFTLEEWQLLNPTQKNLYRDVMLENYSNLIFLGYQILKPDVIFKLEQQDPWIIGQEILNQNFSEVWLD

SEQ ID NO: 21880 - protein, 81 aa, Suricata suricatta
RSVGPVSFRDVAVDFTQEEWQQLDPEQKTTYRDVMLENYSHLVSLEVRKVEDLVERVQETEGKHSRQAVSINKTLTEGRGN

SEQ ID NO: 21881 - protein, 81 aa, Chlorocebus sabaeus
FQGSVTFEDVAIAFSQQEWESLDSSQRGLYRDVMLENYRNLVSMAGHSLSKPHVIALLEQWKEREVTVRKDGRRWYTDLQL

SEQ ID NO: 21882 - protein, 81 aa, Chrysochloris asiatica
PQGLVTFDDVAVDFSHEEWEWLNVAQRSLYQTVMLENYRSLLSLGLCVSKPDLIFLLEEGQEPWMVRETTGDQGPDLTPLQ

SEQ ID NO: 21883 - protein, 81 aa, Chlorocebus sabaeus
DSVVFEDVAVDFTQEEWALLDLAQRNLYREVMLENFQNLASLGYLLHTPHLICQWEQEEDLQTVKTELIQGSIWSCFETQL

SEQ ID NO: 21884 - protein, 81 aa, Suricata suricatta
LQSPVTFEDVTVYFSKEEWGLLDAGQRDLYHNVMLENFELMTSLGCWHGVEDEGAHSKQNASVQGMLQVKIPIANPSTQKA

SEQ ID NO: 21885 - protein, 81 aa, Suricata suricatta
DLALLQEEHSGDQENGHGAPESQKREIPFSKPKLICQLEQGEEPWIEENPHPLGLCPGSKLEVEPGPPCPRALSGQQGLSQ

SEQ ID NO: 21886 - protein, 81 aa, Sus scrofa
CKESVIFKDVCVNFSLEEWECLDLTQRNLYRCVMLENYSNLVSVGLSIPKPDVISLLEQGKEPWGVFDSEMTRGLNQDCGS

SEQ ID NO: 21887 - protein, 81 aa, Suricata suricatta
RQVSVAFQDLAVRFSEDEWQLLGEGQRALYRDVMQENYETLLSLGTAELLPLSAFLSPAEPDRAMEGRSCAGEGQEPPGGQ

SEQ ID NO: 21888 - protein, 81 aa, Sus scrofa
MLENYSHLVSLGCCITKPQVIFKLEQGEEPWSSEEEFLNQSIPGYYKVDDHIEENQEKQEKHSWQVIFIDNKILSKEEQKV

SEQ ID NO: 21889 - protein, 81 aa, Mandrillus leucophaeus
GTVTFEDVAVKFTQEEWNLLSEAQRCLYRDVMLENLALISSLGCWCGVEDEAPSKQSIYIQRETQVRIPMAGVSPKKAHPC

SEQ ID NO: 21890 - protein, 81 aa, Mandrillus leucophaeus
RPESVTFEDVAVYFSESEWIGLGPAQRVLYRDVMLENYGAVASMAFPFPKPALISQLERGEAPWCSVPWGALDGEDPRGIS

SEQ ID NO: 21891 - protein, 81 aa, Mandrillus leucophaeus
MELLTFRDMAIEFSPEEWKCLDPSQQNLYRDVMLENYRNLVSLGVTISNPDLVTCLEQRKELYNFKIHQTAARPSAVCSHF

SEQ ID NO: 21892 - protein, 81 aa, Mandrillus leucophaeus
YQDLLIFEDTAVDFTQEEWTLLDPVQRNLYRDVMLENYENVAKVGFQLLKPSVISWLEEEELRTLQQGVPQDWAMKHQTSV

SEQ ID NO: 21893 - protein, 81 aa, Sus scrofa
QVSVTFQDVAVDFTGEEWQLLGCAQRKALYKAVMLEISGNLVLVGEDSCSLENFLFLWLLKASQPGGRPTAPVRAAVPTRA

SEQ ID NO: 21894 - protein, 81 aa, Sus scrofa
FQEPVTFEDVAVYFTQNQWASLAPAQRALYREVMLENYVNLTSLAFPFSKPDLIFQLERGEALRGVCTGGKTKTENGGQTP

SEQ ID NO: 21895 - protein, 81 aa, Sus scrofa
ERGHSWFPLFSSWQGSVTFEDVYLAMTFTWEEWGELDQAQKTLYREVMLETCGLLVSLGKAHLPSMLLCRLKGIVCTCIYA

SEQ ID NO: 21896 - protein, 81 aa, Sus scrofa
SQGLLTIEDVAIDFSPEEWECLDLRQRELYRDVMIEIYKHLVSLALSSHDTQSLMPQNPGMEFFLQTMLLGKYKSYPVGTF

SEQ ID NO: 21897 - protein, 81 aa, Sus scrofa
TQDPVIFEDVAVDFTQEEWALLDLAQRNLYRDVMLENFQNLASLGYPLHTPYLISQWKEEEDLETVERGPTQGDHQEGFET

SEQ ID NO: 21898 - protein, 81 aa, Sus scrofa
TGLQLPKPDVILRLEKGEDLWPVERGIRQEPCPDLDTAVEIKSISSQSVSKDKQFCDIKVERKAKNDLWYLSLEEVWTCES

SEQ ID NO: 21899 - protein, 81 aa, Equus caballus
TDALVTFSDVAIGFSQEEWECLDPAQRDLYMDVMLENYSNVASLDLESTDETKNTFSEKDNSEIKFSQWEIKERSKTLGLE

SEQ ID NO: 21900 - protein, 81 aa, Equus caballus
LQEAIVFEDVAVYFTRIEWSCLAPDQRALYRDVMLENYGHVASLGCLVAKPALISLLEQGEEPGALILQVAEKRETRASLC

SEQ ID NO: 21901 - protein, 81 aa, Equus caballus
PQVSVSFKDVTVEFTQEEWRQMDSTQRTLYRDVMLENYSHLVSVGYCFTKPELIFTLEQGDDPWLLKKELLSRSSPEESQP

SEQ ID NO: 21902 - protein, 81 aa, Equus caballus
SQESVTFQDVAVDFTEKEWPLLDSSQRKLYKDVMLENYSNLASVGCQVGKPSLISHLEQEEELRTEERGLHRGSCPDWETP

SEQ ID NO: 21903 - protein, 81 aa, Equus caballus
QPLESVTFEDVAIDFTQEEWALLDTSQRKLYRDVMLENVSHLVSMGYQHCKSDVIFHLEQEELWSEGTGFLQGQSPGRESG

SEQ ID NO: 21904 - protein, 81 aa, Equus caballus
KEPVTFKDVAVTFSEEELGLLDHAQRQLYRDVMLENFQNLLSVGGKIQSKIETVSEAGPHEELSCWQIGQQIASDLTECQD

SEQ ID NO: 21905 - protein, 81 aa, Neovison vison
WSQMPVTFEDVALYLSREEWGRLDHAQQSFYRDVLQKRNGLSLAGFPFSRPLWGSQGQGKGEASSSSQQMGDDKEKAGAIE

SEQ ID NO: 21906 - protein, 81 aa, Capra hircus
AHGSVTFRDVAIDFSQEEWEFLDSAQRDLYRDVMWENYSNFISLAGPSMSKPDVITLLDEGKEPWMVVREGTGRHHPDLES

SEQ ID NO: 21907 - protein, 81 aa, Chrysochloris asiatica
IWGSVMFSDVSIVFSQEEWEYLDLEQKDLYRDVMLENYSNLVSLGCFISKPDVISLLEQGKEPWKVVRKGRSQHPDLKTRY

SEQ ID NO: 21908 - protein, 81 aa, Capra hircus
TSEPVSFADVAVYFSPEEWGCLRPAQRALYRDVMRETYGHLGALGFRGTKPALISWVEEEAELWRPDAGPPEMGECLTEAD

SEQ ID NO: 21909 - protein, 81 aa, Suricata suricatta
MSFKGVTVDFTRDEWLQLTGTQRTLCRGVMLENYSHPAAVGCRLAKPEVTFKLEQGEELWPSRRESPDEGDQGELVTMEKE

SEQ ID NO: 21910 - protein, 81 aa, Chlorocebus sabaeus
VTLRDVVINFSQEEWEYLNSAQRNLYWDVMMENYSNLLSLDLESRNETKHLSVGKDIIKNTGSQWEVMESSKLRGLESSIF

SEQ ID NO: 21911 - protein, 81 aa, Suricata suricatta
IGLRRFSPLNSVIIALFPVKCGYFFKEQVESNSLDPILSCPVLTGYQVPKPEVIFKLEQGEEPWILERKTPHQSCSDGRFE

SEQ ID NO: 21912 - protein, 81 aa, Sus scrofa
MLENYCHLISVGCHMTKPDVILKLERGEEPWTSFTGHTCLEENWKAEDFLVKFKEQQNKYPRSVLLINHKKLIKDNNNAFE

SEQ ID NO: 21913 - protein, 81 aa, Mandrillus leucophaeus
DVIVEFTKEEWKLLTPAQRTLYKDVMLENYSHLVSVGYHVNKPTAVFKLKQGKEPWILEVEFPHRVLPFKHQKTRTTEKAY

SEQ ID NO: 21914 - protein, 81 aa, Mandrillus leucophaeus
FQEAVTFKDVAVAFTEEELGLLDSAQRKLYRDVMLENFRNLVSVGHQSFKPDMISQLEREEKLWMKEFQTQRGKFLCIFSS

SEQ ID NO: 21915 - protein, 81 aa, Sus scrofa
LVLFTDVAIDFSQEEWECLDLQQKDLYRDVMLENYSNLVSLEWESRCETRKLSSKGEIYELEASQWEIIEQLTSHKYKCKS

SEQ ID NO: 21916 - protein, 81 aa, Sus scrofa
MIDFLFYSEALNLMSLAQFPCHFPFTGYCIPKPELIFRLEQGEQPWILEEESPSQSYPGVCRVDNQLEQSQEIQNRQFWQA

SEQ ID NO: 21917 - protein, 81 aa, Equus caballus
SVTFHDVAVYFSRGEWRLLDEAQRRLYLDVMLENFALLSSLGCCCGAEGLEAPFERSVSVEVSAARAPKAAPSSQKTHPCE

SEQ ID NO: 21918 - protein, 81 aa, Loxodonta africana
SQGLVTIKDVSLCFSQEEWRSLDPSQTDFYGEYVMQENCGIVVSLRFPIPKLDMLSQLEGGEEQWVPDPQDLEDRDILRVT

SEQ ID NO: 21919 - protein, 81 aa, Loxodonta africana
FQDLVTFGDVAVDFSQEEWEWLNPAQRTLYRKVMLENYRSLVSLGASVSKPDVISLLEQGKEPWMVKKEGTRRTYPDWEYI

SEQ ID NO: 21920 - protein, 81 aa, Capra hircus
SQESVTFEDVAVDFTQEEWALLDTSQRKLFRDVMLENISHLASVGNQLYKSDVISHLEQGEQLSKEGLGFLQSQSPVISDR

SEQ ID NO: 21921 - protein, 81 aa, Capra hircus
MAFRDVAVDFTQDEWVLLSPAQRSLYREVMLENYSNLVSLGIPFSKPKLITQLEQGKETWREERKCSLHILAFLLQGGHRH

SEQ ID NO: 21922 - protein, 81 aa, Capra hircus
LQETLTFRDVFVDFTQEEWQQLDAAQKNLHRDVMLENYSHLVSVGYLVAQPHGIFRLGQGEEEARMAAGESVMWSCPEFWK

SEQ ID NO: 21923 - protein, 81 aa, Chlorocebus sabaeus
FQNLMTFEDVAVEFTQGEWGQLNPAQKDLYREVMLENFRNLAFLGLPVSRPYVICQLEEGGEPFIVEREISTGAYSGHLLG

SEQ ID NO: 21924 - protein, 81 aa, Chlorocebus sabaeus
MLENYSNLVSVGYQASKPDALSKLEQGEPWMVENEIHSQICPEIKKVDNRLQMHSQNQRCLKRVEQCHKHAFGNIIHQRKS

SEQ ID NO: 21925 - protein, 81 aa, Chlorocebus sabaeus
ACESITFGDVAIDFSHQEWEYLNLVQKTLYQEVMMENYDNLVSLGHSMSKPDLITLLEQGKEPWMIVGEETRGECTDLDSR

SEQ ID NO: 21926 - protein, 81 aa, Suricata suricatta
SQELVTYEDVAVDFTQEEWQNLDPAQKILHRDVMLEIYSHLISVGCSGINPGKIFKLEYEEDPGFMKSELSRWTHSDREKS

SEQ ID NO: 21927 - protein, 81 aa, Suricata suricatta
SVGPVSFRDVAVDFTQEEWQQLDPEQKTTYRDVMLENYSHLVSLGCHIIKPEVIIKLEQGEEPWIVEGEFLPHSYPEVRKV

SEQ ID NO: 21928 - protein, 81 aa, Chlorocebus sabaeus
QESLTLEDVAVDFTWEEWQLLGPAQKDLYRDVMLENYSNLVAVGTGYQASKPDALSKLEQGEEPCTTEDEIYTRICCEIRK

SEQ ID NO: 21929 - protein, 81 aa, Suricata suricatta
LQEQVSFKDVCVDFTQEEWYLLDPAQKILYRDVILENYSHLVSVGYCFTKPEVVFKIEQGEEPWIVEAGFPSHCHQEDWKV

SEQ ID NO: 21930 - protein, 81 aa, Suricata suricatta
MDFTLEDWEQLGLDQGDLFWDTALDNYQNLFLLNPCKPKLTSYPDGGKELEAVVRESPKSEGLAPYFSPRGTGDVSTLPPS

SEQ ID NO: 21931 - protein, 81 aa, Suricata suricatta
FEGSVSFEDVAVDFTRQEWHSLDPAQRTMHKDVMLENYSNLASVGLCVAKPEMIFKLERGEELWLLEEESSGHGYPGSLSL

SEQ ID NO: 21932 - protein, 81 aa, Chrysochloris asiatica
PQAAVTFEDVAVLLSQEEWDRLGPAQRGLYRNVMMETYGNVVSLGLPGSKPDVISQLERGEAPWVLDGKEAEGREHLRNGH

SEQ ID NO: 21933 - protein, 81 aa, Chlorocebus sabaeus
MGLLTFRDVAIEFSQEEWEYLDSDQKLLYGDVMLENYRNLVSLGLAVSKPDLIITFLEQRKEPWNVKSEETVALQPDIFSH

SEQ ID NO: 21934 - protein, 81 aa, Mandrillus leucophaeus
CQESVTFEDVAVVFTDEEWSHLVPIQRDLYKEVMLENYNSIVSLGLPVPQPDVIFQLKRGDKPCVVDLHGSEERERPESVS

SEQ ID NO: 21935 - protein, 81 aa, Sus scrofa
MFSDVSIDFSQEEWECLNDDQRALYRDVMLENYSNLVSMAGHSISKPDVISFLEQGKEPWLVDRELTRGQWPVLESRCETK

SEQ ID NO: 21936 - protein, 81 aa, Sus scrofa
GLLSFSDVAVDFTWEEWQLLDTVQKDLYRDVMLENYSNLMSLGKDNFPNNRSICPLIACLFSIATIYGYLDALNDFELGLV

SEQ ID NO: 21937 - protein, 81 aa, Equus caballus
PLGPVSFKDVAVDFTQEEWQQLDPEQKTTYRDVMLENYSHLVSLGCHIIKPEVIIKLEQGEEPWIVEGEFLLQSCPEEVWK

SEQ ID NO: 21938 - protein, 81 aa, Equus caballus
FQGSLTFSDVAIAFSQQEWEGLDPVQKTLYQDVMMENYRNLLSLAGHAISKPGVITLLEQGKEPWMVVREETRRWCPGKVC

SEQ ID NO: 21939 - protein, 81 aa, Equus caballus
GSVSFTDVTVDFTQEEWEQLDPSQRILYMDVMLENYSNLLSVEVWKADDQMERDHRNPDEQARPCIIFKNQTPIEEKDNLF

SEQ ID NO: 21940 - protein, 81 aa, Equus caballus
GQGSLSFRDVAVGFTRKEWQQLDPTQRTLYRDVMLENYSHLVSVGCQVSKPAVISRLEQGQEAWVEDEEILEWSFPEEALR

SEQ ID NO: 21941 - protein, 81 aa, Loxodonta africana
AGCSLSKPDVISFLEQGKEPWVVDRELTRAHWPVLESRCETKKLYLKKESYKIEPSQWEIMERLTRHHLRCSSFRGDWECN

SEQ ID NO: 21942 - protein, 81 aa, Capra hircus
CVTFEDVAIYFSQEEWGLLDEAQRHLYHKVMLENFALTASMVCLHETETKETSSEQNLSLEALSQIRTPKVGPVTENAHPC

SEQ ID NO: 21943 - protein, 81 aa, Capra hircus
RGSVTFEDVAVYFSWEEWALLDEAQRCLYHDVMLENFALTSSLGCCHGVEDKGAPSENSISVEGMSQIKTLKADSSPQKGQ

SEQ ID NO: 21944 - protein, 81 aa, Capra hircus
FRDVAIDFSQEEWEFLDSAQRDLYRDVMWENYSNFISLDLESRYSANILSSEKDIYEVYSFQWEIMERVKSYSLQDSIFRN

SEQ ID NO: 21945 - protein, 81 aa, Chlorocebus sabaeus
TQGRVVFEDVAIYFSQEEWGHLDEAQRLLYRDVMLENLALLSSLGCWHGAEDEEAPSQQGFSVGMLEVTTSKSCLSTQKVH

SEQ ID NO: 21946 - protein, 81 aa, Suricata suricatta
NSEPGACLWILCLPLSLTLPCSRCLDVVIEFSQEEWECLDPTQRALYRDVMLETYRNLISLGEENVPPEVGNYFLCLCIYY

SEQ ID NO: 21947 - protein, 81 aa, Chlorocebus sabaeus
ARGCVVFEDVFVYFSREEWELLDDAQRLLYHDVMLENFALLASLGIAFSRSRAVIKLEQAEEPWVYDQVDMTSATEREAQR

SEQ ID NO: 21948 - protein, 81 aa, Chlorocebus sabaeus
VHGSVTFRDVAIDFSQEEWECLQPEQRTLYRDVMLENYSHLISLAGSSISKPDVITLLEQEKEPWIVVRKETSRWYPDLES

SEQ ID NO: 21949 - protein, 81 aa, Suricata suricatta
FQEAVTFGDVAVHFSREEWQCLDPSQRALYKEVMLENHSSVAGLAGFLVFKPELISRLEQGQEPWVLDLKGVEEREVARTS

SEQ ID NO: 21950 - protein, 81 aa, Suricata suricatta
LLQESVTFKDVVVLFTRDEWAQLSPTQRALYRDVMLENYSNLVSLGLLGPQPDVFSQLRKGEEWVLEGASGGFCLDWMTLP

SEQ ID NO: 21951 - protein, 81 aa, Suricata suricatta
AQGSVSFEDVVVEFTQDEWQYMSPAQRTLYRDVMLENYGHLISVGYCLTKPKMIFRLEQEEEPWSLEEEFLNQRYPGYFSV

SEQ ID NO: 21952 - protein, 81 aa, Chlorocebus sabaeus
LQESVTFQDVAVDFTAEEWQLLDCTERTLYWDVMLENYRNLISVGCPINKTKVILKVEQGQEPWLVEGANPHQSSPESDCP

SEQ ID NO: 21953 - protein, 81 aa, Suricata suricatta
PRPLENDGGCFSEQEWETLEDWQKELYRNVMKSNYEALVSLKVLGPPEEAAELGPGMLGDLEDEGPGGAHPAGGVMIKQEM

SEQ ID NO: 21954 - protein, 81 aa, Suricata suricatta
KPGVLTFADVAVYFSSEEWGCLRPAQRALYRDVMRETYGHLGALGFPGPKPALISWMEQESEESEAWSPAAKDPEEGESLG

SEQ ID NO: 21955 - protein, 81 aa, Suricata suricatta
SQGSVTFRDVAIDFSQEEWERLQPAQRALYRHVMLENYSHLASLGLNISKPYVVSLLEQGKEPWLEKGDVRRDLFSALKEA

SEQ ID NO: 21956 - protein, 81 aa, Suricata suricatta
MFAGYCLTKPKMIFRLEQEEEPWSLEEEFLNQRYPGYFSVDIHIEGNQEKQEKEKPLWQVIFTNTKTWSKEGQKVLKTPFN

SEQ ID NO: 21957 - protein, 81 aa, Chlorocebus sabaeus
QEGVNFKIVTVDFTQEEQGTWNPAQRTLDRDVILENHRDLVSWDLATAVGKKDPTSKQSIFDEEPANGVKIERLTRDDPWL

SEQ ID NO: 21958 - protein, 81 aa, Chrysochloris asiatica
VEPVTIEDVTVVFTEAEWKSLSSEQKNLYGEVMLEIYRNLLSLVDPKPDTHPCSSSLLAFSCQQFLSQHILQIFPGSCAVH

SEQ ID NO: 21959 - protein, 81 aa, Chlorocebus sabaeus
MLENYSHLVSLGFSFSKPHLISQLERGEGPWVADIPRTWTTAGLHIGDRTQSKTSTSTQKHSGRQLPGVDSQGGKDGQAAR

SEQ ID NO: 21960 - protein, 81 aa, Mandrillus leucophaeus
QGHVTFEDIAVYFSQEEWGLLDEAQRCLYHDVMLENFSLMASVAGLSQSNHKDSCSQQKVTVSLNNCVAQCSPDDGHYTPK

SEQ ID NO: 21961 - protein, 81 aa, Mandrillus leucophaeus
RVQSCVTFEDVFVYFSREEWELLEEAQRFLYRDVMLENFALVATLAFIFPVPRSCPVGEGRKPWVPDRADTTAATVKETYR

SEQ ID NO: 21962 - protein, 81 aa, Mandrillus leucophaeus
MFKEAVTFNDVAVAFTEEELGLLGPAQRKLYRDVMVENFRNLLSVGHQPFKQDVSPIERNEQLWIVTTATQRRRNLDTLLV

SEQ ID NO: 21963 - protein, 81 aa, Mandrillus leucophaeus
FFISFTGQLTFRDVAIEFSQEEWKCLNSTQRTLYRDVMLENYRNLVSLEYYLMWEHRKEPWTMESVKIGKTSDGGRRTQSQ

SEQ ID NO: 21964 - protein, 81 aa, Mandrillus leucophaeus
MRETYGHLGALGFPGPKPALISWMEQETEAWSPAAQDPEKGERLGGARRGDAPNRKEEEPEEAPRAKGPRKAPVKDSPEVP

SEQ ID NO: 21965 - protein, 81 aa, Sus scrofa
VTFQDVVVTFTREERELLGQAQRTLYRKVMLETFQLLLSMGKTSPHLQAGALQPPTRPILSLKASREGGQVSGSARPPHPP

SEQ ID NO: 21966 - protein, 81 aa, Sus scrofa
SSHCGSEETNLDVAIEFSQEEWACLDPAQRALYRDVMLETCRNLLSLEEHRFPLGVGICPWVSLHFPLCASWEPLLCLAEH

SEQ ID NO: 21967 - protein, 81 aa, Sus scrofa
VQGKVNLEDVFVYFSQEEWRLLDEAQRLLYREVMLENFALMASLGSWHGTEEEVIPFEQSVSVKGVSQVMIPKMVLSSQKA

SEQ ID NO: 21968 - protein, 81 aa, Neovison vison
SQGLVTIKDVSLCFSQEEWRSLDPSQTDFYGEYVMQENCGIVVSLRFPIPKLDMLSQLEAGEEQWVPDPQDLEERDILRVT

SEQ ID NO: 21969 - protein, 81 aa, Loxodonta africana
VMFSDVSVDFSQEEWECLNEDQRDLYRDVMLENYNNLVSMVLESRCETKKLYLKKESYKIEPSQWEIMERLTRHHLRCSSF

SEQ ID NO: 21970 - protein, 81 aa, Loxodonta africana
PKVPVTFDDVAVHFSEQEWGNLSEWQKELYKNVMRGNYESLVSMDYAISKPDLMSQMERGERPAVQEQEDSEEGETPADPS

SEQ ID NO: 21971 - protein, 81 aa, Capra hircus
RLTSADVAINFTQEEWEFLAPAQRALYRDVMLETYRNLLSVDISPTHVIKLLQPKANRDKLETFQTLMLGRPESCEIKHVH

SEQ ID NO: 21972 - protein, 81 aa, Capra hircus
AQGYVTFEDVTIYFSPEEWGLLDEAQRLLYCDVMLENFALIASLGLASFRSHIVAQLEMGEEPWVPDRVDMTSAMARGMYR

SEQ ID NO: 21973 - protein, 81 aa, Capra hircus
MLENYSHLVSMGHPVSKPDVISKLEQGEDPWIIKTDIPNRICPYEGQADGRLDRKSNLDNPQSCILGSVSFHNKILKGVIK

SEQ ID NO: 21974 - protein, 81 aa, Suricata suricatta
SHSQRELYRDVMLENYGHLLFLGEDHSLSISQTTLRGFVPSFEDSSYPGRNWNDFTFIPYISVVSSNANVRLPSKIFIETS

SEQ ID NO: 21975 - protein, 81 aa, Chrysochloris asiatica
FKEPVTFRDVAVDFTREEWRQLDPAQRTLYRDVMLETFGHLVDVGPELPKPDVISQLEQGAELWAMERGLTQDRCPAWETG

SEQ ID NO: 21976 - protein, 81 aa, Suricata suricatta
NFTWEEWQDLDDSQRTLYRTVMLETYSSLVSLGHCIMKPEVIVKLEQGAEPWMVEEPLKQSLPDVQSAGGLMETDQEHQSR

SEQ ID NO: 21977 - protein, 81 aa, Chrysochloris asiatica
GEGSLSFEDVAVGFTWEEWQFLDPSQQDLYKAVMLENYSNLVSVGCQTTKPDAIFKLEQGETPWIVEGAVHGQTTLEEQPH

SEQ ID NO: 21978 - protein, 81 aa, Suricata suricatta
RPESVTFEDVAVYFSENEWTGLAPAQRVLYRDVMLENYGAVASLAFPFPKPALISQLERGEAPWCRAPRGGLDGERPRGLS

SEQ ID NO: 21979 - protein, 81 aa, Suricata suricatta
NSGVTFEDVAVYFSWEEWRLLEETQRCLYHNVMLENFALISSLGKGPLILRKSQTESPSAGECGKTFRYKSSFAIHQRFHT

SEQ ID NO: 21980 - protein, 81 aa, Chlorocebus sabaeus
PEGSVSFRDVAIDFSREEWRHLDPSQRNLYRDVMLETYSHLLSVGTGYQVPEAEVVMLEQGKEPWALQSERPRQSCPGEKL

SEQ ID NO: 21981 - protein, 81 aa, Suricata suricatta
SQGQLTFRDVALEFSQEEWECLNHSQQELYADVILETYGHLFFLGLLVSKPDLVIFLGHEQELRGVKRQETVASHPGRSLT

SEQ ID NO: 21982 - protein, 81 aa, Suricata suricatta
GWLTFRDVIVEFSPEEWECLGPAQRALYRDVMLENYRNLVSLGSPSAGFTVQELSPTKDINKREFSHLMILKSNESHGIKD

SEQ ID NO: 21983 - protein, 81 aa, Chrysochloris asiatica
SVGYADVALEFTQEEWSLLNFSQRKLYRDVMLEILRYLVSAHMTRVSQKPVMRKAGLLPTGPHCLRPALLHSSPALKTKST

SEQ ID NO: 21984 - protein, 81 aa, Suricata suricatta
MLENYRNMILLGFQFPKPKVICLLEQWEEPWILDLPRAGTRKASSSACSGSEAKWKMKKLTPKQKVSKDLELCKTWAVKQK

SEQ ID NO: 21985 - protein, 81 aa, Chlorocebus sabaeus
RPLEMAVSEPEASAAKEWKQLDSAQRNVYHDVMLENYSNQASMGAGYQAPKPDVISKLEKGEAPWLGKGKRPSQGCPSKIA

SEQ ID NO: 21986 - protein, 81 aa, Chlorocebus sabaeus
MCYFFYAGSSISKPDVITLLEQEKEPWMVVRKETSRWYPDLELKYGPEKVSPENGISEVNLPKQVIKHISTTLSLEAFYFR

SEQ ID NO: 21987 - protein, 81 aa, Sus scrofa
QEDDLKFKDVAIYFSQKEWECLHFAQKDLYREVMFENYNNLIALGFSNSKPDVISLLEQGKEPWLVRSKEIKNDWESRRET

SEQ ID NO: 21988 - protein, 81 aa, Mandrillus leucophaeus
VTFKDVAIDFTLEEWRLMDPTQRNLHKDVMLENYRNLVSLDVEPKPATKNATRTKDISEDLSQDAVLEKLTENGLWDSRVE

SEQ ID NO: 21989 - protein, 81 aa, Mandrillus leucophaeus
PLTFKDVAIEFSQEEWKSLDPVQKALYKDVMLENYRNLVFLGISPKCVIKELPPTENSNTGERFQTVALERHQSCDIENLY

SEQ ID NO: 21990 - protein, 81 aa, Mandrillus leucophaeus
QVRLTFRDVAIEFSQEEWKCLDPAQRTLYRDVMLENYWNLVSLDIPPKCTTKDLLPKEKSSTEAVFHTVMLERHESPDIED

SEQ ID NO: 21991 - protein, 81 aa, Sus scrofa
VTFEDVAIYFSQEEWGLLDEAQRCLYRDVMLETLALTTSLDCWCGAQGEEVLSEQSISVGMSQVKTSQSVSSTQKTHPCEK

SEQ ID NO: 21992 - protein, 81 aa, Sus scrofa
RLESVTFEDVAIFFSENEWTSLAPAQRALYREVMLENYAAVASLAFPFPKPALIFLLERGEAPWSSAPEGPLDGEGPRGIS

SEQ ID NO: 21993 - protein, 81 aa, Mandrillus leucophaeus
SCEGSVSFRDVAIDFSREEWRHLDPSQRNLYRDVMLETYNHLLSVGYQVPEAEVVMLEQGKEPWALQGERLRQSCPGEKLW

SEQ ID NO: 21994 - protein, 81 aa, Equus caballus
QPPVSFKDVAVTFTREEWGQLDPAQRMLYRDVTLETCSHLFSLDWKTTLEKKEPTSKEGTAAEDTSHHVEVKHCVWEEGFW

SEQ ID NO: 21995 - protein, 81 aa, Neovison vison
KSLGSVSFKDITVDFSKEEWQQLNLAQKSLYRDVMLENYFNLISVGCQVPKQEVIFSLEQEEPRMLDGEISSHSSLGGDIG

SEQ ID NO: 21996 - protein, 81 aa, Capra hircus
EQLTSEDVAIEFTQEEWEFLDPPQRALYRDVMLETYRNLLSVDISPTLVIKHLQCKANSDKQETFQTLMLGSPESCEIKHV

SEQ ID NO: 21997 - protein, 81 aa, Loxodonta africana
GSVSFTDVTVDFTQEEWEQLDPSQRILYMDVMLENYSNLLSVEVWKADDQMERDHRNPDEQARQFLILKSQTPVEERGNLF

SEQ ID NO: 21998 - protein, 81 aa, Capra hircus
WSQDLVTFKEVSVEFSQEEWALLAPTQKVLYRDVMLENFRNLALVGYHLCKHSPITEVAQEELRPEERGILQNACTDGVTQ

SEQ ID NO: 21999 - protein, 81 aa, Capra hircus
SFQAPVTFDDITVYLLEEEWVLLSQQQKDICGSDKLVAPLGPTIASPEMFYKFERGPEPWLASVQGQRSHLSPNPGKTKMG

SEQ ID NO: 22000 - protein, 81 aa, Capra hircus
NKFSFTDVTVDFTQEEWEQLEPSQRILYMDVMLENYSNLLSVEVWKADDQMETDHRNPDEQARPFVIFKDQTPTEERDNNL

SEQ ID NO: 22001 - protein, 81 aa, Capra hircus
SQESVKFRDVAVVFSPEQWAHLSPEKRELYRDVMLDTCDHLVSLGHWAYKAEVMSSLRQGKEPWILEKEVTSAPCPACQPA

SEQ ID NO: 22002 - protein, 81 aa, Capra hircus
FDDVAVTFTQEEWGHLEPAQRTLYQEVMLETCRLLVSLGCPVPRPELIYQLEHGQELWTVKRDLSRSTCPVDKGKPKTTEP

SEQ ID NO: 22003 - protein, 81 aa, Chlorocebus sabaeus
PKVPVTFDDVAVHFSEQEWGNLSEWQKELYKNVMRGNYESLVSMDYAISKPDLMSQMERGERPTMPEQEDSEEGETPTDPS

SEQ ID NO: 22004 - protein, 81 aa, Chrysochloris asiatica
LQKFVMFRDVAVFFSQEEWLHLDPAQRALYRDVMLENYSNLVSLGIPFSKPKVISQLQQGEDPWMVEKRVPQGSCRGWKSL

SEQ ID NO: 22005 - protein, 81 aa, Suricata suricatta
SSQGLLTFRDVAVEFSQEEWGCLNHSRWELYRDVMLETYEHLVFLGLVSKPDLVIFLEQKRELWDVKRKETVASYPHTWGL

SEQ ID NO: 22006 - protein, 81 aa, Suricata suricatta
FKLRIFHQRLRKLVPSSGDAYIREKLVNYFNRSNSDFLETGLLVPKPDVVFQLKRGEEPWKLDFQEDEEREVPGSTFLGRY

SEQ ID NO: 22007 - protein, 81 aa, Suricata suricatta
SGHLVTFEDVAVYFTQTEWAGLCSGQKALYRSVMLENYGNLTSLGYSVPRPALISLLEAGSLPWGLEAQGNLSAERTKDIY

SEQ ID NO: 22008 - protein, 81 aa, Suricata suricatta
WSQMPVTFEDVALYLSREEWGRLDHAQQNFYRDVLQKRNGLSLGFPFSRPFWAQGQGKGEASSSWRQMGVEEKTGAVEVGK

SEQ ID NO: 22009 - protein, 81 aa, Chlorocebus sabaeus
QASVSFKDVTVEFTQEEWQHMGPVERTLYRDVMLENYSHLVSVGYCFTKPELIFTLEQGEDPWLLEKERGFLSRNSPDSQP

SEQ ID NO: 22010 - protein, 81 aa, Chlorocebus sabaeus
MPLSEFPTVFHSIGNFYMFFLHAGLCLCKPDVISLLEQEKDPWVIKEEMTRGLCPDLECVWVTKSLSLNQDVYEEKLPPAI

SEQ ID NO: 22011 - protein, 81 aa, Suricata suricatta
MTFEDVAVYFSWEEWGLLDEAQRLLYRDVMLETFALMASLGLGSSRIHEITQLEWWREPSLPPHGVMTAAVPRGVRRRAEV

SEQ ID NO: 22012 - protein, 81 aa, Chlorocebus sabaeus
GIAVSKPDLITCLEQGKEPWNMNRHEMVAKPPVMCSHIAEDLWPEQDIKDFSQKVILGRHDKCEHENLQLRKGCKSVDECK

SEQ ID NO: 22013 - protein, 81 aa, Chrysochloris asiatica
TQDLVVFEDVAVMFTQEEWALLDLAQRNLYKDVMLENFHNLASVGYPLSIPHLILHWEQEEDLKTMEKRFIQVTGTGEHQE

SEQ ID NO: 22014 - protein, 81 aa, Suricata suricatta
MQENYRHLVSVGYRVNKPNAVFKLKQGKEPWILEVEFPGRNYPEDLWKIHDLGTRSEESQAENSRNGELTKHQQTPAREKT

SEQ ID NO: 22015 - protein, 81 aa, Sus scrofa
TFKEAVTFKDVAVAFTEEELGLLDSAQRKLYQEVMVENFRNLVSVGHQPFKRDTSCKEREKLWMMNLATQVNLDKNQMIMS

SEQ ID NO: 22016 - protein, 81 aa, Mandrillus leucophaeus
VQEPVTFKDVAVDFTQEEWGQLDFVQRTLYRDVMLETYGHLLSVGNQIAKPEVISLLEQGEEPWSVEQACPQRACPEWMRN

SEQ ID NO: 22017 - protein, 81 aa, Mandrillus leucophaeus
QGLLTFRDVAIEFSQEEWKCLDSAQRTLYREVMVENYRNLVSLDISSKCMMEFLSTAQSNREVIHTGTLERHESHHIGDFC

SEQ ID NO: 22018 - protein, 81 aa, Neovison vison
APLPLTFEDVAIYFSEQEWQNLEAWQKELYKHVMRTNYEILVSLDNGLPKPELISWIEQEREFFQNWREAQKSGTIICSSA

SEQ ID NO: 22019 - protein, 81 aa, Capra hircus
PQGGVTFEDVALSFSWKEWKLLDAAQRRLYHDVMLENYALISSLGFWSGEEKVETSFAQSVSEAVSQARTSKEASSSQKTH

SEQ ID NO: 22020 - protein, 81 aa, Capra hircus
YQELVTFRDVAVDFSQEEWDYLNPSQRHLYSNVMLENYRILVSLDWESMCETEELTPKQDIYEPQSSQKVIEKLTSYGLEY

SEQ ID NO: 22021 - protein, 81 aa, Chrysochloris asiatica
IKETVTFKDVAVDFTWEEWRLMDPTQRNLHKDVMLENYRNLVSLGLVVSKPDMISHLEDGKRPWVMVREFSRAPYTELETK

SEQ ID NO: 22022 - protein, 81 aa, Chlorocebus sabaeus
DSISLEDVAVNFTLEEWALLDPGQRNIYRDVMRATFKNLACIGEKWKDQDIEDDPKNQGRKPSSPTVETLCENKEDRPCGK

SEQ ID NO: 22023 - protein, 81 aa, Suricata suricatta
GVFVAGTEEWGCLSHSQRELYRDVMLENYGHLLFLDLVVLKPDLVTFLERKRELWDVKRKETQMTEVTLPSKIFIETSFQN

SEQ ID NO: 22024 - protein, 81 aa, Chlorocebus sabaeus
QGLLTFRDVAIEFSQEEWKCLDPAQRTLYRDVMLENYRNLVSLDISSKCMLKTLSSTGKGNTEVILTGTLQRQANDHIGEF

SEQ ID NO: 22025 - protein, 81 aa, Suricata suricatta
PKVPVTFDDISIYFSTPEWEKLEEWQKELYKNIMKGNYESLISMDYAMNQPDVLSQIQPEGEHNTEEPAGPEESEIPADPS

SEQ ID NO: 22026 - protein, 81 aa, Chlorocebus sabaeus
MLEIYSNLVSVGYQVSKPDALSRLERGEEPWTMEDERHSQICPENNKVDDHLQDHLENQRMLKSVEQYHERNAFGNTASQT

SEQ ID NO: 22027 - protein, 81 aa, Chlorocebus sabaeus
MLFIFNKTGIIVSKPDLITRLEQGKKPLTMKRQEMVGKPPVLCSRFTQDLWPEQSIKDSFQKLILRRYEKYGHDNLQFKKG

SEQ ID NO: 22028 - protein, 81 aa, Suricata suricatta
TGSMSFKGVTVDFTRDEWLQLTGTQRTLCRGVMLENYRVLPCIPLTGCRLAKPEVTFKLEQGEDHNKCGEIFQKSQPMDLP

SEQ ID NO: 22029 - protein, 81 aa, Suricata suricatta
SQELLTFRDVAIEFSQEEWGCLNVVQWELYRDVMLENYGHLLFLGLAVSKPDLVIFLEEKRELCDVNEKETTATPLAISSD

SEQ ID NO: 22030 - protein, 81 aa, Chlorocebus sabaeus
WQGRVVFEDVAIYFSQEEWGHLDEAQRLLYRDVMLENLALLSSLGCCHGAEDEEAPLEPGVSIGVSQVMAPKPCLSTQKTQ

SEQ ID NO: 22031 - protein, 81 aa, Sus scrofa
PLQGSVSFKDVTVDFTQEEWQQLDPAQKALYRDVMLENYCHLISVGKENSLNLSMSYFPFQEFLKHISIPHLNVFKRSLFF

SEQ ID NO: 22032 - protein, 81 aa, Mandrillus leucophaeus
EMLSQSPRDVAIEFSLEEWQRLDAAQQNLYRNVMLENYRNLAFLGIAVSKPDLITCLEQGKEPWNMKRHEMVDKPPGLYFS

SEQ ID NO: 22033 - protein, 81 aa, Mandrillus leucophaeus
MEARSKLVPPQASVCFEDVAMAFTQEEWEQLDLAQRTLYREVTLETWEHIVSLGLFLSKSDVISQLEQEEDLCRAEQVAPR

SEQ ID NO: 22034 - protein, 81 aa, Mandrillus leucophaeus
GPLTFRDVAIEFSQEEWKSLDPVQKALYWDVMLENYRNLVFLGILPKCMTKELPPIGNSNTGEKFQRVMLERHECYDIENF

SEQ ID NO: 22035 - protein, 81 aa, Mandrillus leucophaeus
GEGSLSFEDVAVDFTREEWQFLDWSQKVLYKEVMLENYSNLVSVGYQGTKPDALFKLEQGEPPWIVEGAAHSQTCPGFVIQ

SEQ ID NO: 22036 - protein, 81 aa, Sus scrofa
PHRLVLFTDVAIDFSQEEWECLDLQQKDLYRDVMLENYSNLVSLGFSISKPDVLSLLEQGKEPWKVVQDVTSGQSPEWESR

SEQ ID NO: 22037 - protein, 81 aa, Sus scrofa
MLENYSNLVSVGYCITKPEMIFRLEQGEEPWILEDEFPSQSSPVWKNDHIKDRSQENQSKHVWEVVFISNKMLTEEQGNVI

SEQ ID NO: 22038 - protein, 81 aa, Sus scrofa
AQGSLSFEDVTVEFTQDEWRFVGPAQRSLYRAVMLENYSHLVSLGYYKVDDHIEENQEKQEKHSWQVIFIDNKILSKEEQK

SEQ ID NO: 22039 - protein, 81 aa, Equus caballus
VMFRDVAIDFSQEEWECLDAAQKDLYRDVMLENYSNLVSLDLPSRSANKKLSPKKDTYETELSQWEMSARLENWDLEESSS

SEQ ID NO: 22040 - protein, 81 aa, Equus caballus
ARSEVTFKDVAVNFTQEEWGQLDSPQRALYRDVMLENYQNLLSLGPPVCKPDVISHLERGEEPWQVPGEVPGAARPEQEPG

SEQ ID NO: 22041 - protein, 81 aa, Equus caballus
LLTFKDVTIEFSQEEWECLDPAQRALYRDVMLENCRNLLSLGEESFPLEVRICPDISARSMIKELLLKEDINIGELYQPVV

SEQ ID NO: 22042 - protein, 81 aa, Equus caballus
SHGHGTFEDVAVSFSQTECVLCDEAQGCPYREVMLENWSLMAFLGCWHAVKAEEAPSEQCTSVERSITQGYCQFWESPRPP

SEQ ID NO: 22043 - protein, 81 aa, Equus caballus
AQESVMFSDVSIDFSQEEWECLNDDQRQLYRDVMLENYSNLVSMAGHSISKPDVISFLEQGREPWLVHRELTRGQWPVLQS

SEQ ID NO: 22044 - protein, 81 aa, Equus caballus
SHTLVTFKDILVNFNREEWKLLNAAQQIMYKDVMLENYENLVSLGHQLPKPDVILRLEKGQEPWLAERGIHQETHPDLETA

SEQ ID NO: 22045 - protein, 81 aa, Equus caballus
MTESQGTVTFKDVAIDFTQEEWQQLDPAQRNLYRNVMLENYNNLITVGCPFTKPDVIFKLEQEEEPWVEEDVDVLRRHWPG

SEQ ID NO: 22046 - protein, 81 aa, Equus caballus
KFKEPVTFEDVAVVFTEEELGLLDATQRQLYRDVMLENFRNLLSVGHQPLKPDISHIEREAKLWMMKTASQVERNFGENNQ

SEQ ID NO: 22047 - protein, 81 aa, Equus caballus
ARLPLTFEDVAIYFSEQEWQKLEAWQKELYKHVMRTTYDIFVSLDDGIPKPELISWIEQGRELFRNWGESQKSGNIICFSA

SEQ ID NO: 22048 - protein, 81 aa, Equus caballus
QKNVIFHDVAVYFSWGDWRLLDEAQRRLYLDVMLENFVLISSLGLIFSMSHIVAQLRVQIGEKAYKCSDCAKSFTSSAALS

SEQ ID NO: 22049 - protein, 81 aa, Neovison vison
MFQVTFSDVAIDFSHEEWGWLDSAQRDLYKDVMVQNYENLVSLGLSIPKPYVITLLEDGKEPWMVEKKDWESRWENKELVT

SEQ ID NO: 22050 - protein, 81 aa, Neovison vison
EVMLENYGTLVSLGILFSKPKVIFQLQQGKDPWMVENGVSQGPCVGWERLFETTISEEENQEVMNKLLGDGPFDFKLGKAY

SEQ ID NO: 22051 - protein, 81 aa, Neovison vison
VMLENYANVASLAFLFTRPVLVSQLERGELPWGLEPWEPADREALRGICPGGEARAEKEESTPKEHISKEIESHRLTLGGL

SEQ ID NO: 22052 - protein, 81 aa, Loxodonta africana
GSKESVTFQDIAVDFTEKEWPLLDSSQRKLYKDVMLENYSNLTSVGYQGKPSLISHLEQEELLRTEERGACQGTCPDWEIP

SEQ ID NO: 22053 - protein, 81 aa, Chrysochloris asiatica
MLENYRSLVSLGASVSKPDVIALLEQGKEPWMVKKKRTRGTCSGWEYIFGNSEFSSKQTLYEEGSKVIKVGPSPLSYGLDC

SEQ ID NO: 22054 - protein, 81 aa, Suricata suricatta
GTVTFEDVAVYFSGEDWGLLEESHRHLYQDVMLENLALITSLGRQHGAEDKEAPEQSICVQGGSRGRTPKAGLSPQKTSPC

SEQ ID NO: 22055 - protein, 81 aa, Suricata suricatta
HGLLAFRDVAIEFPQEDGGCLRLPQREQDVYRIVMLESYGHHLFLGLVVSKPDLVIFLEQKRELWDVKRKDTTVQCDFSSH

SEQ ID NO: 22056 - protein, 81 aa, Chrysochloris asiatica
APVTFEDVTVVFTEAEWVTLSLEQKNLYKEVMLEMYRNLLSLAEPTPETCPGPSCLLPLSCQQFLSQHVLQIFSGVCAEHP

SEQ ID NO: 22057 - protein, 81 aa, Chlorocebus sabaeus
WLQEPMTFKDVAVEFTQDEWMMLDSAQRSLYKDVMLENYRNLTSVEYQLCRLTVISPLDQEEIRNMEKRIPRGICPDQKIL

SEQ ID NO: 22058 - protein, 81 aa, Chlorocebus sabaeus
EKGPLTFRDVVIEFSQEEWQCLDTAQQDLYRKVMLENFRNLVFLAGIDVSKPDLITCLEQGKDPWNMKRHSMVATPPVNCS

SEQ ID NO: 22059 - protein, 81 aa, Chrysochloris asiatica
GPQSRFVSVTFEDVSVTFTQEEWGQLSPTQRCLYQKVMLETWTLLTSLDLICRLEHGQELWTTETGLAESTCAGDKTQPKT

SEQ ID NO: 22060 - protein, 81 aa, Chlorocebus sabaeus
MCLGLCVSKPDVISSLEQGKEPWTVKRKMTRAWCPDLKTVRKIKELPLKKDFCEGKLSQAVITERLTSYTLEYSLLGEHWD

SEQ ID NO: 22061 - protein, 81 aa, Suricata suricatta
MLENYRNLVWLGLSMSKPNMISLLEQGKEPWMVEKEMSDGPYADWESWYEIKELSAKWYIDEEEISQGMVMERLTSCDLDC

SEQ ID NO: 22062 - protein, 81 aa, Chlorocebus sabaeus
LQESLTLRDVAVDFTWEEWQLLGPAQKHLYRDVMLENYGNLVSVGFQASKPDALTKLEQGEPLWALEDEIHSPTHPEIEKA

SEQ ID NO: 22063 - protein, 81 aa, Suricata suricatta
KPQGLVTFEDVAVDFTQEEWQYLNPSQKSLYREVMLETYSNLVSVGQQVTKPDLILKLEVEEPCLAETEISTWGFPEEDYQ

SEQ ID NO: 22064 - protein, 81 aa, Mandrillus leucophaeus
IQDSVVFEDVAVDFTQEEWALLDLAQRNLYREVMLENFQNLASLGYLLHTPHLICQWEREEDLQTVKRELIQVIFMGEHQE

SEQ ID NO: 22065 - protein, 81 aa, Mandrillus leucophaeus
MTEEFVTLKDVSMDFTLEDWEQLGLEQGDMFWDTALDNCQDLLLLDPPRPNLTSHPDGGEDLEPLPGGSPEATGSDATETK

SEQ ID NO: 22066 - protein, 81 aa, Mandrillus leucophaeus
YVGLQFQGSVTFEDVAIAFSQQEWESLDSSRGLYRDVMLENYRNLVSMGHSLSKPHVIALLERWKEPKVTERKDGRRWCTG

SEQ ID NO: 22067 - protein, 81 aa, Mandrillus leucophaeus
LLTFRDVAIEFSQEEWKCLDPAQRTLYRNVMLENYRNLVSLGIFSKHEIKELPTKKESNTGEIFQTVMLERHESHDIEDFC

SEQ ID NO: 22068 - protein, 81 aa, Sus scrofa
QVSIAFRDLAVRFSEDEWRLLGEGQRALYLDVMQENYEALVSLGTAELLPLSAFLTPMEPGGARGAGDGQEPPRGAGPLGG

SEQ ID NO: 22069 - protein, 81 aa, Pan paniscus
MLRRGHLTFRDVAIEFSQEEWKCLDPAQRTLYREVMVENYRNLVFLLPDLSVISMLEQRRDPRNLQSEVKIANNPGSCSVT

SEQ ID NO: 22070 - protein, 81 aa, Lipotes vexillifer
YFREQNSVVFEDVAVDFTLEEWALLDSAQRELYRDVMLENFRNLASVEDETQFKANGGERPYVCKLCGKTFPRTSSLNRHI

SEQ ID NO: 22071 - protein, 81 aa, Pan paniscus
RDVAVEFSLEEWHCLDTAQQNLYRDVMLENYRHLVFLGIIVSKPDLITCLEQGIKPLTMKRHEMIAKPPVMCSHFAQDLWP

SEQ ID NO: 22072 - protein, 81 aa, Equus caballus
AQDSVIFHDVAVYFSWGDWRLLDEAQRRLYLDVMLENFVLISSLGCCCGAEDLEAPFEQSISVEVSTARAPTAAPSSQKTH

SEQ ID NO: 22073 - protein, 81 aa, Equus caballus
GSAAYEFLCVDYTQKKWRGPAVSQRALYQNVMPENHCSAASLAGENRMESSELPAKQEISKGLESSDRLSGGLCGVVPGGP

SEQ ID NO: 22074 - protein, 81 aa, Equus caballus
YQRPVSFKDVVVGFTQEEWHRLNPAQRALYRDVMLETYSHLVSVGYEGTKPYVILRLEQEEAPWICEAACSGCHCQGIGKL

SEQ ID NO: 22075 - protein, 81 aa, Neovison vison
WGLLDEAQRCLYQDVMLENLALVTSLGCRQGAEDDEAPEQSISVQRASQVRTFRAVVSPQKAHPREVCGQDLRDLLLSSEH

SEQ ID NO: 22076 - protein, 81 aa, Neovison vison
QESLTFRDVFVDFTLEEWQQLDSAQRNLYRDVTLENYSHLVSVGYLITKPDEVLRPRQVEEAMGAEGEPPARNHPEFWQAD

SEQ ID NO: 22077 - protein, 81 aa, Neovison vison
TQEEWQQLDPAQKALYRDVMLENYCHLISVGFHMTKPEMIRKLEQGEEPWTAERNFPSQSYLEEDGKAEDALVKFKEYQDR

SEQ ID NO: 22078 - protein, 81 aa, Chlorocebus sabaeus
QQGVLTFRDVAIEFSLEEWQCLDTAQQNLYRNVMLENYSNLVFLGIAASKPDLITCLEQGKEPWNVKRHEMGAEPPVVCPY

SEQ ID NO: 22079 - protein, 81 aa, Suricata suricatta
EGAGVGAESGTLLVASLCPILCLSLCTGHQLPKPDVILHLEKGEEPWLVGRGIQQEARPDVDTAVEIKSSVSSKSISKDKQ

SEQ ID NO: 22080 - protein, 81 aa, Chlorocebus sabaeus
MKCGYFSKEQMESNLLDPILYHVLLTGFEVPKPEVIFKLEQGEGPWTLEGEAPHQSCSDGKFGIKPSQKRISGKSTLHSEM

SEQ ID NO: 22081 - protein, 81 aa, Chrysochloris asiatica
AQGLLTFEEVAVRFSREEWGHLDSAQRALYRDVMWENYRNLTFVGFIFPKPELISQLEQGEEPWVPEGPRPPDLGLIPTFS

SEQ ID NO: 22082 - protein, 81 aa, Chlorocebus sabaeus
MPSPTFSPQAGPPLHKPDVISHLERGEEPWSMQREVPGGPCPEWQLKAVPSQQQGICKEEPAQEPITERPLGGAQAWGRQA

SEQ ID NO: 22083 - protein, 81 aa, Chlorocebus sabaeus
GYQLTKPDVILRLEKGEEPWLVERGIHQEAHPDSETAFEIKSSVSSRSVFKDKQSCDIKMEGMARNDLWYLSLEEVWKCKD

SEQ ID NO: 22084 - protein, 81 aa, Sus scrofa
MTKPDMIRKLEQGKELWTTEKIFPSQSYPEEDGTAEDILVKFKEYQDRHSRSVVFINHKKLMKERSNIFGKTFTVNKNHII

SEQ ID NO: 22085 - protein, 81 aa, Mandrillus leucophaeus
EKGPLTFRDVAIEFSLEEWQCLDTAQQGLYRKVMLENYRNLVFLGIAVTKPDLITCLEQGKEPWNIKRHEMVAKPSVICSH

SEQ ID NO: 22086 - protein, 81 aa, Mandrillus leucophaeus
AQESVTFEDVAVNFTNREWQSLTYAQRHLYKHVMLENYGNMVSLGFPFPKPPLISHLEQGVEPCVQDPQDRESLSCSYTVS

SEQ ID NO: 22087 - protein, 81 aa, Mandrillus leucophaeus
PVTFEDVAVNFTQEEWDCLDASQRVLYQDVMSEIFKNLASPPVLRALEHLVSLDRTQVLQASQARPPFFCRICGKCFSRRS

SEQ ID NO: 22088 - protein, 81 aa, Sus scrofa
SQGLLTFEDVAIDFSPEEWECLDLGQRHLYRDVMLEICRHLVSLEYVISKPDLVRLLEQKTDPWDMKGMETVAIQPALSSH

SEQ ID NO: 22089 - protein, 81 aa, Equus caballus
FRGPVTFKDVTVEFTKEEWQLLDAAQRTLYREVMQENYGHLLSVGYCVNKSKTIFKLKQGKEPWILEIEFPRRNSPEDLWN

SEQ ID NO: 22090 - protein, 81 aa, Equus caballus
SRSLENDGVCFSEQEWENLEDWQKELYRNVMKSNYETLVSLKVLGQPEEEVELGTEMLGDLEEEGPGGVHQAEGVMIKQEV

SEQ ID NO: 22091 - protein, 81 aa, Equus caballus
PTLHTFDVAVNFTPEEWALLDPSQKKLYRDVMWETFRHLASVGKNEDIPSRHQCRCGKGSQCGENFILLSNLSLNKKTTGA

SEQ ID NO: 22092 - protein, 81 aa, Equus caballus
SLFGPHLLIVIFPQVQRSSSSCCSRAAWLSLCDFPSTGYHGTKPDLIFKLEQGEEPWIVNARASRQSCPVEGWKEWYQKNQ

SEQ ID NO: 22093 - protein, 81 aa, Equus caballus
SQESVTFKDVAVDFTWEEWHYVDPAQRRLYRDVMLENYSHLVSLGYQVSKPEVIFKLEQGEEPWITEGEIQRPFCPAFCFN

SEQ ID NO: 22094 - protein, 81 aa, Neovison vison
LENYSNLASMGFQAPKPDMISKLEKGEEPWLGKGKRPRQGGPSEIARPKQTGTNGNVQQGNDQLENHQESQNKLCKEVAFK

SEQ ID NO: 22095 - protein, 81 aa, Capra hircus
QGHVTFEDVAVSFSQEEWGLLGEAQRLLYYDVMLENLSLIASLGCWRGGETEEAGSEQCVSAEQVTRDRNPRVDSSILKAV

SEQ ID NO: 22096 - protein, 81 aa, Capra hircus
KGSVTFQDVAVEFTPEEWQLLDCDQRTLYWDVMLENFRNLISVGTGCPVTETTVIFRVEQGQEPWMVEGEDSRWSSPEADC

SEQ ID NO: 22097 - protein, 81 aa, Capra hircus
MAFRDVAVDFTQDEWVLLSPAQRSLYREVMLENYSNLVSLGIPFSKPKLITQLEQGKETWREERKCSPVSCLEPKPELHLC

SEQ ID NO: 22098 - protein, 81 aa, Capra hircus
MDFTLENWEQLGQGQGDLFWDTALDNYQNLFLLNPLRPNLTFHLDGGEKLEALAKESPESTDAGIAETSPLPQDFMEEGLF

SEQ ID NO: 22099 - protein, 81 aa, Capra hircus
PQKSVTFEDVAVYFTQTEWDGLSTAQRALYRDVMLENYGNVASLGFPLLKPAVISQLEGGGELEGPSPLASGAGTGPQGLW

SEQ ID NO: 22100 - protein, 81 aa, Chrysochloris asiatica
MLENHSSVAGLAGVLVFKPELISRLEQGQEPWVLDLKGLENRELPRTSPTDSTLRTDNEQACEEMDILRSELHGMRIRIPL

SEQ ID NO: 22101 - protein, 81 aa, Chrysochloris asiatica
PKVPVTFDDVAVHFSEQEWGNLSEWQKELYKNVMRGNYESLVSMDYAISKPDLMSQMERGERPTVPEQDDSEEGEAPTDPS

SEQ ID NO: 22102 - protein, 81 aa, Chrysochloris asiatica
YQELVTFKDVAVDFSREEWDCLDSSQRHLYSNVMLENYRILVSLGLCFSKPSVILLLEQGQEPWLVKTELSEGLCSGWDSM

SEQ ID NO: 22103 - protein, 81 aa, Chlorocebus sabaeus
MNVMLENYKNLVFLGIAVSKQDPVTCLEQEKEPWNMKRHEMVDEPPAMCSYFTKDLWPEQDIKDSFQQVILRRYGKCEHEN

SEQ ID NO: 22104 - protein, 81 aa, Chrysochloris asiatica
TLEMVTFRDVAVDFTQEEWQQLDPAQRDLYNDVMLENFQNLSSLDLESRSKSDGVEGAVSMGLSPLLELEELGRGHLWSFA

SEQ ID NO: 22105 - protein, 81 aa, Chlorocebus sabaeus
KGLVTFEDVAVEFTQEEWTLLGPAQRTLYRDVMLENFRNLASLGTGNQVDKPGLISQLEQEDKVMTEEKGILPGTCPDVEN

SEQ ID NO: 22106 - protein, 81 aa, Chlorocebus sabaeus
QDSVAFEDVAVNFTHEEWALLGPSQKNLYRDVMQETIRNLNCVGMKWENQNIDDQYQNLRRNPRCDVVERFGKIKDGSQCE

SEQ ID NO: 22107 - protein, 81 aa, Chrysochloris asiatica
DSVVVEDVTVKFTQEEWALLDLAQRKLYIDVMMETFVNLASVDHSSYRHCTTSETGCSIYKCKEYEEACRYPYLSTPVKNL

SEQ ID NO: 22108 - protein, 81 aa, Suricata suricatta
LRETAESQPVGIAQDEEFWNAYQDLQEQLSRNTHKETEPVCERALFVLPKPKVISYLEQGEEPWVQGSTEFKDSPGELPTG

SEQ ID NO: 22109 - protein, 81 aa, Chrysochloris asiatica
ILEPITIEDVTVVFTDEEWNMLTSEQKSLYREVMLETYRNLFSLDYDTFSSSALLKNHQPEIIIKDFMEEVFNKSAWLAES

SEQ ID NO: 22110 - protein, 81 aa, Suricata suricatta
LTFGDVAIEFCEEEWGCLNRSQRELYRDVMLENYGHLLFLGEMTGKLYVACLSRMRVYLVYSSFPCPGATTPHHQGTKLSE

SEQ ID NO: 22111 - protein, 81 aa, Chrysochloris asiatica
VTFEDVALYLSREEWGRLDHAQQSSYREDLQKRNGMSLGFPINRALWASHMQGKGEASSSHLQRGDEEETVVCTDAMDVGT

SEQ ID NO: 22112 - protein, 81 aa, Suricata suricatta
YQELVTFGDVAVDFSREEWDCLNSSQRHLYSNVMLENYRILVSLGLCFSKPSVILLLEQGKEPWMVKRELAKGLCSGWESM

SEQ ID NO: 22113 - protein, 81 aa, Sus scrofa
FPETSAFRDMFVDFTLEEWQQLDAAQKTLYRDVTLENYSHLLSVGYLVAQPEGIFSLGQAEGAGKADGEAPTRSGPGERAP

SEQ ID NO: 22114 - protein, 81 aa, Lipotes vexillifer
AGCPPEMAVSEPGGSAAKEWEQLDPAQKSLYKDVMLENYSNLASMGYQALKPDMISKLGKEEPWLGKGKRPRQGDLSEIAR

SEQ ID NO: 22115 - protein, 81 aa, Lipotes vexillifer
QEWLTFEDVAIEFTQEEWECLDPAQRTLYRDMMVETYRNLLSVVSTALLHPSLHLLHHSHCRNDPSVELLDNILRTGPMSP

SEQ ID NO: 22116 - protein, 81 aa, Lipotes vexillifer
FQESVSFEDVAVYFTQNQWASLDSAQRTLYREVMLENYESITSLAAFPFPRPDLIFQLERGEAPGGLDPWIPIRREVRGVC

SEQ ID NO: 22117 - protein, 81 aa, Pan paniscus
SPGLLTFRDVVIEFSLEEWQCLDHAQQNLYRDVMLENYRNLVSLGIAVSKPDLITCLEQNKDPWNIKRNEMVTKHPVMCSH

SEQ ID NO: 22118 - protein, 81 aa, Lipotes vexillifer
EDSVVFEDVAVNFTVEEWALLDPAQRKLYRDVMLETFRNLASVGSCPQVKTSGSSPQWDILENELCSEKKIVRCTRNDSCS

SEQ ID NO: 22119 - protein, 81 aa, Lipotes vexillifer
SQAPVTFEDMAMYLTREEWRPLDPTQRDLYRDVMQENYGNVVSLDFEIRSENEVNPKQESSEDVEFGTASERPVGNTEDSP

SEQ ID NO: 22120 - protein, 81 aa, Callorhinus ursinus
DPVTFEDVAVEFTQEEWILLDQTQRRLCRDVMLANYKSLAAIDWEICLNTKWSAPQQNILQGKTPNVVEMERSHTGEELFN

SEQ ID NO: 22121 - protein, 81 aa, Callorhinus ursinus
VVFADVAVNFTPEEWALLDRGQRRLYRDVMLETCWNLASLVCPSQDKRSASRTQWNILQNELPSEEKIVIFARNDSCSVFG

SEQ ID NO: 22122 - protein, 81 aa, Callorhinus ursinus
VEGSVTFKDVTMAFTQKEWEQLDPAQRNLYKDVMLENYSNLASMGYQAPKPDMISKLEKGEEPWLGKGKRPRRCGPSEIAR

SEQ ID NO: 22123 - protein, 81 aa, Callorhinus ursinus
VMFEEVSVCFTSEEWECLGPIQRALYWDVMLENYGNVTSLEWETMTENEEVTPKPSISQRADSQKGTSKRLQGGVPQTLDF

SEQ ID NO: 22124 - protein, 81 aa, Callorhinus ursinus
MFQVTFSDVAIDFSHEEWGWLDSAQRDLYKDVMVQNYENLVSLGLSIPKPYVISLLEDGKEPWMVEEKLSKDWESRWENKK

SEQ ID NO: 22125 - protein, 81 aa, Tursiops truncatus
MLENYRNLASLGLCISKPDVISLLEQDKEPWMLKGEITRGLPPDLEYVWMRKELSPNQDIYEEKLSQAMIMERLTGCDLKC

SEQ ID NO: 22126 - protein, 81 aa, Equus caballus
WSQMPVTFEDVALYLSREEWGRLDHTQQSFYGDVLQKRNGLSLGAIEVGKEEPAPSLAALRDVKALRTRAGRTQGDILQCR

SEQ ID NO: 22127 - protein, 81 aa, Equus caballus
MNIAQGLVSFEDVTVEFTQEEWRQMDSTQRALYKDVMLENYGHLVSMGYCSTKPRVIFKLEQGEEPWSLEEEFLNQRYPGE

SEQ ID NO: 22128 - protein, 81 aa, Equus caballus
MTKNWKCLESSQKDCPRDAMLDNYENMVPQGSFLQFSVMPQIAGNDTPGVSNTNEMEMERSNMREKFLISVTKLVESKSYN

SEQ ID NO: 22129 - protein, 81 aa, Equus caballus
MIESQISFEDVAVDFTLEEWQLLNPTQKNLYRDVMLENYSNLAFLGYQIIKPDAVFQLEQEEQWITDEEILNHSCPEEVWL

SEQ ID NO: 22130 - protein, 81 aa, Equus caballus
SQHLVTFEDVAVDFTQEEWMLLDPTQRALYRDVMVENYQNLLSVAGYRSCKPDLSSGLKGADEVRTGARGVLQGGKQFWSG

SEQ ID NO: 22131 - protein, 81 aa, Equus caballus
WLKDYQQDSMTLDNVVVDFTQKEWLLLDLTQRNLYRDKNLVTVGYQLFKPSLITWLEQGKKLRAVDRGVLQGRDPQWSRTL

SEQ ID NO: 22132 - protein, 81 aa, Equus caballus
NLEPVTFKDIAIDFTQEEWALLDPSQRKLYRDVMLENISHLVSVGYELRKSDVISELEQGKELWREEKGFPQGLSPGELQA

SEQ ID NO: 22133 - protein, 81 aa, Equus caballus
KEAFVAFRDVAVDFTQEEWRLLSPAQRTLHREVMLETYSHLVSLEIPLSKPKLISQLEQGDEPWIEERQCRLGLCPGSKLE

SEQ ID NO: 22134 - protein, 81 aa, Equus caballus
SQESVTFQDVAVDFTEKEWPLLDSSQRKLYKDVMLENYSNLASVDWETPSKTKWTILVEDIFGKETTNGVTMDRTHLGEKS

SEQ ID NO: 22135 - protein, 81 aa, Neovison vison
LPDLVTFEDVAVEFTQEEWALLAPSQRTLYRDVMRETCRNLASLGYHVDKPSLISQLEQEDKVVTEERGVLPGTCPDLETV

SEQ ID NO: 22136 - protein, 81 aa, Neovison vison
VTFTDVAVNFTREEWALLDSRQRILYRDVMLENCRNLASLDLLTQHQTKNSTPQPDILAKKTTVEAKRVCTVSHASRLSLL

SEQ ID NO: 22137 - protein, 81 aa, Neovison vison
VPALFDEVAIYFSDEEWEVLTEQQKALYREVMRMNYETVLSLGKALFSFVSWKLGAQRVVPMSLLWCVRHPFLLNVDSVSS

SEQ ID NO: 22138 - protein, 81 aa, Capra hircus
QGGVTFPDVAVRFSQREWRLLDETQRRLYLDVMLENYTLVSSLGCCCGAEGEETPCENTVPVGVSWTGSPTAAPFSQKTHP

SEQ ID NO: 22139 - protein, 81 aa, Loxodonta africana
SQELVTFEDVAVYFIRKEWKRLEPAQRNLYRDVMLENYGNVFSLDGENRRENDQEISEDTGSHGVLLGRFQKDISQGLKFE

SEQ ID NO: 22140 - protein, 81 aa, Capra hircus
LQEALTFKDVAVTFTEEELGLLDLAQRKLYRDVMLENFRNLLSVGHQSSKPDMISQLEREEKFWTTEIQPQRGVCSGGWNH

SEQ ID NO: 22141 - protein, 81 aa, Capra hircus
SQDSVTFADVAVNFTQEEWTLLNCFQRKLYRDVMLENYKNLTAAGYQVFKPTLISWLEEEELSTVEKGVLQEWGIQLKAKD

SEQ ID NO: 22142 - protein, 81 aa, Sarcophilus harrisii
SQIPLTFQDVAVDFTWEEWGLLEPSQKDMYWDVMLEIYENFISLGGVPLSIPDVISQLERMEAPWMTQGGVLISTFLDSST

SEQ ID NO: 22143 - protein, 81 aa, Sarcophilus harrisii
SQKALTFQDVAVEFTPEEWGLLEPAQKDMHRDVMLENYENFVFLDLPVPKPTLIFHLEKRETPWLSAGDIIRYTCPDFLVQ

SEQ ID NO: 22144 - protein, 81 aa, Lipotes vexillifer
PVLFEDLAVYFSQEECVSLHPAQRSRSRDTPQECLEDMALMGGEGKIEINQKLRLESMGLEELALEKYSIAMPLVYYPEKS

SEQ ID NO: 22145 - protein, 81 aa, Lipotes vexillifer
MFKEAVTFKDVAVTFTEEELGLLDSTQRKLYQEVMLENFRNLVSVGYHPFKHDIFHLEKEKRLWVVKTATQKEGTSAKNQA

SEQ ID NO: 22146 - protein, 81 aa, Lipotes vexillifer
EAQETLTFDDVAVDFTWEEWQFLAPPQKDLYRDVMLENYSNLLSVGFQASKPDILSKLDQGEPWMMEDEIHCQTHSEVWKV

SEQ ID NO: 22147 - protein, 81 aa, Callorhinus ursinus
AQDSVTFEDVAVYFSWEEWGLLDEAQRRLYHDVMLENFALVTTLGCWHGAEDGKAPSEQAASIGVSQVRTHHAGSYPQKAH

SEQ ID NO: 22148 - protein, 81 aa, Callorhinus ursinus
MLENYRNLVSVGYEASKPDSVFQLEQGEPPWMVEGAAQSQTCQEEIWEIDHMQWHPENQNESKTLERYQQSNALGNNFDLC

SEQ ID NO: 22149 - protein, 81 aa, Callorhinus ursinus
SQASVSFKDVTVEFTQEEWQQMGPIQRTLYRDVMLENYNNLVSVGNCIFKPAVIFKLEQGEEPWFLEEEFSNQSHREDYRD

SEQ ID NO: 22150 - protein, 81 aa, Callorhinus ursinus
LLTFRDVAIEFSPEEWECLDPAQRALYRDVMVENYRNLVSLDISVRSMIKKLSPKEDISKEELFQTLMLERHKRNDIKDLG

SEQ ID NO: 22151 - protein, 81 aa, Callorhinus ursinus
LLTFRDVAIEFSPEEWECLDPAQRALYRDVMVENYRNLVSLGEDSFPPEESLALNVISILEPGTEPRAVEGEVKIEKKPSG

SEQ ID NO: 22152 - protein, 81 aa, Tursiops truncatus
KLKPAEAQQVGMSQDEEFWNTHQSLQELLIRNTHKETEPVCERALFVLPKTKVICCLEQGEEPWVQGPPIFKDSPEELFSE

SEQ ID NO: 22153 - protein, 81 aa, Tursiops truncatus
APLPLTSEDVAVYFSEQEWRDLEPWQKELYKQVMNTNYEILVSLDDGLPKPELISWLEQGRERFRIWGQSQKSGNIICTSA

SEQ ID NO: 22154 - protein, 81 aa, Tursiops truncatus
QDPVAFEDVAVNFTLEEWALLGPSQKKLYRDVMRETLRNLASIGEKWEDHNTEDQYKNQGRNLRSHTLRRCCESEEGSQCG

SEQ ID NO: 22155 - protein, 81 aa, Tursiops truncatus
PLESVTFEDVAINFTQEEWALLDTSQKTLFRNVMLENITHLVSVGYQISKSDVISQLEQGKELWSEATGCLQGQSPGSESP

SEQ ID NO: 22156 - protein, 81 aa, Equus caballus
MFQVTFSDVAIDFSHEEWGWLDSAQRDLYKDVMVQNYENLVSLAGLSIPKPYVITLLEDGKEPWMVEKKLSEGVYSGWESR

SEQ ID NO: 22157 - protein, 81 aa, Equus caballus
SQASVSFKDVTVEFTQEEWQQMGPIQRTLYRDVMLENYKNLVLVGNCTYKPEVIFKLEQGEEPWFLEEEFSNQSLQVLGDC

SEQ ID NO: 22158 - protein, 81 aa, Equus caballus
AQGCVTFEDVTIYFAQEEWGLLDEAQRLLYCDVMLENFALIASLGLTSFRSHVVAQLELGAEPWVPDRVDMTSAMARGLYG

SEQ ID NO: 22159 - protein, 81 aa, Equus caballus
LQVLVTFKDVAVTFTQEEWGQLDLHQRTLYQEVMLETCRLLVSLGHPVPTPEFFPLLEHRQELWTVRTGLSHSPCPGDTTK

SEQ ID NO: 22160 - protein, 81 aa, Equus caballus
AQESLTLEDVAVEFTWEEWQLLAPAQRNLYRDVMLENYSNLVSVGYQVSKADALSKLEQIEPPWTLEDEIHSQPHPEFEKV

SEQ ID NO: 22161 - protein, 81 aa, Equus caballus
GFGSLTFSDVAIAFSQQEWEGLDPVQKTLYQDVMMENYRNLLSLGHAISKPGVITLLEQGKEPWMVVREETRRWCPVFLDF

SEQ ID NO: 22162 - protein, 81 aa, Neovison vison
DPVTFKDVAIDFTLEEWRLMDPSQRNLHKDVMLENYRNLVSLGLAVSKPDMISHLEAGKGPWVVVREIARTPYPELETKPA

SEQ ID NO: 22163 - protein, 81 aa, Neovison vison
YRDVMLETFGHLLSVGPELPKPEVISQLEQGTELWAAERGIAQGYYPGWESGPESHTPPKEHGLPEMEPSCVTEREGFLMD

SEQ ID NO: 22164 - protein, 81 aa, Sousa chinensis
QGSTPFNSVTVAFTQKGWRQLAPTPRDRFKKGMPEKSRNLVLLDWKIVSESPPEQDISEESFQDPSVEMPSGESDHRNSEL

SEQ ID NO: 22165 - protein, 81 aa, Pteropus vampyrus
LAEGMNFEDVAIDFSQEEWGLLDEAQRLLYYDVMLENFALVASVGCWHKTEDEEAPSEQSESVGEARVRASKTAPTIQKTH

SEQ ID NO: 22166 - protein, 81 aa, Pteropus vampyrus
TARSQASVTFKDVAMDFTPEEWGKLDPAQRDTMLENYRNLVSLWLPVSKPENYSLENGKDPLMLERKAPKSSYSDLESGPE

SEQ ID NO: 22167 - protein, 81 aa, Pteropus vampyrus
AQESVMFRDVAVDFSQEEWECLDPAQRDLYREVMLENYSNLVSMGLYIPKPQVISLLEQGKEPWMVGRELTRGLCSDLESM

SEQ ID NO: 22168 - protein, 81 aa, Pteropus vampyrus
AQEPVTFADVAVLFTPEEWMFLDSAQKSLYRDVMLENYRNLASVGDQLCKPSTFSCLEQREELWTTERGTFPGDHPEPQLQ

SEQ ID NO: 22169 - protein, 81 aa, Pteropus vampyrus
SVTFQDVAVGFSPEEWALLDHSQRRLYREVMLETRRNLASVGKACVTCSHLFSISCVPRAMPGSGSFLVDKEATVLPTWGS

SEQ ID NO: 22170 - protein, 81 aa, Pteropus vampyrus
SQEPVTFRDVAVDFTQEEWGQLGPAQRTLYRDVMLETFGHLLSVGKHTAKPEVISLLEQGEEPWLVEHAPPQRICPEMMKN

SEQ ID NO: 22171 - protein, 81 aa, Trichechus manatus
QESVTFKDVAVDFTLEEWGWLGPGQRELYRDVMLENYQNLLSLGAGLPGTKPDVISRLERGEEPKMEERQARWVTCSDLEK

SEQ ID NO: 22172 - protein, 81 aa, Trichechus manatus
LQESLSFEDLSVDFTQKEWQLLDPSQKDLYKDVMLENYSSLVSLGYEVMKPDVIFKLEQGEEPWIVDGEIASSDSPEEVWQ

SEQ ID NO: 22173 - protein, 81 aa, Trichechus manatus
PKAVENEQIPDFTQEEWEQLDPSQRILYMDVMLENYSNLLSVEVWKADDQMERDHRNPDEQARQFLILQSQTPVEERGNLF

SEQ ID NO: 22174 - protein, 81 aa, Trichechus manatus
VVFEDVAVEFTQEEWALLDFSQRKLYTDVMMDTLRNLDSVFLQDTNGQILPIKCDSCSSMLGEICEFHGIERQHNHQRKHM

SEQ ID NO: 22175 - protein, 81 aa, Trichechus manatus
IVASVSFKDVAVELTQEEWQHMGPAQRTLYRDVMLENYSHLISVGYCITKPEVIFQLEQGGEPWSLKEEFPNNSYPVHQET

SEQ ID NO: 22176 - protein, 81 aa, Trichechus manatus
DSVVEDVAADFTQEEWALLDHSQRQLYRDVMMEIFRSLASVASQNLIDGDKLSTENIIVRFMKNDTWSSMVGEICELPGTQ

SEQ ID NO: 22177 - protein, 81 aa, Trichechus manatus
CGGSVVFEDVAVDFTQEEWAFLDPAQRKLYRDVMLETFRNLASVDDETPFKANGSISQESTPEEKISNEDKILKFRRNDSW

SEQ ID NO: 22178 - protein, 81 aa, Zalophus californianus
MLENCGLLVSLGCPVPRPELIYQLQHGQELWTWKRDLSQSAYPGDKGKPKTTESTASEPALSEGVSFQEQLTQGVPGITQV

SEQ ID NO: 22179 - protein, 81 aa, Zalophus californianus
GVTFEDIAVYFSWKEWKLLDEAQRRLYHHVMLENFTLISSLGCCCGAEDEAPFAQSTSVGVSQTRTPKAAQSSRKTHPCEM

SEQ ID NO: 22180 - protein, 81 aa, Zalophus californianus
SVTFEDIAVYFSWEEWRLLDEAQRCLYHDVMLENFTLISSLGCCCGAEDEAPFAQSTSVGVSQTRTPKAAQSSRKTHPCEM

SEQ ID NO: 22181 - protein, 81 aa, Zalophus californianus
MLENYGHLLFLGLIASKPDLIIFLEQEEQLWVVKRKETVAFHPGRQIHTGEKLYICKECGKAFKRLQHLSQHHRIHTGEKP

SEQ ID NO: 22182 - protein, 81 aa, Zalophus californianus
RWGWLIQRMLLESAKEWVLLDEAQRHLYHDVMLENFALIASLVCWHGMEDEEAPFEQSISGEVLSWVRTPKAGPSTQKTHP

SEQ ID NO: 22183 - protein, 81 aa, Zalophus californianus
PQESVTFKDVAVDFTQEEWHHVDAAQRRLYRDVMLENYSHLVSLGYQVSKPEVIFKLEQGEEPWISEGEIQRPFCPDWKTR

SEQ ID NO: 22184 - protein, 81 aa, Zalophus californianus
VSRSLENDGVCFSEQEWENLEDWQKELYRNVMKSNYETLVSLKVLGQTEGEAELGAGMLGDLEEEGPGDVHPAEGVMIKQE

SEQ ID NO: 22185 - protein, 81 aa, Zalophus californianus
PKVPVTFDDVAVYFSEPEWGKLDEWQKELYKHVMRGNYETLVSLDYAISKPDILTRMERGEEPCPEGPWGQEEGSKREAAR

SEQ ID NO: 22186 - protein, 81 aa, Zalophus californianus
SQGLVTFRDVALDFSQEEWEWLDQSQKDLYRDVMLENYRNLVWLGLSISKPNMISLLEQGKEPWMVEKEMSDGQCADWDSW

SEQ ID NO: 22187 - protein, 81 aa, Zalophus californianus
SRSLENDGVCFSEQEWENLEDWQKELYRNVMKSNYETLVSLKVLGQTEGEAELGAGMLGDLEEEGPGDVHPEGVMIKQEIQ

SEQ ID NO: 22188 - protein, 81 aa, Zalophus californianus
SQHLVTFEDVAVNFTQEEWTLLDQTQRDLYRDVMLENYQNLIILGCESCKPDLNSSMGGAEELRTGGRGILQELDLQLKTK

SEQ ID NO: 22189 - protein, 81 aa, Equus caballus
KVPVTFVDIAVYFSEDEWKNLDEWQKELYNNLVKENYKTLMSLDSEGPVPKPDAPTQAEPREEPCMWEQRDPEEREILMDP

SEQ ID NO: 22190 - protein, 81 aa, Equus caballus
CQESVTFEDVAVIFTDEEWRHLVPIQRDLYKEVMLENYKSIVSLGLPVPRPDVIFQLKTGDEPWRVDCHGAEERECSETVP

SEQ ID NO: 22191 - protein, 81 aa, Equus caballus
DEALMAFRDVAVAFTQKEWKLLSPAQRTLYRDVMLENYSHLVSLGIAFSKPKLITQLEQADEPWREESEGVLDLCPEPEAE

SEQ ID NO: 22192 - protein, 81 aa, Equus caballus
AHALVTFSDVAIDFSQEEWACLDSTQRDLYWDVMLENYSNLVSLDLESPYETKSLPIEKGIYEINFSKWNSNGKRKSLGVD

SEQ ID NO: 22193 - protein, 81 aa, Equus caballus
SLGSDLFRDVAVVFSQEEWEWLAPAQRDLYRDVMLETYSNLVSLGLAISKPDVISFLEQGKEPWMVEKVATGGLCPVLESR

SEQ ID NO: 22194 - protein, 81 aa, Equus caballus
AQGQVNFEDVFVYFSQEEWGLLDETQKLLYRDVMLENFALMASLGNASSMSREVTPLELGSELWVPDWADGTPAMTREAQH

SEQ ID NO: 22195 - protein, 81 aa, Neovison vison
SQGLVTFEDVAVYFSLEGWERLDADQRDLYKDVMQENYGILVSLGYPIPKPDLIFRLEQGEEPWVPDSPRPEEGDIVTGVY

SEQ ID NO: 22196 - protein, 81 aa, Neovison vison
GHREPASASFHPPRIQEEWGLLDPSQKELYWDAMLEKYGTVVSLAGIPAPQPEAREELEPGALRTGTEGRRSLHPGDESES

SEQ ID NO: 22197 - protein, 81 aa, Neovison vison
VMRGNYESLVSMDYAISKPDLMSQMERGERPTVQEQEDSEEGETPADPSAAHDGIVIKIEVQTNDEGSESLETPEPLMGQV

SEQ ID NO: 22198 - protein, 81 aa, Neovison vison
LMEAVTFGDVAVHFSREEWQCLDPGQRALYKEVMLENYKSIVSLGLPVPQPDVIFQLKRGDEAWVVDLHGSEERECPENVS

SEQ ID NO: 22199 - protein, 81 aa, Neovison vison
ENYSNLVSVGYQASKPDALSRLERGEEPWAKQEEVPSGTRQEPSKVHNHLQGHWENPRMLKGMEQNHKNDAFGNTVPQSKN

SEQ ID NO: 22200 - protein, 81 aa, Neovison vison
DVMLENYSHLVSMGHSVSKPDVISFLEQGKEPWLVDRELTRDQWPVLESRCETKKLFLKKEIYEIESAQWEIMERLTRHDL

SEQ ID NO: 22201 - protein, 81 aa, Loxodonta africana
KPGVVRFVDVAVYFSPEEWACLRPAQRALYRDVMRETYGHLGALGFPGPKPALISWMEQENEAWSPAAQDPEERENLGGVP

SEQ ID NO: 22202 - protein, 81 aa, Capra hircus
RLTFQDVALDFTQEEWECLDLSQRELYRDVMLENYRNLASLAVSSHNTHGLMSKNPRLENLIQKANLGIHERAHLGNEHLM

SEQ ID NO: 22203 - protein, 81 aa, Pteropus vampyrus
MPVTFEDVALYLSREEWGRLDHTQQSFYHDVLQKRNRLALGVSSSQRTLGSLDFSHRAVEVGKEEPMPCPASHGDVKSFRT

SEQ ID NO: 22204 - protein, 81 aa, Pteropus vampyrus
AQESLTFDDVAVDFTWEEWQLLAPTQKDLYRDVMSENYSNLVSVGCQAKKPDTLSRLDQGEPPWTMADEVHPRSRSGIWKV

SEQ ID NO: 22205 - protein, 81 aa, Pteropus vampyrus
FQGSVMFRDVSINFSQEEWECLDPGQMNLYKEVMLENFSNLVSVGLSSAKPVVISLLEEGKEPWMVEREVKRGLCSDLESM

SEQ ID NO: 22206 - protein, 81 aa, Pteropus vampyrus
MDMVVFEDVAVDFSQEEWALLDAAQRELYREVMLETCQNLASVGKIWEELSIEDQYTHQERQERNHVMERLWESNDQCGEG

SEQ ID NO: 22207 - protein, 81 aa, Pteropus vampyrus
CEGPVSFEDVTIDFSREEWQQLDPAQRHLYQDVMLEICSHLFSVGYHVPNPEVIFRMEKEAKLPHRRCQEEEFGLETQQQE

SEQ ID NO: 22208 - protein, 81 aa, Pteropus vampyrus
PEESVTFKDVAVDFTQEEWGQLDSPQRALYRDVMLENYQNLLALGPPVCKPDVISHLERGEEPWQVPREVPGGAHPEWEPR

SEQ ID NO: 22209 - protein, 81 aa, Trichechus manatus
MESVVFEDVAVDFTLEEWALLDPVQRKLYRDVMLETFRNLASVDDETPFKANESVSQRDTHEKKISKEDKILKFTRNDSWS

SEQ ID NO: 22210 - protein, 81 aa, Trichechus manatus
SQSLVIFGDVSVVFSQDEWEWLNPAQRSLYRNVMLENYRNLVSLGLCISKPDIISLLEQGKEPWMVKRKMTRGWGPDLKPL

SEQ ID NO: 22211 - protein, 81 aa, Trichechus manatus
AQESLSFEDVAVGFTWEEWQLLDPSQKDLYKEVMLENYNNLVSVGYPATKPNPVFKLEQGEPPWIVEGAIHSWTSPEEIWA

SEQ ID NO: 22212 - protein, 81 aa, Trichechus manatus
SQGLLTFRDVAIEFSQEEWDCLDPAQKALYKDVMLENYRNLVSLGISIPELNLISILEQGAEPWTVEIKVKIAKNLGRWEC

SEQ ID NO: 22213 - protein, 81 aa, Trichechus manatus
QQRSVSLKDVVVGFAQEARHQLIPAQRALYQDVMLETYRNLISVGYEGTKPDVILKLEAEEEPWISKAVCPGCYCQEDFWE

SEQ ID NO: 22214 - protein, 81 aa, Trichechus manatus
LKASVSFKDVAVELTQEEWQHMGPAQRTLYRDVMLENYSHLVSVGYCIFKPEVIFKLEQGEQPWFLEQEFSNQSYPEDYNI

SEQ ID NO: 22215 - protein, 81 aa, Trichechus manatus
AQESLTFNDVGMEFTLEEWQLLDAAQKKLYWDVMLENYRNLVSIGYQVSKPEALSRLEQRKQSWTISDENHRGVFSEIRKV

SEQ ID NO: 22216 - protein, 81 aa, Trichechus manatus
MGEGLTFKDVAIYFSQKEWECLESTQKDLYRDVMLKNYDILVSLGLPDSKPSVISLLEQGKEPWMVRREEAEGWCPDWESR

SEQ ID NO: 22217 - protein, 81 aa, Trichechus manatus
TSKEAVTFNDVALVFTEEELGLLDSAQRKLYRDVMVENFMNLVSMGIHPFKHNIFYLIREKSLWIMKPRTQREGNSGSKIQ

SEQ ID NO: 22218 - protein, 81 aa, Trichechus manatus
GGELITFKDVAVDFTWWEWEQLDPTQKDLYREVMLENFRNLASLGLLLSKPYVICQLEEGEEPCVLEREISAGAHSDWERK

SEQ ID NO: 22219 - protein, 81 aa, Trichechus manatus
AQDSLTFSDVAVKFTWEEWQLLDPAQKDLFWDVMLENYNNLVSLGYRVSKPDALSRLEQGEQPWTILDESHNQNFSGKEQG

SEQ ID NO: 22220 - protein, 81 aa, Zalophus californianus
RPESVTFEDVAVYFSENEWTGLAPAQRVLYRDVMLENYGAVASLAAFPFPKPALISQLERGEAPWCKAPQGARDGEGPRGV

SEQ ID NO: 22221 - protein, 81 aa, Zalophus californianus
MGEGGEEASFLVAKPALISLLEQGEEPGALILQGTEEPGSTASLCPDSRMQAAIKESCLRRVSSKQLGPLGTVWGHLPGGR

SEQ ID NO: 22222 - protein, 81 aa, Zalophus californianus
TPGVAGAAARMNTAQGCVTFEDVFVYFSREEWELLEEAQRLLYRDVMLENFALVSSLGLAVSRSHVVTHMEPEGSPGCLRR

SEQ ID NO: 22223 - protein, 81 aa, Zalophus californianus
PQASVSFKDVTVEFTQEEWRQMDSAQRTLYRDVMLENYSHLVSVGYCFTKPELIFTLEQGEDPWLLKKELLRKSSPEDSQP

SEQ ID NO: 22224 - protein, 81 aa, Equus caballus
GTGWGTFEDVAVYFAQEEWELLDEAQRHLYRDVMLENLALVASLGCASSKSRVAAQLGEGKEPWVLDRVDVSPHSREKPFT

SEQ ID NO: 22225 - protein, 81 aa, Equus caballus
QQGGVTFEDVAIYFSLKEWGLLDEAQRRLYRDVMLENLALITSLGCCHEAENKEDPFEQSVSVQRVSQVRTPKADLPPKKV

SEQ ID NO: 22226 - protein, 81 aa, Equus caballus
FWILRLPPGSKGEAPKEWGKLDEWQKELYKHVVRGNYETLVSLGSGPPVPAPDLLMQIKQEGELQLQEQQALGVEAWAAGQ

SEQ ID NO: 22227 - protein, 81 aa, Equus caballus
ARALVSFEDVAVTFTVEEWRHLDLAQRTLYQEVMLETCGLLVSLGHPVPKPELISLLEHGQELWSGKKVRFKSTYTGERRK

SEQ ID NO: 22228 - protein, 81 aa, Neovison vison
ENYSHLVSVGYDSTKPKVILKLEQGEEPWVAEGEVPCQSQPEEVWKADDPIERIPGSEDEHSRQAISINSKTPVEERENAF

SEQ ID NO: 22229 - protein, 81 aa, Neovison vison
SKVPVTFGDLAIYFSQEEWEWLHPAQRDLYRHVMLENYGHLVSLGLNISKPYVVSLLEQGRDPWLDNRDVRRDLFSESKGE

SEQ ID NO: 22230 - protein, 81 aa, Loxodonta africana
ESVTFRDVAVLFSQEEWGQLDPAQRALYREVMLENYSNLVSLGIPFSKPKVISQLQQGEDPWMVDKGVPQGTRQGLKTWPK

SEQ ID NO: 22231 - protein, 81 aa, Capra hircus
QAQETLTFADVAVDFTWEEWQLLAPVQKALYWHVMLENYSNLVSAGFQASTSEVLSKLDQGEPWMMDDEIHCQTLSEVWKV

SEQ ID NO: 22232 - protein, 81 aa, Capra hircus
LQGSVTFQDVAVEFTPEEWQLLDCDQRTLYWDVMLENFRNLISVGCPVTETTVIFRVEQGQEPWMVEGEDSRWSSPEADCP

SEQ ID NO: 22233 - protein, 81 aa, Chrysochloris asiatica
PKVPVTFDDVSIYFSTSEWEKLEEWQKELYKNIMKGNYGSLVSMDYAMSQPDVLSQIQPEGGQGAPGESELPTDPSEEPGI

SEQ ID NO: 22234 - protein, 81 aa, Chrysochloris asiatica
SQGLVTIKDVSLCFSQEEWRSLDPSQTDFYGEYVMQENCGIVVSLRFPIPKLDMLTQLENGEEQWVPDPHDLEDRDILRVT

SEQ ID NO: 22235 - protein, 81 aa, Chrysochloris asiatica
TQESVMFSDVSIDFSQEEWEYLNEDQRDLYRDVMLENYSNLVSMGYSISKPDVISFLEQRKEPWFVDRELTRGQWPVLESR

SEQ ID NO: 22236 - protein, 81 aa, Chrysochloris asiatica
MAFRDVAVDFTQEEWRLLSSAQRALYREVMLENYGNLVSLGIPFSKPRLITQLEQGKDTWREETKCPPAICPELKPEIQLC

SEQ ID NO: 22237 - protein, 81 aa, Mandrillus leucophaeus
DSVTFDDVAVDFTQEEWTLLDPTQRSLYSDVMLENYKNLATVGKTGLIPSCSEPRSGWEMQLETQWSALQQDSLTGQTSIG

SEQ ID NO: 22238 - protein, 81 aa, Lipotes vexillifer
SDSVGFEDVAVNFTAEEWALLDPAQRKLYRDVMLETFRNLASVEVLGCLGVNHLVESLCEGKEGHQCLETQNQLTHLTVHK

SEQ ID NO: 22239 - protein, 81 aa, Callorhinus ursinus
VHQALLTFRDVAIEFSQEEWGCLTHTQRQLYRDVMLENYGHLLFLGLIVSKPDLVSFLEQKKEPWDVKRKKTVAIPRGRWE

SEQ ID NO: 22240 - protein, 81 aa, Callorhinus ursinus
GLVTFRDVAIDFSQEEWECLDPAQRDLYVDVMLENYSNLVSLDLESTYETKNTISEKDIFEINFSQWEMKERSKTLGLEAS

SEQ ID NO: 22241 - protein, 81 aa, Callorhinus ursinus
AQGLMAFEDVAVYFSQEEWELLDPAQRALYCHVMLENFTLVASLGLSASRPRVVIQLERGEEPWVLGGTVATPARNAHRKP

SEQ ID NO: 22242 - protein, 81 aa, Callorhinus ursinus
FQESVTFEDVAVYFSENEWTGLAPAQRVLYRDVMLENYGAVASLAAFPFPKPALISQLERGEAPWCKAPQGALDGEGPRGV

SEQ ID NO: 22243 - protein, 81 aa, Tursiops truncatus
VTFKDVAVDFTQEEWQYLDPPQRDLYRDVMLEDYINLISVDEDRFPVLVGYKTTKPALIYKLEQGEEPWMVEREISSWRYP

SEQ ID NO: 22244 - protein, 81 aa, Tursiops truncatus
QGSVTFEDVAVYFSWEEWCLLDEVQIHLYLDVMLENFAVVCMLGSFPAVEDEEMPSEQSVSAEGVSQMRTPRAGSSPERAQ

SEQ ID NO: 22245 - protein, 81 aa, Equus caballus
VKKLVTFEDVAVNFTREEWECLDASQRVLYQDVMSKTFENLMSVARFFLSNPNLTTKLEQEEKQWRADLCHQNEKGLPSEG

SEQ ID NO: 22246 - protein, 81 aa, Equus caballus
FQESVTFEDVAVYFTENQWASLDPVQRALYREVMLENYANVTSLVAFPFPKPHLILQLEQGEAPWGLDPWTPVVGEALRCV

SEQ ID NO: 22247 - protein, 81 aa, Equus caballus
ALLDGAQRKLYRDVMLETFRNLVSVDNEIQLKTNGSISQRDIFEEKLSNEQKIARFTKNDSWTSLLGESWEDQCIEDKHNN

SEQ ID NO: 22248 - protein, 81 aa, Equus caballus
LQESFSFEDLSVDFTQKEWQLLGPHQKDLYRDVMLENYSSLVSLGYEVTKPDVIFKLEQGEEPWVGDGEVPSSDSPEQLLQ

SEQ ID NO: 22249 - protein, 81 aa, Equus caballus
FQEAVTFGDVAVHFSREEWQCLDPGQRALYKEVMLENHSSVAGLAGFLVFKPELISRLEQGQEPWVLDLQGAEGDEAARTS

SEQ ID NO: 22250 - protein, 81 aa, Chrysochloris asiatica
APGSVSFKDVAVDFTQEEWQRLDTSQKTIYKDVMLENYSHLISLGHPIIKPDVITKLEQGEEPWIVEGEFLLQSYPEEAQK

SEQ ID NO: 22251 - protein, 81 aa, Suricata suricatta
MASSQGLLPFRDVAIGFSQEEDVMLENYGHLFFLGCLVSKPDLVIFLEKKQVLWDVKRKETVASYPAVSLDDTEKLLPKIF

SEQ ID NO: 22252 - protein, 81 aa, Suricata suricatta
AQESVTFRDVAVVFSRDEWLCLDPAQRSLYREVMLENYGTLVSLGILFSKPKVIFQLQQGEDPWMVESGVSQGPCVGWESM

SEQ ID NO: 22253 - protein, 81 aa, Suricata suricatta
MFQVTFSDVAIDFSHEEWGWLDSAQRNLYKDVMVQNYENLVSLGLSIPKPYVISLLEDGKEPWMVEKKLSKDWESRWEKKE

SEQ ID NO: 22254 - protein, 81 aa, Chlorocebus sabaeus
PLTFKDVAIEFSQEEWKCLEPVQKALYKDVMLENYRNLVFLGISPKCVIKELPPTEDSNTGERFQTVALERHQSYDIENLY

SEQ ID NO: 22255 - protein, 81 aa, Suricata suricatta
PQASVSFKDVTVEFTQEEWRQMDYAQRTLYRDVMLENYSHLVSVGYCFTKPELIFTLEQGEDPWLLTKEFLRKTSPEESQP

SEQ ID NO: 22256 - protein, 81 aa, Chrysochloris asiatica
DSVIVEDVAVVFTQEEWALQELAQRKLYRDVMMETFRNLASVDGYKTYCCPSPFILHSSFHNKEKCHECQECGKAFSDSSA

SEQ ID NO: 22257 - protein, 81 aa, Suricata suricatta
KFQEAVTFKDVAVVFTEEELGLLDPAQRELYRDVMLENFRNLVSLGHSSSKPDMISQLEREEKLCVKDVHAQRGGHAVWTL

SEQ ID NO: 22258 - protein, 81 aa, Suricata suricatta
ISFEDVAVDFSLEEWQLLNPTQKNLYRDVMLENYSNLVFLEVWLDNNLKMWHQHNQDTLRRMERGREYDVFRKIFHSSINF

SEQ ID NO: 22259 - protein, 81 aa, Equus caballus
SDSLERNTHQGCALAGTLPALLDTSQRKLYRDVMLENISHLVSMGYQHCKSDVIFQLEQEELWSEGTGFLQGQSPGRESGR

SEQ ID NO: 22260 - protein, 81 aa, Equus caballus
MAHLVALRDVAVDFSQEEWECLDSEQKDLYRDVMLENYSNLVSLGLCIYQPDVFSLLKKGKEPWMVSKDKTTGSCSDVQSR

SEQ ID NO: 22261 - protein, 81 aa, Equus caballus
SQGLVTFRDVALGFSQEEWEWLDSSQKDLYRDVMLENYRNLVWLGLSISKPNMISLLEQGKEPWMVEREMSDGQYADWESW

SEQ ID NO: 22262 - protein, 81 aa, Neovison vison
KVPVTFVDIAVYFSEDEWKNLDEWQKELYNNLVKENYKTLMSLDTEGTVPKPDAPSQVEPREEPCVWEQRDPEDREILMDP

SEQ ID NO: 22263 - protein, 81 aa, Neovison vison
DVMLENYNNLVSVGNCIFKPAVIFKLEHGEEPWFLEEEFSNQSHQEIRDDDLMKKNKKIQDKHLQEIIFIDNKPLTIKEEE

SEQ ID NO: 22264 - protein, 81 aa, Loxodonta africana
LQEFVMFRDVAVFFSQEEWGQLDTAQRALYREVMLENYSNLVSLGIPFSKPKVISQLQQGEDPWMVDKGVPQGACQGWKSF

SEQ ID NO: 22265 - protein, 81 aa, Loxodonta africana
PKVPVTFDDVAVYFSEQEWGKLDEWQKELYKHVMRGNYETLVSLDYAISKPEVLSQIEQGKEPCSWRRAGPKIPDVPVDPS

SEQ ID NO: 22266 - protein, 81 aa, Capra hircus
MAAHSKEWQQLDLDQKNLYRDVMLETCSHLLSIGYQVPEIEVFMLEQGKEPWALQGEGPYQSCPGEKLQDHNQCGKILSYE

SEQ ID NO: 22267 - protein, 81 aa, Chrysochloris asiatica
CVTLEDVAIYFSLEEWSLLDESQRLLYYNVMLENFALITSLGYGHEMETQETPPEHCVFIEGLSQDRTLNVDLSIQKHYPD

SEQ ID NO: 22268 - protein, 81 aa, Chlorocebus sabaeus
AQEPVTFRDVAIYFSREEWACLEPSQRALYRDVMLDNFSSMAALGFCSPRPDLVSRLEQWEEPWVEDRESPELQAVQRGHW

SEQ ID NO: 22269 - protein, 81 aa, Chrysochloris asiatica
VTIEDVAVVFTHEEWDLLDPTQRKLYRDVMMETLRNLASREKPSESKKAIPEASSLPQRVSSHSGEMPYECKECGKTFRES

SEQ ID NO: 22270 - protein, 81 aa, Chrysochloris asiatica
CQEPVTFEDVAIIFTEEEWGHLVPIQRDLYKEVMLENYTSIVSLGLPVPQPDVIFHLKKEEEAWVVDLHESEERECPENVS

SEQ ID NO: 22271 - protein, 81 aa, Mandrillus leucophaeus
PQGLLTFRDVAIEFSQEEWKCLDPAQRTLYRDVMLENYRNLVSLDISSKCMLKTLSSTGKGNTEVIVTGTLQRQASHHTGE

SEQ ID NO: 22272 - protein, 81 aa, Chlorocebus sabaeus
AGYQVSKPEVIFKLEQGEEPWISEGEIQRPFCSDWKTRPEVKSSHLQQDVSEVSHCTHDLSHATLEDSWDVSSQLNRQQEN

SEQ ID NO: 22273 - protein, 81 aa, Mandrillus leucophaeus
TPEPHFAQATDMEQGLTRAPPVPQVPALPHEESPGDQAAVLLTVRYQQFVTFEDVAEWGYLDPVQRDPYRDVRLEIYGNVV

SEQ ID NO: 22274 - protein, 81 aa, Sus scrofa
RPGAVKFADVAAYFFQEEWGCLRPAQRALDRDVMREIYRHLGALGFAGLKPALISWMEGRKEVWRPEAEDPKKGRGTQVLG

SEQ ID NO: 22275 - protein, 81 aa, Mandrillus leucophaeus
SQGRVTFEDVTVNFTKGEWQRLNPKQRNLYRDVMLENYSNLVFVGREETTKPDVILRLEQGKEPWLVEEEVLGSGRPEKNG

SEQ ID NO: 22276 - protein, 81 aa, Sus scrofa
GTICSGQLVGIFFPFCAKNIDHFTWNRNVLFQGPVSFKAMAVNFTQEEWQYLDPPQRDLYKDMMLDNYISLISVGKDHFPG

SEQ ID NO: 22277 - protein, 81 aa, Sus scrofa
MAHDLVMFRDVTVDFSQEEWECLNSNQRNLYRDVILENYSNLVSLVITLLEQGKEPWMVVRDEKRRWSLDLESRYDTKKLF

SEQ ID NO: 22278 - protein, 81 aa, Aotus trivirgatus
GTVTFEDVAVKFSQEEWSLLSEAQRCLYHDVMLENLALISSLGCWYGANDETPSKQTLSIQQQSPLRSHWTGVCTKKAHPW

SEQ ID NO: 22279 - protein, 81 aa, Papio anubis
SLKKVTFEDVAIDFTQEEWAMMDTSKRKLYRDVMLENNSHLVSLGYQISKSYITLQLEQGKELWWKGREFLQGQNLNKESA

SEQ ID NO: 22280 - protein, 81 aa, Sarcophilus harrisii
PQECVTFKDVAVNFTQEEWQQLNPAQRDLYREVMLENYRNLISLGLPVSKPDVIFQLEQGEEPWMLDLQRIEEGEISRNMY

SEQ ID NO: 22281 - protein, 81 aa, Sarcophilus harrisii
LQESVTFSDVAVDFTLEEWGCLCPPQKEMYREVMLENYGNLVCLGLAMSKPDVISRLERGEAPRSPGGDLGSADWGTESGA

SEQ ID NO: 22282 - protein, 81 aa, Sarcophilus harrisii
AWKPMTFKDVSVDFTQGEWGQLDPAQRDLYRDVMLENYRNLVSLELQVIKPEVISRLERGEAPCMLEREGISSCPDNDTIS

SEQ ID NO: 22283 - protein, 81 aa, Pan paniscus
AQGLVTFRDVAIEFSLEEWKCLEPAQRDLYREVTLENFGHLASLGLSISKPDVVSLLEQGKDPWMIANDVTGPWCPDLESR

SEQ ID NO: 22284 - protein, 81 aa, Lipotes vexillifer
SQDPVSFEDVAIDFTQEEWQQLDPAQRTLYRDVMLENYSHLVSVGYPVSKPGVISKLEQGEEPWIMKKDVSNWIYPGENLA

SEQ ID NO: 22285 - protein, 81 aa, Lipotes vexillifer
FQDAVTFEDVAVVFTDEEWRCLVPAQRDLYKEVMLENYKSIVSLGLPVPGPDVIFQLKRGDEPWIVELHGSEGKECAENVS

SEQ ID NO: 22286 - protein, 81 aa, Lipotes vexillifer
GSVSFKDVTVDFTQEEWQQLDSAQRNLYKDVMLENYSNLVSVVKNINVFSVGKPSVESQDLLYIREFILGKNRTNVMTEKA

SEQ ID NO: 22287 - protein, 81 aa, Lipotes vexillifer
QGHVIFEDVAVSFSQEEWGLLNNAQRLLYCDVMLENLSLIASLGCWHGVEAEEAISEQCVSVEQVTEDRNPKLEPSILKPL

SEQ ID NO: 22288 - protein, 81 aa, Lipotes vexillifer
SHTLVTFKDILVNFTREEWKLLDPAQQLMYKDVMLENYRNLMSLGHQLPKPEVILQLEKGEEPWLMERGIHQESHPDLETA

SEQ ID NO: 22289 - protein, 81 aa, Pan paniscus
FQEMVTFKDVAVVFTEEELGLLDSVQRKLYRDVMLENFRNLLLVAHQPFKPDLISQLEREEKLLMVETETPGDGCSGRKNQ

SEQ ID NO: 22290 - protein, 81 aa, Pan paniscus
GTVTFEDVAVKFTQEEWNLLSEAQRCLYRDVTLENLALISSLGCWCGVEDEAAPSKQSIYIQRETQVRTPMTGVSPKKAHP

SEQ ID NO: 22291 - protein, 81 aa, Lipotes vexillifer
PQGSTPFNSMTVAFTQKGWRQLAPTPRDRFKKGMPEKSRNLVLLGLPVSQPGMNSQLEQREGSWMLEREGLRSTCPDWKIV

SEQ ID NO: 22292 - protein, 81 aa, Pan paniscus
TFKETVTFKDVAVVFTEEELGLLDPAQRKLYRDVMLENFRSLLLVGNQPFHQDTFHFLRKEEFWMMKTTSQREGNSGGKIQ

SEQ ID NO: 22293 - protein, 81 aa, Lipotes vexillifer
LQGLVSFKDVAVDFTQEEWQQLDPAQKTLYRDVMLENYSHLVSMGHPVSKPDVISKLEQGEDPWIIKRDISNWIYPYEDQA

SEQ ID NO: 22294 - protein, 81 aa, Callorhinus ursinus
SQEPVTFEDVAVYFTQNQWASLDPMQRALYLEVMLENYANITSLALPFPKPDLILQLEQGEAPWGLDPWTPLDGEALGGVH

SEQ ID NO: 22295 - protein, 81 aa, Callorhinus ursinus
MDSVVFEDVAVDFTLDEWALLDSMQKNLYRDVMLETFQNLVSVDYETLLKASGLVSQQDMHEKKKSNEQKMAKFTKNHSCA

SEQ ID NO: 22296 - protein, 81 aa, Callorhinus ursinus
LQGSVTFPDVAVDFTPEEWQLLDCEQRTLYWDVMLENFRNLISVGGPVTKTKAIFKAEQGQEPWMREGVNPRWRHPEADCL

SEQ ID NO: 22297 - protein, 81 aa, Callorhinus ursinus
WLTFRDVAIEFSQEEWECLDPAQRALYRDVMVENYRNLVFLAISSKCMIKELPPKENSNTGEVLQTVILERHKSRDTEDYA

SEQ ID NO: 22298 - protein, 81 aa, Tursiops truncatus
LLTFEDVALFFTEEEWQLLDPAQKILYHNVMQENYETVISLGLKLKNDTGNDQPMSLSTLEIQASGCKVLRKARMKVAQKT

SEQ ID NO: 22299 - protein, 81 aa, Zalophus californianus
VEGSVTFKDVTMAFTQKEWEQLDPAQRNLYKDVMLENYSNLASMGYQAPKPDMISKLEKGEEPWLGKGKRPRQCGPSEIAR

SEQ ID NO: 22300 - protein, 81 aa, Zalophus californianus
LLTFRDVAIEFSPEEWECLDPAQRALYKDVMLENYRNLVSLDISVRSMIKKLSPKEDISKEELFQTLMLERHKRNDIKDLG

SEQ ID NO: 22301 - protein, 81 aa, Zalophus californianus
QDSVTFEEVAVDFSQEEWALLDPAQKILYRDVMLENYRNLASVGYPLCKHSLIMEVEQEVLGTEEGAVLQGACTDWDIQLK

SEQ ID NO: 22302 - protein, 81 aa, Equus caballus
DHELLTFRDVVINFSQEEWDYLDSAQRDLYWDVMMENYSNLVSLDLESKYDTKNLSIEKDITENNSSEWKVTEGSKFLGFE

SEQ ID NO: 22303 - protein, 81 aa, Equus caballus
EAVTVLFDDVALYFSEEEWEILEKWQKEMYQQVMKTNYETLDSLGWVFSKPDLITWMEQGRMLFTRDQGHLEKTRITLSPS

SEQ ID NO: 22304 - protein, 81 aa, Equus caballus
QSPVTFEDVAVYFSKEEWGLLDAAQRHLYHNVMLENFELMTSLGCWHGVEDEEAHSKQTASVEGVSQVRIPSAHASTQKAD

SEQ ID NO: 22305 - protein, 81 aa, Equus caballus
AQGLVTFRDVAIEFSQEEWKCLEPAQRDLYRDVTLENFSNLVSLGLSIAKPDVVSLLEQGKEPWTIANDMPGAWCPDLESR

SEQ ID NO: 22306 - protein, 81 aa, Equus caballus
LQEPVTFRDVAVDFTQEEWGQLGPAQRTLYRDVMLETFGHLLSVGPELPKPEVISQLEQGAELWVMERGIAQGCCPDWEPG

SEQ ID NO: 22307 - protein, 81 aa, Equus caballus
FQEQVTFEDVVVDFTREEWGQLEPAQRTLYRDVMLETFGLLVSVGHWLPKLDVISLLEQVTEPWAVDKGLPQDLETRPQTK

SEQ ID NO: 22308 - protein, 81 aa, Equus caballus
NMDSVVFEDVAVDFTQEEWDLLNLAQRNLYRDVMLENLQNLASLGYPLHTPCLISHWKQEEDLERVKRGPIQGEHQEGFET

SEQ ID NO: 22309 - protein, 81 aa, Equus caballus
PLESVTFEDVAIDFTQEEWLLLDTSQRKLYRDVMLESIDHLVSIGYQIFKSDVIFQLEQGKELWSEGDGFLQGQSPVTLGS

SEQ ID NO: 22310 - protein, 81 aa, Equus caballus
TARSQASVTFKDVAMDFTPEEWGKLDPAQRDVMLENYRNLVSLWLPVSKPENYYLENAKEPLMLERKAPKSGYSDLETSPE

SEQ ID NO: 22311 - protein, 81 aa, Capra hircus
QAEVTFKDVAVFLSQEEWGLLGPAQKGLYREVMLETYRNLVSLGAGLAGPKPEVIVHLERGDELWVLDMRGAEQPSVDGSA

SEQ ID NO: 22312 - protein, 81 aa, Capra hircus
PSEGRLTFQDVAIDFTQEEWECLDLSQRKLYRDVMLENYGNLASLGLVSVLDLVTFLEQLKDPRNIRRMETTAIYPAVSPQ

SEQ ID NO: 22313 - protein, 81 aa, Lipotes vexillifer
FRGSVMFRDVSINFSQEEWECLDSGQMNLYKEVMLENFSNLVSVGLSSSKPTVISLLEQGKEPWMVDKELTRGLCSDLESM

SEQ ID NO: 22314 - protein, 81 aa, Pan paniscus
ESITLKDVAVTFSRGEWKKLEPFQKELYKEVLLENLRNLEFLDFPVSKLELISQLKWVELPWLLEEVSKGSRLDESALDKI

SEQ ID NO: 22315 - protein, 81 aa, Tursiops truncatus
MLDLEQKSLYREVLLENYRNLVSVEHQLSKPDVVSQLEEEEELWSVERGIPRDTFSECPEAQLDPQFHPFPAGNPLMKIEV

SEQ ID NO: 22316 - protein, 81 aa, Tursiops truncatus
TQVSVTFDDVAVTFTQEEWRQLDPAQRTLYQEVMLENCRLLVSLGCPVPRLELIFQLEQGQKLWTVKKDLSRSTCPGKRCR

SEQ ID NO: 22317 - protein, 81 aa, Tursiops truncatus
SVTFEDIAVYFSWEEWRLLDETQRRLYLDVMLENFALISSLGCCCGAEDAEAPFEQITSLGVSQARTPKADLSFQKTHPCE

SEQ ID NO: 22318 - protein, 81 aa, Tursiops truncatus
AAMSFADVAVYFSPEEWGCLRPAQRALYRDVMRETYGHLDALGDAPNKKEEEPKTGPGAKGSEKTPRKERPEELVKNSLDS

SEQ ID NO: 22319 - protein, 81 aa, Tursiops truncatus
MESVTLEDVAVGLIQEWALLDDARRNLCRYALLDNCRTLAPQAGTPSCKTCLVSQVGPREELMTAERGILCAMGVDWESQL

SEQ ID NO: 22320 - protein, 81 aa, Tursiops truncatus
LQETLTFRDVFVDFTLEEWQQLDATQRNLCKDVMLENYSHLVSVGFLVAQPGRTFRLGQGEEEARMAAGESPTQRCPDLHP

SEQ ID NO: 22321 - protein, 81 aa, Pteropus vampyrus
VKEPVTFKDVIVEFTREEWQLLDPSQRTLYREVMQENYGHLVSVGYCLNKPNAVFKLKQGKEPWILEVEFPRRNYPGENVA

SEQ ID NO: 22322 - protein, 81 aa, Trichechus manatus
QSAVAFEDVAVYFSGDEWRLLNVTQRHLYRDVMLENFALIGSLGCLCGAEDEGAPLKHVKSFRAHLLKKPFIRGESPKDVM

SEQ ID NO: 22323 - protein, 81 aa, Trichechus manatus
ALALVSFEDVAVTFTGEEWQYLDLAQRILYQEVMLETCGLLVSLGHPVPKPELIFLLEHRQELWTMKRGLSQSISPGEKAK

SEQ ID NO: 22324 - protein, 81 aa, Trichechus manatus
DSAVEDVVVDFTQEEWALLDLSQRQLYRDVVMEIFRSLASVASRNLIDGEKLSTEKIIVRFMKNDTWSSVVGEIHELHGTE

SEQ ID NO: 22325 - protein, 81 aa, Trichechus manatus
SVVIEDVAVEFTQEEWALLDLAQRKLYKDVMMETFRNLASIVSQNLNDGEKLSSEYLIVELMKNDTSFSILGEICKLHDIE

SEQ ID NO: 22326 - protein, 81 aa, Trichechus manatus
GLLTFEDVAVFFTQEEWDYLDPAQRSLYKDVMMENYGNLVSLDVLNKDKDEEPTVKQEIEEIEEEVEPQSVIVTRIKSEID

SEQ ID NO: 22327 - protein, 81 aa, Trichechus manatus
HKPVVTFKDVAVDFTREEWGLLGPTQRILYRNVMLRNYSNLVSLGLPDSKPDVISKLEQWEDPWIVERDVPRGSWPDSEPD

SEQ ID NO: 22328 - protein, 81 aa, Trichechus manatus
VTFEDVAVYFIRKEWKRLEPAQRDLYRDVMLENYGNVFSLDGENDQEISEDTGSHGVLLGRFQKGISQGLKFEEAYEQEVG

SEQ ID NO: 22329 - protein, 81 aa, Trichechus manatus
GPGCVTFEDVAVCFSREEWELLDVAQRLLYRDVMLETFGLMASLGLVSSRTHEITQLEQWSEPWVPDQEAMAPDTPRGCWR

SEQ ID NO: 22330 - protein, 81 aa, Trichechus manatus
FTESVTFKDVAVVFTEEEMGLLTPAQKKLYRDVMVENFRNLVSVGGKNPRQVETVPQAGAHEELSSLHIWQQIASDLTGCQ

SEQ ID NO: 22331 - protein, 81 aa, Trichechus manatus
GETHMAFRDVAVDFTQDEWRLLSSAQRTLYREVMLENYGNLVSLGIPFSKPKLIIQLEQGKETWREEKKCPPAICPAEPKP

SEQ ID NO: 22332 - protein, 81 aa, Zalophus californianus
LHKPVTFKDVAVDFTQEEWGLLGPTQRILYRDVMLRNYSNLVSLGLPDCKPDVISKLEQWEDPWTVKRDVPRGPDSEPGPR

SEQ ID NO: 22333 - protein, 81 aa, Zalophus californianus
FQGSVSFKDVTVGFTQEEWQRLDPAQRSLYRDVMLENYSNLVSLGYCVTKPEVIFRLEQGEEPWILEEEFPSQSFPEIWKT

SEQ ID NO: 22334 - protein, 81 aa, Zalophus californianus
SVTFRDVTVDFTQEEWQQLEPAQKDLYRDVMLENYRNLVSLDLETRPEMKESGPKEDSAEDRPSVGAVVEGPPRNGARGLA

SEQ ID NO: 22335 - protein, 81 aa, Zalophus californianus
MDFTLEDWEHLGLDQGDLFWDTALDNYQNLFLLNPSKPKLTSHTDGTEELKVRVRESPESAGPDTAEVKNCLLAQDFLEEE

SEQ ID NO: 22336 - protein, 81 aa, Chrysochloris asiatica
APESVTFRDVTVDFTQEEWQQLEPAQKALYRDVMMENYRNLVSLEGTWKQSDCRERQPGSADTHLESLEISHDNKLTRELG

SEQ ID NO: 22337 - protein, 81 aa, Chrysochloris asiatica
RPRAVRFADVAVYFSPEEWGCLRPTQRALYRDVMREIYGHLGALGCAGPKPALISWLERNADDWEPAALDPQKCPRGITVQ

SEQ ID NO: 22338 - protein, 81 aa, Chlorocebus sabaeus
VMLENYSLLLSVGYCITKPVVICKLEHGEVLWILEEESPSQNHLDCCIDDNLLERRQENQDQHLQKVDFFNNKTLTTDRNG

SEQ ID NO: 22339 - protein, 81 aa, Chlorocebus sabaeus
GEGSLSFKDVAVDFTREEWQFLDWSQKVLYKEVMLENYSNLVSVGYQGTKPDSLFKLEQGEPPWIVEGAAHSQTCPGFVIQ

SEQ ID NO: 22340 - protein, 81 aa, Chrysochloris asiatica
QDLVVVDDVTVNFTQEEWALLDFSQRKLYKDVMMETFRNLDSEDPNLLCLFQKSMVENLHESKEYTVKENKEGNQCGKTFS

SEQ ID NO: 22341 - protein, 81 aa, Chlorocebus sabaeus
MLETYSSLVSLGHCITKPEVIFKLEQGAEPWLGEEWANQCLSDVQTVDIIERSQEIHHRHIWQVAITNSKTSTKETVELGK

SEQ ID NO: 22342 - protein, 81 aa, Suricata suricatta
WGCLSHSQRELYRDVMSENYGHLLFLGEDHSLSISQPDLVFLLEPKQELWDVKRMETVASYPVSSNANERLSPKIFIENSF

SEQ ID NO: 22343 - protein, 81 aa, Chlorocebus sabaeus
QGSLTFRDVAIEFSLEEWQCLDTAQQNLYRNVMLENYRNLVFLGIAVSKPKLITCLEQEKEPWNVKTHDMVAKPPVICSHI

SEQ ID NO: 22344 - protein, 81 aa, Sarcophilus harrisii
MTFRDVAVDFTGEEWRRLEPAQRALHRDVMLENYQNLVFLGLPVSKLDVISLLERGEAPWRPKGGGPPDPCPDALSQETRF

SEQ ID NO: 22345 - protein, 81 aa, Sarcophilus harrisii
PQGPVTFQDVAVVFTQEEWRYLDPSQKELYRDVMLENYRNLLYLGLVVSKPNVIYRFEQGEASWRPDQRDSGSTCSDEETG

SEQ ID NO: 22346 - protein, 81 aa, Lipotes vexillifer
LKEAVTFKDVAVVFTEEELGLLDSAQKKLYQEVMLENFQNLVSVGHQSFTPDVISQLKREENLWMIKIATQSCRSLGDKNL

SEQ ID NO: 22347 - protein, 81 aa, Tursiops truncatus
AQVLVTFKDVAVTFTREEWGQLDLDQRTLYQEVMLEICGLLVSLGHPVPKPELIHLLEHGQELWMGRRGLPHSMCPDDRAK

SEQ ID NO: 22348 - protein, 81 aa, Tursiops truncatus
QGLLTFRDVAIEFSQEEWECLDPAQRALYRDVMLETYRNLLSLDTSISFLTKELLKKKNINNRELYQSVVLGRHGSHGIED

SEQ ID NO: 22349 - protein, 81 aa, Trichechus manatus
SLDTVTFKDVAVDFTQEEWQQMKPAQRNLYRDVMLENYSNLVTVGCQVTKPDVIFKLEQEEEPWVGEEETLGRHCPEIWEV

SEQ ID NO: 22350 - protein, 81 aa, Trichechus manatus
VQESLTFSDVAVKFTWEEWQLLDPAQKDLYWDVILENYSNLVSIGYQVSKPDVLSRLELGEQPWTILYERHSGIFSEIQKG

SEQ ID NO: 22351 - protein, 81 aa, Trichechus manatus
SVVIEDVAVVFSQEEWALLDLAQKKLYRDVMMETFRNLASVDSQNFNDGEKLSSEHIMMQFMKNNLWSSMLREISDQSHDN

SEQ ID NO: 22352 - protein, 81 aa, Trichechus manatus
AQESLAFEDVAVKFTWEEWQLLDPAQKNLYRDVMLENFRNLVSVGYQVTKPDALSRLRRGELPWSILDEIDSRNFLEIWKV

SEQ ID NO: 22353 - protein, 81 aa, Trichechus manatus
YQDLVTFEDVAVDFTKEEWTLLDEMQRDLYRDVMLENYRNLVAVGYRLCKPNLISRLEQGEELRTRERGVLQKLYLQFKRR

SEQ ID NO: 22354 - protein, 81 aa, Trichechus manatus
SVVAEDVAMVFSQEEWALLDLAQRKLYKDVMLETFRNLASVVSRNLSDGEKLSSEHIMVQFIKNNTWSSMLGEIFESHGNK

SEQ ID NO: 22355 - protein, 81 aa, Trichechus manatus
LLTFKDVAIEFSQEEWECLDPAQKALYRDVMLENYRNLISLDVSSTCVIKELSPKEIINKGELFQRMMLERHESHGTEDFD

SEQ ID NO: 22356 - protein, 81 aa, Trichechus manatus
AHGSVTFRDVAVDFSQEEWECLDPAQRDLYRDVMWETYSNFISLDLESTYRTNNLSPEKDIYEIYSFQWEIMERIKSYSFP

SEQ ID NO: 22357 - protein, 81 aa, Trichechus manatus
SVVIEDVAVVFSQEEWALLDLAQRKLYRDVMMENFRNLASIVSRKLNDGNKLSSELIMLRFMKNNTWSSMLGEISESHGTR

SEQ ID NO: 22358 - protein, 81 aa, Zalophus californianus
PQGSAAYQFLSVDYTERKWKGPALSQRAVYRSIVPENYCSMASLGETRTRRSELPARQEVSKGPASSDGTSGGLCGVVSGE

SEQ ID NO: 22359 - protein, 81 aa, Zalophus californianus
AQESVTFRDVAVFFSQDEWLRLDSAQRTLYREVMLENYGTLVSLGILFSKPKVIFQLQQGEDPWMVENGVCQGPCVGWERL

SEQ ID NO: 22360 - protein, 81 aa, Zalophus californianus
SPGAVSFADVAVYFSPEEWGCLRPAQRALYRDVMRETYGLLGALGEVEAWSPEAQDPEGETRAAVIRDRGSRDESEEKEEL

SEQ ID NO: 22361 - protein, 81 aa, Zalophus californianus
APGLVTFEDVAVYFSREEWGLLNLTQRSLYRDVMLENFALIGSLGVAPSGSHVVAQLESEEDLWMPNMVDLTLGSRAEARR

SEQ ID NO: 22362 - protein, 81 aa, Equus caballus
EAGPVSFADVAVYFSPEEWGCLRPAQRALYRDVMRETYGHLGALGFRGTKPALISWVEEEAELWSQDAQDPVGECLAKADT

SEQ ID NO: 22363 - protein, 81 aa, Equus caballus
DSVAIEDVKVNFTPEEWALLDPSQKKLYRDVMWDTFRHLASVGKNEDIPSLDSVKVKTVVSAEKTSALFQISSSCVIHPFM

SEQ ID NO: 22364 - protein, 81 aa, Neovison vison
QRTLYRDVMLENYSHLVSLGIAFSKPRLITQLEQGEEPWREESECLLDLCPEPGIECQPYGHSCPLTFSSPQFLEQYVLCG

SEQ ID NO: 22365 - protein, 81 aa, Equus caballus
VGLQFQGSVTFGDVAVAFSQQEWASLDPAQRALYRDVMLETYSHLASLGHSVSKPHVITFLEQWKEPWVVVRKEQRQRQTG

SEQ ID NO: 22366 - protein, 81 aa, Neovison vison
LVSFEDVAMDFSREEWQQLDPAQRCLYQDVMLEIYSHLLSVEGALGLKTSQQKIFEKASFHNGKESEVTRGGMWCSISEDL

SEQ ID NO: 22367 - protein, 81 aa, Loxodonta africana
AGYQRSKPGVISQLEKGEEPWLTEREISGGPSSDLESETETKESTLKNDISWKELHDGLMMERSTKGSTLYSTLGEVSKCD

SEQ ID NO: 22368 - protein, 81 aa, Loxodonta africana
ESVTFKDVAMDFSPEEWGKLDPAQRDVMLENYRNLASLWLPVSKVENYNLENGKEPWMFEEKKNKSSYSDWEARPESKEST

SEQ ID NO: 22369 - protein, 81 aa, Loxodonta africana
SQGLVTFEDVAVYFSLEEWERLDTGQRDLYRDVMQENYGILVSLGYPIPKPDLIFRLEQGEEPWVPDSPHPEEGDIVTGVY

SEQ ID NO: 22370 - protein, 81 aa, Capra hircus
MAESVAFRDIAVLFSRDEWLCLDSAQRTLYREVMLENYSTLVSLGIPFSMPELICQLQQGEDPCMVEREIPQDTCLGFKTW

SEQ ID NO: 22371 - protein, 81 aa, Aotus trivirgatus
AHGSVTFRDVAIDFSQEEWEFLDPAQRDLYRDVMWENYSNFISLGPSISKPDVITLLDEEGKEPGMVVREGIRRYCPDLDS

SEQ ID NO: 22372 - protein, 81 aa, Aotus trivirgatus
AQGSVSFNDVTVDFTQEEWQHLDHAQKTLYMDVMLENYCHLISVGCHMTKPDVILKLERGEEPWTSFAGHTYLEENWKAED

SEQ ID NO: 22373 - protein, 81 aa, Aotus trivirgatus
FSSLRVPWLAEMDPAQDRVVFEDVAIYFSQEEWGHLDEAQRLLYRDVMLENLALLSSLGKALTLVQCPGLGCPQAALRFLQ

SEQ ID NO: 22374 - protein, 81 aa, Aotus trivirgatus
MLENYRNLAFLAGIAVSKADLITCLQQGKDPWNMKRHSIVAKPPVLCSHFGQDLWPRLGIKDSFQKVILRENGKCGHKDLQ

SEQ ID NO: 22375 - protein, 81 aa, Pan paniscus
MLLFFLNKTGIAVSKPDLITCLEQNKDPWNIKRNEMVTKHPVMCSHFTQDLPPELGIKHSLQKVIPRRYGKCGLDNLQVKK

SEQ ID NO: 22376 - protein, 81 aa, Lipotes vexillifer
SLGTVTFKDVAVDLTQEEWQEMKPAQRDLYRDVMLENYSNLVTVGCQVTKPDVIFKLEQEEEPWVIEEEMLGRPCPEVWED

SEQ ID NO: 22377 - protein, 81 aa, Lipotes vexillifer
KFQPVSFKDVAVVFTEGELGLLDSAQRKLYRDVMLENFRNLLSVGNQPFKPELIFQLEREEELLMMETETQREGCSGTKSQ

SEQ ID NO: 22378 - protein, 81 aa, Pteropus vampyrus
SQSLLAFEEVAVYFSQEEWELLDPSQRALYNDVMQENYETVISLAIFVLPKPKVISCLEQGEEPCVQGSPNFKDSPGALSM

SEQ ID NO: 22379 - protein, 81 aa, Pteropus vampyrus
MEPVTFEDVAVYFTQNQWASLDPVQRALYREVMLENYANVASLAFPFPKPVLISQLEQGEAPWGPDPGEAEVLKGIWPGGE

SEQ ID NO: 22380 - protein, 81 aa, Pteropus vampyrus
SLGSDLFRDVAVLFSQEEWDRLAPAQRDLYRDVMLETYSNLVSLDLAICKPDVIAFLEQGREPWVVEEAAFGGLCPAYRSL

SEQ ID NO: 22381 - protein, 81 aa, Trichechus manatus
RYQEFVTFEDVAVYLTREEWGCLDPVQRDLYREVMLENYGNVVSLGFPFFKPDGISQLEQDLQVFDLETKNREVLKRQLLR

SEQ ID NO: 22382 - protein, 81 aa, Trichechus manatus
SQVLLTFRDVAIEFSQEEWDYLDPAQRTLYRDVMLENYRNLLSLGISPSEINIVSILKKGTEPWTVEKTAKLAENPDVIST

SEQ ID NO: 22383 - protein, 81 aa, Trichechus manatus
VTESVTFRDVAVLFSQEEWGHLDSSQRALYREVMLENYSNLISLGIRFSKPKVISQLQQGEDPWMVDKGVSHGTCQGIPFS

SEQ ID NO: 22384 - protein, 81 aa, Trichechus manatus
MDSVVAEDVAVVFSKEEWALLNLTQRKLYREVMIETFRNLVSVGELSELYGSKDHHKFPEGCLRSHTVENLFEDNEGNQCG

SEQ ID NO: 22385 - protein, 81 aa, Trichechus manatus
SQSLLTFEEVAMYFSQEEWELLEPPQKVLYHDVMQENYETVISLALFVLPKPKVISCLEQGEEPWIQGPQEFKDSHVESPT

SEQ ID NO: 22386 - protein, 81 aa, Trichechus manatus
SVAVEDVTVDFTREEWALLDLSQRKLYRDVMMETFRNLASIVSQNINVGEKLSTENRIVQFMKNDTCSSMVGEICELHGIE

SEQ ID NO: 22387 - protein, 81 aa, Trichechus manatus
EELPVVFEDVAVYFTREEWGLLDKQQKELYRDVMRMNYELLASLGPAAAKPDLISKLERRAAPWIKDPRGPKWGKGHPPDP

SEQ ID NO: 22388 - protein, 81 aa, Trichechus manatus
SQGLLTFRDVAIEFSQEEWECLDPAQRALYRDVMLENYRNLVSLGISSSEMNGISILKKKTEPWTLYTMMDIAYDPDVFST

SEQ ID NO: 22389 - protein, 81 aa, Trichechus manatus
AEGLVAFEDVAVYFSQEEWRLLNMAQRALYRHVMLENFALVASLGLAASRPRVVIQLDGDEEPWVPNGTDVAPVTARKVQR

SEQ ID NO: 22390 - protein, 81 aa, Trichechus manatus
SQELLTFRDVAIEFSQEEWECLAPAQRTLYWDVMLENYSNLVSLAEVSLSEMNIISILKKGTEPWTVENKMKIAKNPDVSP

SEQ ID NO: 22391 - protein, 81 aa, Trichechus manatus
IPAFSDKDSFGNEMLAAALLKAKSRELVTFEDVAVYFIRKEWKRLEPAQRDLYRDVMLENYGNVFSLGFPFLNPDMISQLE

SEQ ID NO: 22392 - protein, 81 aa, Zalophus californianus
LQGSVTFPDVAVDFTPEEWQLLDCEQRTLYWDVMLENFRNLISVGGPVTKTKAIFKAEQGQEPWMGEGANPRWCHPEADCL

SEQ ID NO: 22393 - protein, 81 aa, Equus caballus
PHGSMPFGSVTEACTQEGWRHSVPAPQDRFKEGIPEKSRNLVLLGLPVSQAGMNSQLEQREGSWVLEGEGLRSPCPDQKIV

SEQ ID NO: 22394 - protein, 81 aa, Equus caballus
LQGCVISEDVFVYFSWEEWMLLDDAQRLLYWDVMLENFALLASLGIASFRSHLVTQLEQGEEPWMPDQVDVTPASEREAQK

SEQ ID NO: 22395 - protein, 81 aa, Mandrillus leucophaeus
FEELVTFEDVFVDFSPEELSSLSAAQRNLYREVMLENYRNLVSLGYQFSKPDIISRLEAEESRAMEKDSRHTVICQGEAHD

SEQ ID NO: 22396 - protein, 81 aa, Aotus trivirgatus
PQDLMTFDDVAVEFTQWEWGQLNPAQKDLYREVMLENFRNLTLLGLLVSKPYMICQLEEGGEPFMVNTEISVGAHSDWERR

SEQ ID NO: 22397 - protein, 81 aa, Sarcophilus harrisii
PQQSMAFKNVAVAFGQEEWSQLDPTQKDVYRDVILEKYRHLVSMGLPISKPDVISQLERKEDPWMLEREVSRDVYSDWETK

SEQ ID NO: 22398 - protein, 80 aa, Pan paniscus
GPLTFMDVAIEFSLEEWQCLDTAQQNLYRNVMLENYRNLVFLGIAVSNLDLITCLEQGKEPWNMKIHEMVAKPPGWSAVA

SEQ ID NO: 22399 - protein, 81 aa, Lipotes vexillifer
ESVTFKDVAVDFTQEEWALLDTSQRKLFRDVMLENISHLVSVGNQLYKSDVISHLEQGEQLSREGLGFLQGQSPGREDDLR

SEQ ID NO: 22400 - protein, 81 aa, Lipotes vexillifer
RESGKAPVTFDDITVYLLQEEWMLLSQQQKEIYGSDELVAPLGPTIANPELFYKFERGPEQWLANVQGQRSLLSLHRGKNK

SEQ ID NO: 22401 - protein, 81 aa, Pan paniscus
FQEMVTFKDVAVVFTREELGLLDLAQRKLYQDVTLENFRNLLSVGYQPFKLDVILQLGKEDKLLMMETEIQGDGCSGHRNQ

SEQ ID NO: 22402 - protein, 81 aa, Lipotes vexillifer
MAHLMMFRDVAVDFSQEEWECLDLEQRALYRDVMLENYSNMVSLGLCLYQPDVFSLLEKGKEPWMVLKDEIRGPCPDMQSR

SEQ ID NO: 22403 - protein, 81 aa, Pan paniscus
DTVAYEDLSVDYTQKKWKGLTLSQRALQWNMMPENHHSMASLAGENMMKGSELTPKQEIFKGSESSNRTSGGLFGVVPGAA

SEQ ID NO: 22404 - protein, 81 aa, Callorhinus ursinus
VQGSMSFEDVIVKFTQDEWQYMSPAQRTLYRDVMLENYSHLISVGYCTAKPEMIFKLEQGEEPWSLEEEFLNQRYPGYFSV

SEQ ID NO: 22405 - protein, 81 aa, Callorhinus ursinus
DNVTLEDVAVYFSWEEWGLLDEAQRRLYHDVMLENLALITSLDCLCGIEHEEVPSGQNVSLGRMPQIRSSEPNPSTEKVHF

SEQ ID NO: 22406 - protein, 81 aa, Callorhinus ursinus
SQGLVTFEDVAVYFSLEEWERLGADQRDLYKDVMQENYGILVSLGYPIPKPDLIFRLEQGEEPWVPDSPRPDEGDIVTGVY

SEQ ID NO: 22407 - protein, 81 aa, Callorhinus ursinus
STEPVIFRDVAMYFTQKEWQLLEPAQKDLYREVMLENYGNLASLGYRLFKPKLITRLEQGDEPCVKERDVPRDPQQGGAGI

SEQ ID NO: 22408 - protein, 81 aa, Tursiops truncatus
MLENYSNLVSLGLPFSKPEVISLLQQGEDPWKVVKESPGGSSLGRKNSYKTTKSTQTQGSSFQEMIMKRSKRNGPWDFKSE

SEQ ID NO: 22409 - protein, 81 aa, Tursiops truncatus
PQGSTPFNSVAVAFTQKGWRQLAPTPKDRFKKGMPEKSRNLVLLGLPVSQPGMNSQLEQREGSWMLEREGLRSTCSDWKIV

SEQ ID NO: 22410 - protein, 81 aa, Tursiops truncatus
PVRRLAPVTFDDITVYLLQEEWMLLSQQQKEICGSDELAAPLGPTIANPELFYKFERGPEQWLANVQGQRSLLSLHRGKNK

SEQ ID NO: 22411 - protein, 81 aa, Equus caballus
PQDLVTFKDVAIDFSQEEWEWLTPAQRSLYRSMMLENYRSLVSLGLCVSKPYVISLLEQGKEPWEMKNEMTRSPFPDWESM

SEQ ID NO: 22412 - protein, 81 aa, Equus caballus
FQESVKFEDVAVNFSSGEWQCLTHAQRHLYKDVMLENYGNMVSLGFPFPKPPLISHLEREAEPCVQDLQDSEFLSCSYPVS

SEQ ID NO: 22413 - protein, 81 aa, Equus caballus
PMLFEDLAVYFSQEECVSLHPAQRSLSRDATQECFEDMALIGGEGKTDINQQVNVESMGREELALEEYSIAMPLVCYPEES

SEQ ID NO: 22414 - protein, 81 aa, Equus caballus
QISFEDVAVDFTLEEWQLLNPTQKNLYRDVMLENYSNLAFLEVWLDDNLKMWHQDNQDKGMERGHEYDVFGKIFHSSINFV

SEQ ID NO: 22415 - protein, 81 aa, Monodelphis domestica
MLENAWNLLSVGLPAPPEDVISYLEQKVTSWMREQEGLRSCCPEGKIRPEMKVTPPEVSLSVEETEKQKFLSDGPDHLAWR

SEQ ID NO: 22416 - protein, 81 aa, Monodelphis domestica
ARGSVTFRDVAVDFSGDEWGFLSPAQRELYWDVMLENFKNLLFLGLLDPEPNLLSCSEGREDLQIWHLQGGVLGSTCSCKA

SEQ ID NO: 22417 - protein, 81 aa, Papio anubis
FQGSVSFKDVTVGFSQEEWQHLDPSQRALYRDVMLENYSNLVSVGYCVHKPEVISRLEQGEEPWRLVEEFPSQSFSEVWTA

SEQ ID NO: 22418 - protein, 81 aa, Aotus trivirgatus
LQESFSFDDLSVDFTQKEWQLLDPSQKNLYKDVMLENYSSLVSLGYEALKPDVIFKLEQGEEPWIGDEEIPSSYSPEVWKV

SEQ ID NO: 22419 - protein, 81 aa, Aotus trivirgatus
ARGCVVFEDVFVYFSREEWELLDDAQRLLYHDVMLENFALLASLGIAFSTSDAVMKLEQGEKPWVYDQVDMTSATGREAQR

SEQ ID NO: 22420 - protein, 81 aa, Papio anubis
SCEGSVSFRDVAIDFSREEWRHLDPSQRNLYRDVMLETYSHLLSVGYQVPEAEVDMLEQGKEPWALQGERPRQSCPGEKLW

SEQ ID NO: 22421 - protein, 81 aa, Aotus trivirgatus
RSQESLTFQDVAVDFTREEWDQLYPAQKDLYRDVMLENYRNLVALGHQLYKPEVIAQLELEEEWMIERDSLLDTCLDGENR

SEQ ID NO: 22422 - protein, 81 aa, Sarcophilus harrisii
PRAPLVFQDVAVDFTREEWRRLSPAQRDLYREVTLETYENLVFLGFPVSKPEVIWRLERGEAPWPPRRGTSRAACPGSYGQ

SEQ ID NO: 22423 - protein, 81 aa, Tursiops truncatus
APVTFGDLAIYFSQEEWEWLSPIQKDLYEDVMLENYQNLVSLDLGSKCETKKLSPYQCNKSGQSIYQKAVSTPQKVPTGKR

SEQ ID NO: 22424 - protein, 81 aa, Tursiops truncatus
QGSVTFEDVALYFSWEEWALLDEAQRCLYHDVMLENFALTSSLGCWHEVEDKETSPEQSISVEGVSQIRTLKAISSPQKAQ

SEQ ID NO: 22425 - protein, 81 aa, Trichechus manatus
SVAIEDVAVDFTQEEWALLDLSQRKLYRDVMMETFRNLASVVSRNNDGGKLSTENTIVGFMKNDTCFSMVGDICKSHGVED

SEQ ID NO: 22426 - protein, 81 aa, Zalophus californianus
VTESVTFRDVAVFFSQDEWLHLDSAQRTLYREVMLENYGTLVSLGIPFSRPKVICQLQEGEDPCVVDRELPWDACLGLKTR

SEQ ID NO: 22427 - protein, 81 aa, Zalophus californianus
QGSAAYQFLSVDYTERKWKGPALSQRAVYRSIVPENYCSMASLAGETRTRRSELPARQEVSKGPASSDGTSGGLCGVVSGE

SEQ ID NO: 22428 - protein, 81 aa, Pan paniscus
KEAVTFKDVAVVFTEEELGLLDPAQRKLYRDVMLENFRNLLSVGEHGHLLCLNIRPQQWFCTLECSSLSVHWEPKYPVNFA

SEQ ID NO: 22429 - protein, 81 aa, Pan paniscus
FQKSVTFEDVAVYFTQAEWDGLSPAQRTLYRDVMLENYGNVASLGFPLLKPAVISQLEGGGELGGPSPLAAGTGLQGLQTV

SEQ ID NO: 22430 - protein, 81 aa, Lipotes vexillifer
RYLGPVKFEDVVVIFTEAEWKRLSLEQRNLYKEVMLENFRNLVLLADSKPEVHPWPLCPACPLAFDGQQFLSHHELCSHLI

SEQ ID NO: 22431 - protein, 81 aa, Lipotes vexillifer
QAEVTFEDVAVLLSREEWGRLGPVQKGLYRDVMLETYRNLVSLGAGPAGPKPEVITQLERGDEPWVPDVQGREQPTIDGSA

SEQ ID NO: 22432 - protein, 81 aa, Lipotes vexillifer
QAGCPPEMAVSEPGGSAAEWEQLDPAQKSLYKDVMLENYSNLASMGYQALKPDMISKLGKEEPWLGKGKRPRQGDLSEIAR

SEQ ID NO: 22433 - protein, 81 aa, Pan paniscus
SQHLVTFEDVAVDFTQEEWTLLDQAQRDLYRDVMLENYKNLIILAGSELFKRSLMSGLEQMEELRTGVTGVLQDEFIKLDL

SEQ ID NO: 22434 - protein, 81 aa, Pan paniscus
HLTFTDVAIEFSQEEWKSLDPGQRALYRDVMLENYRNLVFLGRSCVLGSNAENKPIKNQLGLTLEPHMSELQLFQAGRKIY

SEQ ID NO: 22435 - protein, 81 aa, Tursiops truncatus
SPLPAPLRPRTAMASAAAALRDPPQDSMTFEDIAVYFSWEEWRLLDEVQRHLYHDVMLENFTSYPHWSTGSGRTGLVTMAH

SEQ ID NO: 22436 - protein, 81 aa, Pteropus vampyrus
EQESVSFKDVTIDFSREEWQQLDFAQKSLYRDVMLENYFNLISVGCQVPKPEVIFNLEQVENSCMLHRKISRQSCLDGDIG

SEQ ID NO: 22437 - protein, 81 aa, Pteropus vampyrus
AQVSLAFRDVAVEFSQEEWACLDPAQRALYRDVMAENYRTLLSLGHSIPKPDVITLLEQEKEPWMFVTEGTRIWHAAEMCL

SEQ ID NO: 22438 - protein, 81 aa, Pteropus vampyrus
MTFTDVAIDFSQDEWEWLNLAQRTLYKKVMLENYRNLVSVGLCISKPDVISLLEQGKEPWVVNRDMTAGSCPNLEYVWIVK

SEQ ID NO: 22439 - protein, 81 aa, Pteropus vampyrus
PQESLTFDDVAVDFTWEEWQLLAPAQKDLYRDVMSENYSNLVSLGCQARKPDTLSRLDQGEPPWTLADRVYSQTRSGIWKV

SEQ ID NO: 22440 - protein, 81 aa, Pteropus vampyrus
KVPVTFVDIAVYFSEDEWKNLDEWQKELYNNLVKENYKTLTSLDAEGTAPKPDAPSQAEPREEPCVWEQREPGDREILMDP

SEQ ID NO: 22441 - protein, 81 aa, Pteropus vampyrus
SQELLTLEDVAVDFTWEEWQLLAPAQKDLYWDVMSENYSNLVSVGYEVSKPDVLSKLERGEEPWTIEHEIHSPVCPEIDKV

SEQ ID NO: 22442 - protein, 81 aa, Trichechus manatus
SVAVEDVAVDFTQEEWALLDLSQRQLYRDVMMEIFRSLASVASRNLTDGDNLSTESIIVRFMKNDTWFLMVGEIRELHGTE

SEQ ID NO: 22443 - protein, 81 aa, Trichechus manatus
MLENYRILVSLGLCFSKPSVILLLEQGKEPWMVKRELTEGLCSGWESMCETEELTPKQAIYEEESSQKLIEEITSCGLEFS

SEQ ID NO: 22444 - protein, 81 aa, Trichechus manatus
SLVIEDVAVDFTQEEWTLLDLPQRKLYRDVMIETLRNLASIVSRDVNDGGKLSNEHITEEIMKKTTWFSMLGEICELHGTE

SEQ ID NO: 22445 - protein, 81 aa, Trichechus manatus
VTFEDVTVVFTEAEWKRLSSEQKHLYKEVMLEIYRNLLSLEPKPELHPCSSCLLAVSCQRFLSQHVLPIFPGFCAEHHFHP

SEQ ID NO: 22446 - protein, 81 aa, Trichechus manatus
SVVIEDVAVVFSQEEWALLDLAQQKLYKDVMIENFRNLASVVSRNLKDGEKLSSDNIMVRYMNSNTWFSMLGEISESHGNK

SEQ ID NO: 22447 - protein, 81 aa, Trichechus manatus
MSFSSMTVAFTQEGCRHPVLAPRDRYKEGIPEKSRNLVLLGLPVSQPGLNSQLEQREEPWMLEGEGLRSTCPDWKTVSKES

SEQ ID NO: 22448 - protein, 81 aa, Trichechus manatus
KGCVIFEDVAVNFSQEEWGLLDEAQRLLYQDVMLENFAIIDSLGCCHETEEEEAFSEQSVSVEGVSQVRTPQAGPCTQKTH

SEQ ID NO: 22449 - protein, 81 aa, Trichechus manatus
TARSQESVTFKDVAMDFTPEEWGKLDPAQRDVMLENYRNLVSLWLPVSKAENYNLENGKEPWMFEGKKTKSSYSDWEARPE

SEQ ID NO: 22450 - protein, 81 aa, Trichechus manatus
FQEAVTFGDVAVHFSREEWQCLDPGQRALYREVMLENHSSVAGLAGVLVFKPELISRLEQGQEPWVLDLQASEGRETSKTS

SEQ ID NO: 22451 - protein, 81 aa, Zalophus californianus
MAVTFEDVTVIFTWEEWKFLDSSQKKLYREVMWENYTNVMSVGNWKESYKPQEEGFRYLEHENLPCWQAWRNASAQTYENR

SEQ ID NO: 22452 - protein, 81 aa, Zalophus californianus
SQEPVTFEDVAVYFTQNQWASLDPMQRALYLEVMLENYANITSLALPFPKPDLILQLEQGGAPWGLDPWTPLEGEALGGVH

SEQ ID NO: 22453 - protein, 81 aa, Equus caballus
TSAPVTFGDLAIYFSQEEWEWLSPVQKALYEDVMLENYQTLASLGLSFRRPNVITLLEKGKAPWMVEPVRRRRGLDSGSKC

SEQ ID NO: 22454 - protein, 81 aa, Equus caballus
RQEPVTFEDVAVYFTQNEWVILDPAQRALYREVMLENYANVASLAFSFTRPVLVSQLERGELPPGLDPWERASPEALRGIC

SEQ ID NO: 22455 - protein, 81 aa, Equus caballus
PKVPVTFDDVAVYFSESEWGRLDKWQKELYKHVMRGNYEMLVSLDYAISKPDILTRMERGEEPCPDGPWGPEEGKEREAAR

SEQ ID NO: 22456 - protein, 81 aa, Loxodonta africana
RQAEVTFEDVAVLLSQEEWDHLGPAQRGLYRNVMMETYGNVVSLGLPGSKPDVISQLERGEEPWVLGGHEAEGREHLKNGH

SEQ ID NO: 22457 - protein, 81 aa, Loxodonta africana
SSNHFCYLGTSLNASPWKNKWLSPMVESQYKGIAVKLFSNIKWLGLCISKPDIISLLEQGKEPWIMKRKMTQGQGPDLKPL

SEQ ID NO: 22458 - protein, 81 aa, Lipotes vexillifer
MAFEDVAVYFSREEWGLLDAAQRALYRRVMLENFTLLASLGLSVSRPHVVIQLECGEEPWVLNGTDVTLARNAAAAASPGE

SEQ ID NO: 22459 - protein, 81 aa, Pan paniscus
IGGDVTFNDVAIDFSHEEWGWLSSAQRDLYKDVMVQNYENLVSVAGLSITKPYVITLLEDGKEPWMMEKKLSKGMIPHWES

SEQ ID NO: 22460 - protein, 81 aa, Tursiops truncatus
MLENYSHLVSVGYPVSKPGVISKLEQGEEPWIMKRDISNWIYPDRETRLDTHQLDTLGDVYFHKDILESVTRDHSLYSILK

SEQ ID NO: 22461 - protein, 81 aa, Tursiops truncatus
MAEDLKFKDVAIYFTQKEWECLHSAQKDLYRDVMLENYNILISLGFSDSKPDVISLLEQGKEPWMVNSKETKEWCPDWESR

SEQ ID NO: 22462 - protein, 81 aa, Tursiops truncatus
EQLTFKDIDIEFSQEEWECLEPAQQALYRDVMLETYRNLLSLDISPMHVIKKLQLKVNTGRGEVLQKVMLGRHERNKVKRF

SEQ ID NO: 22463 - protein, 81 aa, Pteropus vampyrus
SWGPVTFKDVAVNFSRGEWKKLEPFQKQLYKEVLLENFRNLEFLGFPVSKLDLISQLKWVELPWLLEKEVSKGSKPECNSR

SEQ ID NO: 22464 - protein, 81 aa, Pteropus vampyrus
MRDELPQEEWECLDPGQMNLYKEVMLENFSNLVSVGLSSAKPVVISLLEEGKEPWMVEREVKRGLCSDLESMCETKILSLK

SEQ ID NO: 22465 - protein, 81 aa, Pteropus vampyrus
TIKEEVTFKDVAVIFTEEELGLLDSAQRQLYRDVMLENFKNLVSVGYQPFKQGVIHLVRGEKYWMMKMATQRKGNSGGKIQ

SEQ ID NO: 22466 - protein, 81 aa, Pteropus vampyrus
MREEWALLDHSQRRLYRDVMLETCQNLAFVVHVRTHSGEKFSKCLQCGRTISQQQYLQIQSTRHSWDKPWECKQPRNAFSD

SEQ ID NO: 22467 - protein, 81 aa, Trichechus manatus
AHVSLAFRDVTIDFSQEEWECLDPAQRSLYRDVTLENYSNLVSLGCSFPKPDVITLLEQEKEPWMVVKEGTRSWYTDLESK

SEQ ID NO: 22468 - protein, 81 aa, Trichechus manatus
SLVIEDVAVDFTQEEWTLLDLPQRKLYRDVMMETLRNLASVVSQDLSSGEKLSSEHITEKIMKRNTWLSVLGEIGKLHGIE

SEQ ID NO: 22469 - protein, 81 aa, Trichechus manatus
RTGVISFAGVAVYFSPEEWACLRPTQRALYPDMMRKPYDHLGALGFSGPKPAFNFWVEGEVEAWSPEAQEEDENPGVVSRG

SEQ ID NO: 22470 - protein, 81 aa, Trichechus manatus
REAFVAFGDLAVDFTQEEWWLLSPAQRTLYREVMLETCNHLVSLAGIPFSKPKLITQLEHREEPRRGERKHLLDPCLGGSK

SEQ ID NO: 22471 - protein, 81 aa, Trichechus manatus
AHGSVTFRDVAVDFSQEEWECLDPAQRDLYRDVMWETYSNFISLAGPSISKPDGITLLEEGKEPWMAVREGAGKHGRDLES

SEQ ID NO: 22472 - protein, 81 aa, Trichechus manatus
GVTFEDVAIDFSQEEWGLLDETQRILYRDVMLENFAIIASLGCWHGTEEEVASSEQSVSVGVSQVRAPQEGPFTQKTHPCE

SEQ ID NO: 22473 - protein, 81 aa, Trichechus manatus
WLQKPVTFKDVAVEFTQEEWVMLDPAQRNLYRDVMLENYRNLTSVEYQLCRPTVISQLDQEERRTVERRISQGTYPDRENL

SEQ ID NO: 22474 - protein, 81 aa, Trichechus manatus
SQGLLSFNDVAVDFSWEEWQLLDPVQKNLYWDVMLENYSNLMSLGYQATKPEAIVQLEKGDEQGIVEKEFPSQCSPEVIWQ

SEQ ID NO: 22475 - protein, 81 aa, Trichechus manatus
AVTFKDVAVAFTEEELELLDPAQRKLYQDVMVENFRNLVSVGEKNQRALGTVEDEGSREELSRWQIWQQIANDLARCQDSI

SEQ ID NO: 22476 - protein, 81 aa, Trichechus manatus
MTKPDMILKLEQGEELWTTGRVYPSHTYLEEDGKAGDVLVKFREYQDKHSRSGVFINHRKLIKERSNVYGKTFTLGKNRIT

SEQ ID NO: 22477 - protein, 81 aa, Trichechus manatus
SVAVEDVAVDFTQEEWALLDLSQRQLYRDVMMETFRNLASVVSRNLSDGGKLSSENIIVRFTKNDTWFSMVGEICELHGSE

SEQ ID NO: 22478 - protein, 81 aa, Trichechus manatus
SVVIEDVAVVFTQEEWALLDLTQRKLYRDVMMETFKNLVSVVSRNINEGEESSSEHIMMQFVKTNTWSSMLGEISESCGSK

SEQ ID NO: 22479 - protein, 81 aa, Trichechus manatus
SRMLVTFKDVLVDFTKEEWKLLNASQQIMYKHVMLENYKNLVSLGHQFPKPDVILQLEKGEDPWLMEIHQETFPDSETAVE

SEQ ID NO: 22480 - protein, 81 aa, Trichechus manatus
SMLFEDLAVYFSQEECVSLHPAQRSLSKGITQECFGDVAWLGEEDKTEINQQLSLESIELEELALEKYSTAVPLIYYSEES

SEQ ID NO: 22481 - protein, 81 aa, Zalophus californianus
DPVTFEDVAVEFTQEEWILLDQTQRRLCRDVMLENYKSLAAVDWEICLNTKWSAPQQNILQGKTPNVVEMVRFSVCNSLSS

SEQ ID NO: 22482 - protein, 81 aa, Zalophus californianus
MPQEEWQQLDPGQKALYRDVTLENYCHLISVGFHMTKPDMIRKLEQGEELWTTEKIFPSQSYLGEDGKTEDVLVKFKEYQD

SEQ ID NO: 22483 - protein, 81 aa, Zalophus californianus
PQRFPALVPGQSGRSFEEWHRLDPAQRTMHKDVMLENYSNLASVGLCVAKPEMIFKLERGEELWILEEESSGHGYPGSLSM

SEQ ID NO: 22484 - protein, 81 aa, Equus caballus
SQALVSFKDVTVEFNQEEWRHLGPAQRALYRDVMLENYSHLVSVGYCFIKPEVIFKLEQGEDPWLLEDEFPNRSYQEDRRL

SEQ ID NO: 22485 - protein, 81 aa, Equus caballus
AQELVTLEDVAVKFSWEEWQLLDPAQKDLYRDVMLENYHNLVSLGYQATKPDVLFKLEHRDELWRIEEEIQTKTCPGIGKV

SEQ ID NO: 22486 - protein, 81 aa, Equus caballus
SQGSVTFGDVAIDFSREEWEWLQPAQRDLYRIVMLENYGHLVSLGLNVSKPDVVSLLEQGKEPWLGNGDVRRDLFSVSESN

SEQ ID NO: 22487 - protein, 81 aa, Equus caballus
FTEPVTFKDVAVTFSEEELGLLDHAQRQLYRDVMLENFQNLLSVGHLPFKPGLLSQLEAEENLCMVERETWRNGCSSEKHV

SEQ ID NO: 22488 - protein, 81 aa, Equus caballus
AQESLTFDDVAVEFTWEEWQLLAPAQKDLYRDVMLENYSNLVSVGYQASKPDALSKLVQGEPPWTMEDEIHCRTHSEIWEV

SEQ ID NO: 22489 - protein, 81 aa, Equus caballus
CEVSVSFEDVTVDFSREEWQQLDSTQRRLYQDVMLENYSHLLSVGYEVPKPEVIFKLEQGEEPWILEGETPHQSCSAQKKM

SEQ ID NO: 22490 - protein, 81 aa, Physeter macrocephalus
QPQEAVTFKDVEVTFSQDEWGWLDASQRNLYRDVMLENYGNVASLVGPFTKPALISWLEAREPWGLNVQGAHPKGSPSAAP

SEQ ID NO: 22491 - protein, 81 aa, Physeter macrocephalus
ARLTFKDVVIEFSPEEWECLDPAQRVLYRDVMLETYRNLISVDLSHIHMIKKLQLKSNTDTGEIFQTVMLGSHGSCEIKHF

SEQ ID NO: 22492 - protein, 81 aa, Physeter macrocephalus
MKPGVILKLEHGEEPWTGDGEIPGSDSPEQVLQVNGHITWHKDNQEKLKNMKQDQECDALGKNFNLSMNFVPLRKSNSEGN

SEQ ID NO: 22493 - protein, 81 aa, Physeter macrocephalus
VTFEDIALYFSWEEWKLLDEAQRRLYHDVMLENFALISSLGCCCGAEDAEAPFQRSISISMSQARTPRASSFSQKSHPCKK

SEQ ID NO: 22494 - protein, 81 aa, Monodelphis domestica
PEAPRSLESVTFPDVPLINAQKSLYREVMLENYENFVSVAGFPSFKPELISQLECGKGPWMLVEEEMIQRFSERPRRLSLF

SEQ ID NO: 22495 - protein, 81 aa, Monodelphis domestica
IQGSLTFKDVAVDFTQEEWCLLDHSQKELYLEVMLENVQNLLSVGLPVPREYCASYFQQGKAPWLLELKGPRSSFPEAETN

SEQ ID NO: 22496 - protein, 81 aa, Monodelphis domestica
RQGTLTFQDVAVIFSPGEWRLLGRAQRELYREVMLENYWTLAWLAGFVGAQPEVISHLEQADMPWVPEDSFPSSNHTDLDT

SEQ ID NO: 22497 - protein, 81 aa, Aotus trivirgatus
MELLTFRDVAIEFSPEEWKCLDPGQQNLYRDVTLENYRNLVSLDLVTCLEQRKELYNVKIHETVARPPMIYLQGYSESQYP

SEQ ID NO: 22498 - protein, 81 aa, Aotus trivirgatus
KKKPVTFEDVAVNFTQEEWDCLDASQRVLYQDVMLETFKNLASVARMFVHKPELITKLEQQEKQWRVFLHLPNTEGLSEGM

SEQ ID NO: 22499 - protein, 81 aa, Aotus trivirgatus
DPEQVTFEDVVVDFTQEEWGQLELAERTLYCDVMLDTFRLLVAVGHWLPKPNIISLLEQEAKLWAVDPGVPRGVYQEIKGH

SEQ ID NO: 22500 - protein, 81 aa, Pan paniscus
MWLSWNTAQKDLYQDVMVENSNHLVSLGYQTSKPDALSKLAHGWEPLKTDAKVQNKNCPGIRKVDSHLQEHSPNHMQQCSG

SEQ ID NO: 22501 - protein, 81 aa, Pan paniscus
PQGLLTFRDVAIEFSQEEWKCLDPAQRTLYRDVMLENYRNLVSLDISSKCMMKEFSSIGKGNTEVIHTGTLQRLARHHIGE

SEQ ID NO: 22502 - protein, 81 aa, Tursiops truncatus
LSFEDVALYFTREEWDTLDWAQKDLYRDVMLDNYRNVLSLGPEARFKMKELTPKQNISEDLESCKMSLVKQKMARKPLEKL

SEQ ID NO: 22503 - protein, 81 aa, Pteropus vampyrus
MRDELPQVMSKEEWECLDPGQMNLYKEVMLENFSNLVSVGLSSAKPVVISLLEEGKEPWMVEREVKRGLCSDLESMCETKI

SEQ ID NO: 22504 - protein, 81 aa, Pteropus vampyrus
RKARLRVTFEDVTVYFSSEEWDLLDEAQRRLYQDVMLENLALITSLAPTPAVMKICRERIRVWSLPVNLKDTTLLAFSLTR

SEQ ID NO: 22505 - protein, 81 aa, Pteropus vampyrus
LEEQVTFEDVVVYFSQEEWGLLDDTQRLLYRDVMLETFALTASLGYASSMSHGIACLELDGKAQVSHWTDMTPAMTREARD

SEQ ID NO: 22506 - protein, 81 aa, Pteropus vampyrus
TQESVTFEDVAVDFTQEEWRQLDPAQKTLHRDVMLEIYSHLVSVGCSSIKPGIIFKLEHETDLWIIDSELSRWIYSDREKS

SEQ ID NO: 22507 - protein, 81 aa, Pteropus vampyrus
SQGALTLSDVFIEFSQEEWECLTPAQRALYREVTLESYRKLRFLGISVSDLYIVSILEQGKAPWILESELKIAQKPNRQKC

SEQ ID NO: 22508 - protein, 81 aa, Trichechus manatus
SLIIEDVAVVFSQEEWALLDLAQRKLYREVMMETFRNLALVVSQNLNNGEKLSTEHIIVRFMKNDSWSSMLGEISESHGSK

SEQ ID NO: 22509 - protein, 81 aa, Trichechus manatus
SGEPVTFEDVTLGFTPEEWELLDPMQKTLYREVMLENYRNLVSVEHQLSKPDVVSQLEEAEELWLKEREIPQDTFPECPVA

SEQ ID NO: 22510 - protein, 81 aa, Trichechus manatus
LSFKDVAVGFTWEEWQLLDPSQKDLYKEVMLENYNNLVSVEEIWATDQMQWQPENQNELKSLERCQQNYAFGNNLDLSKNL

SEQ ID NO: 22511 - protein, 81 aa, Trichechus manatus
AKMSVTFEDVSVTFTQKEWGQLGPAQRTLYREVMLETWGLLTSLGKPLPKPELIYGLEHGQELWTTEGGLAQSTCAGNKTQ

SEQ ID NO: 22512 - protein, 81 aa, Trichechus manatus
RHQEPVTFEDVAVIFTEEEWRHLVPIQRDLYKEVMLENYRSIVSLDGETKPEIQDTSEEEISKGTLRERLGSKGPLCPKFE

SEQ ID NO: 22513 - protein, 81 aa, Trichechus manatus
KNELLSFEDVAMFFTREEWENLDSAQKYLYRDVMLENYRNLIFLGSATQGALPGWICRSFLWKGNFQAHPQVKCKEEGMNI

SEQ ID NO: 22514 - protein, 81 aa, Trichechus manatus
TQDSVVFEDVAVDFTQEEWALLDLAQRNLYRDVMLENFQNLASLAGYPLHIPHLISQWEQEDLKIVKRGLIQDTCTGEHQE

SEQ ID NO: 22515 - protein, 81 aa, Trichechus manatus
SVVIEDVAVVFSQEEWALLGLAQRKLYRDVMMETFRNLASIVSQNLNDGEKLLSSEHIMMQFVKNDMWSSMLGEISKSHGN

SEQ ID NO: 22516 - protein, 81 aa, Trichechus manatus
MEDSVVFEDVAVEFTQEEWALLDFSQKKCYRDVMMETFRNLDSVFKQDNNGQMTVKNDSWFSMLGAIFEFHGIECQHNNQG

SEQ ID NO: 22517 - protein, 81 aa, Trichechus manatus
SVAVEDVAVDFTQEEWALLDHSQRQLYRDVMMEIFRSLASVASQNLIDGDKLSTENIMVRFMKNDTWSSMVGEICELPVTE

SEQ ID NO: 22518 - protein, 81 aa, Neovison vison
ALALVSFQDVAVTFTGEEWRHLDLAQRTLYREVMLETCGLLVSLGRPVPKAELISLVEQGQELWTVMRGLSKSMYTGEKAK

SEQ ID NO: 22519 - protein, 81 aa, Lipotes vexillifer
PKESLSFEDVTLDFTQEEWQHLDTAQRTLYRDVMLENYSHLVSVGYCIPKPELIFRLEQGEQPWVLEEESPGQSYPEVCKV

SEQ ID NO: 22520 - protein, 81 aa, Lipotes vexillifer
ELQETVTFKDVAIDFTEEEWQQLDPAQRNLYWNVMLENYNNLITVGCPFTKPDVIFKLEQEEPWVVAEEVSKRHCPGEIWG

SEQ ID NO: 22521 - protein, 81 aa, Callorhinus ursinus
QGHVTFEDVAVYFSQEEWALLDEAQRHLYHTVMLENLALIASLGCWHGVKAEEAFSEQCVFMERVAQARTPDPGLSIPKAH

SEQ ID NO: 22522 - protein, 81 aa, Callorhinus ursinus
PWEPVTFADVAVLFTPEEWMFLDSAQRSLYRDVMLENYRNLASVGDQLGKPSTFSHLEPGEELWPPERRSFPGTHPEPQHQ

SEQ ID NO: 22523 - protein, 81 aa, Tursiops truncatus
VTFRDVAVDFSQEEWDCLNSSQRHLYSNVMLENYRILVSLDWESVCETEELTPKQDIYQVRSSQKVIETLTSCGLEYSRLK

SEQ ID NO: 22524 - protein, 81 aa, Tursiops truncatus
EGSVTFEDVAVNFSLEEWGLLDEAQRCLYHDVMLENLALTTSPGCWHGEEDEEALSEQSISDQGSSQIRIVKAGLSPQKAN

SEQ ID NO: 22525 - protein, 81 aa, Tursiops truncatus
KSQGFVSFKDVTVDFTQEEWQQLDSAQRNLYKDVMLENYSNLVSVGYQSLNSDVIFLFKQGEPWMEEGEMSNWAYSETVYQ

SEQ ID NO: 22526 - protein, 81 aa, Trichechus manatus
IQDLVTFGDVAVDFSQEEWEWLNPAQKTLYRKVMLENYRSLVSLAGASLSKPDVISLLEQGKEPWTVKKQGTRGICPDWEY

SEQ ID NO: 22527 - protein, 81 aa, Trichechus manatus
MTEEFVTLKDVAMDFTLEDWEQLGLDQGDLFWDTALDNYQNLFLLNPLRPNLISHPGDGEELEALGRESSKAADPDTAEPK

SEQ ID NO: 22528 - protein, 81 aa, Trichechus manatus
AEGHVTFEDVAVYFSQEEWGLLDVAQRLLYHDVMLETFALMASLGLVSSRTHEITQLEWWREPWMPDREAMAPDMTRGCWH

SEQ ID NO: 22529 - protein, 81 aa, Zalophus californianus
PCRLVLFKDVAVDFSQEEWECLDLEQKDLYRDVMLENYSNLVSLAGFSISRADVLSLLKQGKEPWKVVQDVTRSQSSDWES

SEQ ID NO: 22530 - protein, 81 aa, Zalophus californianus
GQGSLSFEDVAVDFTREEWQLLDSAQKTLYRNVTLENLSSLVSLGFQLIRPDVIFRLEQEKPRVISEDIPSQSFSEYWKVD

SEQ ID NO: 22531 - protein, 81 aa, Zalophus californianus
WEAWLEKPVTFDDVAVNFTQEEWVCLDASQRVLYQNVMSETFRNLMSVDLIIELEQEEKQWRAELQLHPPNGEGLPSGGRT

SEQ ID NO: 22532 - protein, 81 aa, Zalophus californianus
KFQAVTFKDVVVVFTREELGLLDSTQRKLYRDVMLENFRNLLSVGYEPFRLDTTLLLGREEKLWMMETQTPGDGRSGLRNQ

SEQ ID NO: 22533 - protein, 81 aa, Equus caballus
FQESVTFKDVIVDFTQEEWKQLDPVQRDLFRDVTLENYTHLVSIGLQVSKPDVISQLEQGTEPWIMEHFIFLSDWETRPEN

SEQ ID NO: 22534 - protein, 81 aa, Equus caballus
KPRAVKFADVAVYFSPEEWECLRPAQRALYRDVMRETYGHLGALGCAGPKPVLISWLERNTDVWEPAALDPQEYPRGVTGQ

SEQ ID NO: 22535 - protein, 81 aa, Equus caballus
FLSVNLSLDVAIAFSQQEWEGLNPVQKTLYQDVMMENYRNLLSLGHAISKPGVITLLEQGKEPWMVVREETRRWCLKHIEN

SEQ ID NO: 22536 - protein, 81 aa, Sarcophilus harrisii
MSFSQEEWRCLNSAQRVLYRGIMQENCRNVDSLGLSKPLLISEVEHGKDICLPDLQSSKETEILNTSHTNEDRIQTEKRAK

SEQ ID NO: 22537 - protein, 81 aa, Lipotes vexillifer
LQGSVSFKDVTVDFTQEEWQQLVPAQKALYRDVMLENYCHLISVGFHMTKPDMIHKLEQGKELWTTEQTFPSQSYLEEDWK

SEQ ID NO: 22538 - protein, 81 aa, Tursiops truncatus
MLETCGLLVSLGHPVPKPELIHLLEHGQELRTVKRGLSRSTCTGEKAKPEITELTASHLVLTEGAPFEERVTHGASRHSRL

SEQ ID NO: 22539 - protein, 81 aa, Tursiops truncatus
MDVFVDFTWEEWQLLDPAQKHLYRSVMLENYSNLVSLGYQHTKPNIIFQLEQEELWMMQIPSEGHMDEVWEIDGHMEWHKE

SEQ ID NO: 22540 - protein, 81 aa, Pteropus vampyrus
EMDSVTFEDVAVNFTSEEWALLDPSQKKLYRAVMRETFRNLASIGLNLGKKWEDHNIEDRYKTHGKKLRSHMVEKLHESKE

SEQ ID NO: 22541 - protein, 81 aa, Pteropus vampyrus
FKESVSFEDVAVDFTRQEWYRLDSAQRTMHKDVMLENYSNLASVGLCVAKPEMIFKLERGEELWVLEEESSGHGYPGSLSL

SEQ ID NO: 22542 - protein, 81 aa, Trichechus manatus
MAAPSPPPEPKEWDYLDPAQRSLYKDVMMENYGNLVSLDVLNKDKDEEPTVKQEIEEIEEEVEPQSVIVTRIKSEIDQDPM

SEQ ID NO: 22543 - protein, 81 aa, Trichechus manatus
SLVIEDVVVVFTQEEWALLDLAQRKLYRDVMMETFRNLASVVSRNLNDENKLSSEHIIVRLMNNYTWSSMLEEISESHGSK

SEQ ID NO: 22544 - protein, 81 aa, Trichechus manatus
SVAFEDVAVDFTQEEWSLLDLSQRQLYRDVMMEIFRSLASVASQNLIDGDKLSTENIIVQFVKNDTWSSMVGDVRELHGTE

SEQ ID NO: 22545 - protein, 81 aa, Trichechus manatus
MKPAQRNLYRDVMLENYSNLVTVGCQVTKPDVIFKLEQEEEPWVGEEETLGRHCPEIWEVDEQIEKQQETLVRKVTSISKE

SEQ ID NO: 22546 - protein, 81 aa, Trichechus manatus
PVTFEDMAMYLTREEWRPLDPTQRDLYRDVMQENYGNVVSLDFEIRNENEVNPKQEISEDVEFGTTSKRPVGNAEENPESE

SEQ ID NO: 22547 - protein, 81 aa, Trichechus manatus
CGESVTFKDVAVDFTQEEWGQLDSPQRALYRDVMLENYRNLLALGPPVCKPDVISHLERGEAPWCSQRGGHAAACPEWEPP

SEQ ID NO: 22548 - protein, 81 aa, Trichechus manatus
SVVIEDVAVVFSQEEWALLDLAQRKLYRDVMMETFRNLASVVSQNLNDGEMLFNEHVMVRFMKNTWSSILEENSESCGNQD

SEQ ID NO: 22549 - protein, 81 aa, Trichechus manatus
SKEPVTFADVAVDFTQEEWQQLDPAQKTLHRDVILETSSHLVSTGRSGMKPYVIFKLEHGANPWIIERQLSMWLYPDREKS

SEQ ID NO: 22550 - protein, 81 aa, Trichechus manatus
SVAVEDVAVDFTQEEWALLDLSQRKLYRDVMMETFRNLASVVSRNLNDGEKLSSENIIVQFMRNDTWSSMVGEIHEFHSTE

SEQ ID NO: 22551 - protein, 81 aa, Trichechus manatus
SVIIEDVAVLFSQEEWALLDIAQRKLYRDVMMETFRNLASVVSQNFIDGEKLSSEHIMMRLTKDNTWSSVLGNIFKSHGSK

SEQ ID NO: 22552 - protein, 81 aa, Zalophus californianus
QESVTFEDVAIDFTEEEWALLDISQRKLFRDVMLENISRLVFLVILGMESPRKNQEIKLTYQQEGYSPDYANDLSNSFSLR

SEQ ID NO: 22553 - protein, 81 aa, Zalophus californianus
SQGLLTFRDVAIEFSQEEWGCLNHTQRELYRDVMLENYGHLLFLGLIVWKPDLVLFLEQEKQLWDVKRKETVAFHPAVISL

SEQ ID NO: 22554 - protein, 81 aa, Zalophus californianus
MLENYSHLVSVGCQVTKPAVISRLEQGQEPWMEEEEILRWSFPEEILQVGRPVGRQQEHQDKLLRHVTFLDKQEPTKKGHR

SEQ ID NO: 22555 - protein, 81 aa, Equus caballus
MNFEDVAISFSQEEWRLLDEAQRLLYCDVMLETFALVASLGCWHGAEDEDAPSEQNVSAEGDLQVRASTTGPSTQNTHSCE

SEQ ID NO: 22556 - protein, 81 aa, Equus caballus
LQGALSFEDVAVGFTWEEWQLLDPSQKDLYRDVMLENYNNLLSVGYQAMKPDSLFRLEQGEPPWIAEGAAHSQTCPEIWEI

SEQ ID NO: 22557 - protein, 81 aa, Equus caballus
HQEVMTFEDLAVYFTRAEWAGLSPAQRALCRSVMLENYGNLTSLGYPVPTPALISLLDGGDLSWGLEAQDDPPAERTTDIC

SEQ ID NO: 22558 - protein, 81 aa, Equus caballus
SKDLVTFGDVAVDFSQEEWQWLNPAQRNLYRKVMLENYRSLVSLGVSVSKPDVISLLEQGKEPWMVKKEGTRGTCPDWEYA

SEQ ID NO: 22559 - protein, 81 aa, Equus caballus
FTPEEWGLLDLEKKSLYRQVMLENYRNLVSVEHQLSKPDVVSQLEEEEELWSVERGIPQDTFSECPEAQLDPQLDPLPAGN

SEQ ID NO: 22560 - protein, 81 aa, Equus caballus
AAGSVTFKDVTMAFTQKEWEQLDPAQRNLYKDVMLENYSSLASMGYQAAKPDMISKLEKGEEPWLGKGKRPSQGGPSEIAR

SEQ ID NO: 22561 - protein, 81 aa, Equus caballus
FQGSVTFQDVAVDFTPEEWQLLDCDQRTLYWDVMLENFRNLVSVGDPVTKTKVIFKVEQGQEAQMGEGESPRWSCPEADYP

SEQ ID NO: 22562 - protein, 81 aa, Neovison vison
YQELVTFRDVAVDFSQEEWDCLNSSQRHLYSNVMLENYRILVSLGLCFSKPNVILLLEQGKEPWMVKRELAKGLCSGWDSM

SEQ ID NO: 22563 - protein, 81 aa, Neovison vison
EWGQLDPAQRTLYQEVMLENCGLLVSLGCPVPRPELIYQLEQGQELWMLKGHLSQSAYADVKGKLTTTELSSCAPALSGEA

SEQ ID NO: 22564 - protein, 81 aa, Aotus trivirgatus
AQDRVVFEDVAIYFSQEEWGHLDEAQRLLYRDVMLENLALLSSLGCWHGAEDEVAPSQQDFSAGVSEVTTSKSCMFTQKVH

SEQ ID NO: 22565 - protein, 81 aa, Aotus trivirgatus
LTGSTSFSSVTVAFAQEEWRCLVSTPRDRFKEGLPEKSRNLVLLGLPVSQPGMNSQLELREGAWMLEGEDLRNPSPNWKIV

SEQ ID NO: 22566 - protein, 81 aa, Papio anubis
RGHVTFEDIAVYFSQEEWGLLDEAQRCLYHDVMLENFSLMASVAGLSQSNHKDSCSQQKVTVSLNSCVAQCSPDDGHYTPK

SEQ ID NO: 22567 - protein, 81 aa, Papio anubis
MLENYKNLATVGYQLFKPSLISWLEQEEQRGDFPQVSEWKVQLKIKESALQQDFLGEPNSSGIQMIGSHTIFLRANVSARE

SEQ ID NO: 22568 - protein, 81 aa, Aotus trivirgatus
QGRLTFRDVVIEFSLAEWKCLTRAQRVLYREVMLENYRNLESVDISSKCIMKKFSSTGQGNTEVFHTGTLERDESHHIGEF

SEQ ID NO: 22569 - protein, 81 aa, Aotus trivirgatus
TLVTFKDIFVDFTREEWKLLDTAQQIVYRNVMLENYKNLVSLDSETAFEIKSSVCSRSIFKDKQSCDSKMQGMARNDLWYL

SEQ ID NO: 22570 - protein, 81 aa, Aotus trivirgatus
LQEPVTFRDVAVDFTQEEWGQLDPTQRILYRDVMLETFGHLLSIGSELPKPEVISHLEQGTEPWVTERGTTQGCSPGWEPQ

SEQ ID NO: 22571 - protein, 81 aa, Aotus trivirgatus
GEGLLSFEDVAVDFTQEEWQFLDPSQKVLYKEVMSENYRNLVSVGYQGTKPDVLFKLERGESPWIVEGAAYSQTCPGFVIQ

SEQ ID NO: 22572 - protein, 81 aa, Lipotes vexillifer
SQGTLTFRDVFVDFNLEEWQQLDATQKNLCRDVMLENYSHLVSVGFLVAQPGRIFRLGQGEEEARMAAGESPTRRCPEFWQ

SEQ ID NO: 22573 - protein, 81 aa, Pan paniscus
SQGLLIFRDVAIEFSPEEWSYLDPAQQNLYRDVMLENYRNLVSLGIAVSKPDLITCLEQRNEPWNVKKHETVAIHPAVSSH

SEQ ID NO: 22574 - protein, 81 aa, Lipotes vexillifer
LQNSITFEDVAMDFTQEEWALLNSSQRKLYRDVMLENYRNLASLGHQLSKPPLITQMEQEDEMEIVERRTHQDTRSDELIL

SEQ ID NO: 22575 - protein, 81 aa, Tursiops truncatus
AQLTFKDVAIEFSQEEWECLDPAQRALYRDVMLETYRNLVSLDISHVHVIKKLQLNANTDRAEVFQTLILGRHEKIKPFYL

SEQ ID NO: 22576 - protein, 81 aa, Pteropus vampyrus
SEDLVTFGDVAVDFSQEEWARLNPAQRDLYRHVMLENYRNLVSLGVSVSKPDVISLLEQGKEPWMVKKEGSRGKCYDWEYA

SEQ ID NO: 22577 - protein, 81 aa, Pteropus vampyrus
PDSVVFEDVAVDFTQEELALLNPAQRKLYRDVMLETFRNLVSVADEIQLKTNGSTSQKDIFGEKLSNEQKIARFTKNDSWT

SEQ ID NO: 22578 - protein, 81 aa, Pteropus vampyrus
SVAFEDVAVNFTPEEWALLDPSQKKLYRDVMRETFENLASVGKGMEDYDIEDQYKNQGRKLRSHIEERIYESEASGQCEEN

SEQ ID NO: 22579 - protein, 81 aa, Pteropus vampyrus
TQDSVLFEDVAVDFSQEEWALLDLTQKSLYRDVMLENFQNLASLGYPLHTPCLILQWKQEEELEIAKRGPIEQEHQEGFET

SEQ ID NO: 22580 - protein, 81 aa, Pteropus vampyrus
KPRAVKFADVAVYFSPEEWGCLRPAQRALYRDVMRETYGHLGALGCVGPKPALISWLERNTDDWELAALDPQECPKRVTVQ

SEQ ID NO: 22581 - protein, 81 aa, Trichechus manatus
GWVPALFDEVAIYFSDEEWEVLTEQQKALYREVMRMNYETVLSLEFPFPKPDMITRLEGEEESQKSKEWQLQGGTFTENED

SEQ ID NO: 22582 - protein, 81 aa, Pteropus vampyrus
AEVLVTFKDVAVTFTQEEWGQLDLDQRTLYWEVMLETCRFLVSLGHPVPRPELIHPLEHRQELWMAKRGFSHSTCPGDGAK

SEQ ID NO: 22583 - protein, 81 aa, Trichechus manatus
VAVEDVAVDFTQEEWALLDVSQRQLYRDVMMEIFRSLASVASRNPVDEEKLSTENKTVRFMKNDTCSSMVGEMRELHGTED

SEQ ID NO: 22584 - protein, 81 aa, Trichechus manatus
LLTFRDVAIEFSQEEWDCLDPAQRALYREVMLENYRNLVSVDIFARKVINKLLPKQDNNKGELHHPVILERHESHGIEDFD

SEQ ID NO: 22585 - protein, 81 aa, Trichechus manatus
KSQGPVSFEDVAVNFTQEEWQQPAQRTLYRDVMLENYSHLVSMGYPVPKPDVIAKWEHGEEPRIVKRDIVHWIYPGEILAD

SEQ ID NO: 22586 - protein, 81 aa, Trichechus manatus
AHDLVMFTDVAVDFSQEEWECLDSYQKNLYRDVILENYNNLVSLGCSISKPDVVTLLEQGKEPWLIGRDKKIRWSPDLESK

SEQ ID NO: 22587 - protein, 81 aa, Trichechus manatus
KAQESLIFSDVVVKFTWEEWQILDPAQKDLFWNVMLENYSNLVSIGCRGSKPDAHPRLEREQPWTLLNRSHSEIFSEIQNV

SEQ ID NO: 22588 - protein, 81 aa, Trichechus manatus
ARAPVSFEDMAVTFSWEEWGCLEPAQTALYRDVMLDTCGHLVFLGLLLSKTDVISRLEQEDPWWVEQGRPRDWKTTLGKKQ

SEQ ID NO: 22589 - protein, 81 aa, Zalophus californianus
PQGLVTFGDVVVDFTPEEWQYLNPPQKTLYREVMLETYSNLVSVGPQVTKPDLILKLEVEEPCPAETKISFWSFPAACQID

SEQ ID NO: 22590 - protein, 81 aa, Zalophus californianus
PQDLMTFEDVAVEFTQWEWGKLDPAQKDLYRAVMLENFKNLASLGLPVSKPYVISQLEEGKEPYVLEGEISTDFILERNPT

SEQ ID NO: 22591 - protein, 81 aa, Zalophus californianus
VLQGLSFKDVAVNFTEEEWKELDPAQRDLYKDVMLENYRNLVSLGFPFSKPDIISQLEQAGNPWMQEREVLRRSCTYLETR

SEQ ID NO: 22592 - protein, 81 aa, Equus caballus
PVTFEDVAVAFTEEELGLLDAAQRQLYRDVMLENFWNLLSVGDRNAKDLENIQEKELTSLPYRELLCWKIWEQAADELTGS

SEQ ID NO: 22593 - protein, 81 aa, Equus caballus
MIPSLSSSRSFFLFQRPSSLGHLVQVLNYFTLTGYCVTKPEVIFRLEQGEEPWISEEEFPSQVFPEVWKSDQLKERSQENQ

SEQ ID NO: 22594 - protein, 81 aa, Equus caballus
PQVSVTFEDVAVLFTRDEWRKLSPSQRSLYQDVMLENYSNLVSLGLPFSKPKVISLLQRGEDPWKVERESSGGCSAGCKSS

SEQ ID NO: 22595 - protein, 81 aa, Equus caballus
TAHMAFRDVAVDFTQEEWLLLSPAQRSLYREVMLENYSNLVSLGIPFSKPKLITQLEQGKETWREETQGPPATCPAEAKPE

SEQ ID NO: 22596 - protein, 81 aa, Equus caballus
SLDSVTFTDVAIDFSQDEWEWLNLAQRTLYKKVMLENYRNLVSLGLCVSKPDVISLLEQGKEPWMMKGEMTRGLCPDLEYV

SEQ ID NO: 22597 - protein, 81 aa, Equus caballus
FQELLTFRDVAIEFSQEEWECLDPAQRALYRDVMLENCRNLLSLGLIASKPELVTFLEQKKDPWVVKREKKIVIHPGRWGW

SEQ ID NO: 22598 - protein, 81 aa, Pan paniscus
MCFQELLTFRDVAIEFSPEEWKCLDPAQQNLYRDVMLENYRNLVSLDLVTCLEQRKEPYNLKIDETVAKPPMISLQVYSET

SEQ ID NO: 22599 - protein, 81 aa, Lipotes vexillifer
MTFKDVAIDFTEEEWQQLDPAQRNLYWNVMLENYNNLITVGCPFTKPDVIFKLEQEEPWVVAEEVSKRHCPGEIWGMDEHQ

SEQ ID NO: 22600 - protein, 81 aa, Pan paniscus
LRGLVTFEDVAVEFTQEEWALLDPAQRTLYRDVMLENCRNLASLGCRVNKPSLISQLEQDKKVITEERGILPSTCPDLETL

SEQ ID NO: 22601 - protein, 81 aa, Lipotes vexillifer
WLQEKEGKAQVVKMVTFRDVAVVFTEAEWKRLSSEQRDLYREVLLENYRNLLSLGQKVTILGFVCDMVSVTTLNSALVGLK

SEQ ID NO: 22602 - protein, 81 aa, Lipotes vexillifer
FQVLVSFEEVAVLLSQEEWGHLGPAQKGLYRDVMLETYGNLVSLGLQGSKPDVISKLEQGEEPWAPHSPRIEGSWIWRRRR

SEQ ID NO: 22603 - protein, 81 aa, Callorhinus ursinus
LQESLTFRDVFVDFTLEEWQQLDSAQKSLYRDVTLENYSHLVSVGYLVARPDEVSRLGRGEEARRADGGPSAPNFPEFWQV

SEQ ID NO: 22604 - protein, 81 aa, Callorhinus ursinus
LQEAIVFEDVAVYFTRIEWSCLAPDQRALYRDVMLENYRHMASLGFLVAKPALISLLEQGEEPGALILQGTEEQGSTASLC

SEQ ID NO: 22605 - protein, 81 aa, Callorhinus ursinus
SQALLTFRDVAIEFSQEEWGCLTHTQRELYRDVMLENYGHLLFLGLIASKPDLIIFLEQEEQFWVVKRKETVTFHPGRWEW

SEQ ID NO: 22606 - protein, 81 aa, Callorhinus ursinus
MLENFSHLVSLGHPVSKPDIISKLEQGEEPWIIKRHISDWICPERETRLENPQLDILEGVSFPKEILEGVTRDHSLYSIFK

SEQ ID NO: 22607 - protein, 81 aa, Callorhinus ursinus
AQVCVISEDVFVSFSREEWMLLDDSQRLLYQDVMLETFALLASLGIVSSRSHSVAQLEQKEDPQMAAQVDMTPVSEREAQK

SEQ ID NO: 22608 - protein, 81 aa, Callorhinus ursinus
MKMHLPPPSEALSSDNLAHVLCHFPLTGLCVAKPEMIFKLERGEELWILEEESSGHGYPGSLSMLCGNSSVGGNAVRHDND

SEQ ID NO: 22609 - protein, 81 aa, Callorhinus ursinus
GQRSVSFRDVTVDFTRDEWLQLTGPQRMLYRDVMLENYSHLVSVGCHLTKPEVIFRLEQGEELWPSGGEFPDQGDQDKSQE

SEQ ID NO: 22610 - protein, 81 aa, Callorhinus ursinus
QESVTFKDVAVDFTLEEWGQLGPGQRELYRDVMLENYQNLLSLGVGPLGSKPDVISRLERGEEPRMEKKEARQATCPALHT

SEQ ID NO: 22611 - protein, 81 aa, Tursiops truncatus
AQGSVTFEDVAVYFSWEEWCLLDEVQIHLYLDVMLENFALVCMLGSWHRVEDEETPFEQSVSAGVSQIRTSSAGSSPEKAQ

SEQ ID NO: 22612 - protein, 81 aa, Tursiops truncatus
QSLVTFEDVAVHFSKEEWGLLDAAQRQLYHSVMLENLELMTSLGCWHGVEDEEVCSKQDASVDVVSQVRIFSAHFSTQKAD

SEQ ID NO: 22613 - protein, 81 aa, Tursiops truncatus
MDSVTIEDVAVDFTLEEWALLGPSQRKLYRDVMQETLRNLAAVGAKREYHAIEDQYKNQGRKLRTFMVERFCKSKDISLCG

SEQ ID NO: 22614 - protein, 81 aa, Sousa chinensis
LQETLTFRDVFVDFTLEEWQQLDATQKNLCKDVMLENYSHLVSVGFLVAQPGRTFRLGQGEEEARMAAGESPTRRCPGEPV

SEQ ID NO: 22615 - protein, 81 aa, Pteropus vampyrus
MKPAQKNLYRDVMLENYSNLVTVGYQVTKPDVIFKLEQREEPWVIEEEMFGRHCPEVWEVDEQIKKQQEIVRKVTSISNKT

SEQ ID NO: 22616 - protein, 81 aa, Pteropus vampyrus
VTFEDVALYLSREEWGRLDHTQQSFYHDVLQKRNRLALGAVEVGKEEPMPCPASHGDVKSFRTRAERAHGDSLQCGQQAAR

SEQ ID NO: 22617 - protein, 81 aa, Pteropus vampyrus
SQGCVTFEDVAVYFSWEEWGLLDEAQRLLYRSVMLENFALMASLGLASSGTQDITQLQRWGEPFLPAREVITVAVPRGSWC

SEQ ID NO: 22618 - protein, 81 aa, Pteropus vampyrus
WLLTFRDVAVDFSQEEWDYLNPAQRDLYRDVMMENYSNLVLLDLEFRCKTKELCLRKEINEVTSSQWMITEKSHSLLGSNI

SEQ ID NO: 22619 - protein, 81 aa, Pteropus vampyrus
SQGSVTFRDVAIDFSREEWEWLRPAQRDLYRQVMLENYGHLVSLGLNFSKPDLVSFLEQGKEPWLGRGNVRRDLCSVSESN

SEQ ID NO: 22620 - protein, 81 aa, Trichechus manatus
MDSVVFEDVAVEFTQEEWALLDFSQRKLYRDVMMENFRNLDSVFKQDNNGQTSMKNDSWPSMLGEVHEFHGIEHQHNNRRR

SEQ ID NO: 22621 - protein, 81 aa, Trichechus manatus
MAQESLTVSDVFVKFTWEEWQILDPAQKDLFWNVMLENYSNLVSIGCRVSKPDVLSRLEQEQPWTILDESHSGTFSETWRV

SEQ ID NO: 22622 - protein, 81 aa, Zalophus californianus
AQISVTFDDVAVTFTQEEWGQLDPAQRTLYQEVMLENCGLLVSLGCPVPRPELIYQLQHGQELWTWKRDLSQSAYPGDKGK

SEQ ID NO: 22623 - protein, 81 aa, Zalophus californianus
FVSLKDVTVDFTWEEWQHLNSAQRNLYRDVMLENYSNLVSVGCQSLKSDVISLKQGEPWMKEEGISSWAYSELKSQVTSFT

SEQ ID NO: 22624 - protein, 81 aa, Equus caballus
MGEGLKFKDVAIYFSQKEWECLHSTQKDLYQDVMLENYNNLISLGLSDSKPDVISLLEQKKEPWMVKRKETREWCPDWESK

SEQ ID NO: 22625 - protein, 81 aa, Equus caballus
DHMSLAFGDVAIDLSQEEWACLDPAQRALYRDVMLENYRNLASLGWSIPKPDVITFLEQDKEPWMVTREGTRSWCSDLESK

SEQ ID NO: 22626 - protein, 81 aa, Equus caballus
WLQGPVTFKDVAVEFTQEEWLMLDSAQRSMYRDVMLENYINLTSVEYQLCKPTVISLLGQEEIRIIKRRIPQGTYSDWEIQ

SEQ ID NO: 22627 - protein, 81 aa, Equus caballus
PLPALLPDPCGCAREGWVRAGEKKLRVVSFADVAVYFSPEEWGCLRLVQRALYQDVMRETYGHLGALGSPGFHGPQSNPGV

SEQ ID NO: 22628 - protein, 81 aa, Aotus trivirgatus
QASVCFEDVAMAFTQEEWGQLDLAQRTLYREVTLETWEHLVSLDWKATLEKNRLNSGKDQAWDEISHHVEVKQCVQEEPPC

SEQ ID NO: 22629 - protein, 81 aa, Lipotes vexillifer
GVSVNFEDVAVTFSWEEWGLLDEVQRYLYRDVMLEDLALITSLGPISASLQPSLEGSSVRNLPISLIKSNLIEHQRSNTRD

SEQ ID NO: 22630 - protein, 81 aa, Callorhinus ursinus
VLCEGERITSGGLVSQLLAHSQEHPKMNKSQRSVSSKDLTVDFTPQEEWQQLCPTRRLLDRAVILENCRQLVSVGEYSFPG

SEQ ID NO: 22631 - protein, 81 aa, Callorhinus ursinus
SQGSISFEDVTVNFTQEEWGQLDPDQRTLYRDVMLENYSIFISLECHFKPQEMRRGPEANGSGEAPMREKRKKSVSVLRQR

SEQ ID NO: 22632 - protein, 81 aa, Callorhinus ursinus
SQDLVTFKDVAIDFSQEEWEWLNPAQRNLYKNMMLENYQNLVSLGLCISKPYVISLLEQGKEPWEMKTEMTRSPFPDLGPI

SEQ ID NO: 22633 - protein, 81 aa, Callorhinus ursinus
QGSLSFKDVAVVFTWEEWQLLDPIQKNLYQDVMLENYSNLVSLEDTWQVDCHTDEHQDNQGNLETMESHQKNNAFRKILCL

SEQ ID NO: 22634 - protein, 81 aa, Tursiops truncatus
MLQNYSNLVSLGISFSKPTPVILLEYGEEPWKEERGHQPSPCSADPKPEIPPYSSSVLVFCGQQLHQHVLHDHHLPICPGL

SEQ ID NO: 22635 - protein, 81 aa, Tursiops truncatus
VTFPDVAVRFSWGEWKLLDEAQRRLYLSVTLDIYALISSLGCCCGAEGEETSCEETVPVGVSQAGSPKAAPSSQKTHPCEM

SEQ ID NO: 22636 - protein, 81 aa, Pteropus vampyrus
VTFEDVTVYFSSEEWDLLDEAQRRLYQDVMLENLALITSLVGMGPRMRRHFLSRAFLYKECHRSGLPRLACVPRRPIPMRC

SEQ ID NO: 22637 - protein, 81 aa, Pteropus vampyrus
PWLPLTFEDIAIYFSEQEWQNLEAWQKDLYRNVMRANYEILVSLGDGLPKPELISHIEQGKELFWNLGETQKSGNIICSSA

SEQ ID NO: 22638 - protein, 81 aa, Pteropus vampyrus
SQKSLTFADVFMDFTLEEWQQLDSTQKSLYRDVMLENYSHPVSVGYLVAKPDVIFRLGQVEARKADGEPATQSCPEVLQVD

SEQ ID NO: 22639 - protein, 81 aa, Pteropus vampyrus
MDFTPEEWGKLDPAQRDTMLENYRNLVSLWLPVSKPENYSLENGKDPLMLERKAPKSSYSDLESGPESKDSTSVQDFSKEE

SEQ ID NO: 22640 - protein, 81 aa, Pteropus vampyrus
GRVTFEDVIVYFSSEEWDLLDEAQRRLYRDVMLENWALITSLGGWHGVQDEEAPSEQSISVRGGSGSRVRTPKAGVSLQKP

SEQ ID NO: 22641 - protein, 81 aa, Equus caballus
FKEPVTFEDVAVVFTEEELGLLDATQRQLYRDVMLENFRNLLSVGHQSVTPDGIPRLEREEKLWLVKTAAQSQSSSGDKNL

SEQ ID NO: 22642 - protein, 81 aa, Bos indicus x Bos taurus
NKTFLGRLTFKDVAIEFTPEEWECLDLAQRALYREVMVETLRNLLSVGEDHFPPEVGICPWVALNQKGVPATHPKNLTCPR

SEQ ID NO: 22643 - protein, 81 aa, Pan troglodytes
QGLVTFRDVALDFSQEEWEWLKPSQKDLYRDVMLENYRNLVWLGDGCSCRSTLRTTVTAEASSSSSSIQASFHSLALPLMS

SEQ ID NO: 22644 - protein, 81 aa, Pan troglodytes
MGSLDTLFTQGLPVPQPDVIFQLKRGDKPWMVDLHGSEEREWPESVSLDWETKPEIHDASDKKSEGSLRECLGRQSPLCPK

SEQ ID NO: 22645 - protein, 81 aa, Pan troglodytes
IGGDVTFNDVAIDFTHEEWGWLNSAQRGLYKDVMVQNYENLVSVAGLSITKPYVITLLEDGKEPWTVEKKLSKGMIPREWE

SEQ ID NO: 22646 - protein, 81 aa, Pan troglodytes
KSMVTFEDVAVYFSQEEWELLDAAQRHLYHSVMLENLELVTSLGCWRGVEGEEAHPEQNVSVEVLQVRIPNADPSTKKANS

SEQ ID NO: 22647 - protein, 81 aa, Cercocebus atys
PQGLLTFRDVAIEFSQEEWKCLDPAQRTLYRDVMLENYRNLVSLEFQSVTQAKVQWCHLGSLQPPIPRFKQFSCLSLPSSW

SEQ ID NO: 22648 - protein, 81 aa, Cercocebus atys
QAEVTFEDVAVFLSREEWGRLGPAQRGLYRDVMLETYGNLVSLGVGPAGPKPGVISQLERGDEPWVQDVQGTSGREHLKVN

SEQ ID NO: 22649 - protein, 81 aa, Felis catus
WSQMPVTFEDVALYLSREEWGRLDHVQQNFYRDVLQKRNGLSLGFPFSRPFWASQGQGKGEASGSCRQMGDEEKTGACRGA

SEQ ID NO: 22650 - protein, 81 aa, Leptonychotes weddellii
CEVSVSFEDVTVDFSREEWQHLDPAQRRLYRDVTLENYSHLRSVGYQVPKPEVIFKLEQGEGPWTLEGETPHQRCSDEAIG

SEQ ID NO: 22651 - protein, 81 aa, Leptonychotes weddellii
SQGLLSFSDVAVDFTWEEWQLLDTVQRNLYRDVMLENYSNLMSLERPLQCFSKGIRLKQKSDSKFQSKNYAEMNSFELSSH

SEQ ID NO: 22652 - protein, 81 aa, Felis catus
YTLESLTLEDVAVDFTQEEWRLLAPAQKDLYRDVMLENFRNLVSVGYVASMPAALSRLERGGWWMTEDETRRWICPEIKKD

SEQ ID NO: 22653 - protein, 81 aa, Felis catus
SQAPVTFEDMAMYLTREEWRPLDPTQRDLYRDVMQENYGNVVSLDFEIRSENEVNPKQEISEDVEFGTASERPVGNAEENP

SEQ ID NO: 22654 - protein, 81 aa, Leptonychotes weddellii
ADSVVFEDVAVDFTLEEWALLDSMQKNLYRDVMLEIFQNLVSVDYETLLKASGLVSQQDMHEEKKSNEQKMAKFTRNCSCA

SEQ ID NO: 22655 - protein, 81 aa, Felis catus
AYGSVSFRDVAISFSQEEWAYLDPAQRALYRDVMLENYSHLLSLAGRSISKPDVITLLEQEKEPWVVIWSQIMELRSYLQK

SEQ ID NO: 22656 - protein, 81 aa, Neomonachus schauinslandi
MEEWALLDPSQKKLYRDVMQETFRNLASIVCISEEKWEIHDSEDQNENRGTDLSNQMVERLCKSKECSQYEEIFSQIPYHN

SEQ ID NO: 22657 - protein, 81 aa, Pongo abelii
QESVTFHKDVSVDFTQEEWYHVDPAQRSLYRDVMLENYSHLVSLGYQVSKPEVIFKLEKGEEPWISEGEIQRPFYPDWKTR

SEQ ID NO: 22658 - protein, 81 aa, Pan troglodytes
GKGVLTFRDVAIEFSLEEWHCLDTAQQNLYRNVMLENYRNLVFLGVGVSKPDLITCLEQGEEPWKRHKMVSKPPVVCSHFA

SEQ ID NO: 22659 - protein, 81 aa, Pan troglodytes
LTFRDVAIEFSQEEWKSLDPVQKALYWDVMLENYRNLVFLGKDNFALEVKICPRVFLYFLCCLSWEPFHYLTETEALLTHK

SEQ ID NO: 22660 - protein, 81 aa, Pan troglodytes
DHLSQDVFCLHESEFEEERMVAGWLTNYSQDSVTFEDVAVDFTQEEWTLLDQTQRNLYRDVMLENYKNLVAVSSVVEMNSE

SEQ ID NO: 22661 - protein, 81 aa, Pan troglodytes
ATLRLSAQGTVTFEDVAVNFTWEEWNLLSEAQRCLYRDVTLENLALISSLGMTFLHVCQALDSLRQVIHPPQPPKVLGLQV

SEQ ID NO: 22662 - protein, 81 aa, Pan troglodytes
VAFEDVAVNFTQEEWTLLDISQKNLFREVMLETFRNLTSIGKKWSDQNIEYEYQNPRRSFRSLIEEKVNEIKEDSHRGETF

SEQ ID NO: 22663 - protein, 81 aa, Pan troglodytes
FQKPVTFEDVAVNFTQEEWDCLDASQRVLYQDVMSETFKNLISVARIFLHKPELITKLEQEEEQWRETQVLQASQAGPPFF

SEQ ID NO: 22664 - protein, 81 aa, Camelus dromedarius
SLGSVSFKDVTVDFSREEWQQLDLAQKSLYTDVMLENYFNLISVGCQVPKPEVIFTLELGEEPCMLDDGISSQSCLDQSVG

SEQ ID NO: 22665 - protein, 81 aa, Camelus dromedarius
EDTAHSVAHLDIDCHSEQLIFEDVAIRFSQEEWECLVPAQRALYRDVMLETYRNLLSVGERTSLLMLRFALGYLHFPLCAC

SEQ ID NO: 22666 - protein, 81 aa, Myotis davidii
KQMSVTFKDVAVLFTRDEWRKLRPPQRHLYQDVMLENYSNLVSLGLLFSKPKVISLLQQGEEPWKVEEESPWGAPLGCKSN

SEQ ID NO: 22667 - protein, 81 aa, Myotis davidii
CSEGAWVPALFDEVAIYFSDEEWEVLTEPQKALYREVMRMNYETVLSLEHEDADIKPPDWAGPMHTVSPFPPPQPLDGLGL

SEQ ID NO: 22668 - protein, 81 aa, Myotis davidii
MLENYNNLITVGCPFTKPDVIFKLEQEEEPWVVEEEVLKRHCPGELSGLDHQNIQDRLLTQLRDKFIKVLTEEKVSECHKK

SEQ ID NO: 22669 - protein, 81 aa, Myotis davidii
LQISLSFEDVTVDFSRDEWQHLDPAQRCLYWDVTLENYSHLLSVGYQVPKPEVIFKLEQGKGPWTLEGETPHQSCSDKDVG

SEQ ID NO: 22670 - protein, 81 aa, Myotis davidii
LIGDQDFGTSLLHTAPQEHWKHLDSIQKEQYWDLMLETYGKMVSGGISNSKPDLTNSTESNSKPVLTNSTECGEELAGLHL

SEQ ID NO: 22671 - protein, 81 aa, Myotis davidii
MDLEDVAIAFSQEEWGLLDAAQRLLYCEVMLEIFALVASVGKTLLFSRCPEEDWGLLDAAQRLLYCEVMLENFALVASVGC

SEQ ID NO: 22672 - protein, 81 aa, Cercocebus atys
QDTVAYEDLCVDYTQKKWKCPALSQRALQWNMIPENDRSMASLGENMMKGSELTPKQEIFKGSESSNKTSGGLFGMVPGGA

SEQ ID NO: 22673 - protein, 81 aa, Cercocebus atys
PQGLLTFRDVAIEFSQEEWKCLDPAQRTLYRDVMLENYRNLVSLDISSKCMLKTLSSTGKGNTEVILTGTLQRQASHHTGE

SEQ ID NO: 22674 - protein, 81 aa, Neomonachus schauinslandi
QGHVTFEDVAVYFSQEEWGLLDEAQRHLYRTVMLENLALMASLGCWHGVKTEEAFSEQCVFMERVSQTRTPDPGLSIPKAH

SEQ ID NO: 22675 - protein, 81 aa, Neomonachus schauinslandi
RPPLVTFKDVAVDFAQEEWEHLDASQSHLYGEVMLENYENLISLGHLLSKPEMIFYFEQEDGVWMEEEMPRSSYSETPRER

SEQ ID NO: 22676 - protein, 81 aa, Monodelphis domestica
DQEAVTFKDVTVDFTQEEWCLLSPPQKELYKEVMLENAQNLISVGLPAPSEEVISYLEQRETPWMLEQEDLRSFYPGPLPQ

SEQ ID NO: 22677 - protein, 81 aa, Physeter macrocephalus
AQGSVSFEDVTVEFTQDEWQYVGPAQRTLYKDVTLENYSHLVSLGYCIIKPQVIFKLEHGEEPWSSEEEFLNQKYPGYYRV

SEQ ID NO: 22678 - protein, 81 aa, Physeter macrocephalus
AQGSVSFEDVTVEFTQDEWQYVGPAQRTLYKDVTLENYSHLVSLGYYRVDVHIEENQEKQEKPLWQVVFTDNKILSKEEQK

SEQ ID NO: 22679 - protein, 81 aa, Monodelphis domestica
PQASVTFEDVAVYLTQEEWGHLGPAQRGLYRDVMLENYGNVVSLGFPVSKPDVILQLEQKGEPWFLGMQDTEDCETRTEIK

SEQ ID NO: 22680 - protein, 81 aa, Monodelphis domestica
AQEAVTFKDVAVNFTQEEWCLLSPPQKELYKEVMLENAWNLLSVGLPGPPEDMISYLEQKDSPWMLEQEGLRSFCLEGEIR

SEQ ID NO: 22681 - protein, 81 aa, Monodelphis domestica
CRVSMTFKDVAVEFTSEEWGCLKPFQKKLYRDVMLENYRNLVSLGFTVSKPDVICRLERKKASWMPEANVPRSSSASEYLK

SEQ ID NO: 22682 - protein, 81 aa, Monodelphis domestica
MLENVQNLLSVGLPVPRENFISCFQQGKASWLLEQKDPRNSCPEAEANFEVKEMSMNLSFFVEVSCPQRCMNEGPHDFILR

SEQ ID NO: 22683 - protein, 81 aa, Monodelphis domestica
GLAARFQDVAVEFTWEEWRHLDPAQRALHRNVMLENYENLVSIEGKIRLEMNEISAELRLSREETQKQRYIGDGASDSTWR

SEQ ID NO: 22684 - protein, 81 aa, Physeter macrocephalus
QGSVTFEDVALYFSWEEWALLDEAQRCLYHDVMLENFALTSSLGCWHGVEDKEAPSQQSISVDGVSQIRPLKAGSSLQKAQ

SEQ ID NO: 22685 - protein, 81 aa, Monodelphis domestica
LQAAVSFRDVVVDFTEEEWGRLSPAQWQLYKEVMLENYRNLVSLGLMEDKPGLISRLEQGEVLPLTSAAPRPPLWEGDASA

SEQ ID NO: 22686 - protein, 81 aa, Monodelphis domestica
MDFTQEEWRLLDHSQKELYLEVMLENVQNLLSVEAKTDFEVKDMSTKLSLFVEGSGSQRCVNEGLCHFILKEIFASNIKVN

SEQ ID NO: 22687 - protein, 81 aa, Monodelphis domestica
PKEAVTFKEVAVDFTGEEWCLLSPPQKELYKEVMLENAQNLLSVGLPGTPEDMISSLEQREAPWILEQEGLRNCCPEGEIR

SEQ ID NO: 22688 - protein, 81 aa, Monodelphis domestica
FQGSITFKDVAVDFTQEEWYLLDHSQKELYLEVMLENVQNLLSVGLPVPRENFISHIQQRKTSWLLEQKGPRSSSLDFEVK

SEQ ID NO: 22689 - protein, 81 aa, Physeter macrocephalus
FQEPVSFKDVAVTFTKEELGLLDSTQRKLYRDVMLENFQNLLSVGYQPFKLDMILQLGRKEKLWVMEPETQGAGCSGHGNQ

SEQ ID NO: 22690 - protein, 81 aa, Monodelphis domestica
SQGLMNFKDVAVDFSQEEWCLLDHSQKELYLEVMLENVQNLLSVGLLVPREDIVSCFQQGEAPWLLEQRGPRSSCPETETN

SEQ ID NO: 22691 - protein, 81 aa, Monodelphis domestica
LQEVVTFQDVAMDFTREEWPLLSPHQKELYKEVMLENARNFLSVGLPAPSEEVISYLEQREAPWILEQEGLRNCCSEGEIR

SEQ ID NO: 22692 - protein, 81 aa, Monodelphis domestica
VVTFQDVAVDFTREEWRLLSPPQKELYKEVMLENARNLLFVEGEIRPEIKENPIEVSFPVEEMNLQRCTDGLDKFASREFC

SEQ ID NO: 22693 - protein, 81 aa, Monodelphis domestica
APEAVTFKDVAVDFTREEWRLLSPPQKELYKEVMLENAQNLLSVGLPGPPEDVISYLEQREAPWLLEKEGLRSCCPGDIRP

SEQ ID NO: 22694 - protein, 81 aa, Physeter macrocephalus
MLENFRNLISVGCPVTKTKVIFKVEQGQEPWMMEGENARWHSPEVICLLDDELEGQEGEGSKDNFLNQGMFTFKKTLTNET

SEQ ID NO: 22695 - protein, 81 aa, Monodelphis domestica
VTFRDVSLDFTWEEWECLSAVQRELYRDVMLENYRNLVSLAWDPKLKNQESAEKQEVRPVEILEERRPGVVLRNQIFVVGP

SEQ ID NO: 22696 - protein, 81 aa, Papio anubis
TVTFEDVAVNFSQEEWSLLSEVQRCLYRDVMLENLALISSLDCWCGSKDKEAQSKQSISVQRESQNRTPRAVVSPKKAHPC

SEQ ID NO: 22697 - protein, 81 aa, Aotus trivirgatus
FQGPVTLKDVTVEFTKEEWKLLTPAQRTLYKDVMLENYSHLASVGYRVNKPNVVFKLKQGKEPWMLVVEFPHRGLPEDLWN

SEQ ID NO: 22698 - protein, 81 aa, Aotus trivirgatus
ELLTFRDVAIEFSPEEWTCLDPAQQNLYRDVMLENYRNLVSLGVAISNPDLVTCLKQRKEPCNVKIRETVAKPPAVCSHFT

SEQ ID NO: 22699 - protein, 81 aa, Papio anubis
GRVVFEDVAIYFSQEEWGHLDEAQRLLYRDVMLENLALLSSLGCWHGAEAKEALEQSASVKVPSSNVQQHQKHYGEKPLKR

SEQ ID NO: 22700 - protein, 81 aa, Aotus trivirgatus
TFLSVTFEDVVVHFSLEELSSLSAAQRNLYREVTLETYRNLVSLGYHFSKPDIISRLEKEESRAMETDSSAVICQGESYDD

SEQ ID NO: 22701 - protein, 81 aa, Aotus trivirgatus
LQGLVTFEDVAVEFTQEEWALLDPAQRTLYKDVMLENCRNLASLGCHVNKPRLISQLEQDKKVMTEERGILPSTCPDLETL

SEQ ID NO: 22702 - protein, 81 aa, Sarcophilus harrisii
ALESVTFQDVAVNFTHEEWGHLKPAQKDLYREVMMENYQNFVSLGLPFSKPHVISQLEKGEAPWITEKASLVPRVSCQDFF

SEQ ID NO: 22703 - protein, 81 aa, Lipotes vexillifer
CEGSVSFEDVTIDFSREEWQQLDPAQRCLYQDVMLEIYSHLFSVGYHIPNPEVIFRMEKGKEQWMQEAELPRQRYHVSETA

SEQ ID NO: 22704 - protein, 81 aa, Lipotes vexillifer
PKVPVTFDDISIYFSTPEWEKLEEWQKELYKNIMKGNYESLISMDYAMNQPDVLSQIQPEGDHNTEDQAAPEESEIPTDPT

SEQ ID NO: 22705 - protein, 81 aa, Callorhinus ursinus
MLENYGNLTSLGYPVPKPALISLLEGGNLPWGLEAQDNPSAERTKDICKDTETNVGSESTSTQGISEERDVILSHGLQKSV

SEQ ID NO: 22706 - protein, 81 aa, Callorhinus ursinus
VLQGLSFKDVAVNFTEEEWRELDPAQRDLYKDVMLENYRNLVSLGFPFSKPDIISQLEQAGNPWMQEREVLRSSCTYLETR

SEQ ID NO: 22707 - protein, 81 aa, Callorhinus ursinus
PQESVTFKDIAVDFTQEEWALLDTSQRKLYRDVMLENISHLVSVGYHLCKSDVISQLEQGVELWREGRGFPQGPNPDRKSG

SEQ ID NO: 22708 - protein, 81 aa, Monodelphis domestica
PQELVTFKDVAVEFTRTEWRCLTPSQKELYRDVMLENYGNLVCLGLAVSKPDVISQLERREAPWMPGGIQRSCCPDWEASC

SEQ ID NO: 22709 - protein, 81 aa, Monodelphis domestica
EAVTFQDVAVDFTRGEWRLLSPPQKELYKEVMLENARNLLSVGEIRPEMKVTPKDASLSVEDSDRQRFMSDGPNKLSWREL

SEQ ID NO: 22710 - protein, 81 aa, Monodelphis domestica
SLESVTFQDVAVDFTHEEWGRLEPAQKDLYRDVMLENYQNFVSLGLPFSKPHMISQLERGEAPWITEKDIIPRVSCPDFFI

SEQ ID NO: 22711 - protein, 81 aa, Monodelphis domestica
PQGMVTFRDVAVIFSPGEWRLLDPPQKQLYREVMLENYRTLVWLGFVGAKPEVISHLEQGDAPWVPEDPFPSGSCTDRDTE

SEQ ID NO: 22712 - protein, 81 aa, Monodelphis domestica
AQEVVTFQDVAVDFTQEEWRLLSPPQMELYKEVILENARNLLSVGLPAPPEEVISYLEQRKAQWMLEQEGLRNCCPEGEIR

SEQ ID NO: 22713 - protein, 81 aa, Monodelphis domestica
SQGSIAFKDVAVDFTQEEWCLLDHSQKELYLEVMLENVQNLCSVGLPVPRENLISYFQQRKAPWLLEQKGPRSSCPEAETN

SEQ ID NO: 22714 - protein, 81 aa, Physeter macrocephalus
MAHQDLAVRFSKDEWRLLGQGQRALYLDVMRENYETLASLGTVELLPLSAFLSPSEPGGAMGGGSCAGDGQEPPRGGGPLG

SEQ ID NO: 22715 - protein, 81 aa, Physeter macrocephalus
MLYKRVMLENYHHLVSLGFSSSKPHLVSRLERGEGPWVADVHRMGTTTGMQAGDRMKSKPIISKQKNCPEELAGADLQGGN

SEQ ID NO: 22716 - protein, 81 aa, Aotus trivirgatus
PQGQVTFRDVAVEFSQEEWTCLDPAQRSLYRDVMLENYRNLASLGISCFDLSIISMLEQGKEPFTLESQVQIAGNPDGWEW

SEQ ID NO: 22717 - protein, 81 aa, Aotus trivirgatus
FQESVTFQDVAVDFTPEEWQLLDCAERTLYWDVMLENYKNLISVGCPVTKTKVILKAEQGQEPWMVEGVNPHQSSPESDCP

SEQ ID NO: 22718 - protein, 81 aa, Aotus trivirgatus
IQELLTFGDVAVAFTRIEWRHLDAAQRALYRDVMLENYGNLVSVGLLSSKPKLITQLEQGAEPWMEVREAPSGTRAVPDYW

SEQ ID NO: 22719 - protein, 81 aa, Aotus trivirgatus
SHDSVTFDDVAVDFTQEEWTLLDPTQRNLYSDVMLENYKNLATVGGQIIKPSLISWLEQEEESRTVQGGVLKGWELQLETQ

SEQ ID NO: 22720 - protein, 81 aa, Sarcophilus harrisii
SSRPVTFQDVAVHFTWEEWSRLDSAQRALYREVMLETFENIVSLGLPVSKPQVICLLERGETPCLPETEGPYPDSLNSGTK

SEQ ID NO: 22721 - protein, 81 aa, Sarcophilus harrisii
IQESVTFKDVAVDFTQEEWIQLDPAQRNLYRDVMLENYKNFVSLGFPIFKPDVISQLERGEGPWAPETEISQVICPDSIIQ

SEQ ID NO: 22722 - protein, 81 aa, Lipotes vexillifer
SQGLVAFEDVAVYFSLEEWERLDADQRELYQEVMQENYGILVSLGYPIPKPDLIFRLEQGEEPWVPDSPRPEEGDIVTGVY

SEQ ID NO: 22723 - protein, 81 aa, Pan paniscus
IGGDVTFNDVAIDFTHEEWGWLNSAQRGLYKDVMVQNYENLVSVGLSITKPYVITLLEDGKEPWMVEKKLSKGMIPGEWEN

SEQ ID NO: 22724 - protein, 81 aa, Tursiops truncatus
SQKSVTFQDVAVDFTEKEWPLLDSSQRKLYKDVMLENYSNLASVGCQVSKPSLISHLEQEEELRTEEQELHQGPCPDWETP

SEQ ID NO: 22725 - protein, 81 aa, Monodelphis domestica
MLENVQNLLSVGLPVTREHLISCFQQGKTPWLPEQKGPKSSSPDFEMNVMCTNLSLFVEGSGPQRCMKEVPHDFILREICD

SEQ ID NO: 22726 - protein, 81 aa, Monodelphis domestica
MFDDVAVYFTRKEWMCLDSPQRALYRDIMLENYENLVCLGFPDSKPNVIFQLERGKEPWDMELLQGPEEREYTLKGLKTDS

SEQ ID NO: 22727 - protein, 81 aa, Monodelphis domestica
AQKLVTFQDVAVDFTQEEWGLLDHSHKELYMEVMLENAQNSLFLGLLVPRESFISCFQQKEALWIRESKGPRNSCPEIKFN

SEQ ID NO: 22728 - protein, 81 aa, Monodelphis domestica
SQESVTFKDVAVNFTQEEWQQLNPAQRDLYRDVMLENYRNLISLGFPIAKPAVIFQLEQGEEPWIHELQRIEEREVSKNTY

SEQ ID NO: 22729 - protein, 81 aa, Physeter macrocephalus
SLGPVSFTDVAVDFTQEEWQQLDPEQKTTYRDVMLENYSHLVSVGCHIIKPEVITKLEKGEEPWIVGGEFLLQSYPEEDWE

SEQ ID NO: 22730 - protein, 81 aa, Aotus trivirgatus
CQESVTFEDVAVVFTDEEWSHLIPIQRDLYKEVMLENYKSVVSLGLPVPQPDMIFQLKRGDEPWMVDLHGSEEREWPESGS

SEQ ID NO: 22731 - protein, 81 aa, Aotus trivirgatus
ESVAFEDVAVYFTQNQWASLDPAQRALYREVMLENYANVASLVAFPFPKPALISHLEKGEAPWGPDPWDAEIPSSLSQGDE

SEQ ID NO: 22732 - protein, 81 aa, Papio anubis
MVEGEEEWQQLNPAQKTLHRDVMLETYSHLVSVGCSGIKPDVIFKLEHGKDPWIIESELSRWIYLDRVKGLESSQQIISGE

SEQ ID NO: 22733 - protein, 81 aa, Aotus trivirgatus
AQDRVVFEDVAIYFSQEEWGHLDEAQRLLYRDVMLENLALLSSLGCCHGAEDEEAPLEQGVSVGLSQVMAPKPCLSTQKTQ

SEQ ID NO: 22734 - protein, 81 aa, Aotus trivirgatus
VPGSVTFRDVAIDFSQEEWECLQPAQRTLYRDVMLENYSHLISLGSSISKPDVITLLEQEKEPWMVVRKETSRWYTDLESK

SEQ ID NO: 22735 - protein, 81 aa, Aotus trivirgatus
MVAGERKRQQLNPAQKTLHRDVMLETYSHLVSVGCSGIKPEVIFKVEHGKDPWIKDSELSRWIYPDREKGLKSSQRIISGE

SEQ ID NO: 22736 - protein, 81 aa, Papio anubis
GTVTFEDVAVNFSQEEWSLLSETQRCLYHDVMLENLALISSLGCWYGAKDETPSKQTLSIQQESPLRTHWTGVCTKKVHLW

SEQ ID NO: 22737 - protein, 81 aa, Lipotes vexillifer
QLTLNDVAIEFSPEEWECLDPAQRALYRDVMLETCRNLISVDISHIHVIRKLQLKSNIDRGGVFQTVILGRHEIQEIKPFY

SEQ ID NO: 22738 - protein, 81 aa, Pan paniscus
QGTVTFEDVAVHFSWEEWGLLDEAQRCLYREVMLENLALLTSLDVHHQKQHLGEKHFRSNVGRALFVKTCTFHVSGEPSTC

SEQ ID NO: 22739 - protein, 81 aa, Lipotes vexillifer
LQGSFSFEDLSVDFTQKEWQLLAPYQKDLYKDVMLENYSSLVSLGYEVMKPGVILKLEHGEEPWTGDGEIPGSDSSEQVLQ

SEQ ID NO: 22740 - protein, 81 aa, Callorhinus ursinus
MLENYGHLVSLAGFNISKPYVVSLLEQGREPWLVKGDVRRDPFSESNGEIKEFSPKNVTYEDSSSQYLVVERILNQDPEYS

SEQ ID NO: 22741 - protein, 81 aa, Tursiops truncatus
WLTFKDVVIEFSQEEWECLDPGQRALYRDVMLETYRNLISVDICPIHVVKQLQPKGNSDPGEVFQRVILGRSKSREIKHFY

SEQ ID NO: 22742 - protein, 81 aa, Tursiops truncatus
GVTFEDIAVYFSWEEWRLLDEAQIRLYLDVMLENYALISSVGCCCGAEDAEAPFEQIASLGMSQARTPKAALCSQKTHPCE

SEQ ID NO: 22743 - protein, 81 aa, Tursiops truncatus
QAQETLTFEDVAVDFTWEEWQLLAPPQKDLYRDVMLENYSNLLSVGFQASKPNVLSKLGQGEPWMMEDEIHCQTRSEIWKV

SEQ ID NO: 22744 - protein, 81 aa, Tursiops truncatus
PEVGVTFEDIALYFSWEEWKLLDEAQRHLYHDVMLENFALISSLGVWSGEENVEASFEQNVSVVMSQVRTSKEPSSSQKTH

SEQ ID NO: 22745 - protein, 81 aa, Monodelphis domestica
FQESVTFRDVAVDFTQEEWRHLEPAQRALYRDVMLENYENLVSVGIPVSRLDVTSLLERQEAVWKDGGLRDSCLDSLSNKI

SEQ ID NO: 22746 - protein, 81 aa, Monodelphis domestica
MLENVWNLHSVGLPTPPEDVISYLDLREFPWMLEQDGLRSCCPEGKIRPEMKVKPTEMSLPVEEMDLQRFMSDGPDNFSLK

SEQ ID NO: 22747 - protein, 81 aa, Monodelphis domestica
RPPSQGLITFKDVAVDFTQEEWCLLDHSQKELFLEVMLENVHNLLSVGIPVPRKYCTSCFQQGEAPWLLEQKDPRSSFSGE

SEQ ID NO: 22748 - protein, 81 aa, Physeter macrocephalus
SQESVSFEDVAVYFTQNQWASLDSAQRTLYRKVMLENYANVTSLAFPFPKPDLILQLEQGEAPGGLDPWTPIRREVRGVCT

SEQ ID NO: 22749 - protein, 81 aa, Monodelphis domestica
AQEVMTFKDVAVDFTREEWHLLSPPQKELYKEVMLENAQNLLSVGLLGPPEDAISYLEQKEAPWMLEQEGLRGCCREGEIR

SEQ ID NO: 22750 - protein, 81 aa, Monodelphis domestica
GQEAVTFQDVAVDFTREEWRLLSPPQKELYREVMLENVRNLLSVGLPASPEDVLSSLEQKEAPWMLEQEGLRSCCPEGEVR

SEQ ID NO: 22751 - protein, 81 aa, Monodelphis domestica
SQELVTFEDVAIYFTEEEWGLLDPAQRKLYRDVMLENFGNVLLLGFPVSKPDIISKLERGEIPCVPFLPRKKILVIRLGGG

SEQ ID NO: 22752 - protein, 81 aa, Monodelphis domestica
AQEAVMFKDVAVDFTREEWRLLSPPQKLLYKEVMLENARNLLSVGLQAPSDDVFSSLEQREAPWMLEQEVLRSCCPGEIKP

SEQ ID NO: 22753 - protein, 81 aa, Physeter macrocephalus
MAHLMMFRDVAVDFSAEEWECLDLEQRALYRDVMLENYSNMVSLGLCLYQPDVFSLLEKGKEPWMVLKDETRGPCPDVQSR

SEQ ID NO: 22754 - protein, 81 aa, Monodelphis domestica
GQEVVTFQDVAVDFTQGEWRLLSPPQKELYREVMLENVRNLLSVEREIRPEMKLTATEVSLSVEEMNLQRFMSDCPDNFAF

SEQ ID NO: 22755 - protein, 81 aa, Monodelphis domestica
IQGSLTFKDVTVDFTEEEWCHLDHSQKELYLEVMLENVQNLLSVGLPVPREYYTSYFQQEKAPWLLVQKGPRNSSPEAETN

SEQ ID NO: 22756 - protein, 81 aa, Monodelphis domestica
TKESVTFKDVSVDFTREEWGQLDPTQKNLYRDVMLENYRNLVSLGLQVFKPDVITRLERAEAPWTLENKGFRPTCLDWEMK

SEQ ID NO: 22757 - protein, 81 aa, Monodelphis domestica
PQDLVTFWDVAVDFTQQEWRRLGPAQKELYREVMLENYRNLVSLGFVGAKPEVISHLEQGEVPWMPEGSFPRSSSHEDLNT

SEQ ID NO: 22758 - protein, 81 aa, Physeter macrocephalus
PLTFKDVAMVFTEEELGLLDSAQRKLYRDEMLENFRNVVSVGDKDAKDMEYIQEKELRLLLHRELSYCKIWEQVAGELTRN

SEQ ID NO: 22759 - protein, 81 aa, Physeter macrocephalus
WLQGPVSFKDVAVEFTQEEWMMLDSAQRSMYRDVMLENYINLTLVEYQLRKPVISLSGQEDIRTVKRRIPQGTCPDWEIQL

SEQ ID NO: 22760 - protein, 81 aa, Papio anubis
QGLLTFRDVAIEFSQEEWKCLDPAQRTLYRDVMLENYRNLVSLDISSKCTMKEFSSTAQGNTEVIHRETMQRHERHHIGDF

SEQ ID NO: 22761 - protein, 81 aa, Papio anubis
SQGLVTFEDVAVYFSLEEWERLEADQRGLYQEVMQENYGILVSLGYPIPKPDLIFRLEQGEEPWVPDSPRREEGDIVTGVY

SEQ ID NO: 22762 - protein, 81 aa, Papio anubis
MGPLQFRDVAIEFSLEEWHCLDTAQRNLYRNVMLENYKNLVFLGIPVSKPDLITCLEQGKKSWTMKRHEMVAKSPVSFLQL

SEQ ID NO: 22763 - protein, 81 aa, Aotus trivirgatus
FEEAVTFKDVAVVFSSEELRLLDLTQRKLYRDVMVENFKNLVAVGHLPFQPDMVSQLEAEEKLWIMEAETQRSRYSGENPA

SEQ ID NO: 22764 - protein, 81 aa, Aotus trivirgatus
RPGAVSFADVAVYFSPEEWGCMRPAQRALYRDVMRETCGHLGALGFSGPKSAFISWVEGEVEAWSPEVQDPEGESPGTVSR

SEQ ID NO: 22765 - protein, 81 aa, Pan paniscus
GHLTFKDVAIEFSQEEWKCLEPMQKALYKDVMLENYRNLVFLGISPKYVIKELPPTENSNTGERFQTVPLERHQSYDIENL

SEQ ID NO: 22766 - protein, 81 aa, Pan paniscus
RGTVTFEDVAVKFTQEEWNLLSEAQRCLYRDVTLENLALISSLGCWCGSKDEEAPCKQSISVQRESQSRTPRAGVSPKKAH

SEQ ID NO: 22767 - protein, 81 aa, Tursiops truncatus
MEFTWEEWQLLDSAQKHLYRDVTLENYSNLVSVGYHGTKPDLVFKLEQGEEPWIINAEVSRQSCPEGWKEWYQKNQDELES

SEQ ID NO: 22768 - protein, 81 aa, Tursiops truncatus
QGHVIFEDVAVSFSQEEWGLLNNAQRLLYCDVMLENLSLIASLGCWHGVEAEEAVSEQCVSVEQVTENRNPKLEPSILKPL

SEQ ID NO: 22769 - protein, 81 aa, Monodelphis domestica
VSFADVAVYFSPEEWGRLRPEQRALYRDVMRETYGHLGALGEERVHEAEGPSSGGEGAVRMLGTEEEPVIKRLEDVGQPPI

SEQ ID NO: 22770 - protein, 81 aa, Monodelphis domestica
MLENVQNLQTVGLPVPREIFLSCFQQGEAPWLLEQKGPRSSCPKAETTFDVEMSTKLSLFVEGCGPQRCMNEGPCDFISRE

SEQ ID NO: 22771 - protein, 81 aa, Monodelphis domestica
QQGAVTFRDVAVDFSPDEWRRLGPAQKELYREVMLENYRSLAWLGLEVCKPHVIQRLECGEAPWTPQGGVPGSCAPDCKTR

SEQ ID NO: 22772 - protein, 81 aa, Monodelphis domestica
KVPVTFVDIAVYFSEDEWKNLDEWQKELYNNLVKENYKTLMSLGAENTVPKPDAQSRVEPREEPCVWEQHNPEEREIPMDP

SEQ ID NO: 22773 - protein, 81 aa, Monodelphis domestica
SQGSVTFQDVTMDFTQEEWRLLDHSQKELYREVMLENVQNLLSVGLPVPRENFISCFQQGKAPWLLEQKGPRSFCPEAETT

SEQ ID NO: 22774 - protein, 81 aa, Physeter macrocephalus
PQGCAISEDVFVYFSREEWVLLDENQRLLYRDVMLENFALLASLGITSSRSHLVMQLEQGEEPWMPAQVDMTPATEKEAQK

SEQ ID NO: 22775 - protein, 81 aa, Monodelphis domestica
VVTFQDVAVDFTWEEWRLLSPPQKELYKEVMLENVRNLLSVGKEPLPAASVCHPSVSHFVEEMDLQRFMSDGPNNMTPKEF

SEQ ID NO: 22776 - protein, 81 aa, Monodelphis domestica
LVTFKDVAVDFTKEEWCLLSPPQKELYKEVMLENAQNLLSVEGEIRSEIKANPTDISFPLEEVELQRFMRGGPGNFASREF

SEQ ID NO: 22777 - protein, 81 aa, Monodelphis domestica
SQEVVTFQDVAVNFTREEWRLLSPPQKELYREVMLENARNLLSVGLPASIEDVISNVEQREALWMLEREGLRSCCPEEDIR

SEQ ID NO: 22778 - protein, 81 aa, Monodelphis domestica
GPGSVTFRDVAVDFTWEEWRRLGPAQKELYREVMLETYRTLVCLGLAVPKPGVSAQLDGGERRASARGRPGTHVVHGFLNP

SEQ ID NO: 22779 - protein, 81 aa, Monodelphis domestica
QGSITFKDVAVDFTQEEWRLLDHSQEELYREVMLENVQNLLFVEAETNFEVKEMTTKLSLFLEGSGPSRGMNKGPCDFILR

SEQ ID NO: 22780 - protein, 81 aa, Monodelphis domestica
STFHLTFKDVAVEFTWEEWIYLNSSQRKLYRDVMLENYRNLVFLGFTVSKPDVICRLERKKASWMPEADVPRSSSASEYLK

SEQ ID NO: 22781 - protein, 81 aa, Papio anubis
PQGLLTFRDVAIEFSQEEWKCLDSAQRTLYRDVMVENYRNLVSLDISSKCMMEFLSTAQSNREVIHTGTLERHESHHIGDF

SEQ ID NO: 22782 - protein, 81 aa, Papio anubis
EDVAVDFTLEEWALLDSAQRNLYRDVISVSRFEMWERTKTQFKANGSVSQQDTYRKEKSKEQTIPNFTRNNSCAYTLEKTC

SEQ ID NO: 22783 - protein, 81 aa, Aotus trivirgatus
FQKPVTFEDVAVNFTQEEWDCLDASQRVLYQDVMLETFKNLASVARMFVHKPELITKLEQQEKQWRVTRVLQASRGGPPFF

SEQ ID NO: 22784 - protein, 81 aa, Aotus trivirgatus
AHRSVMFSDISIDFSPEEWEYLDLEQKDLYRDVMLENYSNLVSLGCFISKPDVISLLEQGKEPWKVVRKRRRQYPDLETKY

SEQ ID NO: 22785 - protein, 81 aa, Aotus trivirgatus
LQGLVTFEDVAVEFTQEEWALLDPAQRTLYRNVMLENFWNLSSSLGNQVDKPSLISQLEQEDKLMTEERGIVPGPRPDVET

SEQ ID NO: 22786 - protein, 81 aa, Aotus trivirgatus
MEPLTFKDVAIEFSLEEWQCLDAAQRDLYRNVLLENYRNLVFLGIAVSKPYLITCLEQKKEPWNMKRHEMVAKPPVMCFHF

SEQ ID NO: 22787 - protein, 81 aa, Lipotes vexillifer
WKEMVTFKDVAIYFTQKEWECLHSAQKDLYRDVMLENYNTLISLGFCDSKPDVISLLEQGKEPWMVNSKETKEWCPDWESR

SEQ ID NO: 22788 - protein, 81 aa, Lipotes vexillifer
LQESVTFRDIAVLFSRNEWLHLDSAQRTLYREVMLENYSTLVSLGIPFSMPKLICQLQHGEDPCMVEREIPQGTCLGFKTW

SEQ ID NO: 22789 - protein, 81 aa, Callorhinus ursinus
MLENYRHMASLGFLVAKPALISLLEQGEEPGALILQGTEEQGSTASLCPDSRMQAAIKESCLRRVSSKQLGPLGTVWGHLP

SEQ ID NO: 22790 - protein, 81 aa, Callorhinus ursinus
AQGSVVFTDVSVDFSQEEWECLDPGQRDLYRDVMLENYSNLLSMGLYIPKPQVISLLEQGKEPWMVGRELTRGLCSDLESM

SEQ ID NO: 22791 - protein, 81 aa, Tursiops truncatus
MKFTWEEWQLLDTDQKDLYRDVMLENYSNLLSIGYRASKPDALSRLERGEQLWPVEDDSHGRICPEIRKVDDALQHHLPNH

SEQ ID NO: 22792 - protein, 81 aa, Monodelphis domestica
MTFQDVAVDFTREEWCLLSPPQKELYKEVMLENARNLLSVGLPVPTEDVLSYLEQSEAPWMLEQEDLRSCHPEGEIRPEMK

SEQ ID NO: 22793 - protein, 81 aa, Monodelphis domestica
QESVAFKDVVMDFTPEEWKQLELPQKDLYKDLMLEKYRNLVLLGLPVSKPDVNSELEQGEGEESWIPRKEVPGSTCSDWET

SEQ ID NO: 22794 - protein, 81 aa, Physeter macrocephalus
MLQNYSNLLSVGYRVSKPDALSKLERGEEPWTIEDEIHSQTCPETGNVGNHLQGEWENERMLKGIEQYQEHNAFGNPVPQS

SEQ ID NO: 22795 - protein, 81 aa, Physeter macrocephalus
MGFTQEEWQHLDPAQRTLDRDVMLKNYSHLISVGYCVTKPEVIFKLEQEEPWMLEEESQSQSHPASPSVILRTNCVNKTVL

SEQ ID NO: 22796 - protein, 81 aa, Physeter macrocephalus
KVPVTFVDIAVYFSEDEWRNLDEWQKELYNNLVKENYKSLASLDSEGPVSKPDAPPQAEPREEPCVWEQRDPEEREILMDP

SEQ ID NO: 22797 - protein, 81 aa, Monodelphis domestica
FQGSITFKDVVVNFTKEELCLQDCSQKKLCKEVMLENVQNLLSVGLIVPRRNLITCLQQGESPWLPENEGSVFSLGPRPSE

SEQ ID NO: 22798 - protein, 81 aa, Physeter macrocephalus
QDPVAFEDVAVNFTLEEWALLGPSQKKLYRDVMRETLRNLASIGGKWEDHNTEDQYKNQGRNLRSHTLQRRCESEEGSQCG

SEQ ID NO: 22799 - protein, 81 aa, Monodelphis domestica
SQGSITFMDVAVDFTQEEWCLLDHSQKELYLEVMLENVKNLLSVGLPVPTETFISCFQQRKAPCLVEQKVPRNFFPDFEVK

SEQ ID NO: 22800 - protein, 81 aa, Papio anubis
FRDVAIEFSQEEWKCLDPAQRTLYRDVMVENYRNLVSLDISSKCKMKEFLSTAQSNREVFHTGTLQRHESQQIGDYCFQDV

SEQ ID NO: 22801 - protein, 81 aa, Aotus trivirgatus
PQESVAFEDVAVYFTKKEWATMMPEQRASYCVMLENYEAVAFVAVPSTSKLALVSHLEQGKEPCFTQPQGVLSRRGWRAGF

SEQ ID NO: 22802 - protein, 81 aa, Aotus trivirgatus
PVTFRDVTVIFTEAEWKRLSPEQRNLYKEVMLESYRNLLSLAELKPEIYPCFSCLLAFSCQQFLSQHVLQIFLGLCAENHF

SEQ ID NO: 22803 - protein, 81 aa, Lipotes vexillifer
SWDSVTFADVAVDFTQEEWTLLDPIQRKLYRDVMLENYKNLTTAGYQSLKPTVISWLEQEDDLRTVERRGVLQEGTWESSV

SEQ ID NO: 22804 - protein, 81 aa, Lipotes vexillifer
KFQVMSFKDVAVVFTEGELGLLDSAQRKLYRDVMLENFRNLLSVGNQPFKPELIFQLEREEELLMMETETQREGCSGTKSQ

SEQ ID NO: 22805 - protein, 81 aa, Pan paniscus
FQELLTFRDVTIEFSLEEWEFLNPAQQSLYRKVMLENYRNLVSLGLTVSKPELISCLEQREEPWNVKRHETIAKPPAMSSH

SEQ ID NO: 22806 - protein, 81 aa, Lipotes vexillifer
QGHVIFEDVAVSFSQEEWGLLNDAQRLLYCDVMLENLSLIASLGCWHGVEAEEAISEQCVSVEQVKEDRNPKLEPSILKPL

SEQ ID NO: 22807 - protein, 81 aa, Lipotes vexillifer
MLENYSHLVSVGYDSTKPNVILKLEQGEEPWVADGEFPRQFHPEEVWKVDDLMERAQENKDECSRQAVSINSRTLTKEREV

SEQ ID NO: 22808 - protein, 81 aa, Lipotes vexillifer
GSVTFEDVAVYFSCEEWCLLDEVQIHLYLDVMLENFALVCMLGSWRGVDEETPSEENICVEGVSQIRTPRAGSSEKAQPCK

SEQ ID NO: 22809 - protein, 81 aa, Pan paniscus
QGRLTFRDVAIEFSLAEWKFLNPSQRALYREVMLENYRNLEAVDISSKRMMKEVLSTGQGNAEVIHTGMLQRHESYHTGDF

SEQ ID NO: 22810 - protein, 81 aa, Callorhinus ursinus
RDWGTFEDVAVYFSREEWELLDETQRHLHHDVMLENLALVASLGCWCGVEEAPLEQSVSVEGALHFRTPKACPSTQKANTC

SEQ ID NO: 22811 - protein, 81 aa, Callorhinus ursinus
SPGAVSFADVAVYFSPEEWGCLRPAQRALYRDVMRETYGLLGALGFSGPKPAFISWVEGEVEAWSPEAQDPEGETRAAVIR

SEQ ID NO: 22812 - protein, 81 aa, Callorhinus ursinus
MDSVVFEDVVVDFTQEEWALLNPAQRKLYKDVMLETFRNLVSVDDETQLKTNESISQQDIFGEKLSTEQKIARFTKNDFWT

SEQ ID NO: 22813 - protein, 81 aa, Monodelphis domestica
RPPSQGSITFKDVAVDFTQEEWCLLDPSQKELFRKVMLENVQNLLFVGLPTTRAYLISGSQGEESPWLLVKKDPKISCPGG

SEQ ID NO: 22814 - protein, 81 aa, Monodelphis domestica
SQGPITFKDVAVDFTQDEWGLLEPAQKGLYRDVMLENYRNLVSLGLVLVKPKVISRLERWGEPWRPDGGGRSSGASEMKTA

SEQ ID NO: 22815 - protein, 81 aa, Physeter macrocephalus
SQGLVSFKDVSVNFTQAEGQWLDSAQKILYRDVMLENYSNLVSVGCLISKTDVTSQLEQGEEPWIIEVEFSSQSLPGMESS

SEQ ID NO: 22816 - protein, 81 aa, Monodelphis domestica
EVVTFRDVAVDFTREEWRLLSPPQKELYREVMLENVRNLLSVGETRSEMKVNPREVSLLLEEMDLQRFKSDGLDKFAAVQF

SEQ ID NO: 22817 - protein, 81 aa, Monodelphis domestica
QETLTFKDVAVEFTWEEWRHLDPAQRALHRNVMLENYENLISIEGKIRLEMKEMTAELSLSGDETQRQRCIGDGACDSTWR

SEQ ID NO: 22818 - protein, 81 aa, Physeter macrocephalus
VQELLTLEDVAVEFNWEEWQLLDAAQKDLYRDVMLENFNNLVSLGYQATNPDTLSKLEHGKEPCIIENEIQNRTCPGIGKV

SEQ ID NO: 22819 - protein, 81 aa, Physeter macrocephalus
GVMESVTLEDVAVGLIQEWALLDDAQRNLCRYVLLDNCRTLAPWGTPPCKACLVSQVGPREELVTAERGILCATGVDWESQ

SEQ ID NO: 22820 - protein, 81 aa, Monodelphis domestica
MLENARNLLSVGLAVPRDVISYVEQREAPWRLEQEGLRSCSPGEIRPDMKVTSIDVNLSVDESDQQRLMSGGLAKLPLREF

SEQ ID NO: 22821 - protein, 81 aa, Monodelphis domestica
SQGSIAFKDVAVDFTQEEWCLLSYSQKELYLEVMLENVQNLLSLGLPVPRENFIFCFLQRESPWLLDQKSPRSFCPETDTN

SEQ ID NO: 22822 - protein, 81 aa, Monodelphis domestica
SITFKDVVVDFTQEEWCLLDPSQKELYREVMLENVQNLFFVEAETNFEVKEISTKQSLFVEGSDPPRGMSKSPCDFILRKI

SEQ ID NO: 22823 - protein, 81 aa, Monodelphis domestica
AQEVVTFKDVAVDFTEEEWHLLSPPQKELYKEVMLENAQNLLSVGLPGCPEDVISYLEQKEAPWMLKQEGLRSCCPEGEIR

SEQ ID NO: 22824 - protein, 81 aa, Papio anubis
KVTFEDVAIDFTQEEWAMTDTSKRKLYREAMLENVCHLVSLGEVQISKSYITLQLEQGKELWREGREFLQGQNLDKESALK

SEQ ID NO: 22825 - protein, 81 aa, Aotus trivirgatus
MGPLEFMDVAIEFSLEEWHCLDTAQRNLYRDVMLENYRNLVFLGIVVSKPDLITCLQQGKKPLTVKRHEMIATPPVTYSHF

SEQ ID NO: 22826 - protein, 81 aa, Aotus trivirgatus
KQYDSVAFEDVAVNFTQEEWALLGPSQKSLYRDVMWETIRNLDYIGMKWEDTNTEDQHKNPRRSLRCHIVERFHKSSQISD

SEQ ID NO: 22827 - protein, 81 aa, Aotus trivirgatus
IKGSLTFRDVAIEFSLEEWQCLDTAQQDLYRQVMLENYTNLAFLGIAVSKADLIACLQQEKDPWNMKRHSMVAKPPVLCSH

SEQ ID NO: 22828 - protein, 81 aa, Aotus trivirgatus
MAPLTFRDVTVEFSLEEWQCLDAVQRKLYRDVMLENYRNLAFLGIAVSKPDLITCLEQEKEPWNMKRHEMVAKSSVMCSHF

SEQ ID NO: 22829 - protein, 81 aa, Aotus trivirgatus
SQELLTFKDISIDFTQEEWGQLTPAHQSLYREVMLENYSNLVSVGYQLSKPSVISQLEKGEEPWMTEKEGPGDPSSDLKSN

SEQ ID NO: 22830 - protein, 81 aa, Pan paniscus
EMGLLTFRDIAIEFSLAEWQCLDRAQQNLYRDVMLENYRNLFSLGMTVSKPDLIACLEQNKEPQNIKRNEMAAKHPVTCSH

SEQ ID NO: 22831 - protein, 81 aa, Pan paniscus
AQESVTFEDVAVNFTNREWQCLTYAQRHLYKDVMLENYGNMVSLVLILYHQDLAQKLRVLSLSADKMWPENEKASSQQEIF

SEQ ID NO: 22832 - protein, 81 aa, Lipotes vexillifer
MLETFGLLASVGHWLPKPDVISLLEHEAELWVVDKGAPRGVCTELGLRDISIFLFLLDFETRQTKLSTVKQDITEEIPNNA

SEQ ID NO: 22833 - protein, 81 aa, Callorhinus ursinus
MDPSQRNLHKDVMLENYRNLVSLGLAVSKPDMISHLEDGKGPCVVEREIARTPYPELETKPATKNVSIEDISEDVSQETII

SEQ ID NO: 22834 - protein, 81 aa, Monodelphis domestica
SQGSITFKDVAVDFTQEEWCLLDHSQKELYQEVMLENVHNVLSVGLPVPRENLIFCFQQGLAPWLLEQKGPRISCPDAERC

SEQ ID NO: 22835 - protein, 81 aa, Monodelphis domestica
SQGLITFKDVAVDFTQEEWCLLGYSQKELYLEVMLENVQNLLSLGLPVPRENFIFCFLQRESPWLLDQKSPRSSCPDAETN

SEQ ID NO: 22836 - protein, 81 aa, Monodelphis domestica
SQGLITFKDVAVDFTQEEWCLLDHSQKELYLEVMLENVQNVLSVGLPVPRENLIYCFQQGKTPWLLEQKGPRMSCPELHSL

SEQ ID NO: 22837 - protein, 81 aa, Monodelphis domestica
PQESMTFKDVAVEFTWEEWGHLNPSQKKLYRHVMLENYRNLVSLGFAVSKPDVIYHLERKEAFWRPEADISRNNCPESKEF

SEQ ID NO: 22838 - protein, 81 aa, Physeter macrocephalus
LQETVTFKDVAIDFTEEEWQQLDPAQRNLYRNVMLENYNNLITVGCPFTKPDVIFKLEQEEEPWVVEEEVSKRHCPGEIWG

SEQ ID NO: 22839 - protein, 81 aa, Monodelphis domestica
SQKLLTFQDVAVDFTREEWGLLEPAQKDLFRDVMLESYENFVSLGLPDSKEDVISQLEKTEAPGPPEGEVPGDTYTDFLHE

SEQ ID NO: 22840 - protein, 81 aa, Monodelphis domestica
SEELITFKDVVVDFTKEEWCLLDSSQKELCKEVMLENVQNLLSVGHTLPRENFITCLQQGESPWLPENEGSLHPYVLPLNT

SEQ ID NO: 22841 - protein, 81 aa, Physeter macrocephalus
SQPPVSFKDVAVTFTWEEWGQLDLAQRMLYREVTLETCSHLVSLGLLLSKPDVIARLEQGEDPWRVEQGPPRDWKTTLEKK

SEQ ID NO: 22842 - protein, 81 aa, Monodelphis domestica
SQGSITLKDVTVDFTQEEWHLLDHSQKELYLEVMLENVQNLLAVGLPVPRENFISCFQQGEAPWLLKQECARSSCPEADTN

SEQ ID NO: 22843 - protein, 81 aa, Monodelphis domestica
MTFKDVAVDFTREEWCLLSPPQKELYREVMLENAWNLLFVGLPAPPEDVISSLEQREVPLMLVQEDLRSCCPEEEIRPEMK

SEQ ID NO: 22844 - protein, 81 aa, Monodelphis domestica
YQESMTFKDVAVEFSWEEWGHLNPSQKKLYRHVMLENYRNLVSLGFAVSKPDVIYRLERKEAFWRPEADILRNCPENKEFN

SEQ ID NO: 22845 - protein, 81 aa, Monodelphis domestica
IQAPVTLRDVAVEFTWEEWRHMEPAQRDLYRDVMLDNYENLVFIGIPVSKPDLLFLLKRDVQNQEGKVRSGIYSDPVFEEN

SEQ ID NO: 22846 - protein, 81 aa, Physeter macrocephalus
MTFEDIAVYFSWEEWRLLDEVQRHLYHDVMLENFTLISSLGCCCGAEDAEAPFQRSISISMSQARTPRASSFSQKSHPCKK

SEQ ID NO: 22847 - protein, 81 aa, Physeter macrocephalus
MAAMLLMARRKTEWKLLDLRQRMLYKRVMLENYHHLVSLGFSSSKPHLVSRLERGEGPWVADVHRMGTTTGMQAGDRMKSK

SEQ ID NO: 22848 - protein, 81 aa, Papio anubis
EPVTFKDVAVVFSEEELRLLNLAQRKLYRDVMLENFRNVVSVGEDRHSLTEHCLPLVSLCKNLKEMETLQEVGLRYLSHEE

SEQ ID NO: 22849 - protein, 81 aa, Aotus trivirgatus
YEVSVSFEDVTVDFSREEWQHLDSTQRRLYQDVMLENYSHLLSVGFEVPKPEVIFKLEQGEGPWTLEGETPHHSCSDGKFG

SEQ ID NO: 22850 - protein, 81 aa, Aotus trivirgatus
RRGSVTFKDVTMAFTQKEWEQLDPAQRNLYKDVMLENYSNLASMGCQAPKPDLISKLEKGEAPCLGKGKRLSQGCPSKIAR

SEQ ID NO: 22851 - protein, 81 aa, Aotus trivirgatus
EMGLLTFRDVAIEFSRKEWQCLDTAQQNLYRNVMLENYRNLVFLGIAASKPDLITCLEQGKEPWNVKRHEMVAESPVACSY

SEQ ID NO: 22852 - protein, 81 aa, Aotus trivirgatus
EDVSVNFSQEEWALLAPSQKKLYRDVMQETFKNLASIGKDDIIFSFFFFFEMESFFMRRSSLTRHMRSHTGYELIEKPYKC

SEQ ID NO: 22853 - protein, 81 aa, Aotus trivirgatus
VQESVTFRDVAVFFSPDEWLHLDSAQRALYREVMLENYSSLVSLGILLSKPKVISHLEQGEDPWMVESGVPQGTHLGWESL

SEQ ID NO: 22854 - protein, 81 aa, Aotus trivirgatus
EDVAVNFTQEEWALLDSSQKNLYREVMQETCRNLTDVGNKWKDQNIEDYFKKPGKDIRNHMEQRLCESKEGNQYGEVVSQI

SEQ ID NO: 22855 - protein, 81 aa, Aotus trivirgatus
MGQLTFNDVIIEFSLEEWQRLDKTQRNLYRDVMLENYRNLVFLGIAVSKPDLIACLKQGKEPWNMRRHEMVTKPPAMCSHF

SEQ ID NO: 22856 - protein, 81 aa, Papio anubis
MNMFKEAVTFNDVAVAFTEEELGLKLYRDVMVENFRNLLSVGHQPFKQDVSPIERNEQLWIVTTATQRQRNLALLLYDLAQ

SEQ ID NO: 22857 - protein, 81 aa, Lipotes vexillifer
TQASVSFKDVTVEFTQEEWWQMDSAQRTLYRDVMLENYSHLVSVGHCFTKPELIFMLEQGEDPWLLEKEFVNRSSPEESQP

SEQ ID NO: 22858 - protein, 81 aa, Pteropus vampyrus
HQEVVTFKDVAVYFTQAEWDGLSSAQKALYRSVMLENCGNLTSLGYPVPKPALISLLEGGDLPWGLEAQGDPSAERTTDFC

SEQ ID NO: 22859 - protein, 81 aa, Pteropus vampyrus
MGPAHRTLYRDVMLENCSHFVSMGYCITKPQVIFKLEQGEEPWSLEEEFPNQRFPGYYKVDVHIEGNQEKQEKPLWQVVIF

SEQ ID NO: 22860 - protein, 81 aa, Pteropus vampyrus
QAQEPLTLEDVAVDFTWEEWQLLDPDQKDLYRDVMSENYSNLVSVGYQVSKPDALSRLEQGEPWAVEDEVHSRICPEIQKD

SEQ ID NO: 22861 - protein, 81 aa, Pteropus vampyrus
LQETVTFKDVAVVFTEEELGLLDAAQRKLYRDVTLENFRNLVSVGSQPLKPDLIFQLEREEKLSRVETETQRDGCSGTKNQ

SEQ ID NO: 22862 - protein, 81 aa, Trichechus manatus
MDSVLFEDVAMNFTQEEWALLDFSQRKLYKDVMMETFRNLDSVFQQDKQKTKPTAIESILTEFEKDNNSQKLSMKNDSWSS

SEQ ID NO: 22863 - protein, 81 aa, Trichechus manatus
MDVMLENYCHLVSVGCHMTKPDVILKLERGEEPWTSFAGRAYLEENWKAEDFLMKSKEHQDTYSRSVVFINHKKVIKEKSN

SEQ ID NO: 22864 - protein, 81 aa, Trichechus manatus
SVTIEDVAVVFSQEEWALLDLTQRKLFRDVMMETFRNLASVVSRNLDNGEKLSSEHIMVQFMKNKTWSSMLGDISKLHGNK

SEQ ID NO: 22865 - protein, 81 aa, Zalophus californianus
AQESLTFDDVAVDFTWEEWQLLAPAQKDLYRDVMLENYRNLVSVGFHTSKQDVLSKLDQGEPTWTVEDDIPCQSHSETWKL

SEQ ID NO: 22866 - protein, 81 aa, Zalophus californianus
SVLSQKEQKKNKSQGSISFEDVTVNFTQEEWGQLDPDQRTLYRDVMLENYSIFISLGHCITKPEEILKLEQEGTMGVRERI

SEQ ID NO: 22867 - protein, 81 aa, Zalophus californianus
ESAFVSFHDVAVDFTREEWRLLSHAQRMLYRCVMLENYSNLVSLGTPFPKPTLVILLEQGEEPWKEESEHLLSPCSADAKP

SEQ ID NO: 22868 - protein, 81 aa, Zalophus californianus
WQKSLKFKDVAVKFSKDEWKQLVPTQRDLYREVMLENYQGFVSLGLLVPKPDVIFQLKRGEEPWKLDFQEGEESDVPGSTF

SEQ ID NO: 22869 - protein, 81 aa, Zalophus californianus
MGMAGPVSEGFIQRCHVGELQELGLSISKPNMISLLEQGKEPWMVEKEMSDGQCADWDSWYEIKELSPKWYIDEEEISQGM

SEQ ID NO: 22870 - protein, 81 aa, Zalophus californianus
MQRALYLEVMLENYANITSLAALPFPKPDLILQLEQGGAPWGLDPWTPLEGEALGGVHIGGKNKIEREEQSPRLNISKDSA

SEQ ID NO: 22871 - protein, 81 aa, Zalophus californianus
AREPVTYEDVAVDFTQEEWQHLDPAQKTLHRDVMLEIYSHLVSVGCSGIKPGVIFKLEHEEDPWIIKTELSRWIHSDREKS

SEQ ID NO: 22872 - protein, 81 aa, Zalophus californianus
PKVSRSLENDGVCFSEQEWENLEDWQKELYRNVMKSNYETLVSLTEGVMIKQEIQYAQEGSADLPGEFSGIAEEQAFLSPE

SEQ ID NO: 22873 - protein, 81 aa, Equus caballus
FEGSVSFEDVAVDFTRQEWHRLDPAQRIMHKDVMLENYSNLASVGLCVAKPEMIFKLERGEELWILEEDSSGHGYPGSLSL

SEQ ID NO: 22874 - protein, 81 aa, Equus caballus
MEGLVMFRDVAVDFSQEEWACLDPAQRGLYRDVMLENYHHLVSLGLSLSKPDVISLLEQGKEPWMVSRNMAGGWCPDRLKN

SEQ ID NO: 22875 - protein, 81 aa, Equus caballus
RDSVIFHDVAVYFSWGDWRLLDEAQRRLYLDVMLENFVLISSLGKTWNSLTTPSSQKTHPCQMCGPVLRDIFHLAEQQGTQ

SEQ ID NO: 22876 - protein, 81 aa, Capra hircus
LPLDLFRDVAVVFSQEEWERLAPTQRDLYRDVMLETYSNLVSLGLAISKPDVISFLEQGKEPWTVEEVATGGLCPVLKSRH

SEQ ID NO: 22877 - protein, 81 aa, Chlorocebus sabaeus
CEASLSFEDVTVDFSREEWQQLDPAQRRLYQDVTLELYSHLFSVGYHIPNPDVIFRMLKEKEPCVEEAELSHQRYQEEEFG

SEQ ID NO: 22878 - protein, 81 aa, Lipotes vexillifer
SLDSVSFMDIAIDFSQDEWEWLNLAQRTLYKKVMLENYRNLASLGLCISKPDVISLLEQDKEPWMMKGEITRGLPPDLEYV

SEQ ID NO: 22879 - protein, 81 aa, Lipotes vexillifer
VQESVTFKDVAVLFTQDEWAQLSPAQRALYRDVMLENYSNLVSLGLLGPKPDTFSQLGKGEESMPEDSLGGFCLDWMTTPV

SEQ ID NO: 22880 - protein, 81 aa, Callorhinus ursinus
SYEGSVSFRDVAVDFSREEWQHLDLAQRNLYRDVMLETYSHLLSVGYEVPQPEVFMLEQGKEPWALQGESPHQSCPVTPKH

SEQ ID NO: 22881 - protein, 81 aa, Tursiops truncatus
TSTSVGSQDVAVDFTEKEWPLLDSSQRKLYKDVMLENYSNLASVGCQVSKPSLISHLEQEEELRTEEQELHQGPCPDWETP

SEQ ID NO: 22882 - protein, 81 aa, Tursiops truncatus
MDSVVFEDVAVNFTAEEWALLDLAQRKLYRDVMLETFRNLASVGSCSPVKTSRSSAHWDILETGLCSEEKVVRFTRNDSRS

SEQ ID NO: 22883 - protein, 81 aa, Tursiops truncatus
ELVTFRDVVISFSQEEWEYLDSAQRDLYWDVMMENYSNLVSLDLESKCDKKTLSTEKDIIEKNDSQWEVIESSKLVGLENS

SEQ ID NO: 22884 - protein, 81 aa, Tursiops truncatus
FRGSVMFRDVSINFSQEEWECLDSGQMNLYKEVMLENFSNLVSVGLSSSKPTVISLLEQGKEPWMVDRELTRGLCSDLESM

SEQ ID NO: 22885 - protein, 81 aa, Tursiops truncatus
KDQGSLTLEDVAVDFTWEEWQLLAPAQKDLYRDVMLENYSNLLSVGYQASKPDALSRLERGEPWPVEDEIHSRICPEMRKD

SEQ ID NO: 22886 - protein, 81 aa, Tursiops truncatus
KGCVTFEDVASYFSQEEWGLLDEAQRRLYHKVMLENFLLTASMVCLHGTEKKETHSGQNISLEVLSQVRTPKVGLISQKAH

SEQ ID NO: 22887 - protein, 81 aa, Equus caballus
KSQGSLSFKDVAVVFTWEEWQLLDPIQKNLYQDVMLENYSNLVSVGYQVTKADAVYQLEQGTPWRIEEEIQSQTHPDNTWK

SEQ ID NO: 22888 - protein, 81 aa, Equus caballus
KGRVVFEDVAIYFSQEEWDLLDEAQRRLYCHVMLENFALLSSIGEDEEAPSEQGVSVGVSQVRTPKPGPSIQNAHSCEMCG

SEQ ID NO: 22889 - protein, 81 aa, Equus caballus
SQEQVSFKDVCVDFTQEEWYLLDPAQKILYRDVILENYSHLLSVGYCITKPEVIFKIEQGEEPWILEEGFPGHSHPEDWKV

SEQ ID NO: 22890 - protein, 81 aa, Equus caballus
AQGLMAFEDVAVYFSREEWELLDAAQRALYRHVMLENFSLVASLGLSASRPRVVIQLECGEEPWVLSGMDVTPVRNVQRRP

SEQ ID NO: 22891 - protein, 81 aa, Capra hircus
QSPMAAALRDPAQGSVTFPDVAVYFSWEEWRLLDEAQRRLYLDVMLENYALISSLGSVTFEDVAVNFSWEEWGLLDESHKR

SEQ ID NO: 22892 - protein, 81 aa, Chrysochloris asiatica
LQDSVTFQDVAVDFTEKEWPLLDSSQRKLYKDVMLENYSNLTSVGYQLGKPSLISHLEQEEELRTEEKEAHQAFSQGWEIP

SEQ ID NO: 22893 - protein, 81 aa, Chrysochloris asiatica
LQESLSFEDLSVDFTQKEWQLLDSRQRDLYKDVMLENYSSLVSLGYEVMKPDVIFKLEQGEEPWIVDGEVASSNSPEVWQV

SEQ ID NO: 22894 - protein, 81 aa, Chrysochloris asiatica
GLSSKDTGWPQEKKRKPQIPAPVTFEDITVVFTEAEWVTLSLEQKNLYKEVTLETYRNLLSLGEDVFFSPPSLTQSICIAT

SEQ ID NO: 22895 - protein, 81 aa, Chrysochloris asiatica
VVVEDVTMVFSQEEWTLLDLAQRKLYKDVMMETYRNLASVVSQNLDDEEKVPSDHTEPTMMQFMNDSAWSSTFGELSRSHG

SEQ ID NO: 22896 - protein, 81 aa, Chlorocebus sabaeus
MTFEDVAIYFSQEEWELLDESQRFLYCDVMLENFAHVTSLGYCHGMDNEVIASEQSVSTQVRTSKGDTPTQKSLSEIKMCV

SEQ ID NO: 22897 - protein, 81 aa, Suricata suricatta
KEARVAFRDVAVDFTREEWGLLSPAQRTLHREVMLETYSHLVSLEIPFSKPKLICQLEQGEEPWIEENPHPLGLCPGSKLE

SEQ ID NO: 22898 - protein, 81 aa, Trichechus manatus
SQGLVTFEDVAVYFSLEEWDRLDAGQRDLYKDVMQENYGILVSLGYPIPKPDLIFHLEQGEEPWVPDSPHPEEGDIVTGVY

SEQ ID NO: 22899 - protein, 81 aa, Trichechus manatus
MFFTREEWENLDSAQKYLYRDVMLENYRNLIFLGFQFPKPEVISQLEDWEEPWILDLPSAGNRKASSSACPGSEARYKMKK

SEQ ID NO: 22900 - protein, 81 aa, Trichechus manatus
LTFSDVAVKFTWEEWQLLDPAQKDLFWDVMLENYNNLVSLEIWEVDHLLGHSQNESRVDSMEQCYEHNTLENIVHRHKNHS

SEQ ID NO: 22901 - protein, 81 aa, Trichechus manatus
MLLSDRFSDPFLEAKKWYQASKQDALSMLERGEELWTIEDETHCQTHSEIGKVNDHLQCLLQKQRIQKCMEQCHKHNAFGN

SEQ ID NO: 22902 - protein, 81 aa, Trichechus manatus
SRELVSFKDVTVEFTQEEWQQLDSAQRNLYRDVMLENYSNLVSVGYQSLKSDLIFLLKQEESLMEEGEISSWVYSDFDISP

SEQ ID NO: 22903 - protein, 81 aa, Trichechus manatus
RPRAVRFADVAVYFSPEEWGCLRPMQRALYRDVMRENYGHLGALGCAGPKPALISWLERNTDDWEPAALDPQECPRGITVQ

SEQ ID NO: 22904 - protein, 81 aa, Trichechus manatus
AQVSVTFKDVAILFTRDEWRKLDPSQRSLYRDVMLENYSNLVSLGPPFSKPEVISLLQQGEEPWKVEKEGPAGSSLGWENS

SEQ ID NO: 22905 - protein, 81 aa, Trichechus manatus
AQEFVMFRDVAVFFSQEEWGHLDPAQRALYREVMLENYSNLVSLGIRFSKPKVISQLQQGEDPWMVDRGVPQGACQGWKSL

SEQ ID NO: 22906 - protein, 81 aa, Trichechus manatus
SQALVSFKDVTVEFTQEEWKHMNLAQRTLYRDVMLENYSHLVSVGYCFTKPEVIFKLEQAKDPCLSEEDFLNRSYQEDCQL

SEQ ID NO: 22907 - protein, 81 aa, Trichechus manatus
HKEAVTFEDVAVYFTRTEWAGLSPTQRALYRHVMLENYGNLTFLGYPVPEPSLISLLEGGDLPWGLETQDDPPAERTKDIC

SEQ ID NO: 22908 - protein, 81 aa, Trichechus manatus
EEEPLTFQDVAVYFSQAEGKQLGPHQRALYRDVMLENYGNMASLGFPVPKPDLISQLEQGEELWVLDLLGAEEPEVLRSCR

SEQ ID NO: 22909 - protein, 81 aa, Trichechus manatus
GMSPVTFEDVAVYFSWEEWGLLDAAQRHLYYDVMLENFELMTSLGYWHGIEDEGSSPKQSVSIEGVSQVKIPKADPSTQKA

SEQ ID NO: 22910 - protein, 81 aa, Trichechus manatus
PKVPVTFDDVAVYFSEPEWGQLDEWQKELYKHVMRGNYETLVSLDYAISKPDILTQIERGEEPCCDGQWGQEKQKEMVHPR

SEQ ID NO: 22911 - protein, 81 aa, Trichechus manatus
MLESFRNLVSAGQQPFKSGKISHLEQDKETWVTEREAPADAYPGDKNEKDMEYIQEKELKVLLHKELSYWKLWEQVTGELT

SEQ ID NO: 22912 - protein, 81 aa, Trichechus manatus
AQELLTFDDVAIKFTWEEWQLLDPAQKDLYLDVMLENYSNLVSMGYQANNPVTLSMLERGEELWTTEDEIHSQICPETCRV

SEQ ID NO: 22913 - protein, 81 aa, Trichechus manatus
PQESVTFEDVAVYFTQSQWASLGPLQRALYREVMLENYANVASLVAFPFPKPVLISQLEREEAPLGPDPWETEVLRDICPG

SEQ ID NO: 22914 - protein, 81 aa, Trichechus manatus
DSVVFEDVAMGFSQEEWALLDFSQRKLYKDVMVETFRNLDSVSQQDNNGQKLSIEHILVQFMMNDSWSSMVGEICEFHDSE

SEQ ID NO: 22915 - protein, 81 aa, Zalophus californianus
TQESVVFNDVSIDFSQEEWECLNDDQRDLYRDVMLENYSHLVSMAGHSVSKPDVISFLEQGKEPWLVDRELTRDQWPVLES

SEQ ID NO: 22916 - protein, 81 aa, Equus caballus
MLEHYSLLVSVGHPVSKPDVISKLEQGEDPWIIKRDISNWIYPDENQADGRQDRKSNLENPESCILGSVSFHNKILKGVTK

SEQ ID NO: 22917 - protein, 81 aa, Equus caballus
LPDLVTLEDVAVEFTPDEWALLDPSQRTLYRDVMLENCRNLASLGYHVDKPSLISQLEQEDKVMAEERGILPGTCPDLETV

SEQ ID NO: 22918 - protein, 81 aa, Equus caballus
SWGPFSFTDVFVDFTWEEWRLLDVAQKHLYRSVMLENYSNLVSLGHQHTKPDIILKLERGEELWMMQAQSPSQGRPGKVWE

SEQ ID NO: 22919 - protein, 81 aa, Equus caballus
MLENYSTLVSLGIPFSTPKVICQLQQGEDPCMMEREIPQDTCRGFKTWPEIEAFPPRQDAFIEETARGIMKKKAIKFGHWD

SEQ ID NO: 22920 - protein, 81 aa, Neovison vison
DVAVDFTPEEWQLLDCGQRTLYWNVMLENFRNLISVGGPGTKTKGIFKAEQGQEPWLGEGENPRLCCPEADCLLVDESEKH

SEQ ID NO: 22921 - protein, 81 aa, Loxodonta africana
VAFEDVAVYFSQEEWRLLDMAQRALYHHVMLENFALVASLGKALTSRPRVVVQLERGKEPWVPDGTDTAPSRGGLALVSGG

SEQ ID NO: 22922 - protein, 81 aa, Loxodonta africana
PPGSKGEVPKVPVTFDDVAVYFSEQEWGKLDEWQKELYKHVMRGNYETLVSLDYAISKPDILTQIERGEEPCPEDQWGQEK

SEQ ID NO: 22923 - protein, 81 aa, Capra hircus
SQVSVTFEDVAVLFTRDEWRKLAPPQRNLYQDVMLENYSNLVSLGLLFPKPKVISLLQQGEDPWKVEKENLGGEWVGILCS

SEQ ID NO: 22924 - protein, 81 aa, Capra hircus
PQGSTPFSSVTVDFTHGGWRQLAPAPRDRFEEGMPEKSRNLVLLGLPVSQPGMNSQLEQREGSWMLERDGLRNACPDWKII

SEQ ID NO: 22925 - protein, 81 aa, Capra hircus
WLQGPMSFKDVAVEFTQEEWMMLDSAQRSMYRDVMLENYINLTLVEYQLCKPVISLLGQEDIRTVKSRIPQGTCSDWEIQL

SEQ ID NO: 22926 - protein, 81 aa, Chrysochloris asiatica
SQGVVTFRDVAVDFSQEEWDWLNLSQRDLYRDVMLENYRNLVWLGLSISKPNMISLLEQGKEPWMLEREMSAGQCADWESW

SEQ ID NO: 22927 - protein, 81 aa, Suricata suricatta
GCVTFEDVFVYFSREEWELLEEAQRLLYRDVMLENFALVASLGCWREADEETPEQSVSVSISPLRTHESDLFMQKAHPCDV

SEQ ID NO: 22928 - protein, 81 aa, Suricata suricatta
SQESVTFEDVAVDFTQEEWTLLDGSQRKLFRDVMLENMSHLVSIGKQLYKSDTISHLVKGVHLSREGIGLLQYSEDDLKKQ

SEQ ID NO: 22929 - protein, 81 aa, Suricata suricatta
RSRESLTFQDVAVDFTREEWDQLYPAQKNLYRDVMLENYRNLVALGHQLYKPKVISQLEQEERRMMEGGSPGGTRAGGENR

SEQ ID NO: 22930 - protein, 81 aa, Chrysochloris asiatica
MHSVVIEDVAVVFSQEEWALLDIAQRQIYRDVMMEAFKNLASVKSYIENLCEDIEGNQYGNTFSWIPDLTVVKENAPEASR

SEQ ID NO: 22931 - protein, 81 aa, Chlorocebus sabaeus
DSLVFEEVAVNFTPEEWALLDHAQRSLYRDVMLETCRNLASLDCCIYVRTSGSSSQRDVLGNGISNDEEIVKFTRDYWSIF

SEQ ID NO: 22932 - protein, 81 aa, Suricata suricatta
SQGTVTFRDVAIDFTQEEWQQLDPAQRNLYRNVMLENYNNLITVGCPFTKPDVIFKLEQEEEPWVVKEEVLRRHRPGEVWG

SEQ ID NO: 22933 - protein, 81 aa, Chrysochloris asiatica
MIIEDVAVVFTHEEWDLLDPAQRKLYRDVMMETLRNLASVELTAHKRIHSGEKPYECKQCGKAFRLSLQCSRHMRTHSGER

SEQ ID NO: 22934 - protein, 81 aa, Lipotes vexillifer
KSCSGFSGLCASPVEERYGALISSCNSRTMTDGLVTFRDVAIDFSQEEWEFLDPAQRDLYVDVMLENYSNLVSLGKFICLK

SEQ ID NO: 22935 - protein, 81 aa, Lipotes vexillifer
VTFPDVAVRFSWGEWKLLDEAQRRLYLSVMLDSYALISSLGCCCGAEGEETPCEETVPVGVSQAGSPKAASFSQKTHPCEM

SEQ ID NO: 22936 - protein, 81 aa, Pteropus vampyrus
PEESVTFKDVAVDFTQEEWGQLDSPQRALYRDVMLENYQNLLALAGPPVCKPDVISHLERGEEPWQVPREVPGGAHPEWEP

SEQ ID NO: 22937 - protein, 81 aa, Pteropus vampyrus
TSKETVTFKDVAVTFTKEELRLLNSAQRKLYQDVMLENFRNLVSVGRYPFKHDVFYLEQEKRLWMMTVTQREGKSGGKIQS

SEQ ID NO: 22938 - protein, 81 aa, Pteropus vampyrus
FKVAVTFADVAVSFSREEWRLLDEAQRRLYLAVMLENFALVSSQGCCCGAEDVEASIEPSISHSYLCSVSVFSCTFVVELS

SEQ ID NO: 22939 - protein, 81 aa, Pteropus vampyrus
GSEPVTFEDVTLGFAPEEWGLLDLEHKSLYREVMLENYRNLVSVEHQLSKPDVVSQLEEEEELWSVERGILQDTFSGCPEA

SEQ ID NO: 22940 - protein, 81 aa, Zalophus californianus
DEALMAFRDVAVAFTQKEWKLLSPAQRTLYRDVMLENYSHLVSLEPGTEFRPCGHSCPVTFSSTQFFGQYVLCGHLPQIFP

SEQ ID NO: 22941 - protein, 81 aa, Equus caballus
FQGSVMFSDVSIDFSQEEWEYLDLEQRALYRDVMLENYSNLVSLGCFISKPDVISLLEQGKEPWKVVRKGKRRYPDLETRY

SEQ ID NO: 22942 - protein, 81 aa, Equus caballus
QAELTFEDVAVFLSQEEWGRLDPAQRGLYRDVMLETYRNLVSLGAGPAGPKPGVITQLERGDEPWVLDTQGVEGRERQKVD

SEQ ID NO: 22943 - protein, 81 aa, Equus caballus
SQAPVTFEDMAMYLTREEWRPLDPTQRDLYRDVMQENYGNVVSLDFEIRSENEVNPKQEISEDVEFGTTSERPVENTEENP

SEQ ID NO: 22944 - protein, 81 aa, Equus caballus
SQGPVSFKDVAVDFTREEWQFLDPPQRDLYKDVMLENYINLISVGFQSTKPAVVHKLEQGEEPWIVERKIPSWSYPDEVLQ

SEQ ID NO: 22945 - protein, 81 aa, Equus caballus
DVESLTFDDVAVEFTWEEWQLLAPAQKDLYRDVMLESYNNLVSLGYQASKPDALFKLERGEELWTGEDETPSQTCPEIRKV

SEQ ID NO: 22946 - protein, 81 aa, Equus caballus
AHGLVMFRDVAVDFSQEEWECLKPYQRNLYRDVILENYNNLVSLGWSSSKPDVITLLEQGKEPWMVLRDEEKRWSLDLDSK

SEQ ID NO: 22947 - protein, 81 aa, Equus caballus
LLQEPVTFKDVAVAFTEEELGLLDSTQRQLYQDVMLENFRNLLSVGHQPLKPDISHIEREAKLWMMKTASQVERNFGENNQ

SEQ ID NO: 22948 - protein, 81 aa, Neovison vison
QKELYKHVMRGNYEMLVSLDYAVSKPDILTRMERGEEPCPGGPWGQEEGSRREVAQPRRPSPGVPPRPEHILGPVSPAREE

SEQ ID NO: 22949 - protein, 81 aa, Neovison vison
YSNLVSLESSISKPDMITLLEQEKEPWVVLRRETSGWYPDLESNYGTEKLPSENYTYEINLPKLGIKQISKTLGLKASNFR

SEQ ID NO: 22950 - protein, 81 aa, Capra hircus
MVIEFFPHEWEFLDSLQKKLYCNVMMENYSNLVSLGHSISKPNVITLLEQGKEPWIVVREETRSWCTDLDSRYEITSNGKA

SEQ ID NO: 22951 - protein, 81 aa, Capra hircus
ELEPVTFADVAVLFTPEEWLFLDSSQKSLYRDVMLENYRNVASVAGDQLCKTRMSSRLEQREELCVTERGIFPGEPPQVGE

SEQ ID NO: 22952 - protein, 81 aa, Capra hircus
LGLFTFKDVAVEFTQEEWECLDPTQRALYRDVMLETYRNLLSLGEENISPDISKVSELSSPKEDISKGELCHLMTLEKNET

SEQ ID NO: 22953 - protein, 81 aa, Chlorocebus sabaeus
MLENYRNLVSLGLPFTKPKVISLLQQGEDPWKVEKDSSGDSSLGSKSSHKTTKSTQTQDSSFQGLILKRSNRNVPWDLKLE

SEQ ID NO: 22954 - protein, 81 aa, Chrysochloris asiatica
AQSVVTFEDVAVYFSQDEWRLLNVTARHLYRDVTLENFALIGSLGLAPSRFHVVAQLEGDEELWVPNIVDVTLVSRAEAGR

SEQ ID NO: 22955 - protein, 81 aa, Chrysochloris asiatica
MDVMLENYCHLVSVGCHMTKPDVILKLERGEEPWPSFAGHTYLEENWKAEDFLMKSKEQQDKYSRSVVFINHKKLIKEKGI

SEQ ID NO: 22956 - protein, 81 aa, Chlorocebus sabaeus
MLENYRNLVSLGLPFTKPKVISLLQQGEDPWKVEKDSSVDSSLGCKSTPKMTKSAQTQDSFQEQMRKRLKRVEPWNFIPER

SEQ ID NO: 22957 - protein, 81 aa, Chrysochloris asiatica
KGEPVRFADVAVYFSREEWACLRPVQKALYLDVMRETYGHLLALGFRGSKPALISWVEEEAELWGPNAQDPEAGICLTETD

SEQ ID NO: 22958 - protein, 81 aa, Chrysochloris asiatica
FQGSVTFQDVAVDFTPEEWQLLNYAQRKLYGSVMLENCRNLLSVGCPVTSPKGILKLKQGKKPWMEEGEDPHLSYPEADCL

SEQ ID NO: 22959 - protein, 81 aa, Chlorocebus sabaeus
MLENYNSIVSLGLPVPQPDVIFQLKRGDKPWVVDLHGSEERERPESVSLETKPEIHDASDEKSEGSLRECLGRQSPLCPKF

SEQ ID NO: 22960 - protein, 81 aa, Suricata suricatta
NFWILRLPPGSKGEAPKEWGKLDEWQKELYKHVMRGNYETLVSLDYAISKPEVLSQTEQGKEPCSWRRAAPKVPDVPVDPS

SEQ ID NO: 22961 - protein, 81 aa, Chrysochloris asiatica
AQGMVTFRDVTIEFSQEEWKYLEPTQKDLYRDVTLENFSHLLSLGISISKPDVISLLEQGKEPWILAKNMKEQWCSDLESR

SEQ ID NO: 22962 - protein, 81 aa, Chrysochloris asiatica
KGPPVSFEDVAVDFSREEWQQLDPAQRQLYQEVMMENYSHFLSMGYDLPKPELIFRLDREKEPWMVEVGLPPWSYPDEQFG

SEQ ID NO: 22963 - protein, 81 aa, Aotus trivirgatus
VQEPVTFKDVAVDFTQEEWGQLDLVQRTLYRDVMLETYGHLLSVGNQIAKPEVISLLEQGEEPWSVEQTCPQRSCPEWMRN

SEQ ID NO: 22964 - protein, 81 aa, Sarcophilus harrisii
HQELVTFKDVAVEFTPEEWGHLHSSQKALYRDVMLENYRNLVCLGLAVSKPGVICQLEQGKVPWMPEDDIPRTPYLDWDTT

SEQ ID NO: 22965 - protein, 81 aa, Zalophus californianus
HGPLTFGDIPFYFSREEWGSLDPAQRELFWDIKRENSRNVALALVPEPSGTEEAAPSRLAGAGLQSQSQRSGLGEAVTVLP

SEQ ID NO: 22966 - protein, 81 aa, Zalophus californianus
MLENYSNLVSLGYQDSKPDIIFKLEQEELWMMQAQIPSQGHPEKVWEIDDHMEWHQENEGKLESVAKGYECPTFGKLCLLT

SEQ ID NO: 22967 - protein, 81 aa, Zalophus californianus
QPREAVTFKDVEVTFSQDEWGWLDPAQRNMYRDVMLENYGNVVSLVGPFTKPVLISWLEAREPWGLNVQEAQPKGKPGVAP

SEQ ID NO: 22968 - protein, 81 aa, Equus caballus
DHGLVMFQDVAIDVSQEEWECLNPAQRNLYKDVMLENYSNLVSLDLESKYDTKNLSIEKDITENNSSEWKVTEGSKFLGFE

SEQ ID NO: 22969 - protein, 81 aa, Equus caballus
SCEGSVSFKDVAVDFSREEWQHLDLAQRNLYRDVMLETYSHLLSVGYQVPEPEVFMLEQGKEPWALQGESQHQSCPGEKLW

SEQ ID NO: 22970 - protein, 81 aa, Capra hircus
QERLTSEDVAIEFTPEEWEFLDPAQRALYRDVMLETYRNLLSVDIPPTHVIKHLQPTANSDKLETFQTLMLGSPESCEIKL

SEQ ID NO: 22971 - protein, 81 aa, Capra hircus
VFQGQLTFQDVAIDFTQEEWECLDLSQRELYRDVMLQNYRNLASLGLVSMLDLVAFLEQLKDPRSMRRMETTAIYPAMSPQ

SEQ ID NO: 22972 - protein, 81 aa, Chlorocebus sabaeus
FQELLTFRDVAIEFSPEEWKCLDPAQQNLYRDVMLENYRNLVSLGVAISNPDLVTCLEQRKEPYNVKIRKIVARSPAVCSH

SEQ ID NO: 22973 - protein, 81 aa, Chlorocebus sabaeus
DTVAYKDLSVGYTQKKWKCPALSQRALQWNMMLENDCSMASLAGGNMMESSELIPKQEIFKGSESSNSTSGGLFGVVPGGA

SEQ ID NO: 22974 - protein, 81 aa, Chlorocebus sabaeus
QGSLSFEDVTVGFTQEEWQHLDPAQRTLYRNVMIENYSHLVSVGYCVPKPEVIFKLEQGEQPWILEEELPGQRYPVLEVCK

SEQ ID NO: 22975 - protein, 81 aa, Chlorocebus sabaeus
MYSEPLKQSYLAPVLCYFILTGYCITKPEVIFKIEQGEEPWILEKGFPSQCHPERKWKVDDMLGSNQENEDDHFWELLFHN

SEQ ID NO: 22976 - protein, 81 aa, Suricata suricatta
SQGLVTFRDVAIEFCEEEWGCLTRSQRELYRDVMFENYGHLLFLGLIVSKPDLVIFLEQKKDVWDVRRKETEASCPNSYWS

SEQ ID NO: 22977 - protein, 81 aa, Chlorocebus sabaeus
RGLVTFEDVAVEFTQEEWALLDPAQRTLYRDVMLENCRNLASLEIGCRVNKPSLISQLEQDKKVMTEERGILPSSCPDLET

SEQ ID NO: 22978 - protein, 81 aa, Suricata suricatta
GLLTFRDVAIEFSQEEWGCLNHSQWELYRDVMLETYGHLVFLDLVVSKPDLVIFLEQKRELWNVKRKETVASYPVRVLHVH

SEQ ID NO: 22979 - protein, 81 aa, Suricata suricatta
FQESVTFEDVAVDFTQEEWALLDTSQRKLFRDVMLENIRHLVSLGCQHCQSAVVFQLEHGEELWGEGSRSLRGQGPVLLGR

SEQ ID NO: 22980 - protein, 81 aa, Suricata suricatta
MAHAMMFGDVAVDFSQEEWECLDLEQRHLYRDVMLENYSNMISLGLCIYQPDVFSLLEKGKEPWIFLQDETRGHCPELQSR

SEQ ID NO: 22981 - protein, 81 aa, Chlorocebus sabaeus
FEELVTFEDVFVDFSPEELSSLSAPQRNLYREVMLENYRNLVFLGYQFSKPDIISRLEVEESHAMETDSRHTVICQGEAHD

SEQ ID NO: 22982 - protein, 81 aa, Chlorocebus sabaeus
MLENYRNLVFLGIAVSKPDLITCLEQEKEPWEPMRRHEMVAKPSVMCSHVAQDFWPEQHIKHPFQKVTLRRYKNCGHKNVH

SEQ ID NO: 22983 - protein, 81 aa, Chrysochloris asiatica
KPASASLLPTKIQEEWGLLDPSQKELYWDAMLEKYGTVVSLGMSPPRPEAHTLPRSGVPHAGPGSLPGFHPGNGSGHPHPS

SEQ ID NO: 22984 - protein, 81 aa, Chrysochloris asiatica
DEAFVAFRDVSVDFTQNEWQLLSPAQRTLYKDVMLENYINLSSLGISFSKPKLITQLEQGIAPWIEERECILGPCPAEPKP

SEQ ID NO: 22985 - protein, 81 aa, Suricata suricatta
KVPVTFVDIAVYFSEDEWKNLDEWQKELYNNLVKENYKTLVSLDAEGAAPKPDAPSQAEPREEPCVWEQRDPEEREILMDP

SEQ ID NO: 22986 - protein, 81 aa, Sousa chinensis
VTFEDVAVLFTRDEWRKLAPSQRNLYQDVMLENYSNLVSLAGLPFSKPEVISLLQQGEDPWKVVKESPGGSSLEKLFKCKD

SEQ ID NO: 22987 - protein, 81 aa, Pteropus vampyrus
MLENCGNLTSLGYPVPKPALISLLEGGDLPWGLEAQGDPSAERTTDFCKDAETNTDSESTSTQGVSEDRDVMLSCGLQKSI

SEQ ID NO: 22988 - protein, 81 aa, Pteropus vampyrus
MDVVVFADVAVNFTREEWALLDHTQRRLYRDVMLETCRNLAFVGCYTEVKTFGSFSQRKTLENNIANKEKTVRFTRNDSWS

SEQ ID NO: 22989 - protein, 81 aa, Pteropus vampyrus
WQGWGTFEDVAVYFSREEWELLDEAQRHLYHSVMLENLALVASLGPASPKSCVVAHLEQGKDPWVPDRGDVSPATARETWR

SEQ ID NO: 22990 - protein, 81 aa, Pteropus vampyrus
GPAEGRVTFEDVTVYFSSEEWDLLDEAQRRLYQDVMLENLALITSLAPTPAVMKICRERIRVWSLPVNLKDTTLLAFSLTS

SEQ ID NO: 22991 - protein, 81 aa, Pteropus vampyrus
MLENYGHLVSLAGLNFSKPDLVSFLEQGKEPWLGRGNVRRDLCSVSESNDEIREFSPKNVIYENDSSQYLIKERILSQGPE

SEQ ID NO: 22992 - protein, 81 aa, Pteropus vampyrus
WLTFKDVFIEFSPEEWERLDPAQRALYWDVMAENYRNLLSLGSLTVGFSIKELPPRWDINKDELYHLMILERNDSHVVKNC

SEQ ID NO: 22993 - protein, 81 aa, Pteropus vampyrus
MIVSQISFEDVAVEFTLDEWQLLDPAQKNLHRDVMLENYSNLVLLGCQILKPGAVFKLEQEEPWMINAEVPSQSFAAKGRA

SEQ ID NO: 22994 - protein, 81 aa, Pteropus vampyrus
VTESVTFRDVAVLFSRDEWLCLDPAQRALYREVMLENYSSLVSLGIPLSTPKVICQLQRGKDPCLVEGEACQGACQDFKTW

SEQ ID NO: 22995 - protein, 81 aa, Pteropus vampyrus
KFTSVSFKDVTVGFTQEEWQHLDPTQRSLYRDVMLENYSNLVSVGYCVTKPEVIFRLEQGEEPWILEKELPSQSFSEVWKT

SEQ ID NO: 22996 - protein, 81 aa, Trichechus manatus
MLENYGNLVSMGLRSSKPKLITQLEQGAEPWMEDGDFPSSTCPVQEYWFEAKISALKQNTSEESLLGEQTKSATMERSLDW

SEQ ID NO: 22997 - protein, 81 aa, Trichechus manatus
SEDLVTFGDVAVDFSQEEWEWLNPAQKTLYRKVMLENYRSLVSLGASLSKPDVISLLEQGKEPWTVKKQGTRGICPDWEYV

SEQ ID NO: 22998 - protein, 81 aa, Trichechus manatus
MLENYSHLVSVGYCVTKPEVIFMLEQGDEPWILEEESPCHIHPDFHILDDQMEKSQENQDQHLCKIDFINNKTLTKGRNST

SEQ ID NO: 22999 - protein, 81 aa, Trichechus manatus
LLTFRDVAIEFSQEEWECLDPAQRALYKDVMLENYRNLISLDISYRCMLQELSPNENIIKEELFPAVMFEGHESHGIENFD

SEQ ID NO: 23000 - protein, 81 aa, Trichechus manatus
TGKALMEPTQGSVNFEDVAVYFSQEEWGLLDEAQKLLFCDVMLENFAIIASLGSWHGTEDEETSSKQNVSVEIQIPGKNEY

SEQ ID NO: 23001 - protein, 81 aa, Trichechus manatus
SQGLVSFKDVAVDFTQEEWQQLDPAQRTLYRDVMLENYSHLVSMGYPVSKPDVISKLEQGEDPWIIKKDISNWIYPDENQA

SEQ ID NO: 23002 - protein, 81 aa, Zalophus californianus
AQGSMVFSDVSIDFSQEEWECLDPGQRDLYRDVMLENYSNLLSMGLYIPKPQVISLLEQGKEPWMVGRELTRGLCSDLESM

SEQ ID NO: 23003 - protein, 81 aa, Zalophus californianus
MNTSQASVSFKDVTVEFTQEEWQQMGPIQRTLYRDVMLENYNNLVSVVIFKLEQGEEPWFLEEEFSNQSHREDYRDDDLLK

SEQ ID NO: 23004 - protein, 81 aa, Zalophus californianus
RDWGTFEDVAVYFSREEWELLDETQRHLYHDVMLENLALVASLGCWCGVEEAPLEQSVSVEGALHFRTPKACPSTQKANTC

SEQ ID NO: 23005 - protein, 81 aa, Zalophus californianus
DEALMAFRDVAVAFTQKEWKLLSPAQRTLYRDVMLENYSHLVSLGIAFSKPKLITQLEQGDEPWREESECLPDLCPAEPGT

SEQ ID NO: 23006 - protein, 81 aa, Equus caballus
TQDCVTFEDVAIDFSQEEWGILDEAQRRLYHDTVLENFALIASLVCWHGTENEETPFEQSVSVEALSQIRTPKVGPATQKA

SEQ ID NO: 23007 - protein, 81 aa, Equus caballus
GWVPALFDEVAIYFSDEEWEVLTEQQKALYREVMRMNYETVLSLEFPFPKPDMITRLEGEESQNPDEWQLQGGSFAENEDS

SEQ ID NO: 23008 - protein, 81 aa, Equus caballus
FQGSLSIEDVTVGFTQEEWQHLDPAQRTLYRDVMLENYSHLVSVGYCIPKPEVIFKLERGEQLWILEEESSSQSHPEVCKV

SEQ ID NO: 23009 - protein, 81 aa, Neovison vison
QQVPVTLEDMAAYLSQEEWESPDPAQRDCSWDALPEHRGLGLQLDGEDAREDMSMRRERDREPAGVMTRPEQPLERAGPRR

SEQ ID NO: 23010 - protein, 81 aa, Chrysochloris asiatica
SVFLQKGPPLTLEDVAMYSQAEGQQLGALYRDVMLDNNSLGFPVPKLELITQLEHREEMWVLNLLGAERLEVLRCCRTDED

SEQ ID NO: 23011 - protein, 81 aa, Suricata suricatta
MAHMAFRDVAVDFSQEEWMLLSPAQRSLYREVMLENYSNLVSLGIPFSKPKLITQLEQGKETWREEGKCPPGTCPAEPKPE

SEQ ID NO: 23012 - protein, 81 aa, Suricata suricatta
AQASVSFKDVTVDFSREEWQHLDPAQKTLYVDVMLENYCHLISVGCHMTKPDVILKLERGEEPWTSFTGHTCLEENWKDED

SEQ ID NO: 23013 - protein, 81 aa, Mandrillus leucophaeus
VGLQFQGSVTFEDVAIAFSQQEGLYRDVMLENYRNLVSMAGHSLSKPHVIALLERWKEPKVTERKDGRRWCTDLQLEDDTI

SEQ ID NO: 23014 - protein, 81 aa, Lipotes vexillifer
LQESLLFEDVAVEFTREEWRLLDPAQKDLYQDVMLENYSNLLSVGYQSPKPIHIFRLKQRDKPWLEKENIHGQNFPEVGEI

SEQ ID NO: 23015 - protein, 81 aa, Lipotes vexillifer
TQGLVTFRDVAIEFSQEEWKCLEPAQKDLYKDVTLENFSNLVSLGLSLPKPDVISLLEQGKEPWMVINDMTGPWCPDLESR

SEQ ID NO: 23016 - protein, 81 aa, Lipotes vexillifer
PQKSVTFEDVAVYFTQAEWDGLSPAQRALYRDVMLENYGNVASLGFPLLKPTVISQLEGGGELEGPSPLASGTGTGPQGLW

SEQ ID NO: 23017 - protein, 81 aa, Lipotes vexillifer
GVMESVTLEDVAVGLIQEWALLDDARRNLCRYVLLDNCRTLAPRGTPFCKACLVSQVGPREELMTAERGILCATGVDWESQ

SEQ ID NO: 23018 - protein, 81 aa, Trichechus manatus
SLSFEDVSLDFTWEEWQLLDSAQKNLYRNVMLENFSSLVSLEYWNIDDYVAWHQELQDKLKRLEKDHGSNASGKLFQSGMN

SEQ ID NO: 23019 - protein, 81 aa, Equus caballus
SQGLVTFEDVAVYFSLEEWERLDAAQRDLYKEVMQENYGILVSLGYPIPKPDLIFRLEQGEEPWVPDSPRPEEGDIVTGVY

SEQ ID NO: 23020 - protein, 81 aa, Equus caballus
SLGSVSFKDVTVDFSREEWQQLDLAQKSLYRDVTLENYFNLLSVGCQVPKPEIVFHLEHGEEPCLLDGEISSQSCLGGNIG

SEQ ID NO: 23021 - protein, 81 aa, Equus caballus
AQESVTFKDVAVLFTWDEWAQLSPAQRALHREVMLENYSTLVSLGLLGPEPDMLSQLGKGGVWMPEDASRCLCLDWITMPV

SEQ ID NO: 23022 - protein, 81 aa, Equus caballus
ADSVIFHDVAVYFSWGDWRLLDEAQRRLYLDVMLENFVLISSLGKTWNSLTKFYVWDRMDITAAMAGWAQRGPALLSGSWG

SEQ ID NO: 23023 - protein, 81 aa, Neovison vison
YQNLVSVGLSFRRPNVITLLEKGRAPWMVEPVRKRRGVDSGSKCETKKLLPNLCNKSGQSIYQKPVSASQKVPSGKRGCKR

SEQ ID NO: 23024 - protein, 81 aa, Capra hircus
HLTFKDVAIKFSQEEWECLDPAQRTLYRDVMLETYRNLLSVAVSHIHVIKKLKPKANRDTGVFQRVMLGRYESHEIRDFYF

SEQ ID NO: 23025 - protein, 81 aa, Chrysochloris asiatica
RNESVTFKDVAVLFSQDEWEHLNSAQRALYKDVMLENYSNLVSVGLIVPKPDMFSQTRKGEEWMLEDASGGSCLGKIHTYD

SEQ ID NO: 23026 - protein, 81 aa, Chlorocebus sabaeus
MGLLTFRDVAIEFSLEEWRRLDAAQQNLYRNVMLENYRNLVFLGIAVSKPDLITCLEQGKEPWNMKRHEMVDKPPDICPHF

SEQ ID NO: 23027 - protein, 81 aa, Chlorocebus sabaeus
SQESLTFQDVAVDFTKEEWDQLYPAQKNLYRDVMLENYRNLVALGIGYQLYKPEVIAQLELEEEWVIERDSLLDTHPDGEN

SEQ ID NO: 23028 - protein, 81 aa, Suricata suricatta
AHHLVMFRDVAVDFSQDEWECLNSYQRNLYRDVILENYSNLVSVAGCSISKPDVITLLEQGREPWMVVRDERRRRTLDLES

SEQ ID NO: 23029 - protein, 81 aa, Chlorocebus sabaeus
VTFEDVTIIFTWEEWKFLDSSQKRLYREVMWENYTNVMSVENCNKSYTSQEEKFRYLEYENFSCWQGWWNAGAQMCENQNY

SEQ ID NO: 23030 - protein, 81 aa, Suricata suricatta
QSPVVFEDVAIHFSQEEWGLLDGAQRLLYRAVMLENLALLSSLGCWHGARGEELSQVRTPQPGPSVQEAQPCETCGPVWKH

SEQ ID NO: 23031 - protein, 81 aa, Chrysochloris asiatica
EPFTLDDVTVKFTQEEWNCLDASQKALYRDVMLETFKNLASIGDKEYEEPREWRLCLRDRTGGNKVSPAGEGAGPQSPRSS

SEQ ID NO: 23032 - protein, 81 aa, Suricata suricatta
MLENYRNLVSLGLCISKPDVISLLERGEDPWMVKGDVTGGLCPDVEYVWMTQESSPKQEIYEGKLSEAVMLERLPSCDLTC

SEQ ID NO: 23033 - protein, 81 aa, Suricata suricatta
RPRAVKFADVAVYFSTEEWGCLRPAQRALYRDVMRETYGHLGALGFPGPKPALISWMEQESEESEAWSPAAKDPEEGESLG

SEQ ID NO: 23034 - protein, 81 aa, Suricata suricatta
AQESLTLEDVDVVFSREEWQLLGPAQKDLYRDVMLENYRNLMSVGWQTAKPDALSKLEHRDETWMTKDKIQDRTWAGIGKV

SEQ ID NO: 23035 - protein, 81 aa, Chlorocebus sabaeus
MLENYRNLVFLGICLPDLSIISMLEQRRDPRNLQSEVKIANNPDGRECIKGVNTESSSKLGSNTENKSLKNQLGLTFQLHL

SEQ ID NO: 23036 - protein, 81 aa, Chrysochloris asiatica
MGIEDVAVVFSPEEWALLDPAQRELYRDVMMETFTNLASVVSYNLSDKEKWPSEPTVLRSMKNNPWSSLLPEISDCPLTND

SEQ ID NO: 23037 - protein, 81 aa, Chlorocebus sabaeus
QESVTFKDVAVDFTLEEWGWLEPGQRELYRDVMLENYRNLLSLGAGLPGSKPDVISRLERGEEPRPEEREAWRVTCPDLET

SEQ ID NO: 23038 - protein, 81 aa, Suricata suricatta
CWGLLSFKDVSVEFTRDEWQLLDSAQKHLYRDVVLENYSHLVSVGYHGTKPDLIFKLEQGQEPWIINARVSRQSYPENWED

SEQ ID NO: 23039 - protein, 81 aa, Suricata suricatta
SQGQLTFQDVAVEFSQEEWECLNHSQRELYADVILETYGHLLFLGLLVSKPDLVIFLGHEQELRGVKRQETVASHPAVSSH

SEQ ID NO: 23040 - protein, 81 aa, Chrysochloris asiatica
FQEAVTFKDVAVVFSEEELRLLDSTQKKLYQDVMLETFWNLLSVEDKHQTKNKIETLERLRYHLYEELSCSVIWEKVVREL

SEQ ID NO: 23041 - protein, 81 aa, Chlorocebus sabaeus
SFQGSVTFQDVAINFSKEEWGFLNPAQRDLYTTVMLENYQNLVWLGLSVSKSVISLLEKRKLPWIMGKEEIRVPLPDAPGA

SEQ ID NO: 23042 - protein, 81 aa, Suricata suricatta
MAHGSVTFRDVAIDFSQEEWEFLDSAQRDLYRDVMWENYSNFISLEPSISKPDVIEGKEPWMVVREGTRRHCPDLESRYRT

SEQ ID NO: 23043 - protein, 81 aa, Suricata suricatta
RLLTFRDVAIKFSQEEWGCLKHSQGELYRDVMLENYGHLLFLGSPTGFGIKELSPTEDINKGEFYHVVILERNESHGIKDF

SEQ ID NO: 23044 - protein, 81 aa, Lipotes vexillifer
EEGRVTFEDVAVYFSQEEWGLLDKAQRLLYYSVMLENFSLMASLGLTSSRTQEVTQLEQWGEPFVPACGVVITATPRGCWC

SEQ ID NO: 23045 - protein, 81 aa, Lipotes vexillifer
TQEPVVFEDVAVAFTQEEWALLDLAQRNLYRDVMLENFQNLASLGYPLHTPYLISQWKQEEDLEIAERGPTQGEHQEGFEA

SEQ ID NO: 23046 - protein, 81 aa, Lipotes vexillifer
VAESVVFEDVAVDFTPEEWALLDPAQRNLYRDVMLETFRNLASVETHTVEKPYACKECEKSFSSPSSLRKHARMHTGEKAY

SEQ ID NO: 23047 - protein, 81 aa, Callorhinus ursinus
AHHLVMFRDVAVDFSKEEWECLNSYQRNLYRDVILENYSNLVSVGCSISKPDVITLLEQGKEPWMVVRDERRRRSLDLESR

SEQ ID NO: 23048 - protein, 81 aa, Trichechus manatus
QGCVTFEDVAIYFSQEEWGLLDEAQRILYSDVMLENFTIIASLGHWHEMEEEETSSEQNVSIEGVSQTGPSTQKTHSWEMC

SEQ ID NO: 23049 - protein, 81 aa, Trichechus manatus
HPESLTFEDVAVYFSENEWTSLAPAQRALYRDVMLENYGAVASLAAFPFPKPALISQLEQGEIPWCLAPQGALDGKGPRGI

SEQ ID NO: 23050 - protein, 81 aa, Trichechus manatus
LQEPVTFRDVAVDFTREEWGQLDPAQRTLYRDVMLETFGHLVDVGPELPKPDVISQLEQGAELWVAERGLAQGCCPGWETR

SEQ ID NO: 23051 - protein, 81 aa, Trichechus manatus
PKVPVSFEDVAVYFTKTEWKLLDLRQRIFYKRVMLENYSHLVSLGFSFSKPHLVSQLERGEAPWVTNTDRMETGGISGGDR

SEQ ID NO: 23052 - protein, 81 aa, Zalophus californianus
IEEARMVAGLLMDSSQEEWTLLDQTQRDLYRDVMLENYQNLIILGCESCKPDLNSSMGGAEELRTGGRGILQELDLQLKTK

SEQ ID NO: 23053 - protein, 81 aa, Loxodonta africana
GWVPALFDEVAIYFSDEEWEVLTEQQKALYREVMRMNYETVLSLEFPFPKPDMITRLEGEEESQKSNEWQLQGGPFPENED

SEQ ID NO: 23054 - protein, 81 aa, Loxodonta africana
VSFRDVAVNFTREEWQQLDSDEKIIYRDVMLENYSHLISLGFDITKPDVIIKLEQGEEPWIVEGEVPCQRHVKEAWKVDDL

SEQ ID NO: 23055 - protein, 81 aa, Capra hircus
SRSLENDGVCFSEQEWENLEDWQKELYANVMKSNYETLVSLKVLGQPEGEMELGAEMPGDLEEEESRGVHPAEEVVAKQET

SEQ ID NO: 23056 - protein, 81 aa, Pteropus vampyrus
MRLSAHSGFGEMAVFSLLLREEPCLCRCCQARKPDTLSRLDQGEPPWTLADRVYSRTRSGIRKVDDHELEHFQDGSLENNL

SEQ ID NO: 23057 - protein, 81 aa, Trichechus manatus
FMEAVTFKDVAVVFTEDELGLLDPAQKKLYRDVMVETFRNLVSVGDKNPRQVETVLQAGAHEDLSSLHIWQQIASDLTRCQ

SEQ ID NO: 23058 - protein, 81 aa, Trichechus manatus
GTGLLTFRDVAIEFSQQDWECLDPAQRALYRDVMLENYRNLVSLGISPSEMNIISILKKDTEPWTVEKKKTAKNPGMWEYI

SEQ ID NO: 23059 - protein, 81 aa, Trichechus manatus
PVTFEDVTVVFTEAEWKRLSSEQKNLYKEVMVEIYRNLLSLAELKRELYPCSSCLLAVSCQQFLSQHVLQIFPGLRAENHF

SEQ ID NO: 23060 - protein, 81 aa, Trichechus manatus
REAFVAFGDLAVDFTQEEWWLLSPAQRTLYREVMLETCNHLVSLGIPFSKPKLITQLEHREEPRRGERKHLLDPCLGGSKP

SEQ ID NO: 23061 - protein, 81 aa, Trichechus manatus
KQGQVTFKDLFVYFSQDEWGLLDEAQRLLYRDVMLDNLALMASLGHSPSMSQVVAPLELGREPWVPGWADRTPAVTREAQH

SEQ ID NO: 23062 - protein, 81 aa, Trichechus manatus
DSVTGADVAVDFTQEEWALLDLSQRKLYREVMTETFRNLASVGEIYKLHGVEEQDDNQKTHVSMQPVFNRRHMVENLCESY

SEQ ID NO: 23063 - protein, 81 aa, Trichechus manatus
SQRLLTFRDVAIEFSQEEWDYLDPAQRTLYRDVMLENYRNLVSLGISPSEINIISILKKGTEPWTVEKETKLAKNPDVFST

SEQ ID NO: 23064 - protein, 81 aa, Trichechus manatus
DSVVIEDVAVIFSQEEWALLDLTQRKLYRDVMLETFRNLASVVSRNLDGERLSSEHIMVQFMKSNTWSYVLGKISKSYGSK

SEQ ID NO: 23065 - protein, 81 aa, Trichechus manatus
VKEAVTFKDVAIDFTLEEWRLMDPTQRNLHKDVMLENYRNLVSLGLAVSKPDMISHLEDGKGPWVVVREISRAPYPELETK

SEQ ID NO: 23066 - protein, 81 aa, Trichechus manatus
LQEAVTFKDVAVVFTEEELGLLDSTQRTLYRDVMLENFRNLVSLGHQSFKPDVISQLEREEKLWLKKLQTQRGRRSGGRSQ

SEQ ID NO: 23067 - protein, 81 aa, Zalophus californianus
LFQGSLSFKDVAVVFTWEEWQLLDPIQKNLYQDVMLENYSNLVSLGYQITKADAFYQLEHGTPWITEEEIQSQIYPEDTWQ

SEQ ID NO: 23068 - protein, 81 aa, Equus caballus
WSQMPVTFEDVALYLSREEWGRLDHTQQSFYGDVLQKRNGLSLGFPFGRPVWASQVQGKGEASSSCRQTDEEEKRGAIEVG

SEQ ID NO: 23069 - protein, 81 aa, Equus caballus
WALLDPSQKKLYRDVMWETFRHLASVGKNEDIPSQKPYECKICSKAFSYITSLTTHERSHTGAKPYECKCGKAFASSRSLQ

SEQ ID NO: 23070 - protein, 81 aa, Equus caballus
PHRLVLFRDVAVDFSQEEWACLDSEQKDLYRDVMLENYSNLVSLGFSSSKADMLSLLEQGKEPWKVVQDVARSQSSDLGSR

SEQ ID NO: 23071 - protein, 81 aa, Equus caballus
MYFSQEEWELLDPTQKALYNDVMQENYETLISLALFVLPKPKVISCLEQGEDPWVQGSPEFNDRPRELPTGLKLKNNTENQ

SEQ ID NO: 23072 - protein, 81 aa, Neovison vison
VMRGNYETLVSLDYAISKPEVLSQTEPGKEPCSWRRPGPKVPDVPVDPSPGSGPPVPAPDLLMQIKQEGELQLQEQQALGV

SEQ ID NO: 23073 - protein, 81 aa, Loxodonta africana
QSLVTFGDVAVIFSQDEWEWLNPAQRSLYRNVMLENYRSLVSLGLCISKPDIISLLEQGKEPWIMKRKMTQGQGPDLKPLQ

SEQ ID NO: 23074 - protein, 81 aa, Capra hircus
SQVSVTFEDVAVLFTRDEWRKLAPPQRNLYQDVMLENYSNLVSLAGLLFPKPKVISLLQQGEDPWKVEKENLGGSSLGWKN

SEQ ID NO: 23075 - protein, 81 aa, Capra hircus
PQESVTFEDVAVNFSHEEWQCLTHAQRHLYKDVMLENYGNMVSLGFSFSKPPLISCLEQGAESYVQDQQDWEFLSCSYPVS

SEQ ID NO: 23076 - protein, 81 aa, Capra hircus
LFQSLSFRDVAVDFTQEEWQHLDPEQKTTYRDVMLENYSHLISVGCHIIKPEVITKLEQGEEPWVVEGEFLLQIHDLMEGR

SEQ ID NO: 23077 - protein, 81 aa, Capra hircus
PHRLVLFKDVAIDFSQEEWAYLDLEQKDLYRDVMLENYSNLVSVGVSISKLDVLSLLEQGKEPWKVVQEVTRDLSPDWESR

SEQ ID NO: 23078 - protein, 81 aa, Capra hircus
EQLTFKDVAVEFSQEEWECLDPAQRAFYMDVMVETLRNLISVDISHIHVVKKLQPIARSDRGDAFQTMTLERQESPEMKYF

SEQ ID NO: 23079 - protein, 81 aa, Chrysochloris asiatica
RSQESVTFQDVAVDFTQEEWEQLDPAQKSLYRDVTLENYRNLAALGHQLYKPEVITHLEQEEQWMMESKNLPVTHPDVENR

SEQ ID NO: 23080 - protein, 81 aa, Chlorocebus sabaeus
QEPLTFRDVAIEFSPEEWKCLDPAQQNLYRDVMLENYRNLVSLAMCSHFTQDFLPVQGIEDSFHKCILRRYEKCGHENLQL

SEQ ID NO: 23081 - protein, 81 aa, Suricata suricatta
WSLLDEAQRRLYYDVMLENFTLVSSLGKALPVPRGPDWAFLCPDQCHICGLESDYVCSGCAKSFNHSEVLITRSVQTLERP

SEQ ID NO: 23082 - protein, 81 aa, Chrysochloris asiatica
PVTFEDVTVVFTEAEWKRLSSEQKNLYREVMLEIYRNLLSLAEPKPETYHCFSCLLAFSCQQFLSQHVLQIFPSLCAEHLF

SEQ ID NO: 23083 - protein, 81 aa, Suricata suricatta
SQGLLTFRDVAVKFSQEEWGCLNHSQWELYRDVMLETYGHLVFLGLVVSMPDLVIFLEQKRELWDVKRKETVASYPRIALN

SEQ ID NO: 23084 - protein, 81 aa, Lipotes vexillifer
MDFTLEDWEQLGLDQGDLFWDTALDNYQNLFLADPPRPNLPSHPDDGEELAALAKGSPESTDPDTAEGKTSPLPEDFLEEG

SEQ ID NO: 23085 - protein, 81 aa, Pteropus vampyrus
MLETCGFLVSLGQLVPIPELIYFLEPWQTLWTVKRDLSKSTCTGEKAKLETKEPPASQLAFTEEAAFKEGVTQRASRDSRL

SEQ ID NO: 23086 - protein, 81 aa, Pteropus vampyrus
GSVTFEDVAVYFSWEEWDLLDEAQRRLHQDVMLENLALMTSLGWWCGAEDEAPEQSISVGRMSQVRISEAGLSSQMAHPCG

SEQ ID NO: 23087 - protein, 81 aa, Pteropus vampyrus
LTLEDVAVDFTWEEWQLLAPAQKDLYWDVMSENYSNLVSVVPLHFPQAGYEVSKPDVLSKLERGEEPWTIEHEIHSPVCPE

SEQ ID NO: 23088 - protein, 81 aa, Pteropus vampyrus
CVTFEDVAIYFSREEWGLLDEAQRFLYRDVMLENFALTTSLDCWYGAKDEETPSEQRVSVEQESQARTPKACPSTQKTHPC

SEQ ID NO: 23089 - protein, 81 aa, Trichechus manatus
MPVTFEDVALYLSREEWGRLDHAQQNFYRGTHTGAKPHKCPVCSKCFTHSSALVSHQRTHTGVKPYPCPECGKCFSQRSNL

SEQ ID NO: 23090 - protein, 81 aa, Trichechus manatus
SVAVEDVAVDFTQEEWALLDLSQRQLYSDVMMEIFRSLASVASRNLIDGEKLSTENIIVRFMKNDTWSLMVGEICKLHGIE

SEQ ID NO: 23091 - protein, 81 aa, Trichechus manatus
MDSVVFEDVAVEFTQEEWALLDFSQKKLYRDVMMETFSNLDSGEICEFHGSIHQYNNQGRHLKTCTVESLYENKDGKVNKG

SEQ ID NO: 23092 - protein, 81 aa, Trichechus manatus
GLVTFADVAIDFSQEEWACLDTAQRDLYWDVMLENYSNLVSLDLVSTYETESLPTEKNIYEISFSQWNAHRKSKSTGLDWK

SEQ ID NO: 23093 - protein, 81 aa, Trichechus manatus
SLVFEDVAVCFTQEEWALLDFSQRNLYRDVMMETFRNLDSVSQQDNNGEKFSSEHTVVRLMKNDSWSSMSGEIFEFRGNEN

SEQ ID NO: 23094 - protein, 81 aa, Zalophus californianus
YQEVVTFEDVAVYFTRTEWAGLSPAQRALYREVMLTNYGNLTSLGYPVCRLALISLLEGGDLPWGLEPQDDLPAENTSDVS

SEQ ID NO: 23095 - protein, 81 aa, Zalophus californianus
EPRPELRPQGELAAAGWCLGPEGGQLTFRDVAIEFSQEEWECLDPAQRELYKDVMVENYRNLVSLDVSYTCDQEITTKGEQ

SEQ ID NO: 23096 - protein, 81 aa, Zalophus californianus
MQENYGILVSLGYPIPKPDLIFRLEQGEEPWVPDSPRPDEGDIVTGVYTGAWFWTDDLDDHEEDDDEDFLAEVAEEENEPP

SEQ ID NO: 23097 - protein, 81 aa, Equus caballus
FQGSVSFKDVTVGFTQEEWQHLDSTQRSLYRDVMLENYSNLVSVGYCVTKPEVIFRLEQGEEPWISEEEFPSQVFPVWKSD

SEQ ID NO: 23098 - protein, 81 aa, Equus caballus
MHLTNFSNVLKPKQLNPNLPLSGCHMTKPEVILKLERGEEPWTSFTGHTCLEENWKAEDFLVKFKEHQDKYSRSVVFINQK

SEQ ID NO: 23099 - protein, 81 aa, Equus caballus
RSQESLTFQDVAVDFTREEWDQLYPAQKNLYRDVMLENYRNLVTLGHQLYKPEVIIQLEQEEQWMMERDSPPDTPPDGENR

SEQ ID NO: 23100 - protein, 81 aa, Equus caballus
IYGLVSFEDVAVHFTWEEWQDLDDAQRTLYKDVMLETYSSLASLGHCITKPEVIVKLEQDAEPWTVEAPPNQNLPGGSMRA

SEQ ID NO: 23101 - protein, 81 aa, Chrysochloris asiatica
VQRSLTLEDVDVNFTWEEWQLLDSAQKDLYRDVMLENYNNLVLMGYQGSKPDAFSKREQGEEPWITEDEIHPIVCPEIKKG

SEQ ID NO: 23102 - protein, 81 aa, Chrysochloris asiatica
EPVTFEDVNVVFTKAEWKRLSAEQKKLYREVMLDTYRNLLSLGKVMKELKMLRFGADSYREDGADCGLKADFITNQRSVFW

SEQ ID NO: 23103 - protein, 81 aa, Suricata suricatta
CQGLVVFTDVAVHFSQEEWGLLDEAQRRLYCGVMLETFALVSSLGCWHGAQDEEASSEHGVSVRASQVRMPQPGPSVQEAQ

SEQ ID NO: 23104 - protein, 81 aa, Suricata suricatta
PQKSVTFEDVAVYFTQTEWDGLSPAQRALYRDVMLENYGNVASLGFSLLKPAVILQLEGAGELGDPSLLVAGTEVGSQGVW

SEQ ID NO: 23105 - protein, 81 aa, Chrysochloris asiatica
KQGQVTFEDVFVYFSPEEWGLLDEAQRLLYRDVMLDNFALMDSLGKALALTPVSVNWTLPFPSSWRRPAGCKDGGTSGQLT

SEQ ID NO: 23106 - protein, 81 aa, Chlorocebus sabaeus
FQGSVSFRDVTVGFTQEEWQNLDPAHRTLYRDVMLENYSHLVSVGYCIPKPEVILKLEKGEEPWILEEKFPSQRHLELINT

SEQ ID NO: 23107 - protein, 81 aa, Sarcophilus harrisii
VPALVTFRDVAVDFTQEEWRHLEPAQRALHRDVMLENFQNLVSVGLPVSKVDVISLLERGEAPWQPEGGGPPDPCYDYLNW

SEQ ID NO: 23108 - protein, 81 aa, Sarcophilus harrisii
PKVPVTFDDVSIYFSTPEWEKLEEWQKELYKNIMKGNYESLISMDYAMTQPEVLSQTHPESEQNTENQARPDENEMAAEPS

SEQ ID NO: 23109 - protein, 81 aa, Pan paniscus
AQESLTLEDVAVDFTWEEWQFLSPAQKNLYRDVMLENYSNLVAVGYQAGKPDALTKLEQGEPLWTLEDEIHSPAHPEIEKA

SEQ ID NO: 23110 - protein, 81 aa, Lipotes vexillifer
AQGKVNFEDVFVYFSQEEWGLLDEAQRLLYREVMLENFALMASLGYASSMFHGIAPLELDSEPWLSEWANMTPAMTREAQG

SEQ ID NO: 23111 - protein, 81 aa, Lipotes vexillifer
MLENYQNVLSLGLPESKPDVISRLERGEEPRMERREAWRVTCSDTFMILKATGHLFQEAFPDFQAERPFNCTECGKAFIYH

SEQ ID NO: 23112 - protein, 81 aa, Lipotes vexillifer
MAFKDVAVAFTQKEWKLLSPAQRTLYRDVMLENYSHMVSLGIAFPKPKLIIQLEQGDEPWREESESLLDLCPEPRTEFQPH

SEQ ID NO: 23113 - protein, 81 aa, Pan paniscus
GTVTFEDVAVKFTQEEWNLLSEAQRCLYRDVTLENLALMSSLGCWCGVEDEAAPSKQSIYIQRETQVRTPMASVSPKKAHP

SEQ ID NO: 23114 - protein, 81 aa, Pan paniscus
PVTSEDVAVLFIEAEWKRLRLEQRNLYKEVMLENLTESKPEVHTCPCCPLAFGSPQFLNQDELHNHPIPGFHAGNQLHPGN

SEQ ID NO: 23115 - protein, 81 aa, Lipotes vexillifer
DHSLVSFKDVAIDFSQEEWECLDLEQKDLYRDVMLENYSNLVSLGFSISKPDVLSLLEQGKDPWKVVWDVTRGLSPDWESR

SEQ ID NO: 23116 - protein, 81 aa, Pan paniscus
SQKSLTFKDVFVDFTLEEWQQLDSAQKNLYRDVMLENYSHLVSVGHLVGKPDVIFRLGPGEESWMADGGTPVRTCAGEDRS

SEQ ID NO: 23117 - protein, 81 aa, Pan paniscus
PQGCLTFRDVAIEFSLEEWKCLNPAQRALYRAVMLENYRNLESVDSSLKSMMEFSSTGHGNTGEVIHTGTLQRHKSHHIGD

SEQ ID NO: 23118 - protein, 81 aa, Callorhinus ursinus
SEESVTFKDVAVDFTQEEWGQLDSPQRALYRDVMLENYQNLLSLAGPPVCKPDVISHLERGEEPWQMPREVPGGACSEGEP

SEQ ID NO: 23119 - protein, 81 aa, Pteropus vampyrus
VPVIFRDVAVVFTEAEWKRLSSEQRNLYKEVMCENYRNLLSLIKAKTRLLSSCLLASSQPLLSQHVLQIFSGLCDFHPRNS

SEQ ID NO: 23120 - protein, 81 aa, Pteropus vampyrus
SQESVTFEDVAVDFTQEEWALLDTSQRELFRDVMLENISHLVSIVSQLYKSDVISLSEEREQLSREGIGFLQGQSPDRGDD

SEQ ID NO: 23121 - protein, 81 aa, Pteropus vampyrus
SQGLLIFRDVAIEFSQEEWECLDTAQRALYRDVMSENYRNLVFLGLAVSKPDLITFLEQMKEYCVLKRKKTISIHPGTWEC

SEQ ID NO: 23122 - protein, 81 aa, Pteropus vampyrus
MLETCRNLASLGYHVNEPSLISHLEQEDKVMTEQRGILPGTCPDLETVLKDRWLTPKKHGFRKKRSNGIKAERNHLGVKLN

SEQ ID NO: 23123 - protein, 81 aa, Pteropus vampyrus
GLLTFEDVAVFFTQEEWDYLDPAQRSLYKDVMMENYGNLVSLDVLNRDKDEEPTVKQEIEEIEEKVESQGIIVTRIKSEID

SEQ ID NO: 23124 - protein, 81 aa, Pteropus vampyrus
SQGLVTFEDVAVYFSLEEWQRLDAAQRDLYKEVMQENYGILVSLGYPIPKPDLIFRLEQGEEPWVPDSPRPEEGDIVTGVY

SEQ ID NO: 23125 - protein, 81 aa, Pteropus vampyrus
VPVTFDDVAVHFSEQEWGNLSEWQKELYKNVMRGNYESLVSMGKSGVRPAALNPAVWCDGAKADRHPLDLHMGSGSDLSKR

SEQ ID NO: 23126 - protein, 81 aa, Pteropus vampyrus
MLENYGHLVSLGLNFSKPDLVSFLEQGKEPWLGRGNVRRDLCSVSESNDEIREFSPKNVIYENDSSQYLIKERILSQGPEH

SEQ ID NO: 23127 - protein, 81 aa, Zalophus californianus
GVTFEDIAVYFSWKEWRLLDEAQRRLYHHVMLENFTLISSLGCCCGAEDEAPFAQSTSVGVSQTRTPKAAQSSRKTHPCEM

SEQ ID NO: 23128 - protein, 81 aa, Zalophus californianus
KPQGLVTFGDVVVDFTPEEWQYLNPPQKTLYREVMLETYSNLVSVGPQVTKPDLILKLEVEEPCPAETKISFWSFPEAACQ

SEQ ID NO: 23129 - protein, 81 aa, Zalophus californianus
TRNIVTFEDVCIYFSPEEWELLDEAQKRLYCNVMLENFLLVTSLGLAISRYHLIPQRLPVREPVVPANVAIAPAEAGMVSG

SEQ ID NO: 23130 - protein, 81 aa, Equus caballus
SQGSLSFRDVTVGFTQEEWQHLDPAQRTLYRDVMLENYSHLISVGYCTPKPEVILKLEQGEEPWILEEEFPSQSDPELTNS

SEQ ID NO: 23131 - protein, 81 aa, Aotus trivirgatus
FQGPVSFRDVTVGFTQEEWQHLDPAQRTLYRDVMMENYSHLVSVGYCIPKREVILKLENGKEPWISEEKFPSQSHLDQLVC

SEQ ID NO: 23132 - protein, 81 aa, Aotus trivirgatus
PKVPVSFEDVSVYFTKTEWKLLDLRQKVLYKRVMLENYSHLVSLGFSFSKPHLISQLERGEGPWVADIPRTWATRGLLIGD

SEQ ID NO: 23133 - protein, 81 aa, Aotus trivirgatus
MRPLTFMDVAIEFSPEEWQCLDTTQQNLYRNVMLENYRNMVFLGIAVSKPDLIACLEQGKDPWNMKRQEMVAKPPDMCSYF

SEQ ID NO: 23134 - protein, 81 aa, Lipotes vexillifer
TFQEAVTFKDVAVAFTEEELGLLDSAQRKLYQDVMVENFRNLVSVGEDSFRQDTKHIEREERLWLMNSATQIEIALKENNQ

SEQ ID NO: 23135 - protein, 81 aa, Pan paniscus
VMFRDVAIDFSQEEWECLDSAQRDLYRDVMLENYSNLVSLDLPSRCASKDLSPEKNTYETELSQWEMSDRFENCDLEESNS

SEQ ID NO: 23136 - protein, 81 aa, Lipotes vexillifer
KPAAVSFADVAVYFSPEEWGCLRPAQKALYRDVMRETYGHLDALGFPGPKPALISWMEQESEAWSPAAQDPEEGESLGGAL

SEQ ID NO: 23137 - protein, 81 aa, Lipotes vexillifer
VTGLVSFEDVAVNFTWEEWQDLDDAQRTLYRDVMLENYSSLVSLGHCITKPEVIIKLEQGAAPWTVKEKPQTRVSRASQCT

SEQ ID NO: 23138 - protein, 81 aa, Callorhinus ursinus
AQGSVTFEDVALYFSWEEWDLLDEAQRCLYHDVMLENFALTSSLGFGSSRSHAVAQLGLGEESPVLPVSTRWAPRGPDPGC

SEQ ID NO: 23139 - protein, 81 aa, Callorhinus ursinus
MDSVAFEDVTVKFTMEEWALLDPSQKKLYRDVMQETFRNLASIVCISEEKWEIHDREDQNENHGTDLSSQMVERLCKSKEC

SEQ ID NO: 23140 - protein, 81 aa, Callorhinus ursinus
LQNSITFEDVAMDFTQEEWALLNSRQRKLYRDVMLENYRNLASLEKQLSKPTVITQMKQEDEMKTGTGNHQDTCSNGMVLL

SEQ ID NO: 23141 - protein, 81 aa, Tursiops truncatus
AHGSVMFSDVSIDFSQEEWDYLDLEQRDLYRDVMLENYSNLVSLGCFVSKPDVIFLLEQGKEPWKVVRKGRRRYPDLETNY

SEQ ID NO: 23142 - protein, 81 aa, Tursiops truncatus
MQENYETVISLALFVLPKTKVICCLEQGEEPWVQGPPIFKDSPEELFSEIKMKNDTENHQPICFSDLEIQAPGDIVSKKAS

SEQ ID NO: 23143 - protein, 81 aa, Tursiops truncatus
MLENYGNVVSLGFPFPKPPLISHLEQEAELCVQDGQDREFLSCPHPVSAAKTRPENEKASSEQAVFENGEVCWVKFKSLLK

SEQ ID NO: 23144 - protein, 81 aa, Tursiops truncatus
RAGSVTFRDVAIDFSQEEWEFLDSAQRDLYRDVMWENYSNFISLAGPSISKPDVTTLLDEGKEPWMVVREGTRRHHPDLES

SEQ ID NO: 23145 - protein, 81 aa, Trichechus manatus
LQGSVSFRDVAVDFSREEWQHLDPDQRNLYWDVMLETYSHLLSVGYQVPKSDFFFMVEQGKEEGENPHQSCPGEKLWYQNA

SEQ ID NO: 23146 - protein, 81 aa, Trichechus manatus
KPGAVRFVDVAVYFSPEEWACLRPAQRALYRDVMRETYGHLGALGFPGPKPALISWMEQESEAWSPAAQDPEERENLGGAP

SEQ ID NO: 23147 - protein, 81 aa, Trichechus manatus
SVVVEDVTVIFSQEEWALLDLVQRKLYRDVMMETFRNLATVVSRNLNDGERLSSEHIMVQFMKNNTWSYVLGEIFEWRSST

SEQ ID NO: 23148 - protein, 81 aa, Trichechus manatus
AQGLVTFRDVTVEFSQEEWKYLEPAQKDLYRDVTLENFSNLVSLGISISKSDVISLLEQRKEPWMIAKDMTEQWYPDLVSR

SEQ ID NO: 23149 - protein, 81 aa, Trichechus manatus
SVVIEDVAVVFSQEEWTLLNLTQRKLYRDVMMETFRNMASVVSRNLNDGEELSSEHIMVQFMKSNTWSSMLGEISELYGNK

SEQ ID NO: 23150 - protein, 81 aa, Trichechus manatus
AQGLLTFEEVAVSFSQEEWGHLNSAQRALYRDVMWENYRNLISVGFIFAKPKLISQLEQGEEPWVPEGPRPSNLGLIPTFS

SEQ ID NO: 23151 - protein, 81 aa, Trichechus manatus
IQAQESLTFDDVAVEFTWTEWQLLGPDQKDLYWHVMLENYNNLVSVAGKPDALSKLEQGEELWTTEDEIHCRICPEIRKVD

SEQ ID NO: 23152 - protein, 81 aa, Zalophus californianus
GVTFEDIAVYFSWKEWRFLDEAQRRLYHHVMLENFTLISSLGCCCGAEDEAPFAHSTSVGVSQTRTPKAAQSSRKTHPCEM

SEQ ID NO: 23153 - protein, 81 aa, Zalophus californianus
SQSLLTFEEVAMYFSQEEWELLDPTQKALYNDVMRENYETVISLALFVLPKPKVISYLEQGEDPWVQGPLEFKNSPGGLPT

SEQ ID NO: 23154 - protein, 81 aa, Aotus trivirgatus
ETGPLTFRDVAIEFSLEEWQCLDTAQQDLYRKVMLENYRNLIFLAGIAVSTPDWITCLEQGKDPWNIKRHSMVAKPPVLCS

SEQ ID NO: 23155 - protein, 81 aa, Sarcophilus harrisii
ARSHESVTFKDVAMDFTPEEWGQLDPAQRDVMLENYRNLVSLWLPVSKPDGNSNFDQGENQWMMEKKVPRGNCSDWDTRSE

SEQ ID NO: 23156 - protein, 81 aa, Pan paniscus
MGPLQFRDVAIEFSLEEWHCLDTAQWNLYRDVMLENYRNLVFLGIVVTKPDLITCLEQGKKPFTVKRHEMIAKPPVMCFHF

SEQ ID NO: 23157 - protein, 81 aa, Callorhinus ursinus
FQGSVTFRDVAIDFSQEEWEWLQPAQRDLYRHVMLENYGHLVSLGFNISKPYVVSLLEQGREPWLVKGDVRRDPFSESNGE

SEQ ID NO: 23158 - protein, 81 aa, Tursiops truncatus
LRGWGTFKDIAVYFSQEEWGLLDEAQRHLYCDVMLENLALVASLDYGCGAEAEEASYEQSVYVAVLQSRTPKADPSIQKAN

SEQ ID NO: 23159 - protein, 81 aa, Tursiops truncatus
PQACVTFEDVAIYFSQEEWGLLDEAQRFLYHDVMLENFELTTSLDCQCGAEDEEIPSEQSVSGGESQVRTSQSVPSNQKTH

SEQ ID NO: 23160 - protein, 81 aa, Tursiops truncatus
AAVFEFLSVDYTQQKWKGLALSQRALYWNIMLENCCSLASLGENRMESSELPPKQELSKVLKSSDRTSVVLCGMIPGEPEA

SEQ ID NO: 23161 - protein, 81 aa, Tursiops truncatus
AAVFEFLSVDYTQQKWKGLALSQRALYWNIMLENCCSLASLAGENRMESSELPPKQELSKVLKSSDRTSVVLCGMIPGEPE

SEQ ID NO: 23162 - protein, 81 aa, Trichechus manatus
AQKLLTLEDVAVNFTWEEWQLLDPTQKELYWDVMLENYNNLISMGYQASKPHALSKLEQGEEPWIIEDEICSIVCPEMRKV

SEQ ID NO: 23163 - protein, 81 aa, Trichechus manatus
AHEEEEGIAPYLMANASFAGQQVCGAPHTVMPEVELTDQLFTVLPVDHELVTFRDVVISFSQEEWEYLDSSQKDLYWDVMM

SEQ ID NO: 23164 - protein, 81 aa, Equus caballus
MLENYRNLVSLGFPFSKPGIISRLEQVVNPWMQEGEVLSSSCTYLETRKSKPKKVFSEKESYQRINMERSTEADARTSSLK

SEQ ID NO: 23165 - protein, 81 aa, Equus caballus
MAVTFEDITVIFTWEEWRFLDSSQKKLYREVMWENYTNVLSVENWKESYKPQEERFRYLEHENLSCWQGWRNANTQIHENQ

SEQ ID NO: 23166 - protein, 81 aa, Equus caballus
AEGHVTFEDVAVYFSWEEWGFLDEGQRLLYHNVMLENFALMASLGLASSRTHEVTQWERWGEPFVPACGVMTAAMPRGCWH

SEQ ID NO: 23167 - protein, 81 aa, Aotus trivirgatus
AQESVTFEDVAVNFTDREWQCLTYAQRHLYKDVMLENYGNMVSLGFPVPKPPLISHLERGVEPCVQDPQDRESLSCSYPVS

SEQ ID NO: 23168 - protein, 81 aa, Sarcophilus harrisii
QEAVTFKDVYVDFSLAEWGCLGPDQRELYRDVMLENYRNLVSLGAEFPSAKPELISQLEQSGGEPRPQGGPPGDPCPDGRP

SEQ ID NO: 23169 - protein, 81 aa, Lipotes vexillifer
GWVPALFDEVAIYFSDEEWDVLTEQQKALYREVMRMNYETVLSLEFPFPKPHMITRLEREEESQNSDEWQFQGGTFAENEE

SEQ ID NO: 23170 - protein, 81 aa, Pan paniscus
ILKSQVRDVAVYFSWEEWDLLDEAQKHLYFDVMLENFALTSSLGCWCGVEHEETPSEQRISGERVPQFRTSKEGSSSQNAN

SEQ ID NO: 23171 - protein, 81 aa, Lipotes vexillifer
AQGSVLFEDVSVDFTQKEWQLLDRAQRLLYRDVMLENYRHLVSLGHCVSKPELILKLEQEEELWVLKGQLPSESHPEVQRT

SEQ ID NO: 23172 - protein, 81 aa, Pteropus vampyrus
PKVPVTFDDVAVYFSELEWGKLDEWQKELYKHVMRGNYEMLVSLDYAISKPDILTRMERGEEPCPEGLWGQEEGKESEAAR

SEQ ID NO: 23173 - protein, 81 aa, Pteropus vampyrus
RESGKAPVTFDDITVYLLQEEWMLLSQQQKEICGSDRLLAPLGATLANPEPFYKFERGPEPWLGSIQGRRHLLGHYPGKKM

SEQ ID NO: 23174 - protein, 81 aa, Pteropus vampyrus
MAMYLTREEWRPLDPTQRDIYRDVMQENYGNVVSLDFEIRSENEVNPKQEISENVEFGTTSERPVGNTEENPESEEVFESR

SEQ ID NO: 23175 - protein, 81 aa, Trichechus manatus
LQGPVIFEDVFVYFSQEEWGLLDEAQRLLYRNVMLENFALIASLGIASSRLHKVTQLEQGEEPWMPDQVDMIPAPARTAQR

SEQ ID NO: 23176 - protein, 81 aa, Trichechus manatus
LVTFEDVAVEFTQEEWALLDPSQRKLYRDVMLENSRNLASLDLESIPKVKELTSKQRVFRKKQTKHMKTERSHLGVKLNEC

SEQ ID NO: 23177 - protein, 81 aa, Trichechus manatus
AAGAVTFKDVTMAFTQKEWEQLEPVQRDLYKDVMLENYSNLASMGYEASKPDMISKLEKGEEPWLRKRKRPSQGGPSELAR

SEQ ID NO: 23178 - protein, 81 aa, Trichechus manatus
SMQSAVAFEDVAVYFSGDEWRLLNVTQRHLYRDVMLENFALIGSLGLAPSRSHVVAQLGSEEPWVPNMLDVILVSRAEARK

SEQ ID NO: 23179 - protein, 81 aa, Trichechus manatus
PVTFEDVSVVFTEAEWKRLSCEQKNLYKEVMLEIYRNLLSLAELKPELYPCSSCLLAVSCQQFLSQHVLQIFPGLCAENHF

SEQ ID NO: 23180 - protein, 81 aa, Trichechus manatus
FQESVTFKDVAVYFTQSQWASLDPAQRGLYKEVMLENYANVASLAEFPFLKPDLILQLERGEAPWGPDPWTLLGEEALRGI

SEQ ID NO: 23181 - protein, 81 aa, Trichechus manatus
AVVFEDVAVEFTQEEWALLDFSQRKLYRDVMMETFRNLDSVFKQDDNGQTFMKNDSSSSMLGKICEFHGIEHQYNNQGRHV

SEQ ID NO: 23182 - protein, 81 aa, Zalophus californianus
LLDLVTFEDVAVEFTREEWALLDPSQRTLYRDMMRENCRNLASLGNQVDKPGLVSELEQEDKVITEEIRILPGNCPDLETL

SEQ ID NO: 23183 - protein, 81 aa, Zalophus californianus
MKWGKPAGFLVFKPELISRLEQGQEPWVLDLKGVEGREGARTFLTDSAVGIAGEQACEDMDVLKSEPCVAMVRSPPQGFPQ

SEQ ID NO: 23184 - protein, 81 aa, Zalophus californianus
RFRTASCWDISVEFTWEEWQLLDSTQKYLYRDVILENYSHLVSVGYHGTKPDLIFKLEQGEEPWIINAKVSRQSCPEGWKE

SEQ ID NO: 23185 - protein, 81 aa, Equus caballus
LQAEVTFEDVAVLLSQEEWDRLGPAQRGLYRHVMMETYGNVVSLGLPGSKPSIISQLERGEEPWVLDGQGTEKSRGPGSSH

SEQ ID NO: 23186 - protein, 81 aa, Aotus trivirgatus
SVTFEDVAVNFTQEEWALLDPSQKKLYRDVMWETFRNLASIGKQKEWNVEEEYKNQGRNLRSHMVERFFESKEGSHGGESF

SEQ ID NO: 23187 - protein, 81 aa, Lipotes vexillifer
MAVTFEDVTVNFTWEEWKFLDSSQKKLYREVMWENYTNVMSVGNWKESYRLQEERFRYFEHEHLSCWQGWRNASTQIYDNQ

SEQ ID NO: 23188 - protein, 81 aa, Lipotes vexillifer
LQAPVTFEDVAVYFSREEWGILNLTQRSLYRDVMLENFALIGSLGNSPTRDPTRVAQMKGEEEPWVPNMLDMTVVSRAEAR

SEQ ID NO: 23189 - protein, 81 aa, Lipotes vexillifer
MFKDVAIDVSQEEWECLNPAQRNLYKDVMLENYSNLVSLGLSISKPAVISSLEQGKEPWMVMREVIGEQFPDLVSKRESKK

SEQ ID NO: 23190 - protein, 81 aa, Lipotes vexillifer
MMLENYQSLVSVGLCISKPYVISLLEQGKEPYEDPEFSKLCKVYRYVPSLLQPIIKETFAFLNLSDWESVYETQELPLKQF

SEQ ID NO: 23191 - protein, 81 aa, Pan paniscus
PQGHLTFTDVAIEFSQEEWKSLDPGQRALYRDVMLENYRNLVFLGICLPDLSIISMLKQRREPLILQSQVKIVKNTDGREC

SEQ ID NO: 23192 - protein, 81 aa, Pteropus vampyrus
SQGLLSFTDVFVHFTWEEWRLLDAAQKHLYRSVMLENYGNLVSLGYQHTKPDVIFKLEQEEELWMRQAQVPSQSPLDRVWE

SEQ ID NO: 23193 - protein, 81 aa, Pteropus vampyrus
PQSPVTLEDVAVCFSQEEWGLLDIAQRHLYHDVMLEIFELMISLGCWHGVEDEGACSEQNAVEGVSQVGILSAHPSTQKTD

SEQ ID NO: 23194 - protein, 81 aa, Pteropus vampyrus
ITGQLTLNDVFIEFSQEEWECLAPAQRALYREVMLESYRNMRFLGISVSDLYIVSILEQGKAPWTLESESNIAQKPNRWER

SEQ ID NO: 23195 - protein, 81 aa, Trichechus manatus
WGPLSFKDVFVDFTWEEWRLLDPAQKSLYRTVMLENYSNLMSLEKVREIDHNMEWQHENQGKLGSVAKGYEYTTFKKLCLS

SEQ ID NO: 23196 - protein, 81 aa, Trichechus manatus
AQGCVTFEDVAIYFSQEEWGLLDETQRLLYCNVMLENFALIASLGITSFRPNVVAQLEMEKEPWMPDRVDMTPAMARGAYR

SEQ ID NO: 23197 - protein, 81 aa, Trichechus manatus
VVFEDVAVNFSRAEWALLSASQRNLYKDVMLETFWNLASVDWCIQVKTTGSSPQQDLFGSEISNDEKRKKFMQKDSSSDLE

SEQ ID NO: 23198 - protein, 81 aa, Trichechus manatus
PQGSVTFEDVAVDFSQEEWELLDPAQRTLYREVMLETCRNLVSLGCSLCQPVAPPHLEQGEAVWMVDRGIPQAFCSDWETR

SEQ ID NO: 23199 - protein, 81 aa, Trichechus manatus
LQASVSFKDVAVELTQEEWQHMGPAQRTLYRDVMLENYNHLVSVGSCFTKPELIFRLEQGEDPWLLKEEFLNRSTPENCQH

SEQ ID NO: 23200 - protein, 81 aa, Trichechus manatus
SVTFKDVAVVFTEEELGLLNSAQKKLYQDVMVENFRNLVSVGGKNPRQMEIVPPAGAHEELSSSRIWQQIASDLTRCQDSV

SEQ ID NO: 23201 - protein, 81 aa, Trichechus manatus
PQDLVTFKDVAIDFSQEEWEWLNPTQRSLYKSMMLENYQSLVSLGLCISKPYIISLLEQGKEPWKVKSEMTRGPFLDWESI

SEQ ID NO: 23202 - protein, 81 aa, Trichechus manatus
IQGPVSFKDVTVGFTQEEWLHLDPAQRTLYRDVMLENYSHLVSVGYCVTKPEVIFMLEQGDEPWILEEESPCHIHPDFHIL

SEQ ID NO: 23203 - protein, 81 aa, Zalophus californianus
MPLAGCPVPRPELIYQLEHGQELWTWKRHLSQSAYPGDKGKPKTTELSPCAPALSEGALFQELRQGDPGNFHLGQTKDQSG

SEQ ID NO: 23204 - protein, 81 aa, Zalophus californianus
YQGRLTFRDVAIEFSEEEWECLDPAQRALYRDVMVENYRNLVSLGEDNVPPEVGICPKSSARFMIKELLPKKENNRKLCQL

SEQ ID NO: 23205 - protein, 81 aa, Zalophus californianus
QESVTFEDVAVDFTQEEWTLLDRSQRKLFRDVMLENISHLVSIDREDDLKKQEMIFVQHICKKDTTLISAMQRSHTQEDTF

SEQ ID NO: 23206 - protein, 81 aa, Zalophus californianus
KRKALLTFRDVAIEFSQEEWRCLNHTQRQLYRDVMLENYGHLLFLGLILSKPDLIMFLEQEKQLWDVRRKETVAFHPGRWE

SEQ ID NO: 23207 - protein, 81 aa, Zalophus californianus
KRKALLTFRDVAIEFSQEEWRCLNHTQRQLYRDVMLENYGHLLFLGFVLSKPDLMMFLEQEKQLWDVKRKETVAFHPGRWE

SEQ ID NO: 23208 - protein, 81 aa, Equus caballus
PKVPVSFEDVSVYFTKTEWKLLDLRQRILYKQVMLENYRHLVSLGFSSSKPHLVSQLERGQGPWVADVRRMGATTRMEAGD

SEQ ID NO: 23209 - protein, 81 aa, Papio anubis
YQDSVTFDDVAVDFTQEEWTLLDPSQRDLYRDVMLENYENLASVGRDLFKPSVICWLEEEEELRAEQRGVLQEWRLKTKGP

SEQ ID NO: 23210 - protein, 81 aa, Aotus trivirgatus
AQGQVNFEDVFVYFSQEEWVLLDEAQRLLYRDVMLENFALMASLGHTSFTSHTVASLWELGKGFWFSTNLHQHQKQHSGEK

SEQ ID NO: 23211 - protein, 81 aa, Aotus trivirgatus
KVSITFKDLAVRFSEEEWRLLEEGQREFYRDVMRENYETLVSVGTAELLPLSAFLSPSEPGGAAGGGSRADEGQEPAGCGG

SEQ ID NO: 23212 - protein, 81 aa, Papio anubis
KSLVTFEDVAVYFSQEEWELLDAAQRHLYHSVMLENLKLVTSLGCWHGVEGEEAHPKQNISVEEVLPVRIPNADSSTKKAN

SEQ ID NO: 23213 - protein, 81 aa, Aotus trivirgatus
SQESLTFKDVFVDFTLEEWQQLDSAQKNLYRDVMLENYSHLVSVGYLLAKPDMIFRLGPGDESWRADGGTPVRTCAGKVFQ

SEQ ID NO: 23214 - protein, 81 aa, Sarcophilus harrisii
PQKSLTSKELAVKFTQEEWEQLDPSQRNLYRDVLLERYRNLVLLGLPISKPDVISQLERGKEPWMLEREDSKGAHLDWDRP

SEQ ID NO: 23215 - protein, 81 aa, Pan paniscus
QGRLTFRDVAIEFSLAEWKCLNPSQRALYREVMLENYRNLEAVDISSKRMMKEVLSTGQGNTEVIHTGTLQRHRSYHIGDF

SEQ ID NO: 23216 - protein, 81 aa, Lipotes vexillifer
PLTFKDVAIEFSREEWECLDPDQKAFYVDVMLETYSNLISLDISHIHMIKKLQPGANSDRGEVFQTVMLERQKSHEMKHFY

SEQ ID NO: 23217 - protein, 81 aa, Pan paniscus
CEASVSFEDVTVDFSREEWQQLDPAQRCLYRDVMLELYSHLFSVGYHIPNPEVIFRMLKEKEPRVEEAEVSYQRCQEREFG

SEQ ID NO: 23218 - protein, 81 aa, Tursiops truncatus
VGVTFEDIALYFSWEEWKLLDEAQRRLYHDVMLENFALISSLGCCCGAEDAEAPFQQSISISMSQARTHREGSFSQKSHPC

SEQ ID NO: 23219 - protein, 81 aa, Tursiops truncatus
MMENYSNLVSLGHSISKPDIIVLLEQGKEPWMVVREETRNWSTGLDSSYKIISDRKTFIPGKHSSLLLHQRIHSGEKPYED

SEQ ID NO: 23220 - protein, 81 aa, Tursiops truncatus
QAQETLTFDDVTVDFTWEEWQLLTPPQKDLYQEVMLENYSNLLSVGYQARKPDVLSNLDHEEPWMMEDEIHCQTHSGYQAS

SEQ ID NO: 23221 - protein, 81 aa, Tursiops truncatus
MQENYRHLISVGYCVNKPNAVFKLKQGKEPWILEVEFPRQKYPEDLWNTHDQGARYQESQAKNSRNGELTKHQKTHTNEKS

SEQ ID NO: 23222 - protein, 81 aa, Tursiops truncatus
SEEEARKRRERKEKESEMALSQAPLTFKDVAIEFTQEWERLDPAQRALYRDVMEETSRNLLSVGEKTRVQKRSFPIPGRME

SEQ ID NO: 23223 - protein, 81 aa, Tursiops truncatus
RDPPEGSVTFEDVAVNFSLEEWGLLDEAQRCLYHDVMLENLALTTSPGCWHGEEDEEALSEQSISDQGSSQIRIVKAGTLM

SEQ ID NO: 23224 - protein, 81 aa, Tursiops truncatus
YQGLVSLEDVAVNFTWEEWQDLDDAQRTLYRDVMLENYSSLVSLGHCITRPEVIIKLEQGAAPWTVKEKPQTRVSRCQCTL

SEQ ID NO: 23225 - protein, 81 aa, Zalophus californianus
AHRSMTFRDVAIDFSQQEWEYLDSLQKNLYRDVMMENYDNLVSLAGHSISKPDVITLLEQGKDPWMVVREDTRRWCTDLES

SEQ ID NO: 23226 - protein, 81 aa, Zalophus californianus
MIKSQISFEDVAVGFTSEEWQLLNPSQKSLYREVMLENYSNLVFLGCQIIKPDAIFKLEHEEPWIIDEEVLSQNFSEEVWL

SEQ ID NO: 23227 - protein, 81 aa, Zalophus californianus
PKVPVSFEDVSVYFTKTEWKLLDLRQRILYKRVMLENYRHLASLGFLSSKPHLVSWLEQGEGPRAAGTCRTRAAAGMQKGD

SEQ ID NO: 23228 - protein, 81 aa, Equus caballus
LLQGSVSFKDVTVAFTQEEWQHLDPAQRTLYRDVMENYSHLVSVGYCITKPEVVFKLEQGEEPWVLEDESSSQSPPGELGL

SEQ ID NO: 23229 - protein, 81 aa, Equus caballus
AQDSVTFHDVAVYFSRGEWRLLDEAQRRLYLDVMLENFALLSSLGCCCGAEGLEAPFEQSISVEVPLARTPEAAPSSQKTH

SEQ ID NO: 23230 - protein, 81 aa, Papio anubis
GTVTFEDVAVNFTQEEWNLLSEAQRCLYRDVMLENQALISSLGCWCGVEDEEAPSKQSIYIQRETQVRIPMAGVSLKKAHP

SEQ ID NO: 23231 - protein, 81 aa, Aotus trivirgatus
PQGHLTFMDVAIEFSQEEWRCLDPAQQALYRDVMLENYRNLVSLGICLPDLSIISMLEQRREPSTLQGEVKIVKIQDGREC

SEQ ID NO: 23232 - protein, 81 aa, Aotus trivirgatus
MEPLEFRDVAIEFSLEEWHCLDTAQRNLYWDVMLENYRNLVFLGIVVSKPDLITCLQQGKKPLTVKRHEMIATPPVTYSHF

SEQ ID NO: 23233 - protein, 81 aa, Aotus trivirgatus
FQEMVTFKDVAVVFTEEELGLLDSVQRKLYRDVMLENFRNLLLVAHQPFKPDLISQLEREEKLLMVDTETPRDGCSGRKNQ

SEQ ID NO: 23234 - protein, 81 aa, Aotus trivirgatus
STLSISFKDVTVDFSRDEWQQLNVAQKSLYRDVMLENYFNLISVGCQVPKPEVIFNLEQEEPCMLNGGNSSQSCPDGKIGF

SEQ ID NO: 23235 - protein, 81 aa, Aotus trivirgatus
SQEPVTFEDVAVDFTREERQQLNPAQKTLHRDVMLETYSHLVSVGCSGIKPEVIFKVEHGKDPWIKDSELSRWIYPDREKG

SEQ ID NO: 23236 - protein, 81 aa, Sarcophilus harrisii
FHQLVTFEDVAVYLSKEEWKRLNLAQRELYRDVMLENYENLLSLGFPVSKPDIISQLEQRKEAWIVQGPEKRKFSQNAHRD

SEQ ID NO: 23237 - protein, 81 aa, Lipotes vexillifer
RSQESLTFQDVAVEFTREEWVQLYPAQKNLYRDVMLENYRNLVALGHQLYKPEVITQLEQEEQWMMERDSPPDTHPDGENS

SEQ ID NO: 23238 - protein, 81 aa, Lipotes vexillifer
TALGSVTFEDVAVYFSQEEWRLLDEAQRFLYHDVMLETFALVASLGLAFSRSHVVQVKLGGEPWVLDRVDMTPAFHNEQRH

SEQ ID NO: 23239 - protein, 81 aa, Lipotes vexillifer
PLESVTFEDVAINFTQEEWALLDTSQKTLFRNVMLENITHLVSVGYQIGKSDVVSQLEQGKELWSEATRCLQGQSPDGESP

SEQ ID NO: 23240 - protein, 81 aa, Pan paniscus
MLRRGHLTFRDVAIEFSQEEWKCLDPAQRTLYREVMVENYRNLVFLGEDNVPSEQRRDPRNLQSEVKIANNPGGRECIKGV

SEQ ID NO: 23241 - protein, 81 aa, Pteropus vampyrus
MGPAHRTLYRDVMLENCSHFVSMGYCITKPQVIFKLEQGEEPWSLEEEFPNQRCPGGHIPAAQLKAETHPGQDTIPSQGAF

SEQ ID NO: 23242 - protein, 81 aa, Pteropus vampyrus
SVAFEDVAVNFTPEEWALLDPSQKKLYRDVMRETFENLASVGKRMEDYDIEDQYKNQERKLRSHIEERICESEASGQCEEN

SEQ ID NO: 23243 - protein, 81 aa, Pteropus vampyrus
KSQEFVSFKDVTVDFTWEEWQQLDSAQRNLYRDVMLENYSNLVSVGYPSLKSDKILLKQREPWTEEGEISNWAYPDFEIRP

SEQ ID NO: 23244 - protein, 81 aa, Pteropus vampyrus
SSLLPQEIIIKVEREDAGSLAVPSQEGVNFKIVTVDFTREEERTLKHVQRTLDRGVILENHKDLVSWGCLIFLFSRLSNCI

SEQ ID NO: 23245 - protein, 81 aa, Pteropus vampyrus
AQGLMVFEDVAVYFCEEEWDLLDAAQRALYCHVMLENFALVASLGLSASRPRVVTQLERGEEPWVLSGTDVTLARNAQRRP

SEQ ID NO: 23246 - protein, 81 aa, Pteropus vampyrus
MLENYGHLVSLGFPLFKPKLISLLQQGEEPWKVEEGSRRGSWLGSKSSPKTTKSTQTQDSSFWGLIKKRLKRDEPWNFLSE

SEQ ID NO: 23247 - protein, 81 aa, Pteropus vampyrus
YQEFVTFEDVAVHLTREEWGCLDPVQRDLYREVMLENYGNVVSLGFPISKPDGISQLEQDLQVFDLETKNREVLRDGCSDG

SEQ ID NO: 23248 - protein, 81 aa, Trichechus manatus
SVVFEDVAMDFTQEEWALLDFSQRKLYKDVMVETFRNLDSVSHQDNNGQKLSIEHIIVRFMENDSCSPVVGEICEFLDYEN

SEQ ID NO: 23249 - protein, 81 aa, Trichechus manatus
APLPLTFEDVAVYFSEQEWQNLKAWQKDLYKHVMRANYETLASLGDGIPKPELISWIEQGREPFRNWGESQKCENIICSSA

SEQ ID NO: 23250 - protein, 81 aa, Trichechus manatus
MLENYGNLVSMGYEVSKPDALSRLERGEQPWTVLDESHSRTFSEIWIFDNHLPEHMKNENRMDKMKQCYEHNTLENIVHQH

SEQ ID NO: 23251 - protein, 81 aa, Trichechus manatus
SVIFEDVAVDFTREEWALLNFAERKLYRDVMMETFRNLASVVSQQVDNGQMVSSEHLIMRFMKNNSQYTMLGEICESHGIE

SEQ ID NO: 23252 - protein, 81 aa, Papio anubis
FQESVTFQDVAVDFTAEEWQLLDCTERTLYWDVMLENYRNLISVGCPINKTEVILKVEQGQEPWMVEGANPHQSSPGWSTV

SEQ ID NO: 23253 - protein, 81 aa, Sarcophilus harrisii
RSQSVTFRDVAVDFTQEEWRRLAPAQRDLYRDVMLENYHNFASLGLPVFKPDVISQLERGEGPWTPEAEVPQVTCPESLVQ

SEQ ID NO: 23254 - protein, 81 aa, Lipotes vexillifer
QQGLLSFNDVAVDFTWEEWQLLDIVQKNLYRDVMLENYSNLMSLGYQVTKPEPVMHLEKGKEKEKEVVEREFPIQCGPGEK

SEQ ID NO: 23255 - protein, 81 aa, Lipotes vexillifer
FQEAVTFKDVAVTFTEEELGLLDSAQRKLYQDVMVENFRNLVSVGHLPFKPDMVSQLETEEKLWMMERETQRNGHSSENRR

SEQ ID NO: 23256 - protein, 81 aa, Lipotes vexillifer
FEGSVSFEDVAVNFTRQEWYRLDPAQRTMHKDVMLENYSNLASVGLCVAKPDMIFKLERGEELWILEEEFSGHGYPGSLSL

SEQ ID NO: 23257 - protein, 81 aa, Lipotes vexillifer
MLENYQNLLALGPPVCKPDVISHLERGEEPWWAPRAVPGGAGPEPEWEPEPEVEEPWSQQLCVYKEEPSWELIAGGLARSG

SEQ ID NO: 23258 - protein, 81 aa, Pan paniscus
SQGRVTFEDVTVNFTQGEWQRLNPEQRNLYRDVMLENYSNLVSVGQEETTKPDVILRLEQGKEPWSEEEEVLGSGRAEKNG

SEQ ID NO: 23259 - protein, 81 aa, Tursiops truncatus
SRDSVTFADVAVDFTQEEWTLLDPIQRKLYRDVMLENYKNLTTAGYQSLKPTLISWWEQEDDLRTAERKGVLQDSAIQQDN

SEQ ID NO: 23260 - protein, 81 aa, Tursiops truncatus
SQELLTFKDISVDFTQEEWGQLAPAHRNLYREVMLENYGNLVSVGYQLSKPGVISQLEKGEQPWLMEREISGGPSPDLEDE

SEQ ID NO: 23261 - protein, 81 aa, Tursiops truncatus
LQGSLTLKDVAVDFTWEEWQLLDPDQKDLYRDVMLENYSNLVSVGYQVNKPDILSKLEQGEPPWTLEDEVHSHPHPEIDKV

SEQ ID NO: 23262 - protein, 81 aa, Pteropus vampyrus
LLTFEDVAISFSEEEWKLMDPAQKMLYSDVMQENYETVISLGLKLKKDTGNDQPISTSTLEIQASGCKVLRKARMKVAQKT

SEQ ID NO: 23263 - protein, 81 aa, Pteropus vampyrus
MSENYSNLVSVDHSPIQRACLFCHFPRTGYQVSKPDALSRLEQGEPWAVEDEVHSRICPEIQKDNVHLQGHLQNQRCLKRM

SEQ ID NO: 23264 - protein, 81 aa, Pteropus vampyrus
LQESISFEDLSVDFTQKEWQLLDPYQKDLYKDVMLENYGSLVSLGYEVVKPDIIFKLEQGEEPWVGDGAVPRSAPLEQVLQ

SEQ ID NO: 23265 - protein, 81 aa, Pteropus vampyrus
MEFTWEEWQLLDPTQRYLYREVILENYHNLVSVGYHGTKPDLIFKLEQGEEPWILSARISHESCAEGWKEWYQKNQDELQS

SEQ ID NO: 23266 - protein, 81 aa, Trichechus manatus
MRANYETLASLGDGIPKPELISWIEQGREPFRNWGESQKCENIICSSANIHFDTVLEGQLFWVSGCWPAVKAGEREGHFLR

SEQ ID NO: 23267 - protein, 81 aa, Trichechus manatus
SQASVSFKDVAVELTQEEWQHMGPAQRTLYRDVMLENYSHLVSVGYCLIKPEVIFQLEQGEDPWSLEEEFPNQSCPGYCKV

SEQ ID NO: 23268 - protein, 81 aa, Trichechus manatus
AQGTLSFEDVAVGFTWEEWQLLDLSQKDLYKDVMLENYNNLVSVGYQGTKPDSVFKLEQGETPWIVEGGIHSGTSPEEIWA

SEQ ID NO: 23269 - protein, 81 aa, Trichechus manatus
MLENYSNLMSLGYQHTKPDIIFKFKQGEELRMIKAQIPNQSFPEKVREIDHNMEWQHENQGKLGSVAKGYEYTTFKKLCLS

SEQ ID NO: 23270 - protein, 81 aa, Trichechus manatus
QAAVTFEDVAVLLSREEWCRLAPAQRDLYRDVMLETYRNLISLGTGLTGPKPGVISQLERGHEPWVLDVQSTKGRVDGSDC

SEQ ID NO: 23271 - protein, 81 aa, Trichechus manatus
SVVVEDVAVEFTQEEWALLSLAQRKLYKEVMMETFRNLASVISQNLNGGKKLSSEYVIVEFMKNDIWSSMLEGICELRGVE

SEQ ID NO: 23272 - protein, 81 aa, Zalophus californianus
VRMPVTFEDVAVTFTQEEWGQLDPAQRTLYQEVMLETCGLLVSLGCPLPKPELFYPLDHSPELQTLKRGLSPNSCPGDSTK

SEQ ID NO: 23273 - protein, 81 aa, Zalophus californianus
QAEVTFEDVAVLFSREEWGRLGPAQRGLYRDVMLETYRNLVSLGHGTRTEYKELSSGEMLDEEELDQLQRAVPQGPDPGET

SEQ ID NO: 23274 - protein, 81 aa, Zalophus californianus
IEGSLTFGDVAVALTQFEWKHLDATQQALYRDVMLENYGNLVSVGLLSSKPKLITQLEQGAEPWMQVQQIPSDTCSVQEYW

SEQ ID NO: 23275 - protein, 81 aa, Papio anubis
SLKKVTFEDVAIDFTQEEWAMMDTSKRKLYRDVMLENVSHLASLGYQISKSYVTLQLEQGKELWREGREFLQGQNLDKESA

SEQ ID NO: 23276 - protein, 81 aa, Lipotes vexillifer
GLSSFKDISMEFTWEEWQLLDSAQKHLYRDVTLENYSNLVSVEGWKEWYQKNQDELESVERSYACNAFGKLHLSKSHISSR

SEQ ID NO: 23277 - protein, 81 aa, Lipotes vexillifer
LQVSVSFEDVAVDFSREEWQQLDSTQRRLYQDVMLENYSHLLSLGCEIPKPEVIFKLEQGEEPWTLEEETPHQSCSDEKFG

SEQ ID NO: 23278 - protein, 81 aa, Lipotes vexillifer
LQGPVSFTDVAVDFTQEEWQQLDPEQKTTYRDVMLENYSHLVSVGCHIIKPEVITKLEKGEEPWIVRGEFLLQSCPEEDWE

SEQ ID NO: 23279 - protein, 81 aa, Callorhinus ursinus
ALALITFKDVAVTFTGEEWRHLDLAQRTLYREVMLETCGLLVSLGHPVPKPELTYLVEDGQELWTVRRGLSKSTYTGEKAK

SEQ ID NO: 23280 - protein, 81 aa, Tursiops truncatus
NQGQVTFEDVAITFSREEWECLDPAQRALYRDVMLETYGNLLSLVRISVSVVNIVSILEQGKELWALQSEVKNSKKSNEWE

SEQ ID NO: 23281 - protein, 81 aa, Tursiops truncatus
MLENYRSLVSLGLCVSKPKMISSLEQRKEPWVAKRTLTRGGCPDSRALPKTKELSSKKSFCEEKSSQAVLMERPTTYSLEC

SEQ ID NO: 23282 - protein, 81 aa, Tursiops truncatus
GEFVTFEDVAVHLTREEWGCLDPVQRALYREVMLENYGNLVSLDGETREENKLLIPKQKIPEEVHSYKVRVGRLKKDIAQV

SEQ ID NO: 23283 - protein, 81 aa, Trichechus manatus
VVFEDVAMDFSQEEWALLDLAERKLYRDVMVETFRNLAAVVSRNLNDGEKLSSEPIMLQYLENKTWLSVLEICELHSNVDH

SEQ ID NO: 23284 - protein, 81 aa, Trichechus manatus
MYPQESGTIKDEAVDFTHGEWALLDTSQWKLYNMENINHLVSTGYHLCQSDVISHSRQGEELWRDKRELIQNQSPGSQQTQ

SEQ ID NO: 23285 - protein, 81 aa, Trichechus manatus
FQESVTFEDVAVYFTQSQWASLGPLQRALYREVMLENYANVASLAFPFPKPVLISQLEREEAPLGPDPWETEVLRDICPGG

SEQ ID NO: 23286 - protein, 81 aa, Trichechus manatus
SVVIEDVVVVFTQEEWALLDLAQRKLYRDVMMETFRNLASVVSENVNDGEKLPSERIIVQFMKNNSSSSVLGKIFKLLVSE

SEQ ID NO: 23287 - protein, 81 aa, Trichechus manatus
SQNSLTFEEVAVEFSQEEWALLNPAQKNLYRDVMLENFRNLASLDWETQLKSKDAMAMQNVPGKKTSNGIKMAPAQPGKKL

SEQ ID NO: 23288 - protein, 81 aa, Trichechus manatus
VVFEDVAVDFTLEEWALLDPAQRKLYKDVMLETFRNLASLDDETPFKANESVSQQDIYVKKLSKEHKTTKFTRSDSQTSIL

SEQ ID NO: 23289 - protein, 81 aa, Zalophus californianus
AHGSVTFRDVAIDFSQEEWEFLDSAQRDLYRDVMWENYSNFISLGEPSISKPDVITLLDEGKEPWMVVREGTRRHYSDLES

SEQ ID NO: 23290 - protein, 81 aa, Zalophus californianus
MLENYGTLVSLGIPFSRPKVICQLQEGEDPCVVDRELPWDACLGLKTRPEMEALPPRQGISREETSQGIIKKRSVKCGLWD

SEQ ID NO: 23291 - protein, 81 aa, Pan paniscus
VTFEDVAVYFIRKEWKRLEPAQRDLYRDVMLENYGNVFSLDWIHVSLTTQKVMLAWLTGTLSVAKGLCSSELVSVEPPDTF

SEQ ID NO: 23292 - protein, 81 aa, Lipotes vexillifer
LVTFRDVAINFSQEEWEYLDPIQRDLYREVMVENYSHLISLDLEYSCETKRSCPEKGTCEMESLQWENMRKPISHNLECND

SEQ ID NO: 23293 - protein, 81 aa, Callorhinus ursinus
VHQALLTFRDVAIEFSQEEWGCLNHTQRELYRDVMLENYGHLLFLGLIVSKPDLVSFLEQKKEPWDVKRKKTVAIPRGRWE

SEQ ID NO: 23294 - protein, 81 aa, Callorhinus ursinus
MLETYSNLVSLGLAIAKPDVISFLEQGKEPWVVEKMSRGGLCPVLESRYDTKVSSPEQHIYEIQSPQWEIMESLTSYGLEC

SEQ ID NO: 23295 - protein, 81 aa, Callorhinus ursinus
VTGFPATWLQVPVTFKDAWMMLDSDQRRIYRDVMLENYMNLTSVEYQLGKPTMISPLGQEEIRTMKRRLLAGTYPDWEIQL

SEQ ID NO: 23296 - protein, 81 aa, Callorhinus ursinus
RWAGREAEVVCAVLLNFLGPAEDSAAVRLEVRRLVTLSFKDVVVDFTSEEWQLLDAVQKNLYWDVILENYSNLLSVGKDPW

SEQ ID NO: 23297 - protein, 81 aa, Callorhinus ursinus
RESGKAPVTFDDITVYLLQEEWMLLSQQQREICGSDKLVAPLGPTIANPELFYKFEQGPEPWLGNVQSQRNVLSHHPGKNK

SEQ ID NO: 23298 - protein, 81 aa, Tursiops truncatus
GQLTLNDVAIEFSPEEWECLDPAQRALYRDVMLETYRNLISVDISHIHVVRKLQLKSNIDRGGVFQTVILGRHEIQEPFYL

SEQ ID NO: 23299 - protein, 81 aa, Tursiops truncatus
KGFEGGVTFQDIAMYFSWEEWGLLDEAQRRLYLEVMLENSALVSSLKRFPPFSDFRSPAMHSSHFFRVQPACLQKYPWTHA

SEQ ID NO: 23300 - protein, 81 aa, Pteropus vampyrus
SQDPVTFEDVAVYFSREEWSLLNSTQRCLYRDVMLENFALIISLGFAPSRAHVVAQLEGEEEPWVPSIVDMTLVSRAEAGR

SEQ ID NO: 23301 - protein, 81 aa, Trichechus manatus
SVVFEDVTVDFTQEEWALLDFSQRKLYRDVMMETFRNLALVVSQQVGNGQMMSSEHLIMRFMKSNSWYSRLGETCEFCGIE

SEQ ID NO: 23302 - protein, 81 aa, Trichechus manatus
SQASVSFKDVAVELTQEEWQHMGPAQRTLYRDVMLENYNHLVSVGYNFTKPEVIIKLEQGEDPWLLEEEFLNKNSPEVCQL

SEQ ID NO: 23303 - protein, 81 aa, Trichechus manatus
YVTFEDVAINFTREEWGQLDLTQRTLYLEVMLEICGLLVSLGGKAKLESTEPTTPELALSEGASDQGRLTQVVSKDCQLGR

SEQ ID NO: 23304 - protein, 81 aa, Trichechus manatus
PQELLTFRDVAIEFSQQEWECLEPAQRALYRDVMLENYRNLISLGISPSEMNIISILKKGTEPWTVKKKMKLAKNSDVLSP

SEQ ID NO: 23305 - protein, 81 aa, Trichechus manatus
LVKIEDVADVAVSFILEEWGHLDQSQKNHYRDDRKENYGSIASIDYESRNENMELIVEQNSDEAESHWMTSGSTERNVPQS

SEQ ID NO: 23306 - protein, 81 aa, Trichechus manatus
KVPVTFVDIAVYFSEDEWKSLDGWQKELYNNLIKENYKTLMSLDAEDPAPKPDAPPQVEPREEPCVWEQRNPEERDIPMDP

SEQ ID NO: 23307 - protein, 81 aa, Trichechus manatus
ESVTFKDVAVDFTLEEWALLDTSQRKLFRDVMMENIDHLVFVGGETGLNKEEMVSLQHISRKDTPTIMALQRSLTGEDTFE

SEQ ID NO: 23308 - protein, 81 aa, Trichechus manatus
KESMTFKDVAVVFTEEELGLLDSDQRKLYQDVMLENFRNLVSVGGQIQSEMETAPDARPCDALSCWQIWQQSTSDLTRCQG

SEQ ID NO: 23309 - protein, 81 aa, Trichechus manatus
FQGLMMFRDVFINFSLEEWECLDSGQMDLYTEVMLENYSNLVSVGLSSSKPAVISLLEQGKEPWMVDRELTRGLCSDLESM

SEQ ID NO: 23310 - protein, 81 aa, Trichechus manatus
SQVLLTFRDVAIEFSQEEWDYLDPAQRTLYRDVMLENYRNLLSLAGISPSEINIVSILKKGTEPWTVEKTAKLAENPDVIS

SEQ ID NO: 23311 - protein, 81 aa, Trichechus manatus
TQVSLTFDDVAVKLTWEEWQLLDPAQKDLYRDVMLENYSNLVSVGYQVSKPDALSRLERGEPPWSIEDKIHTRTFSGERPY

SEQ ID NO: 23312 - protein, 81 aa, Trichechus manatus
SQGLLTCRDVAIEFSQEEWDCLDPAQRALYRDVMLENFRNLVSLGISPSGMNIIPILKERTEPWTVVKKMDKANYPEPTQA

SEQ ID NO: 23313 - protein, 81 aa, Zalophus californianus
LQESLTLEDVAVDFTWEEWQLLAPAQKDLYRDVMLENYSNLVSVGYQASKPDALSKLERGEEPCTKQEEVPSGTRPEPSKV

SEQ ID NO: 23314 - protein, 81 aa, Lipotes vexillifer
PEGSLSFRDVTVGFTQEEWQHLDPAQRTLYRDVMLENYSHLISVGFCIPKPEVIFKLEQGEEPWILEEESPGQSVPELINS

SEQ ID NO: 23315 - protein, 81 aa, Lipotes vexillifer
SRELLTFKDISVDFTQEEWGQLAPAYRNLYREVMLENYGNLVSVGYQLSKPGVISQLEKGEEPWLMEREISGGPNPDLEDE

SEQ ID NO: 23316 - protein, 81 aa, Lipotes vexillifer
NFWILRLPPGSKGEAPKEWGNLSEWQKELYKHVMRGNYETLVSLDYAISKPEVLSQIEQGKEPCSWRRTGPKVPDVPVDPS

SEQ ID NO: 23317 - protein, 81 aa, Lipotes vexillifer
PQACVTFEDVAVYFSQEEWGLLDEAQRFLYHDVMLENFALTTSLDCQCGAEDEEIPSEQSVSGGESQVRTSQSVPSTQKTH

SEQ ID NO: 23318 - protein, 81 aa, Pteropus vampyrus
KQEMLSFEDVAMYFTREEWNKLDWTQKDLYRDVMLENYRNMILLGFQFPKPEVICQLEQWEDPWILDLPRAGTRKSSSSAC

SEQ ID NO: 23319 - protein, 81 aa, Pteropus vampyrus
SASQTCAPCRLPVPGTGDFRDVAIGFSHEEWECPDPAQRDLYQDVMLENYSNLVSLDLGSNYGAEKLSPETDVYEINLPRV

SEQ ID NO: 23320 - protein, 81 aa, Pteropus vampyrus
MFKEAVTFKDVAVAFTEEELELLDSAQRKLYQDVMLENFKNLVSVGYQPFRRDISYIEREERLWMMKTELQIDKKKKIGKN

SEQ ID NO: 23321 - protein, 81 aa, Trichechus manatus
AQGSLSFEDVAVGFTWEEWQLLDPSQKDLYKEVMLENYNNLVSVGYPATKPDSIFKLEQRETPWIVEGAIHSQSSPEKIWA

SEQ ID NO: 23322 - protein, 81 aa, Trichechus manatus
SVAVEEVAVNFTQEEWALLDLSQRQLYRDVMMEIFRSLASVASQNLIDGDKLSTENTILRFMKNDTWSSIVGEIFELLVTE

SEQ ID NO: 23323 - protein, 81 aa, Trichechus manatus
PQESVTFKDVAVYFTQKEWASLVPAQKALYRDVMLENYEAVAFLVSPASKPALISQLEQGEEPGFSQPQGALSRRGRRAGL

SEQ ID NO: 23324 - protein, 81 aa, Trichechus manatus
SVVVEDVAVEFSQEEWALLDLAQRKLYRDVMMETFRNLASVVSRNFNDGERLSSEHIMVRFMKNNIWSSMLGAISESHDNK

SEQ ID NO: 23325 - protein, 81 aa, Trichechus manatus
SQGQVTFEDVAVDFTQEEWQYLDPPQRTLYRDVMLETYSNLVCVEHQVTKPDLIFKLELEEPSPAEGKIPIWSFPEEDCQV

SEQ ID NO: 23326 - protein, 81 aa, Trichechus manatus
MDPAQRILYRDVMLENYSHLVSLGYQVSKPEVIFKLEQGEEPWISEEEIQRPFCPDWETPEAKSSKPQQGISTISCNTDDL

SEQ ID NO: 23327 - protein, 81 aa, Trichechus manatus
NQESLTFNDVAMEFTLEEWRLLDPAQKKLYWDMLLENYRNLVSIGYQVSKPHALSRLEQGKQPWNVSEESHHGIFSGRQKV

SEQ ID NO: 23328 - protein, 81 aa, Trichechus manatus
FEGSVSFEDVAVDFTRQEWHGLDPAQRTMHKDVMLENYSNLASVGLCVAKPEMIFKLERGEELWILEEESSGHNYSGSLSL

SEQ ID NO: 23329 - protein, 81 aa, Zalophus californianus
HQALLTFRDVAIEFSQEEWGCLNHTQRELYRDVMLENYGHLLFLGLIVSKPDLVSFLEQKKEPWDVKRKETVAFHPAISSH

SEQ ID NO: 23330 - protein, 81 aa, Equus caballus
LSCKKCAGHGSVSFEDVTVDITQDEWLQLTLMQRTLYPDVMLEDYSHLVSVREECSLCNASQHAFLFLLLSCQNLWAFGGV

SEQ ID NO: 23331 - protein, 81 aa, Equus caballus
MDPAQRIRYSDVILTGYCSTKPRVIFKLEQGEEPWSLEEEFLNQRYPGYYKVDVHLEGNREKEEKPLWQVIFMDNKRLSKE

SEQ ID NO: 23332 - protein, 81 aa, Loxodonta africana
VTFRDVAIAFSQEEWECLDPAQRDLYVDVMLENYSNLVSLGNQSFTPNIIPQLEREEKLWMITPATQRDSSSGAKNLNEME

SEQ ID NO: 23333 - protein, 81 aa, Loxodonta africana
DFLTAGSQVSDLLLVEPTLGSGHTPQKPRDCEGEVEEEGEGVWTGAGYPIPKPDLIFRLEQGEEPWVPDSPHPEEGDIVTG

SEQ ID NO: 23334 - protein, 81 aa, Capra hircus
RAVKFGDVALYFSREEWGCLRPAQRALYRDVMQETYGHLGALGATPNKKEEEPEAGLGAKAPRKAPGKERPEELVKHNPGT

SEQ ID NO: 23335 - protein, 81 aa, Capra hircus
PQDLVTFKDVAVDFSQEEWQWLSPAQRSLYRSMMLENYQSLVSLGLCISKPSVISLLEQGKEPWMMMENELRSPFPDWESI

SEQ ID NO: 23336 - protein, 81 aa, Capra hircus
MTFEDVAVEFTWWEWGQLDPTQKDLYREVMLENFKNLASLGFPVSKPYMICQLEEGEEPCILERAISTGVHSDWERRPQAK

SEQ ID NO: 23337 - protein, 81 aa, Pan paniscus
MFLDVAIEFSLEEWQCLDTIQQNLYRNVMLENYRNLVFLGIVVSKPDLITCLEQEKEPWTRKRHRMVAEPPVICSHFAQDF

SEQ ID NO: 23338 - protein, 81 aa, Pan paniscus
SILKSQVRDVAVYFSWEEWDLLDEAQKHLYFDVMLENFALTSSLGLTLSWSHVVAQLGLGEVPSVLHRMFMTPASARWDQR

SEQ ID NO: 23339 - protein, 81 aa, Pan paniscus
MMTFRDVAIDFSQEEWKWLQPAQRDLYRCVMLENYGHLVSLGLSISKPDVVSLLEQGKEPWLGKKGISESSGEIKDFSPKN

SEQ ID NO: 23340 - protein, 81 aa, Tursiops truncatus
SVTFEDVAVYFSQEEWRLLDEAQRFLYHDVMLETFALVASLGCWHGAEVKETPSEQNVFVEVPRINTSKTNLSTQEAYPWE

SEQ ID NO: 23341 - protein, 81 aa, Tursiops truncatus
SQGPVSFEGVSMGFTQEEWQHLDPAQRTLYRDVMLENYSHLISVGYCVIKPEAIFKLQQGEEPWMLEEESQSQSHPDFCIV

SEQ ID NO: 23342 - protein, 81 aa, Pteropus vampyrus
FQEPVTFKDVAVFFTEEELGLLDASQRKLYQDVMLENFKNLVSAGHLPFKPDIVSQLETEEKLWMMERETPRNGNSGSKNQ

SEQ ID NO: 23343 - protein, 81 aa, Pteropus vampyrus
MQEQVTFEDVVVYFSQEEWGLLDDTQRLLYRDVMLETFALTASLGCWHRIEEEEIPFEQKVSVEGVSQIRTPKAVPSTQKA

SEQ ID NO: 23344 - protein, 81 aa, Pteropus vampyrus
MGPAHRTLYRDVMLENCSHFVSMGYCIPKPQVIFKLEQGEEPWSLEEEFPNQRFPGGHIPAAQLKAETHPGQDTIPSQGAF

SEQ ID NO: 23345 - protein, 81 aa, Pteropus vampyrus
SVAFEDVAVNFTPEEWALLDPTQKKLYRDVMRETFENLASVGKRVEDYDTEDQYKNHGRKLRSHIEERIYESEASGQCEEN

SEQ ID NO: 23346 - protein, 81 aa, Pteropus vampyrus
PEESVTFKDVAVDFTQEEWGQLDSPQRALYRDVMLENYQNLLALGPPVCKPDVISHLEREWEPRPEMKEESCQQQVIYKEE

SEQ ID NO: 23347 - protein, 81 aa, Pteropus vampyrus
SRSLENDGVCFSEQEWENLEDWQKELYRNVMKSNYETLVSLKVLGQPEGEAELGTEMLGDLEEEGPGGVHPEGVMIKQETQ

SEQ ID NO: 23348 - protein, 81 aa, Pteropus vampyrus
FQGLLSFKDVAVDFTREEWQLLDTVQKNLYRDVMLENYSNLMSLGYQAAKPGAVVHWEKEEQGLVEREFPSHFSSEVIWQV

SEQ ID NO: 23349 - protein, 81 aa, Pteropus vampyrus
VTTVLLTPASQKSVLIGDMAEALTQWGQRHPPRGHMQEKHRNLVLLGLPISKPGVISQVEHGEELERKVPKATSPDWETRP

SEQ ID NO: 23350 - protein, 81 aa, Pteropus vampyrus
AVTFADVAVSFSREEWRLLDEAQRRLYLAVMLENFALVSSQGCCCGAEDVEASIEPSISVGASHGGTPKEPSSSQKTHPCE

SEQ ID NO: 23351 - protein, 81 aa, Pteropus vampyrus
MLFWSLSFRLVLESCSTQRHATPSPQAGPPVCKPDVISHLERGEEPWQVPREVPGGAHPEWEPRPEMKEESCQQQVIYKEE

SEQ ID NO: 23352 - protein, 81 aa, Pteropus vampyrus
LSQGLVTFKDVAVCFSQDQWSDLDPTQKEFYGEYVLEEDCGIVVSLSFPIPRLDEISQVREEPLVPDILELQEPQEPEILS

SEQ ID NO: 23353 - protein, 81 aa, Pteropus vampyrus
WLQGPVTFKDVAVEFTQEEWMMLGSAQRSMYKDVMLENYINLISVEYQLCKPTVISLLGQETGTMKRIPQDTYPDWEIQIK

SEQ ID NO: 23354 - protein, 81 aa, Trichechus manatus
SVAVEDVAVDFTQEEWALLDFSQRQLYRDVMMEIFRSLASVASRNLIDGDKLSTENIIVRFMKNDTWSSVVGETCELHGTE

SEQ ID NO: 23355 - protein, 81 aa, Trichechus manatus
AQESVTFNDVAVEFTWEEWQLLLPAQKDLYQDVMLENYSNLVSVGYQVSEPNAPCKLKRGEQPWPIQDEIHSQNFSEIWKA

SEQ ID NO: 23356 - protein, 80 aa, Trichechus manatus
MTKSQGSLSFKDVAVVFTWEEWQLLDPVQKNFYKDVMLENYSNLVSVGYEVPKADTVFQLEQGKPWIVEEEIQSQVHPGK

SEQ ID NO: 23357 - protein, 81 aa, Zalophus californianus
MLENYGNLVSVAGYQLSKPSVISQLEKGQEPWMTEKEGPGDPSSDLKNKTETNGSTAKNDILQEQLYHGIVMEGFLRDDVI

SEQ ID NO: 23358 - protein, 81 aa, Zalophus californianus
VQGQVNFEDVAVYFSQEEWGLLDEAQRLLYRDVMLENLALMASLGYESSTSHGVASLELGSKLWRSDWADVTPGGTREAQG

SEQ ID NO: 23359 - protein, 81 aa, Equus caballus
AHGSVTFRDVAIDFSQEEWECLDSAQRDLYRDVMWENYSNFVSLDLESRYRTNTLSPEKDIYEIYSFQWEIMERIKSYSLQ

SEQ ID NO: 23360 - protein, 81 aa, Equus caballus
CWGLLSFKDISMEFTWEEWQLLDPAEKHLYRDVILENYRNLLSVGYHGTKPDLIFKLEQGEEPWIVNARASRQSCPVEGWK

SEQ ID NO: 23361 - protein, 81 aa, Equus caballus
MLETCGLLVSLGHPVPKPELISLLEHGQELWSGKKVRFKSTYTGERRKHETTELTAASHLAFTEEAPFKEQVTQAAPRDSR

SEQ ID NO: 23362 - protein, 81 aa, Equus caballus
SLKGSVSFKDVTVAFTQEEWQHLDPAQRTLYRDVMENYSHLVSVGYCITKPEVVFKLEQGEEPWIYGLQISSPNCYVVFSF

SEQ ID NO: 23363 - protein, 81 aa, Neovison vison
MLENYGNLVSVGYQFSKPGVISQLEKGEEPWLIEREISGSPSSDLENKTETRESALKNDISWEELHHGLMKEQSTRGGTLY

SEQ ID NO: 23364 - protein, 81 aa, Loxodonta africana
QEQVSFKDVCVDFTQEEWYLLDPAQKILYRDVILENYSHIVSVGCCVTKPEVIFKIEQGEEPWILEEGFSGLRHPEDWKVD

SEQ ID NO: 23365 - protein, 81 aa, Pteropus vampyrus
QMPVTFEDVALYLSREEWGRLDHTQQSFYHDVLQKRNRLALGVSSSQRTLGSLDFSHSFPFSRTFWASQVQGKGKASSSCQ

SEQ ID NO: 23366 - protein, 81 aa, Pteropus vampyrus
TENSITFEDVSMDFTQEEWALLNSSQRKLYRDVMLENYRNLASLGHQFSKPALIAKMEREDEMETVERSHQDTYSGDYQAY

SEQ ID NO: 23367 - protein, 81 aa, Pteropus vampyrus
IREQRMPAVRGKPKSKEEWEGLSPIQKDLYEDVMLETYQNLVSVGLSCRRPSVITLLEKGKAPWTVEPARQRRGPDSGAKC

SEQ ID NO: 23368 - protein, 81 aa, Pteropus vampyrus
GSAAYEFLSVDYSERKWKGPALSQRAQRRNIMPETHRSVASWAGDIRMENSELPLKQEISKGSESSDGTSGGLYGVVPGGQ

SEQ ID NO: 23369 - protein, 81 aa, Trichechus manatus
FKEAVTFKDVAVVFTEEELELLDSAQRKLYQDVMLENFRNLVSLGHQSFTPNIIPPLEREEKLWMMKPATQRDSSLGGKNL

SEQ ID NO: 23370 - protein, 81 aa, Trichechus manatus
MLENYSHLLSVGYQVPKPEVIFKLEQGEEPWMLEGEPAHQSRSDEDIGQTQQQGISGEVSFHCERFDQSTGEDSVCSILEE

SEQ ID NO: 23371 - protein, 81 aa, Trichechus manatus
FQEAVTFRDVAVVFTKEELGLLNSAQRKLYRDVMVENFRNLVSVGSQPFTPGAMLQLGREAKLWMTETETQGDGCSGHRNQ

SEQ ID NO: 23372 - protein, 81 aa, Trichechus manatus
AQESLTFDDVAVEFTWAEWQLLGPDQKDLYRDVMLENYNNLVSVGYQAGKPDGLSKLEQGEELWTIEDEVHCQISPEIRKV

SEQ ID NO: 23373 - protein, 81 aa, Trichechus manatus
IRGLLTFGDVAIEFSQEEWECLNPAQRALYRDVMLENFRNLVSLGISPFEMNIISILKKGTELWMVEKKMKLANNTDVIST

SEQ ID NO: 23374 - protein, 81 aa, Trichechus manatus
MLENYFNLVSVGYQISKPEVIFNLEQGEEPYMLDDGEISRRSCQDGDIGFETSQQGISEQVLFQYEGVNLFTRDDSLYSII

SEQ ID NO: 23375 - protein, 81 aa, Trichechus manatus
SVVIEDVAVVFSQEEWALLDLAQRMLYRDVMMETFRNLASVVFQNLHDGETLFSEHVMVRFMKSTWSAVLGEISESYGNKD

SEQ ID NO: 23376 - protein, 81 aa, Trichechus manatus
SVAFEDVAVDFTQEEWALLDLSQRQLYRDVMMEIFRSLASVASRKVIDGCKLSTESITVRFMKNDTWSLMVREIFELPVTE

SEQ ID NO: 23377 - protein, 81 aa, Trichechus manatus
SVIVEDVAVLFSQEEWALLDLAQKTLYRDVMMETFRNLASVVSGNLKNGEKLSSEHIMVRLLKNETWSSMLGEISDQSHGN

SEQ ID NO: 23378 - protein, 81 aa, Zalophus californianus
HILALLTFRDVAIEFSQEEWGCLNHTQRELYRDVMLENYGHLLFLGLIVSKPDLIMFLEQERQLWDVKRKETVAFHPGRWE

SEQ ID NO: 23379 - protein, 81 aa, Zalophus californianus
MDSVAFEDVTVKFTMEEWALLDPSQKKLYRDVMQETFRNLASIVCISEEKWEIHDREDQNENHGTDLSQMVERLCKSKECS

SEQ ID NO: 23380 - protein, 81 aa, Equus caballus
VQEPVTFEDVAVAFTEEELGLLDATQRQLYRDVMLENFWNLLSVGNQPFKPELIFQLEREEKLSMMETETWRDGCSGTKNE

SEQ ID NO: 23381 - protein, 81 aa, Equus caballus
SLETVTFKDVAVDLTQEEWQQLKPAQRNLYRDVMLENYSNLVTVGYEVTKPDVIFKLEQEEEPWVVEEEMFGSHCPEVWEV

SEQ ID NO: 23382 - protein, 81 aa, Equus caballus
SRELVTFEDVAVYFIRKEWKRLEPAQRDLYRDVMLENYGNVFSLDGETRTEHDQEISEDTGSHGVLLGRLQKDISQGFKFE

SEQ ID NO: 23383 - protein, 81 aa, Equus caballus
VQASVTFRDVAVLFSRDEWLHLDSAQRTLYREVMLENYSTLVSLGILFSKPKVIFQLQQGEDPWMVENGVSQGACLGWESL

SEQ ID NO: 23384 - protein, 81 aa, Capra hircus
PQGSVTFEDVAVYFSWNEWCLLDEVQIRLYLDVMLENFALVCMLGSWRGVQDKETPSEEIKPAGVLQFLTPRAGLSPEKTQ

SEQ ID NO: 23385 - protein, 81 aa, Pan paniscus
GPLPGSLLFRSTIFGEFSLEEWQCLDTAQQNLYRNVMLENYRNLVFLGIAVSKPDLITCLKQGKEPWNMKRHEMVTKPPGM

SEQ ID NO: 23386 - protein, 81 aa, Lipotes vexillifer
AREPVTFEDVAVDFSQEEWQNVDPAQKTLHTDVMLEIYSHLVSVGCSGIKPDIISKLEHGEDLWIIKSELSRWIYSDKEKS

SEQ ID NO: 23387 - protein, 81 aa, Lipotes vexillifer
ELVTFRDVVISFSQEEWEYLDSAQRDLYWDVMMENYSNLVSLDLESKYDKKTLSTEKDIIEKNDSQWEVIESSKLVGLANS

SEQ ID NO: 23388 - protein, 81 aa, Pan paniscus
RDVAIEFSLEEWECLNPAQQNLYMNVMLENYKNLVFLGVAVSKQDPVTCLEQEKEPWNMKRHEMVDEPSAMCSYFTKDLWP

SEQ ID NO: 23389 - protein, 81 aa, Pan paniscus
GPLTFRDVAIEFSQEEWKSLDPVQKALYWDVMLENYRNLVFLGILPKCMTKELPPIGNSNTGEKCQTVMLERHECYDVENF

SEQ ID NO: 23390 - protein, 81 aa, Sousa chinensis
QESLTFQDVAVEFTREEWDQLYPAQKNLYRDVMLENYSNLVALGHELHKPEVITQLEQEEQWMMERDSPPDTHPGEKQAFG

SEQ ID NO: 23391 - protein, 81 aa, Pteropus vampyrus
SCEGSVSFRDVAVDFSREEWQHLDLAQKNLYRDVMLETCSHLLSVGYQVPEPEVFMLEQGKEPWALQDESPHQSSSEKLWQ

SEQ ID NO: 23392 - protein, 81 aa, Pteropus vampyrus
LMEAVTFGDVAVHFSREEWQCLDPGQRALYKEVMLENHSSVAGLGEPVPRGPLRSASSISAHLPGICERLGIWWPCSQALS

SEQ ID NO: 23393 - protein, 81 aa, Pteropus vampyrus
TDGLVTFRDVAIDFSQEEWECLDPAQRDLYVDVMLENYRNLVSLDLESTYETKNTFLGKDIFEINFSQWEIKEGKKTLGLE

SEQ ID NO: 23394 - protein, 81 aa, Pteropus vampyrus
MLENYRNLVTLGHQLYKPKVITQLEQEEQWMMERDSPLDIHPDGENKPEIKKSTPNQNISDENKTHDMIMERLAGDSFWYS

SEQ ID NO: 23395 - protein, 81 aa, Pteropus vampyrus
PEESVTFKDVAVDFTQEEWGQLDSPQRALYRDVMLENYQNLLALAGPPVCKPDVISHLEREWEPRPEMKEESCQQQVIYKE

SEQ ID NO: 23396 - protein, 81 aa, Pteropus vampyrus
QGSAAYEFLSVDYSERKWKGPALSQRAQRRNIMPETHRSVASWGDIRMENSELPLKQEISKGSESSDGTSGGLYGVVPGGQ

SEQ ID NO: 23397 - protein, 81 aa, Pteropus vampyrus
KPEDVSFAEVAVYFSLDEWGYLWPAQRALYRDVMRETYGHFGELGFPGPKPALISWMEQESEAWSPAAQDPEEGESVGGAV

SEQ ID NO: 23398 - protein, 81 aa, Pteropus vampyrus
QGCVTFEDVALYFSWEEWDLLDEAQRCLYHDVMLENLVLTSSLGCWSGVEGEEAASEQSSSVEGESQIRILKAGSSPQKAQ

SEQ ID NO: 23399 - protein, 81 aa, Pteropus vampyrus
SQSLVTFGDVAVDFSQEEWERLSSDQRDLYRRVMLENYRNLVSLGLCFSKPDIISSLEQRKELWMAKREVTRGQCPDWKAV

SEQ ID NO: 23400 - protein, 81 aa, Pteropus vampyrus
AHDLVMFGDVAIDFSQEEWECLNSYQRNLYRDVILENYSNLVSVGCSTSKPGVITLLEQGKEPWMVRYRDRQTDRWQEEGR

SEQ ID NO: 23401 - protein, 81 aa, Pteropus vampyrus
AQTSVTFKDVAVTFTQDEWEQLNPAQRTLYWEVMLETCRLLISLGYPVTHLEPMHLPEHRQELWMVKRGLSRSVCPGARTK

SEQ ID NO: 23402 - protein, 81 aa, Trichechus manatus
YQRSVSFKDVVVGFTQEEWHQLNPAERALYRDVMLETYSNLVSVGYEGTKPDVILRLEQEEAPWISEAGCHCREDFWEVDV

SEQ ID NO: 23403 - protein, 81 aa, Trichechus manatus
IKAQESLTLEDVAVEFTWEEWQLLGPAQKDLYRDVMLENFSNLVSVGIQKVDRLPEHLEDESWVDGKEQCYEYNALENVVH

SEQ ID NO: 23404 - protein, 81 aa, Trichechus manatus
KTQVSLEFNDVAVEFAWEEWQLLDPAQKDLYREVMLENFHNLVSVGCQVGKPDVLFRLEREPPWSLEDEIHSQNFSEIQEV

SEQ ID NO: 23405 - protein, 81 aa, Trichechus manatus
ALGCVTFEDVAIDFSQEEWGLLDETQRLLFYDVMLENFAIIASLGSLHGRQEEVETSSGHSVSVGVSQVRTSQAGPSTQKT

SEQ ID NO: 23406 - protein, 81 aa, Zalophus californianus
FKEAVTFKDVAVVFTEEELGLLDPAQRKLYRDVMLENFGNLVSVGEKVQHEMETIPKAEPHEELSCWQIWQHIANDLTRCQ

SEQ ID NO: 23407 - protein, 81 aa, Zalophus californianus
FQEPVMFKDVAVVFSEEELGLLDSTQRKLYRDVMLENFRNLVSVGNQPSKPELIFRLEREEKLLMMETETQRDGYLGTKSQ

SEQ ID NO: 23408 - protein, 81 aa, Zalophus californianus
ARPESVTFEDVAVYFSENEWTGLAPAQRVLYRDVMLENYGAVASLEGVLKSQKDFILKEERFEEAKDHVVLSSRPRWCGSQ

SEQ ID NO: 23409 - protein, 81 aa, Equus caballus
AQGSVSFKDVTVDFSREEWQHLDPAQKTLYMDVMLENYCHLVSVGCHMTKPEVILKLERGEEPWTSFTGHTCLEENWKAED

SEQ ID NO: 23410 - protein, 81 aa, Equus caballus
AQESVTFKDVAVLFTWDEWAQLSPAQRALHREVMLENYSTLVSLGILFSKPKVIFQLQQGEDPWMVENGVSQGACLGWESL

SEQ ID NO: 23411 - protein, 81 aa, Equus caballus
FQGSLTFSDVAIAFSQQEWEGLDPVQKTLYQDVMMENYRNLLSLGHAISKPGVITLLEQGKEPWMVEFNFSYGTCISAVFL

SEQ ID NO: 23412 - protein, 81 aa, Equus caballus
LVTFRDVAIDFSQEEWECLDPAQRDLYREVMLENYSNLVSLDLESSCGTKKSSPEKGTYETESLQWNYMRKPVSHNLKHHD

SEQ ID NO: 23413 - protein, 81 aa, Papio anubis
MTFEDIVVDFTREEWALLDTSQRKLFQDVMLENISHLVSIGKQLCKSVVLSHLQQVEKLSTQGISLLQGGEGDIKHQEIPF

SEQ ID NO: 23414 - protein, 81 aa, Aotus trivirgatus
MLENYGSVASLTAFPFPKPALISQLEGKAPWCSAPRGALDGEGQRGISSGEILELPGATMWSLRIKPIPKKTVAKQTETRS

SEQ ID NO: 23415 - protein, 81 aa, Aotus trivirgatus
GLLAFRDVAIEFSLEEWQCLNHAQQNLYRDVMFENYRNLVSLGIAVSKPELITCLEENNEPWNIKRNEMVCEVHKGGYNEV

SEQ ID NO: 23416 - protein, 81 aa, Sarcophilus harrisii
HQDLVTFKDVAVDFTPEEWGQLVPSQKELYRDVMLENYQNLVWLGLAVSKPDVIYQLEQVGGTWVPEGETLTVSCSDFVTR

SEQ ID NO: 23417 - protein, 81 aa, Lipotes vexillifer
PQEAVTFEDVAVNFSNEEWQCLTHAQRHLYKDVMLENYGNMVSLGFPFPKPPLISHLEQEAELCVQDGQDREFLSCSHPVS

SEQ ID NO: 23418 - protein, 81 aa, Lipotes vexillifer
SQLSVTFEDVAVFFTRDEWRKLAPSQRNLYQDVMLENYSNLVSLGLLFSKPEVISLLQQGEDPWKVEKESPGGSSVGCKSS

SEQ ID NO: 23419 - protein, 81 aa, Lipotes vexillifer
SQKQLTFKDVAIEFTQEEWECLDPAQRALYRDVMLENYRNLLFLVISVPDLNIICILEQEEEPLTVKSDMKIAKKTMAGDV

SEQ ID NO: 23420 - protein, 81 aa, Callorhinus ursinus
KIEDVADVAVSFILEEWGHLDQSQKSLYRDDRKENYGSITSMDYESGHDNVELAVKPISDDAEPHWMTSGSPERNVPQSQG

SEQ ID NO: 23421 - protein, 81 aa, Callorhinus ursinus
SLESDLFRDVAIVFSQEEWEQLAPTQRDLYRDVMLETYSNLVSLGLAIAKPDVISFLEQGKEPWVVEKMSRGGLCPVLESR

SEQ ID NO: 23422 - protein, 81 aa, Tursiops truncatus
MLENYSNLVSLGLLFSKPAVISLLQQGEDPWKVEKESPGGSSVGCKSSPKTTKSTQTQDSSFWGPVRKRLKKNEPWNFISE

SEQ ID NO: 23423 - protein, 81 aa, Tursiops truncatus
LPGLLTFKDVAITFSQEEWECLDPAQRALYRDVMLETYRNLLSLGEDISSPEVGSLSAGFAIKELSPREDITKGELYHLVI

SEQ ID NO: 23424 - protein, 81 aa, Pteropus vampyrus
PQESLTFEDVAVYFTEEEWASLVPAQRALYRDVMLENYGALAFLAPSTTKPALIYQLEQEKELCFSESQEALSGRASLAGY

SEQ ID NO: 23425 - protein, 81 aa, Pteropus vampyrus
MAVSEPGGSAAKEWEQLDPAQRNLHKDVMLENCSHLASMGYQAAKPDMISKLEKGEEPWLGKGKTPRQGGPNETARPKQTE

SEQ ID NO: 23426 - protein, 81 aa, Pteropus vampyrus
NSNTVLFTHTVEPLQFLTFFQEQQKMNIAQGSVSFEDVTVEFTPGYCITKPQVIFKLEQGEEPWSLEEEFPNQRCPGYYKV

SEQ ID NO: 23427 - protein, 81 aa, Pteropus vampyrus
PQKSVTFEDVAVYFTPTEWDGLSPAQRALYRDVMLENYGNVASLGFPLLKPAVISQLEERSELEGPSPLAAGTGTGPPDLR

SEQ ID NO: 23428 - protein, 81 aa, Pteropus vampyrus
IVTFKDVAVVFTEEELALLDKAQINLYQDVTLENFRNLVSVGDGIKNNILNLQEKGLSCLSREVLYCWQIRKQRISELTVS

SEQ ID NO: 23429 - protein, 81 aa, Pteropus vampyrus
QESVTFEDVAVDFTQEEWALLDTSQRELFRDVMLENISHLVSIDRGDDLKKQEMISIQHSYKKDTSLLDAVRFHTQEYPFE

SEQ ID NO: 23430 - protein, 81 aa, Monodelphis domestica
AQEVVSFKDVAVDFTREEWRLLSPPQKELYKEVMLENARNLLSVGLSAPPEDMFSSLEQREAPWMLEKDDLRSCCPEGKMR

SEQ ID NO: 23431 - protein, 81 aa, Monodelphis domestica
FQTPLTFQDVAVDFSWEEWGLLEPFQKDMYWDVMLENYENFVSLGGLPISIPDVISQLERLEAPWMAEKGVLISTFLDSLS

SEQ ID NO: 23432 - protein, 81 aa, Aotus trivirgatus
MGLLTFRDVAIEFSLEEWEHLDSNQKNLYGDVMLENYRNLVCLGLAVSKPDLITFLEQRKEPWNVKSVETVAIQPDVFSRN

SEQ ID NO: 23433 - protein, 81 aa, Papio anubis
GEACIGGDVTFSDVAIDFSHEEDLYKDVMVQNYKNLVSVTGLSVTKPYVITLLEDGREPWMVEKKLSKDWESRWESKELST

SEQ ID NO: 23434 - protein, 81 aa, Aotus trivirgatus
MFSDVSIDFSQEEWDCLDPVQRDLYRDVMLENYSNLVSMGLYTPKPQVISLLEQGKEPWMVGRELTRGLCSDLESMCETKL

SEQ ID NO: 23435 - protein, 81 aa, Aotus trivirgatus
TFKEAVTFKDVAVFFTEEELELMDPAQRKLYRDVMLENFRNLLAVGHQPFHGDTFYFLREEKFWMMETRSQGEGNSGGRIQ

SEQ ID NO: 23436 - protein, 81 aa, Aotus trivirgatus
SVVFEEVAVRFTPEEWALLSHAQRRLYRDVMLEICRNLASLGKDSCLHYVPGEQRYLGLISNEEEIAKFTRSDSWSIFGQN

SEQ ID NO: 23437 - protein, 81 aa, Lipotes vexillifer
MLVTYEDVAVTFTQEEWGQLDPAQRTLYQEVMLETCGLLVSLGCPLPKAELIHPLEHSPELQTWKRGLSPSSCPGDNTKAD

SEQ ID NO: 23438 - protein, 81 aa, Pan paniscus
QGRLTFRDVAIEFSLAEWKFLNPAQRALYREVMLENYRNLEAVDISSKRMMKEVLSTGQGNTEVIHTGTLQRHQSYHIGDF

SEQ ID NO: 23439 - protein, 81 aa, Pan paniscus
GHLTFRDVAIEFSLEEWKCLDPMQRALYRAMMLENYRNLHSVDISSKCMMKKFSSTAQGNTEVDTGTLERHESHHIGDFCF

SEQ ID NO: 23440 - protein, 81 aa, Tursiops truncatus
QQEPVTFEDVTVYFTQNEWVILDPVQRALYREVMLENYANVTSLAFSFTRPVLVSQLEAGELPWGLDPWEPVGREALRGVC

SEQ ID NO: 23441 - protein, 81 aa, Tursiops truncatus
QPQEAVTFKDVEVTFSQDEWGWLDASQRNLYRDVMLENYGNVTSLVGPFTKPALISWLEAREPWGLNVQGAHPKRSPSAAP

SEQ ID NO: 23442 - protein, 81 aa, Sarcophilus harrisii
AQESVSFRDVAVDFSQEEWGFLDASQKKLYREVMLENYRNLASLGLPVCKPDEVSQLERGDAPWMLEREGPRASLADWELR

SEQ ID NO: 23443 - protein, 81 aa, Pan paniscus
APLQFRDVAIEFSLEEWHCLDTAQRNLYRNVMLENYRNLVFLGIVVSKPDLITCLEQGEKPLTMKKHEMVAQPLSNVLLLF

SEQ ID NO: 23444 - protein, 81 aa, Lipotes vexillifer
FQDLMTFEDVAVEFTRWEWGQLDPTQKDVYREVMLENFKNLASLGFPMSKPYVICRLEEGEEPCILERDISTGAPAGYYKC

SEQ ID NO: 23445 - protein, 81 aa, Callorhinus ursinus
SQGSISFEDVTVNFTQEEWGQLDPDQRTLYRDVMLENYSIFISLEELKVDGIIESKENQDRHYGKMITEKENVLRKTFNLY

SEQ ID NO: 23446 - protein, 81 aa, Callorhinus ursinus
FQRSVTFRDVAVAFSQQEWESLNPAQRHLYRNVMLENYSNLVSLAGHSISKPHVITLLEQWKEPAMIVRKDQRRQYTDFQL

SEQ ID NO: 23447 - protein, 81 aa, Tursiops truncatus
SLGSDLFRDVAVVFSQEEWEQLAPAQRDLYRDVMLEIYSNLVSLGFAISKPDVISFLEQGREPWMVEKVATGGQCPDQVSQ

SEQ ID NO: 23448 - protein, 81 aa, Trichechus manatus
PQGLLTFRDVAVEFSQEEWECLDPAQKTLYKDVMLENYRNLVSLAGISVSELNIISVLEQGTEPWTLEGKEKIAKYPDVSP

SEQ ID NO: 23449 - protein, 81 aa, Trichechus manatus
PQKLVTFEDVAVYFTQTEWDGLSPTQRALYRDVMLENYGHVASLDIDIQTDNNLTKEMCEEKDSTSFKLQRNFPQEADFPE

SEQ ID NO: 23450 - protein, 81 aa, Trichechus manatus
ERDRVTFEDIAVYFTWKEWGLLDEAQRHLYHDVMLENFSLVASLGLASSKSCVVAQLEQDREPWMPDTVDASPATAREAQR

SEQ ID NO: 23451 - protein, 81 aa, Trichechus manatus
LQEAVTFKDVAVVFTEEELGLLDSTQRTLYRDVMLENFRNLLSVGHQPFKPDLISQLEKEEKLLMMETETQGDEGSGDKSQ

SEQ ID NO: 23452 - protein, 81 aa, Zalophus californianus
MLENYSHLVSLGLSLSKPTLISFLEQDNEPWIVEKESPKSLYPDVKSQCATKELSSKDDNYEMKLSQRKKMERLTSHDFGC

SEQ ID NO: 23453 - protein, 81 aa, Zalophus californianus
MKGLDQASGNIAVYSAFSVLSQKEQKKNKSQGSISFEDVTVNFTQEEWGQLDPDQRTLYRDVMLENYSIFISLEKCPVNII

SEQ ID NO: 23454 - protein, 81 aa, Zalophus californianus
RPESVTFEDVAVYFSENEWTGLAPAQRVLYRDVMLENYGAVASLAFPFPKPALISQLERGEAPWCKAPQGARDGEGPRGVS

SEQ ID NO: 23455 - protein, 81 aa, Aotus trivirgatus
EMGPLTFRDVAIEFSLEEWQCLDTAQQDLYRKVMLENYRNLAFLGIAVSKPDLITCLEQGKEPWNMKRQEMVDETPVIYSH

SEQ ID NO: 23456 - protein, 81 aa, Papio anubis
PQGLLTFRDVVIEFSQEEWKCLDPAQRTLYRDVMLENYRNLVSLDISSKCMMKTLSSTGQGNTEVILKGTLQRQASHHIGE

SEQ ID NO: 23457 - protein, 81 aa, Papio anubis
MHSLNKVTFEDVAIDFTQEEWAMTETSKRKLYRDVMLENVSHLQISKSYITLQLEQGRELWWDGRQFLQGQNLDKESALEK

SEQ ID NO: 23458 - protein, 81 aa, Aotus trivirgatus
KGCVTFEDIAIYFSQEEWGRLDEAQRLLYLEVMLENFALVASLGVTSRQGLPQDCGCGHGTEDEKTPSEQNVSIGVSQSKA

SEQ ID NO: 23459 - protein, 81 aa, Papio anubis
MDTVVFEDVVVGFTLEEWALLNPAQRNLYREVMLETFKHLASVDDEAQLKTNASISQQDTSGEKLSLKQKIEKFTRKHTWA

SEQ ID NO: 23460 - protein, 81 aa, Aotus trivirgatus
VTFEDVAVYFIRKEWKRLEPAQRDLYRDVMLENYGNVFSLDRIRVSLTIQKVMLAWFTGTLTVGRGLCPSELASVEPPDTN

SEQ ID NO: 23461 - protein, 81 aa, Papio anubis
VAFEDVAVNFTQEEWALLGPSQNNLYRYVMQETIRNLDCIRKIWEGQNTEDQNKNPRRNLRCHMLERFSESKDSSQCGEPF

SEQ ID NO: 23462 - protein, 81 aa, Aotus trivirgatus
QGHVTFEDIAVYFSQEEWGLLDEAQRCLYHDVMLENFSLMTSVAGLSQNNHKDSCLQWKVPVSMKNCVAQCSPDEVHYTPM

SEQ ID NO: 23463 - protein, 81 aa, Pan paniscus
QGLLTFRDVAIEFSQEEWKCLDPAQRTLYRDVMLENYRNLVSLDISSKCTMKEFSSTAQGNREVFHAGTSQRHESHHNGDF

SEQ ID NO: 23464 - protein, 81 aa, Tursiops truncatus
ARLTFKDVVIEFSPEEWECLDPAQRALYRDVMVENYRNLISVDLSHIHVIKKLQLKSNTDIGEIFPTVMLGSHGSCEIKHF

SEQ ID NO: 23465 - protein, 81 aa, Tursiops truncatus
AHMSLSFRDVAIDLSQEEWECLDAVQRALYRDVMLENYSNLVSLGCSSPKPDVITLLEQEKEPWTVMREGTRSWYTDLESK

SEQ ID NO: 23466 - protein, 81 aa, Tursiops truncatus
MLETYSNLVSVGYEGTKPYVILRLEQEEAPWICEASCSGCHCRENIWQGNVQKKRRQDMLLRQGTFISKKTLPKERSHECN

SEQ ID NO: 23467 - protein, 81 aa, Pteropus vampyrus
MESVTFEDVAVTFTLEEWALLDPSQKKLYRDVMQETIRNLASVGKKWENHYIEDKYKNQGRKQSSHKVKRIYEEKKSSQCG

SEQ ID NO: 23468 - protein, 81 aa, Pteropus vampyrus
VKKPVTFEDVAVNFTQEEWESLDASQRVLYQDVMSETFKNLVSVACIFLSNPDLITKLEQDEKQWRADLCPPNREGHPSGG

SEQ ID NO: 23469 - protein, 81 aa, Pteropus vampyrus
SRSLENDGVCFSEQEWENLEDWQKELYRNVMKSNYETLVSLKVLGQPEGEAELGTEMLGDLEEEGPGGVHPAEGVMIKQET

SEQ ID NO: 23470 - protein, 81 aa, Pteropus vampyrus
AHGSVTFRDVAIDFSQEEWEFLDSAQRDLYRDVMWENYSNFISLAGPSISKPDVVTLLDEGKEPWMVVREGISRHYPDLES

SEQ ID NO: 23471 - protein, 81 aa, Pteropus vampyrus
NFQGSVTFQDVALDFTPEEWQLLDCDQRTLYWDVMLENFRNLISVGGPVTKTKVIFKQGQEPQMVERENPYWSRPEAECPH

SEQ ID NO: 23472 - protein, 81 aa, Trichechus manatus
SQELLTFRDVAIEFSQEEWDCLDPTQRTLYRDVMLENYRNLVSLGVSPSEMNIICILKKETEPWTVEKTMKLANNSDVFSP

SEQ ID NO: 23473 - protein, 81 aa, Aotus trivirgatus
EMGPLTFRDVAIEFSLEEWQCLDTDQQDLYRNVMLENYTNLVFLGIAVSKADLITCLQQEKDPWNMKRHSIVAKPPVLCSH

SEQ ID NO: 23474 - protein, 81 aa, Aotus trivirgatus
EAVTFKDVAVFFTEEELELMDPAQRKLYRDVMLENFRNLLAVGGRIQTETATVPEARTHEKFSCQKIWEQIASDLTKSQDS

SEQ ID NO: 23475 - protein, 81 aa, Aotus trivirgatus
SQGSVLFEDVSVYFTQKEWQLLDPAQRLLYRDVMLENYRHLVSLGHCVTKPELIVKLKQGDEPWILKRQPPSQSHSEDQKA

SEQ ID NO: 23476 - protein, 81 aa, Aotus trivirgatus
QMPVTFEDVALYLSREEWGRLDHTQQNFYRDVLQKRNGLSLGKHLPGGGTGVSGRGPIQEGQGVPIPPVAALGDVKPFRIR

SEQ ID NO: 23477 - protein, 81 aa, Aotus trivirgatus
MGPLQFKDVAIEFSLEEWHCLDTAQRNLYTDVMLENYRNLVFLGIVVSKPDLITCLEQGKKPLTMKKHGMIAKPPVMCSHL

SEQ ID NO: 23478 - protein, 81 aa, Aotus trivirgatus
QDSVAFEDVAVSFTQEEWALLDPSQKNLYRDVMQEIFKNLASVGKTWQVQNIEDKYKNSRRNLSLLIREKLFESKESNHRG

SEQ ID NO: 23479 - protein, 81 aa, Papio anubis
PQGLLTFRDVAIEFSQEEWKCLDPAQRTLYRDVMLENYRNLVSLAISSKCRMKKFSSTGQGNIEVIHTGTLQSQASHLIGE

SEQ ID NO: 23480 - protein, 81 aa, Sarcophilus harrisii
YQESLTFEDVAVYFTRKEWKHLDSCQKDLYRNVMLENYGNMTLLKFTVSKPELISQLELGEEPWVLTLQGAEDQDTSKGFY

SEQ ID NO: 23481 - protein, 81 aa, Lipotes vexillifer
LQEPVTFRDVAVDFTQEEWGQLGPAQRTLYRDVMLETFGHLLSVGPELPKPEVISQLEQGAELWLAETGIAQGRCPGWGRG

SEQ ID NO: 23482 - protein, 81 aa, Lipotes vexillifer
SAAGSVTFKDVTMAFTKKEWEQLDPAQKSLYKDVMLENYSNLASMGYQALKPDMISKLGKEEPWLGKGKRPRQGDLSEIAR

SEQ ID NO: 23483 - protein, 81 aa, Papio anubis
PQASVCFEDVAMAFTQEEWEQLDLAQRTLYREVTLETWEHIVSLGLFLSKSDVISQLEQEEDLCRAEQVAPREGGAAGSFL

SEQ ID NO: 23484 - protein, 81 aa, Aotus trivirgatus
MGPLTFRDVKIEFSLEEWQCLDTAQRNLYRDVMLENYRNLVFLAMCSHFTQNCWLEQNIKGSFRKVTLSRYGKCGHKNLQL

SEQ ID NO: 23485 - protein, 81 aa, Aotus trivirgatus
AIRSVMFSDISIDFSPEEWEYLDLEQKDLYRDVMLENYSNLVSLGCFISKPDVISLLEQGKEPWKVVRKRRRQYPEMLLLL

SEQ ID NO: 23486 - protein, 81 aa, Sarcophilus harrisii
TQELVTFKDVAVDFSPEEWGLLDPDQRELHKEVMLENAENLLSLGVPVPREDFISHVERGGLRNSCPDAETLFDMKEVSAN

SEQ ID NO: 23487 - protein, 81 aa, Callorhinus ursinus
SQESVTFQDVAVDFTEKEWPLLDSSQRKLYKDVMLENYSNLASVGYQVGKPSLISHLEQEEELRTEERALHQATSPDWETP

SEQ ID NO: 23488 - protein, 81 aa, Callorhinus ursinus
QAEVTFEDVAVLFSREEWGRLGPAQRGLYRDVMLETYRNLVSLGRGTRTEYKELSSGEMLDEEELDQLQRAVPQGPDPGET

SEQ ID NO: 23489 - protein, 81 aa, Callorhinus ursinus
LQEPVTFRDVAVDFTQEEWGQLGPAQRTLYRDVMLETFGHLLSVGPELPKPEVISQLEQGAELWAAERGIAQGYCPGREPG

SEQ ID NO: 23490 - protein, 81 aa, Callorhinus ursinus
MAFSQEEWGCLNHTQRELYRDVMLENYGHLLFLGFIVSNHLVIVSTDLVIFLEQKNAHWDVKTVAIQLVCTDEEGAHLCVV

SEQ ID NO: 23491 - protein, 81 aa, Lipotes vexillifer
GSVSFTDVTVDFTQEEWEQLDPSQRILYMDVMLENYSNLLSVEVWKADDQMERDHRNPDEQARPFIIFKNQTSIEERDNLF

SEQ ID NO: 23492 - protein, 81 aa, Lipotes vexillifer
FFDLVMFRDVTVDFSQEEWECLNSNQRNLYRDVILENYSNLVSLGGCSVSKPDVITLLEQGKEPWMVVRDEKRRWSLDLES

SEQ ID NO: 23493 - protein, 81 aa, Lipotes vexillifer
PQEPVTFEDVAVYFTQNQWASLEPVQKALYREVMLENYANVASLEALPFPSPVLIAQLERGEAPWGPDPWEAEILRGICPG

SEQ ID NO: 23494 - protein, 81 aa, Tursiops truncatus
PQGCAISEDVFVYFSREEWVLLDEDQRLLYRDVMLENFALLASLGITSSRSYLVTQLEQGEEPWMPAQVDMTAATEKEAQK

SEQ ID NO: 23495 - protein, 81 aa, Tursiops truncatus
QLTFKDVAIEFSQEEWECLDPAQRALYRDVMLETYGNLLSLDASLKCVIKESAPKENSHTGEVLQTVLLERHESCETEDYG

SEQ ID NO: 23496 - protein, 81 aa, Tursiops truncatus
KSAAMSFADVAVYFSPEEWGCLRPAQRALYRDVMRETYGHLDALGFPGPKPALISWMEQESEAWSPAAQDPEEGESLGGAL

SEQ ID NO: 23497 - protein, 81 aa, Tursiops truncatus
RPRAVKFGDVAVYFSPEEWECLWPAQRALYRDVMQETYGHLGALGCAGPKPTLISWLERNTDDWEPAALDPQECPRRVTVQ

SEQ ID NO: 23498 - protein, 81 aa, Tursiops truncatus
WLQGPVSFEDVTVEFTQEEWVLLDSAQRSMYRDVMLENYMNLTLVEYQLCKPVISLSGQEDIRTVKRRIPQGTCLDWEIQL

SEQ ID NO: 23499 - protein, 81 aa, Tursiops truncatus
LQETLTFRDVFVDFTLEEWQQLDATQRNLCKDVMLENYSHLVSDSSWPNQVGPSGWDKEKRRPGWQLEKAQHRGVQISILC

SEQ ID NO: 23500 - protein, 81 aa, Tursiops truncatus
PQDLVTFKDVAIDFSQEEWEWLNPAQRSLYRSMMLENYQSLVSVGLCVSKPYVISLLEQGKEPWEMKSEMRRTPFPDWESV

SEQ ID NO: 23501 - protein, 81 aa, Pteropus vampyrus
CEVSISFEDVTVDFSREEWQHLDPAQRCLYRDVTLENYSHLLSVGYQVPKPEIIFQLEQGEGPWMLERETPHQSYSDEDIG

SEQ ID NO: 23502 - protein, 81 aa, Pteropus vampyrus
TQESVTFRDVAVHFSRDEWLYLDPAQRALYREVMLENYSSLVSLGILFSKPKVIFQLQQGEDPWMVENGVSCGACLGWESL

SEQ ID NO: 23503 - protein, 81 aa, Pteropus vampyrus
WKAWVKKPVTFEDVAVNFTQEEWESLDASQRVLYQDVMSETFKNLVSVDLITKLEQDEKQWRADLCPPNREGHPSGGKKEE

SEQ ID NO: 23504 - protein, 81 aa, Trichechus manatus
SVIIEDVAVLFSQEEWALLDLAQRRLYRDVMMETFRNLASVVSLHLNDGENLSSEHIMVRLMKNNTWSSMLGEISDSLGNK

SEQ ID NO: 23505 - protein, 81 aa, Trichechus manatus
AQVSVTFEDVAVTFTQEEWGQLDLTQRSLYQEVMLENCGLLISLGCPVPKPELIYELELRQKLWAVKKDLSLSIFPGDKTK

SEQ ID NO: 23506 - protein, 81 aa, Trichechus manatus
IKSQVSFEDVAVDFTLEEWQLLNLTQKNLYRDVMLENYSNLVFLGYQIIKPNAIFKLEQGEEPWIIDEEMISQNFSEVWLD

SEQ ID NO: 23507 - protein, 81 aa, Trichechus manatus
SVAFEDVAVDFTQEEWALLDLSQRKLYRDVMMEIFRNLASVVSRKLNDGEKLSSENIILRFMKNDTWSSMVGEMCELHGTE

SEQ ID NO: 23508 - protein, 81 aa, Trichechus manatus
LVLIEDVVVVFTQEEWALLDLAQRKLYKDVTMETFKNLASVVSQNLNDGDKLSSEHTIVRLMKNDTWSSVLGEISESYGSK

SEQ ID NO: 23509 - protein, 81 aa, Trichechus manatus
VYPCPDPLHFAPSESLSLPHTSLPLKASGDFARYTGPPKPISFSAHHTAGVLVFKPELISRLEQGQEPWVLDLQASEGRET

SEQ ID NO: 23510 - protein, 81 aa, Trichechus manatus
ESVTFKDVALDFTQEEWSLLDTTQRNLFRDVMKENINHLVFIVISVRESGRKKQEVISCRKNISTIMAMQRSLTEENPFEC

SEQ ID NO: 23511 - protein, 81 aa, Trichechus manatus
LREPVTFEDVAVHFSKEEWACLDPSQRVLYQDVMLENFRTLAALGLHGLRPQLVLCLEKWVEPWADKWERSEALAWPRGSS

SEQ ID NO: 23512 - protein, 81 aa, Trichechus manatus
QCLPLKYEGGMGKNELLSFEDVAMFFTREEWENLDSAQKYLYRDVMLENYRNLIFLDQRDKTKLQDISLQLTNHHIPFTSP

SEQ ID NO: 23513 - protein, 81 aa, Trichechus manatus
AEGCVNFEDVAIDFSQEEWGLLDETQKLFYCDVKLENFAVISSLACWHGVEEEKASSEQSVSLEGVLQVRTPQEVHPPRRL

SEQ ID NO: 23514 - protein, 81 aa, Leptonychotes weddellii
WGAWLEKPVTFDDVAVNFTQEEWVCLDASQRVLYQDVMSETFRNLMSVDLIIELEQEEKQWRAELQLRPPNGEGLPSGGRK

SEQ ID NO: 23515 - protein, 81 aa, Monodelphis domestica
PAQEVVTFQDVAVDFTREEWRLLSPPQKVLYKEVMLENVRNLLSVGLSAPPEDMILEQREAPWMLEQEGLKCCCPGEVRSE

SEQ ID NO: 23516 - protein, 81 aa, Monodelphis domestica
CRVSVTFKDVAVEFTSEEWGCLKPFQKQLYRDVMLENYRNLVSLGFTVSKPDVICRLERKKASWMPEANVPRSSSASEYLK

SEQ ID NO: 23517 - protein, 81 aa, Physeter macrocephalus
PKVPVTFDDVAVYFSEQEWGKLDECQRELYKHVMRGNYETLVSLDYAISKPDILTRMERGEEPCPEGPRGREEGSDREEAR

SEQ ID NO: 23518 - protein, 81 aa, Monodelphis domestica
FIFRIWKFDVAVDFTQEEWCLLDHSQKELYLEVMLENVQNLLSVGKDHFLLLISAQGSTCACFSIKKRRKKKKTLNSVMGS

SEQ ID NO: 23519 - protein, 81 aa, Monodelphis domestica
SQGSITIKDVTVDFTQEEWVLLDHSQQELYLEVMLENVQNLLSVGLLVPRENVISSFQQGEAPCLLEQDCPRSSCPEAKIY

SEQ ID NO: 23520 - protein, 81 aa, Monodelphis domestica
WQDSLTFKDVTVDFTQEEWHLLNHSQKELYKTVMLENSQNLLSLGIPVVREDLISHFEEKEALWILDQKGLKNSSLDGETS

SEQ ID NO: 23521 - protein, 81 aa, Monodelphis domestica
SQMSLTFQDVTVDFSQEEWDRLEPAQKDMYRDVMLENYENFVFLGLPVSKPDVISHLERRETSWMTESEVLISTYLDSLIP

SEQ ID NO: 23522 - protein, 81 aa, Monodelphis domestica
AQESLTFQDVAVDFTQEEWRLLEPPQKELYREVMLDNAQNLLFLGIPVPRGYLISHFKQEGPRNSCLDAETRVDVKELPTE

SEQ ID NO: 23523 - protein, 81 aa, Physeter macrocephalus
GQLTLNDVVIEFSQEEWECLDPAQRALYRDVMLETYRNLISLDISQIHVIKKLQLKSNTDRGGVFQTLMLGSHESQGIKHF

SEQ ID NO: 23524 - protein, 81 aa, Monodelphis domestica
LAAQVTFKDVAVDFTREEWRLLSPPQKELYKEVMLENTWNLLSVGLLAPPEDVISSLEQREAPWMLGQEGLRSCCPGEREG

SEQ ID NO: 23525 - protein, 81 aa, Aotus trivirgatus
TSALMAFWDVAVAFTQKEWQLLSSAQRTLYREVMLENYSHLVSLGIVFSKPKLITQLEQGDEPWREENKHLLDLCPETHKL

SEQ ID NO: 23526 - protein, 81 aa, Aotus trivirgatus
EPGAVTFGDVAVYFSREEWGCLRPAQRALYRDVTRETYSHLGALGVGGSKPALISWMEEEAELWGPAAQDPEVAKCPTEAD

SEQ ID NO: 23527 - protein, 81 aa, Aotus trivirgatus
PQASVCFEDVAMAFTQEEWGQLDLAQRTLYREVTLETWEHLVSLGLLLSKPDVISQLEQEEDLCRAEQVALQDWKATLEKN

SEQ ID NO: 23528 - protein, 81 aa, Aotus trivirgatus
SVTFEDVFVYFSRDEWELLEEAQRFLYRDVMLENFALVATLGFWCEAENEEAPSEQSISVEGVSQVRTAEPGLFQKAHPCE

SEQ ID NO: 23529 - protein, 81 aa, Papio anubis
RNVMLENYKNLVFLGIDISKQGPLTSLEQEKEPWNMKRHEMVDESPGQVWLTPVISALWEARAGGLLEPRSLRPAWSTWKN

SEQ ID NO: 23530 - protein, 81 aa, Aotus trivirgatus
IGWQESVTFQDVAVGFTPEEWQLLDCNYRNLFSVGCPVTKTKVILKAEQEQEPWIVEGVNPHQSSPESDCPLVDEPGKHWE

SEQ ID NO: 23531 - protein, 81 aa, Aotus trivirgatus
EMGLLTFRDVAIEFSLTEWQFLDTAQRNLYRNVMLENYENLVFLGIAVSKPDLITCLEQEKELWNMKRLEVVDKPPVLCSH

SEQ ID NO: 23532 - protein, 81 aa, Aotus trivirgatus
VTFEDVFVYFSRDEWELLEEAQRFLYRDVMLENFALVATLAFIFQFHVVAHLERGRKPWVPNRADITPATIWETWGGPVLA

SEQ ID NO: 23533 - protein, 81 aa, Papio anubis
GLLTFRDVAIEFSQEEWKCLDPAQRTLYRDVMLENYRNLVSLGIFSKYEIKELPTKKESNTGEIFQTVMLERHESHDIEDF

SEQ ID NO: 23534 - protein, 81 aa, Sarcophilus harrisii
TSWLHQESVTFKDVAVDFTQEEWRQLNPSQKELYRDVMLENYRNLVFLDVIYQLEQRKIPWMLGREVPRSTYTDWETKPEI

SEQ ID NO: 23535 - protein, 81 aa, Sarcophilus harrisii
CQRPVTFQDVSVDFTWEEWGQLDLPQRDLYRDVMLENYENLVFLGLSVSKPYVISQLERGEAPGLLKEPEEEVLIDPGPDY

SEQ ID NO: 23536 - protein, 81 aa, Lipotes vexillifer
LQGSVTFQDVAVDFTLEEWQLLGCAQRKLYWDVMLENFRNLISVGCPVTKTKVIFKVEQGQEPWMVEGENPRWRSPEVICL

SEQ ID NO: 23537 - protein, 81 aa, Pan paniscus
TGYVTFEDVAVYFSQEEWRLLDDAQRLLYRNSFWLSAATHLSFSLGLASSKTHEITQLESWEEPFMPAWEVVTSAIPRGCW

SEQ ID NO: 23538 - protein, 81 aa, Pan paniscus
PQLTFEDVAVKFTQEEWNLLSEAQRCLYRDVTLENLALISSLGCWCGVEDEAAPSKQSIYIQRETQVRTPMTGVSPKKAHP

SEQ ID NO: 23539 - protein, 81 aa, Lipotes vexillifer
SLGSVSFKDVTVDFSREEWQQLDLAQKSLYRDVMLENYFNLISVGCQVPKPEVIFNLERGEEPCMLDGEISSQSYLDQGIG

SEQ ID NO: 23540 - protein, 81 aa, Pteropus vampyrus
VLEQVTFEDVVVDFTQEEWEQLTPAQRMLYSDVMLDTFELLVSIGHWLPKPAVISLLEQEAEPWAAAEGVPDGVCPDFETG

SEQ ID NO: 23541 - protein, 81 aa, Pteropus vampyrus
DQALMAFQDIAVAFTEKEWKILSPAQRTLYRDVMLENYSHLVSLGIAFSKPELITQLEQGDEPWKDESECLLDLCPAEPRT

SEQ ID NO: 23542 - protein, 81 aa, Pteropus vampyrus
QESVTFKDVAVDFTLEEWGRLGPGQRELYRDVMLETYQNLLSLGAGLPGSKPDVISRLERGEEPRMEEREVWQVTCPDLET

SEQ ID NO: 23543 - protein, 81 aa, Aotus trivirgatus
QAEVTFEDVAVLLSREEWGRLGPAQRGLYRDVMLETYGNLVSLALGTSTEYKELTSRETFDEEELGRLRGIFPQGSEPVDA

SEQ ID NO: 23544 - protein, 81 aa, Aotus trivirgatus
SQEPVTFADVAVVFTPEEWVFLDSTQRSLYRDVMLENYRNLASVAGDQLCKPNALSYLEQRGEQWTTERGVISDTCPEPQL

SEQ ID NO: 23545 - protein, 81 aa, Aotus trivirgatus
IQGQVNFEDVFVYFSQEEWVLLDEAQRLLYRDVMLENFALMASLGCWPGMKDEEIPFEQSISIGLSQIRIPKGSPSTQKAY

SEQ ID NO: 23546 - protein, 81 aa, Pan paniscus
APDLDTVTFDDVAVDFTQEEWTLLDPSQRDLYRDVMLENYENLASVEWRLKTKGPALLQDGSWFRASNETQMARSHNGGQL

SEQ ID NO: 23547 - protein, 81 aa, Lipotes vexillifer
FQVPVTFSDVAIDFSQEEWECLNSDQKNLYRDVMLENYTNLISLDIDFTSESNKLSSEKSSYEVNSYHRETMNRSKTFNFM

SEQ ID NO: 23548 - protein, 81 aa, Lipotes vexillifer
MLENYGHLVSLGFNISKPHVVSLLEQGKDWRNPWLGKDASRGLFSASESNGEIKEFSPKNVIYEDDSSQYLIRSSNLSFER

SEQ ID NO: 23549 - protein, 81 aa, Callorhinus ursinus
FQGSVTFRDVAIDFSQEEWEWLQPAQRDLYRHVMLENYGHLVSLAGFNISKPYVVSLLEQGREPWLVKGDVRRDPFSESNG

SEQ ID NO: 23550 - protein, 81 aa, Callorhinus ursinus
MFKDVAVVFSEEELGLLDSTQRKLYRDVMLENFRNLVSVGNQPSKPELIFRLEREEKLLMMETETQRDGYLGTKSQHIMES

SEQ ID NO: 23551 - protein, 81 aa, Callorhinus ursinus
NSQGFVSLKDVTVDFTWEEWQHLNSAQRNLYRDVMLENYSNLVSVGCQSLKSDVISLKQGEPWMKEEEISSWAYSDFDIRP

SEQ ID NO: 23552 - protein, 81 aa, Callorhinus ursinus
MLENYSNLVSIGLCIPKPDVISLLEQGKEPWSVFDSELTRGLYLEYKSRCKNKKLSLKKDNYKIDSSQCVIMEGFTKHGLK

SEQ ID NO: 23553 - protein, 81 aa, Tursiops truncatus
FQEPVSFKDVAVTFTKEELGLLDSTQRKLYQDVMLENFRNLVSVGYLPFKLDMILQLGRKKKLWVMEPEAQGAGCSGHGNQ

SEQ ID NO: 23554 - protein, 81 aa, Tursiops truncatus
GGTGMCKGFEDIAMYFSWEEWGLLDEAQRRLYLEVMLENSALVSSLKRFPPFSDFRSPAMHSSHFFRVQPACLQKYPWTHA

SEQ ID NO: 23555 - protein, 81 aa, Tursiops truncatus
VTFEDVAINFTQEEWALLDTSQKTLFRNVMLENITHLVSVGESVNTDVSHTQGDPVGWTDLSDEFTPRSSPQHSPIPLRRK

SEQ ID NO: 23556 - protein, 81 aa, Tursiops truncatus
PLGPVSFKDVAVDFTQDEWQQLDPEQKTTYRDVMLENYSHLVSVEEDWEAHDLIEGAQENEDKHSRQTESVNNKTLIEERG

SEQ ID NO: 23557 - protein, 81 aa, Tursiops truncatus
PALSVQISTASEEQQKMSKSQGFVSFKDVTVDFTQEEWQQLDSAQRNLYKDVMLENYSNLVSVVNLDGKKMGTASCSFFRG

SEQ ID NO: 23558 - protein, 81 aa, Tursiops truncatus
MDPALEEWKLLDEAQRFLYHDVMLETFALAASLGLSSSRYHVVQLELRGEPWVHDRVDMTPDRARGAQIWPGPGCWYIAEN

SEQ ID NO: 23559 - protein, 81 aa, Pteropus vampyrus
SQGRLTLSDVFVEFSQEEWECLAPAQRAFYREVMLESYQNLLFLGISVPDLYIVSILEQGKAPWTLESELKIAQKPNWWEC

SEQ ID NO: 23560 - protein, 81 aa, Pteropus vampyrus
MFQVTFSDVAIDFSHEEWRWLDSAQRNLYKDVMVQNYENLVSLGLSIPKPYVITLLEDGKEPWMVEKKLTKAMFPGWESKW

SEQ ID NO: 23561 - protein, 81 aa, Pteropus vampyrus
MRLSAHSGFGEMAVFSLLLREEPCLCCQARKPDTLSRLDQGEPPWTLADRVYSRTRSGIRKVDDHELEHFQDGSLENNLEQ

SEQ ID NO: 23562 - protein, 81 aa, Pteropus vampyrus
GLLIFRDVAIEFSQEEWECLDTAQRALYRDVMSENYRNLLSLGLAVSKSETCLLDPIIFLEQMKEPWDLKRKKTISIHPAV

SEQ ID NO: 23563 - protein, 81 aa, Pteropus vampyrus
FVGPVSFKDVAVDFTQEEWQQLDLVQRTTYRDVMLENYSHLVAVGCHVVKPEVIIKLEQGEEPWIVEGEVLLQSYPEVWKV

SEQ ID NO: 23564 - protein, 81 aa, Pteropus vampyrus
VAIDDVAVNFTLEEWALLDPSQKKLHKDVMQEIFRNLDSIGKKWEDQNIEDQYKHQGRKLRSQMVEILCENKEESQRGENS

SEQ ID NO: 23565 - protein, 81 aa, Pteropus vampyrus
SQGTVTFKDVAIDFTQEEWQQLDPAQRNLYRNVMLENYNNLITVGYPFTKPDVIFKLEQEEEPWVVEEEVLRRHCPGEIWG

SEQ ID NO: 23566 - protein, 81 aa, Pteropus vampyrus
SVAFEDVAVNFTPEEWALLDPSQKKLYRDVMRETFENLASVGKRVEDYDTEDQYKNHGRKLRSHIEERIYESEASGQCEEN

SEQ ID NO: 23567 - protein, 81 aa, Monodelphis domestica
SQGFITFKDVTVDFTQEEWCLLDYSQKDLYREVMLENVKNLFSVGLSVLREDFVSSFQKGEGTWLLEQKGSKSSCPGTQTN

SEQ ID NO: 23568 - protein, 81 aa, Physeter macrocephalus
VKESVTFKDVAIDFTLEEWRLMDLTQRKLHKDVMLENYRNLVSLGLAVSKPDMISHLEDEKGPWVVVRETSKTPYSELETK

SEQ ID NO: 23569 - protein, 81 aa, Physeter macrocephalus
QLTFEDVAIEFSQEEWECLDPAQRALYRDVMLETYRNLISLDISPIHVIKQLQPKVNSDKGEVFQTPMLGRPESCKIKHFH

SEQ ID NO: 23570 - protein, 81 aa, Monodelphis domestica
PLTFRDVAVDFTREEWRYLHPSQKDLYRDVMLENYRNLVCLGKHSSPGPQNLSGGGSLLSFLVHIVGSPECFLLHVWPTDD

SEQ ID NO: 23571 - protein, 81 aa, Physeter macrocephalus
RISAFTQGLQKTTKSQEEWQYLDPPQRDLYWDVMLENYINLISVGYKTTKPAVIYKLEQGEEPWMVEREISSWRYPEKVWQ

SEQ ID NO: 23572 - protein, 81 aa, Monodelphis domestica
SQESVTFKDVAVYFTQEEWGQLDPGQKYLYRDVMLENYRNLVSLGHHISKPDVISHLEQGEEPWMVGIEILRGTSPGGMTR

SEQ ID NO: 23573 - protein, 81 aa, Monodelphis domestica
AQEVVTFKDVAVDFTREEWCLLSPPQKELYKEVMLENAQNLLSVGLPGPPEDVISYLKQRKDPWMLEQEGLRSCCPEGEIR

SEQ ID NO: 23574 - protein, 81 aa, Physeter macrocephalus
SQGSLSFRDVTVGFTQEEWQHLDSAQRTLYRDVMLENYSHLISVGFCIPKPEVILKLEQGEEPWILEEESPSQCVPELINS

SEQ ID NO: 23575 - protein, 81 aa, Monodelphis domestica
SITFKDVAVDFTQEEWCLLDHSQKALHLEVMLENVQNLLSVETETNFEVKELSRKVNLIIEGSGPQGYINENPHDFFLREI

SEQ ID NO: 23576 - protein, 81 aa, Monodelphis domestica
QGALTFKDVAVDFTQEEWCLLDHSQKELYLEVMLENVQNLLSVETETNFEVKEMSTKLTLFVEGFGPERCLNDGPHVFILR

SEQ ID NO: 23577 - protein, 81 aa, Monodelphis domestica
VQVPIKFEDVAVYFSEPEWKNLDQWQKELYKHVMTANYEILFSLDSAIPKPDLISHIERGEEPFLRDHGNLMKRDKTIGYG

SEQ ID NO: 23578 - protein, 81 aa, Monodelphis domestica
SQGPVKFEDVAIYLWKEEWELMDSTQKRLYRQVMLETYENVLSVGTPHDKPAMIVHLEQGETAWSPALQRPGKEKGRLHGH

SEQ ID NO: 23579 - protein, 81 aa, Monodelphis domestica
LSQRDSDVAVDFTQEEWCLLDHSQKELYLEVMLENVEHLISCFQQGKAPWLLEKKGPRSFSPDFKVKLICTKLSPFMEGSV

SEQ ID NO: 23580 - protein, 81 aa, Monodelphis domestica
MVENAQNLLSVGLPAPPEDVISYLEHREAPWILDEEDPSCCCPEGENRPKIKVNPTDMSLPVEDMDLQRFLSDDPDNVAFR

SEQ ID NO: 23581 - protein, 81 aa, Monodelphis domestica
SQKALTFQDVAVEFTQEEWGLLEPAQKNMHRDVMLENYENFVSLGLPVPKSALIFHLERRETPWLPSGEVLRNTYPDYLVQ

SEQ ID NO: 23582 - protein, 81 aa, Monodelphis domestica
MAGSVTFRDVAVDFSPDEWGRLGPAQRELYREVMLENYRSLAWLAGLAGSCPEVVCQLERGAGPWLLEGDGLASGGPEAGE

SEQ ID NO: 23583 - protein, 81 aa, Monodelphis domestica
SQEYVSFKDVTVDFTHEEWCLLDSSQKALYRDVMLEIAQNLHSLAGLPVPKADLISQLDQEEVPWLLDPKDPRNSCLDRQT

SEQ ID NO: 23584 - protein, 81 aa, Papio anubis
LVMFQDLFIDFSQEEWECLDADQKDLYRDVMMENYSSLVSLDSEFRCKTKDSCLPKEIYEVTSSQWVRMEKCHSLVGSSVR

SEQ ID NO: 23585 - protein, 81 aa, Papio anubis
DSVTFEDVAVDFTQEEWTLLDQTQRNLYRDVMLENYKNLVAVDWESHVNTKWSAPQQNCLQGKTSSVVEMSHTLSPRLECS

SEQ ID NO: 23586 - protein, 81 aa, Papio anubis
MGLLTFRDVAIEFSQEEWEHLDSDQKLLYGDVMLENYRNLVSLGLAVSKPDLITFLEQRKEPRNVKSEETVAIQPDMFSHD

SEQ ID NO: 23587 - protein, 81 aa, Papio anubis
SQHLVTFEDVAVDFTQEEWTLLDQTQRDLYRDVMLENYKNVIILAGSELCKTSLMSGLEQMEELRTGVTGVLQGEKQYCRE

SEQ ID NO: 23588 - protein, 81 aa, Aotus trivirgatus
IQDSVVFEDVAVDFTQEEWALLDLAQRNLYRDVMLENFQNLASLGYLLHTPHLISQWEQEEDLQTVKRELIQGICVREHQE

SEQ ID NO: 23589 - protein, 81 aa, Papio anubis
VTFEDVAVYFIRKEWKRLEPAQRDLYRDVMLENYGNVFSLDWIHISLTMQKVMLAWFTGTLSVGKDSGSRELASVEPPDTF

SEQ ID NO: 23590 - protein, 81 aa, Papio anubis
SQESVAFEDVAVYFTTKEWAIMVPAERALYRDVMLENYEAVAFVVPPTSKPALVSHLEQGKESCFIRPQVVLSRSDWRAGL

SEQ ID NO: 23591 - protein, 81 aa, Papio anubis
MFKEAVTFNDVAVAFTEEELGLLPAQRKLYRDVMVENFRNLLSVGHQPFKQDVSPIERNEQLWIVTTATQRQRNLGEKNQS

SEQ ID NO: 23592 - protein, 81 aa, Aotus trivirgatus
VTFEDVAVNFSKEEWCLLSEAQRCLYRDVMLENLALISSLGCWCGLKDEAAPSKQSLTVQTESQDRTPRAVSPKKAHSCDM

SEQ ID NO: 23593 - protein, 81 aa, Sarcophilus harrisii
MFEDVAVYFTQKEWADLAPAQRALYKDVMLENYGNIVSLAFPFPKPAVISKLEQGEEPWSLDPQVAPNGEGLKGISFSKTA

SEQ ID NO: 23594 - protein, 81 aa, Pan paniscus
EMGLLTFRDVAIEFSPEEWQCLDTAQQNLYRNVMLENYRNLAFLGIAVSKPDLITCLEQGKEPWNMKQHEMVDEPTDRVLL

SEQ ID NO: 23595 - protein, 81 aa, Pan paniscus
PQGSLTFRDVAIEFSQEEWKCLDSVQKALYRDVMLENYRNLGFLGLCLPDLNIISVLEQGKEPWTVVSQVKIARNPNCGEC

SEQ ID NO: 23596 - protein, 81 aa, Lipotes vexillifer
AKDCVTFEDVAIYFSQEEWGLLDEAQRLLYCDVMLENFALIASLGLTSFRSHVVAQLEMGAEPWVPDRVDMTSAMARGAYR

SEQ ID NO: 23597 - protein, 81 aa, Aotus trivirgatus
DSMTLEDIVVDFTREEWALLDTSQRKLFRDVMLENISHLVSIGKEGDIKHQEMPFIQHIYQKDISTISTMRSHTQDDPFLC

SEQ ID NO: 23598 - protein, 81 aa, Aotus trivirgatus
RPRALKFVDVAVYFSSEEWGCLRPAQRALYRDVMRETYGHLGALGFPGPKPALISWMEQESEAWSSAAQDPEKGENLGGAR

SEQ ID NO: 23599 - protein, 81 aa, Papio anubis
LTGLLTFRDVAIEFSQEEWKCLDPAQRTLYRDVMLENYRNLVSLDISSKCMMNTLSSTGQGNTEVFHTGILQRQASYHIGA

SEQ ID NO: 23600 - protein, 81 aa, Aotus trivirgatus
AHALVTFRDVAIDFSQKEWECLDPTQRKLYRDVMLENYSNLVSLGLLSRHKTKKLSSEKDIHEISFSKGNIIEKSKTLHLK

SEQ ID NO: 23601 - protein, 81 aa, Aotus trivirgatus
TSKEAVTFKDVAVVFTEEELGLLDSAQRRLYRDVMLENLRNLLSVGHLPFNRDTFHFLREEKFWMMDIATQREGNSGGKIE

SEQ ID NO: 23602 - protein, 81 aa, Aotus trivirgatus
TQESLTLEDVAVEFSWEEWQLLDTAQKDLYRDVMVENYNHLVSLGYQTSKPDALSKLAHGQEPWMTDAKIQNKNCPGIRKV

SEQ ID NO: 23603 - protein, 81 aa, Aotus trivirgatus
MLENYRNLAFLGIAASKPDLITCLEKAKEPWKMKQHAMVDEPPVICPHFAQDLWPEQGMEDSFQKVILRRYQKCGHENLQF

SEQ ID NO: 23604 - protein, 81 aa, Aotus trivirgatus
GMTFEDVAIYFSQEEWELLDEAQRFLYCNVMLENFAHVTSLGFCHGTENEAIASEHSVSLQVRTSKGDTPTQNTHLTEVKM

SEQ ID NO: 23605 - protein, 81 aa, Lipotes vexillifer
RKVPVSFEDVSVYFTKTEWKLLDLRQRMLYKRVMLENYRHLVSLGFSSSKPHLVSRLERGEGPWVADVHRMGTTTGMQAGD

SEQ ID NO: 23606 - protein, 81 aa, Pan paniscus
VKESLTLEDVAVEFSWEEWQLLDTAQKNLYRDVMVENYNHLVSLGYQTSKPDVLSKLAHGQEPWITDGKIQNKNCPGIGKV

SEQ ID NO: 23607 - protein, 81 aa, Lipotes vexillifer
SVTFEDIAVYFSWEEWRLLDETQRRLYLDVMLENFALISSLGCCCGAEDAEAPFEQITSLGVSQARIPKAALSSQKTHPCE

SEQ ID NO: 23608 - protein, 81 aa, Lipotes vexillifer
SRSLENDGVCFSAQEWENLEGWQKELYTNAMKSSYETLVSLKVLGQPEGEAELGTEMLDDLEEEDSHGVHPVEGVMIKQEI

SEQ ID NO: 23609 - protein, 81 aa, Pan paniscus
ETVTFKDVAMDFTPEEWGKLDPVQRDVMLENYRNLVSLWLPVSKPENYNLENGKEPLKLERKAPKSSYSDVETRPQSKDST

SEQ ID NO: 23610 - protein, 81 aa, Lipotes vexillifer
AQVLVTFKDVAVTFTREEWGQLDLDQRTLYQEVMLEICGLLVSLGHPVPKPESIHLLEHGQELWTGRRGLPRSMCPGDRAK

SEQ ID NO: 23611 - protein, 81 aa, Callorhinus ursinus
FQELVTFRDVAIDFSRQEWEYLDPIQRDLYRDVMLENYRNLVSLGHSISKPDVVDLLEQGKEPWMILREETQGQYTDLDLH

SEQ ID NO: 23612 - protein, 81 aa, Callorhinus ursinus
MDFTLEDWEHLGLDQGDLFWDTALDNYQNLFLLNPSKPKLTSHTDGTEELKVLVRESPESAGPDTAEVKNCLLAQDFLEEE

SEQ ID NO: 23613 - protein, 81 aa, Callorhinus ursinus
FQESVTFEDVAVYFSENEWTGLAPAQRVLYRDVMLENYGAVASLAFPFPKPALISQLERGEAPWCKAPQGALDGEGPRGVS

SEQ ID NO: 23614 - protein, 81 aa, Callorhinus ursinus
CEGLVSFEDVTMDFSREEWQQLDPAQRCLYWDVMLEIYSHLLSVGYHIPNPEIISRMEKGKKSWIRGAQLPHQRHREVVFG

SEQ ID NO: 23615 - protein, 81 aa, Tursiops truncatus
EEGRVTFEDVAVYFSQEEWGLLDKAQRLLYRSVMLENFSLMASLGLTFSRTQEITQLEQWGEPFVPACEVVITATPRGCWC

SEQ ID NO: 23616 - protein, 81 aa, Tursiops truncatus
MDFTPEEWGRLDPAQRDVMLENYRNLVSLWLPVSKPENHNLENGKEPLMLERKAPKSSCSDSETRPGSKDSTSVQDFSKEE

SEQ ID NO: 23617 - protein, 81 aa, Tursiops truncatus
ASQGLLTFQDVVIEFSQDKWEFLESTQWELYRDVMLENYKNVVSLGPVSKPDLVTFMEQRRAPWDVKGMETIAIHPGTGDP

SEQ ID NO: 23618 - protein, 81 aa, Tursiops truncatus
SAAGSVTFKDVTMAFTKKEWEQLDPAQKSLYKDVMLENYSNLASMGYQALKPDISKLGKGEEPWLGKGKRPRQGGLSEIAR

SEQ ID NO: 23619 - protein, 81 aa, Tursiops truncatus
MVENYSHLISLAGCSIPKPDVFSLLERGKEPWMVVRAMTRWSSDLEYICETKRSCPEKGTYEMESLQWENMRKPISHNLEC

SEQ ID NO: 23620 - protein, 81 aa, Pteropus vampyrus
LQEQVSFKDVCVDFTQEEWYLLDPTQKILYRNVMLENYSHLVSIGCCTIKPEVIIKIEQKEEPWILEQGFPSQCHPEDWKV

SEQ ID NO: 23621 - protein, 81 aa, Pteropus vampyrus
TQASVSFKDVTVEFTLEEWQYLSASQRTLYRDVMLENYSHLISVGYCFTKPELIFMLEQGEALWLLEKEFLSRSSPEESQL

SEQ ID NO: 23622 - protein, 81 aa, Pteropus vampyrus
SQHLVTFEDVAVNFTQEEWTLLDQTQRDLYRDVMLENYKNLITLGYESCKPSVSSGLERAGELKTATGGVWQELDLQLKTK

SEQ ID NO: 23623 - protein, 81 aa, Pteropus vampyrus
PQGLVTFEDVAVDFTQEEWQYLNPPHRTLYRDVMLETYSNLVSVAGQQATKPDIILKLEVEEPCLAEGIIPIWSFPEEACQ

SEQ ID NO: 23624 - protein, 81 aa, Papio anubis
SQGRVTFEDVTVNFTKGEWQRLNPEQRNLYRDVMLENYSNLVFVGREETTKPDVILRLEQGKELWLVEEEVLGSGRPEKNR

SEQ ID NO: 23625 - protein, 81 aa, Aotus trivirgatus
MAATGPCSEAPVQGCDAGELQQLGLCGVPDVQRSWSKFCNFPLTGYHVSKPDVIFKLEQGEEPWIVEEFSNQSYPEVDHTL

SEQ ID NO: 23626 - protein, 81 aa, Papio anubis
FEELVTFEDVFVDFSPEELSSLSAAQRNLYREVMLENYRNLVSLGYQFSKPDIISRLEAEESRAMETDSRHTVICQGEAHD

SEQ ID NO: 23627 - protein, 81 aa, Aotus trivirgatus
MLENYKNLSTVGCQLFKPSLISWLEQEESRTVQRGDFQTGSHNGGELNDIKQCGDVSSEHSCLNTHVRTQNSESTFECHQY

SEQ ID NO: 23628 - protein, 81 aa, Aotus trivirgatus
QERLTFRDVSIEFSSAEWKCLTPAQRALCREVMLENYRNLESVANGNLNCSSFLRKQINHLGKKQYECDVCGKVFNEKRCL

SEQ ID NO: 23629 - protein, 81 aa, Papio anubis
QDTVAYEDLCVDYTQKKWKCPALSQRALQWNMIPQNDHGMASLGRNVMESSELIPKQEIFKGSESSNSTSGGLFGVVPGAA

SEQ ID NO: 23630 - protein, 81 aa, Aotus trivirgatus
GSVTFEDVAVYFSWEEWDLLDETQKHLYFDVMLENFVLTSSLGYWRGLEREEAPSSSRISVKGVPQFRTSKEGSSSQTAYS

SEQ ID NO: 23631 - protein, 81 aa, Aotus trivirgatus
SKGSLMFRDVSIDFSQEEWECLDSGQMNLYKEVMLENFSNLVSVGLSSSKPAVISLLEQGREPWMVDRELTRGLCSDLESM

SEQ ID NO: 23632 - protein, 81 aa, Lipotes vexillifer
KIEDVADVAVSFILEEWGHLDQSQKSLYRDDRKENYGSITSMDYESRNDNVELIVKQISDEAASPWMTSGSPERNVPPSQE

SEQ ID NO: 23633 - protein, 81 aa, Lipotes vexillifer
MLENFRNLLSVGNQPFKPELIFQLEREEELLMMETETQREGCSGTKSQHIMESIQEVGLSCLSPKELSTWQTWQQGAGMLT

SEQ ID NO: 23634 - protein, 81 aa, Pan paniscus
PRGSTFFSSVTVAFAQEGWRCLVSTPRERFKEGIPGKSRSLVLLGLPVSQPGMNSQLEQREGAWMLEGKDLRSPSPGWKII

SEQ ID NO: 23635 - protein, 81 aa, Pan paniscus
WSQMPVTFEDVALYLSREEWGRLDHTQQNFYRDVLQKKNRLSLGFPFSRPFWAPQAHGKGEASGSSRQAGDEKEWRGACTG

SEQ ID NO: 23636 - protein, 81 aa, Lipotes vexillifer
QAQETLTFEDVAVDFTWEEWQLLAPPQRDLYRDVMLENYSNLLSVGFQASKPNILSKLGQGEPWMMEDEIHCQTRSEIWKV

SEQ ID NO: 23637 - protein, 81 aa, Lipotes vexillifer
KEAFMAFGDVAVDFTQEEWRLLSPAQRTLHREVMLETYNHLVSLEIPFSKPKLISQLERGEEPWIKERQRPLSLCPAGSKL

SEQ ID NO: 23638 - protein, 81 aa, Callorhinus ursinus
PKVPVTFDDISIYFSTPEWEKLEEWQKELYKNIMKGNYESLISMDYAMNQPDVLSQIQPEGEHNTEEQAGPEGSEIPTDPS

SEQ ID NO: 23639 - protein, 81 aa, Callorhinus ursinus
SQEPVTFEDVAVYFTQNQWASLDPMQRALYLEVMLENYANITSLAALPFPKPDLILQLEQGEAPWGLDPWTPLDGEALGGV

SEQ ID NO: 23640 - protein, 81 aa, Callorhinus ursinus
TEQAVMFRDVAVDFSQEEWEFQDLKQRNLYRDVMLENYSHLVSLGLSLSKPTLISFLEQDNEPWIVEKESPKSLYPDVKSQ

SEQ ID NO: 23641 - protein, 81 aa, Pan paniscus
SLEVGVLTFRDVAIEFSLEEWQCLDTAQQNLYRNVMLENYRNLVFMGIAASKPDLITCLEQGKEPWNVKRHEMVAEPPGLQ

SEQ ID NO: 23642 - protein, 81 aa, Lipotes vexillifer
QMDSVVFEDVAVNFTAEEWALLDPAQRKLYRDVMLETFRNLASVGNTGQETSYSLECKKSGKALTCPSSFQEHERVHYGQK

SEQ ID NO: 23643 - protein, 81 aa, Callorhinus ursinus
MAFSQEEWGCLNHTQRELYRDVMLENYGHLLFLGFIVWNHLVIVSTDLVIFVEQKNAHWDVKTVAIQLVCTDEEGAHLCVV

SEQ ID NO: 23644 - protein, 81 aa, Callorhinus ursinus
SQGLVTFKDVAVCFSQDQWSDLDPAQKEFYGEYVLEEDCGIVVSLSFPIPRLDEISHVREEEPLVPDTPEPQEPQEPEILS

SEQ ID NO: 23645 - protein, 81 aa, Tursiops truncatus
AHGSLTFSDVAIGFSQQEWECLDLVQKTLYRDVMMENYGNLVSLGHSISKPNVITLLEQGKEPWMFMREKTRSWCTDLDSR

SEQ ID NO: 23646 - protein, 81 aa, Tursiops truncatus
VQASLSFEDVAVHFTWEEWQLLDPSQKDLYRNVMWENYCNLVSVGYQTPKPDSFFQLEQGEPPWTVEGAGQSQTCPGTRAS

SEQ ID NO: 23647 - protein, 81 aa, Tursiops truncatus
SRSLENDGVCFSEQEWENLEGWQKELYTNAMKSSYETLVSLKVLGQPEGEAELGTEMLGDLEEEDARGVHPAEGVMIKQEI

SEQ ID NO: 23648 - protein, 81 aa, Sousa chinensis
TSLSNKKNLVSYDDFLLSKFYPSPGEAQKRRKQCMLNLYKQFSGYVGVSSFFSSKPTVISLLEQGKEPWMVDRELTRGLCS

SEQ ID NO: 23649 - protein, 81 aa, Pteropus vampyrus
SQTLLTFEEVAVYFSQEEWELLDPSQKAFCNDIMQENYESVISLAIFVLPKPKVISCLEQGEEPWVQGSPNLKNNDKELPT

SEQ ID NO: 23650 - protein, 81 aa, Pteropus vampyrus
VQSPLFPTSQKGCTEEEGFVNGFLTSWLLDLVTFEDVAVEFTQEEWALLDPSQRKLYRDVMLETCRNLASLGKADITPTSV

SEQ ID NO: 23651 - protein, 81 aa, Pteropus vampyrus
AHGSVTFRDVAIDFSQEEWEFLDSAQRDLYRDVMWENYSNFISLGPSISKPDVVTLLDEGKEPWMVVREGISRHYPDLESR

SEQ ID NO: 23652 - protein, 81 aa, Trichechus manatus
ESVTFKDVAVDFTLEEWALLDTSQRKLFRDVMMENIDHLVFVGGETGLNKEEMVSLQHISRKDTPTIMALRSLTGEDTFEC

SEQ ID NO: 23653 - protein, 81 aa, Papio anubis
AQGLVTFRDVAIEFSLEEWKCLEPAQRDLYREVTLENFGHLASLGLSISKPDVISLLEQGKEPWMIANDVTGPWCPDLESR

SEQ ID NO: 23654 - protein, 81 aa, Papio anubis
FQKPVTFEDVAVNFTEEEWDCLDASQRVLYQDVMSEIFKNLASVARIFLHKPERITQLEQQEEQWRETQVLQASQAGPPFF

SEQ ID NO: 23655 - protein, 81 aa, Aotus trivirgatus
VQESVTFRDVAVFFSPDEWLHLDSAQRALYREVMLENYSSLVSLGIPFSMPKVIHQLQQGQDPCMVEGEVPSDICLGFKTW

SEQ ID NO: 23656 - protein, 81 aa, Aotus trivirgatus
LVTFRDVAIDFSQEEWECLDPAQRDLYRDVMLENYSNLISLDLESSCEINKLSPEKEIYEVESFQWENMGKFINHHLQYNG

SEQ ID NO: 23657 - protein, 81 aa, Papio anubis
PQGHLTFMDVAIEFSQEEWKCLDPGQRALYRDVMLENYRNLVSLGRSCILGSNAENKPTKNQLGFTLESHLSELQLFEAGR

SEQ ID NO: 23658 - protein, 81 aa, Aotus trivirgatus
LFQVTFSDVILLRDLYKDVMVQNYENLVSLGLSITNNVITLLEDGKEPWMVEQKLSKGVTPDWESKLENKELSTKKDIYEE

SEQ ID NO: 23659 - protein, 81 aa, Aotus trivirgatus
KSQGSVSFKDVAVGFTWEEWQLLDPVQKTLYRDVMLENYSNLVSLGYQVTKADALFRLEHRKLWILEEEIQSQVCPEDAWQ

SEQ ID NO: 23660 - protein, 81 aa, Callorhinus ursinus
TFKEAVTFKDVAVVFTEEELGLLDPAQRKLYRDVMLENFGNLVSVGHQPFKRDVVHLVREEKFWMVKLATQRKGNSGEKVQ

SEQ ID NO: 23661 - protein, 81 aa, Callorhinus ursinus
AVTFKDVVVVFTEEELALLDKAQINLYQDVMLENFRNLVSVGDRIKNNISHLQGKGLSYLSQKVLYCWQIWKQRISELTVS

SEQ ID NO: 23662 - protein, 81 aa, Callorhinus ursinus
YQEFVTFEDVAVHLTREEWGCLDPVQRDLYREVMLENYGNVVSLGFPISKPDGISQREQDLQVFDLETKNREVLRDDCSDG

SEQ ID NO: 23663 - protein, 81 aa, Callorhinus ursinus
MDSVVFADVAVYFTPEEWALLNRGQRRLYRDVMLETCRNLASLDCCIQVKPCGSGTQLNILENELSSEDKIVRFTRNDSWA

SEQ ID NO: 23664 - protein, 81 aa, Callorhinus ursinus
SVAFQDLAVRFSEEEWQLLGEGQRALYRDVMRENYETLRSLGTDELLPLSAFLSPTAPGGATEGRSYAGEGQEPPRGGGPL

SEQ ID NO: 23665 - protein, 81 aa, Callorhinus ursinus
SQHLVTFEDVAVNFTQEEWTLLDQTQRDLYRDVMLENYQNLIILGCESCKPDLNSSVGGAEELRTGGRGILQELDLQLKTK

SEQ ID NO: 23666 - protein, 81 aa, Callorhinus ursinus
MLENYGNLVSVGLLSSKPKLITQLEQGAEPWMEVKQIPSDTCSVQEYWFETKMSPLKQHTSEGSDLGEQTKSDVMERGLDW

SEQ ID NO: 23667 - protein, 81 aa, Callorhinus ursinus
MLENYRNLVSVGYVARKPDALSRLEQGELWTTEHEIPSRICPEIKKDDGHLQGHLQNQRCPKRMKQCHEHNAFGNVIHQSK

SEQ ID NO: 23668 - protein, 81 aa, Tursiops truncatus
MLENFRNLISMGCPVTKTIVIFKVEQGQEPWMVEGENPRWRSPEADCPLIDESDKHQESKDNFLNSVLFMFNKILTVKRLH

SEQ ID NO: 23669 - protein, 81 aa, Tursiops truncatus
CEGSVSFEDVTIDFSREEWQQLDPAQRRLYQDVMLEIYSHLFSVGYRIPNPEIIFRMEKRKEQWMREAELPRQRYHEGESG

SEQ ID NO: 23670 - protein, 81 aa, Tursiops truncatus
VPVTFDDVAVYFSEPEWGKLDEWQKELYKHVMRGNYETLVSLGLPPYPEHTSSPVSPARKEPKEGQASKHQQDSETRVTPP

SEQ ID NO: 23671 - protein, 81 aa, Monodelphis domestica
MLENYRNLVCLGLADSNKDVRISELESGEPHWIPTGGVLRSCWPGWESRPQNKESAPKMSISVKVLSQEKFLEDDPRICKM

SEQ ID NO: 23672 - protein, 81 aa, Papio anubis
GSVTFTDVAIDFSQDEWERLNLAQRSLYKKVMLENYRNLVSVGLCLSKPDVISLLEQEEDPWVIKGEMTRSLCPDLECVWV

SEQ ID NO: 23673 - protein, 81 aa, Papio anubis
WSQMPVTFEDVALYLSREEWGRLDRTQQNFYRDVLQKRNGLSLGFPFSRPFWAPQALGKGEASGSSRQTGDEKEEWRGAYS

SEQ ID NO: 23674 - protein, 81 aa, Papio anubis
PLTFKDVAIEFSREEWKCLEPVQKALYKDVMLENYRNLVFLGISPKCVIKELPPTENSNTRERFQTVALERHQSCDIENLY

SEQ ID NO: 23675 - protein, 81 aa, Sarcophilus harrisii
RRESVTFKDVAVEFTLEELVHLNPSQKKLYKEVMMENYKNLVFLGCTISKPDMIYQMESKEIFWVPDADIPRTSCPETKEC

SEQ ID NO: 23676 - protein, 81 aa, Pan paniscus
ALAQGQLSFSDVAIEFSQEEWKCLDPGQKALYRDVMLENYRNLISLDFSLLAWDARVSRVEAWRASGGAEEPTDPNFVGND

SEQ ID NO: 23677 - protein, 81 aa, Pan paniscus
AQESLTLEDVAVDFTWEEWQFLSPAQKDLYRDVMLENYSNLVAVGYQASKPDALFKLEQGEQPWTTEDGIHSGACSDIWKV

SEQ ID NO: 23678 - protein, 81 aa, Lipotes vexillifer
AAVSFADVAVYFSPEEWGCLRPAQKALYRDVMRETYGHLDALGDAPNKKEEEPKTGPGAKGSEKTPRKERPEELVKNNLDP

SEQ ID NO: 23679 - protein, 81 aa, Pan paniscus
KSKEAVTFKDVAVVFSEEELQLLDLAQRKLYQDVMLENFRNVVSVGHQSTPDGLPQLEREEKLWMMKMATQRDNSSGAKNL

SEQ ID NO: 23680 - protein, 81 aa, Lipotes vexillifer
GQLTLNDVVIEFSQEEWECLDPAQRALYRDVMLETYRNLIFVDISHIHVTKKLQLKSNTDKGGVFQTLMLERHESQGIKHF

SEQ ID NO: 23681 - protein, 81 aa, Lipotes vexillifer
LQDLVSFEDVTVEFTQEEWALLDPSQRTLYRDVMLENCRNLASLGYHVDKPSLISQLEQEDKVMAEETGILPGTCPDLETV

SEQ ID NO: 23682 - protein, 81 aa, Lipotes vexillifer
PEGGVTFEDIALYFSWEEWKLLDEAQRRLYHDVMLENFALISSLGVWSGEENVEASFEQSVSVVMSQVSTSKEPSSSQKTH

SEQ ID NO: 23683 - protein, 81 aa, Pan paniscus
PQGLLTFRDVAIEFSQEEWKCLDPAQRTLYRDVMLENYRNLVSLDISSKCMLKTLSSTGQGNTEVIHTGTLQRQASHHTGE

SEQ ID NO: 23684 - protein, 81 aa, Papio anubis
KDVAIDFTLEEWRLMDPTQRNLHKDVMLENYRNLVSLGLAVSKPDMISHLENGKGPWVTMREISRIPYPDMEPKPATKNAT

SEQ ID NO: 23685 - protein, 81 aa, Papio anubis
VQEPVTFKDVAVDFTQEEWGQLDLVQRTLYRDVMLETYGHLLSVGNQIAKPEVISLLEQGEEPWSVEQACPQRACPEWMRN

SEQ ID NO: 23686 - protein, 81 aa, Aotus trivirgatus
AQESMTFRDVAVFFSQDEWLHLDSAQRALYREVMLENYSTLVSLGIPFSMPKVIHQLQQGQDPCMVEGEVPSDICLGFKTW

SEQ ID NO: 23687 - protein, 81 aa, Aotus trivirgatus
GPLTFRDVTIEFSQEEWKCLDPAQKALYKDVMLENYRNLVFLGIIPKCTTKELPPIGNSNTGEKIQTMTLERHECYDIEDI

SEQ ID NO: 23688 - protein, 81 aa, Papio anubis
FQELVTFRDVAVDFSQQEWEYLDPNQKDLYRDVMLENYRNLVSLGGHSISKPVVVDLLEQGKEPWMILREETQFTDLDLQC

SEQ ID NO: 23689 - protein, 81 aa, Aotus trivirgatus
MTTVSSTARPQESVAFDDMARALYRDVMLENYEAVVFVVPPTSKPALVSHLEQGKEPCFTQPQGILSRRDWKAAFIGRSEL

SEQ ID NO: 23690 - protein, 81 aa, Aotus trivirgatus
PRLPLTFEDVAIYFSEQEWQDLQAWQKELYKRVMRSNYETLISLDAGLPKPELISWIEQGEEPFRNWRESQKSGNIICSSV

SEQ ID NO: 23691 - protein, 81 aa, Pan paniscus
KDVAIEFSPEEWKCLDTSQQNLYRDVMLENYRNLVSLGVTISNPDLVTCLEQRKEPYNLKIHETAARPPAVCSHFTQNLWT

SEQ ID NO: 23692 - protein, 81 aa, Lipotes vexillifer
QGLLTFRDVAIEFSQEEWECLDPAQRALYRDVMLETYRNLLSLDISISFLTKELLKKKNINNRELYQPVVLGRHGSHGIED

SEQ ID NO: 23693 - protein, 81 aa, Callorhinus ursinus
MKWGKSAGFLVFKPELISRLEQGQEPWVLDLKGVEGREGARTFLTDSAVGIAGEQACEDMDVLKSEPYVAMVRSPPQGFPQ

SEQ ID NO: 23694 - protein, 81 aa, Callorhinus ursinus
ELLSFEDVAMYFTREEWNKLEWAQKDLYRDVMLENYRNMILLGSEARCKMKKPTPKQKISEDLESSVVKQTTANRSAEELH

SEQ ID NO: 23695 - protein, 81 aa, Tursiops truncatus
AQGKVNFEDVFVYFSQEEWGLLDEAQRLLYREVMLENFALMASLGCSHGMEEEEIPFEQSVSVKGVSQVTIPKTIPSSQKA

SEQ ID NO: 23696 - protein, 81 aa, Tursiops truncatus
MYKDVMLENYRNLVSLGHQLPKPEVILQLEKGEEPWLLERGIHQETYPDLETAVEVKSSASSKSISKDKHSCDVKMKRMAK

SEQ ID NO: 23697 - protein, 81 aa, Pteropus vampyrus
MASPSPPLEPKEWDYLDPAQRSLYKDVMMENYGNLVSLDVLNRDKDEEPTVKQEIEEIEEKVESQGIIVTRIKSEIDQDPM

SEQ ID NO: 23698 - protein, 81 aa, Sus scrofa
MESVTLKDVAMGLIQEWALLDDAWRNLCRYMLLDNCRTLAPRGAPPCKASLVSQVGPRKELRAAEGGILQATCADWESQLK

SEQ ID NO: 23699 - protein, 81 aa, Bos mutus
QELVMFEEVSVCFTSEEWACLSPVQRALYWDVMLENYGNVTSLAFILKKSLILHQRIHSGEKPYKCDECGKTFAQTTYLVD

SEQ ID NO: 23700 - protein, 81 aa, Nomascus leucogenys
QDSVAFEDVAVNFTREEWALLGPSQKSLYRDVMWETIRNLDCIGMKWEDTNIEDQHKNPRRNLRCHIIERFSESSQIPDNT

SEQ ID NO: 23701 - protein, 81 aa, Nomascus leucogenys
RDVAIELSLEEWQCLDTAQQNLYRNVMLENYRNLVFLGIAAFKPDLIIFLEQGKEPWNMKRHEMVEEPPVICSHFAQELWP

SEQ ID NO: 23702 - protein, 81 aa, Nomascus leucogenys
MLENYFNLISVGCQVPKPEVIFSLEQEEPCMLDGEIPSQSRLDGDIGFGPLQQRMSEEVSFQSEININLFTRDDPYSILEE

SEQ ID NO: 23703 - protein, 81 aa, Nomascus leucogenys
SKESVSFKDVAVDFTQEEWGQLDSAQRALYRDVMLENHQNLLALGPPLHKPDVISHLERGEEPWSMQREVPGGPCPGEQRH

SEQ ID NO: 23704 - protein, 81 aa, Nomascus leucogenys
FQGSVTFEDVAIAFSQQEWERLDSSQRGLYRDVMLENYRNLVSMAGHSLSKPHVIALLEQWKEPEVTVRKDGRRWCTDLQL

SEQ ID NO: 23705 - protein, 81 aa, Nomascus leucogenys
FQASVSFQDVTVEFSQEEWQHLGPVERTLYRDVMLENYSHLVSVGYCFTKPELIFTLEQGEDPWLLEKEKGFLSRNSPEDS

SEQ ID NO: 23706 - protein, 81 aa, Nomascus leucogenys
VAFEDVAVNFTLEEWALLDPSQKNLYRDVMRETFRNLASIGKGDNIPSLSELENNHIPERLCESKEGSQGEETFSQIPDGF

SEQ ID NO: 23707 - protein, 81 aa, Nomascus leucogenys
KSKEPVTFKDVAVVFSEEELRLLDLAQRKLYRDVMLENFRNVVSVGHQSTPDGLPQLEREEKLRMMKMATQRDNSSGGKNL

SEQ ID NO: 23708 - protein, 81 aa, Bos indicus
LLAGPTAAAARMDRAQGGVTFADVFVYFSREEWELLEEAQRLLYRDVMLENFAHVAALGESLFQLPIGTCQTTPKVADVKQ

SEQ ID NO: 23709 - protein, 81 aa, Bos indicus
QMTVEDVAIKFTPEEWECLSPAQRTLYWDVMLETYRNLLSVDISPIHIIKKLQSKENTNSTDTLQTVILGRHESHGVQDFY

SEQ ID NO: 23710 - protein, 81 aa, Bos indicus
LSQKRLTSEDVAIKFTQEEWEFLDPAQRALYRDVMLETFRNLLSVGEDDFLPELPLGIYIFPVCPLGGPDVFHLRVLVTRA

SEQ ID NO: 23711 - protein, 81 aa, Canis lupus
IQGSLTFGDVAVAFTQFEWKYLDATQRALYKDVMLENYGNLLSVGFLSSKPKLITQLEQGAEPWMEVQQIPSDNYSVQEYW

SEQ ID NO: 23712 - protein, 81 aa, Muntiacus muntjak
GLGNVTFEDVFVSFSQEEWGLLGEAQRLLYREVMLETFALMASLGHTSSVSHGVSPQELGREPWVSDRADTSPALTREAQS

SEQ ID NO: 23713 - protein, 81 aa, Canis lupus
SMEPVIFRDVAMYFTQNEWQLLEPAQKDLYRDVMLENYGHLASLGHWFFKPKLITRLEQGDEPCVKERGIPPAPQRGSAGI

SEQ ID NO: 23714 - protein, 81 aa, Muntiacus muntjak
MGRLTFWDVAIDFTQEEWECLDLGQRELYADVMVENYRNLASLGLVVSKLDLVTFLEQMKNPWDVRRMQTTGIYPVLLLYR

SEQ ID NO: 23715 - protein, 81 aa, Muntiacus muntjak
PTLTPHTRTFTPHWRQHVTFEDVFLYFSREEWELLEEAQRLQYRDVMLEDFALVSSLGLAVSRSHGATQPEPEGSPGCLRR

SEQ ID NO: 23716 - protein, 81 aa, Gorilla gorilla
PQVSLTFEDVAVLFTRDEWRKLAPSQRNLYRDVMLENYRNLLSLGLSFTKPKVISLLQQGEDPWELEKDSSGVSSLGCKST

SEQ ID NO: 23717 - protein, 81 aa, Homo sapiens; identical to SEQ ID NO: 821

SEQ ID NO: 23718 - protein, 80 aa, Homo sapiens
ARNLVFLGIAVSKPDLITCLEQEKEPWNLKTHDMVAKPPGTAFSIFYMFVKFYKYMQCQYTFSEFGYFGTSFFHFSGQIC

SEQ ID NO: 23719 - protein, 81 aa, Homo sapiens; identical to SEQ ID NO: 822

SEQ ID NO: 23720 - protein, 81 aa, Homo sapiens; identical to SEQ ID NO: 823

SEQ ID NO: 23721 - protein, 81 aa, Homo sapiens; identical to SEQ ID NO: 824

SEQ ID NO: 23722 - protein, 81 aa, Homo sapiens; identical to SEQ ID NO: 825

SEQ ID NO: 23723 - protein, 81 aa, Homo sapiens; identical to SEQ ID NO: 826

SEQ ID NO: 23724 - protein, 80 aa, Homo sapiens; identical to SEQ ID NO: 827

SEQ ID NO: 23725 - protein, 81 aa, Homo sapiens; identical to SEQ ID NO: 828

SEQ ID NO: 23726 - protein, 81 aa, Homo sapiens; identical to SEQ ID NO: 829

SEQ ID NO: 23727 - protein, 81 aa, Homo sapiens; identical to SEQ ID NO: 830

SEQ ID NO: 23728 - protein, 81 aa, Homo sapiens; identical to SEQ ID NO: 831

SEQ ID NO: 23729 - protein, 81 aa, Homo sapiens; identical to SEQ ID NO: 832

SEQ ID NO: 23730 - protein, 81 aa, Homo sapiens; identical to SEQ ID NO: 833

SEQ ID NO: 23731 - protein, 81 aa, Homo sapiens; identical to SEQ ID NO: 834

SEQ ID NO: 23732 - protein, 81 aa, Homo sapiens; identical to SEQ ID NO: 835

SEQ ID NO: 23733 - protein, 81 aa, Homo sapiens; identical to SEQ ID NO: 836

SEQ ID NO: 23734 - protein, 81 aa, Homo sapiens; identical to SEQ ID NO: 837

SEQ ID NO: 23735 - protein, 81 aa, Homo sapiens; identical to SEQ ID NO: 838

SEQ ID NO: 23736 - protein, 81 aa, Homo sapiens; identical to SEQ ID NO: 839

SEQ ID NO: 23737 - protein, 81 aa, Homo sapiens; identical to SEQ ID NO: 840

SEQ ID NO: 23738 - protein, 81 aa, Homo sapiens; identical to SEQ ID NO: 841

SEQ ID NO: 23739 - protein, 81 aa, Homo sapiens; identical to SEQ ID NO: 842

SEQ ID NO: 23740 - protein, 81 aa, Homo sapiens; identical to SEQ ID NO: 843

SEQ ID NO: 23741 - protein, 81 aa, Homo sapiens; identical to SEQ ID NO: 844

SEQ ID NO: 23742 - protein, 81 aa, Homo sapiens; identical to SEQ ID NO: 845

SEQ ID NO: 23743 - protein, 81 aa, Homo sapiens; identical to SEQ ID NO: 846

SEQ ID NO: 23744 - protein, 81 aa, Homo sapiens; identical to SEQ ID NO: 847

SEQ ID NO: 23745 - protein, 81 aa, Homo sapiens; identical to SEQ ID NO: 848

SEQ ID NO: 23746 - protein, 81 aa, Homo sapiens; identical to SEQ ID NO: 849

SEQ ID NO: 23747 - protein, 81 aa, Homo sapiens; identical to SEQ ID NO: 850

SEQ ID NO: 23748 - protein, 81 aa, Homo sapiens; identical to SEQ ID NO: 851

SEQ ID NO: 23749 - protein, 81 aa, Homo sapiens; identical to SEQ ID NO: 852

SEQ ID NO: 23750 - protein, 81 aa, Homo sapiens; identical to SEQ ID NO: 853

SEQ ID NO: 23751 - protein, 81 aa, Homo sapiens [sequence omitted]

SEQ ID NO: 23752 - protein, 81 aa, Homo sapiens; identical to SEQ ID NO: 855

SEQ ID NO: 23753 - protein, 81 aa, Homo sapiens; identical to SEQ ID NO: 856

SEQ ID NO: 23754 - protein, 81 aa, Homo sapiens; identical to SEQ ID NO: 857

SEQ ID NO: 23755 - protein, 81 aa, Homo sapiens; identical to SEQ ID NO: 858

SEQ ID NO: 23756 - protein, 81 aa, Homo sapiens; identical to SEQ ID NO: 859

SEQ ID NO: 23757 - protein, 81 aa, Homo sapiens; identical to SEQ ID NO: 860

SEQ ID NO: 23758 - protein, 81 aa, Homo sapiens
ASFKDVVVGFTQEEWHRLSPAQRALYRDVMLETYSNLVSVGYEGTKPDVILRLEQEEAPWIGEAACPGCHCWALKVLRELQ

SEQ ID NO: 23759 - protein, 81 aa, Homo sapiens; identical to SEQ ID NO: 861

SEQ ID NO: 23760 - protein, 81 aa, Homo sapiens; identical to SEQ ID NO: 862

SEQ ID NO: 23761 - protein, 81 aa, Homo sapiens; identical to SEQ ID NO: 863

SEQ ID NO: 23762 - protein, 81 aa, Homo sapiens; identical to SEQ ID NO: 864

SEQ ID NO: 23763 - protein, 81 aa, Homo sapiens; identical to SEQ ID NO: 865

SEQ ID NO: 23764 - protein, 80 aa, Homo sapiens; identical to SEQ ID NO: 866

SEQ ID NO: 23765 - protein, 81 aa, Ursus maritimus
MLENYQNLLSLGAGPPGSKPDVISRLERGEEPRMEKREAKQAACPDLDTSSATPWETPLKKSISEEATSPMGKMEGVLRAV

SEQ ID NO: 23766 - protein, 81 aa, Ursus maritimus
EESVTFEDVAVYFSENEWTGLAPAQRVLYRDVMLENYGAVASLEGVLKSEKEDFILKEEHFEEAKDHMVLSSGPRWPGSQE

SEQ ID NO: 23767 - protein, 81 aa, Rhinopithecus bieti
MVENFKNLVAVGHLPFQPDMVSQLEAEEKLWMMETETQRSSQHQNKMETLQKFALKYLSNQELSCWQIWKQVARELTRCLQ

SEQ ID NO: 23768 - protein, 81 aa, Rhinopithecus bieti
MDSVAFEDVAVSFTQEEWALLDPSQKNLYRDVMQETFRNLTSVGKTWKVQNMEDKYKNPRRNLRWSFALVTQAGVQWCDLG

SEQ ID NO: 23769 - protein, 81 aa, Ursus arctos
VQDPVTFQDVTVEFTRGEWEHLDTYQRALYREVMLENYRSLASLGCQDFKPDVISWLEQGGSPWMVWRDIPRDPSPDQETR

SEQ ID NO: 23770 - protein, 81 aa, Ursus arctos
AQVCVISEDVFVCFSREEWMLLDDSQRLLYQDVMLENFALLASLGITSSRSHLVTQLEQREDPRMPDQVDTTPATEREAQK

SEQ ID NO: 23771 - protein, 81 aa, Ursus arctos
SQELVTYEDVAVDFTQEEWQHLDPAQKTLHRDVMLETYSHLVSVGCSGIKPGIIFKLEREEDPRIIKSELSTWVHSDREKS

SEQ ID NO: 23772 - protein, 81 aa, Ursus arctos
SQESVTFQDVAVDFTEKEWPLLDSSQRKLYKDVMLENYSNLASVGYQVGKPSLISHLEQEEEPRTEERALHRATSPDWEAP

SEQ ID NO: 23773 - protein, 81 aa, Ursus arctos
AHHLVMFRDVAVDFSQEEWECLNPYQRNLYRDVILENYSNLVSVGCSISKPDVITLLEQGKEPWMVVRDERRRSLDLESRY

SEQ ID NO: 23774 - protein, 81 aa, Muntiacus reevesi
MGRLRFQDVTIDFTLEEWECLDLSQLELYRDVMLENYRNLASLGLVVSKPDLVTFLEKMKDPRDVRRMETTAIHPDLASFR

SEQ ID NO: 23775 - protein, 81 aa, Muntiacus reevesi
AWSQMPVTFDDVALYLSREEWGRLDHTQQSYREVLQKRRGLSLGFPFSRPFWASQVQGKGEAPGSSRQLGHEEEEKRGAVE

SEQ ID NO: 23776 - protein, 81 aa, Muntiacus reevesi
EQLTSEDVAIEFTQEEWEFLDPAQRALYRDVMLETYRNLLSVDISPTLVIKHLQPKANNDNKREPFQTLMLGRSESCEIKH

SEQ ID NO: 23777 - protein, 81 aa, Ursus americanus
DPALVSFHDVAVVFTREEWRLLSHAQRLLYRCVMLENYSNLVSLGIPFPKPTLVISLEQGEEPWREESKHLPSPCSADAKP

SEQ ID NO: 23778 - protein, 81 aa, Myotis brandtii
ILESVTFKDVVVDFTQEEWKQLDPVQRDLFRDVTLENYTHLVSIGLQVSKPDVISQLEQGTEPWIVDSGIPVGGSGDCVTG

SEQ ID NO: 23779 - protein, 81 aa, Myotis brandtii
EDPVAIEDVAVNFTLEEWALLDTPQKKLYRDVMKETFRNLDSIGQNWEDHYIEDLYKSQGRKLRSQMVERHYESKEGNQHG

SEQ ID NO: 23780 - protein, 81 aa, Propithecus coquereli
VSVTFEDVAVTFTQEEWGQLDLTQRILYQEVMLETCGLLVSLGDITQPGTPEPTLPQLALPEEVSLEQQLTQGASGDSQLE

SEQ ID NO: 23781 - protein, 81 aa, Propithecus coquereli
LTFSDVAVDFSQEEWECLNSDQRDLYRDVMLENYTNLVSLKRSKTFNFMGFIFRNDSQCRIEFERQQGPNAAYFSQMIFRK

SEQ ID NO: 23782 - protein, 81 aa, Propithecus coquereli
QGTVTFSDVAIDFSQEEWACLTSAQRDLYWDVMLENYSNLVSLDLESSSYDPKGLATGKHIRERNFPKRKESLDGKRKSHS

SEQ ID NO: 23783 - protein, 81 aa, Saimiri boliviensis
AQKVLTFRDVAIEFSLEEWKFLDPAQQNLYRDVMLENYRNLFSVGLSVSKPGLITCLEQRKAPWNLKRREAVDGHPEMEFH

SEQ ID NO: 23784 - protein, 81 aa, Saimiri boliviensis
TFKEAVTFKDVAVVFTEEELELMDPAQRKLYRDVMLENFRSLLSVGHQPLQGDTFYFLQEEKFWMMETRSQREGNSGGRIQ

SEQ ID NO: 23785 - protein, 81 aa, Saimiri boliviensis
VTFEDVAVNFSKEEWCLLSEAQRCLYRDVMLENLALISSLGCWCGLKDEAALSKQSITVQTESQDRTPRAVSPKKAHSCDM

SEQ ID NO: 23786 - protein, 81 aa, Saimiri boliviensis
KPGALSFADVAVYFSPEEWGCLRPAQRALYRDVMRETYGHLGALGFPGPKPALISWMEQESEAWSSAAQDPEKGESLGGAR

SEQ ID NO: 23787 - protein, 81 aa, Vombatus ursinus
MLENYRNLVSLGFVVAKPDVISQSEQEEAPWILEVLFPRSSCSDLDTKPKIKETTLELDISMEESSKKVLSRDSSWILTLG

SEQ ID NO: 23788 - protein, 81 aa, Balaenoptera acutorostrata
TQVSVTFDDVAVTFTREEWRQLDPAQRTLYQEVMLENCRLLVSLGCPVPRPELIFQLEQGQKLWTVKEDLSRSTCPGKRYR

SEQ ID NO: 23789 - protein, 81 aa, Saimiri boliviensis
AQESVIFSDVSIDFSQEEWECLNDDQRDLYRDVMLENYSNLVSMGHSISKPNVISYLEQGKEPWLVDRELTRSQWPVLESR

SEQ ID NO: 23790 - protein, 81 aa, Vombatus ursinus
KGEVPKVPVTFVDIAVYFSEDEWKNLDEWQKELYNNLVKENYKTLMSLDAQSRVEPREEPCVWEQHNSEEREIPMDPTTDG

SEQ ID NO: 23791 - protein, 81 aa, Saimiri boliviensis
MFVTFKDVAVTFTQEEWRQLDLAQRTLYQEVMLETCGLLVSLGDKAQVQTTEPTTYLPVLSKRAFLQGSLTLECSSDSRLG

SEQ ID NO: 23792 - protein, 81 aa, Saimiri boliviensis
VAFEDVAVNFTQEEWALLDPSQKNLYRDVMQETLRNLISIGKGWSNQNAEDKHQNPRRTLRRLIGERLLTLVPDDMWRKKT

SEQ ID NO: 23793 - protein, 81 aa, Saimiri boliviensis
AHVTLAFRDVSIDLSQEEWECLDPAQRDLYKDVMFENYSNLISLGYTIPKPDVIALLEQEKEPWIVMREGTRSWYTDLEYK

SEQ ID NO: 23794 - protein, 81 aa, Balaenoptera acutorostrata
PLESVTFEDVAISFTQEEWTLLDTSQRKLFRDVMLENISHLVSVGYQHCKSDVIFQLDRGEELWIEGRGFFQSHSPGRESA

SEQ ID NO: 23795 - protein, 81 aa, Saimiri boliviensis
AQESVTFEDVAVNFTDGEWQCLTYAQRHLYKDVMLENYGNLVSLGLPFPKPPLISHLERGVELCVQDPQGREPLSCSCLVS

SEQ ID NO: 23796 - protein, 81 aa, Vombatus ursinus
SHGLFLVTFQDVAVTFTPEEWGLLDYPQKELYKEVMLENTWNLLSLGKDTSPGHSISHLLEGKSAGLLCPRDRVPCCLVFL

SEQ ID NO: 23797 - protein, 81 aa, Vombatus ursinus
HQESVTFKDIALGFTQEEQGHLAPSQKELYWEVILENYGHLICLELKVSKPDVISQLERGEHLGLQGEKNRGLCLFPQQRV

SEQ ID NO: 23798 - protein, 81 aa, Balaenoptera acutorostrata
LKGLVMFKDVAIDVSQEEWECLNPAQRNLYKDVMLENYSNLLSLGLSISKPAVISSLEQGKEPWMVMREVIGERFPDLVSK

SEQ ID NO: 23799 - protein, 81 aa, Vombatus ursinus
MPPSLPQDFHFLWAGLAMSKPEVIHQLERGEAPWRPEEKGPQSTCPDGEVRPETKESPPELGISVEQSSGQDRLRRHGLCV

SEQ ID NO: 23800 - protein, 81 aa, Saimiri boliviensis
MLENYRNLVFLGIAVSTPDWITCLEQGKDPWNMKRHSMVATPPVLCSHFGQDLGQRPGIKDSFQKVILREYVKCGHKDLQI

SEQ ID NO: 23801 - protein, 81 aa, Saimiri boliviensis
MPHLLVTFRDVAIDFSQEEWECLDPAQRDLYRDVMLENYSNLISLDLESSHEINKLSPEKEIYEMESLQWENMGKFINHHL

SEQ ID NO: 23802 - protein, 81 aa, Lynx pardinus
KEAVTFKDVAVVFTEEELGLLDPAQKKLYGDVMLENFRNLLSLGGKIQNKMKTVLETEPHKELSCWQIWQQIASDLTQCEG

SEQ ID NO: 23803 - protein, 81 aa, Lynx pardinus
DPVQVNFEDVAVYFSREEWGLLDEAQRLLYRDVMLENLALTASLGSWHGTEDEETAFEQNISVGVSQVRTPKAVPSTQKAH

SEQ ID NO: 23804 - protein, 81 aa, Vombatus ursinus
FQELVTLKDVDPDFTWEEWAQLAPVQQDLYKEVLLENYRNLVFLGLSIPKPDVISQLEREEMPWTLESKTPRAICSYSDTE

SEQ ID NO: 23805 - protein, 81 aa, Balaenoptera acutorostrata
EQLTFKDIDIEFSQEEWECLDPAQRALYRDVMLEIYRNLLSLDISPIHVIKKLQLKVNTGRGEVLQTVMLGRHERNKMKHF

SEQ ID NO: 23806 - protein, 81 aa, Saimiri boliviensis
KSEEAVTFKDVAVVFSDEELRLLDLTQRKLYRDVMLENFRNVVSVGNQFIPDGLPQSEREEKLWMMKTATQRDNSLGGKHL

SEQ ID NO: 23807 - protein, 81 aa, Panthera pardus
FQASVVFEDVAVNFTPEEWALLDHGQRNLFKDVILETCRNLSSVEKQKFHSSGDLTQMQEGLLSSPLLESVCERIEGDPCG

SEQ ID NO: 23808 - protein, 81 aa, Macaca nemestrina
LFQVTFSDVAIDFSHEEWAWLDSAQRDLYKDVMVQNYENLSYVFSGGFISYPFLLITLGKKKSSALWESKELSTKKDIYDE

SEQ ID NO: 23809 - protein, 81 aa, Macaca nemestrina
RNMIPQDNENPPQQGEANQNDSMTFEDVAVNFTPEEWALLDPSQKNLYQEVMQETLRNLASIEVLWKRDYLKVKVISMEKF

SEQ ID NO: 23810 - protein, 81 aa, Myotis brandtii
MLKSVTFEDVAVYFTPTEWDGLSPAQRALYRDVMLENYGNVASLGFPLIKPAVILQLEGGGELRGPSPLAAETGTDPPGLW

SEQ ID NO: 23811 - protein, 81 aa, Propithecus coquereli
GSVMFSDVSVDFSQDEWECLDPVQRDLYREVMLENYSNLVSVGLYIPKPQVISLLEQGKEPWMVGKELTRGLCSDLESMCE

SEQ ID NO: 23812 - protein, 81 aa, Saimiri boliviensis
EMGPLTFRDVAIEFSLEEWQCLDTAQQDLYRKVMLENYTNLAFLAGIAASKPDLITCLEQGKEPWNMKRHEMVDEPPVIYS

SEQ ID NO: 23813 - protein, 81 aa, Propithecus coquereli
SQESVTFQDVAVDFTEKEWPLLDSSQRKLYKDVMLENYSNLTSLGYEVCKPSLISHLEQEEEPRTEERGTQQGPCPDWETP

SEQ ID NO: 23814 - protein, 81 aa, Balaenoptera acutorostrata
AQSLVTFEDVAVHFSKEEWGILDAAQRQLYHSVMLENLELMTSLGCWHGVEDEEVRSKQDASVDVVSQVRIFSAHPSTQKA

SEQ ID NO: 23815 - protein, 81 aa, Propithecus coquereli
ARVLVTFKDVAVTFTREEWRQLDLAQRTLYREVMLETCGLLVSLGHRVPKPELIHLLEHGQELWTVKRGLAHSTCAGDRAQ

SEQ ID NO: 23816 - protein, 81 aa, Vombatus ursinus
FQESVTFEDVAVDFTWEEWGYLDTSQKEVYWEVMLENYRNLVSLGFVVAKPDVISQSEQEEAPWILEVLFPRSSCSDLDTK

SEQ ID NO: 23817 - protein, 81 aa, Saimiri boliviensis
VKGLLSFKDVSVEFTWDEWQLLDSRQKYLYREVILENYHNLISVGYHGAKPDLIFKLEQGEDPWIVNAKISRESCPDGWEE

SEQ ID NO: 23818 - protein, 81 aa, Lynx pardinus
SFGREAENDQVSPFTKEEWQQLDPAQRTLYRDVMLENFSHVISLGHPVSKPDVISKLEQGEEPWIIKRDVSDWIYPERETR

SEQ ID NO: 23819 - protein, 81 aa, Saimiri boliviensis
SFKEAVTFKDVAVVFTEEELGLLDLAQRKLYRDVMLENFRNLLSVGHQPFHQDVFHFLREEKFWMMETATQREGNSGGKIQ

SEQ ID NO: 23820 - protein, 81 aa, Vombatus ursinus
SPELVAFKDVAVEFNQEEWRCLDASQKELYHDVMMENYKNLVCLGKDSFTLSPKICSLEGWEIRPVNKKPITKLGIPVEES

SEQ ID NO: 23821 - protein, 81 aa, Balaenoptera acutorostrata
MLENYSNLVSVGYCVTKPEVIFRLEQGEEPWVLEEEFPRQSFAEVWKTDHMKERSQENQPKHVWEVVFINNKMLTKEQGNV

SEQ ID NO: 23822 - protein, 81 aa, Saimiri boliviensis
SQELVTFEDVAVYFIRKEWKRLEPAQRDLYRDVMLENYGNVFSLDGETRTENDQAVSEDTRSHGVLLGRFQKDMSQGLKFK

SEQ ID NO: 23823 - protein, 81 aa, Saimiri boliviensis
SQGPLTFMDVAIEFSQEEWGCLDPAQRTLYKDVMLENYRNLVSLGVGLPDLSVVSMLEQKREPWTLQSEEKIAWNPDGREC

SEQ ID NO: 23824 - protein, 81 aa, Vombatus ursinus
VLVSVTFDDVIIYFMEQEWRILEEWQEELYKHVMKTNYKNLFSPDYAIPKPDLITQIEQGEKPFIRDWGHLDTSELAIGSR

SEQ ID NO: 23825 - protein, 81 aa, Lynx pardinus
MLVTFDDVAVTFTQEEWGQLDPTQRTLYQEVMLETCRLLVSLGCPLPKPEQIYPLERSPELWTLQRGLSSSNCPGDNVKPE

SEQ ID NO: 23826 - protein, 81 aa, Vombatus ursinus
GKESMTFKDVTVEFTWEEWRQLDHAQRDLYRNVMMENYENLISVGIFVSKLDVISLLERGEASWVSEGEVPRSTYSDSLNL

SEQ ID NO: 23827 - protein, 81 aa, Vicugna pacos
CLQGPVTFKDVAVEFTQEEWMMLDSTQKSMYRDVMLENYINLTSVECQLCKPVVSLLGQEDIRTVKRRISQGTCPDWESQL

SEQ ID NO: 23828 - protein, 81 aa, Propithecus coquereli
VPLPLTFEDVAIYFSEQEWQNLEAWQKELYKHVMRTNYETLISLDDGLPKPELISWIEQGAEPFRDWRESQKSGNIICSSA

SEQ ID NO: 23829 - protein, 81 aa, Propithecus coquereli
ESVTFEDVAVYFSENEWIGLGPAQRALYRDVMLENYGAVASLAFPFPKPALISQLERGEAPWCSAPQGALDGESPRGISSE

SEQ ID NO: 23830 - protein, 81 aa, Vombatus ursinus
SGDSMTFEDVAVYFSQEEWAVLDQQQKELYQDVMRGTYELVTSLGYPAAKPEVICKIEQEEEPWMRDSQNHRRGLNHQWGN

SEQ ID NO: 23831 - protein, 81 aa, Propithecus coquereli
SQASVSFEDVTVEFTCEEWQQMGPAQRNLYRDVMLENDSHMVSVGYCVFKPEVIFGLEQGEEPWFSEEEFSNQSHPKHCRD

SEQ ID NO: 23832 - protein, 81 aa, Propithecus coquereli
QAEVTFEDVAVLLSREEWGRLGPAQRGLYRDVMLETYGNLVSLGTGPAGPKPGVISQLERGDEPWVLDNRRPLDLMFIVSA

SEQ ID NO: 23833 - protein, 81 aa, Propithecus coquereli
MAHLIMLRDVAIELSEEEWECLDLEQRDLYRGVMLENYSSMVSLGLCIYQPDVFSSLEKGKEPWKILRDETREPNPDMHTM

SEQ ID NO: 23834 - protein, 81 aa, Propithecus coquereli
HQEVVTFEDVAMHFTQTEWAGLSPAQRALYRSVMLENYENLTVVEYPVPKPALISFLEGGDLPWGLEAQDEPLTERTRDIY

SEQ ID NO: 23835 - protein, 81 aa, Balaenoptera acutorostrata
AQESVMFSDVSIDFSQEEWEYLNDAQRDLYREVMLENYSNLVSMAGRSISKPDVISFLEQGKEPWLVDRELTRDQWPVLES

SEQ ID NO: 23836 - protein, 81 aa, Saimiri boliviensis
MLENYGHLVSLGLSISKPDVVSLLEQGKEPWLGKRDVKRDLFSVSEPTGDIKDFSSKNVIYDDSSQYLIMERILSQGPVYS

SEQ ID NO: 23837 - protein, 81 aa, Balaenoptera acutorostrata
AQETLSFKDVAVDFTWEEWQLLAPPQKDLYRDVMLENYSNLLSVGYRVSKPDALSKLERGEEPWTIEDEIHSQTCPETGKV

SEQ ID NO: 23838 - protein, 81 aa, Balaenoptera acutorostrata
QGPVLFEDLAVYFSQEECVSLHPAQRSCSRDTPQECLEDMALMGGEGKIEINQKLRLESMGLEELALEKYSIAVPLVYYPE

SEQ ID NO: 23839 - protein, 81 aa, Saimiri boliviensis
VQGLVMFEDVAVYFSREEWGLLNVTQKGLYRDVMLENFALLSSLGLAPSRSPVFTQLVDDEQSCVPSWVDVTLVSRTEASR

SEQ ID NO: 23840 - protein, 81 aa, Saimiri boliviensis
FEESVTFQDVAVDFTPEEWQLLDCAERTLYWDVMLENYRNLISVGCLVTKTKVTLKVEQGQEPWMVEGVNPHQSSPESDCP

SEQ ID NO: 23841 - protein, 81 aa, Vombatus ursinus
KEELVAFKDVAVEFNQEEWRCLDASQKELYHDVMMENYKNLVCLGLVFNKPAVISHLEGKEAPWMAEGQPITKLGIPVEES

SEQ ID NO: 23842 - protein, 81 aa, Balaenoptera acutorostrata
TKDCVTFEDVAIYFSQEEWGLLDEAQRCLYHKVMLENFALTASMVCLHGTENKETPSEQNVSLEALSQVRTPKVGPISQKA

SEQ ID NO: 23843 - protein, 81 aa, Saimiri boliviensis
MLENYWSLVSLGLCHFDMNIISMLEEGKEPWTVKSYMKIARKPRMRKCVKGVVTDIPPKCTIKDLLPKEQSSTEAAFHTVM

SEQ ID NO: 23844 - protein, 81 aa, Balaenoptera acutorostrata
LEGSVTLQDVAVEFTPEEWQLLDCDQRTLYWDVMLENFRNLISMGCPVTKTKVIFKVEQGQEPWMVEGENPCWRSPEADCP

SEQ ID NO: 23845 - protein, 81 aa, Saimiri boliviensis
TQESLTLEDVAVEFSWEEWQLLDTAQKDLYRDVMVENYNHLVALGYQTSKPDALSKVAHGQEPWITDAKIQNKNCPGIRKV

SEQ ID NO: 23846 - protein, 81 aa, Vombatus ursinus
FQNSVTFKDVAVHFTRKEWKQLTPAQRYLYRDVMLENYRNLVSLGLPVSKPKVISQLEQGEGPWIAEEERPTSTYPDWEAR

SEQ ID NO: 23847 - protein, 81 aa, Cervus elaphus
HVHVTFTDVAVTFTEEELGLLDSAQKKLYQDVMVENFWNLVSVDENNQSELRAVQERGLHEELSCWQIWQQIANDLTRYQD

SEQ ID NO: 23848 - protein, 81 aa, Cervus elaphus
ELLTFKDISVDFTQEEWGQLAPAHRNLYREVMLENYGNLVSVGCQLSKPSVISQLEKGEEPWMTEKEGPGDPSSDLKSKTE

SEQ ID NO: 23849 - protein, 81 aa, Colobus angolensis
VHGSVTFRDVAIDFSQEEWECLQPEQRTLYRDVMLENYSHLISLGSSISKPDVITLLEQEKEPWIVVRKETSRWYPDLESK

SEQ ID NO: 23850 - protein, 81 aa, Colobus angolensis
LQESVTFKDVSVDFTQEEWYHVDAAQRSLYRDVMLENYSHLVSLGYQVSKPEVIFKLEQGEEPWISEGEIQRPFCPDWKTR

SEQ ID NO: 23851 - protein, 80 aa, Colobus angolensis
MCGPLQFRDVAIEFSLEEWHCLDTAQRNLYRNVMLENYSNLVFLGIVVSKPDLITRLEQGKNPLTMKRHEMVAKPPGRCE

SEQ ID NO: 23852 - protein, 81 aa, Colobus angolensis
LLKKVTFEDVAIDFTQEEWAMTDTSKRKLYRDVLPGNVSHLESLGYQISKSYIILQLEQGNELWREGREFLQGQNLDKESV

SEQ ID NO: 23853 - protein, 81 aa, Colobus angolensis
MATVVFEDVVVGFTLEEWALLNPAQRNLYRDVMLETFKHLASVRNPRVERPCKSGKGNKRGGTLRKTRNCNRHLRKNHRPG

SEQ ID NO: 23854 - protein, 81 aa, Colobus angolensis
LWDLSFLRDVTVEFSLEEWQCLDAVQKNLYRNVMLENYRNLVFLGIAVSKPDLITCLEQGKEPWNMNRHEMVAKPPVMCSH

SEQ ID NO: 23855 - protein, 81 aa, Rhinopithecus bieti
GTVTFEDVAVNFTWEEWNLLSEAQRCLYRDVMLENLALISSLGCWCGVEDEEAPSKQSIYIQRETQVRIPMAGVSLKKVHP

SEQ ID NO: 23856 - protein, 81 aa, Rhinopithecus bieti
MELLTFRDVAIEFSPEEWKCLDPAQQNLYRDVMLENYRNLVSLGFVISNPDLVTCLEQIKEPYNLKTHETAAKPPVVQHFW

SEQ ID NO: 23857 - protein, 81 aa, Panthera pardus
SLTFQDVAVDFTREEWDQLYPAQKNLYRDVMLENYRNLVALGGENRPDIKKSIPNQNISDENQNHDMIMERLTGDSFWYSI

SEQ ID NO: 23858 - protein, 81 aa, Panthera pardus
APGCVTFEDVAVRFSWEEWGLLDEAQRLLYRDVMLENFALMASLGLASSRTHEISQLEWWRQPSLPPCGVMTAAMPRGLWR

SEQ ID NO: 23859 - protein, 81 aa, Panthera pardus
SYGSLSFEDVTVGFSQEEWQHLDPAQRTLYRDVMLENYSHLVAVGCCVPKPDVIFRLEQGQQPWIVEEESLDQSCPEVCKV

SEQ ID NO: 23860 - protein, 81 aa, Panthera pardus
ESVTFEDVAVGLLREWALLDGARTNLCRYVILDKCRTLAPKDWDSRLKSQASPPVQDTLEGNSSPGLHMGQKAAAQIQRVA

SEQ ID NO: 23861 - protein, 81 aa, Panthera pardus
FQASVVFEDVAVNFTPEEWALLNRGQRKLYRDVMLETCRNLSAVEKQKFHSSGDLTRMQEGLLRSPLVESVCERIEGDPCG

SEQ ID NO: 23862 - protein, 81 aa, Panthera pardus
MLENYSNLISLAGCAIPKPDVFSLLEQGKDPWMVTRAMTRRWSSDLESSCETKKSSPEKGAYEMESLQWENRRKPISHNFD

SEQ ID NO: 23863 - protein, 81 aa, Panthera pardus
SVVFEDVVVDFTQEEWALLKPAQKKLYKDVMLETFRNLVTVDDENQLRTNGSTSQQVISGEKLSNEQKIARFTKNDSWTSL

SEQ ID NO: 23864 - protein, 81 aa, Macaca nemestrina
MLENYRNLVALGLPFTKPKVISLLQQGEDPWKVEKDSSGDSSLGSKSSHKTTKSTQTQDSSFQGLILKRSNRNVPWDLKLE

SEQ ID NO: 23865 - protein, 81 aa, Macaca nemestrina
ITGCIKCEDVAVDFTQEEWRLLSPAQRTLHREVMLETYNHLVSLEIPSSKPKLIAQLERGEEPWREERKCSLDLCPESKPE

SEQ ID NO: 23866 - protein, 81 aa, Muntiacus reevesi
AQLTFKDVAIEFTQEEWECLDPAQRALYRDVMVETLRNLISLDISHILVIKKLQLNAKTDRGEEFQTVILGRHERNKIKDF

SEQ ID NO: 23867 - protein, 81 aa, Ursus americanus
PRGLLTFGDVAIEFSQEEWGCLSHTQRELYRDVMLENYGHLLFLGFILSKPDLIMFLEQEKQLWDVKRETVIFKDNYLWID

SEQ ID NO: 23868 - protein, 81 aa, Ursus americanus
DVAVNFTREEWDQLYPAQKNLYRDVMLENYRNLVALGHQLYKPEVISQLEQEEQWVMERGSPLDTHADGESRPEIKKSTPN

SEQ ID NO: 23869 - protein, 81 aa, Ursus americanus
FFGSISFEDVTVNFTQEEWGQLDPDQRTLYRDVMLENYSIFISLGEILNLEQEAPWVLEKEFAKNMLELTTTNKTYSGKKS

SEQ ID NO: 23870 - protein, 81 aa, Myotis brandtii
PAAHMAFRDVAVDFTQEEWMLLSPAQRSLYREVMLENYSNLVSLGIPFSKPKLITQLEQGKETWREERKCPPATCPGEPKP

SEQ ID NO: 23871 - protein, 81 aa, Myotis brandtii
NFWVLRLPPGSKGEAPKEWGKLDEWQKELYKHVRRGNYETLVSLDYAISKPEVLSQTEPGKEPCGWRRTAPKVPDVPVDPS

SEQ ID NO: 23872 - protein, 81 aa, Myotis brandtii
SQGLVTFRDVALGFSQEEWEWLSPSQKALYRDVMLENYGNLVWLGLSISKPNMISLLEQGKEPWIVEREMSDGQYTDWESW

SEQ ID NO: 23873 - protein, 81 aa, Myotis brandtii
MDFEDVAVAFSREEWGLLDEAQRLLYCDVMLEVFALVSSVGCWHKTDDEEACSEQSVSEQGESLVRASETKPATQRTHVCK

SEQ ID NO: 23874 - protein, 81 aa, Camelus ferus
SQGSLTLKDVAVDFTREEWQLLTPAQKALYREVTLQNYSHLVSVVYQVRNLDTLSKLEQGEPPWTLEHEIHNQPHPGRKRK

SEQ ID NO: 23875 - protein, 81 aa, Colobus angolensis
PQASVCFEDVAMAFTKEEWEQLDLAQRTLYREVTLETWEHIVSLGLFLSKSDVISQLEQEEDLHRAEQVSPRDWKTTLEEN

SEQ ID NO: 23876 - protein, 81 aa, Colobus angolensis
RPESVTFKDVAVCFSENEWIGLGAAQRALYRDVMLENYGAVASLAFPFPKPALISQLERGEAPWCSVPWGALDGEDPRGIS

SEQ ID NO: 23877 - protein, 81 aa, Mustela putorius
MDFTLDWEHLGLDQGDLFWDTALDNYQNIFLLNPSKPKLTSQPDGAEEQKVLERESPESAGPNPAEVKNCLLGQDFLEEGL

SEQ ID NO: 23878 - protein, 81 aa, Mustela putorius
PNEAVTFKDVAVVFTEEELGLLDPAQRKLYGDVMLENFRNLLSVGHQPFIPHVILQCERGEKLQMGKTATQGRGIAGDKNL

SEQ ID NO: 23879 - protein, 81 aa, Mustela putorius
SQGLLTFRDVAIEFSQEEWGRLTHTQRELYRDVMLENYGHLLFLGLTVSKPDLVSFLEQKKDPWDVKRKKTVVFDPAVSSQ

SEQ ID NO: 23880 - protein, 81 aa, Tupaia chinensis
MDVFVDFTWEEWWLLDPAQKCLYISVTLENYSNLVSLGYQHTKPFIISKLEQGEVWMVQAQIPSQGRPAKFIKTAFAEIER

SEQ ID NO: 23881 - protein, 81 aa, Oryctolagus cuniculus
VELVSFDDVAVDFTQEEWTLLDPTQRNLYSDVMLENYKNLATVGCQLIKPDLISWLEQEELKTVQRDMLQGWEMQLEANWS

SEQ ID NO: 23882 - protein, 81 aa, Rhinolophus ferrumequinum
EQVTFEDVVVDFTQEEWGQLEPAQRTLYRDVMLETFGLLVSVGHWLRKPAVISLLELEAEPWEVDEGVPQGVFPDLETTSK

SEQ ID NO: 23883 - protein, 81 aa, Ursus maritimus
MLETCGLLVSLGHPVPKPELTHLLEHGQELWTGKRGLSRSTCSGDNVKLQTRDPSTCQLVLSEGALRQGSLTQGSSRDSRL

SEQ ID NO: 23884 - protein, 81 aa, Ursus maritimus
MLENCGLLVSLGCPVPRPELIYQLEHGRELWTVKRDLSQSAYPGDKGKPKITESTASEPALSEGVFFQEQLTQGFQGNSQV

SEQ ID NO: 23885 - protein, 81 aa, Ursus maritimus
AAGSVTFQDVTMAFTEKEWEQLDPAQRSLYKDVMLENYSNLASMGYQAPKPDMISKLQKGEEPWLGKGKRPKQDGPSELAR

SEQ ID NO: 23886 - protein, 81 aa, Ursus maritimus
RLKREGSSLANLRAMPQEWQHLDPAQKALYRDVMLENYCHLISVGFHMTKPDMIRKLEQGEELWTTERMFPSQSYLEEDGK

SEQ ID NO: 23887 - protein, 81 aa, Ursus maritimus
SQEPVTFEDVAVYFTQNQWASLDPTQRALYREVMLENYANITSLAAFPFPKPDLILQLERGEARWGLDPWIAIEGEALGGV

SEQ ID NO: 23888 - protein, 81 aa, Ursus maritimus
VTFEDVAVIFTDEEWRHLVPIQRDLYKEVMLENYKIIVSLDWGTKPEIHGASEEESEGTARGKLGGEVPVCPKFEAHALEG

SEQ ID NO: 23889 - protein, 81 aa, Ursus maritimus
SQGLLTFKDISVDFTQEEWGHLAPAHRNLYREVMLENYGNLVSVGCQLSKPDVISQLEKGEEPWLIEREISGSPGSDLENK

SEQ ID NO: 23890 - protein, 81 aa, Ursus americanus
RPRAVKFADVAVYFSPEEWGCLRPAQRALYRDVMRETYGHLGALGFPGPKPALISWMEQESEAWSPDAQDPEEGESLGGAL

SEQ ID NO: 23891 - protein, 81 aa, Propithecus coquereli
LQESFSFEDLSVDFTQKEWQLLDPYQKNLYKDVMLENYSSLVSLGYEVMKPDVIFKLEQGEEPWVGEGAVPSSDSPAIIFK

SEQ ID NO: 23892 - protein, 81 aa, Propithecus coquereli
SWGPLSFMDVFVDFTLEEWRLLDPAQKHLYRSVMLENYSNLVSLGYQHTKPNIIFELERGEELWVVHARIPRQGHPDKVWE

SEQ ID NO: 23893 - protein, 81 aa, Saimiri boliviensis
AHALVTFRDVAIDFSQKEWECLDPTQRKLYRDVMLENYSNLVSLGYSGLKPDVITLLEQGKEPCMAVRDMTGRQYPGLLSR

SEQ ID NO: 23894 - protein, 81 aa, Vombatus ursinus
LNELVTFKDVTVNFTQEEWRQLNPAQRDLYRDVMLENYRNLISLGLSISKPDVILQLERGEEPWILNLKRTAEREIPQYTG

SEQ ID NO: 23895 - protein, 81 aa, Propithecus coquereli
MTFEDVTVEFTPWEWGQLDPAQKDLYREVMLENFRNLASLGLPVSKPHVICQLEEGEEPCVLEREISVGAQSDLKRRPKAK

SEQ ID NO: 23896 - protein, 81 aa, Saimiri boliviensis
TQGSLTFKDVAIEFSQEEWKCLDPAQKTLYRDVMLENYRNLGFLGLCLPDLNIISMLEQGKEPWTVVSQVKMTRNPNWGEC

SEQ ID NO: 23897 - protein, 81 aa, Saimiri boliviensis
SQGSVSFKDVTVDFTQEEWQQLDPAQKALYRDVMLENYCHFIAVGFHMTKPDMIRKLEQGEELWTQRIFPSYSYLEEDGKT

SEQ ID NO: 23898 - protein, 81 aa, Balaenoptera acutorostrata
KDQGLLTLEDVAVDFTWEEWQLLAPAQKDLYRDVMLENYSNLLSVGYQASKPDALSRLERGEPWPVEDKIHSRICPEMRKD

SEQ ID NO: 23899 - protein, 81 aa, Balaenoptera acutorostrata
MESVVFEDVAVDFTPEEWALLDPAQRNLYRDVMLETFRNLASVGENWKCHSIEDQHKNQRTHLRWRVVEIPSENNESNQCG

SEQ ID NO: 23900 - protein, 81 aa, Lynx pardinus
PGLLSFKDVAVVFTWEEWQLLEPIQKHLYQDVMLENYSNLVSVDDTWQVDSHTDWHQENQGNLETMESHHINNPFRKILSL

SEQ ID NO: 23901 - protein, 81 aa, Vombatus ursinus
FQGSVTFQDVAVVFTPEEWGHLEPSQKELYREVMLENFRNLVCLGLVVYKPSVIYQLERGGAPWKPGGGGRRSGSSDWETL

SEQ ID NO: 23902 - protein, 81 aa, Balaenoptera acutorostrata
QGHVIFEDVAVSFSQEEWGLLNDAQRLLYCDVMLENLSLIASLGCWRAVGTEEAASEQCVSVELVTQDRNPNPDLSILKTL

SEQ ID NO: 23903 - protein, 81 aa, Balaenoptera acutorostrata
WQGWGTFEDIAVYFSQEEWGLLDEAQRHLYCDVMLENLALVASLDYWCGAEAEGASYEQSVYVAVLQSRTPKAGPSIQKAN

SEQ ID NO: 23904 - protein, 81 aa, Vombatus ursinus
MQLDRPQRALYRDVMLENYRNLLLVSLAGHPISKPDVISRLEQGGVPWVLKKGTTGRAPSDRETKPEAKESASKPFISVEE

SEQ ID NO: 23905 - protein, 81 aa, Lynx pardinus
EPVTMTFDDVALYFSDQEWEILEKWQKEMYQQVMKTNYETLDSLGGVFSKPDLITWMEQGRTLLIRDQGPLEKRMTLSPSA

SEQ ID NO: 23906 - protein, 81 aa, Lynx pardinus
VTFRDVAVAFTEEELGLLDSAQRKLYQDVMLENFRNLVSVGHQSLKQDKWRIEKEKLWSMKTAAQMERNVGGNSQSELRTL

SEQ ID NO: 23907 - protein, 81 aa, Balaenoptera acutorostrata
FYESVTFEDVLINFTQEEWALLDTSQKTLFRNVMLENITHLVSIGYQISKSDVISQLEQGKELWSEATGCLQGQSPDDESP

SEQ ID NO: 23908 - protein, 81 aa, Balaenoptera acutorostrata
GLSSFKDISMEFTWEEWQLLDSAQKHLYRDVTLENYSNLVSLEGWQEWYQKNQDELESVERSYACNAFGKLHLSKSHISSR

SEQ ID NO: 23909 - protein, 81 aa, Balaenoptera acutorostrata
VKSSVWVPEWAAQACPEDQVLNSPFKGWHSRTMLGQESLIYDDMAMKFTWEEWQLLDPNQKDPYRDPVMLENHSNLVSCGV

SEQ ID NO: 23910 - protein, 81 aa, Balaenoptera acutorostrata
TQGLVTFRDVAIEFSQEEWKCLEPAQRDLYKDVTLENFGNLVSLGLSLSKPDVISLLEQGKEPWMVVNDMTGPWCPDLESR

SEQ ID NO: 23911 - protein, 81 aa, Vombatus ursinus
MLENYRNLVRLGLAVSKPDVISQLERREAPWTPGGIQRSGCPDWEATHETKAFAAKLGISVEESSQERGMGEVLHLSTSHE

SEQ ID NO: 23912 - protein, 81 aa, Saimiri boliviensis
YQDSVTFDDVAVDFTQEEWTLLDPSQRDLYRDVMLENYENLASIGHHLFKPSVICWLEKEGQLRAGQRGVLQEWQVKSKGS

SEQ ID NO: 23913 - protein, 81 aa, Lynx pardinus
EEPVTFLDVAVDFSKEEWGLLDPMQRTEYHDVMLETFGHLVSVGWETTLESKELTPKSDIPEEEPAPDLKMEEFSRDDTWS

SEQ ID NO: 23914 - protein, 81 aa, Pteropus alecto
SVTFEDVAVDFTQEEWRQLDPAQKTLHRDVMLEIYSHLVSVGCSSIKPSIIFKLEHETDLWIIDSELSRWIYSVISHEIMT

SEQ ID NO: 23915 - protein, 81 aa, Pteropus alecto
LQKSLTFWDVFMDFTLEEWQQLDSTQKSLYRDVMLENYSHLVSVGYLVAKPDVIFRLGQVEARKADGEPATQSCPEFLQVD

SEQ ID NO: 23916 - protein, 81 aa, Oryctolagus cuniculus
MDSVVSEDVSVNFSREEWALLNPSQKKLYRDVMQETIRNLASCGKAFSCPSSIQIHERTHTGEKPYTCKECGKAFISRTSV

SEQ ID NO: 23917 - protein, 81 aa, Camelus ferus
MKGFLESLRSRWVRPRSEGYRIFLLAPGALVESTGYEVPKPEVIFRLEQGEEPWMSEGETPHQSCSGIAFRFLTSLHLPYP

SEQ ID NO: 23918 - protein, 81 aa, Myotis brandtii
EGQESLEKDIAMDFTWEEWQLLDSAQKYLYRDVTLENYRNLVCTGYHGTKPDLIFKLEQGEEPWIGNAKISHQSCTEDWKE

SEQ ID NO: 23919 - protein, 81 aa, Saimiri boliviensis
LGAVTFEDVAVNFTREEWNILSEAQRCLYRDVMLENLALTSSLGCWCGVEDEEAPSKQSIYVQRETQVRTPTAGVFPEKAH

SEQ ID NO: 23920 - protein, 81 aa, Propithecus coquereli
EAVTFKDVAVVFTEEELGLLDPAQRKLYRDVMLENFRNVVSVGGKNLKEMETLQEIGLRYLPHEELFCSQIWQQVTRELTR

SEQ ID NO: 23921 - protein, 81 aa, Propithecus coquereli
ALALVSFEDVAVTFTGEEWGHLDLAQRTLYQEVMLETCGLFVSLGHPVPKPELIYLLEHGQELRAVQRGLPQSTCASEKPK

SEQ ID NO: 23922 - protein, 81 aa, Vombatus ursinus
MLENYENFVFLVGLPVFKPSMISRLERRETSWIREEEAAFSFEDSLIQKTGSETKKSTPKQGICRGRSSKQRLTKDGPWRS

SEQ ID NO: 23923 - protein, 81 aa, Saimiri boliviensis
AQALVSFEDVVVTFTGEEWGHLDLAQRTLYQEVMLETCRLLISLGHPVPKPELIYLLEHGQEPWTVKRGLSESTCAGEKAK

SEQ ID NO: 23924 - protein, 81 aa, Propithecus coquereli
RLTARSQETVTFKDVAMDFTPEEWGKLDPAQRDVMLENYRNLVSLWLPVSKPENYGLENGKEPLKLERKAPKSTCSELPFC

SEQ ID NO: 23925 - protein, 81 aa, Vombatus ursinus
PKVPLTFDDVAVYFSEQEWGQLEEWQKELYKHVMRGNYEMLVSLDYAVSKPDILSQIERGEKPCHKDQWGSDEEVSCPGKL

SEQ ID NO: 23926 - protein, 81 aa, Saimiri boliviensis
DHELVTFRDVLINFSQEEWEYLDSAQRNLYWDVMMENYSNLLSLDLESKYETKLLSIGTDMIKNTGSQWEVMESSKLCGLE

SEQ ID NO: 23927 - protein, 81 aa, Vombatus ursinus
TKESVTFNDVAMEFTPEEWLHLNPSQKKLYRDVMLENYRNLVSLGFAVSKPDVIYQLERKEAFWMPETDIPRRSCPGDFIK

SEQ ID NO: 23928 - protein, 81 aa, Vombatus ursinus
VRVPIKFEDVAVYFSEPEWKNLDKWQKELYKHVMTVNYEILFSLDSAIPKPDLISHIERGEEPFIRDHGNLMKREMAIRYG

SEQ ID NO: 23929 - protein, 81 aa, Balaenoptera acutorostrata
AQELVTFEDVAVYFIRKEWKRLEPAQRDLYRDVMLENYGNVFSLDGETRTEHGPEISEDTGSHGVLLGRFQKDISQGLKFE

SEQ ID NO: 23930 - protein, 81 aa, Lynx pardinus
MYISQEEWGHQDPSKRALSRDTVQESYENVDSLEAQVPSREALSTQVEQGGKPWDPSVQTCKEGLSPRGPAPGEEKFENQE

SEQ ID NO: 23931 - protein, 81 aa, Balaenoptera acutorostrata
AQGSLTLEDVAVDFTCEEWQLLDPDQKDLYRDVMLENYSNLLSVGYQVSKPDILSKLEQGEPPWTLEDEVHSHPHPEIEKV

SEQ ID NO: 23932 - protein, 81 aa, Saimiri boliviensis
FQEAVTFKDVAVVFSSEELRLLDLTQRKLYQDVMVENFKNLVAVGHLPFQPDMVSQLEAEEKLWMMEAETQRSSKHQNKME

SEQ ID NO: 23933 - protein, 81 aa, Lynx pardinus
EDESLTLEDVAVGFSREEWRLLAPAQKDLYRDVMLENFRNLVSVGHQASKPDVLAKLERGEEPWAIEEEVRSGTSPADPLL

SEQ ID NO: 23934 - protein, 81 aa, Balaenoptera acutorostrata
SRDSVTFADVAVDFTQEEWTLLDPFQRNLYRDVMLENYKNLTTARYQSLKPTLISWLEQDDLRTVERRGVLQGSAIQAAQD

SEQ ID NO: 23935 - protein, 81 aa, Saimiri boliviensis
PQEAVVFEDVAVYFTRIEWSCLDPNQQVLYRDVMLENYRNLASLGFLVAKPALISLLEQGEEPGALILQVAEQRGVKTSLC

SEQ ID NO: 23936 - protein, 81 aa, Saimiri boliviensis
QEGVNFKIVTVDFTQEEQGTWKPAQRSLDGDIILESHRDLVSWDLPAVVGKEDSASKQNISDEEPANGVKTECFTRNDPWL

SEQ ID NO: 23937 - protein, 81 aa, Lynx pardinus
FQASVVFEDVAVYFTPEEWALLNHGQRKLYRDVMLETCRNLSAVEVFWWRVSVNVLNEGDQRRETLNPITSLTVHEGCPTA

SEQ ID NO: 23938 - protein, 81 aa, Balaenoptera acutorostrata
KEAFMAFGDVAVDFTQEEWRLLTPAQRTLHREVMLETYNHLVSLEISFSKPKLISQLERGEEPWIEERQRPLVLCPASGPT

SEQ ID NO: 23939 - protein, 81 aa, Vombatus ursinus
FQGSVTFQDVAVDFTPEEWGRLTPPQKELYQEVMLENYWNLVCLGLALSTQGVIEHLERGEAPWMLERDVPGTRGPVSEIR

SEQ ID NO: 23940 - protein, 81 aa, Saimiri boliviensis
KVPVTFVDIAVYFSEDEWKNLDEWQKELYNNLVKENYKTLMSLDADGPVPKPDAPARAEPREEPCVWEQRHPEEREIPMDP

SEQ ID NO: 23941 - protein, 81 aa, Saimiri boliviensis
REQGSSSGEGSLSLEDVAVDFTREEWQFLDSSQKVLYKEVMLDNYGNLVSVGYQEHPWIVEGAAHSQTCPGFVIQNRRYAE

SEQ ID NO: 23942 - protein, 81 aa, Saimiri boliviensis
PRGSTSFSSVTVAFAQEGWRCLVSTPRDRFKEGIPEKSRNLVLLGLPVSQPGMNSQLELREGAWMLEGKDLRNSSPNWKIV

SEQ ID NO: 23943 - protein, 81 aa, Vombatus ursinus
MLENSQNLLSLGIPLLREDLISPLEEREASRILDRKGPRKSCPDARTRFHVETLAKLNISVEESHQPRFVSDVNLREICDS

SEQ ID NO: 23944 - protein, 81 aa, Colobus angolensis
EGLTFKDVAVVFTEEELGLLDPVQRNLYRDVMLENFRNLLSVGHHPFKHDVFPLEKEKKLDMMKTATQRKRKSADKIQSEM

SEQ ID NO: 23945 - protein, 81 aa, Mustela putorius
QDSVTFEEVAVDFSQEEWALLDPAQKTLYRDVMLENYRNLASVGYPLCKHSLITEVEQEVLGTEEGAILQGAFTDWDIQLK

SEQ ID NO: 23946 - protein, 81 aa, Mustela putorius
TARSQASVTFKDVAMDFTPEEWGKLDPAQREVMLENYKNLVSLWLPVSKPENYSLENGKEPLVLERKAPKSNYDLETKPED

SEQ ID NO: 23947 - protein, 81 aa, Mustela putorius
AQESLTFRDVFVDFTLEEWQQLDSAQRNLYRDVTLENYSHLVSVGYLITKPDEVLRPGQVEEAMGAEGEPPARNHPEFWKV

SEQ ID NO: 23948 - protein, 81 aa, Mustela putorius
WHQLVTFKDVAVYFTRTEWAGLSPTQQALYRSVMLENYGNLTSLGYPVPKPALISLLEGENLPWGLEAQENPSAEGTKDIC

SEQ ID NO: 23949 - protein, 81 aa, Mustela putorius
IPGSISFEDVTVNFTQEEWGQLDPDQRTLYRDVMLENYNIFLSLEELKVDGVIESKENQDKHLWQHAFINNKKVTTEKENV

SEQ ID NO: 23950 - protein, 81 aa, Mustela putorius
FQEAVTFKDVAVVFSEEELGLLDPAQRKLYRDVMLENFRNLVSVGNQPFKPDLIFQLEREEKLLMIETETQRDGYLGAKSQ

SEQ ID NO: 23951 - protein, 81 aa, Tupaia chinensis
PPSRVSPFKDMILCFSEEDWSLLDPAQTGFYGEFIIGEDCGVSMPSSDPTSQPDPSQGEEGEPRLPDLQNLQGKEVPQVSY

SEQ ID NO: 23952 - protein, 81 aa, Tupaia chinensis
TVNGSLTFQDVAVDFTREEWDQLYPAQKNLYRDVMLENYRNLVALGQQLYKPEVITQLEQEEQWTIERDSPLDPPPDGENR

SEQ ID NO: 23953 - protein, 81 aa, Myotis brandtii
AEKPVTLEDVAVRFTPEEWACLDARQRALYQDVMSETFKTLVSVARTALTNPDLVAELEQEVKRWRAALLPLRGGGRPAGE

SEQ ID NO: 23954 - protein, 81 aa, Myotis brandtii
ADMNFEDVAIAFSQEEWDLLDESQRLLYCDAMLEVFALVTSVGCWRKTEDESCPDHSISIQGESQDMNFEDVAIVFSQEEW

SEQ ID NO: 23955 - protein, 81 aa, Myotis brandtii
PLESVTFRDVAVDFTQEEWGQLDSPQRALYRDVMLENYQNLLALGPPVCKPEVISHLERGEEPWQVPREVPGGARPEREPR

SEQ ID NO: 23956 - protein, 81 aa, Myotis brandtii
RKDSVAFEDVNVEFTMEEWAFLDPTQKKLYTDVMLETFWNLASVACILEEKGEDHDTEDKYEYHGMNLSSHMVERLCTRKD

SEQ ID NO: 23957 - protein, 81 aa, Propithecus coquereli
VQGSVTFKDVAVLFTQEEWGHLSPAQRALYRDVMLENYSHLVSLGLLGPKPDLFSQLGKGEEWMPEDASGSFCLDWMTVPV

SEQ ID NO: 23958 - protein, 81 aa, Vombatus ursinus
ARGPMSFADVAVYFSAEEWGRLRPAQRALYRDVMRETYGHLGALGFPGPKPALICWMDEETEVWGPDAQDPEEAGERGTVN

SEQ ID NO: 23959 - protein, 81 aa, Propithecus coquereli
GRVVFEDVAIYFSQEEWGHLDEAQRSLYRDVMLDNMALLSSLGCWQGAQDVEAPSSEQGVSIGMSQVTTPVPHVSTRRIQS

SEQ ID NO: 23960 - protein, 81 aa, Propithecus coquereli
PEELLTFRDVTIEFSAEEWECLNPAQWNLYRDVMLENYRNLVSLGLTASKPDLITCLEQRKEPWNVKRHDKGAEHPAVSSH

SEQ ID NO: 23961 - protein, 81 aa, Lynx pardinus
RLTFRDVAIEFSQEEWECLDPAQRALYRDVMLENYRNLVSVGSLSTGFALMELSPGEDIYKEVFYHLVILERNESHGIKDF

SEQ ID NO: 23962 - protein, 81 aa, Lynx pardinus
PQKSVTFEDVAVYFTQTEWNGLSPAQRALYRDVMLENYGNVASLGFSLLKPAVISQLEGAVDIESQTDNNLTKEIYKEKHN

SEQ ID NO: 23963 - protein, 81 aa, Saimiri boliviensis
DSVAFEDVAINFTCEEWALLGPSQKSLYRDVMQETIRNLDCIGMKWQNLDIEEDKYKNPGRNLRCYMVERSCEIKDNSQCG

SEQ ID NO: 23964 - protein, 81 aa, Vombatus ursinus
FQESVTFKDVAVAFTLEEWRHLGPSQKDLYRDVMLENYRNLVGLGLAISKPYVICQLEQGEAPWTPEGDVPQRHCAGEWGG

SEQ ID NO: 23965 - protein, 81 aa, Lynx pardinus
AQESLTFDDVAVNFTWEEWQLLAPAQKNLYRDVMLENYRNLVSLDFYPRKPDVLTKLDQGKPTGTVEDDIPFRTCSEIWKL

SEQ ID NO: 23966 - protein, 81 aa, Balaenoptera acutorostrata
VKKPVTSEDVAVNFTQEEWECLDASQRVLYQDVMSETFRNLMSVVRIFLSNPDLIAKFEQEEKQWRADLRPPNGEGLHSGM

SEQ ID NO: 23967 - protein, 81 aa, Vombatus ursinus
MLENYRNLVSLGLPVFQPDLISRLERGEVPWIPVGEVLRGSCPDSLIQETTCKIMETALKHNLFVEESSKGRFTNHDPWDS

SEQ ID NO: 23968 - protein, 81 aa, Balaenoptera acutorostrata
PHRLVLFKDVAIDFSQEEWECLELEQRDLYRDVMLENYSNLVSLGFSISKPDVLSLLEQGKDPWKVVRDVTRGLSPDWESR

SEQ ID NO: 23969 - protein, 81 aa, Vombatus ursinus
MLENYKNLVSLGFPISKPKVISKLERGGAHWMLGRRVSRRPFPGRLCQNRGKSKDSTPKQCNYISLKKRLIVNNKECVEAL

SEQ ID NO: 23970 - protein, 81 aa, Saimiri boliviensis
DGLVTFRDVAIDFSPEEWECLDPAQRDLYVDVMLENYSNLVSLDLESTTCDTKKIFSEKDIFEINFSQWEMKEKSKIPGLE

SEQ ID NO: 23971 - protein, 81 aa, Lynx pardinus
MLVKRQKELYRDVMRMNYELLASLGPAAAKPDLILKLERRAAPWIKDPNGPKWGKGRPPGKKKMVAGREADAQALAVESTV

SEQ ID NO: 23972 - protein, 81 aa, Vombatus ursinus
FQESLTFKDVAVYFTQEEWGQLDPGQKYLYRDVMLENYRNLVSLGYHISKPDVISHLEQGEEPWMVGREILRGNSPGGMTR

SEQ ID NO: 23973 - protein, 81 aa, Colobus angolensis
SQTLVTFKDVFVDFTREEWKLLDTAQQSVYRNVMLENYKNLVSLGHQLTKPDVILRLEKGEEPWLVERGIHQEAHPDSETA

SEQ ID NO: 23974 - protein, 81 aa, Colobus angolensis
IQSQVSFEDVAVDFTLEEWRLLNPTQKDLYRDVMLENYSNLIFLEVWLDNPKMWLRDNQDNFKSMERGHKYDVFGKIFNSS

SEQ ID NO: 23975 - protein, 81 aa, Mustela putorius
AQASVSFKDVTVDFTREEWQHLDPAQKTLYMDVMLENYCHLISVGCHMTKPDVILKLERGEEPWTSFTSHTCLEENWKEED

SEQ ID NO: 23976 - protein, 81 aa, Mustela putorius
AYGSLSFGDVAISFSQEEWECLDPAQKALYRDVMLETYSNLVSLESSISKPDMIIFLEQEKEPWVVLRRETSGWYPELESN

SEQ ID NO: 23977 - protein, 81 aa, Tupaia chinensis
MLETFGHLLSVGPDLPKPEVISQLEQGAELWVSERRIAQGHCLGWEPKPECQILPKEQGYPEEEPSYVMKRDAACPSMFGE

SEQ ID NO: 23978 - protein, 81 aa, Tupaia chinensis
MLENYSHLVSVGFCVTKPEVIFRLEQGEEPWILEEEFPSQNFPGEKPYECSECGKTFCQKSQLTQHQRIHMGEKPYDCNEC

SEQ ID NO: 23979 - protein, 81 aa, Vicugna pacos
MLENFRNLVSVGHLPFKPDMVSQLEAEEELWMTERETQRNGCSGENRAAVLSGNRNQNEMENLRKVALKYISWEEPSCWQI

SEQ ID NO: 23980 - protein, 81 aa, Vicugna pacos
AHGSVTFRDVAIDFSQEEWEFLDSAQRDLYRDVMWENYSNFISLAGPSISKPDEITLLDEGKEPWMVVREGTRRLHRGLES

SEQ ID NO: 23981 - protein, 81 aa, Rhinopithecus bieti
ESRPGAVSFADVAVYFSPEEWGCLRPAQKVLYRDVMRHTFGHLGALGEAGIFRPQTREVEAWSPEAQDPEGESPAAVSRGQ

SEQ ID NO: 23982 - protein, 81 aa, Rhinopithecus bieti
TKGCVTFEDIAIYFSQEEWGLLDEAQRLLYLEVMLENFALVASLGCSHGTEDEETPSEQNVSVRVSQSKAGSSTQKTQSCE

SEQ ID NO: 23983 - protein, 81 aa, Ursus arctos
VTFEDVAVYFSWKEWKFLDEAQRRLYHHVMLENFTLISSLGCCCGAEGEEAPFAQSTSVGASQAGTPTAPVSSRKTHPCEM

SEQ ID NO: 23984 - protein, 81 aa, Ursus arctos
AQESVMFSDVSIDFSQEEWECLNDDQRDLYRDVMLENYSHLVSMAGHSVSKPDVISFLEQGKEPWLVDRELTRDHWPVLES

SEQ ID NO: 23985 - protein, 81 aa, Ursus arctos
SVGPVSFKDVAVDFTQEEWQQLEPEQKTTYRDVMLENYRHLVSVGCHIIKPEVIIKLEQGEEPWIVEGEFLPQSYPEEVWK

SEQ ID NO: 23986 - protein, 81 aa, Ursus arctos
FQGSVSFDDVTVGFTQEEWQHLDPAQRSLYRDVMLENYSHLVSVGYCVTKPEVIFRLEQGEEPWILEEEFPSWSFPETWET

SEQ ID NO: 23987 - protein, 81 aa, Ursus arctos
SLDSVTFTDVAIDFSQDEWERLSLAQRTLYKNVMLENYRNLLSLGLCISKPDVISLLEQGREPWMMKGERTRGLCPDLEYV

SEQ ID NO: 23988 - protein, 81 aa, Muntiacus reevesi
PVTFDDVAVYFSQEEWRLLGEAQRLLYHDVMLENFTLVASLGCWHTAENVSVEVPQRNTQKTDLSSQKICPWEMGNLALEG

SEQ ID NO: 23989 - protein, 81 aa, Muntiacus reevesi
MGRLMFQDVAIDFTQEEWECLDLSQRDLYRDVMLETYGNLASLGLVVSKPDLVTFLEQMKNSWDVRRTDTTATYPGELPHR

SEQ ID NO: 23990 - protein, 81 aa, Muntiacus reevesi
RSGFVVFEDVAIYFSQEEWGLLDEAQRLLYCQVMLQNIALLSSVGCWHGTQDEVALSEQHDAAARSQVKTPKPGPCIQKPP

SEQ ID NO: 23991 - protein, 81 aa, Muntiacus reevesi
MGLLTFQDVTVDFTQEEWECLNLGQRELYRDVMLENYGNLACLGLVVSKPDLVTFLEQMKDPWNVRRIETAIYPGMDILHP

SEQ ID NO: 23992 - protein, 81 aa, Ursus americanus
LGLLDPAQRELYRDVMLENFGNLVSVGHQPFRRDVGHLVREEKFWMVKLTTQRKGNSGKNQTIPKAEPHEELSCWQIWQHI

SEQ ID NO: 23993 - protein, 81 aa, Myotis brandtii
MDLEDVAIAFSQEEWGLLDAAQRLLYCEVMLEIFALVASVGCWHKTEADETPGEQSVSVEGESPVGASETAPAAQRTHPCE

SEQ ID NO: 23994 - protein, 81 aa, Camelus ferus
VEMSVSFEDVTVAFTQEEWRHMSPAQRTLYRDVMLENYRHLVSVGRCFTKPYVIFKLERGEDPLLLEEEILKKSLAAESSQ

SEQ ID NO: 23995 - protein, 81 aa, Saimiri boliviensis
VLGPLTFKDVAIEFSQEEWRCLDPAQRTLYRDVMLENYRNLVSLGVSLPDLNINSMLKQRRELWSGENEVKIAKSSDRREG

SEQ ID NO: 23996 - protein, 81 aa, Propithecus coquereli
LKGLLSFTDVSVEFTSEERQLLDSTQKYLYRDVTLENYNNLVSVGYHGTKPGLIFKLEQGEEPWIVNAKISSRSCPEGWEE

SEQ ID NO: 23997 - protein, 81 aa, Propithecus coquereli
MDGKPMEHLTFRDVAIEFSQEEWKCLDPAQRALYRDVMLENYRNLVSLGEDTFPPEPRSVESQVKIARKLKQWERIKGVIT

SEQ ID NO: 23998 - protein, 81 aa, Vombatus ursinus
APVPVTFDDVTMYFTEQEWRNLEEWQKELYKHVVKTNYETLVSLGCAIPKPDLITWIEQGEEPFIRGQENLGTEDLAIGSR

SEQ ID NO: 23999 - protein, 81 aa, Propithecus coquereli
LTFRDVAIEFSLEEWKCLDPAQRALYKAVMLENYSNLVSLDIPPKEKSNAGEVFQTVTLERPESHDIEDFSFREVQKNIHD

SEQ ID NO: 24000 - protein, 81 aa, Vombatus ursinus
MFLFQASVTFQDVAVDFSRDEWKCLDDAQKALYRDVMLENYENLVSLGLPVSKLDVISLLERREAPWRSKEHVPRDPLPGE

SEQ ID NO: 24001 - protein, 81 aa, Vombatus ursinus
SQGLATFKDVTLSFSQEQWGELDPTQKEFYGEYVLQEDCGIVVSLTFPIPRLDEVSQAEEEEESWVPDLEYTQDPEDTEIL

SEQ ID NO: 24002 - protein, 81 aa, Vombatus ursinus
MLENYENLVHLGLAVSKPDVISQLEQREAPWTPGGIQRSGCPDWEATPETKQSVLKLGVSVQDLSQERGTKKNLCFSRLKK

SEQ ID NO: 24003 - protein, 81 aa, Vombatus ursinus
FQELVAFKDVAVEFNQEEWRCLDASQKELYHDVMMENYKNLVCLGLVFNKPAVISHLEGKEAPWMAEGQVQRNSGESFKIP

SEQ ID NO: 24004 - protein, 81 aa, Vombatus ursinus
LSLGELVTFKDVTVGFSQDEWGLDMMLENYRNLVSLGLILAKSEVICHLEQGGELWKLEQGVLCSAWEIKAKTKVLSPKWD

SEQ ID NO: 24005 - protein, 81 aa, Saimiri boliviensis
TGGDVTFSDVAIDFSHEEWGWLDSAQRDLYKDVMVQNYENLVSLAGLSITKPYVITLLEDGKEPWMVEEKLSKGVTPDWES

SEQ ID NO: 24006 - protein, 81 aa, Saimiri boliviensis
MLENYRNLAFLAGIAVSKQNTITCLVQGKEPWNVKRHEMVARPNAMCSYFPKYLWPEQDIKDSFQQVILRRYGKCGHENLQ

SEQ ID NO: 24007 - protein, 81 aa, Saimiri boliviensis
QEQVSFKDVCVDFTQEEWYLLNPAQKMLYRDVILENYSNLVSVERKWKVDDVLESSQENEDDHFWELLFHNNKTVSAESGD

SEQ ID NO: 24008 - protein, 81 aa, Vombatus ursinus
FQEAVTFRDVALDFTWDEWGCLSGVQRELYRDVMLENYRNLVSLGLPGPKPGLISWLEGEGDPHPWESLGHAARSTSLSEA

SEQ ID NO: 24009 - protein, 81 aa, Saimiri boliviensis
SPGSVTFTDVAIDFSQDEWEWLNLAQRSLYKKVMLENYRNLVSVGLCIAKPDVISLLEQEKDPWVIKGEMTRGLCSDLEYV

SEQ ID NO: 24010 - protein, 81 aa, Saimiri boliviensis
MDTVVFEDVVVEFTLDEWALLSPAQRKLYRDVMLETFQNLASVGNETQRKANGSIAQQDNFGEKLSIQQKIEKFIRNNTWA

SEQ ID NO: 24011 - protein, 81 aa, Balaenoptera acutorostrata
CEGSVSFRDVAVDFSREEWQQLDLDQKNLYRDVMLETYSHLLSVEELWQIDDQIESYQQRENKSLRDVTFIKKILTIKRDY

SEQ ID NO: 24012 - protein, 81 aa, Saimiri boliviensis
AQSSVTFEDVAVNFSLEEWNLLNEAQRCLYRDVMLETLTLISSLGCWHGGEEEAAPSKQSTCIHVYKDQRVHNGERPYECG

SEQ ID NO: 24013 - protein, 81 aa, Lynx pardinus
MLENYGNLVSVGYQLSKPGVISQLEKGEEPWLIEREVSGGPRSDLESKAETKESAVKNDTSWEELHHGLMKEQSTRGSTLY

SEQ ID NO: 24014 - protein, 81 aa, Lynx pardinus
PQLPESLEDVAMYISQEEWGHQDPSKRALSRDTVQESYENVDSLEAQVPSREALSTQVEQGGKPWDPSVQTCKEGLSPRGP

SEQ ID NO: 24015 - protein, 81 aa, Cervus elaphus
FQESVTFEDIAVDFTQEEWALLDTSQRKLFRDVMLENISHLVSVGNQLYKPDVISHLEQGEQLSREELGFLQGQSPGELRE

SEQ ID NO: 24016 - protein, 81 aa, Colobus angolensis
MCGLLTFRDVEWQCLDIAQKNLYRNVMLENYRNLAFLGRTGHELWLRELELESWNCFRDHSKGICPHFAQDIWPEQGMEDS

SEQ ID NO: 24017 - protein, 81 aa, Colobus angolensis
QEGVNFKTVTVDFTQGEQGTWNPSQRTLNRDVILENHRDLVSWDLATAVGKKDPTSKQSIFDEELANGVKIERLTRDDPWL

SEQ ID NO: 24018 - protein, 81 aa, Myotis brandtii
VEQDMDFEDVAIAFSQEEWGLLDEAQRLLYCDVMLEVFALVSSAGCGHKTDDEEACPEQSLCVQGESQVRASETEPATQRT

SEQ ID NO: 24019 - protein, 81 aa, Eschrichtius robustus
MPEKSRNLVLLGLPVSQPGMNSQLEQREGSWMLERGGLRSTCPDWKIVSESPPEQDISEESFQDPSVEMPSGESDHRNSEL

SEQ ID NO: 24020 - protein, 81 aa, Eschrichtius robustus
FQNRVSSFKDMIFCFSEEDWSLLDPAQTGFYGEFIIGEDCGVSLPPNDPAAQLDLSQGEENEPRVPELQDLQGKDVSQVSY

SEQ ID NO: 24021 - protein, 81 aa, Myotis brandtii
SALGQLTFSDVAIEFSQEEWACLDPAQRKLYMDVMLQNYRNLVFLGVSKPDLLTFLEHMKEPWELKRKKTIPIQPAISSQV

SEQ ID NO: 24022 - protein, 81 aa, Eschrichtius robustus
QSPGLQEKDVAVYFSLEEWERLDADQRELYKEVMQENYGILVSLGYPIPKPDLIFRLEQGEEPWVPDSPRPEEGDIVTGVY

SEQ ID NO: 24023 - protein, 81 aa, Myotis brandtii
VTFEDIALYFSREEWSLLDEGQRQLYLNVMLENFELISSLGCCCGAENVEAPFEENISVRVSQAMNPKLALSSQKSHPCES

SEQ ID NO: 24024 - protein, 81 aa, Lynx pardinus
FQDFVSFKDVAVNFTEEEWRELDPVQRVLYRDVMLENYRNLVSLVGFPFSKPDIISQLEQAVNPWMQEGEVLRGSCTHSKN

SEQ ID NO: 24025 - protein, 81 aa, Lynx pardinus
SQGLVTFEDVAVYFSLEEWERLDAGERDLYKDVMQENYGILVSLGAWFWTDDIEDHEEEEDEDFLAEVAEEENEPPGLWSA

SEQ ID NO: 24026 - protein, 81 aa, Saimiri boliviensis
CQETVTFEDVAVHFTKTEWTGLSPAQRALYRSVMLENYGNLIAMGYPVPKPALISLLEGGDMAWGLEGTKNICKHAETNTD

SEQ ID NO: 24027 - protein, 81 aa, Lynx pardinus
MLFEDVSVDFTQKEWRLLDPAQRLLCRDVMLENYGHLVSLGRCVTKAELILKLEQGEEPWVPRRELPSQSPPGELTKAAER

SEQ ID NO: 24028 - protein, 81 aa, Lynx pardinus
QESVTFKDVAVDFTLEEWGWLGPGQRELYRDVMLENYQNLLSLGAGPPGFKPDVISRLERGEEPRMEKREGWQMACPDLET

SEQ ID NO: 24029 - protein, 81 aa, Balaenoptera acutorostrata
MAVRCLPTVVQDEWAQLSPAQRALYRDVMLENYSNLVYLGLLGPKPDTFSQLGKGEEWMPEDSLGGFCLDWMTTPVSKKST

SEQ ID NO: 24030 - protein, 81 aa, Lynx pardinus
CQESVTFEDVAVIFTDEEWRHLVPIQKDLYKEVMLENYKSIVSLGLPVPRPEVIFQLKTGDEPWIVDLHGSEERECPENVS

SEQ ID NO: 24031 - protein, 81 aa, Vombatus ursinus
MLENYRNLLYLGLVVSKPDVIYQFERGEVLWRPDRRVPGSICPAGETGPECKESTAKWNISVECSSPNSLTSSGLCVFSLK

SEQ ID NO: 24032 - protein, 81 aa, Saimiri boliviensis
MGVLTFRDVAIEFSPEEWECLDSAQQHLYRDVMLENYRNLVSLGLAIFKPNLITCLEQRKEPWNLKKQETVAKYPAGSFHF

SEQ ID NO: 24033 - protein, 81 aa, Vombatus ursinus
FQESVTFKDVAVEFTREEWVQLNRSQKKLYRDVMLEKYKSLVSLGFAVSKPDVIYQLERKEASWMPEADIPRNSCPGDYIK

SEQ ID NO: 24034 - protein, 81 aa, Balaenoptera acutorostrata
SKGPVSFEDVTMGFTQEEWQHLDPAQRTLYRDVMLENYSHLISVGYCVTKPEAIFKLEQGEEPWMLEEESQSQSHPELIIS

SEQ ID NO: 24035 - protein, 81 aa, Lynx pardinus
VTFEDVVVDFTQEEWGQLEPAQRTLYRDVMLETFRLLVSVDLETRPQTKVSTPTQDITEGIRTSALAERFLWDSLRYSEGD

SEQ ID NO: 24036 - protein, 81 aa, Cervus elaphus
MAFEDVAVHFSQEEWGLLDTAQRSLYRRVMLENFALLASLGLSVSRPHVVTQLERGEEPWVLSGVDVTLPRDAQRRPHRGS

SEQ ID NO: 24037 - protein, 81 aa, Colobus angolensis
LKIQNMTFKDVAVVFSEEELRLLDLAQRKLYREVMLENFRNLLSVGHQPLHRDTFHFLKEEKFWMMETVTQREGNLGKKQA

SEQ ID NO: 24038 - protein, 81 aa, Colobus angolensis
KPGTVSFADVAVYFSREEWGYLRPAQRALYRDVMRETYCHLGALGVGGSKPALISWVEEEAELWDPAARDPEVTKGLTETD

SEQ ID NO: 24039 - protein, 81 aa, Colobus angolensis
DSVTFEDVAVDFTQEEWTLLDQTQRNLYRDVMLENYKNLVAVDWESHINTKWSASQQNFLQGKTSSVVEMERNHFGEELFD

SEQ ID NO: 24040 - protein, 81 aa, Colobus angolensis
MSELLTLEDVTVEFTWEEWQLLDPFQKDLYRDVMLEIYSNLVSVGYQVSKPDALSRLERGEEPWTMEDERHSRICPENNKV

SEQ ID NO: 24041 - protein, 81 aa, Colobus angolensis
TTFKEAVTFEDVAVFFTEEELGLLDPAQRKLYQDVMLENFTNLLSVGHQPFHPFHFLREEKFWMMETATQREGSSGGKTVV

SEQ ID NO: 24042 - protein, 81 aa, Colobus angolensis
TEGRVVFEDVAIYFSQEEWGHLDEAQRLLYRDVMLENLALLSSLGCWHGAEDEEAPSQQGFSVGVPEITTSKSCLPTQKVH

SEQ ID NO: 24043 - protein, 81 aa, Colobus angolensis
KSQESLTLEDVAVDFTWEEWQLLGPIQKDLYRDVMLENYSNLVSVGYQASKPDALSKLEQGEPWTVENEIHSQICPEIKKV

SEQ ID NO: 24044 - protein, 81 aa, Mustela putorius
SQEPVTYEDVAVDFTQEEWQHLDAAQKTLHRDVMLEIYGHLVSVGCSSIKPGVIFKLEHEEDPWIIKSELSTWIHSDREKS

SEQ ID NO: 24045 - protein, 81 aa, Mustela putorius
HWLVTFRDVAINFSQEEWECLNSTQRDLYRDVMLENYSNLISLDLESSCETKKSFPEKGAYEMESLQWENMRKPISHNLDY

SEQ ID NO: 24046 - protein, 81 aa, Tupaia chinensis
KVPVTFVDIAVYFSEDEWKNLDEWQKELYNNLVKENYKTLMSLDAEGPVPKPEAPAQAEPREEPCVWEQRHPEEREIPVDP

SEQ ID NO: 24047 - protein, 81 aa, Tupaia chinensis
VQGSVTFRDVAVLFSQDEWLHLDTAQRTLYREVMLENYSNLVSLGILFSKPKVISQLEQGQDPWKVEHGAPQGTCPGWESL

SEQ ID NO: 24048 - protein, 81 aa, Tupaia chinensis
MYFTQTEWDDLSPAQRALYRDVMLENYGNVASLGFPLLKPAVIAHLEGGGDMGGPFPLATGTEIGSQVLWTVDIYIQTGPE

SEQ ID NO: 24049 - protein, 81 aa, Vicugna pacos
SQEQVSFRDVCVDFTQEEWYLLDPAQKILYRDVILENYSHLVSVGNCITKPEVIFKIEQGEEPWIPEERFPKQCFSEDWKV

SEQ ID NO: 24050 - protein, 81 aa, Vicugna pacos
KGLLTFEDVAVFFTQEEWDYLEPAQRSLYKDVMMENYGNLVSLDVLNRDKEEEPTVKQEIEEIEEEVEPQGVIVTRIKSEI

SEQ ID NO: 24051 - protein, 81 aa, Vicugna pacos
SLGSVSFKDVTVDFSREEWQQLDLAQKSLYTDVMLENYFNLISVGCQVPKPEVIFNLELGEEPCMLDDGTSSQSCLDQSIG

SEQ ID NO: 24052 - protein, 81 aa, Panthera pardus
MVQESVTFKDVVVLFTQDEWAQLSPTQRALYRDVMLENYSNLVSLGLLGPQPDVLSQLGKGEEWVLEDTSAGFCLDWMTMP

SEQ ID NO: 24053 - protein, 81 aa, Panthera pardus
WLTFRDVAIEFSQEEWECLDPAQRALYRDVMLENYRNLVSLALSPKCVIKELPPKENSNTGEVLQTVILERRESRGAEDCG

SEQ ID NO: 24054 - protein, 81 aa, Panthera pardus
SRGSLSFGDVTVDFSWEEWQCLNPAQRTLYRDVMLENYHNFVSVGFLINKPEVIFRLEEGEEPWIVKEEFLYQNYPEDNKA

SEQ ID NO: 24055 - protein, 81 aa, Ursus arctos
SVAFQDLAVRFSEEEWQLLAEGQRALYRDVMRENYDTLRSLGTDELLPLSAFLSPTEAGGAMEGRSSAGEGQEPSRGGGPP

SEQ ID NO: 24056 - protein, 81 aa, Ursus arctos
PQVLVSFEDVAVFLSREEWGCLGPAQRGLYRDVMLETYRNLISLGFQDSKPDVISKLEEGEEPWAPYSPRIEEGWIQSHGS

SEQ ID NO: 24057 - protein, 81 aa, Ursus arctos
IGVVGCQCASRCAEHPGRCGPGGTPSMLGSVVPAPYRSRAPAGGWSDPLFFGGPKLISQLEQGKETWREERTCPLATCPAE

SEQ ID NO: 24058 - protein, 81 aa, Muntiacus reevesi
PQEPVTFADVAVLFTPEEWLFLDSAQKSLYRDVMLENYRNLASVGDQLCKTKMSSHMEQREELCVTERGVFPGAHLGPHLQ

SEQ ID NO: 24059 - protein, 81 aa, Muntiacus reevesi
VSFEDVAVYFSRKEWGLLNWTQRSLYRHVMLENFALIGSLVCAPFPASLSSTVGSSDTCCPTGSWSRTWGVTLLKLWLLCA

SEQ ID NO: 24060 - protein, 81 aa, Muntiacus reevesi
VVFEDVTVNFTLEEWALLDFSQRKLCRDVMGETFRNLALVGTTWEDHDIDDQYRNQGRQLRLCEGKEDIRPWGHKVCGKDL

SEQ ID NO: 24061 - protein, 81 aa, Muntiacus reevesi
EQLTSEDVAIKFTQEEWEFLDPAQRALYRDVMLETYRNLLSVAFTTQSDSDKREPFQTLMLGRPESYEMKHFHLWESQENM

SEQ ID NO: 24062 - protein, 81 aa, Muntiacus reevesi
MGLLTFLDVTVDFTQEEWECLDLGQRELYRDVMLENYGNLACLGLVVSKSDLVTFLEQMKDPWDVWRVETAIYPEHHLPTH

SEQ ID NO: 24063 - protein, 81 aa, Muntiacus reevesi
KPLAVRFADVAVYFSPEEWGCLLPAQRALYRDVMRETYGHLGALGFPGPKPALISWMEQESEAWSPDAQDPEEGESLGGAL

SEQ ID NO: 24064 - protein, 81 aa, Muntiacus reevesi
LRLSVTFDDVAVTFTQEEWGHLDPAQRTLYQEVMLENCGLLVSLGCPVPRPELIYQLEHGQELWTVKRDLSGSTCPGDKGK

SEQ ID NO: 24065 - protein, 81 aa, Ursus americanus
PHGLLISSCNSRTMTDGLVTFRDVAIDFSQEEWECLDPAQRDLYVDVMLENYSNLVSLGKVICLKYFRVFSLHHRLLLWEL

SEQ ID NO: 24066 - protein, 81 aa, Ursus americanus
AAGCVTFEDVAIYFSQEEWVLLDEAQRHLYHDAMLENFALIASLGKAFTLTPPCKAPLSRLVHLIFMGLFLCSLFCSVGLC

SEQ ID NO: 24067 - protein, 81 aa, Balaenoptera acutorostrata
SVTFEDVAVYFSQEEWRLLDEAQRFLYRDVMLETFALVASLGCWHGAEVKETPSEQNVFVEVPRINTSKTNLSTQEAYPWE

SEQ ID NO: 24068 - protein, 81 aa, Vombatus ursinus
MLENYRNLVSLGAECQSAKPKLISQLEQSREPWLLEGEDLRGLCPDGCPKPETLNSGPHQDVSEKPSCREERLEGLRRDGS

SEQ ID NO: 24069 - protein, 81 aa, Saimiri boliviensis
AQVSVTFDDVAVTFTKEEWGQLDLAQRTLYQEVMLENCGLLVSLGCPVPRPELIYHLEHGQEPWTRKEDLSQGTRPGDKGK

SEQ ID NO: 24070 - protein, 81 aa, Lynx pardinus
MLQVTFSDVAIDFSHEEWGWLDSAQRDLYKDVMVQNYENLVSLAGLSIPKPYVISLLEDGKEPWMVQKKLSKDWESRWENK

SEQ ID NO: 24071 - protein, 81 aa, Balaenoptera acutorostrata
LQRPVTFKDVAVDFTQEEWRYLDPSQRDLYRDVMLENYINLISVGYKTIKPAVIHKLEQGEEPWMVEREISSWRYPVYYAS

SEQ ID NO: 24072 - protein, 81 aa, Vombatus ursinus
FQASLTFKDVAVVFTKEEWGQLDYGQKHLYREVMLENYKNLVSLGHKGSKPDVISKLEHERDPWKVEKEITRCTCPGAGQI

SEQ ID NO: 24073 - protein, 81 aa, Balaenoptera acutorostrata
RKVPVSFEDVSVYFTKTEWKLLDLRQRTLYKRVMLENYHHLVSLGFSSSKPHLVSRLERGEGPWVADVHRMETTTGMQAGD

SEQ ID NO: 24074 - protein, 81 aa, Balaenoptera acutorostrata
PQGLLTFGDVAVHFTQEEGARLDPGQRALYRDVMLETYRNLASLGVPGSKPDLISQLEQGKEPWGSDLLGAQEGETAGDPS

SEQ ID NO: 24075 - protein, 81 aa, Vombatus ursinus
QGPRVTFKDVAVDFTQEEWSLLDHPQKALYKGVMLENAWNLLPLGLPVPREDVVSYFEQKEAPWMLEQEGLRSCCLGCISG

SEQ ID NO: 24076 - protein, 81 aa, Balaenoptera acutorostrata
MLENYSNLASVGCQVSKPSLISHLEQEEELRTEEQELHQGPCPDWETPSKTKWSILMEDIFGKETSNGVTMESSRLGEKSS

SEQ ID NO: 24077 - protein, 81 aa, Balaenoptera acutorostrata
TQEPVVFEDVAVDFTQEEWALLDLTQRNLYRDVMLENFRNLASLGYPLHTPYLISQWKQEEDLEIAERGPTQGEHQEGFET

SEQ ID NO: 24078 - protein, 81 aa, Cervus elaphus
FQDLLTFKDVAVDFSQEEWEWLSPAQRGLYRSMMLENYQSLVSLDWESIHETQELPLKQFVCDDTLMERIASYELECPTFG

SEQ ID NO: 24079 - protein, 81 aa, Cervus elaphus
YTEEEGLATGFPTDWLQDSVTFEDVTVEFNQEEWALLDSSQQKLYRDVMLENYGNLALISQLEQEDKVMTEEEGILPGTCP

SEQ ID NO: 24080 - protein, 81 aa, Colobus angolensis
SQHLVTFEDVAVDFIQEEWTLLDQTQRDLYRDVMLENYKNLIILAGSELCKPSLMSGLEQMEELRTGVTGVPQELDLQLKT

SEQ ID NO: 24081 - protein, 81 aa, Myotis brandtii
ESGEPMTFKDIAVNFSRGEWRKLEPFQKEIYKEVLLENCRHLEFLGFPVTKLDVISQLPWVEPGLLEKEVSKGSIPECEPR

SEQ ID NO: 24082 - protein, 81 aa, Myotis brandtii
MEEWAFLDPTQKKLYTDVMLKTFWNLASVACILEEKCEGHVSEDQYENHGRNLSSHMVERLCTRKDGCQCRENFSQIPNHN

SEQ ID NO: 24083 - protein, 81 aa, Myotis brandtii
GLAQVNVEDVFVCFSREEWGLLDEAQRRLYRDVMLENFALLASLGCASSMSRGAAPLELGSEPRASDWAHVSPASTRDAQS

SEQ ID NO: 24084 - protein, 81 aa, Myotis brandtii
SMGSDLFRDVAVLFSREEWEWLAPAQRDLYRDVMLETYTNLRSLDLAISKPDVIAFLEQGKEPWRAEEAAAGGLCPASEAR

SEQ ID NO: 24085 - protein, 81 aa, Myotis brandtii
LQGTVTFKDVAIDFTQEEWQQLEPAQRNLYRHVMLENYNNLITVGCPFTKPDVIFKLEQEEEPWVVEEEVLKRHCPGEISG

SEQ ID NO: 24086 - protein, 81 aa, Myotis brandtii
QMVSLSFEDVTVDFSRDEWQHLDPAQRCLYWDVTMENYSHLLSVGYQVPKPEVIFKLEQDKNIGKTQQQRISGEVSFHCEK

SEQ ID NO: 24087 - protein, 81 aa, Myotis brandtii
LQEPVSFRDVAVDFTQEEWQQLGPEQKTTYRDVMLENYSHLVSVGCHLVKPEVIIKLEQGEEPWRVGEVLLHSRPEVWKVD

SEQ ID NO: 24088 - protein, 81 aa, Myotis brandtii
EVMNFEDVAIAFSQEELGILDEAQRLLYCDVMLEVFAVVSSIGCWHKMEDEEASSDQSVYIQGESQVRASKTAAATQKTFL

SEQ ID NO: 24089 - protein, 81 aa, Vombatus ursinus
AVDFTLEEWGNLRPSQKELYRDVMLENYRNLVWLGKDVSKPDVIYQLEQVEGPWVLEGEAPAVSCPGDKQSPSELDLSMEV

SEQ ID NO: 24090 - protein, 81 aa, Propithecus coquereli
LQGLVTFEDVAVYFSREEWGLLSVTQKSLYRDVMLENFALISSLGKSTLFPSRLSATDSSLPSGCLCRTEDEEAPPKQVKS

SEQ ID NO: 24091 - protein, 81 aa, Propithecus coquereli
SRGSMTFEDVVVDFTQEEWTLLDISQRKLYRDVMLENISHLVSIGKQFCTSGVLSRLEPEGELSREGINVLQGQNPGREGD

SEQ ID NO: 24092 - protein, 81 aa, Saimiri boliviensis
GSVSFTDVTVDFTQEEWEQLDPSQRILYMDVMLENYSNLLSVEVWKADDQMERDHRNPEQQPRQFLILKNQTPMEERGDLF

SEQ ID NO: 24093 - protein, 81 aa, Propithecus coquereli
CWGLLSFTDVSVEFTSEEWQLLDSTQKYLYRDVTLENYSNLVSVGYHGTKPDLIFKLEQGEEPWIVNAKISSQSCPEGWEE

SEQ ID NO: 24094 - protein, 81 aa, Balaenoptera acutorostrata
RIQGPVTFEDVAVYFSQEEWKLLDEAQRFLYHDVMLETFALVASLGLSSSRSHVVQLELRGEPWVHDRVDMTPDRARGAQI

SEQ ID NO: 24095 - protein, 81 aa, Saimiri boliviensis
KSGAVSFGDVAVYFSREEWGCLRPVQRALYRDVMRETYSHLGVLGVGGSKPAFISWVEEEAELWGPAAQDPEVAKHPTEAD

SEQ ID NO: 24096 - protein, 81 aa, Vombatus ursinus
FQELVAFKDVAVEFNQEEWRCLDASQKELYHDVMMENYKNLVCLGLVFNKPAVISHLEGKEAPWMAEGQVQRNSWEIRPVN

SEQ ID NO: 24097 - protein, 81 aa, Lynx pardinus
MLENYGNLTSLGYQVPRPALISLLEAGNLPWGLEAQDNLSAERTKDICEDTETNINSESTSTQGISEERDVMLSHGLQKSV

SEQ ID NO: 24098 - protein, 81 aa, Vombatus ursinus
MFEDVAVYFQKEEWASLDPAQKVLYRDVMLENYRNIESLAYLFPKPLVISKLEQVSGNLQEARDIGQRFVCAGGEVKFEKE

SEQ ID NO: 24099 - protein, 81 aa, Saimiri boliviensis
ITFEDVAIYFSQEEWELLDEAQRFLYCDVMLENFAHVTSLGYCHGTDNEAIASEQSVSLQVRTSKRDTPTQKTHLSEVKVC

SEQ ID NO: 24100 - protein, 81 aa, Saimiri boliviensis
PLTFRDVTVEFSQEEWKCLDPAQKALYKDVMLENYRNLVFLGIIPKCTTKELPPIGNSNTREKFRTMTLERHECYDIEDIY

SEQ ID NO: 24101 - protein, 81 aa, Saimiri boliviensis
AQGPVSFRDVTVGFTQEEWQHLDPAQRTLYRDVMMENYSHLVSVGYCIPKPEVILKLEKGEEPWILEEKFPSQSHLGSTRL

SEQ ID NO: 24102 - protein, 81 aa, Balaenoptera acutorostrata
MLENYRSLVSLGLCVSKPKMISSLEQRKEPWAAKRTLTRDSRALPETKELSSKKNFCEEKSSQAVLMERPTTCSLECSVLG

SEQ ID NO: 24103 - protein, 81 aa, Saimiri boliviensis
WSQMPVTFEDVALYLSQEEWGRLDHTQQNFYRDVLQKRNGLSLGFPFSRPFWAPQVQGKGEASGSSRQAGDEKEDCRGECT

SEQ ID NO: 24104 - protein, 81 aa, Saimiri boliviensis
LVTFEDVAVYFSQEEWGLLDAAQRHLYHNVMVENFELITSLGNALPQHGVLLCSSVGAHLPNCFPNWLPHFTSLSAVYKCC

SEQ ID NO: 24105 - protein, 81 aa, Lynx pardinus
SSQGLLTFRDVAVEFSQEEWGCLNHSQQELYWDVMLETYRHLLFLGLVSKPDLVIFLEQKRELWDVKREETVATHPAVSSN

SEQ ID NO: 24106 - protein, 81 aa, Saimiri boliviensis
QDSVAFEDVAVNFTHEEWALLGPSQKNLYRDVMQETIRNLNCIGMKWENQSTDDQYQNLRRNLRCDVVERFGKSEDGSQCG

SEQ ID NO: 24107 - protein, 81 aa, Saimiri boliviensis
KFLESVSFKDVTVDFSRDEWQQLNIAQKSLYRDVMLENYFNLISVGCQVPKPEVIFNLEQEEPRMLNGGISSQSCPDGKIG

SEQ ID NO: 24108 - protein, 81 aa, Balaenoptera acutorostrata
ESVTFKDVAVDFTQEEWALLDTSQKKLFRDVMLENISHLVSVVISGREDDLRKQEMIFMQHIYKKDTSVISAMQRSHSQED

SEQ ID NO: 24109 - protein, 81 aa, Saimiri boliviensis
SQGHLTFTDVAIEFSQEEWKCLDPAQRALYKDVMLENYRNLVSLGVSLPDLNINSMLKQRRELWSGENEVKIAKSSDRREG

SEQ ID NO: 24110 - protein, 81 aa, Balaenoptera acutorostrata
PKVPVTFDDVAVYFSEPEWGKLDEWQKELYKHVMRGNYETLVSLDYAISKPDILTRMERGEEPCPEGPRGQEEASDREDAC

SEQ ID NO: 24111 - protein, 81 aa, Lynx pardinus
KDQESLTFEDVAVGFSREEWRLLAPAQKDLYRDVMLENFRNLVSVGYVASMPAALSRLERGGRWMTEDETRRGICPEIKKD

SEQ ID NO: 24112 - protein, 81 aa, Balaenoptera acutorostrata
QPQEAVTFKDVEVTFAQDEWGWLDASQRNLYRDVMLENYGNMASLVGPFTKPALISWLEVREPWGLNVQGAHPKGSPSAAP

SEQ ID NO: 24113 - protein, 81 aa, Colobus angolensis
PQGLVTFGDVAVDFSQEEWEWLNPSQRNLYKKVMLENYRNLASLGLCVSKPDVISSLEQGKEPWTVKRKMTRAWCPDLKTM

SEQ ID NO: 24114 - protein, 81 aa, Colobus angolensis
DSVAFEDVAVNFTLEEWALLDPSQKNLYRDVMRETFRNLASIGKQWEDQNIEDPFKIPRRNISHIPERLCESKEGSQGEET

SEQ ID NO: 24115 - protein, 81 aa, Colobus angolensis
RRGHLTFRDVAIEFSQEEWKCLDPVQKALYRDVMLENYRNLVSLGICLPDLSITSMMKQRTEPWTVENEMKVAKNPVRWEG

SEQ ID NO: 24116 - protein, 81 aa, Propithecus coquereli
YEVPVSFEDVTVDFSREEWQQLDSTQRRLYHDVMLENYSHLLSVGFEVPKPEIIFKLEQGEEPWMLEGEAPHQSSSDGKFG

SEQ ID NO: 24117 - protein, 81 aa, Propithecus coquereli
MRNLPCSAAPSEEWQHLDPSQRNLYRDVMLETYSHLLSVGYQVPKEEVVMLEQGKELWALQGENPHQSCPGQKLWDHNQCR

SEQ ID NO: 24118 - protein, 81 aa, Propithecus coquereli
HVTFEDIVVYFSQEEWQLLDEAQRCLYHDVMLENFALLASVGCWHGVEAEEAPPEQTASTEEVSQASSPKPGPSVSNAHPC

SEQ ID NO: 24119 - protein, 81 aa, Propithecus coquereli
KDVAIEFSQEEWTCLDPAQRALYRDVMLENYRNLVSVGVSLPDLTIISILEQGKEPWTVESQAKVARNPHRGKWIKSVNTD

SEQ ID NO: 24120 - protein, 81 aa, Propithecus coquereli
PQDLVTFKDVAIDFSQEEWQWMNPAQKHLYRSMMLENYQSLVSLGLCISKPYVISLLEKGKEPWEMKSEMTRSPFSDWQSI

SEQ ID NO: 24121 - protein, 81 aa, Vombatus ursinus
MSFSQEEWRCLNSTQRVLYRGIVQENYRNVDSVGLPKPLLISPVEHRKDTRIPDLQGCKETEVLSSSCTNENRVQTDEKQA

SEQ ID NO: 24122 - protein, 81 aa, Vombatus ursinus
MLENYRNLVSLGLADSNVEVISQVESGEAHGIPVDSVLRSCRPDGDGKPQTEESTPKLSFSMETLSHPKLLRDDPCISKMK

SEQ ID NO: 24123 - protein, 81 aa, Balaenoptera acutorostrata
EAQETLTFDDVAVDFTWEEWQFLAPPQKDLYRDVMLENYSNLLSVGYKASKSDILSKLDQGEPWTMEDEIHCRTHSVWKVD

SEQ ID NO: 24124 - protein, 81 aa, Lynx pardinus
DAVTFDDVALDFTQEEWILLDLAQRNLYRNVMLENYQNLVTVEWQTQHQSKESPSLQDLGEGKTAREIQKERTHQGAELSE

SEQ ID NO: 24125 - protein, 81 aa, Balaenoptera acutorostrata
RPRAVKFGDVALYFSPEEWECLRPAQRALYRDVMQETYGHLGALGCAGPKPALISWLERNTDDWEPAALDPQECPRRVTVQ

SEQ ID NO: 24126 - protein, 81 aa, Lynx pardinus
AQAPLSFEDVAVSFSREEWRLLVPAQKDLYRDVMLENYRNLVSVGYQASEPDSLFQLEHGGPLWAVEGAAPRPPCPGFVLQ

SEQ ID NO: 24127 - protein, 81 aa, Vombatus ursinus
MLENYGNLVCLGLAVSSPDVVCQLERGEGPWMPEGDVPGSSRAGWETTHQNKEPLSKLGLAIKASFQEGLAGHDSCVSRMG

SEQ ID NO: 24128 - protein, 81 aa, Saimiri boliviensis
PQESVAFDDVAVYFTKKEWAIMVPDQRALYRDVMLENYEAVAFVVPPTSKPALVSHLEQGKEPCFTQPQGVLSRSNWRAGF

SEQ ID NO: 24129 - protein, 81 aa, Balaenoptera acutorostrata
GRVPLTFSDVAVDFSQEEWECLNSDQRNLYRDVMLENYTNLVSLDIDFTSESNKLSSEKSSYEVNSYHRETMNRSKTFNFM

SEQ ID NO: 24130 - protein, 81 aa, Cervus elaphus
RTSAFPFQAPVTFGDLAIYFSQEEWEWLSPIQKDLYEDVMLENYQNLVSLGLCFRRPNVITLLEKGKAPWMVDPVKRRRGL

SEQ ID NO: 24131 - protein, 81 aa, Cervus elaphus
SEGLVTFGDVAVDFSQEEWEWLNPAQRSLYRKVMLDNYRSLVSLGVSVSKPDVISLLEQGKEPWLVKEEGPRGARSDWEYA

SEQ ID NO: 24132 - protein, 81 aa, Cervus elaphus
TSEPVSFADVAVYFSQEEWGCLQPAQRALYRDVMRETYGHLGALGFRGTKPALISWVEEEAELWGPDAGPPEMGECLTEAD

SEQ ID NO: 24133 - protein, 81 aa, Cervus elaphus
KTRKDVTIEFSQEEWECLAPSQRALYRDVMLDTYRNLVSLGEDNFSPDVGILSAGFGINKLSPRENTNVGELYGNENHGIK

SEQ ID NO: 24134 - protein, 81 aa, Cervus elaphus
DSVVFEDVAVNFTLEEWALLNSAQKELYRDVMLETFRNLASVGSFFLVRFVPFLLSDDETQCKANGSVSQQDIYGNKISKE

SEQ ID NO: 24135 - protein, 81 aa, Cervus elaphus
RCQDPVTFEDVAIVFTDEEWRHLVPTQRDLYKEVMLENYKSIVSLDWETKPEIQGASEEEKSEGSLKEKLGRKGSPSPKFE

SEQ ID NO: 24136 - protein, 81 aa, Colobus angolensis
RSMIPQDNENPPQQGEANQNDSMAFEDVAVNFTPEEWALLDPSQKNLYQEVMQETLRNLASIEVLWKRDYLKVKVISVEKF

SEQ ID NO: 24137 - protein, 81 aa, Colobus angolensis
AQMLVTFKDVAVTFTQEEWRQLDLTQRTLYREVMLETCGLLVSLGHRVPKPELVHLLEHGQELWTVKTGLSQPTCAGDRTQ

SEQ ID NO: 24138 - protein, 81 aa, Colobus angolensis
GQVNFEDVFVYFSQEEWVLLDEAERLLYRDVMLENFALTASLGCWRGMEDEEIPFEQSFSIGMSQIRIPKGGPSTQKAYPC

SEQ ID NO: 24139 - protein, 81 aa, Colobus angolensis
AQVSVTFDDVAVTFTQEEWGQLDLAQRTLYQEVMLENCGLLVSLGCPVPRPELIYHLEHGQEPWTRKEDPSQDTCPGDKGK

SEQ ID NO: 24140 - protein, 81 aa, Colobus angolensis
PLQGSVSFRDVAIDFSREEWRHLDLSQRNLYRDVMLETYSHLLSVGYQVPEAEVVMLEQGKEPWALQGERPRQSCPGEKLW

SEQ ID NO: 24141 - protein, 81 aa, Colobus angolensis
QQGYVTFEDVAVYFSQEEWRLLDEAQRLLCRNVMLENFSLLASLGLASSKTHEITQLESWEEPFMPALEVVTSAIPRVWLC

SEQ ID NO: 24142 - protein, 81 aa, Tupaia chinensis
RKELMSFEDVTVDFTWEEWQGLEDAQRILYKDVMLETYSNLVFLGHCIAKPAVILKLEQEGEPWALEELPNQSLPGDKPYE

SEQ ID NO: 24143 - protein, 81 aa, Vicugna pacos
SSQESLTFQDVAVNFTREEWDQLYPAQKNLYRDVMLENYRNLVALGHQLYKPEVITQLEQEEQWMMEGDSPLDTHPDGENR

SEQ ID NO: 24144 - protein, 81 aa, Vicugna pacos
MTEQFSTLKDIAMDFTLDDWEQLGLDQGDLFWDKALDNYQSLFLLDPLRPNLVSHPEAGEALESLVKGSPESTAPDTAEAK

SEQ ID NO: 24145 - protein, 81 aa, Vicugna pacos
PKVPVSFEDVSVYFTKTEWKLLDFRQRVLYKRVMLENYRHLVSLGFSSSKPHLVSLLERGEEPWVADIHRMGAVTGMQTGD

SEQ ID NO: 24146 - protein, 81 aa, Myotis brandtii
GRVSVSLEDVTVDFSREEWQQLNSTQRRLYQEVMLENYSHLLSVGYEVPKPEVIFKLEQGEEPWILEGETPHQSCSDGKFG

SEQ ID NO: 24147 - protein, 81 aa, Myotis brandtii
QEPVTFKDVVVEFSVEEWGQLDSAVKNLYRDVMLENYRNLSSLRKELLFSKPVEAPKLESKIKGWIMEQEIPRTAILGKQH

SEQ ID NO: 24148 - protein, 81 aa, Camelus ferus
YGTVTFEEVAVYFSQDEWRLLDEAQRLLYRDVMLENFVLVASLGCWHRAEDKETTCVQEVSGKGPQVNTSKADLSTQKAYP

SEQ ID NO: 24149 - protein, 81 aa, Saimiri boliviensis
KPDLITCLEQGKEPWNMKRHEMVDEPPAMCSYFVKDLWPEQDIKDSFQEVILRRYGKCGHENLQLKKGSASVDKCKVHKEG

SEQ ID NO: 24150 - protein, 81 aa, Propithecus coquereli
SPGLVTFRDVAIDFSQDEWEWLNLAQRSLYRKVMLENYRNLVSVGLCISKPDVISLLEQEKEPWVMKGEITGGLWPDLEYV

SEQ ID NO: 24151 - protein, 81 aa, Propithecus coquereli
KEALMAFRDVAVAFTQKEWKLLSPAQRNLYREVMLENYSHLVSLGIAFSKPKLIIQLEQGDEPWRGENECLLDLCPGEWEA

SEQ ID NO: 24152 - protein, 81 aa, Propithecus coquereli
RSQESLTFQDVAVDFTKEEWEQLYPAQKKLYRDVMLENYRNLVALGHQLYKPEVIAQLEQEEQWMMERDSPLDTHPDGENR

SEQ ID NO: 24153 - protein, 81 aa, Propithecus coquereli
SQAPVTFEDMAMYLTREEWRPLDPTQRDLYRDVMQENYGNVVSLDFEIRSENEVNPKQEMSEDVEFGTTSERPVGNAEENT

SEQ ID NO: 24154 - protein, 81 aa, Balaenoptera acutorostrata
MLENYSNLVSLGFSISKPDVLSLLEQGKDPWKVVRDVTRGLSPDWESRCENKKLSSKREIYELEASQWETTEQLTGRKCEC

SEQ ID NO: 24155 - protein, 81 aa, Propithecus coquereli
MAITFEDVTIIFTWEEWKFLDSSQKRLYREVMWENYTNVMSVGNWNESHKSQEEIFRHLQYENFSCWQGWRNADTQIYENQ

SEQ ID NO: 24156 - protein, 81 aa, Vombatus ursinus
FSGIVLFSNRNTQIFCLSIWTGHQVSKPDVISQLEQGEEPWTVEREVSTYSCRDWETRNKTKESTLKQDIPEAESSQKVTL

SEQ ID NO: 24157 - protein, 81 aa, Lynx pardinus
SQISLTFEEVAMYFSQEEWEFLDPTQKALYNDVMRENYETVISLALFVLPKPKVISYLEQGEEPWVQGSTELKDSPGELPT

SEQ ID NO: 24158 - protein, 81 aa, Saimiri boliviensis
IQRLLTFGDVAVAFTRIEWRHLDAAQRALYRDVMLENYGNLVSVGLLSSKPKLIAQLEQGAEPWMEARETPSGTRAVPDYW

SEQ ID NO: 24159 - protein, 81 aa, Saimiri boliviensis
MDLVMFRDVAVDFSQEEWECLNSYQRNLYRDVILENYSNLVSLAGCSISKPDVITLLEQGKEPWLVVRNEKRRWSLDLESR

SEQ ID NO: 24160 - protein, 81 aa, Vombatus ursinus
FQESVMFEDVAVYFTQKEWADLAPAQRALYRDVMLENYGNMVSLAFPFPKPAVISKLERGEEPWGLDPQVVPNEEGLKGFP

SEQ ID NO: 24161 - protein, 81 aa, Saimiri boliviensis
MEPLEFRDVAIEFSLEEWNCLDTAQRNLYRDVMLENYRNLVFLGIVVSNPDLITCLEQEKSLNVKSHEMIATSPVTCSHFT

SEQ ID NO: 24162 - protein, 81 aa, Vombatus ursinus
QESLTFRDVAVDFTHEEWRQLDPGQRYLYKDVMLENYRNLVSVGKCGTQVSKPEVIFLLEQGKEPWMVKREIPRVILEYPH

SEQ ID NO: 24163 - protein, 81 aa, Saimiri boliviensis
VTFEDVAVYFSWKEWSLLDEAQKCLYHDVMLENLTLTTSLGGCGTEDEEAPYQQSTSLQRVSQVRIPKALPSPQKTNSCEI

SEQ ID NO: 24164 - protein, 81 aa, Vombatus ursinus
TRFESVTFKNVAVEFTWEWVHLNPFQKKLYGDVMLEFCRSLCSLGFAVSKSDVIYQLERKEASWMPETDIPRSKHISCCVS

SEQ ID NO: 24165 - protein, 81 aa, Saimiri boliviensis
ISFEDVAVDFTLEEWQLLNPTQKNLYRDVMLENYSNLVFLEVWLDNTKMWLQDNHDNLKSMERGHKYGVFGKIFKSSINFV

SEQ ID NO: 24166 - protein, 81 aa, Lynx pardinus
LPHSVTFEDVAVEFTQEEWALLDPSQRTLYRDVMQENCRNLASLGCHVDKPSLTSQLEQQDKVMTQERGILPGTCPGLETV

SEQ ID NO: 24167 - protein, 81 aa, Vombatus ursinus
MLENARNLLSLGLPVPREDLISYFEEREAPWLLELEGLRSCCPGEFRPEMQKTTAKLSISVEQTQGQNFMTDGPRDFTRRQ

SEQ ID NO: 24168 - protein, 81 aa, Vombatus ursinus
LTFRDVAVDFSRDEGRRLSPAQRALYRDVMLQNSGNLRRTSGNGCSQDHKYRERFTEQVGLVESLEKPPVVQTHQCNQCEM

SEQ ID NO: 24169 - protein, 81 aa, Balaenoptera acutorostrata
MDSVTIEDVAVDFTLEEWALLDPSQRKLYRDVMQETLRNLAAVGAKREYHDIEDQYKNQGRKLRTFMVERFCKSKDISLCG

SEQ ID NO: 24170 - protein, 81 aa, Cervus elaphus
EMSLSFRDVAIDLSQEEWECMNPVQRALYRDVMLENYSNLVSLDLESKYFTKKLFPEKDICGPHLFQLQTVDESQTYIHED

SEQ ID NO: 24171 - protein, 81 aa, Colobus angolensis
CQESVTFEDVAVVFTDEEWSHLVPIQRDLYKEVMLENYNSIVSLGLPVPQPDVIFQLKRGDKPWVVDLHGSEEREQPESVS

SEQ ID NO: 24172 - protein, 81 aa, Colobus angolensis
LTFGDVAIEFSQEEWKCLDPAQRTLYRDVMLENYRNLVSLDTSSKCVMKMFSSTGQGNIEVIHTGTLQRHASHHIGDICFQ

SEQ ID NO: 24173 - protein, 81 aa, Vicugna pacos
AQLTVAFDDVALYFSEPEWDILEKWQKELYQQEMKTNYETLDSLGCVFSKPNLITWMEQGRMLFIRDQGRLEKTRVTLSPS

SEQ ID NO: 24174 - protein, 81 aa, Vicugna pacos
LQASVSFRDVTVEFTQEEWRQMDPAQRTLYRDVMLENYSHLVSVGYCFTKPELIFMLEQGEDPWLLEKEFVSGSSPEEPQP

SEQ ID NO: 24175 - protein, 81 aa, Vicugna pacos
MTFRDVAVDFSRQEWEALEPIQRDLYRDVMLENYRNLVTLAVHSTSKPDVADLSEQGKEPWMTLREGTQSQYTNLDLQCEV

SEQ ID NO: 24176 - protein, 81 aa, Odobenus rosmarus
SLDPVTFQDVAVEFTQEEWEHLGTAQRALYREVMLENYRSLASLGCQDFKPDVISRLEQGGLAWMAWRDIPRGPSPDQETR

SEQ ID NO: 24177 - protein, 81 aa, Odobenus rosmarus
PLTFRDVAVVFTEEELRLLDRAQRKLYRDVMLENFRNLLSVGDKNEKEMEYIQERDLKCLSSRELSYWKIWEQVTGELTGS

SEQ ID NO: 24178 - protein, 81 aa, Odobenus rosmarus
MAHLMMFRDVAIDFSQEEWECLSLEQRHLYRDVMLENYSNMISLGLCIYQPDVFSLLEKGKEPWMVLQDETRGPCPDMQSR

SEQ ID NO: 24179 - protein, 81 aa, Odobenus rosmarus
TRDSVTFEDVAVYFSWEEWGLLDEAQRRLYHDVMLEIFALVTTLGCWHGAEDGKAPSEQAASIGVSQVRTHHAGSHPQKAH

SEQ ID NO: 24180 - protein, 81 aa, Vombatus ursinus
FQESGTSENVALYFTRKEWMYLGLHQKALYRDMMQENYGNMVLLGKAVSKPELISQLERGEEPWKSFFQERDWKVLMTHKN

SEQ ID NO: 24181 - protein, 81 aa, Saimiri boliviensis
IQGQVNFEDVFVYFSQEEWVLLDEAQRLLYRDVMLENFALMASLGHTSFTSHIVASPVMGPDWVDVTRAVATGTLSRSCWP

SEQ ID NO: 24182 - protein, 81 aa, Vombatus ursinus
FQESLTFKDVAVDFTQEEWGWLDPAQRGLYRDVMLENYGNLVSLGHQVSKPDMISQLEQGKEPWKVERKASGDICSDLETV

SEQ ID NO: 24183 - protein, 81 aa, Vombatus ursinus
ESVTFKDVAVEFSQEEWVQLNPSQKTLNLVSLEFVYECKECGKVFHWNSVLLRHQRIYTGEKPYEYGVCGKAFSMKANLTR

SEQ ID NO: 24184 - protein, 81 aa, Lynx pardinus
SQISLTFEEVAMYFSQEEWEFLDPTQKALYNDVMRENYETVISLAVPVHQILAFSEKTNAKDWTVAPELVLPKSQSLLTFE

SEQ ID NO: 24185 - protein, 81 aa, Balaenoptera acutorostrata
FQEAVTFKDVAVTFTEEELGLLDSAQRKLYQDVMVENFRNLVSVGHLPFKPDVMSQLETEEKLWMMERETQRNGHSSENRK

SEQ ID NO: 24186 - protein, 81 aa, Balaenoptera acutorostrata
DPEQVTFEDVVVEFTWEEWGQLEPAQRTLYRDVMLETFGLLASVGHWLPKPDVISLLEHEVELWVVDKGAPRGVCTDFETR

SEQ ID NO: 24187 - protein, 81 aa, Saimiri boliviensis
SKGSVMFRDVSIDFSEEEWECLDSDQMNLYREVMLENFSNLVSVGLSSSKPAVISLLEQGREPWMVDRELTRGLCSDLKSM

SEQ ID NO: 24188 - protein, 81 aa, Saimiri boliviensis
CQESVTFEDVAVVFTDEEWSHLVPIQRDLYKEVMLENYKSVVSLGLPVPQPDTIFQLKRGDEAWMVDLHGSEETEWPKSLS

SEQ ID NO: 24189 - protein, 81 aa, Vombatus ursinus
FQESVTFKDVAVDFTWEEWGYLDTSQKELYWEVMLENYRNLVSLGFVVAKPDVISQSEQEEAPWILEVLFPRSSCSDLDTK

SEQ ID NO: 24190 - protein, 81 aa, Saimiri boliviensis
KPGLVTFEDVAVAFTQEEWQYLNPLQRSLYRDVMLETYSNLVFVGQQVTKPDLILKLEVEECPVEGIIPFWSFPEVCQVNE

SEQ ID NO: 24191 - protein, 81 aa, Balaenoptera acutorostrata
VQESLLFEDVAVEFTREEWRLLDPAQKDLYQDVMLENYSNLLSVGYQSPKPIQIFKLKQRNKPWLEKENIHGQNFPEVGEI

SEQ ID NO: 24192 - protein, 81 aa, Saimiri boliviensis
TARSQETVTFKDVAMDFTPEEWGKLDPAQRDVMLENYRNLVSLWLPVSKPDNYTLENGKEPLKLERKAPKNSYSDMKARPE

SEQ ID NO: 24193 - protein, 81 aa, Vombatus ursinus
GARGPVSFADVAVYFSPEEWGRLRPAQRALYRDVMRETYGHLGALGFPGPKPALISWMEQEAWDSDISSPEGEWEKAVTCG

SEQ ID NO: 24194 - protein, 81 aa, Colobus angolensis
GLLTFRDVAIEFSQEEWKCLDPAQRTLYRDVMLENYRNLVSLDISSKCMLKTSSTGKGNTEVIHTGTLQRQASHHTGEFCL

SEQ ID NO: 24195 - protein, 81 aa, Colobus angolensis
MLENYGAVASLEAFPFPKPALISQLERGEAPWCSVPWGALDGEDPRGISSGEILKLPGATIWRLRIKPIPKKTVTKQRETR

SEQ ID NO: 24196 - protein, 81 aa, Colobus angolensis
QDTVAYEDLCVDYTQKKWKGPALSQRALQWNMMLENDHSMASLGESMMKGSELTPKQEIFKGSESSNRTSGGLFGVVPGGA

SEQ ID NO: 24197 - protein, 81 aa, Colobus angolensis
PQDLVTFKDVAIDFSQEEWQWMNTAQKHLYRSMMLENYQSLVSLGLCISKPYVISLLEQGREPWEMTSEMTRSPFSDWESI

SEQ ID NO: 24198 - protein, 81 aa, Colobus angolensis
VTVTFDDVALYFSEQEWEILEKWQKQMYKQEMKTNYQTLDSLGYAFSKPDLITWMEQGRMLFISELGCLDKTRRTTSPPTD

SEQ ID NO: 24199 - protein, 81 aa, Colobus angolensis
GPLTFRDVTVEFSLEEWECLDTVQQDLYWDVMLENYRNLVFLGIAVSKQSNLITCLEQGKEPWNMKRHEMVAKTPVMCSHI

SEQ ID NO: 24200 - protein, 81 aa, Mustela putorius
AECGVTFEDVAVYFSWKEWRLLDEAQRRLYHHVMLENFALVSSLGCCCGAEDEEAPFAQSASVGVSRTWTPRAALSSQKTH

SEQ ID NO: 24201 - protein, 81 aa, Mustela putorius
SKVPVTFGDLAIYFSQEEWEWLSPIQKDLYEDVMLENYQNLVSVGLSFRRPNVITLLEKGRAPWMVEPVRKRRGMDSGSKC

SEQ ID NO: 24202 - protein, 81 aa, Tupaia chinensis
LQELVSFKDVAVDFTQEEWQQLDPDEKTTYRDVMLENYSNLVSVGYDITKPNVIIKLEQGEEPWIIEEVWKIDDLIERIQE

SEQ ID NO: 24203 - protein, 81 aa, Odobenus rosmarus
VAEELLTFRDVAIEFSQEEWGCLNHTQWELYREVMLGNCGHLLFLGLIVSKPDLVSFLEQTKDPWDGKSKKTVAFHPGRWE

SEQ ID NO: 24204 - protein, 81 aa, Odobenus rosmarus
LLTFRDVAIEFSPEEWECLDPAQRALYRDVMVENYRNLVFLDISTRCMSKELPPKDNINNGELFQTLILERHVSHDFDDFG

SEQ ID NO: 24205 - protein, 81 aa, Odobenus rosmarus
MAVSEPGGSAAKEWEQLDPAQRNLYKDVMLENYSNLASMGYQAPKPDMISKLEKGEEPWLGKGKRPRQGGPSEIARPKQIG

SEQ ID NO: 24206 - protein, 81 aa, Odobenus rosmarus
FQEAVTFKDVAVVFTMEELGLLDSTQRKLYQDVMVENFKNLVSVGHLPFKPDMVSQLEAEEELWMMEGEPQRNGKNQNEME

SEQ ID NO: 24207 - protein, 81 aa, Odobenus rosmarus
AQESLTFDDVAVDFTWEEWQLLVPAQKDLYRDVMLENYSNLVSVGFHTSKQDVLSKLDQGEPAWTVEDDIPCQTHSETWKL

SEQ ID NO: 24208 - protein, 81 aa, Odobenus rosmarus
LQESLTFRDVFVDFTLEEWQQLDSAQKNLYRDVTLENYSHLVSVGYLVARPEEVSRLGRGEEARRAEGGPSAPNFPGEPAR

SEQ ID NO: 24209 - protein, 81 aa, Delphinapterus leucas
VKGSVTFKDVTMAFSKKEWEQLDPAQKSLYKDVMLENYSNLASMGYQALKPDMISKLGKGEEPWLGKGKRPRQGGLSEIAR

SEQ ID NO: 24210 - protein, 81 aa, Propithecus coquereli
AQRCVIFEDVFVYFSREEWELLDNAQRLLYHDVMLETFALLASLGIASSRSHVVIQLEPGEELDQVDVTPATKREAQMGAG

SEQ ID NO: 24211 - protein, 81 aa, Propithecus coquereli
IQGQVNFEDVFVYFSQDEWQLLDEAQRLLYRDVMLENFVLMASLGCHGMEYEEIPFEQSISREGWSQMRTPKEGFSAKKVH

SEQ ID NO: 24212 - protein, 81 aa, Propithecus coquereli
ESLTLEDVAVEFTWEEWQLLGPAQKDLYWDVMLENYNHLVSLGYQASKPDALSKLAQGEEPCVIEGKIQNRNCPGIRKADS

SEQ ID NO: 24213 - protein, 81 aa, Vombatus ursinus
MLENAQNLLSLGLPVPREDLISYLEERKAPWLLEREGLRSCCPEGEIRPEMKETTAKLSISVKETHEESSMRDCAYDFTGR

SEQ ID NO: 24214 - protein, 81 aa, Balaenoptera acutorostrata
TAQGSVLFEDVSVDFTQKEWQLLDRAQRLLYRDVMLENYGHLVSLGHCVSKPELILKLEREEPWILKGQLPSESHPEVQRT

SEQ ID NO: 24215 - protein, 81 aa, Saimiri boliviensis
MSQVTFSDVALDFSHEEWGWLDSAQRDLYKDVMVQNYENLVSLGLSITKPYVITLLEDGKEPWMVEEKLSKGVTPDWESRW

SEQ ID NO: 24216 - protein, 81 aa, Saimiri boliviensis
MLENFALIASLGLISFRSYIVSQLEMGKEPWVPDSVDMTSAMARGAYGRPGSDFCHGTEGKEFPSEHNVSVEGAAQDRSPK

SEQ ID NO: 24217 - protein, 81 aa, Balaenoptera acutorostrata
AQGSVSFEDVTVEFTQDEWQYVGPAQRTLYKDVMLENYSHLISLGYCIIKPQVIFKLEHGEEPWSSEEEFLNQKYPGYCRV

SEQ ID NO: 24218 - protein, 81 aa, Colobus angolensis
RVTFKDVAVVFTKEELALLDKAQINLYQDVMLENFRNFISVGDGIKNNILNLQEKGLSFLLQEVLHCWQIWKQRIRDLTVS

SEQ ID NO: 24219 - protein, 81 aa, Colobus angolensis
KSKEPVTFKDVAVVFSEEELRLLNLAQRKLYRDVMLENFRNVVSVEHQSTPDGLPQLEREEKLWMMKMATQRDNSLGGKNL

SEQ ID NO: 24220 - protein, 81 aa, Colobus angolensis
LYEAVTFKDVAVIFTEEELELLDPAQRKLYRDVMLENFRNLLSVGKIQTEVETVPEAGTHEEFSCKQIWGQIASDLTRSQV

SEQ ID NO: 24221 - protein, 81 aa, Colobus angolensis
FQGSVSFKDVTVGFTQEEWQHLDPSQRALYRDVMLENYSNLVSVGYCVHKPEVIFRLEQGEEPWRLEEEFPSQKFPEVWTA

SEQ ID NO: 24222 - protein, 81 aa, Colobus angolensis
VTFDDVAVEFTPEEWVLLDTTQKYLYRDVMLENYMNLASVDFFFCLTSEWEIQPRTKRSSLQQGFLKNQIFTGIQMQTRSY

SEQ ID NO: 24223 - protein, 81 aa, Colobus angolensis
MFKEAVTFNDVAVAFTEEELGLLGPAQRKLYRDVMVENFRNLLSVGHQPFKQDVSPIERNEQLWIMTTATQRQRNLDTLLV

SEQ ID NO: 24224 - protein, 81 aa, Colobus angolensis
SWGPLSFMDVFVDFTWEEWQLLDSAQKCLYRNVMLENYSNLVSLGYQHTKPDIIFKLEEGEELCVVQAQIPNQSCPILKAG

SEQ ID NO: 24225 - protein, 81 aa, Mustela putorius
QQRPVSFKDVVVGFTQEEWHRLNPGQRALYRDVMLETYSNLVSVGYEGTKPYVILKLEQEEAPWICEAACSGCHCQENICQ

SEQ ID NO: 24226 - protein, 81 aa, Mustela putorius
VQGQVNFEDVAVYFSQEEWGLLDEAQRCLYRDVMLENFALMASLRDESSMSHGVPSLELGSKTWMSDWADVIPARTGEAQG

SEQ ID NO: 24227 - protein, 81 aa, Mustela putorius
SLETVTFKDVAVDLTQEEWQQMKPAQRNLYRDVMLENYSNLVTVGYQVTKPDVIFKLEHEEEPWVVEEEMLGRHCPEVWEV

SEQ ID NO: 24228 - protein, 81 aa, Mustela putorius
LQGLLTFRDVAIEFSEEEWGCLTHTQRQLYRDVMLENYGHLHFLGLLLSKPDLIMFLEQEKQLWDVKRKESRGFSPESQCL

SEQ ID NO: 24229 - protein, 81 aa, Mustela putorius
VMAHMAFRDVAVDFSQEEWMLLSPAQRSLYREVMLENYSNLVSLGIPFSKPKLITQLEQGKETWREERTCPPATCPADPKP

SEQ ID NO: 24230 - protein, 81 aa, Tupaia chinensis
KAGALRFADVAVYFSPEEWGCLRPAQRALYRDVMRETYGHLGALGFPGPKPALISWMEQESEAWSPAAQDPEKGESQGGAP

SEQ ID NO: 24231 - protein, 81 aa, Myotis brandtii
TEVGVTFEDVAVYFSRTEWHLLNEAQRHLYLDVMLENFALISSLGCCCGTQDLEASIEQNVSVRVSQAKNNKVALSSQKSH

SEQ ID NO: 24232 - protein, 81 aa, Camelus ferus
GSVCEVSVSFEDVTVDFSREEWQHLDPAQRRLYWDVTLENYSHLCSVGYQVPKPEVIFKLEQGEGPWTLEEETPHQSCSGA

SEQ ID NO: 24233 - protein, 81 aa, Myotis brandtii
MDFEDVAIAFSQEEWGLLDEAQRLLYCDVMLEVFALVSSAGCWHKTDGEEACSEQSVSVHGESQVRAPKTAPATQRTHLCE

SEQ ID NO: 24234 - protein, 81 aa, Myotis brandtii
MNFEDVAIAFSRKEWEILDESQRRLYCDVMLEVFALVSFVGPWHKMNDVEAYSQHSVSVGESHVRASKTAAATQRTHLCKP

SEQ ID NO: 24235 - protein, 81 aa, Propithecus coquereli
FQAEVTFEDVAVLLSQEEWNRLGPAQRGLYRNVMMETYGNVVSLGLPGSKPEVICQLERGEEPWVLDRKGAKKSQGLGSGH

SEQ ID NO: 24236 - protein, 81 aa, Saimiri boliviensis
SSEPVTFEDVTLGFNPEEWGLLDIKQKSLYREVMLENYRNLVSVEHQLSKPEVVSQLEESEDFWPVERGIPQDTIPGFPEL

SEQ ID NO: 24237 - protein, 81 aa, Vombatus ursinus
MRTNYETLTSLDHAVPKPDLISWIEQGKEPFIKDLVDLKRRETVVTCDDDGECNLESTEGWKFFEVSLPLLRADDFPWIKQ

SEQ ID NO: 24238 - protein, 81 aa, Propithecus coquereli
LQESLTFKDVFVDFTLEEWQQLDCAQKNLYRDVMLENYSHLVSVGYLVAKPDVIFGLGPGEESWMADRGTPVRSCPVWQVD

SEQ ID NO: 24239 - protein, 81 aa, Saimiri boliviensis
GWVPALFDEVAIYFSDEEWEVLTEQQKALYREVMRMNYETVLSLEFPFPKPDMITRLEGEEESQNCDEWQLQGGTSAENEE

SEQ ID NO: 24240 - protein, 81 aa, Saimiri boliviensis
LQESFSFDDLSVDFTQKEWQLLDPSQKNLYKDVMLENYSSLVSLGYEAMKPDVIFKLEQGEEPWIGDEEIPSSCSPGTSIV

SEQ ID NO: 24241 - protein, 81 aa, Saimiri boliviensis
MFKEAVTFKDVAVVFTEEELGLLGPAQRRLYRDVMLENFRNLLSVGHQPFHRDTFHLQREETFWMMETATQREGNSGGKIQ

SEQ ID NO: 24242 - protein, 81 aa, Saimiri boliviensis
QGTVTFEDVAVNFTWEEWNLLSEAQRCLYRDVMLENLATTSSLGCWCGVEDEEAPSKQSIYVQRETQVRTPTAGVFPEKAH

SEQ ID NO: 24243 - protein, 81 aa, Saimiri boliviensis
AAGSVTFKDVTMAFTQKEWEQLDPAQRNLYKDVMLENYSNLASMGCQAPKPDMISKLEKGEAPCLGKGKRPSQGCPSKIAR

SEQ ID NO: 24244 - protein, 81 aa, Vombatus ursinus
MSSMFQESVTFKDVAVDFTQEEWRHLNPSQKELYRDVMLENYRNLVFLDVISQLEQRKTPWMLGREDPRGPYMGECTGARP

SEQ ID NO: 24245 - protein, 81 aa, Saimiri boliviensis
FTQLMDVAIEFSQEEWKCLNSAQRTLYRDVMLENYRNLVSLDLSHNGVIKELAPKQKSNMGEVFHTVALEQHETPDMQEFC

SEQ ID NO: 24246 - protein, 81 aa, Vombatus ursinus
MLENYRNLVCLGLSVSKPAVISQLERGEAPWRPEGGGPGAGSADWGMRHEIKESAPQLILSVEESSGKRLTRNGSYASKLG

SEQ ID NO: 24247 - protein, 81 aa, Cervus elaphus
SWGNVTFEDVFVSFSQEEWGLLDEAQRLLYREVMLENFALMASLGYTSSVSHGVSPQELGREPWVSDQADTTPALTREAQS

SEQ ID NO: 24248 - protein, 81 aa, Cervus elaphus
PFKGEGSDEVLQRLLRSQAAEVIERLVSSVPSQTSVPFKDVSVAFTQEEWQHVNPAQRTLNRAVMLENHSHLVALGEPTLL

SEQ ID NO: 24249 - protein, 81 aa, Cervus elaphus
HICNCNSETEDRRGGNGGTPEEWQYLNRPQRTLYKDVMLETYSNLVSVAGHHVTKPDVILKLEVEMQCLPEGKIPVWSFPD

SEQ ID NO: 24250 - protein, 81 aa, Cervus elaphus
PKVPVTFDDVAVYFSELEWGKLDEWQKELYKHVMRGNYEMLVSLDYAISKPDILTRMERGEEPCPEGPWGREEGNEREEAC

SEQ ID NO: 24251 - protein, 81 aa, Cervus elaphus
MEVSVTFDDVAVTFTQEEWGHLDPAQRTLYREVMLETCGLLMSLGCPVPRPELIYQLEHGQELWTVKRDLSGSTCPGPPVL

SEQ ID NO: 24252 - protein, 81 aa, Colobus angolensis
GLLTFRDVAIEFSQEEWKCLDPAQRTLYRDVMVENYRNLVSLDISSKCKMKEFLSTAQSNREVIHTGTLQRHESHHIGDYC

SEQ ID NO: 24253 - protein, 81 aa, Colobus angolensis
GIVTFEDVAVYFSWKEWGLLDEAQKCLYHDVMLENLTLTTSLGGCGAGYEEAPYQQSTSSQRESQVRLPKALPFPQKTSPC

SEQ ID NO: 24254 - protein, 81 aa, Tupaia chinensis
FISFEDVAMDFTWEEWQGLKDAQKILYKDVMLETYRNLVFLGHCIAKPAVILKLEQEGEPWTLGEQLNQSLAGEKPYECKQ

SEQ ID NO: 24255 - protein, 81 aa, Vicugna pacos
SQGLVTFGDVAVDFSQEEWEWLDCAQRTLYRSVMLENYRSLVSLGLCVSKPEMISSLEQRKEPWTVKRKWTRGQCPDSEAV

SEQ ID NO: 24256 - protein, 81 aa, Vicugna pacos
AHGSVTFRDVAIDFSQEEWEFLDSAQRDLYRDVMWENYSNFISLGPSISKPDEITLLDEGKEPWMVVREGTRRLHRGLESR

SEQ ID NO: 24257 - protein, 81 aa, Vicugna pacos
PQEPVAFEDVAVYFTQNQWDSLAPAQRALYREVMLENYANMASLAFPFPKPVLISQLEREEAPWGPDPWEAEVLRDICPGG

SEQ ID NO: 24258 - protein, 81 aa, Odobenus rosmarus
AGVTFEDIAVYFSWKEWKLLDEAQRRLYHHVMLENFTLISSLGCCCGAEDEAPFAQSTSVGMSQTRTPKAAQSSRKTHPCE

SEQ ID NO: 24259 - protein, 81 aa, Odobenus rosmarus
VQGQVNFEDVAVYFSQEEWGLLDEAQRLLYRDVMLENLALMASLGYESSMSLGVASLELGSKLWRSDWADVTPGRTREAQG

SEQ ID NO: 24260 - protein, 81 aa, Delphinapterus leucas
SQELLTFKDISVDFTQEEWGQLAPAHRNLYREVMLENYGNLVSVAGYQLSKPGVISQLEKGEEPWLMEREISGGPTPDLED

SEQ ID NO: 24261 - protein, 81 aa, Vombatus ursinus
MYDIQGVTVDFTWKEWGQQDPSQKELYREVMLENYGNLACLGLAVSKPDVIGSWNEGKHLGSYAWLPPDNHSATAVLPVTK

SEQ ID NO: 24262 - protein, 81 aa, Propithecus coquereli
CQESVTFEDVAVVFTDEEWRHLVPIQRDLYEEVMLENYKSIVSLDWETKPEIQNASEEEKSEGASRERLGRQGLLCPKFED

SEQ ID NO: 24263 - protein, 81 aa, Propithecus coquereli
IPGGSVSFRDVVIDFSREEWQHLDPSQRNLYRDVMLETYSHLLSVGYQVPKEEVVMLEQGKELWALQGENPHQSCPGQKLW

SEQ ID NO: 24264 - protein, 81 aa, Propithecus coquereli
TKGYVTFEDVAIYFSQEEWGLLDETQRLLYLEVMLKNFALVASLGCDHGTEDEETPSEQNVSVGVSQSKTGLSTQKTQPCE

SEQ ID NO: 24265 - protein, 81 aa, Vombatus ursinus
FQELLTFRDVAVDFTQEEWGHLHPSQKDLYRDVMLENYRNLVYLGLVISKPDMIYHLERGGKPWMPEGDVLRSTCPGSCNW

SEQ ID NO: 24266 - protein, 81 aa, Vombatus ursinus
TQESVTFRDVAVDFTGEEWRRLDPAQRALYRDVMWETYESLVFLGIPVCMLDVIFLLEGRETPWRSEGEVHRGLCPDSLHV

SEQ ID NO: 24267 - protein, 81 aa, Lynx pardinus
LQESLTFRDVFVDFTLEEWRCLDSAQKNLYRDVMLENYSHLVSVGQLVPKPDVVIRLGQGEEARMAEGETPTQNPPEFWQV

SEQ ID NO: 24268 - protein, 81 aa, Vombatus ursinus
VPKVPGTFENDGVYFSEQEWENLDDWQKELYRNVMKSNFETLVSLDCAISNPELLAHQEEESGTEELGDLAGESPGGPHPA

SEQ ID NO: 24269 - protein, 81 aa, Saimiri boliviensis
SRSLENDGVCFTEQEWENLEDWQKELYRNVMESNYETLVSLKVLGQPEGEAELGTEMLGDLEEEGPGGAQPAGGVMIKQEL

SEQ ID NO: 24270 - protein, 81 aa, Vombatus ursinus
FQESVTFEDVAVDFTREEWGHLGPAQKELYWEVMLETCRNLVSLGLAVSKLDAISQLMQEEPPWMPAHSVPRTSCPACDTR

SEQ ID NO: 24271 - protein, 81 aa, Balaenoptera acutorostrata
AQVLVTFKDVAVTFTREEWGQLDLDQRTLYQEVMLEICGLLVSLGHPVPKPELIRLLEHGQELWTGTRGLPRSTCPGDRAK

SEQ ID NO: 24272 - protein, 81 aa, Lynx pardinus
MLENYSHLVSLGYQDTKPDIIFKLEQGEELWMLQAQIPSQGHPEKVLEIDDHMDWHQENQGKLESMAKNYECTAFGKLCLL

SEQ ID NO: 24273 - protein, 81 aa, Vombatus ursinus
MTFRDVAVTFSPEEWGQLGPSQKELYRQVMLENYGNLVCLGLVLSKPDVIEQLERSEAPWSPEAAVPGSSHAGQKPRAEAK

SEQ ID NO: 24274 - protein, 81 aa, Saimiri boliviensis
ELLTFRDVAIEFSPEEWKCVDPGQQNLYRDVMLEDYRSLVSLYVSYYNQGILPEQSKEDSFKTATLGRYGSCGLDTLCLWK

SEQ ID NO: 24275 - protein, 81 aa, Saimiri boliviensis
VMFRDVAIDFSQEEWEYLDTAQRDLYRDVMLENYSNLLSLDLPSRCARKDLSPEKNTYETELSQWEMSDRLEKCDLEESNS

SEQ ID NO: 24276 - protein, 81 aa, Balaenoptera acutorostrata
MDSGGFEDVAVNFTAEEWALLDPAQRKLYRDVMLETFRNLASVGSCPQVKTTRSSAHWDILETGLCSEEKIVRFTRNDSCS

SEQ ID NO: 24277 - protein, 81 aa, Vombatus ursinus
MTLTFQDVAVDFTWEEWGQLDPAQQNLYRDVMLDNYQNLIFLAGFPVSKPDVISQLEQGEVPWALEREVAKSSCPGEKSRN

SEQ ID NO: 24278 - protein, 81 aa, Vombatus ursinus
GQLDPAQRDLYRDVMLENYGNLVSLGFPVSKPYVISQLEQGEEPWVVEREVSRGICLDLGTRTEIKETAKQDVSEEGLSQE

SEQ ID NO: 24279 - protein, 81 aa, Lynx pardinus
GSVSFKDVMVDFSREEWQRLDLAQKSLYRDVMLENYFNLISVGRRGARPGCGSGAQPAAGESGSLPGELRDNGDIGFETLQ

SEQ ID NO: 24280 - protein, 81 aa, Saimiri boliviensis
EEALMAFWDVAVAFTQKEWKLLSSAQRTLYREVMLENYSHLVSLGIAFSKPKLIAQLEQGDEPWREESKHLLDLCPEPRTE

SEQ ID NO: 24281 - protein, 81 aa, Saimiri boliviensis
NDHNQVTFKDVAVVFTEEELGLLDPAQRKLYQDVMLDNFRNLLSVGNQPFHQDTFHFLRKEKFWMMKTTSQREGNLGGKIQ

SEQ ID NO: 24282 - protein, 81 aa, Balaenoptera acutorostrata
PLTFEDVALFFTDEEWQLLDPSQKILYNNVMQENYATVTSLGLKLKNDTGNEQRVSLSTLEIQASGRKVLRKARMKVAQKT

SEQ ID NO: 24283 - protein, 81 aa, Saimiri boliviensis
YQEFVTFEDVAVHLTREEWGYLDPVQRDLYREVMLENYGNVVSLGILLRLPTTRIHSVNSCPALSHTQASAFSGETLAVLT

SEQ ID NO: 24284 - protein, 81 aa, Balaenoptera acutorostrata
DSLAIEDVVVNFTLEEWALLDPSQKKLYRDVMQEIFWNLASVGKTREDHDIGDQYKNQGGNLRQENLKMRDECLSFQDAVV

SEQ ID NO: 24285 - protein, 81 aa, Vombatus ursinus
FQESVTFEDVALDFSWEEWGYLDTSQKEVYWEVMLENYRNLVSLGLADSNVEVISQVESGEAHGIPVDSVLRSCRPDGDGK

SEQ ID NO: 24286 - protein, 81 aa, Saimiri boliviensis
LQISVSFEDVTVDFSKEEWQHLDPAQRRLYWDVTLENYSHLLSVGYQVPKLEATFKLEQGEGPWTLEGEAPHQSCSGEATG

SEQ ID NO: 24287 - protein, 81 aa, Mustela putorius
PKVPVTFDDVAVYFSEQEWGKLDEWQKELYKHVMRGNYETLVSLDYAISKPDILTRMERGEEPCPGGPWGQEEGSRREVAQ

SEQ ID NO: 24288 - protein, 81 aa, Mustela putorius
QAQEFLTFDDVAVDFTWEEWQLLAPAQKDLYRDMMLENYRNLVSVGYHASKPDALSKLERGEFWTREDEMHSQICPEIRNV

SEQ ID NO: 24289 - protein, 81 aa, Mustela putorius
MDAVVFADVAVNFTPEEWALLDHGQRQLYRDVMLETCRNLASLDCCTQVNPFGSGTQLNILENELSSEDKIVTFTRNDSWA

SEQ ID NO: 24290 - protein, 81 aa, Mustela putorius
VRGSMSFEDVIVKFTQDEWQYMSPAQRTLYRDVMLENYSHLISVGCYTIKPEMIFKLEQGEEPWSLEEEFLNQRYPGYFSV

SEQ ID NO: 24291 - protein, 81 aa, Mustela putorius
AQEPLTLEDVAVDFTWEEWQLLAPAQKGLYRDVILENYSNLVSVGYQASKPDALSRLERGEEPWAKQEEVPSGTRQEPSKV

SEQ ID NO: 24292 - protein, 81 aa, Tupaia chinensis
GFVSFEDVAVHFTWEEWQNLEDAQRTLYKDVMLETYSSLVFLGHCIAKPAVIFKLEQGEPWTLELCNQNLPVHLRCTEKSY

SEQ ID NO: 24293 - protein, 81 aa, Vicugna pacos
AQGSVTFEDVSVYFSWEEWALLDEAQKLLYCDVMLENFALMASLGYWHGVEDEDAPSEQSVSVEGVSQVSMTFKYLAMTFT

SEQ ID NO: 24294 - protein, 81 aa, Vicugna pacos
SEGLVTFRDVAVDFSQEEWEWLSPSQRTLYRRVMLENYRSLVSLGVSVSKPDVISLLEQGKEPWKVKKEWTGGTRPDWEYV

SEQ ID NO: 24295 - protein, 81 aa, Vicugna pacos
MAVRRLSPVVQEEWAELSPAQRALHRDVMLETCGNLVSLGLLGPKPDTLSQLGRGEGWTLEDSLGGFCLDWVTMPVSKKST

SEQ ID NO: 24296 - protein, 81 aa, Vicugna pacos
QGSVTFEDVALYFSWEEWDLLDEAQRCLYHDVMLENLALTSSLGCWHGVRDKEAPSEQTVSAEGMSQIRTVKAGSSPQKAQ

SEQ ID NO: 24297 - protein, 81 aa, Saimiri boliviensis
AQEQVTFRDVAIYFSREEWECLEPSQRALYRDVMLDNFSNVAVLGFCSPRPDLVSRLEQWEEPWVEDRERPELQAVPRGPR

SEQ ID NO: 24298 - protein, 81 aa, Cervus elaphus
SQGLVTFEDVAVYFSLEEWERLDEDQRELYKEVMRENYGILVSLGYPVPKPDLIFRLEQGEEPWVPDSPRPEEGDIVTGVY

SEQ ID NO: 24299 - protein, 81 aa, Cervus elaphus
SRLQLNDVTIQFSPEEWECLDPAQRALYVDVMSETFRNLLSVDIYHIHIWKLQLKSHTDRGGVCQTVIWGRNEIPEIKHFN

SEQ ID NO: 24300 - protein, 81 aa, Colobus angolensis
SLTLEDVAVDFTWEEWQLLGPAQKDLYRDVMLENYSNLVAVGYQASKPDALSKLEQGEEPCTTEDEIYTRICCGGQPQTCS

SEQ ID NO: 24301 - protein, 81 aa, Colobus angolensis
WSQNSVTFREVAVDFSQEEWALLDPAQKNLYKDVMLENFRNLASVGYQLCRHSLISKVDQEELKTDERGILQGDCADWEIQ

SEQ ID NO: 24302 - protein, 81 aa, Colobus angolensis
QGRVTFQDVAIEFSLAEWKCLNPAQRALYREVMLENYRNLESVDISSKCMKKEVLSTGQGNTEVFYPGTLQSPESHHIGDF

SEQ ID NO: 24303 - protein, 81 aa, Colobus angolensis
MEPLTFKDVAIEFSLEEWQCLDTAQRDLYRNVLLENYRNLVFLVMSFHFAQDLWPEQNIKDSFQKVTLRRYGRCEYENLQL

SEQ ID NO: 24304 - protein, 81 aa, Mustela putorius
PCRLVLFKDVAVDFSQEEWECLDLEQKDLYRDVMLENYSNLVSLGFSISKADVLSLLKQGKEPWKVVQDVSRNQSSDWESR

SEQ ID NO: 24305 - protein, 81 aa, Mustela putorius
LVRALRVHAVVSLAARYASAGLHSCQRGEHRGRDYGCRGFFQLDLWLAVSKPDMISHLEAGKGPWVVVREIARTPYPELET

SEQ ID NO: 24306 - protein, 81 aa, Mustela putorius
MAVTLEDVTVIFTWEEWKFLDSSQKKLYREVMWENYTNVMSVGNWKESYKPQEERFRYLKHENLPCWQGWRNASTQIYENR

SEQ ID NO: 24307 - protein, 81 aa, Tupaia chinensis
LQESVTFQDVAVDFTSEEWKLLDCDQRTLYWDVMMENYRNLNSVGCPVTKTKLTFKVRQGQESLMVEGENPHWSDPDRNRD

SEQ ID NO: 24308 - protein, 81 aa, Tupaia chinensis
LQKSLTLEDVAVEFTWEEWQLLGPAQKDLYWDVMLENYSHLVSLGYQASKPQALTNLEEWEEPSTIEDKIHNRTCPGIRKI

SEQ ID NO: 24309 - protein, 81 aa, Odobenus rosmarus
MLENYKSIVSLGLPVPRPDVIFQLKRGDEPWIVDLHGSEERECPENVSLVVPTPGKKLQLYFLSIPDWETKPEIHGASEEE

SEQ ID NO: 24310 - protein, 81 aa, Odobenus rosmarus
PQVLVSFEDVAVFLSQEEWGCLGPAQRGLYSNVMLETYRNLISLGLQDSKPDVISRLEKGEEPWAPYSPRIEEGWIRSHRS

SEQ ID NO: 24311 - protein, 81 aa, Odobenus rosmarus
PCRLVLFKDVAVDFSQEEWECLDLEQKDLYRDVMLENYSNLVSLGFSISRADVLSLLKQGKEPWKVVQDVTRSQSSDWESR

SEQ ID NO: 24312 - protein, 81 aa, Odobenus rosmarus
TKESVTFRDVAVFFSQDEWLRLDSAQRTLYREVMLENYGTLVSLGIPFSRPKVICQLQEGEDPCVVDGELPWDACLGLKTR

SEQ ID NO: 24313 - protein, 81 aa, Odobenus rosmarus
PWEPVTFADVAVLFTPEEWMFLDSAQRSLYRDVMLENYRNLASVAGGQLGKPSTFSHLEPGEELWPPERRSFPGTHPEPQH

SEQ ID NO: 24314 - protein, 81 aa, Odobenus rosmarus
LQDTFSFEDLSVDFTQKEWQLLDPSQKDLYKDVMLENYSSLVSLGYEVMKPDVIFKLEQGEEPWIGDGEVPSSDCPEQVLQ

SEQ ID NO: 24315 - protein, 81 aa, Odobenus rosmarus
SKVPVTFGDLAIYFSQEEWEWLSPIQKDLYEDVMLENYQNLVSLGLSFRRPNVITLLEKGKAPWIVEPVRKRRGVDSGSKS

SEQ ID NO: 24316 - protein, 81 aa, Delphinapterus leucas
LIREVSSLANIKAMPQEEWQQLDPAQKALYRDVMLENYFHLISVGFHMTKPDMIHKLEQGKELWTTEKIFPSQSYLEEDWK

SEQ ID NO: 24317 - protein, 81 aa, Oryctolagus cuniculus
MTAFEDLAVYFTWEEWQKMNNAQKILYRDVMLETYSSLFSLGHCITKPDLIFKLEQGAEPWMVDECLNESLPVGMKRDDLI

SEQ ID NO: 24318 - protein, 81 aa, Rhinopithecus bieti
EKETLTFRDVAIEFSLEEWECLNPAQQNLYMNVMLENYKNLVFLGIAVSKQDPVTCLEQEKEPWNMKRHEMVDEPGYMCRM

SEQ ID NO: 24319 - protein, 81 aa, Ursus americanus
QAEVTFEDVAVLFSREEWGRLGPAQRGLYRDVMLETYRNLVSLGAGPAAPKPGVITQLERGDEPWVLDAQGAKGKERLRVS

SEQ ID NO: 24320 - protein, 81 aa, Ursus americanus
WDVAVVFTEEELGLLDPAQRKLYRDVMLENFRNLLSVGEGNVWVMDTYLDWQLKCLSYRELSYWKIWEHVAGELTENQDHR

SEQ ID NO: 24321 - protein, 81 aa, Ursus americanus
IIEPVTFKDVAVVFSEEELGLLDSTQRKLYRDVMLENFGNLVSVGNQPFKPELIFQLEREEKLLMMEAETQGEGYLGKNRP

SEQ ID NO: 24322 - protein, 81 aa, Ursus americanus
LQESLTFGDVFVDFTLEEWQQLDSTAQKNLYRDVTLENYSHLVSVGYLVPKPDEVLRLGRGEEARRAEGEPPTRSYPGEHA

SEQ ID NO: 24323 - protein, 81 aa, Camelus ferus
PKVPVTFDDISIYFSTPEWEKLEEWQKELYKNIMKGNYESLISMDYAMNQPDVLSQIQPEGDHNTGDQTGPEESEIPTDPS

SEQ ID NO: 24324 - protein, 81 aa, Myotis brandtii
VGVTFEDIALYFSREEWSLLDEGQRQLYLNVMLENFELISSLAFIINREVTLKKSLINAVNVENLLSLRRSFIDIREFTLE

SEQ ID NO: 24325 - protein, 81 aa, Propithecus coquereli
SCEPVTFEDVTLGFTREEWGLLDLKQKSLYREVMLENYRNLVSVEHQLSKPDVVSQLEEAEEFWLVERGIPQDTFPEYPGP

SEQ ID NO: 24326 - protein, 81 aa, Propithecus coquereli
NRCLVTFSDVAIDFSHEEWRWLDSAQRDLYKDVMVQNYENLVSLAGLSITKPYVITLLEDGKEPWIVDKKLSKGMFPDWES

SEQ ID NO: 24327 - protein, 81 aa, Propithecus coquereli
QVPITFKDLAVRFSEEEWRLLEEGQREFYRDVMRENYETLVSVGTAELLPLSAFLSPTEPGGATGRGGCTAERPEPAGGGV

SEQ ID NO: 24328 - protein, 81 aa, Propithecus coquereli
FQGSLSFKDVTVGFTQEEWEHLDPSQRSLYRDVMLENYSNLVSVGYCVTKPEVIFRLEQGEEPWILKEEFSSQSYPDIWKA

SEQ ID NO: 24329 - protein, 81 aa, Propithecus coquereli
WSQMPVTFEDVALYLSREEWGRLDHAQQNFYRDVLQKRNGLSLGFPFSRPCWVPQVQGKGEASSSSQQRDEPEERGVSTGA

SEQ ID NO: 24330 - protein, 81 aa, Propithecus coquereli
ARGQGPLTFGDVAVALTQIEWRHLDAAQRALHRDARLENWESGLLSSKPKLIAQLEQGAQPWMEEYWFETKMSALKQNTSE

SEQ ID NO: 24331 - protein, 81 aa, Balaenoptera acutorostrata
SQGPVSFEDVAIDFTQEEWQQLDPAQRTLYRDVMLENYSHLVSVGYPVSKPGVISKLEQGEEPWIMKRDVSNWIYPDRETR

SEQ ID NO: 24332 - protein, 81 aa, Vombatus ursinus
MLTDTDISFPPIGLPISKPDVIFQLEQGKEPWLLGLPRAKERELPNNSSLDWKSCDTRKSSPKQKIPEEVESLGTLTVDSA

SEQ ID NO: 24333 - protein, 81 aa, Lynx pardinus
MPGLPVPRPEVIFQLKTGDEPWIVDLHGSEERECPENVSLDWETKPEPQGASEEERPGRIVRERLGRKVPLCPKFEARALE

SEQ ID NO: 24334 - protein, 81 aa, Vombatus ursinus
TQESVMFEDVAVDFTREEWSHLDPAQRALYREVMLENYENLVSLGLPVSKLDVISLLERGEAPWRPEGGGPRCSCPDPFIE

SEQ ID NO: 24335 - protein, 81 aa, Saimiri boliviensis
TESFMAFGDVTVDFTQKEWRLLSPTQRALYKEVTLENYSHLISLGILHSKPELIRRLEQGEAPWGEERRCQPGPHAGIYAE

SEQ ID NO: 24336 - protein, 81 aa, Vombatus ursinus
FQESVTFQDVAVDFTWEEWGHLGPAQKELYREVMLENYRNLVCLGLEVSKPDVVCQLERGEAPWMPEGAVPRSCSQNWGAR

SEQ ID NO: 24337 - protein, 81 aa, Vombatus ursinus
WIESVTFKDVAVEFSQEEWVQLNPSQKTLYKDNSYPFGVLIYTAFSSKKHLAVQQRIRTGEFVYECKECGKVFHWNSANLT

SEQ ID NO: 24338 - protein, 81 aa, Saimiri boliviensis
VQESVTFRDVAVFFSPDEWLHLDSAQRALYREVMLENYRSLVSLGILFSKPKVISHLEQGEDPWMVESGVPQGTHLGWERM

SEQ ID NO: 24339 - protein, 81 aa, Balaenoptera acutorostrata
AHDLVMFRDVTVDFSQEEWECLNSNQRNLYRDVILENYSNLVSLGCSISKPDVITLLEQGKEPWMVVRDEKRRWSLDLESR

SEQ ID NO: 24340 - protein, 81 aa, Lynx pardinus
MYFSWEEWEILDEAQRHLYCDVMLENLALVASLAEHGLLVWNEKAPLEQCVSGVFQFRTPKAGPSTQKDMCGLPPTCDMCG

SEQ ID NO: 24341 - protein, 81 aa, Vombatus ursinus
QVSVTFRDVAVDFTREEWRCLEPAHRALYRDVMLETYENLVSLGVSVPVSKLDLIFLLERGRSLSRPVGRVPSDSCPDSFI

SEQ ID NO: 24342 - protein, 81 aa, Vombatus ursinus
SQGLVTFEDVAVYFSLEEWGRLNEAQKDLYKEVMQENYGILVSLGYPIPKPDVISRMERGEELWVPDSPVLEEGDIVTGVY

SEQ ID NO: 24343 - protein, 81 aa, Tupaia chinensis
SVTFEDVAVVFTDEEWNHLVPIQKDLYREVMLETYSSIASLEWEIKSEIQDTFEEEKPEELWREIFIKQSPLGDSFQGHDP

SEQ ID NO: 24344 - protein, 81 aa, Vombatus ursinus
MLENSQNLLSLGIPLLREDLISHFEEREPSWIRDQKGPRNSCPGAETEFEITKSTAKLRISVEESQQQRFMRDGPCDFNLR

SEQ ID NO: 24345 - protein, 81 aa, Colobus angolensis
QLTFRDVAIEFSQEEWKCLNSTQRTLYRDVMLENYRNLVSLDLSRNCMIKELAPQWESNREEVFHAVTLEQHEKHDIEEFC

SEQ ID NO: 24346 - protein, 81 aa, Colobus angolensis
KKKPVTFEDVAVNFTQEEWDCLDASQRVLYQDVLSEIFKNLASVARIFLHKPELITKLEQEEEQRREFVHRPNTEGLSEGE

SEQ ID NO: 24347 - protein, 81 aa, Colobus angolensis
MIQSQVSFEDVAVDFTLEEWRLLNPTQKDLYRDVMLENYSNLIFLGYQILKPDAIFKLEQQDPWIIGQEILNQNFSEVWLD

SEQ ID NO: 24348 - protein, 81 aa, Colobus angolensis
TQVRLTFRDVAIEFSQEEWKCLDPAQRTLYRDVMLENYWNLVSLGLCHFDMNIISMLEEGKEPWTVKSCVKIARKPRMREC

SEQ ID NO: 24349 - protein, 81 aa, Colobus angolensis
PQGLLTFRDVAIEFSQEEWKCLDSAQRTLYREVMVENYRNLVSLDISSKCMTEFLSTAQSNREVIHTETLERHESHHIGDF

SEQ ID NO: 24350 - protein, 81 aa, Colobus angolensis
FVAFEDVAIYFSQEEWELLDETQRLLYHDVMLENFAVMASLGCWCGAEDEGVPSAESISVAELSQGRTPKADTSTDKSHPC

SEQ ID NO: 24351 - protein, 81 aa, Colobus angolensis
MGPLTFRDVAIEFSLKEWQCLDTAQRNLYRNVMLENYRNLVFLVMCSYFAQDLWPEQNIKDSFQKATLKRYGTCRHENLPL

SEQ ID NO: 24352 - protein, 81 aa, Colobus angolensis
AQGSVSFNDVTVDFTQEEWQHLDHAQKTLYMDVMLENYCHLISVGCHMTKPDVILKLERGEEPWTSFTGHTCLEENWKAED

SEQ ID NO: 24353 - protein, 81 aa, Colobus angolensis
FQKPVTFEDVAVNFTQEEWDCLDASQRVLYQDVLSEIFKNLASVARIFLHKPELITKLEQEEEQRRETQVLQASQAGPPFF

SEQ ID NO: 24354 - protein, 81 aa, Mustela putorius
SQESVTFDDVAVDFTQEEWTLLDRSQRKLFRDVMLENISHLVSIGRQLYKSETISHLEPGEHLSKGLGLLQCQSLDREDDL

SEQ ID NO: 24355 - protein, 81 aa, Mustela putorius
CEVSVSFEDVTVDFSKEEWQHLDPAQRRLYRDVTLENYSHLRSVGCQVPKPEVIFKLEQGEGPWTMEGETPHQSWSDEDIG

SEQ ID NO: 24356 - protein, 81 aa, Mustela putorius
MLENYRNLVSVGFHSGKPDALSKLDPGDPTWTGEDDIPCRTLSGIWKLDDYLPEHLQTEIMENSIERWHKQRTFESNVRQR

SEQ ID NO: 24357 - protein, 81 aa, Tupaia chinensis
VTGSVTFWDVAVLFSQDEWLHLDAAQRTLYREVMLENYSNLVSLGIPSSKPKVICQLQQGEDPCVVERDVPPDTCPGLKTR

SEQ ID NO: 24358 - protein, 81 aa, Vicugna pacos
RPESVTFEDVAIYFSENEWTGLAPAQRALYRDVMLENYGALASLAFPFPKPALIFQLEQGEAPWSSAPQGALDGEGPRGIS

SEQ ID NO: 24359 - protein, 81 aa, Vicugna pacos
GPQGLMTFEDVAVNFTQEEWQYLNPPQKTLYRDVMLETYSHLVSVGQQITKPDLILKLEVEEPCLTEGKIPVWSFPEEAFQ

SEQ ID NO: 24360 - protein, 81 aa, Vicugna pacos
QQDSVTFEDVAVYFSREEWCLLDEVQICLYLDVMLENFALVSMLGSCHGVEDEQPPCEQSSPVGVSQIRTSGAGVSPEKGQ

SEQ ID NO: 24361 - protein, 81 aa, Vicugna pacos
QDSVTFEDVAVYFSWEEWCLLDEVQIRLYLDVMLENFALVSMLGSWHGVEDEEVPSKRRVSVEGVSQIRTSRAGVSPEKAQ

SEQ ID NO: 24362 - protein, 81 aa, Vicugna pacos
NFWILRLPPGSKGEAPKEWGKLDEWQKELYKHVMRGNYETLVSLDYAISKPEVLSQIEQGKEPCSWRRPGPKVPDVPVDPS

SEQ ID NO: 24363 - protein, 81 aa, Vicugna pacos
WLTFKDVAIEFSPEEWECLDPAQRTLYRDVMLETYRNLISVDTAPKCVIKEPPPKESHNTGKTLHTASLESQEHRALQEDG

SEQ ID NO: 24364 - protein, 81 aa, Vicugna pacos
MFQVTFSDVAIDFSHEEWGWLDSAQRDLYKDVMVQNYENLVSLAGLSIPKPNVIALLEEGKDPWMVERKLSTDWDSRWENK

SEQ ID NO: 24365 - protein, 81 aa, Vicugna pacos
LIPVDFTPAQLTFRDAATDFSQEEWECLDPAQRAFYVDVLLELVSLGSQMVSMLLLRGHTWSSKGLNWRMRFFTGLLRGKD

SEQ ID NO: 24366 - protein, 81 aa, Vicugna pacos
MTSSLETVTFKDVAVDLTQEEWQQMKPAQRDLYRDVMLENYSNLVTVGYQVTKPDVIFKLEQEEEPWVVEEEIFGRHYPGK

SEQ ID NO: 24367 - protein, 81 aa, Vicugna pacos
QESVTFRDVAVDFTLEEWGQLGPGQRELYRDVMLENYQNLLSLGAGLPGSKPDVISRLERGEEPRMEAREDWRVTCSDVET

SEQ ID NO: 24368 - protein, 81 aa, Vicugna pacos
SLGPVSFKDVAVDFTQEEWQQLDPEQKTTYRDVMLENYSHLVSVGCHVMKPEVITKLEQGEEPWMVEGGFLLQSYPEVWKV

SEQ ID NO: 24369 - protein, 81 aa, Delphinapterus leucas
MDSVTIEDVAVDFTLEEWALLGPSQRKLYRDVMQETLRNLAAVGAKREYHDIEDQYKNQGRKLRTFMVERLCKSKDISLCG

SEQ ID NO: 24370 - protein, 81 aa, Carlito syrichta
VTEPVTFRDVAVLFSQDEWLRLDSAQRILYREVMLETYSSLAALGIPFSMPKAIRQLKQGEDPCTLGRDVPSDPCLGFKIW

SEQ ID NO: 24371 - protein, 81 aa, Mustela putorius
QGLLTLRDVTIEFSEEEWGCLTHTQRQLYRDEMLENYGHLHFLETGLTVSKPNLIMFLEQDKELRDVKRKDTVALHAAVSS

SEQ ID NO: 24372 - protein, 81 aa, Tupaia chinensis
RDQDFGASLLPSAPQQEQWRHLDSTQKEQYWDLMLETYGKMVSGGISNSKPNLTNSTEYGEELAGLHLHISEKIPRLTCIG

SEQ ID NO: 24373 - protein, 81 aa, Tupaia chinensis
QQEEVTFKDVAVYFTWTEWADLSPAQRALYRNVMLENFGNLTSLGYPIPKPALISLLEKGDLSLGLEAQGDPPEKRTKDSS

SEQ ID NO: 24374 - protein, 81 aa, Odobenus rosmarus
CRKGCVTFEDVAIYFSQEWVLLDEAQRHLYHDVMLENFALIASLVCWHGMEDEEAPFEQSVSGEVLSWVRTPKAGPPTQKT

SEQ ID NO: 24375 - protein, 81 aa, Odobenus rosmarus
AVTFKDVAVVFTMEELGLLDSTQRKLYQDVMVENFKNLVSVGSKNQNEMETLRKVALKYLSHEGLSCWQIWKQVASDLTRC

SEQ ID NO: 24376 - protein, 81 aa, Odobenus rosmarus
VLGRVTFRDVAVDFSEEEWECLDPAQRALYRDVMLENYRNLVSLGIPLPDLNINVILEQGKEPQTGEQEKSLVKNLLKIKN

SEQ ID NO: 24377 - protein, 81 aa, Carlito syrichta
LQVSVSFEDVTVDFSREKWQHLDRAQRHLYWDVTLENYSHLLSVEYQIPKPEATFKLEQGEGTWMLEGEAPHQSCSASRTV

SEQ ID NO: 24378 - protein, 81 aa, Ornithorhynchus anatinus
VEVTFKDVAIFLTQQEWESLADAQRELYTTVMLENYGHLQSLGKDTESLIRGFPNLRLTTDGFSPKKPGKVSPNVSDLDTN

SEQ ID NO: 24379 - protein, 81 aa, Tupaia chinensis
QPGAVRFADVAVYFSPEEWGCLRPVQRALYRDVMRETYSHLVALGVGGTKPKLISWVEEEAELWGPEAQDLEGAKCLTEAN

SEQ ID NO: 24380 - protein, 81 aa, Vicugna pacos
MASRSPPPEPKEEWDYLEPAQRSLYKDVMMENYGNLVSLDVLNRDKEEEPTVKQEIEEIEEEVEPQGVIVTRIKSEIDQDP

SEQ ID NO: 24381 - protein, 81 aa, Odobenus rosmarus
MASGPELPKPEVISQLEQGAELWAAERGIAQGYCPGREPGPQSQVPPKELGLPEVETSCVTEREGFLRDASCPTILGEDWE

SEQ ID NO: 24382 - protein, 81 aa, Odobenus rosmarus
SVTFRDVTVDFTQEEWQQLEPAQKDLYRDVMLENYRNLVSLDLETRPEMKESGPKEDSAEDRPSVGVVVEGPPRNGAHGLA

SEQ ID NO: 24383 - protein, 81 aa, Odobenus rosmarus
AQESLTLEDVAVDFTWEEWQLLGPAQKDLYRDVMLENYSNLVSVGCQATKPDALSKLEHRDEPWITEDEIQNRTHLEFRKL

SEQ ID NO: 24384 - protein, 81 aa, Odobenus rosmarus
LLTFRDVAIEFSPEEWECLDPAQRALYKDVMLENYRNLVSLDISVRSMIKELSPKEDISKEELFQTLMLERHKRNDIKDLG

SEQ ID NO: 24385 - protein, 81 aa, Delphinapterus leucas
DGVAFEDIALYFSWEEWKLLDEAQRRLYHDVMLENFALISSLGCCCGAEDAEAPFQRSISISMSQARTHREGSFSQKSHPC

SEQ ID NO: 24386 - protein, 81 aa, Carlito syrichta
YYQDSVTFDDVAVDFTQEEWTLLDTSQRHLYSDVMMENYKNLATVGCQIIKPSLISWLEQEESRTVQGGVLQGRKSEWRGT

SEQ ID NO: 24387 - protein, 81 aa, Carlito syrichta
VQEPVTFKDVAVDFTQEEWGQLDLVQRTLYRDVMLETYGHLLSVGNQITKPEVISLLEQGEEPWSMEQAYPQSTCPEWMRS

SEQ ID NO: 24388 - protein, 81 aa, Carlito syrichta
KVPVTFVDIAVYFSEDEWKNLDEWQKELYNNLVKENYKTLMSLDAEGPVPKPDAPAQVEPREEPCVWEQRHTEEREIPVAP

SEQ ID NO: 24389 - protein, 81 aa, Carlito syrichta
FEGSVSFRDVAIDFSREEWQHLDPSQRNLYQDVMLETYNHLLSVAGYQVPEPEVFMLEQGKEPWTLQRESPHQSCPGEKLW

SEQ ID NO: 24390 - protein, 81 aa, Carlito syrichta
MLENYGNVASLGFPLLKPAVILQLEGGGELGGPSPLAVGTRTDSQDLWNVDIDIQTDNNLTKEMCEEKGNTLFELQKNFSQ

SEQ ID NO: 24391 - protein, 81 aa, Gulo gulo
QGQVTFEDVAVYFSQEWRLLDVTWRHLYHDVMLENFELIGSLGESLHPPTVYWLPSAVSHGKFCLSQSWTTRAASFPGFPM

SEQ ID NO: 24392 - protein, 81 aa, Gulo gulo
PKVPVSFEDVSVCFTKTEWKLLDVQQRILYKTVMLENYHHLVSLGFLSTKPHLVSWLEQGEGPWATDIWRSTSTGDADRRR

SEQ ID NO: 24393 - protein, 81 aa, Erinaceus europaeus
MAFTEKEWKQLDPSQKNLYKDVMRENYNNLASMAGNQLTKSDVISQLEKGEEPHLGMWKRPSKGQGGPCEIGRPKQIDSSK

SEQ ID NO: 24394 - protein, 81 aa, Erinaceus europaeus
MAVFQVSLDVAIEFSAEEWECLSQAQRDLYRDVMLENYGHLVFLDLTLSKSDLVTFLELQVNPWAENRKEKLPIAEDISSY

SEQ ID NO: 24395 - protein, 81 aa, Gulo gulo
DQESVTFKDVAIDLTQEEWTLMDRSQRKLYIDVMLENITHLVSVGCQFFQADVISQWEQGGELWREDRGLAQSWNPGLENS

SEQ ID NO: 24396 - protein, 81 aa, Erinaceus europaeus
PVTFEDVKVNFSQEEWGCLDINQRTLYKDVMSETLKNLLSVGKRLHFPQQAPCPRLLVTSVNPGQVDYLNKKENSGVKISV

SEQ ID NO: 24397 - protein, 81 aa, Cervus elaphus
KRDQELKPRRDMLADANLPQRPQFLGSEEQDGSCEGLVSFEDVTMDFSKEEWQQLDPAQRHLYQDVMLEIYSHFFSVGEHT

SEQ ID NO: 24398 - protein, 81 aa, Colobus angolensis
ACESITFGDVAIDFSHQEWEYLNLVQKTLYQEVMMENYDNLVSLAGHSISKPDLITLLEQGKEPWMIMREETGGECTDLDS

SEQ ID NO: 24399 - protein, 81 aa, Colobus angolensis
VQESVTFRDVAVFFSHDEWLHLDSAQRALYREVMLENYSSLVSLGILFSKPKVISQLEQGEDPWMVDSGVPQGAHLGWESL

SEQ ID NO: 24400 - protein, 81 aa, Colobus angolensis
CWGLLSFKDISMEFTWDEWQLLDSTQKYLYRDVILENYHNLISVGYHGTKPDLIFKLEQGEDPWIINAKISRQSRPDGWEE

SEQ ID NO: 24401 - protein, 81 aa, Colobus angolensis
PQASVCFEDVAMAFTKEEWEQLDLAQRTLYREVTLETWEHIVSLGLFLSKSDVISQLEQEEDLHRAEQVSPRDTSGLSQVT

SEQ ID NO: 24402 - protein, 81 aa, Colobus angolensis
GLLTFRDVVIEFSLEEWQCLDTAQRNLYKNVILENYRNLVFLGIAVSKPDLITCLEQEKEPLTMQRHEMVDEPPGNFAPVA

SEQ ID NO: 24403 - protein, 81 aa, Colobus angolensis
GSVTFEDVAIYFSQEEWGLLDEAQRLLYRDVMLENFALITALVCCHGMEDEETPEQSVSVERVAQVRTPEASPSTQKTQSC

SEQ ID NO: 24404 - protein, 81 aa, Colobus angolensis
YPDSVTFDDVAVDFTPEEWALLDTTEKYLYRDVMLENYMNLASVEWEIQPRIKRSSLQQGFLKNPVFSGIQMTRGYSGWKL

SEQ ID NO: 24405 - protein, 81 aa, Mustela putorius
FQEAVTFNDVAVVFSEEELGLLDSTQRKLYRDVMLENFRNLVSLGHSSSKPDMISQLEREEEKLCMKEIRTERGGRNPNEA

SEQ ID NO: 24406 - protein, 81 aa, Mustela putorius
ALALVSFQDVAVTFTGEEWRHLDLAQRTLYREVMLETCGLLVSLGHPVPKAELISLVEQGQELWTVTRGLSKSTYTGEKAK

SEQ ID NO: 24407 - protein, 81 aa, Mustela putorius
GNYETLVSLDYAISKPDILTRMERGEEPCPGGPWGQEEGSRREVAQPRRPSPGVPPRPEHNLGPVSPAREEPKEEQVTRRQ

SEQ ID NO: 24408 - protein, 81 aa, Tupaia chinensis
MLETYSNLVSLGHCITKPELILKMEQGAEPWMVEEPPNQSLPDVQKVDDLNETSEKSQDKTLWQLVITNNNISTKERIELE

SEQ ID NO: 24409 - protein, 81 aa, Vicugna pacos
PESVTFEDVAIYFSENEWTGLAPAQRALYRDVMLENYGALASLEGVLKSKKKDFILKNIFEEAQDHMVLSSGPQWYDSQEF

SEQ ID NO: 24410 - protein, 81 aa, Delphinapterus leucas
VQESVTFKDVAVLFTQDEWVQLSPAQRALYRDVMLENYSNLVSLGLLGPKPDMFSQLGKGEEWMPEDSLGGFCLDWMTTPV

SEQ ID NO: 24411 - protein, 81 aa, Delphinapterus leucas
RLTFEDVAIEFTQEEWECLDPAQRALYRDVMVETYRNLISLDISPIHVIEQLQPKVNSDKGEVFQTPMLGRPESCKIKHFH

SEQ ID NO: 24412 - protein, 81 aa, Erinaceus europaeus
SLESVTFMDVVVDFSQGEWERLTLAQRTLYKKVMLENYRNLVSLGLCASKPNVISLLEQGKEPCLVKGEMTKGQCSNLEYV

SEQ ID NO: 24413 - protein, 81 aa, Erinaceus europaeus
SQTPVTFEDMAMYLTREEWRPLDPTQRDLYRDVMQENYGNVVSLDFEIRSENDVNPKQEISEDVEFGTTSERPVENTEENP

SEQ ID NO: 24414 - protein, 81 aa, Vicugna pacos
MESVTLEDVAVGLMQEWALLDDARRKLCRYVLLDNCRTLAPRGTSPCKPSLVSQGALREELRAVERGILCSTGEDWESQLK

SEQ ID NO: 24415 - protein, 81 aa, Vicugna pacos
GQESVSFKDVTVTFTRDEWLQLTGTQRTLYRDVMLENYSHLVSVGCCITKPEVIFKLEQGEEPWPREGELPGWRDPDRSQE

SEQ ID NO: 24416 - protein, 81 aa, Odobenus rosmarus
QSRGPLSFVDVFVDFTWEEWRLLDPTQKHLYRSVMLENYSNLVSLGYQDSKPDIVFKLEQEELWMMQAQIPSQGHPEKVWE

SEQ ID NO: 24417 - protein, 81 aa, Delphinapterus leucas
ASVTLEDVAVYFSWEEWSLLDKAQRHLYHDVMLEIFTLISSLGCLCGIEDDKTPSGQSVSQERMPQIRTLKPDLSTQKAHL

SEQ ID NO: 24418 - protein, 81 aa, Delphinapterus leucas
KVPVTFVDIAVYFSEDEWKNLDEWQKELYNNLVKENYKTLMSLDSEGPVSKPDAPPQAEPREEPCVWEQRDPEEREVLMDP

SEQ ID NO: 24419 - protein, 81 aa, Carlito syrichta
MPGPKEEWDYLDPAQRSLYKDVMMENYGNLVSLDVLNRDKDDEPTVKQEIEEIEEEVEPQGVIVTRIKSEIDQDPMGRETF

SEQ ID NO: 24420 - protein, 81 aa, Gulo gulo
SQDLVTFKDVAIDFSQEEWEWLNPAQRNLYKNMMLENYQNLVSLGLCISKPYVISLLEQGKGPWEMKTEMTRSPFPDSGSV

SEQ ID NO: 24421 - protein, 81 aa, Erinaceus europaeus
QKTFDDVAVTLPQEEWEQLRPAQRALYHEVMLASPPLLGRACQKIGSRQGTPEDFCVSHIKNQDGPSEIREHLRPEGDPQK

SEQ ID NO: 24422 - protein, 81 aa, Mustela putorius
SQGQLTFRDVVIELSQEEWGCLTHTQRQLYRDVMLENYGHLCFLGLTVSKPDLITFLEQEKQLWDMKRKETGGFHPAVSSH

SEQ ID NO: 24423 - protein, 81 aa, Tupaia chinensis
VQEPVTFKDVAVDFSQEEWGQLDLVQRTLYRDVMLETYGHLLSVGNQIAKPEVISLLEQGEEPWLVEQAYPQSTGPAKIIT

SEQ ID NO: 24424 - protein, 81 aa, Odobenus rosmarus
QESVTFQDVAVDFTEKEWPLLDSSQRKLYKDVMLENYSNLASVDWETPSKSKWSILMEGIFGKETSSGVTVERTRLGEKST

SEQ ID NO: 24425 - protein, 81 aa, Odobenus rosmarus
GTFEDVAVYFSREEWELLDETQRHLYHNVMLENLALVASLDILHLAMHQGIYPRQKPYKCATCGRGFWLSTNSHQRQKEHS

SEQ ID NO: 24426 - protein, 81 aa, Odobenus rosmarus
DSESVTFKDVIVDFTQEEWKQLDPVQRDLFRDVTLENYTHLVSIGLQVSKPDVISQLEQGTEPWIVEPGIPIGTLGEAESV

SEQ ID NO: 24427 - protein, 81 aa, Delphinapterus leucas
MLENYRNLVALGHQLYKPEVITQLEQEEQWMMERDSPPDSHPDGENSPEIKKSNQNISDENKTCDMLMERLTGDSFWYSIL

SEQ ID NO: 24428 - protein, 81 aa, Carlito syrichta
AQGSLTFDDVLLDFTWEEWQLLGPDQKDLYRDVMLENYSNLVSLGYEASKPNILSKLEQGEEQWTTEDEVCSRVCSEVGKT

SEQ ID NO: 24429 - protein, 81 aa, Gulo gulo
GQGSVSFRDVTVDFTRDEWLQLTGTQRTLYRDVMLENYSHLVSVGCHLTKPEVIFRLEQGEEPWPSDAEFPDQGDPDPPQS

SEQ ID NO: 24430 - protein, 81 aa, Erinaceus europaeus
KFQAVTFRDVAVVFTEEEQGLLDPTQRQLYRDVMLENFRNLLSVGAQHFKPELIFQLESEEKFWMETEAQRHGCPGPKNQH

SEQ ID NO: 24431 - protein, 81 aa, Erinaceus europaeus
KVPVTFVDIAVYFSEDEWKNLDEWQKELYNNLVKENYKTLVSLDTEAPVPKSDALTQVEPREEPCAWEPREPEEREILMDP

SEQ ID NO: 24432 - protein, 81 aa, Erinaceus europaeus
TGDWEMAAALLAAGSQEEWRSLDPSQTDFYGEYVMQENCGIVVSLRFPIPKLDMLSQLEGGEEQWVPDTQDMEERDILKVT

SEQ ID NO: 24433 - protein, 81 aa, Ornithorhynchus anatinus
MLENYGNLASLAGCPVPKPEVISQLEEGKDLWGLVLQEPDNRETLRDPYTDCRTGTETESIITKQDIYEEGDFRRPLLVRR

SEQ ID NO: 24434 - protein, 81 aa, Mustela putorius
ILQKMNKSQESVSFTDVTVDFTQEEWEQLDPSQRILYMDVMLENYSNLLSVEVWKADDQMERDRSGPDEQARPFIIFKNQT

SEQ ID NO: 24435 - protein, 81 aa, Vicugna pacos
ARMPVTYEDVAVTFTREEWGHLDPAQKTLYQEVMLETCGLLASLGCSLPKPELVYSLEHSPGSRTSKTGLSPGSCAGDGAE

SEQ ID NO: 24436 - protein, 81 aa, Vicugna pacos
AQETLSFKDVAVDFTWEEWQLLAPAQKALYRDVMLENYSHLLSVGCQVRRPDALAELERGEDPWAREEGTGSGPCPGEGGP

SEQ ID NO: 24437 - protein, 81 aa, Vicugna pacos
MLENFGHLVSLAGLNISKPDVVSLLEQGREPWLGKGDMSRGLFPASESNAEIREFSPENVLCEDDSSRCLIMDRFLSQGSE

SEQ ID NO: 24438 - protein, 81 aa, Vicugna pacos
VQGKVNFEDVFVYFSQEEWGLLDEAQRLLYREVMLENFALMVSLGYVSSMPHGVAPRELGSEPWGSDWADVTPAVTREAQG

SEQ ID NO: 24439 - protein, 81 aa, Vicugna pacos
MIMTFEDVAVDFTQEEWQQLDLAQKTLHRDVMLEICSHLVSVGCSDIKPDIISKLEHGEDKWIIESELSRWIYSDSLTCNR

SEQ ID NO: 24440 - protein, 81 aa, Delphinapterus leucas
MMKSQEEWQQLDPAQKTLYRDVMLENYSHLVSMGHPVSKPDVISKLEQGEDPWIIKRDIPNWIYPYEDQADGRQDRKSNLD

SEQ ID NO: 24441 - protein, 81 aa, Carlito syrichta
GWVPALFDEVAIYFSDEEWEVLTEQQKALYREVMRMNYETVLSLEFPFPKPDMITRLEGEEESQNSDEWQLHGGTFADTAK

SEQ ID NO: 24442 - protein, 81 aa, Erinaceus europaeus
SLGMVSFEDVAVTFSREEWQQLDEAQRTLYREVMLEAYSNLKTVGCCWSKPEVIIRLEQGVEPWTVEGVTNQRFSDVLTVD

SEQ ID NO: 24443 - protein, 81 aa, Erinaceus europaeus
DIVTYEDVTVIFTQEEWALLNPSEKKLYRDVMWETFMNFLSIEKLQGDHSTEEQHNHQGSKQSNIISITGAKKRSQKPQEC

SEQ ID NO: 24444 - protein, 81 aa, Cervus elaphus
SQAFMAFRDVAVGFTQEEWKLLSPAQRTLHREVMLEIYNHLLSLDILFSKPELICKLEQGEEPWIEERQRSLGLCPASPHP

SEQ ID NO: 24445 - protein, 81 aa, Colobus angolensis
PQASVCFEDVAMAFTKEEWEQLDLAQRTLYREVTLETWEHIVSLGLFLSKSDVISQLEQEEDLHRAEQVSPRGARSSKEQR

SEQ ID NO: 24446 - protein, 81 aa, Colobus angolensis
AQGLVTFADVAIDFSQEEWACLNSAQRDLYWDVMLENYSNLVSLDLESAYESKGLPTGKNIHEIRASRRNSDRRSKSLGRN

SEQ ID NO: 24447 - protein, 81 aa, Colobus angolensis
AQGRVVFEDVAIYFSQEEWGHLDEAQRLLYRDVMLENLALLSSLGCCHGAEDEEAPLEPGVSLGVSQVMAPKPCLSPQKTQ

SEQ ID NO: 24448 - protein, 81 aa, Colobus angolensis
QGTVTFEDVAVHFSWEEWGLLDEAQRCLYRDVMLENLALLTSLDVHHRKQHLGEKHFRSNVGRALFVKTCTFHVSGEPSTC

SEQ ID NO: 24449 - protein, 81 aa, Carlito syrichta
CFQDSVTFDDLAVDFTPEEWTLLDPTQRNLYRDVMLENYKNLATVGCQLFKPSLISWLEQEESRTFQRGVVQEWKVQLKTK

SEQ ID NO: 24450 - protein, 81 aa, Carlito syrichta
LQELLSFEDLSVDFTQKEWQLLNPYQKNLYKDVMLENYSSLVSLGYEVIKPDVIFKLEQGEEPWIRDAEMPSSPSLEVWQV

SEQ ID NO: 24451 - protein, 81 aa, Carlito syrichta
IPGLLSFKDVAIEFSPEEWECLDSPQRILYRTVMLEIHRNLVFLGLADSKSDLIMHLEQRKEPWDVKRHDILAKLPAVTSH

SEQ ID NO: 24452 - protein, 81 aa, Carlito syrichta
AQGSVSFEDVNVELTRDEWQQMGPGERSLYRDVTLENYGHLVALGCCITKPKVILMLEQGEEPWSLEVKFLNRKYPGYYKI

SEQ ID NO: 24453 - protein, 81 aa, Delphinapterus leucas
MLENYGHLVSLGHCVSKPELILKLEQEEPWTLKGQLPSESHPEVQRTNNMEEISQENEGKYLRQGLFINNKTLTEDRNKTF

SEQ ID NO: 24454 - protein, 81 aa, Delphinapterus leucas
MLENFRNLISVGCPVTKTKVIFKVEQGQEPWMVEGENPHWRSPEVICLLDDELEGQEGEGSKDSFLNQGMFTFKKTLTNET

SEQ ID NO: 24455 - protein, 81 aa, Carlito syrichta
FQELVTFRDVAIDFSRQEWEYLDPNQRDLYRDVMLENYSNLVSLGHSISKPDVVDLLEQGKEPWMLLGEETQYSGSNPEPV

SEQ ID NO: 24456 - protein, 81 aa, Carlito syrichta
LQESVTFKDVSVDFTQEEWHHVDPAQRSLYRDVMLENYSHLVSLGCQVSKPEVIFKLEQGEEPWISEGEIQRPFCPDWKTR

SEQ ID NO: 24457 - protein, 81 aa, Carlito syrichta
MSQVTFSDVAIDFSHEEWTWLDSAQRNLYKDVMVQNYKNLVSLAGLSVTKPYVITLLEDGKEPWMVEKKLSKGMFPDWESR

SEQ ID NO: 24458 - protein, 81 aa, Carlito syrichta
DSVVFEEVAVNFTPEEWALLDGAQRTLYRDVMLETCRNLASLDCCIYVRTRGSSPQRGIFGNEMPSDEKIVQFTRNGSWSV

SEQ ID NO: 24459 - protein, 81 aa, Carlito syrichta
REGLLTFKDVAIEFSPEEWECLDAPQRILYKNVMLENHRNLVFLGLAVSKPDLIKCLEQKKKPWVVKRHSTLAKPPTVTSH

SEQ ID NO: 24460 - protein, 81 aa, Carlito syrichta
AHDLVVFRDVSVDFSQEEWECLNSYQRNLYRDVILENYSNLVSLGCSISKPDVITLLEQGKEPWMVVRNEKRRWNLDLESK

SEQ ID NO: 24461 - protein, 81 aa, Carlito syrichta
FQEPVTFEDVAVYFTQNEWATLDPTQRALYREVMLENYANVASLPFPFPKPDVIFQLEQGEAPWDLDPWASVVGAAPRAMC

SEQ ID NO: 24462 - protein, 81 aa, Carlito syrichta
EIGFLSFKDVAIEFSPEEWECLDSPQRLLYRTVMLENHRNLVFLGIAVSKPDLIMCLEQRKEPWSVKGHGTLAKLPAVTSH

SEQ ID NO: 24463 - protein, 81 aa, Erinaceus europaeus
SQMALTFRDVFIEFSQEEWECLDQSQRDLYKDVMLENYANLVSLGFAVSKEEILTLLEEEKRSCVGRTENAEISCDKVFLP

SEQ ID NO: 24464 - protein, 81 aa, Erinaceus europaeus
MVSFEDVTVTFSSEEWQNLDGAQRSLYMDVMLETYSSLVSLGPSLTKPVVIVKLEEGTESQLVEEPPSQSLSDALPVDGLA

SEQ ID NO: 24465 - protein, 81 aa, Erinaceus europaeus
SRGLVTFEDVAVYFSLEEWERLDMMQRDLYRDVMQENYGILVSLGYPIPKPDLIVRLEQGEEPWAHDSPCPEEGDIVTGVY

SEQ ID NO: 24466 - protein, 81 aa, Carlito syrichta
MAGSQGLLTFKDVAIEFSPEEWECLDRAQQILYRDTMLENHRNLVFLGLVVSKPDLITCLEQRKEPWNVKKHSTLARPPGR

SEQ ID NO: 24467 - protein, 81 aa, Carlito syrichta
VHGSVTFRDVAIDFSQEEWECLEPTQRSLYRDVMLENYSNLISLGSFISKPGVITLLEQEKEPWMVVRKETSRWYPDLESN

SEQ ID NO: 24468 - protein, 81 aa, Carlito syrichta
VRELLTFKDVAIEFSPEEWECLYPTQRILYRNVMLENHRSLVFLGLAVSKPDLITCLEQRKNPWDMRRLSMLAKTPAVTSH

SEQ ID NO: 24469 - protein, 81 aa, Carlito syrichta
EMRLLTFRDVAIDFSLEEWKCLDPAQRNLYRDVMLENYRNLVSLGLVIFKPDVITSLEQRKEPWNVNRCDIGAKHPAVSSY

SEQ ID NO: 24470 - protein, 81 aa, Delphinapterus leucas
TKGCVTFEDVAIYFSQEEWGLLDEAQRRLYHKVMLENFLLTASMVCLHGTEKKETPSEQNVSLEVLSQVRTPKVGPISQKA

SEQ ID NO: 24471 - protein, 81 aa, Delphinapterus leucas
PQELVTFKDIAVDFTQEEWALLDTSQRKLFRDVMLESISHLVSVGYQLRKSYVTSQLEQRVELWREGKGVHQCLSPDMTAV

SEQ ID NO: 24472 - protein, 81 aa, Carlito syrichta
SQGPLTFRDVAIEFSQEEWKCLDRTQRALYKDVMLETYRHLVSLGMSCFDLSIISMLEQGRNPWTVESLVKMARKSKGWEW

SEQ ID NO: 24473 - protein, 81 aa, Carlito syrichta
RDMGLLTFKDVTIEFSPEEWECLDPPQRILYRNVMLENHKNLVFLGLTVSKPDLIRCLEQRKEPWDVKRHSTLAKPPGRWE

SEQ ID NO: 24474 - protein, 81 aa, Delphinapterus leucas
PLESVTFEDVAISFTQEEWALLDTSQRKLFRDVMLENISHLVSVGYQHCKSDVIFQLDRGEELWIEGRGFFQSHSPGRESA

SEQ ID NO: 24475 - protein, 81 aa, Carlito syrichta
CEMSVSFEDVTVDFSREEWQHLDRAQRHLYWDVTLENYSHLLSVGYQIPKPEATFKLEQGEGLWTLEVEAPHQSCSEELWQ

SEQ ID NO: 24476 - protein, 81 aa, Carlito syrichta
MAFEDVAVYFSQEEWGLLDTAQRALYRCVILENFALVSSLGLSTSRPHVVTQLERGEEPWVPHGADTAPTPARNAHRRHNL

SEQ ID NO: 24477 - protein, 81 aa, Carlito syrichta
GAFELREAAESWKAGDPQDSLAFEDVAVTFTQEEWALLDPSQKNLYRDVMRETFKNLASIGNKWEDQNIKDQYENSWRNLR

SEQ ID NO: 24478 - protein, 81 aa, Carlito syrichta
MDLVAFEDVAVNFTQEEWALLDPSQKNLYKDVMQETFRNLASIGTKWEDQIIEDQYKNSWRNLRYMKEFILERNPMNVKNV

SEQ ID NO: 24479 - protein, 81 aa, Carlito syrichta
SLEPMTFKDVVVDFTQEEWALLDTSQRQLFRDVMLENISHLVSIGKQPCKSVVLSHLEQGEELSREEISFLQGQNPGEEGN

SEQ ID NO: 24480 - protein, 81 aa, Gulo gulo
MDFTLDWEHLGLDQGDLFWDTALDNYQNLFLLNPSKPKLTSQPDGAEEQKVLERESPESAGPNPAEVKNCLLGQDFLEEGL

SEQ ID NO: 24481 - protein, 81 aa, Erinaceus europaeus
PKVPVTFDDISIYFSTPEWEKLEEWQKELYKNIMKGNYESLVSTDYAMNQPDVLSQIQPEGEHQAEAQAAPPESEIPADPS

SEQ ID NO: 24482 - protein, 81 aa, Erinaceus europaeus
RPRAVRFADVAVYFSAEEWGCLRPAQRALYRDVMRETYGHLGALGCAGPKPALISWLERNTDDWELAALDPQECPKGLTVQ

SEQ ID NO: 24483 - protein, 81 aa, Erinaceus europaeus
MDSVTFKDITVEFSPEEWQLLDAAQRTLYKDVMQENYRLLISVGYGLSKPTAVFKLKQGKEPWILEIKCPRRKKPEDIWKS

SEQ ID NO: 24484 - protein, 81 aa, Erinaceus europaeus
ARAGVLFRDVAVCFSWEEWRLLDESQRKLYRDVMLENFELLSSLGCCFGVENVEIPLEQSLSLNVLQSSTSQPALSSLETH

SEQ ID NO: 24485 - protein, 81 aa, Erinaceus europaeus
YQELVTFRDVAVDFSQEEWDCLNSTQRHLYSNVMLENYRVLVSLGLCFSKPSVILLLEQGKEPWMVKQELTRGLCTGWKAT

SEQ ID NO: 24486 - protein, 81 aa, Ornithorhynchus anatinus
SQVAVTFEDVAVPLTGAEWRCLGPAQRRLYRDVMLENYAHVVWLGFPGPKPAVISQLERGAGPSGAQDPMAPGGARHEGEA

SEQ ID NO: 24487 - protein, 81 aa, Ornithorhynchus anatinus
GPLEDVPVVFAELPVTFEDVAVYFTREEWGMLDKRQKELYRDVMRVNYELLASLGEPRSRSPPPLPRGPRAVASSSWRTPS

SEQ ID NO: 24488 - protein, 81 aa, Vicugna pacos
DSWGPLSFMDVFVDFTWEEWRLLDPAQKHLYRSVMLENCNNLASLGHQHTKPSVVFQLEQEELWTMRIPSQGRADEVQEID

SEQ ID NO: 24489 - protein, 81 aa, Vicugna pacos
YQEFVTFEDVAVHLTREEWGCLDPVQRDLYREVMLENYGNLVSLGILLRLPTTRIPSVNSCPALSHTQASAFSGETLAVLS

SEQ ID NO: 24490 - protein, 81 aa, Vicugna pacos
LQGLVMFRDVAVDFSQEEWEGLDSTQRGLYRDVMMENYSNLALLGPSIPKPDVIFLLEQGKEPWMVLRSLAGGWHPGEQIE

SEQ ID NO: 24491 - protein, 81 aa, Vicugna pacos
SQQLMVFRDVAVDFSPEEWECLDLEQRGLYRDVMLENYSNMVSLGLCIYQPDVFSLLEKGKEPWMVLKNETGGPCPDMQSR

SEQ ID NO: 24492 - protein, 81 aa, Vicugna pacos
LVPFTFRDVAVFFTEAEWERLSSEQRNLYREVMLENYRNLLSLAEPKPDIYPCSSCLLAFSCLPFLHQHALQIFPGVCVEN

SEQ ID NO: 24493 - protein, 81 aa, Vicugna pacos
WQGRVVFEDVAIFFSQEEWGLLDEAQRHLYHAVMTENLALLSSLGFWPGAQDEEALSEQGVSVRVSEVRTLKPGLSTRKAL

SEQ ID NO: 24494 - protein, 81 aa, Vicugna pacos
YQRPVSFKDVVVGFTQEEWHRLNPAQRALYRDVMLETYSNLVSVGYEGTKPYVILRLEQEEAPWICEAACPGCHCRENIWQ

SEQ ID NO: 24495 - protein, 81 aa, Odobenus rosmarus
FQLPLTFEDVAIYFSEQEWQNLEAWQKELYKRVMRTNYEILVSLDDGLPKPELISWIEQGKEFFKNWGESQKSGNIICSSA

SEQ ID NO: 24496 - protein, 81 aa, Odobenus rosmarus
YQEVVTFEDVAVYFTWTEWAGLSPAQRALYRSVMLENYGNLTSLGYPVPKPALISLLEGGNLPWGLEAQDNPSAERTKDIC

SEQ ID NO: 24497 - protein, 81 aa, Odobenus rosmarus
PQEPVTFEDVAVYFTQNQWASLDPTQRALYREVMLENYASVASLVAFPFPKPDLVSQLERGEAPWSPDPWEAEVLKGTCPG

SEQ ID NO: 24498 - protein, 81 aa, Carlito syrichta
SLGPVSFKDVAVDFTQEEWQQLDPEQKITYRDVMLENYSNLVSVGYHIIKPDVIIKLEQGEEPWIVEGEFLLQSYPGEVWR

SEQ ID NO: 24499 - protein, 81 aa, Carlito syrichta
GLVTFRDVAIDFSQEEWECLDPAQRDLYVDVMLENYSNLVSLDLESTYETKNIFSEKDIFEINFPPWEIKEKSKTLGLEPS

SEQ ID NO: 24500 - protein, 81 aa, Carlito syrichta
LLTLKDVAIEFSPEEWECLDPTQRVLLKQFPVNLTEKLLNIQSRGFVGLEALHPSLLKTSKSQEEPDETDLQLQRDKQRLI

SEQ ID NO: 24501 - protein, 81 aa, Delphinapterus leucas
FQGSVTFRDVAIAFAQREWESLDSAQRDVDRDVMLENYRNLVSLARHSCSKPHEITLLEQWKEPWMIVKKDQGRQYTEFQL

SEQ ID NO: 24502 - protein, 81 aa, Carlito syrichta
SQGLLTFRDVAIEFSPEEWECLDPAQRVLYRNVMLENHRNLFFLGLAVSKPDLITCLEQRKEPWNVKRHITLVKPPGRWEE

SEQ ID NO: 24503 - protein, 81 aa, Carlito syrichta
GETGKAPVTFDDITVYLLQEEWMLLSQQQKKICGSDKLVAPLGPTVANSELFYKFEQGPEPWLGSIQHQRRLLEHHPRKSH

SEQ ID NO: 24504 - protein, 81 aa, Delphinapterus leucas
SQEMLTFRDVFVDFTLEEWQQLDATQKNLCRDVMLENYSHLVSVGFLVAQPGRISRLGQGEEEARMAAGESATRRCPEFWQ

SEQ ID NO: 24505 - protein, 81 aa, Carlito syrichta
VVFEDVAIYFSQEEWGHLDEAQRLLYHDVMLENLALLSSLGCWHGAENEEPLSDQGVSVAASEVMSPVPYLSTQKVQPSET

SEQ ID NO: 24506 - protein, 81 aa, Gulo gulo
MFQESMTFKDVAVDITQEDWEIMRPVQKELYKTVTLQNYWNMVSLGLTVYRPTVIPLLEEPWMVIKEILEGPSPEWKTEAQ

SEQ ID NO: 24507 - protein, 81 aa, Ornithorhynchus anatinus
LGPGRDVSVELSREEWGLLDRARRELYRDVMLDNYPRAGAAGGRRGRTSPDLPPSVERGRSPRATARRPRLFPGAGHVAGA

SEQ ID NO: 24508 - protein, 81 aa, Colobus angolensis
KKVTFEDVAIDFTQEEWAVMDTSKRKLYRDVLLENVSHLVSLGYQTSKSYIILQLEQGKEEFLQGQNLDKESALKKKHTIS

SEQ ID NO: 24509 - protein, 81 aa, Colobus angolensis
MASPSPPPESKEEWDYLDPAQRSLYKDVMMENYGNLVSLGLTVLPRLVCSDANMACCSLNLLDLSDQSSHLSYLSSWDYRC

SEQ ID NO: 24510 - protein, 81 aa, Colobus angolensis
MELLTFRDVAVEFSLEEWEHLEPAQKNLYQDVMLENYRNLVSLGLTVSKPELISRLEQRQEPWNVKRHETIVKPSAVSSRY

SEQ ID NO: 24511 - protein, 81 aa, Colobus angolensis
VTFEDVTIIFTLEEWKFLDSSQKRLYREVMWENYTNVMSVENWNESYKSQEEKFRYLEYENFSCWQGWWNAGAQMCENQNY

SEQ ID NO: 24512 - protein, 81 aa, Tupaia chinensis
DVAIEFSQGEWKRLDPAQRALYREVMLENYRNLVSVGEKPYKCNECGKAFMERSSLTQHKRIHSGEKPYKCKECGKAFNQS

SEQ ID NO: 24513 - protein, 80 aa, Vicugna pacos
MAPSQGRLTFEDVAIEFSQEEWECLDPAQRALYGEVMLETYRNLVSLGLTSKDSCSLRKKPRRRRRGQKRTREWPLLRYH

SEQ ID NO: 24514 - protein, 81 aa, Vicugna pacos
VQGRVVFEDVAIFFSQEEWGLLDEAQRHLYHAVMTENLALLSSLGCWPGAQDEEVPSEQGVCVEVSEVRTPKLGPSTRKAL

SEQ ID NO: 24515 - protein, 81 aa, Vicugna pacos
LTFEDVAITFSQEEWECLVPAQRTLYRDVMLETCRNLLSVDMSHILVIKKLQVKANMDKKLLQTAMTERHERTERKHFDPR

SEQ ID NO: 24516 - protein, 81 aa, Vicugna pacos
AHGSVMFSDVSIVFSQEEWEYLDLKQRDLYRDVMLENYSNLVSLDLETRYETKKLSSENDVYEMNLTQWKIMERIKNCGLK

SEQ ID NO: 24517 - protein, 81 aa, Vicugna pacos
PKVPVTFDDISIYFSTPEWEKLEEWQKELYKNIMKGNYESLISMDYAMNQPDVLSQIQPEGDHNTGNQAGPEESEIPTDPS

SEQ ID NO: 24518 - protein, 81 aa, Vicugna pacos
TQDPVVFEDVAVDFTQEEWALLDLAQRNLYRDVMLENFQNLVSLGYPLHTPSLISQWKQEEEPETVKKGPTQEEHQEGFET

SEQ ID NO: 24519 - protein, 81 aa, Vicugna pacos
MLENYSSLVSLGYKVTKPGVILKLERGEEPWVGDGGAPRADAVEQVLQVNGHMTWHKDNQEELKNMKQDHECDAFGKHFNL

SEQ ID NO: 24520 - protein, 81 aa, Carlito syrichta
EMELLTFKDVAIEFSPAEWECLDPPQRILYRNVMLENHKHLVFLGLAVSKPDLIIRLEEKKEPWNVKRHSVLAKPTAVTSS

SEQ ID NO: 24521 - protein, 81 aa, Delphinapterus leucas
MLENYGHLVSLAGLNISKPHVVSLLEQGKEPWLGKDASRGLFSASESNGEIKEFSPKNVIYEDDSSQYLIRSSDLSFERFL

SEQ ID NO: 24522 - protein, 81 aa, Erinaceus europaeus
FQDFVTFGDVAVDFSQEEWEWLTPVQRNLYKKVMLENYRSLVSLGVSVSKPDVISLLEQGKEPWMMKEEARGICHDWKYAF

SEQ ID NO: 24523 - protein, 81 aa, Erinaceus europaeus
TESLNVEDVTVIFTQEEWALLNSSEKKLYRDVMCENLRNFLSIEKIQEHSTKGQHILHGSKQSNTTVNISEGKDSQNAGIS

SEQ ID NO: 24524 - protein, 81 aa, Erinaceus europaeus
SPGPVSFRDVAVDFTRDEWQQLDREQRATYRDVMLENYSHLEAVGWHIIKPEVIIKLEQGEELWGAGGDSLLQSCPEVWNI

SEQ ID NO: 24525 - protein, 81 aa, Erinaceus europaeus
SVEPVTFWDVAVDFSQEEWGQLDPVQRTLYRDVMLETYGHLLSVGPELPKPDVISQLERGAELWALQRGVSPACRAGENTR

SEQ ID NO: 24526 - protein, 81 aa, Erinaceus europaeus
TAKSQASLTFKDVAMDFTPEEWGKLDPAQRDVMLKNYKNLVSFWLPVSKAKNCSLEKEKEPLMLERKKTQNSCSGLETKPE

SEQ ID NO: 24527 - protein, 81 aa, Saimiri boliviensis
AQMFVTFKDVAVTFTQEEWRQLDLAQRTLYQEVMLETCGLLVSLGYWVPKPELVHLLEHGQELWTVKRDHSHPTCAGDKAQ

SEQ ID NO: 24528 - protein, 81 aa, Lynx pardinus
SQVPVTLEDVAAYLSQEEWECLDPAQRGCVWDVLPDSGGLGLQLEDGEGARQDVPTRREQDRELVGGMTRPEQSLEGGRPR

SEQ ID NO: 24529 - protein, 81 aa, Tupaia chinensis
LVKIEDVADVAVSFILEEWGHLDQSQKSLFRDNRKENYGSITSMGYESRENNMELIVKQISDEAESQWMASGSTDRNVTQN

SEQ ID NO: 24530 - protein, 81 aa, Tupaia chinensis
CQVSVSFEDVTVDFSREEWQHLNPAQRHLYWNVTLENYSHLLSVGCQVPKTAAIFKLEQGEGPWMLERETPHQSYSDEDIR

SEQ ID NO: 24531 - protein, 81 aa, Vicugna pacos
ALALVSFEDVAITFTGEEWRHLDLAQRTLYQEVMLETCGLLVSLGHPVPKLELIHLPEHGQELWTVKRGLSRSTYSGEKAK

SEQ ID NO: 24532 - protein, 81 aa, Vicugna pacos
KEAFVVFGDVAVDFTQEEWRLLSPAQRTLHREVMLETYSHFISLEIPFSKPKLISQLERGEEPWKEERQSLLRLCPGSKLE

SEQ ID NO: 24533 - protein, 81 aa, Vicugna pacos
AFKEALTFKDVAVVFTEEELRLLDSTQRELYQDVMLENFRNLVSVGCHPFKHDIFHLEKADGLWWVKTAAQRERKSEGKIP

SEQ ID NO: 24534 - protein, 81 aa, Odobenus rosmarus
MVMFKDVAIDVSQEEWECLNPTQRNLYKDVMLENYSNLVSLGLSISKPAVISSLEQGKEPWMVVRKVTGGRCPDLMSRCEA

SEQ ID NO: 24535 - protein, 81 aa, Odobenus rosmarus
MLENYGNLLFLGLVVSKPDLVIFLEQKRELWDVKGKETVAIHPDLIVWKPNLVLFLEQEKELWDMKRKKRVAIHPAVSSNG

SEQ ID NO: 24536 - protein, 81 aa, Carlito syrichta
RCQEAVTFEDVAVVFTDEEWKHLVPVQRDLYKEVMLENYESIASLDWETKPEIQDALENAKSEDALGEPLGRQSPLCAKSE

SEQ ID NO: 24537 - protein, 81 aa, Carlito syrichta
SFETVTFKDVAVDLTQEEWEQMKPAQRNLYRDVMLENYSNLVIVGCQITKPDVIFKLEQEEEPWVMEEVFGRPCPEVWEVD

SEQ ID NO: 24538 - protein, 81 aa, Gulo gulo
FQEAVTFKDVAVVFSEEELGLLDPAQRKLYRDVMLENFRNLVSVGHSSSKPDMISQLEREEKLCVKEIHTERGGRNPNEAE

SEQ ID NO: 24539 - protein, 81 aa, Gulo gulo
SLETVTFKDVAVDLTQEEWQQMKPAQRNLYRDVMLENYSNLVTVGYQVSKPDVIFKLEHEEEPWVVEEEMLGRHCPEESRR

SEQ ID NO: 24540 - protein, 81 aa, Erinaceus europaeus
SSEPVIFRDVAVDFSPEEWQLLEPEQKALYREVMLENFQNLASLGHHCWRPRLIVRLEGAAQLCASERSAPAAPPQGDGGL

SEQ ID NO: 24541 - protein, 81 aa, Ornithorhynchus anatinus
MEVTFEDVAIFLTRREWESLAGTQKKLYTTVMLENYGHLQSLGAGHPKPHCIRKLQKGEGPWIPEPPSHPKWTFPEEAWTE

SEQ ID NO: 24542 - protein, 81 aa, Ornithorhynchus anatinus
SQTPVTFEDVAAYLTREEWRPLDPAQRDLYREVVQENFGDMVSLDFTIGGENEVIPKQEVVDEAYGALPGRPKGGGSQELE

SEQ ID NO: 24543 - protein, 81 aa, Vicugna pacos
CEVSVSFEDVTVDFSREEWQQLDSTQRRLYQDVMLENYSHLLSLGYEVPKPEVIFRLGQGEEPWMSEGETPHQSCSDGKFG

SEQ ID NO: 24544 - protein, 81 aa, Vicugna pacos
QLTFEDVAIEFSQEEWECLDAAQRALYRDVMLETCRNLLSLDISPSHVTKKLQPKENTNTTDVFQTVIWGRLGSHEVRDVH

SEQ ID NO: 24545 - protein, 81 aa, Vicugna pacos
MLETYRNLASLGGPGSKPDLISQLEQGKEPWGLEMLETKERETPGDPGTDSDWGSLCKQVTSRVKMTQGAEPEGGGPESCS

SEQ ID NO: 24546 - protein, 81 aa, Vicugna pacos
DSQESVTFEDVAVDFTQEEWALLDTSQRKLFRDVMLENISHLVSVAIYFFPVISDREDDLKKQMISMQHINKKDAPLIRTV

SEQ ID NO: 24547 - protein, 81 aa, Vicugna pacos
MLENYGHLVSVGYQLSKPGVISQLEKGEEPWLTEREVSGGPSPDLESKTETKESTLKNDISWEELHHGLMMERSTRGSTLI

SEQ ID NO: 24548 - protein, 81 aa, Carlito syrichta
MLENYSNLVSLGIPFSKPKLITQLEQEKETWREERKCPLATCPAEPEPELHLHPFCPPDFSSQKLPMQHVPCNHPPWLFTC

SEQ ID NO: 24549 - protein, 81 aa, Carlito syrichta
QGSVTFRDVAIDFSQEEWKWLQPAQRDLYRCVMLENYGHLVSLVSNCEIKDFSSKNVIYDGSSQYFIMGRILSQGPVYSSF

SEQ ID NO: 24550 - protein, 81 aa, Carlito syrichta
YQDSVTFDDVAVDFTQEEWTLLDTSQRHLYSDVMMENYKNLATVGCQIIKPSLISWLEQEESRTVQGGVLQGWEMPLETKL

SEQ ID NO: 24551 - protein, 81 aa, Carlito syrichta
GSQGLLTFKDVAIEFSPEEWECLDYSQRILYRTVMLENHRNMVFLGLAVSKPDLITCLEQRKEPWDVKRHSTLAQMPGRWE

SEQ ID NO: 24552 - protein, 81 aa, Carlito syrichta
MLENYGNLVSVGYQLPKPGVIFHLEKGEDPWLRDRDISGGPSSDLESKAETKESNLKNDISWENLPCDVMTEKATRGSTLY

SEQ ID NO: 24553 - protein, 81 aa, Carlito syrichta
LQGLVTFEDVAVEFTQEEWVLLDPSQRTLYRDVMLENCRNLASLGCHVDKPRLISQLEEEDKMMTEERDILPSACPDLEAL

SEQ ID NO: 24554 - protein, 81 aa, Carlito syrichta
SQELLTFRDVAIEFSQEEWEFLDPAQRTLYRDVMMENYRNLVSVGISFSNLNIISILEQGKEPWTVESKVKITKISDGWEC

SEQ ID NO: 24555 - protein, 81 aa, Carlito syrichta
YQTPVSFKDVVVGFTQEEWHRLNPAQRALYRDVMLETYSNLVSVGYEGTKPDVILRLEQEEAPWICEAACSGCHCWEDSWQ

SEQ ID NO: 24556 - protein, 81 aa, Carlito syrichta
SLGSVTFTDVAIDFSQDEWEWLNLAQRSLYRKVMLENYRNLVSVGLCISKPHMISLLEQEKEPWVTKGEMTRGLCPDLEYV

SEQ ID NO: 24557 - protein, 81 aa, Carlito syrichta
QAEVTFEDVAVLLSREEWGRLGPAQRGLYRDVMLETYGNLVSLGTGHAGPKPGVISQLERGDEPWVLDGQGASGREHLRVT

SEQ ID NO: 24558 - protein, 81 aa, Carlito syrichta
LQVLVSFEDVAVLLSEEEWDCLGPAQRGLYRDVMLETYGNLVSLGLQGSKPNVISRLEQGDKPWTLYSLGTGGSWSWKHRR

SEQ ID NO: 24559 - protein, 81 aa, Gulo gulo
PNEAVTFKDVAVVFTEEELGLLDPAQRKLYGDVMLENFRNLLSVGHQPFTPHVILQCERGGKLWMIKTATQGHGISGDKNL

SEQ ID NO: 24560 - protein, 81 aa, Gulo gulo
YQQIAVTFEDVAVDFTQEEWLLLDLTQRNLYRNVMLENYQNLVAVEYQLSKPKLIAWLEQQELRTVEKGVFQEWETRPQTK

SEQ ID NO: 24561 - protein, 81 aa, Gulo gulo
AQEPVTYEDVAVDFTQEEWQYLDAAQKTLHRDVMLEIYGHLVSVGCSRIKPGIIFKLEHEEDPWIIKSELSTWTHSDREKS

SEQ ID NO: 24562 - protein, 81 aa, Ornithorhynchus anatinus
PKVPVIIDDVAVYFSEQELGNLDQGQKELYKNATKGNYETLVSLDYAISKPDLLTQMERGEEPCGRDQPGAVEAGIPPHPA

SEQ ID NO: 24563 - protein, 81 aa, Mustela putorius
IQVLVTFKDVAVTFTQEEWGHLDLDQRALYQEVMLETCGLLVSLGHPVPKAEFAHLLEHGQELWTGKGGLSHSTCSGDSMR

SEQ ID NO: 24564 - protein, 81 aa, Mustela putorius
SQGQLTFRDVAIEFSEEEWGRLTHTQRQLYRDVMLESYGHLLFLGLTVSKPDLIMFLEEGKWLWDVKRKETVRFHPGPPVA

SEQ ID NO: 24565 - protein, 81 aa, Mustela putorius
CQESVTFEDVAVIFTDEEWRHLVPIQRDLYKEVMLENYKSIVSLGLPVPQPDIIFQLKRGDEPWVVDLHGSEERECPEDVS

SEQ ID NO: 24566 - protein, 81 aa, Mustela putorius
SQGLVTFRDVALDFSQEEWEWLDPSQKDLYRDVMLENYRNLVWLGLSISKPNMISLLEQGKEPWMVQKEMSDGQYTDWESW

SEQ ID NO: 24567 - protein, 81 aa, Tupaia chinensis
PKVPVAFDDVAVYFSEQEWGRLEDWQKELYKHVMRGNYETLVSLDYAISKPEVLSQVEQGKEPCSWRRTGPKIPDVPVDPS

SEQ ID NO: 24568 - protein, 81 aa, Vicugna pacos
MLENYCHFVSVGFHMTKPDMIHKLEQGKELWTTGRIFPSRSYPEDDGKAEDVLVKFKEYQERHSRSAVFLNHKGLMKERSN

SEQ ID NO: 24569 - protein, 81 aa, Vicugna pacos
PHRLVLFKDVAIDFSREEWECLDLEQKDLYRDVMLENYNNLVSLGISISKPDVLSLLEQGKEPWKVVQDETRGQSPDWESR

SEQ ID NO: 24570 - protein, 81 aa, Vicugna pacos
LQETLTFRDVFVDFTLEEWQLLDAAQKNLYRDVTLENYGHLLSVGYLMAQPGAIFRMGQVEEEARMADGQTPKRSCPEVWQ

SEQ ID NO: 24571 - protein, 81 aa, Carlito syrichta
YQELVTFRDVAVDFSQEEWDCLDSSQRHLYSNVMLENYRILVSLGLCFSKPSVILLLEQGKEPWMVKRELTKGLCSGWEPM

SEQ ID NO: 24572 - protein, 81 aa, Carlito syrichta
MAFMDVAVDFTQEEWRLLSPAQRTLYREVMLENYSNLVSLGIPFSKPKLITLLEQEKVTWREKRKCPLATCPAEPEPEPEL

SEQ ID NO: 24573 - protein, 81 aa, Carlito syrichta
GKALLSFEDVAMYFTREEWNHLDWAQKDLYRDVMLENYMNMVLLGFQFPKPEVICQLENWDEPWILDLPRAGNRKASSSAC

SEQ ID NO: 24574 - protein, 81 aa, Gulo gulo
QGQLTFRNVAIEFSQEEWGRLTHTQWELYRDVMLENYGNLLSLETGLVVSKPDLVIFLERKRELWDVKGKETVAIHPAAAA

SEQ ID NO: 24575 - protein, 81 aa, Erinaceus europaeus
FRDPVTFEDVTLIFTPEEWEKLSLEQKCLYREVILENYRNLVSVEHQLSKPDVVSQLEEAEELWSVERGIEDKSADSARMQ

SEQ ID NO: 24576 - protein, 81 aa, Tupaia chinensis
CQGYVSFEDVAVNFTWAEWQNLDDAQKTLYKDVMLETYSNLVFLGHCVAKPVVIFSLEQGGEPWTLEELPNQSLPGEKLYE

SEQ ID NO: 24577 - protein, 81 aa, Vicugna pacos
MFQVTFSDVAIDFSHEEWGWLDSAQRDLYKDVMVQNYENLVSLGLSIPKPNVIALLEEGKDPWMVERKLSTGMFPDWDSRW

SEQ ID NO: 24578 - protein, 81 aa, Vicugna pacos
CEESVTFKDVAVDFTQEEWGQLDSPQRALYRDVMLENYQNLLALGPPVCKPDVISHLERGEEPWRVPREVLGGVHPERGPR

SEQ ID NO: 24579 - protein, 81 aa, Vicugna pacos
FEMSVSFEDVTVAFTQEEWRHVSPAQRTLYRDVMLENYRHLVSVGYWFTKPDIIFKLERREDPLLLENEFLTKSQAGCCVD

SEQ ID NO: 24580 - protein, 81 aa, Vicugna pacos
PQKSVTFEDVAVYFTQTEWDGLSPAQRALYRDVMLENYGNVASLGFPLLKPAVISQLEGGDIDIQTDNNLTEEMYEEKHNT

SEQ ID NO: 24581 - protein, 81 aa, Vicugna pacos
GVSFLDVAVHFSWEEWRLLDEAQRRLYLDVMLENYALVSSLGCCCGAGDAEAPFEQMAPLGGSQARTPKAALSSQKTHPCE

SEQ ID NO: 24582 - protein, 81 aa, Vicugna pacos
FEMSVSFEDVTVAFTQEEWRHMSPAQRTLYRDVMLENYRHLVSVGHCLTKPYVIFKLERGEDPLLLEEEILKKSLADCQLD

SEQ ID NO: 24583 - protein, 81 aa, Odobenus rosmarus
FQGSFSFEDVTVGFTQEEWQHLDPAQRILYRDVMLENYSHLVSVGCCIPKPEVILKLEQGEQPWTLGEESPSQSYPEVCRV

SEQ ID NO: 24584 - protein, 81 aa, Carlito syrichta
SQILVTFKDVLVEFSREEWKLLDITQQIMYKDVMLENYKNLVSLGYQLPKPDVILWLEKGQEPWLVERRIHQKTHPNLETA

SEQ ID NO: 24585 - protein, 81 aa, Carlito syrichta
QKGLVSFEDVVVYFTWEEWQDLNDAQRTLYRDVMLETYRSLVSLGCCITKPEVIFKLEQGAEPWPGEEPRQQSHPDVLTVS

SEQ ID NO: 24586 - protein, 81 aa, Delphinapterus leucas
LRGWGTFEDIAVYFSQEEWGLLDEAQRHLYCDVMLENLALVASLDYGCGAEAEEASYEQSVYVAVLQSRTPKADPSIQKAN

SEQ ID NO: 24587 - protein, 81 aa, Carlito syrichta
RTDTVTFKDVAVVFTEEELGLLDSAQRKLYRDVMLENFRNVVSVGHQFFTPDGIPELEREEKLCMVKTVIQSGNTSGGKNL

SEQ ID NO: 24588 - protein, 81 aa, Carlito syrichta
MSQGSVTFQDVVIDFSKEEWEFLNPAQRDLYTTVMLNYHNLVWLGLSISKSVISLLEHRKLPWMIGKKGIRNPLPDESGGE

SEQ ID NO: 24589 - protein, 81 aa, Carlito syrichta
ELVTFRDVVISFSQEEWEYLDSAQRDLYWDVMMENYSNLVSLDLESRFETKNLSVGMDIIENNRSQWKVMESSKFCGLKNS

SEQ ID NO: 24590 - protein, 81 aa, Carlito syrichta
SRSLENDGVCFSEQEWENLEDWQKELYRNVMESNYETLVSLKVLGQPEGEAELGTEMLGDLEEEGPAGAHPADGVMIKQEL

SEQ ID NO: 24591 - protein, 81 aa, Carlito syrichta
IKGTRDGHYVAVYFSPEEWGCLRPAQRALYRDVMRETYGHLGALGVGGTKPALISWVEEEAEVWGPDAQDPVAAKCPTEVD

SEQ ID NO: 24592 - protein, 81 aa, Carlito syrichta
MAQGSVSFEDVTVELTREEWQLMGPRERSLYRDVTLENYGHLIAVGCCIAKPQVILKLEQGEPWPLEVKFLNRKYTGYYKI

SEQ ID NO: 24593 - protein, 80 aa, Gulo gulo
MQGLLTFRDVAIELSQEEWGHLTHTQRRLYRDVMLENYGHLCFLGLTVSKPDLIIFLEQEKQLWDMKRKETVGFHPGRWE

SEQ ID NO: 24594 - protein, 81 aa, Ornithorhynchus anatinus
RSRGSDVSVELSREEWGLLDRARRELYRDVMLDNYPRAGAAGGRRGRTSPDLPPSVERGRSPRATARRPRLFPGAGHVAGA

SEQ ID NO: 24595 - protein, 81 aa, Mustela putorius
RLTFRDVAIEFSREEWECLDPAQRALYRDVMVENYRNLVSLNISTRCMNKELPPKDNINNGELFQTLILKRRISHDFDFGL

SEQ ID NO: 24596 - protein, 81 aa, Mustela putorius
LVSFEDVAMDFSREEWQQLDPAQRCLYRDVMLEIYSHLLSVEGALGLKTSQQKIFEKASFHNGKESEVTRGGMWCSISEDL

SEQ ID NO: 24597 - protein, 81 aa, Mustela putorius
SHGPLSFEDVAIAFTKEEWQQLDRTQRTLYRDVMLENFSHLVSLGHPMSKPDVISKLEQGQEPWIVKRDISSWIYPGPALL

SEQ ID NO: 24598 - protein, 81 aa, Tupaia chinensis
MSFKDVIVDFTQDEWLRLNGTQRTLYRDVMLENYSHLISVGYCITKPDMIFKLEQGEEPLDIRGRILRLGLSKGKTVVFLK

SEQ ID NO: 24599 - protein, 81 aa, Odobenus rosmarus
SQSLVTFGDVAVDFSQEEWEWLNSAQRNLYRSVMLENYRNLVSLGLCVSKPDVISSLEQRKEPWMVKRKLTRGRCPDLKTV

SEQ ID NO: 24600 - protein, 81 aa, Odobenus rosmarus
QGHVTFEDVAVYFSQEEWALLDEAQRHLYRTVMLENLALIASLGCWHGVKAEEAFSEQCVFMERVSQARTPDPGLSVPKAH

SEQ ID NO: 24601 - protein, 81 aa, Odobenus rosmarus
AQDSVTFEDVAVRFSSGEWQCLTRAQRHLYADVMLENYGNMISVGFAVPEPPLISHLEQGAEPCLQDLQDGGFLSCSFPVS

SEQ ID NO: 24602 - protein, 81 aa, Odobenus rosmarus
QAQESLTFDDVAVDFTWEEWQLLAPAQKDLYRDMMLENYRNLVSVGYQASKPDALSKLERGELWMIEDEIHSRICPEIRKV

SEQ ID NO: 24603 - protein, 81 aa, Delphinapterus leucas
TQVSVTFDDVAVTFTQEEWRQLDPAQRTLYQEVMLENCRLLVSLGCPVPRFELIFQLEQGQKLWTVKKDLSRSTCPGKRCR

SEQ ID NO: 24604 - protein, 81 aa, Gulo gulo
TARSQASVTFKDVAMDFTPEEWGKLDPAQREVMLENYKNLVSLWLPVSKSENYNLENGKEPLMLERKGPKSNYSDLETKPE

SEQ ID NO: 24605 - protein, 81 aa, Gulo gulo
MAHLMMFRDVAVDFSQEEWECLNLEQRHLYRDVMLENYSNMISLGLCIYQPDVFSLLEKGKEPWIVSQDETGGPCPDMQSR

SEQ ID NO: 24606 - protein, 81 aa, Erinaceus europaeus
SQELLTFQDVYVDFTQEEWEQLTPAYRNLYREVMLENYWNLVSVGYQLSKPGMTSQLNKGELPLIEQDVSGVSSSDMKNKE

SEQ ID NO: 24607 - protein, 81 aa, Erinaceus europaeus
SQELLTFRDVAIEFSAEEWECLNQAQRDLYRDVMLENYGHLVFLDLTLSKSDQITFLELQVNPWAEKRKKKLPILQNISSY

SEQ ID NO: 24608 - protein, 81 aa, Mustela putorius
AHGLVMFKDVAIDVSQEEWECLNPTQRNLYKDVMLENYSNLVSLGLSISKPAVISSLEQGKEPWMVVREMTGRRCPELVSR

SEQ ID NO: 24609 - protein, 81 aa, Mustela putorius
QESLTFKDVAVDFTLEEWGQLGPGQRELYRDVMLENYQNLLSLGAGPPGSKPDVISRLERGEEPRMENREAQLAACPALDT

SEQ ID NO: 24610 - protein, 81 aa, Mustela putorius
QQSAVTFEDVAVDFTQEEWLLLDLTQRNLYRKVMLENYQNLVAVEYQLSKPKLIAWLEQQELRTVEKGVFQEWETQPQTKG

SEQ ID NO: 24611 - protein, 81 aa, Mustela putorius
MLENYSHLVSVGYDSTKPKVILKLEQGEEPWVAEGEVPCQSQPEEVWKADDPIERIPGSEDEHSRQAISINSKTPVEEREN

SEQ ID NO: 24612 - protein, 81 aa, Mustela putorius
SQGSVSFEDISVAFTQKEWQLLDPAQRLLYREVMLENYRQLVSLGHCVATPELILKLEQGEEPWVPKRELPSPSRPEVHKT

SEQ ID NO: 24613 - protein, 81 aa, Mustela putorius
QAEVTFEDVAVLFSREEWGRLGPAQRGLYRDVMLETYRNLVSLGAGPAGPKPGVITQLERGDEPWVLDAQGAEGKERLRVS

SEQ ID NO: 24614 - protein, 81 aa, Mustela putorius
RDSVTFEDVAVRFSGGEWRRLTRAQRRLYAAVMLDNYGLVVSLAQPGFAGPKPPLISCLERGAEPRVRDLQDWGLLSCSFP

SEQ ID NO: 24615 - protein, 81 aa, Mustela putorius
FQEAVTFKDVAVVFTVEELGLLDSTQRKLYRDVMLENFKNLVSVGHLPFKPEMVSQLEAEEELWMMEGEPQKSVTSEDHMA

SEQ ID NO: 24616 - protein, 81 aa, Tupaia chinensis
MLETYSSLVSLGHCITKPEVIFKLEEAAEPWTVEEPPNQSLPDVPIVGDLIERNQESHRRQLWQLLTNSRTSTEKRIELGK

SEQ ID NO: 24617 - protein, 81 aa, Tupaia chinensis
MEFTWEEWQLLNSAQKHLYTDVMLENYNSWVSVEGWEEWYQKSQDDFESVERKYTCNMFGKLHPNKTDIFPRQRLHKYNAH

SEQ ID NO: 24618 - protein, 81 aa, Tupaia chinensis
FQGFISFEDVAMDFTWEEWQDLEDAQKILYKDVMLETYSNLMFLGQSIAKPAVIFKLEQGEDPWTLEELPSLSLPGEKPYE

SEQ ID NO: 24619 - protein, 81 aa, Vicugna pacos
SRSLENDGVCFSEQEWENLEDWQKELYTNVMKSNYETLVSLKVLGQPEGDSELGTEMLGDLEEEGPGRVHPAGAAMIKQEI

SEQ ID NO: 24620 - protein, 81 aa, Vicugna pacos
GSVTFEDVSVYFSWEEWALLDEAQKLLYCDVMLENFALMASLGYWHGVEDEDAPSEQSVSVEGVSQVSMTFKYLAMTFTWE

SEQ ID NO: 24621 - protein, 81 aa, Vicugna pacos
DPPQVSVTFEDVAIYFSQTEWGLLDEAQKFLYRDVMLENFALTRSLDCWRGAEDEVVLSEQSVSISESQIRISKPVPLNLK

SEQ ID NO: 24622 - protein, 81 aa, Odobenus rosmarus
QQIAVTFEDVAVDFTQEEWLLLDLTQRNIYRNVMLENYQNLVAVEYQLSKPKLIAWLEQQELRTVEKGVFQEWETQPQTKG

SEQ ID NO: 24623 - protein, 81 aa, Delphinapterus leucas
MLENYSHLVSVGCHIIKPEVITKLEKGEEPWIVGGEFLLQSYPEEDWEAHDLIEGAQENEDKHSRQTEFVNNKTLIEERGN

SEQ ID NO: 24624 - protein, 81 aa, Carlito syrichta
MLENYRNLVSLGFLFTTPRVISLLQRGEDPWKVGKEGSGGSSLGCKNSPKTTKSSQTQDSFQGLMRKRLKRNETWDCVLQK

SEQ ID NO: 24625 - protein, 81 aa, Erinaceus europaeus
SLTCEDVTVNFSQEEWTLLNPSQKKLYKDVMLEIFHNLVSIGKLQENLFIEQQQDHERNKQRNIEKTLSEKAESLYRQKPH

SEQ ID NO: 24626 - protein, 81 aa, Mustela putorius
QGHVTFEDVAVYFSQEEWGLLDEAQRCLYHIVMLETLALIASLGCRHGVKAEEAFSEQCVFVERVSHSRTPDPALSIPGAC

SEQ ID NO: 24627 - protein, 81 aa, Mustela putorius
IQEPVTFKDVAVDFTQEEWGQLDSVQRTLYRDVMLETYGHLLSVGNHIAKPEVISLLEQGEEPWSVEQAYPQSTCPEWMRN

SEQ ID NO: 24628 - protein, 81 aa, Mustela putorius
WLTFRDVAIEFSREEWECLDPAQRALYRDVMVENYRNLVSLAISPKCMIKELPPKENSNTEELSQRVKLERYKSCDTEDYA

SEQ ID NO: 24629 - protein, 81 aa, Tupaia chinensis
KNGYGAEYQERKAILVISPCGCELHQEEWRLLCPVQRTLNRDVMLENYRNLASLGIPFSKPTPAILLEQGDEPWREERQVL

SEQ ID NO: 24630 - protein, 81 aa, Tupaia chinensis
MLENYSHLVSVGYCIFRPEVIFKLEQGEEPWMSEEEFLNKSYSSLEDYEGEDLIKRSKKSKHLQQVVFINNKTLTREEEKV

SEQ ID NO: 24631 - protein, 81 aa, Tupaia chinensis
SEESVTFKDVAVDFTQEEWGQLDSPQRALYRDVMLENYQNLLALAGRPVHKPDVISHLERGEEPWQVQTTVPGAAGPEWEP

SEQ ID NO: 24632 - protein, 81 aa, Tupaia chinensis
EQVTFKDVAIEFSKTEWKRLDPAQRALYREVMLENYRNLVSVGTSPPDVTVISMLEQGEEPWTAESRVQRPEVPGGREWTQ

SEQ ID NO: 24633 - protein, 81 aa, Odobenus rosmarus
SSQELLTFRDVAIEFSQEEWRCLNHTQRELYRDVMLENYGHLLFLGLIVSKPDLVSFLEQTKDPWDGKSKKTVAFHPGRWE

SEQ ID NO: 24634 - protein, 81 aa, Odobenus rosmarus
KDQESLTLEDVAVDFTWEEWQLLAPTQKDLYRDVMLENYSNLVSVGYVASKPGALSRLEQGELWTTEHEIPSRICPEIKKD

SEQ ID NO: 24635 - protein, 81 aa, Delphinapterus leucas
PALGSVTFEDVAVYFSQEEWRLLDEAQRFLYHDVMLETFALAASLGLSSSRYHVVQLELRGEPWVHDRVDMTPDRARGAQI

SEQ ID NO: 24636 - protein, 81 aa, Carlito syrichta
SFETVTFKDVAVDLTQEEWEQMKPAQRNLYRDVMLENYSNLVIVGCQITKPDVIFKLEQEEEPWVMEEVFGRPCPVWEVDE

SEQ ID NO: 24637 - protein, 81 aa, Carlito syrichta
WSQMPVTFEDVALYLSQEEWGRLDHTQQNFYRDVLQKRNGLSLGFPFGRPFSPQVQDKGEAAGSSGQTGDGKEEKRGVCAA

SEQ ID NO: 24638 - protein, 81 aa, Carlito syrichta
QPQEAMTFKDLEVTFSQDEWEWLDSTQRNLYRDVMLENYRSVASLVGPFTKPAIISWLEAREPWGLNIQAAQPNANPGSTP

SEQ ID NO: 24639 - protein, 81 aa, Carlito syrichta
MMENYKNLATVGCQIIKPSLISWLEQEESRTVQGGVLQGWEMPLETKLSALEQDFSEGETSIGIQTEGSQNGGELCDNKQC

SEQ ID NO: 24640 - protein, 81 aa, Delphinapterus leucas
QSLVTFEDVAVHFSKEEWGLLDAAQRQLYHSVMLENLELMTSLGCWHGVEDEEVCSKQDASVDVVSQVRIFSAHSSTQKAD

SEQ ID NO: 24641 - protein, 81 aa, Carlito syrichta
ASVMVTFDDVALYFSEQEWGILEKWQKEMYKQEMKTNYETLDSLGYAFSKPDLITWIEQGRMLLIRDRGCLEETRMTVSPS

SEQ ID NO: 24642 - protein, 81 aa, Carlito syrichta
PKVPVTFDDVAVYFSEQEWGKLENWQKELYKHVMRGNYETLVSLDYAISKPDILTRIERGEEPCPEDQWGQEKGNEAEATH

SEQ ID NO: 24643 - protein, 81 aa, Delphinapterus leucas
EEVPVVFEDVAVYFTREEWGTLDKQQKELYRDVMRMNYELLASLGPAAAKPDLISKLERRAAPWIKDPNGPKWGKGRPPGG

SEQ ID NO: 24644 - protein, 81 aa, Carlito syrichta
EEMPLTFQDVAVYFSQAEGQQLGPQQRALYRDVMLENYGNMASLGFPVPKPELISQLEQGEELWILDLLGAEESEVLKSFQ

SEQ ID NO: 24645 - protein, 81 aa, Carlito syrichta
EMGLLSFKDVAIEFSSEEWECLDSPQRILYRTVMLENHRNLVFLGLAVSKPDLIMCLEQRKETWDVKRNGTLAKLPAVTSY

SEQ ID NO: 24646 - protein, 81 aa, Delphinapterus leucas
MLENYSNLLSVGFQASKPNVLSKLGQGEPWTMEDEIHCQTRSEIWKVDDHLLEHLQNESMEKRLEKWHEQNPLEYFVHQSR

SEQ ID NO: 24647 - protein, 81 aa, Saimiri boliviensis
KPVTFEDVAVNFTQEEWDCLDASQRVLYQDVMSETFKNLASVARMFLHKPELITKLEQQEKQWRVFLHLPNTEGLSEGKKK

SEQ ID NO: 24648 - protein, 81 aa, Cervus elaphus
SQDLVTFEEVSVDFSQEEWALLAPAQKILYRDVMLENFRNLASVGYHLCKHSPITEVAQEELRPEGRGILQSACTDGATQL

SEQ ID NO: 24649 - protein, 81 aa, Cervus elaphus
GQGPVTFEDVAVYFSREEWGLLNLTQRSLYRHVMLENFALIGSLGFAPSKSPKVAQMEGEEEAWVPNMVDSVVSRAEARKG

SEQ ID NO: 24650 - protein, 81 aa, Cervus elaphus
QRETRSQVSVTFEDVAVLFTRDEWRKLAPSQRNLYQDVMLENYSNLVSLGLPFSKPEVISLLQQGEDPWKVEKEGPEGPSL

SEQ ID NO: 24651 - protein, 81 aa, Colobus angolensis
MTFEDVAVEFTQWEWGQLNPAQKDVYREVMLENFRNLAFLGLLVSKPYVICQLEEGGEPFIVERDVSTGAHSDWERRSKSN

SEQ ID NO: 24652 - protein, 81 aa, Colobus angolensis
LAFREEWRHLDLSQRNLYRDVMLETYSHLLSVGYQVPEAEVVMLEQGKEPWALQGERPRQSCPGEKLWDHNQCRKILSYKQ

SEQ ID NO: 24653 - protein, 81 aa, Colobus angolensis
EEALMAFRDVAVAFTQKEWKLLSSAQRTLYREVMLENYSHLVSLGIAFSKPKLIEQLEQGNEPWREENEHLLDLYLEPRTE

SEQ ID NO: 24654 - protein, 81 aa, Colobus angolensis
THGQLLFRDVAIEFSQEEWKCLNPGQKALYRDVMLENYRNLVSLGICLPDLSVISMLEQKRDPWTLQRDVKIANNPNGREY

SEQ ID NO: 24655 - protein, 81 aa, Colobus angolensis
MGPLQFRDVAIEFSLEEWHCLDTAQRNLYRNVMLENYRNLVFLGIVVSKPDLITCLEQGEKPLTMKKHDMVTNPSETGFHH

SEQ ID NO: 24656 - protein, 81 aa, Colobus angolensis
FQASVSFKDVTVEFSQEEWQHLGPVERTLYRDVMLENYSHLISVGHCFTKPELIFTLEQGEDPWLLEKEKGFLSRNSPEDS

SEQ ID NO: 24657 - protein, 81 aa, Mustela putorius
MFQVTFSDVAIDFSYEEWGWLDSAQRDLYKDVMVQNYENLVSLGLSIPKPYVITLLEDGKEPWMVEKKDWESRWENKELVT

SEQ ID NO: 24658 - protein, 81 aa, Mustela putorius
ESVSFTDVTVDFTQEEWEQLDPSQRILYMDVMLENYSNLLSVEVWKADDQMERDRSGPDEQARPFIIFKNQTPMEERGSLF

SEQ ID NO: 24659 - protein, 81 aa, Tupaia chinensis
LQRFISFEDVTMDFTREEWQDLEDAQKTLYKDVMLETYSNLVFLGYCIAKPSVILKLEQGGDPWTLEECPILSLTGEKPYE

SEQ ID NO: 24660 - protein, 81 aa, Tupaia chinensis
MAFRDVAVAFTQEEWRLLSSAQRTLYREVMLENYSNLVSLGPKPDVHLSVSCPLDFSSEKFPMQHELCNHHPWIFTCLCAE

SEQ ID NO: 24661 - protein, 81 aa, Tupaia chinensis
MLENYRNLASLGLCVSKPDMISSLEQGREPWMLKKMMTRGRGSDLKAMQETKEVPPKKDLCEEKLSQAVITEKLTNCSLEY

SEQ ID NO: 24662 - protein, 81 aa, Tupaia chinensis
FSGFISFKDVAMDFTREEWQDLEDAQKILYKDVMLETYSSLMFWGQSIAEPAVIFKLEQGGEPWTLEELPSLSLPGEKPCE

SEQ ID NO: 24663 - protein, 81 aa, Carlito syrichta
PHWLVTFKDVAIDFSQEEWECLDSAQRNLYRDVMLENYSNLISLDLESICEPKKSFPEWGIYEMKSLQWQNMRKLINHNLQ

SEQ ID NO: 24664 - protein, 81 aa, Erinaceus europaeus
SLGADLFRDVAVVFSQEEWEQLAPAQRNLYRDVMLETYSNLVSLGLAVSKPDVIYFLEQGREPWRSKKAVNRGPSPVLESR

SEQ ID NO: 24665 - protein, 81 aa, Ornithorhynchus anatinus
SQGLVTIKDVSLCFSQEEWGSLDPGQTDFYGEYVMQENCGIVVSLRFPIPKLDGFSQVEGGEDQWMPDSQDSEILRVTYPG

SEQ ID NO: 24666 - protein, 81 aa, Tupaia chinensis
MASPSPSPDPKEEWDYLDPAQRSLYKDVMMENYGNLVSLDVLNRDKDEEPTVKQEMEEIEEEVEPQGVIVRRIKSEIDQDP

SEQ ID NO: 24667 - protein, 81 aa, Vicugna pacos
MGPVTFEDVAVSFSQEEWGLLSDAQRLLYHDVMLDTLSLLASLAWTVGAADSLMSWHLAVSPSCVRAVSPEAVRRRRWAPR

SEQ ID NO: 24668 - protein, 81 aa, Carlito syrichta
MLETYSSLVFLGHCIARPEVIFKLERGAEPRTVEERPKQNSDVQIVNDIIERNLETHGRHLWQVVITNSKTSTEERVELGK

SEQ ID NO: 24669 - protein, 81 aa, Carlito syrichta
MFTQEEWGQLDLTQRSLYLEVMLDTCGLLVSLGDSAEPSTTEPPSCHFTLPEKVSLQEQLTQGASRDSQLGQAKVQDGPSE

SEQ ID NO: 24670 - protein, 81 aa, Carlito syrichta
SQESVTFEDVAVYFTKKEWASLVPAQRALYRDVMLENYGAVAFLVPHTSKPALISQLEQGKEPWFSKPQGALSRKGQRAGS

SEQ ID NO: 24671 - protein, 81 aa, Delphinapterus leucas
QGLLTFRDVAIEFSQEEWECLDPAQRALYRDVMLETYGNLLSLDISISFLTKELLKKKNINNRELYQPVVLGRHGSCGIED

SEQ ID NO: 24672 - protein, 81 aa, Gulo gulo
SQGSVSFEDVSVDFTQKEWQLLDPAQRLLYREVMLENYRQLVSLGHCVTTPGLILKLEQGEEPWVPKRKLPSPSRPEVQKT

SEQ ID NO: 24673 - protein, 81 aa, Gulo gulo
PLESVTFEDVVIDFTKEEWALLDISQRKLFRDVMLENIRHLVSLGYQHCKSDLIFQLEQGQELWSEGTGFLRGQSPGRGSA

SEQ ID NO: 24674 - protein, 81 aa, Erinaceus europaeus
FWVPVTFDDVAVYFSEQEWGKLDEGQKELYKHVMRGNYETLVSLDYAISKPDLLARIERGEEPCSQEDSLEEVAEPRQSGA

SEQ ID NO: 24675 - protein, 81 aa, Erinaceus europaeus
PQESLTFEDVAVDFTQEEWHHMNPAQRCLYKDVMLENYSHLVSLGYQVSKPEVIFKLEQGEEPWISEGEIQRTLCPDWKTR

SEQ ID NO: 24676 - protein, 81 aa, Ornithorhynchus anatinus
GSQPVLFEDVAVSFSREEWECLDPSQKVLYQDVMGENYRNVVLLGIPCPEVDLKTWIEFSEEPGGPNLPTVEEGENARTAP

SEQ ID NO: 24677 - protein, 81 aa, Ornithorhynchus anatinus
LQMAVTFEDVALYFSLEEWAHLDSSQRKLYRNVMWENYKNVVSLGILLPKPDLIALIEQGEELWGLEFHVAKERGSPKAIR

SEQ ID NO: 24678 - protein, 81 aa, Colobus angolensis
SLGSVTFTDVAIDFSQDEWEWLNLAQRSLYKKVMLENYRNLVSVGLCLSKPDVISLLEQEKDPWVIKGEMTRGLCPDILKM

SEQ ID NO: 24679 - protein, 81 aa, Colobus angolensis
MELFTFRDVAIEFSPEEWKCLDPAQQNLYRDVMLENYRNLVSLGFVISNPDLVTCLEQIKEPYNWKIHETAAKPPAVCSPF

SEQ ID NO: 24680 - protein, 81 aa, Colobus angolensis
YQTPVSFKDVVVGFTQEEWHWLSPAQRALYRDVMLETYSNLVSVGYEGTKPDVILRLEQEEAPWIGEAACPGCHCWGISKL

SEQ ID NO: 24681 - protein, 81 aa, Colobus angolensis
MGLLTFMDVAVEFSLEEWQCLDTAQQNLYRNVMLENYRNLVFLAMCSHFAKGLRPEQYIKNSFQQMILRRYGKCGYQNLQL

SEQ ID NO: 24682 - protein, 81 aa, Colobus angolensis
QGRLTFRDVAIEFSFMEWKCLNPAQRALYREVMLENYRNLDFVDSSLKSMMELSSHEHSNTGEGFYTGTLERCKSYHIGDF

SEQ ID NO: 24683 - protein, 81 aa, Colobus angolensis
MYFSQEEWELLDSTQKALYNEVMQENYETVISLALFVLPKPKVISCLEQGEEPWVQVSPEFKDSAGKSPTGLKLKNDTENH

SEQ ID NO: 24684 - protein, 81 aa, Colobus angolensis
KEAFVAFRDVAVDFTQEEWRLLSPAQRTLHREVMLETYNHLVSLEIPSSKPKLIAQLEQGEEPWREERKCSLDLCPESKPE

SEQ ID NO: 24685 - protein, 81 aa, Colobus angolensis
FEELVTFEDVFVDFSPEELSSLSAAQRNLYREVMLENYRNLVSLGYQFSKPDIISCLEAEESHAVETDSRHRVICQRQSHD

SEQ ID NO: 24686 - protein, 81 aa, Colobus angolensis
PQSLLTFRDVAIEFSQEEWKCLDPAQRTLYRDVMLENYRNLVSLDISSKCMLKTLSSTGQGNTEVILTGTLQRQANHHTRD

SEQ ID NO: 24687 - protein, 81 aa, Delphinapterus leucas
PHWLVTFRDVAINFSQEEWECLDPIQRDLYREVMVENYSHLISLAGCSIPKPDVFSLLERGKEPWMVVRAMTRWSSGSGRA

SEQ ID NO: 24688 - protein, 81 aa, Carlito syrichta
MGLLSFKDVAIEFSPEEWECLNSPQRILYRTVMLENHRNLVFLGLAVSKPDLIMCLEQKKEPWDMKRHGTLVKLPAVTSHY

SEQ ID NO: 24689 - protein, 81 aa, Carlito syrichta
TQGSVTFEDVAIYFSQEEWGLLDEAQRFLYRDVMLENFALITSLVCWHGKEDEEIPSEQSVSLEGMSQIRTPKASPSTQKT

SEQ ID NO: 24690 - protein, 81 aa, Carlito syrichta
LLQGSLTFDDVLLDFTWEEWQLLGPDQKDLYRDVMLENYSNLVSLGCQASKSDALSMLEREETWTTEDEIRSQVCAEIRKI

SEQ ID NO: 24691 - protein, 81 aa, Carlito syrichta
SLVLVSFEDVAVDFSLEEWQDLDSAQKTLYRDVMLETYSSLLSLGHCMTKPEVIFRLEQGAEPWTVCEPSHRSLSDVQKVD

SEQ ID NO: 24692 - protein, 81 aa, Carlito syrichta
MEVVTFGDVAVHFSREEWQCLDPGQRALYREVMLENHSSVAGLGFLVFKPELISRLEQGQEPWFLDLQGAERTETPRTSKT

SEQ ID NO: 24693 - protein, 81 aa, Gulo gulo
QGSVTFRDVAIDFSQEEWEWLQPAQRDLYRHVMLENYGHLVSLGLNISKPYVVSLLEQGRDPWLEKDVRRDLFSESSGEIR

SEQ ID NO: 24694 - protein, 81 aa, Erinaceus europaeus
KPAAVRFADVAVYFSPEEWGCLRPAQRTLYRDVMRETYGHLGALGFPGPKPALISWMEQESEVWSPAAQDPEEGESLGGAR

SEQ ID NO: 24695 - protein, 81 aa, Erinaceus europaeus
SKAPVTFGDLAVYFTQAEWEWLSPVQKALYQDVMLENYQVLVSLGLCLRRPNLISLLEKGKAPWVAEPVRRRRGPDSASKF

SEQ ID NO: 24696 - protein, 81 aa, Erinaceus europaeus
QDTVIFEDVAVNFTPDEWALMDHGQRKLYRDVMLETCRNLALVDCCTQVKSSVSSLRHEILKSNICSEKNIVILTRNDSWY

SEQ ID NO: 24697 - protein, 81 aa, Tupaia chinensis
MSFEDVAVDFTWEEWQDLEDVQKILYKDVMPATYGSLMSLGHCIAKPAVIFIVYHRVLQTVHTNIQKLRYGVSELMVTAAY

SEQ ID NO: 24698 - protein, 81 aa, Tupaia chinensis
PKVPVTFDDVAVYFSEQEWGRLEDWQKELYKHVMRGNYETLVSLDYAISKPDILTRIERGEEPCPGDLWGQEKGDEEDSAR

SEQ ID NO: 24699 - protein, 81 aa, Tupaia chinensis
FQEMVTFRDVAVVFTEEELGLLDSAQRTLYRDVMLENFQNLLSVDHQPFKPDLISQLEREEELLMVETETQRAGCSDHQPF

SEQ ID NO: 24700 - protein, 81 aa, Vicugna pacos
TVTFKDVAVVFTEEELALLDKAQINLYQDVMLENFRNLVSVGDRIKNNISNLQEKGLSYLSQEVLYFWQIWKQRISEFTVS

SEQ ID NO: 24701 - protein, 81 aa, Vicugna pacos
FRGPVTFKDITVEFTREEWQLLDAAQRTLYREVMQENYRHLISVGYRVNRPNAVFKLKQGKEPWILEVEFPHRNYPEDLWN

SEQ ID NO: 24702 - protein, 81 aa, Vicugna pacos
SQESVTFEDVAVDFTQEEWALLDTSQRKLFRDVMLENISHLVSVVISDREDDLKKQMISMQHINKKDAPLIRTVQSSHTQE

SEQ ID NO: 24703 - protein, 81 aa, Vicugna pacos
AQGSLTFRDVAIDFSQEEWEWLQPAQRDLYRHVMLENFGHLVSLGLNISKPDVVSLLEQGREPWLGKGDMSRGLFPASESN

SEQ ID NO: 24704 - protein, 81 aa, Vicugna pacos
KDQGSLTLEDVAVDFTWEEWQLLAPAQKALYRDVMLENYSHLVSVGYQASKTDVLSRLGRGELWTVEDEVCGHICPEMRKG

SEQ ID NO: 24705 - protein, 81 aa, Vicugna pacos
SCEGSVSFRDVAVDFSREEWQQLDLDQKILYRDVMLETYSHLLSVGYQVPEPEVFMLEQAEEPWAMQSESLRQSCPEEFWQ

SEQ ID NO: 24706 - protein, 81 aa, Vicugna pacos
SQHLVTFEDVAVNFTQEEWTLLDQTQRDLYRDVMLENYQNLMALAGSESCKPHVNSPLEGAEELRTRARRILQKSDLQLKT

SEQ ID NO: 24707 - protein, 81 aa, Vicugna pacos
SQGLFTLKDVAIEFSQEEWECLVPAQRALYRDMMLETCRNLLSLGEENVPPEVAGSLSAGFAIKELVPREAIHKEELYHLV

SEQ ID NO: 24708 - protein, 81 aa, Odobenus rosmarus
VTLEDVAVYFSWEEWGLLDEAQRRLYHDVMLENLALITSLENEEVPSGQNVFLGRMPQIRSSEPNPSTEKVHFCEMCVSVM

SEQ ID NO: 24709 - protein, 81 aa, Odobenus rosmarus
ARGLVTFEDVAVYFSREEWGLLNLTQRSLYRDVMLENFALIGSLGFAPSRSHVVAQLESEEELWVPSMVDLTLGSRAEARR

SEQ ID NO: 24710 - protein, 81 aa, Odobenus rosmarus
AQESLTLEDVAVDFTWEEWQLLAPAQKDLYRDVTLENYSNLVSVGYQASKPDALSKLERGEEPCAKQEEVPSGTRPEPSKV

SEQ ID NO: 24711 - protein, 81 aa, Carlito syrichta
AAGSVTFKDVTMAFTQKEWKQLDPAQRNLYKNVMLENYSNIASMGCQASKPDIISKLEKGEEPWLGKEKRPSQGHLSKTAG

SEQ ID NO: 24712 - protein, 81 aa, Carlito syrichta
FQESVTFQDVAVDFTPEEWQLLGGAERTLYWDVMLENYRNLVSVGSPVAKTEVTLKVEQGQKPWLVEEENPHWSHPEADCP

SEQ ID NO: 24713 - protein, 81 aa, Carlito syrichta
SCEPVAFDDVTLGFTPEEWGLLDLKQKSLYREVTLENYRNLISVEHQLSKPDVVSQLEAAEEFWPVKRVPQDIVPECPGPQ

SEQ ID NO: 24714 - protein, 81 aa, Gulo gulo
AQGLVTFRDVAIEFSQEEWKCLEPAQRDLYRDVTLENFSNLASLGLSISKPDVISLLEQGREPWMITSDMTGPWCPELESR

SEQ ID NO: 24715 - protein, 81 aa, Erinaceus europaeus
SEGSISFKDVTMDFSIEEWQCLDSSQRRLYREVTLENYGHLLSLGYTSPKPEIVCKLEKGEEPWVLEEEAPHQSYSDEKFE

SEQ ID NO: 24716 - protein, 81 aa, Ornithorhynchus anatinus
MPKPELISSLEQGEEAWFPAPQEYEKIPRPSPTEPELRSETKKEVPGQPVHLEELVPGATLSENSNKEVPKRTESAEVQAS

SEQ ID NO: 24717 - protein, 81 aa, Mustela putorius
LQEPVTFRDVAVDFTQEEWGQLGPAQRTLYRDVMLETFGHLLSVGPELPKPEVISQLEQGTELWAAERGIAQGYYPGWESG

SEQ ID NO: 24718 - protein, 81 aa, Mustela putorius
SKVLVTFGDVAVDFSQEEWKWLNPAQRNLYRKVMLENYRSLVSLGVSVSKPDVISLLEQGKEPWMVKKEGTRGTCPDWEYT

SEQ ID NO: 24719 - protein, 81 aa, Mustela putorius
SQELVTFEDVAVYFIRKEWKRLEPAQRDLYRDVMLENYGNVFSLDGETRTEHDQEISEDTGSHGVLLGRFQKGISQGLKFK

SEQ ID NO: 24720 - protein, 81 aa, Tupaia chinensis
MLEIYSSLVFLGHCIAKSAVIFKLEQGGEPWTLELCNQKLPVHLRSTESYASKEKSFFRASDGAVSQRIFTREKPYEYNKC

SEQ ID NO: 24721 - protein, 81 aa, Tupaia chinensis
MVLLLLLDEWQQLDPCQRSLYRDVMLENYSHLVSVGFCVTKLEMIFRLEQGEEPWILEEEFPSQTFQISQSAMYSRKAMYK

SEQ ID NO: 24722 - protein, 81 aa, Tupaia chinensis
GSVSFTDVTVDFTQEEWEQLDPSQRVLYMDVMLENYSNLLSVEVWKADDQMEKKDQRNPDQPAKQFLILKNQTPIEERGNL

SEQ ID NO: 24723 - protein, 81 aa, Vicugna pacos
MFQVTFSDVAIDFSHEEWGWLDSAQRDLYKDVMVQNYENLVSLGLSIPKPNVIALLEEGKDPWMVERKLSTDWDSRWENKE

SEQ ID NO: 24724 - protein, 81 aa, Delphinapterus leucas
GQGSVSFKDVTVDFTWDEWLQLTCMQRTLYQDVMLENYSHLVSVGYCVSKPEVIFKLEQGEEPWPLERAFPCRSDPAQGTI

SEQ ID NO: 24725 - protein, 81 aa, Delphinapterus leucas
PGIYLFRREQKMMKSQEEWQQLDPAQKTLYRDVMLENYSHLVSMGHPVSKPDVISKLEQGEDPWIIKRDIPNWIYPYEDQA

SEQ ID NO: 24726 - protein, 81 aa, Gulo gulo
MLENYSNLVSLGIPFPKPTLVILLEQGEEPWTEEGEALPSSCTADAKPEIQLGSSSALDFCSWQRQHRLPICPGLLAGTLC

SEQ ID NO: 24727 - protein, 81 aa, Gulo gulo
VEDHVTFEDVAVHFSWEEWGLLDEAQRLLYRDVMLENFALMASLGLASSSARAVTQLEWWREPFVPPCAVLTAAAPRGWRR

SEQ ID NO: 24728 - protein, 81 aa, Gulo gulo
CQKSVTFEDVAVIFTDEEWRHLVPIQRDLYKEVMLENYKSIVSLGLPVPQPDVIFQLKRGDEPWVVDLHGSEERECPENVS

SEQ ID NO: 24729 - protein, 81 aa, Gulo gulo
MLENFRNLVSVGNQPFKPDLIFQLEREEKLLMMEMETETQRDGYLGAKSQHNMESSQEVGLHYISPKEVSSRQTWQQGAGG

SEQ ID NO: 24730 - protein, 81 aa, Gulo gulo
QDSVTFEEVAVDFSQEEWALLDPAQKTLYRDVMLENYRNLASVGYPLCKHSLITEVEQEVLGTEEGAILQGACTDWDIQLK

SEQ ID NO: 24731 - protein, 81 aa, Erinaceus europaeus
MDAISSEDVTVNFSQEEWELLNPSEKKLYNDVMWEIFHNLVSIGKLLEDSFIEQSEDQEGSKQRNIEDKTSEKKEGSLYRE

SEQ ID NO: 24732 - protein, 81 aa, Ornithorhynchus anatinus
VPVTFVDIAVYFSEDEWKNLDEWQKELYNNLLRENYKTLMSLGEDPEESVPKPDTLSRAEPRDESCAWEQNEPQAREIPMD

SEQ ID NO: 24733 - protein, 81 aa, Ornithorhynchus anatinus
NFWILRLPPATNGEVPKELGNLDQGQKELYKNVMKGNYETLVSLDYAISKPEILSRLEQGKEPCDVDRRGSKGPAAPSDSS

SEQ ID NO: 24734 - protein, 81 aa, Mustela putorius
RSQDSLTFQDVAVNFTREEWNQLYPAQKILYRDVMLENYRNLVALGHQLYKPEVISQLEKEEQRGMERDSAVDAHADGESR

SEQ ID NO: 24735 - protein, 81 aa, Mustela putorius
FSFEDLSVDFTQKEWQLLDPSQKDLYRDVMLENYSSLVSLGYEVVKPEVIFKLEQGEEPWTGDGEAPSTGGPEQVLQVNGH

SEQ ID NO: 24736 - protein, 81 aa, Mustela putorius
GCQGLLTFSDVALEFSDDEWGRLTHSQRQLYRDVMLENYGHLLFLGLLLSKSDLIIYLEQEKVLWDVKRKETGGFHPGRWE

SEQ ID NO: 24737 - protein, 81 aa, Mustela putorius
SQESVTFQDVAVDFTEKEWPLLDSSQRKLYKDVMLENYSNLASVGYQVGKPSLISHLEQEEELRTEERTRHRATSPDWETP

SEQ ID NO: 24738 - protein, 81 aa, Mustela putorius
VTFTDVAVNFTREEWALLDSRQRILYRDVMLENCRNLASLDLLKQHQTKNSTPQPDILAKKTPVEAKRVCTVSHASQQSLL

SEQ ID NO: 24739 - protein, 81 aa, Mustela putorius
ARGLVAFEDVAVYFSREEWGLLNLTQRSLYRDVMLENFALIGSLGFAPSRSHVVAQLESEEELWVPNMVDLTLGSRTESRR

SEQ ID NO: 24740 - protein, 81 aa, Vicugna pacos
PQDLVSFKDVAIDFSQEEWEWLSPAQRRLYRRMMMENYQNLLSLGLCTSKPYVISLLEQGKEPWGMKSEVRNPFSDWDSVC

SEQ ID NO: 24741 - protein, 81 aa, Vicugna pacos
CEGSVSFEDVTMDFSREEWQQLDPAQRRLYQDVMLEIYSHLFSVGYHIPSPEITVRMGKGKEPRMGEADLPQHRCPGELGL

SEQ ID NO: 24742 - protein, 81 aa, Vicugna pacos
MLENYFNLISVGCQVPKPEVIFNLELGEEPCMLDDGTSSQSCLDQSIGFETSQQGMSEEVSVHFERMNLFTRDDPYSVLEE

SEQ ID NO: 24743 - protein, 81 aa, Vicugna pacos
SMTFEDVAVHFSWEEWRPLDDVQRHLYLSVMLENFALMSSLGCCCATENTESPFQSSVSIDMSPAKTPKANQSSQKSHPCE

SEQ ID NO: 24744 - protein, 81 aa, Vicugna pacos
MVADCVRNRPQDSVTFADVAVGFTQEEWILLDSFQRNLYRDVMLENYKNLTTAGYQWFKPTLISWLEQEELRTEERGAVQG

SEQ ID NO: 24745 - protein, 81 aa, Vicugna pacos
RGSLSFRDVAVVFTWEEWQLLDLIQKNLYQDVMLENYSNLVSVEDTWQADSHRDWHEENQGNLETMGSHHEANTFGKIPSL

SEQ ID NO: 24746 - protein, 81 aa, Odobenus rosmarus
SPGAVSFADVAVYFSPEEWGCLRPAQRALYRDVMPETYGLLGALGFSGPKPAFISWVEGEVEAWSPEAQDPEGETPAAVTR

SEQ ID NO: 24747 - protein, 81 aa, Delphinapterus leucas
IQGSLTFGDVAVAFTQIEGRHPDAAQRALYRDVILENYGNLVFVGLLSSKPKLITQLDAEEPRMEVAGVPSGTYTVQEYIF

SEQ ID NO: 24748 - protein, 81 aa, Carlito syrichta
MLDNFRNLATLGFRSSRPDFVFHREQWDEPWVEDWGRPEFQKVQRGPCPGARKSLAHKRHCDRLTWAHEKIHMRERVKEGG

SEQ ID NO: 24749 - protein, 81 aa, Delphinapterus leucas
GQLTLNDVVIEFSQEEWECLDPAQRALYRDVMLETYRNLIFVDISHIHVIKKLQLKSNTDKGGVFQTLMLERHESQGIKHF

SEQ ID NO: 24750 - protein, 81 aa, Gulo gulo
RQEPVTFEDVAVYFTQNEWVILDPSQRALYREVMLENYANVASLAFLFTRPVLVSQLERGELPWGLEPWEPAGRETLRGIC

SEQ ID NO: 24751 - protein, 81 aa, Gulo gulo
DEALMAFRDVAVAFTQKEWKLLSPAQRTLYRDVMLENYSHLVSLGIAFSKPKLITQLEQGDEPCREESECLLDLCPADPGT

SEQ ID NO: 24752 - protein, 81 aa, Erinaceus europaeus
VTFEDVALHFSWEEWELLDEAQRLLYCSVMRDNFALAASLDCWHAVASEETPSEQSISVKGESHIRTLEVVATSPQKTQPL

SEQ ID NO: 24753 - protein, 81 aa, Erinaceus europaeus
MLETYGHLLCVGSQTVKPKVISLLERGAEPWPVGQAAAPGSCPEWMRNLESKALLTPQNAFEEEQSHSMRLERYIWNDPWF

SEQ ID NO: 24754 - protein, 81 aa, Delphinapterus leucas
SRDSVTFADVAVDFTQEEWTLLDPIQRKLYRDVMLENYKNLTTAGYQSLKPTLISWLEQEDDLRTVERRGVLQGSAIQQDN

SEQ ID NO: 24755 - protein, 81 aa, Carlito syrichta
MTEDFVTLKDVAMDFTCEDWEHLGLDQEGLFWDMALDNYQDLFLLNPSKPNLTSHPDDREELEALVRGSPEATPDVAETKN

SEQ ID NO: 24756 - protein, 81 aa, Carlito syrichta
AGPQGSTSFSSVTVAFAQDRWRYLVPTPRDRFKEGISETSRNLFLLVSQPRMNSQLEQREGPWMLEGEDLRSTCPDWKTVS

SEQ ID NO: 24757 - protein, 81 aa, Carlito syrichta
MLENYGAVASLAFPFPKPALISQLEQEEAPWCSTFWGAVNGEGLSGISSGYPFLKPAGVSHLEQVEESLNLKLQGKGPSLI

SEQ ID NO: 24758 - protein, 81 aa, Carlito syrichta
MLENYRNLVSLGISLSDLNIISMLEQGKEPWTVESQMQIARKPNRGEWIKGVNSDISPKCVIKELPTIENRDAVETFQTVM

SEQ ID NO: 24759 - protein, 81 aa, Carlito syrichta
AVVSVTFDDVAVTFTQEEWGQLDPAQRTLYQEVMLENCGLLVSLGCPVPRPELIYQLEHGQELWTDKKDLFQGTCLGDEAK

SEQ ID NO: 24760 - protein, 81 aa, Carlito syrichta
VSFEDVAVYFTQEEWTLLDSAQRDLYRDVMLETCENLASIGNLLNHSVMYWLEGEENLGTVQEGDPQEWRLKTKGSTLRPD

SEQ ID NO: 24761 - protein, 81 aa, Delphinapterus leucas
QPQEAVTFKDVEVTFSQDEWGWLDASQRNLYRDVMLENYGNVTSLVGPFTKPALISWLEAREPWGLNVQGAHPKGSPSAAP

SEQ ID NO: 24762 - protein, 81 aa, Gulo gulo
SQESVTFQDVAVDFTEKEWPLLDSSQRKLYKDVMLENYSNLASVGYQVGKPSLISHLEQEEEPRTEERTLHRATSPDWETP

SEQ ID NO: 24763 - protein, 80 aa, Gulo gulo
LQGLLTFRDVAIEFSQEEWGAAAAAAAELYRDVMLENYGHLLFLGLVVWKPDLVIFLEQEKQLWDVKRKESVAFHPGRWE

SEQ ID NO: 24764 - protein, 81 aa, Erinaceus europaeus
SLGTVSFEDLAVTFTLEEWRQLDGAQRSLYREVMLETYSSLAVVGHCRSKPEVIVKLEQGAEPWTVGDPPPRSLSDTLDDP

SEQ ID NO: 24765 - protein, 81 aa, Tupaia chinensis
LQESLTLEDVAVEFTCEEWQLLDPAQKDLYRDVMLENYGNLVSLGYQYRKPDVFSKLERGEEPWAVEDEIQSQVCPENGKD

SEQ ID NO: 24766 - protein, 81 aa, Vicugna pacos
LSFEDVALYFTREEWSRLDWAQKDLYRDVMLENYRNMIVLGSETRFKMRELTPKQNISEDLESHKISVVKQKKAKKPSEEL

SEQ ID NO: 24767 - protein, 81 aa, Vicugna pacos
AQGPVLFEDLAVYFSQEECVSLHPAQRSLSRDTAQECFMDNALMGEGKIEINQQLSLESMGLEELALEKYSITVPLVYCPE

SEQ ID NO: 24768 - protein, 81 aa, Carlito syrichta
CWGLLSFKDISMEFTWEEWQLLDSTQKYLYRDVILENYNNLVAVGYHGTKPDLIFKLEQGEEPWIINATISSQNCPEDWEE

SEQ ID NO: 24769 - protein, 81 aa, Delphinapterus leucas
EQLTFKDIDIEFSQEEWECLEPAQQALYRDVMLETYRNLLSLDISPTHVIKKLQLKVNTGRGEVLQTVMLGRHERNKVKRF

SEQ ID NO: 24770 - protein, 81 aa, Delphinapterus leucas
LVMFKDVAIDVSQEEWECLNPAQRNLYKDVMLENYSNLVSLDLVSKCEAKKLSPKRNIYETESSQWAIMEPFKSHSPEKSI

SEQ ID NO: 24771 - protein, 81 aa, Carlito syrichta
SQGSVTFRDVAIDFSQEEWKWLQPAQRDLYRCVMLENYGHLVSLAGLSVSKPDVVSLLEQGKEPWLGKGDVRGDLFSVSNC

SEQ ID NO: 24772 - protein, 81 aa, Carlito syrichta
MGLLTFRDVAIEFSPEEWECLDPTQRILYRNVMLENHRNLVSLGLAVSKPDLITCLEQRKEPWSVKRYSTLAKPLVVSGCF

SEQ ID NO: 24773 - protein, 81 aa, Carlito syrichta
MTFSDVAVDFSQQEWECLDPVQKTLYRDVMMENYGNLVSLGHSISKPDVIALLEQGKEPWVVTKEETRRCCTDLESRYEII

SEQ ID NO: 24774 - protein, 81 aa, Carlito syrichta
RETFMTFGDVIVDFTQKEWRLLNPAQRTLYREVMLENYSHLVSVEIAHSKPEFIRLLEQGRAPWEDKKRQPLGHCAGLYTE

SEQ ID NO: 24775 - protein, 81 aa, Delphinapterus leucas
LKEVVTFKDVAVVFTEEELGLLDSAQKKLYQEVMLENFQNLVSVGHQSFTPDVISQSKREEKLWMIKIATQSRRSLGDKNL

SEQ ID NO: 24776 - protein, 81 aa, Delphinapterus leucas
PKVSRSLENDGVCFSEQEWENLEGWQKELYTNAMKSSYETLVSLMEGVMIKQEIQYTQDGSADLPGEFSGIAEEHALLSPE

SEQ ID NO: 24777 - protein, 81 aa, Delphinapterus leucas
WLQGPVSFEDVTVEFTQEEWVMLDSAQRSMYRDVMLENYMNLTLVEYQLCKPVISLSGQEDIRTVKRRIPQGTCLDWEIQL

SEQ ID NO: 24778 - protein, 81 aa, Carlito syrichta
SQEPVTFADVAVVFTPEEWVFLDPSQRSLYRDVMLENYRNLASVGDHLCKPSTLSHLEQRRGLWTTERGVISDTCPEPQLQ

SEQ ID NO: 24779 - protein, 81 aa, Delphinapterus leucas
VSVNFEDVAVTFSWEEWGLLDEAQRYLYHDVMLENLALITSLGCCHEVENEKASFEQRTSIQRVSQIRSPKANLSFKKAHP

SEQ ID NO: 24780 - protein, 81 aa, Carlito syrichta
TGMSVTFEDVAVMFTQEEWGQLDVTQRTLYWEVMLEICHLLFSLGCPLSKQELIYQLEHSEELWMVKKDTSHNSCPGHSRK

SEQ ID NO: 24781 - protein, 81 aa, Carlito syrichta
WLDAVSFADVAVYFSPEEWGCLRPAQRALYRDVMRETYGHLGALGFSGPKPAFISWVEAEVEAWSPEAQDSEGKSLAAVSR

SEQ ID NO: 24782 - protein, 81 aa, Delphinapterus leucas
LLTFEEVAIYFSQEEWELLDPTQKALYNDVMQENYETVISLEIKMKNDTENHQPICFSDLEIQAPGDIVSKKASVNVHQKT

SEQ ID NO: 24783 - protein, 81 aa, Delphinapterus leucas
EEGRVTFEDVAVYFSQEEWGLLDKTQRLLYRSVMLEIFSLMASLGLTSSRTQEFTQLEQWGEPFVPACGVVITATPRGCWC

SEQ ID NO: 24784 - protein, 81 aa, Gulo gulo
MTIKDVVVSFSRGEWRRLEPFQKELYKEVLLENSRSLEFLGFPVSKLDLISQFKWIELPRLLEKEISKGSRPECEPRGELK

SEQ ID NO: 24785 - protein, 81 aa, Ornithorhynchus anatinus
PLSQPRRGSPSRPGLVTFKDVTMSISQEEWEQLDPDQVDFYGEYVPQENCDFVVSLGKNSPAPHPPILEIREQSRDPTDQG

SEQ ID NO: 24786 - protein, 81 aa, Delphinapterus leucas
PGPVKFEDVVVIFTEAEWKRLSLEQRNLYKEVMLENFRNLVLLDSKPEVHPWPLCFCPLAFDGQQFLSHHELCSHLIPYSY

SEQ ID NO: 24787 - protein, 81 aa, Carlito syrichta
EMGLLSFKDVAIEFSPEEWACLTNPQRIMYWTVMLENHRNLVFLGLAVSKPDLITCLEQRKEPWDVKRHGTLAKLPAVTSH

SEQ ID NO: 24788 - protein, 81 aa, Carlito syrichta
FKGLVTFGDVAIDFSKEEWEYLGPAQRDLYRDVMLENYSCFVSLGLATSKPSVIFLLEQGKEPWMVGEAGWYADLPSRHET

SEQ ID NO: 24789 - protein, 81 aa, Carlito syrichta
FQEAVTFKDVAVAFTEEELGLLDSAQRKLYRDVMLENFRNLVSVGHQFFKPDMISQLEKEEKLWLREFQTPRGRHSGDSHQ

SEQ ID NO: 24790 - protein, 81 aa, Delphinapterus leucas
MTLSQALLTFRDVAIEFSQEEWECLDPAQRALYRDVMLENYRNLVSLDMSTRCVIKELSPKQDINNGDLFQTLAFERLGFP

SEQ ID NO: 24791 - protein, 81 aa, Carlito syrichta
FQETVTFKDMAMVFTQEDLGLLDSAQRKLYQDVVLENFGNLLSVGYQPFSLDMVLWLVREEKFSMMETETQGDGYSGHRNQ

SEQ ID NO: 24792 - protein, 81 aa, Gulo gulo
QAMVKIEDMAVSLILEEWGCQNLARRNLNRDNRQENYGNVFSQGCENRSENEESTSKAEIAEDSASRGEPTGRFQKDFGEK

SEQ ID NO: 24793 - protein, 81 aa, Gulo gulo
QSRGPLSFVDVFVDFTWEEWRLLDPSQKHLYRSVMLENYSNLVSLGYQDSKPDIIFKLEQEEPWMMPAQIPSQGHPEKVGG

SEQ ID NO: 24794 - protein, 81 aa, Gulo gulo
PPDSVTFMDVAIDFSQDEWEWLNLAQRALYKKVMLENYRNLLSLGLCLSKPDVISLLEQGREPWMLEGEMTRGLCSDLEYV

SEQ ID NO: 24795 - protein, 81 aa, Colobus angolensis
IQGQVNFEDVFVYFSQEEWVLLDEAERLLYRDVMLENFALTASLGYTSFMSHIVASLVMGSEPWVPDWVATETPGGSCWRG

SEQ ID NO: 24796 - protein, 81 aa, Colobus angolensis
DSISLEDVAVNFTLEEWALLDPGQRNIYRDVMRATFKNLACIGEKWKDQDIEDDPKNQGRKLSSPTVETLCENKDDHPCEK

SEQ ID NO: 24797 - protein, 81 aa, Tupaia chinensis
NCVTFEDVAIYFSREEWDLLDESQRLLYLDVMMENFTLVNSLVCCHGMQDEVTPEQSVPVERVSRVWTPKAGFSNQKTHPC

SEQ ID NO: 24798 - protein, 81 aa, Tupaia chinensis
MAFEDVAVYFSREEWELLDTAQRALYRHVMLENFALVASLGFSPSRPCVVIQLESGKEPWLHSGMDTTMSRHAHKRPSSGS

SEQ ID NO: 24799 - protein, 81 aa, Vicugna pacos
AHGSVMFSDVSIVFSQEEWEYLDLKQRDLYRDVMLENYSNLVSLGCFISKPDVISLLEQGKEPWKVMRKGRGRYPDLETRY

SEQ ID NO: 24800 - protein, 81 aa, Vicugna pacos
DPEQVTFEDVAVDFTWEEWGQLEPAQRTLYRDVMLETFRLLVSVGHWLPKLDVISLPEQEVELWAVDKGVPQGVCPDLETR

SEQ ID NO: 24801 - protein, 81 aa, Vicugna pacos
SQESVTFEDVAVDFTQEEWALLDTSQRKLFRDVMLENISHLVSVGNQFYKSDVISHLEQGEQLSRERLDFLQGQTIYFFPV

SEQ ID NO: 24802 - protein, 81 aa, Vicugna pacos
MAVTFEDVTVIFTWEEWRFLDSSQKKLYREVMWENYTNVMSVGNWRQRYKPQEKRFRYLTHDNLSCWHGWRNASTQIYENR

SEQ ID NO: 24803 - protein, 81 aa, Vicugna pacos
AQVLVTFKDVAVTFTQEEWGQLDLDQRTLYREVMLETCGLLVSLGHPVPKAELMHLLEPGPKVWTVTRGLSRSTCSGDRAE

SEQ ID NO: 24804 - protein, 81 aa, Carlito syrichta
TVTFEDVAVYFSWEEWGLLDETQRCLYRDVMLENLALITFLDVHQHPKQHFGEKRFRNNVNRGLFVKSCKFYVSEEPFTCG

SEQ ID NO: 24805 - protein, 81 aa, Carlito syrichta
EMRLLMFRDVAIEFSPEEWECLDPAQRNLYRDVMLENYRNLVSLGLTIFKPALVTFLEHWQESWNVKRKETVAKHLELYSH

SEQ ID NO: 24806 - protein, 81 aa, Carlito syrichta
LKGSVSFEDVIVELTQEEWRRMGPRDRSLYRDVMLENYGHLVAVGCCITKPKVILKLEQGEEPWSLEVKFLNQKYPGYYKI

SEQ ID NO: 24807 - protein, 81 aa, Gulo gulo
MHKDVMLENYSNLASVGLCVAKPEMIFKLERGEELWILEEESPGRGYPGSLSLLCENSSVGGNALGHDNDLGHQKIQTLDQ

SEQ ID NO: 24808 - protein, 81 aa, Erinaceus europaeus
PRPLESEDVYFSEEQWENLEDWQKELYRNVMASNYETLVSLKVLGQPEEEAELGPEMSGDLEGHPADGVVVKPESQDALAG

SEQ ID NO: 24809 - protein, 81 aa, Ornithorhynchus anatinus
MYNFISPLVGFSMVKPVVICRLEEGKDPWGQDLPETEDRETLGDPHTDCKTKPETESVPPQQEVSEEADFKRASLERCQQN

SEQ ID NO: 24810 - protein, 81 aa, Mustela putorius
SQVSVTFEDVAVLFTRDEWRKLCPSQRNVYQEVMLENYSNLVSLGLLFSKPRVISLLQQGEDPWKVEKESPGGPSLGWKSG

SEQ ID NO: 24811 - protein, 81 aa, Mustela putorius
AQVPLTFSDIAIDFSLEEWECLNSDQRDLYRDVMLENYTNLVSLDFDFTTETNKLSSEKSSYQVNSYHRETMKRNKTFNLM

SEQ ID NO: 24812 - protein, 81 aa, Vicugna pacos
LQNLVNFEDVAVRFCKEEWGLLDAAQRHLYHSVMLENLELVTSLGCWHGVEDKEVRSKQNASVEVVSQARIPSVHPSTQKA

SEQ ID NO: 24813 - protein, 81 aa, Vicugna pacos
FQEPVLFKDVAVVFTEEELGLLDPAQRELYRDVMLENFRNLLSVGKQLFKPELIFQLEREEELLMMETETQRDGCSGTKSQ

SEQ ID NO: 24814 - protein, 81 aa, Vicugna pacos
RLTFKDVAIEFSQEEWECLDPAQRAFYVDVMLETYRNLVSLDVSHIHVIKKLQPTTNSDSGEVFQAVMLERQESPEVKHFY

SEQ ID NO: 24815 - protein, 81 aa, Vicugna pacos
SQDAVTFGDVAVNFTQEEWALLDLSQRNLYRDVMLENYNNLITTGYQSVKPALISWLEQGEFRTVERGALQEWEMNQKVKD

SEQ ID NO: 24816 - protein, 81 aa, Vicugna pacos
GPVLFEDLAVYFSQEECVSLHPAQRSLSRDTAQECFMDNALMGKIEINQQLSLESMGLEELALEKYSITVPLVYCPEKSSE

SEQ ID NO: 24817 - protein, 81 aa, Vicugna pacos
VTFEDVAVYFSWEEWCLLDEVQICLYLDVMLENFALVSMLGSCHGVKDGETSSEQSIFVGVSQTRTPKAGVSPEKSQPCRM

SEQ ID NO: 24818 - protein, 81 aa, Vicugna pacos
AAGSVTFKDVTMAFTKKEWEQLDPAQRSLYKDVMLENYSNLASMVGYQALKPDMICKLEKGEGLWLGKGKSPTRGGLSETA

SEQ ID NO: 24819 - protein, 81 aa, Vicugna pacos
SHGLVSFKDVAVDFTQEEWQQLDPAQRTLYRDVMLENYSHLLSVGHPVSKPDVISKLEQGEDPWIIKRDMPNWVYPGENQA

SEQ ID NO: 24820 - protein, 81 aa, Vicugna pacos
VTFEDVAVYFSREEWCLLDEVQIRLYLDVMLENFALVSMLDSLHGVEGEETPSEQSIFVGMSQTRTPKAAVSPEKSQPCRM

SEQ ID NO: 24821 - protein, 81 aa, Carlito syrichta
MVTFKDVAVYFSQTEWAGLSHPQRALYRTVMLENYENLTTVGYLIPKPALISLLDGGDLPWVLESQDDIPAERTKIICKDA

SEQ ID NO: 24822 - protein, 81 aa, Carlito syrichta
SVTFKDVAVIFTKEELALLDKAQISLYQDVMLENFRNLVSVGDGIKTNIFNLQEKGLKILSQEVFHCWQIWKQKICKLTAG

SEQ ID NO: 24823 - protein, 81 aa, Carlito syrichta
QGHVTFEDIAVYFSQEEWELLDEAQRCLYHAVMLENFSLMASVGSWHLVEAEEAPSDQTVSTENVSQARTPKANPSIPNTY

SEQ ID NO: 24824 - protein, 81 aa, Delphinapterus leucas
GTGGAGPSPGPCLGAGPGDAGMAPRPPTARPQESVTFKDVAVNFTQEEWHHMDPAQRRLYRDVMLENYSHLVSLEFLRIKA

SEQ ID NO: 24825 - protein, 81 aa, Delphinapterus leucas
KISVCTDSTASEEQQKMSKSQGFVSFKDVTVDFTQEEWQQLDSAQRNLYKDVMLENYSNLVSVVNLDGKKMDTASCSFFRG

SEQ ID NO: 24826 - protein, 81 aa, Carlito syrichta
PQELVTFRDVAVDFTQEEWGQLDPTQRTLYRDVMLETFGHLLSVGPELPKPEVISQLEQGAELWVAEIGTTQGRHSGWQPQ

SEQ ID NO: 24827 - protein, 81 aa, Carlito syrichta
SQASVSFKDVTVEITQEEWQQMGPVQRTLYRDVTLENYSHLVSVGNCISKPEMIFKLEQGEEPLFSEEEFSNQSHPKDYKG

SEQ ID NO: 24828 - protein, 81 aa, Carlito syrichta
AHRSVMFNDVSIDFSREEWEYLNLEQRDLYRDVMLENYSNLVSLGYFISKPDVISLLEQGEEPWKVVRKGRRRYPDLKTNY

SEQ ID NO: 24829 - protein, 81 aa, Carlito syrichta
MVENFKNMVAVGHLLFKPDMVSQLEAEEKLWMMEAEAQRRNKNQHEMETLRKFAFKYFSHEELSCWQIWKQVASELTRCLQ

SEQ ID NO: 24830 - protein, 81 aa, Gulo gulo
AQELVTFKDIAIDFTQEEWALLDTSQRQLYRDVMLENISHLVSVGYHLCKSDVISQLEQGVELWRDGREFLQGLNPDRKSG

SEQ ID NO: 24831 - protein, 81 aa, Erinaceus europaeus
SQGLVTFKDVAVYFSQDQWSDLDPTQKEFYGEYVLEEDCGIVVSLSFPIPRLDEISHVGEGEPLIQEPQEPQEPEILSFTY

SEQ ID NO: 24832 - protein, 81 aa, Erinaceus europaeus
NQKSVTFEDVAVYFTQTEWDGLSPAQRALYRDVMLENYGNVASLGFSLLKPAVILQLEEGGELGATFPLATQTDTGPHTLW

SEQ ID NO: 24833 - protein, 81 aa, Erinaceus europaeus
EAVPLTFQDVAVYFSPSEGQQLGPDQRALYRDVMLENYGHVASLGLPVPKPELISQLEQGEELWVLNLMGTEEPEPLSSSK

SEQ ID NO: 24834 - protein, 81 aa, Erinaceus europaeus
CQDTVTFEDVAVIFTDEEWNLLDPIQRDLYKEVMLENYKSIVSLGLPVPQPDRIFHLKREDETWMVDLHGSEKKKCPQKVS

SEQ ID NO: 24835 - protein, 81 aa, Ornithorhynchus anatinus
MEVTFKDVAIFLTQWEWGSLADAQRELYTSVMLENYGHLRSLGAGRPKPQCIRQLEKGEDPWVPEPPAHHKWIFLKEAWTE

SEQ ID NO: 24836 - protein, 81 aa, Ornithorhynchus anatinus
RAEELETFEDAAIPLARRERGHLVPARCNMHWGMMLGNYRKRSSLRRSIARPNLISQLKEEDPCNLDMREAEESETRRDAF

SEQ ID NO: 24837 - protein, 81 aa, Delphinapterus leucas
MLENYSTLFSLGILFSKPKVILQLEQGEDPWMVENGVSQSTCLGWESLFETTVSEEENQEVMNQLIGDGPFYFKLGEIYIN

SEQ ID NO: 24838 - protein, 81 aa, Carlito syrichta
AQESLTFEDVAVNFTDWEWQCLTYTQRHLYKDVMLENYENLVSLGFPFSKPPLISHLEQRVEPCIQDLQDRESLSCSYPVS

SEQ ID NO: 24839 - protein, 81 aa, Carlito syrichta
AYEGSVSFRDVAIDFSREEWHHLNPSQRNLYWDVMLETYSHLLSLGYQVPEAEVFMLEQGKEPWALQGESPRQSYPGEKLW

SEQ ID NO: 24840 - protein, 81 aa, Carlito syrichta
AHDLVVFRDVSVDFSQEEWECLNSYQRNLYRDVILENYSNLVSLAGCSISKPDVITLLEQGKEPWMVVRNEKRRWNLDLES

SEQ ID NO: 24841 - protein, 81 aa, Carlito syrichta
TVAERIVTDCLTNYYQEEWTLLDTSQRHLYSDVMMENYKNLATVGCQIIKPSLISWLEQEESRTVQGGVLQGWEMPLETKL

SEQ ID NO: 24842 - protein, 81 aa, Carlito syrichta
SQGLLTFKDVAIEFSPEEWEYLDPPQRMLYRTVMLENHRNLVFLGLAVSKPDLIMCLEQRREPWNVKSHSKLAKSPAVTSH

SEQ ID NO: 24843 - protein, 81 aa, Gulo gulo
LQGPVSFKNVAVDFTQEEWQYLDLPQRHLYKDVMLENCINLILVGYQTTKPSVIHKLEQGEEPRKMEREIPSWSHADFVSS

SEQ ID NO: 24844 - protein, 81 aa, Erinaceus europaeus
MFRDVSVDFSQEEWECLDSYQRNLYRDVTLENYSNLVSLGCPISKPDVITLLEQGKEPWIIVRDEKRRWSLDLKSKYDTKM

SEQ ID NO: 24845 - protein, 80 aa, Colobus angolensis
MLPECSVRFHNQQTMNKSLTWEEWQDLDDAQRTLYRDVMLETYSSLVSLGHCVTKPEVIFKLEQGAEPWLGEEWANRCLS

SEQ ID NO: 24846 - protein, 81 aa, Colobus angolensis
EMGPLTFMDVAIEFSVEEWQCLDTAQQNLYRNVMLENYRNLVFLGIAVSKPDLITCLEQGKEPWNVERPEMVAKPPGINWD

SEQ ID NO: 24847 - protein, 81 aa, Colobus angolensis
LSFEDVAMYFTREEWGHLDWGQKDLYRDVMLENYRNMVLLGSEARHKMKKLTPKQKFSEDLESYKVSVVMQESAEKLSEKL

SEQ ID NO: 24848 - protein, 81 aa, Colobus angolensis
MEHLTFRDVAIEFSPEEWKCLDPAQQNLYRDVMLENYRNLVSLGVAISNSDLVTFLEQRKEPYNVKIHETVAKHPAKCSHF

SEQ ID NO: 24849 - protein, 81 aa, Colobus angolensis
PQGSTFFSSVTVAFAQEGWRYLVSTPRERYKERVPEKSRNLVLLGLPVSQPGMNSQLEQREGTWMLEGEDLRSPSPGWKIV

SEQ ID NO: 24850 - protein, 81 aa, Colobus angolensis
EMGLLTFRDIAIEFSLAEWQCLDHAQRNLYRDVMLENYRNLVSLGVAVSKPDLITCLEHNKEPRNIKRNEMVSKHPVTCSH

SEQ ID NO: 24851 - protein, 81 aa, Colobus angolensis
RDVAIEFSLEEWKCLDPAQQNLYRDVMLENYRNLFSIGLTVSKPGLITCLEQRKEPWNVKRQEAVDGHPEMGFHHATQACL

SEQ ID NO: 24852 - protein, 81 aa, Delphinapterus leucas
MLENYSNLVSLGLLFSKPEVISLLQQGEDPWKVEKESPGGSSVGCKSSPKTTKSTQTQDSSFWGPVRKRLQKNEPWNFISE

SEQ ID NO: 24853 - protein, 81 aa, Carlito syrichta
VVQEPVTFEDVAVLFTHEEWGRLSPAQRALHGEVMRENCGHLLSLGLLGPKPDMSPQLGKREDWTPEAAPGGFSLDWLTVP

SEQ ID NO: 24854 - protein, 81 aa, Carlito syrichta
MLETYSNLVSVGYEGTKPDVILRLEQEEAPWICEAACSGCHCWEDSWQVNTQRKRWQDILLKQGAFISKKTLPTEKSRECN

SEQ ID NO: 24855 - protein, 81 aa, Carlito syrichta
QDFVTFEDVAISFSQEEWKLLDEAQKFFYRDVMLENFALITSQGCWYGAETEEVSSEYSVSVEGLSQIRTPKASPFTQKNY

SEQ ID NO: 24856 - protein, 81 aa, Carlito syrichta
PQEAVAFEDVAVYFTRIEWSCLAPDQRALYRDVMLENYGNLTSLGFLVTKPALISLLEQGEEPGALIRQMTEKTGTKASLC

SEQ ID NO: 24857 - protein, 81 aa, Delphinapterus leucas
MFKDVAIDVSQEEWECLNPAQRNLYKDVMLENYSNLVSLGLSISKPAVISSLEQGKEPWMVMREVIGDQFPDLVSKCEAKK

SEQ ID NO: 24858 - protein, 81 aa, Carlito syrichta
TQGPLTFRDVAIEFSLEEWKCLDPAQQTLYRNVMMENHRNLVSLGLDVSKPDLIMCLKRRNKPWNVKRHNMLEKPTESHSV

SEQ ID NO: 24859 - protein, 81 aa, Carlito syrichta
MDSVAFEDVAVNFTEEEWALLDPSQRNLYRDVMQETFRNLASVGNKCEDQNTGDQYKNSWRNLRSHTVEILAKSQTGSQCG

SEQ ID NO: 24860 - protein, 81 aa, Gulo gulo
FTGSLSFGDVAISFSQEEWECLEPAQKALYRDVMLETYSNLVSLESSISKPDTITLLEQEKEPWVVLRREASGWHPDLESN

SEQ ID NO: 24861 - protein, 81 aa, Gulo gulo
QGPMLFEDLAVYFSQEEYVSLHPVQRSLSRDTTQECFKDMVLMGGEGKTETSQQLNLECTGFEELAAENSSITVPLVYYPE

SEQ ID NO: 24862 - protein, 81 aa, Myotis brandtii
VTFEDVALYLSREEWGQLDHAQQSFYRDVLQKRNGLALGFPFSRTFWASQVQGKGEASSSCLQMGDEEEKRGAVEVRKEDP

SEQ ID NO: 24863 - protein, 81 aa, Myotis brandtii
SKTSVTFKDVAVTFTQDEWEQLDLAQRTLYREVMLEICRLLVSLGYPVPKSELVHLSEHRQELWIVKRGLSQSACAGAREK

SEQ ID NO: 24864 - protein, 81 aa, Myotis brandtii
MVFEDVAVYFSREEWGLLDSAQRALYRQVMLENFALVASLGLSASRPRIILQLERGEEPWVLSGLDVALARDAQRRPSPAQ

SEQ ID NO: 24865 - protein, 81 aa, Propithecus coquereli
VSVTFEDVAVTFTQEEWGQLDLTQRTLYREVMLETWGLLVSLGDSTQPWTPEPTLPHLALPEEVSLEQQLTQGASGDSQLE

SEQ ID NO: 24866 - protein, 81 aa, Propithecus coquereli
SQGSVTFRDVAIDFSQEEWKWLQPAQRDLYRCVMLENYGHLVSLGLSISKPDVVALLEQGKEPWLGKGDVRRDLFSVSQSN

SEQ ID NO: 24867 - protein, 81 aa, Propithecus coquereli
AQGSVSFKDVTVDFTQEEWQHLDPAQKTLYMDVMLENYCHLISVGCHMTKPDVILKLEQGEEPWASFAGLTCLEENWKAED

SEQ ID NO: 24868 - protein, 81 aa, Propithecus coquereli
WKELLSFEDVAMYFTREEWGHLDWAQKDLYRDVMLENYRNMILLGFQFPKPEVICQLEQWDEPWILDLLRAGNRKASSSAY

SEQ ID NO: 24869 - protein, 81 aa, Balaenoptera acutorostrata
LQGSFSFEDLSVDFTQKEWQLLDPYQKDLYKDVMLENYSSLVSLGYEVMKPGVILKLEHGEEPWTGDGEIPGSDSPEQVLQ

SEQ ID NO: 24870 - protein, 81 aa, Lynx pardinus
MLEIYSHLVSVGCSGISPGIIFKLEHEEDPWTMKSELSRWIHSDREKSLDSSQQIISEELSFQKEILEKAPKDNSLYYLLK

SEQ ID NO: 24871 - protein, 81 aa, Balaenoptera acutorostrata
MDPAQRRLYRDVMLENYSHLVSLGYQVSKPEVIFKLEQGEEPWIAEGEIQRPFCPDWKTRPEAKSSRLQQSISEVSLSTDD

SEQ ID NO: 24872 - protein, 81 aa, Vombatus ursinus
MLENYKNLVSLGLLDPKPDLISRLEQGEPQSWDVQERPSSSVCAQAGGHPSRESGARGSRPAASEGWGGAAWNIKLENEES

SEQ ID NO: 24873 - protein, 81 aa, Saimiri boliviensis
MDSVAFEDVSVNFSQEEWALLAPSQKKLYRDVMQETFKNLVSISHKVERLCESKEGSQCGETFSPSLCVTKKTARVKLDEC

SEQ ID NO: 24874 - protein, 81 aa, Saimiri boliviensis
AHGSVTFRDVAIDFSQEEWEFLDPAQRDLYRDVMWENYSNFISLGPSISKPDVITLLDEEGKEPGMVVREGIRRYYPDLDS

SEQ ID NO: 24875 - protein, 81 aa, Vombatus ursinus
KKESVAFKGVVVDFIQEEWGQLDLPQKDLYKDLMLEKYRNLVLLGLPVFKPDVNSELEQGEDSWIPRKEDPGSNCSDWPGL

SEQ ID NO: 24876 - protein, 81 aa, Vombatus ursinus
MLENYRNLLSLGLPVPKPDVISQLERGAAPGMLEREGPRASCPDWETRPETSESLPKMAISMDESSPERHSPQDFKLGEVK

SEQ ID NO: 24877 - protein, 81 aa, Lynx pardinus
FQGSVSFRDVAISFSQEEWACLDPAQRALYRDVMLENYSHLLSLGRSISKPDVITFLEQEKEPWVVVRKETSGWYPDLESN

SEQ ID NO: 24878 - protein, 81 aa, Balaenoptera acutorostrata
PLTFKDVAVTFTEEELGLADSTQRKLYRDVMLENFRNLLSVEDKDEKDMEYIQEKELRLLLHRELSYWKILEQVAGELTQN

SEQ ID NO: 24879 - protein, 81 aa, Saimiri boliviensis
RESGKAPVTFDDITVYLLQEEWVLLSQRQKELCGSDKLVPPLGPTVANPELFRKFGRGPEPWLGSVQGQGSLLEQHPGKKQ

SEQ ID NO: 24880 - protein, 81 aa, Lynx pardinus
VSFEDVPVYFIKTGWKLLDLSQRILYKRVSLENYRHFVSLGQGITPLSGWPHSPPTWGSPCPPGPHASKVHASRVHGGAHA

SEQ ID NO: 24881 - protein, 81 aa, Lynx pardinus
PAATSFHPPRIQEEWGLLDRSQKELYWDAMLEKYGTVVSLAGLPAPLPEARVESEPGVLRSGTEGQRSLHPGDESESHCEG

SEQ ID NO: 24882 - protein, 81 aa, Delphinapterus leucas
WSQMPVTFEDVAVYLSREEWGRLDHTQQSFYRDILQKRHGLSLGFPFSRPFWASQVQGKGEASGSCQQMGDEEEEKRGAVE

SEQ ID NO: 24883 - protein, 81 aa, Colobus angolensis
VAFEDVAVNFTQEEWALLDISQRNLYREVMLETFRNLTSIGKSWKDQNIEYECQNPRRNFRSLIEDKVNEIKEDSHCGETF

SEQ ID NO: 24884 - protein, 81 aa, Mustela putorius
VTESVTFRDVAVLFSQDEWLHLDATQRTLYREVMLENYGTLVSLGIPCSTPKVICQLQQGEDPCLVDRKLPQDASLGLKAQ

SEQ ID NO: 24885 - protein, 81 aa, Mustela putorius
DGGLVVFTDVAIHFSREEWGLLDEAQRSLYHSVMLETLALLSSLGCWHGAQDEAAPLEQGDSVGGSQVRTPTQKSQPWERC

SEQ ID NO: 24886 - protein, 81 aa, Mustela putorius
QGLLTFSDVAIEFSEEEWRRLTHSQRQLYLDVMLENYGHLLFLETGLLLSKPDLIIYLEQEKVLWDVKRKETGGFHPALSS

SEQ ID NO: 24887 - protein, 81 aa, Tupaia chinensis
GLVTFEDVAVDFTKEEWQYLNPPQRTLYRDVMLENYSNLVSAGRQVAKPDLILKLEVEEPHPAEVKIPTWSFLEVCQVGEQ

SEQ ID NO: 24888 - protein, 81 aa, Odobenus rosmarus
KQEAIVFEDVAVYFTRIEWSCLAPDQRALYRDVMLENYGHMASLGFLVAKPALISLLEQGEEPGALILQGTEEQGSTASLC

SEQ ID NO: 24889 - protein, 81 aa, Odobenus rosmarus
MEEWALLDPSQKKLYRDVMQETFRNLASIEEKWEIHDREDQNENRGTDLRCQMVERLCKSKECSQCEEIFSQIPYHNQKKK

SEQ ID NO: 24890 - protein, 81 aa, Odobenus rosmarus
MLENYRNLASLEKQLSKPTLITQMEQEDEMKTETGNHQDTCSNGMVLLKTKQSQHKQGILEKEALSAKKEQTHGGRSIEKN

SEQ ID NO: 24891 - protein, 81 aa, Odobenus rosmarus
MLETYSHLLSVGYEVPQPEVFMLEQGKEPWAVQGESTHQSCPGEKLWDHNQCGKILSYKQAPSQHQKIHTGEKSYECAEFG

SEQ ID NO: 24892 - protein, 81 aa, Odobenus rosmarus
VTFEDVAVIFTDEEWRHLVPIQRDLYKEVMLENYKSIVSLDWETKPEIHGASEEESEGTARGKLGGEVPVCPKFGTLEGES

SEQ ID NO: 24893 - protein, 81 aa, Odobenus rosmarus
APDSITFEDVAMDFTQEEWVLLNSRQRKLYRDVMLENYRNLASLEKQLSKPTVITQMEQEDEMKTETGNHQDTCSNGMVLL

SEQ ID NO: 24894 - protein, 81 aa, Odobenus rosmarus
ACGSLSFGEVAISFSQEEWECLDPAQRALYRDVMLETYSNLVSLAGSSISKPDVITLLEQEKEPWVVVRRETSGWYPDLES

SEQ ID NO: 24895 - protein, 81 aa, Carlito syrichta
GPELLTFWDVAIEFSPEEWECLDPVQRNLYRDVMLENYRNLASLGFTVFKPDLVTFLEHMQEPWNVKRKETVAKHPDAHSH

SEQ ID NO: 24896 - protein, 81 aa, Delphinapterus leucas
RESGKAPVTFDDITVYLLQEEWMLLSQQQKEICGSDELVAPLGPTIANPELFYKFERGPEQWLANVQGQRSLLSLHRGKNK

SEQ ID NO: 24897 - protein, 81 aa, Carlito syrichta
SQGLLTFKDVAIEFSPEEWECLDYSQRILYRTVMLENYRNLGFLGLAVSKPDLITCLEQRKEPLDVKRHSTLAKLSVVTSH

SEQ ID NO: 24898 - protein, 81 aa, Carlito syrichta
MLENYSHLISVGYCTPKPEVILKLEKGEEPWILEEEFPSQSHPELINTSRSYSRKKFNEFNKGGKRLHDEKHEGIYSQEKP

SEQ ID NO: 24899 - protein, 81 aa, Carlito syrichta
HGSVTFRDVAIDFSQEEWEFLDPAQRDLYRDVMWENYSNFISLAGPSISKPGVITLLDEEGKEPGMIVREETRRYCADLES

SEQ ID NO: 24900 - protein, 81 aa, Carlito syrichta
AQGSVTFEDVAIYFSQEEWRVLDEAKRLLYLEVMLENFELVASLGCGHGTAEDEETLSEQNVCVGVSQSKAASSTQKTYPC

SEQ ID NO: 24901 - protein, 81 aa, Carlito syrichta
MMENFSNLVSVGYQVTKADAFFQLKQGKPWIIEEEIQSQFHLEDVWQDNNHTDGHQENQSNLESMKNHHRYHTFGKIMSHL

SEQ ID NO: 24902 - protein, 81 aa, Gulo gulo
AAASVSFKDVTVDFTREEWQHLDPAQKTLYMDVMLENYCHLISVGCHMTKPDVILKLERGEEPWTSFTGHTCLEENWKEED

SEQ ID NO: 24903 - protein, 81 aa, Cervus elaphus
VGRLLGPRGPMAEPAPQEWQNLEAWQKELYKQVMRANYEILLSLDNGLPKPELISWIEQGEELYKKWGESQESRSIICSSA

SEQ ID NO: 24904 - protein, 81 aa, Cervus elaphus
VSVNFEDVAVTFSWEEWDLLDEPQRCLYRDVMLENLALITSLGCCHEVETKKTSFEQNVYFQRMSQIRTPKADLSSKKAHP

SEQ ID NO: 24905 - protein, 81 aa, Cervus elaphus
MEELALLDSAQINLYQDVILENFRNLVSVEMLYFWQIWNQRISELIVSHDYVIMNLQGDCSQYLGDISLCEEWTGVSLQIS

SEQ ID NO: 24906 - protein, 81 aa, Colobus angolensis
LQASVSFEDVTVDFSREEWQHLDPAQRRLYWDVTLENYSHLLSVGYQVPKSETAFKLEQGEGPWTLAGEAPHQSCSGEAIE

SEQ ID NO: 24907 - protein, 81 aa, Colobus angolensis
SQHLVTFEDVAVDFIQEEWTLLDQTQRDLYRDVMLENYKNLIILAGSELCKPSLMSGLEQMEELRTGVTGVPQGQKQYCRE

SEQ ID NO: 24908 - protein, 81 aa, Mustela putorius
SYEGSVSFRDVAVDFSREEWQHLDLAQRNLYRDVMLETYSHLLSVGYEVPQPEVFMLEQGQEPWALQCDPHQSCPALDFLE

SEQ ID NO: 24909 - protein, 81 aa, Mustela putorius
PQVLVSFEEVAVFLSREEWGCLGPAQRGLYSDVMLETYRNLISLGLQGSKPDVISRLEKGEEPWAPYSPRIEEGWIWSHGS

SEQ ID NO: 24910 - protein, 81 aa, Mustela putorius
MAFTQKEWERLDPAQRDLYKDVMLENYSNLASMGFQAPKPDMISKLEKGEEPWLGKGKRPRQGGPSEIARPKQIRTNGNEV

SEQ ID NO: 24911 - protein, 81 aa, Tupaia chinensis
LQGLVSFEDVAVNFSWEEWQDLDDAQRTLYKDVMLETYSCLVSLDVQLDDDVIERSQEIHCRHLWQVVINNSNTTTKERVE

SEQ ID NO: 24912 - protein, 81 aa, Odobenus rosmarus
AWAPLSFEDVAVGFSWEEWQLLAPSQKDLYRDVMLENYRNLVSVGYQASKPDSVFQLEQGEPPWIVEGAAQSQTCQEEIWE

SEQ ID NO: 24913 - protein, 81 aa, Odobenus rosmarus
KYGQLTFRDVAIEFSQEEWECLDPAQRELYKDVMLENYRNLVSLGISVSDLNIMSFWSKGKSLDCGGQRANSIKPNGWECV

SEQ ID NO: 24914 - protein, 81 aa, Odobenus rosmarus
VQGSMSFEDVIVKFTQDEWQYMSPAQRTLYRDVMLENYSHLISVGYCTTKPEMIFKLEQGEEPWSLEEEFLNQRYPGYFSV

SEQ ID NO: 24915 - protein, 81 aa, Odobenus rosmarus
MGAVGCQCASGCAEHPGRCGPGARPRMLDSVVPAPYRSRSPAGGWSDPLFFGGPKLITQLEQGKETWREERTCPPATRPVE

SEQ ID NO: 24916 - protein, 81 aa, Delphinapterus leucas
QEPVVFEDVAVDFTQEEWALLDLAQRNLYRDVMLENFRNLASLGFETQLKTNELVAAQDIYGEKISSEQNVVRFKRSASSL

SEQ ID NO: 24917 - protein, 81 aa, Carlito syrichta
AEGSVMFSDVSVDFSQEEWECLDPIQKDLYRDVMLENYNNLVSVGLYIPKPQVISLLEQGKEPWMVGRELTRGLCSDLESM

SEQ ID NO: 24918 - protein, 81 aa, Delphinapterus leucas
MAFSKKEWEQLDPAQKSLYKDVMLENYSNLASMGYQALKPDMISKLGKGEEPWLGKGKRPRQGGLSEIARPKGIGTNGKEV

SEQ ID NO: 24919 - protein, 81 aa, Carlito syrichta
FVTFEDVAVHLTREEWGYLDPVQRDLYREVMLENYGNVVSLDGETREENKLLIPKKISEEVHSHRVRVGRLKQNIAQVPET

SEQ ID NO: 24920 - protein, 81 aa, Cervus elaphus
EYQVGKRPALVMSIQLSIEDVDIQFIPEEWECLDPAQRALYWDMMVETYRNLLSVAEEDPWIVENEVQMSRNLMNCKVSTV

SEQ ID NO: 24921 - protein, 81 aa, Cervus elaphus
AYIHESESPLSSKDHSCPQDVDLFACNGLEPHTSTSVEPPQESVTFQDVAVDFTEKEWPLLDSTQRKLYKDVMLENYSNLA

SEQ ID NO: 24922 - protein, 81 aa, Cervus elaphus
IQRLLTFRDVTIDFTLEEWGCLDLSQRELYRDVMLENYRNLASLGLVVFKPDLVTFLEQRKHLWDVRRVETTATYPAVSSH

SEQ ID NO: 24923 - protein, 81 aa, Colobus angolensis
SQGRVTFEDVTVNFTKGEWQRLNPEQRNLYRDVMLENYSNLVSVGREETTKPNVILRLEQGKEPWLVEEEVLGSGRPEKNG

SEQ ID NO: 24924 - protein, 81 aa, Mustela putorius
SQGQLTFKDVAIEFSQEEWGHLTHTQRQLYRDVMLENYGHLCFLGLTVSKPDLITFFGAKEAALGCEEKGDRRLPSREDAH

SEQ ID NO: 24925 - protein, 81 aa, Mustela putorius
FEGSVSFEDVAVDFTRQEWHRLDPAQRTMHKDVMLENYSNLASVGLCVAKPEMIFKLERGEELWILEEESPGPGYPGSLSL

SEQ ID NO: 24926 - protein, 81 aa, Mustela putorius
FQELLSFKDISMEFTWEEWQLLDSTQKYLYRDVILENYSHLVSLGYHGTKPDLIFKLEQGEEPWIINARVSRPSCPEGWKE

SEQ ID NO: 24927 - protein, 81 aa, Mustela putorius
LVSFEDVAVNFSWEEWQDLDDAQRTLYRAVMLETYRSLVSLDVQSAGDLTETRQDHQSRHVGQVGFSSNKRSTTKRTALGK

SEQ ID NO: 24928 - protein, 81 aa, Tupaia chinensis
MLENYSNLVSLGFSISKPEVLSLLAQEKELWKVVRDLTRGQSPDGGSKCQVKKLSSKRKNYETESSQWEQLTSHNKECKDL

SEQ ID NO: 24929 - protein, 81 aa, Vicugna pacos
ESVTFEDVAVDFTQEEWALLDTSQRKLFRDVMLENISHLVSVVISDREDDLKKQMISMQHINKKDAPLIRTVSSHTQEDPL

SEQ ID NO: 24930 - protein, 81 aa, Odobenus rosmarus
FQEAVTFKDVAVVFTMEELGLLDSTQRKLYQDVMVENFKNLVSVGHLPFKPDMVSQLEAEEELWMMEGEPQRNGYSREDHV

SEQ ID NO: 24931 - protein, 81 aa, Odobenus rosmarus
FQETVTFKDVAVVFSEEELGLLDSTQKKLYRDVMLENFRNLVSVGHSSSKPDMISQLEREEKLCIKEIHTERGRHLGGRNQ

SEQ ID NO: 24932 - protein, 81 aa, Odobenus rosmarus
QDPVAFEDVTVNFTLEEWALLNPSQKKLYRDVMQETLRNLASVVCILEEKWEDHDNEDQDENSGTNLSRHTVERLAKRKQG

SEQ ID NO: 24933 - protein, 81 aa, Odobenus rosmarus
AQGLMAFEDVAVYFSQEEWELLDTAQRALYCHVMLENFTLVASLGLSASRPRVVIQLERGEEPWVLGGTVATPARNAHRKP

SEQ ID NO: 24934 - protein, 81 aa, Carlito syrichta
LQELLTLEDVSVEFTSAEWQLLDPAQKDLYRDVMLENYRNLVSVGYQASKTDALSKLEQGEEPWTGENEMHCEICPENDKF

SEQ ID NO: 24935 - protein, 81 aa, Gulo gulo
AAGSVTFKDVTMAFTQKEWERLDPAQRDLYKDVMLENYSNLASMGFQAPKPDMISKLEKGEEPWLGKGKRPRQGGPSEIAR

SEQ ID NO: 24936 - protein, 81 aa, Gulo gulo
SQESVTFEDVAVDFTREEWTLLDRSQRKLFRDVMLENISHLVSVGRQLYKSDTISHLEPGEHLSKEGLGLLQCAISDREDD

SEQ ID NO: 24937 - protein, 81 aa, Erinaceus europaeus
SQCSITYEDVAVIFTQEEWALLNSTEKKLYRNVMWENFRNFLLIGKLQGEHSIKEHYNDQGSKSNIMKISEAEKQSQNSGK

SEQ ID NO: 24938 - protein, 81 aa, Mustela putorius
VRETVTFKDVAVVFSEEELALLDPAQRKLYGDVMLENFRNLISVGGKIQSKMKTVLETEPSEELSCWQIWQQIASDLTRCQ

SEQ ID NO: 24939 - protein, 81 aa, Mustela putorius
RQEPVTFEDVAVYFTQNEWVILDPSQRALYQEVMLENYANVASLAFLFTRPVLVSQLERGELPWGLEPWEPADREALRGIC

SEQ ID NO: 24940 - protein, 81 aa, Tupaia chinensis
LQGFISFEDVAMDFTREEWQDLDDAQKILYKDVMLETYSNLMFLGEKPYECKECKKTFSQNSDLTVHQRRHIEEKSYENKI

SEQ ID NO: 24941 - protein, 81 aa, Tupaia chinensis
SVTFEDVIINFTQEEWALLDTSGRKLYKDVILENISHLVSVGREVAHKMQEIIPTQQISREDTPTVISMKNQSSKIYECHL

SEQ ID NO: 24942 - protein, 81 aa, Tupaia chinensis
MESVTFEDVAVYFSENEWTGLAPAQRTLYRDVMLENYGAVASLAFPFPKPALISQLERGEAPWRLTPQGALDGQCPRGTSC

SEQ ID NO: 24943 - protein, 81 aa, Tupaia chinensis
MVKIEDMAVSLILEEWGCQNLARRNLSRDNRQDNYGNVFSQDCENRNENEESASKAEDSASRGETAGKFQKELGEKREQQG

SEQ ID NO: 24944 - protein, 81 aa, Odobenus rosmarus
AQGMNFEDVAIDFSQEEWGLLDETQRLLYCDVMLENFALVASLGFGHGMEDEEAPSKQTMSVGEYQLRAFQTGLSTQKIHP

SEQ ID NO: 24945 - protein, 81 aa, Odobenus rosmarus
GVTFEDIAVYFSWKEWRLLNEAQRRLYHHVMLENFTLISSLGCCCGAEDEAPFAHSTSVGVSQTRTPKAAQSSRKTHPCEM

SEQ ID NO: 24946 - protein, 81 aa, Odobenus rosmarus
MPVTFEDVAVTFTQEEWGQLDPAQRTLYQEVMLETCGLLVSLGCPLPKPELFYPLDHSPELHTLKRGLSPNSCPGDSTKPG

SEQ ID NO: 24947 - protein, 81 aa, Odobenus rosmarus
WLQVPVTFKDVAVEFTQEGWMMLDSGQRRIYRGVMLENYMNLTSMEYQLWKPTMISPLGQEEIRTMKRRLLAGTYPDWEIQ

SEQ ID NO: 24948 - protein, 81 aa, Odobenus rosmarus
MLENYANVASLAFLFTRPVLVSQLERGELPWGLEPWEPAGREALRGICPGGETRAEKEESTPKEHISKETESHRLTLGGLP

SEQ ID NO: 24949 - protein, 81 aa, Delphinapterus leucas
CMNSVTFEDVAMDFTQEEWALLNSSQRKLYRDVMLENYRNLVSLGHQLSKPPLITQMEQEDEMEIAERRIHQDTCSGAHQA

SEQ ID NO: 24950 - protein, 81 aa, Delphinapterus leucas
VTFRDVAVFFSRDEWLHLDSAQRTLYQEVMLENYSTLFSLGWESLFETTVSEEENQEVMNQLIGDGPFYFKLGEIYINEEK

SEQ ID NO: 24951 - protein, 81 aa, Carlito syrichta
GTAAYEDLFGDCTQKEAKGLSLSQKSLYASMILVNYCSMVSLADANIMEHSELTLKQEISKGLESSDRTSGGLFGVVPGEP

SEQ ID NO: 24952 - protein, 81 aa, Carlito syrichta
IQELLTFEDVAVDFTHEEWQYLNPPQRTLYRDVMLETYSNLVFVGKQVTKPDLILKLEVEECPAEVKIPVWSFPEEVFQGE

SEQ ID NO: 24953 - protein, 81 aa, Carlito syrichta
AQGSVSFEDVTVELTREEWQQMGPRERSLYRDVTLENYGHLVAVGCCITKPKVILKLEEGEEPWSLEVTFLNRKYPGLNSN

SEQ ID NO: 24954 - protein, 81 aa, Carlito syrichta
SQESVTFQDVAVDFTEKEWPLLDSSQRKLYKDVMLENYSNLTSLGYQVGKPSLISHLEQEEESRTEERGTHQSTYPDWETP

SEQ ID NO: 24955 - protein, 81 aa, Mustela putorius
SQGLLTFRDVAIEFSKEEWGRLTHTQRQLYKDVMLENYGHLHFLGLLLSKPDLIMFLEQEKQLWDVKRKESGGFHPALSSH

SEQ ID NO: 24956 - protein, 81 aa, Mustela putorius
QVSVAFQDLAVRFSEEEWQLLGEGQRALYRDVMRENYETLRSLGTDGLLPLSAFLSPAEPGGAVAGRRYAGEGQETPRGGG

SEQ ID NO: 24957 - protein, 81 aa, Tupaia chinensis
MLETYGILVSLGHSIIKPEVIFKLEQGAEPWIVDLPNQSLPCQLAHTGEEGWHEESSADIGRVELFSPFVFPGLKSEDSWS

SEQ ID NO: 24958 - protein, 81 aa, Tupaia chinensis
RPRAVKFPDVAVYFSPEEWGCLRPEQRALYRDVMRENYGHLGALGCAGPKPALISWLERNTDDWEPAALDPQEYPRGITIQ

SEQ ID NO: 24959 - protein, 81 aa, Tupaia chinensis
LQGFVSFEDVAVDFTWEEWQDLEDAQKTLYKDVMLETYSNLVFLGHCIAKPAVIFKLEQGKEPWTLEELPNQRLSGEKPYE

SEQ ID NO: 24960 - protein, 81 aa, Tupaia chinensis
YSGFVNPGFISFEDVAMDFTWEEWQVLEDAQKTLFKDVMLETYNSLMFLGQSIAKPAVIFKLEQGGDPWTLEELPSLSLPG

SEQ ID NO: 24961 - protein, 81 aa, Odobenus rosmarus
LPDLVTFEDVAVEFTREEWALLDPSQRTLYRDVMRENCRNLASLGYHIDKPSLISHLEQEDKVMTEERGILPGTCPDLETV

SEQ ID NO: 24962 - protein, 81 aa, Delphinapterus leucas
DPEQVTFEDVVVEFTWEEWGQLEPAQRTLYRDVMLETFGLLASVGHWLPKPDVISLLEHKAELWVVDKGAPQGVCTDFETR

SEQ ID NO: 24963 - protein, 81 aa, Carlito syrichta
LVTFGDVALDFSQEEWEWLNPSQKDLYRDVMLENYRNLVWLDWESWCEIKELSPKWFTDEDEISQGMEMESLTSHDLECSN

SEQ ID NO: 24964 - protein, 81 aa, Carlito syrichta
MLENHRNLVFLGLAVSKPDLITCLEKKKEPWDVKRHGTLVKLPAVTSHYTEGLLPENSIEDSLSKVPMGKYVIHTGKKPYK

SEQ ID NO: 24965 - protein, 81 aa, Carlito syrichta
MDTSQRNLFRDVMLENIKHLVSIGYELCKSDMIFQLEQGKELWREGVLLQGQSLGRKSALKQEMTFMHQMSRKHTPAIRST

SEQ ID NO: 24966 - protein, 81 aa, Carlito syrichta
MQENYGILVSLGYPIPKPDLIFRLEQGEEPWVPDSPRPEEGDIVTGVYTGAWFWTDDIEDHEEEDDEDFLAEVAEEENEPP

SEQ ID NO: 24967 - protein, 81 aa, Carlito syrichta
FQGLLSFKDVAIEFSPEEWACLNSPQRILYRTVMLENHRNLVFLGLAVSKPDLIAFLEQRKEPWDVKSHDTLAKLPAVNSH

SEQ ID NO: 24968 - protein, 81 aa, Carlito syrichta
SWGSLSFMDVFVDFTWEEWQLLDPTQKHLYRSVMLENYSNLVSLGYQHTKPDVIFKLEQEELCVVQSKTPSQGHPDKVWKT

SEQ ID NO: 24969 - protein, 81 aa, Carlito syrichta
VAGSVSFTDVTVRFTQEEWQHLNPGQRTLYEDVMLENYSHVVSVRCCVTKPELVFKLEQGEEPWIAEEESSSQSHPEFWKV

SEQ ID NO: 24970 - protein, 81 aa, Carlito syrichta
NAGLLTFRDVSIEFSEEEWVFLDPTQRVLYRNVMLENHRNLVFLGLTASKPDLITCLEQRKEPWKMKKHSTSAKPPGLAVS

SEQ ID NO: 24971 - protein, 81 aa, Carlito syrichta
MLENYRHLVSVGYRVNKPNAIFKLKQGKEPWILEVEFPHQNFPEDLWDIHDLEAGYQESQAGNSRSGELNKHQKTHTGEKT

SEQ ID NO: 24972 - protein, 81 aa, Carlito syrichta
QDGVTFEDVAVNFSREEWSLLNEDQRCLYREVMLENVALIFSLGHWHGAEDEEAPSKQSISIQRESQVRTPRTGVSPRKSH

SEQ ID NO: 24973 - protein, 81 aa, Gulo gulo
SQSLVTFGDVAVDFSREEWEWLSSAQRNLYRTVMLENYRNLVSLGLCISKPEMISSLEQRKEPWMAKRRLTRGRCPDLKIV

SEQ ID NO: 24974 - protein, 81 aa, Gulo gulo
FQESVTFKDVTVDFTQEEWKQLDPVQRDLFRDVTLENYTHLVAIGLQVSKPDVISQLEQGTEPWTVEPGIPGGAFRDCETR

SEQ ID NO: 24975 - protein, 81 aa, Erinaceus europaeus
SLGMVSFDDVMVTFSLEEWQLLSTSQRTLYRTVMLDTYSSLAALGHCAVKPGVIIKLEQGAEPWMGAQAPPRSLSDPCGPS

SEQ ID NO: 24976 - protein, 81 aa, Erinaceus europaeus
GQEPVTFWDVAVDFSQEEWGQLDPVQRTLYRDVMLETYGHLLCVGSQTVKPKVISLLERGAEPWPVGQAAAPGSCPEWMRN

SEQ ID NO: 24977 - protein, 81 aa, Mustela putorius
QGPMLFEDLAVYFSQEEYVSLHPAQRSLSRDTTQECFKDVVLMGGEGKTETSQRLNLESTGFEELAAENSSITVPLVYYPE

SEQ ID NO: 24978 - protein, 81 aa, Mustela putorius
KSQGLLSFSDVAVDFTWEEWQLLDTVQRNLYRDVMLENFSNLMSLGYQVTRSEAMVHLEKEQGVLEREFPSSSSPERPRQC

SEQ ID NO: 24979 - protein, 81 aa, Mustela putorius
AEDHMTFEDVAVHFSWEEWGLLDEAQRLLYRDVMLENFALMASLGLASSSAHAITQLEWWREPFVPPCAVLTAATPRGWHH

SEQ ID NO: 24980 - protein, 81 aa, Mustela putorius
MAHLMMFRDVAVDFSQEEWECLDLEQRHLYRDVMLENYSNMISLGLCIYQPDVFSLLEKGKEPWMVSQDETGGPCPDMQSR

SEQ ID NO: 24981 - protein, 81 aa, Mustela putorius
LEESVTFKDVVVLFTRDEWAQLSPTQRALYRDVMLENYSNLVSLGLLGPQSDVFSRLGKGEEWMLEDTSGSFCLDWMTMPV

SEQ ID NO: 24982 - protein, 81 aa, Mustela putorius
RPELVTFEDVAVYFSENEWTSLAPTQRVLYRDVMLENYGAVASLAVPFPKPALISQLERGEAPWCKAPQGALDGEGPRGIS

SEQ ID NO: 24983 - protein, 81 aa, Mustela putorius
TQGNVTFEDVALYFSWEEWDLLDEDQRCLYHDVMLENFALTSSLGCWLGVKDEHAPSEESIPIGVSEIGTLKADSPSQKAQ

SEQ ID NO: 24984 - protein, 81 aa, Mustela putorius
TVTFRDVTVDFTQEEWQQLEPAQKDLYRDVMLENYRNLVSLDLETRPEMKESGPQEDSAEDRPPAGVVTERPPRHGARGVA

SEQ ID NO: 24985 - protein, 81 aa, Tupaia chinensis
SQGSLSFGDVAVGFTRREWQQLDPTQRTLYRDVMLENYSHLVSVGCQGSKPAVISRLEQEKDPWMEEEEMYRWSFSEEVWQ

SEQ ID NO: 24986 - protein, 81 aa, Tupaia chinensis
MLENYNHLVSLGLSISKPDVVSLLEQGKEPWLGKGDVRRDLFSVSESNGEIKEFLPKSVIYKGDSSQYLIMEKILSQSPRY

SEQ ID NO: 24987 - protein, 81 aa, Vicugna pacos
AHDLVMFRDVTVDFSQEEWECLNSNQRNLYRDVILENYSNFVSLDLESRYDARKLSQVKDICEMNLSQWEIMERIRSCGLE

SEQ ID NO: 24988 - protein, 81 aa, Vicugna pacos
KCQEVTFSDVAVTFTREELGLLDSAQRELHRDVMLENFRNLLSVGHPSFRLGLILQVGREEKLWAMETETQGGHRNPNELE

SEQ ID NO: 24989 - protein, 81 aa, Carlito syrichta
PKVPVSFEDVSVYFTKAEWKLLDLRQKILYKQVMMENYSHLVALGFSFSKPHLISQLERGAGPWVANFRISRATTGPQAGD

SEQ ID NO: 24990 - protein, 81 aa, Carlito syrichta
KAQESLTLEDVAVPFTWEEWQLLGPAQKDLYRDVMLENYKNLVSVGYQASKPDALSKLEQGEPWTVEDEIHSQVNSEIKNS

SEQ ID NO: 24991 - protein, 81 aa, Carlito syrichta
ALEAVTFRDVTVDFTQEEWQQLEPAQKDLHREVMLENYRNLVSLETIIERQKMEKETMKDKRFSTVKKRSHILINRNGQQL

SEQ ID NO: 24992 - protein, 81 aa, Carlito syrichta
EMGLLSFKDVAIEFSPEEWECLDSPQRILYRTVMLEIHRNLVFLGIAVSKPDLITCLEQRKEPWDVKRRGTLAKLPAVTSH

SEQ ID NO: 24993 - protein, 81 aa, Carlito syrichta
YEESVTFKDVAVDFTQEEWGQLDSPQRALYRDVMLENYQNLLALGPPVHKPDVIFYLERGEEPWYVQREVPGGPCPEWEPR

SEQ ID NO: 24994 - protein, 81 aa, Carlito syrichta
PKVPVTFDDVAVYFSEQEWGKLEDWQKELYKHVMRGNYETLVSLDYAISKPEVLSQIEQGKEPCNWRRTGPKIPDVPVDPS

SEQ ID NO: 24995 - protein, 81 aa, Carlito syrichta
FQGRLTFSDVAIEFSQEEWKCLDPAQRALYRDVMLKNYRNLVSLGISLSKMNIVSMLEHLIFCVNLKNKPIGNQNKLTFWS

SEQ ID NO: 24996 - protein, 81 aa, Carlito syrichta
MAHLMMFRDVAIDFSQEEWECLDLKQRDLYKDVMFENYSNMVSLGLCIYQPNVFSLLEKGKEPWKILRNETRRLCPDLQSR

SEQ ID NO: 24997 - protein, 81 aa, Delphinapterus leucas
CEGSVSFEDVTIDFSREEWQQLDPAQRRLYQDVMLEIYSHLFSVGYHIPNPEIIFRMEKRKEQWMREAELPRQRYHEGESG

SEQ ID NO: 24998 - protein, 81 aa, Carlito syrichta
EMVLLTFRDVAIEFSLEEWDCLDPAQRNLYRDVMLENYRNLVSLDLAMSTPDLITCLEQSKEPWNLERQEIVAKHPVSSHF

SEQ ID NO: 24999 - protein, 81 aa, Carlito syrichta
MFEDVFVYFSREEWELLDNAQRFLYQDVMLENFALLASLGIAFSRSHVIMQLKEGEEPSVPAQMNVTPATEREALRGPGPG

SEQ ID NO: 25000 - protein, 81 aa, Carlito syrichta
SEHLVTFEDVAVDFTQEEWTLLDQTQRDLYRDVMLENYKNLVTLGSELCKPNLMSRLERVEELRTGGRGVLHELDLQLKTK

SEQ ID NO: 25001 - protein, 81 aa, Gulo gulo
PRDSVTFEDVAVRFSGGEWRRLTRAQRRLYAAVMLENYGLLVSLGFAGPKPPLISCLERGEPRVRDLQDWGLLSCSFPVSA

SEQ ID NO: 25002 - protein, 81 aa, Cervus elaphus
MKGPVTFKDVTVEFTHEEWKLLDTAQRTLYREVMQENYSHLISVGYCANRPNAIFKLKQGKEPWILEVQFPRQNNPGLTHH

SEQ ID NO: 25003 - protein, 81 aa, Cervus elaphus
VFLQVSFEDVTVDFSQEEWQHLDPVQRCLYRDVTLETYSHLCAVGYQVPKPEVIFRLEQGEESWTLGKETPHHSCSDEDIG

SEQ ID NO: 25004 - protein, 81 aa, Colobus angolensis
ELVMFRDVAIDVSQEEWECLNPAQRNLYKEVMLENYSNLVSLGLSVSKPAVISSLEQGKEPWMFVREETGRWCSDLASRDE

SEQ ID NO: 25005 - protein, 81 aa, Colobus angolensis
QDTVAYEDLSVGYTQKKWKGLALSQRALQWNMMLENDHSMASLGRNMMESSELIPKQEIFKGSESSNSTSGGLFGVVPGEA

SEQ ID NO: 25006 - protein, 81 aa, Colobus angolensis
LEDVAVDFTWEEWQLLGPAQKDLYRDVMLENYSNLVAVGYQASKPDVFFKLERGEPPWTTEDGLHGGACSEIWKVDDHVLK

SEQ ID NO: 25007 - protein, 81 aa, Colobus angolensis
YVGLQFQGSVTFEDVAIAFSQQEWESLDCSQRGLYRDVMLENYRNLMSMGHSLSKPHVITLLQQWKEPEVTVRTDERRWCT

SEQ ID NO: 25008 - protein, 81 aa, Mustela putorius
VQSRVVLEDVAICFSQEEWGLLDEAQRFLYHAVMLETCALLSSVGCWHGAQDEESPSEQGDPIGGSQVRTLTPGPPTQKSQ

SEQ ID NO: 25009 - protein, 81 aa, Mustela putorius
HELVTFRDVVITFSPEEWEYLDSAQRNLYWDVMMENYSNLVSLDLDSNYDKKCLSTRKDITENSGSQCKVTESKFIGLESS

SEQ ID NO: 25010 - protein, 81 aa, Mustela putorius
EMSNGSQIVRSQDSLTFQDVAVNFTREEWNQLYPAQKILYRDVMLENYRNLVALGHQLYKPEVISQLEKEEQRGMERDSAV

SEQ ID NO: 25011 - protein, 81 aa, Mustela putorius
AQGLVTFRDVAIEFSQEEWKCLEPAQRDLYRDVTLENFSNLASLGLSISKPDVISLLEQGKEPWMITNDMTGPWCPGEQGV

SEQ ID NO: 25012 - protein, 81 aa, Mustela putorius
RPQELIAFQDVAIDFSQEEWGQLSPGQKVLYWDVMLENYRNLISLGICGFENFISDWGTGSDNRIPSKHNISEESPQKKGH

SEQ ID NO: 25013 - protein, 81 aa, Mustela putorius
PLESVTFEDVAIDFTKEEWALLDISQRKLFRDVMLENIRHLVSLGYQHCKSDLIFQLEQGQELRSEGTGFLQGQSPGRGNA

SEQ ID NO: 25014 - protein, 81 aa, Mustela putorius
FQGSVTFRDVAIDFSQEEWEWLQPAQRDLYRHVMLENYGHLVSLGLNISKPHVVSLLEQGRDPWPDNGAVGGGLFSESKGE

SEQ ID NO: 25015 - protein, 81 aa, Mustela putorius
SQALVSFKDVAVDFTQEEWQQLDPAQRTLYRDVMLENFSHLVSMGYPVSKPDVISKLEQGEDPWIIKRDMPDWIYLDENQA

SEQ ID NO: 25016 - protein, 81 aa, Mustela putorius
AQISVTFDDVAVTFTQEEWGQLDPAQRTLYQEVMLENCGLLVSLGCPVPRPELIYQLEHRQELWMLKGHLSQSAYADVKGK

SEQ ID NO: 25017 - protein, 81 aa, Mustela putorius
LQGQLTFRDVAIEFSEEEWRCLTHTQRQLYRDMMLENYRHLLFLGLIVSKPDLVSFLEQKKDPWDVKRKKTVVFDPGRWEW

SEQ ID NO: 25018 - protein, 81 aa, Mustela putorius
ELLSFEDVAMYFTREEWNKLDWAQKDLYRDVMLENYRNMILLGSEIRCRMKKPTPKQKISEDSESCKTSVVKQTLAKRPAE

SEQ ID NO: 25019 - protein, 81 aa, Mustela putorius
WAGSVTFRDVAIDFSQEEWEFLDSAQRDLYRDVMWENYSNFISLAEPSISKPDVITLLDEGKEPWMVVREGTRRHCSDLES

SEQ ID NO: 25020 - protein, 81 aa, Tupaia chinensis
LQGLVSFEDVAVVFTWEEWQDLNDAQKTLYRDVMLETYSILVSLYVQKVDEQIERSQQNQGRCLHQVVITNINMSTNKTTE

SEQ ID NO: 25021 - protein, 81 aa, Odobenus rosmarus
AVTFKDVAVVFTEEELALLDKAQINLYQDVMLENFRNLVSVGDRIKNNISHLQGKGLSYLSQEVLYCWQIWKQRINELTVS

SEQ ID NO: 25022 - protein, 81 aa, Odobenus rosmarus
DPVTFEDVAVEFTQEEWILLDQTQRRLCRDVMLENYKSLAAIDWEICLNTKWSAPQQNILQGKTPNVVEMERSHTGEELFN

SEQ ID NO: 25023 - protein, 81 aa, Odobenus rosmarus
SQESVTFEDVAIDFIEEEWALLDISQRKLFRDVLLRGLTFKSSFYSSLVKPTLDLVIAKVNLHRTQVHILFFLHKRNKICK

SEQ ID NO: 25024 - protein, 81 aa, Odobenus rosmarus
LEVCVISEDVFVSFSREEWMLLDDSQRLLYQDVMLENFALLASLGIVSSRSHSVAQLEQKEDPQMPAQVDMTPVSEREAQK

SEQ ID NO: 25025 - protein, 81 aa, Carlito syrichta
IQDSVVFEDVAVDFTQEEWALLDLAQRNLYRDVMLENFRNLASLGYPLHTPYLISQWKQEEDLETIKRELLHGICTGEHLE

SEQ ID NO: 25026 - protein, 81 aa, Carlito syrichta
GGPVSFEDVAVVFTEAEWKRMSLEQRNLYREEMLENARNLVSLAESKPAEVHFWLSCPLAFGSQQFLSQDELHNHPIPCFH

SEQ ID NO: 25027 - protein, 81 aa, Delphinapterus leucas
GVMESVTLEDVAVGLIQEWALLDDTRRNLYRYVLLDNCRTLAPRGTPSCKACLVSQVGPREELMTAEQGILCATGVDWESQ

SEQ ID NO: 25028 - protein, 81 aa, Delphinapterus leucas
LSFEDVALYFTREEWDTLDWAQKDLYRDVMLDNYRNVLSLGPEARFKMKDLTPKQNISEDLESCKMSLVKQKMARKPLEKL

SEQ ID NO: 25029 - protein, 81 aa, Carlito syrichta
MSKDLVTFGDVAVNFSQEEWEWLNPAQRNLYRRVMLENYRSLVSLDVISLLEQGKEPWMVKKEGTRGACPDWEYVFKSRQF

SEQ ID NO: 25030 - protein, 81 aa, Carlito syrichta
SQELVTFEDVAVYFIRKEWKRLEPAQRDLYRDVMLENYGNVFSLDGETRTENDQEISEDTGPHGVLLGRFQKDISQGLKCK

SEQ ID NO: 25031 - protein, 81 aa, Mustela putorius
MDPSQRNLHKDVMLENYRNLVSLGLAVSKPDMISHLEAGKGPWVVVREIARTSYPEFETKPATKNALSTEDVFEDVSQETI

SEQ ID NO: 25032 - protein, 81 aa, Tupaia chinensis
PKVPVAFDDVSIYFSTPEWEKLEEWQKELYKNIMKGNYESLISMDYAMNQPDVLSQIQPEGGHNTEDPAGPEESEIPADPS

SEQ ID NO: 25033 - protein, 81 aa, Tupaia chinensis
EAVTFGDVAVLFTQEEWGRLSPAQRALYRDVMLENYSNLVSLGKEIGSQQVLHSHQSSPLGAGEQEGVEPGKGCLLGSSRV

SEQ ID NO: 25034 - protein, 81 aa, Odobenus rosmarus
AQESVTFRDVAVFFSQDEWLRLDSAQRTLYREVMLENYDTLVSLGILFSKPKVIFQLQQGEDPWMVENGVSQGPCVGWERL

SEQ ID NO: 25035 - protein, 81 aa, Odobenus rosmarus
FQGSVTFRDVAIDFSQEEWEWLQPAQRDLYRHVMLENYGHLVSLGLDISKPYVVSLLEQGREPWLVKGDVRRDPFSVSESN

SEQ ID NO: 25036 - protein, 81 aa, Odobenus rosmarus
TQDSVVFEDVAVDFTQEEWALLDFAQRSLYRDVMLENFQNLASLGYPLQTPYLISQWKQEEDLETVERGPIQGEHQEGFEI

SEQ ID NO: 25037 - protein, 81 aa, Carlito syrichta
AQGCVTFEDVTIYFSQEEWGLLDEAQRLLYYDVMLENFALIASLGLRSFRSHIIAQLEMGKEPWVPDSVDMTLAMARGAYS

SEQ ID NO: 25038 - protein, 81 aa, Carlito syrichta
KEAFVAFRDVVVDFTQEEWTLLSPAQRTLHREVMLETYNHLVSLEIPFSKPKLIAQLEQGEEPWRKEGKQQLDFWAAGSKP

SEQ ID NO: 25039 - protein, 81 aa, Carlito syrichta
FKEAVTFKDVAVAFTEEELGLLDSAQRKLYRDVMLENFQNLLSVGHQSFPADIFHFLREEKFYMRNTANQREGNLGGKIQT

SEQ ID NO: 25040 - protein, 81 aa, Delphinapterus leucas
SQRPVTFKDVAVDFTQEEWQYLDPPQRDLYRDVMLENYINLISVGYKTTKPALIYKLEQGEEPWMVEREISSWRYPEKVWQ

SEQ ID NO: 25041 - protein, 81 aa, Carlito syrichta
MEFTWEEWQLLDSTQKYLYRDVILENYNNLVAVGYHGTKPDLIFKLEQGEEPWIINATISSQNCPEDWEEWYQESQDEFES

SEQ ID NO: 25042 - protein, 81 aa, Delphinapterus leucas
HVIFEDVAVSFSQEEWGLLNDAQRLLYCDMMLENLSLIASLEQVTEDRNPKLEPSILKPLYSDTSVLVEKDVLYLADNMFT

SEQ ID NO: 25043 - protein, 81 aa, Delphinapterus leucas
RSQESLTFQDVAVEFTREEWDQLYPAQKNLYRDVMLENYRNLVALGHQLYKPEVITQLEQEEQWMMERDSPPDSHPDGENS

SEQ ID NO: 25044 - protein, 81 aa, Carlito syrichta
TQDLMTFEDVAVEFSWWEWRQLDPAQKELYREVMLENFRNLAFLGLPVSKPYVICQLEEGEEPCVLEKEISTGAHSDWEKR

SEQ ID NO: 25045 - protein, 81 aa, Carlito syrichta
ERGLLSFKDVAIEFSPEEWECLDPPQRILYRTVMLENHRNLVFLGLAVSKPDLITCLEQRKEPWDVKRHGTLAKLPAVTSH

SEQ ID NO: 25046 - protein, 81 aa, Carlito syrichta
MASACSKRFVQMCNVGELWSFGLTGMQGLILNLFHFLQAGLSVSKPDVVSLLEQGKEPWLGKGDVRGDLFSVSNCEIKDFS

SEQ ID NO: 25047 - protein, 81 aa, Carlito syrichta
MLAAALLKAKSQEWKRLEPAQRDLYRDVMLENYGNVFSLDGETRTENDQEISEDTGPHGVLLGRFQKDISQGLKCKEAYEQ

SEQ ID NO: 25048 - protein, 81 aa, Carlito syrichta
IQELLTFEDVAVDFTHEEWQYLNPPQRTLYRDVMLETYSNLVFVGKQVTKPDLILKLEVEECPAEVKIPVWSFPEVFQGEE

SEQ ID NO: 25049 - protein, 81 aa, Carlito syrichta
MLENINHLISVGYQLQKSDVIFHLKQGEMLWMVEGIEFPQGQSPGRKSAHKEQEMITTQHITMKDTATIKSVKSYTQDLFK

SEQ ID NO: 25050 - protein, 81 aa, Gulo gulo
AHGSVMFNDVSIVFSQEEWEYLDLEQRDLYRDVMLENYSNLVSLGCFISKPDVISLLEQGKEPWKVVRKGRRQYPDLETRY

SEQ ID NO: 25051 - protein, 81 aa, Gulo gulo
TVTFRDVAVVFTEEELALLDRAQINLYQDVMLENFRNVVSVGDRIKNNTSHLQGKALGSLSQEVLYCWQIWKQRISEFTVS

SEQ ID NO: 25052 - protein, 81 aa, Erinaceus europaeus
SQGSVTYEDVTVIFTQEEWALLNPSEKKLYRDVMWENFRNFLSIGKKHQECEVYNKLFTYSGHRQKHERTHKGVKPYECKQ

SEQ ID NO: 25053 - protein, 81 aa, Bacillus weihaiensis
TAVVVDEAFIHFVRSEFEDLTSLQKTYDNLILLRSLTKIFSIPGLRLGYVIAHEKIIRTLKGNQIPWSINSVVINLLPTLF

SEQ ID NO: 25054 - protein, 81 aa, Roseimicrobium sp. ORNL1
PICQDERQYVGLNGQEWTTLETMQRGGWKNVFKEQEPNVIGIGTEPKMGIGQRTLLLRTPKGNILWDCVSYLDEDTIREVK

SEQ ID NO: 25055 - protein, 81 aa, Anopheles stephensi
PNGFAGKEAWLQFNICLQQSSNWPQHVHLRQGLGEAARRGQGARDGSAGKEHLQEPVAFAEVAVYFSREEWALLDPAQRAL

SEQ ID NO: 25056 - protein, 81 aa, Ixodes ricinus
LDPAQRDLYRDVMLENYSNLLSMGLYIPKPQVISLLEQGKEPWMVGRELTRGPCSDLESMCETKLLSLKKEVYEIESCQRE

SEQ ID NO: 25057 - protein, 81 aa, Ixodes ricinus
SEVSVSFKDVTVDFSREEWQHLDPAQRRLCRDVTLENYSHLLSVGYKVPKPEVIFKLEQGEGPWTLEGETPHQSCSDEDVG

SEQ ID NO: 25058 - protein, 81 aa, Trichomonas vaginalis
GNDYMFANSTIPFTKQEMNVINTAERRQDVEIEMHNDVSRVNLAKQINAQSKIEFETLLQRQQEEANLKKKQAMLFKDPEG

SEQ ID NO: 25059 - protein, 81 aa, Homo sapiens; identical to SEQ ID NO: 867

SEQ ID NO: 25060 - protein, 81 aa, Homo sapiens; identical to SEQ ID NO: 868

SEQ ID NO: 25061 - protein, 81 aa, Homo sapiens; identical to SEQ ID NO: 869

SEQ ID NO: 25062 - protein, 81 aa, Homo sapiens; identical to SEQ ID NO: 870

SEQ ID NO: 25063 - protein, 81 aa, Syntrophorhabdus sp. PtaU1.Bin058
FWTVDVYVMMSKKKWDSLDPSQRDALTKIMAEYEHKTYEAQIKGQDDITKDLLAKGMKEIKFSPADEKWYINMAYEEGWKA

SEQ ID NO: 25064 - protein, 81 aa, Oryctolagus cuniculus
MMMAFEDLAVYFAWEEWQNMNKVQKILYRDVMLETYSSLLFLGHCITKPDLIFKLEQGAQPWMVSEFLNQNLPKPYECNDC

SEQ ID NO: 25065 - protein, 81 aa, Oryctolagus cuniculus
VAFEDVAVYFSQEEWGHLDEAQRLLYCDVMLENLALLSSLGCWHGAENEKVPSEQDVFVGLSQIMTPKPGLSTPKAHLSEM

SEQ ID NO: 25066 - protein, 81 aa, Pteropus alecto
YEDSVALDDVNVKFTLEEWAFLDRTQKKLYRDVMQETFRNLASIACILEEKWEDHDNDDQHKNHGTNLRLCPASQEYPQNH

SEQ ID NO: 25067 - protein, 81 aa, Ursus maritimus
MPQRCPPVCGLVALEAGFLVFKPELISRLEQGQEPWVLDLKGVEGREGARTFLTDSAVGTASEQACADMGVLKPEPCVAVV

SEQ ID NO: 25068 - protein, 81 aa, Ursus maritimus
ALALVSFKDVAVTFTGEEWRHLDLAQRTLYREVMLETCGLLVSLGHPVPKPELIYLVEHGQELWTVKRGLSKSTFTGASHY

SEQ ID NO: 25069 - protein, 81 aa, Ursus maritimus
FQEPVTFRDVAVDFTQEEWGRLGPAQRTLYRDVMLETFGHLLSLGPELPKPEVISQLEQGAELWAAERGIAQGYCPGGDPG

SEQ ID NO: 25070 - protein, 81 aa, Rhinopithecus bieti
RLESVTFEDVAVYFTQNQWASLDPAQRALYGEVMLENYANVASLVAFPFPKPALISHLERGEAPWGPDPWDTEIQRGISQG

SEQ ID NO: 25071 - protein, 81 aa, Ursus arctos
LQESLTLEDVAVDFTWEEWQLLAPAQKELYRDVMLENYSNLVSVGYQASKPDALAKLERGEEPWAKQEEVPSGTRPELSKV

SEQ ID NO: 25072 - protein, 81 aa, Muntiacus reevesi
AQGSVMFTDVSIDFSQEEWEFLNPDQRDLYKDVMLENYSNLVSMGLYIPKPQVISLLEQGKEPWMIGRELTRGLCSALESM

SEQ ID NO: 25073 - protein, 81 aa, Muntiacus reevesi
EPATFEDVAVDFTQEEWQQLPGNTQEDCQDQGNCNFSLTGCSDLKVDIISKLEHGKDPCIIDVCGKGFIKKSQLVIHQRVH

SEQ ID NO: 25074 - protein, 81 aa, Muntiacus reevesi
ESVTFEDVAVDFTQEEWSLLDKSQKNLFRNVMVETITHLVSVGQSPGECQGPELQGKTVSAGVLRSFLNAQGHIHSRGKLC

SEQ ID NO: 25075 - protein, 81 aa, Muntiacus reevesi
ELLTLEDVAVEFNWEEWQLLDSAQKDLYWDVMLENYNNLVSLEYQGTKSGMLSKLEHGKEPCIIENEMQNRICPGLGKGDS

SEQ ID NO: 25076 - protein, 81 aa, Muntiacus reevesi
GLLTFQDVTIDFTQEEWECLDLGQRELYRDVMLENYGNLACLGLVVSKPDLVTFLEQMKDPWNVRRIETAIYPGMDILHPG

SEQ ID NO: 25077 - protein, 81 aa, Ursus americanus
GCGMNFEDVAIDFSQEEWGLLDETQRLLYCDVMLENFALVASLGCRHGMAPSEQTVPIGESQARASQAGLSQQKIHPCETC

SEQ ID NO: 25078 - protein, 81 aa, Ursus americanus
LLTFGDVAIEFSQEEWGCLSHTQRELYRDVMLENYGHLLFLGEDDSCQISQAPLGVSFLLMPSIEGSSQKVSILENLESYL

SEQ ID NO: 25079 - protein, 81 aa, Ursus americanus
MYFTREEWNRLDWAQKDLYRDVMLENYRNMILLGFQFPKPEVICLLEQWEEPWILDLPRAGTRKASSSACPGSEARCKMKK

SEQ ID NO: 25080 - protein, 81 aa, Ursus americanus
QGCVTFEDVTIYFSQEEWGLLDEAQRLLYCDVMLENFALIASLGKAFAPTRGSELVSDRKLQAALSNQKDYSCDTCGLHLK

SEQ ID NO: 25081 - protein, 81 aa, Ursus americanus
EVISLLEQGEEPWSVEQAYPQSTCPEWMRNLESKPLIPTQSIFEEELSHSMKLERYIWDDPWFSRLEVLGCKDQLEMYHMN

SEQ ID NO: 25082 - protein, 81 aa, Ursus americanus
NFWILRLPPGSKGEIPKEWGKLDEWQKELYKHVMRGNYETLVSLDYAISKPEVLSQTEQGKEPCSWRRTGPKVPDVPVDPS

SEQ ID NO: 25083 - protein, 81 aa, Myotis brandtii
ASLDMKFEDVVIAFSQEQWVLLDEVQRLLYRDVMLEVFTLVSICSPATLLIRPFSCQMCCGCQSRAVWRELTPIVSQNTGS

SEQ ID NO: 25084 - protein, 81 aa, Myotis brandtii
FQASVSFKDVTVGFTQEEWQHLDPTQRSLYRDVMLENYSNLVSVGYCVTKPEVIFRLEQGEEPWILEEEFPSQRLPAIWKP

SEQ ID NO: 25085 - protein, 81 aa, Myotis brandtii
DMNFEDLAIAFSQEEWNLLDEDQRLLYCEEMLEVFALVSSVGCWHKMDEEEVPPEQSVSVGESQVGVSKTAPATQKTYLCK

SEQ ID NO: 25086 - protein, 81 aa, Propithecus coquereli
ELLTFRDVTIEFSPEEWACLDPAQWNLYRDVMLENYRNLFSLGLAASKPDLITCLEQRKEPWKVKRRETVAEHPAVSSHST

SEQ ID NO: 25087 - protein, 81 aa, Propithecus coquereli
VKESVTFKDVAVDFTLEEWRLMDPTQRNLHKDVMLENYRNLVSLGLAVSKPDMIFYLENGKGPWATVKEISRTSYPNLETK

SEQ ID NO: 25088 - protein, 81 aa, Propithecus coquereli
VTFEDVAIYFSQEEWEFLDETQRRLYHNVMLENLALIKSQGCWYGTADDKAPSALSVFEELSQGRTPKAGPSSHKTQPCET

SEQ ID NO: 25089 - protein, 81 aa, Propithecus coquereli
FQEPVIFEDVAVYFTQNEWASLDSMQRALYKEVMLENYANVASLPFPVLKPDLIFQLEQGEAPWVPDPWMSAGGEALRGMC

SEQ ID NO: 25090 - protein, 81 aa, Lynx pardinus
QEPVTFEDVAVYFTQNQWASLDPMQRALYREVMLENYTNMASLGGESRIRNEEPAGKREASEDAEWHRMPGGGLLRNVSQH

SEQ ID NO: 25091 - protein, 81 aa, Saimiri boliviensis
AQESLTLEDVTVDFTWEEWRLLGPTQKDLYRDVMLENYSNLVAVGYQASKPDALLKFERGEESCCRTEDEIYTHVCSEIRK

SEQ ID NO: 25092 - protein, 81 aa, Lynx pardinus
SQGLLTFEDVAIEFSQEELIYLNYSQRELYRDVMLENYGHLLFLGLVVSKPDLVIFLEHKKGVWAVERKETVATHPAVFSP

SEQ ID NO: 25093 - protein, 81 aa, Balaenoptera acutorostrata
MDSLAFEDVAVNFTLEEWVLLDSSQRKLYRDVMRENFQNLVSVETKQEDHDIEDQYKNQGRKLRSPRVEILSGSKGSIFCE

SEQ ID NO: 25094 - protein, 81 aa, Vombatus ursinus
MLENYGNVLLLGFPIPKPDLISQLERGEIPCVPFLPRMKIQVICFDYGSENKVSIPKQDIAKEGKAQRILSAKVPRTICHS

SEQ ID NO: 25095 - protein, 81 aa, Saimiri boliviensis
EEGYVTFEDVAVCFSQEEWRLLDEAQRLLYRNVMLENFSLMASLGLASSKTREITQLESWEEPFMPAWEVMTSAIPRGCWH

SEQ ID NO: 25096 - protein, 81 aa, Saimiri boliviensis
KDVAVVFTEAEWKRLSLEQRNLYKEVMLENLRNLVSLESKPEVHTCPSCPVVFGSQQFLSQDELHNHPIPGFYAGNQPTQE

SEQ ID NO: 25097 - protein, 81 aa, Balaenoptera acutorostrata
QQRPVSFKDVVVGFTQEEWHRLNPAQRALYRDVMLETYSNLVSVGYEGTKPYVILRLEQEEAPWICEASCSGCHCFENIWQ

SEQ ID NO: 25098 - protein, 81 aa, Balaenoptera acutorostrata
SQESVSFEDVAVYFTQNQWASLASAQRTLYREVMLENYANVTSLAAFPFPKPDLIFQLERGEAPGGLDPWTSIRREVRGVC

SEQ ID NO: 25099 - protein, 81 aa, Saimiri boliviensis
MKPGVISHAPDTVVPAAFPFSKPDLIFRLEQGEAAWGSDPWTLAGEEAPRGLCTGGKTKTKTEEQTAQLNISEESESHRLI

SEQ ID NO: 25100 - protein, 81 aa, Oryctolagus cuniculus
SQASVSFKDVSVEFTPEEWQHVSPAQRTLYRDVMLENYSHLVSLGYCIFKPEVIFKLEQGEEAWFSEGDFSSQDLPVLEDY

SEQ ID NO: 25101 - protein, 81 aa, Oryctolagus cuniculus
PKVPVTFDDVAVYFSEQEWGKLEDWQKELYKHVMRGNYETLVSLDYAISKPEVLSQIEQGKEPCTWRRTGPKIPDVPVDPS

SEQ ID NO: 25102 - protein, 81 aa, Oryctolagus cuniculus
FQGAVSFKDVTVGFTQEEWQHLDSSQRSLYRDVMLENYSHLVSVGFCVTKPEVIFRLEQGEEPWILEEEFSNQSFPGIWKA

SEQ ID NO: 25103 - protein, 81 aa, Oryctolagus cuniculus
LQVMIAFEDLAVYFSWEEWQNMNNAQKILYRDVMLETYSSLLSLGHCTTKPDLIFKLERGAEPWMVEECLNQSLPVAMKRD

SEQ ID NO: 25104 - protein, 81 aa, Oryctolagus cuniculus
STVMIAFEDLAVYFTWEEWKKMNNAQKILYKDVMLETYSSLFSLGYCTTKPDLIFKLERGAEPWMVDECLNRSLPVVMKRD

SEQ ID NO: 25105 - protein, 81 aa, Pteropus alecto
GSAAYEFLSVDYSERKWKGPALSQRARRRNVMPETHRSVASWAGDIRMENSELPLKQEISKGSESSDGTSGGLYGVVPGGQ

SEQ ID NO: 25106 - protein, 81 aa, Oryctolagus cuniculus
SQAPVTFEDMAMYLTREEWRPLDPTQRDLYRDVMQENYGNVVSLDFEIRSENEVNPKQEISDDVEFGTTSERPVGNAEENP

SEQ ID NO: 25107 - protein, 81 aa, Oryctolagus cuniculus
MSTLVTFKDVLVDFTKEEWKLLDTVQQMIYKDVMLENYKNLLSLGHPLPKPDVILRLEKGEEPWLVERGFRCKAHSDSETE

SEQ ID NO: 25108 - protein, 81 aa, Oryctolagus cuniculus
SVTFKDVAVDFTQEEWSQLDSPQRALYRDVMLENYQNLLALEGAPRPEVEEAEPPQRRAACQGEAFQEPIMQPARPPGETW

SEQ ID NO: 25109 - protein, 81 aa, Rhinolophus ferrumequinum
SQGPVSFHDVAVDFTQEEWQQLDPEQKTTYRDVMLENYSHLVSVGYDSTKPNVIVKLEQGEEPWIAEGDLPCQSPEEVWKV

SEQ ID NO: 25110 - protein, 81 aa, Rhinolophus ferrumequinum
ARVSVMFSDVSIDFSQEEWESLNDDQRDLYRDVMLENYNNLVSMAGHSISKPDVISFLEQGKEPWLVDREVTGSQCPVLGS

SEQ ID NO: 25111 - protein, 81 aa, Rhinolophus ferrumequinum
MTRPWIEFWGTHHNWVACFFSQPDLAISKPDVISFLEQGKEPWMVERAATRGVCPVLESSYDTKVLSPKQPICEVQSPEWQ

SEQ ID NO: 25112 - protein, 81 aa, Ursus maritimus
QEPVIFRDVAMYFTQKEWQLLKPAQKDLYREVMLENYGNLASLGKDNVPTDRPLRSRRCPSRPPPPTTSQSTPRGTKTLKR

SEQ ID NO: 25113 - protein, 81 aa, Ursus maritimus
LQASVSFKDVTVEFTQEEWQQMGPIQRTLYRDVMLENYNNLVSVGNCIFKPAVIVKLEQGEEPWFLEEKFSNQSHQEDYGD

SEQ ID NO: 25114 - protein, 81 aa, Ursus maritimus
IFRPSQMKVIIFAEGLLDCFIVALLKIYLHFFLQCSQSQFLCDFHLIGYPVSKPDVISKLEQGEDPWTIKRDIPNWIYPDE

SEQ ID NO: 25115 - protein, 81 aa, Ursus maritimus
MDPAPEEWRLLNKAQRHLYRDVMLEVFAIVTSLGCRHGAEDEAAPSEQSISVGRSQINSTQKAYAQEYGMASEGSLRPAEN

SEQ ID NO: 25116 - protein, 81 aa, Ursus maritimus
RLTFRDVAIEFSAEEWECLDPAQRALYRDVMVENYRNLVSLGEENVPPEVGICPNSSARFMIKELLPKKERKNRELCQPVV

SEQ ID NO: 25117 - protein, 81 aa, Ursus maritimus
PQGSAAYQFLSVDYTERKWKGPALSQRAVHQSIMPGNYCSMASLGETRMRRSELPAKQEVSKGPASCDGTSRGVRGVVSEE

SEQ ID NO: 25118 - protein, 81 aa, Ursus maritimus
FQGSVSFRDVAIDFSQEEWEWLQPAQRDLYRHVMLENYGHLVSLAGLNISKPYVVSLLEQGREPWLEKAEVRRDLFSESDG

SEQ ID NO: 25119 - protein, 81 aa, Rhinopithecus bieti
DSVTFEDVAVDFTQEEWTLLDQTQRNLYRDVMLENYKNLVAVDWESHINTRRSAPQQNFLQGKTSSVVEMVRFRRYNLLPS

SEQ ID NO: 25120 - protein, 81 aa, Camelus ferus
PSFHRLRFQFIRSMGWKTRVTREECEKVPRIKSGLEKLGFFFTISGEEGYDSTKPNVIVKLEQGEEPWTVAGELPRPAHPG

SEQ ID NO: 25121 - protein, 81 aa, Myotis brandtii
SRGLVKVKDVPVTWEEWEHLDPVQRDFYRESTLKDYGNTVLPSLETRTENKELIPKQEILEVEPQMQLQERSQGNAPLLSK

SEQ ID NO: 25122 - protein, 81 aa, Myotis brandtii
SDVPQKEQEKMTKFQEAVTFKDVAVVFTEEELALLDPSQRKLYRDVMLENFRNLVSVGEDGRPVTLNDVAVVFTEEELALL

SEQ ID NO: 25123 - protein, 81 aa, Myotis brandtii
DSQVVTFGDLAIYFSQEEWEGLSPEQRGLYKGVMLENYQTLVSLGLCGRKPSMIALLEKGQAPWMERFVRLPCGLGSKCET

SEQ ID NO: 25124 - protein, 81 aa, Propithecus coquereli
IQDSVVFEDVAVDFTQEEWALLDPSQRNLYRDVMLENFRNLASLGYPLHTPHLISQWEQEEDLQPVKRGLSQGICTGEHRE

SEQ ID NO: 25125 - protein, 81 aa, Propithecus coquereli
QAQESLTLEDLAVEFTWEEWQLLGPAQKDLYRDVMLENYSNLVSVGYQASKSDTLSKLERGELWMIEDEICGQICSDIRKI

SEQ ID NO: 25126 - protein, 81 aa, Propithecus coquereli
SVTFKDVAVVFTEEELALLDKAQINLYQDVMLENFWNLVSVGDGIKNNILNLEEKGFSYLLQEMLHCWQIWKQKLHELTVN

SEQ ID NO: 25127 - protein, 81 aa, Propithecus coquereli
YYQDLVTFDDVAVDFTQEEWTLLDTTQRNLYSDVMLENYNNLATVGCQLIKPSLITWLEQEELKAVQGGVFQGWEMQFETK

SEQ ID NO: 25128 - protein, 81 aa, Propithecus coquereli
RPRAVKFVDVAVYFSPEEWGCLRPAQRALYRDVMRETYGHLGALGCAGPKPALISWLERNTDDWEPAALDPQEYPRGVTVQ

SEQ ID NO: 25129 - protein, 81 aa, Vombatus ursinus
MLVTFDDITVYLLQEEWMLLGEQQKEICGSDKLVAPLGTPIANPELFSKLEREVEPWLGDAPGRRKLLSHHLGNKKRRSMG

SEQ ID NO: 25130 - protein, 81 aa, Vombatus ursinus
MLENYGHLVCLGLVVSSPDVISQLERGDAPWTAARDPPRRSRPDGDIRTGTSESAPKLGPSVEEASFERLTRGGSCISSFR

SEQ ID NO: 25131 - protein, 81 aa, Saimiri boliviensis
MGPLQFRDVAIEFSLEEWHCLDTAQRNLYTDVMLENYRNLVFLGIVVSKPDLITCLEQGKKLLTMKKHEMIANPPVICSHL

SEQ ID NO: 25132 - protein, 81 aa, Balaenoptera acutorostrata
SQEQLTFKDVAIEFSQEEWECLDPGQRALYRDVMVETYRNLLSLVISVPDLNIICIVEQEEDPLTVKSDMKIAKNQWVGMY

SEQ ID NO: 25133 - protein, 81 aa, Saimiri boliviensis
SQNAVTFQEVAVDFSQEEWALLDLAQKNLYKDVMLENFRNLTSVGYQLCRHNLIPKVDQQKLKTDEGGILQSDCAEWETQL

SEQ ID NO: 25134 - protein, 81 aa, Saimiri boliviensis
LVTFEDVAVYFSQEEWGLLDAAQRHLYHNVMVENFELITSLGCWHGVEGEEAHPKKNASVEEVLKVRIANADPSTQKANPC

SEQ ID NO: 25135 - protein, 81 aa, Vombatus ursinus
FQEPLTFKDVAVEFTQEEWGQLNSSQKNLFRDVMLENYKNFVYLGLPVSMPAVILLLERGEVPWMSEGEVPRGIHSDSVSQ

SEQ ID NO: 25136 - protein, 81 aa, Vombatus ursinus
ESLTFKDGAVDFTPEEWGCLGPSEKELYRNVMLENYGHLVYLGPLLQTSAYSAPENSCRKERLPIHSRPFKINLRKTSSKE

SEQ ID NO: 25137 - protein, 81 aa, Rhinolophus ferrumequinum
MLENYGNVVSLGFPIFKPDGISQLEQDLLVFDLETKNREVLRDDCSDGETREENKLLIPKQKISEEVHSYKVRVGRLKKDI

SEQ ID NO: 25138 - protein, 81 aa, Rhinolophus ferrumequinum
QESVTFKDVAVDFTVEEWGWLGPGQRELYWDVMLENYQNLLSLGAGLPGSKPDVISRLERGEEPRIEKREAQRVTCPELET

SEQ ID NO: 25139 - protein, 81 aa, Rhinolophus ferrumequinum
AHGSVMFSDVSVVFSQEEWDYLDVEQRDLYRDVMLENYNNLVSLGCFISKPDVISLLEQGKEPWKVVRKERRRYPDLETRH

SEQ ID NO: 25140 - protein, 81 aa, Ursus maritimus
FQELVTFRDVAIDFSRQEWEYLDPIQRDLYRDVMLENYRNLVSLGHSISKPDVITLLEQGKDPWMVVKEDTRRWCTDLESR

SEQ ID NO: 25141 - protein, 81 aa, Ursus maritimus
FNSNTHFLDISVDFTQKEWQLLDPAQRLLYKEVMLENYRQLVSLGHCVTKPELVLKLEQGEKPWAPKRELPSQSCPGEFTR

SEQ ID NO: 25142 - protein, 81 aa, Ursus maritimus
MFGISSTGHSISKPDVITLLEQGKDPWMVVKEDTRRWCTDLESRYEIISCDKVHIYKKHSSFTLHQKIHTREKPYECDTCG

SEQ ID NO: 25143 - protein, 81 aa, Ursus maritimus
FQELVTFRDVAIDFSRQEWEYLDPIQRDLYRDVMLENYRNLVSLAGHSISKPGVVDLLEQGKEPWIILREETQRQYTDLDL

SEQ ID NO: 25144 - protein, 81 aa, Ursus arctos
FQEAVTFKDVAVVFSEEELGLLDPAQRELYRDVMLENFRNLVSVGHSSSKPDVISQLEREEKLCMKETHSERGDRHQKEME

SEQ ID NO: 25145 - protein, 81 aa, Ursus arctos
RPHPRHHLPMDVPEEPVTFEEVSTQFSGEQWQCLDPDQQALSRDMMLDNFGSSASLGSPISLPQPEAMQPHVVPGHSPSRP

SEQ ID NO: 25146 - protein, 81 aa, Ursus arctos
GQGSVSFRDVTVDFTRDEWLRLTGTQRTLYRDVMLENYSHLVSVGCHLSKPEVIFRLEQGEELWPSEGGFPDQCDQDRSRE

SEQ ID NO: 25147 - protein, 81 aa, Ursus arctos
KPGAVSFADVAVYFSPEEWGCLRPAQRALYRDVMRETYGHLGALGFPGPKPALISWMEQESEAWSPDAQDPEEGESLGGAL

SEQ ID NO: 25148 - protein, 81 aa, Ursus arctos
WVESVTFKDIAVDFTQEEWALLDTSQRKLYRDVMLENISHLVSVGYHLCKSDVISQLEQGVELWREGGGFLQGLNPDRKSG

SEQ ID NO: 25149 - protein, 81 aa, Ursus arctos
MQVRFVSVRESCALVGAGPAGPKPGVITQLERGDEPWVLDAQGAKGKERLRVSVSGHETRTEYKELSSGETLDGEELDQLQ

SEQ ID NO: 25150 - protein, 80 aa, Muntiacus reevesi
LSKDPLCHPEGKIEADRMVSKCLRDCSQDSVTFADVAVYFTQEEWTLLNPFQRKLYRNVMLENYKNLTTADTKSQWTGTV

SEQ ID NO: 25151 - protein, 81 aa, Muntiacus reevesi
MDFKDVVIYFSQKEWECLHSAQKDLYRDVMLENYNNLISLAIVISLLEQGKEPWVVKGKDTEAWCPGEENDVISTLQKSIV

SEQ ID NO: 25152 - protein, 81 aa, Myotis brandtii
SLLTFEEVAVYFSQEEWELLDISQKTLYNDVMQENYETVISLAVPTHQILYFPEQTNTKDWTVAPELILPESQTLLTFEEV

SEQ ID NO: 25153 - protein, 81 aa, Myotis brandtii
DMNFEDVAIAFSQEEWGLLDEDQRHLYCDVMLEVFALVSSVGCWHKTEKEDTCSDESISVQGESKFMASKTATATQKTHLC

SEQ ID NO: 25154 - protein, 81 aa, Propithecus coquereli
FQEAVTFKDVAVAFTEEELGLLDSAQRKLYREVMLENFRNLVSVGHQSFKPEMISQLEREEKLWVKEIQTQMGRCRGGRNQ

SEQ ID NO: 25155 - protein, 81 aa, Propithecus coquereli
SQGSVTFRDVAIDFSQEEWKWLQPAQRDLYRCVMLENYGHLVSLAGLSISKPDVVALLEQGKEPWLGKGDVRRDLFSVFSA

SEQ ID NO: 25156 - protein, 81 aa, Propithecus coquereli
SKNLVTFGDVAVNFSQEEWEWLNPAQRNLYRKVMLENYRSLVSLGVSVSKPDVISLLEQGQEPWMVKKEGTKGTSPGWEYV

SEQ ID NO: 25157 - protein, 81 aa, Propithecus coquereli
NFWILRLPPGSKGEVPKEWGKLEDWQKELYKHVMRGNYETLVSLDYAISKPEVLSQIEQGKEPCSWRRAGPKIPDVPVDPS

SEQ ID NO: 25158 - protein, 81 aa, Propithecus coquereli
CQESVTFEDVAVVFTDEEWRHLVPIQRDLYEEVMLENYKSIVSLGLPVPQPDVIFRLKREDWPWIVDLHRSEEKECPQSVS

SEQ ID NO: 25159 - protein, 81 aa, Propithecus coquereli
SQEQVSFTDVCVDFNQEEWSLLDPAQKILYRDVILENYSNLVSVGHCVTKPEVIFKIEQGEEPWILEKGFPRQCYPERKWK

SEQ ID NO: 25160 - protein, 81 aa, Propithecus coquereli
NPGSWEMKLVTFSDVTINFSLCGWACLDPAQRDLCRNVMFENYRNLVFLGLAAFMLDLIACLEQRKEPWDVKRHEIVAKHP

SEQ ID NO: 25161 - protein, 81 aa, Propithecus coquereli
VQEPVTFKDVAVDFTQEEWGQLDLVQRTLYRDVMLETYGHLLSVGNQITKPEVISLLEQGEEPWSVEQAYPQSTCPEWMRN

SEQ ID NO: 25162 - protein, 81 aa, Propithecus coquereli
SQTLVTFDDVLVDFTREEWKLLDAAQQIMYKDVMLENYKNLLSLGHQLPKPDVVLRLEKGEEPWLAERGIHQETPPDLETA

SEQ ID NO: 25163 - protein, 81 aa, Propithecus coquereli
RGIVTFEDVAVYFSWEEWDLLDEAQKHLYFDVMLENFALTSSVGKALTLILVPWTRFCISPFPQEQLCCWHGVEHEEAPSK

SEQ ID NO: 25164 - protein, 81 aa, Propithecus coquereli
PKVPVAFDDVSIYFSTPEWEKLEEWQKELYKNIMKGNYESLVSMDYAMNQPDVLSQIQPEGEQNTEHQAGPEESEIPTDPS

SEQ ID NO: 25165 - protein, 81 aa, Propithecus coquereli
AAQGMTFEDVAICFSQEEWMLLDGAQRLLYCSVMLENFALVASLGYCHGTENEVITSEQKVSVEGMSQVRISEAGPSTQKT

SEQ ID NO: 25166 - protein, 81 aa, Balaenoptera acutorostrata
MIKSQISFEDVAVDFTLEEWQLLNPTQKTLHRDVMLENYSNLVFLGYQMIKPEAIFKLEQEEPWILGEEILSQNFPEEVWL

SEQ ID NO: 25167 - protein, 81 aa, Saimiri boliviensis
MGLLTFRDVAIEFSVEEWEHLEPAQKTLYWDVMLENYRNLVSLGLTVSKPDLITFLEQRKEPWNVKSAETVASQPDMFSHD

SEQ ID NO: 25168 - protein, 81 aa, Lynx pardinus
MLENYSNLASVGYQVGKPSLISHLEQEEELRTEERGLHRATSPDWETPSKSKWSILMEDIFGKETPRGVTVERTRLGEKPA

SEQ ID NO: 25169 - protein, 81 aa, Saimiri boliviensis
QVNFEDVFVYFSQEEWVLLDEAQRLLYRDVMLENFALMASLGKAITSTPVTWTGPSVATGTLSRSGPGNTNLHQHQKQHSG

SEQ ID NO: 25170 - protein, 81 aa, Vombatus ursinus
EQYITFKEMAMKFAAEEWVQLNPSQKKLYRDVMLEYYRKLVSLGFAIYLECQRQIFQETQGDIPDTVHRRIHTGENPYEGS

SEQ ID NO: 25171 - protein, 81 aa, Balaenoptera acutorostrata
MWCWRTTAAASRWGINVSKPDVIFRLEQGEEPWTAEEFSNQNYSEAGDALKEDKEIQGKHLRQIVFFCNKTLITERATVFG

SEQ ID NO: 25172 - protein, 81 aa, Vombatus ursinus
MEICDVAVYLTQKEWEALTPFQQALYRHVVLENYSNMISLAFLFPKPAVISQLEQGGDPWVLDPQGPLDREGTCYTGECTK

SEQ ID NO: 25173 - protein, 81 aa, Balaenoptera acutorostrata
EEGQVTFEDVAVYFSQEEWGLLDEAQRLLYRSVMLENFSLMASLGLTCSRTHEVTQLEQWGEPFMPACGVVITAMPRGCWC

SEQ ID NO: 25174 - protein, 81 aa, Vombatus ursinus
VAFKDVAVEFNQEEWRCLDASQKELYHDVMMENYKNLVCLGKDSFTLSPKICSLEGLCYCKLHSHLQSFRFKVKYFISCND

SEQ ID NO: 25175 - protein, 81 aa, Saimiri boliviensis
YQDSVTFDDVAVEFTPEEWALLDTTQKYLYRDVMLENYKNLASVEWEIQPRTQGLSLQQSFLKNEIFSGIQMTSYSGWKLC

SEQ ID NO: 25176 - protein, 81 aa, Saimiri boliviensis
RQEPVTFEDVAVYFTQNEWTSLDPAQRALYREVMLKNYANMASLAFPFTTPVLVSQLEQGERPWGLDPWEPVGREARRGVC

SEQ ID NO: 25177 - protein, 81 aa, Vombatus ursinus
LQTSLMFKDVAVYLTREEWGCLGPAQRGLYRDVMLENYRNLVSLGFSVSKPDIISQLEKGEEPWVLDIQGAGGREIMKSDY

SEQ ID NO: 25178 - protein, 81 aa, Lynx pardinus
VGDQDFTASVLQAAPQEPWRHLESVQKEQYWDLMLETYGKMVSGGISSSKPDPTGPTEYGEEPAGRHPHLSEKIPRPACLG

SEQ ID NO: 25179 - protein, 81 aa, Saimiri boliviensis
IQGQVNFEDVFVYFSQEEWVLLDEAQRLLYRDVMLENFALMASLGCWPGTKDEEIPFEQSFSIGLSQIKIPKGSPFTQKAY

SEQ ID NO: 25180 - protein, 81 aa, Balaenoptera acutorostrata
GVTFEDIAVYFSWEEWRLLDEAQIRLYLDVMLENYTLISSLGCCCGAEDAEAPFEQIASLGVSQARTPKAALCSQKTHPCE

SEQ ID NO: 25181 - protein, 81 aa, Rhinolophus ferrumequinum
MLETYSHLLSVGYQVPEPEVFMLEQGKKSWTLQDESPHQSCSEKLWQIGDQIESHQQRGNKYLRDGAFIQEIMSTKRDYEY

SEQ ID NO: 25182 - protein, 81 aa, Rhinolophus ferrumequinum
AQGRVVFEDVAIHFSQEEWELLDEAQRRLYHRVMTENVALLSAIGWCHGAQDEEAPSEQGDSVGESQVRTPKPDLSTHRAQ

SEQ ID NO: 25183 - protein, 81 aa, Rhinolophus ferrumequinum
MLENFRNMVSVGHQPFTPDVVPPLEREEKLWMTKPASQSHGSLGDKNLNDTKIVQEVGLRYLSHEELFCSQIWQQVTKELA

SEQ ID NO: 25184 - protein, 81 aa, Rhinolophus ferrumequinum
ALLDPSQKKLYRDVMRETFRNLASVGMPDNLIFTLLEAKCFLSHKIERLCESKEGSQCEKNFSRVPNLNLKRKTLSRVEPW

SEQ ID NO: 25185 - protein, 81 aa, Rhinolophus ferrumequinum
AQGYVTFEDVAVYFSWEEWGLLEEAQRLLYRSVMLENFALVASLGLASSGTHEITQLERWGEPFLPAPGVMTMAAPKGCWY

SEQ ID NO: 25186 - protein, 81 aa, Rhinolophus ferrumequinum
QDTVVFADVAVNFTREEWALLDGAQRKLYREVMLETCRNLASVDCFTQVKTSASCPQQDNLEKEISSEQKIVKFTRNDFCS

SEQ ID NO: 25187 - protein, 81 aa, Ursus maritimus
SVTFRDVTVDFTQEEWQQLEPAQKDLYRDVMLENYRNLVSLDLETRPEMKESGPKEDSAEDRPSAGVVVEGPTRNGAHGLA

SEQ ID NO: 25188 - protein, 81 aa, Ursus maritimus
MLENYGNLVSVGLLSSKPKLITQLEQGAEPWMEVQQIPSDTCSVQEYWFETKMSTLKQHASEGSDLGEQTKSDVMERDLDW

SEQ ID NO: 25189 - protein, 81 aa, Ursus maritimus
PGGLLTFGDVAIEFSQEEWRCLSHTQRELYRDVMLENYGHLLFLGLIASKPDLVSCLEQKKEPWDLKRRKTVVIHSGSFMP

SEQ ID NO: 25190 - protein, 81 aa, Rhinopithecus bieti
TQGQVTFKDVAIEFSQEEWTCLDPAQRTLYRDVMLENYRNLASLGISCFDLSIISMLEQGKEPFTVESQVQIARNPDGWEW

SEQ ID NO: 25191 - protein, 81 aa, Rhinopithecus bieti
RNVMLENYKNLVFLGIDVSKQDPITSLEQEKEPWNMKRHEMVDESPGYMCRMCSYVFLFYQRPLARARHKRFFSTSDTEKV

SEQ ID NO: 25192 - protein, 81 aa, Ursus arctos
STEPVIFRDVAMYFTQKEWQLLKPAQKDLYREVMLENYGNLASLGYRLFKPKLITRLEQGDEPCVKERDVPRAPLQGDAGI

SEQ ID NO: 25193 - protein, 81 aa, Ursus arctos
MDSVAFEDVTVKFTMEEWALLDPSQKKLYRDVMQETFRNLASIECISEEKWEIHDREDQDEDHGTNLSSQMVERLCKSKEY

SEQ ID NO: 25194 - protein, 81 aa, Ursus arctos
SQGRLTFRDVAIEFSPEEWECLDPAQRALYRDVMVENYRNLVSLGEDSFPPEVVSSCCIKKCFLKTPGRVVSMSQDAEMEG

SEQ ID NO: 25195 - protein, 81 aa, Ursus arctos
SHGPLSFEDVAIAFTKEEWQQLDPAQRTLYRDVMLENFSHLVSLGHPVSKPDVISKLEQGEDPWIYPGRETRLENPQLDIL

SEQ ID NO: 25196 - protein, 81 aa, Ursus arctos
LVMFEEVSVCFTSEEWECLGPIQRALYWDVMLENYGNVTSLEWETMTENEEVTPKPSISQRADSQKGTSRRLQGGAPQTPG

SEQ ID NO: 25197 - protein, 81 aa, Muntiacus reevesi
SQSLLTFEEVAIYFSQEEWELLDPAQKALYNDVMHENYETVISLLLFVLPKPKAISCLEQGEEPYIQGSPVFKDNPGALLS

SEQ ID NO: 25198 - protein, 81 aa, Ursus americanus
MDRSQRKLYIDVMLENITHLVSVGCQFFQSDVISQWEQGGELWREDRGFAQGWNPGLENSHKKEETISMQDIFKEDPSNYN

SEQ ID NO: 25199 - protein, 81 aa, Ursus americanus
RRPSGHVTFEDVAVYFSQEEWRLLDEAQRHLYRTVMLENLALIASLGWWHGVKAEEALSEQCVFVERVSQASTPDPGLSIP

SEQ ID NO: 25200 - protein, 81 aa, Myotis brandtii
ELLQESLTFHDVAVDFTWEEWQLLDSEQKDLYRDVMMETYSHLVSVGEDSSHVSLKRRPDSASPGRSGSFWTPSRRTCTGT

SEQ ID NO: 25201 - protein, 81 aa, Eschrichtius robustus
FQGPVTFKDVTVEFTQEEWQLLDAAQRTLYREVMQENYRHLISVGYCVNKPNAVFKLKQGKEPWILEVEFPCRNYPEDLWN

SEQ ID NO: 25202 - protein, 81 aa, Myotis brandtii
FQESVTFEDVAVYFTQNQWASLDPVQRALYRDVMLENYANVAALVAFPAPKPDLISQLERGSAPWRPDPWEAEVLRGICPG

SEQ ID NO: 25203 - protein, 81 aa, Myotis brandtii
QLTFSDVAIEFSQEEWACLDPAQRKLYRDVMLQNYRNLVFLALSSQVTQGLFLKSDVEDSFQKMQQSSHNEERSNQCNDYF

SEQ ID NO: 25204 - protein, 81 aa, Propithecus coquereli
HLVTFEDVAVDFAQEEWTLDLYRNAMLENYRNLITLGKSGIVSSLSPSENECSLNFFSKPIFFILFSELNLQIKTKGSTLL

SEQ ID NO: 25205 - protein, 81 aa, Propithecus coquereli
FQESVTFQDVAVDFTPEEWQLLDCAERTLYWDVMLENYRNLISVGCPVTKTKVIFRVEQGQEPWMVEGGNSCWSHPKADCP

SEQ ID NO: 25206 - protein, 81 aa, Propithecus coquereli
EGMAAGLLTAGPHFAQEGWRYLVPTPRDRFKEGIPEKSRNLVLLGLPVSQSGMNSQLEQREGPWMLEGEDLRSSCPDWKII

SEQ ID NO: 25207 - protein, 81 aa, Vombatus ursinus
MALLLPILSHFFPLSSGLPVFKPDVISQLERGEGPWTPEAEVPQVSCPESLVQKQRCETMNLTSKQGISMGRSCMGRLTKN

SEQ ID NO: 25208 - protein, 81 aa, Lynx pardinus
LFQGWLTFRDVAIEFSQEEWECLDPTQRALYRDVMLENYRNLVSLGEDNFSPEYINCVENRIGLSLQAHLAELQRFHSEEK

SEQ ID NO: 25209 - protein, 81 aa, Balaenoptera acutorostrata
ALAPVTFKDVVVTFTPEEWELLDPAQRTLYRKVMLVTYRLLVSLGHPVPKPELTYLLNPGQKLWMVKRGFSQSSSSGDKAK

SEQ ID NO: 25210 - protein, 81 aa, Saimiri boliviensis
DVALDFSHEEWGWLDSAQRDLYKDVMVQNYENLVSLAGLSITKPYVITLLEDGKEPWMNAFHILFLIVFFFCILFYPLPIF

SEQ ID NO: 25211 - protein, 81 aa, Balaenoptera acutorostrata
FRGSVMFRDVSINFSQEEWECLDSGQMNLYKEVMLENFSNLVSVGLSSSKPAVISLLEQGKEPWMVDRELTRGLCSDLESM

SEQ ID NO: 25212 - protein, 81 aa, Saimiri boliviensis
FFGQVTFRDVAIEFSQEEWTCLDPAQRSLYRDVMLENYRNLASLAGISCFDLSIISMLEQGKEPFTLDSQVQIAGSPNGWE

SEQ ID NO: 25213 - protein, 81 aa, Panthera pardus
SQGLLTFRDVAIEFSQEELRCLNHSQWELYRDVMLENYGHLLFLGLVVSKPDLVIFLEHKKDVWAMERKETVATHPAVFSP

SEQ ID NO: 25214 - protein, 81 aa, Panthera pardus
TQDSVVFEDVAVDFTQEEWALLDLAQRNLYRDVMLENFQNLASLGYPLYTPYLISQWKQEEDLETVERGPIQGEHQEGFET

SEQ ID NO: 25215 - protein, 81 aa, Panthera pardus
MDSSQEEWTLLDQTQIALYRDAMLENYQNLITLGYKSCKPDLSSALEGAELLRTGGRGVLQDLRPSEVDRDSLEREADGHN

SEQ ID NO: 25216 - protein, 81 aa, Macaca nemestrina
KKKPVTFEDVAVNFTQEEWDCLDASQRVLYQDVMSEIFKNLASVARIFLHKPERITKLEQEEEQWREFVHLPNTEGLSEGK

SEQ ID NO: 25217 - protein, 81 aa, Macaca nemestrina
GTVTFEDVAVNFTQEEWNLLSEAQRCLYRDVTLENLALISSLGCWCGVEDEEGPSKQSIYIQRETQIRIPMAGVSLKKVHP

SEQ ID NO: 25218 - protein, 81 aa, Ursus arctos
MAVTFEDVTVIFTWEEWKFLDSSQKKLYREVMWENYTNVMSVGNWKESYKPQEERLRYLEHENRLSWQGWRNASAQIYENR

SEQ ID NO: 25219 - protein, 81 aa, Ursus arctos
WAQVPVTFKDVAVEFTQEEWMMLDSGQRRICRDVILENYMSLTSVEYQLWKPTVISPLAAEEIRTMKRRILQGTYPDWEIQ

SEQ ID NO: 25220 - protein, 81 aa, Ursus arctos
MQKNLYRDVMLETFQNLVSVDYETLFKASGLVSQQDRHEEKNASEQKMAKFTRNHSCAYILEKNWEDHSIEDQHGNHSRHL

SEQ ID NO: 25221 - protein, 81 aa, Muntiacus reevesi
ETVTLKDIAIDFTQEEWALLDTSQKKLFREVMLESISHLVSVGYQLRKSDVISQLEQGAELWKEEKGFPQCPSSGELQAPA

SEQ ID NO: 25222 - protein, 81 aa, Muntiacus reevesi
SWGPLSFMDVFVDFTWEEWQLLVPAQKCLCRSVMLENYSNLVSLGYRHTKPSIIFQLEQEELRMMQILSQGHPGKLRQKTV

SEQ ID NO: 25223 - protein, 81 aa, Muntiacus reevesi
MGRLTFWDVAIDFTQEEWECLDLGQRELYTDVMVENYRNLASLGLVVSKPDLVTFLEQMKDLRNIRRMQTTGIYPVLLLYR

SEQ ID NO: 25224 - protein, 81 aa, Muntiacus reevesi
CQDPVTFEDVAIVFTDEEWRHLVPTQRNLYKEVMLENYKSIVSLGLPIPGPDVIFQLKRGDEPWLVEFHGFEGKEGAENVS

SEQ ID NO: 25225 - protein, 81 aa, Ursus americanus
MFFNPITLLCSEGSIKLILFFLLCTIMFFQAGCSISKPDVITLLEQGKEPWMVVRDERRRSLDLESRYDTKKLFQEKDIYE

SEQ ID NO: 25226 - protein, 81 aa, Myotis brandtii
QGPLTFKDVAIDFSQEEWECLDPAQRKLYLDVMVENCSNLASLAMASEDNQAFLLKPTLQSLSSEIILGPVTFRDVAIDFS

SEQ ID NO: 25227 - protein, 81 aa, Myotis brandtii
MSEMNFEDVAIAFSEEEWGLLDAAQRLLYCEEMLEIFALVASVGCCHKTDDEEACSEQSVSVEGESQVRESETAPAAEKTH

SEQ ID NO: 25228 - protein, 81 aa, Myotis brandtii
GNDVNKDSVAFEDVAVNFTLEEWALLDSSQKKLYRDVMRETFRNLASIDVNICLMECCKWWAAKKEDSVAFEDVAVNFTLE

SEQ ID NO: 25229 - protein, 81 aa, Propithecus coquereli
SQGLVTFEDVAVYFSLEEWERLDADQRGLYQEVMEENYGILVSLGYPIPKPDLIFRLEQGEEPWVPDSPRPEEGDIVTGVY

SEQ ID NO: 25230 - protein, 81 aa, Propithecus coquereli
KDVAIEFSQEEQACLDPAQQNLYRDVMLENYRNLVFLGLVVSKPDLITFLEQRQGPWNVKRHETVAKLQGIFSHYTQGLWK

SEQ ID NO: 25231 - protein, 81 aa, Propithecus coquereli
MEHLTFRDVAIEFSQEEWKCLDPAQRALYRDVMLENYRNLVSLDISPKCVIKELSPTGESATGEVFHTVMLERHESHPIAD

SEQ ID NO: 25232 - protein, 81 aa, Propithecus coquereli
YQTPVSFKDVVVGFTQEEWHRLSPAQRALYRDVMLETYSNLVSVGYEGTKPDVILRLEQEEAPWICEVACPGCHRWEDIWQ

SEQ ID NO: 25233 - protein, 81 aa, Propithecus coquereli
SQVLVSFKDVTVGFTQEEWQHLGPAQRALYRDVTLENYSHLVSVGCCVTKPEVVFKLEQGEEPWIGEEESPSQSHPEFWKV

SEQ ID NO: 25234 - protein, 81 aa, Vombatus ursinus
MLENYRNLVSLGLKEDKPDLVSWLEQGEEPSASDLQGEGPRSPCPWEGDTSARCRGASGCHSPAGPSAWDTGTENQEESLH

SEQ ID NO: 25235 - protein, 81 aa, Saimiri boliviensis
ELLTFRDVAIEFSPEEWTCLDPAQQNLYRDVMLENYRNLVSLGVAISNPDLVTCLEQRKEPCNVKIRETVAKPRAVCSHFT

SEQ ID NO: 25236 - protein, 81 aa, Saimiri boliviensis
FQELLTFRDVTIEFSLEEWEFLNPAQQNLYRNVMLENYRNLVSLGLGWISEPVLVPRDLEQASVFLFNHTMSCHYTEDFLP

SEQ ID NO: 25237 - protein, 81 aa, Saimiri boliviensis
METHSQLVPPQASVCFEDVAMAFTQEEWEQLDLAQRTLYREVTLETWEHLVSLGLLLSKPDVVSQLEQEEDLYRAEQVALQ

SEQ ID NO: 25238 - protein, 81 aa, Propithecus coquereli
FEGSLSFEDVAVDFTRQEWHRLDPAQRTMHKDVMLETYSNLASVGLCVAKPEMIFKLERGEELWILEEESSSHGYSGSLSL

SEQ ID NO: 25239 - protein, 81 aa, Vombatus ursinus
DHELVAFKDVAVEFNQEEWRCLDASQKELYHDVMMENYKNLVCLGKDSFTLSPKICSLEVTKFPITKLGIPVEESSQETLT

SEQ ID NO: 25240 - protein, 81 aa, Balaenoptera acutorostrata
AQESVMFSDVSIDFSQEEWEYLNDAQRDLYREVMLENYSNLVSMGRSISKPDVISFLEQGKEPWLVDRELTRDQWPVLESR

SEQ ID NO: 25241 - protein, 81 aa, Saimiri boliviensis
TQDRVVFEDVAIYFSQEEWGHLDEAQRLLYRDVMLENLALLSSLGCCHGAENEEAPLEQGVSVGVSQVMAPKPCLSTQKTQ

SEQ ID NO: 25242 - protein, 81 aa, Balaenoptera acutorostrata
KSQGSLSFKDVAVVFTWEEWQLLDRVQKNLYQDVMLENYINLISVGYQVTKADAFYRLEQETPWIIEEESQSHIHPEDTWQ

SEQ ID NO: 25243 - protein, 81 aa, Balaenoptera acutorostrata
DETLMAFKDVAVAFTQKEWKLLSPAQRTLYRDVMLENYSHMVSLGIAFPKPKLITQLEQGDEPWREESESLLDLCPEPGTE

SEQ ID NO: 25244 - protein, 81 aa, Saimiri boliviensis
MAFEDVAVYFSQEEWGLLDTAQRALYRRVMLDNFALVASLGLSTTRPRVVIQLERGEEPWVPSGTDMTMSRNAHRRRNPGS

SEQ ID NO: 25245 - protein, 81 aa, Oryctolagus cuniculus
MLETYSSLQSLGHCITKPDLIFKLEQGAEPWLVKECLNQSLPVAQRRDDVIRTKQESEDTNLRQELITNSTSTHKKVDSRK

SEQ ID NO: 25246 - protein, 81 aa, Rhinolophus ferrumequinum
AQGSLSFEDVTVEFTQEEWPYLGPAQRALYRDVMLENYSHLVSVGYCITKPQVIFKLEQEEEPWSLGEEFLNQRYPGHYKV

SEQ ID NO: 25247 - protein, 81 aa, Rhinolophus ferrumequinum
LLTFRDVAIEFSQEEWECLDPAEQKLYMDVMSENYRNLLSLDISTSCVVKESSPKEDVNNGELFQTLILERQVSHDLNDFD

SEQ ID NO: 25248 - protein, 81 aa, Macaca nemestrina
EMGLLTFRDIAIEFSLAEWQCLDRAQQNLYRDVMLENYRNLVSLGIADSKPDLITCLEQNKESWNIKRNEMVCEVHKGGYN

SEQ ID NO: 25249 - protein, 81 aa, Macaca nemestrina
QLLFRDVAIEFSQEEWKCLNPGQKALYRDVMLENYRNLISLGEDNVPPEAWICSGICLPDLSQKRDPWTLQQTIQEWQEYI

SEQ ID NO: 25250 - protein, 81 aa, Macaca nemestrina
SQHLVTFEDVAVDFTQEEWTLLDQTQRDLYRDVMLENYKNLIILAGSEFCKPSLMSGLEQMEKLRTGVTGVLQELDLQLKT

SEQ ID NO: 25251 - protein, 81 aa, Ursus arctos
SLELVSFEDVAVNFSWEEWQDLDDAQRTLYRVVTLETYSSLVSLGHCITKPEVIVKLEQGAEPWTVEEAPTQSLPDVQTSG

SEQ ID NO: 25252 - protein, 81 aa, Ursus arctos
LVTFKDVSGGFTEEERGCRDPTQRKLHRAVMLENYSQLVSVGDLNENSMENLQEKVLRDLLRRLFCWLILGDTASTITEYY

SEQ ID NO: 25253 - protein, 81 aa, Ursus arctos
QQIAVTFKDVAVDFTQEEWLLLDLTQRNLYRNVMLENYQNLVAVEYQLSKPKLIAWLEQQELRTVEKGVFQEWETQPQTER

SEQ ID NO: 25254 - protein, 81 aa, Ursus arctos
AQAPVTFKDVLVTFTQEEWELLDLPQRTLYWKVMGETCRLLVSLGKNLCTDDLQEQVSPGDALLECESHRSRRDPLIHGGK

SEQ ID NO: 25255 - protein, 81 aa, Muntiacus reevesi
PQESVTFEDVAVNFSHEEWQCLTHAQRHLYKDVMLENYGNMVSLGFSFSKPPLISDLEQGTEPYVQDRQDWEFLSCSYPAA

SEQ ID NO: 25256 - protein, 81 aa, Muntiacus reevesi
MTFKDVFIDFTPEEWECLDPAQRNLYKDVMVETLRNLLSVDMSHMHTIKKLQAKANSVKGEIFQRVMFGRAESLDIKDFHL

SEQ ID NO: 25257 - protein, 81 aa, Muntiacus reevesi
HLTFKDVAVEFSQEEWECLDPAQRALYRDVMLETYRNLLSVAVSHIHVIKKLKPKANSDTGVFQTVMLGRYESHEIRDFYF

SEQ ID NO: 25258 - protein, 81 aa, Muntiacus reevesi
GSVSFTDVTVDFTQEEWEQLDPSQRILYMDVMLENYSNLLSVEVWKADDQMETDHRSPDEQARPFVIFKDQTTIEERDNNL

SEQ ID NO: 25259 - protein, 81 aa, Muntiacus reevesi
TFRDVAIHFSQQEWECLNPVQKNLYRDVMMKNYDNLVSLGHSISKPDVISLLEQGKEPWMVVGEETRRWCTVEACELLVKA

SEQ ID NO: 25260 - protein, 81 aa, Muntiacus reevesi
WFSHSISFEDVAVNFTLEEWQLLNPTQKTLYRDVMLENYSNLVLLGYQVIKPEMIFKLEQEKPWLLDEEILSQNFSEKVWL

SEQ ID NO: 25261 - protein, 81 aa, Ursus americanus
TQEEWQHLDPAQRSLYRDVMLENYSHLVSLGYSISKPEVILKLEQGEEPWILEEEFPSQSDPELINSRNYSRKKFNEFNKG

SEQ ID NO: 25262 - protein, 81 aa, Ursus americanus
VDFTQEEWQHLDPAQKTLHRDVMLETYSHLVSVGCSGIKPGIIFKLEREEDPRIIKSELSTWVHSDREKSLDSPQQIISEE

SEQ ID NO: 25263 - protein, 81 aa, Ursus americanus
PKVPVSFEDVSVYFTKTEWKLLDLRQRILYKRVMLENYRHLVSLGFLSSKPHLVSWLEQGEGPWAADICRTPAATGRQTGE

SEQ ID NO: 25264 - protein, 81 aa, Propithecus coquereli
PLTFKDVAVVFTEEELGLLDSAQRKLYRDVMLENFRNLLSVGDQNGKDMEYIQEKELRFLSHKELSSWKIWEQVAGELTRS

SEQ ID NO: 25265 - protein, 81 aa, Saimiri boliviensis
AEGSVMFSDVSIDFSQEEWDCLDPVQRDLYRDVMLENYSNLASMGLYTPKPQVISLLEQGKEPWMVGRELTRGLCSDLESM

SEQ ID NO: 25266 - protein, 81 aa, Saimiri boliviensis
IQDSVVFEDVAVDFTQEEWALLDLAQRNLYRDVMLENFQNLASLGYLLHTPHLICQWEQEEGLQTVNRELLQGICVREHQE

SEQ ID NO: 25267 - protein, 81 aa, Balaenoptera acutorostrata
SQALLTFRDVAIEFSQEEWECLNPAQRALYRDVMLENYRNLVSLDMSTRCMIKELSPKEDINNGDLFQTLVFERLTSHVLP

SEQ ID NO: 25268 - protein, 81 aa, Balaenoptera acutorostrata
APLPMAFDEVALYFLEQEWEILEKWQKEMYQQEMKTNYETLDSLGCISSKPDLITWMEQGRMLLIRDQGHLEKTQMTLGLS

SEQ ID NO: 25269 - protein, 81 aa, Lynx pardinus
EVSVSFEDVTVNFSREEWQHLDPAQRRLYRDVTLENYSHLRSVGEDIGKVQQQRISGKVPLPCEKFGQSIRKAPLCSILEE

SEQ ID NO: 25270 - protein, 81 aa, Balaenoptera acutorostrata
MAVTFEDVTVNFTWEEWKFLDSSQKKLYREVMWENYTNVMSVGNWKESYRPQEERFRYFEHEHLSCWQGWRNASTQTYDNQ

SEQ ID NO: 25271 - protein, 81 aa, Vombatus ursinus
FWESVTFQDVAVDFTWEEWGHLGPAQKELYREVMLENYRNLVCLGLAVSKPDVICQLEQGGAPWWPEGGVPGSSCAVWDTR

SEQ ID NO: 25272 - protein, 81 aa, Lynx pardinus
MLENYSNMISLGLCIYQPDVFSLLEKGKEPWIFLQDETRGHCPDMPFRCQTKELSQKSVTFERELSQLEICKKHNLEYSCF

SEQ ID NO: 25273 - protein, 81 aa, Saimiri boliviensis
RVTFKDVAVVFTKEELALLDKTQINLYQDVMLENFRNLISVGDRIENNLLNLQEKGLSYLSQEVLHCWQIWKQRIWDLTVS

SEQ ID NO: 25274 - protein, 81 aa, Vombatus ursinus
MMWLGMSGRSGLSGPCPENPLQGCRPAGLEEWALNRISRPTVISQLEQKEEPWVLDLQSLEEGEILRAAHTAFENQVEKLN

SEQ ID NO: 25275 - protein, 81 aa, Saimiri boliviensis
FEASVSFEDVTMDFSREEWQQLDPAQKRLYQDVMLELYSHLFSVGYQIPNPDVIFRRLKEKEPCMEEAELSRQKCQGEKPL

SEQ ID NO: 25276 - protein, 81 aa, Vombatus ursinus
GLESVTFQDVAVTFTAEEWEQLGPPQKALYREVMLENYGNLVCLGFAACKPEVIDQLEQGQAPWKPGAGESRSSQAGECLK

SEQ ID NO: 25277 - protein, 81 aa, Saimiri boliviensis
SQASVSFQDVAVEFTQEEWQRLGPVEWTLYRDVMLENYSHLISVGYCITKPKVISQLEQGEEPWSLEDEFLKQRYPGHFKV

SEQ ID NO: 25278 - protein, 81 aa, Lynx pardinus
DRNIVTFEDVCIYFSREEWDLLDEAQKCLYCHVVLENFLLVTSLGLTISRYHLIPQPQTENKDASSGQGVFIRQSQVRTLT

SEQ ID NO: 25279 - protein, 81 aa, Saimiri boliviensis
EPGAVTFGDVAVYFSREEWSCLRPAQRALYRDVMRETYSHLGALGVGGSKPALISWMEEEAELWGPAAQDPELAECPTEAD

SEQ ID NO: 25280 - protein, 81 aa, Vombatus ursinus
MLENARHLLSLGLPVPREDVVSYFEQREAPWMLEQEDLRSRCPGEIRVEVKTMAELNLSVEETQEQRSMDDGPCDITWREI

SEQ ID NO: 25281 - protein, 81 aa, Balaenoptera acutorostrata
QESVTFKDVAVDFTQEEWALLDTSQKKLFRDVMLENISHLVSVGREDDLRKQEMIFMQHIYKKDTSVISAMQRSHSQEDPL

SEQ ID NO: 25282 - protein, 81 aa, Saimiri boliviensis
QESVAFEDVAVYFTQNQWASLDPAQRALYREVMLENYANVASLGGESCIKNEGPVIKQEASEETELHRMPVGGLLRNVSQH

SEQ ID NO: 25283 - protein, 81 aa, Balaenoptera acutorostrata
PVVFEDVAVDFTQEEWALLDLTQRNLYRDVMLENFRNLASLGFETQLKTNELVAPQDIYGEKISSEQNVVRLKRSASSLSI

SEQ ID NO: 25284 - protein, 81 aa, Saimiri boliviensis
KESVSFKDVAVDFTQEEWGQLDSPQRALYRDVMLENYQNLLALGAGPPLHKPDVISHLERGEEPWCMQRDVPGGPCPEWEM

SEQ ID NO: 25285 - protein, 81 aa, Panthera pardus
LFQGLLTFRDVAIEFSQEEWGCLNHSQRELHRDVMLETYGHLLFLGLIVSKPDLVIVLEQEKELWGVKRKETVASHSGRWE

SEQ ID NO: 25286 - protein, 81 aa, Macaca nemestrina
VQGLLTFRDVAIEFSQDEWKCLDPAQRSLYRDVMLENYRNLVSLEFQSVTQAKVQWCDLGSLQPPLPRFKQFSCLSLPSSW

SEQ ID NO: 25287 - protein, 81 aa, Macaca nemestrina
SYQDSVTFDDVAVDFTPEEWALLDTAEKYYRDVMLENYINLASVEWEIQPRIKGSSLQQGFLKNPIFNGIQMVRFMTSIEQ

SEQ ID NO: 25288 - protein, 81 aa, Ursus arctos
MLENYSNLMSLGYQATRPEATVHLEKEQRMVEREFPSQRSPERPLQCFSRGIKLKSDSKFQSKNYAEMNSDEPNSHGKPFF

SEQ ID NO: 25289 - protein, 81 aa, Muntiacus reevesi
SESLSFEDVTVGFTQEEWQKLDPAQRTLYRDVMLENYSHLISVGEQPWVLETESPSQIYPAEKREGAFAGWVETENVVSYS

SEQ ID NO: 25290 - protein, 81 aa, Muntiacus reevesi
TARSQASVTFKDVAMDFTPEEWGRLDPAQRDVMLENYRNLVSLWLPVSKPENHSLENGKEPLLLERKAPRSSCSDSETSPR

SEQ ID NO: 25291 - protein, 81 aa, Ursus americanus
DTISVTFDDVAVTFTQEEWGQLDPAQRTLYQEVMLENCGLLVSLGCPVPRPELIYQLEHGQELWTVKRDLSQSAYLGDKGK

SEQ ID NO: 25292 - protein, 81 aa, Myotis brandtii
EAEPVAFEDVSLGFDLEEWELLDPEQKSLYRQVVLENYRNLASVEYQLSKPEVVSRLEEEEELWSVERGIPQDTFSALPAP

SEQ ID NO: 25293 - protein, 81 aa, Balaenoptera acutorostrata
MDFTQEEWALLNSSQRQLYRDVMLENYRNLVSLRHQLSKPPLITQMEQEDEMETLPDTARPDPTEPVSGPPARAAVNVSTL

SEQ ID NO: 25294 - protein, 81 aa, Balaenoptera acutorostrata
GMKFEDVAIDFSQEEWGLLDEAQRLLYYNVMLENFALVASLGCCHGTEDEEAPSEQSISVDGESQVRASKAGPSTQKTHPY

SEQ ID NO: 25295 - protein, 81 aa, Lynx pardinus
MFSDVSIVFSQEEWEYLDLEQRDLYRDVMLENYSNLVSLGCFISKPDVISLLEQGKEPWKVVRKGRRRYADLETRYETKKL

SEQ ID NO: 25296 - protein, 81 aa, Saimiri boliviensis
MKPAQRNLYRDVMLENYSNLVTVEVWEVDEQIKKQQETLVRKVTSISKKILIKEKVIEYKKVAQIFPLSSDIVTSRQSFYE

SEQ ID NO: 25297 - protein, 81 aa, Saimiri boliviensis
MLENYGNVASLGFPLLKPAVISQLEGGGELGGPSPLAAGTGLRGLWTGKGVDTQTDSDFTEEMYDGKEDVSFELQRDFSQE

SEQ ID NO: 25298 - protein, 81 aa, Balaenoptera acutorostrata
QAMVKIEDMAVSLILEEWGCQNLARRNLNRDARQENYGNVISQGCENRNENEESTSKAEIAEDSASHGETTGKFQKDFGEK

SEQ ID NO: 25299 - protein, 81 aa, Saimiri boliviensis
MAEEFVTLKDVAMDFTLEDWEQFGLDQGDPFWDTALDNYQNLFLLNPPRPNLTSHPDGSEDLEPLAQGSPEATGPDLAETT

SEQ ID NO: 25300 - protein, 81 aa, Lynx pardinus
FKFKDVAIYFSQKEWECLHPSQKGLYRDVMLENYNNLISLDWESRGETNNLFPKTDSYEIKSLQLKIKRLESSHLECTKVR

SEQ ID NO: 25301 - protein, 81 aa, Balaenoptera acutorostrata
KILVPVTFRDVAVVFTEAEWKRLSSEQRDLYREVLLENYRNLLSLAEPKPEIYPCSSCLLAFFCQQFLSQHTLQIFPGVCV

SEQ ID NO: 25302 - protein, 81 aa, Lynx pardinus
MTESQEEWQQLDLAQRNLYRNVMLENYNNLITVGCPFTKPDVIFKLEQEEEPWVVEEEVLRRHCPGEVWGIDERQKIQDRL

SEQ ID NO: 25303 - protein, 81 aa, Pteropus alecto
MAFPQKEWEQLDPAQRNLHKDVMLENYSHLASMGYQAAKRDMISKLEKGEEPWLGKGKTPRQGGPNETARPKQTEANGSKF

SEQ ID NO: 25304 - protein, 81 aa, Oryctolagus cuniculus
MAVAFTQEEWQLLGPAQRDLYWDVMLENYSNLVSVGWRASKPDLLSQLERGEPWTIEGENHCGTPPEIWKADGVLEHLQNG

SEQ ID NO: 25305 - protein, 81 aa, Pteropus alecto
PQDLVTFKDVAVDFSQEEWDWLNSAQRSLYRSMMLENYQSLVSLGLCISKPYVITLLEQGKEPWRMKSDMTSPFSDWESSC

SEQ ID NO: 25306 - protein, 81 aa, Rhinopithecus bieti
MELLTFRDVAIEFSPEEWKCLDPSQQNLYRDVMLENYRNLVSLGVAISNPDLVTCLEQRKEPYNFKIRETAARPSEFCFSF

SEQ ID NO: 25307 - protein, 81 aa, Rhinopithecus bieti
SQGLLIFRDVAIEFSPEEWSYLDPAQQNLYRDVMLENYRNLLSLGIAVSKPDLITCLEQRNEPWNVKKHETIGRHPAVSSH

SEQ ID NO: 25308 - protein, 81 aa, Rhinopithecus bieti
LEMGPLTFRDVAVEFCLEEWQCLDTAQQDLYRKVMLENYRNLVLGIAVSKPNLITCLEQGKDPWNMKRHSMVVKPPVICSH

SEQ ID NO: 25309 - protein, 81 aa, Panthera pardus
RPRAVKFADVAVYFSTEEWGCLRPAQRALYRDVMRETYGHLGALETRTRKKNGDKEVFPPKEAPRKGKRGRRPSKPRLIPR

SEQ ID NO: 25310 - protein, 81 aa, Macaca nemestrina
QGLLTFRDVAIEFSQEEWKCLDPAQRTLYRDVMLENYRNLVSLDISSKCTMKDFLSTVQGNTEVIHTRTLERHHIGDFCFQ

SEQ ID NO: 25311 - protein, 81 aa, Macaca nemestrina
LEMGPLTFRDVAIEFSLEEWQCLDTAQQDLYRKVMLENYRNLVLGIDVSKPNLITCLEQGKYPWNMKRHSMVVKPPVICSH

SEQ ID NO: 25312 - protein, 81 aa, Macaca nemestrina
VAFEDVAVNFTQEEWALLDIFQKNLYREVMLETFRNLTSIGKSWKDQNIEYEYQNPRRNFRSLIEEKVNEIKENSHCGETF

SEQ ID NO: 25313 - protein, 81 aa, Ursus arctos
AQGPVLFEDISVDFTQKEWQLLDPAQRLLYKEVMLENYRQLVSLGHCVTKPELVLKLEQGEEPWAPKRELPSQSCPGNKPY

SEQ ID NO: 25314 - protein, 81 aa, Muntiacus reevesi
EQVTFEDVVVDFTQEEWGHLEPAQRTLYRDVMLETFGLLVSVGHWLPEPDALSLLEQEAELRAADEGGPRGVCPDLETRPQ

SEQ ID NO: 25315 - protein, 81 aa, Muntiacus reevesi
DLVTFEEVSVDFSQEEWALLAPAQKILYRDVMLENFRNLASVGYHLCIHSPITEVVQKELRPEGRGILQSACTDGATQLKS

SEQ ID NO: 25316 - protein, 81 aa, Muntiacus reevesi
LQEAAELEFLSVNYTQKKWKGTALSQRALYWNIMLENCCSLAPLGENRMASSQLSQKQDISEELKSADRTSGILCGLILGG

SEQ ID NO: 25317 - protein, 81 aa, Ursus americanus
FQKPVTFDDVAVNFTQEEWVCLDAGQRVLYQDVMSETFRNLMSVVRIFLSNPDLIIKLEQEEKQWRAGAPAQPASPARPPF

SEQ ID NO: 25318 - protein, 81 aa, Myotis brandtii
RSKESLTFQDVAVDFTGEEWDQLCPAQKNLYRDVMLENYRNLVALGHQLYKPEVITQLEQEEQWMMERDSPLDTHPGEKPY

SEQ ID NO: 25319 - protein, 81 aa, Myotis brandtii
MAVPLTFEDIAIYFSEQEWQDLEAWQKELYKRVMRTNYEILVSLDGGLPKPELISRIEQGRELFRNLGEPQKSGNVIFNPA

SEQ ID NO: 25320 - protein, 81 aa, Propithecus coquereli
MINAQESLTPEDVAVEFTWEEWQLLGPAQKDLYRDVMLENYSNLVSVGYQARKPDALSKLERGEGPWTIEDETCSRICPGE

SEQ ID NO: 25321 - protein, 81 aa, Propithecus coquereli
MYFSQEEWELLDPTQKALYSDVMQENYETVISLALFVLPKPKVISCLEHGEDPWVQVSLELKDSAGESSTGLKLKSDTENH

SEQ ID NO: 25322 - protein, 81 aa, Propithecus coquereli
GTVTFEDVAVYFSWEEWGLLDEAQRCLYRDVMLENLALITSLDVYQHQKEHFGEKHFRSSVGKTLFVKTCTFHVSGEPFTC

SEQ ID NO: 25323 - protein, 81 aa, Propithecus coquereli
SLGSVSFKDVTVDFSREEWQQLDLAQKSLYRDVTLENYFNLISVGCQVPKPEVIFNLEQGGELCVLDGGLSCQNCSDGDIG

SEQ ID NO: 25324 - protein, 81 aa, Propithecus coquereli
PKVPVSFEDVSVYFTKTEWKLLDLRQRILYKRVMLENYGHLVSLGFSFSKPHLISQLERGEGPWVAGIRRTGAAAGLQEGD

SEQ ID NO: 25325 - protein, 81 aa, Propithecus coquereli
VHGSVTFRDVAIDFSQEEWECLDPAQRNLYRDVMTENYSNLVSLAENFISKPDVITVLEQEPEPWMVIGSHIMELRKYLQK

SEQ ID NO: 25326 - protein, 81 aa, Propithecus coquereli
LQGSVSFKDVTVDFTQEEWQHLDPAQKALYRDVMLENYCHLISVGFHMTKPDMIRKLEQGEELWTQGIFPSQSYLEGGKAE

SEQ ID NO: 25327 - protein, 81 aa, Propithecus coquereli
KPWAVRFADVAVYFSPEEWGCLRPAQRALYRDVMRETYGHLGALGVGGTKPALISWVEEEAELWGLDAQDPEVAKCTTEAD

SEQ ID NO: 25328 - protein, 81 aa, Propithecus coquereli
TQMSVTFDDVAVTFTKEEWGQLDPAQRTLYQEVMLENCGLLVSLGCPVPRPELIYQLEHGQELWTVRKDLFQGLCPGDKEK

SEQ ID NO: 25329 - protein, 81 aa, Pteropus alecto
GLSVPEPHQDSALCYQESTQEGMAAAAPTAGCQSIVTFADVAVIFTDEEWRHLVPIQRDLYKEVMLETYESIVFLGKENTP

SEQ ID NO: 25330 - protein, 81 aa, Pteropus alecto
KNENKEGGELSVLSGTGDFRDVAIGFSHEEWECPDPAQRDLYQDVMLEDYSNLVSLDLGSNYGAEKLSPETDVYEINLPRV

SEQ ID NO: 25331 - protein, 81 aa, Pteropus alecto
KQVSISFEDVTVDFSREEWQHLDPAQRCLYRDVTLENYSHLLSVGYQVPKPEIIFQLEQGEGPWMLERETPHQSCSDEDIG

SEQ ID NO: 25332 - protein, 81 aa, Rhinolophus ferrumequinum
LLFQGRLTFRDVSIDFSQEEWECLHPADRKLYMDVMLENYRNLYLAVSTPDVVIFLERMKEAWDVKRKKTVSIHPVFRESS

SEQ ID NO: 25333 - protein, 81 aa, Rhinolophus ferrumequinum
DFAFVSFPDVAVDFTQEEWQLLNHAERTLYRDVMLENYSNLFSLGIPFSKPTLVFLLEQGEEPWREEREHLPSCCSADPKP

SEQ ID NO: 25334 - protein, 81 aa, Rhinolophus ferrumequinum
MEFTWEEWQLLNSAQKYLYRDVILENYSNLVSVGYHGNKPDLIFKLEQGEEPWTVNAKVSHQSCAESWKEWFWKNQDELES

SEQ ID NO: 25335 - protein, 81 aa, Rhinolophus ferrumequinum
GEGTDLLTFENGAVYFSREEWCLLNLTQRSLYRDVMLENSALTVSLGMSLTRSPSKLTEEPWVPSIMDMTLVSRAEAKRGP

SEQ ID NO: 25336 - protein, 81 aa, Ursus maritimus
MDFSREEWQQLDPAQRRLYQDVMGEVYSHLLSLGYHIPNPEIISRMEKGEKLWLREAQLPHQRQGEGVFGLKTSQQKMFEK

SEQ ID NO: 25337 - protein, 81 aa, Ursus maritimus
TVGFTQEEWQHLDPAQRSLYRDVMLENYSHLVSVGYCVTKPEVIFRLEQGEEPWILEEEFPSWSFPETWETDHTKERSHEN

SEQ ID NO: 25338 - protein, 81 aa, Ursus maritimus
MDFTPEEWGKLDPTQREVMLENYRNLVSLWLPVSRPENYNLENGKEPLMLERKAPKSSYPDLETKPEGKDSTSVQDISKDE

SEQ ID NO: 25339 - protein, 81 aa, Ursus maritimus
AQISVTFDDVAVTFTQEEWGQLDPAQRTLYQEVMLENCGLLVSLGCPVPRPELIYQLEHGRELWTVKRDLSQSAYPGDKGK

SEQ ID NO: 25340 - protein, 81 aa, Ursus maritimus
MLENFSHLVSLGHPVSKPDVISKLEQGEEPWIYPERETRLENPQLDILGGVSLHKEILESVTRDHSLYSIFKVWQGDDQLE

SEQ ID NO: 25341 - protein, 81 aa, Ursus maritimus
LQNSITFEDVAMDFTQEEWALLNSRQRKLYRDVMLENYRNLASLEKQHSKPTLITQMEQEDEMKTETGSHQDICSNGMVLL

SEQ ID NO: 25342 - protein, 81 aa, Ursus maritimus
FPEAVTFKDVAVVFTLEELGLLDSTQRKLYRDVMLENFKNLVSVGHLPFKPDMVSQLEAEENLWVMEGETQRNGYSSEDHV

SEQ ID NO: 25343 - protein, 81 aa, Ursus maritimus
AQAPVTFKDVLVTFTQEEWELLDLPQRTLYWKVMRETCRLLVSLGKNLCTDDLQEQVSPGDALLECESHRSRRDPLIHGGK

SEQ ID NO: 25344 - protein, 81 aa, Rhinopithecus bieti
ETELEVPQWHREQILHRLHSLLQFCIAVSKPDLITCLEQGKEPWNMNRYEMVAKPPVMCSHIAEDLWPEQDIKDFPQKVIL

SEQ ID NO: 25345 - protein, 81 aa, Rhinopithecus bieti
AQGLVTFADVAIDFSQEEWACLNSAQRDLYWDVMLENYSNLVSLDLESAYENKGLPSEKNIHEIRAAKRNSDRRSKSLGRN

SEQ ID NO: 25346 - protein, 81 aa, Rhinopithecus bieti
EKGPLTFRDVVIEFSQEEWQCLDTAQQDLYRKVMLENFRNLVFLAGIDVCKPDLITCLEQGKDPWNMKRHSTVATPPVKCF

SEQ ID NO: 25347 - protein, 81 aa, Ursus arctos
MLENYGHLLFLGLIVSKPDLVSFLEQTKEPWDVKRRKTVVFDPVLTSHGALSFLPEPCKEASFQNVSVGRYKHSALEKLHL

SEQ ID NO: 25348 - protein, 81 aa, Muntiacus reevesi
CLGNVTFEDVFVSFSQEEWGLLGEAQRLLYREVMLENFALMASLGYTSSVSHGVSPQELGREPWVSDRADTSPALTRGAQS

SEQ ID NO: 25349 - protein, 81 aa, Muntiacus reevesi
SQSPLTFGDVAVEFSGDEWAWLDSAQRSLHRSVMLENYRNLASLGLCMSKPEMISSLEQSKEPWAVKAKSTRGRCPGLEAI

SEQ ID NO: 25350 - protein, 81 aa, Muntiacus reevesi
GRLTFRDVAIDFTQEEWECLDLGQRELYRDVMLENYGNLASLGLVSKLDLVAFLEQLKAPRNIRRMETATSYLGKFIQEGN

SEQ ID NO: 25351 - protein, 81 aa, Ursus americanus
VLLTRRSILDVAVGFTQKEWQQLEPAQRTLYRDVMLENYSHLVSVGEESFPCFLILLEQGQEPWMEEEEILRWSFPGERGS

SEQ ID NO: 25352 - protein, 81 aa, Ursus americanus
EEWEWLDPSQKDLYRDVMLENYRNLVWLGLSISKPNMISLLEQGKEPWMVEKEMSDGQYADWESWYEIKELSPKWYIDEEE

SEQ ID NO: 25353 - protein, 81 aa, Ursus americanus
MLETYSHLLSVGYEVPQPEVFMLEQGKEPWALQGESPHQNCPGEKLWDHNQYGKILSYKQAPSQHQKIHTGEKSYECAEFG

SEQ ID NO: 25354 - protein, 81 aa, Ursus americanus
LMAFEDVAVYFSQEEWELLDAAQGALYCHVMLENFALVASLGKALGSPWEAQLSPALTPCLLTAEASPPREKALMTRPMPG

SEQ ID NO: 25355 - protein, 81 aa, Ursus americanus
SPGCVTFEDVTIYFSQEEWGLLDEAQRLLYCDVMLENFALIASLGKAFAPTRGSELVSAGPLFLPTARPMGTASFPTLPGC

SEQ ID NO: 25356 - protein, 81 aa, Camelus ferus
PARRKGSRELTLLFPAKRFQKIKWVRVSWKPGASTVLYPVSITAGPPVCKPDVISHLERGEEPWRVPREVPGGVRPERGPR

SEQ ID NO: 25357 - protein, 81 aa, Eschrichtius robustus
MLENYSNLVSVGYQASKPDAVSRLERGEQLWPVEDDSHGRICPEIRKVDDPLQHHLPNHSIQNTVEQCCEHNTFADIVNQS

SEQ ID NO: 25358 - protein, 81 aa, Myotis brandtii
TARSQASVTFKDVAMDLTPEEWGKLDPAQRDVMLENYRNLVSLWLPVSKPENYNLENGKETLMLERKVPRSSYSGESNRWE

SEQ ID NO: 25359 - protein, 81 aa, Propithecus coquereli
TRDSVTFDDVAVGFTREEWALLDSAQRDLYRDVMLENYRNLASVGSRLFKPSVIRWLEEAEWMAVQRGELHEWQLKTSGSA

SEQ ID NO: 25360 - protein, 81 aa, Propithecus coquereli
RQEPVTFEDVAVYFTQNEWASLDPVQRALYREVMLENYANVASLAFPFTIPVLVSQLEQGELPWGLDPWEPVGREALRGVC

SEQ ID NO: 25361 - protein, 81 aa, Propithecus coquereli
LQDLVTFKDVAVEFTQEEWALLDPSQRTLYRDVTLENCRNLASLGCHVDNPNLISQLEQEDKVMTEERGILPSTCPDVGTL

SEQ ID NO: 25362 - protein, 81 aa, Saimiri boliviensis
LLVSLTFEDVAVLFTRDEWKKLAPSQRNLYRDVMLENYRNLVSLGLPFTKPKVISLLQQGEDPWKVEKDGSGGPCPGLKSI

SEQ ID NO: 25363 - protein, 81 aa, Oryctolagus cuniculus
AQVSVTFEDVAVTFTQEEWRQLEPAQHNLYREVMLDVCGLLVSLGCPVPRPELICHSEHRPELWTVKKHLFQSTCLDDKRE

SEQ ID NO: 25364 - protein, 81 aa, Rhinolophus ferrumequinum
LFQGRLTFRDVAVDFSQEEWECLHPAERKLYTDVMLENYRNLCSLGLAVSKPDLVIFLERMKDAWDVKRKKTVSIHPGRWE

SEQ ID NO: 25365 - protein, 81 aa, Ursus maritimus
VFQGLVTFEDVAVYFSLEEWERLDVDQRDLYKDVMQENYGILVSLGEQGECVFPSFLHRCQSLWAPEGTEAGKTKTNICGE

SEQ ID NO: 25366 - protein, 81 aa, Ursus maritimus
IPKVPVTFDDVAVYFSEPEWGKLDEWQKELYKHVMRGNYEIWVADYAISKPDILTRMERGEDPCPEGPWGQEERSKKEAVR

SEQ ID NO: 25367 - protein, 81 aa, Ursus maritimus
FQEALTFKDVAVVFSEEELGLLDPAQRKLYRDVMLENFRNLVSVGHSSSKPDVISQLEREEKLCMKETHSERGDRHQKEME

SEQ ID NO: 25368 - protein, 81 aa, Ursus maritimus
VKDSVTFKDVAIDFTLEEWRLMDPSQRNLHKDVMLENYRNLVSLGLAVSKPDMISHLEDGKGPWVVVREIARAPYPELETK

SEQ ID NO: 25369 - protein, 81 aa, Ursus maritimus
FQEPVTFKDVAVVFSEEELGLLDSTQRKLYRDVMLENFGNLVSVGNQPFKPELIFQLEREEKLLMMEAETQREGYLGTKSQ

SEQ ID NO: 25370 - protein, 81 aa, Ursus maritimus
MLENFALIASLGLTAFRSHIVAQLQMGAEPWVPDRVDMTSAMARGVYSGPVSGFCYETEGECNVSAEGVSQDRKLQVALSN

SEQ ID NO: 25371 - protein, 81 aa, Rhinopithecus bieti
EKGPLTFRDVAIEFSLEEWQCLDTAQQDLYRRVMLENYRNLVFLAGIAVSNPDLITCLEQGKEPWNMKRHAMADEPPVMYS

SEQ ID NO: 25372 - protein, 81 aa, Ursus maritimus
VKIEDVADVAVSFILEEWGHLDQSQKSLYRDDRKENYGSITSMDYESGHDNVELAVKQISDDAEPHWMTSGSPERNVPQSQ

SEQ ID NO: 25373 - protein, 81 aa, Rhinopithecus bieti
PQGLLTFRDVAIEFSQEEWKCLDPAQRTLYRDVMLENYRNLVSLAISSKCMMKMFSSTAQGNSEVIYTGALQRHASHHIGE

SEQ ID NO: 25374 - protein, 81 aa, Ursus arctos
MGMAGPVSEGFIQRCHVGELQELGLSISKPNMISLLEQGKEPWMVEKEMSDGQYADWESWYEIKELSPKWYIDEEEISQGM

SEQ ID NO: 25375 - protein, 81 aa, Ursus arctos
VTFEDVAVYFSWEEWGLLDEAQRCLYQDVMLENLALINSLGLRHGAEDEDAPEHRVSVQAASQVGTRKAVVSPQKAHPREV

SEQ ID NO: 25376 - protein, 81 aa, Ursus arctos
MDLVVFEDVAVDFTLEEWALLDSAQRKLYREVMLENLKNLASVDDEIQFKASGSVSQQDIYGKKISKEHKMAKFIRNDSWA

SEQ ID NO: 25377 - protein, 81 aa, Ursus arctos
LLETSSPLDISMEFTWEEWQLLDSTQKYLYRDVILENYSHLVSVGYHGTKPDLIFKLEQGEEPWIINAKVSRQSYPEGWKE

SEQ ID NO: 25378 - protein, 81 aa, Ursus arctos
MPQEEWQHLDPAQKALYRDVMLENYCHLISVGFHMTKPDMIRKLEQGEELWTTERMFPSQSYLEEDGKAEDVLVKFKEYQD

SEQ ID NO: 25379 - protein, 81 aa, Ursus arctos
SQRLLTFGDVAIEFSQEEWRCLSHTQRELYRDVMLENYRHLLFLGLIVSKPDLVSLLEQRKEPWDVKRKKTVVSSHGALSF

SEQ ID NO: 25380 - protein, 81 aa, Muntiacus reevesi
MLETCGLLVSLGHPVPKPELTHLLEHGQKLWTGTRGLPRGSGPGDRAKCQTREPSNSQPVLSEEALLRGSLTLGSSWDSRL

SEQ ID NO: 25381 - protein, 81 aa, Ursus americanus
WQDLDDAQRTLYRVVMLETYSSLVSLGHCIMKPEVIVKLEQGAEPWTVEEAPTQNVQTSGDLIETCQEHQSRHVWQAGVAN

SEQ ID NO: 25382 - protein, 81 aa, Ursus americanus
LKNMPHWLVIFRDVAIDFSLEEWECLNATQRDLYRDVMLENYSNLISLVLFRNTNGPKTVAQSHDLSLSLYFSGSYSEVSV

SEQ ID NO: 25383 - protein, 81 aa, Myotis brandtii
SQVSVTFEDVAVTFSQEEWGQLDVAQRTLYQEVMLENCRLLASLGCPVPRPQLICQPESGRELWMVKTDLSRGACPDHVYF

SEQ ID NO: 25384 - protein, 81 aa, Eschrichtius robustus
MSLGHQLPKPEVILQLEKGEEPWLVERGIHQETHPGEDQTARFGQESLARVVTSSLHFEDLETAVEVKSSTSSKSISKDKH

SEQ ID NO: 25385 - protein, 81 aa, Myotis brandtii
METYSHLVSVGYHVSKPDALFKLEREEEPWTVQHGLHCLVSPEGTVGDSLQYPLQSRSIQSLETCCENSMFGDIVNQSKGN

SEQ ID NO: 25386 - protein, 81 aa, Myotis brandtii
EQLSFMDVAIDFSQEEWECLDPAQRKLYLDVMSENYSNLVSVECDKAFRWPSTLSIHQRIHTEEKPYKYRKCGTSSINFAN

SEQ ID NO: 25387 - protein, 81 aa, Myotis brandtii
NKMPQISFEDVAVDFTLEEWQLLNPIQKNLYRDVMLENYSNLVFLGHEIIEPDAVWKLEQEEPWKINEEILNHDFSDVAYR

SEQ ID NO: 25388 - protein, 81 aa, Propithecus coquereli
AHSSVTFRDVAIDFSQEEWEFLDPAQRDLYRDVMWENYSNFISLGPSISKPDVITLLDEEGKEPGMLVREGTRRYCPGDLE

SEQ ID NO: 25389 - protein, 81 aa, Propithecus coquereli
VLVTFKDVAVTFTREEWRQLDLAQRTLYREVMLETCGLLVSLGDRAQLQTREPTTCLPILFEGAFLQGSLSLGSSRDSRLG

SEQ ID NO: 25390 - protein, 81 aa, Propithecus coquereli
SRSLENDGVCFSKQEWENLEDWQKELYRNVMESNYETLVSLKVLGQPDGEAELSTEILGDLEEEGPVGAHPADGVVIKQEL

SEQ ID NO: 25391 - protein, 81 aa, Balaenoptera acutorostrata
AAVFEFLSVDYTQQKWKGPALSQKAALYRNIMLENCRSLASLAGENRMESDLPPKKEISKVLKSSDRTSVVLCGMIPGGPE

SEQ ID NO: 25392 - protein, 81 aa, Balaenoptera acutorostrata
SRSLENDGVCFSEQEWENLEDWQKELYTNVMKSNYETLVSLKVLGQTEGEAELGTEMLGDLEEEDSRGVHPVEGVMIKQEI

SEQ ID NO: 25393 - protein, 81 aa, Panthera pardus
VVFEDVAVNFTPEEWALLNRGQRKLYRDVMLETCRNLSAVGCRSQGNTSASRLQWSILLNEPPGEDKTGIFTRKDSCSVFG

SEQ ID NO: 25394 - protein, 81 aa, Macaca nemestrina
MELLTFRDMAIEFSPEEWKCLDPSQQNLYRDVMLENRNLVSLGVTISNPDLVTCLEQRKELYNFKIHETAARPSVYRESRC

SEQ ID NO: 25395 - protein, 81 aa, Macaca nemestrina
MEEWQQLNPAQKTLHRDVMLEIYSHLVSVGCSGIKPDVIFKLEHGKDPWIIESELSRWIYSDRVKGLESSQQIISGELLFQ

SEQ ID NO: 25396 - protein, 81 aa, Ursus arctos
MFQVTFSDVAIDFSPEEWGWLDSAQRDLYKDVMVQNYENLVSLGLSIPKPYVISLLEDGKEPWMVEKKLSKGMFLDWESRW

SEQ ID NO: 25397 - protein, 81 aa, Ursus arctos
SSLQRPALPSLDSAYLQEKNPENQSVLTVLKNMPHRLVTFRDVAIDFSPEEWECLNATQRDLYRDVMLENYSNLISLENRI

SEQ ID NO: 25398 - protein, 81 aa, Ursus arctos
AHGSVTFRDVAIDFSQEEWEFLDSAQRDLYRDVMWENYSNFISLEPSISKPDVITLLDEGKEPWMVVREGTRRHYSDLESR

SEQ ID NO: 25399 - protein, 81 aa, Ursus arctos
PPGQVTFDDVAVDFTQEEWGLLGPAQRTLYHDVMLETLRHLVTVGPWNPTPDIVAHLELRIDQWMMGRGLTQDSCLEWEKR

SEQ ID NO: 25400 - protein, 81 aa, Muntiacus reevesi
MTFKDVAIEFTQEEWECLDPAQRALYRDVMVETLRNLVSLDKEPWSVESEVNAFGGVSKCEHGSDLRRVRGSLTRQRHGRR

SEQ ID NO: 25401 - protein, 81 aa, Muntiacus reevesi
QAEVTFEDVAVLLSQEEWGLLGPSQKGLYREVMLETYRNLLSLGVGLADPKPEVIVQLERGDELWVLDMHGAEQPSVDGSA

SEQ ID NO: 25402 - protein, 81 aa, Muntiacus reevesi
KGSVTLQDVAVEFTPEEWLLLDCDQRTLYWDVMLENFRNLISVGTGCPVTETTVIFKVEQGQEPWMVEGENSCWSSPEADC

SEQ ID NO: 25403 - protein, 81 aa, Muntiacus reevesi
MGLLTFQDVTVDFTQEEWECLDLGQRELYRDVMLENYGNLACLGVLVSKPDLVTFLEQMKHPWDVRRMETAIHPAVSSHDT

SEQ ID NO: 25404 - protein, 81 aa, Ursus americanus
MPNIDVAIDFSPEEWGWLDSAQRDLYKDVMVQNYENLVSLAGLSIPKPYVISLLEDGKEPWMVEKKLSKGMFLDWESRWEN

SEQ ID NO: 25405 - protein, 81 aa, Myotis brandtii
MYFTREEWNKLDWAQKDLYRDVMLENYRNMILLGSEARYQMIKLTPKQKISENTESCKISVVKQKTAMTPSEKLLKFNKFV

SEQ ID NO: 25406 - protein, 81 aa, Vombatus ursinus
MLENYRHLVFLGLPVSKPELISQLECGGGPWMPLEEEPRNPHADQNSSPKTKKTVLKQGILVGKSSQERLSRDHRKDFKFG

SEQ ID NO: 25407 - protein, 81 aa, Eschrichtius robustus
MGAGGPRRQVPAGFLVFKPELISRLEQGQEPWVLDLQGAEGREAARTSEADSTIGTESEQACEDIDRLKSESHVVMVKTPS

SEQ ID NO: 25408 - protein, 81 aa, Propithecus coquereli
AQVYLAFRDVAIDLSQEEWECLDPVQRDLYKDVMLENYSNLVSLGCAIPKPDVITLLEQEKEPWVVIREGTRNWYPDLEGK

SEQ ID NO: 25409 - protein, 81 aa, Vombatus ursinus
ELPDSRPRDVAMDFTQREWGCLQPTQKALYWDMTLENFKNLVCLGLTFSKPCVICQLEQGDAPWGPEGDAPRIDDADQESK

SEQ ID NO: 25410 - protein, 81 aa, Lynx pardinus
FKEVVTFKDVAVVFTEEELGLLDPTQRKLYREVMLENFGNLVSVGDKIQHKMETIPKVEPHEELSCWQIWQHIADDLTWCH

SEQ ID NO: 25411 - protein, 81 aa, Vombatus ursinus
MSFRDVAVDFTEEEWGCLSPAQWQLYKEVMLENYRNLVSLGLKEDKPDLVSWLEQGEEPSASDLQGEGPRSPCPWEGDTSA

SEQ ID NO: 25412 - protein, 81 aa, Rhinolophus ferrumequinum
PEPPGWDVSIDFSQEEWECLHPADRKLYMDVMLENYRNLCSLGEGDFLPELLPHRRVVFPSSVQSMSFEDTLDLLPNPSIG

SEQ ID NO: 25413 - protein, 81 aa, Rhinolophus ferrumequinum
MLETCSFLVSLGHPVPKTELTHLLEHGQKLWTVERGISRSTCPGDRTKLQTSEQSTSQPALYEGALFKGSLTPGSPRDSKL

SEQ ID NO: 25414 - protein, 81 aa, Rhinolophus ferrumequinum
RPQESVTFEDVAVYFTEEERAWLVPGQRALYRDVMLENCGAVSSASSTSKPALICQLEQGKEPCFTEPQGDLSRRAGPERY

SEQ ID NO: 25415 - protein, 81 aa, Rhinolophus ferrumequinum
FQEAVTFGDVAVHFSREEWQCLDPGQRALYKEVMLENHSSVAGLAGFLVFKPELISRLEQGQEPWVIDLQGAEGREAPRTP

SEQ ID NO: 25416 - protein, 81 aa, Ursus maritimus
LEPAQRTLYRDVMLENYSHLVSVGCQVTKPAVISRLEQGQEPWMEEEEILRWSFPEILQVDHQVDRQQEHQDKLLRHVAFL

SEQ ID NO: 25417 - protein, 81 aa, Ursus maritimus
AQGDVTFEDVAVYFSQDEWSLLNEAQRRLYCDVMLENFALISSLGCCCRAEAVETPFEQSISVGVSQARTPKEPRSSQKTH

SEQ ID NO: 25418 - protein, 81 aa, Ursus maritimus
MLENYGHVASLGFLVAKPALISLLEQGEEPGALILQVTEERGFAASLCPDSRMEAGIKESSLKRVPSKQLGLLGTVWGRLP

SEQ ID NO: 25419 - protein, 81 aa, Macaca nemestrina
MNKAGLLFHFAQRTLYKDVMLENYSHLVSVGYHVNKPNAVFKLKQGKEPWILEVEFPHWVLPYLWSIHDLESRYRESQAGN

SEQ ID NO: 25420 - protein, 81 aa, Muntiacus reevesi
RLTFRDVAIDFTQEEWECLDLGQRELYRDVMLENYANLASLELVSKLDLVAFLEQLKDPRNIRRLETTAIYPALSPQDTQD

SEQ ID NO: 25421 - protein, 81 aa, Myotis brandtii
RQDPVTFDDVAVYFSRREWRLLDEAQRGLYQEVMLENLALASSLGSCCGSEDADAPCEQSVSVGVSPSSPSKVAVSSLKTH

SEQ ID NO: 25422 - protein, 81 aa, Myotis brandtii
HPRTRISSWDQMAASQEEWECLDLAQRKLYMDVMLENYGNLASVAMSSEDAQAFFLKPRIQDLFSEIVLGLLTFRDVAIDF

SEQ ID NO: 25423 - protein, 81 aa, Myotis brandtii
VTFEDIALYFSRKEWNLLDESQRQLYLNVMLENFELISSLGCCCGVENVEAPTKQKVCVKVSQARKPKVAFSSRKSHPCES

SEQ ID NO: 25424 - protein, 81 aa, Myotis brandtii
FQEAVTFGDVAVHFSREEWMCLDPGQRALYKEVMLENHSSVAGLGFLLFKPELISRLEQGQEPWVLDLQGTEAREARRTLQ

SEQ ID NO: 25425 - protein, 81 aa, Propithecus coquereli
PKAPVTFGDVAIYFSKEEWECLSPNQKDLYEDVMMENYQNLASIGFSCRRPNVITLLEKGEAPWMAEPLRRRQGPDSGSKK

SEQ ID NO: 25426 - protein, 81 aa, Propithecus coquereli
SQELLTFKDISVDFTQEEWGQLGPAHQNLYREVMLENYRNLVSVGYQLSKPSVISQLEKGEEPWMTEKEGPGDPSSDLKSK

SEQ ID NO: 25427 - protein, 81 aa, Vombatus ursinus
NQVAVTFDDVTMYFTEQEWGTLEEWQKELYKHVMKTNYENLFSLGYAIPKPDLITQIEQGEEPFIRDEGHLDRELAIGSRA

SEQ ID NO: 25428 - protein, 81 aa, Propithecus coquereli
EAVTFKDVAVVFTEEELGLLDSAQRELYRDVMLENFRNLLSVGHQPFHRDAFHFLREEKFWMMRTSTRREGNSGKNKATVC

SEQ ID NO: 25429 - protein, 81 aa, Macaca nemestrina
FRGMVTFKDVAVVFTREELGLLDLAQRKLYQDVMLENFRNLLSVGYHPFKLDVILQLGREDKLSLMETEIQRDGCSGENHA

SEQ ID NO: 25430 - protein, 81 aa, Macaca nemestrina
GMEPLQFRDVAIEFSLEEWHCLDTAQQNLYRDVMLENYRNLVFLGIVVSKPDLITRLEQGENPLTVKRHKMTANPSGPGMV

SEQ ID NO: 25431 - protein, 81 aa, Ursus arctos
MKMHLHPPSEALSSDNLAHVLCHFPLTGLCVAKPEMIFKLERGEELWILEEESSGRGYPGSLSLLCGNSSVGGNALRHDND

SEQ ID NO: 25432 - protein, 81 aa, Ursus arctos
QEAVVFADVAVDFTPEEWALLDGGQRRLYRDVMLETCRNLASLDCCTQVKPCGSRTQLSILENELSSEEKIVRFIRNDSWA

SEQ ID NO: 25433 - protein, 81 aa, Ursus arctos
MLENYGNLVSVAGYQLSKPSVISQLEKGQEPWMTEKEGPGDPRSAYNTENNKSCHDLLEDLKNKTESDASAAKNDILQEQL

SEQ ID NO: 25434 - protein, 81 aa, Myotis brandtii
AEDSVAFEDVAVNFTQEEWALLNPSQKKLHRDVMRETFRNLAFLGKKWEDHDIEENQGRKQKSLMLEKLGEGENGSQCGEN

SEQ ID NO: 25435 - protein, 81 aa, Myotis brandtii
LPESLTVHDVAVDFTWEEWQLLGPEQKDLYTDVMLETYSHLVSVGYEASKPDILSKLDHGEAPWTVAGELLCGTCSDIWKL

SEQ ID NO: 25436 - protein, 81 aa, Myotis brandtii
LDAPVTFEDVAVYFSENEWTCLTCPQRALYRDVMLENYGAVASLAFLFPKPALISRLERGEAPWCSAPQGALDGEGWKGVS

SEQ ID NO: 25437 - protein, 81 aa, Eschrichtius robustus
LQGPVSFKDVAVDFTQEEWQQLDPDEKTTYRDVMLENYSHLVSVGYDSTKPNVILKLEQGEEPWVADGEFPRQFHPEEVWK

SEQ ID NO: 25438 - protein, 81 aa, Myotis brandtii
PAGLVSFKDVTVDFTQEEWQHLDPAQKTLYMDVMLENYCHLISVGCHMTKPDVILKLERGEEPWTSLTGQTCLEKNWKPED

SEQ ID NO: 25439 - protein, 81 aa, Myotis brandtii
FQLPVSFKDVVVSFTREEWGQLDLVQRTLYRDVTLETCDHLVSLGLLLPTVDVISCLERGAGPWRAEQELPPGEWKTSLAK

SEQ ID NO: 25440 - protein, 81 aa, Myotis brandtii
MNFEDMAIAFSQEEWGLVDEAQRLLYCDVMLEVFALVSSVGCYHKTDDAEDCSEQSVSVQGESQDSASKTAPETQRTHLCG

SEQ ID NO: 25441 - protein, 81 aa, Myotis brandtii
AQGRVVFEDVAVRFSREEWGLLDEAQRHLYHNVMLENVALLCSVEPTHLRDRSLPAASGAAGKPRLQKRDGMYPDQSLRIC

SEQ ID NO: 25442 - protein, 81 aa, Propithecus coquereli
PQASVCLEDVAVTFTQEEWRQLDLAQRMLYCDVTLETCGHLVSLGLLLSKPEVISQLERDDLCRVGQPPPRDCKATLEKKR

SEQ ID NO: 25443 - protein, 81 aa, Propithecus coquereli
EDVAVNFTRGEWALLNPSQKNLYRDVMRETLMNLLKPINTCKLHESKEGRQRGEASSQILEHVLNKKTPPAVKACESSVYG

SEQ ID NO: 25444 - protein, 81 aa, Propithecus coquereli
KVPVTFVDIAVYFSEDEWKNLDEWQKELYNNLVKENYKTLMSLDAEGPVPKPDAPAQAEPREEPCVWEQRHPEEREIPMDP

SEQ ID NO: 25445 - protein, 81 aa, Propithecus coquereli
SQGLVTFGDVAVDFSQEEWEWLNPAQRHLYSRVMLENYRNLVSLGLCVSKPAVISSLEQGKEPWTAQRKMTRGGCPDLNAV

SEQ ID NO: 25446 - protein, 81 aa, Propithecus coquereli
VQKPVTFEDVAVNFSQEEWECLGASQRVLYQDVMSETFRNLASVARIFLHKPDLISKLEQEEEQWRACLRPPDREGLLSED

SEQ ID NO: 25447 - protein, 81 aa, Saimiri boliviensis
ELLTFRDVAIEFSPEEWKCLDPTQQNLYRDVMLENYRNLVSLGVAFSNPDLVTCLEQRKEPYNVKIHEAVARPPVYRESQC

SEQ ID NO: 25448 - protein, 81 aa, Saimiri boliviensis
PQASVCFEDVAMAFTQEEWEQLDLAQRTLYREVTLETWEHLVSLGLLLSKPDVVSQLEQEEDLYRAEQVALQDWKATLENN

SEQ ID NO: 25449 - protein, 81 aa, Saimiri boliviensis
FQGQLTFNDVAIEFSLEEWQCLDKTQQNLYRDVMLENYRNLIFLGIAVSKPDLVTCLKQGKEPWNMRRHEMVTKPPAMCSH

SEQ ID NO: 25450 - protein, 81 aa, Balaenoptera acutorostrata
SVCEVSFEDVTVDFSREEWQHLDPAQRRLYRDVTLENYSHLCSVGYQVPKPEVIFKMEQGEGPWTLEEETPHQSSSDEDNG

SEQ ID NO: 25451 - protein, 81 aa, Saimiri boliviensis
FQRSVSFRDLTVNFNKEEWQQLDPAQRLLYRDVMLENYSNLVSVGYPVSKPDVIFKLEQGEEPWIVEEFSNQNYPEVDDAL

SEQ ID NO: 25452 - protein, 81 aa, Balaenoptera acutorostrata
SVTFEDVALYFSWEEWALLDEAQRCLYHDVMLENFALTSSLGCWHGVEDKEAPSQQSISVDGVSQIWILKAGSSPQKAQPF

SEQ ID NO: 25453 - protein, 81 aa, Vombatus ursinus
MAQRDLYKDVTLENYKNLISLGFPICKPVVISQLERGDGSWMLRKDIPRSTSPGPLCQVSTCETNHSTLKQDNCMEESSKK

SEQ ID NO: 25454 - protein, 81 aa, Balaenoptera acutorostrata
SEELVTFKDVAVDFSQEEWGQLDSPQRALYRDVMLENYQNLLALGPPVCKPDVISHLERGEEPWWAPRAVPGGAGPEPERE

SEQ ID NO: 25455 - protein, 81 aa, Lynx pardinus
MDSAQRTLYRDVMLENYSHLVSVGYCFTKPELIFTLEQGEDPWLFKKEFLRKGFPEEYQPNQLSEKSLENQSKYLWQVLFT

SEQ ID NO: 25456 - protein, 81 aa, Vombatus ursinus
FQGSLTFRDVAVEFTQTEWRHLAPFQKELYRDVMLENYRNLVCLGLAVSKPDVISQLERREAPWTPGGIQRSGCPGEWVIV

SEQ ID NO: 25457 - protein, 81 aa, Rhinopithecus bieti
PQGRLTFRDVAIEFSLEEWKCLNPAQRALYRAVMLENYRNLESVDSSFKTMMEYSSTGQGNTEVFHTEMLERHESHHFGDF

SEQ ID NO: 25458 - protein, 81 aa, Rhinopithecus bieti
GLVTFGDVAVDFSQEEWQWLNPNQRNLYRKVMLENYRNLASLGKGDCISVWTPDVISSLEQGKEPWTVKRKMTRAWCPDLK

SEQ ID NO: 25459 - protein, 81 aa, Rhinopithecus bieti
IQGPLTFGDVAVAFTRIEWRHLDAAQRALYRDVMLENYGNLVSVVQDYWFETKMSALKQSTSAGSVLGERRKSVMTEKGLD

SEQ ID NO: 25460 - protein, 81 aa, Rhinopithecus bieti
TQGHLTFRDVAIEFSQEEWKCLDPVQKALYRDVMLENYRNLVSLGICLPDLSIISMMKQRTEPWTVENEMKVAKNLVRWEG

SEQ ID NO: 25461 - protein, 80 aa, Ursus americanus
MTRSQVLLTFRDVAVEFSAEEWECLDPAQRALYRDVMLENYSNLVSLGEDNVSLNVGICPSEFLGGPCPARLIEAILTLN

SEQ ID NO: 25462 - protein, 81 aa, Muntiacus reevesi
MGLLTFQDVTADFTQEEWECLDLGQRELYRDVMLENYGNLACLGLVVSKQDLVMFLEQMKDPWDVWRIETAIYPGMNVLHP

SEQ ID NO: 25463 - protein, 81 aa, Ursus americanus
TQEEWGQLEPDQRTLYRNVMLETFRLLVSVGKATTEPPVNISIFFLSDLETQPKTKLSAPKQDITEERASSVLVERFLWDS

SEQ ID NO: 25464 - protein, 81 aa, Myotis brandtii
FQLPESLEDVAMYISQEEWGHQDPSKRALSRDTVQESYENVDSLESQVPNQEALSIQVEQGRKPWEPSAQTCKEGLSPRNP

SEQ ID NO: 25465 - protein, 81 aa, Myotis brandtii
TVVFADVAVCFTREEWALLDGAQRKLYREVMLETFRNLASVGNQCGDTLNQITDLPVDETHIPGVKHYECTKCGKVFTDCS

SEQ ID NO: 25466 - protein, 81 aa, Propithecus coquereli
NSRCVTFSDVAIDFSHEEWRWLDSAQRDLYKDVMVQNYENLVSLGLSITKPYVITLLEDGKEPWIVDKKLSKDWESRWENK

SEQ ID NO: 25467 - protein, 81 aa, Propithecus coquereli
AQESVMFSDVSIDFSQEEWECLNDDQRDLYRDVMLENYSNLVSMAGHSISKPSVISYLEQGKEPWLVPREPTRGQWPVLES

SEQ ID NO: 25468 - protein, 81 aa, Propithecus coquereli
LVFEDVAVNFTLEEWALLEPSQKNLYRDVMQETFRNLASIGKDGNVPSLSKLENKSHIPERLCERKEDSQCGETFIQIPDH

SEQ ID NO: 25469 - protein, 81 aa, Propithecus coquereli
SQVSLMFEDVAVLFSRDEWRKLDPSQRNLYREVMLENYSHLVSLGLPFTKPKVISLLQQGEDPWKVERESPGRPSLGWNTK

SEQ ID NO: 25470 - protein, 81 aa, Propithecus coquereli
GHVTFEDVAVCFSQEEWKLLDEAQRLLYRSVMLENFALTASLGLASSRSHEIIQLESWGEPFMPAWGFLAPALPKGCWHGV

SEQ ID NO: 25471 - protein, 81 aa, Propithecus coquereli
KAQESLTPEDVAVEFTWEEWQLLGPAQKDLYRDVMLENYSNLLSVGYQANKPDVLSKLERGELWTAEDEIHSRIYPEIKKV

SEQ ID NO: 25472 - protein, 81 aa, Propithecus coquereli
AAGSVTFKDVTMAFTQKEWEQLDPAQKNLYKDVMLENYSNLASMGCQAPKPDMISKLEKGEEPWLGKEKRPTQCHSNKIAR

SEQ ID NO: 25473 - protein, 81 aa, Saimiri boliviensis
AQESMTFRDVAVFFSQDEWLHLDSAQRALYREVMLENYSTLVSLGIPFSMPKVIHQLQQGQDPCMVEGEVPSDTCLGFKTW

SEQ ID NO: 25474 - protein, 81 aa, Propithecus coquereli
GLLTFKDVAIEFSQEEQACLDPAQQNLYRDVMLENYRNLVFLGLVVSKPDLITFLEQRQGPWNVKRHETVAKLQGIFSHYT

SEQ ID NO: 25475 - protein, 81 aa, Propithecus coquereli
SQELVTFEDVAVYFIRKEWKRLEPAQRDLYRDVMLENYGNVFSLDGETRTENDQEISEDTGSHAVLLGRFQKDISQGLKFE

SEQ ID NO: 25476 - protein, 81 aa, Propithecus coquereli
EDVAVDFSREEWQFLDPSQKVLYKEVMLENYSNLVSVGYQGTKPDSLFKLEEGKPPWIVEAAHSHTCPGLVIQNRRHAGKD

SEQ ID NO: 25477 - protein, 81 aa, Propithecus coquereli
MLTFRDVTIEFSLEEWECLNPAQQNLYRDVMLEYYGNLISLCEDNFSLAVSKQDLITCLEKRKEPWNVKKPETVVEHPAIS

SEQ ID NO: 25478 - protein, 81 aa, Propithecus coquereli
ASVTVTFDDVALYFSEQEWEILEKWQKEMYKQEMKTNYETLDSLGCAFSKPDLITWMEQGRMLLIGDQECLDGRRMTISPS

SEQ ID NO: 25479 - protein, 81 aa, Vombatus ursinus
MLENYGNLVCLGLAVSSPDVVCQLERGEGPWMPEGDVPGSSCAGWETKFSAPKLGIALKESSQETLTRVDICVSKLGEAWK

SEQ ID NO: 25480 - protein, 81 aa, Balaenoptera acutorostrata
RSQEPLTFQDVAVDFTREEWDQLYPAQKNLYRDVMLENYRNLVALGHQLYKPEVITQLEQGEQWMMETDSPPDTHPGDQSH

SEQ ID NO: 25481 - protein, 81 aa, Saimiri boliviensis
LANVTFDDVAVEFTPEEWALLDTTQKYLYRDAMLESYKNLVSVGCHLTSWLKQEELKTEIQPRTKGSLLQQGFLKNQIFNG

SEQ ID NO: 25482 - protein, 81 aa, Balaenoptera acutorostrata
RLTFEDVAIEFTEEEWECLDPGQRALYRDVMLETYRNLLSLDIFPIHVIKQLQPKVNSDKGEVFQTPMLGRPESCKIKHFH

SEQ ID NO: 25483 - protein, 81 aa, Vombatus ursinus
FQESMAFQDVAVDFTQEEWGYLDPAQRDLYREVMLENYRNLVFLGLVVSKPDVICHLEQRKELWNLEGVDKRRVPRDPCPG

SEQ ID NO: 25484 - protein, 81 aa, Saimiri boliviensis
VYSFFEKETLTFRDVAIEFSLEEWQCLNPAQQNLYRNVMLENYRNLVFLDIAVSKQNPISGLEQKKEPCSMKSHEMVARPS

SEQ ID NO: 25485 - protein, 81 aa, Saimiri boliviensis
SQTLVTFKDIFVDFTREEWKLLDTAQQIVYRNVMLENYKNLVSLGCQLTKPDVILRLEKGEEPWVVERGIHQETHPDSETA

SEQ ID NO: 25486 - protein, 81 aa, Balaenoptera acutorostrata
MESVTLEGVAVGLIQEWALLDDARRNLCRYVLLDNCRTLAPRGTPPCKACLVSQVGPREELRTAERGILCATGVDWESQLK

SEQ ID NO: 25487 - protein, 81 aa, Vombatus ursinus
MLENAQTFLSLGLPVPREDLISYLEEREAPWLLELEGLRSCCPEGEVRPEMKETSAKLSISVEQTYEQNHVSEGPCDFTRR

SEQ ID NO: 25488 - protein, 81 aa, Balaenoptera acutorostrata
SVTFEDIAVYFSWEEWRLLNETQRRLYLDVMLENFALISSLGCCCGAEDAEAPFEQIASLGVSQARTPKAALSSQKTHPCE

SEQ ID NO: 25489 - protein, 81 aa, Lynx pardinus
GLAVFKDVAIDFTQGEWNYLGAAQKDLSRDVMLENYHNLVSVGLSRSKPDVISLLEQEKQPWMVTKAMTGGPCPDLQCMCD

SEQ ID NO: 25490 - protein, 81 aa, Saimiri boliviensis
SKNGEHIETMKKLAQNHEAKGLPSNDTDWPQEKEGKAQIVVPVTLRDVTVIFTEAEWKRLSPEQRNPYKEVMLENYRNLLS

SEQ ID NO: 25491 - protein, 81 aa, Rhinopithecus bieti
MESVTLEDVAVEFIQEWALLGSARRSLCRYGMLDQCRTLTSRGAGAVPEDAVGALYRSEGDTVDSRGPASSPGAALVSGMH

SEQ ID NO: 25492 - protein, 81 aa, Panthera pardus
PQVSVSFEDVAVLLSWEEWGCLGPAQKGLYRDVMLETYRNLVSLGLQRSKPDVISRLEKGEEPWAPQSLRIEESWIRNHRS

SEQ ID NO: 25493 - protein, 81 aa, Panthera pardus
ESVTFKDVAVDFTQEEWGQLDSPQRALYRDVMLENYQNLLALEGEPGHEVKDESCQRQGVHKEEPYQEPITEPLVKSSIHS

SEQ ID NO: 25494 - protein, 81 aa, Panthera pardus
QEPVTFEDVAVYFTQNQWASLDPMQRALYREVMLENYTNMASLGGESRIKNEEPAGKREASEEAEWHRMPGGGLLRNVSQH

SEQ ID NO: 25495 - protein, 81 aa, Panthera pardus
CWGLLSFKDVSVEFTRDEWQLLDSAQKYLYRDVILENYSHLVSVGYHGTKPDLIFKLEQGEEPWIINAKVSRQSCPEDWKE

SEQ ID NO: 25496 - protein, 81 aa, Macaca nemestrina
MAFEDVAVYFSQEEWGLLDTAQRALYRRVMLDNFALVASLGSWSVAEDGDVSGEWPRAFSDTPPGMTTSIFPVAGAYHSVK

SEQ ID NO: 25497 - protein, 81 aa, Macaca nemestrina
FQEPVTFEDVAVYFTQNEWASLHPMQRALYREVMLENYANVTSLWGFPLSTERFLGCSLPSFLPSSVPELPVFLSPLHAFP

SEQ ID NO: 25498 - protein, 81 aa, Macaca nemestrina
GRVTFRDVAVEFSLAEWKCLNPVQRALYREVMLENYRNLEFVDSSLKSMMEFSSHEHSNTGEGFHTGTLERHKSYHIGDFW

SEQ ID NO: 25499 - protein, 81 aa, Muntiacus reevesi
SVTFPDVAVYFSWEEWRLLDEAQRCLYLDVMLENYALISSLGCCCGTENAEAPSEQITSLGVSQARTTKAALSTQKTHPCE

SEQ ID NO: 25500 - protein, 81 aa, Ursus americanus
RRAESVTFKDVAIDLTQEEWTLMDRSQRKLYIDVMLENITHLVSVGESATSDVISQWEQGGELWREDRGFAQGWNPGELWT

SEQ ID NO: 25501 - protein, 81 aa, Ursus americanus
GLLTFGDVAIEFSQEEWGCLSHTQRELYRDVMLENYGHLLFLGEDDSCQISQAPLGVSIEGSSQKVSMHRYKNSAVEILHL

SEQ ID NO: 25502 - protein, 81 aa, Ursus americanus
FQDLVTFKDVAVDFSQEEWEWLNPAQRNLYKNMMLENYQNLVSLGLCVSKPYVISLLEQGKEPWETKTEMTRNSGSIYETQ

SEQ ID NO: 25503 - protein, 81 aa, Ursus americanus
VLVTFKDVAVTFTQEEWGQLDLDQRALYQEVMLETCGLLVSLGDNVKLQTRDPSTCQLVLSEGALRQGSLTQGSSRDSRLA

SEQ ID NO: 25504 - protein, 81 aa, Ursus americanus
PTHSPGSSDISVDFTQKEWQLLDPAQRLLYKEVMLENYRQLVSLGHCVTKPELVLKLEQGEKPWAPKRELPSQSCPEIQKA

SEQ ID NO: 25505 - protein, 81 aa, Ursus americanus
KGAFVAFRDVAVDFTQEEWRLLSPAQRTLHWEVMLETYNHLVSLEIPFCKPKLISQLEQGEEPWIEERQHPLGLCPAGSKL

SEQ ID NO: 25506 - protein, 81 aa, Ursus americanus
LHGLLTFRDVAIEFSQEEWRCLSHTQRELYRDVMLENYRHLLFLGLIVSKPDLVSLLEQRKEPWDVKRKKTGLWCNENHLE

SEQ ID NO: 25507 - protein, 81 aa, Myotis brandtii
SDVNFEEVVIAFSQEEWGLLDEAQKLLYYNVMLEVFAFVSSVGCWHKMDDEEACSAQSVSIQGESQVGASKTATATQKTLL

SEQ ID NO: 25508 - protein, 81 aa, Myotis brandtii
MSVTFKDVAVLFTRDEWRKLRPPQRHLYQDVMLENYSNLVSLGLLFSKPKVISLLQQGEEPWKVEEESPGGAPLGWKSNHK

SEQ ID NO: 25509 - protein, 81 aa, Camelus ferus
MLRALEPLGAKAREMPWFVQGCSALIRISRPSVISQLEQKEEPWVLPLQNFEARKILRESHTAVLDNERLTAEEMDERRRQ

SEQ ID NO: 25510 - protein, 81 aa, Vombatus ursinus
MLENYRNLVSLGLLGPKPDLISWLEQGEETEFWDPLGCLARCTCLCEGGRSTWQSGSRGRSNSACHPCADILEALDGAAWE

SEQ ID NO: 25511 - protein, 81 aa, Propithecus coquereli
SQELLTFKDISVDFTQEEWGQLGPAHRNLYREVMLENYGNLVSVGYQLSKPGVISQLEKGEEPWLMEREISGCPGSDLESK

SEQ ID NO: 25512 - protein, 81 aa, Propithecus coquereli
SLGSELFRDVAIVFSQEEWQWLAPAQRDLYRDVMLETYSNLVSLGLAISKPDVISFLEQGKEPWMVERVATGDLCPVLESG

SEQ ID NO: 25513 - protein, 81 aa, Vombatus ursinus
MLENSQNLLSLGIPVLREDLTSHLMEREASWILDGKGPKNSSPGPVSLPSRTPRKHKSKRRPWMPFTTAQRLALEQKFQQK

SEQ ID NO: 25514 - protein, 81 aa, Propithecus coquereli
MAFRLLKAMYQLCFSKPGVILLLEQGKEPWMVKRELTKGLYSDWEPICETEELTPKQDLFKEQQSQKIIEKLTSYGLEYSS

SEQ ID NO: 25515 - protein, 81 aa, Saimiri boliviensis
TSKEAVTFKDVAVVFTEEELGLLGPAQRRLYRDVMLENFRNLLSVGHQPFNRDTFYFLREEKFWMMDVGTQREGNSGGKIQ

SEQ ID NO: 25516 - protein, 81 aa, Lynx pardinus
SQEPVTFEDVAVYFTRNQWTGLDPVQRALYREVMLENYANITSLGAFPFPKPELILRLERGEAPRGLDPWTPTGGEAPGDV

SEQ ID NO: 25517 - protein, 81 aa, Balaenoptera acutorostrata
AQGLMAFEDVAVYFSREEWGLLDAAQRALYRCVMLENFTLLASLGLSVSRPRVVIQLECGEEPWVLNGTDVTLASTAQRRP

SEQ ID NO: 25518 - protein, 81 aa, Vombatus ursinus
KGFLGSKPDVISQLERGEESWVLDIEKPEERELSSRKGAYGGYKKKYKEKLSLRQEVPKGRKIYKNASVKYPWDTSQVLDF

SEQ ID NO: 25519 - protein, 81 aa, Saimiri boliviensis
ADISGLVTFRDVAVEFSLEEWKCLEPAQRDLYREVTLENFGHLVSLGKEIVSHGPDGKQGTWDYNHFERQVSEECYFKQVN

SEQ ID NO: 25520 - protein, 81 aa, Vombatus ursinus
PQESVTFWDVAVTFTEEEWGCLAPPQRELYQEVMLENYQNLACLGLATSTPEMIIQLEQGEVPSTPGGGGPGICPPDGGTK

SEQ ID NO: 25521 - protein, 81 aa, Vombatus ursinus
SQELVTFKDVAVDFTWEEWELLEPGQKALYRDVTLENYRNLVSLGHPVSKPNVIFQLEQSDTPWLLEREAPRSIFPGEGMD

SEQ ID NO: 25522 - protein, 81 aa, Saimiri boliviensis
AQGSVSFNDVTVDFTQEEWQHLDHAQKTLYMDVMLENYCHLISVEENWKAEDFLVKFREHREKYSRSVVSINHKKLVKEKS

SEQ ID NO: 25523 - protein, 81 aa, Vombatus ursinus
SRGSVTFQDVAVTFTPEEWGRLAAPQKELYREVMLENFGHLACLGLVISKPDVICQLERGEGPWKPEGDAPLSSCAGGSKN

SEQ ID NO: 25524 - protein, 81 aa, Saimiri boliviensis
QGTVTFEDVAVHFSWEEWGLLDEAQRCLYRDVMLENLALLTSLDVHYQKQHPGEKHFGSNVDRALFVKTCIFHVLGETSTC

SEQ ID NO: 25525 - protein, 81 aa, Vombatus ursinus
GQLDPAQQNLYRDVMLDNYQNLIFLVRITHKKNPNTVKDHECNTLQRNSSPRSILVTQQTGPAGKSFHQCGAREKTLQKLS

SEQ ID NO: 25526 - protein, 81 aa, Panthera pardus
KSPGLLSFKDVAVVFTWEEWQLLDPIQKHLYQDVMLENYSNLISVGCQVTKADAFYQLEQGPPWITEEEIQSQIHPDDTWQ

SEQ ID NO: 25527 - protein, 81 aa, Panthera pardus
MLENYQNLLSLGAGPPGFKPDVISRLERGEEPRMEKREGWQMTCPDSETRSAPTQETLVKKSISAEAASPVGKTGGGLRAA

SEQ ID NO: 25528 - protein, 81 aa, Panthera pardus
FQGSVSFKDVTVGFTQEEWQCLDSSQRSLYRDVMLENYSHLVSVGSCATKPEVIFRLEQGEEPWIWEEEFPSQSLPEVWET

SEQ ID NO: 25529 - protein, 81 aa, Macaca nemestrina
MLENYKNLVFLGIDISKQDPITSLEEEKEPWNMKRHEMVDESPGYMCWMCSYVFLFYQRPLARARHKRFFPTSDTEKIQKM

SEQ ID NO: 25530 - protein, 81 aa, Macaca nemestrina
PAQGMTFEDVAIYFSQEEWELLDESQRFLYCDVMLENFAHVTSLGYCHGTENEVIAPEQSVSTQVRTSKGDTPTQKSLSEI

SEQ ID NO: 25531 - protein, 81 aa, Macaca nemestrina
MGPLQFRDVAIEFSLEEWHCLDTAQRNLYKNVMLENYSNLVFLGIVVSKPDLITRLEQGENPLTVKRHKMTANPSVMCSHF

SEQ ID NO: 25532 - protein, 81 aa, Ursus arctos
RLTFRDVAIEFSQEEWECLDPAQRELYRDVMLENYRNLVSLDVSPTHVMKKLQPKENSNTREVFQTAMLERHEGHEIKDFY

SEQ ID NO: 25533 - protein, 81 aa, Muntiacus reevesi
MGRLTFWDVAIDFTQEEWECLDLGQRELYTDVMVENYRNLASLGLVVPKPDLVTFLEQMKDLRNIRRMQTALIYPAISPQD

SEQ ID NO: 25534 - protein, 81 aa, Muntiacus reevesi
SMTLEDVAVNFTQKEWALLDAAQRQLYRDVILETCGHLAYSTPRQNNLAKRTFQEVNRAHLASSGRTLKQVAVAHEKDAFP

SEQ ID NO: 25535 - protein, 81 aa, Muntiacus reevesi
SIAFQDLAVRFSEDEWRLLGEGQRALYLDVMRENYDTLASLGTAEPLPLSAFLSPSELGGAVGARSRVGDRKEPTQGGGPV

SEQ ID NO: 25536 - protein, 81 aa, Muntiacus reevesi
DCVVFEDVAVYFSQEEWGLLDEAQRHLYRAVMTENLALVTSLGCWHGAQGEEPSSEQGVSVGMSEVRTAKPDPSSRKAQPS

SEQ ID NO: 25537 - protein, 81 aa, Ursus americanus
WVKSWGGSDVAIDFSPEEWGWLDSAQRDLYKDVMVQNYENLVSLAGLSIPKPYVISLLEDGKEPWMVEKKLSKGMFLDWES

SEQ ID NO: 25538 - protein, 81 aa, Muntiacus reevesi
KLGQVTFEDVAVYFSWEEWGLLDEAQRLLYHGVMLETFSLMASLGLTSFRTHDMTQMEQRGEPCVPAEGVSATATPAGCWC

SEQ ID NO: 25539 - protein, 81 aa, Muntiacus reevesi
MFGLVTFRDVAVEFSQEEWKCLEPAQRDLYREVTLENFGNLASLGLSISKPDVVSLLEQGKEPWMVVNDMTGPWCPDLESR

SEQ ID NO: 25540 - protein, 81 aa, Muntiacus reevesi
SSETLTFRDVFVDFTQEEWQQLNAAQKNLHRDVMLENYSHLVSVGYLVAQPHGIFRLGQEEEEAGMAAGESPLWSCPGEPM

SEQ ID NO: 25541 - protein, 80 aa, Ursus americanus
MKQLTEGRDVAIEFSQEEWGCLSHTQRELYRDVMLENYGHLLFLGLTVWKPDLVIFLEQEKQLWDVKRKETVAFHPGRWD

SEQ ID NO: 25542 - protein, 81 aa, Ursus americanus
PLGLLTFGDVAIEFSQEEWRCLSHTQRELYRDVILENYGHLLFLGVIVSKPDLVSLLEQRKEPWGEKRNKTVLFDPVRMCL

SEQ ID NO: 25543 - protein, 81 aa, Myotis brandtii
LSEESLTLEDVAVDFTWEEWQLLGPEQKDLYRDVMLETYSHLVSVGYPASKPDTLSRLERGEPWTREGGLHSGICSETKKN

SEQ ID NO: 25544 - protein, 81 aa, Myotis brandtii
MAFTQKEWEQLDPAQRSLYKDVMLENYSNLTSMGYQAAKPDMISKLEKGEEPCLGKGKRPRQGGPGEIARPKQIGANRKEM

SEQ ID NO: 25545 - protein, 81 aa, Myotis brandtii
AEFWDMNFEDVAIAFSQEEWGLLDEAQRLLYCDVLLEGFALVSSVARGSSAGGLNYIEASEAVSLLCKDMNFEDVSIAFSQ

SEQ ID NO: 25546 - protein, 81 aa, Eschrichtius robustus
ELLTFKDISVDFTQEEWGQLAPAHRNLYREVMLENYGNLVSVGCQLSKPSVISQLEKGEAPWMTEKEGPGDPSSAGGILVP

SEQ ID NO: 25547 - protein, 81 aa, Propithecus coquereli
SYEGSVSLRDVSIDFSREEWQHLDPSQRNLYRDVMLETYSHLLSVGYQVPKEEVVMLEQGKEPWALQGENPHQSCPGQKLW

SEQ ID NO: 25548 - protein, 81 aa, Propithecus coquereli
GRLTFRDVAIEFSLEEWKCLDPAQRALYKAVMLENYRNLVSLGISPFDLRIISLLEQGKEPWTVESQVQIARKSDGWKRIK

SEQ ID NO: 25549 - protein, 81 aa, Propithecus coquereli
CEKSVSLEDVTVDFSREEWQQLDPSQRHLYQDVMLEICNHLISVGYHIPSPEVIFRIVKGQGQWMGEAELPHQRCQEGKFG

SEQ ID NO: 25550 - protein, 81 aa, Lynx pardinus
FQGSVSFRDVAISFSQEEWACLDPAQRALYRDVMLENYSHLLSLAGRSISKPDVITFLEQEKEPWVVVRKETSGWYPDLES

SEQ ID NO: 25551 - protein, 81 aa, Saimiri boliviensis
VTFEDVAVVFTDEEWSHLVPIQRDLYKEVMLENYKSVVSLDWETKPEIYDASEEKAEGLLRESLGRQSPLCPKFEVHAPDG

SEQ ID NO: 25552 - protein, 81 aa, Balaenoptera acutorostrata
MFSDVSIDFSQEEWDYLDLEQRDLYRDVMLENYSNLVSLGCFVSKPDVISLLEQGKEPWKVVRKGRRRYPDLETNSETKKL

SEQ ID NO: 25553 - protein, 81 aa, Vombatus ursinus
AQASVSFKDVAVDFSQEEWCFLDASQKKLYKEVMLENYRNLVSLGLPVGKADVIFQLEQGQVPGTLEGEDPAASRPDWELR

SEQ ID NO: 25554 - protein, 81 aa, Saimiri boliviensis
LQGPVSFKDVAVDFTQEEWQQLDPDEKITYRDVMLENYSHLVSVGCDITKPNVIIKLEKGEEPWIMEDEFPCQHNPEVWKV

SEQ ID NO: 25555 - protein, 81 aa, Saimiri boliviensis
SWGPLSFMDVFVDFTREEWQLLDPAQKCLYRSVMLENYSNLVSLGYQHTKPDIIFRLEQEELCMVQTPIPNQCCPVLEAGK

SEQ ID NO: 25556 - protein, 81 aa, Ursus americanus
GLLDPAQRKLYRDVMLENFRNLLSVGEGNVWVMDTYLDWRCKKLDRQDIVYKHEGDSYGFSWISRCHDAHRLPERETPCNW

SEQ ID NO: 25557 - protein, 81 aa, Ursus americanus
AQGRTFQDVAVVFSEEELGLLDSTQRKLYRDVMLENFGNLVSVGEDRRSVTESQVLIIPIQQQDVSVLRSMELGKLWSCPV

SEQ ID NO: 25558 - protein, 81 aa, Ursus americanus
WGLLDEAQRLLYRDVMLENFSLMASLGLASSRTHEITQLEWWREPFLPPCEVLTAAMPRGTWRAEAEAEEAPREQSVYIAG

SEQ ID NO: 25559 - protein, 81 aa, Eschrichtius robustus
VPVTFDDISIYFSTPEWEKLEEWQKELYKNIMKGNYESLISMDYAMNQPDVLSQIQPEGDHNTEDQAGPEGSAIPTDPSEE

SEQ ID NO: 25560 - protein, 81 aa, Myotis brandtii
MNFEDVAIVFSQEEWGLLDEAQRLLYWDVMLEVFALVSSVGCWHKIDGDEACSVFIQGESLVRASKTAPSTQKIPLCKRCF

SEQ ID NO: 25561 - protein, 81 aa, Myotis brandtii
VTFEDIALYFSREEWSLLDEGQRQLYLNVMLENFELISSLGCCCGAENEEAVTEQNFFVRVSQARNPQLPLSSQKSHPCES

SEQ ID NO: 25562 - protein, 81 aa, Propithecus coquereli
SLVTVTFKDVAVDLTQEEWQQMKPAQRNLYRDVMLENYSNLVTVGCQVTKPDVIFKLEQEEEPWVMKEEMFGRHCPEPRRG

SEQ ID NO: 25563 - protein, 81 aa, Vombatus ursinus
ASVPVKFDDVAIYFSEQEWDILDDWQKDLYKHVMRANYSTLVSLDYTIPKPDLIFRIELGEVLFVGNWGDLEQAEIGVSLN

SEQ ID NO: 25564 - protein, 81 aa, Saimiri boliviensis
EMGPLTFRDVAIEFSLEEWQCLDTAQQDLYRKVMLENYTNLAFLAGIAVSKPDLITCLEQGKEPWNMKRHEMVDEPPAMCS

SEQ ID NO: 25565 - protein, 81 aa, Propithecus coquereli
SQGLVSFKDVAVDFTQDEWQQLDPAQRTLYRDVMLENYSHLVSMGYPVSKPDVISKLEQGEDPWIIKRDISNWIYPDENQA

SEQ ID NO: 25566 - protein, 81 aa, Propithecus coquereli
MVTFKDVAVVFTEEELGLLDSAKRKLYRDVMLENFRNLLLVAHQPFKPDLISQLEREEKLLMVETDTQRDGCSENKNQQKT

SEQ ID NO: 25567 - protein, 81 aa, Vombatus ursinus
MLENYQNLVFLGLVVSKPAVIDQLERGEEPWIPEGDVPRGPRPGWESWPEIKESVPKLGISMEEYQERLASYGPQASHLEE

SEQ ID NO: 25568 - protein, 81 aa, Vombatus ursinus
FQESVTFEDVAVDFTWEEWGCLDTSQKELYWEVMLETCRNLVSLGLADSNVEVISQVESGEAHGIPVDSVLRSCRPDGDGK

SEQ ID NO: 25569 - protein, 81 aa, Vombatus ursinus
VWIFQKSLTFQDVAVEFTQEEWGLLEPAQKDLFREVMLENYENFVSLGLPVSKPDVTSHLERRETFRLPEGEVPRGTYLGE

SEQ ID NO: 25570 - protein, 81 aa, Saimiri boliviensis
HPGSWETGPLTFRDVAIEFSLEEWQCLDTAQQDLYRKVMLENYRNLVFLGIAVSTPDWITCLEQGKDPWNMKRHSMVATPP

SEQ ID NO: 25571 - protein, 81 aa, Saimiri boliviensis
MNSVSFEDVAVNFTLEEWALLDSSQKKLYKDVMRETFKNLVCLGKSWEDQDVEDDHSNLGRNQRGYMVERLCESRKGTKSR

SEQ ID NO: 25572 - protein, 81 aa, Saimiri boliviensis
MAEGEEEWQQLNPAQKTLHRDVMLETYSHLDSVGCSGIKPDVIFKVEHRKDPWIKDSELSRWIYPDRQKGLKSSQQIISGE

SEQ ID NO: 25573 - protein, 81 aa, Vombatus ursinus
FQELVIFEDVSIYFTLKEWKLLIPTQRVLYRNVMLENYGNVVSVGFPFSKPALISHLEQEEEPLVQYLQETERKDAQKGLC

SEQ ID NO: 25574 - protein, 81 aa, Saimiri boliviensis
PSEGVTFEDVAVYFSWEEWDLLDETQKHLYFDVMLQNFVLTSSLGLVSSWSHVVAQLGVGEVSSVLHRMFMTPASHEEAPS

SEQ ID NO: 25575 - protein, 81 aa, Balaenoptera acutorostrata
QAQETLTFDDVTVDFTWEEWQLLTPPQKDLYQEVMLENYSNLLSVGYQARKPDILSKLDQGKPWTMEDEIHCQTHSGYQAS

SEQ ID NO: 25576 - protein, 81 aa, Lynx pardinus
QPQEAVTFKDVEVIFSQDEWGWLDPAQRNLYRDVMLENYGNMVSLVGPFTKPVLISWLEAREPWGLNVQGAQPKGNPGVAP

SEQ ID NO: 25577 - protein, 81 aa, Lynx pardinus
FQGSLSFEDVTVGFSQEEWQHLDPAQRTLYRDVMLENYSHLVAVGCCVPKPDVIFRLEQGQQPWLVEEESLDQIWPEVCRV

SEQ ID NO: 25578 - protein, 81 aa, Saimiri boliviensis
MGLLTFRDVAIEFSLEEWEHLDSNQKNLYGDVMLENYRNLVCLGLTVSKPDLITFLEQRKEPWNVKSAETVASQPDVFSRD

SEQ ID NO: 25579 - protein, 81 aa, Vombatus ursinus
MLENSQNLLSLGIPVLREDLISHFEEREASWILDQIDLRNSCPDAQTRSEVNEPTTKLSISVEESHQQRYLSDSPCDLNLR

SEQ ID NO: 25580 - protein, 81 aa, Balaenoptera acutorostrata
RLTFKDVVIEFSPEEWECLDPAQRALYRDVMLETYRNLVFIMKAYLSHIHMIKKLQLKSNTDIGEIFQTVMLGSHGSCEIK

SEQ ID NO: 25581 - protein, 81 aa, Lynx pardinus
PQVSVSFEDVAVLLSWEEWGCLGPAQKGLYRDVMLETYRNLVSLGLQHSKPDVISRLEKGEEPWTPHSLRIEESWIRNHRS

SEQ ID NO: 25582 - protein, 81 aa, Balaenoptera acutorostrata
LQEAVTFEDVAVNFSNEEWQCLTHAQRHLYKDVMLENYGNVVSLGFPFPKPPLISHLEQEAELCAQDRQDREFLSCSYPVS

SEQ ID NO: 25583 - protein, 81 aa, Cervus elaphus
QPKAKKSWGHLSFMDVFVDFTWEEWQLLDSAQKHLYRSVMLENYRNFVSLGYQYTKPSIIFQLEQEELWMMHSPSQDHSGE

SEQ ID NO: 25584 - protein, 81 aa, Colobus angolensis
MELFTFRDVAIEFSPEEWKCLDPAQQNLYRDVMLENYRNLVSLAVCSPFSQDLSPVQGIEDSFQKLVLRRYEKCGYKNLQL

SEQ ID NO: 25585 - protein, 81 aa, Oryctolagus cuniculus
VTIYQLGSIPYRGWSNISLGSWLFLYGFRVSPIERPHGVFITSHNSVTMTDGLVMFRGVAVDFSQEEWECLDLVRGPCTWA

SEQ ID NO: 25586 - protein, 81 aa, Rhinopithecus bieti
DSVTFEDVAVDFTQEEWTLLDQTQRNLYRDVMLENYKNLVAVDWESHINTRRSAPQQNFLQGKTSSVVEMSHTLSPRLEYS

SEQ ID NO: 25587 - protein, 81 aa, Macaca nemestrina
QELLTFRDVTIEFSLEEWEFLKPAQQNLYRKVMLENYRNLVSLAVSSHCTEDFLPEQGMKDSFQKVILRRYGSCGLEDLHL

SEQ ID NO: 25588 - protein, 81 aa, Macaca nemestrina
QGRVTFRDVAIEFSLAEWKCLNPAQRALYREVMLENYRNLEAVDISSKCMMKEILSTGQGNTEVFHTGTLQRHESHHIGDF

SEQ ID NO: 25589 - protein, 81 aa, Macaca nemestrina
MGPLTFRDVAIEFSLKEWQCLDTAQRNLYRNVMLENYRNLVFLVMCSHFAQDLWPEQNIKDSFQKVTLKRYGTCRHENLPL

SEQ ID NO: 25590 - protein, 81 aa, Macaca nemestrina
PQGHLTFMDVAIEFSQEEWKCLDPGQRALYRDVMLENYRNLVSLGICLPDLSIISMLKQRREPLTLQSGVKIVKNPDGREC

SEQ ID NO: 25591 - protein, 81 aa, Ursus arctos
MCDSVFPSWPCAGFLVFKPELISRLEQGQEPWVLDLKGVEGREGARTFLTDSAVGTASEQACADMGVLKPEPCVAVVRSPP

SEQ ID NO: 25592 - protein, 81 aa, Ursus arctos
VMAHMAFRDVAVDFSQEEWLLLSPAQRSLYREVMLENYSNLVSLGIPFSKPKLISQLEQGKETWREERTCPLATCPEPKPE

SEQ ID NO: 25593 - protein, 81 aa, Ursus arctos
AQESVTFRDVAVFFSQDEWLRLDSAQRTLYREVMLENYGTLVSLGILFSTPKVIFQLQQGEDPWMVENGVSRGPRVGWERL

SEQ ID NO: 25594 - protein, 81 aa, Ursus arctos
PKVPVTFDDVAVYFSEPEWGKLDEWQKELYKHVMRGNYEMLVSLDYAISKPDILTRMERGEDPCPEGPWGQEERSKKEAVR

SEQ ID NO: 25595 - protein, 81 aa, Muntiacus reevesi
APVTFDDITVYLLQEEWVLLSQQQKNICGSDKMVAPLGPSIASPELFYKFEQGPEPWLASVQGQRSHLSPNPGKNKMGFME

SEQ ID NO: 25596 - protein, 81 aa, Muntiacus reevesi
MGLLTFQDVTIDFTQEEWECLDLGQRELYRDVMLENYGNLACLGLVVSKPDLVTFLEQMKDPWDARRVETAIYPGIIHDEM

SEQ ID NO: 25597 - protein, 81 aa, Muntiacus reevesi
PQDLMTFEDVAVEFTWWEWGQLDPAQKDLYREVMLENFKNLASLDWERRPQAKEAMLSQGLSKEELLQRASEEKHIRDELR

SEQ ID NO: 25598 - protein, 81 aa, Muntiacus reevesi
LGLLTFEDVAVHFTQEEGARLDAGQRTLYRDVMLETYRILISLGEPFPPPHPQYPSELRWDLGGARLAVTLGPEVGHSAPR

SEQ ID NO: 25599 - protein, 81 aa, Muntiacus reevesi
GSVTFEDVAVNFSWEEWGLLDESQKRLYHDVMLENLALISSLGCWPGEEDKEAFSEQSISDQGCSQIRIAKAGLSPQKANL

SEQ ID NO: 25600 - protein, 81 aa, Ursus americanus
HCIMKPEVIVKLEQGAEPWTVEEAPTQSLPDVQTSGDLIETCQEHQSRHVWQAGVANNETSTKERTDLGKPFNLSAIHISN

SEQ ID NO: 25601 - protein, 81 aa, Ursus americanus
DQMAVTFEDVTVIFTWEEWKFLDSSQKKLYREVMWENYTNVMSVGNWKESSKPQEERLRYLEHENRLSWQGWRNASAQIYE

SEQ ID NO: 25602 - protein, 81 aa, Myotis brandtii
PSSPVTFEDVAVFFSQEEWGLLDEARRRLCRDVMLEIFELMASLGCWHEVEDEEACSKQNASVEGVSQVRIPNAHPSTEKT

SEQ ID NO: 25603 - protein, 81 aa, Eschrichtius robustus
EEWDYLDPAQRSLYKDVMMENYGNLVSLDVLNRDKDEEPTVKQEIEEIEEEVEPQGVIVTRIKSEIDQDPMGRETFELVGE

SEQ ID NO: 25604 - protein, 81 aa, Myotis brandtii
MEEWAFLDPTQKKLYTDVMLETFWNLASVACILEQCDDHDNEDQYKKHGMNLSNHIVKRLCTRKDGSQYRENFSQIPNNNE

SEQ ID NO: 25605 - protein, 81 aa, Myotis brandtii
PRESVTFKDVAVLFTQDEWAQLSPAQRALYRDVMLENYSHLVSLGLLGPKPDLFAQLGKGEEWTPEDTSRGFCLGKTLYVG

SEQ ID NO: 25606 - protein, 81 aa, Propithecus coquereli
FQEVVTFGDVAVHFSREEWQCLDPGQRALYREVMLENHSSVAGLAGFLVFKPELISRLEQGQEPWVLDLQGVEGTEAPRTS

SEQ ID NO: 25607 - protein, 81 aa, Propithecus coquereli
PQETIVFEDVAVYFTRIEWSCLAPDQRALYRDVMLENYGNLAALGFLITKPALISLLEQGEEPGALILQVAEERGTKASLC

SEQ ID NO: 25608 - protein, 81 aa, Oryctolagus cuniculus
CEVSVSFEDVTVDFSKEEWQQLDFTQRSLYQDVMLENYSHLLSVGFEVPKPEVIFKLEQGQEPWMLEEEAPHQRCSDGIKA

SEQ ID NO: 25609 - protein, 81 aa, Oryctolagus cuniculus
MLPLTFEDVAIYFSEQEWQSLEAWQRELYGHVMRTNYETLASLDGGLPKPELITWIEQQGEFGSCTESQKPRNIICSSADT

SEQ ID NO: 25610 - protein, 81 aa, Pteropus alecto
SQRQLTLSDVFIEFSQEEWECLSPAEQALYREVMLESYRNLLFLGISVSDLYIVSILEQGKAPWTQESELKLAQKPDWWEH

SEQ ID NO: 25611 - protein, 81 aa, Pteropus alecto
SAASVSFKDVTVEFTPDEWQYLGASQSTLYRNVMLENYSHLVSPGYCSIKPEVIFKLEQGEDPWLVEDEFLNRSFSAIHQR

SEQ ID NO: 25612 - protein, 81 aa, Oryctolagus cuniculus
SKAPVTFGDLAIYFSQEEWEWLSPIQKDLYEEVMLENYQNLVSLGLSFRRPNVITLLEKGKAPWMVELLRRHRGPDKGSKC

SEQ ID NO: 25613 - protein, 81 aa, Rhinopithecus bieti
ISGVLTFRDVAVEFSLEEWQCLDTAQQNLYRNVMLENYRNLVFLGIAVSKPDLITCLEQGKKPWNMKRHEMVAKPPGWSAV

SEQ ID NO: 25614 - protein, 81 aa, Ursus americanus
FVCSMTFRDVAIDFSRQEWEYLDPIQRDLYRDVMLENYRNLVSLGHSISKPGVVDLLEQGKEPWIILREETQRQYTVYNSI

SEQ ID NO: 25615 - protein, 81 aa, Ursus americanus
RPGAVSFADVAVYFSPEEWGCLRPAQRALYREVMRETYGHLGALGFPGPKPALISWMEQESEAWSPDAQDPEEGESLGGAL

SEQ ID NO: 25616 - protein, 81 aa, Propithecus coquereli
SCEGSVSFRDVVIDFSREEWQHLDPSQRNLYQDVMLETYSHLLSVGYQVPKAEVVMLEQGKEPWALQGESLHQSCPGEKLL

SEQ ID NO: 25617 - protein, 81 aa, Propithecus coquereli
TQGQLTFRDVAIEFSQEEWKCLDPAQRALYRDVMLENYWNLVYLGISSFDMNIIYILEEGKEPWTVESQVKIARKPHRWEG

SEQ ID NO: 25618 - protein, 81 aa, Propithecus coquereli
FASFQEQQKMSKSLDVAVDFTWEEWQDLDDAQKTLYRDVMLETYSSLVSLGHCVTKPEVIFKLERGAEPWMVEESSKQSLP

SEQ ID NO: 25619 - protein, 81 aa, Saimiri boliviensis
QGSLTFRDVTIEFSPEEWRCLDPAQRTLYRDVMLENYRNLVSLDISPKYKMKELFSTAQGDTEVFHGGILDRRESHHIGDF

SEQ ID NO: 25620 - protein, 81 aa, Propithecus coquereli
MDVMLENYCHLISVGCHMTKPDVILKLEQGEEPWASFAGLTCLEENWKAEDFLVKFREQQDKYFRSVVCINHKKLVNKKNN

SEQ ID NO: 25621 - protein, 81 aa, Propithecus coquereli
RFQGSVTFGDVAIDFSQQEWESLDSAQKDLYRDVMLETYRNLVSMDLHLKEEIISYEEMPTSEKCTSLALHQKVLNQEKPC

SEQ ID NO: 25622 - protein, 81 aa, Propithecus coquereli
CEVPVSFEDVTVDFSREEWQHLDPAQRRLYWDVTLENYSHLLSVGYRVPKPEAIFQLEQEEGLWTLEGKAPHQSDSGEALG

SEQ ID NO: 25623 - protein, 81 aa, Propithecus coquereli
SQVSLMFEDVAVLFSRDEWRKLDPSQRNLYREVMLENYSHLVSLGLPLTKPKVISLLQQGEDPWKVERESPGRPSLGCKSS

SEQ ID NO: 25624 - protein, 81 aa, Lynx pardinus
MDTSQRMLYRDVTLENISHLVSVGCHFFRSDVISPWEQRGELWREERGPPQGWSPGMKKSHNKQEIISMQDIYMKDPPNCW

SEQ ID NO: 25625 - protein, 81 aa, Saimiri boliviensis
DAEQVTFEDVVVDFTKEEWGQLAPAQKTLYCDVMLDTFRLLVAVGHWLPKPNIISLLEQEAELAVDPGVPQGVYQESKGHF

SEQ ID NO: 25626 - protein, 81 aa, Vombatus ursinus
MLENYQNFVSLGGLPAPKPHVISQLERGEAPWIAEREALGGVCQDSFIQNTRYEIKEPSINYGIFMGASAKERLSKNPIWN

SEQ ID NO: 25627 - protein, 81 aa, Balaenoptera acutorostrata
KTWGPLSFMDVFVDFTWEEWQLLDPAQKHLYRSVMLENYSNLVSLGYQHTKPNIIFQLEQEELWMMQIPSEGHPDEVWEID

SEQ ID NO: 25628 - protein, 81 aa, Balaenoptera acutorostrata
AQACVTFEDVAIYFSQEEWGLLDEAQRFLYHDVMLENFTLTTSLDCQCGGEDEEIPSEQSVSGGESQVRTSQSVPSTQKTH

SEQ ID NO: 25629 - protein, 81 aa, Saimiri boliviensis
PQDLMTFEDVAVEFTQWEWGQLNPAQKDLYREVMLENFRNLTLLGLLVSKPYVICQLEEGGECFMVRREISIGAHSDWERR

SEQ ID NO: 25630 - protein, 81 aa, Vombatus ursinus
PKVPVTFDDVAVYFSEKEWGNLDKWQKELYKHVMTGNYEMLVSLDYALSKPEFLTRIEQGEEPCVQNQLDSEEAEVAASPD

SEQ ID NO: 25631 - protein, 81 aa, Balaenoptera acutorostrata
PKVPVTFDDVAVHFSEQEWGNLSEWQKELYKNVMRGNYESLVSMDYAISKPDLMSQMERGERPVMQEPEDSEEGEAPADPS

SEQ ID NO: 25632 - protein, 81 aa, Balaenoptera acutorostrata
FQGSVSFKDVTVGFTQEEWQHLDPTQRSLYRDVMLENYSNLVSVGYCVTKPEVIFRLEQGEEPWVLEEEFPRQSFAEVWKT

SEQ ID NO: 25633 - protein, 81 aa, Saimiri boliviensis
FQASVSFQDVAVEFTQEEWQHMGPVERTLYRDVMLENYSHLVSVGYCFTKPELIFTLEQGEDPWLLEKEKGFLSRTSPEDS

SEQ ID NO: 25634 - protein, 81 aa, Balaenoptera acutorostrata
SQSLVTFGDVAVEFSPEEWAWLDSAQRSLYRSVMLENYRSLVSLGLCVSKPKMISSLEQRKEPWAAKRTLTRGGCPDSRAL

SEQ ID NO: 25635 - protein, 81 aa, Balaenoptera acutorostrata
WLTFKDVVIEFSQEEWECLDPAQRALYRDVMLETCRNLLSLDICPIHVVKQLQPKGNSDPGEVFQRVILGRSKSREIKHFY

SEQ ID NO: 25636 - protein, 81 aa, Lynx pardinus
MDTSQRTLYRDVTLENISHLVSVGCHFFRSDVISQWEQRGELWREERGPPQGWSPGMKNSHNKQEIIPMQDICMNDPPNCW

SEQ ID NO: 25637 - protein, 81 aa, Balaenoptera acutorostrata
KPAAVSFADVAVYFSVEEWGCLRPAQRALYRDVMRETYGHLGALGFPGPKPALISWMEQESEAWSPAAQDPEEGESLGGAL

SEQ ID NO: 25638 - protein, 81 aa, Saimiri boliviensis
SQDSMTFEDIVVDFTREEWALLDTSQRKLFRDVMLENISHLVSIGNQFCKSVVFSHLEQVEKLSTQGISLLQGKEGDIKHQ

SEQ ID NO: 25639 - protein, 81 aa, Saimiri boliviensis
VTFEDVAVYFIRKEWKRLEPAQRDLYRDVMLENYGNVFSLDPIRVSLTIQKVMLAWFTGTLTVVRGLCPSELASVEPPDTE

SEQ ID NO: 25640 - protein, 81 aa, Oryctolagus cuniculus
SLNRCAFEDLAVYFTWEEWQKMNNAQKILYRDVMLETYSSLFSLGSCITKPDLIIKLEQGAEPWMVEEYLNESLPGQCAHN

SEQ ID NO: 25641 - protein, 81 aa, Oryctolagus cuniculus
GSVSFTDVTVDFTQEEWEQLDPAQRILYMDVMLENYSNLLSVEVWKADDQMEGHPRSPEEQARQFIIHKSPVEERGNPFGK

SEQ ID NO: 25642 - protein, 81 aa, Oryctolagus cuniculus
KGQVTFEDVFVHFSWEDWGLLDEAQKHLYRDVMLENFALVASLGKDLISTPASFPPGARSFLLVSHAGAGPKDLGHPPLPS

SEQ ID NO: 25643 - protein, 81 aa, Oryctolagus cuniculus
SQASVSFKDVSVEFTLEEWQHVSPAQRTLYRDVMLENYSHLVSLGYCFTKPGLIFILEQGEDPWLLDKEFLSRSSPEDFQP

SEQ ID NO: 25644 - protein, 81 aa, Rhinopithecus bieti
MLENYGNLVSVGYQLSKPGVISQLEKGEEPWLMEREISGVPSSDLESKTKTKESALQNDISWEELHCGLMMERSTKGSTMY

SEQ ID NO: 25645 - protein, 81 aa, Panthera pardus
ESGAQVPVSFEDVSMYFIKTEWKLLGLSQRILYKRVLLENYRHLVSLGQGITPLSCWPQSPPAWGSPGPAWPPCIQSPLLP

SEQ ID NO: 25646 - protein, 81 aa, Panthera pardus
MLETYSHLLSVGYEVPQPEVFMLEQGKEPWALQGESPHQSCSEELWQIDDQTESYQQRENKSLRDVVFIKKILTTKKDYEY

SEQ ID NO: 25647 - protein, 81 aa, Panthera pardus
MLENYSHLVSVGYDSTKPKVILKLEQGEEPWVVEGDLPCRRRPEVWKVDDLIERIPENGDDISRQAVSANSKTPNEEREDA

SEQ ID NO: 25648 - protein, 81 aa, Panthera pardus
MFFVITSPLTKIVMNTLNVPLLKLYLPSHSETVKPVQLTQVLNYFPFTGYCFTKPELIFTLEQGEDPWLLKKEFLRKGSPE

SEQ ID NO: 25649 - protein, 81 aa, Panthera pardus
GERTVTRCLTNYSQDLVILEDVAVEFIQEEWTLLDPTQRNLYRDVMLENHKNLVAVDWEICLNTKWSAPQQNILQGKTPNG

SEQ ID NO: 25650 - protein, 81 aa, Panthera pardus
LREPTQDTVTFEDVAVYLSRQEWGLLDEFQRHFYHDVMLENFELTVFLGGWCGGDHEEEHFCRRATSEDSKAGVSAQKACS

SEQ ID NO: 25651 - protein, 81 aa, Panthera pardus
PCRLVLFKDVAIDFSQEEWECLDLEQKDLYRDVMLENYNNLVSLAGFSISKTNVLSLLKQGKEPWKVVQDVTRSQSSAWES

SEQ ID NO: 25652 - protein, 81 aa, Macaca nemestrina
QGLLTFRDVAIEFSQEEWKCLDPAQRTLYRDVMVENYRNLVSLDISSKCTMKDFLSTVQGNTEVIHTRTLERHHIGDFCFQ

SEQ ID NO: 25653 - protein, 81 aa, Macaca nemestrina
ADVSLAFRDVSIDLSQEEWECLDPAQRDLYKDVMLENYSNLVSLGYTIPKPDVITLLEQQKEPWIVMREGTRSWYTDLEYK

SEQ ID NO: 25654 - protein, 81 aa, Ursus arctos
QGTVTFEDIAVSFSWEEWDLLDDTQRHLYQDVMLENLALITSLGCWHGAEDEEAPSEQSVSVEGVSHVRTPETALFPQKAN

SEQ ID NO: 25655 - protein, 81 aa, Ursus arctos
APLPLTFEDVAIYFSEQEWQNLEAWQKELYKHVMRTNYEILVSLDDGLPKPELISWIEQGREFFKNWGESQKSGNIICSSA

SEQ ID NO: 25656 - protein, 81 aa, Ursus americanus
MELTQVLNYFPFTGYCFTKPELIFTLEQGEDPWLLKKEFLRKSSPEDSQPNQLSEKSLGNQGKYLWQVLFTNKSLTTEEEI

SEQ ID NO: 25657 - protein, 81 aa, Ursus americanus
TSESLTLEDVAVDFTWEEWELLAPTRKELYWDVMLENYRNLVSVGYQASQPDVLSELEQGEPPWILEDEDEVQSQTHPQIQ

SEQ ID NO: 25658 - protein, 81 aa, Myotis brandtii
LQGSVSFEDVAVELTRDEWQCLGPGQRTLYREVMLENYSHLVSTGYCITKPPVILKLEQGEEPWSLEEEFLSQTHPARPSQ

SEQ ID NO: 25659 - protein, 81 aa, Myotis brandtii
FQGSVTFQDVAVDFTSEEWQLLDCDQRTLYWDVMLENFRNLISVGGAVTKTKVVVKMQQGQELQVVEGENPHWSHPEADCP

SEQ ID NO: 25660 - protein, 81 aa, Myotis brandtii
DPVTFDDVVVYFSLEEWGLLDEAQRRLYHEVMLDNLALVSSLGGCCGAEDAQANCEQSVSGGGSPSSPSKAALSLLKTHFC

SEQ ID NO: 25661 - protein, 81 aa, Myotis brandtii
LFQGSTPFSNVTAAFTHKEWRHLVRAPREGFEEIPEKSRNLVLLGLPVSQPGMNSQLEQGKSPWMLEGEGLRSTCPDWKTV

SEQ ID NO: 25662 - protein, 81 aa, Propithecus coquereli
MADLVLFRDVAVDFSQEEWECLNSHQRNLYRDVILENYSNLVSLAGCSISKPDVIALLEQGKEPWMVVRDEQRARSPGECP

SEQ ID NO: 25663 - protein, 81 aa, Propithecus coquereli
AQGLVTFRDVAVEFSQEEWKCLEPAQRDLYRDVTLENFSNLVSLGLSISKPDVISLLEQGKEPWMTANDMTEPWCPDLESR

SEQ ID NO: 25664 - protein, 81 aa, Ursus americanus
SAGLLTFRDVAIEFSQEEWRCLSHTQRELYRDVMLENYRHLLFLGLIVSKPDLVSLLEQRKEPWDVKRKKTGGRFLLSYFV

SEQ ID NO: 25665 - protein, 81 aa, Ursus americanus
VLGLVTFGDVAIDFSREEWEWLNSAQRTLHRDVMLENYRNLVSLGLCVSKPDMISSLEQRKEPWMVKRKLTRGRCPDLKTM

SEQ ID NO: 25666 - protein, 81 aa, Ursus americanus
PVPQVPALPHEGSPGDQAATLLTARYQAVLFQEFVTFEDVAVHLTREEWGCLDPVQRDLYREVMLENYGNVVSLVGLWQPP

SEQ ID NO: 25667 - protein, 81 aa, Propithecus coquereli
QDSVTFEDVAVNFTLEEWTLLDPFQKNLYRDVMQETFRNLAAIGKKWKDQNIEDQCKNPRRKIRSLIEERVCESKEGSQRG

SEQ ID NO: 25668 - protein, 81 aa, Propithecus coquereli
GCVVFEDVAIYFSQEEWGHLDEAQRSLYRDVMLENMALLSSLGCCHGAEDVEVPSEQGVSVGMSQVTTSKALLSTKKTQPC

SEQ ID NO: 25669 - protein, 81 aa, Propithecus coquereli
ELVTFEDVAVYFIRKEWKRLEPAQRDLYRDVMLENYGNVFSLDWIYISLTIQKAMLAGSPGILSVGWGLCPSQLASVEPAD

SEQ ID NO: 25670 - protein, 81 aa, Propithecus coquereli
MVAGWSTNYSQDSVTFEDVAVDFTQEEWTLLDPTQRNLYRDVMLENYRNLVAVDWEICINTKCSAPQQNFLQGKTSNVVEM

SEQ ID NO: 25671 - protein, 81 aa, Propithecus coquereli
YQDSVTFDDVALDFTQEEWVLLDKTQKILYRDVMLENYKNLATVGCQFIKPSLISCLEQKEELRTVQGGVLQDWEILLQTN

SEQ ID NO: 25672 - protein, 81 aa, Propithecus coquereli
AQGPMLFEDLAVYFSQEECVSLHPVQRSLSRDATQECFEDVALMGVEGETEMNQQLSLESMELEELSLEEYPIPTSPVQYP

SEQ ID NO: 25673 - protein, 81 aa, Vombatus ursinus
DFSGIVLFSNRNTQIFCLSIWTGHQVSKPDVISQLEQGEEPWTVEREVSTYSCRDWETRNKTKESTLKQDIPEAESSQKVT

SEQ ID NO: 25674 - protein, 81 aa, Saimiri boliviensis
SFKEAVTFKDVAVVFTEEELGLLDLAQRKLYRDVMLENFRNLLSVGHQPFNRDTFYFLREEKFWMMDVGTQREGNSGGKIQ

SEQ ID NO: 25675 - protein, 81 aa, Balaenoptera acutorostrata
QGSVTFEDVAVYFSWEEWCLLDEVQIHLYLDVMVENFALVCMLGSLPGVEDEETPSEQSVSAEGVSQMRTPRAGLSPEKTQ

SEQ ID NO: 25676 - protein, 81 aa, Vombatus ursinus
SQELVTFKDVAVDFTWEEWELLEPGQKALYRDVTLENYRNLVSLGHPVSKPSVIFQLEQSDTPWLLEREAPRSIFPGEGMD

SEQ ID NO: 25677 - protein, 81 aa, Saimiri boliviensis
RNTIPQDNESPPQQGKANQNDSVAFEDVAVNFTSEEWALLDPSQKTLYREVMQETLRNLASIEVLWKRDSLKAKVISIEKF

SEQ ID NO: 25678 - protein, 81 aa, Lynx pardinus
MAFTQKEWEQLDPAQRNLYKDVMLENYSNLASMGYQAPKPDMISKLEKGEEPWLGKGKKPRQGGPSEIARPKQIGTNGKEV

SEQ ID NO: 25679 - protein, 81 aa, Balaenoptera acutorostrata
LAFEDVAVYFTREEWDALHWPQKALYRDVMLDNYRNVLSLGPEARFKVKELTPKQNISEDLESCKMSLVKQKMARKPLEKL

SEQ ID NO: 25680 - protein, 81 aa, Balaenoptera acutorostrata
VKESMTFKDVAIDFTLEEWRLMDPTQRKLHKDVMLENYRNLVSLGLAVSKPDMISHLEDGKGPWAVVRETSKTPYSELETK

SEQ ID NO: 25681 - protein, 81 aa, Vombatus ursinus
MLENYRNLVFLGLTVWKPDVISHLEEGEAPWIQDREVPKTISPGESLKIRQMGIFMSYTLAGLLWEISFLEFSLEVSISGA

SEQ ID NO: 25682 - protein, 81 aa, Balaenoptera acutorostrata
PKVPVTFDDISIYFSTPEWEKLEEWQKELYKNIMKGNYESLISMDYAMNQPDVLSQIQPEGDHNTEDQAGPEGSEIPTDPS

SEQ ID NO: 25683 - protein, 81 aa, Saimiri boliviensis
YQDSVTFDDLAVDFTPEEWTLLDPTQRNLYRDVMLENYKNLATVGCQLFKPSLISWLEQEESRTAQRGDFQEWKVQLKTKE

SEQ ID NO: 25684 - protein, 81 aa, Vombatus ursinus
SQIGVTFKDVAVFFSQEEWCSLDPSQQKLYKDVMLEISQNMLSLGLPVPKADWISKLDKREAPWLLEHKDPRNSCLGRRNR

SEQ ID NO: 25685 - protein, 81 aa, Saimiri boliviensis
ASVTVTFDDVALYFSEQEWEILEKWQKQMYKQEMKTNYETLNSLGYAFSKPDLITWMEQGRMLLISDQGRLHKTKRTTGPP

SEQ ID NO: 25686 - protein, 81 aa, Balaenoptera acutorostrata
TRVSVTFDDVAVTFTREEWGQLDPAQRTLYQEVMLENCGLLVSLGCPVPRPELIYQLEQGQELWTVKKDLSQSTCPGDKGK

SEQ ID NO: 25687 - protein, 81 aa, Saimiri boliviensis
SLEMGPLTFMDVAIEFSLEEWQCLDTGQQNLYRNVMLENYRNLAFLGIAVSKPDLIACLEKEKEPWKTKRHAVVDEPPGLQ

SEQ ID NO: 25688 - protein, 81 aa, Lynx pardinus
MEWGLLDEAQMCLYHNVMLENLALMTSLGCRCGVEDKAICFEQCISARVLSQDGTSKAGMSPQKICGPILRDILHLIEHQD

SEQ ID NO: 25689 - protein, 81 aa, Saimiri boliviensis
PQKSVTFEDVAVYFTQAEWDGLSPAQRTLYRDVMLENYGNVASLGFPLLKPAVISQLEGGGELGGPSPLAAGTGLRGLWTV

SEQ ID NO: 25690 - protein, 81 aa, Balaenoptera acutorostrata
PLESVTFEDVAINFTQEEWALLDTSQRNLFRNVMLENISHLVSIGYQISKSDVISQLKQGKELRKSTVSKQCGKSLSQGSF

SEQ ID NO: 25691 - protein, 81 aa, Balaenoptera acutorostrata
SQSLLTFEEVAIYFSQEEWELLDPTQKALYNDVMQENYETVISLALFVLPKTKVICCLEQGEEPWFQGSPVLKDSPGELFS

SEQ ID NO: 25692 - protein, 81 aa, Colobus angolensis
AQGQVNFEDVFVYFSQEEWVLLDEAERLLYRDVMLENFALTASLGYTSFMSHIVASLVMGSEPWTPGGSGPGCWRGMEDEE

SEQ ID NO: 25693 - protein, 81 aa, Colobus angolensis
RCQESVTFEDVAVVFTDEEWSHLVPIQRDLYKEVMLENYNSIVSLDWETKPEIHDASDEKSEGSLRERLGRQSPLCPKFEV

SEQ ID NO: 25694 - protein, 81 aa, Colobus angolensis
EPLRFRDVAIEFSLEEWQCLDTIQQNLYRNVMLENYRNLVFLGIAVSKPDLITCLEQEKEPCTRKRHRMVAKPPVTCSHFA

SEQ ID NO: 25695 - protein, 81 aa, Colobus angolensis
DVAVEFSQEEWKCLDPVQRTLYRDVMLENYRNLVSLGICLPDLSVISMLEQKKDPWILQSEEKIANNPDGRECSKGVKTVP

SEQ ID NO: 25696 - protein, 81 aa, Colobus angolensis
AQESITLEDVAVDFTWEEWQLLGPAQKDLYRDVMLENYSNLVAVGYQASKPDVFFKLERGEPPWTTEDGLHGGACSEIWKV

SEQ ID NO: 25697 - protein, 81 aa, Colobus angolensis
MGVLTFRDVAIEFSPEEWECLDSAQQCLYRDVMLENYRNLVSLGLAIFKPDLMTCLEQRKEPWKVKRQKAVVKHPAGSFHF

SEQ ID NO: 25698 - protein, 81 aa, Colobus angolensis
SKAPITFGDLAIYFSQEEWEWLSPIQKDLYEDVMLENYRNLVSLGLSFRRPNVITLLEKGKAPWMVEPVRRRQAPAPCLYS

SEQ ID NO: 25699 - protein, 81 aa, Colobus angolensis
VTFEDVAVYFIRKEWKRLEPAQRDLYRDVMLENYGNVFSLDWIHISLTMQKVMLAWFTGTLSVGRGLCSSELASVEPPDTF

SEQ ID NO: 25700 - protein, 81 aa, Oryctolagus cuniculus
FQGSVTFRDLAIDFCQQEWECLDLTQKTLYRDVMMENYANLLSLGYAISKPDVITLLEQGKEPWMIVKEETRWCADLESRC

SEQ ID NO: 25701 - protein, 81 aa, Oryctolagus cuniculus
GTNEEELRLLDTAQRALYRAVMLENFRNLLSVGEDGRARILGVTLCSDLVCPGIKALESSALRVHQRAHRGERRCKCAECG

SEQ ID NO: 25702 - protein, 81 aa, Pteropus alecto
AEVLVTFKDVAVTFTQEEWGQLDLDQRTLYWEVMLETCRFLVSLGHPVPRPELIHPLEHRQELWMAKRGFSRSTCPGDGAK

SEQ ID NO: 25703 - protein, 81 aa, Pteropus alecto
VMFSDVSIDFSQEEWECLNDEQRHLYRDVMLENYNNLVSMVLGSRCQTKKLFLKKEIFEIESAQWEIMGRLTRHDLQCSSF

SEQ ID NO: 25704 - protein, 81 aa, Pteropus alecto
FQLPESLEDVAMYISQEEWGHQDPSKRALSRDTVQESYENVDSLEPQVPSQEPLSTQVEQGGKPWDPSVQSCKECLSPRNQ

SEQ ID NO: 25705 - protein, 81 aa, Rhinolophus ferrumequinum
MLENYRNLCSLDLAVSTPDVVIFLERMKEAWDVKRKKTNIHTGEEHYKCNPCGRVFSRLPSLNRHKKIHAGVKPYKCRECD

SEQ ID NO: 25706 - protein, 81 aa, Rhinolophus ferrumequinum
SQHLVTFKDVTVDFTQEEWTLLDQTQRDLYRDVMLENYENLIAVAGYESCTPSVCSGMEGAEELRTGTRGVLQGEKCRSET

SEQ ID NO: 25707 - protein, 81 aa, Rhinolophus ferrumequinum
MFQESLTFQDVAVNFTREEWDQLYPAQKNLYRDVMLENYRNLVALGHQLYKPEVITQLEQEEQWMMERDSPLDIHPDGENR

SEQ ID NO: 25708 - protein, 81 aa, Rhinolophus ferrumequinum
LGGRLTFRDVSIDFSQEEWECLHPADRKLYMDVMLENYRNLCSLDLAVSTPDVVIFLERMKEAWDVKRKKTVRQMTQVRGI

SEQ ID NO: 25709 - protein, 81 aa, Rhinolophus ferrumequinum
AQESVMFRDVAVDFSQEEWECLGPAQRALYRDVMLENYSNLLSMGLYIPKPQVISLLEQGKEPWMVGRELTRGLCSDLESM

SEQ ID NO: 25710 - protein, 81 aa, Rhinolophus ferrumequinum
FQEPVTFRDVAVDFTQEEWGQLGPAQRTLYRDVMLETFGHLLCVGPELPKPEVISQLEQGAELWVADRGITQRCCPGWEPG

SEQ ID NO: 25711 - protein, 81 aa, Rhinolophus ferrumequinum
MLDNYQNLLFLGLSYRRPNVITLLEEGRAPWMVEPVRRRRGLDLGSKCETKKLPSNHCNKSGQSICQKPVSVSQKVLTGKR

SEQ ID NO: 25712 - protein, 81 aa, Ursus maritimus
VTFEDVAVYFSWEEWGLLDEAQRCLYQDVMLENLALINSLGRRHGTEDEEAPEHRVSVQGASQVGTRKAVVSPQKAHPREV

SEQ ID NO: 25713 - protein, 81 aa, Ursus maritimus
MLFQKPVTFDDVAVNFTQEEWVCLDAGQRVLYQDVMSETFRNLMSVDLIIKLEQEEKQWRAGLQLRPPNGEGLPSGGRRKT

SEQ ID NO: 25714 - protein, 81 aa, Rhinopithecus bieti
NQQTKNKSLFVSFEEVAVHFTWEEWQDQDDAQRTLYRDVMLETYSSLVSLGHCVSKPEVIFKLEQGSEPWLGEEWANQCLS

SEQ ID NO: 25715 - protein, 81 aa, Rhinopithecus bieti
GDVAVNFTREEWALLGPCQKNLYKDVMQETIRNLNCVGMKWKDQNIEDQYKYSRKNLRCRMLERFGENKDGSKWGETSNQI

SEQ ID NO: 25716 - protein, 81 aa, Rhinopithecus bieti
RAEEAVTFKDVAVVFTEEELGLLDPAQKKLYRDVMLENFRNLLSVGHQPFHGDTFHFLREEKFWVMETTSQREGNSGKSQT

SEQ ID NO: 25717 - protein, 81 aa, Ursus americanus
EWQLLAPAQKDLYRDMMLENYRNLVSVGYQASKPDALSKLEQGEELWTIEDEIHSRICPGEGELNPGELRKVDDPLQCHLQ

SEQ ID NO: 25718 - protein, 81 aa, Ursus americanus
FGWLTFRDVATEFFQEEWECLDPAQRALYRDVVVENCRNLVSLGEENVPLEMRVCPWVSLYFPLIPLGRHLSLDSCFLGDF

SEQ ID NO: 25719 - protein, 81 aa, Ursus americanus
QCGLLTFGDVAIEFSQEEWRCLSHTQRELYRDVMLENYGHLLFLGLIVSKPDLVSLLEQSKEPWDVRRKKTQRPSVLMGHV

SEQ ID NO: 25720 - protein, 81 aa, Ursus americanus
SLDWGTFEDVAVYFSREEWELLDETQRHLYHNVMLENLALMASLELKTFRPCAVAHLEQDKEPWEPERVDISPYTAQEDGR

SEQ ID NO: 25721 - protein, 81 aa, Propithecus coquereli
RLTFRDVAIEFSLEEWKCLDPAQRALYKAVMLENYRNLVSLGREAGNKLTKNQCGVIFKSHVPQRKLLQSKRKVDECNQIK

SEQ ID NO: 25722 - protein, 81 aa, Vombatus ursinus
LTFQDVAVDFTWEEWGQLDPAQQNLYRDVMLDNYQNLIFLGKGNTLYQSFVPTEEKSYTCNEYKEDFSQKEYLNQPEKSPI

SEQ ID NO: 25723 - protein, 81 aa, Vombatus ursinus
FQELVAFKDVAVEFNQEEWRCLDASQKELYHDVMMENYKNLVCLGLVFNKPAVISHLEGKEAPWMAEGQVQRNSCPGEPVN

SEQ ID NO: 25724 - protein, 81 aa, Balaenoptera acutorostrata
PLTFRDVAIEFSREEWECLDPTQKAFYVDVMLETYRNLLSLDISHIHVIRKLQPRANSDRGEVFQTVMLERQESHEMKHFY

SEQ ID NO: 25725 - protein, 81 aa, Lynx pardinus
LTDSVSFEDVAVYFSWEEWRLLDEAQRCLYHDVMLENFALISSLGCCCGAEDAEAPLEQSVSVGVSQAGTPKAALSSRKTH

SEQ ID NO: 25726 - protein, 81 aa, Vombatus ursinus
FQELVTFKDVSVDFTREEWGQLDPAQKNLYRDVMLENYRNLVSLGLQVFKPDVIARLERTEAPWTLDSKVFRLSCPDWERK

SEQ ID NO: 25727 - protein, 81 aa, Saimiri boliviensis
TSQESLTLEDVSVEFTWEEWQLLGASQKDLYRDVMLENYSNLVSVGYQAGKPDALSKLEQGEPWTTENEIHSQICPEIKRV

SEQ ID NO: 25728 - protein, 81 aa, Lynx pardinus
LLQEGALRAPQHPAFANDGSHGDWPGANTTLDAVTFEDVAVCFSSGEWQCLTRAQRHLYTDVMLENYGNMLSAGEDTLCLA

SEQ ID NO: 25729 - protein, 81 aa, Lynx pardinus
AQESVKFRDVAVIFSPDQWAYLSPEERQLYKDVMLDNCDYLVSLGHWTYKAEVISSLKQGKDLLMVEREVTGAPCPACQPA

SEQ ID NO: 25730 - protein, 81 aa, Lynx pardinus
HQELVTFEDVAVYFTGTEWTCLSPGQKALYRSVMLENYGNLTSLGYQVPRPALISLLEAGNLPWGLEAQDNLSAERTKDIC

SEQ ID NO: 25731 - protein, 81 aa, Balaenoptera acutorostrata
DQGSVSFRDVTVDFTWDEWLQLTCMQRTLYRDVMLENYSHLVSVGYCISKPEVVFKLEQGEEPWPLERAFPCRSDPGCCPP

SEQ ID NO: 25732 - protein, 81 aa, Saimiri boliviensis
PKVPVTFDDVAVYFSELEWGKLEDWQKELYKHVMRGNYETLVSLDYAISKPDILTRIERGEEPCLNQWGQEKGSEVEVAHS

SEQ ID NO: 25733 - protein, 81 aa, Cervus elaphus
PQDLMTFEDVAVEFTWWEWGQLDPAQKDLYREVMLENFKNLASLGFPVSKPYMICQLEEGEEPCILEREISTGVHSDWERR

SEQ ID NO: 25734 - protein, 81 aa, Colobus angolensis
TEGLVMFEDVAVYFSREEWGLLNVTQKGLYQDVMLENFALVSSLGLAPLRSPVFSQLENDEQLWVPSWVDETPVSRAEARR

SEQ ID NO: 25735 - protein, 81 aa, Colobus angolensis
AQESVTFEDVAVNFTNREWQSLTYAQRHLYKHVMLENYGNMVSLGFPFPKPPLISHLERGVEPCMQDPQDRESLSCSYPVS

SEQ ID NO: 25736 - protein, 81 aa, Colobus angolensis
QASVCFEDVAMAFTKEEWEQLDLAQRTLYREVTLETWEHIVSLDWKTTLEENRLNSEKDGAREELSHHVEVKQCVQEEPPC

SEQ ID NO: 25737 - protein, 81 aa, Colobus angolensis
AKGLPSNDTDWPQEKEGKAQIVVPVTFRDVAVIFTEAEWKRLSPQQRNLYKEVMLENYRNLLSLGQEIETILANMVKPRLY

SEQ ID NO: 25738 - protein, 81 aa, Rhinopithecus bieti
DSVTFDDVAVDFTPEEWALLDTTQKYLYRDVMLENYMNLASVEWEIQPRIKRPSLQQGFLKNPIFNGIQMTRGYSGWKLCD

SEQ ID NO: 25739 - protein, 81 aa, Rhinopithecus bieti
MFKEAMTFKDVAVVFTEEELGLLDPAQRKLYQDVMLENFRNLLSVGHQAFHRDTFHFLREEKIWMMKTATQREGNSGDKIQ

SEQ ID NO: 25740 - protein, 81 aa, Rhinopithecus bieti
QGRLTFRDVAVEFSLAEWKCLNPAQRALYREVMLENYRNLESVDISSKCMMKEVLSTGQGNMEVFYTGTLQRHESHHIGDF

SEQ ID NO: 25741 - protein, 81 aa, Rhinopithecus bieti
DSVTFEDVAVDFTQEEWTLLDQTQRNLYRDVMLENYKNLVAVDWESHINTRRSAPQQNFLQGKTSSVVEMERNHFGEELFD

SEQ ID NO: 25742 - protein, 81 aa, Rhinopithecus bieti
EPGIVSFADVAVYFCREEWGCLRPAQRALYRDVMRETYGHLSTLGIGGNKPALISWVEEEAELWGPAARDPEVMKCPTETD

SEQ ID NO: 25743 - protein, 81 aa, Panthera pardus
KDQESLTLEDVAVDFTQEEWRLLAPAQKDLYRDVMLENFRNLVSVGYVVSMPAALSRLERGGRWMTEDETRRRICPEIKKD

SEQ ID NO: 25744 - protein, 81 aa, Panthera pardus
GLGSMSFKDVTVDFTWDEWLQLTGTQRTLYRDVMLENYSHLVSVGCRLTKPEVIFKLEQGEELWPSRGESPDQGDQGSLQS

SEQ ID NO: 25745 - protein, 81 aa, Macaca nemestrina
PQVSLTFEDVAVLFTRDEWRKLVPSQRNLYRDVMLENYRNLVSLGLPFTKPKVISLLQQGEDPWKVEKDSSGDSSLGCKST

SEQ ID NO: 25746 - protein, 81 aa, Macaca nemestrina
GLTFRDVAIEFSQEEWKCLDPAQRTLYRDVMLENYRNLVSLDLSRNCMIKELAPQRESNREEVFHTVTLEQHEKHDIEEFC

SEQ ID NO: 25747 - protein, 81 aa, Macaca nemestrina
MVFEDVAIYFSREEWGILNDAQRQLHSNVMLENFALLSSVGCWHGAKDEEVLSKQCVSVRVLQVTAPKPALPTLKAQPCKT

SEQ ID NO: 25748 - protein, 81 aa, Macaca nemestrina
MDVAIEFSQEEWKCLEPAQRTLYRDVMLENYRNLVSLGICLPDLSVISTLEEKKDPWILQSEEKIANNPDGRECIKGVNTV

SEQ ID NO: 25749 - protein, 81 aa, Macaca nemestrina
TVTFEDVAVNFSQEEWSLLSEVQRCLYRDVMLENLALISSLDCWCGSKDKEAPSTQSISVQRQSQNRTPRAVVSPKKAHPC

SEQ ID NO: 25750 - protein, 81 aa, Macaca nemestrina
GLLTFRDVAIEFSQEEWKCLDPAQRTLYRNVMLENYRNLVSLGIFSKYEIKELPTKKESNTGEILQTVMLERHESHDIEDF

SEQ ID NO: 25751 - protein, 81 aa, Ursus americanus
MTKPDMIRKLEQGEELWTTERMFPSQSYLEEDGKAEDVLVKFKEYQDRHSKSVIFINHKRLIKERSNIFGKTLTVGKNRII

SEQ ID NO: 25752 - protein, 81 aa, Myotis brandtii
DVNFEGVAIAFSEEEWVILDEAQRLLYCDVMLEVFALVSSVGCWHKMEDEEACSDQRVCIQGESQVRTSKTAPATHKNHLC

SEQ ID NO: 25753 - protein, 81 aa, Myotis brandtii
VTFEDIALYFSREEWSLLDEGQRQLYLNVMLENFELLSSLGCCCDAENVEAPTEQKVSVRLSQARNPKLALSSQKSHPCES

SEQ ID NO: 25754 - protein, 81 aa, Saimiri boliviensis
MTKDWNYLEASQKDYYRDTMLDSYENIVPQGSFLQFSMMPQRAGNDPPGASNASEMEMEISNMREKFLMSVTKLVESKSYN

SEQ ID NO: 25755 - protein, 81 aa, Propithecus coquereli
RESGKAPVTFDDITVYLLQEEWMLLSQQQKEICGSDKLVAPLGPTVANPELFYKFGQGPEPWLGNVQDQRSLLDHHPGKNQ

SEQ ID NO: 25756 - protein, 81 aa, Saimiri boliviensis
YQELVTFRDVAVDFSQEEWDCLDPSQRHLYSNVMLENYRILVSLGLCFSKPSVILLLEQGKAPWMVKRELTKGLCSGWEPL

SEQ ID NO: 25757 - protein, 81 aa, Propithecus coquereli
DSVVFEDVAVEFSLEEWALLDSAQRDLYRDVMLETFQNLASVDDETQFKANGSVSKQDIYGEKILKEPKIAKFIRNVSWAS

SEQ ID NO: 25758 - protein, 81 aa, Vombatus ursinus
MLENYRNLACLGLAFSKPHLISQLERGEAAWTPAEESQRVVCADWKSKPSNKKSDPNIGISVEASPQEKLISNVFNLRETL

SEQ ID NO: 25759 - protein, 81 aa, Lynx pardinus
PQDLMTFKDVAVEFTQWEWGQLDPAQKDLYREVMLENFKNLASLGLPVSKPYVICQLEEGGEPCVVEGEISTDWEKRPKAK

SEQ ID NO: 25760 - protein, 81 aa, Vombatus ursinus
FQVSVTFKDVAVDFTQEEWGHLDPTQRALYRDVMLENYRNLVSLGCQVFKPDVISQLEQGKEPWMVEAEILRGSCPANTSL

SEQ ID NO: 25761 - protein, 81 aa, Lynx pardinus
MDFTEEEWVLLNPRQRKLYRDVMLENYRNLASLEKQLSRPALITQMQQEDEMKSETRNHQDTCSNGIVLPKTTQSQHKQDV

SEQ ID NO: 25762 - protein, 81 aa, Saimiri boliviensis
PQAKLTFEDVAVLLSQDEWNRLGPAQRGLYRNVMMETYGNVVSLGLPITKPDLISQLERGEDPWVLDGKGAKESQDLWSGH

SEQ ID NO: 25763 - protein, 81 aa, Saimiri boliviensis
PQESVSFKDVTIEFTQEEWQQMAPVERNLYRDVMLENYSHLVSVGYCLFKPEVIFKLEQGAEPWFSEEEFSNKSHPKDYRG

SEQ ID NO: 25764 - protein, 81 aa, Vombatus ursinus
MLENYKNLVSLRLPVFKPHVICQLERGEGPWISETDVPQVICPDSIMLKTRCENLEWTSNLVGSLGESAKEISSKNNPFTS

SEQ ID NO: 25765 - protein, 81 aa, Lynx pardinus
LVKIEDVADVAVSFILEEWGHLDQSQKSLYRDDRKENYGSIPSMDYESRNDNVELTVKQISDDAEAHWMTSASTERNVPQG

SEQ ID NO: 25766 - protein, 81 aa, Saimiri boliviensis
MFENYRNLAFLGIAVSKPHLITCLEQGKEPWNRKRQEMIAKPPVMCSHFAEDLWPEHRIKDSFQKMILRGYGKCGHENLQL

SEQ ID NO: 25767 - protein, 81 aa, Vombatus ursinus
FQEPVTFKDVVVDFSQEEWGLLNPGQRHLYRDVMLENYRNLVFLGLILTKPEVVCHLEQGGELWKPERGVLCSAWEIKAKT

SEQ ID NO: 25768 - protein, 81 aa, Cervus elaphus
ALALISFEDVAITFTGEEWRHLDLAQRTLYQEVMLETCGLLVSLGHPVPKAELIHLLEYGPGLWMVKRGLSRNTCTGECHG

SEQ ID NO: 25769 - protein, 81 aa, Cervus elaphus
VKKPVTFEDVAVTFTQEEWKCLDASQRVLYQDVISETVRNLMSVDGIFLSNLDLIAKLEQEEKQWEADLCSPNGEGFHSGG

SEQ ID NO: 25770 - protein, 81 aa, Cervus elaphus
MFPQPFPGSRERQSASRSAPRGILGGDVAGLGSLGGFPEPGTPGGLSISKPNMISLLEQGKEPWMVEREMSDGQHADWESW

SEQ ID NO: 25771 - protein, 81 aa, Cervus elaphus
EAMFLPVSWKGLLSFEDVALYFTREEWDTLDWAQKALYRDFPKPEVICQLEQWEEPWILEVPRAGTRKASGSACPDLEARF

SEQ ID NO: 25772 - protein, 81 aa, Cervus elaphus
TPQTLKPRAPGACSRARSPGPGIQDSDAVGSVTFEDVAVYFSWEEWALLDEAQRCLYHDVMLENFALTSSLGGPTGGGRVV

SEQ ID NO: 25773 - protein, 81 aa, Cervus elaphus
AWGPITLRDVVIEFFPHQWEFLNPLQKKLYCSVMMENYSNLVSIGHFISKPDIIVLLEERRDPWMVVREETRSWNTDPKVK

SEQ ID NO: 25774 - protein, 81 aa, Colobus angolensis
GLLTFRDVAIEFSQEEWKCLDPAQRTLYRDVMLENYRNLVSLGIFSKYEIKELPTKNESNTGEIFRTVMLERHESHDIEDF

SEQ ID NO: 25775 - protein, 81 aa, Colobus angolensis
DSVTFEDVAVDFTQEEWTLLDQTQRNLYRDVMLENYKNLVAVDWESHINTKWSASQQNFLQGKTSSVVEMSHTLSPRLECS

SEQ ID NO: 25776 - protein, 81 aa, Rhinopithecus bieti
APKVSRSLENDGVCFTEQEWENLEDWQKELYRNVMESNYETLVSLTSVILLYMFGPEETKAGGVMIKQELQYTQEGPADLP

SEQ ID NO: 25777 - protein, 81 aa, Muntiacus reevesi
GLLTFQDVTIDFTQEEWECLDLGQRELYRDVMLENYGNLACLGLVVCKPDLVTFLEQMKDPWDVRRIETAKYPGIGTSIVE

SEQ ID NO: 25778 - protein, 81 aa, Muntiacus reevesi
MLENYVNLTSLAFPLPKPDLIFWLERGEEPGHPDPWTLVGGEDLRGICRGGKAKTEYRGQTTELSISKGPEYHKLITEVPL

SEQ ID NO: 25779 - protein, 81 aa, Muntiacus reevesi
EEWECLDLSQRELYRDVMLENHGNLACLGLVVSKPDLVTFLEQMKDPWGVRRLETAIHPARIEIYEKFHLGNVHLSKDWIY

SEQ ID NO: 25780 - protein, 81 aa, Muntiacus reevesi
KSWGHLSFMDVFVDFTWEEWQLLDSAQKHLYRSVMLENYRNLVSLGYQYTKPSIIFQLEQEELWMMHSPSLDHSDEVWEID

SEQ ID NO: 25781 - protein, 81 aa, Ursus americanus
MYISQEEWGHQDPSKRALSRDTVQESYENVDSLESQVPSQEALSTQVEQGGKPWDPSVQTCKEGLRPRSPAPGEEKLENQE

SEQ ID NO: 25782 - protein, 81 aa, Myotis brandtii
SLALVTFKDVLVNFTREEWKLLDAAQQVMYRDVMLENYRNLVSLGHRLPKPDVILQLEKGEEPWLVERGTHQDAHPDWDTA

SEQ ID NO: 25783 - protein, 81 aa, Propithecus coquereli
QGHLTFRDVAIEFSQEEWKCLNPAQRALYRDVMLENYRNLASLDISPKCVIKELPPTGKSTTGEVFHTLMLGRHESHPIGK

SEQ ID NO: 25784 - protein, 81 aa, Propithecus coquereli
MKPGVISHAPDSMVPAFPVLKPDLIFQLEQGEAPWVPDPWMSAGGEALRGMCTGGKTKTKKEEQAPQLNISKGSESHGLPA

SEQ ID NO: 25785 - protein, 81 aa, Propithecus coquereli
PKVPVTFDDVAVYFSEVEWGKLEDWQRELYKHVMRGNYEMLVSLDYAISKPDILTRIERGEQPCPKDHWDQEKGNEEEAAC

SEQ ID NO: 25786 - protein, 81 aa, Propithecus coquereli
AQGCVTFEDVTIYFTQEEWGLLDEAQRLLYCDVMLENFALIASLGLTSFRSHVLAQLEMGKEPWVPDSVDMTSAMARGAYG

SEQ ID NO: 25787 - protein, 81 aa, Propithecus coquereli
KFKEAVTFKDVAVAFTEEELGLLDSAQRELYRDVMLENFRNLLSVGHQPFKRDTSHMEIEKKLWMMKTATQRDRNLEELSC

SEQ ID NO: 25788 - protein, 81 aa, Propithecus coquereli
PQELVTFEDVAVDFSQEEWQYLNLPQRTLYRDVMLETYSNLVSVGQQVTKPDLILKLEVKEFPEEGRIPIWSFPEEVCQVD

SEQ ID NO: 25789 - protein, 81 aa, Propithecus coquereli
ALSQGLFTFKDVAIEFSQEEWKCLDSAQKASYRDVMLENYRNLLSLDVSEELSSKEDNKEELYHLVILERNESHGIKKVWK

SEQ ID NO: 25790 - protein, 81 aa, Propithecus coquereli
LQETVTFRDVAVDFTQEEWGRLDPTQRTLYRDVMLETFGHLLSIGPELPKPEVISQLEQGAELWVAERGTTQGHCPVWEPR

SEQ ID NO: 25791 - protein, 81 aa, Vombatus ursinus
FQKSMTFKDVAPDFTWEERTQLNPVEQALCREVLLETYRNLVFLGLSTTSKPDVISQLEDGKVPGMLGSETPKGTSSYWDT

SEQ ID NO: 25792 - protein, 81 aa, Saimiri boliviensis
MDSVVFEEVAVRFTPEEWALLSHAQRRLYRDVMLEICRNLASLDNCVRVRTSGSSSQREVFRNETSSEGEIAKFTRSDSWS

SEQ ID NO: 25793 - protein, 81 aa, Balaenoptera acutorostrata
LQGTVTFKDVAIDFTEEEWQQLDSAQRNLYRNVMLENYNNLITVGCPFTKPDVIFKLEQEEEPWVVEEEVSKRHCPGEIWG

SEQ ID NO: 25794 - protein, 81 aa, Balaenoptera acutorostrata
FQEPVSFKDVAVTFTKEELGLLDSTQRKLYLDVMLENFQNLVSVGYQPFKLDMILQLGRKEKLWVMEPETQGAGCSGHGNQ

SEQ ID NO: 25795 - protein, 81 aa, Vombatus ursinus
PLTFRDVAVDFSRDEGRRLSPAQRALYRDVMLIYLYICVYKEIRLGMRGSTAKPSIFVEQSQQQRFVNHSHCDLNLRETRD

SEQ ID NO: 25796 - protein, 81 aa, Lynx pardinus
SKVPVTFGDLAIYFSQEEWEWLSPIQKDLYEDVMLENYQNLVSLGLSFRRPNVITLLEKGRAPWMVEPVRKRRVLDSRSKY

SEQ ID NO: 25797 - protein, 81 aa, Lynx pardinus
RKGCVTFEDVAIDFSQEEWGLLDEAQRRLYHDAMLENLALTASLVCWHGMEDEETPFEQSVSIEVLSQKTHPCEKCVPILK

SEQ ID NO: 25798 - protein, 81 aa, Cervus elaphus
AQLTFKDVAIEFTQEEWECLDPAQRALYRDVMVETLRNLVSLVEQGTRILAKPQQVMCLSSYVETSLHWQSSSQSTEIRAD

SEQ ID NO: 25799 - protein, 81 aa, Colobus angolensis
PLTFMDVAIEFSQEEWKCLDPGQRALYRDVMLENYRNLVSLGRSCILGSNAENKPIKNQLGFTLESHLSELQLFQAGRKIY

SEQ ID NO: 25800 - protein, 81 aa, Colobus angolensis
NKGPVTLKDVIVEFTKEEWKLLTPAQRTLYKDVMLENYSHLVSVGYHVNKPNAVFKLKQGRKPWILEVEYPHWGFSEDLWS

SEQ ID NO: 25801 - protein, 81 aa, Rhinopithecus bieti
EMGPLTFRDVAVEFCLEEWQCLDTAQQDLYRKVMLENYRNLVLAGIAVSKPNLITCLEQGKDPWNMKRHSMVVKPPGFLLP

SEQ ID NO: 25802 - protein, 81 aa, Eschrichtius robustus
MLENFRNLISMGCPVTKTKVIFKVEQGQEPWMVERENPCWRSPEADCPLIDESDKNQESKDNFLNSVLFMFNKILTVKRLH

SEQ ID NO: 25803 - protein, 81 aa, Myotis brandtii
PVTFEDVALHFSKEEWRLLAEAQRSLYLDVMLENFALVSSQGCCCGTKNVEAPSEQSIPVGVSQARTSRESQSSQKTHPCE

SEQ ID NO: 25804 - protein, 81 aa, Myotis brandtii
PVTLEDMAVYLSQKEWGCLDPAQQDRSQDMLPESEGRGMQFKDEEDTQMRTEWDRVLSARCRGPSSPFLGHKPAPVRGLTK

SEQ ID NO: 25805 - protein, 81 aa, Propithecus coquereli
MLENYGAVASLAAFPFPKPALISQLERGEAPWCSAPQGALDGESPRGISSGFPFLTLAGIFHLEQAEELLNLKLQGERPSL

SEQ ID NO: 25806 - protein, 81 aa, Propithecus coquereli
TKLELSFKDVAVDFTQEEWQQLDPEQKITYRDVMLENYSNLVSVGYHIIKPDVIIKLEQGEEPWIVEGEFLLQSYPDEAWQ

SEQ ID NO: 25807 - protein, 81 aa, Propithecus coquereli
ESVTFEDVAVGLLQEWALLDGARRNLCRYVILDNCRTLASRGTPPCKPSLVPQLGPRAEPLAVTGAGEYQADWESQLKPKE

SEQ ID NO: 25808 - protein, 81 aa, Balaenoptera acutorostrata
MLENYGNLVSLGLPFSKPEVISLLQQGEDPWKVEKESPGGSSLGCKSSPKTTKSTQTQDASFWGPVRKRLKKNEPWNFISE

SEQ ID NO: 25809 - protein, 81 aa, Propithecus coquereli
MRSVSFRDVTVSFTREEWQHLDPAQRNLYRDVMLENYSHLVSVGYCIPKPEVILKLEKGEEPWILEEEFPSQSCPELINSS

SEQ ID NO: 25810 - protein, 81 aa, Propithecus coquereli
SQGPVSFKDVAVDFTQEEWQKLDPDEKITYRDVMLENYSNLVSVGYDITKPNVIIKLEQGEEPWIIEGEFSCQSHPEEVLK

SEQ ID NO: 25811 - protein, 81 aa, Vombatus ursinus
MDVMMENYGNVASLGVPVSKPDLISQLEQTDLPLVPHLPQTEIEDLFDEKLDITFIMSSKRPSDGSGPSEKKAQRKSISLE

SEQ ID NO: 25812 - protein, 81 aa, Vombatus ursinus
GSRRPPAQELVTFKDVAVDFTKELYKEVMLENAQNLLLLGLSVPREDLFSYLEERESPWLLEQEDLRSCCPEREIRPEMKE

SEQ ID NO: 25813 - protein, 81 aa, Saimiri boliviensis
MAFRDVAVDFTQDEWSLLSPAQRTLYREVMLENYSNLVSLGISFSKPEIITQLEQGKETWREEKKCPPATCPDPGPELYLD

SEQ ID NO: 25814 - protein, 81 aa, Saimiri boliviensis
ARDLVMFRDVAVDFSQEEWECLNSYQRNLYRDVILENYSNLVSLGCSISKPDVITLLEQGKEPWLVVRNEKRRWSLDLESR

SEQ ID NO: 25815 - protein, 81 aa, Saimiri boliviensis
QGRLTFRDVAIEFSLVEWKCLTPAQRALYREVMLENYRNLESVDISSKCMVKMGSSTGQGNTEMFHTGTLETHKSHHTGDF

SEQ ID NO: 25816 - protein, 81 aa, Balaenoptera acutorostrata
VAGNLDLQDVFVDFTLEEWQKLDATLKNLRRDVMLENYSHLVSMGFLMAQPGRIFRLGQGEEEARMAAGESPTRRCPEFWQ

SEQ ID NO: 25817 - protein, 81 aa, Lynx pardinus
MPKSQEEWQYLDLPQRDLYKDVMLENYINLISVGYQTTKPSVIHKLEQGEEPWMVEREIPNWSYAEETWQLDGHMEQHQEN

SEQ ID NO: 25818 - protein, 81 aa, Lynx pardinus
MMENYDNLVSLEHSISKPDVITLLEQRKEPWMVVREDTKRWCTDLESKYEIISCEKVHVYKKHSPLTLRQKIHTREKPCEC

SEQ ID NO: 25819 - protein, 81 aa, Balaenoptera acutorostrata
QGSVTFEDVALYFSWEEWALLDEAQRCLYHDVMLENFALTSSLGCWHEVEDKEASPEQSISVEGVSQIRTPKAISSPQKAQ

SEQ ID NO: 25820 - protein, 81 aa, Balaenoptera acutorostrata
QGSVTFEDVAVYFSWEEWCLLDEVQIHLYLDVMLENFAVVCMLGSFPAVEDEETPSEDSVSAEGVSQMRTPRAGLSPEKAQ

SEQ ID NO: 25821 - protein, 81 aa, Vombatus ursinus
SQESVTFQDVAVDFTQEEWGRLEPAQKDLYREVMLENYQNLVSLGLPFSKPHVISQLERGEAPWITEKDVPRVSCQDFFIQ

SEQ ID NO: 25822 - protein, 81 aa, Saimiri boliviensis
VQESVTFKDVAVLFTQEEWGQLSPAQRALYRDVMLENYRNLVSLGLLGPKPDIFSQLEKREEWMPEDPSGGFCLDWMAVPV

SEQ ID NO: 25823 - protein, 81 aa, Saimiri boliviensis
MAFEDVAVYFSQEEWGLLDTAQRALYRHVMLENFTLVTSLGLSTSRPLVVIQLERGEEPWVPSVKDMTLARNVYGRCNTGE

SEQ ID NO: 25824 - protein, 81 aa, Balaenoptera acutorostrata
QALLTFRDVAIEFSQEEWECLDPAQRALYRDVMLETYRNLISLDISISFMTKELLKKKNINNRELYQSVVLGRHGSHGIED

SEQ ID NO: 25825 - protein, 81 aa, Vombatus ursinus
DIFPRKHQKEWGCLGPSEKELYRNVMLENYGHLVYLELDLTLSVQQTVRTGKIHHECDENGRGFRQYSDLIQFKKITSGNG

SEQ ID NO: 25826 - protein, 81 aa, Lynx pardinus
MDTSQRTLYRDVTLENISHLVSVGMKNSHNKQEIIPMQDICMNDPPNCWTVQKCHTGEDLSVYSGFDEVFTHTYTLTQHVL

SEQ ID NO: 25827 - protein, 81 aa, Saimiri boliviensis
VRLTFRDVAIEFSQEEWKCLDPTQRALYRDVMLENYWSLVSLGLCHFDMNIISMLEEGKEPWTVKSYMKIARKPRMRKCVK

SEQ ID NO: 25828 - protein, 81 aa, Saimiri boliviensis
SVASEDVAVNFTLEEWALLDPSQKKLYRDVMRETFRNLACVGKKWEDQSIEDWYKNQGRILSNHVEVGLSESKEHNQCGEA

SEQ ID NO: 25829 - protein, 81 aa, Saimiri boliviensis
AQVSVTFEDVAVTFTQEEWGQLDATQRTLYQEVMLETCGLLVSLGCPLSKPELICPLDHRQELWMGKEDLSQSSYPGDSTK

SEQ ID NO: 25830 - protein, 81 aa, Saimiri boliviensis
MEWRHLDPSQRNLYRDVMLETYSHLLSVGYQVPEAEVVMLEQGNEPWALQGERPHQSCPGEKLWDHNQCRKILNYKQASSQ

SEQ ID NO: 25831 - protein, 81 aa, Cervus elaphus
EALTFKDVAVTFTEEELGLLDLAQRKLYRDSSKPDMISQLEREEKLWTTEIPPQRGGRSGVRCLSLGELSCWQIRHVVSKS

SEQ ID NO: 25832 - protein, 80 aa, Cervus elaphus
IEPKFQGSVSFKDVTVGFTQEEWQHLDSTQRSLYRDVMLENYRNLVSVGYCITKPEVIFRLEQGEEPWILEEEFPSQNFS

SEQ ID NO: 25833 - protein, 81 aa, Cervus elaphus
SVTFKDVIVDFTQEEWKQLDPVQRGLFRDVTLENYTHLVSIGKDDFSELISGGVEEEGTHLEQGTEPWIVEPSIPAGTPGD

SEQ ID NO: 25834 - protein, 81 aa, Cervus elaphus
VPVTFDDISIYFSTPEWEKLEEWQKELYKNIMKGNYESLISMDYAMNQPDVLSQIQPEGDRNTEDQAGQEESGIPTDPSEV

SEQ ID NO: 25835 - protein, 81 aa, Cervus elaphus
FQEPVTFEDVAVYFTQNQWASLDSAQRALYREVMLENYVNITSLAAFPLPKPDLIFWLERGEEPGRLDPWTLVGEEDLRGI

SEQ ID NO: 25836 - protein, 81 aa, Colobus angolensis
EDVAVDFTLEEWALLDSAQRNLYREVIFEMWERTKTQFKVNGSVSQQDIYGEEKSKEQTTPNFTRNNSCAYTLEKTCEGYG

SEQ ID NO: 25837 - protein, 81 aa, Colobus angolensis
SVAFEDVAVTFTQEEWALLDPSQKTLYRDVMQETFRNLASVGKKWKVQNIYVEYENLKRNLRIFVGERLESKEGHQHGEIL

SEQ ID NO: 25838 - protein, 81 aa, Muntiacus reevesi
CNMSLSFSDVAVDLSQEEWECMSPAQRALYRDVMLENYSNLVSLGCSTPKPDMITLLEQEKEPWMILREGTGSWFTDLESE

SEQ ID NO: 25839 - protein, 81 aa, Muntiacus reevesi
SETQLTIEDVDIKFTPEEWECLNPAQRALYWDVMEETYRNLLSVDVSHIHMTKKLQAKGNSGKGEILQRVMFRRTETHETK

SEQ ID NO: 25840 - protein, 81 aa, Muntiacus reevesi
LYGSLLFEDVAVEFTWEEWRLLDPAQKHLYQDVMLENYSNLLSVGYQSPKPIEIFKLKQGDKPWIERESIHDPDLVNQNRS

SEQ ID NO: 25841 - protein, 81 aa, Muntiacus reevesi
QLTSEDVAIEFTQEEWEFLDPAQRALYRDVMLETYRNLLSVDISPTHVIKHLQPKANSDKRELFQTLMLGRSESCEIKHFY

SEQ ID NO: 25842 - protein, 81 aa, Muntiacus reevesi
PKVPVSFEDVAVYFTKAQWKLLDHRQRKLYKQVMLDNYHNLVSLGFSSSKPQLVIQLEQGEKPWVADAQRMRITTGMQEGD

SEQ ID NO: 25843 - protein, 81 aa, Muntiacus reevesi
EQVSFKDVCVDFTQEEWYLLDPAQKILYRDVILENYSHLVSVGNCTTKPEVVFKIEQGEEPWILKERCPKQCRSEDWKVDD

SEQ ID NO: 25844 - protein, 81 aa, Ursus arctos
RPGAVSFADVAVYFSPEEWGCLRPAQRALYRNVMRETYGHLGALGFAGPKPALISWLERKKEVWSPEAEDPEAGARHPGSG

SEQ ID NO: 25845 - protein, 81 aa, Muntiacus reevesi
SPTLEDVAVAFTWEEWQLLVPAQKALYWDVTLENYSDLVSVSYQVSKPDVLFNSPQDIFEIVLFHLMLIKCSSFSFLDIKE

SEQ ID NO: 25846 - protein, 81 aa, Ursus americanus
WALLDSAQRKLYREVMLENLKNLASVDDETQFKASGSVSQQDIYGKKISKEHKMAKFIRNDSWASVLGKIWEELSTEDQRT

SEQ ID NO: 25847 - protein, 81 aa, Ursus americanus
FWILRLPPGSKGEIPKPEWGKLDEWQKELYKHVMRGNYEMLVSLDYAISKPDILTRMERGEDPCPEGPWGQEERSKKEAAR

SEQ ID NO: 25848 - protein, 81 aa, Ursus americanus
WALLDSAQRILYRDVMLENCRNLASCPFISDSVTQHKAKNSTRQQDILARKTPDEASRVCAVSHSSRPSPSGEDWKCPRTD

SEQ ID NO: 25849 - protein, 81 aa, Myotis brandtii
LIGDQDFGTSLLHTAPQEHWKHLDSIQKEQYWDLMLETYGKMVSGGISNSKPDLTNSTECGEELAGLHLHVSEKIPRPTCR

SEQ ID NO: 25850 - protein, 81 aa, Myotis brandtii
RHDDMDFEDVAIAFSEEEWGLLDEAQRLLYCDVMLQVFALVSSAGCWHKKDDAEACSEQSVSVQVESQVSAFKSAPATQKS

SEQ ID NO: 25851 - protein, 81 aa, Propithecus coquereli
AQVSVTFDDVAVTFTQEEWGQLDPAQRTLYQEVMLENCGLLVSLGCPIPRSELIYQLEHGQEPWTVRKDLSQGLCPDDKGK

SEQ ID NO: 25852 - protein, 81 aa, Balaenoptera acutorostrata
QDPVTFEDVAVYFSQEEWKLLDEAQRLLYRDVLLETFALVASLGCWHGAEHKEITSEHNVSIEVPRINTSKTDLSIWKSYP

SEQ ID NO: 25853 - protein, 81 aa, Vombatus ursinus
PHLLWFRSALGETPEWGHLGPSQKELYRQVMLENYGNLVCLGEDPRCRGHGEGTGGQGTGPPSEPWHGASLEVPAQALLNA

SEQ ID NO: 25854 - protein, 81 aa, Saimiri boliviensis
EPVTFEDVAVDFTQEEWQQLNPAQKTLHRDVMLETYSHLDSVGCSGIKPDVIFKVEHRKDPWIKDSELSRWIYPDRQKGLK

SEQ ID NO: 25855 - protein, 81 aa, Ursus americanus
WDVAVVFTEEELGLLDPAQRKLYRDVMLENFRNLLSVGEGNEMEYIQGRELKCLSYRELSYWKIWEHVAGELTENQDHRVN

SEQ ID NO: 25856 - protein, 81 aa, Ursus americanus
EWQLLDPAQRLLYKEVMLENYRQLVSLGHCVTKPELVLKLEQGEKPWAPKRELPKIQKAKNMKERTQEKEDKYSRQALFFN

SEQ ID NO: 25857 - protein, 81 aa, Myotis brandtii
FMDSVTFEDVNVEFTMEEWAFLDSTQKKLYTDVMLETFWNLASVACILEEKCEDLDSEDQYENHGMNHSSHTVERLCTRND

SEQ ID NO: 25858 - protein, 81 aa, Myotis brandtii
LPESLTFHDVAVDFTWEEWQLLGPEQKDLYRDVMMETYSHLVSLGCQASKPDALSKLERGEEPWTVQRGRHCPVSPELRKV

SEQ ID NO: 25859 - protein, 81 aa, Myotis brandtii
PPDAVTFPDVAIDFSQDEWECLNLSQRILYRKVMLENYRTLVSVGLCVSKPDVISLLEQGEEPWVTDGKMAGGLCPPLPYG

SEQ ID NO: 25860 - protein, 81 aa, Myotis brandtii
MDFEDVAVAFSQEEWGLLDEAQRLLYCDVMLEVFALVSSAGCRHKMGDAEACSEQSVSVQGESKVSASKTAPATQRTLLCG

SEQ ID NO: 25861 - protein, 81 aa, Propithecus coquereli
AAALVGRVQDCVTFEDVFVYFSREEWELLEEAQRFLYRDVMLENFALVATLGKGRKPWVSDRADISPPTVREDFFAFLSGC

SEQ ID NO: 25862 - protein, 81 aa, Myotis brandtii
MDFEDVAIAFSQEEWGLLDEAQRLLYCDVMLEVFALVSCADCWHKMDDEEVRPVPFVSIQGESQVRASKTAPATQSTHLCK

SEQ ID NO: 25863 - protein, 81 aa, Propithecus coquereli
VTFQDVAVDFTEKEWPLLDSSQRKLYKDVMLENYSNLTSLDWETPSKTKWSILMEDIFGKETSSSVTMERARLGEKSTEYA

SEQ ID NO: 25864 - protein, 81 aa, Propithecus coquereli
AQGSVTFRDVAVLFSQDEWSHLDSAQRTLYQEVMLENYGNLVSLGIVFSKPKVISQLEQGEDPWMMENGIPQGPLLGWESL

SEQ ID NO: 25865 - protein, 81 aa, Saimiri boliviensis
FQGLLAFRDVAIEFSLEEWQCLDCAQQNLYRDVMLENYRNLVSLGIAVSKPDLITYLEQNKEPWNIKRNEMVLPILCLSVM

SEQ ID NO: 25866 - protein, 81 aa, Propithecus coquereli
PQESVTFKDVSVDFTQEEWHHIDPAQRRLYRDVMLENYSHLVSVGYQVSKPEVIFKLEQGEEPWISEGEIQRPFCPDWKIR

SEQ ID NO: 25867 - protein, 81 aa, Propithecus coquereli
QAEVTFEDVAVLLSREEWGRLGPAQRGLYRDVMLETYGNLVSLGTGPAGPKPGVISQLERGDEPWVLDVQGTSGRGRLRVN

SEQ ID NO: 25868 - protein, 81 aa, Propithecus coquereli
MGSVTFRDVAIDFSQEEWECLDPAQRNLYRDVMTENYSNLVSLENFISKPDVITVLEQEPEPWMVVKKETNWESYYGTEEI

SEQ ID NO: 25869 - protein, 81 aa, Propithecus coquereli
VMFRDVAIDFSQEEWECLDSVQRDLYRDVMLENYSNLVSLDFPLCCASKDLSPKKDPYETELSQWEMSERLENCNLEESNF

SEQ ID NO: 25870 - protein, 81 aa, Lynx pardinus
EERDLVTFQDVAVEFTQEEWEHLGTTQRTLYQEVMLENYRSLASLVKSGPGPTICTGLGGSTRQHPGKDRGHSCHLLRLSA

SEQ ID NO: 25871 - protein, 81 aa, Saimiri boliviensis
AQGSVTFEDVTVCFSEEEWGLLDEAQRLLYCDVMLENFALIASLGLISFRSYIVSQLEMGKEPWVPDSVDMTSAMARGAYG

SEQ ID NO: 25872 - protein, 81 aa, Balaenoptera acutorostrata
IAVHTAFSVLSQKEQKKNKSPGSISFEDVTVNFTQEEWGQLDPDQRTLCRALHYQTRGDLQVRARSTMDIRGRICKPLLPR

SEQ ID NO: 25873 - protein, 81 aa, Balaenoptera acutorostrata
FQESVTFRDVAIAFAQQEWESLDSAQRVLDRDVMLENYRNLVSLAGHSCSKPHVITLLEQWKEPWMIVKKDQGRQYTEDDS

SEQ ID NO: 25874 - protein, 81 aa, Vombatus ursinus
MAVEFTLEEWEQLDPAQRNLYRDVMLERYRNLVLLGLPISKPDVISQLERGKEPWMLERKDPKGGHLDWDIRPETEKLISR

SEQ ID NO: 25875 - protein, 81 aa, Vombatus ursinus
LVFQESVTFKDVAMDFTPEEWGQLDPAQRDVMLENYRNLVSLWLPVSKPDGSSNFDQGENQWMMERRVPRGTRPDWDTRSE

SEQ ID NO: 25876 - protein, 81 aa, Balaenoptera acutorostrata
SQGLVSFKDVAVDFTQEEWQQLDPAQKTLYRDVMLENYSHLVSMGHPVSKPDVISKLEQGEDPWIVKRDIPNWIYPYEDQA

SEQ ID NO: 25877 - protein, 81 aa, Saimiri boliviensis
MSENYRNLVSVGYQGTKPDSLFKLERGEPPWVVEGAAHSQTCAGFVIQNTRYAGKDSDAFGGYGKSRLHIKHDKTLTGIKY

SEQ ID NO: 25878 - protein, 81 aa, Saimiri boliviensis
MLSHGPCLCIYQPDVFSSLEKGKEPWKILRNETRGRCPDMRSKCPIKKLLPKNGIFEREIAQLEIRKICKKHSLECLCFRG

SEQ ID NO: 25879 - protein, 81 aa, Saimiri boliviensis
VQSCVTFEDVFVYFSREEWDLLEEAQRFLYRDVMLENFALPFVCFTAFIFPPWVPNRADITPATIRETWGGPVLAEWELGR

SEQ ID NO: 25880 - protein, 81 aa, Saimiri boliviensis
ISFEDVAVDFTLEEWQLLNPTQKNLYRDVMLENYSNLVFLGYQIIKPDAISKWEQQDPWIVDQEILSQNFSEVWLDNTKMW

SEQ ID NO: 25881 - protein, 81 aa, Balaenoptera acutorostrata
VTFEDIALYFSWEEWKLLDEAQRRLYHDVMLENFALVSSLGCCCGAEDAEAPFQRSISISMSQARTPRAGSFSQKSHPCKK

SEQ ID NO: 25882 - protein, 81 aa, Vombatus ursinus
MVLSGYQISKPDVISKLQQGEEPCIVEREIPRGICPDWKTNPGIKKSTIKQEEELTQEAMMERFTRDGLWYSKLGKPFEWD

SEQ ID NO: 25883 - protein, 81 aa, Vombatus ursinus
MLENYENVVSLGFPVSKPDVISQLERGEEPWVVHTQEKVSLKGNCSDFETRPENERLSQKQKIPQEMELQATALERFTGHL

SEQ ID NO: 25884 - protein, 81 aa, Saimiri boliviensis
QGHVTFEDIAVYFSQEEWGLLDEAQRYLYHDVMLENFSLMTSVAGLSQNNHKDSCLQWKVPVSMNNCVAQCAPDEVHYTPL

SEQ ID NO: 25885 - protein, 81 aa, Lynx pardinus
SQGPVSFKDVVVNFTQEEWQYLDLPQRDLYKDVMLENYINLISVGYQTTKPSVIHKLEQGEEPWMVEREIPNWSYAEETWQ

SEQ ID NO: 25886 - protein, 81 aa, Colobus angolensis
PVTFRDVAVIFTEAEWKRLSPQQRNLYKEVMLENYRNLLSLAEPKPDIYPCSSCLLAFSCQQFLSQHVLQIFLGLCAENHF

SEQ ID NO: 25887 - protein, 81 aa, Colobus angolensis
AQESVTFRDVAVFFSQDEWLHLDSAQRALYREVMLENYSSLVSLGSPFSTPKLIHQLQQGEDPCLVEREVPPDTCLGFKTW

SEQ ID NO: 25888 - protein, 81 aa, Myotis brandtii
SFGPLTFRDVAIDFSQEEWECLDPAQRKLYLDVMSENYSNVASLAILSEDNQAILQKPKIRDLFPKIILVRYGRYGFDNVH

SEQ ID NO: 25889 - protein, 81 aa, Myotis brandtii
AKESVTFMDVAVIFTDEEWRHLIPIQRDLYKEVMLENYQSIISLGLPVPQPDVIFQLKREDKPWIIDLHGPDEGRWPENIS

SEQ ID NO: 25890 - protein, 81 aa, Myotis brandtii
FQEVVTFEDVAVHFTQAEWAGLSSAQRALHRSVMLENYGNLTSLGYTVPNSALISLLEGRDLPWGLEAQNDPPAERSTHVC

SEQ ID NO: 25891 - protein, 81 aa, Myotis brandtii
SQESLTFRDVFVDFTLEEWQQLDFSQKNLYRDVMLENYGHLVSVGYLVDTPDVIFRFGQGEEARREDGEPIIQSCPEFWKV

SEQ ID NO: 25892 - protein, 81 aa, Myotis brandtii
DPELLTLEDVAVEFSWEEWQLLDPAQKELYRDVMLETYNNLVSLGYHTAKPDALSKLEHGKEARIEDEIYSGSCPGIRKVD

SEQ ID NO: 25893 - protein, 81 aa, Myotis brandtii
DSVAFGDVAVKFTLEEWALLDSSQKKLYRDVMRETFRNLASIGKRWEEHDIEDQYKNQRRKLRNPMVEKFCESKEVSQYGE

SEQ ID NO: 25894 - protein, 81 aa, Myotis brandtii
AEVGVTFEDIALYFSRKEWNLLDESQRQLYLNVMLENFELLSSLEALTFVVIREFTLEKGHISAVNVAKLLAVVIASAIIK

SEQ ID NO: 25895 - protein, 81 aa, Eschrichtius robustus
AQGKVNFEDVFVYFSQEEWGLLDEAQRLLYREVMLENFALMASLGYASSMFHGVAPLELDSEPWLSDWADMTPAMTREAQS

SEQ ID NO: 25896 - protein, 81 aa, Propithecus coquereli
CEESVTFKDVAVDFTQEEWGQLDSPQRALYRDVMLENYQNLLALGPPVHKPDVISHLERGEEPWQVQREGPGGVPTNEWIL

SEQ ID NO: 25897 - protein, 81 aa, Vombatus ursinus
GWVPALFDEVAIYFSDEEWEVLTEQQKALYREVMRMNYETVLSLEFPFPKPDVISQLEVEESPWAPYPQNSEDWKLQGGTF

SEQ ID NO: 25898 - protein, 81 aa, Vombatus ursinus
MYRDVMLENYENFVFLGLPVSKPDVISHLERRETPWMTENEVLISTYLDSFIQKTGFEIKESIPKQYIAMGESFNERLTKE

SEQ ID NO: 25899 - protein, 81 aa, Saimiri boliviensis
GRVTFEDVTVNFTKGEWQQLNPEQRNLYRIVMLENYSNLVSVGREETTKPNVILRLEQGKEPWSEGEEVLRGGHPEKNWDI

SEQ ID NO: 25900 - protein, 81 aa, Balaenoptera acutorostrata
QGSVTFEDVVVYFSWEEWGLLDEAQRCLYHDVMLENFALVTSLGCWYGMEDEEAFSVQSVSVEQMSLRKTPTPDPSIQKTH

SEQ ID NO: 25901 - protein, 81 aa, Balaenoptera acutorostrata
MLENYGNLVSVVGCQLSKPSVISQLEKGEAPWMTEKEGPGDPSSDLKGKTETAASTAKNDVLQEQFYHGMMMERFMRDDVI

SEQ ID NO: 25902 - protein, 81 aa, Vombatus ursinus
LLELVAFKDVAVEFNQEEWRCLDASQKELYHDVMMENYKNLVCLGLVFNKPAVISHLEGKEAPWMAEGQRTQLIQHFKILT

SEQ ID NO: 25903 - protein, 81 aa, Saimiri boliviensis
SQEPVTFADVAVVFTPEEWVFLDSTQRSLYRDVMLENYRNLASVGDQLCKPNALSYLEQRGEQWTTERGVISDTCPEPQLQ

SEQ ID NO: 25904 - protein, 81 aa, Saimiri boliviensis
WQESVTFQDVAVGFTPEEWQLLDCADRTLYWDVMLENYRNLFSVGCPVTQTKVILKAEQEQEPWMAEGVNPHHSSPESDCP

SEQ ID NO: 25905 - protein, 81 aa, Vombatus ursinus
FQESVTFKDVAVDFTQEEWAQLDPPQRNLYRDVMLENYEHFVFLGLPVAKPEVISQLERGEVPLFPEQPEFSTSICPDSLN

SEQ ID NO: 25906 - protein, 81 aa, Vombatus ursinus
FQQLVTFEDVAVYFSKEEWGQLDLAQRELYRDVMLENYENLLSLGFPVSKPDIITQLEQRKEAWIRDIQGPKEREFSQNAC

SEQ ID NO: 25907 - protein, 81 aa, Vombatus ursinus
FQESVTFKDVAVEFTGEEWRQLDRAQRSLFRDVMLENYRNLVSLGLTVAKPNLIFLLERGEAPWTLQRQIPGGTSSDCPCW

SEQ ID NO: 25908 - protein, 81 aa, Cervus elaphus
LTVEDVDIKFTPEEWECLDPAQRALYWDVIEETYRNLLSVGEDHFPEKLESDVSCIDMTMKLQAKGNSGKGEIFQRVIFER

SEQ ID NO: 25909 - protein, 81 aa, Cervus elaphus
FQGLLTFEDVAVHFTQEEGARLDAGQRTLYRDVILETYRNLVSLEVPGSKPDLISQLEQGREPWGSDLLGTQEAETVGDAG

SEQ ID NO: 25910 - protein, 81 aa, Colobus angolensis
LKGLVTFEDVAVEFTQEEWTLLDPAQRTLYRDVMLENFRNLASLGNQVDKPGLISQLEQEDKVMTEERGIFPGACPDVENL

SEQ ID NO: 25911 - protein, 81 aa, Colobus angolensis
QGLLTFRDVAIEFSQEEWKCLDPAQRTLYRAVMLENYRNLVSLAISSKCMKKEFSSAAQGNREVLHAGTLQRHESHHIGDF

SEQ ID NO: 25912 - protein, 81 aa, Colobus angolensis
MGQESVTFKDVAVLFTQEEWGQLSPAQRALYRDVMLENYSNLVSLGLLGPKPDMFSQLEKREVWMPEDAPGSFCLDWMTRP

SEQ ID NO: 25913 - protein, 81 aa, Colobus angolensis
MGPLQFRDVAIEFSLEEWHCLDTAQRNLYRDVMLENYRNLVFLGIPVSKQDLITCLEQGKKPLTMKRHEMVAKSTVSFLQV

SEQ ID NO: 25914 - protein, 81 aa, Colobus angolensis
PQESVAFEDVAVYFTTKEWAIMVPAERALYRDVMLENYEAVAFVVPPTFKPALVSHLEQGKESCFIQPQGVLSRSDWRAGL

SEQ ID NO: 25915 - protein, 81 aa, Colobus angolensis
RAQSCVSFEDVFVYFSREEWELLEEAQRFLYRDVMLENFALVATLAFIFPVPCSCPVGGGRKPWVPDRADITAATVKETYR

SEQ ID NO: 25916 - protein, 81 aa, Colobus angolensis
DGLVTFRDVAIDFSQEEWECLDPAQRDLYVDVMLENYSNLVSLDLESTTYETTKIFSEKDIFEINFSQWEMEEKSKTLGLE

SEQ ID NO: 25917 - protein, 81 aa, Colobus angolensis
AGWLTNYSQDSVTFEDVAVDFTQEEWTLLDQTQRNLYRDVMLENYKNLVAVDWESHINTKWSASQQNFLQGKTSSVVEMNE

SEQ ID NO: 25918 - protein, 81 aa, Mustela putorius
SQELLTFRDVAIEFSEEEWGRLTHTQQQLYRDVMLENYGHLHFLGLLLSKPDLIMFLEQEKKLGNVKRKETVAVHPAVSSH

SEQ ID NO: 25919 - protein, 81 aa, Mustela putorius
GHLTFRDVAIEFSQEEWECLDPAQRALYRDVMVENYRNLVSLGSLSAGFAIKKLSPKEDINKGESYHLVILEGNESQGIKD

SEQ ID NO: 25920 - protein, 81 aa, Mustela putorius
IRRRGRSRRLGFVLRALPFSKKSPEDNQPFSANTKAMAQESVMFSDVSIDFSQEEWECLNDDQRDLYRDVMLENYSHLVSM

SEQ ID NO: 25921 - protein, 81 aa, Mustela putorius
GLVTFSDVAINFSQEEWACLNSSQRDLYWDVMLENYSNLVSLDLESPYGTKSLPTEKGLYEMNLSKWNSNGKSKSLGLDWM

SEQ ID NO: 25922 - protein, 81 aa, Mustela putorius
VTFEDVAVYFSWKEWRLLDETQRRLYHHVMLENFALVSSLGCCCGAEDEEAPFAQSASVGVSQTGTPRAALSSQKTHPCQM

SEQ ID NO: 25923 - protein, 81 aa, Myotis brandtii
MLENYRHLLSLGHCVAKPELIFKLEQGEEPRIVKGEFPSQSHPAYNRTSDSQYDALITSNLVPMYEAFQKIWDYFHSVLLL

SEQ ID NO: 25924 - protein, 81 aa, Camelus ferus
LTFKDVAIEFSQEEWECLDAAQRALYRDVMLETCRSLLSLGAASPRGAPLCPTAPSTALRLQVHPLPWPLHSVVPRQARTW

SEQ ID NO: 25925 - protein, 81 aa, Myotis brandtii
EAEDMDFEDVAIAFSQEEWGLLDEAQRLLHCEVMLENFALVASVGCWHKSEDEETSSKQSVSVTAESQVKASKTALPTQKT

SEQ ID NO: 25926 - protein, 81 aa, Myotis brandtii
DMIFEDLAIAFSQEEWGLLDEDQRLLYCDVMLGVFALLSSLGCWHKMDEKEVPPEQSVSVGESQVRASKTAPATQKAYLCK

SEQ ID NO: 25927 - protein, 81 aa, Myotis brandtii
FQEPLTLEDVAVDFTWEEWQLLGPDQKILYRDVMLETYSHLLSVGYQVSKPDALSKLELGEEPWTIDNELHRLVCPDTGKV

SEQ ID NO: 25928 - protein, 81 aa, Myotis brandtii
VTFEDIALYFSREEWSLLDEGQRQLYLNVMLENFELISSLGCCCGAENVEETTEQKVSVRLSQARNPKVGVTFEDIALYFS

SEQ ID NO: 25929 - protein, 81 aa, Myotis brandtii
QEALTFKDVEVTFSQDEWAWLNPAQRNLYRDVMLENYGSLASLGGELQIKSSKLILNPKPLEDAQALAVSSGCRVMSVSEE

SEQ ID NO: 25930 - protein, 81 aa, Propithecus coquereli
SQERVTFEDVAVYFSREEWEYLDSGQRALYRDVMLDNFRIFATLGFCSPRPDLVSCLQQWDEPWVEDWERLESQKVRRGPY

SEQ ID NO: 25931 - protein, 81 aa, Propithecus coquereli
VSFEDVAVDFTWEEWQLLNPTQKNLYRDVMLENYSHLVFLGCQIVRPDGICKPEQEEAWMIDEEILSQNLSEVWLDNKSKM

SEQ ID NO: 25932 - protein, 81 aa, Propithecus coquereli
QEHLTFRDVAIEFSQEEWKCLDPAQRALYRDVMLENYRNLVSLDIPPKCVVKELPPTGKSSREVFHTVMLERHESHPIGDI

SEQ ID NO: 25933 - protein, 81 aa, Propithecus coquereli
VTFKDVAVDFTQEEWGQLDSPQRALYRDVMLENYQNLLTEESSQRQDVYKEEPSREPAVGRVLGDAWAWESQAGALRPSPA

SEQ ID NO: 25934 - protein, 81 aa, Saimiri boliviensis
CYQDSVTFDDVAVDFTQEEWTLLDPTQRSLYSDVMLENYKNLATVGGQIIKPSLISWLEQEESRTVQGGVLQGRKPQWKET

SEQ ID NO: 25935 - protein, 81 aa, Balaenoptera acutorostrata
MAFQDLAVRFSEDEWRLLGEGQRALYLDVMRENYETLASLGTVELLPLSAFLSPSEPGGATGGGSCAGDGPEPPRGGGPLG

SEQ ID NO: 25936 - protein, 81 aa, Saimiri boliviensis
FFSREPICFFEEKTKVERTVVDYLANGYQDSVTFDDVAVEFTPEEWALLDTTQKYLYRDVMLENYKNLASVADKLQWMETL

SEQ ID NO: 25937 - protein, 81 aa, Lynx pardinus
AQVSVTFDDVAVTFTQEEWGQLDLAQKTLYQEVMLENCGLLVSLGCPVPRPELICQLERGQEPWTAKRGLSQNTYPGDKDK

SEQ ID NO: 25938 - protein, 81 aa, Saimiri boliviensis
DSVTFEDVAVNFTQEEWALLDSSQKHLYRDVIQETINNLMSVGIIWQGQNTEYHCKDSRRNPRNHMAERLCECKDGQCDET

SEQ ID NO: 25939 - protein, 81 aa, Vombatus ursinus
MLENYRNLVCLGLAASSPEVIGQLERGDGPWRLEGKVQKGLCADQKTSNGTQEITTKQGLSIEESSQERLKNDISYVSQLR

SEQ ID NO: 25940 - protein, 81 aa, Saimiri boliviensis
MLENYFNLISVGCQVPKPEVIFNLEQEEPRMLNGGISSQSCPDGKIGFESLQQRMSEEVSFQSERINLFTRDDPYSILEKL

SEQ ID NO: 25941 - protein, 81 aa, Balaenoptera acutorostrata
QLTFKDVAIEFSQEEWECLDPGQRALYRDVMLETYRNLLSLGISPTHVIKKLQPKENTNSTDIFQTVILGRHESHEVKSFY

SEQ ID NO: 25942 - protein, 81 aa, Vombatus ursinus
MFEDVAVYLTEEEWGCLSPAQRGLYKDVMLENYGNLVSLGFPVSKPDVISQLERGEEPWVLNMLQRAEKREILRGSCSDYV

SEQ ID NO: 25943 - protein, 81 aa, Saimiri boliviensis
MEGLVRFQDLSIDFSQEEWECLNSAQKDLYRDVMMETYNSLLSLGLSIPKPDVISLLEQGKEPWMVSRDVLGGWCPDLEFR

SEQ ID NO: 25944 - protein, 81 aa, Saimiri boliviensis
FQESVTFEDVAVYFSENEWIGLGPARRALYRDVMLENYGSVASLAFPFPKPALISQLEQGEAPWCLAPRGALDGEGQRGIS

SEQ ID NO: 25945 - protein, 81 aa, Balaenoptera acutorostrata
VTFPDVAVRFSWGEWRLLDEAQRRLYLSVMLESYELISSLGCCCGAESEETTCEETVAVGVSQAGSPKAAPFSQKTHPCEM

SEQ ID NO: 25946 - protein, 81 aa, Vombatus ursinus
ALVSVTFDDVIMYFMEQVWRTLEEWQKELYKDKMNINYKTLVSLGCAIPKPDLNIQIEQGKEPFFRDQGHLEITDLAICSS

SEQ ID NO: 25947 - protein, 81 aa, Cervus elaphus
ERESVTFRDVAVVFSRDEWLHLDAAQRSLYREVMLENYSTLVSLGIPFSMPKLICQLQQGEDPCMVEREIPQDACLGFKTW

SEQ ID NO: 25948 - protein, 81 aa, Cervus elaphus
KGSVTLQDVAVEFTPEEWQLLDCDQRTLYWDVMLENFRNLISVGTGCPVTETTVIFKVEQGQEPWMVEGENSHRSSPEADC

SEQ ID NO: 25949 - protein, 81 aa, Colobus angolensis
QAMVKIEDMAVSLILEEWGCQNLARRNLSRDHRQENYGSTFPQANVFTAFQHAVHVFCFLEEKGHVQSCHGPEACPACSKG

SEQ ID NO: 25950 - protein, 81 aa, Colobus angolensis
VAFEDVAVNFTQEEWTLLDISQKNLFREVMLETFRNLTSIGKKWKDQNIEYEYQNPRRSFRSLIEEKVNEIKEDSHCGETF

SEQ ID NO: 25951 - protein, 81 aa, Colobus angolensis
MLENYENLATVGCQLFKPSLISWLEQEESRTVQRGDFQASEWKVQLKTKESALQQDFLGEPNSSGIQMIGSHSGGEANDVK

SEQ ID NO: 25952 - protein, 81 aa, Colobus angolensis
QELVTFEDVSVDFSQEEWELLEPAQKNLYREVMLENYRNVVSLDCMTILRNQDSTYKKVALQEEPASGLKMIKLIREDGGW

SEQ ID NO: 25953 - protein, 81 aa, Colobus angolensis
QGQLTFKDVAIEFSQEEWKCLDPAQKTLYRDVMLENYRNLVSLDISCKCVNKDLPPKGKNNMGEAFHMVKLERLESHDEVL

SEQ ID NO: 25954 - protein, 81 aa, Colobus angolensis
DSVAFEDVAINFTCEEWALLGPSQKSLYRDVMQETIRNLDCIGMIWQNHNIEEDQYKDLRRNLRCHMVERSCEIKDDSQCG

SEQ ID NO: 25955 - protein, 81 aa, Oryctolagus cuniculus
VMFRDVAIDFSQEEWECLDSAQRDLYRDVMLENYSNLVSLDLPSIYGSKDFSPKRDTYETELSQWEISDKPGNRDLQESNS

SEQ ID NO: 25956 - protein, 81 aa, Pteropus alecto
RPEPVSFAEVAVYFSPEEWGCLRPAQRALYRDVMRETYGHLGALGFRGTKPALISWVEEEAELWGPDARDPEIEECMTEAD

SEQ ID NO: 25957 - protein, 81 aa, Pteropus alecto
FQASVSFKDVTVELTQEEWQQMGPLQRTLYRDVMLENYNNLVSVGSCIYKPELIFKLEQGEEPWLLEEEFSNQSYQVLEHY

SEQ ID NO: 25958 - protein, 81 aa, Rhinolophus ferrumequinum
CVTFEDVAIYFCQEEWGLLDEAQRFLYRDVMLENFALTASLGKTFTFLSVSVSGLSLSPKTHPCEKCVPALKDILHLTKLQ

SEQ ID NO: 25959 - protein, 81 aa, Rhinopithecus bieti
HLTFMDVAIEFSQEEWKCLDPGQRALYRDVMLENYRNLVSLGRSCILGSNAENKPIKNQLGFTLESRLSELQLFQAGRKIY

SEQ ID NO: 25960 - protein, 81 aa, Ursus arctos
RSQESLTFQDVAVNFTREEWDQLYPAQKNLYRDVMLENYRNLVALGHQLYKPEVISQLEQEEQWVMERGSPLDTHADGESR

SEQ ID NO: 25961 - protein, 81 aa, Ursus arctos
VTFEDVAVYFSWEEWGLLDEAQRCLYQDVMLENLALINSLGRRHGTEDEEAPEHRVSVQAASQVGTRKAVVSPQKAHPREV

SEQ ID NO: 25962 - protein, 81 aa, Ursus arctos
SSQGLLTFGDVAIEFSQEEWRCLSRTQRELYRDVMLENYGHLLFLGFILSKPDLIMFLEQEEQFWDVNRKKTVAFHPGRWE

SEQ ID NO: 25963 - protein, 81 aa, Ursus arctos
QDSVTFEEVAVDFSQEEWALLDAAQKILYRDVMLENYRNLASVDWDIQLKSKDGIPMQNVPGEKTCNGIKPAPTQPGKKPL

SEQ ID NO: 25964 - protein, 81 aa, Ursus arctos
AQVPLTFSDVAIDFSQEEWECLNSDQKDLYRDVMLENYTNLVSLDFDFTTETNKLSSEKSSYEVNSYHRETMKRSKIFSPT

SEQ ID NO: 25965 - protein, 81 aa, Muntiacus reevesi
SEDPVTFQEVLVDFSQEEWAQLAPAQKILYQDMMLENCRNLTSVGYHLCKPRLLTQGELRTRKRRFLQDTCADQNSQLKTK

SEQ ID NO: 25966 - protein, 81 aa, Ursus americanus
WCWGLLTFGDVAIEFSQEEWRCLSHTQRELYRDVMLENYGHLLFLGLIVSKPDLVSFLEQRKEPWDEKRNKTAGFDPGTWE

SEQ ID NO: 25967 - protein, 81 aa, Propithecus coquereli
FQGPVTLKDVTVEFTKEEWKLLTPAQRTLYKDVMLENYSHLVSVGYRVNKPNGVFKLKQGKKPWILEVEFPRRSFPEDLWN

SEQ ID NO: 25968 - protein, 81 aa, Propithecus coquereli
ETRERRQGAVSFADVAVYFSPEEALYRDVMRETYGHLDALGFSGSRPAFVSWVEGQVEAWIPEAQDPSGSRDGNEEKARLK

SEQ ID NO: 25969 - protein, 81 aa, Balaenoptera acutorostrata
AAGSVTFKDVTMAFTKKEREQLDPAQKSLYKDVMLENYSNLASLVTYQALKPDMISKLGKGEEPWLGKGKRPRQGGLSEIA

SEQ ID NO: 25970 - protein, 81 aa, Vombatus ursinus
FQKSMTFKDVSVDFTQGEWGQLDPSQRDLYRDVMLENYRNLVSLELQVIKPEVISRLERGEAPCMLEREGLIGSCPDNDTR

SEQ ID NO: 25971 - protein, 81 aa, Lynx pardinus
MEPLTFKDVAVVFTEEELRLLDPTQRKLYRDVMLENFQNLLSLGQQAFKPDKAPPWNKIQKKCLGSYDTHRWILLQAVTGD

SEQ ID NO: 25972 - protein, 81 aa, Balaenoptera acutorostrata
SQGLLSFNDVALDFTWEEWQLLDTVQKNLYRDVMLENYSNLMSLGYQVTKPEPVMHLEKGKEKEKAVVEREFPIQCGPEVM

SEQ ID NO: 25973 - protein, 81 aa, Balaenoptera acutorostrata
ISETSVSFKDVTVEFTQEEWQCMNSAQRTLYRDVMLENYSHLVSLGYYFTKPDVIIKLEQDDPLLLEEEFLNKSHTDSKLD

SEQ ID NO: 25974 - protein, 81 aa, Lynx pardinus
MLENYQNLITLGYKSCKPGLSSALEGAELLRTGGRGVLQEVDLQLQTKGSTPLREIPWEKTPNGIQLLKITQKQGRISVHL

SEQ ID NO: 25975 - protein, 81 aa, Cervus elaphus
FQGSLSFRDVAVGFTRKEWQQLDPTQRTLYREVMLENYSHLLSVGEKGCQCPHPCLCLSSFLSSYRRPLKQREHREEPLKQ

SEQ ID NO: 25976 - protein, 81 aa, Colobus angolensis
REDRGTSESQEMEEWALLDIFQKNLYREVMLETFKNLTSIGKSWKDQNIEYEYQNPRRNFRSLIEEKVNEIKEDSHCGETF

SEQ ID NO: 25977 - protein, 81 aa, Colobus angolensis
PQGLLTFRDVAIEFSQEEWKCLDPAQRTLYRDVMLENYRNLVSLEFRSVTQAKVQWLGSLQPPLPRFKQFSCLSLPSSWDY

SEQ ID NO: 25978 - protein, 81 aa, Sus scrofa
PFQGLLTFEDVAIDFSPEEWECLDLGQRHLYRDVMLEICRHLVSLGEDPFLPEFLFSHWVGFACVQKHFIFHSSPQWRCYR

SEQ ID NO: 25979 - protein, 81 aa, Neophocaena asiaeorientalis
QGHVIFEDVAVSFSQEEWCLLNDAQRLLYGDMTLENLSLIASLGCAHGVEAEEAVSEQCVSVEQVTEDRNPKLEPSILKPL

SEQ ID NO: 25980 - protein, 81 aa, Neophocaena asiaeorientalis
PHWLVTFRDVAINFSQEEWECLDPIQRDLYRQVMVENYSHLISLAGCSIPKPDVFSLLERGKEPWMVVRAMTRWSSDLEYS

SEQ ID NO: 25981 - protein, 81 aa, Bos mutus
MCIPAFCCWLVLPRPPAPRGKQSLASRSTGEGAAGNCITKPEVIFKIEQGEEPWILEERFPKQWHSEDWKVDDLIDSTQEN

SEQ ID NO: 25982 - protein, 81 aa, Neophocaena asiaeorientalis
QGSVTFEDVAVYFSWEEWCLLDEVQMHLYLDVMLENFALVCMLGSFPAVEDEETSSEQSVSAEGVSQMRTPRAGSSPERAQ

SEQ ID NO: 25983 - protein, 81 aa, Nomascus leucogenys
VTFEDVALYLSREEWGRLDHTQQNFYRDVLQKENGLSLGFPFSRPFWAPQAHGKGEASGSSRQTGDEEWRGACTGAVEMGQ

SEQ ID NO: 25984 - protein, 81 aa, Nomascus leucogenys
VVFEDVAVDFTLEEWALLDSAQRNLYRDVMLETFRNLASVDDETQFKANGSVSQQDMYGQDKSKEQTIPTFTGNNSCAYTL

SEQ ID NO: 25985 - protein, 81 aa, Bos mutus
LTFKDLAIEFSQEEWECLDLAQRALYRNVMVEICGFMTKELLQKKYINNRELYQPVVLGRFGNHGIEESDFSEVWGNTFEF

SEQ ID NO: 25986 - protein, 81 aa, Nomascus leucogenys
TQEHVTFRDVAVFFSQDEWLHLDSAQRALYREVMLENYSSLVSLGIPFSMPKLIHQLQQGEDPCMVEREVSADTCLGFKTW

SEQ ID NO: 25987 - protein, 81 aa, Nomascus leucogenys
AEGSVTFSDVSIDFSQEEWDCLDPVQRDLYRDVMLENYSNLVSMGLYTPKPQVISLLEQGKEPWMVGRELTRGLCSDLESM

SEQ ID NO: 25988 - protein, 81 aa, Nomascus leucogenys
AVLTDRAQVSVTFDDVAVTFTKEEWGQLDLAQRTLYQEVMQENCGLLVSLAPSQTHPGSIRCILQSNQVDTLIKIPEHTEH

SEQ ID NO: 25989 - protein, 81 aa, Nomascus leucogenys
LSFRDVAIEFSQEEWKCLDPGQKALYKDVMLENYRNLVSLCEENVPSRRICLPDLSVISMLEQKKDPWTLQSEVKIAKNPN

SEQ ID NO: 25990 - protein, 81 aa, Nomascus leucogenys
SQESLTFKDLFVDFTLEEWQQLDSAQKNLYRDVMLENYSHLVSVGYLVVKPDVIFRLGPGEESWMADGGTPVRTCAGEDRP

SEQ ID NO: 25991 - protein, 81 aa, Nomascus leucogenys
CYQDSVTFDDLAVDFTPEEWTLLDPTQRNLYRDVMLENYKNLATVGCQLFKPSLISWLEQEESRTVQRGDFQALEWKMQLK

SEQ ID NO: 25992 - protein, 81 aa, Bos indicus
FQEAAELEFLSVNYTLKNWKGTALSQRALYWNIMLENCCSLAPLGENRMASSQLSPKQDISEESASADRTSGILCGLILRG

SEQ ID NO: 25993 - protein, 81 aa, Bos indicus
WLQGPMSFKDVAVEFTQEEWMMLDSAQRSMYRDVMLENYINLTLVEYQLCKPVISLSGQEDIRTVKSRIAQGTCPDWEIQF

SEQ ID NO: 25994 - protein, 81 aa, Bos indicus
VTFRDVAVFFSRDEWLCLDSAQRTLYQEVMLENYSTLFSLGWESLFETAISEEENQEVMNQLLGDGPFDFRLGKIYINEET

SEQ ID NO: 25995 - protein, 81 aa, Muntiacus muntjak
MLENFALIASLGLTSFRSHIVAQLEMGAEPWVPDQVDMTSAMARGVYRDFYCGTEGENSPAELSVSVEVSQNMNPKAVPST

SEQ ID NO: 25996 - protein, 81 aa, Muntiacus muntjak
PQESVTFEDVAVNFSHEEWQCLTHAQRHLYKDVMLENYGNMVSLGFSFSKPPLISSLEQGTEPYVQDRQDWEFLSCSYPAA

SEQ ID NO: 25997 - protein, 81 aa, Muntiacus muntjak
PQACVTFEDVAVYFSQEEWRLLNETQRFLYCDVMLENFALTTSLEDEVIPSEQSLSVGESQVRPSQSGPSTQKIHLCEKSV

SEQ ID NO: 25998 - protein, 81 aa, Muntiacus muntjak
SREQVTFEDVVVDFTQEEWGHLEPAQRTLYRDVMLETFGLLVSVGHWLPKPDALSLLEQEAALRAADEGGPRGVCPDLETR

SEQ ID NO: 25999 - protein, 81 aa, Muntiacus muntjak
CQAPVTLKDVIVTFTQQEWKLLDLTQRTLYQEVVLETSRLLVSLGDKAKTKPTETTAAQQALFKGHLLQRSVSQEGCSVSP

SEQ ID NO: 26000 - protein, 81 aa, Ailuropoda melanoleuca
ESLTFEDVAVGLIQEWALLDGARRNLCQFVILDKCRILAPRGVGSPPCKPSLGSQVGPEEELRTPRVSEKDLFRCLSLYWE

SEQ ID NO: 26001 - protein, 81 aa, Gorilla gorilla
EADGSPEVRMTFQDMAMDFTREEWVMLENYRNLVTLGEGGIPPEVITQLELQEEWVIERYSPLDTHPGKDGENRPEIKKST

SEQ ID NO: 26002 - protein, 81 aa, Ailuropoda melanoleuca
IQEPVTFKDVAVDFTQEEWGQLDLVQRTLYRDVMLETYGHLLSVGNQIAKPEVISLLEQGEEPWSVEQAYPQSTCPEWMRN

SEQ ID NO: 26003 - protein, 81 aa, Ailuropoda melanoleuca
FQGSLSFKDVAVVFTWEEWQLLDPIQKNLYQDVMLENYSNLVSVVGYQVTTADAFYQLENGTPWITEEEIQSQIHPVTNVS

SEQ ID NO: 26004 - protein, 81 aa, Myotis lucifugus
MNIEDVAIVFSQEEWGLLDEAQRLLYYDVMLEVFALVSSVGCWHKMDDKEACSSQSVSIQGESQVRASKTAAATQKTLLCK

SEQ ID NO: 26005 - protein, 81 aa, Myotis lucifugus
DDMNFEDVAIAFSRKEWEILDESQRRLYCDVMLEVFSLVSFVGPWHKMNDVEAYSQHSVSVGESHVRASKTAAATQRTHLC

SEQ ID NO: 26006 - protein, 81 aa, Oryctolagus cuniculus
MYFTQKEWQLLKPAQKVLYKDVMLENYENLAFLVGHPVFKPKLIANLEQGIKPYVKKKAVPRDHQRGDEGISGSNIASDKK

SEQ ID NO: 26007 - protein, 81 aa, Oryctolagus cuniculus
YQELVTFKDVAVCFTQAEWAELSPAQRALYRSVMLENYGTLTMLGYPVPKPALISLLERGDLPWNLEVQEEPPAERTRELC

SEQ ID NO: 26008 - protein, 81 aa, Oryctolagus cuniculus
VQGLVTFKDVAVLFTQEEWGRLSPAQRTLYRDVMLENYSHLVSLGLLGAKPDIFSQLGKGEEWVPEDGSGSFCLDGMTLPV

SEQ ID NO: 26009 - protein, 81 aa, Rhinolophus ferrumequinum
CSGFSGLCASPVEEPHGALINSCNSRAMTNGSVTFRDVAIDFSQEEWECLDPAQRALYMDVMLENYSNLVSLDTSFLSQMG

SEQ ID NO: 26010 - protein, 81 aa, Rhinolophus ferrumequinum
SQGPLSFTDVCVHFTWEEWQLLDAVQKHLYRIVTLENYGHLVSLGYQHTKPDIILKLEQEGEQWMTQSHVPSQGQPDKVWE

SEQ ID NO: 26011 - protein, 81 aa, Rhinolophus ferrumequinum
SLGSDLFRDVAVVFSQEEWERLVPAQRDLYRDVMLETYSNLVSLDLAISKPDVISFLEQGKEPWMVERAATRGVCPVLESS

SEQ ID NO: 26012 - protein, 81 aa, Ursus maritimus
MLENFKNLVSVGHLPFKPDMVSQLEAEENLWVMEGETQRNGYSSEDHVAVPSGSKTQNEMETLQKVALKYLSHEELSCWQI

SEQ ID NO: 26013 - protein, 81 aa, Ursus maritimus
MKPDVIFKLEQGEEPWIGDGEVASSECPEQVLQVNGHMTWHQDNQEKFRNMKQDHECDAFGKKFNLSMNFVPVRKSNSEDD

SEQ ID NO: 26014 - protein, 81 aa, Ursus maritimus
VKFSKDEWKRLVPTQRALYREVMLENYQGFISLGLLVPKPDVIFQLKRGEEPWKLDFQEDEKSEVPGSTFPGMCELGGWDF

SEQ ID NO: 26015 - protein, 81 aa, Ursus maritimus
FLPWPSFPKLALRSFPCLPVLCQLWPGTFPREHRRGENGSCASNSQTAGLLVPKPDVIFQLKRGEEPWKLDFQEDEKSEVP

SEQ ID NO: 26016 - protein, 81 aa, Ursus maritimus
GQGSVSFRDVTVDFTRDEWLRLTGTQRTLYRDVMLENYSHLVSVGCHLSKPEVIFRLEQGEELWPSEGGFPDQRDQDRSRE

SEQ ID NO: 26017 - protein, 81 aa, Ursus maritimus
MTFEDVAVEFTQWEWGQLDPAQQGLYREVMLENFKNLASLGLPVSKPYVITQLDEPCVLDGEISTDWEKRPKAKESILNQG

SEQ ID NO: 26018 - protein, 81 aa, Ursus maritimus
VTESVTFRDVAVLFSRDEWLRLDSAQRTLYREVMLENYGTLVSLGIPFSMPKVICQLQQGEDPCVVDRELPRDACPGLKTQ

SEQ ID NO: 26019 - protein, 81 aa, Ursus maritimus
QEPLTFRDVAVVFTEEELGLLDPAQRKLYRDVMLENFRNLLSVGEGNPTGDKNEKEMEYIQGRELKCLSYRELSYWKIWEH

SEQ ID NO: 26020 - protein, 81 aa, Rhinopithecus bieti
FQGLLTFRDVAIEFSLEEWQRLDAAQQNLYRNVMLENYRNLVFLGIAVSKPDLITCLEQGKEPWNMKRHEMVDESPGLHFS

SEQ ID NO: 26021 - protein, 81 aa, Gorilla gorilla
YQDSVTFDDVAVDFTQEEWTLLDPSQRDLYRDVMLENYENLASVGHHLFKPSVIYWLEEEEELRAGRRGVLQEWRLKTKGP

SEQ ID NO: 26022 - protein, 81 aa, Ailuropoda melanoleuca
EMEPHSHAVPCQPSMSFKDVAVTFTQEEWGQLNLAQRRLYRNVTLETWSHLVSLGLLLSKPDVISWLEQGQDPWRAEQGPP

SEQ ID NO: 26023 - protein, 81 aa, Gorilla gorilla
EYSYFEKGPLTFRDVVIEFSQEEWQFLDTAQQDLYRKVMLENFRNLVFLGIDVSKPDLITCLEQGKDPWNMKRHGMVATPP

SEQ ID NO: 26024 - protein, 81 aa, Ailuropoda melanoleuca
QGPVSFKDVAVDFTQEEWQYLDLPQRDLYRDVMLENYINLISVGYQTTKPSVICKLEQGEEPWMVEREIPSWSYAEEVWQL

SEQ ID NO: 26025 - protein, 81 aa, Ailuropoda melanoleuca
SDESVTFEDVAVYFSENEWTGLAPAQRVLYRDVMLENYGAVASLAFPFPKPALISQLERGEAPWCKAPQGALDDIPRLLTV

SEQ ID NO: 26026 - protein, 81 aa, Phyllostomus discolor
EDTQTMKKSTQSHQAKGVPSKDTDWPREREGKPKISLPVTFRDISVVFTKAEWRWLSPKQRSLYKEVMLENCRNLLALATP

SEQ ID NO: 26027 - protein, 81 aa, Myotis lucifugus
LRQDMNFEDVAIAFSQEEWGLLDEAQRLLCYDVMLEVFAVVSSVGCWHKTDDVEACSEQNASIEGESQVSASKTAPTTQKS

SEQ ID NO: 26028 - protein, 81 aa, Puma concolor
QDVNFEDVAIDFSQEEWGLLDETQRLLYCDVMLETFALVASLGCRHGTEDEGAPSEQTVSVGESQFRASQAGPSTHPPAEM

SEQ ID NO: 26029 - protein, 81 aa, Puma concolor
PLTFKDVAVVFTEEELRLLDPTQRKLYRDVMLENFQNLLSLGDKNEKDLEYIQERELKCLSYRELSYWKIGEQAAGELTGS

SEQ ID NO: 26030 - protein, 81 aa, Puma concolor
AQDSVSFEDVAVYFSWEEWRLLDEAQRCLYHDVMLENFALISSLGCCCGAEDAEAPLEQSVSVGVSQASTPKAALSSRKTH

SEQ ID NO: 26031 - protein, 81 aa, Puma concolor
GRLTFRDVAIEFSQEEWECLDPAQRALYRDVMLENYRNLVSLGIPSDGFAIKELSPTEDINKGEFYHLVILERNESYGIKD

SEQ ID NO: 26032 - protein, 81 aa, Puma concolor
LQGSVTFQDVAVDFTPEEWQLLDCDQRTLYWDVTLENFRNLTAVEVICLLDDALERQEGSKDNFLNQDMFTFKKTLTMKRV

SEQ ID NO: 26033 - protein, 81 aa, Sapajus apella
MLENYQNLLALGAGPPLHKPDVISHLERGEEPWCVQRDIPGGPCPEWEMKEVPSQQQGMCKEELAQEPTLEWPLGGAQAWG

SEQ ID NO: 26034 - protein, 81 aa, Sapajus apella
MLENFALLASLGIAFSRSDAVMKLEQGEEPWLYDQVDMTSATGRESQRGPRPGCWHGVEDEVVSSEQSISAAGVSQVRTLM

SEQ ID NO: 26035 - protein, 81 aa, Sapajus apella
GPLTFMDVAIEFCLEEWQCLDTAQQNLYRNVMLENYRNLVFLVTCSHFAQDFWPEQHLKDPFQKVTLRYKNCEHKNLHLKK

SEQ ID NO: 26036 - protein, 81 aa, Sapajus apella
MSDYTPGPGSILVVGLSARTRGCPPTEPHAGFLVFKPELISRLEQGQEPWVLDLQGAEGTEAPKTSKTDSTIRTDNEQACE

SEQ ID NO: 26037 - protein, 81 aa, Sapajus apella
ASETLTFRDVAIEFSLEEWQCLNPAQQNLYRNVMLENYRNLVFLGIAVSKQNPVTCLEHGKEPWNMKRYEIMAKPTAMCSY

SEQ ID NO: 26038 - protein, 81 aa, Sapajus apella
ALALVSFEDVVVTFTGEEWGHLDLAQRTLYQEVMLETCRLLISLGHPVPKPELIYLLEHGQELWTVKRGLSQSTCAGEKAK

SEQ ID NO: 26039 - protein, 81 aa, Sapajus apella
SQGSVTFRDVAIDFSQEEWKWLQPAQRDLYRCVMLENYGHLVSLAGLSISKPDVVSLLEQGKEPWLGKRDVKRDLFSAHFF

SEQ ID NO: 26040 - protein, 81 aa, Sapajus apella
SYEGSVSFRDVAIDFSREEWRHLDPSQRNLYRDVMLETYSHLLSVGYQVPEAEVVMLEQGNEPWALQGERPRQSCPGEKLW

SEQ ID NO: 26041 - protein, 81 aa, Sapajus apella
MDVAIEFSQEEWKCLDLAQRTLYKDVMLENYRNLVSLGVGLPDLSVVSMLEQKREPWTLQSEEKIARNPDGRECIKGVNTE

SEQ ID NO: 26042 - protein, 81 aa, Sapajus apella
MLENYSNLVAVGYQASKPDALLKLERGEEPCCTTEDEIYTQICSEIRKIDDPLQHHLQNQSIQKSVKQFHEQNMFGNIVNQ

SEQ ID NO: 26043 - protein, 81 aa, Sapajus apella
MLENYRNLGFLAGLCLPDLNIISMLEQGKEPWTVVSQVKITRNPNWGECMKDVITGISPKCVIKELPPIQNSNTREKFQMV

SEQ ID NO: 26044 - protein, 81 aa, Sapajus apella
AQGSVTFEDVAVTFTQEEWGQLDATQRTLYQEVMMETCGLLVSLGCPLSKPELIYQLDHRQELWRSKKDLSQSSYPGDSTK

SEQ ID NO: 26045 - protein, 81 aa, Oryctolagus cuniculus
DQMAVTFEDVTVTFTWEEWNFLDSSQKKLYREVMWENYTNVMSVGKVIPAGNWNQSYKPQEERFRYLECENSSCWQGWKNA

SEQ ID NO: 26046 - protein, 81 aa, Oryctolagus cuniculus
GWVPALFDEVAIYFSDEEWDVLTEPQKALYREVMRMNYETVLSLEFPFPKPDMIARLEREEESQTSDEWPLQGGTFAENED

SEQ ID NO: 26047 - protein, 81 aa, Rhinolophus ferrumequinum
MEDAPSCSIPGWALGRISRPNIISQLEQKKEPWILQLQNFEARTILRESHTDFNNQVEKLNRDISEPAEHSRTSSETANRD

SEQ ID NO: 26048 - protein, 81 aa, Ursus maritimus
TKAMAQESVMFSDVSIDFSQEEWECLNDDQRDLYRDVMLENYSHLVSMDVISFLEQGKEPWLVDRELTRDHWPVLESRCET

SEQ ID NO: 26049 - protein, 81 aa, Ursus maritimus
FQESVIFRDVSVDCTWEEWIHLDSAQRNLYGTVMLENYRDVVSLGHQLSKPNVISQLELKELSWMKKELSACLSPDFLQCY

SEQ ID NO: 26050 - protein, 81 aa, Ursus maritimus
CLGLLTFGDVAIEFSQEEWRCLSHTQRALYRDVMLENYGHLLFLGFILSKPDLIMFLEQEEQFWDVNRKKTVAFHPGTSSH

SEQ ID NO: 26051 - protein, 80 aa, Rhinopithecus bieti
MCGPLQFRDVAIEFSLEEWHCLDTAQRNLYRNVMLENYRNLAFLGIVVSKPDLITCLEQGEKPLTMKKHDMVTNPSGRCE

SEQ ID NO: 26052 - protein, 81 aa, Macaca fascicularis
QDLVTFDDVVWYLTTGEWFKLDPEQRVLAYYRNVTYVGVPVLNPALVPHLAQGQVLLVSDPSPNTDPAKYSENTSATRHQT

SEQ ID NO: 26053 - protein, 81 aa, Macaca fascicularis
QDTVAYEDLSVGYTQKKWKCPALSQRALQWNMMPENDRSMASLGENMMKGSELTPKQEIFKGSESSNKTSGGLFGMVPGGA

SEQ ID NO: 26054 - protein, 81 aa, Phascolarctos cinereus
AQELVTFQDVAVDFTQEEWGLLDHPQKELYKEVMLENAQNLVSLGLPVPREDLMSYFEEKEAPWLLEHEGLRSCYPEGEIR

SEQ ID NO: 26055 - protein, 81 aa, Phascolarctos cinereus
MWLWTSPQREWRQLAPSQKELYREVMLENYRNLVCLGLALSTQGVIEHLERGDMPWMLERDVPGTHGPVSEIRPQTRVSAP

SEQ ID NO: 26056 - protein, 81 aa, Phascolarctos cinereus
PQESVTFKDVAVDFTQEEWRLLDHPQKLLYKEVMLENAQNLLSLGLPVPREDVVSYFEQREAPWMLEQEGLKSCCPEREIR

SEQ ID NO: 26057 - protein, 81 aa, Phascolarctos cinereus
CQPSITFEDIVVDFTWEEWEYLDMAQRNLYKDVTLENYKNLISLGFPICKPVLISQLERGDGSWMLRKDIPRITSPGPLCQ

SEQ ID NO: 26058 - protein, 81 aa, Phascolarctos cinereus
PQEQVTFSDVAVDFTVEEWGRLAPAQKELYRSVMLENYRNLVCLGLAASSPDVIGQLERGEGPWRVEGKVRKGLCADQKTS

SEQ ID NO: 26059 - protein, 81 aa, Myotis lucifugus
MAAPSSPLDPKEEWDYLDPAQRSLYKDVMMENYGNLVSLDVLNRDKDEEPTVKQEIEEIEEEMESKGIIVTRIKSETDQDP

SEQ ID NO: 26060 - protein, 81 aa, Puma concolor
EGTVTFEDVAVYFSREEWGLLEEAQRRLYQDVMLENLALVTSLGCQHGAENEEAPSEQSVSVEGVPHVRTPKAGLSPQKAS

SEQ ID NO: 26061 - protein, 81 aa, Puma concolor
WSQMPVTFEDVALYLSREEWGRLDHAQQNFYRDVLQKRNGLSSGFPFSRPFWASQGQGKGEASGSCRQMGDEEKTGACRGA

SEQ ID NO: 26062 - protein, 81 aa, Puma concolor
NPQELLTFKDVAIEFSQEEWGFLNHSQRELYRDVMLENYGHLLLLGLVSKPDLVNFLEQKKEAWDVNGKGTVATHPAVSSH

SEQ ID NO: 26063 - protein, 81 aa, Puma concolor
AHRSVTFRDVAIHFSQQEWEYLDSVQKNLYRDVMMENYDNLVSLAEHSISKPDVITLLEQRKEPWMVVREDTKRWCTDLES

SEQ ID NO: 26064 - protein, 81 aa, Sapajus apella
GSREMGLLAFRDVAIEFSLEEWQCLDHAQQNLYRDVMLENYRNLVSLGIAVSKPDLITYLEQNKEPWNIKRNEMVAKHPGK

SEQ ID NO: 26065 - protein, 81 aa, Oryctolagus cuniculus
YCVMIAFEDLAVYFSWEEWQNMNNAQKTLYRDVMLETYSSLFSLGHCITKPDLIFKLERGEEPWMVDECLNQSLSVVIKRD

SEQ ID NO: 26066 - protein, 81 aa, Ursus maritimus
ASCGLLTFRDVAIEFSQEEWRCLSHTQRELYRDVMLENYGHLLFLGLIVSKPDLVSFLELRKDPWDVKRRKTAGFDPGRWQ

SEQ ID NO: 26067 - protein, 81 aa, Ursus maritimus
LQESLTFGDVFVDFTLEEWQQLDSAQKYLYRDVMLENYSHLVSVGYLVPKPDEVLRLGREEEARRAEGEPPTRSYPGGKLP

SEQ ID NO: 26068 - protein, 81 aa, Ursus maritimus
AGSQGLLTFKDVAIEFSQEEWRCLSHTQRELYRDVMLENYGHLLFLGFILSKPNLIMFLEQEKQFWDVKRETVAFHPGRWD

SEQ ID NO: 26069 - protein, 81 aa, Ursus maritimus
MIKSQISFEDVAVDFTSEEWQLLNPTQKSLYRDVMLENYSNLVFLGYQIIKPDAIFKLEQEEPWIIDEQVLSQSFSEVWLD

SEQ ID NO: 26070 - protein, 81 aa, Ailuropoda melanoleuca
GQGSVSFRDVTVDFTRDEWLRLTGTQRTLYRNVMLENYSHLVSVGCHLSKPEVIFRLEQGEELWPSEGRFPDQRDQGELVI

SEQ ID NO: 26071 - protein, 81 aa, Gorilla gorilla
IQGQVNFEDVFVYFSQEEWVLLDEAQRLLYRDVMLENFALMASLGCWHGMEDEEIPFEQSFSIGMSQIRIPKGDPSTQKAY

SEQ ID NO: 26072 - protein, 81 aa, Ailuropoda melanoleuca
LLTFEDVAMYFSQEEWELLDPTQEALYNDVMRENYETVISLALFVLPKPKVISYLERGEEPWVQGPLEFKNSPGDLPAVEK

SEQ ID NO: 26073 - protein, 81 aa, Ailuropoda melanoleuca
VSFHDVAVDFTREEWRLLSHAQRLLYRCVMLENYSNLVSLGIPVPKPTLVISLEQGEEPWREESKHLPSPCAADAKPEIQR

SEQ ID NO: 26074 - protein, 81 aa, Ailuropoda melanoleuca
HLVTFEDVAVNFTQEEWTLLDQTQRDLYRDVMLENYQNLIILAGYESCGPDLNSPVGGAEELRTGGRGILQELDLQLKTKG

SEQ ID NO: 26075 - protein, 81 aa, Macaca fascicularis
VQESVTFRDVALFFSQDEWLHLGSAQRALSREVMLENYSSLVSLGILFSKPKVISQLEQGEDPWMVESGVPQGAHLGWESL

SEQ ID NO: 26076 - protein, 81 aa, Phascolarctos cinereus
ILESWAGHFHSILKRPRTSTVVATGHLPQELVTYKDVAVDFTQEQWSFLDHPQELYKEVMLENAQNLLSLASCQRRFDLLF

SEQ ID NO: 26077 - protein, 81 aa, Phascolarctos cinereus
MLENAQNLLSLGLPVTREDLISSFQKGEAPWILEPKGPRNFYLDIETKFKVNEMPRKLGIFVEERDLQRFMSDHPWDFKLR

SEQ ID NO: 26078 - protein, 81 aa, Phascolarctos cinereus
PQELVTFKDVVVDFTEEEWGLLDHSQKELYKEVMEENAQNLLTLGLPVPREDLISPFHQGEAPGTLGQKGPRNSWPGAETR

SEQ ID NO: 26079 - protein, 81 aa, Phascolarctos cinereus
PQESVAFKDVAVEFTQEEWRCLDTSQKELYHDVMMENYKNLVCLGLVLNKPAVISQLEGKEAPWMTERQVQRNSCPGWEIR

SEQ ID NO: 26080 - protein, 81 aa, Phascolarctos cinereus
PQELVTFKDVAVDFTCEEWGQLGPAQKELYKDVTLENYRNLVCLGLAVSKPDVISQLERGGARWIPEGKGPRCRCAGWETR

SEQ ID NO: 26081 - protein, 81 aa, Myotis lucifugus
VTFEDIALYFSREEWSLLDEGQRQLYLNVMLENFELISSLGCCCGAENVEALTEQKVSVRLSQARNPKLALSSQKSHPCES

SEQ ID NO: 26082 - protein, 81 aa, Puma concolor
VVFTDVAVCFSQEEWGLLDEAQRRLYHSVMLETFALLSSLGHSVSVGASQVRTPKPGPSFQEAQPCETCSSLLKDLLHLAE

SEQ ID NO: 26083 - protein, 81 aa, Puma concolor
PMLFEDLAVFFSQEERVCLHSVQRSLSRDTTQECFEEMALMGGKGKTEITQQLNLDSMGVEELAPENSSIAVPLVYYPEKS

SEQ ID NO: 26084 - protein, 81 aa, Sapajus apella
ARGCVVFEDVFVYFSREEWELLDDAQRLLYHDVMLENFALLASLGIAFSRSDAVMKLEQGEEPWLYDQVDMTSATGRESQR

SEQ ID NO: 26085 - protein, 81 aa, Oryctolagus cuniculus
SPVLVSFEDVAVDFSWEEWQNLDNAQRTLYRDVMLEIYSNLLSLGYCITKPEVIFKLEQGAEPWIVEGPLSPSLPAVQKMD

SEQ ID NO: 26086 - protein, 81 aa, Ursus maritimus
SQGLLTFGDVAIEFSQEEWRCLSHTQRELYRDVMLENYGHLLFLGLIVSKPDLVSVLEQSKEPWDVRRKKTVVFDPAVSSH

SEQ ID NO: 26087 - protein, 81 aa, Ursus maritimus
KPQGLVTFEDVAVDFTPEEWQYLNPPQKTLYREVMLETYSNVVSVGPQATKPDLVLKLEVEEPCPAETKISFWSFPEAACQ

SEQ ID NO: 26088 - protein, 81 aa, Ursus maritimus
MFRAVAVDFSQEEWEFLDLKQRNLYRDVMLENYSHLVSLDVKSQCATKELSSNDDNYEIKLSHRKIMERLTSHEFGCSIFQ

SEQ ID NO: 26089 - protein, 81 aa, Canis lupus
PQASVSFKDVTVEFTHEEWRQMDSAQRTLYRDVMLENYSHLVSVEDSQPNHLSKKSLESQGKYLWHVLFTNKSLPTEEEIS

SEQ ID NO: 26090 - protein, 81 aa, Canis lupus
SQGLVSFKDVAVDFTQEEWQQLDPAQKTLYKDVMLENFSHLVSMGYPVSKPDVISKLEQGEDPWIIKRDIPNWMYPDENQA

SEQ ID NO: 26091 - protein, 81 aa, Canis lupus
KETVTFKDVAVVFTEEELGLLDPAQRKLYGDVMLENFRNLISVGGKIQNKMKTVLEAEPPEEHSCWRIWQQIASDLSRCQG

SEQ ID NO: 26092 - protein, 81 aa, Canis lupus
FQESVTFEDVAIYFSENEWTGLAPAQRVLYRDVMLENYGAVAALGYPFLKPAGISHFKQVEEPLNLKLQGEGPSLTCTEGV

SEQ ID NO: 26093 - protein, 81 aa, Canis lupus
ELLSFDDVAMYFTREEWNRLDWAQKDLYRDVMLENYRNMILLGSEARCKMKKPTPKQKISEDVESCKTSVKQKMAKRLGEK

SEQ ID NO: 26094 - protein, 81 aa, Muntiacus muntjak
RPRAVKFGDVALYFSREEWGCLRPAQRALYRDVMQETYGHLGALGCAGPKPALISWLERNTDDWEPAALDPQQCPKGVAVQ

SEQ ID NO: 26095 - protein, 81 aa, Gorilla gorilla
SLKKVTFEGVAIDFTQEKWAMMDTSKRKLYRDVMLENISHLVSLGYQISKSYNPGKQQGPVESALKKKHMISMHPIIRKDV

SEQ ID NO: 26096 - protein, 81 aa, Ailuropoda melanoleuca
QELLTLEDVAVDFTWEEWQLLGPAQKDLYRDVMLENYSNLVSVGTGCQATKPDALSKFEHRDELWLTEDEIQNRTHPVNEK

SEQ ID NO: 26097 - protein, 81 aa, Gorilla gorilla
SVAFKDVAVTFTQEEWALLDPSQKNLYRDVMQETFRNLASIGKKWKHQNIYVEYENLRRNLRIVGERLFESKEGHQHGEIL

SEQ ID NO: 26098 - protein, 81 aa, Phyllostomus discolor
AHDSVTFGDVAIDFSQEEWEFLDAAQRDLYRNVMWENFSNFISLDLESRYKTSTLSPGKDIYETYLFQWEIMETTKSYCLQ

SEQ ID NO: 26099 - protein, 81 aa, Phyllostomus discolor
MDFTLEDWEQLGLDQEDLFWDKALENYQNLFLLNPLRPSLTNPDGGEELKTLVRGSPEVTGPDTAEAKISMLQEFSEEGLS

SEQ ID NO: 26100 - protein, 81 aa, Phyllostomus discolor
VVFADVAVNFTQEEWALLDGAQRKLYREVMLETFRNLASVVVTDCFTQVKTHPSRPGQDTLENKISSEEKILRFTRNDSWP

SEQ ID NO: 26101 - protein, 81 aa, Puma concolor
MLENYGVVASLGKAFPFPKPALISQLERGEAPWCKAPQGALDGECPRGVSTGYPFLKPAAISHLEQVEEPLNLKLQGEGPS

SEQ ID NO: 26102 - protein, 81 aa, Sapajus apella
MLENYRNLVCLGLAVSKPDLITFLEQRKEPWNVKSAETVAIQPDIFSHDTQALLRKKCIEASFQKVILDGYGSCGLQNLHL

SEQ ID NO: 26103 - protein, 81 aa, Sapajus apella
FQGVLTFMDVAVEFSLEEWQCLDTAQQNLYRNVMLENYRNLVFLADIAASKPDLITCLEQGKEPWNVKRHEMVAKAPGWSH

SEQ ID NO: 26104 - protein, 81 aa, Sapajus apella
AQESVMFSDVSIDFSQEEWECLNDDQRDLYRDVMLENYSNLVSMGHSISKPNVISYLEQGKEPWLVDREITSGQWPVLESR

SEQ ID NO: 26105 - protein, 81 aa, Oryctolagus cuniculus
FSTVMIAFEDLAVYFSWEEWQNMNNAQKILYRDVMLETYSSLFSLVGMKRDDLIRINQESQDTNLNQDFMKNNKTSALKRV

SEQ ID NO: 26106 - protein, 81 aa, Oryctolagus cuniculus
AFVSFEDVAVSFTWEEWQELDNAQRALYKDVMLETYNSLMLETYNSLGCCISKPEVIFKLEQGAEPWVMEEPLTQSLPVVQ

SEQ ID NO: 26107 - protein, 81 aa, Oryctolagus cuniculus
SQETLTFQDVAVDFTREEWDQLHPTQKHLYRDVMLENYQNLVALGHQLYKPEVLVQLEHEEPQTTEASPLNTLPDEKNRPE

SEQ ID NO: 26108 - protein, 81 aa, Pteropus alecto
LTLSDVFIEFSQEEWECLAPAQRALYKEVMLESYQNLLFLGISLSDLHIVSFLERGNVPWTLESKLKRAQKPNQWEHIERV

SEQ ID NO: 26109 - protein, 81 aa, Pteropus alecto
MLENYSSLVSLGIPLSTPKVICQLQRGKDPCLVEGEACQGACQDFKTWPEIEALPPRQDIFIEEASQGIITKKSTKFGHWG

SEQ ID NO: 26110 - protein, 81 aa, Pteropus alecto
RVEAVTFKDVAVVFTEEELGLLDSAQRKLYRDVTLENFRNLVSVGHQSSKPDVISQLEREEKLRTTEASQAEAGVLRSIQL

SEQ ID NO: 26111 - protein, 81 aa, Oryctolagus cuniculus
LLDLVTFDDVAVDFTHEEWTLLDSTQRNLYRDVMVENYKNLAIVGYQLFKPSLISWLEEEVEQCVHQEWVMDLNTKGTALQ

SEQ ID NO: 26112 - protein, 81 aa, Oryctolagus cuniculus
KPAAVSFADVAVYFSPEEWGCLRPAQRALYREVMRETYGLLGALGGGGTKPALICWVERDAELWGPDAQDPAAAAARGYGT

SEQ ID NO: 26113 - protein, 81 aa, Oryctolagus cuniculus
QGLVTFRDVAVEFSQEEWKCLKPAQRDLYRDVTLENFGNLVSLDLASRCETFPQREIFEIDSFNWEIMESLRCCDLEITSF

SEQ ID NO: 26114 - protein, 81 aa, Pteropus alecto
KPSDRMTFQDVALDFTPEEWQLLDCDQRTLYWDVMLENFRNLISVGGPVTKTKVIFKQGQEPQMVERENPYWSHPEAECPH

SEQ ID NO: 26115 - protein, 81 aa, Ursus maritimus
QETVTFKDVAVVFTEEELALLDKAQINLYQDVMLENFRNLVSVGEDNSPLFKPHTVFQGEHKEKLWPLNPCGRESVWMCSV

SEQ ID NO: 26116 - protein, 81 aa, Ursus maritimus
SVTFEDVAVLFTRDEWRKLGPSQRNVYQEVMLENYTNLVSLGKGTVPVDEKVRRYLSRFSLPDRRTLYDASLNGKKESPGG

SEQ ID NO: 26117 - protein, 81 aa, Ursus maritimus
SVAFQDLAVRFSEEEWQLLAEGQRALYRDVMRENYETLRSLGTDELLPLSAFLSPTEAGGAMEGRSSAGEGQEPSRGGGPP

SEQ ID NO: 26118 - protein, 81 aa, Ursus maritimus
MGLLTFGDVAIEFSQEEWRCLSHTQRELYRDVMLENYRHLLFLGLIVSKPDLVSLLEQRKEPWDVKRKKTVFLGGWLIYFV

SEQ ID NO: 26119 - protein, 81 aa, Ursus maritimus
PKLKLVTFKDVAVDFTQEEWEHLDPSQRHLYREVMLENYGNLILGHLLCKPEMIFHFEQEDDVWVEEEMPGNSYSGMRMMR

SEQ ID NO: 26120 - protein, 81 aa, Rhinopithecus bieti
EKGPLTFRDVVIEFSQEEWQCLDTAQQDLYRKVMLENFRNLVFLGIDVCKPDLITCLEQGKDPWNMKRHSTVATPPESGLL

SEQ ID NO: 26121 - protein, 81 aa, Myotis lucifugus
AWVPALFDEVAIYFSDEEWEVLTESQKALYREVMRMNYETVLSLEFPFPKPDMISRLDGEEEPQNADRWPLPGGSVAENEE

SEQ ID NO: 26122 - protein, 81 aa, Myotis lucifugus
FQESVTFKDVVVDFTREEWKQLDPVQRDLFRDVTLENYTHLVSIGLQVSKPDVISQLEQGTEPWIVDSGIPVGGSGDWVTG

SEQ ID NO: 26123 - protein, 81 aa, Puma concolor
WQTLSLKPVTFEDVAVNFTQEEWMYLDASQRALYQDVMSETVRNLMSVDLVTKLEEEEQWRIELQLQPPNGEGLPSGSRKQ

SEQ ID NO: 26124 - protein, 81 aa, Puma concolor
QAQESLTFEDVAVGFSREEWRLLAPAQKDLYRDVMLENYRNLVSVGYLTSKPDALSKLEGGELWTTEDEIDSRICPEIRKV

SEQ ID NO: 26125 - protein, 81 aa, Sapajus apella
IQGLLTFGDVAVAFTRIEWRHLDAAQRALYRDVMLENYGNLVSVGLLSSKPKLIAQLEQGAEPWMEMREAPSGTCAVPDYW

SEQ ID NO: 26126 - protein, 81 aa, Sapajus apella
MELLTFRDVTIEFSLEEWEFLKPAQQNLYRNVMLENYRNLVSLAMSCHYTEDFLPEQGMKDSFQKVILRRSGSCGLENLHL

SEQ ID NO: 26127 - protein, 81 aa, Sapajus apella
IRDQDLGTSLLPAAPQEQWRHLDSTQKEQYWDLMLETYGKMVSGAGISHSKPDLTNSIEYGEELAGLYLHVNEKIPRPSCI

SEQ ID NO: 26128 - protein, 81 aa, Sapajus apella
GTVTFEDVAVHFSWEEWGLLDEAQRCLYRDVMLENLALLTSLDVHYQKQHLGEKHFRSNVDRALFVKTCIFHVSGETSTCK

SEQ ID NO: 26129 - protein, 81 aa, Sapajus apella
FQGVLTFMDVAVEFSLEEWQCLDTAQQNLYRNVMLENYRNLVFLDIAASKPDLITCLEQGKEPWNVKRHEMVAKAPGWSHD

SEQ ID NO: 26130 - protein, 81 aa, Oryctolagus cuniculus
MLDNFTLVASLGFASSQIRVVVRLEAGEGTWAPGRAGVGPAAALGTWRGPGPGCWFRMENAEAPLQAVPRIRTPGSGSATH

SEQ ID NO: 26131 - protein, 81 aa, Pteropus alecto
ITFEDVSMDFTQEEWALLNSSQRKLYRDVMLENYRNLASLGKLIGNFLLYEYERGSKKAKLREIDTTQRAAVAFGLCTGNS

SEQ ID NO: 26132 - protein, 81 aa, Oryctolagus cuniculus
MITFEDLAVYFTWEEWQNMNQAQKILYRDVMLETYSSLFSLVAMKRDDLISKNQKSQDKNLNQNVMKNNKTSTPKIIELRK

SEQ ID NO: 26133 - protein, 81 aa, Oryctolagus cuniculus
PCEPVTYEDVTLGFTPEEWGLLDVKQKSLYREVMLENYRNLVSVEHQLSKPNVVSQLEEAEDFWPVGRGILQDPFPECSET

SEQ ID NO: 26134 - protein, 81 aa, Oryctolagus cuniculus
AQESVAFGDVAVFFSQDEWLHLDSAQRHLYREVMLENYSNLLSLGTPFSTPKVIYQLQQGEDPSVVEREVPPDTSPDFKTC

SEQ ID NO: 26135 - protein, 81 aa, Oryctolagus cuniculus
SLGPVSFKDVAVGFTQEEWRQLEPAQRRTYREVMLENYSHLVAVGCHFIKPDVITKLERGEEPWIEGGFLPQGCAGDEVWQ

SEQ ID NO: 26136 - protein, 81 aa, Oryctolagus cuniculus
MLENYGHLVSLAGLSISKPDLVSLLEQGKEPWLGKGDIRRNLFSASPSQDSPVIQESAIKDKKGMEAEWLSAQSQTLVTFK

SEQ ID NO: 26137 - protein, 81 aa, Oryctolagus cuniculus
DQRCVTLKDVFVYLSHEEWKLLDEDQKCLYYDVMLNIFLYVLSLRLPISRSCLLTQPEPESQPRQPDSADVAPVNAKTTKR

SEQ ID NO: 26138 - protein, 81 aa, Pteropus alecto
LQEPVTFRDVAVDFTQEEWGQLGPAQRTLYRDVMLETFGHLLSVGPELPKPEVISQLEQGAELWVAERGIARGSCAGWETG

SEQ ID NO: 26139 - protein, 81 aa, Pteropus alecto
PQVSLAFRDVAVEFSQEEWACLDPAQRALYRDVMAENYRTLLSLGHSIPKPDVITLLEQEKEPWMFVTEGTRVWHADSESK

SEQ ID NO: 26140 - protein, 81 aa, Rhinolophus ferrumequinum
FQELVTFEDVAVYFIRKEWKRLEPAQRDLYRDVMLENYRNVFSLDGESRTEHDQEISEETGSHGVLLGRFQKDISQGLKFE

SEQ ID NO: 26141 - protein, 81 aa, Rhinolophus ferrumequinum
VTESVTFGDVAVLFSQDEWLCLDPAQRALYREVMLENYSSLVSLGIPFAMPKVICQLQEGKDPCMVERERPQDTCLDFKTW

SEQ ID NO: 26142 - protein, 80 aa, Ursus maritimus
LQGLLTFGDVAIEFSQEEWQCLSHTQRELYRDVMLENYGHLLFLGLVVSKPDLVIFLEQKRELWDVRRKETVFIHPGRWE

SEQ ID NO: 26143 - protein, 81 aa, Ursus maritimus
MTFKDVAVDFTQEEWVQLDSPQRALYRDVMLENYQNLLALGKTAPRSSRTHLTRHQRIHTGEKPYQCGACGKAFNQRTHLT

SEQ ID NO: 26144 - protein, 81 aa, Ursus maritimus
MGLLTFGDVAIEFSQEEWRCLSHTQRELYRDVMLENYGHLLFLGLIVSKPDLVSFLEQTKEPWDVKRRKTGLHNQRAFPLH

SEQ ID NO: 26145 - protein, 81 aa, Ursus maritimus
AYGSLSFGDVAISFSQEEWECLDPAQRALYRDVMLETYSNLVSVGSSISKPDVIALLEQEKEPWVVLRRETSRWYSDLESS

SEQ ID NO: 26146 - protein, 81 aa, Rhinopithecus bieti
LQFRDVAIEFSLEEWHCLDTAQRNLYRSVMLENYRNLVFLECEECGKAFKRSSILTIHKRIHTGEKPYECEECGKTFKYLS

SEQ ID NO: 26147 - protein, 81 aa, Desmodus rotundus
AQVSVTFEDVAVTFTREEWGQLDLDQRTLYQEVMVETCRLLVSLGCPLSKLELIHLLERSLELQMLKRGLSPSSFPGDSTK

SEQ ID NO: 26148 - protein, 81 aa, Desmodus rotundus
WLQTPVTFKDVAVEFTQEEWMMLDSAQRSIYRDVMLENYINLTSLAYQLCKPSVISQLGQEEIRTMKRRIPKGTYLDWEIQ

SEQ ID NO: 26149 - protein, 81 aa, Desmodus rotundus
QRSTPFGNVTVAFTHKEWERSVLAPRRGFKEETPDKSRNLVLLGLLVSQPGMNSQLEQRESPWILEREGLRTTYPDWRTVF

SEQ ID NO: 26150 - protein, 81 aa, Desmodus rotundus
VMFRDVVIDFSQEEWECLDFAQRHLHRDVMLENYSNLVSLDLPSRCANKYLPLRKDTYETELSQWEMSNKLQNDDLKESSS

SEQ ID NO: 26151 - protein, 81 aa, Desmodus rotundus
FQDLVTFGDVAIDFSQEEWEWLNLAQRNLYRKVMLENYRNLVSLGVSVSKPEVISLLEQGKEPWMVKEVGTGGMYSDWEYA

SEQ ID NO: 26152 - protein, 81 aa, Desmodus rotundus
AHDSVTFGDVAIDFSQDEWEFLDAAQRDLYRNVMWENYSNFISLDLESRYRINTLSPEKDIYETYLFQWEIMETTKSYCIQ

SEQ ID NO: 26153 - protein, 81 aa, Macaca fascicularis
LQASVSFQDVTVEFTQEEWQHLGPAGRTLYRDVMLENYSHLISVGYCFTKPKVISRLEQGEEPWSLEDEFLNQKHQGYFKV

SEQ ID NO: 26154 - protein, 81 aa, Phascolarctos cinereus
RQGSLTFQDVAVDFTWEEWGQLGPTQKELYREVMLENYGNLVCVAGLAGSKPDVICRLEQGEAPWRPGEGFSGSGRPDWET

SEQ ID NO: 26155 - protein, 81 aa, Macaca fascicularis
QGTVTFEDVAIHFSWEEWGLLDEAQRCLYRDVMLENLALLTSLDVHHRKQHLGEKHFRSNVGTALFVKTCTFHVSGEPSTC

SEQ ID NO: 26156 - protein, 81 aa, Phascolarctos cinereus
SQEPVTFKDVAVDFSQDEWGHLDTAQRHLYRDVMLENYRNLVSLGLVRAQSEVVSHLERGDEPWRPERGELRGTHPVQLIQ

SEQ ID NO: 26157 - protein, 81 aa, Phascolarctos cinereus
FQELVTFKDVAVNFTQEEWRQLNSAQRDLYRDVMLENYRNMISLGLSISKPDVILQLERGEEPWMLNLKRTAEREIPQYMS

SEQ ID NO: 26158 - protein, 81 aa, Phascolarctos cinereus
VPVAVTFDDVTVYFTEQEWGTLEEWQKELYKHVMKTNYENLFSLGYAIPKPDLITQIEQGEEPFIRDGGHLNTRELTIGSK

SEQ ID NO: 26159 - protein, 81 aa, Phascolarctos cinereus
CQESVTFNDVAVDFTQEEWRHLDPSQKDLYRDVILENYRNLVCLAGLAASKPEVIDQLERGEAPWMPEGDVPGSACLDSET

SEQ ID NO: 26160 - protein, 81 aa, Phascolarctos cinereus
TQELVTFKDVAVDFTQEEWGLLDHPQKELYKEVMLENAQNLLSLGLPVPREYLISYLEEREAPWLLEQEGLRSCCPGEIRP

SEQ ID NO: 26161 - protein, 81 aa, Phascolarctos cinereus
AQGLLTFEDVAVIFSQEEWRHLDCVQRALYKDVMWENYRNLASVGFPFPKPELISSLERGEEPWLPDVLGSSERRRILFFC

SEQ ID NO: 26162 - protein, 81 aa, Myotis lucifugus
ESQDMNFEDVAIAFSQEEWGLLDEAQRHLYCDVLLEVFALVSFIGHWHKMDDVEAYSEHSVSVGESQVRASKTAVATQRTH

SEQ ID NO: 26163 - protein, 81 aa, Puma concolor
DQGLVTFEDVAVDFTHEEWQYLNPSQKSLYREVMLETYSNLVSVAGQQVTKPDLILKLEVEEQCLAETKISIWNFPEAYQV

SEQ ID NO: 26164 - protein, 81 aa, Puma concolor
FQDSVVFVDVAVNFTPEEWALLDSSQRNLYRDVMLETCKNLASVGKDGSIPSLVFGENQTFRSRGDYLQTQERRLRSPFVE

SEQ ID NO: 26165 - protein, 81 aa, Sapajus apella
MLENYSNLVAVGYQASKPDALFKLEQGQPPWTIKDGIHSGGCSEIWKFDDHVHLQHESLVNRRKQCHENDAFENILHWSKS

SEQ ID NO: 26166 - protein, 81 aa, Oryctolagus cuniculus
TPVPVTFEDVAVTFTQEEWRQLDPAQRSLYQEVMLENCGLLVSLGCPVPRPELICQLERVQEPWTLKNDLSQSSRSGPKGR

SEQ ID NO: 26167 - protein, 81 aa, Oryctolagus cuniculus
MAFKDVAVDFTQEEWSLLSPAQRTLYREVMLENYSNLVSLGIPFSKPKLITQLEQGKETWREDRRCPLAACPAGTKPELHL

SEQ ID NO: 26168 - protein, 81 aa, Oryctolagus cuniculus
SEESVTFKDVAVDFTQEEWSQLDSPQRALYRDVMLENYQNLLALGPPVCKPDVISHLERGEEPWRVQREVPGGACPEGAPR

SEQ ID NO: 26169 - protein, 81 aa, Oryctolagus cuniculus
SQVLVSFKDVAVDFTQEEWQQLDPAQRTLYRDVILENYSHLVSMGYPICKPDVISKLEQGEDPWIIQRDISHWIYADEHQA

SEQ ID NO: 26170 - protein, 81 aa, Oryctolagus cuniculus
SQESVTFQDVAVDFTEKEWPLLDSSQRKLYIDVMLENYSNLTSLDWETPSKTKWSVLMENIFGKQTSSSVTMERTPPGEKS

SEQ ID NO: 26171 - protein, 81 aa, Pteropus alecto
LFESVSFKDVTIDFSWEEWQQLDFAQKSLYRDVMLENYFNLISVGCQVPKPEVIFNLEQVENPCMLHRKISRQSCLDGDIG

SEQ ID NO: 26172 - protein, 81 aa, Pteropus alecto
KIDLVTFEDVAVEFTQEEWALLDPSQRKLYRDVMLETCRNLASLGYHVNEPSLISHLEQEDKVMAEQRGILPGTCPVFSTK

SEQ ID NO: 26173 - protein, 81 aa, Ursus maritimus
SGLLTFGDVAIEFSQEEWRCLSHTQRELYRDVMLENYGHLLFLAVSSHGSLSFQPEPCKEASFQNVLVGRYQHSVLEKLHL

SEQ ID NO: 26174 - protein, 81 aa, Ursus maritimus
SQGWLTFRDVAIEFSPEEWECLDPAQRALYQDVMVENYRNLVSLGEDSFPPEVVSSCCIKKCFLKTPGRVVSMSQDAEMEG

SEQ ID NO: 26175 - protein, 81 aa, Ursus maritimus
MLENYGHLLFLGLTVWKPDLVIFLEQEKQLWDVKRKETVAFHPAISSNGTQSFLPTLCIEASFQNVAVRRYKHTALENLHF

SEQ ID NO: 26176 - protein, 81 aa, Rhinopithecus bieti
INQKLSFKDVTVEFTQEEWQHMGPVERTLYRDVMLENYSHLVSVGYCFTKPELIFTLEQGEDPWLLEKEKGFLSRNSPEDS

SEQ ID NO: 26177 - protein, 81 aa, Ailuropoda melanoleuca
PMLFEDLAVYFSQEEYVSLHPAQRSLSRDTIQECFEDMALMGKNSPGDNKAISNNQVVSLLSPLTGSPTARCSGKSVEPAG

SEQ ID NO: 26178 - protein, 81 aa, Gorilla gorilla
SQGLLTFRDVAIEFSQEEWKCLDPAQRTLYRDVMLENYRNLVSLDISSKCMMKEVSSTAQGNTEVIHTGTLQRHEHHHIGD

SEQ ID NO: 26179 - protein, 81 aa, Ailuropoda melanoleuca
PQVLVSFEDVAVFLSREEWGCLGPAQRGLYRDVMLETYRNLISLGFQDSKPDVISKLEKGEEPWAPYSPRIEEGWIWSHGS

SEQ ID NO: 26180 - protein, 81 aa, Ailuropoda melanoleuca
SVTFEDVAVYFSWEEWSLLDEAQRHLYHDVMLENFALVTAVGCWHGAEDGKSPSKQAVSVGVSQVRTHHAGPYPQKAYPCG

SEQ ID NO: 26181 - protein, 81 aa, Ailuropoda melanoleuca
SLTFGDVAVSFTQFEWKHLDATQQALYRDVMLENYGNLVFVGTGLLSSKPKLITQLEQGAEPWMEVQQITSDTCSVLISII

SEQ ID NO: 26182 - protein, 81 aa, Phascolarctos cinereus
SHESVTFKDVAVDFTWEEWGYLDTSQKELYWEVMLENYRNLVSLGLADSNVDMISQLESGEAHGIPVDSVLRSCWPDGDTR

SEQ ID NO: 26183 - protein, 81 aa, Myotis lucifugus
LQGLVSFKDVTVDFTQEEWQHLDPAMLENYCHLISVGCHMTKPDVILKLERGEEPWTSLTGQTCLKKNWKPEDFLVKFKEH

SEQ ID NO: 26184 - protein, 81 aa, Myotis lucifugus
VQEPLTVHDVAVDFTWEEWQLLGPEQKDLYTDVMLETYSHLVSVGYEASKPDILSKLDHGEAPWTVAGELLCGIRSDIWKL

SEQ ID NO: 26185 - protein, 81 aa, Puma concolor
KSNDPCVRAPENDQLPEEWQLLDCDQRTLYWDVMLENFRNLTAVGKDITKTKVIFKEEQGQESWMVEGENPCWRYPEADWL

SEQ ID NO: 26186 - protein, 81 aa, Puma concolor
MLENFSHVISLGYPVSKPDVISKLEQGEDPWIIKRDSNSRKNPDESLGCGKSSSYGASDSNLEKMHNGVMPCNNNQCGNIF

SEQ ID NO: 26187 - protein, 81 aa, Puma concolor
MAFTQKEWEQLDPVQRNLYKDVMLENYSNLASMGYQALKPDMISKLEKGEEPWLGKGKKPRQGGPSEIARPKQIGTNGKEV

SEQ ID NO: 26188 - protein, 81 aa, Sapajus apella
EPGAVSFGDVAVYFSREEWGCLQPAQRALYRDVMRETYSHLGALGVGGSKPALISWMEEEAELWVPAAQDPEVAKCPTEAD

SEQ ID NO: 26189 - protein, 81 aa, Sapajus apella
TQGQVTFRDVAIEFSQEEWTCLDPAQRSLYRDVMLENYRNLASLGISCFDLSIISMLEQRKEPFTLESQVQIAGNPDGWEW

SEQ ID NO: 26190 - protein, 81 aa, Sapajus apella
MAMYLTREEWRPLDPAQRDLYRDVMQENYGNVVSLDFEIRSESEVNPKQEISEDVQFGTTSERPVENAEENPESEEAFESR

SEQ ID NO: 26191 - protein, 81 aa, Oryctolagus cuniculus
KVPVTFVDIAVYFSEDEWKNLDEWQKELYNNLVKENYKTLMSLDSEGSVPKPDPPAQVEPREEPCVWEQRHPEERDVPMDP

SEQ ID NO: 26192 - protein, 81 aa, Pteropus alecto
VAIDDVAVNFTLEEWALLDPSQKKLHKDVMQEIFRNLDSIGKKWEDHNIEDQYKHQGRKLRSQMVEILCENKEESQRGENS

SEQ ID NO: 26193 - protein, 81 aa, Pteropus alecto
EVVTFKDVAVYFTQAEWDGLSSAQKALYRSVMLENCGNLTSLGYPVPKPALISLLEGGDLPWGLEAQSDPSAERTTDFCKD

SEQ ID NO: 26194 - protein, 81 aa, Pteropus alecto
LQELLKPEDVAVEFNREEWQLLAPDQKDLYRDVMLENYYNLMSLGYQTKKPNALPKLEHGEEPQLIEDELQNGTCPGIGKV

SEQ ID NO: 26195 - protein, 81 aa, Pteropus alecto
FQGRLTLGDVFIEFSLEEWKCLSPAQRALYREVMLESYRNLLFLGISVSDLYIVSILEQGKAPWTLESEWKIPQEPNWREH

SEQ ID NO: 26196 - protein, 81 aa, Rhinolophus ferrumequinum
MFQVTFSDVAIDFSHEEWGWLDSAQRDLYKDVMVQNYETLVSLAGLSIPKPYVITLLEDGKEPWMVEKKLTKAMFPDWESR

SEQ ID NO: 26197 - protein, 81 aa, Rhinolophus ferrumequinum
QDTVVFADVAVNFTREEWALLDGAQRKLYREVMLENFRNLASVDDETQFKANGSVSQRDIYGNKISKEDKIEFSGNDPCIS

SEQ ID NO: 26198 - protein, 81 aa, Rhinolophus ferrumequinum
MLENYANVASLAAFPFSKPDLIFQLERGEAPRDLDPWTPGEAEALRSVCTGGKTKTENEEQMLKLNMPKEPEWARLTAEML

SEQ ID NO: 26199 - protein, 81 aa, Rhinolophus ferrumequinum
AQGSVSFEDVTVEFTQEEWPYLGPAQRAVYRDVMLENYSHLVSVGYCITKPQVIFKLEQGEQPWSLGEEFLNQRYPEYYKV

SEQ ID NO: 26200 - protein, 81 aa, Ursus maritimus
AEGHVTFEDVAVYFSWEEWGLLDEAQRLLYRDVMLENFSLMASLGLASSRTHEITQLEWWREPFLPPCEVLTAAMPRGWRH

SEQ ID NO: 26201 - protein, 81 aa, Ursus maritimus
SQGLLTFGDVAIEFSQEEWGCLSHTQRELYRDVMLENYGHLLFLGFILSKPDLIMFLEQEKQLWDVKRKETRAFHPGILLQ

SEQ ID NO: 26202 - protein, 81 aa, Desmodus rotundus
AEVGVTFADIAVYFSRKEWCLLDEDQRRLYLDVMLENFELVSSLGCCCGTEDVEVPIEQNVSVGVSQGKNSKVASSSRKNH

SEQ ID NO: 26203 - protein, 81 aa, Macaca fascicularis
TDVAVEFSLEEWQCLDTAQQNLYRNVMLENYRNLVFLGITVSKPDLITCLEKEKEPWNMKRYEMVDEPPVICSHFAEDFWP

SEQ ID NO: 26204 - protein, 81 aa, Macaca fascicularis
EMGLLTFRDIAIEFSLEEWQCLDRAQRNLYRDVMLENYRNLVSLGIAVSKPDLITCLEQNKEPRNIKRNEMVSKHPVTCSH

SEQ ID NO: 26205 - protein, 81 aa, Macaca fascicularis
DSVTFEDVAVDFTQEEWTLLDQTQRNLYRDVMLENYKNLVAVDWESHINTKWSAPQQNFLQGKTSSVVEMSHTLSPRLECS

SEQ ID NO: 26206 - protein, 81 aa, Macaca fascicularis
VAFEDVAIYFSQEEWELLDETQRLLYHDVMLENFAVMASLGCWCGADEGAPSAESISVSELSQGRTPKADTSTDKSHPCEI

SEQ ID NO: 26207 - protein, 81 aa, Phascolarctos cinereus
RRQILTFQDVTVDFTREEWRLLGPAQKDLFRKVMLENYENFVFLVGMPVFKPSVISKPERRETSWMREEEAAFSFEDSLIQ

SEQ ID NO: 26208 - protein, 81 aa, Phascolarctos cinereus
PEESVTFKDVAVEFTQEEWVQLNPSQKKLYKDVMLENYRNLVSLGFPVSKPDVIYQLERREASWMPEADISGSSCPGSREF

SEQ ID NO: 26209 - protein, 81 aa, Phascolarctos cinereus
EEAVTFRDVAVDFTEEEWGCLSPAQRELYWEVMLENYRNLVSLVWDTRLENQKLVETQEVSSGTFMGRGNILQNDLVEESP

SEQ ID NO: 26210 - protein, 81 aa, Phascolarctos cinereus
VQESVTFRDLAVDFDMEEWGYLCPSQKELYREVMLENYRHLVSLGLLEAKPDLISRLEQEEPQVWEVQEGASGSVCACTGG

SEQ ID NO: 26211 - protein, 81 aa, Phascolarctos cinereus
SQESLTFKDVAVDFTQEEWRQLDPGQRYLYKDVMLENYRNLVSVGHQVCKPDLISQLEQGKEPWIAETEIPRGTFSDWEIT

SEQ ID NO: 26212 - protein, 81 aa, Phascolarctos cinereus
AQELVTFKDVAVDFTQEEWGLLDHHQKELYKEVMLENVQNLLSLGLPVPREDLISYFEEKEAPWLLEHQGLRSCCPEGEIR

SEQ ID NO: 26213 - protein, 81 aa, Phascolarctos cinereus
SQESLTFKDVAVDFTQEEWGKLDSGQRYLYRDVMLENYRNLVSLGHQGSKPYVISQLEQGQEPWIVEREISRGNCKDWGTR

SEQ ID NO: 26214 - protein, 81 aa, Phascolarctos cinereus
PLKPVTFRDVAVTFSPEEWGHLGPSQKELYRQVMLENYGNLVCLGLALSKPDVIEQLERGEAPWRPEADVPGGSHADWEAR

SEQ ID NO: 26215 - protein, 81 aa, Oryctolagus cuniculus
ITFEDLAVYFTWEEWQHMNKAQKILHRDVMLETYSSLLFLGECDFFCLISVAMKSDDIIRTNQEIREKNVKQNVITNNKTS

SEQ ID NO: 26216 - protein, 81 aa, Oryctolagus cuniculus
SQRSVTFRDVAIDFSQEEWKWLQPAQRDLYRCVMLENYGHLVSLGLSISKPDLVSLLEQGKEPWLGKGDIRRNLFSVSEPT

SEQ ID NO: 26217 - protein, 81 aa, Oryctolagus cuniculus
MSYLTAAQRKLHREVTLENYRNLVSFGYQFAKPYIISCLEEEESCTIEEGSNAVIEEESHAVEEGSSTVRYQGYEKKPETK

SEQ ID NO: 26218 - protein, 81 aa, Oryctolagus cuniculus
LQAKVTFDDVAVLLSQEEWDQLGPAQRGLYRNVMMETYGNVVSLGIPGSKPIVISQLERGEDPWVLDGQGAEKSQRPGSNY

SEQ ID NO: 26219 - protein, 81 aa, Oryctolagus cuniculus
WKGLLSFKDISMEFTWEEWQLLDSTQKYLYRDVILENYSNLVSVGYHGTKPDLIFKLEQGEEPWIIAKISSQSCPEGWEEW

SEQ ID NO: 26220 - protein, 81 aa, Rhinolophus ferrumequinum
PVTFEDMAMYLTREEWRPLDPTQRDLYRDVMQENYGNVVSLDFEIRSENEVNPKQEISEDVEFGTASERPDGNTEENHESE

SEQ ID NO: 26221 - protein, 81 aa, Rhinolophus ferrumequinum
NFWVLRLPPGSKGEVPKEWGKLDEWQKELYKHVMRGNYETLVSLDYAISKPDILTRMERGEEPCPEGVWCQEEGKEREAAC

SEQ ID NO: 26222 - protein, 81 aa, Rhinolophus ferrumequinum
HQEMVTFEDVAVYLTQAEWAILSSTQRALYRSVMLENYGNLTSLGYPVPRPALISLLERGDLPWGLEAQDDPPAERTTLIY

SEQ ID NO: 26223 - protein, 81 aa, Rhinolophus ferrumequinum
MLENFRNLLSVGNQPFKPDLISQLEREEKTEKRLLTTETETQRDGCSGTKNQHNTERTQEVGLNYPSPEELSSWQTCQQGT

SEQ ID NO: 26224 - protein, 81 aa, Rhinolophus ferrumequinum
HTAGRLTFRDVAIDFSQEEWECLYTAERKLYTDVMLENYRNLCSLGLAVSKPDLVIFLERMKLAWAVKRKKTVSIHPGRWE

SEQ ID NO: 26225 - protein, 81 aa, Canis lupus
AQGQVNFEDVAVYFSPEEWGLLDEAQRLLYRDVMLENLALMASLGYESSMSHGFASLELGSKPWGSDWADVTPARTRDTQG

SEQ ID NO: 26226 - protein, 81 aa, Canis lupus
KDQELLTLEDVAVDFTWEEWQLLAPAQKNLYRDVMLENYSNLVSVGYVAGKPDALFRLEQGEPWATEDEIRSQIHPEIKKD

SEQ ID NO: 26227 - protein, 81 aa, Muntiacus muntjak
SQGPVTFEDVAVYFSQEEWRLLDETQRRLYCYVMLETFALVASLGLASSRSHVIVPLELGGEPWVQDRVDMTPGTARGAQS

SEQ ID NO: 26228 - protein, 81 aa, Muntiacus muntjak
SLGRLTFWDVAIDFTQEEWECLDLGQRELYTDVMVENYRNLASLGLVVSKPDLVTFLEQMKDLRNIRRMQTAVIYPAISPH

SEQ ID NO: 26229 - protein, 81 aa, Gorilla gorilla
PQGRLTFRDVAIEFSLEEWKCLNPVQRALYRAVMLENYRNLEFVDSSLKSMMEFSSTGQGNREVFHIGTLERHENHHTGDF

SEQ ID NO: 26230 - protein, 81 aa, Gorilla gorilla
SPDSMTFEDIIVDFTQEEWALLDTSQRKLFQDVMLENISHLVSIGKQLCKSVVLSQLEQVEKLSTQRISLLQGREFGIKHQ

SEQ ID NO: 26231 - protein, 81 aa, Ailuropoda melanoleuca
QGAVSFKDVTVDFSREEWQQLDLAQKSLYRDVMLENYFNLISVENLDKIIGCGNIFTHMNSHTETNACEYNQYKKLLSHKQ

SEQ ID NO: 26232 - protein, 81 aa, Ailuropoda melanoleuca
NQITVTFNDVAVDFIQEEWILLDLTQRSLYRHVMLENYQNLVAIGYQLPKPKLITWLEQQELRTVEKRVFQGELETSLVNE

SEQ ID NO: 26233 - protein, 81 aa, Phyllostomus discolor
VTFADIALYFSREEWRLLDEAQRCLYLDVMLENFELISSLGCCCGAKDVEEVTQQNVSVRMVKSENPKVALSSQKSHPCES

SEQ ID NO: 26234 - protein, 81 aa, Phyllostomus discolor
MAASQESLTFKDVSVDFSGEEWECLDPGQRKLYSDVMLENYSNLVSLGLVVSKPVLVTFLEEMRECWNVCRKKVISDPPGR

SEQ ID NO: 26235 - protein, 81 aa, Oryctolagus cuniculus
PFDRHAFEDLAVYFSWEEWQKMNNAQKILYRDVMLETYSSLFSLGHCTTKPDLIFKLERGAEPWMVEECLNQSLPGQSAHS

SEQ ID NO: 26236 - protein, 81 aa, Rhinopithecus bieti
RVETTKPDVILRLEQGKEPWLVEEEVLRNGRPEKNGDVGGQIWKPQDVKESLAREVPPINKEMLTTQKAVERTGSKKILEL

SEQ ID NO: 26237 - protein, 81 aa, Rhinopithecus bieti
VGQESVTFKDVAVLFTQEEWRQLSPAQRALYRDVMLENYSNLVSLGLLGPKPDMFSQLEKREAWMPEDTPGGFCLDWTTQP

SEQ ID NO: 26238 - protein, 81 aa, Rhinopithecus bieti
TFKEAVTFKDVAVVFTEEELGLLDSAQRKLYRDVMLENFRNLLSAGHQPFHQDTFHFLREDKFWMMETVTQREGNSGGKIQ

SEQ ID NO: 26239 - protein, 81 aa, Panthera pardus
MPFSSVTVAFTQDGWRRLIPAPKDRFKEGIPENTRNLVLLGLPVSQPGMNSQLEQREEGPWMLEGGGLRSTCTDWKIMSES

SEQ ID NO: 26240 - protein, 81 aa, Ailuropoda melanoleuca
VLFKDVAVDFSQEEWECLDLEQKDLYRDVMLENYSNLVSLDLPSRSANKDLSPKKDTYETELSQWEMSARLENCDLEESSS

SEQ ID NO: 26241 - protein, 81 aa, Ailuropoda melanoleuca
KVSRSLENDGVCFSEQEWENLEDWQKELYRNVMKSNYETLVSLKVLGQPEGEAELGAGMLGDLEEEGPAAEGVMIKQEIQY

SEQ ID NO: 26242 - protein, 81 aa, Ailuropoda melanoleuca
MLFEDLAVYFSQEEYVSLHPAQRSLSRDTIQECFEDMALMGGEGKTEISQQLNLESTGFEELAPGNSSITVPLVYYPEKSD

SEQ ID NO: 26243 - protein, 81 aa, Ailuropoda melanoleuca
GTVTFEDIAVSFSWEEWDLLDETQRHLYQDVMLENLALITSLDLQQQQKQHMSDKPFGNNRGRASVVKSCRLQVSGKPFIC

SEQ ID NO: 26244 - protein, 81 aa, Puma concolor
TFKEVVTFKDVAVVFTEEELGLLDPTQRKLYREVMLENFGNLVSVGHQPFKRDMVHLVREGKFWMMKLATQGKGNSGDKIQ

SEQ ID NO: 26245 - protein, 81 aa, Puma concolor
HQISVTFDDVALDFTQEEWILLDLSQRNLYRNVMLENYQNLVTVEYQLSKPKLIAWLEQQELRAVEQGILQEWETGLQTKG

SEQ ID NO: 26246 - protein, 81 aa, Sapajus apella
MDTVALEDVAVNFTQEEWALLGPSQKNLYRDVMQETIRNLDCIKMIYEDQNIEDQYKNPRRNLRCHMAERLSESKDNSQCG

SEQ ID NO: 26247 - protein, 81 aa, Sapajus apella
DSVAFEDVAINFTCEEWALLGPSQKSLYRDVMQETIRNLDCIGMKWQNLDIEEDEYKNPGRNLRCFMVERSCEIKDNSQCG

SEQ ID NO: 26248 - protein, 81 aa, Sapajus apella
MLENYRNLVFLGIAVCKPDLIICLEQEKEVWSRKSQEIMVAKPPVMRSHFAQHLWPGKNVKDSFQKVTLERYGKCRRENLP

SEQ ID NO: 26249 - protein, 81 aa, Sapajus apella
WLHEPMTFKDVAVEFTQEEWIMLDSAQRSLYKDVMLENYQNLTSVEYQLCKLTVISPLHQKEIRNMKKRNLQGLCPDQKIQ

SEQ ID NO: 26250 - protein, 81 aa, Sapajus apella
LQEPLEFMDVAIEFSLEEWHCLDTAQRNLYRDVMLENYRNLVFLGIVVSKPDLITWLEQGKKPLTVKRRGMIAAPPGMSSH

SEQ ID NO: 26251 - protein, 81 aa, Rhinopithecus bieti
MLFITTWDVAIEFSLKEWQCLDTAQRNLYRNVMLENYRNLVFLGIAVSKPDLIACLEQGKEAWSMKRHEIMVAKPPGWSAV

SEQ ID NO: 26252 - protein, 81 aa, Rhinopithecus bieti
SVMESVTLEDVAVEFIQEWALLGSARRSLCRYGMLDQCRTLTSRGTPPCKPSRVSQLGPRAEPRATERGILHATGIAWESQ

SEQ ID NO: 26253 - protein, 81 aa, Rhinopithecus bieti
MLENYRNLVFLGIVVSKPDLITCLEQGKKPLTMKRHEMIAKPPVMCSHFAQDVWSEQSIKDSFQKVILRRYEKCGHDNLQL

SEQ ID NO: 26254 - protein, 81 aa, Panthera pardus
RESGKAPVTFDDITVYLLQGEWMLLSQQQKEICGSDKLVAPLGPTIANPELFYKFERGPEPWVGSAQGQRNVLRHHPGPAA

SEQ ID NO: 26255 - protein, 81 aa, Panthera pardus
QESRMTLSQELLTFRDVAIEFSQEEWECLDPAQRALYRDVMLENYRTLVSLGEDSFPAEVGNCSRLPLCFFWEALESPCPV

SEQ ID NO: 26256 - protein, 81 aa, Panthera pardus
TVGLVSFKDVSVSFTQVERQWLDSAQKILYRVVMLENYSKLVSVGCLTIKPDVISQLERGEEPWIIEVMFSSQSLPAIHST

SEQ ID NO: 26257 - protein, 81 aa, Panthera pardus
LQGLLTFRDVAIEFSQKELRCLNHSQWELYRDVMLENYGHLHFLGLVVSKPDLVIFLEHKKDVWAMKRKETVATHPGIKPY

SEQ ID NO: 26258 - protein, 81 aa, Panthera pardus
LSQEPQKMNTPQDITVEFTQEEWQQMDSAQRTLYRDVMLENYSHLVSVASLFRSIWTYLRDFAGSIPDHHNEMNTTIQQVK

SEQ ID NO: 26259 - protein, 81 aa, Panthera pardus
IQGSLTFGDVAVAFTQIEWKHLDAAQRALYKDVMLENYGNLVSVGLLSSKPKLITRLEQGSEPRMEVQQVPSGTCSVQEYW

SEQ ID NO: 26260 - protein, 81 aa, Panthera pardus
PLTFKDVAVVFTEEELRLLDPTQRKLYRDVMLENFQNLLSLGDKNEKDLEYSQERELKCLSYRELSYWKIGEQAAAELTGS

SEQ ID NO: 26261 - protein, 81 aa, Panthera pardus
MLEDYRNLVSVGHQASKPDVLAKLERGEEPWAIEEEVRSGTSPETGKVDNHLQGHWEDERMLKGMELYPKHDAFGSIVPQS

SEQ ID NO: 26262 - protein, 81 aa, Panthera pardus
AQVSVTFDDVAVTFTQEEWGQLDPAQKTLYQEVMLENCGLLVSLGCPVPRPELICQLERGQELWTAKRGLSQNTYPGDKGK

SEQ ID NO: 26263 - protein, 81 aa, Panthera pardus
VQKFVSFKDVTVDFTWEEWQQLDSAQRNLYRDVMLENYSNLVSVDFETGMKELTTQKSISEEVVLYNMIVYSTFEDWKLED

SEQ ID NO: 26264 - protein, 81 aa, Macaca nemestrina
QAEVTFEDVAVFLSREEWGRLGPAQRGLYRDVMLETYGNLVSLGVGPAGPKPGVISQLERGDEPWVLDVQGTSRREHLKVN

SEQ ID NO: 26265 - protein, 81 aa, Macaca nemestrina
MVSFEDVAVLLSQEEWDCLIPAQRGLYRDVMLETYGNLVSLGLQASKPDVISRLEQGDKPWTPHILRTQRSWSWRHKRECY

SEQ ID NO: 26266 - protein, 81 aa, Macaca nemestrina
TCDEAVTFKDVAVVFTEEELELLDPAQRKLYRDVMLENFRNLLSVGYQPFHGDTFHFLREEKFWVMETTSQREGTSGKIQT

SEQ ID NO: 26267 - protein, 81 aa, Ursus arctos
QGSVTFEDVVVYFSWEEWGLLDETQRCLYHDVMLENFALVISLGCWYGMEDEEAVSVQQMSLGRTPSPEPSLWKVQPCEKC

SEQ ID NO: 26268 - protein, 81 aa, Muntiacus reevesi
HCGLMTFEDVAVDFTQEEWQYLNPPQRTLYRDVMLETYSNLVSVGHHITKPDLILKLEVEERCLLEGKIPIWSFPAPWPQG

SEQ ID NO: 26269 - protein, 81 aa, Muntiacus reevesi
LSTQLTVEDVDIKFTPEEWECLDPAQRTLYRDVMEETYRNLLSVGIGPRLPDCSSCIHMTKKLQAKENSGKGEILQRVMCG

SEQ ID NO: 26270 - protein, 81 aa, Muntiacus reevesi
GSFSFEDLSVDFTQKEWQLLDPYQKDLYKDVMLENYSSLVSLGYEIMKPGVILKLEQGEEPWTGDGEIPSSDSLDQVFQVN

SEQ ID NO: 26271 - protein, 81 aa, Muntiacus reevesi
VSVTFEDVAVYFSWEEWGLLDDAQRCLYHSVMLENLSLVISLGCWHGVEDEEAPSEQNISIHGLSQVRIPKAGMFSQKAHF

SEQ ID NO: 26272 - protein, 81 aa, Muntiacus reevesi
LERLTSEDVAIEFTQEEWEFLDPAQRALYRDVMLETYRNLLSVDISPTHVIKHLQLKVNSDKREPFQTLMLGRSESHEIKH

SEQ ID NO: 26273 - protein, 81 aa, Eschrichtius robustus
YQTPKPDSLSQLEQGEPPWTVEGAGQSQTYPEEIWEIDPMQWHPENQNGIKTLERYQQSYALGNNFDLCKSLLPLTQRYNN

SEQ ID NO: 26274 - protein, 81 aa, Myotis brandtii
MLENYGHLVSLGFNISKPDVVSLLEQGKEPWLGKGDVRTDFFPVSESNGEIRKFSPKNVIYEEDFPQYLIKENHRSQGPEH

SEQ ID NO: 26275 - protein, 81 aa, Camelus ferus
MPEAVIVLSVFAFGLDSKAETLFPLAPEGIPFSKPKLITQLEQGRETWKEERKGPPGPCPEQGIGSYRRTRQSGFGSSVSI

SEQ ID NO: 26276 - protein, 81 aa, Myotis brandtii
DKTIIAFGDVAVAFTEREWKLLSPAQRTLYRDVMLETYSHLVSLGIAFSKPKFITQLEQGDEPWREESECLLELCPEPRTE

SEQ ID NO: 26277 - protein, 81 aa, Propithecus coquereli
LELLTFRDVAIEFSPEEWECLDTAQQNLYRDVMSENYRNLVSVELAVYKLDLLTFLKQMKEAWNVKREETVAKHPETRSRL

SEQ ID NO: 26278 - protein, 81 aa, Propithecus coquereli
EAVTFKDVAVVFTEEELGLLDSAQRRLYRDVTLENFRNLLSVGCQPFKLDTPLQLGREEKLWVTEAETQGDGCSGHRNQNE

SEQ ID NO: 26279 - protein, 81 aa, Propithecus coquereli
TFKEAVTFEDVAVVFTQEELSLLEPGQRKLYRDVMLENFRNLLSVEHQPFLQDTFHVLREEKFWMMKTATHREGNSGKNQA

SEQ ID NO: 26280 - protein, 81 aa, Oryctolagus cuniculus
VTITFKDLAVRFSEEEWRLLEERQREFYREVMRENYETLVSVGGKPQHSLHLTALVQLVKEIPEFLFREVKGTVDSPESRG

SEQ ID NO: 26281 - protein, 81 aa, Pteropus alecto
AQGLMVFEDVAVYFCEEEWDLLDAAQRALYCHVMLENFALVASLGLSASRPRVVIQLERGEEPWVLSGTDVTLARNAQRRP

SEQ ID NO: 26282 - protein, 81 aa, Pteropus alecto
ILPESQSLLAFEEVAVYFSQEEWELLDPSQRALYNDVMQENYETVISLDNVERTDYLKEADAFVALAGPLRSSALVVVMLT

SEQ ID NO: 26283 - protein, 81 aa, Oryctolagus cuniculus
MGYCTTKPDLIFKLERGAEPWMVDECLNRSLPVVMKRDDLIRINQENQDKNLNQDFMENNKTSALKRVELRKTPSLNSSHI

SEQ ID NO: 26284 - protein, 81 aa, Pteropus alecto
HTESVTFEDVAVTFTLEEWALLDPSQKKLQRCDAGNHQEPDLSGSHKVKRICEEKKGSQCGENFSSMPNLNLKKKTLPGVK

SEQ ID NO: 26285 - protein, 81 aa, Macaca nemestrina
MESLTLRDVAVDFTWEEWQLLGPAQKHLYRDVMLENYSNFVSVGFQASKPDALTKLEQGEPLWALEDEIHSPTHPEIEKAD

SEQ ID NO: 26286 - protein, 81 aa, Macaca nemestrina
MDTVVFEDVVVGFTLEEWALLNPAQRNLYREVMLETFKHLASVDNKTHFKASGSVSQQDTYREEKSKEQTIPNFTRNNSCA

SEQ ID NO: 26287 - protein, 81 aa, Muntiacus reevesi
ESVTFEDIAVDFTQEEWALLDTSQRKLFRDVMLENISHLVSVGNQLYKSDVISHLEQGEQLSRKKLGFLQGQSPVISDRED

SEQ ID NO: 26288 - protein, 81 aa, Muntiacus reevesi
EAPKVPFDDVAVYFSEQEWSKLDEWQKELYKHVMRGNYETLVSLDYAISKPEVLSQIEQGKEPCSWRRAGPKVPDVPVDPS

SEQ ID NO: 26289 - protein, 81 aa, Ursus americanus
RNIVTFEDVCIYFSPEEWELLDEAQKRLYCNVILENFLLVTSLGLAISRYHLIPQLLSVTMGNGPPTGVVAISRGTWPLLN

SEQ ID NO: 26290 - protein, 81 aa, Ursus americanus
NLDWGTFEDVAVYFSREEWELLDETQRHLYHNVMLENLALMASLGKALPPPMEEAPLEQSVSVEGALHLRTPKVCPSTQKA

SEQ ID NO: 26291 - protein, 81 aa, Myotis brandtii
MSFEDVTIAFSQEEWGLLDAAERLLYCEVMLEICTLVASVGYWHKPADEEAPCEQIASADPEPQPALGTEEPHSVIESWQP

SEQ ID NO: 26292 - protein, 81 aa, Myotis brandtii
SVDITPLSGRLGMELLQEPLTFHDVAVDFTWEEWQLLGPEQKDLYRDVMLETYSHLVSVGEDSSPVSVRWASVSGLSILSF

SEQ ID NO: 26293 - protein, 81 aa, Camelus ferus
ESVTFRDVAVFFSRDEWLHLNPAQRALYREVMLDNYSALVSLVGGRAGVRLGGAVCGAGAVGQEAVRCARLDITGPRDTRG

SEQ ID NO: 26294 - protein, 81 aa, Myotis brandtii
AQGLVTFEDVAVDFTQEEWQYLNSPQRILYRDVMLETYSNLVSVAGKQATKPDLILNLEVEEPCLAEGKIPIWSFPEETCQ

SEQ ID NO: 26295 - protein, 81 aa, Myotis brandtii
PQGQLTFSDVAIEFSQEEWACLDPAQRKLYVDVMLQNYRNLVFLGLVVSKPDLVTFLEHMMEPWELKRKETISSQPVMSSQ

SEQ ID NO: 26296 - protein, 81 aa, Oryctolagus cuniculus
KKVMITFEDLAVYFTWEEWQHMNKAQKILYRDVMLETYSSLLFLGHCITKPDLIFKLEQGAEPWMVNEFLNQNLPVAMKSD

SEQ ID NO: 26297 - protein, 81 aa, Oryctolagus cuniculus
LQDLVTFEDVAVEFSQEEWALLDPSQRMLYRDVMLENRKNLASLGCHVDKPKLITHLEQEDRLIPEERSLLPDTCPDLEPV

SEQ ID NO: 26298 - protein, 81 aa, Pteropus alecto
KGSVTFEDVAVYFSQEEWRLLDEAQRLLYRDVMLEVFALAVSLGTWHGTESPSEQNGFEEESQENTSQACPWKLCGLALES

SEQ ID NO: 26299 - protein, 81 aa, Pteropus alecto
VLFEDVAVDFSQEEWALLDLTQKSLYRDVMLENFQNLASLGFETRFKANESVTSQDIHGEKKSSEQGIVRFRRNDSWSSIL

SEQ ID NO: 26300 - protein, 81 aa, Pteropus alecto
TVLLTPASQKSVLIGDMAEALTQWGQRHPPRGHMQEKHRNLVLLGLPISKPGVISQVEHGEELERKVPKATSPGEPVVEMG

SEQ ID NO: 26301 - protein, 81 aa, Pteropus alecto
MQRTLYRDVMLENYSHLVSVGCQVTKPAVISRLEQGQEPWVEEEEILGWGFPEEVLQVDTQVDRQQKHQDKLLRQVSFLDR

SEQ ID NO: 26302 - protein, 81 aa, Pteropus alecto
SQGLLIFRDVAIEFSQEEWECLDTAQRALYRDVMSENYRNLVFLGLAVSKSDPIIFLEQMKEPWDLKRKKTISIHPGPVLF

SEQ ID NO: 26303 - protein, 81 aa, Rhinolophus ferrumequinum
SLGLVSFKDVTVDFSREEWQQLDLTQKSLYRDVMLENYFNLISVGCGVPKPKVIFNLEQVEKPCMLDGEASSQSCLDGDIG

SEQ ID NO: 26304 - protein, 81 aa, Rhinolophus ferrumequinum
GVMESVTFEDVAVRLIQDWALLDGARRNLCRYGKLDNCRTLAPGGTPPCKPRLVSQVGPREEQRAAERGILRAMGVDWESQ

SEQ ID NO: 26305 - protein, 81 aa, Panthera pardus
AHHLVMFRDVAVDFSQEEWECLNSYQRNLYRDVILENYSNLVSVGYTISKPDVITLLEQGKEPWMVVRDERRRRSLALRSL

SEQ ID NO: 26306 - protein, 81 aa, Rhinopithecus bieti
RDVAIDFSQEEWEFLDPAQRDLYRDVMWENYNNFISLGPSISKPDVITLLDEEGKEPGMVVREGTRRYCPDLESRYKTNTL

SEQ ID NO: 26307 - protein, 81 aa, Panthera pardus
RKVQESRMTLSQELLTFRDVAIEFSQEEWECLDPAQRALYRDVMLENYRTLVSLAVQELGLVYGKAAGHHLPVSMSARPSF

SEQ ID NO: 26308 - protein, 81 aa, Panthera pardus
LQSPVTFEDVAVYFSKEEWGLLDAGQRDLYHNVMLENFQLMTSLGCWHGVEDEGAHSKKNASIQGMLQVRIPTANPSTQKA

SEQ ID NO: 26309 - protein, 81 aa, Panthera pardus
TQASVSFKDVTVEFTQEEWQQMGPIQRTLYRDVMLENYNNLVSVGNCIFKPAVIFKLEQGEEPWFLEEEFLNQSHQEDYRD

SEQ ID NO: 26310 - protein, 81 aa, Panthera pardus
VQGQVNFEDVAVYFSREEWGLLDEAQRLLYRDVMLENLALTASLGSRHGTEDEETAVEQNISVGVSQVRTPKAGPSTQKAH

SEQ ID NO: 26311 - protein, 81 aa, Panthera pardus
SSQTLLTFRDVAIEFSQEEWGCLNHSQRELFRDVILETYGHLLFVGLVSKPDLVIVLEQKKELWGVKRKETVASHPGRVHA

SEQ ID NO: 26312 - protein, 81 aa, Macaca nemestrina
GTVTFEDVAVNFTQEEWNLLSEAQRCLYRDVTLENLALISSLGCWCGVEDEAPSKQSIYIQRETQVRILMAGVSLKKVHPC

SEQ ID NO: 26313 - protein, 81 aa, Macaca nemestrina
SQEPVTFADVAVVFTPEEWVFLDSTQRSLYRDVMLENYRNLASVADQLCKPNASSYLEQRGEQWTTDRGILADTCAEPQLQ

SEQ ID NO: 26314 - protein, 81 aa, Macaca nemestrina
MNSVAFEDVAVNFTQEEWALLDPSQKSLYRDVMQETFRNLASIGNKGKDQSIEDQYKNSSRNLSSFQMHQRNHTGEKPYEC

SEQ ID NO: 26315 - protein, 81 aa, Ursus arctos
VTFEDVAVYFSWKEWRLLDEAQRRLYHRVMLENFTLTSSLGCCCGAEGEEAPFAQSTTVGASQAGTPAAAVSSRKTHPCEL

SEQ ID NO: 26316 - protein, 81 aa, Ursus americanus
FQGSLSFRDVAVGFTQKEWQQLEPAQRTLYRDVMLENYSHLVSVGEEITKPAVISRLEQGQEPWMEEEEILRWSFPGERGS

SEQ ID NO: 26317 - protein, 81 aa, Eschrichtius robustus
MTFEDVAVDFTQEEWQYLNPPQRNLYRDVMLETYSNLLSVGYEGTKPYVILRLEQEEAPWICEASCSGCHCWENIWQGNVQ

SEQ ID NO: 26318 - protein, 81 aa, Myotis brandtii
MAMYLTREEWRPLDPTQRDLYRDVMQENYGNVVSLDFEIRSENEVNPKQEISEDVELGTASERPVGNTEENPESEEAFESR

SEQ ID NO: 26319 - protein, 81 aa, Myotis brandtii
PLVGLKFEDVAIFFSQKEWECLHSTQKDLYRDIMLENYNNLISLGLCYSMPDVISLLEQGKEPWIVKRKEAKEWCPDWESR

SEQ ID NO: 26320 - protein, 81 aa, Myotis brandtii
LQGSVTFKDVIVEFTKEEWQLLDEAQRALYKEVMRENYRHLVSVGYFVNKSNAVLKLKQGKEPWILEVEFPHQNYTGLENP

SEQ ID NO: 26321 - protein, 81 aa, Rhinopithecus bieti
MDTVAFEDVAVNFTQEEWALLGPSQKNLYRYVMQETIRNLDCIRKIWEGQNTEDQNKNPRRNLPGAGHLSLNSHIRVDAGY

SEQ ID NO: 26322 - protein, 81 aa, Rhinopithecus bieti
PQASVCFEDVAMAFTQEEWEQLDLAQRTLYREVTLETWEHIVSLGLFLSKSDVISQLEQEEDLCRAEQVVPREKRVLGSFL

SEQ ID NO: 26323 - protein, 81 aa, Panthera pardus
AHRSLMFSDVSIVFSQEEWEYLDLEQRDLYRDVMLENYSNLVSLGCFISKPDVISLLEQGKEPWKVVRKGRRRYAAPMSIA

SEQ ID NO: 26324 - protein, 81 aa, Panthera pardus
SSQGLLTFRDVAVEFSQEEWGCLNHSQKELYWDVMLETYGHLLFLGLVVSKPDLVIFLEQKRELWDIKREETVATHPGRWE

SEQ ID NO: 26325 - protein, 81 aa, Panthera pardus
AHQLMMFRDIAVDLSQEEWECLDLEQRHLYRDVMLENYSNMISLGLCIYQPDVFCLLEKGKEPWIFLQDETRGHCPDMPFR

SEQ ID NO: 26326 - protein, 81 aa, Macaca nemestrina
GTVTFEDVAVNFTQEEWNLLSEAQRCLYRDVMLENLALISSLGCWCGVEDEEGPSKQSIYIQRETQIRIPMAGVSLKKVHP

SEQ ID NO: 26327 - protein, 81 aa, Ursus arctos
VTFEDIAVYFSWEEWRLLDEAQRCLYHDVMLETFTLISSLGCCCGAEDAEAPFAQSTSVGASQTGTPTAAVSSRKTHPCEM

SEQ ID NO: 26328 - protein, 81 aa, Muntiacus reevesi
ISGRLMFQDVAIDFTQEEWECLDLGQRDLYRDVMLETYGNLASLGLVVSKPDLVTFLEQMKTPWGVRRTDTTATYPGLSLN

SEQ ID NO: 26329 - protein, 81 aa, Myotis brandtii
DVNFEDVAIAFSQEEWGLLDEPQRLLYCDVMLEVFALISSVGTWHLHCTASWDADSPLRGSGAETSTRTSVPGLQQPSAFT

SEQ ID NO: 26330 - protein, 81 aa, Myotis brandtii
QELPVVFEEVAVYFTREEWGVLDQRQKELYRDVMRMNYELLASLGPVATKPDLISKLEHRAAPWIKDPKGTKWGKGCSPGK

SEQ ID NO: 26331 - protein, 81 aa, Myotis brandtii
LPDPVTFDDVAVYFSLEEWGLLDEAQRRLYHEVMLENLALASSLGPCCGSEDADAPCEQSASVGGSPSSPSKAAVSSLKTH

SEQ ID NO: 26332 - protein, 81 aa, Myotis brandtii
SQGPLTFRDVAVDFSQKEWECLDPSQRKLYVDVMLDNYENLVSMGLAVSEPDLATFFEQMMENWDAKGKMTVLTHPAMPSE

SEQ ID NO: 26333 - protein, 81 aa, Myotis brandtii
GQRDMNFEDVAIAFSQEEWGLLDEAQRLLCYDVMLEVFAVVSSVGCWHKTDDVEACSEQNASIEGESLVSASKTPPTTQKS

SEQ ID NO: 26334 - protein, 81 aa, Propithecus coquereli
FQESVTFKDVIVDFTQEEWKQLDPVQRDLFRDVTLENYTHLVSIGLQVSKPDVISQLEQGTEPWVIESGIPVGTFADWETR

SEQ ID NO: 26335 - protein, 81 aa, Pteropus alecto
NFWVLRLPPGSKAEAPKEWGKLDEWQKELYKHVMRGNYETLVSLDYAISKPEVLSQTEQAKEPCSWRRAGPKVPDVPVDPS

SEQ ID NO: 26336 - protein, 81 aa, Pteropus alecto
SMTFTDVAIDFSQDEWEWLNLAQRTLYKKVMLENYRNLVSVDLEYVWIVKELSADFDIHEEKLSQAMIMERLTSYDLECST

SEQ ID NO: 26337 - protein, 81 aa, Pteropus alecto
FYELVTFEDVAVYFSENEWTCLAPAQRVLYKDVMLENYGAVASLAFPFPKPALISQLGRGEAPWCSATQGALDGEAPRAIS

SEQ ID NO: 26338 - protein, 81 aa, Oryctolagus cuniculus
FEELVMFSDVAIEFSEEEWECLGPAQRDLYRDVMLENYGNFVSLGLAISKPSVISLLEQGKEPWMAEKAEWYPELPSRYET

SEQ ID NO: 26339 - protein, 81 aa, Panthera pardus
QDSVTFEEVAVDFSQEEWALLDPTQKILYRDVMLENYRNLASVGLDIQLKSKDAFPVQNVPREKTCNDIKTQVPTKPSKKP

SEQ ID NO: 26340 - protein, 81 aa, Panthera pardus
AQGCVISEDVFVYFSWEEWMLLDDSQRLLYQDVMLENFALLASLGIAPSTSRLVAQPKQREDPWVPDRVDVTPATEREAQK

SEQ ID NO: 26341 - protein, 81 aa, Panthera pardus
FQEPVMFKDVAVVFSEEELGLLGPTQRKLYRDVMLENFRNLVSVGNQPFKPELVSQLEREEKLLMMETETQRDGCLGAKSQ

SEQ ID NO: 26342 - protein, 81 aa, Macaca nemestrina
PQGLLTFRDVAIEFSQEEWKCLDPAQRTLYRDVMLENYRNLVSLAISSKCMMNMFSSTGQGNTEVIHTGTLQRQASHHIGD

SEQ ID NO: 26343 - protein, 81 aa, Macaca nemestrina
QDSVTFDDVAVDFTPEEWALLDTAEKYYRDVMLENYINLASVGKSNITLLEWEIQPRIKGSSLQQGFLKNPIFNGIQMVRF

SEQ ID NO: 26344 - protein, 81 aa, Ursus arctos
SQGLLTFKDISVDFTQEEWGHLAPAHRNLYREVMLENYGNLVSVGCQLSKPGVISQLEKGEEPWLIEREISGSPGSDLENK

SEQ ID NO: 26345 - protein, 81 aa, Ursus arctos
VTFEDVAVIFTDEEWRHLVPIQRDLYKEVMLENYKIIVSLDWATKPEIHGASEEESEGTARGKLGGEVPVCPKFEAHALEG

SEQ ID NO: 26346 - protein, 81 aa, Muntiacus reevesi
RAETLSFKDVAVDFTWEEWQLLAPAQKTLYRDVMLENYSNLVSMGYRVSKSDVLSKIEQGEGQWMTEDEIHSHTWPETGSV

SEQ ID NO: 26347 - protein, 81 aa, Muntiacus reevesi
FKVSVSFEDVAVDFTRQEWHRLDLAQRTMHRDVMLENYSNLVSVGLCVAKPEMIFKLERGEELWILEEESSDHGYTGGNSS

SEQ ID NO: 26348 - protein, 81 aa, Ursus americanus
LTFRDVAIEFSQEEWECLDPAQRELYRDVMLENYRNLVSLGEENVPPEVGVYPWVSLHFPLSVFWGPLSCLTEIEALLTQK

SEQ ID NO: 26349 - protein, 81 aa, Ursus americanus
CGVTFEDVAVYFSWKEWRLLDEAQRRLYHRVMLENFTLISSLGKGLTVWSSLESTFPRLAGAHAKSQQQQEEHTEEKPFRC

SEQ ID NO: 26350 - protein, 81 aa, Ursus americanus
KSGLVTFEDVAVYFSLEEWERLDVDQRDLYKDVMQENYGILVSLGYPIPKPDLIFRLEQGEEPWVPDSPPPPIPTPSATWQ

SEQ ID NO: 26351 - protein, 81 aa, Ursus americanus
AGYQAPKPDMISKLQKGEEPWLGKGKRPKQDGPSELARPKQIGTNRNELQQGNAQLGNDQESQNKLLKEVTFKKKSLTKKK

SEQ ID NO: 26352 - protein, 81 aa, Myotis brandtii
AKVPVSFEDVSVHFSKTEWKLLDLKQRILYKQVMLENYRHLVSLGFSSSKPHLVSLLERGEWPWVTDSRTRAAVGTQADER

SEQ ID NO: 26353 - protein, 81 aa, Saimiri boliviensis
PQVSLTFEDVAVLFTRDEWRKLAPSQRNLYRDVMLENYRNLVSLGLPFTKPKVISLLQQGEDPWKVEKDSSGGCSPGCKSN

SEQ ID NO: 26354 - protein, 81 aa, Oryctolagus cuniculus
LPGLMAFEDVAVYFSQEEWGLLDAVQRALYRHVMLENFALVASLGLSASPPHVVIQLQRGEEPWVPSGLDMTSARNGHRRP

SEQ ID NO: 26355 - protein, 81 aa, Oryctolagus cuniculus
STVMIAFEDLAVYFTWEEWQNMNKAQKILYRDEMLETYSSLLFLGHCITKPDLIFKLEQGAEPWMVSEFLNQNLPVAMKTS

SEQ ID NO: 26356 - protein, 81 aa, Oryctolagus cuniculus
TARSQTTVTFKDVAMDFTLEEWEKLGPTQRAVLLENYRNLVSLWLPISKPESYNLENGKEPLMLERKVPSSSYLGENLNSF

SEQ ID NO: 26357 - protein, 81 aa, Rhinolophus ferrumequinum
PQGSVSFKDVTVDFTQEEWQQLDPDQKALYRDVMLENYCHLISVGFHMTKPDMIRKLEEGEELWTTERIFPNQSYLEEDGK

SEQ ID NO: 26358 - protein, 81 aa, Rhinolophus ferrumequinum
GEPRRAPVTFDDITVYLLQEEWMLLSQQQKICGSDKMLAPLGPTIANPELFCKFKRGPGPWLGNVRGQRDLLRCHPGKNKM

SEQ ID NO: 26359 - protein, 81 aa, Rhinolophus ferrumequinum
EAFVSFPDVAVDFTQEEWQLLNHAERTLYRDVMLENYSNLCCSADPKPETQPYSSCPLDFCSQRLCQQVLHDHRLSSSPGM

SEQ ID NO: 26360 - protein, 81 aa, Rhinolophus ferrumequinum
MGHRVMWPLRQHLLLRALKAEQLVQVHVHFPLTGYDSTKPNVIVKLEQGEEPWIAEGDLPCQSPEEVWKVDDMTNRIQETE

SEQ ID NO: 26361 - protein, 81 aa, Rhinopithecus bieti
TFKEAVTFKDVAVVFTEEELGLLDSAQRKLYRDVMLENFRNLLSAGHQPFHGDTFHFLREEKFWVMETTSQREGNSGKSQT

SEQ ID NO: 26362 - protein, 81 aa, Rhinopithecus bieti
MLENYGHLVSLGLSISKPDVVSLLEQGKEPWLGKRNVKRDLFSASESSGEIKDFSPKNVIYDDSSQYLIMERILSQGPMYS

SEQ ID NO: 26363 - protein, 81 aa, Panthera pardus
SQGLLTFRDVAIEFSQEELRCLNHSQWELYRDVMLENYGHLLFLGLVVSKPDLVIFLEHKKDVWAVERKETVVTHPGHQRI

SEQ ID NO: 26364 - protein, 81 aa, Panthera pardus
MAFEDVAVYFSQEEWELLDAAHVMLENCHVMLENFALVSSLGLSASRPRVVLQLERGEEPWVLSGTVVTPARNAQRKPSPG

SEQ ID NO: 26365 - protein, 81 aa, Macaca nemestrina
WSQMPVTFEDVALYLSREEWGRLDHTQQNFYRDVLQKGNGLSLGFPFSRPFWAPQALGKGEASGSSRQTGDEKEEWRGAYS

SEQ ID NO: 26366 - protein, 81 aa, Ursus arctos
RKGFVIFRDVSIDFSQEEWECLDSTQRNLYKYVMLENYSNLVSVGLCIPKPDVISLLEQGKEPWSVFDSELTRGLYLEEET

SEQ ID NO: 26367 - protein, 81 aa, Ursus arctos
QLVTFKDVAVDFTQEEWQQLEPAQRDLYRDVMLENFQNLSSLDLESRPDRDGPEEAMEELGGSRLWHSKGGGPRDPRNPDW

SEQ ID NO: 26368 - protein, 81 aa, Muntiacus reevesi
SQDSVTFADVAVNFTQEEWTLLDCFQRKLYRDVMLENYKNLTTAGYQVFKPTLISWLEEEELSTVERGILQEWGMQLKAKD

SEQ ID NO: 26369 - protein, 81 aa, Muntiacus reevesi
FQGSVSFKDVTVGFTQEEWQHLDSTQRSLYRDVMLENYRNLISVEVCKTDGMKERSQENQPKHIWKVVLINNKSLTKEQGN

SEQ ID NO: 26370 - protein, 81 aa, Muntiacus reevesi
ALNRVTFEDVAVYFSQEEWCLLDEAQIQLYLDVMLENFALVCMLGSWSGAGDEDTPFEQSKSVGVSQIGTPRADSSAENVQ

SEQ ID NO: 26371 - protein, 81 aa, Muntiacus reevesi
AVTFTDVAVDFSQDEWEWLTLAQRTLYKKVMIENYSNLASLGLCVSKPDVICLLEQDKEPWTMKGELTRGPCADLEYVWMK

SEQ ID NO: 26372 - protein, 81 aa, Muntiacus reevesi
MGRLTFRDVAIDFTQEEWECLDLGQRELYRDVMFENYGNLASLGLVSKLDLVAFLEQLKAPRNIRRMKTATSYLAITPQDT

SEQ ID NO: 26373 - protein, 81 aa, Ursus americanus
LLTFGDVAIEFSQEEWGCLSHTQRELYRDVMLENYGHLLFLGEDDSCQISQAPLGVSLRNEQSTKWGPYERCFTEGSTPQN

SEQ ID NO: 26374 - protein, 81 aa, Ursus americanus
SNWGLLTFGDVAIEFSQEEWQCLSHTQRELYSDVVLENYGHLLFLGLIVSKPDLVSFLEQRKELWDEKRNKTVVFDPGRWE

SEQ ID NO: 26375 - protein, 81 aa, Oryctolagus cuniculus
CQGSVTFDDVAVVFTDEEWRHLIPVQRDLYKEVMLENYKSIVSLGLPVPQPDVIFQLKRRDETWIADLHGPEQREWPESIS

SEQ ID NO: 26376 - protein, 81 aa, Oryctolagus cuniculus
MPVTFEDVALYLSREEWGRLDHTQQDFYRDVLPKRNGLALGFPFGRPFWAAHVPGKGEALSSGRPAGEAKEKRGACAESLE

SEQ ID NO: 26377 - protein, 81 aa, Rhinolophus ferrumequinum
SQASVTFKDVTVEFTQEEWQRLGPAQRALYRDVMLEIYSHLVSVGNCIYKPGVIFKLEQREDPWFLEEEVSNQSHQEHYRD

SEQ ID NO: 26378 - protein, 81 aa, Rhinolophus ferrumequinum
AGYQVSKPEVIFKLEQGQEPWLSEGEIRRPFCPDWKTRPEAKSSNLQQNISEVSLSTDDLSHATSEDAWDTSSRLERHQEN

SEQ ID NO: 26379 - protein, 81 aa, Panthera pardus
MDSSQEEWTLLDQTQIALYRDAMLENYQNLITLDLRPSEVDRDSLEREADGHNGATQDHHRSLSGSGYNSPNEHFQLFPLP

SEQ ID NO: 26380 - protein, 81 aa, Panthera pardus
CEVSVSFEDVTMDFSREEWEQLDPAQRCLYWDVMLEICSHLLSLGYPIPRPEMIFRMEKEEEPWIREAQLPHQWRPEGEFG

SEQ ID NO: 26381 - protein, 81 aa, Panthera pardus
MQENCRNLASLGCHVDKPSLTSQLEQEDKVMTQERGILPGTCPGLETVLKAKWLTPKKHVFRKEHSNGIKAERNHLGVKVN

SEQ ID NO: 26382 - protein, 81 aa, Panthera pardus
MAQESVMFSDVSIDFSQEEWECLNDDQKDLYRDVMLENYSHLVSMDVISFLEQGKEPWLVDRELTRDQWPVLESRCETKKL

SEQ ID NO: 26383 - protein, 81 aa, Panthera pardus
QELVTFEDVAVAFSREEWALLDPAQKRLYREVMLETYRNLAALDLAAILKSQESSCKKVVWGEEPPSGIVKLPKGDWGCGQ

SEQ ID NO: 26384 - protein, 81 aa, Macaca nemestrina
MGPLQFRDVAIEFSLEEWHCLDTAQRNLYRNVMLENYRNLVFLETGFHHVGKAGLKLLTSDDLPALASESTGITGMRHAFP

SEQ ID NO: 26385 - protein, 81 aa, Macaca nemestrina
MGALTFRDVAIEFSLEEWQCLDTEQQNLYRKVMLENYRNLVFLGIAVSKRDLIPCLEQEKEPWNVKTHDMVAKPPVICSRI

SEQ ID NO: 26386 - protein, 81 aa, Macaca nemestrina
MLETYSHLLSVGYQVPKPEVVMLEQGKEPWALQGERPRQSCPGEKLWDHNQCRKILTYKQVSSQPQKVYPGEKPYECAEFE

SEQ ID NO: 26387 - protein, 81 aa, Macaca nemestrina
AHELVMFRDVAIDVSQEEWECLNPEQRNLYKEVMLENYSNLVSLGLSVSKPAIISSLEQGKEPWMVVREETGRWCPDLASR

SEQ ID NO: 26388 - protein, 81 aa, Ursus arctos
MLENYSHLVSLGYSISKPEVILKLEQGEEPWILEEEFPSQSDLELIKSRNYSRKKFNEFNKGRNWLHNKYERIHSEEKPYE

SEQ ID NO: 26389 - protein, 81 aa, Ursus americanus
QGRLTFRDVAIEFSPEEWECLDPAQRALYRDVMVENYRNLVSLGEDSFPPEVGNYFCMPLRFVLRAPDLICMNFRSPFLRE

SEQ ID NO: 26390 - protein, 81 aa, Ursus americanus
MLFVSSPELPNPCPFLYLLLCTGHQLPKPDVILQLEKGEEPWLVERGIHRETHPDLETTVEIKSSISSKSISKNKQSYGIK

SEQ ID NO: 26391 - protein, 81 aa, Pteropus alecto
SVTFRDVTVDFTQEEWQQLEPAQKALYRDVMLETYRNLVSLDLETRPDMKESDPKEAILEDRPSMGVVVEGPTRTGVWGSA

SEQ ID NO: 26392 - protein, 81 aa, Rhinolophus ferrumequinum
EAVTFGDVAVHFSREEWQCLDPGQRALYKEVMLENHSSVAGLGSMISTEGEQSREDADALQSESPATMFRSAPQACPRSPG

SEQ ID NO: 26393 - protein, 81 aa, Rhinolophus ferrumequinum
ILVPVTFRDVAVVFTEAEWKRLSSEQRNLYKEVMLENYRNLLSLGEAVFFPSLIQWRFIYHLLVSSRVSLLAESKPETDPC

SEQ ID NO: 26394 - protein, 81 aa, Rhinopithecus bieti
RPWEGKPRYLGPVTFEDVAVLFTEAEWKRLNLEQRNLFEEVMLENLRNLVSLGEDIYQECFSIIQHLDHLKFFCKFESGFR

SEQ ID NO: 26395 - protein, 81 aa, Rhinopithecus bieti
TKVSITFKDLAVRFSEEEWRLLEEGQREFYRDVMRENYETLVSVGTAELLPLSAFLSPSEPGGAVVGGSHADEGQEPAGGG

SEQ ID NO: 26396 - protein, 81 aa, Panthera pardus
SQEPVTFEDVAVYFTRNQWTSLDPMQRALYREVMLENYANITSLGGKNKTAKGEQTPRPDVSGASAAQRLAVEGLLPDGPQ

SEQ ID NO: 26397 - protein, 81 aa, Macaca nemestrina
MGLLTFRDVAIEFSLEEWQCLDTAQKNLYRNVMLENYRNLAFLGIAVSKPDLITCLEQGKEPWNMKRHEMVDKPPAICPHF

SEQ ID NO: 26398 - protein, 81 aa, Macaca nemestrina
MDSVAFEDVAVNFTREEWALLGPSQKTLYRDMMWETIRNLNCIGMKWEDTDVEDQHKNPRRSLRCLIVERFSESNQIPGST

SEQ ID NO: 26399 - protein, 81 aa, Ursus arctos
ALGLVTFEDVAVYFSREEWGLLNLTQRSLYRDVMLENFALIGSLGFAPSRSHVVAQLDSEEELWVPSMVDWTMGSRAEARR

SEQ ID NO: 26400 - protein, 81 aa, Ursus arctos
SEESVTFKDVAVDFTQEEWVQLDSPQRALYRDVMLENYQNLLALGPPVCKPDVISHLERGEEPWQMPREVPGGAYLEGEPR

SEQ ID NO: 26401 - protein, 81 aa, Ursus arctos
PVTFEEVSTQFSGEQWQCLDPDQQALSRDMMLDNFGSSASLGSSEDRESCLHWRPELTPELCSANPPSADRASRAVRARVS

SEQ ID NO: 26402 - protein, 81 aa, Ursus arctos
MLETYNHLVSLEIPFCKPKLISQLEQGEEPWIEERQHPLGLCPGSKLNIQPCPHCLLAFTSQQGLSQHVWFSHLPQLFSSL

SEQ ID NO: 26403 - protein, 81 aa, Muntiacus reevesi
QLTFKDVAVEFSQEEWECLDPAQRAFYMDVMVETLRNLISVDISHIHVVKKLQPTSSSDTGDAFQTVTLERQKIPEMKYFC

SEQ ID NO: 26404 - protein, 81 aa, Muntiacus reevesi
VVTFKDVAVTFTREEWGQLDLDQRTLFREVMPETCGLLVSLGADTRVAPLTVIHSEALWDTFAFRPHEVLTKVGGRKESRK

SEQ ID NO: 26405 - protein, 81 aa, Oryctolagus cuniculus
SQVMIAFEDLAVYFTWEEWQNMNQAQKILYRDVMLETYSSLFSLGHCRTKPDLIFKLEQGADVYITGREAKAEAVQQILTG

SEQ ID NO: 26406 - protein, 81 aa, Oryctolagus cuniculus
DVMSFEDVAMDFTREEWQFLNPYQRDLYKEVMLANYSNLVAVGEDITATPGSHHSIGLCSCLVCMESYRIGLSAAGLFYSV

SEQ ID NO: 26407 - protein, 81 aa, Ursus maritimus
ALLDSAQRILYRDVMLENCRNLASCPFISDSVTQHKAKNSTRQQDILARKTPDEANRVCAVSHSSRPSPSGEDWKCPRTDE

SEQ ID NO: 26408 - protein, 80 aa, Ursus maritimus
LQRLLTFGDVAIEFSQEEWRCLSHTQRELYRDVMLENYRHLLFLGLIVSKPDLVSLLEQRKEPWDVKRKKTVVFDPGRWE

SEQ ID NO: 26409 - protein, 81 aa, Ursus maritimus
AQGPVLFEDISVDFTQKEWQLLDPAQRLLYKEVMLENYRQLVSLGHCVTKPELVLKLEQGEKPWAPKRELPSQSCPEIQKA

SEQ ID NO: 26410 - protein, 81 aa, Ursus maritimus
AQMPVTFDDVAVTFTQEEWGQLDPAQRTLYREVMLETCGLLVSLGCPLPKPELIYALDHSPELQTLKRGLSLNSCPGDSTK

SEQ ID NO: 26411 - protein, 81 aa, Ursus maritimus
MVPVSLGILFSTPKVIFQLQQGEDPWMVENGVSRGPRVGWERLFETTVSEEENQEVMNKLLGDGPFDFRLGKVYKNEDKLE

SEQ ID NO: 26412 - protein, 81 aa, Ursus maritimus
CVTFEDVFVYFSREEWELLEEAQRLLYRDVMLENFALVASLGCWRVTDNEDTPSEQSVCIGVSQLRTPESGAFIQKAHPCE

SEQ ID NO: 26413 - protein, 81 aa, Macaca nemestrina
FFISFTGQLTFRDVAIEFSQEEWKCLDPAQRTLYRDVMLENYRNLVSLEYYLMWEHRKESWTMESQVQIARKPKGWEWIKG

SEQ ID NO: 26414 - protein, 81 aa, Ursus arctos
GAPEQVTFEDIVVDFTQEEWGQLEPDQRTLYRNVMLETFRLLVSVGCWLPRLDVISLLEQEEWWAADMCLGEGRAPEIRNI

SEQ ID NO: 26415 - protein, 81 aa, Ursus arctos
VTFTDVAVNFTREEWALLDSAQRILYRDVMLENCRNLASVDSVTQHKAKNSTRQQDILARKTPDEANRVCAVSHSSRPSPS

SEQ ID NO: 26416 - protein, 81 aa, Muntiacus reevesi
ECLDLEQRHLYSDVILENYSNLVSLGLCFYHPEVFSLLEKEREPWMALKDETCPDIQSRCQTKKLSPKNGIFDTEVSQWEI

SEQ ID NO: 26417 - protein, 81 aa, Muntiacus reevesi
EVQETLTFDDVAVAFTWEEWQLLAPAQKALYRDVMLENHSNLVSAGFQASTPEVLSKLDQGEPWTMDDEVHCQTRSEVWKF

SEQ ID NO: 26418 - protein, 81 aa, Muntiacus reevesi
DLVTFKDVAVDFSQEEWEWLSPAQRGLYRSMMLENYQSLVSLGLCISKPYVISLLEQGKEPWMMMENEMRSPFPDWESIHE

SEQ ID NO: 26419 - protein, 81 aa, Muntiacus reevesi
AQLTFKDLFIDFTLEEWECLDPAQRTLYKDVMVETLMNLLSVDMSHIHMVKKLHAEANSGKGEIFQRVIFGRTESLEVKGF

SEQ ID NO: 26420 - protein, 81 aa, Ursus americanus
MINNTELLTLEDVAVDFTWEEWQLLGPAQKDLYWDVMLENYSNLVSVGCQATKPDALSKFEHRDELWVTEDEIQNRTHPGE

SEQ ID NO: 26421 - protein, 81 aa, Ursus americanus
TLGSLMFRAVAVDFSQEEWEFLDLKQRNLYRDVMLENYSHLVSLGLSLPKPTLISFLEQDNEPWIVEKKGRCPCATKELSS

SEQ ID NO: 26422 - protein, 81 aa, Ursus americanus
AVDFTQEEWHHVDPAQRRLYRDVMLENYSHLVSLGYQVSKPEVIFKLEQGEEPWISEGEIQRPFCPDWKTRPEAKSSHLQQ

SEQ ID NO: 26423 - protein, 81 aa, Ursus americanus
GSLSFGDVAISFSQEEWECLDPAQRALYRDVMLETYSNLVSVGKSISPNSSSFYRLIKITIKGRLGGSVGEQPVTGSYYVL

SEQ ID NO: 26424 - protein, 81 aa, Ursus americanus
MNFEDVAIDFSQEEWGLLDETQRLLYCDVMLENFALVASLGKIVTLLLELYSGEYRENTGFTGSGPHEWQLISLLSGCRHG

SEQ ID NO: 26425 - protein, 81 aa, Macaca fascicularis
QGPLTFRDVAIEFSQEEWKSLDPVQKALYWDVMLENYRNLVFLGKHNFALEVKICPCAFLCFLSWEPFRHLTETEALLTHR

SEQ ID NO: 26426 - protein, 81 aa, Myotis lucifugus
KGKNMNFEDVAIVFSEEEWGLLDEAQRLLYCNVMLEVFALVSSAGCLHKMDDEEACPEQRVSVRGESQVRASTSEPGTQRT

SEQ ID NO: 26427 - protein, 81 aa, Puma concolor
FQDFVSFKDVAVNFTEEEWRELDPVQRVLYRDVMLENYRNLVSLGFPFSKPDIISQLEQAVNPWMHEGAVHQRIHTGEKPY

SEQ ID NO: 26428 - protein, 81 aa, Sapajus apella
MLENYGNVVSLGFPISKPDGISQLEQDLQVFDLETKTKEVLRDDCSDGETREENKLLIPKQKISEEVHSYKVRVGRLKHDI

SEQ ID NO: 26429 - protein, 81 aa, Sapajus apella
VQESMTFRDVAVFFSQDEWLHLDSAQRALYREVMLENFSTLVSLGIPFSMPKVIHQLQQGQDPCMVEGEVASDTCLGFKAW

SEQ ID NO: 26430 - protein, 81 aa, Sapajus apella
MFQNYENLVSLAGLSITKPYVITLLEDGKEPWMMEKNLSKGVTPDWESRWENKELSTKKDIYDEDSPQTVIIEKVIKQSYE

SEQ ID NO: 26431 - protein, 81 aa, Sapajus apella
AQVSVTFDDVAVTFTKEEWGQLDLAQRTLYQEVMLENCGLLVSLGCPVPRPELIYHLEHGQEPWTRKEDLSQGTHPGDKGK

SEQ ID NO: 26432 - protein, 81 aa, Sapajus apella
MDFSREEWQQLDPAQKRLYQDVMLELYSHLFSVGYQIPNPDVIFRRLKEKEPCMEEAEFSHQRCQEGELQEISKKASFQKD

SEQ ID NO: 26433 - protein, 81 aa, Oryctolagus cuniculus
VLVTFRDVAVTFTREEWRQLDPSQRTLFREVMLETCELLVSLGEPQHQTRKPTTFLSVTSEGGLLRGSLTQGSSRDSKLGQ

SEQ ID NO: 26434 - protein, 81 aa, Oryctolagus cuniculus
PLESVTFEDIVIDFTKEEWALLDTSQRKLYRDVTLENISHLVSLGYQIYKLDVISYLEQEEDLWSQGRRVFQDQSSGSALN

SEQ ID NO: 26435 - protein, 81 aa, Rhinolophus ferrumequinum
MLENYANVASLAFPLPKPVLISQLEKGEAPWGPDPWEAEVLRGVCPGGESWIKNEEPAVKQEASEETELPGVPAGGLLRNV

SEQ ID NO: 26436 - protein, 81 aa, Ursus maritimus
QDLDDAQRTLYRVVMLETYSSLVSLGHCITKPEVIVKLEQGAEPWTVEEAPTQNVQTSGDLIETRQEHQSRHVWQAGVANN

SEQ ID NO: 26437 - protein, 81 aa, Ursus maritimus
EQDEFVPLGDAAMDFTLEDWEHLGLDQGDLFWDTALDNYQNLFLLNPSKPKLTSHPDGTEEPKVLVRESPESAGPDTAEVK

SEQ ID NO: 26438 - protein, 81 aa, Ursus maritimus
AHRSMTFSDVAIDFSQQEWEYLDSVQKNLYRDVMMENYDTLVSLGHSISKPDVITLLEQGKDPWMVVKEDTRRWCTDLESR

SEQ ID NO: 26439 - protein, 81 aa, Rhinopithecus bieti
GPLTFRDVAIEFSQEEWKCLDPVQKALYWDVMLENYRNLVFLGILPKCMTKELPPIGNSNTGEKFQTVMLERHECYDIENF

SEQ ID NO: 26440 - protein, 81 aa, Phyllostomus discolor
AQVSVTFEDVVVTFTREEWGQLDLAQRTLYQEVMLETCMLLVSLGCPLSKPELIYLWEHSLKLQMLKRGLSPSSCPGDSTK

SEQ ID NO: 26441 - protein, 81 aa, Desmodus rotundus
RVTFEDVAVYFSLEEWNLLNEAQRHLYHDVMLENLALITSLGCWHGAQNEEVPSEHRDSLQGVSQVWTPKAGVSPQKAHPC

SEQ ID NO: 26442 - protein, 81 aa, Desmodus rotundus
GLLTFRDVSVDFSQEEWECLDPGQQELYSDVMLENYRNLVSLGLVVSKPDLITFLEQIKERWDMQRKKSISTHPAVSSEDN

SEQ ID NO: 26443 - protein, 81 aa, Desmodus rotundus
FQGSVTFRDVAIDFSQEEWEWLQPAQRNLYRRVMLENYGHLVSLAGLNMSKPDVVSLLEQGKEPWLGKDVRTDFFSVSGSN

SEQ ID NO: 26444 - protein, 81 aa, Macaca fascicularis
EMGLLTFRDIAIEFSLAEWQCLDRAQQNLYRDVMLENYRNLVSLGIADSKPDLITCLEQNKESWNIKRNEMVAKQPVTCSH

SEQ ID NO: 26445 - protein, 81 aa, Phascolarctos cinereus
GKESVTFKDVAVEFTQEEWVQLNPSQKKLYRDVMLENYRNLVSLGFAASKPNESDQLERKEVSSLPEADISRISCPESQEF

SEQ ID NO: 26446 - protein, 81 aa, Phascolarctos cinereus
HQESVTFKDVAVDFTWEEWGRLRPAQKQLYRDVMLENYRNLVWLGLAVSKPAVIGHLERGEVVWVSEGEGPRSTCADWDSR

SEQ ID NO: 26447 - protein, 81 aa, Phascolarctos cinereus
AQELVTFQDVAVDFTQEEWGLLDHPQKELYKEVMLENAQNLVSLGVPVPREDLISYFEEKEAPWLLEHEGLRSCYPEGEIR

SEQ ID NO: 26448 - protein, 81 aa, Phascolarctos cinereus
AQELLTFKDVSVDFTQEEWGLLDHPQKELYKEVMLENAKNLLSLGLAVSTEDLISYFEEEEAPWLLEHEGLRSCYPEGEIR

SEQ ID NO: 26449 - protein, 81 aa, Phascolarctos cinereus
WEESVTFKDVAVDFTQEEWDHLDPSQKELYRDVMQENYTNLVCLGLAVSKPDVIYQLEQGGVPWRAEEEVLRWSCPVLATK

SEQ ID NO: 26450 - protein, 81 aa, Phascolarctos cinereus
SQEVVTFKDVAVDFSPEEWGLLDCSQKELYKDVMVENAQNLLSLGLPVPREYLISHFEQEGLRNSCSDSETRFDVKESTAK

SEQ ID NO: 26451 - protein, 81 aa, Phascolarctos cinereus
SQESVTFQDVAVDFTPEEWGRLGPAQKELYQEVMLENYRNLVCLGLSVSKPALISRLERGEAPWRPEGGGHGAGCADRGMR

SEQ ID NO: 26452 - protein, 81 aa, Phascolarctos cinereus
YQTILTFQDVAVDFTQEEWGLLEPAQKDLFRDVMLENYENFVSLGLPVSKTDVLSQLEKREALRLPEREIPRSPYLEFLQK

SEQ ID NO: 26453 - protein, 81 aa, Phascolarctos cinereus
IQELVTFKDVAVDFTQEEWGLLNNPQKELYKEVMLENAQNMLSLGLPVPREDLFSYFEEREAPWLLEQEGLRSCCAEREIR

SEQ ID NO: 26454 - protein, 81 aa, Puma concolor
MLENYSHLVSLGYQDTKPDIIFKLEQGEELWMLQAQIPSRGRPEKVLEIDDHMDWHQENQGKLESMAKNYECTAFGKLCLL

SEQ ID NO: 26455 - protein, 81 aa, Puma concolor
ISFEDVAVDFTLEEWRLLNPTQKNLYRDVMLENYSNLVFLEVWLDNSLKMWHQDNQDELRSMERGDECDVFRKIFHSSINF

SEQ ID NO: 26456 - protein, 81 aa, Puma concolor
MAIDFTQGEWNYLGAAQKDLSRDVMLENYHNLVSVGLSRSKPDVISLLEQEKQPWIVTGHDRRTLPRECGKAFIQLSSLIR

SEQ ID NO: 26457 - protein, 81 aa, Sapajus apella
CGASVLFEDVTMDFSREEWQQLDPAQKRLYQDVMLELYSHLFSVGYQIPNPDVIFRRLKEKEPCMEEAEFSHQRCQEGELQ

SEQ ID NO: 26458 - protein, 81 aa, Oryctolagus cuniculus
DRVMTAFEDLAVYFTWDEWQKMNNAQKILYRDVMLETYSSLFSLGHCITKPDLIFKLERGEEPWMVDECLNQSLSGQSAHN

SEQ ID NO: 26459 - protein, 81 aa, Oryctolagus cuniculus
LLDTAQRALYRAVMLENFRNLLSVGFQLSLCEAVVRHRFFHVPGCSRSQCAASALRVHQRAHRGERRCKCAECGKEFSQSC

SEQ ID NO: 26460 - protein, 81 aa, Oryctolagus cuniculus
LQMMLTFEDLAIYFTWEEWQNMNKAQKILYRDVMLETYNSLLFLGHCITKPDLIFKLEQGGEPWMVNKCLNQSLPVAMKSD

SEQ ID NO: 26461 - protein, 81 aa, Oryctolagus cuniculus
METVPLQNLAVYFSWEEWQHMNKAQKILYRDVMLETYSSLFSLGHCITKPDLIFKLEQGEEPWMVDECLHQSLSGIQKNQS

SEQ ID NO: 26462 - protein, 81 aa, Rhinopithecus bieti
MLENYRNLFSLGLAMSKPELIICLEARKEPWNVNTEKTAKHSALSSYLTEDILPEQGLQIAFQKVMLRRYERCCLEKLRLR

SEQ ID NO: 26463 - protein, 81 aa, Rhinopithecus bieti
TVTFEDVAVKFTWEEWNLLSEAQRCLYRDVMLENLALISSLGKLLIETPSQKAPSKQSIYIQRETQVRIPMAGVSPKKADP

SEQ ID NO: 26464 - protein, 81 aa, Rhinopithecus bieti
RHGLLTFRDVAIEFSQEEWKCLDPAQRTLYRDVMLENYRNLVSLDISSKCMLKTLSSTGEGNTEVILTRTLQRQANHHTGD

SEQ ID NO: 26465 - protein, 81 aa, Puma concolor
ERMGSVSFKDVMIDFSREEWQRLDLAQKSLYRDVMLENYFNLISVGCQVPKPEVIFNLEQEEPCVLDGDISSHNCLNGDIG

SEQ ID NO: 26466 - protein, 81 aa, Sapajus apella
EMTKFQKAVTFKDVAVVFSSEELRLLDLTQRTLYRDVMVENFKNLVAVDMVSQLEAEEKLWMMEAETQRSSKHQNKMETLQ

SEQ ID NO: 26467 - protein, 81 aa, Sapajus apella
EKETLTFRDVAIEFSLEEWQCLNPAQQNLYRNVMLENYRNLVFLDIAVSKQSPITGLEQKKESCNMKRHEMVARPTAMCSY

SEQ ID NO: 26468 - protein, 81 aa, Oryctolagus cuniculus
SQGTVTFKDVAIDFTQEEWKQLDPTQRNLYRNVMLENYNNLITVGYPFTKPDVIFKLEQEEEPWVAEEEALRRHCPGDIWG

SEQ ID NO: 26469 - protein, 81 aa, Oryctolagus cuniculus
MTHAQKILYREVMLEIYSSLLSLGFCVTKPELIFKLEQGGEPWILEEDLNQSLPVTMRRDCLIMNNQENKGKNLNQDVIKY

SEQ ID NO: 26470 - protein, 81 aa, Oryctolagus cuniculus
MFASLTGGSIRHLWDSGSCAVLSQCASAVSRSILFTGCCITKPDVIFKLEQGEEPWTLDAGFAGWAYSKVQKLNDLIKRSQ

SEQ ID NO: 26471 - protein, 81 aa, Oryctolagus cuniculus
VLQVLSFEDLAVDFTQEEWQELNSAQRTLYRDVMLEVYSSLLSLGYCITKPDLIFWLEQGEELWLKASGTNVHGPSFSCWE

SEQ ID NO: 26472 - protein, 81 aa, Oryctolagus cuniculus
KPGAVRFADVAVYFSSEEWGCLRPAQRALYRDVMRENYGHLGALGQVPNKKEEEEEPQEAAGVKGPANAPEDLVTHSPDPP

SEQ ID NO: 26473 - protein, 81 aa, Pteropus alecto
FQGSVSFTDVTVDFTQEEWEQLDPSQRILYMDVMLENYSNLLSVAKGLTKYFVCFFLEVWKADDQMEREHRSPDEQARPFI

SEQ ID NO: 26474 - protein, 81 aa, Rhinolophus ferrumequinum
FQGRLTFRDVSIDFSQEEWECLHPADRKLYMDVMLENYRNLCSLDLAVSTPDVVIFLERMKEAWDVKRKKTVSIHPGSTCN

SEQ ID NO: 26475 - protein, 81 aa, Rhinolophus ferrumequinum
AQESLTFDDVAVHFTWEEWQLLVPEQKDLYRDVMLENYSHLVSVGYQVSKPDVFCKLERGECTIDKIHSQNCPEIRKVNDP

SEQ ID NO: 26476 - protein, 81 aa, Rhinolophus ferrumequinum
VKESVTFKDVAVDFTLEEWRLMDPPQRDLHKDVMLENYRNLVSLGLAVSKPDMIAHLEDGKGPWVVVREISRIPYPELETK

SEQ ID NO: 26477 - protein, 81 aa, Rhinolophus ferrumequinum
DLGSVTFKDVAVEFTQEKWVRLDAAQRSAYRDVMLENYMNLTTVELQLCKPPVLSLLGEEEMIPSDRSNLLLQRDMGGNSV

SEQ ID NO: 26478 - protein, 81 aa, Ursus maritimus
SQELLTFKDISVDFTQEEWGHLAPAHRNLYREVMLENYGNLVSVAGYQLSKPSVISQLEKGQEPWMTEKEGPGDPRSDLKN

SEQ ID NO: 26479 - protein, 81 aa, Ursus maritimus
SGLLTFGDVAIEFSQEEWRCLSHTQRELYRDVMLENYGHLLFLATSSHDIQSFMPKPSIEASFQKVSMGRHKSSDVEDLHL

SEQ ID NO: 26480 - protein, 81 aa, Ursus maritimus
IKQDLSLQESLTLEDVAVGFTWEEWQLLAPTQKELYQDVMLENYRNLVSVGEDKWEVTSRKPVWIEQSAQKGKLLEMKLME

SEQ ID NO: 26481 - protein, 81 aa, Rhinopithecus bieti
SQHLVTFEDVAVDFTQEEWTLLDQTQRDLYRDVMLENYKNLIILAGSEICKPSLMSGLEQMEELRTGVTGVLQEILCSSFI

SEQ ID NO: 26482 - protein, 81 aa, Panthera pardus
PQDLMTFKDVAVEFTQWEWGQLDPAQKDLYREVMLENFKNLASLGLPVSKPHVICQLEEGEEPCVVEGEISTGEGSYKSDT

SEQ ID NO: 26483 - protein, 81 aa, Panthera pardus
SVTYKDVAVDFTQEEWALMDTSQRTLYRDVTLENISHLVSVGMKNSHNKQEIIPMQDICMNDPPNCWTVQKCHTGEDLSVY

SEQ ID NO: 26484 - protein, 81 aa, Panthera pardus
MAEGFKFKDVAIYFSQKEWECLHPSQKGLYRDVMLENYSNLISLDWESRGETNNLFPKTDSYEIKSLQLKIKRVESSHLEC

SEQ ID NO: 26485 - protein, 81 aa, Panthera pardus
EMDSVAFEDVTVKFTMEEWALLDPSQKKLYRDVMQETFRNLASIVCISEEKWEVYDSEDRDENHGTHLISQMVGRLCKCKE

SEQ ID NO: 26486 - protein, 81 aa, Rhinolophus ferrumequinum
FQGLVSFKDVAVDFTQEEWQHLDPAQRTLYRDVMLENYSHLVSVGHPLSKPDVISKLEQGEDPWIIKRDMSNWIYPGENQA

SEQ ID NO: 26487 - protein, 81 aa, Panthera pardus
LLTFRDVAIEFSQDEWGCLNQSQRELYRDVMLETCGHLLFLAISSHGTQNLLPKPCIETSSQNVSLGTGKHHTFENLHLMI

SEQ ID NO: 26488 - protein, 81 aa, Panthera pardus
SVALEDVAVNFTLEEWALLNPSQKKLYRDVMQETFRNLASVGDKWEDRNSKSLYEHETNRRRVVEGPCQSKEGSQRGDPRR

SEQ ID NO: 26489 - protein, 81 aa, Panthera pardus
LLEAVTFKDVAVVFTEEELGLLDPTQRKLYREVMLENFGNLVSVGDKIQHKMETIPKVEPHEELSCWQIRQHIADDLTWCH

SEQ ID NO: 26490 - protein, 81 aa, Macaca nemestrina
SLVTFEDVAVYFSQEEWELLDAAQRHLYHSVMLENLELVTSLGNTLSQHVLLCSSVGTDLSNYFPNWLHHFTSLSGVYKCS

SEQ ID NO: 26491 - protein, 81 aa, Ursus arctos
LLRLLLRMCSTSQAPLDVPACCGRRSGTSRVLEGYMLLWELVRPEWEGCCIPKPEVILKLEQGEQPWILEEESPSQSYPEV

SEQ ID NO: 26492 - protein, 81 aa, Ursus arctos
KSQGFVSFKDVTVDFTWEEWRQLDSAQRNLYRDVMLENYSNLVSVGCQSLKSDVILLKQGEPWMKEEEISSWAYSDFGIRP

SEQ ID NO: 26493 - protein, 81 aa, Ursus arctos
AQASVSFKDVTVEFTREEWRQMDSAQRTLYRDVMLENYSHLVSVGYCFTKPELIFTLEQGEDPWLLKKEFLRKSSPEDSQP

SEQ ID NO: 26494 - protein, 81 aa, Muntiacus reevesi
QLTFKDVFIDFSPEEWECLDPAQRTLYKDVMVETLMNLLSVEMSHKHMIKKLHAKASSGKGEIFQRVMFGRAESLDIKDFR

SEQ ID NO: 26495 - protein, 81 aa, Muntiacus reevesi
RMKSVTFEDVAVYFTQTEWDSLSIAQRALYRDVMLENYGNVASLGFPLLKPAVISQLEGGGELEGPSPLASGAGTGPQGLW

SEQ ID NO: 26496 - protein, 81 aa, Ursus americanus
HILKSRFSSGFSGFCDSPIEEPHGLLISSCNSRTMTDGLVTFRDVAIDFSQEEWECLDPAQRDLYVDVMLENYSNLVSLGK

SEQ ID NO: 26497 - protein, 81 aa, Ursus americanus
GLLDPAQRKLYGDVMLENFRNLISVGEDRRPVDLRDKNLNDLETLQEIGLKYLPHEELFCSQIWQQVTKELTQCQDSMVSI

SEQ ID NO: 26498 - protein, 81 aa, Sapajus apella
ALRSVMFSDISIDFSPEEWDCLDLEQKDLYRDVMLENYSNLVSLGCFISKPDVISLLEQGKEPWKVVRKRRGQCPDLQTKY

SEQ ID NO: 26499 - protein, 81 aa, Oryctolagus cuniculus
SQEQVSFKDVCVDFTQEEWYLLDPAQRVLYRDVILENYSNLVSVGYCFTKPEVVFKIEQGEEPWILEKGFSSQSHSERKWG

SEQ ID NO: 26500 - protein, 81 aa, Oryctolagus cuniculus
NQCPYGMPVLQAAALPNTPQSGRFISKPDVISLLEQGKEPWKVVRKGRRCYPELETRCETKKLSSESNIYEISLSHFKIME

SEQ ID NO: 26501 - protein, 81 aa, Rhinolophus ferrumequinum
DEALMAFRDVAVAFTWKEWKLLSPAQRILYRDVMLENYSHLVSLGIAFSKPKPITQLEQGDEPWREESECLLDLCVEPRKE

SEQ ID NO: 26502 - protein, 81 aa, Rhinolophus ferrumequinum
YRELVTFRDVAVDFSQEEWDCLNSSQRHLYSNVMLENYRILVSLGLCFSKPSVILLLEQGKEPWMVKRELAKDLCSGWESM

SEQ ID NO: 26503 - protein, 81 aa, Rhinolophus ferrumequinum
DHELVTFRDVIINFSQDEWEYLNSAQRDLYWDVMMENYSNLVSLGCFISKPDVISLLEQGKEPWKVVRKERRRYPDLETRH

SEQ ID NO: 26504 - protein, 81 aa, Rhinolophus ferrumequinum
MLEIYSHLVSVGYCITKPQVIFKLQQGEEPWSLEKEFLNQKYPGYYEVDVHIERNQEKEEKPLWQVIFSDKKTLSKEGQKV

SEQ ID NO: 26505 - protein, 81 aa, Ursus maritimus
LGFTSEEWGLLDLEQKSLYREMMLENYRNLVSVEHQLSKPDVVSQLEEEEALWSVERGIPQDTFSEYPTAQLDPQLDPFPA

SEQ ID NO: 26506 - protein, 81 aa, Ursus maritimus
FQELIAFQDVVVDFSQEEWEQLSPGQKALYWDVMLEDYRNLVSLGKGSFRHGWIQELKCYFLKGLWNMNFIKACKEDSLPE

SEQ ID NO: 26507 - protein, 81 aa, Ursus maritimus
SSQGLLTFGDVAIEFSQEEWRCLSHTQRELYRDVMLENYGHLLFLDFILLKPDLIMFLEQEKQLWDVKRKETVAFHPGRWD

SEQ ID NO: 26508 - protein, 81 aa, Ursus maritimus
SQEPVTFEDVAVYFTQNQWASLDPTQRALYREVMLENYANITSLAFPFPKPDLILQLERGEARWGLDPWIAIEGEALGGVH

SEQ ID NO: 26509 - protein, 81 aa, Ursus maritimus
MLENYSNLVSLGFSISKADVLSLLKQGKAPWKVVQDVTRSQSSDWESKCETKKLSSKRGIYEIESSQWEIIEQLTRHKCEC

SEQ ID NO: 26510 - protein, 81 aa, Ursus maritimus
SVTFEEVAVDFSQEESASLDPAQKILYRDLMLENYRNLRQPHIVIDQKFQLKIKRPLQSRIKSGKNTYCQENDQTFLPRKE

SEQ ID NO: 26511 - protein, 81 aa, Rhinopithecus bieti
PQGRLTFRDVAIEFSLAEWKCLNPAQRALYREVMLENYRNLESVDSSFKTMMEYSSTGQGNTEVFHTEMLERHESHHFGDF

SEQ ID NO: 26512 - protein, 81 aa, Myotis brandtii
MDFEDVAITFSQEEWGLLDEAQRLLYCDVMLEIFALAASLGCWHNLEDKEAPSTQSVSVEGELQVRASETAPAARRTHPCR

SEQ ID NO: 26513 - protein, 81 aa, Myotis brandtii
AVVGQLTFSDVAIEFSQEEWACLDPAQRKLYMDVMLQNYRNLVFLGVSKPVLLTFLKHMKEPWELKGKKTIPIQPAITSQV

SEQ ID NO: 26514 - protein, 81 aa, Myotis brandtii
VTFEDIALYFSREEWSLLDEGQRQLYLNVMLENFELLSSQGCCCGAENVEALTEQNISVRVSQARNPKDFTVEKGLMSAVN

SEQ ID NO: 26515 - protein, 81 aa, Propithecus coquereli
SVTFKDVAVVFTREELGLLDPAQRKLYRDVMVENFKNLVAVGSKNQNKMETFQKFAFKYLSHEELSCWQIWKQVASELSRC

SEQ ID NO: 26516 - protein, 81 aa, Gorilla gorilla
QVTFSDVAIDFSHEEDLYKDVMVQNYENLVSVGLSVTKPYVITLLEDGKEPWMMEKKLFLFSYTVLSIMYILPISVITPAS

SEQ ID NO: 26517 - protein, 81 aa, Ailuropoda melanoleuca
GYQAPKPDMISKLQKGEEPWLGKGKRPKQDGPRELARPKQIGTNRNEVQQGNDQLGNDQESQNKLLKEVTFKKKSLTKKKD

SEQ ID NO: 26518 - protein, 81 aa, Lynx canadensis
PCRLVLFKDVAIDFSQEEWECLDLEQKDLYRDVMLENYNNLVSLGFSISKTDVLSLLKQGKEPWKVVQDVTRSQSSAWESR

SEQ ID NO: 26519 - protein, 81 aa, Lynx canadensis
FQELVTFRDVAIDFSRQEWEYLDSVQRDLYRDVMLENYRNLVSLGHSISKPDVVDLLEQGKEPWMILREETQRQYTDLDLH

SEQ ID NO: 26520 - protein, 81 aa, Phyllostomus discolor
MDSVAFEDVAVSFSLEEWALLDPSQKKLYRDVMQETFWNLTSIGGKWEDHDIEDQYKHQGGKQRSDMVERICEGKEGSQQG

SEQ ID NO: 26521 - protein, 81 aa, Phyllostomus discolor
AQGLLTFKDVSIDFSQEEWECLGPAQRKLYMDVILENYRNLVSLGLVDSKPYLVTFLEQMKECWDMQRKKLISAHPALTSE

SEQ ID NO: 26522 - protein, 81 aa, Phyllostomus discolor
ARVGVTLEDVAIYFSLDEWHLLNEAQRCLYLDVMLENFELISSLGCCCGAEDMEASIEQNVSVRVSQVKNPKVSLSSQKCH

SEQ ID NO: 26523 - protein, 81 aa, Phyllostomus discolor
AQDRVTLEDVTVYFSRTEWRLLDETQRRLYLDVMLENFALISSLGCCCGAEDVEAPTEQNLSTQASQEKNLKIALPSQKSH

SEQ ID NO: 26524 - protein, 81 aa, Desmodus rotundus
SVTFRDVIVDFTQEEWQQLKPAQKDLYRDVMMEVYWNLVSLDVETRPDAKESDPQEDDWEDRPSVVVIAEGPTRNGARSYT

SEQ ID NO: 26525 - protein, 81 aa, Myotis lucifugus
FSDDMNFEDVAIAFSQEEWGLLDEAQRLLYCDVMLEVFALVSSVGCYHKTDDAEDCSEQSVSVQGESQDRASKTAPETQRI

SEQ ID NO: 26526 - protein, 81 aa, Myotis lucifugus
TARSQASVTFKDVAMDLTPEEWGKLDPAQTDVMLENYRNLVSLWLPVSKPENYNLENGKETLMLERKVPRSSYSDSESRPE

SEQ ID NO: 26527 - protein, 81 aa, Myotis lucifugus
ESVTFKDVAVLFTQDEWAQLSPAQRALYRDVMLENYSHLVSLDWMTIPVSKKSTLKADIPEEELDQWMIKERLTSNSHWKY

SEQ ID NO: 26528 - protein, 81 aa, Puma concolor
APEQVTFEDVVVDFTQEEWGQLEPAQRTLYRDVMLETFRLLVSVGGPLMPDPGLHAEQKTHAKAKPYECQACGKAFGHSSA

SEQ ID NO: 26529 - protein, 81 aa, Puma concolor
SYGSLSFEDVTVGFSQEEWQHLDPAQRTLYRDVMLENYSHLVAVGCCVPKPDVIFRLEQGQQPWLIEEESLDQSCPEVCRV

SEQ ID NO: 26530 - protein, 81 aa, Sapajus apella
VQESVTFRDVAVFFSPDEWLHLDCAQRALYREVMLENYSSLVSLGILFSKPKVISHLEQGEDPWMVESGVPQGIHLGWESL

SEQ ID NO: 26531 - protein, 81 aa, Sapajus apella
PQELLTFRDVAIEFSPEEWTYLDPAQQNLYRDVMLENYRNLVSLGVAICNPDLVTCLEQRKEPCNVKIRKTVAHPPAVCSH

SEQ ID NO: 26532 - protein, 81 aa, Sapajus apella
AHDRVVFEDVAIYFSQEEWGHLDEAQRLLYRDVMLENLALLSSLGCWHGAEDEVAPSQQGFSAGVSEVTTSNSCMITQKIH

SEQ ID NO: 26533 - protein, 81 aa, Sapajus apella
MDVAIEFSLEEWQCLDTAQQNLYMDVMLENYRNLAFLGIAASKPDLITCLEQGKEPWNVTRHELVAEPPVVGSLFAQDLGP

SEQ ID NO: 26534 - protein, 81 aa, Sapajus apella
LQGLVTFEDVAMEFTQEEWALLAPAQRMLYRNVMLENCRNLASSLGNQVDKPSLISHLEQEDKLMTEERGIVPGTRPDVET

SEQ ID NO: 26535 - protein, 81 aa, Sapajus apella
VSFGDVAVYFSREEWGCLQPAQRALYRDVMRETYSHLGALDSRNKEEKRPREGVGALEKPLPVATGPLGLKAPQALSAGPP

SEQ ID NO: 26536 - protein, 81 aa, Oryctolagus cuniculus
FGMMIAFEDLAVYFTWEEWQNMNQAQKILYRDVMLETYSSLFSLGHCMTKPDLILKLEQGAEPWMGEECLHHSLPVAMKRD

SEQ ID NO: 26537 - protein, 81 aa, Oryctolagus cuniculus
MTAFEDLAVYFTWEEWQKMNNAQKILYRDVMLETYSSLFSLGHCITKPDLIFKLERGEEPWMVDECLNRSLSGQSAHKRQG

SEQ ID NO: 26538 - protein, 81 aa, Oryctolagus cuniculus
MTAFEDLAVYFTWEEWQKMNNAQKILYRDVMLETYSSLFSLVVMKRDDLIRINQESQDKNLNQDFMKNNKTSALKRIELRR

SEQ ID NO: 26539 - protein, 81 aa, Ursus maritimus
SHGPLSFEDVAIAFTKEEWQQLDPAQRTLYRDVMLENFSHLVSLGHPVSKPDVISKLEQGEEPWIYPERETRLENPQLDIL

SEQ ID NO: 26540 - protein, 81 aa, Ursus maritimus
SQHLVTFEDVAVNFTWEEWTLLDQTQRDLYRDVMLENYQNLIILGYESCGPDLNSPVGGAEELRTGGRGILQELDLQLKTK

SEQ ID NO: 26541 - protein, 81 aa, Ursus maritimus
VTFEDVAVYFSWKEWKFLDEAQRRLYHHVMLENFTLISSLGCCCGAEGEEAPFAQSTSVGASQAGTPTAPVSSRKTHPCEL

SEQ ID NO: 26542 - protein, 81 aa, Ursus maritimus
MPHPKVVKTLPSEISTFFQERPAKYEEVLWCCIPKPEVILKLEQGEQPWILEEESPSQSYPEVCKVDNQLEQNQEAQDRHF

SEQ ID NO: 26543 - protein, 81 aa, Ursus maritimus
AQESLTLEDVAVGFTWEEWQLLAPTQKELYQDVMLENYRNLVSVGYQASQPDVLSELEQGEPPWILEDEDEVQSQTHPQIQ

SEQ ID NO: 26544 - protein, 81 aa, Rhinopithecus bieti
EMGLLTFRDIAIEFSLAEWQCLDHAQRNLYRDVMLENYRNLVSLGIAVSKPDLITCLEQNKEPRNIKRNEMVSKHPVTCSH

SEQ ID NO: 26545 - protein, 81 aa, Rhinopithecus bieti
QQGYVTFEDVAVYFSQEEWRLLDETQRLLYRNVMLENFSLLASLGLASSKTHDITQLESWKEPFMPAWGVVTSAIPRVWLC

SEQ ID NO: 26546 - protein, 81 aa, Rhinopithecus bieti
RPESVTFEDVAVYFSENEWIGLGPAQRALYRDVMLENYGAVASLAFPFPKPALISQLERGEALDGVPVPWGALDGEDPRGI

SEQ ID NO: 26547 - protein, 81 aa, Rhinopithecus bieti
LGLDSARPWEGKPRYLGPVTFEDVAVLFTEAEWKRLNLEQRNLFEEVMLENLRNLVSLGEDILGSLRSGLLHLDVNLDLWL

SEQ ID NO: 26548 - protein, 81 aa, Oryctolagus cuniculus
SEVMIAFEDLAVYFTWEEWQNMNKAQKILYRDVMLEIYSSLFSLGHCITKPDLIFKLEQGAEPWMVEECLNQSLPVAMKSD

SEQ ID NO: 26549 - protein, 81 aa, Pteropus alecto
SVMFRDVAVDFSQEEWECLDPAQRDLYREVMLENYSNLVSMGLYIPKPQVISLLEQGQEPWMVGRELTRGLCSDLESMCET

SEQ ID NO: 26550 - protein, 81 aa, Rhinolophus ferrumequinum
IGEQLVTFKDVAVVFTEEELGLLDSAQRKLYQDVMMENFRNLLSVGHQPFKQGTVHLVRGEKFWMIKVATQIKGNSGGKIQ

SEQ ID NO: 26551 - protein, 81 aa, Rhinolophus ferrumequinum
AQGSVSFEDVTVEFTQEEWPYLGPAQRAVYRDVMLENYSHLVSVEYYKVDVHVTENQEKQEKALWQVIISNNKTLSKEGQK

SEQ ID NO: 26552 - protein, 81 aa, Rhinolophus ferrumequinum
FQESVTFKDVIVDFTQEEWRQLDPVQRDLFRDVTLENYTHLVSIGLQVSKPDVISHLEQGTEPWTVEPGIPVGGVADWETS

SEQ ID NO: 26553 - protein, 81 aa, Ursus maritimus
ECLSHTQRELYRDVILENYGHLLFLGVIVSKPDLVSLLEQRKEPWGEKRNKTVLFDPGSLSFLPEPCKEASFQNVSVGRYK

SEQ ID NO: 26554 - protein, 81 aa, Ursus maritimus
LLGSLSFEDVAVDFTWEEWQLLDSAQKTLYRSVTLENLSSLVSLGFQLIRPDVISRLEQEQPRVVGEDIPGQSFSEYWKVD

SEQ ID NO: 26555 - protein, 81 aa, Rhinopithecus bieti
LYEAVTFKDVAVVFTEEELGLLDPAQKKLYRDVMLENFRNLLSVGKSQTEMETVPEAGTHEEFSCKQIWEQIASDLTRSQD

SEQ ID NO: 26556 - protein, 81 aa, Rhinopithecus bieti
EQGLVTFEDVAVDFTQEEWQYLNSPQRTLYRDVMLETYSNLVFVGQQVTKPNLILSWSRRMPAEGKIPFGTFLVKVCQVGE

SEQ ID NO: 26557 - protein, 81 aa, Ursus arctos
MDFSREEWQQLDPAQRRLYQDVMGEVYSHLLSLGYHIPNPEIISRMEKGEKLWLREAQLPHQRHGEGVFGLKTSQQKMFEK

SEQ ID NO: 26558 - protein, 81 aa, Ursus arctos
AQDSVTFEDVAVYFSWEEWGLLDEAQRHLYHDVMLENFALVTALGYWHGAEDGKSPSKQAASVGVSQVRTHHAGPYPQKAH

SEQ ID NO: 26559 - protein, 81 aa, Ursus arctos
ARVLVTFKDVAVTFTQEEWGQLDLDQRALYQEVMLETCGLLVSLGHPVPKPELTHLLEHGQELWTGKRGLSRSMCSGDNVK

SEQ ID NO: 26560 - protein, 81 aa, Muntiacus reevesi
ELVTFRDVVISFSQEEWEYLDSAQRDLYWDVMMENYCNLVSLDLESKYDTKTLSVEKGILEKNNSQWEVIENSKLVGLQNS

SEQ ID NO: 26561 - protein, 81 aa, Muntiacus reevesi
MGLLTFQDVTVDFTQEEWECLDLGQRELYRDVMLENYGNLACLGLVVSKPDLVTFLEQMKDPWDVRGMETAIHPVINFHIY

SEQ ID NO: 26562 - protein, 81 aa, Muntiacus reevesi
QAGSDLFRDVAIVFSQEEWEQLAPTQRDLYRDVMLETYSNLVSLGLAVSKPDVIAFLEQGREPWTVEGVATGGLCPVLKSR

SEQ ID NO: 26563 - protein, 81 aa, Muntiacus reevesi
AQETLTFDDVAVAFTWEEWQLLAPAQKVLYRDVMLENHSNLVSVGFQASTPEVLSKLDQGEPWTMMDDEVHCRTRSEVWKV

SEQ ID NO: 26564 - protein, 81 aa, Muntiacus reevesi
KQLTFKDVAIEFTQEEWECLDPVQRALYRGVMWETYRNLVSVQCCKEQYCIGTWNVRTMNQGKLEAVKQEMARVVRIHKRT

SEQ ID NO: 26565 - protein, 81 aa, Muntiacus reevesi
ALISFEDVAITFTGEEWRHLDLAQRTLYQEVMLETCSLLVSLGHPVPKAELIHLLEYGPGLWTVKRGLSRNTCTGEKANPK

SEQ ID NO: 26566 - protein, 81 aa, Myotis brandtii
VTFEDVAVYFSGTEWQLLDEAQRCLYLDVMLENFALISSLGCCCGTRDLEASLEQNMSVRVSQAKKTKVPLSSQNSHPCES

SEQ ID NO: 26567 - protein, 81 aa, Oryctolagus cuniculus
MVGELNFKDVAIYFSQKEWERLHCAQKDLYRDVMLENYSNLIFVGFYDAKPSVISLLEQGKEPWMVQRKDTKEWRPDQASK

SEQ ID NO: 26568 - protein, 81 aa, Oryctolagus cuniculus
TETQISFDDVAVDFTLEEWLLLNPTQKNLYRDVMLENCSNLVFLAGYQMMTPDVIFKLKHDEPWIIDEEILSQNFSEVWLD

SEQ ID NO: 26569 - protein, 81 aa, Rhinolophus ferrumequinum
SQEQVSFQDVCVDFTQEEWYLLDPAQKILHRDVMLENYNHLVTIGHCITKPDVIIKIEQGEEPWILEQGFPSQCRLEDWKV

SEQ ID NO: 26570 - protein, 81 aa, Rhinolophus ferrumequinum
AQVPLTFSDVAIDFSQEEWECLNSDQRDLYRDVMLENYTNLVSLDFDFTTETNKLSSEKSNYEVNSYHWETTKRSKTLNLM

SEQ ID NO: 26571 - protein, 81 aa, Ursus maritimus
LGLLDPAQRKLYRDVMLENFRNLLSVGEGNVWVMDTYLDWRCKKLDRQDIVYKHEGDSYGFSWISRCHDAHRLPERETPCN

SEQ ID NO: 26572 - protein, 81 aa, Ursus maritimus
WQGLVVFTDVAIHFSQEEWGLLDEAQRSLYHSVMLENLALLSSLGKALPPPPVSGAGHQVSPFPGGSSVVSTHLSHYFPSG

SEQ ID NO: 26573 - protein, 81 aa, Rhinopithecus bieti
FQESVTFQDVAVDFTAEEWQLLDCTERTLYWDVMLENYRNLISVAGCPINKTKVILKVEQGQEPWMVEGVNPHQSSPESDC

SEQ ID NO: 26574 - protein, 81 aa, Rhinopithecus bieti
AQESLTLEDVAVDFTWEEWQFLSPAQKDLYRDVMLENYSNLVAVGYQASKPDVFFKLEQGEPPWTTEDGIHSGACSEIWKV

SEQ ID NO: 26575 - protein, 81 aa, Rhinopithecus bieti
AATLRLSAQGTVTFEDVAVKFTWEEWNLLSEAQRCLYRDVMLENLALISSLDPVLDGSADNTQTGNLGQSVLPSHPEQKTA

SEQ ID NO: 26576 - protein, 81 aa, Rhinopithecus bieti
PQASVCFEDVAMAFTQEEWEQLDLAQRTLYREVTLETWEHIVSLGLFLSKSDVISQLEQEEDLCRAEQVVPRGTSGLSQVT

SEQ ID NO: 26577 - protein, 81 aa, Macaca nemestrina
QEPVTFEDVAVYFTQNEWASLHPMQRALYREVMLENYANLPVFLSPLHAFPSPNQDLICHIPDPWTLAGGRGEQESLPSSF

SEQ ID NO: 26578 - protein, 81 aa, Macaca nemestrina
TCDEAVTFKDVAVVFTEEELELLDPAQRKLYRDVMLENFRNLLSVGHQLSYQDTFHFQREEKFWIMETATQKEGNSGGKIQ

SEQ ID NO: 26579 - protein, 81 aa, Ursus arctos
SPGFVSFADVAVYFSPEEWGCLRPAQKALYRDVMRETYGLLDALGFSGPKPAFIFWVEGEVEAWSPESQDPEGESPAAVIR

SEQ ID NO: 26580 - protein, 81 aa, Ursus arctos
SGTSRVLEGYMLLWELVRPEWEALPSEISTFFQERPAKYEEVLWCCIPKPEVILKLEQGEQPWILEEESPSQSYPEVCKVD

SEQ ID NO: 26581 - protein, 81 aa, Muntiacus reevesi
AAFQEIATLKDVAMDFTLENWEQLGQGQGDLFWDTALDNYQNLFLLSEPNLTFHPDGGEKLEALVKESPESTDADIAETSP

SEQ ID NO: 26582 - protein, 81 aa, Muntiacus reevesi
QACVTFEDVAVYFSQEEWRLLNETQRFLYCDVMLENFALTTSLGEAFIFLPEDEVIPSEQSLSVGESQVRPSQSGPSTQKI

SEQ ID NO: 26583 - protein, 81 aa, Muntiacus reevesi
MALERLTSEDVAIEFTQEEWEFLDPAQRALYRDVMLETYRNLLSVGEDDLLPELPLGICIFPVCPLGGPDVFHLRVLVTRA

SEQ ID NO: 26584 - protein, 81 aa, Myotis brandtii
LPDMVTFKDVAIEFTQEEWALLDPSQKTLYKDVMLENCRNLASLGYHVDKLSLISQLEQEDKVMTEERGILPGICSGAEGV

SEQ ID NO: 26585 - protein, 81 aa, Oryctolagus cuniculus
AQESVVFSDVSVEFSQEEWEYLSDDQRTLYRNVMLENYSNLVSMGYSISKPNVISCLEQGKEPWLVSRELTRSQWPESSCE

SEQ ID NO: 26586 - protein, 81 aa, Oryctolagus cuniculus
SLQSVSFKDVTVDFSREEWQRLDLAQKSLYRDVTLENYFNLVSVGCRVPRPEVVFNLELGAEPCVLAGEVSSQSCSDGDIE

SEQ ID NO: 26587 - protein, 81 aa, Pteropus alecto
AQMSVTFDDVAVTFTQEEWGQLDLSQRTLYQEVMLENCGHLVSLGCPIPRPELIYQLEHGQELWMVDRDLSQSTCPGDREK

SEQ ID NO: 26588 - protein, 81 aa, Pteropus alecto
VAFEDVAVNFSLEEWALLDSLQKELYRDVMRETFRNLASVGKKWEDHDIEDQYKNRVRKLRLMFGELTMSYEERPVIGQQN

SEQ ID NO: 26589 - protein, 81 aa, Oryctolagus cuniculus
SQGLVTFEDVAVYFSLEEWARLDASQRGLYQEVMQENYGILVSLGYPIPKPDLIFRLEQGEEPWVPDSPRPDEGDIVTGVY

SEQ ID NO: 26590 - protein, 81 aa, Rhinopithecus bieti
FQGSVTFEDVAIAFSQQEWESLDCSQRGLYRDVMLENYRNLISMAGHSLSKPHVIALLEQWKEPEVTVRTDERRWCTDLQL

SEQ ID NO: 26591 - protein, 81 aa, Rhinopithecus bieti
MLFLFNETGIAFSKPDLITYLEQGKEPWNMKRHETVAKPLVMCSYFAQDLWPEQNIRSSFQKVILRRYGKCRDENLPLRKD

SEQ ID NO: 26592 - protein, 81 aa, Panthera pardus
SQVLLTFRDVTIDFSQEEWECLDPAQRALYRDVMLENYRNLVSLGVDKVRPDVGICPNISVRSVIKELSTKEDINKEELFQ

SEQ ID NO: 26593 - protein, 81 aa, Panthera pardus
QAPESVTFEDIAVDFTKEEWALLSASQRKLFRDVMLESINHLIFLENNSCKRSFRLEQEGELQSEGTGFLQEHSPAECQFL

SEQ ID NO: 26594 - protein, 81 aa, Panthera pardus
SEESVTFKDVAVDFTQEEWGQLDSPQRALYRDVMLENYQNLLALGPPVCKPDVISHLERGEEPWWMPREAPGGACPEGEPG

SEQ ID NO: 26595 - protein, 81 aa, Panthera pardus
FQEAVTFKDVAVVFTEEELGLLDPTQRKLYREVMLENFRNLVSVGHSSSKPDVISQLEREEKLCTKEIHTQRGGRNQNEKE

SEQ ID NO: 26596 - protein, 81 aa, Macaca nemestrina
MLFIFNKTGIAAFKPDLIIFLEQGKEPWNVKRYEMVEEPPVICSHFAQHLCPEQGIEDSLQKVILRKYEKCGRENLQLKID

SEQ ID NO: 26597 - protein, 81 aa, Ursus arctos
SVTFEEVAVDFSREESASLDPAQKILYRDLMLENYRNLRQPHIVIDQKFQLKIKRPLQSRIKSGKNTYCQENDANSTQRET

SEQ ID NO: 26598 - protein, 81 aa, Ursus arctos
RKGCVTFEDVAIYFSQEEWVLLDEAQRHLYHDAMLENFALIASLVCWHGMEDEEAAFEQSISGEVLLRVKTPKAGPSTQKT

SEQ ID NO: 26599 - protein, 81 aa, Ursus arctos
PKVPVTFDDVAVYFSEQEWGKLDEWQKELYKHVMRGNYETLVSLDYAISKPEVLSQTEQGKEPCSWRRTGPKVPDVPVDPS

SEQ ID NO: 26600 - protein, 81 aa, Ursus arctos
MNKSQEEWEQLDPSQRILYMDVMLENYSNLLSVEVWKADDQVERDRSNPDEQARPFIIFKNQTPIEERGNLFGKTFNLSTD

SEQ ID NO: 26601 - protein, 81 aa, Muntiacus reevesi
RLTFKDVAIEFTPEEWECLDPAQRALYREVMVETLRNLLSVDTSPKRVMKGSAPKQSSHTGGILQTVLSERHKSHDTKDHA

SEQ ID NO: 26602 - protein, 81 aa, Ursus americanus
MGLLTFRDVAIEFSQEEWGCLNLVQRELYRDVMLENYGNLLFLGPDLVIFLEQKRELWDVKGKETVAIHPGWGPKVREEGR

SEQ ID NO: 26603 - protein, 81 aa, Myotis brandtii
KIEDVADVAVSFILEEWEHLDQSQKSLYRDDRKENYESITSMDCKSKNDNMELIVKQISDEAKSHWMTSGITERSVAQSQE

SEQ ID NO: 26604 - protein, 81 aa, Ailuropoda melanoleuca
SQDPVTFEDVAVEFTQEEWTLLDQTQRRLCRDVMLENYKSLAAIARYQLCRPGLIFKVEQKVCNSLPSTPVEDWKFHNISI

SEQ ID NO: 26605 - protein, 81 aa, Phyllostomus discolor
CQVSVTFEDVAVLFSRDEWRKLCPSQRSLYQDVMLENYSHLVSLGLPFSKPKVISLLQQGEEPWKAEEERRRHASPGQKSS

SEQ ID NO: 26606 - protein, 81 aa, Phyllostomus discolor
AEVGVTFEDVAVYLSRTEWLLLDEAQRRLYFDVMLENYTLISSLGCCCGAEDGEAPIEENVSIRVSRAMNLKSALSSQKNH

SEQ ID NO: 26607 - protein, 81 aa, Phyllostomus discolor
SKDLVTFGDVAIDFSQEEWEWLNLAQRNLYRKVMLENYRNLVLLGVSVSKPEVISLLEQGKEPWMVKEVETGGTYSDWEYA

SEQ ID NO: 26608 - protein, 81 aa, Phyllostomus discolor
SVTFEDVAVHFSWEEWRLLDEAQRLLYLRVMLENFSLISSLGCCCGAEGVEAPTELNICAQAPQERNAKAASSSQKSHPCE

SEQ ID NO: 26609 - protein, 81 aa, Phyllostomus discolor
SQGSVTFRDVAIDFSQEEWEWLQPAQRDLYRRVMLENYGHLVALAGLNMSKPDVVSLLEQGKEPWLGKDVRTDFFSVSGSN

SEQ ID NO: 26610 - protein, 81 aa, Phyllostomus discolor
LQESLTFKDVSVDFSWEEWECLDPAQRKLYSDVMLENYSNLVSLAVSSADKQDFLQRTGREDALFEATLHRFHTGHGPGKY

SEQ ID NO: 26611 - protein, 81 aa, Phyllostomus discolor
SEESVTFKDVAVDFTQEEWGQLDSPQRALYRDVMLENYQNLLALGPPVCKPDVISHLERGEEPWQVPRKVPGGARPEWEPR

SEQ ID NO: 26612 - protein, 81 aa, Phyllostomus discolor
VTFEDVAVYFSRTEWSLLDAAERRLYLHVMLENFGLISSLGCCCGAADVEAPTDQNLSVRVAQAKDPKAALSPKKSHPCDS

SEQ ID NO: 26613 - protein, 81 aa, Myotis lucifugus
KVPVTFVDIAVYFSEDEWKNLDGWQKELYNNLVKENYKTLMSLDAEGPGPKPEAPSQAEPREEPCVWEQRNPEEREILMDP

SEQ ID NO: 26614 - protein, 81 aa, Puma concolor
VVFEDVAVNFTPEEWALLNRGQRKLYRDVMLETCRNLSAVGCRSQGNTSTSRPQWSILLNEPLGEEKTGIFTRKDSCSVFG

SEQ ID NO: 26615 - protein, 81 aa, Puma concolor
VNFSDVAVYFFAGGWGCRRPAQSALYRDVMWETYGRLGALGFLGPKSAFISWVEGEVEAADPEGETPAAVIRDGGGGEGSG

SEQ ID NO: 26616 - protein, 81 aa, Sapajus apella
DSVTFDDVAVDFTQEEWTLLDPTQRSLYSDVMLENYKNLATVGWELQLETQWSTLQQNCLMGQTSIGIQLEGNHNRGKLCD

SEQ ID NO: 26617 - protein, 81 aa, Sapajus apella
YISAFSQEEQEMAKPQEEWQYLNPLQRTLYRDVMLETYSNLVFVGQQVTKPDLILKLEVEECLVEGKIPFWSFPEVCQVNE

SEQ ID NO: 26618 - protein, 81 aa, Sapajus apella
LCVFQAPLTFRDVTVEFSLEEWQCLDTVQRNLYRDVMLENYRNLAFLGIAVSKPDMITCLEQGKEPWNMKRYEMVAKSPGR

SEQ ID NO: 26619 - protein, 81 aa, Sapajus apella
MAKPQEEWQYLNPLQRTLYRDVMLETYSNLVFVGQQVTKPDLILKLEVEECLVEGKIPFWSFPEVCQVNEQIERQHQDDQG

SEQ ID NO: 26620 - protein, 81 aa, Oryctolagus cuniculus
MFQVTFSDVAVDFSPEEWGWLSSAQRDLYREVTVQNYENLVSLGLSVAKPCVVTLLENGKEPWMVEKNLPKDWAPRWESKE

SEQ ID NO: 26621 - protein, 81 aa, Oryctolagus cuniculus
MSKDLVTFGDVAVNFTQEEWEWLNPAQRNLYRKVMLENYRSLASLGVSAKPDVISLLEQGKEPWMVKEGTRGTCPDWEYVF

SEQ ID NO: 26622 - protein, 81 aa, Oryctolagus cuniculus
AHGPVTFRDVAIDFSQEEWEFLDSAQRDLYRDVMWENYSNFISLGPSISNPNLVTLLDDEGKEPGMVVREGTRKYCHDLES

SEQ ID NO: 26623 - protein, 81 aa, Rhinolophus ferrumequinum
MFKDAVTFKDVAVGFTEEELGLLDSAQRKLYQDVMVENFRNLVSVGHQPFRRDISHVEREERLWMMKTSPQIERNLGDNNQ

SEQ ID NO: 26624 - protein, 81 aa, Rhinolophus ferrumequinum
TASSQASVTFKDVAMDFTPEEWGKLDPAQRDVMLENYRNLVSLWLPVSKPENYNLENEREPLKFERKTPQSSYSDLESGPE

SEQ ID NO: 26625 - protein, 81 aa, Rhinolophus ferrumequinum
QGEVTFEDVAVLLSREEWGRLGPAERGLYRDVMLETYGHLVSLGAGPAGPKPGVITQLERGDEPWVLDMQGAEETGRLRVD

SEQ ID NO: 26626 - protein, 81 aa, Rhinopithecus bieti
VAFEDVAVNFTQEEWALLDISQRNLYREVMLETFRNLTSIGKSWKDQNIEYEYQNPRRNFRSLIEEKVNEIKEDSHCGETF

SEQ ID NO: 26627 - protein, 81 aa, Rhinopithecus bieti
VGLQFQGSVTFEDVAIAFSQQEWESLDCSQRGLYRDVMLENYRNLISMGHSLSKPHVIALLEQWKEPEVTVRTDERRWCTG

SEQ ID NO: 26628 - protein, 81 aa, Panthera pardus
QDSVTFEEVAVDFSQEEWALLDPTQKILYRDVMLENYRNLASVGLDIQLKSKDAFPVQNVPREKTCNDIKTVPTKPSKKPL

SEQ ID NO: 26629 - protein, 81 aa, Panthera pardus
TQGCVTFEDVAIDFSQEEWGLLDEAQRRLYHDAMLENLALIASLGSRHGTEDEETAVEQNISVGVSQVRTPKAGPSTQKAH

SEQ ID NO: 26630 - protein, 81 aa, Rhinolophus ferrumequinum
MNFEDVAIDFSQEEWVLLDEAQRLLYCDVMLENFALVASMGCWHKMEDEEAPSEQSVSVEGESQVRASKISSIIQKIHPCE

SEQ ID NO: 26631 - protein, 81 aa, Rhinolophus ferrumequinum
TQDSVVFEDVAVNFTLEEWALLDGAQKNLYRDVMLENFQNLASLGYPLHTPCLIFQWKQEENLEIAKRRPIQGEQQEGFET

SEQ ID NO: 26632 - protein, 81 aa, Rhinolophus ferrumequinum
PQESVTFEDVAVYFTQNQWASLEPVQRALYREVMLENYANVASLVAFPLPKPVLISQLEKGEAPWGPDPWEAEVLRGVCPG

SEQ ID NO: 26633 - protein, 81 aa, Ursus maritimus
FQEPVTFKDVAVVFSEEELGLLDSTQRKLYRDVMLENFGNLVSVGHSSSKPDVISQLEREEKLCMKETHSERGDRHQKEME

SEQ ID NO: 26634 - protein, 81 aa, Ursus maritimus
MIQWEAELEEWQHLDPAQKALYRDVMLENYCHLISVGFHMTKPDMIRKLEQGEELWTTERMFPSQSYLEEDGKAEDVLVKF

SEQ ID NO: 26635 - protein, 81 aa, Ursus maritimus
PVTFEEVSTQFSGEQWQCLDPDQQALSRDMMLDNFGSSASLGKGCAVGLQSLSGLWLALGLRGEAKRTATTSSCPVCHKGA

SEQ ID NO: 26636 - protein, 81 aa, Ursus maritimus
RPGAVSFADVAVYFSPEEWGCLRPAQRALYRDVMRETYGHLGALGCAGPKPALISWLERNTDEWEPAALDPRECPRGVTVQ

SEQ ID NO: 26637 - protein, 81 aa, Ursus maritimus
RLTFRDVAIEFSPEEWECLDPAQRALYRDVMVENYRNLLSLDISTRCMRKELPPKDNINNGELFQTLILERHVSRDFDDFG

SEQ ID NO: 26638 - protein, 81 aa, Rhinopithecus bieti
RDVAIEFSLEEWQCLDTAQRNLYKNVILENYRNLVFLGIAVSKPDLITCLEQEKEPLTMQRHEMVDEPPVMCSHFAQEFWP

SEQ ID NO: 26639 - protein, 81 aa, Rhinopithecus bieti
GTVTFEDMAVKFPREEWNLLSEVQRCLYCDVTLENLALISSLGCWCGVEDEAPSKQSIYIQRETQVRIPMAGVSPKKAHTC

SEQ ID NO: 26640 - protein, 81 aa, Rhinopithecus bieti
MLENYSSLVSLGILFSKPKVISQLEQGEDPWMVESGVPQGTHLGWESLFETIISKEENQEVMKKLIIDGAFDFKLEKTYIN

SEQ ID NO: 26641 - protein, 81 aa, Rhinopithecus bieti
EDVAVDFTLEEWALLDSAQRNLYREVIFEMWERTKTQFKANGSVSQQDMYGEEKSKERTIPNFTRNNSCAYTLEKTCRGRQ

SEQ ID NO: 26642 - protein, 81 aa, Panthera pardus
AHRSVTFRDVAIHFSQQEWEYLDSVQKNLYRDVMMENYDNLVSLEHSISKPDVIRLLEQRKEPWMVVREDTKRWCTDLESK

SEQ ID NO: 26643 - protein, 81 aa, Panthera pardus
KGSMMFRDVSINFSQEEWECLDSGQMNLYKEVMLENFSNLVSVVASLSSHQGTGSDFWDTHSITMSHVFSCDQDFPILSQL

SEQ ID NO: 26644 - protein, 81 aa, Panthera pardus
GFRTASCWDVSVEFTRDEWQLLDSAQKYLYRDVILENYSHLVSVGYHGTKPDLIFKLEQGEEPWIINAKVSRQSCPEDWKE

SEQ ID NO: 26645 - protein, 81 aa, Macaca nemestrina
VAFEDVAVNFTQEEWTLLDISQKNLFREVMLETFRNLTSVGKDDSFPFLSALVNQSLIEEKVNEIKEDSHCGETFTQVPDD

SEQ ID NO: 26646 - protein, 81 aa, Ursus arctos
SSQGLLTFGDVAIEFSQEEWRCLSHTQRELYRDVMLENYGHLLFLGLIVSKPDQVSFLEQEKQLWDVTRKETVAFHPGRWD

SEQ ID NO: 26647 - protein, 81 aa, Ursus arctos
PCKLVLFKDVAVDFSQEEWECLDLEQKDLYRDVMLENYSNLVSLGFSISKADVLSLLKQGKEPWKVVQDVTRSQSSDWESK

SEQ ID NO: 26648 - protein, 81 aa, Ursus arctos
MHKDVMLENYSNLASVGLCVAKPEMIFKLERGEELWILEEESSGRGYPGSLSLLCGNSSVGGNALRHDNDLRRQKIQTLDQ

SEQ ID NO: 26649 - protein, 81 aa, Ursus arctos
RFRTASCWDISMEFTWEEWQLLDSTQKYLYRDVILENYSHLVSVGYHGTKPDLIFKLEQGEEPWIINAKVSRQSYPEGWKE

SEQ ID NO: 26650 - protein, 81 aa, Muntiacus reevesi
MGRLTFQDVAIDFTQEEWECLDFGQRELYRDVMLENYANLASLGLVSKLDLVAFLEQLKAPRNIRRMETTTSYPDSNLKNH

SEQ ID NO: 26651 - protein, 81 aa, Oryctolagus cuniculus
FQVSVTFEDVAVLFTRDEWRKLDPPQRILYRDVMLENYSNLLSLGLPCTKPKVISLLQQGEDPWKIEKDSPGGSSVDWKSG

SEQ ID NO: 26652 - protein, 81 aa, Ursus maritimus
SQESVTFQDVAVDFTEKEWPLLDSSQRKLYKDVMLENYSNLASVGYQVGKPSLISHLEQEEEPRTEERVLHRATSPDWEAP

SEQ ID NO: 26653 - protein, 80 aa, Ursus maritimus
LQGLLTFGDVAIEFSQEEWRCLSHTQRELYRDVMLENYGHLLFLGLTVSKPDLVSFLEQRKEPWDEKRNKTAGFDASRWE

SEQ ID NO: 26654 - protein, 81 aa, Ursus maritimus
MLENYRNLVALGHQLYKPEVISQLEQEEQWVMERGSPLDTHADGESRPEIKKSTPNQNISDETQNHDMIMERLTGDSFWYS

SEQ ID NO: 26655 - protein, 81 aa, Ursus maritimus
VPKFSQEEWECLSHTQRELYRDVILENYGHLLFLGVIVSKPDLVSLLEQRKEPWGEKRNKTVLFDPGSFLPEPCKEASFQN

SEQ ID NO: 26656 - protein, 81 aa, Ursus maritimus
PRNPVSPHPLQHMLCGSVSFRDVTVDFTRDEWLRLTGTQRTLYRDVMLENYSHLVSVGEGLPLKLPPQDLFAIFFFFFLIS

SEQ ID NO: 26657 - protein, 81 aa, Ursus maritimus
LKREGSSLANLRAMPQEEWQHLDPAQKALYRDVMLENYCHLISVGFHMTKPDMIRKLEQGEELWTTERMFPSQSYLEEDGK

SEQ ID NO: 26658 - protein, 81 aa, Macaca nemestrina
RCVLENYRNLVSLGVAISNPDLVTCLEQRKEPYNVKIRKIVARPPAVCSHFTQDRWPVQGIEDSFHNLILRRYEKCRHENL

SEQ ID NO: 26659 - protein, 81 aa, Macaca nemestrina
QDVTIEFSLEEWQCLDTAQQTLYRDVMLENYRNLVFLGIAVSKLDLIACLKQGKELWNMKRHEMVTKPPVMRSHFTQDLWP

SEQ ID NO: 26660 - protein, 81 aa, Muntiacus reevesi
SRSLENDGVCFSEQEWENLEDWQKELYANVMKSNYETLVSLKVLGQPEGDMELGAEMPGDLEEEESRGGHPVEEVVVKQET

SEQ ID NO: 26661 - protein, 81 aa, Ursus americanus
IIEPVTFKDVAVVFSEEELGLLDSTQRKLYRDVMLENFGNLVSVGNQPFKPELIFQLEREEKLLMMEAETQGEGMNIFPFI

SEQ ID NO: 26662 - protein, 81 aa, Ursus americanus
LQGLLTFGDVAIEFSQEEWGCLSHTQRELYRDVMLENYGHLLFLGFILSKPDLIMFLEQEKQLWDVKRETVAFHPENPHEY

SEQ ID NO: 26663 - protein, 81 aa, Ursus americanus
SLLHTHGLLTFKDVAIEFSQEEWRCLSHTQRELYRDVMLENYGHLLFLGEDDSFQISQATLWVRMTPSRFPKPHSGFSSFL

SEQ ID NO: 26664 - protein, 81 aa, Ursus americanus
LTFRDVAIEFSREEWRCLSHTQRELYRDVMLENYGHLLFLGEDDSFQISQSTLRVFFLPVKTVSWKIPLCMNGIQIQAERE

SEQ ID NO: 26665 - protein, 81 aa, Ursus americanus
MLENYGAVASLAFPFPKPALISQLERGEAPWCKAPQGALDGEGPRGISSGCPFLKPAGISHLEQVEEPLNPKLQGEVPSLV

SEQ ID NO: 26666 - protein, 81 aa, Pteropus alecto
AQGCVTFEDVFVCFSREEWELLEEAQRRLYRDVMLENFALVSSLGCCHVAEEEPVPSEQSVSDPMAAAALMDRARGSVTFK

SEQ ID NO: 26667 - protein, 81 aa, Pteropus alecto
AVTFADVAVSFSREEWRLLDEAQRRLYLAVMLENFALVSSQGCCCGAEDVEASIEPSISVGASHGRTPKEPSSSQRTHPCE

SEQ ID NO: 26668 - protein, 81 aa, Pteropus alecto
SQELLTFKDISVDFTQEEWGHLAPAHRNLYREVMLENYGNLISVGYELSKPGVISQLEKGEEPWLTEREISGGPSSDLESK

SEQ ID NO: 26669 - protein, 81 aa, Oryctolagus cuniculus
MITFEDLAVYFTWEEWQHMNKAQKILYRDVMLETYSSLLFLVAMKSDEIIRTNQEIQENIFKQNVITNNKTSTPKRAESIK

SEQ ID NO: 26670 - protein, 81 aa, Rhinolophus ferrumequinum
PLCLLGKQRARIWGYCFTKPELIFRLEQCEDPWLIEKEFLSRNSPEASQLDELSEKSPENQGKHLWQVLFTKNSLITEQEI

SEQ ID NO: 26671 - protein, 81 aa, Rhinolophus ferrumequinum
LQGPVSFEDVTIHFSREEWQHLDPAQRRLYQDVMLEIYSHLFSVEYHIPNPEVIFRMEKEKELWLGEAELSHQRHPEEESG

SEQ ID NO: 26672 - protein, 81 aa, Rhinopithecus bieti
PQGLVTFGDVAVDFSQEEWQWLNPNQRNLYRKVMLENYRNLASLGLCVSKPDVISSLEQGKEPWTVKRKMTRAWCPDLKTV

SEQ ID NO: 26673 - protein, 81 aa, Panthera pardus
SSQTLLTFRDVAIEFSQEEWGCLNHSQRELYRDVMLETYGHLLFLGLVSKPDLVIVLEQKKELWGVKRKETVASHPAVSSQ

SEQ ID NO: 26674 - protein, 81 aa, Panthera pardus
QGSAAYEFLSVDYTERKWKGPALSQRAVYRSLMPENYRRVASLANEARMECPDLPAKQEVSKGLGSSDGTSGGLCGVVSGE

SEQ ID NO: 26675 - protein, 81 aa, Panthera pardus
TQDSVTFEDVAMYFSWEEWGLLDEAQRWLFHNVMLENFALVTSLGCWHGAGDGETPSEQSAFVGASQVRTHQASPDPQKAH

SEQ ID NO: 26676 - protein, 81 aa, Panthera pardus
DRRRRTASQNAPPESGAQVPVSFEDVSMYFIKTEWKLLGLSQRILYKRVLLENYRHLVSLDAGFTAQFWNRQSMPHVPAAS

SEQ ID NO: 26677 - protein, 81 aa, Macaca nemestrina
LFQVTFSDVAIDFSHEEWAWLDSAQRDLYKDVMVQNYENLSYVFSGGFISYPFLLITLGKKKSSALWENKELSTKKDIYDE

SEQ ID NO: 26678 - protein, 81 aa, Macaca nemestrina
MELLTFRDVAIEFSPEEWKCLDPAQQNLYKDVMLENYRNLVSLAMCSPFSQDLSPVQGIEDSFQKLVLKRYEKCGYENLQL

SEQ ID NO: 26679 - protein, 81 aa, Ursus arctos
VKIEDVADVAVSFILEEWGHLDQSQKSLYRDDRKENYGSITSMDYESGHDNVELAVKQISDDAEPRWMTSGSPERNVPQSQ

SEQ ID NO: 26680 - protein, 81 aa, Ursus arctos
MTRLEGFQFPKPEVICLLEQWEEPWILDLPRAGTRKASSSACPGSEARCKMKKPTPKQKISEDSESCKMSVVKQTTAKRPA

SEQ ID NO: 26681 - protein, 81 aa, Muntiacus reevesi
CIKDEGSITFEDVAVYFSWEEWALLNETQKLLYCNVMLENFALMASLAYVSSFLPMLEIVVTDMESLQPQIPETPQKGKST

SEQ ID NO: 26682 - protein, 81 aa, Muntiacus reevesi
FTFRDVAIEFSQEEWECLAPSQRALYRDVMLETYRNLVSLGEDNFSPEVGILSVGFAINKLSPRENTNVGELYGNENHGIK

SEQ ID NO: 26683 - protein, 81 aa, Muntiacus reevesi
RKRGSLTLEDVAVDFTWEEWQLLAPAQKALYQEVMLENYGNLVFVGYQASKPAALSRLERGEPWPVEDEVHSQLCPEMRKD

SEQ ID NO: 26684 - protein, 81 aa, Muntiacus reevesi
LPLTFEDVAVYFSEQEWQNLEAWQKELYKQVMRANYEILLSLDNGLPKPELISWIEQGKELFKKWGESQQSRSIICSSADL

SEQ ID NO: 26685 - protein, 81 aa, Oryctolagus cuniculus
ETMLVSFEELAVNFTQEEWQHLDNAQRTLYRDVMLETYSSLLSLGYCISKPEVILKLEQGAEPWMVIEPLNQSLSGQSLHT

SEQ ID NO: 26686 - protein, 81 aa, Oryctolagus cuniculus
LQVMLTFEDLAVYFTWEEWQNMNKAQKILYRDVMLETYSSLLSLGHCITKPDLIFKLEQEAEPWMVNECLNQSLPVAMKSD

SEQ ID NO: 26687 - protein, 81 aa, Pteropus alecto
IREQDFGASLLQTAPQEQWRNLDSTQKEQYWDFMLETYGKMVSGGISSSKPDLTNSADYGEELTELHLHVSEKIPIPTCIG

SEQ ID NO: 26688 - protein, 81 aa, Oryctolagus cuniculus
SQASVSFKDVSVEFTLEEWQHVSPAQRTLYRDVMLENYSHLVSLGYCIFKPEVIFKLEQGEEAWFSEGDFSSQDLPVLEDY

SEQ ID NO: 26689 - protein, 81 aa, Pteropus alecto
MLENYGHLVSLGLPLFKPKVISLLQQGEEPWKVEEGSRRGSWLGSKSSPKTTKSTQTQDSSFWGLIKKRLKRDEPWKFLSE

SEQ ID NO: 26690 - protein, 81 aa, Rhinolophus ferrumequinum
SQESLTFEDVAVNFTQEEWALLDTSQRKLFRDVMLENISHLVSVGSQLYKSDMISHLEKGEKLSREGIGFLPGQGPGRRDY

SEQ ID NO: 26691 - protein, 81 aa, Ursus maritimus
EWMLLSQQQKEICGSDKLVAPLGPTIATPELFYKFEQGPEPWLGNVQGQRNVLSHQPGKNKMGCMEERDSRSPAREARLDL

SEQ ID NO: 26692 - protein, 81 aa, Ursus maritimus
SPLLESVTFKDIAVDFTQEEWALLDTSQRKLYRDVMLENISHLVSVGESVNINIFIQQVSSTVLVIQGEHRPQEEGPGREG

SEQ ID NO: 26693 - protein, 81 aa, Ursus maritimus
SHGLLTFGDVAIEFSQEEWECLSHTQRELYRDVILENYGHLLFLGVIVSKPDLVSLLEQRKEPWGEKRNKTVLFDPAVSSH

SEQ ID NO: 26694 - protein, 81 aa, Ursus maritimus
MLENFRNLVSVGHSSSKPDVISQLEREEKLCMKETHSERGDRHQKEMETLHEAGIRCLSLGELSCWQIKRHVVSRLTKNQD

SEQ ID NO: 26695 - protein, 81 aa, Ursus maritimus
CSILSGFLDPGHRNIRSSWILLDPSQTDFYGEYVMQENCGIVVSLRFPIPKLDMLSQLEGGEEQWVPDPQDLEERDILRVT

SEQ ID NO: 26696 - protein, 81 aa, Ursus maritimus
MLENYSNLVSVGCQATKPDALSKFEHRDELWITENEIQNRTHPGFGNFDHHLQEPSQNHRFLKNTQQYGERSAFRNTVHLS

SEQ ID NO: 26697 - protein, 81 aa, Rhinopithecus bieti
PQVSLTFEDVAVLFTRDEWRKLAPSQRNLYRDVMLENYRNLVSLGFPFTKPKVISLLQQGEDPWKVEKDSSGDSSLGCKSM

SEQ ID NO: 26698 - protein, 81 aa, Ursus maritimus
SSPVCYQKEEEMTESQEEWQQLDPAQRNLYRNVMLENYNNLITVGCPFTKPDVIFKLEQEEEPWVVEEEVLRRHCPGEIWG

SEQ ID NO: 26699 - protein, 81 aa, Macaca nemestrina
AATLRLSAQGTVTFEDVAVNFTQEEWNLLSEAQRCLYRDVTLENLALISSLDSALDGSVDKTETGNLGQSVLPSHPEQKTA

SEQ ID NO: 26700 - protein, 81 aa, Macaca nemestrina
MEGLVMFQDLFIHFSQEEWECLDAAQKDLYRDVMMENYSSLVSLGLCIPKPDVISLLEQGKEPWMVSRDVLGGWCPDSEFR

SEQ ID NO: 26701 - protein, 81 aa, Macaca nemestrina
MAKPVREEWRHLDPSQRNLYRDVMLETYSHLLSVGYQVPKPEVVMLEQGKEPWALQGERPRQSCPGEKLWDHNQCRKILTY

SEQ ID NO: 26702 - protein, 81 aa, Ursus arctos
TFKEALTFKDVAVVFTEEELGLLDPTQRELYRDVMLENFGNLVSVGHQPFRRDVGHLVREEKFWMVKLATQRKGNSGDKVQ

SEQ ID NO: 26703 - protein, 81 aa, Oryctolagus cuniculus
MLQFGKMLHYFPLTGYCITKPEVIFKLEQGAEPWIVEGPLSPSLPAVQKMDNLIKASQESQDGYISQAATTNNNTSTEERI

SEQ ID NO: 26704 - protein, 81 aa, Oryctolagus cuniculus
MLENFRNLLSVGHQSFKPDVISQLEREERLQVQEIQTQRGSKNGNKTGTCLDAESRCLALGDLPCWRIERRPGSQLPGSQD

SEQ ID NO: 26705 - protein, 81 aa, Rhinolophus ferrumequinum
GQESLTFDDVAVDFTWEEWQLLVPEQKDLYRDVMLENYSHLVSLGYQACKPDMLSKLDRGESPWTMADEVHYWTRSEIWKD

SEQ ID NO: 26706 - protein, 81 aa, Rhinolophus ferrumequinum
DSVQGQVTFEDVAVYFSQEEWRLLEDTQRLLYRDVMLENFALTASLGCWHGMENEEIPFEQWVSIKGVSQVRTPKSGPSTQ

SEQ ID NO: 26707 - protein, 81 aa, Rhinolophus ferrumequinum
CLQGPVTFKDVAVEFTQEKWVRLDSAQRSAYRDVMLENYMNLTTVELQLCKPPVLSLLGQEEMIPRQRIPQGTCPDWETQN

SEQ ID NO: 26708 - protein, 81 aa, Rhinolophus ferrumequinum
AEDLVTFKDVAIDFSQEEWDWLNPAQRSLYRSMMLENYQSLVSLGLCISKPCVISLLEQGKEPWEMKSDMTGSIFSDCESR

SEQ ID NO: 26709 - protein, 81 aa, Panthera pardus
KMNTPQASVSFKDITVEFTQEEWQQMDSAQRTLYRDVMLENYSHLVSVASLFRSIWTYLRDFAGSIPDHHNEMNTTIQQVK

SEQ ID NO: 26710 - protein, 81 aa, Panthera pardus
DRRRRTASQNAPPESGAQVPVSFEDVSMYFIKTEWKLLGLSQRILYKRVLLENYRHLVSLDADAALSSGVTDLLRFHGQDF

SEQ ID NO: 26711 - protein, 81 aa, Ursus arctos
SVTFRDVTVDFTQEEWQQLEPAQKDLYRDVMLENYRNLVSLDLETRPEMKESGPKEDSAEDRPSAGVVVEGPTRSGAHGLA

SEQ ID NO: 26712 - protein, 81 aa, Ursus arctos
QTEPSGPKLVARLSGPTQPTPTPGVAGAAARMNPAQGCVTFEDVFVYFSREEWELLEEAQRLLYRDVMLENFALVSSLGPM

SEQ ID NO: 26713 - protein, 81 aa, Ursus arctos
SVTFEEVAVDFSREESASLDPAQKILYRDLMLENYRNLRQPHIVIDQKFQLKIKRPLQSRIKSGKNTYCQENDQTFLPRKE

SEQ ID NO: 26714 - protein, 81 aa, Ursus arctos
SEESVTFKDVAVDFTQEEWVQLDSPQRALYRDVMLENYQNLLALAGPPVCKPDVISHLERGEEPWQMPREVPGGAYLEGEP

SEQ ID NO: 26715 - protein, 81 aa, Ursus arctos
MLENYGNLVSVGYQLSKPSVISQLEKGQEPWMTEKEGPGDPRSAYNTENNKSCHDLLEDLKNKTESDASAAKNDILQEQLY

SEQ ID NO: 26716 - protein, 81 aa, Pteropus alecto
VGPVVSVRAVAIEFTPEEWERLDLAQRALSRDMMSEDYGTLLSLGEGDFPPEIGEFLRVSVTLKSGVLGKGLLTFRDVAIE

SEQ ID NO: 26717 - protein, 81 aa, Pteropus alecto
WDSVTFEDVAVNFTPEEWALLDPTQKKLYRDVMRETFENLASVEVFIQHSSCNRHIRCHTGHKAYEFRKCGEKPYKCKECS

SEQ ID NO: 26718 - protein, 81 aa, Pteropus alecto
NKGQLTLSDVFIEFSQEEWECLTPAQRALYREVMLESYRKLRFLGISVSDLYIVSILEQGKAPWILESELKIAQKPNRQKC

SEQ ID NO: 26719 - protein, 81 aa, Rhinolophus ferrumequinum
LPDLVRFEDVAVEFTQEEWALLDPSQRTLYRDVMLETCRNLASLGYDVDKPSLISQLEQEDKMLTEERGVLPGTCSDLETV

SEQ ID NO: 26720 - protein, 81 aa, Ursus maritimus
METSLRLRAGITAFAHHHSHIPFLSLQTGLLSSKPKLITQLEQGAEPWMEVQQIPSDTCSVQEYWFETKMSTLKQHASEGS

SEQ ID NO: 26721 - protein, 81 aa, Rhinolophus ferrumequinum
KSQGRVAFKDVSASQLPPGGCQELDSAQKILCWDVMLENDSSLVSMGCHDQTKCVSQLEQEEPWITEVELLVQSLPHSGQR

SEQ ID NO: 26722 - protein, 81 aa, Ursus maritimus
NRNIVTFEDVCIYFSPEEWELLDEAQKRLYCNVILENFLLVTSLGLAISRYHLIPQLLPVREPGVPANVAIAPAGAGMVQG

SEQ ID NO: 26723 - protein, 81 aa, Ursus maritimus
MMLENYRNLVSVGYQASKPDALSKLERGEELWTIEDEIHSRICPELRKVDDPLQCHLQNRSIQKSVEQCCEHNTFADILNQ

SEQ ID NO: 26724 - protein, 81 aa, Ursus maritimus
RLTFRDVAIEFSAEEWECLDPAQRALYRDVMVENYRNLVSLDSSARFMIKELLPKKERKNRELCQPVVLGGHESHDLKDFD

SEQ ID NO: 26725 - protein, 81 aa, Ursus maritimus
MRLCQLWPGTFPREHRRGENGSCASNSQTAGLLVPKPDVIFQLKRGEEPWKLDFQEDEKSEVPGSTFPDQNARLESQDSTQ

SEQ ID NO: 26726 - protein, 81 aa, Ursus maritimus
MFKETVTFKDVAVVFTEEELGLLDPAQRKLYRDVMLENFRNLISVGEHPFRHDICFLEKAKKLWMMLGAHREEKSGGKIQS

SEQ ID NO: 26727 - protein, 81 aa, Rhinopithecus bieti
AQSSVTFEDVAVNFSLEEWSLLNEAQRCLYRDVMLETLTLISSLGCWHGGEDEAAPSKQSTCLHIYKDQGGHSGERPYECG

SEQ ID NO: 26728 - protein, 81 aa, Panthera pardus
TVTFKDVAVVFTEEELVLLDKAQIHPYQDVTLENFRNIVSVGDRIRDNISHLQGKGLSYLSPEGLYRWPIWKQRISELTGS

SEQ ID NO: 26729 - protein, 81 aa, Panthera pardus
TQGCVTFEDVAIDFSQEEWGLLDEAQRRLYHDAMLENLALIASLVCWHGMEDEETPFEQSVSIEVLSQVRIPKAGASIQKT

SEQ ID NO: 26730 - protein, 81 aa, Panthera pardus
MDFSREEWEQLDPAQRCLYWDVMLEICSHLLSLGYPIPRPEMIFRMEKEEEPWIREAQLPHQWRPEGEFGLKTSRQKIFEK

SEQ ID NO: 26731 - protein, 81 aa, Balaenoptera physalus
LPMAFDDVALYFLEQEWEVLEKWQKEMYQQEMKTNYETLDSLGCISSKPDLITWMEQGRMLLIRDQGHLEKTQMTLGLSGR

SEQ ID NO: 26732 - protein, 81 aa, Balaenoptera physalus
PKVPVTFDDISIYFSTPEWEKLEEWQKELYKNIMKGNYESLISMDYAMNQPDVLSQIQPEGGHNTEDQAGPEGSEIPTDPS

SEQ ID NO: 26733 - protein, 81 aa, Muntiacus reevesi
HRGRLMFRDVAIDFTQEEWECLDLGQWDLYRDVMLETYGKLASLGLVVSKPDLVTFLEQMKNPWDVRRTDTTATYPELIQQ

SEQ ID NO: 26734 - protein, 81 aa, Muntiacus reevesi
SVTFEDVAVYFSWEEWALLDDAQRCLYHDVMLENFALTSSLGCWHGVEDKGAPSEKSVSVEGVSQIKTLKADSSPQKDQPF

SEQ ID NO: 26735 - protein, 81 aa, Ursus americanus
MQENYGLLISVGYRVNKPNAVFKLKQGKEPWILEVEFPHRNYPEDLWKIHDLGAKYQESRAENSRNGELRKHQQPQPREKI

SEQ ID NO: 26736 - protein, 81 aa, Oryctolagus cuniculus
AQGLVTFRDVAVEFSQEEWKCLKPAQRDLYRDVTLENFGNLVSLGISISKPDIISLLEQGKEPWTIANDITGPWCPDLASR

SEQ ID NO: 26737 - protein, 81 aa, Rhinolophus ferrumequinum
AQGSLSFEDVTVEFTQEEWPYLGPAQRALYRDVMLENYSHLVSVGHYKVDVYLAGNQEEQEKPLWQVIFNKTLRKEGQKDI

SEQ ID NO: 26738 - protein, 81 aa, Rhinolophus ferrumequinum
GLLDSAQRKLYRDVMLENFRNLLSVGHQPFKQGTVHLVRGEKFWMIKVATQIKGNSEMGTIPESEPHEELSCWQIWQQIAR

SEQ ID NO: 26739 - protein, 81 aa, Rhinolophus ferrumequinum
SVKEAQRKRKEEGMALFQGWLTFKDVFIEFSQEEWECLDPAQRALYRDVMSENYKNLLSLGDGNFPPEIGNYLWMSFCFAL

SEQ ID NO: 26740 - protein, 81 aa, Rhinolophus ferrumequinum
SAAGLVTFKDVTMAFTQKEWEQLDPAQRSLYKDVMLENYSSLASMGYQADKPDVISKLEKEEPWLGKGKRPRQGGPSAIAT

SEQ ID NO: 26741 - protein, 81 aa, Ursus maritimus
ECLSHTQRELYRDVILENYGHLLIHSHTYFPFLYETGVIVSKPDLVSLLEQRKEPWGEKRNKTVLFDPGSLSFLPEPCKEA

SEQ ID NO: 26742 - protein, 81 aa, Ursus maritimus
RPGAVSFADVAVYFSPEEWGCLRPAQRALYRDVMRETYGHLGALGFAGPKPALISWLERKKEVWSPEAEDPEAGARHPGSG

SEQ ID NO: 26743 - protein, 81 aa, Ursus maritimus
SVTFEDVAVYFSWEEWGLLDEAQRHLYHDVMLENFALVTALGKALIPSSGTWAKPLCFYPRDGSISLPLQTWALLPPQFPG

SEQ ID NO: 26744 - protein, 81 aa, Ursus maritimus
VTFEDVAVYFSWKEWRLLDEAQRRLYHHVMLENFTLISSLGCCCGAEGEEAPFAQSTTVGASQAGTPTAAVSSRKTHPCEL

SEQ ID NO: 26745 - protein, 81 aa, Ursus maritimus
PRDPAQGMNFEDVAIDFSQEEWGLLDETQRLLYCDVMLENFALVASLDLHQQQRHGSGEKPWKRDVDRVSCVTSCNFCVSG

SEQ ID NO: 26746 - protein, 81 aa, Ursus maritimus
SQELVTYEDVAVDFTHKEWQHLDPAQKTLHRDVMLETYSHLVSVGCSGIKPGIIFKLEREEDPRIIKSELSTWVHSDREKS

SEQ ID NO: 26747 - protein, 81 aa, Rhinopithecus bieti
PLESVTFKDVAIDFTLEEWRLMDPTQRNLHKDVMLENYRNLVSLGLAVSKPDMISHLENGKGPWVTMRGISRIPYPDIEPK

SEQ ID NO: 26748 - protein, 81 aa, Panthera pardus
SVTLKDIAVDFTQEEWALMDTSQRTLYRDVMLENISHLVSVGMKKSHNKQEIISMQDIYLKDPPNCWTIQKRHAGEDLSVY

SEQ ID NO: 26749 - protein, 81 aa, Macaca nemestrina
LEDVAVDFTWEEWQLLGPAQKDLYRDVMLENYSNLVAVGYQASKPDVFFKLEQGEPPWTTEDGIHSGACSEIWKVDDHVLK

SEQ ID NO: 26750 - protein, 81 aa, Macaca nemestrina
GSVSFKDVTVDFTQEEWQQLDPAQKALYRDVMLENYCHFVSVDEWTRIFYGKTEDVLVKFKEYQDRHSRSLIFINHKKLIK

SEQ ID NO: 26751 - protein, 81 aa, Ursus arctos
MLENYSHLVSLGCCIPKPEVILKLEQGEQPWILEEESPSQSYPEVCKVDNQLEQNQEAQDRHFWQAPFINNKTLTMHRGNV

SEQ ID NO: 26752 - protein, 81 aa, Oryctolagus cuniculus
MITFEDLAVYFTWEEWQHMNKAQKILYRDVMLETYSSLLFLGHCITKPDLILKLEQGAEPWMVNEFLNQNLPVAMKSDEII

SEQ ID NO: 26753 - protein, 81 aa, Pteropus alecto
SMEPLTFKDVAVVFTEEELGLLDAAQRKLYRDVMLENFKNLVSVGQQPCKPGEMSHLEQDRETWVTERGTLRGAHSGDNNE

SEQ ID NO: 26754 - protein, 81 aa, Rhinolophus ferrumequinum
AQGSVSFEDVTVEFTQEEWPYLGPAQRALYRDVMLENYSHLVSVGHYKVDVYLAGNQEEQEKPLWQVIFNKTLRKEGQKDI

SEQ ID NO: 26755 - protein, 81 aa, Rhinolophus ferrumequinum
MLENFRNLLSVGHPSSKPDVISQLEREEKLWMMEIQTQRGGSSENEMDTLHEARVRCLSLGELSCWQIKKHVVSKLTRSQD

SEQ ID NO: 26756 - protein, 81 aa, Rhinolophus ferrumequinum
LFQGRLTFRDVAIDFSQEEWKCLHPAERKLYMDVMLENYRNLCSLGLAVSKPDLVIFLERMKEAWAVKRKKTVSIHPGRWE

SEQ ID NO: 26757 - protein, 81 aa, Ursus maritimus
MFFQAGCSISKPDVITLLEQGKEPWMVVRDERRRSLDLESRYDTKKLFQEKDIYEMNLSQWEIMGRIRSCGLEDSFVRKDY

SEQ ID NO: 26758 - protein, 81 aa, Ursus maritimus
MYFSQEEWELLDPTQEALYNDVMRENYETVISLALFVLPKPKVISYLDHEEEPWVQGPLEFKNSPGDLPAGLKVKTDTENH

SEQ ID NO: 26759 - protein, 81 aa, Ursus maritimus
LGLLDPAQRKLYRDVMLENFRNLLSVGEGNVWVMDTYLDWRDKNEKEMEYIQGRELKCLSYRELSYWKIWEHVAGELTENQ

SEQ ID NO: 26760 - protein, 81 aa, Ursus maritimus
SQSFLTFEDVAMYFSQEEWELLDPTQKALYNDVMWENYETVISLALFVLPKPKVISYLDHEEEPWVQGPLEFKNSPGDLPA

SEQ ID NO: 26761 - protein, 81 aa, Ursus maritimus
QSLQDPVAFEDVAVNFTLEEWALLDPSQKKLYRDVMRETLRNLASIGKDDTLPNIEDQYKNQGRKLRSHMVETLCQSKEGS

SEQ ID NO: 26762 - protein, 81 aa, Ursus maritimus
PKPSVSFKDVAVTFTQEEWGQLNLAQRRLYRNVTLETWSHLVSLGLLLSKPDVISWLEQGQDSWRAEQGPPQDWKNTFEKK

SEQ ID NO: 26763 - protein, 81 aa, Panthera pardus
EQESVTYKDVAVDFTQEEWALMDTSQRTLYRDVTLENISHLVSVGCHFFRSDVISPWEQRGELWREERGPPQGWSPGMKKS

SEQ ID NO: 26764 - protein, 81 aa, Panthera pardus
FETMAHGSVTFRDVAIDFSQEEWEFLDSAQRDLYRDVMWENYSNFISLDVITLLDEGKEPWMVIREGTRRHYPDLESRYRT

SEQ ID NO: 26765 - protein, 81 aa, Macaca nemestrina
FQKPVTFEDVAVNFTQEEWDCLDASQRVLYQDVMSEIFKNLASVARIFLHKPERITKLEQEEEQWRETQVLQASQAGPPFF

SEQ ID NO: 26766 - protein, 81 aa, Macaca nemestrina
DSVTFEDVAVDFTQEEWTLLDQTQRNLYRDVMLENYKNLVAVDWESHINTKWSAPQQNFLQGKTSSVVEMVRFRSLALSPR

SEQ ID NO: 26767 - protein, 81 aa, Macaca nemestrina
DSISLEDVAVNFTLEEWALLDPGQRNIYRDVMRATFKNLACIGEKWKDQDVEDDPKNQGRKPSSPMVETLCENKEDHPCGK

SEQ ID NO: 26768 - protein, 81 aa, Ursus arctos
AQESVMFSDVSIDFSQEEWECLNDDQRDLYRDVMLENYSHLVSMGHSVSKPDVISFLEQGKEPWLVDRELTRDHWPVLESR

SEQ ID NO: 26769 - protein, 81 aa, Ursus arctos
KFQEAVTFKDVAVVFTEEELGLLDPVQRKLYRDVMLENFRNLLSVGYEPFRLETLPLGREEKLWVMETETQGDGPSGLRNQ

SEQ ID NO: 26770 - protein, 81 aa, Oryctolagus cuniculus
STEASVSFEDVAVDFTRQEWHRLDPAQRTMHKDVMLETYSNLASVGLCVAKPEMIFKLEGEELWIIESSGHGYPGSLSRLC

SEQ ID NO: 26771 - protein, 81 aa, Oryctolagus cuniculus
FQGPVTFKDITVEFNKDEWKLLTTAQRTLYKEVMLENYSLLAAVGYRVSKPNTVFKLKQGKKPWILEVEFPHQSHPEDLWK

SEQ ID NO: 26772 - protein, 81 aa, Oryctolagus cuniculus
SVTFRDVAIDFSQEEWKWLQPAQRDLYRCVMLENYGHLVSLVSEPTDEIKEFSPENVIYKGDSSQYLIVERILSQNPVHSS

SEQ ID NO: 26773 - protein, 81 aa, Pteropus alecto
LWLPLTFEDIAIYFSEQEWQNLEAWQKDLYRNVMRANYEILVSLDDGLPKPELISHIEQGKELFWNLGETQKSGNIICSSA

SEQ ID NO: 26774 - protein, 81 aa, Rhinolophus ferrumequinum
GWVPALFDEVAIYFSDEEWEVLTEQQKALYREVMRMNYETVLSLEFPFPKPDMISRLEGEEEPQNSDGWQLPGGTFAENED

SEQ ID NO: 26775 - protein, 81 aa, Rhinolophus ferrumequinum
LQGSVMFRDVSINFSQEEWECLDSGQMNLYKEVMLENFSNLVSVGLSSSKPAVISLLEQGKEPWMVETEMKRGLCSDLESM

SEQ ID NO: 26776 - protein, 81 aa, Rhinolophus ferrumequinum
FQESVTFEDVAIYFAENEWTGLTPAQRALYRDVMLENYAAVASLAFPFPKPALISQLERGEAPWSSAPQGALDGEGPRDIS

SEQ ID NO: 26777 - protein, 81 aa, Rhinolophus ferrumequinum
VQESVTFKDVAVLFTPDEWAQLSPAQRALYREVMLENYSNLVSLGLLGPKPDMVAHLGKKEEWMPQDASGCFCLDWMTTPM

SEQ ID NO: 26778 - protein, 81 aa, Rhinolophus ferrumequinum
LQVSVTFEDVAVLFTRDEWRKLRPFQRNLYQDVMLETYSNLVSLGLPFSKPKVISLLQQGEAPWELEEGSPEGSWPEERYV

SEQ ID NO: 26779 - protein, 81 aa, Rhinolophus ferrumequinum
SRRQCPMVTRMMFQPPVSFKDVVVTFTREEWGQLDPAQRTLYITITLETCDHLLSLGKAGSAHHRGFLPLGLRAVSLHKGC

SEQ ID NO: 26780 - protein, 81 aa, Ursus maritimus
MLENYRHLVSVGCHIIKPEVIIKLEQGEEPWIVEGEFLPQSYPEEVWKTDDLGERVQENEGRYSRQTVSINNKTLIEERGN

SEQ ID NO: 26781 - protein, 81 aa, Ursus maritimus
MDSAQRTLYRDVMLENYSHLVSVGYCFTKPELIFTLEQGEDPWLLKKEFLRKSSPEDSQPNQLSEKSLGNQGKYLWQVLFT

SEQ ID NO: 26782 - protein, 81 aa, Ursus maritimus
MLENYGNLVSVGCQLSKPDVISQLEKGEEPWLIEREISGSPGSDLENKTETRESTLKNGISWEELHHGLMMEQSTRGSTLY

SEQ ID NO: 26783 - protein, 81 aa, Ursus maritimus
AKESLTLEDVAVDFTWEEWQLLGPAQKDLYWDVMLENYSNLVSVGCQATKPDALSKFEHRDELWITENEIQNRTHPGFGNF

SEQ ID NO: 26784 - protein, 81 aa, Ursus maritimus
AHRSMTFSDVAIDFSQQEWEYLDSVQKNLYRDVMMENYDTLVSLAGHSISKPDVITLLEQGKDPWMVVKEDTRRWCTDLES

SEQ ID NO: 26785 - protein, 81 aa, Rhinopithecus bieti
MELLTFRDVAIEFSPEEWKCLDPAQQNLYRDVMLENYRNLVSLAMCSPFSQDLSPVQGIEDSFQKLVLRRYEKCGYKNLQL

SEQ ID NO: 26786 - protein, 81 aa, Rhinopithecus bieti
PQGHLTFMDVAIEFSQEEWKCLDPGQRALYRDVMLENYRNLVSLGICLPDLSIISMLKQRREPLILQSEVKIVKNPDGREC

SEQ ID NO: 26787 - protein, 81 aa, Balaenoptera physalus
MGTPDLGYCIPKPELIFRLEQGEQPWVLEEESPSQSYPEVCKVDNQLEQSQEIQDRHFGQAPFINNKTLTIERGSVTGNIE

SEQ ID NO: 26788 - protein, 81 aa, Muntiacus reevesi
GSVSFEDVAVGFSQEEWQLLGPSQKALCWDVMLENYCNLVSVGYQAPKPDSLFRLEQGRPPWKVKGAALSPTCPGLVFGNR

SEQ ID NO: 26789 - protein, 81 aa, Muntiacus reevesi
GLESVTFKDVAVDFTPEEWGRLGPGQRELYRDVMLENYQNLLSLGFPGAKPDVISRLEQGEEPRMERREAQQGTCPDLETS

SEQ ID NO: 26790 - protein, 81 aa, Muntiacus reevesi
GLLSFEDVALYFTREEWDTLDWAQKALYRDVMLDNYRHIVSLGFPFPKPEVICQLEQWEEPWTLDLPRAGTRKASGSACPD

SEQ ID NO: 26791 - protein, 81 aa, Muntiacus reevesi
PQGSTPFSSLTVDFTQGGWRQLAPAPRDRFEEGMPEKSRNLVLLGLPVSQPGMNFQLEQREDSWMLKRDGLRNACPDWKII

SEQ ID NO: 26792 - protein, 80 aa, Rhinolophus ferrumequinum
KMEQLMTFRDVAIDFSQEEWDYLDPAQRALYRDVMMENYSHLVLLISKPDVISFLEQEKEPWMVSRNMARGWCPETFKKA

SEQ ID NO: 26793 - protein, 81 aa, Rhinolophus ferrumequinum
QTQVSVTFEDVAVTFTQEEWGHLDPAQKILYQEVMLENCGLLVSLGCPIPRPELIYHLEQELWTVKKDLSQSTCPGDKEKL

SEQ ID NO: 26794 - protein, 81 aa, Rhinolophus ferrumequinum
FMVTFKDVAVVFTEEELGLLDSAQRKLYQDVMMENFRNLLSVGHQPFKQESEPHEELSYWQIWQQIARDLIRCQASMIKSS

SEQ ID NO: 26795 - protein, 81 aa, Rhinolophus ferrumequinum
MLENYSHLVSVGYQVSKPDTLSKLEQGEEPWIIEDEIHIPVCPEIGKVDNHLQGHLENEIMLKGMKQNHKHKALGNNVPQS

SEQ ID NO: 26796 - protein, 81 aa, Ursus maritimus
VTFGDVAVHFSREEWQCLDPGQRALYKEVMLENHSSVAGLGEAGSWDPSPASLINTHLARPCQKLGIWGPRVFVGQELTLG

SEQ ID NO: 26797 - protein, 81 aa, Ursus maritimus
WALLDTSQRKLFRDVMLENIRHLVSLGYQHCKSDVIFQLEQGEELWREGPGFLRGPSPGGPSFNNLSSLSPKQKSHTPEDP

SEQ ID NO: 26798 - protein, 81 aa, Ursus maritimus
LQGSVSFEDVAVDFTRQEWHRLDPAQRTMHKDVMLENYSNLASVGLCVAKPEMIFKLERGEELWILEEESSGRGYPGSLSL

SEQ ID NO: 26799 - protein, 81 aa, Ursus maritimus
ISQDLVTFKDVAVDFSQEEWEWLNPAQRNLYKNMMLENYQNLVSLGLCVSKPYVISLLEQGKFWATKTEMTRSLFPDSGSI

SEQ ID NO: 26800 - protein, 81 aa, Rhinopithecus bieti
IYFPQEEWELLEYTQKALYNDVMQENYETVISLALFVLPKPKVISCLEQGEEPWVQVSPEFKDTFVPFFKKSLNFSFYSWL

SEQ ID NO: 26801 - protein, 81 aa, Rhinopithecus bieti
PRLPLTFEDVAIYFSEQEWQDLEAWQKELYKHVMRSNYETLVSLDDGLPKPELISWIEHGGEPFRNWRESQKSRNIICSSS

SEQ ID NO: 26802 - protein, 81 aa, Rhinopithecus bieti
ESRPGAVSFADVAVYFSPEEWGCLRPAQKVLYRDVMRHTFGHLGALGFSGPKPAFISGVEAWSPEAQDPEGESPAAVSRGQ

SEQ ID NO: 26803 - protein, 81 aa, Panthera pardus
MAPLLGTEGLILNLFPFLQAGLNISKPYVVSLLEQGKEPWLEKRGVRRDLFSEPNREVKEFSRKNVIYEDDSPQCFVVGRI

SEQ ID NO: 26804 - protein, 81 aa, Panthera pardus
TQGCVTFEDVAIDFSQEEWGLLDEAQRRLYHDAMLENLALIASLGYESSMSLGVASLELGGKPWVSDWADVTPARTREAQG

SEQ ID NO: 26805 - protein, 81 aa, Panthera pardus
PRVSLTFEDVAVLFTRDEWRKLGPSERNLYQDVMLENYSNLVSLGLLFSKPKVISLLQQGEDPWKVEKESPGGPSLGYKSS

SEQ ID NO: 26806 - protein, 81 aa, Panthera pardus
SVTYKDVAVDFTQEEWALMDTSQRTLYRDVTLENISHLVSVGMKNSHNKQEIIPMQDICMNDPPNCWTVKCHTGEDLSVYS

SEQ ID NO: 26807 - protein, 81 aa, Panthera pardus
GCVTFEDVFVYFSREEWELLEEAQRLLYRDVMLENFALVASLDCWREADNEETPEQNVFVGVSQLRTPESGPFIQKAHPCE

SEQ ID NO: 26808 - protein, 81 aa, Macaca nemestrina
MDPLGLAISKPDVISFLEQGKEPWMVERVVSGGLCPVLESRYDTKELSPKQHVYEVESPQWEIMESLTSYGLECSSFQDDW

SEQ ID NO: 26809 - protein, 81 aa, Macaca nemestrina
PQASVCFEDVAMAFTQEEWEQLDLAQRTLYREVTLETWEHIVSLGLFLSKSDVISQLEQEEDLCRAEQVAPREARSSKEQR

SEQ ID NO: 26810 - protein, 81 aa, Gorilla gorilla
TARSQETVTFKDVAMDFTPEEWGKLDPAQRDVMLENYSNLVSLWLPVSKPENYNLENGKEPLKLERKAPKSSYSGKQSPLL

SEQ ID NO: 26811 - protein, 81 aa, Gorilla gorilla
ASGSVTFEDVAVYFSWEEWDLLDEAQKHLYFDVMLENFALTSSLGLTSSWSHVVAQLGLGEVPSVLHRMFMTPASARWDQR

SEQ ID NO: 26812 - protein, 81 aa, Gorilla gorilla
MDSVVFEDVAVDFTLEEWALLDSAQRDLYRDVMLETFRNLASVVSVHVRTHNGERPYVCKLCGKTFPRTSSLNRHVRIHTA

SEQ ID NO: 26813 - protein, 81 aa, Gorilla gorilla
QVTFSDVAIDFSHEEWGWLNSAQRDLYKDVMVQNYENLVSVGLSVTKPYVITLLEDGKEPWMMEKKLSKAISVITPASSVN

SEQ ID NO: 26814 - protein, 81 aa, Ailuropoda melanoleuca
PKVPVSFEDVSVYFTKTEWKLLDLRQRILYKRVMMENYRHLVSLGFLSSKPHLVSWLEQGEGPWAADICRTPAATGRQTGD

SEQ ID NO: 26815 - protein, 81 aa, Ailuropoda melanoleuca
LQGLVTFEDVAVYFSREEWGLLNLTQRSLYRDVMLENFALIGSLGFAPSRSHVVAQLESEEELWVPSMVNLTMGSRAEARR

SEQ ID NO: 26816 - protein, 81 aa, Gorilla gorilla
SLDLVSFEEVAVHFTWEEWQDLDDAQRTLYGDVMLETYSSLVSLGHCITKPEMIFKLEQGAEPWIVEETPNLRLSGGSRKQ

SEQ ID NO: 26817 - protein, 81 aa, Lynx canadensis
EEWGCLNHSQRELYRDVMLETYGHLLFLGAPQTQISRRNGNICSNEDIPNLKIDDFLTTKNVENKYLNQFENRIGLTFQTT

SEQ ID NO: 26818 - protein, 81 aa, Lynx canadensis
PQKSVTFEDVAVYFTQTEWNGLSPAQRALYRDVMLENYGNVASLGFSLLKPAVISQLEGAGQLGDPSPLVAGTEICSQGVW

SEQ ID NO: 26819 - protein, 81 aa, Phyllostomus discolor
WVQAPVTFKDVAMEFTQEEWMMLDSAQRSMYRDVMLENYMNLTSVAYQLCKPSVTSQLGQEETRTMKRRIPKGTYLNWEIQ

SEQ ID NO: 26820 - protein, 81 aa, Phyllostomus discolor
MTFADIALYFSREEWRLLNEAERRLYLDVMLENFELISSLGCCCGGEDVEELSEQNVSVRVVQAENPKVALSSQKSHPCES

SEQ ID NO: 26821 - protein, 81 aa, Phyllostomus discolor
SLDLVTFTDVAIVFSQDEWEWLNLAQRTLYKKVMLENYKNLVSVGLCLSKPDMISLLEQGKEPWVINGEMTGGLYPDLEYM

SEQ ID NO: 26822 - protein, 81 aa, Oryctolagus cuniculus
SGPERPEVAGQARAPRSVSGAAARWRAPGALLGGSRQDLWMPPTQPHAGFLVFKPELISRLEQGQEPWVLDLQGAEKTEAS

SEQ ID NO: 26823 - protein, 81 aa, Oryctolagus cuniculus
MTAFEDVAVYFTWEEWQKMNNAQKILYRDVMLETYSSLFSLGHCITKPDLIFKLEQGAEPWMVDECLNESLPVGMKRDDLI

SEQ ID NO: 26824 - protein, 81 aa, Rhinolophus ferrumequinum
GLLTFRDVFIEFSQEEWECLDPAQQKLYMDVMLENYRNLVSLGLAIAKPDLVTFLEQKQEAWGVKIKRTAIHPDMSPHDTL

SEQ ID NO: 26825 - protein, 81 aa, Rhinolophus ferrumequinum
MSLTFRDVAIHLSQDEWECLDPAQRALYRDVMMENYSNLVSLGCSIPKPDVITLLEQEKEPWMVMREGTRSWYTDLESKCV

SEQ ID NO: 26826 - protein, 81 aa, Rhinolophus ferrumequinum
MLENFRNLLSVGHLPFKPDMVSQLEVEEKLWMMERETQRNENSSGSHMAVLSGSKNQNKVETLQKVALKYLLHEELPCWQI

SEQ ID NO: 26827 - protein, 81 aa, Rhinolophus ferrumequinum
QPWLTLQDVIIEFSPEEWECLDSAQRLYRDVKSENYRNLRSLDEGDVSPEVRICPCVSSPLCASWEPLPCVTEIEALFTQT

SEQ ID NO: 26828 - protein, 81 aa, Ursus maritimus
FQGSLSFRDVAVGFTRKEWQQLEPAQRTLYRDVMLENYSHLVSVGEEITKPAVISRLEQGQEPWMEEEEILRWSFPGERGS

SEQ ID NO: 26829 - protein, 81 aa, Ursus maritimus
SVTFEEVAVDFSQEESASLDPAQKILYRDLMLENYRNLRQPHIVIDQKFQLKIKRPLQSRIKSGKNTYCQENDANSTQRET

SEQ ID NO: 26830 - protein, 81 aa, Ursus maritimus
STEPVIFRDVAMYFTQKEWQLLKPAQKDLYREVMLENYGNLASLGYRLFKPKLITRLEQGDEPCVKERDVPRAPQQGDAGI

SEQ ID NO: 26831 - protein, 81 aa, Ursus maritimus
MGLLTFGDVAIEFSQEEWRCLSHTQRELYRDVMLENYGHLLFLGLIASKPDLVSCLEQKKEPWDLKRRKTVANISENQRFK

SEQ ID NO: 26832 - protein, 81 aa, Rhinopithecus bieti
SQEPVTFADVAVVFTPEEWVFLDSTQRSLYRDVMLENYRNLASVADQLCKPTALSYLEQRGEQWTTDRGILSDTCAEPQLQ

SEQ ID NO: 26833 - protein, 81 aa, Phascolarctos cinereus
GKESVTFKDVAVEFTQEEWVQLNSSQKKLYKDMMLENYRNLVSLERRGFTGDKPLECNECGKAFWSKNHLAVHQRIHTGDI

SEQ ID NO: 26834 - protein, 81 aa, Phascolarctos cinereus
HQALVTFKDVAVDFTQEEWGRLCPSQKELYRDVMLENYRNLVWLGLAVSKPDVIYQLEQVEGPWVPEGEAPAVSCPESFIS

SEQ ID NO: 26835 - protein, 81 aa, Phascolarctos cinereus
MLENYRNLVSLGLPVSKPEVISQLEQGEVPWLAEEEVPRSTYSDWETRPETKNSVAKQGTSVKESSQERLAGCGLWDSNLG

SEQ ID NO: 26836 - protein, 81 aa, Puma concolor
MSPAQRTLYRDVMLENYSHLISVGYCLTKPKMIFRLEQEEEPWSLEEEFLNQRYPGYFSIDIHIEGNQEKQEKPLWQVIFT

SEQ ID NO: 26837 - protein, 81 aa, Myotis lucifugus
ESQDMNFEDVAIAFSQEEWGLLDEAQRHLYCDVMLEVFALVSFIGHWHKMDDVEAYSEHSVSVGESQVRASKTAIATQRTH

SEQ ID NO: 26838 - protein, 81 aa, Myotis lucifugus
FQETVTFGDVAVHFSREEWMCLDPGQRALYKEVMLENHSSVAGLAGFLLFKPELISRLEQGQEPWVLDLQGTEAREARRTL

SEQ ID NO: 26839 - protein, 81 aa, Myotis lucifugus
MNFEDVAIAFAQEEWEILDEAQRRLYCDVMLEVFSLVSFVGPWRKMDDVEAYSQHSVSVGDSQVRASRTAAATQRTHLCKP

SEQ ID NO: 26840 - protein, 81 aa, Sapajus apella
SRSLENDGVCFTEQEWENLEDWQKELYRNVMESNYETLVSLKVLGQPEGEAELGTEMLGDLEEEGPGGAHPGGVMIKQELQ

SEQ ID NO: 26841 - protein, 81 aa, Oryctolagus cuniculus
TPGSLTFTDVAIDFSEDEWQWLNLAQRSLYRKVMLENYRNLVSVGLCISKPDMISLLEQEKEPWVVTGDMTRGLYPDLEYV

SEQ ID NO: 26842 - protein, 81 aa, Oryctolagus cuniculus
PQVSVTFEDVAVLFTWDEWKKLDPSQRILYRDVMLENYSNLLSLGLPCTKPNVISLLEQGEDPIEEESPGGFSLGCKSRLK

SEQ ID NO: 26843 - protein, 81 aa, Oryctolagus cuniculus
SQELVTFEDVAVYFIRKEWKRLEPAQRNLYRDVMLENYGNVFSLDGETRTEDDQDISQDRGSHGVLLGRFQKDISQGLKFE

SEQ ID NO: 26844 - protein, 81 aa, Pteropus alecto
PKVPVTFDDISIYFSTPEWEKLEEWQKELYKNIMKGNYESLISMDYAMNQPDVLSQIQPEGEHNTEDQTRPQESEIPTDPS

SEQ ID NO: 26845 - protein, 81 aa, Pteropus alecto
SQGLVTFEDVAVYFSLEEWQRLDAAQRDLYKEVMQENYGILVSLGYPIPKPDLIFRLEQGEEPWVPDSPSPEEGDIVTGVY

SEQ ID NO: 26846 - protein, 81 aa, Pteropus alecto
QGLLIFRDVAIEFSQEEWECLDTAQRALYRDVMSENYRNLVFLAGPDHLFGANEGVLRFEEKKDNIHPPRYVGMSEADDTD

SEQ ID NO: 26847 - protein, 81 aa, Oryctolagus cuniculus
MVIVQEFLTLEDMAVAFTQEEWQLLGPAQRDLYWDVMLENYSNLVSVGYQASKPDVISKLERGELWTMEDKMHSPVCLGEW

SEQ ID NO: 26848 - protein, 81 aa, Rhinolophus ferrumequinum
LQASVSFKDVTVEFTQEEWQHLGPAQRALYRDVMLENYSHVVSVEDWQLDHLENTQENQDKYLCQVLFTSSQSLTNEQEKV

SEQ ID NO: 26849 - protein, 81 aa, Rhinolophus ferrumequinum
TPVLYTLPRATENERTSGYCFTKPELIFRLEQCEDPWLIEKEFLSRNSPEASQLDELSEKSPENQGKHLWQVLFTKNSLIT

SEQ ID NO: 26850 - protein, 81 aa, Rhinolophus ferrumequinum
QAQESLTFDDVAVHFTWEEWQLLVPEQKDLYRDVMLENYSHLVSVGYQVSKPDVFCKLERGELWTIDKIHSQNCPEIRKVN

SEQ ID NO: 26851 - protein, 81 aa, Ursus maritimus
VTFEDVAVYFSWKEWRLLDEAQRRLYHRVMLENFTLISSLGCCCGAEGEEAPFAQSTSVGASQAGTPTAPVSSRKTHPCEL

SEQ ID NO: 26852 - protein, 81 aa, Ursus maritimus
QEEWQHLDPAQRSLYRDVMLENYSHLVSLGYSISKPEVILKLEQGEEPWILEEEFPSQSDLELIKSRNYSRKKFNEFNKGR

SEQ ID NO: 26853 - protein, 81 aa, Ursus maritimus
SLTHIKQDLSLQESLTLEDVAVGFTWEEWQLLAPTQKELYQDVMLENYRNLVSVGEDKTTLFHLSVKHFLNARFLLKGFSI

SEQ ID NO: 26854 - protein, 81 aa, Ursus maritimus
DGILDVAVYFSREEWELLDETQRHLYHNVMLENLALVASLGKALPPPSFLFCSLSFLFSRNSSEHSELSTSIEHAEDVLDS

SEQ ID NO: 26855 - protein, 81 aa, Ursus maritimus
MLENYKIIVSLGLPVPRPDVIFQLKRGDEPWIVDLHRSEERECPENVSLDWGTKPEIHGASEEESEGTARGKLGGEVPVCP

SEQ ID NO: 26856 - protein, 81 aa, Ursus maritimus
MAAGFKFKDVAIYFSQKEWECLHSAQKALYRDVMLENYNNLISLGLSDSKPDVISLLEQGKEPWMVKSQETKECCPDWESR

SEQ ID NO: 26857 - protein, 81 aa, Rhinopithecus bieti
NFWILRLPPGSKGEAPKEWGKLEDWQKELYKHVMRGNYETLVSLDYAISKPDILTRIERGEEPCLDGWGQEKQNEVEVGHP

SEQ ID NO: 26858 - protein, 81 aa, Puma concolor
FEGSVSFEDVAVDFTRQEWHRLDPAQRTMHKDVMLENYSNLASVGLCVAKPEMIFKLERGEELWILEEESSGQRFPGSLSL

SEQ ID NO: 26859 - protein, 81 aa, Sapajus apella
MGVLTFRDVAIEFSPEEWECLDSAQQHLYRDVMLQNYRNLVFLGLAVTKPDLITHLEQEKELWNVERQETVAKYPEILPKQ

SEQ ID NO: 26860 - protein, 81 aa, Sapajus apella
FQESVAFEDVAVYFTQNQWGSLDPAQRALYSEVMLENYANVASLAFPFPKPALISHLEKGEAPWGPDPWDAEIPSGINQGG

SEQ ID NO: 26861 - protein, 81 aa, Sapajus apella
MDVAIEFSLEEWQCLDTAQRNLYRDVMLENYRNLVFLGIVVSEPDLITCLEKGKKPLTVKGHEMIATPPVMCSHFAKDLWP

SEQ ID NO: 26862 - protein, 81 aa, Oryctolagus cuniculus
FRAGTLWPPCSLGLSGPLEFTVRGRSRLEGLSFEDLTVYFTHEEWQDLDDAQRTPYREVMHYLVNINFQSTVYGLQWLPPR

SEQ ID NO: 26863 - protein, 81 aa, Oryctolagus cuniculus
MLENYGHLVSLGLSISKPDLVSLLEQGKEPWLGKGDIRRNLFSVSEPTDEIKEFSPENVIYKGDSSQYLIVERILSQNPVH

SEQ ID NO: 26864 - protein, 81 aa, Oryctolagus cuniculus
MKGHKDSQGGPRDELIHTSRQALTHGLCFGFCVTKPEVIFRLEQGEEPWILEEEFSNQSFPGIWKADHLNERSKENHLKHF

SEQ ID NO: 26865 - protein, 81 aa, Pteropus alecto
MNRVSPFKDMIFCFSEEDWSLLDPAQTGFYGEFIIGEDCGVSLPPDVPAAQLDLSQEENEPRVPELQDPQEKGAAQASYAA

SEQ ID NO: 26866 - protein, 81 aa, Oryctolagus cuniculus
SQSFVEFGDVAIGFSQEEWEWLNPAQRTLWKRVVWENHSDLGASEHCVSKPDFVSLLEEGKEPWMGRRDVTGGLFSLESSG

SEQ ID NO: 26867 - protein, 81 aa, Rhinolophus ferrumequinum
PQKSVTFEDVAVYFTPTEWDGLSPAQRALYREVMLENYGNVASLGFSLLKPAVISQLEGGGELGCPSLLTAGTGTGPPGLW

SEQ ID NO: 26868 - protein, 81 aa, Rhinolophus ferrumequinum
FQGAVTFKDVIVEFTQEEWKLLDTAQRTLYREVMQENYGHLVSVGYCVNKSNAVFKLKQGKEPWTLEVEFPRQNHPENLWN

SEQ ID NO: 26869 - protein, 81 aa, Ursus maritimus
MLENYSNLVSVGYQVTKADAFYQLENGTPWITEEEIQSQSHPEDTWEVDCHTDGHKENQGNLETMESHHENNAFRKILSLS

SEQ ID NO: 26870 - protein, 81 aa, Ursus maritimus
GLLTFGDVAIEFSQEEWQCLSHTQRELYRDVMLENYGHLLFLECGKSGNESSRIRIHKTVCSGEKPYKCKECGKAFIQKSH

SEQ ID NO: 26871 - protein, 81 aa, Panthera pardus
ALALVSFEDVAVTFTGEEWRQLDLAQRTLYQEVMLETCGLLVSLGHPVPKPELIYPLEPGQELWTGKRGISKSTYTGEKAK

SEQ ID NO: 26872 - protein, 81 aa, Panthera pardus
RLPALLLALDRRRRTASQNAPPESGAQVPVSFEDVSMYFIKTEWKLLGLSQRILYKRVLLENYRHLVSLGCTVQSLAVSVP

SEQ ID NO: 26873 - protein, 80 aa, Oryctolagus cuniculus
MEIFESFEDLAVYFTWEEWQNMNKAQKILYRDVMLETYSSLLFLGHCITKPDLIFKLEQGAENLMNVITVAKPSAISHNS

SEQ ID NO: 26874 - protein, 81 aa, Oryctolagus cuniculus
RPRALKFVDVAVYFSEEEWGCLRPAQRALYRDVMRENYGHLGALGFPGPKPALISWMERESEAWSPAAQDPDEGQSPGGAL

SEQ ID NO: 26875 - protein, 81 aa, Ursus maritimus
SLSFEDVAVDFTWEEWQLLDSAQKTLYRSVTLENLSSLVSLGKDTSCVDVDARPFPAHLLKSGTCECGVKLAPLKQKPNKH

SEQ ID NO: 26876 - protein, 81 aa, Ursus maritimus
DVAIDFSREEWEWLNSAQRTLHRDVMLENYRNLVSLGPCVSKPDLVSLLEHGKEPWMVEREVTRGLFSGECGGPGGVGSAT

SEQ ID NO: 26877 - protein, 81 aa, Ursus maritimus
MGLLTFGDVAIEFSQEEWRCLSHTQRELYRDVMLENYGHLLFLGLIASKPDLVSCLEQKKEPWDLKRRKTVNLTVPNDNLE

SEQ ID NO: 26878 - protein, 81 aa, Ursus maritimus
EAVVFADVAVDFTPEEWALLDGGQRRLYRDVMLETCRNLGTNVSYECPILLGPRNGGTLHVWESNEGNRCGETVKQIPSLT

SEQ ID NO: 26879 - protein, 81 aa, Ursus maritimus
PQEPVTFADVAVLFTPEEWMFLDSAQRSLYRDVMLENYRNLASVGDQLGKPSTFSHLEPPERSSFPGTHPEPQHQPQDSVS

SEQ ID NO: 26880 - protein, 81 aa, Rhinopithecus bieti
FRDVAIEFSQEEWKCLDPAQRTLYRDVMLENYRNLVSLDISSKCTMKEVLSTVQGNREVFHTGTLQRHESHHFGDFCFQDI

SEQ ID NO: 26881 - protein, 81 aa, Panthera pardus
YMQGLLTFRDVAIEFSQEEWGCLNHSQRELYMGVMLDTYGHLLFLGLVVSKTDLVIVLEQEKELWGVKRKETVALHPGRWK

SEQ ID NO: 26882 - protein, 81 aa, Panthera pardus
SQVSVSFKDVTVEVTQEEWHQMDPAQRTLYRDVMLENYSHLVSLGYCFIKPEVIFRLEQGEDPWLLEDEFLNRSYLGDCQL

SEQ ID NO: 26883 - protein, 81 aa, Panthera pardus
HQEVVTFEDAAIYFTRTEWAGLSSAQRDLYREVMLTNYGNLTSLGYPVCRLALMSLLEEGDLSWGLETQDDPPAESTNDVC

SEQ ID NO: 26884 - protein, 81 aa, Panthera pardus
QDFVSFKDVAVNFTEEEWRELDPVQRVLYRDVMLENYRNLVSLDLETRKLSPKNVFSEEESYQGISMEKNTEVDASLKEAW

SEQ ID NO: 26885 - protein, 81 aa, Macaca nemestrina
MLENYRNLAFLGIAVSKPDLITCLEQGKEPWNMKRHEMVDKPPAICPHFAQDFWPEQGMEDSFQKVLLRKYEKCGHENLQL

SEQ ID NO: 26886 - protein, 81 aa, Macaca nemestrina
MLENYRNLAFLGIAVSKPDLITCLEQGKEPWNMTQHEMVDESPGICPRFAQDLWPEQGMDDSFQKVILRRYEKYGPENLQL

SEQ ID NO: 26887 - protein, 81 aa, Oryctolagus cuniculus
PKVPVTFDDVAVYFSELEWGKLEDWQKELYKHVMRGNYETLVSLDYAIAKPDILTRMERGENPCPEDQWGQEKKENEQGTA

SEQ ID NO: 26888 - protein, 81 aa, Oryctolagus cuniculus
AQGPVSFKDVAVGFTQEEWRQLEPAQRRTYREVMLENYSHLVAVGGDISKPRVIVKLEQGEEPWVPEGELPCRSRAEEAWK

SEQ ID NO: 26889 - protein, 81 aa, Pteropus alecto
MVKIEDMAVSLILEEWGCQNLARRNLSRDNRQENYGNVFSQENIFAASQHAVCGDSLQEEKKEVFRAAIDKKLTQLCSKGN

SEQ ID NO: 26890 - protein, 81 aa, Rhinolophus ferrumequinum
SLETVTFKDVAVDLTQEEWQQMKPAQRNLYRDVMLENYSNLVTVGYQVTKPDVIFKLEQEEEPWVIEEEMFGTHCPESRRG

SEQ ID NO: 26891 - protein, 81 aa, Rhinolophus ferrumequinum
VQGSVSFEDVTVEFTQEEWPYLGPTQRALYRDVMLENYSHLVSVGYCITKPQVIFKLEQGEELWSLEEEFLIQRYPGYYQV

SEQ ID NO: 26892 - protein, 81 aa, Rhinolophus ferrumequinum
FCVTFEDVAVFFSWEEWELLDEAQRHLYHDVMLENLRLITSPGKIFTPTSPLVVHRMVMSPATARWAQREPGPEEWHPGGG

SEQ ID NO: 26893 - protein, 81 aa, Rhinolophus ferrumequinum
FQASVSFKDVTVGFTPEEWQHLDPTQRSLYRDVMLENYSNLVSVGYCVTKPEVIFRLEQGEEPWILEKEFMSQSFPEVWKT

SEQ ID NO: 26894 - protein, 81 aa, Rhinolophus ferrumequinum
MSFMVTFKDVAVVFTEEELGLLDSAQRKLYQDVMMENFRNLLSVGHQPFKQGKIQQEMGTIPESEPHEELSYWQIWQQIAR

SEQ ID NO: 26895 - protein, 81 aa, Rhinolophus ferrumequinum
AQGSVSFEDVTVEFTQEEWPYLGPAQRALYRDVMLENYSHLVSVGYCITKPQVIFKLEQEEEPWSLEEEFLNQRYPGYYQV

SEQ ID NO: 26896 - protein, 81 aa, Ursus maritimus
LTFGDVAIEFSQEEWRCLSHTQRELYRDVMLENYGHLLFLGEDDSFQISQAPLGPDLVSCLEQKKEPWDLKRRKTVVIHSG

SEQ ID NO: 26897 - protein, 81 aa, Ursus maritimus
RGGCGEKQAGATLKLLLAKVPVTFVDIAVYFSEDEWKNLDEWQKELYNNLVKENYKTLMSLGKRSFPPPGRAVSGLCVRSL

SEQ ID NO: 26898 - protein, 81 aa, Ursus maritimus
TVTFKDVAVVFTEEELALLDKAQINLYQDVMLENFRNLVSVGDRIKNNISHLQGKGLSYLSQEVLYCWQIWKQRVSELTVS

SEQ ID NO: 26899 - protein, 81 aa, Rhinopithecus bieti
EKGPLTFRDVAIEFSLEEWQCLDTAQQDLYRRVMLENYRNLVFLGIAVSNPDLITCLEQGKEPWNMKRHAMADEPPVMYSH

SEQ ID NO: 26900 - protein, 81 aa, Rhinopithecus bieti
PQASVCFEDVAMAFTQEEWEQLDLAQRTLYREVTLETWEHIVSLGLFLSKSDVISQLEQEEDLCRAEQVVPRGARSSKEQR

SEQ ID NO: 26901 - protein, 81 aa, Panthera pardus
PKSVCRLEEGIPLPHPHPEMESTLPTTGAQGPMLFEDLAVFFSQEECVCQHSVQRSLSRDTTQEGFEEMALMENSFRREEV

SEQ ID NO: 26902 - protein, 81 aa, Panthera pardus
SQDLVTFKDVAIDFSQEEWEWLNPAQRSLYKNMMLENYRNLVSLDLESMYETHELSLKHFVYDDVLMERITGCGLEHSTFS

SEQ ID NO: 26903 - protein, 81 aa, Macaca nemestrina
LFQVTFSDVAIDFSHEEWGWLDSAQRDLYKDVMVQNYKNLVSVTGLSVTKPYVITLLEDGREPWMVEKKLSKDWESRWENK

SEQ ID NO: 26904 - protein, 81 aa, Macaca nemestrina
VTFRDVAIEFSLAEWKCLNPAQRALYREVMLENYRNLEAVDSSFKTMMEYSSTGQGNTEVLHTGMLERHESHHIGDFCFPE

SEQ ID NO: 26905 - protein, 81 aa, Ursus arctos
ELLSFEDVAMYFTREEWNRLDWAQKDLYRDVMLENYRNMILLGSEARCKMKKPTPKQKISEDSESCKMSVVKQTTAKRPAE

SEQ ID NO: 26906 - protein, 81 aa, Ursus arctos
MASPSPPPEPKEWDYLDPAQRSLYKDVMMENYGNLVSLDVLNRDKDEEPTVKQEMEEIEEEVEPQGVIVTRIKSEIDQDPI

SEQ ID NO: 26907 - protein, 81 aa, Oryctolagus cuniculus
MCCFALTGCCISKPEVIFKLEQGAEPWIVEEPVNHSLPVLQKMDDLIGTSQEIQDMIFWQVVMTNNTSTKENTYLGETFNL

SEQ ID NO: 26908 - protein, 81 aa, Pteropus alecto
PKASRSLENDGVCFSEQEWENLEDWQKELYRNVMKSNYETLVSLRPRLQRRLENMENLLKNRNFWILRLPPGSNGEVPKVP

SEQ ID NO: 26909 - protein, 81 aa, Rhinolophus ferrumequinum
VMFRDVAIDFSQEEWECLDFAQRDLYRDVMLENYSNLVSLDLPSRCANKELSPKKDTFETELSQWEMSDRLENYDLKECSS

SEQ ID NO: 26910 - protein, 81 aa, Rhinolophus ferrumequinum
LLQAPVSFKDVTVEFTQEEWQHLGPAQRALYRDVMLEIYSHLVSVGYCSIKPEVIFQLEQEDPLLVEDKFLNGSYPAGIFE

SEQ ID NO: 26911 - protein, 81 aa, Rhinolophus ferrumequinum
QGRVTFDDVAVYFSLEEWDLLDEAQRHLYHDVMLENLALITSLELEHQKQHIGEKCFRSNMGTVSLVKDCKFCVSGKPFSC

SEQ ID NO: 26912 - protein, 81 aa, Ursus maritimus
MLENYRNLVSVGYQASKLDSLFQSEQGGPPWTVEGAAQSQTCPEEIWEIDHMQWHPENQNESKTLERYQQSYALGNNFDLC

SEQ ID NO: 26913 - protein, 81 aa, Ursus maritimus
LGLLDPAQRKLYRDVMLENFRNLLSVGEGNYIQGRELKCLSYRELSYWKIWEHVAGELTENQDHRVNLQGKSFQFSEDASL

SEQ ID NO: 26914 - protein, 81 aa, Ursus maritimus
QDSVVFEDVIVDFTQEEWTLLNPAQRRLYKDVMLETFRNLVSVDDDTQLKTNGSISQQDIFGEKISNEQKIARFIKNDYWT

SEQ ID NO: 26915 - protein, 81 aa, Ursus maritimus
QGWLTFRDVAIEFSPEEWECLDPAQRALYQDVMVENYRNLVSLGEDSFPPELNSISVSEQGEEPWTVESEGEIGGNADRWE

SEQ ID NO: 26916 - protein, 81 aa, Ursus maritimus
ALGLVTFEDVAVYFSREEWGLLNLTQRSLYRDVMLENFALIGSLGFAPSRSHVVAQLDSEEELWVPSMVDLTMGSRAEARR

SEQ ID NO: 26917 - protein, 81 aa, Rhinopithecus bieti
AQGYVTFEDVTIYFSQEESGLLDEAQRLLYCDVMLENFALIASLGLISFRSHIVSQLEMGKEPWVPDSVDMTSAMARGAYG

SEQ ID NO: 26918 - protein, 81 aa, Rhinopithecus bieti
ADVSLAFRDVSIDLSQEEWECLDPAQRDLYKDVMLENYSNLVSLGYTIAKPDVITLLEQQQEPWIVMREGTRSWYTDLEYK

SEQ ID NO: 26919 - protein, 81 aa, Rhinopithecus bieti
MDTVVFEDVVVGFTLEEWALLNPAQRNLYRDVMLETFKHLASVDNEAQPKTGGSISQQDTSGEKLSLKQKIEKFTRKNTWA

SEQ ID NO: 26920 - protein, 81 aa, Panthera pardus
RPESVTFEDVAVYFSENEWIGLAPAQRVLYRDVMLENYGVVASLGYPFLKPAAISHLEQVEELLNLKLQGEGPSLLCTEGV

SEQ ID NO: 26921 - protein, 81 aa, Macaca nemestrina
TQGPLKFMDVAIEFSQEEWKCLEPAQRTLYRDVMLENYRNLVSLGICLPDLSVISTLEEKKDPWILQSEEKIANNPDGREC

SEQ ID NO: 26922 - protein, 81 aa, Macaca nemestrina
PQGHLTFRDVAIEFSQAEWKCLDPAQRALYKDVIIMGSEFYSFLAFLGSSYALGSNAKDKPVKKQLGVSFHLHLSELELFP

SEQ ID NO: 26923 - protein, 81 aa, Myotis lucifugus
QEQVSFKDVCVDFTQEEWYLLDSAQKILYRDMMLENYSHLVSIGYCITKPEVIIKIEQGEEPWILKQGFPSQCHPEDWKVG

SEQ ID NO: 26924 - protein, 81 aa, Myotis lucifugus
DMNFEDVVIAFSQEEWGLLDEVQRHLYCDVMLQALLNTVSLSCWHKMDNEEAYSDQSVSVQGESRVRASKTAPATQKSHSC

SEQ ID NO: 26925 - protein, 81 aa, Myotis lucifugus
SQDMNFEDMAIAFSQEEWEILEEAQRRLYCDVMLEVFALVASVGCRHKMNDEEAYSDQSVSIEEESHVRDSETASASQKSH

SEQ ID NO: 26926 - protein, 81 aa, Puma concolor
AQAPLSFEDVAVSFSREEWRLLVPAQKDLYRDVMLENYRNLVSVGYQASEPDSLFRLEHGGPLWVVEGAAPRPPCPGEYVA

SEQ ID NO: 26927 - protein, 81 aa, Sapajus apella
MLETYSHLLSVGYQVPEAEVVMLEQGNEPWALQGERPRQSCPGEKLWDHNQCRKILDYKQVSSQPQKMHPGKKPYERAEFQ

SEQ ID NO: 26928 - protein, 81 aa, Sapajus apella
FFAVLSFMTVAIEFSQEKWECLNPAQANLYRGAMLENYRNLLLLGLTVSKLDLVTFLEGRKEPWTVTSEETVAAQPGMCSY

SEQ ID NO: 26929 - protein, 81 aa, Oryctolagus cuniculus
GAQGSVTFRNVAMFLSQAEWLHLDSTQSSSYQEVTLENYNNLLSLRILFSQPKVISQLQQADHWLVKKEVPRGTCLGWESL

SEQ ID NO: 26930 - protein, 81 aa, Oryctolagus cuniculus
QQVMIAFEDLAVYFTWEEWQKMNNAQKTLYRDVMLETYSNLFSLGHCITKPELIFKLERGAEPCMVDECLNQSLSVGMKRD

SEQ ID NO: 26931 - protein, 81 aa, Pteropus alecto
WSQMPVTFEDVALYLSREEWGRLDHTQQSFYHDVLQKRNRLALGAVEVGKEPMPCPASHGDVKSFRTRAERAHGDSLQCGQ

SEQ ID NO: 26932 - protein, 81 aa, Oryctolagus cuniculus
TSPTMIAFEDLAVYFSWEEWKNMNKAQKILYRDVMLETYSSLLSLVAMKNDDIIRTNQEIQENLNQNGTTDNKTATPKRVE

SEQ ID NO: 26933 - protein, 81 aa, Rhinolophus ferrumequinum
ELVTFRDVIINFSQDEWEYLNSAQRDLYWDVMMENYSNLVSLDLEYKYATKSLSVGKNIIENNGSLWEVIESSKFIGLQNY

SEQ ID NO: 26934 - protein, 81 aa, Rhinolophus ferrumequinum
LTFEDIAIYFSAQEWRTLEAWQKELYKHVMRTNYEILVSLGNQQAVSSGEPACHFQADPLQSQCSSEPLLGKREAVSFTPD

SEQ ID NO: 26935 - protein, 81 aa, Rhinolophus ferrumequinum
VDDLVIFRDVAVDFAQEEWECLNSYQKNLCRDAILENYSNLVSVGYSISKPHVVTLIEQGKEPWMVARDEKKRWNFIHHLF

SEQ ID NO: 26936 - protein, 81 aa, Ursus maritimus
MQKNLYRDVMLETFQNLVSVDYETLFKASGLVSQQDRHEEKNPSEQNMAKFTRNHSCAYILEKNWEDHSIEDQHGNHSRHL

SEQ ID NO: 26937 - protein, 81 aa, Ursus maritimus
RRICTNTDSVTFTDVAVNFTREEWALLDSAQRILYRDVMLENCRNLASVGSQAEPESKIWIDRQNNILHVHNSICVGVDID

SEQ ID NO: 26938 - protein, 81 aa, Ursus maritimus
MLENYQNLVAVGYQLPKPKLITWLEQQELRTVEKRVFQEWEMQHQAKGSASHQDSLEGKTARKIKKEGTHRGAEYSDYQQS

SEQ ID NO: 26939 - protein, 81 aa, Rhinopithecus bieti
SCEGSVSFRDVAINFSREEWQHLDLSQRNLYRDVMLETYSHLLSAGYQVPKPEVVMLEQGKEPWALQGDRPRQSCPGEKLW

SEQ ID NO: 26940 - protein, 81 aa, Myotis lucifugus
AQDMNFEDMAIAFSQEEWEILDESQRRLYCNVMLEVFAFVSFVGSKGHSSFIPYVQHTFIMGLHPVNIHFLIISLFSGPWH

SEQ ID NO: 26941 - protein, 81 aa, Puma concolor
MLENFSHVISLGYPVSKPDVISKLEQGEDPWIIKRDIPYYGASDSNLEKMHNGVMPCNNNQCGNIFSSKQSLMQYQNVETK

SEQ ID NO: 26942 - protein, 81 aa, Sapajus apella
MFQNYENLVSLGLSITKPYVITLLEDGKEPWMMEKNLSKGVTPDWESRWENKELSTKKDIYDEDSPQTVIIEKVIKQSYEF

SEQ ID NO: 26943 - protein, 81 aa, Sapajus apella
MLENYRNLVFLGIALSKPALITYLEQGKEPWNMKRHETVAKPPVMCSYFAQDLLPEQDTKKLFPKVILRSYGNCGDKHVPL

SEQ ID NO: 26944 - protein, 81 aa, Sapajus apella
QGCLTFSDVAIEFSLAEWKCLTPAQRALYREVMSENYRNLESVGEENVPLDMRNLCQAGVQWRNLGSLQPPPPRFKKFSYL

SEQ ID NO: 26945 - protein, 81 aa, Sapajus apella
PKVPVTFDDVAVYFSEQEWGKLEDWQKELYKHVMRGNYETLVSLDYAISKPDILTQIERGEEPCPDQWSQKKGSEVEVAHS

SEQ ID NO: 26946 - protein, 81 aa, Oryctolagus cuniculus
MIAFEDLAVYFMWEEWKKMNNAQKILYRDVMLETYSSLFSLGYCTTKPDLIFKLERGAEPWMVDECLNRSLPVVMKRDDLI

SEQ ID NO: 26947 - protein, 81 aa, Oryctolagus cuniculus
ISFDDVAVDFTLEEWLLLNPTQKNLYRDVMLENCSNLVFLEVWLDNDSKIWHQDNQDKLKSMERGHQYDVLEKIFNSSINF

SEQ ID NO: 26948 - protein, 81 aa, Oryctolagus cuniculus
KVPVTFDDVAVYFSEQEWGKLEDWQKELYKHVMRGNYETLVSLGSAPPVPAPDLLMQIKQEGELQLQEQQALGVEAWAAGQ

SEQ ID NO: 26949 - protein, 81 aa, Oryctolagus cuniculus
SCEGSVSFRDVAIDFSSEEWQHLEPAQRSLYWDVMQETFSHLLSVGFQVPEPEVFMLEQGEEPWELQSKNPSQFCPGEKLW

SEQ ID NO: 26950 - protein, 81 aa, Pteropus alecto
SCEGSVSFRDVAVDFSREEWQHLDLAQKNLYRDVMLETYSHLLSVGYQVPEPEVFMLEQGKEPWALQDESPHQSCSGEKLW

SEQ ID NO: 26951 - protein, 81 aa, Pteropus alecto
MDFTLEDWEQLGLDQGDVFWDTALDNYQNLFLLNPPGSDLPSPPDVAEEPEALMRGSPEATGPDIAEAKNCSPLQDFLEEG

SEQ ID NO: 26952 - protein, 81 aa, Oryctolagus cuniculus
LQVLVSFEDLAVDFTWEEWQDLDSAQRTLYRDVMLETYSSLLSLGFCITKPEVIFKLEQGAEPWTVEESLNQSVSGQSVHT

SEQ ID NO: 26953 - protein, 81 aa, Rhinolophus ferrumequinum
SVTFGDVAVLFSQDEWLCLDPAQRALYREVMLENYSSLVSLDFKTWPEIEALPPRQDIFIEETSQGIRKKKCAKFGHWGIK

SEQ ID NO: 26954 - protein, 81 aa, Rhinolophus ferrumequinum
AQDSVTFEDIAVFFSWEEWGLLDEAQRRLYHDVMLENFALISSLGCCCGAGDVEAPTEQNDCVEVSQARTPEGAPTSQKTH

SEQ ID NO: 26955 - protein, 81 aa, Rhinolophus ferrumequinum
VQGQVTFEDVAVYFSQEEWRLLEDTQRLLYRDVMLENFALTASLGYASSMSHGVAPLELDGKPWVPDWVDVIPAMTREAQG

SEQ ID NO: 26956 - protein, 81 aa, Ursus maritimus
WVPSLSQAGKSGDQAAAAALQMVRPQGSAAYQFLSVDYTERKWKGPALSQRAVHQSIMPGNYCSMASLGNDSVPQYYSLHS

SEQ ID NO: 26957 - protein, 81 aa, Ursus maritimus
HDVAVNFSWEEWQDLDDAQRTLYRVVMLETYSSLVSLGHCITKPEVIVKLEQGAEPWTVEEAPTQSLPGQSTSGDLIETRQ

SEQ ID NO: 26958 - protein, 81 aa, Ursus maritimus
MRLLTFRDVAIVFSQEEWEQLTPAQRDLYRDVMLETYSNLVSLGLCVSKPDMISSLEQRKEPWMVKRKLTRGRCPGEHGRP

SEQ ID NO: 26959 - protein, 81 aa, Oryctolagus cuniculus
YQELVTFGDVAVDFSQEEWDCLDSSQRHLYSNVMLENYSVLVSLGLCFSKPSVILLLEQGKEPWMVKRELTKGLCSGWESM

SEQ ID NO: 26960 - protein, 81 aa, Pteropus alecto
ASVTFADLAVYFSQEEWEGLSPIQKDLYEDVMLETYQNLVSVALILHVRIHSGENLYRCNKCEKVCNRHSSLLQHQKVHTK

SEQ ID NO: 26961 - protein, 81 aa, Rhinolophus ferrumequinum
MLTFRDVFIEFSQEEWECLDPAQRKLYMDVMLESYRNLVSLGHSISKPDVITLLEQGKDPCMVVREETRRWCTGKNKSGRR

SEQ ID NO: 26962 - protein, 81 aa, Rhinolophus ferrumequinum
PKVPVTFGDLAIYFSQEEWEWLSPTQKDLYKDVMLDNYQNLLFLGLSYRRPNVITLLEEGRAPWMVEPVRRRRGLDLGSKC

SEQ ID NO: 26963 - protein, 81 aa, Ursus maritimus
MFSDVSVDFSQEEWECLDPGQRDLYRDVMLENYSNLLSMGLYIPKPQVISLLEQGKEPWMVGRELTRGLCSDLESMCETKL

SEQ ID NO: 26964 - protein, 81 aa, Panthera pardus
AQELLTLEDVAVDFSWEEWQLLAPAQKDLYRDVMLENYRNLVSVGCQATKRDALSVLEHRDEAWMKAEDEIQDRTRAGIGR

SEQ ID NO: 26965 - protein, 81 aa, Panthera pardus
MLETYRNLVSLGLQRSKPDVISRLEKGEEPWAPQSLRIEESWIRNHRSGSFESLMEKKELTPKQEISKAMESQRAKSEEHA

SEQ ID NO: 26966 - protein, 81 aa, Panthera pardus
VQEQLTFRDVAIEFSQEEWECLDPAQRALYRDVMLENYRNLVSLGEKNVPPEVGICPNSSATFVIKELLPKKDINNGELYQ

SEQ ID NO: 26967 - protein, 81 aa, Panthera pardus
KSQGSLAFEDVAVNFTRDEWQLLDSAQKNLYRNVMLENVSSLVSLGFQLIKPDVIFKLEREQPWILGEEVPSQSLSEYWKV

SEQ ID NO: 26968 - protein, 81 aa, Panthera pardus
RDSVVFEDVAVDFTLEEWSLLDSVQKNLYRDVMLVSVEKIGKTIALKISMETMQDIKSCDRFYESNEGNQHRDTCSHCPHL

SEQ ID NO: 26969 - protein, 81 aa, Panthera pardus
MLETCGLLVSLGHPVPKPELIYPLEPGQELWTGKRGISKSTYTGEKAKPETTEFTASQLAFTEEAPFEDQMTQGASRDSRL

SEQ ID NO: 26970 - protein, 81 aa, Macaca nemestrina
LQESVTFQDVAVDFTAEEWQLLDCTERTLYWDVMLENYRNLISVGCPINKTKVILKVEQGQEPWMVEGVNLHQISLCHPGW

SEQ ID NO: 26971 - protein, 81 aa, Myotis brandtii
MDFEDVAIAFSQEEWRLLDEAQRLLYCDVMLEVFALVSSVGCWHKTYDDEVFPERSISVQGESQVRASETAPATQRTLLCN

SEQ ID NO: 26972 - protein, 81 aa, Myotis brandtii
PQVKVTFEDVAVLLSQEEWDQLGPAQRGLYRHVMMETYGNVVSLGLPGTKPSVISQLERGEEPWVLDGHGAKESWGLGSDS

SEQ ID NO: 26973 - protein, 81 aa, Propithecus coquereli
PQEPVTFEDVAVYFTQNQWASLDSAQRALYREVMLENYANVASLVAFPFLKPVLISQLEKGEAPWGPDPWDTEILRGISPG

SEQ ID NO: 26974 - protein, 81 aa, Balaenoptera acutorostrata
QLTFKDVAIEFSQEKWECLDPGQRALYRDVMLETYRNLLSLGTSAKCVIKESAPKENSHTGEMLQTVLLERHESCETEDYG

SEQ ID NO: 26975 - protein, 81 aa, Vombatus ursinus
MGLPISKPDVISQLERKEDPWMLEREVSRDAYPDWEAKPEIKQSSPKHDFSEEGSSHGEIIERFTRDGPWDSMFLESWDCK

SEQ ID NO: 26976 - protein, 81 aa, Balaenoptera acutorostrata
AHMSLSFRDVAIDLSQEEWECLDPVQRALYRDVMLENYSNLVSLGCSSPKPDVITLLEQEREPWTVMREGTRSWYTDLESK

SEQ ID NO: 26977 - protein, 81 aa, Saimiri boliviensis
MGLLTFRDVAIEFSLEEWQCLDTAQQNLYRNVMLENYRNLAFLVVCPHFAQDLWPEQGMEDSFQKVILRRYEKCGHENLQF

SEQ ID NO: 26978 - protein, 81 aa, Vombatus ursinus
FQGSVTFRDVAVTFSHEEWGHLDPSQKALYCEVMLENYRNMVCLGLAASQPNVMDQLERGEAPWTPEGDVAWSSSADWVTS

SEQ ID NO: 26979 - protein, 81 aa, Saimiri boliviensis
MLENYGNLVSVGYQLSKPGVISQLEKGEEPWLMEREISGVPSLDLESKTKTKESSLQNDISWEELHCGLMMERSTKRSTLY

SEQ ID NO: 26980 - protein, 81 aa, Saimiri boliviensis
RSQESLTFQDVAVDFSREEWDQLYPAQKDLYRDVMLENYRNLVALGHQLYKPEVIAQLELEEEWVIEKDSPLDTCPDGENR

SEQ ID NO: 26981 - protein, 81 aa, Vombatus ursinus
GQLDPAQQNLYRDVMLDNYQNLIFLEDSINLFCLKHSGKRKEVGWFNLSKIWAYQALGGPNFHSFLVPLNPRRSLAFERDS

SEQ ID NO: 26982 - protein, 81 aa, Lynx pardinus
EEAFASFHDVSVDFTQEEWPLLSHAQRLLYRYVMLENYSNLVFLGIPFPKPTLVIVLEQGEEPWREERECLCSGDSKPDIQ

SEQ ID NO: 26983 - protein, 81 aa, Vombatus ursinus
MLENYGNLVCVGLAGAKPDVIQRLEQGEPPWRPGEGFSRSSRPDWETRLENKELSSALGIFIEESSRGKLKVDSPCVLNLR

SEQ ID NO: 26984 - protein, 81 aa, Vombatus ursinus
FQDSVTFQDVAVTFTPEEWGRLAAPQKELYREVMLENFGHLACLGLALSKPDVICQLERGEAPWMPRGDVPQRPSAAPSGD

SEQ ID NO: 26985 - protein, 81 aa, Balaenoptera acutorostrata
PLESVTFEDVAINFTQEEWALLETSQRNLFKNVMLENITHLVTVGYQISKSDVISQLEQGKELWSEATGCLQGQSPDDESP

SEQ ID NO: 26986 - protein, 81 aa, Saimiri boliviensis
SQGHLTFTDVAIEFSQEEWKCLDPAQRALYKDVMLENYRNLVSLGVGLPDLSVVSMLEQKREPWTLQSEEKIAWNPDGREC

SEQ ID NO: 26987 - protein, 81 aa, Saimiri boliviensis
DSVVFEDVAVDFTLEEWALLDSAQRDLYRDVMLETFQNLASVDDETQFKASCSVSQQDIYGEEISKESKIAEFTRNVSWAS

SEQ ID NO: 26988 - protein, 81 aa, Vombatus ursinus
FQESVTFKDVSVDFTQGEWGQLDPAQKNLYRDVMLENYRTLVSLGLQVFKPEVIYRLERGEAPWILEREISRGPCPDWPET

SEQ ID NO: 26989 - protein, 81 aa, Cervus elaphus
KDQGSLTLEDVAVDFTWEEWQLLAPAQKALYRDVMLENYSNLVSVGYQASKPAALSRLERGEPWPVEDEVHSRLCPEFSNL

SEQ ID NO: 26990 - protein, 81 aa, Colobus angolensis
QGRLTFRDVAIEFSLAEWKCLNPAQRALYREVMLENYRNLESVDISSKCMMKDVLSTGQGNMEVFHTGTLQRHESHHIGDF

SEQ ID NO: 26991 - protein, 81 aa, Vicugna pacos
AQGSLTLKDVAVDFTREEWQLLTPAQKALYREVMLQNYSHLVSVEIEKVAGLVQLHWQNQNMPQRMEQCYGQDAFGNSIHW

SEQ ID NO: 26992 - protein, 81 aa, Odobenus rosmarus
LQALLTFRDVAIEFSQEEWRCLNHTQRQLYRDVMLENYGHLLFLGLVLSKPDLIMFLEQEKQLWDVKRKETVAFHPDLLMN

SEQ ID NO: 26993 - protein, 81 aa, Eschrichtius robustus
SQAPVTFEDMAMYLTREEWRPLDPTQRDLYRDVMQENYGNVVSLACLYRSLTKQHQRTHSGEKPYECEECGKSFSRSSHLA

SEQ ID NO: 26994 - protein, 81 aa, Eschrichtius robustus
VTFQDVAVDFTEKEWPLLDSSQRKLYKDVMLENYSNLASVDWETPSKTKWSILMEDIFGKETSNGVTMESSRLGEKSSEYA

SEQ ID NO: 26995 - protein, 81 aa, Myotis brandtii
VMMDVNFEDVAIAFSEEEWVILDDAQRLLYYDVMLKVFALVSSVGCWHKMEDEEACSDQRVCIQGKSQVRTSKTAPVTHKN

SEQ ID NO: 26996 - protein, 81 aa, Myotis brandtii
MATRPSPLQEFCLICFDEVSVSRERSRPLNQFSPVCTPPTGTEKHLPGHPVSKPEVISKLEQGEDPWIIKRDISNWIYPEL

SEQ ID NO: 26997 - protein, 81 aa, Propithecus coquereli
MAVGLCKTMSQLSISKPNVVSLLEQGKDPWMVETEMSHSQFADWESWCEIKELSPTWFIDEEEISQGMVMERITSHGLICS

SEQ ID NO: 26998 - protein, 81 aa, Saimiri boliviensis
MLENYRNLAFLGIAVSKPDLIACLEKEKEPWKTKRHAVVDEPPVVCPHFAQDLWPEQGMEDSFQKVILRRYEKCGHENLQF

SEQ ID NO: 26999 - protein, 81 aa, Lynx pardinus
TFKEVVTFKDVAVVFTEEELGLLDPTQRKLYREVMLENFGNLVSVGHQPFKRDMVHLVREGKFWMMKLATQGKGSSGDKIQ

SEQ ID NO: 27000 - protein, 81 aa, Saimiri boliviensis
MLENYRNLVFLGLAVTKPDLITHLEQEKELWNVKRQETVAKYPEILPRQNIKDSSKNVIPRKYESCDLDNLCLKKVWQDVN

SEQ ID NO: 27001 - protein, 81 aa, Saimiri boliviensis
TVTFKDVAVDLTQEEWEQMKPAQRNLYRDVMLENYSNLVTVEVWEVDEQIKKQQETLVRKVTSISKKILIKEKVIEYKKVA

SEQ ID NO: 27002 - protein, 81 aa, Cervus elaphus
SRDSARAARLRSSSRTEPGEPGASQRVPTRSASAFTVLQGSMSFRDVAVDFTQEEWQHLDPEQKTTYRDVMLENYSHLISV

SEQ ID NO: 27003 - protein, 81 aa, Colobus angolensis
VAFEDVAVNFTQEEWALLDIFQKNLYREVMLETFKNLTSIGKSWKDQNIEYEYQNPRRNFRSLIEEKVNEIKEDSHCGETF

SEQ ID NO: 27004 - protein, 81 aa, Mustela putorius
LPDLVTFEDVAVEFTQEEWALLDPSQRTLYRDVMRENCRNLASLGYHVDKPSLISQLEQEDKVVTEERGVLPGTCPDLDTV

SEQ ID NO: 27005 - protein, 81 aa, Mustela putorius
SLGPVSFRDVAVNFTQEEWQQLEPEQKTTYRDVMLENYSHLVSVGCHIIKPEVIIKLEQGEEPWIVEGEFLPQSYPGDVWK

SEQ ID NO: 27006 - protein, 81 aa, Mustela putorius
LQVCVISEDVFVSFSREEWMLLDDSQRLLYQDVMLENFVLLASLGITSSRSHLVTPLEQRADPRIADQVDMAPATERKTWK

SEQ ID NO: 27007 - protein, 81 aa, Mustela putorius
MFKSQISFEDVAVDFTSEEWQLLNPTQKSLYRDVMLENYSNLVFLGYQIIRPDAVFKPEPEEPWVTEAAPRRAAAEEVWLD

SEQ ID NO: 27008 - protein, 81 aa, Mustela putorius
TVVFADVAVNFTREEWALLDRGQRQLYRDVMLETCRNLAFLVDTSQNKRSASRPQRNVLQNELPSEGKTILFARNDSCSVF

SEQ ID NO: 27009 - protein, 81 aa, Tupaia chinensis
MKRFISFEDVTMDFTWEEWQDLEDAQEILYKDLMLETYSNLMFLGQCIAKPAVIFKLEQGGDPWTLEELLSLSLPGHVCLP

SEQ ID NO: 27010 - protein, 81 aa, Opitutae bacterium
EGIVVIDEAYVDFAEQNALCLLDEFSNLVITRTMSKSYSLAGLRVGYGLSSPEVVSVLDQARDVYNVDRLAQVAASACLKD

SEQ ID NO: 27011 - protein, 81 aa, Halomonas heilongjiangensis
VTVVVDEAFIDFVDEPGEALTPLLAHFDNLILLRSLTKLYTLPGLRLGYILAGAQTIRRLQAGQPPWSVNHLSAALVAPLL

SEQ ID NO: 27012 - protein, 81 aa, Sporosarcina newyorkensis 2681
DFVGLALVDISKKRHELKWRYVSGNLSTRYRRIVLQSGRGVAGLVFKMGKPIMIENVEAQLDPQDLYNHPIVLFEKLKSFG

SEQ ID NO: 27013 - protein, 81 aa, Geotrypetes seraphini
MKENYETLISLGSVRISPDLLSWIKQDEEPNIQDPQESGEREVRHSDTGLNCLQRIHESERPFTCPECGKSFTQQSHLITH

SEQ ID NO: 27014 - protein, 81 aa, Geotrypetes seraphini
MQVTFEDITVSFSQEEWGYLAEEQKELYREVMKENYQTLISLGTDSPNVTPDSVSHIEQGEEPYIKSEPGSEESETGRSSC

SEQ ID NO: 27015 - protein, 81 aa, Geotrypetes seraphini
AQMQVTFEDIAVSFSQEEWEYLDEEQKELYREVMKEIYQTLLSLGSPTVIPDIISQIERGEETYIRDEPGSEERETGKSSC

SEQ ID NO: 27016 - protein, 81 aa, Pogona vitticeps
LPNEPPVSLEEVALYFTKEEWDRLDLGQRALYKEVMLANYGNVVSLVPRPHLISQLEEGGDPFVQNPSDREGSASGYSEKA

SEQ ID NO: 27017 - protein, 81 aa, Micrurus lemniscatus
SEDEWSRLDPVQKDLHREVMLENSRNVAFLGNNVQENKETFQTFRDEERRKEFSYSMEKTENERNLSNNASKRNSTVPSIE

SEQ ID NO: 27018 - protein, 81 aa, Microcaecilia unicolor
SRTMRVTFEDIAVSFSQEEWEYLDEGQKELYREVMKENYETLISLGYNKISPDILSRIKQETYVQDVQETRETEFTSDTSA

SEQ ID NO: 27019 - protein, 81 aa, Alligator sinensis
RPLKREASLELQEVFEDVAVYFTRKEWELLEDEDKVLYQAQMLKNYQALISLGKNLVLASPWSYVNTRVLQSLPVSTVSSL

SEQ ID NO: 27020 - protein, 81 aa, Alligator sinensis
AKLQVVFEDVALYFTRKEWTLLEDGDKALYREQMLRNYQALVSLGHRGPTPDLICRIQRGEVELSVHDHEDSGESALSEGS

SEQ ID NO: 27021 - protein, 81 aa, Micrurus lemniscatus
ASFEDVAVYFSKEEWSQLNADQKALHGEVMLENSRNLFSLGFNGQENKNCNEECQAIHLKMEKGKFADQMQSNSDETKQSQ

SEQ ID NO: 27022 - protein, 81 aa, Aythya fuligula
MEPWVMLDPRQKALYRDVMQESYETLMSLAAQGLVSEKAAEEGAAQQIPEELEARPSRSPERAKTLGSNRRKTKRPDKAVP

SEQ ID NO: 27023 - protein, 81 aa, Pogona vitticeps
WAAQVTFEDVAVYFSSEEWAELTAWQKDLYWEVMKGNHNLTASLAPACGPASEVLRRMERGEAPPSETPPDEKQEDPPPCP

SEQ ID NO: 27024 - protein, 81 aa, Micrurus lemniscatus
LSDASQELPFRGIPQEDPSWDNSGGSSPFPGGTERVAEPPVQGLVSFEDVAVCFSKEEWTQLDPCQKALHGEVMRDNLRNV

SEQ ID NO: 27025 - protein, 81 aa, Pantherophis guttatus
NSIFFEDVAVFFSVEEWALLDLGQKNLYREVMLDNARNLSSLTGDGWWMEGHGQEAAAAFPKGIKEVVERMFGKKGSKENQ

SEQ ID NO: 27026 - protein, 81 aa, Amazona aestiva
PKVPVSFNDASFNFSEEEWKSLNEWQKELYRHIMKGNYEAVISMDAAISKPDLLSRIEQGEDPNAEDQDDSEGGETPTDPS

SEQ ID NO: 27027 - protein, 81 aa, Anaerococcus lactolyticus S7-1-13
VDLDEVSPYLSTDDDISIDETEEILKVLDEKDREIFRKLFLEGYSYDDLAKVYDISKAGLYNRVARGKKKIKEEIQNEKCL

SEQ ID NO: 27028 - protein, 81 aa, Micrurus paraensis
LVSFEEVAVYFSEDEWSQLDSDQKELYLEVMLENHRNVVSLGNNGQENQDSCELSQVINTKDGMEKFGIRTEFEKHERNQS

SEQ ID NO: 27029 - protein, 81 aa, Micrurus paraensis
PSKSSLEMFFRKISQNDPKKDMTTGKNSRKLTLPEGGTERMVETPVQEGLVSFEDVAVYFSEEEWSQLDPDQKALHWEVML

SEQ ID NO: 27030 - protein, 81 aa, Micrurus paraensis
LFFRRIPWEDPSQGTSGEKQRMKLSGFYDGDQTVVEPPNQEGLVSFEEVAVHFSEEEWSQLHSDQKALHSEVMIENHRNVV

SEQ ID NO: 27031 - protein, 81 aa, Micrurus paraensis
LDQRQKALYRDVMQESYETLMSLANQLLNNSNHDDEDEEDEEEPEGVEELRPGTSQSAPRKVKPLTRRETPKQPKIIPVVK

SEQ ID NO: 27032 - protein, 81 aa, Micrurus paraensis
DFVSFEDVAVSFSEEEWALLDSEQKALYREVMLENKRNVASLGNGWEMEDSGQEVVAPLPKDKQEEKRHGRQSLEQNQLTG

SEQ ID NO: 27033 - protein, 81 aa, Xenopus tropicalis
FSKVAVYFTESEWICLEEGQKELYKEVMLENYLTFNSLGYLHKKPDIISRIERDEDPSLKPHKKLQMKRISSMTNEQLQKK

SEQ ID NO: 27034 - protein, 81 aa, Micrurus paraensis
GFLTQGPVSFGEVAIHFSSEEWLLLDPSQKALYHEVMLETSRMVASLAFDAQKNEIDQEPKLVPLQIIKTEIPGETSTNKR

SEQ ID NO: 27035 - protein, 81 aa, Xenopus tropicalis
ASVAFDDLASSFSKEEWMELEEWQKELYRNVMKETSETLISLGEGRNLISLPTKAIGEKDSDTLEPAASLAMDCTNNLPFC

SEQ ID NO: 27036 - protein, 81 aa, Bambusicola thoracicus
GEVPKLVLDPAQGFSEDEWKNLNEWQKELYRHIMKGNYEAVISMDTAISKPDLLSRIEQGEDPNAEDQDDSEGGETPTDPS

SEQ ID NO: 27037 - protein, 81 aa, Xenopus tropicalis
MEESAKSNDVTVCFSVEELDSLEDGQRDHNKNLKTKIHHSPNLVGYLYVKPEIVPRIRRGEGLCVSSDLYTEKRRNRARLA

SEQ ID NO: 27038 - protein, 80 aa, Xenopus tropicalis
MGCLSFDDIAIYFSEEEWKSLKEGQKALYKDVMIENYQTLRLLGIKPSHSNLTYLPPLKSTDPLKQTEHEAWLGAWPGWD

SEQ ID NO: 27039 - protein, 81 aa, Xenopus tropicalis
EEDSIKPDNVAVCFSVEELESFEERQKESCKNVMREIHQTPTVVGYIYVKPETVSLIRRGEELCVSSNLYSRKQELCTSPP

SEQ ID NO: 27040 - protein, 81 aa, Bambusicola thoracicus
EPVTFEDVAIYLSRAEWDMVAEEQRELYRSVMLDNYELLASLGYPGPKPDILHRLERGEEPWVNTPQSTVTWDGPDRPLGC

SEQ ID NO: 27041 - protein, 81 aa, Micrurus paraensis
LVSFEEVAVYFSEEEWSQLDPDQKSLHSEVMLENHRNLVSLGKNGQGNQDSCELSQVINTKDGMEKFGIRTEFEKHERNQS

SEQ ID NO: 27042 - protein, 81 aa, Xenopus tropicalis
GQMEEASVSFSAEEWGSLEKEQRDLYKDLLMENDETLRSLNSFSVKTESCSRAEREELHIKDPPEDPPPDLHPNTFPCTDA

SEQ ID NO: 27043 - protein, 81 aa, Microcaecilia unicolor
EALVTFKDVAAYFLEVDWDLLGEWQKELYKKVIKEIHDILISRGKYVSLSSTTQAHYGISGVKITGIRYHEHLKFRSWFLI

SEQ ID NO: 27044 - protein, 81 aa, Microcaecilia unicolor
NEAFITFNDVAAYFLEAEWKIFGEWKKELYKKVIKEIHVILLSRGYSIVNPDVIFKIKKEDENYFIQQFNWKGKENPNDFT

SEQ ID NO: 27045 - protein, 81 aa, Microcaecilia unicolor
DQASVTFSDVAAYFWEVEWDILGEWQKNLYKKIIKEIHNFLMSQGYSIVNPDVIFKIKKEDEKYFTQHYDWEEKEDMNDST

SEQ ID NO: 27046 - protein, 81 aa, Microcaecilia unicolor
SKMPVTFEDIAVSFSQEEWGYLDEGQKELYREVMKENYETLISLGYERTNPEILSRIKQKEEPYVQELQESEEDCHSYTDQ

SEQ ID NO: 27047 - protein, 81 aa, Microcaecilia unicolor
QMQVKFEDVAVSFSQEEWEYLDEEQKELYREVMKENYQILISLGTGSLTFTPKIISQIERGEEPYSRDEPGSEEREPGKSS

SEQ ID NO: 27048 - protein, 81 aa, Microcaecilia unicolor
EPVTFEDITVHFSQEQWEYLDEGQKELYREVMKENYQTLISLEKDDSRNSNTETHHWKLSEKPKGEKMLSERDKEETSSCC

SEQ ID NO: 27049 - protein, 81 aa, Microcaecilia unicolor
DQVLVAFKDVAAYFLEVDWDILGEWQKELYKKVVKEIHDILISQGYSVVNPDVVFKIKNEDEKYFTQQSEWEGKENPNDSN

SEQ ID NO: 27050 - protein, 81 aa, Micrurus paraensis
EWSQLDPDQKALHSEVMLENHRNVVSLGNNGQENLDSCELFQVINAKDRMEKFGIGIEFKSHERNQSKNWNQESSSSTDAP

SEQ ID NO: 27051 - protein, 81 aa, Xenopus tropicalis
LQAPAHFKEVAVYFTESEWICLEEGQKELYKEVMLENYLTFNSLGYLHKKPDIISRIERDEDPCLSYNKDKRKSFHFDGAR

SEQ ID NO: 27052 - protein, 81 aa, Microcaecilia unicolor
VPVTFEDITVHFSQEQWEYLDEGQKELYREVMKENYETLISLEKDDSKNNNTEVHHWNLSEKPEEEKKLSESLKEETSSCS

SEQ ID NO: 27053 - protein, 81 aa, Microcaecilia unicolor
DQVLVSFKDVAAYFLKVDWDILGEWQKELYKKVIKEIHDILISRGYSIVNPDVIFKIKKEDEKYFSPHFDWEEKENPDDLI

SEQ ID NO: 27054 - protein, 81 aa, Xenopus tropicalis
RKGPIKFEDVAVYFSEDEWNYLEDGQKNLYKNVMMENYYTVSSVGCANEKPKIIVKIEQGEKTYLGHTPEKTKYVSMLRNA

SEQ ID NO: 27055 - protein, 81 aa, Microcaecilia unicolor
GQASVIFKDVAAYFLEVEWNILGEWQKELYKKIIKEIHGFLWSRGYAIVNPDVIFKIKKEDEKYLIQHFEWEGKENPDDSP

SEQ ID NO: 27056 - protein, 81 aa, Microcaecilia unicolor
AQVPVTFEDITVHFSKEEWEDLEEWQKELYKDVMKENYEILNSLGCLSVIPDIIANIESGEEPGFKERETGKSSCSEINVC

SEQ ID NO: 27057 - protein, 81 aa, Microcaecilia unicolor
QVPVTFEDIAVYFSQEEWEDLQEQQRELYKDVMKENYETLSSLGTGPPAVTPDIISHIERGEEPYIRGETGSEERETGKSI

SEQ ID NO: 27058 - protein, 81 aa, Microcaecilia unicolor
DQALVTFKDVSAYFLEAEWIILGQWQKELYKKVVKEFHDILTSKGYSIVNPDVIFKIKKEDEKYFTQHFEWERKENPDDLM

SEQ ID NO: 27059 - protein, 81 aa, Xenopus tropicalis
MSQVGKVTFQEVALYFSRGEWERLSEEQKELYREVMLDNYQLVLSLCRPEIISRIVLGQEPCIGSRSSSAEGGPANDRLLP

SEQ ID NO: 27060 - protein, 81 aa, Xenopus tropicalis
LQVAPTFDDVAVYFSWSEWESLSPSQRDMYKSVMAENYECVLSLGYPIGKPEIVSKIEAGEDLWSRSDARPERKEKDGETP

SEQ ID NO: 27061 - protein, 81 aa, Acidimicrobiaceae bacterium
RGLVGEIIGRFERKGLRMVEAELRTLDRDVLARHYSEHVGKGFYDDLVAFMGRGPVLVAVVEGPRDTWSVVRQMMGATDPM

SEQ ID NO: 27062 - protein, 81 aa, Candidatus Shapirobacteria bacterium CG10_big_fil_rev_8_21_14_0_10_36_6
AITLDEFNKDVTPKEWKFIEAEQKYYYLVVALKKARNSMGLTQNKLAELSNMPRTTITRIESGSRNATLQTLMTIAGSMGK

SEQ ID NO: 27063 - protein, 81 aa, Gordonia sputi NBRC 100414
VDEAFADLTVDPVTGEREPQSLASMRNDDIVVLRSVTKTFGLAGLRAGYLLASPEIVERLSRGRRPWPLSTPALAALAECV

SEQ ID NO: 27064 - protein, 81 aa, Halomonas titanicae
LDTFRKLWFTASLEQWSQMDDHQRTLLDSGMIANARKAEPWKAVELFRALADRAELTQRLEHFNQEYHLLMTPSVAIPPFE

SEQ ID NO: 27065 - protein, 81 aa, Rhizobiales bacterium
KLPSRTLNNLVGFSAEELAELDNAIAILKRDNMNEQANILHSLATKLKTLQKPEAMSRVEPDYEALLEAEGLAMRPGPKPK

SEQ ID NO: 27066 - protein, 81 aa, Colinus virginianus
LKAPEASEGDAACFTEQEWENLEEWQKELYKNMLRGNSESLSSLADYAIPEPSFAGALKQNEEVCVEEQEATEGAEFTELS

SEQ ID NO: 27067 - protein, 81 aa, Geotrypetes seraphini
SAQKQVTFEDITVSFTQEEWAYLDEEQKKLYREVMKDNYQMLISLDHQIRPEWQRIKSQREDPVEMDQIQTQSENIYENIS

SEQ ID NO: 27068 - protein, 81 aa, Geotrypetes seraphini
AEASVMFSDVTAYFLEAEWDILREWQKEIYKKVIKEIHSFLISQGYSILNPDVIFKIKKEDEKYFTQHYESEEKENMNDSS

SEQ ID NO: 27069 - protein, 81 aa, Geotrypetes seraphini
EVQETFEDIAVFFSQEEWGYLDEEQKELYREVMRENFQTLISLGTGSLTVAPDIICRIERGEEPYIKDEPGSEEREPGRSS

SEQ ID NO: 27070 - protein, 81 aa, Geotrypetes seraphini
AQASVTFHDVAIYFSEKEWQLLEEWQKELYRNVIKMIHGALTSLGHIIINSGVVFRIKKEKAPYLWNPCDSEGQERIKDPT

SEQ ID NO: 27071 - protein, 81 aa, Geotrypetes seraphini
NLLRLEQSTMADQMLLTFHDVAVTFSEEEWQLLEDWQKDLYRKVMKETYDNLISLMPLTFHDIAIYFSEEEWQLLGEHQKA

SEQ ID NO: 27072 - protein, 81 aa, Geotrypetes seraphini
AQMQVAFQDIAISFSQEEWEYLDEGQKELYREVMKENYETLISLGFVRISPDLLSWIKQDGESNIQDPQESGEREVRHSYT

SEQ ID NO: 27073 - protein, 81 aa, Geotrypetes seraphini
MQMRLRFEDISVSFSQEEWGYLAEEQKELYREVMKENYQTLISLGSPLVTPDIISHIERGEEPYVRDEPGSEEREPGRSSC

SEQ ID NO: 27074 - protein, 81 aa, Geotrypetes seraphini
MEVTFKDIAVSFSQEEWRYLDEEQKELYVEVMEENFQTLISLEQQLKQEKESEKNQGEDPLEMGQIQRQSGNVSANISQRT

SEQ ID NO: 27075 - protein, 81 aa, Geotrypetes seraphini
VTFEDITVAFSQEEWEYLDEGQKELHREVMKENYEILRTLEKDDPKNNPWKLSEKPEGVKMLSEGEKEKWGEKEKNQNPKY

SEQ ID NO: 27076 - protein, 81 aa, Geotrypetes seraphini
SAQKQVTFEDITVSFTQEEWDYLNEEQKKLYREVMKENYQMLNSLDHQIRPEWQRIKSQREDPVEMDQIQTQSENIYENNS

SEQ ID NO: 27077 - protein, 81 aa, Geotrypetes seraphini
DHASVTFSDVAAYFLEVEWNILGEWQKELYKNVIKKIHSFLILQGYSIVNPDVVFKIKKEDEKYFTQHCEWEGKENSNDPS

SEQ ID NO: 27078 - protein, 81 aa, Geotrypetes seraphini
AQMQLTFEDITVSFSQEEWEYLDEEQKELYREVMKDNYQTLLSLGSPTFTPKIISCIEQGEEPYIRFEAESEERETGKSSC

SEQ ID NO: 27079 - protein, 81 aa, Geotrypetes seraphini
HPASVTFNDVAAYFWEVEWDVLGEWQKKLYKTVIEEIHDLLMSRGYSIVNPDVIFKIKKEDEKYFTQHSEWEGKGYPNDPT

SEQ ID NO: 27080 - protein, 81 aa, Geotrypetes seraphini
AQMRVTFEDIAVSFSKEEWEYLREGQKELYREVMKENYENLIFLGYEGINADILSRIKQEEEPNIQDPKELGEREVTHSYS

SEQ ID NO: 27081 - protein, 81 aa, Geotrypetes seraphini
DQTSVTFRDVAAYFLEMEWDILGEWQKELYKRVIEEIHDILISRGYLIVNPDVIFKIKKEDEKYFAQHCELEGKDNPNEPS

SEQ ID NO: 27082 - protein, 81 aa, Geotrypetes seraphini
AREMVTFEDIAVSFSEEEWAYLDEEQKKLYREVMEENYQTLVSLAEQELKQERESEKNQGEDRLEMEQIQRQSGNVCANIS

SEQ ID NO: 27083 - protein, 81 aa, Geotrypetes seraphini
QMRLRFEDISISFSQEEWGYLDEEQKELYREVMKENYQTLISLATDSPLVTPDIISHIERGEEPYVRDEPGSEERETERSS

SEQ ID NO: 27084 - protein, 81 aa, Geotrypetes seraphini
MRVTFEDITVSFSQEEWMYLDEGQKELYREVMMENYEILMSLADHEVTDEVRESREEHCLKWKPHPRNVGVSQGTEWKERH

SEQ ID NO: 27085 - protein, 81 aa, Geotrypetes seraphini
VKLEDVTVSFSQEEWEYLDEGQKELHREVMKENYELLRTLEKDDPKNNHWKLSEKPEGVKMLSEGEKEETSSCSVWGEKEK

SEQ ID NO: 27086 - protein, 81 aa, Geotrypetes seraphini
QMQVTFEEVAVSFSQEEWEYLDDEQKELYREVMKENYQILISLATGSPTVTPKIISHIERGEEPYIRGEPGSEERETGNSS

SEQ ID NO: 27087 - protein, 81 aa, Geotrypetes seraphini
DQVSVTFNDVASYFLEVEWDILGEWQKEMYKKVIKEIHDILRSQGYSIANPDVVVKIKQEDEKYFTQHFGWEEKENLNGPM

SEQ ID NO: 27088 - protein, 81 aa, Geotrypetes seraphini
SAHMQASVTFIDVAAYFLEGEWNVLGEWQKELYKKIIKDIQGYSIVYPDVIVKIKKEDEKYFTHHYEGEEKENPTKSLPVV

SEQ ID NO: 27089 - protein, 81 aa, Geotrypetes seraphini
MQVKFEDVAISFSQEEWEYLDEGQKELYKEVMKENYETLISLGLNCLQRIHESERPFTCPECGKSFTQQSHLIKHRRIHTG

SEQ ID NO: 27090 - protein, 81 aa, Geotrypetes seraphini
QMPVTLEDIFISFSQEEWEYLNEEQKELYREVMAENYETLMSLGTDSPPVTPDIISHTERGEEPYIKDEPGSEERETGTSS

SEQ ID NO: 27091 - protein, 81 aa, Geotrypetes seraphini
QMRLRFEDISVSFSQEEWAYLDEEQKELYREVMRDNYQTLISLGVGFSSVTPDIISRIEQGEEPYVRDEPGSEERETGRSS

SEQ ID NO: 27092 - protein, 81 aa, Geotrypetes seraphini
ARAPVSFEEVAVYFSPEEWQTLQGWQKEMYRGVMRENYEIMLSLGYQFSKPEILLMMERGEEPCVEDCQRRIPVTFREKHL

SEQ ID NO: 27093 - protein, 81 aa, Geotrypetes seraphini
AGASAQVTFEDIAVSFSQEEWEYLNEGQKELYREVMKENYEILISLDTKAMQETKREENEEKWLLEHIPRQPGNVSENISQ

SEQ ID NO: 27094 - protein, 81 aa, Anas platyrhynchos
HILKWDLLLLQEPRWVLLDPVQRTLYVDVMLENYETITSLGKESWPLEFWSQELLELWLLAFMLQTVSVLGWHELCGADAN

SEQ ID NO: 27095 - protein, 81 aa, Geotrypetes seraphini
QMPVTFDDVAIYFSQEEWEELNEQQRELYQEVMRENLELLTSLDTGPAQKDPDVTLSIDHMKVPYIEEQQILHWITGTTLS

SEQ ID NO: 27096 - protein, 81 aa, Geotrypetes seraphini
EQMRLRFEDISVSFSQEEWAYLDEEQKELYREVMMDNYQTLISLGSPPATPDIISHIEQGEEPYIKDEPGSEEREPGRSSW

SEQ ID NO: 27097 - protein, 81 aa, Geotrypetes seraphini
LQFSVTFRDVAAYFSEEEWEVLEDWQKELYRNVMKEIHRTLFSLGYAIVNPSVLVRIQKEQDLAPGDQCLTREISVNCKDA

SEQ ID NO: 27098 - protein, 81 aa, Geotrypetes seraphini
QMQVTFEEVAVSFSQEEWEYLNEEQKELYREVMKDNYQTLISLGVGSPNFTPEIISYIERGEEPYIRGETGSEERRPETSS

SEQ ID NO: 27099 - protein, 81 aa, Geotrypetes seraphini
QMQVTFEEVAVSFSQEEWEYLDEEQKELYREVMKENYQTVISLATGSPTVTPKIISHIERGEEPYIRGEPGSEERETGNSS

SEQ ID NO: 27100 - protein, 81 aa, Geotrypetes seraphini
RMQVTFEEVSFSFSQEEWEYLDDEQKELYREVMKENYQTIISLGTGSPTFTPKIISYIERGEEPYIRDEPVSEEKETEKSS

SEQ ID NO: 27101 - protein, 81 aa, Geotrypetes seraphini
MQVKFENVAVSFSQEEWENLDEGKKELYREVMKENYETLVSLGSVRISPDLLSGIKQEGEPNIQDPQEREKLDIQTRQIQE

SEQ ID NO: 27102 - protein, 81 aa, Geotrypetes seraphini
QMQVTFEEVAVSFSQEEWEYLDEEQKELYREVMKENYQTLISLAAGSLTVTPKIISHIERGEEPYIRGEPGSEEREIGKSS

SEQ ID NO: 27103 - protein, 81 aa, Geotrypetes seraphini
PQELVTPCDMAAAIPEVEWNLLEDWQKQLYKDVMKESYKTILSLGYSVAKQNIMTEPTAEEKACNSGVRNPESGNIAGSSS

SEQ ID NO: 27104 - protein, 81 aa, Geotrypetes seraphini
TMRVTFEDITVSFSQEEWEYLDEGQKELYREVMNENYQTLISLETGYERIDHDILSRIKQEEEPYVWDSLETREREVTLLD

SEQ ID NO: 27105 - protein, 81 aa, Geotrypetes seraphini
NQVSVAFKDVAAYFLEVEWSILREWQKEIYEKVIKEVHGILTSQGYSIVNPDVIFKIKKEDEKYFSQGCESEGKEIPNDPT

SEQ ID NO: 27106 - protein, 81 aa, Geotrypetes seraphini
AQMQVKFEDVVVSFTQEEWEYLDEGQKELYKEVMKENYETLISLGAVRISPDLLSWIKQDGEPNIQDPQESGEREVRHSDT

SEQ ID NO: 27107 - protein, 81 aa, Geotrypetes seraphini
QMRVSFEDVTVSFSQEEWEYLEEGQKELYREVMKENYETLISLGTGSPAVTPDIISHIEQGEEPYVRDEPGSEERETGRSS

SEQ ID NO: 27108 - protein, 81 aa, Geotrypetes seraphini
AQMQVKFEDVAVSFSQEEWEYLDEGQKELYREVMKENYETLISLGSVRISPDLFLWIKQDGETHIQDPQESGEREVRHSDK

SEQ ID NO: 27109 - protein, 81 aa, Geotrypetes seraphini
SAQVTFEDIAVSFSQEEWGYLDEEQKNLYREVMKENYQTLISLGTGSPTFTPKMTSHIERGQGPYIKDEPESEERETGQNS

SEQ ID NO: 27110 - protein, 81 aa, Geotrypetes seraphini
AQMQVTFEEIAVSFSQEEWEYLDEEQKELYREVMKENYEILISLGSPTFTPKIISYIERGEEPYIRDEPVSEERETEKSIC

SEQ ID NO: 27111 - protein, 81 aa, Geotrypetes seraphini
EQMQVTFEDIAVSFSQEEWEYLDEGQKELYREVMKENYETLISLGYVRISPDPLSWIKQEGEPNIQDPQEPGEREVRHSYT

SEQ ID NO: 27112 - protein, 81 aa, Geotrypetes seraphini
DQALVTFKDVAAYFWEVEWNILGEQQKELYKKVVKEVHGILLSRGYSIVNPNVLFKIKKEDEKYFTQHFECERKENTLDPM

SEQ ID NO: 27113 - protein, 81 aa, Geotrypetes seraphini
QVPVTFEDITVYFSQEQWRYLDEGQKELYREVMKENYETLISLGTGHESFNSELLLRIKQEEEPHVWDPKASEREATHSHA

SEQ ID NO: 27114 - protein, 81 aa, Anas platyrhynchos
PKVPLTFDDISVYFNEQEWETLDSWQKDLYKAVMRGNYETLISLEETGRKEEALGEQKVPSEAGTDVSCPLVLKAAFLFPA

SEQ ID NO: 27115 - protein, 81 aa, Geotrypetes seraphini
QMPVKFEDIAVSFSQEEWEYLNEEQKELYREVMEENYQTLISLGTGSPPITPDIISHIERGEEPYIREEPGSEERGPVRSS

SEQ ID NO: 27116 - protein, 81 aa, Geotrypetes seraphini
DLASVIFNDVVAYFWDAEWDVLEERQKELYKKVIKEIHGFLMSRGYLIVNPDVLIRVKHEGGKYFTQHHDWEENENINDPL

SEQ ID NO: 27117 - protein, 81 aa, Geotrypetes seraphini
AQGQVTFEDIAVSFSQEEWEYLDEEQKELYREVMKENYQTLISLGYEKINPEMLSGIKSEEKSYVQDPQESGEKEVTHLYP

SEQ ID NO: 27118 - protein, 81 aa, Geotrypetes seraphini
DQASVTFKDVAAYFLEVEWDIVGEWQKELFKKVIEEIHDILIIQGCSIVNPDVIFKIKKKDEKYFAENFGWEGKENSNDPP

SEQ ID NO: 27119 - protein, 81 aa, Geotrypetes seraphini
NQALITFSDVAAYFWEVEWDILGEWQKELYKKVIKEIHSFLISQGYSIVNPDIIFKIKKEDEKYFTQHCEWKEKEKTHNST

SEQ ID NO: 27120 - protein, 81 aa, Geotrypetes seraphini
WEMQVTFEEVAVSFSQEEWEYLDDEQKELYREVMKENYQILISLGSPTVTPKIISHIERGEEPYIRGEPGSEERETGNSSC

SEQ ID NO: 27121 - protein, 81 aa, Geotrypetes seraphini
AQMQVMFEDIAVSFSQEEWKYLDEGQKELYREVMKENYETLISLGYIGIRSDVLSWIKEEGEPKIQDPQDPGETEVRHSDT

SEQ ID NO: 27122 - protein, 81 aa, Geotrypetes seraphini
QVSVTFEDIAIYFSQEEWEDLEKWQKELYKDVMKENYEILISLGTSSVTVTPDIISHIEQGEELNIRNEPGSEERETGKSS

SEQ ID NO: 27123 - protein, 81 aa, Geotrypetes seraphini
KMRVTFEDVAVSFSQEEWEYLDEEQKELYWEVMKENYKTVISLGTEYQKIDPDLSSRITQKEKPSVWDPQESAEREVTPTY

SEQ ID NO: 27124 - protein, 81 aa, Geotrypetes seraphini
KEMQVSFEDIAVSFSQEEWEYLEEEQRELYREVMKENYQTLISLGCPNLTPEIISRIERGEEPYIRGEPGSEERETGKSNC

SEQ ID NO: 27125 - protein, 81 aa, Geotrypetes seraphini
AQMQVKFEDVAVSFSQEEWEYLDEGQKELYREVMKANYETLVSLGSVRISPDLFSWIKQDGEPNIQDPQESGEREVRCSFM

SEQ ID NO: 27126 - protein, 81 aa, Geotrypetes seraphini
AAISVTFSDVAVYFSEKEWGLLDEWQKELYRNVMKEIHGALLSMGYKILNPGNLFRIRKAEESNDRDPDDAKQKDFTICST

SEQ ID NO: 27127 - protein, 81 aa, Geotrypetes seraphini
QMPVKFEDIAVSFSQKEWEYLNEEQKELYREVMKENYLTLISLGTGSPSITPDIISHIERGEELYIKEEPGSEEREPGRSS

SEQ ID NO: 27128 - protein, 81 aa, Geotrypetes seraphini
FVQVTFQDISISFSQEEWGYLDEEQKDLYREVMKENYQTLISLGTGSPNLTPEIISRIERGEEPYIRGEPGSEERETGESS

SEQ ID NO: 27129 - protein, 81 aa, Geotrypetes seraphini
QMWVTFEDVAVSFSQEEWVYLDEGQKELYREVMKENYETVMSLAGEEFSRGKEKEGSIEQQSLKTEVHEMNKRVKLFKCSE

SEQ ID NO: 27130 - protein, 81 aa, Geotrypetes seraphini
QVQETFEDIAVSFSQDEWEYLDEEQKELYREVMRENYQTLLSLGTGSLTVAPDIICRIERGEEPYIKDEPGSEEREPGRSS

SEQ ID NO: 27131 - protein, 81 aa, Geotrypetes seraphini
QMQVKFEDIAISFSQEEWEYLNEEQKELYREVMEENYQTLLSLATDSPTFTPKIISYIKRGEEPYIRGEPDSEERESGKSS

SEQ ID NO: 27132 - protein, 81 aa, Geotrypetes seraphini
AQMQVTFEEIAVSFSQEEWEYLDEEQKELYREVMKENYEILISLGSPTFTPKIISYIERGEEPYIRDEPGSEERETVKSSC

SEQ ID NO: 27133 - protein, 81 aa, Geotrypetes seraphini
QMPVKFEDIAVSFSQEEWEYLNDEQKELYREVMKENYQTLISLGIGSPSVTPDIISHIERREEPGSEEREPGRSSCSDHQK

SEQ ID NO: 27134 - protein, 81 aa, Geotrypetes seraphini
FQMQVKFEDVAVSFSQEEWEYLDEGQKELYREVMKENYETLISLGSVRISPDLLSWIKQDGETHIQDPQESGEREVRRSDT

SEQ ID NO: 27135 - protein, 81 aa, Geotrypetes seraphini
DQKLVTFKDVSAYFWEMEWNILGEQQKELYKKVIKEVHGILLSLGYSIVNPDVIFKIKKEDEKHFTQHFEWEGKENPHDPM

SEQ ID NO: 27136 - protein, 81 aa, Geotrypetes seraphini
QMPVKFEDIAVSFSQEEWEYLNEEQKELYREVMEENYQTLISLGTGSLPVTPDIISHIELGEEPYIREDPGSEEREPGRSS

SEQ ID NO: 27137 - protein, 81 aa, Geotrypetes seraphini
GQMPVKFEDIAVSFSQEEWEYLNEEQKELYREVMKENYETLISLGSPPVTPDIISHIERGEEPYIKEEPGSEERGPVRSSC

SEQ ID NO: 27138 - protein, 81 aa, Geotrypetes seraphini
TRIQVKFEDIAVSFSQEEWEYLDEGQKELYREVMKENYETLISLGSVRISPDLFSWIKQDGKPKIQDPQESGEREVRHSDT

SEQ ID NO: 27139 - protein, 81 aa, Geotrypetes seraphini
QMQVTFEDIAISFSQEEWEYLDEEQKELYREVMKENYQTLISLGTGSLTFTPKIISHIERGEEPYIRREPGSEERETWKNS

SEQ ID NO: 27140 - protein, 81 aa, Anas platyrhynchos
GSSRTGILRDRDERWVLLDPVQRTLYVDVMLENYETITSLGKESWPLEFWSQELLELWLLAFMLQTVSVLGWHELCGADAN

SEQ ID NO: 27141 - protein, 81 aa, Geotrypetes seraphini
AQMQVTFEEIAVSFSQEEWEYLDEEQKKLYREVMKENYEILISLDSPTFTPKIISYIERGEEPYIRDEPGSEERETEKSSC

SEQ ID NO: 27142 - protein, 81 aa, Geotrypetes seraphini
QEPVTFEDITVSFSKEQWEYLDEEQKELYREVMKNNYETLISLGADHKSIDPEVLSRITEEEEPCVGDPKEREDTHANTGI

SEQ ID NO: 27143 - protein, 81 aa, Geotrypetes seraphini
KMLVTFDDVTVYFSEEEWNGLEDEQKQLYKEVMRDNYEALIFLGKDSAAADPAVLSRIEEGEVHCNDHSASEGGEHNLWAS

SEQ ID NO: 27144 - protein, 81 aa, Geotrypetes seraphini
AKMQVTFEDIAVSFSQEEWRYLDEGQKELYREVMMENYETLIFLENNPRSKNQEIHHCEVTENAKRNKMSEGDEEHTSFGS

SEQ ID NO: 27145 - protein, 81 aa, Geotrypetes seraphini
QIPVTFEDIAIYFFQKEWEDLDAWQKELYKDVMKENYQTLMSLEKAFSNVIPDIISHIERGEEPYIRDDSGSEERETGKST

SEQ ID NO: 27146 - protein, 81 aa, Geotrypetes seraphini
VMFEDVFISFSQEEWQYLDEEQKELYKEVMKENYEILMSLEKDDPKYNPSKLTEKPEGVKMLSEKEETSSCSDWGEKGKNQ

SEQ ID NO: 27147 - protein, 81 aa, Anas platyrhynchos
RPGADPRDEPRPCRAPGLSLQMPVMFEDVAIYFSPEEWAELAGWQRQLYREVMLENFEALASLGEERDGDAGPGPSRGQGK

SEQ ID NO: 27148 - protein, 81 aa, Geotrypetes seraphini
MQNQMRVKLEGISVSFSQEEWAYLDERQKELHREVMKENYELLRSLANEMRLKKEKREEQLLKWKPYSSQVDISQRTERRN

SEQ ID NO: 27149 - protein, 81 aa, Geotrypetes seraphini
AQMQVAFEDISISFSQEEWEYLNEEQKELYREVMKENYQTLISLGSMAFTPKIISHIERGEEPYIRGEPGSEEREHEKSSC

SEQ ID NO: 27150 - protein, 81 aa, Geotrypetes seraphini
EQISVTFRDVVASFSEEEWKVLEDWQKELYGNVMKEIHGTLISLGYAIANPSVLFRIKRKDEPNEWDSQNSDGKDGIGVSS

SEQ ID NO: 27151 - protein, 81 aa, Geotrypetes seraphini
ARALVTFHDVAIYFSEEEWQLLEEWQKELYRNVMEEIHEVLISLGHTSTSPGISYRIKEEEEPYFGDQDNSSRNLNKRPSA

SEQ ID NO: 27152 - protein, 81 aa, Geotrypetes seraphini
QKPMITFNAVAAYFSEAVWEALEEWQKELYRSVVQEIHGALLSLGYAIIHPDVLLRIKGQEDPYKDERSKTYKEQMTSDSS

SEQ ID NO: 27153 - protein, 81 aa, Geotrypetes seraphini
APVSVAFSDVAAYFLETEWDILGEWQKELYEKVIQEIHDLLMSRGYSIVNPDVIFKIKKKDEKYFTRHRDLEGNKDVCDPS

SEQ ID NO: 27154 - protein, 81 aa, Geotrypetes seraphini
MEVTFKDIAVSFSQEEWRYLDEEQKELYVEVMEENFQTLISLAEQQLKQEKESEKNQGEDPLEMGQIQRQSGNVSANISQR

SEQ ID NO: 27155 - protein, 81 aa, Geotrypetes seraphini
MQVKFEDVAVSFSQEEWEYLDEGQKELYREVMKENYETLISLGSVRLSPDLLSWIKQEGETHIQDPQESGEREVRHSDTVD

SEQ ID NO: 27156 - protein, 81 aa, Geotrypetes seraphini
FMTSVTFKDVAAFFSEEEWAALEEWQKELYRSVMKEIHTALLSLGYRIVNPDTVFWVKNELVSTAKWNQNLGEIESINVSY

SEQ ID NO: 27157 - protein, 81 aa, Geotrypetes seraphini
PVTLEDIFISFSQEEWEYLNEEQKELYREVMAENYETLMSLEHEITQERKREGEHPIEREEIQRQSENVCENISQGTKRIH

SEQ ID NO: 27158 - protein, 81 aa, Geotrypetes seraphini
QMQVKFEDIAISFSQEEWEYLNEEQKELYREVMKDNYQTLLSLATGSPTFTPKIISHIKHGEEPYIRGEPESEERETGKSS

SEQ ID NO: 27159 - protein, 81 aa, Geotrypetes seraphini
AQMQVTFEDIAISFTQEEWEFLDEEQKELYREVMKENNQILISLADQQIPHEWKREKNQGEDPVEMEQIQTQSENVCENIS

SEQ ID NO: 27160 - protein, 81 aa, Geotrypetes seraphini
KMRVTFKDIAISFSQEEWGYLKEEQKELYREVMMENYQTLISLGTGSPPVTPDIISHIERGEEPYIREEPGSEEREPGRSS

SEQ ID NO: 27161 - protein, 81 aa, Geotrypetes seraphini
QMQVTFEDIAVSFSQEEWEYLDEEQKELYREVMKENYQTLISLATGSPTFTPKIISHIEPEEKPYLRDEPGSEERETEESS

SEQ ID NO: 27162 - protein, 81 aa, Geotrypetes seraphini
ISDQVSVTFGDFLETEWDVLGEWQKELYKRVIKEIHSFLISQGYSIINPDIIFKIKNEDEKYLTRRYQWEGKESKNDLTAS

SEQ ID NO: 27163 - protein, 81 aa, Geotrypetes seraphini
QMRLRFEDISVSFSQEEWAYLDEEQKELYREVMRDNYQTLISLGIGSPPVTPDIISCIEQGEEPYIRDEPGSEERKTGRSS

SEQ ID NO: 27164 - protein, 81 aa, Geotrypetes seraphini
QMQVTFEEVAVSFSQEEWEYLDEEQKELYREVMKENYQTVISLAAGSLTVTPKIISHIERGEEPYIRGEPGSEEREIGKSS

SEQ ID NO: 27165 - protein, 81 aa, Geotrypetes seraphini
AQMQVAFEDIAVSFSQEEWRYLEEEQKELYREVMKENYQTLISLGFPAITPEIISQIERGEEPYVRDEPGSEGRETGKSSY

SEQ ID NO: 27166 - protein, 81 aa, Geotrypetes seraphini
RIPVTFEDIIVHFSQEEWEHLEEWQKELYKDVMKENYETLILLGMYSPTDTPDIISHIERGEEPYIRDETGSEERETGKSS

SEQ ID NO: 27167 - protein, 81 aa, Geotrypetes seraphini
DQTSVTFKDVAAYFLEMEWDVLGEWQKELYKKVIKEIHDILISRGYLIVNPDVIFKIKKEDEKYVAQHCELEGNEDPNEPT

SEQ ID NO: 27168 - protein, 81 aa, Geotrypetes seraphini
TGASITFCDVAAYFLELEWEALEEWQKELYKKVIKEIHTFLTSRGYVIANPDVIVKIKKEDEKYFTQHYECKGTENMNDPT

SEQ ID NO: 27169 - protein, 81 aa, Geotrypetes seraphini
GMRVTFEDIAISFSQEEWGYLDEGQKELYKEVMKENYQILISLGAASATFTPEIISHIERGEEPCVRDEPGSKERETGQSS

SEQ ID NO: 27170 - protein, 81 aa, Geotrypetes seraphini
DQASITFKDVAAYFLEVEWSILGEWQKELYKKVIKEVHDILISRGYSIVNPDVIFKIGKEDDKYFTQQFEWKEEEDLNDPT

SEQ ID NO: 27171 - protein, 81 aa, Geotrypetes seraphini
AKAAVTFDDVAVYFSEEEWEKLEEGQKELYRETMKDNYEALISLGVPVFKHEIISRIESGEEPCVQGSQYLEQREMPESNF

SEQ ID NO: 27172 - protein, 81 aa, Geotrypetes seraphini
VLASVTFSDVSAYFRKMEWDIMEKWQKELYKKVIKEIHSFLISQGYSILNPDVIFKIKKEDEKYFTQRYEWKRKENLNDPS

SEQ ID NO: 27173 - protein, 81 aa, Geotrypetes seraphini
QMRVTFEDIAVSFSQEEWEYLDEEQKDFYREVMKENYQILISLGAGSPILTPKIISHIERGEEPYIKDEPESEEREIGKSS

SEQ ID NO: 27174 - protein, 81 aa, Geotrypetes seraphini
QMQITFEDIAFSFSQEEWEYLDEEQKELYKEVMKENYQTLISLETGSPAAIPDIISHIERGEEPYIRGEPGSEERETGKSS

SEQ ID NO: 27175 - protein, 81 aa, Geotrypetes seraphini
MMENYVTLASLGNIITSCLYFTRHTSVKPVIVSKIEDGEAPCTSQFSDAEKRKAFKCHSREPGSRNISKDNFHKQFATSLR

SEQ ID NO: 27176 - protein, 81 aa, Geotrypetes seraphini
QMRLSFEDISVSFSQEEWAYLDEEQKELYREVMKENYQTLISLGTGSPSVTPDIISHIEREEEPYVRDEPGSEEREPGTSS

SEQ ID NO: 27177 - protein, 81 aa, Geotrypetes seraphini
SAQMQVKFEDIAISFSQEEWEYLNEEQKQLYREVMEENYQILLSLDHQIQHEWKREKNQGEDPVEMEQIQTLSKNVCENNS

SEQ ID NO: 27178 - protein, 81 aa, Geotrypetes seraphini
QMQVTFEEVAVSFSQEEWEYLDEEQKELYKEVMKENYQILISLATGSPTVTPMIISHIEQGEEPYIRGEPGSEERETGNSS

SEQ ID NO: 27179 - protein, 81 aa, Geotrypetes seraphini
SAQMQVKFEDVAVTFSQEEWEYLDEGQKELYREVMKENYETLISLADSEATQETKREENQVNWLLEIEPIPRQSGNVSENI

SEQ ID NO: 27180 - protein, 81 aa, Geotrypetes seraphini
AQKQVTFEDITVSFTQEEWDYLNEEQKKLYREVMKENYQMLNSLADHQIRPEWQRIKSQREDPVEMDQIQTQSENIYENNS

SEQ ID NO: 27181 - protein, 81 aa, Geotrypetes seraphini
QITVTFNDVAAYFSEQEWQALEEWQRELYRGVMKQIHRALFSLGYPFIRPDVLFRIKQEEMEEAYYWDPQEPEGGDETFCT

SEQ ID NO: 27182 - protein, 81 aa, Geotrypetes seraphini
MPVTFEDIFISFSQEEWDYLNEEQKELYREVMKDNYQTLISLDHQITQEQRDPAGDSSYEHQGKRKGKTHQKQLQSMHKRN

SEQ ID NO: 27183 - protein, 81 aa, Geotrypetes seraphini
DQTLVTFKDVAAYFWEVEWNILGEWQKELYKKVIKEVHGILLSRGYSIVNPDVIVKIKKEDEKYFTQNFEWAGKGNPHDPM

SEQ ID NO: 27184 - protein, 81 aa, Geotrypetes seraphini
VPITFEDVTVNFSQEEWEDLEEWQKELYKDVMKENYETIISLEQREEPYVKDELESEERETGKSSCSESDEPGSQNEPTCL

SEQ ID NO: 27185 - protein, 81 aa, Geotrypetes seraphini
QVPAMFEDVAIYFGEEEWELLEEWQKKLYKETMKENYETLVSLGMGLLAEKPDLIVRIEREENPCVKAQWDSRDEKRWRSS

SEQ ID NO: 27186 - protein, 81 aa, Geotrypetes seraphini
QSPVSFEDIAIYFSQEEWAYLEEWQKELYKDVMKENYEMLSSLEIEFKRRHEGTLPKELHLEVTKTESEKERRDTCPCCDW

SEQ ID NO: 27187 - protein, 81 aa, Geotrypetes seraphini
VSAQVTFEDIAVSFSQEEWGYLDEEQKNLYREVMKENYQTLISLGSPTFTPKMTSHIERGQGPYIKDEPESEERETGQNSC

SEQ ID NO: 27188 - protein, 81 aa, Geotrypetes seraphini
AQMQLKFEDVAVSFSQEEWEYLDEGQKELYREVMKENYETLVSLGSVRISPDLFSWIKQDGEPNIQNPQESGEREVRCSFT

SEQ ID NO: 27189 - protein, 81 aa, Geotrypetes seraphini
DRVKFTFSDVAVYFSEEEWQLLEEQQKELYQNVMKENYTTLMSLGYTTVKPDVISKIEQGKQPLVSSPSGSKGRRAIGRPS

SEQ ID NO: 27190 - protein, 81 aa, Geotrypetes seraphini
AQVPVTFEDIAVYFSQKEWEDLEEWQKELYKDVMKENYEILISLGFLTVIPDIICHIEQGEEPFTRDEPGFKARETGKSSG

SEQ ID NO: 27191 - protein, 81 aa, Geotrypetes seraphini
QEMVTFEDITVRFSQEQWDYLDEGQKKLYREVMKENYETLISVEKDNPINSSAEIYHWEGEKMLSERDKENASSCSDGGEK

SEQ ID NO: 27192 - protein, 81 aa, Geotrypetes seraphini
RMQVTFEEVAVSFSQEEWEYLDEEQKELYREVMKDNYQILISLGKDSPTITPKIISHIDRGEEPYIRGEPGSEERETGKSS

SEQ ID NO: 27193 - protein, 81 aa, Geotrypetes seraphini
QMRLSFEDISVSFSQEEWAYLDEEQKELYREVMKENYQTLISLGTGSPTITPDIISHIERGEEPYVRDVAGTEEKESGISS

SEQ ID NO: 27194 - protein, 81 aa, Geotrypetes seraphini
DQKSVTFKDVAAYFWEVEWNILGEWQKELYKKVIKEVHGILLSRGYSIVNPDVIFKIKKEDEKHFTQHFEWEGKENPHDPL

SEQ ID NO: 27195 - protein, 81 aa, Geotrypetes seraphini
MKENYEILISLETDSPTVIPDIISQIERGEEPFIMDEPGSEERETGKSSCSDHQKRHDWKRIENQGEGPVEMEKIQTQSEN

SEQ ID NO: 27196 - protein, 81 aa, Geotrypetes seraphini
AQMQLKFEDVAVSFSQEEWEYLDEGQKELYREVMKENYETLISLGSVRINPDLLSWIKQDGEPNIQDPQESGEREVRRSDT

SEQ ID NO: 27197 - protein, 81 aa, Geotrypetes seraphini
AQMQVAFEDIAISFSQEEWEYLDEGQKELYREVMKENYETLISLGFVRISPNLLSWIKQDGESNIQEPQESGEREVRHSNT

SEQ ID NO: 27198 - protein, 81 aa, Geotrypetes seraphini
SAQMPVKFEDVAVSFSQEEWEYLNEEQKELYREVMKENYQTLISLDHQITQEMKREKKQGEDPVEIEQVQRQSGNVCENIS

SEQ ID NO: 27199 - protein, 81 aa, Geotrypetes seraphini
EDQVTFQDISISFSQEEWGYLDEEQKDLYREVMKENYQTLISLGTGCPELTPEIISRIERGDELYIRGEPGSEERETGKSS

SEQ ID NO: 27200 - protein, 81 aa, Geotrypetes seraphini
AKVPITFEDVTVNFSQEEWEDLEEWQKELYKDVMKENYETIISLGFLTITPEIIPHIEQREEPYVKDELESEERETGKSSC

SEQ ID NO: 27201 - protein, 81 aa, Geotrypetes seraphini
EQMRVTFEDIAVSFSQEEWEYLDEEQRELYREVMKENYQTLISLGFPTITPDIISHIERGEEPYVRDKPGSEERETGRSNC

SEQ ID NO: 27202 - protein, 81 aa, Geotrypetes seraphini
QMRVTFEDIAVSFSQEEWEYLDEEQRELYREVMKENYQTLISLGTGFPTITPDIISHIERGEEPYVRDKPGSEERETGRSN

SEQ ID NO: 27203 - protein, 81 aa, Geotrypetes seraphini
MLRRRRGRGREEAAEAPRGRRGNGRGPGRAGFAMKKPEVVSRIEQGEEPWVMENAGSSISGTNTILTILERLEKRMARIEH

SEQ ID NO: 27204 - protein, 81 aa, Geotrypetes seraphini
SAQMRVTFEDIAVSFSQEEWEYLDEEQKELYREVMKENYETLISLADTEAMHETKREENEEKCLLEIENISKQSGNVSENI

SEQ ID NO: 27205 - protein, 81 aa, Geotrypetes seraphini
EQVPVTFSDVAAYFWEAEWDVLGEWQKELYRQVIKGIHGVLISWGYSIINPDVIFRIKQPEEKYFSQYHDWEETQPPLGHP

SEQ ID NO: 27206 - protein, 81 aa, Geotrypetes seraphini
QVPITFEDIALYFSRAEWEYLQEQQKELYKDVMKENYEILISLEAGSPIVTPDIISHIERGEELYIMNDPISEERETGKSS

SEQ ID NO: 27207 - protein, 81 aa, Geotrypetes seraphini
VTFEDITVAFSQEEWEYLDEGQKELHREVMKENYEILKSLEKDDPKYNPWKLSEKPEGVKMLSEGEKENWGEKEKNQNPKY

SEQ ID NO: 27208 - protein, 81 aa, Geotrypetes seraphini
NVPVTFQDIAVYFSQEEWEDLEEWQKELYKDVMKENYQTLMSLGAGPLTVTPDIISHIERGEELYTRDKLGSEERETGKSS

SEQ ID NO: 27209 - protein, 81 aa, Geotrypetes seraphini
DQVSITFSDIAAYFLEVEWDILGEWQKEMYQKAIEEIHDILRSRGYSIANPDVVFKIKKEDEKHFAQPFASEGNENLNDHM

SEQ ID NO: 27210 - protein, 81 aa, Geotrypetes seraphini
QEALVTFKDVAAYFWEVEWNILGEQQKELYKKVIKEVHGILLSRGYSIVNPDVIFKIKKADENYFTQHFEWEGKGNPHDLM

SEQ ID NO: 27211 - protein, 81 aa, Geotrypetes seraphini
DQTLVTFKDVAAYFWEVEWNILGDQQKELYKKVIKEVHGILLSRGYSIVNPDVIFKIKKEDEKYFTQDFEWEGKENPHDSM

SEQ ID NO: 27212 - protein, 81 aa, Geotrypetes seraphini
ASAQVTFEDVVVSFSQEEWEYLNEEQKELYREVMEENYQTLISLADHQIQHEWKREKNQGEDPVEMEQIQTQSENVCENNS

SEQ ID NO: 27213 - protein, 81 aa, Geotrypetes seraphini
DQVSITFNDVAAYFLETEWNILEEWQKEMYRNVIQEIHGILTSRGYSIVNPDVIFKIKREDEKYPVQHYEWEKKENMTDPP

SEQ ID NO: 27214 - protein, 81 aa, Geotrypetes seraphini
DQTSVTFKDVAAYFLEMEWDILGEWQKELYKKVIKEIQDILISRGCLIVNPDVIFRIKKEDEKYFPQHCELEEKGNPNEST

SEQ ID NO: 27215 - protein, 81 aa, Geotrypetes seraphini
DQTSVTFKDVAAYFLETEWDVLGEWQKELYKKVIKEIQDILISRGYLIINPDVVFKIKKEDEKYFPQHCDLEEKGNPNEPT

SEQ ID NO: 27216 - protein, 81 aa, Geotrypetes seraphini
MQASVTFIDVAAYFLEGEWNVLGEWQKELYKKIIKDIQGMLISWGYSIVYPDVIVKIKKEDEKYFTHHYEGEEKENPTKSL

SEQ ID NO: 27217 - protein, 81 aa, Geotrypetes seraphini
VTFEDITVAFSQEEWEYLDEGQKELHREVMKENYEILRSLEKDDPKNNPWKLSEKPEGVKMLSEGEKENWGEKEKHQNQKY

SEQ ID NO: 27218 - protein, 81 aa, Geotrypetes seraphini
ALTSVVFSDVAACFWELEWDILKEWQKEIYKKVIKDIHSILMSQGHPLVTSVLSVSVKQESDLSFTDSPESEITEQVHVPV

SEQ ID NO: 27219 - protein, 81 aa, Geotrypetes seraphini
DQVPVAFSDVAAYFWEVEWDVLGERQKKLYKEVIKEIHGILTSRGYSILNPDVIFKIKKEDEKYLTQHCEQKEKENLKVPT

SEQ ID NO: 27220 - protein, 81 aa, Geotrypetes seraphini
MPAGASAQEEWQDLEEWQKELYKDVMKENYETLVSLGAGSPILTPDTISHIERGEEPYIRDDPRSAERETGKSSCSDYEIG

SEQ ID NO: 27221 - protein, 81 aa, Geotrypetes seraphini
MPAEAAAQVLVTLEEEWKGLEEGQRKLNSDVMRDCDENYEALISLGCTAPTPEVLSRIEVENEVQSHSDQFVSEARENATD

SEQ ID NO: 27222 - protein, 81 aa, Geotrypetes seraphini
EMRVMFEEITVSFSQEEWEYLDEGQKELYQEVMKENHETLIFLETNLQFVNPDMLSKIRRDSRMSRKRKATRSYAADDEAK

SEQ ID NO: 27223 - protein, 81 aa, Geotrypetes seraphini
AEMLVTFEDVAVYFSEEEWKVLEDGQKELYKDVMKENFESLMILGYPLVKPDVLIKLERGEDPWEKNWGHLRNTVISRTLC

SEQ ID NO: 27224 - protein, 81 aa, Geotrypetes seraphini
DQTSVTFKDVAAYFLEIEWDVLEEWQKELYKKVIKEIHDILISRGYLIINPDVIFKIKKEDEKYFPQHCELEEKGNPNEPT

SEQ ID NO: 27225 - protein, 81 aa, Geotrypetes seraphini
AQMQVTFEDIAVSFSQKEWEYLDEEQKELYREVMKENYQTVLSLGSPTVIPDIISQIERGEELYIRDEPGSDERETGKNSC

SEQ ID NO: 27226 - protein, 81 aa, Geotrypetes seraphini
TGVPVTFEDIAVYFLEDEWEMLAEWQKELYKETMKENYETLTSLGSSPEKPSLISKIEREEDPCIRNQQDSQDRRRPRSCW

SEQ ID NO: 27227 - protein, 81 aa, Geotrypetes seraphini
DQKLVTFKDVTAYFWEVEWNILGEWQKELYKKVIKEVHGILLSRGYSIVNPDVIFKIKKEDEKHFTQDCEWKGKENPHDPM

SEQ ID NO: 27228 - protein, 81 aa, Geotrypetes seraphini
VKLEDITVSFSQEEWKYLDEGQKELHREVMKENYELLRTLEKDDPIYNPWKLTEKPEGVKMLSEGEKEETSSCSDWGEKGK

SEQ ID NO: 27229 - protein, 81 aa, Geotrypetes seraphini
AQMQVTFEEVAVSFSQEEWEYLDEEQKELYREVMKENYQTLISLAGSLTVTPKIISHIERGEEPYIRGEPGSEEREIGKSS

SEQ ID NO: 27230 - protein, 81 aa, Geotrypetes seraphini
QMQVKFEDIAISFSQEEWEYLNEEQKELYREVMEENYQTLLSLATGSPTFAPKIISYIERGEEPYIRGEPESEERESGNSS

SEQ ID NO: 27231 - protein, 81 aa, Geotrypetes seraphini
QMSVKFEDIAVSFSQEEWEYLNEDQKELYREVMKENYQTLISLGTGSPSITPDIISHIERGEELYIKEEPGSEEREPGRSS

SEQ ID NO: 27232 - protein, 81 aa, Geotrypetes seraphini
QMPVKFEDVAVSFSQEEWEYLNEEQKELYREVMEENYQILLSLATGSPTFTPKIISLIKQEEEPYFRGEPESEERETGKSS

SEQ ID NO: 27233 - protein, 81 aa, Geotrypetes seraphini
VQIPVTFEDLVIYFSKEEWEDLEEWQKELYKEVMKENYKSLISLGSPTITPDVISLIERGEEPYVRDDPGSEERDSGKSSC

SEQ ID NO: 27234 - protein, 81 aa, Geotrypetes seraphini
EDCMQTWVTFEDVAVSFSLEEWQYLNEGQKDLYREVMKENLELLTSLSSLVAQLEQNRELFMKGQRGTLLSPSTGNRVAPG

SEQ ID NO: 27235 - protein, 81 aa, Geotrypetes seraphini
DQKLVTFKDVAAYFWEVEWNILGEWQKELYKKVIKEVHGILLSRGYSIVNPDVIFKIKKEDEKYFTQDFEWEGKENQHDSM

SEQ ID NO: 27236 - protein, 81 aa, Geotrypetes seraphini
RMQVTFKDITVSFSQEEWEYLDEGQKELYREVMKENYRTLISLDHQISQERKREKKQREDSVEIEQVQRQSGNVCENISQG

SEQ ID NO: 27237 - protein, 81 aa, Geotrypetes seraphini
AQMQVKFEDVAVSFSQEEWEYLDEGQKVLYREVMKENYETLISLGTVRISPDLLSWIKQDGETHIQDPQESGEREVRHSDT

SEQ ID NO: 27238 - protein, 81 aa, Geotrypetes seraphini
TRVTFEDITVSFSQEEWEYLNEEQKDLYREVMKENYETLSSLDYQITQEQRDPAGDSSYEHQGERKGKTHQKELQSIHKRN

SEQ ID NO: 27239 - protein, 81 aa, Geotrypetes seraphini
DLASVIFHDVAVYFSSEEWEILTDWQKELYKNVMREIHGTLVALGYTIVNRSTLLRVKEKTEAWRRRDRNKPSPTSTTSYP

SEQ ID NO: 27240 - protein, 81 aa, Geotrypetes seraphini
AQMQVKFEDVVVSFTEEEWEYLDEGQKELYKEVMKENYETLISLGSVRISPDLLSWIKQEGEPNIQNPQESGEREVRRSDT

SEQ ID NO: 27241 - protein, 81 aa, Geotrypetes seraphini
FQVSVTFKDVAAHFSEEEWEGLEEWQKEFYRKVMLEVHEALISLGYGILNSDIIFRVKQRDKLYSKDWQDVDGGRSARTSS

SEQ ID NO: 27242 - protein, 81 aa, Geotrypetes seraphini
AQMQVKFEDVAVSFSQEEWEYLDEGQKELYREVMKENYETLISLGSVRISPDLFSWIKQDGETHIQDPQESGEREVRHSDK

SEQ ID NO: 27243 - protein, 81 aa, Geotrypetes seraphini
QNQMRVKLEGISVSFSQEEWAYLDERQKELHREVMKENYELLRSLAANEMRLKKEKREEQLLKWKPYSSQVDISQRTERRN

SEQ ID NO: 27244 - protein, 81 aa, Geotrypetes seraphini
MKDNYEALISLGVPVFKHEIISRIESGEEPCVQGSQYLEQREMPESNFMDDDLIKEIKVEEEHLVECASVPDEQIIPSEKL

SEQ ID NO: 27245 - protein, 81 aa, Geotrypetes seraphini
EVPVTFEDIALYFSQEEWEALEEWQKELYKDVMKENYQILLSLGIGSLNVTPDIISHIERGEEPYIRDELRSEERDTGKSS

SEQ ID NO: 27246 - protein, 81 aa, Geotrypetes seraphini
QMRVTFEDISVSFSQEEWGYLNEEQKELYREVMKENYQTLISLATDSPIIDPDIISRIERGEEPYVRDEPASEERETGRSN

SEQ ID NO: 27247 - protein, 81 aa, Geotrypetes seraphini
VQTLLAFEDVAVYFSEEEWALLDELQKDIYKNTMRENYETLLSLGLTNMKPEIIAKIDAGEAPSVRNGSYLEKQGRKNAAG

SEQ ID NO: 27248 - protein, 81 aa, Geotrypetes seraphini
QMPVKFEDIAVSFSQEEWEYLNEEQKELYREVMKENYQTLISLGTGSPCVTPDIISHIEWGEEPYIREEPGSEEREPVRSS

SEQ ID NO: 27249 - protein, 81 aa, Geotrypetes seraphini
AQMQLKFEDVAVSFSQEEWEYLDEGQKELYREVMKENYETLLSLGSVRISPDLLSWIKQDGETHIQDPQESGEREVRHSDT

SEQ ID NO: 27250 - protein, 81 aa, Geotrypetes seraphini
AQMPVKFEDIAVSFSQEEWEYLNEEQKELYREVMEENYQTLISLGSPPVTPDIISHIERGEEPYIREEPGSEEREPGRSSC

SEQ ID NO: 27251 - protein, 81 aa, Geotrypetes seraphini
RVPVTFEEIAVHFSREQWECLNEGQKELYREVMKENYETVISLGIDHESINPEVLSRIKQEEEPCVWDPKESGEREVTHLY

SEQ ID NO: 27252 - protein, 81 aa, Geotrypetes seraphini
AQMPVKFEDIAISFSQEEWEYLDEEQKQLYREVMKDNYQTLLSLADHQIHHEWKREKNQGEDPVDMEQIQIQSENVSENNS

SEQ ID NO: 27253 - protein, 81 aa, Geotrypetes seraphini
AQVPVTFEDIAIYFSQEEWEYLDEGQKALYREVMKENYETLLLLGCPGLKPVIISSIEQGEEPCVRKLQERAELYPTAGDE

SEQ ID NO: 27254 - protein, 81 aa, Geotrypetes seraphini
DQTSVTFKDVAAYFLEMEWDILGEWQKELYKKVIKEIHDILMSRGYLIVNPDVVFKIKKEDEKYFPQHCDLEEKGNPNEST

SEQ ID NO: 27255 - protein, 81 aa, Geotrypetes seraphini
DQASVIFSDVAAYFWDVEWDILGEWQKELYKKVIKEIHSFLIAQGYSILNPDVIFKIKKEENKYFTQHCEMEGKENINDST

SEQ ID NO: 27256 - protein, 81 aa, Geotrypetes seraphini
QMPVTLEDIFISFSQEEWEYLNEEQKELYREVMAENYETLKSLGTDSPPVTPDIISHTERGEEPYIKDEPGSEERETGTSS

SEQ ID NO: 27257 - protein, 81 aa, Geotrypetes seraphini
AQVSVTFDDAAGRSLEDEWKGLEEGQKMLHMDTMKDTYEVLTCLDSAAANPEVLSRIKEEDEPPCSDHSASEGKEDSNPGI

SEQ ID NO: 27258 - protein, 81 aa, Geotrypetes seraphini
AQGLVSFEDIAIYFSQEEWEDLEEPQKELYKDVMKDNYQTLSSLGRASITPDIITHIEQGEEPYIRTWPKSEEREARKSSH

SEQ ID NO: 27259 - protein, 81 aa, Geotrypetes seraphini
ASGQVAFEDIAVSFSQEEWEYLDEGQKELYREVMKENYETLISLGYVKISPDLLSWIKQEGEPNIQDPQESEERERHSYTG

SEQ ID NO: 27260 - protein, 81 aa, Geotrypetes seraphini
QMPVKFEDIAVSFSQEEWEYLNDEQKELYREVMKENYQTLISLGIGSPSVTPDIISHIERKEEPGSEEREPGRSSCSDHQK

SEQ ID NO: 27261 - protein, 81 aa, Geotrypetes seraphini
TQMRVTFEDITVSFSQEEWEYLDQGQKELYREVMKENYEILISLADHQISQEWKKEKNQGEDPVKMEQMQTQENVGQNISQ

SEQ ID NO: 27262 - protein, 81 aa, Geotrypetes seraphini
AQMQVKFEDVAVSFSQEEWEYLDEGQKELYREVMKENYETLISLGSVRISPDLFSWIKQDGEPNIQDPQESGEREVRCSFT

SEQ ID NO: 27263 - protein, 81 aa, Geotrypetes seraphini
AQMQVKFEDVAISFSQEEWEYLDDGQKELYREVMKENYETLISLGLICLQRIHESERPFTSPECGKSFNHQSSLRRHERIR

SEQ ID NO: 27264 - protein, 81 aa, Geotrypetes seraphini
QQMWVTFEDVAVSFSQEEWEYLDDGQKELYQEVMKENYETVMSLGEEFSQEKEKEENAEHSLKTEVHEMNLKAVNLFKCSL

SEQ ID NO: 27265 - protein, 81 aa, Geotrypetes seraphini
DKALVTFKDVAAYFWEVEWNILGERQKELYKKVIKEVHGILLSRGYSIVNPDVLFKIKKEDEKYFTQHFEWEGKGNPHDPM

SEQ ID NO: 27266 - protein, 81 aa, Geotrypetes seraphini
QIPVTFEDTAIYFSQEEWDDLEEWQKELYKDVMKENYEILISLGAGSPAVTPDIISYIERVKELYIGDELGSEERETRKSS

SEQ ID NO: 27267 - protein, 81 aa, Geotrypetes seraphini
AQMQITFEDIAFSFSQEEWEYLDEEQKELYKEVMKENYQTLISLGSPPVTPDIIFHIERGEEPYIREEPGSEEREPGRSSC

SEQ ID NO: 27268 - protein, 81 aa, Geotrypetes seraphini
QVPVTYEDITVHFSREQWECLNEGQKELYREVMKENYDTLISLGTGHESIGPEVLSKIKQEEEPLVWDPKEAGETEITHSY

SEQ ID NO: 27269 - protein, 81 aa, Geotrypetes seraphini
DQASVIFSDVAAYFWEMEWNILGEWQKNLYKKIIKEIHNFLMSQGYSIVNPDVIFKIKKEDEKHFTQCYEREDMKDSIMKF

SEQ ID NO: 27270 - protein, 81 aa, Geotrypetes seraphini
QKPVTFEDIIVSFTQEEWAYLDEEQKKLYREVMKENYQMLNSLGTGSPTFTLKILSHIKPRQKPNIRSEPGSEERETGKSS

SEQ ID NO: 27271 - protein, 81 aa, Geotrypetes seraphini
SAQKQVTFEDITVSFTQEEWAYLDEEQKKLYREVMKDNYQMLISLDHQIRPEWQRIKSQREDPVEMDQIQTESENIYENIS

SEQ ID NO: 27272 - protein, 81 aa, Geotrypetes seraphini
AQMRVTFEDIAVSFSPEEWEYLDQRQKDLYREVMKENYEILISLGCPNLTPEIISRIERGEEPYIRGEPGSEERETGKSSC

SEQ ID NO: 27273 - protein, 81 aa, Geotrypetes seraphini
QMQVTFEDIAVSFSQEEWEYLDEEQKELYREVMKDNYQTLLSLAIDSLTFTPKIISHIKRGEEPYIRSEPESEERESVKSS

SEQ ID NO: 27274 - protein, 81 aa, Geotrypetes seraphini
RAMPVTLEDVTVSFSSEEWQMLEEWQKELYRNVMSDNYDTISSLGEIDLKPNVMPNFEWDEELIAGDRAEVAGNDGYSVFN

SEQ ID NO: 27275 - protein, 81 aa, Geotrypetes seraphini
SAQMQLKFEDVAVSFSQEEWEYLDEGQKELYREVMKENYETLISLADTEAMQEMKMEENQENWLLEIELIPRQSGNVSENI

SEQ ID NO: 27276 - protein, 81 aa, Geotrypetes seraphini
QMQVTFEEVAISFSQEEWEYLDEEQKELYREVMKENYQTLISLATGSPTVTPKIISHIERGEEPYIRGEPGSEERETGKNS

SEQ ID NO: 27277 - protein, 81 aa, Geotrypetes seraphini
QMPVKFEDVAVSFSQEEWEYLKEEQKELYREVMKENYETLISLGTGSPPVTPDIISHIERGEEPYIREEPGSEERGPVRSS

SEQ ID NO: 27278 - protein, 81 aa, Geotrypetes seraphini
DQTSVTFKDVAAYFLEMEWDILGEWQKELYKKVIKEIHDILISRGYVILNPDVIFKIKKEDEKYFAQHCELEGKGNPNEPI

SEQ ID NO: 27279 - protein, 81 aa, Geotrypetes seraphini
RVTFEDIAVSFSQEEWEYLDEGQKELYREVMKENYQTLMFLDNEAVWEPKREPNREPQVDMEKGPPKSGNGCQNISERNER

SEQ ID NO: 27280 - protein, 81 aa, Geotrypetes seraphini
GQMPVTFEDIFISFSQEEWDYLNEEQKELYREVMKDNYQTLISLDHQIMHEQSDPARDSRFQPQAKRKGKAHQKELQCVHK

SEQ ID NO: 27281 - protein, 81 aa, Geotrypetes seraphini
VKMEDVTVSFSQEEWEYLDEGQKELHREVMKENYELLRSLEKDDPKYNSWKLSEKTERVKMLSETSSCSVWGEKEKHQNQK

SEQ ID NO: 27282 - protein, 81 aa, Geotrypetes seraphini
GMRVTFEDIAVSFSQEEWEYLGEGQKELYREVMKENYETLISLGTDSSALTPEIISRIERGEEPCIRDKPGSEERETGKSS

SEQ ID NO: 27283 - protein, 81 aa, Geotrypetes seraphini
DQTSVTFKDVAGYFLETEWDILREWQKELYKKIIKEIHDILISRGYLIVNPDVIFKIKKEDEKYFAQHCELERKGNPNEPT

SEQ ID NO: 27284 - protein, 81 aa, Geotrypetes seraphini
SAQMRVTFEDIAVSFSQEEWEYLDEKQKELYREVMKENYEILISLADTEAMQWIKREENEEKWLLEIEHIPRQPGNVSENI

SEQ ID NO: 27285 - protein, 81 aa, Geotrypetes seraphini
MRVTFEDIAVSFSQEEWEYLDEEQKELYREVMKENYEILISLADTEAMQEMKREQNEEKWLLEIEPIPRQPGNVSENISQS

SEQ ID NO: 27286 - protein, 81 aa, Geotrypetes seraphini
VTFEDITVSFSQEEWEYLDEGQKELHQEVMKENYEILRSLEKDDPKNNPWKLSEKTEGVKMLSEGEKENWGEKEKNQNQKY

SEQ ID NO: 27287 - protein, 81 aa, Geotrypetes seraphini
AQMQVKFEDIAISFSQEEWEYLDEEQKELYREVMKENYQTLLSLADHQIQHEWKRENNQGEDPVEMEQIQTQSENVCENIS

SEQ ID NO: 27288 - protein, 81 aa, Geotrypetes seraphini
AQLHVKFEDVAVSFSQEEWEYLNEEQKELYREVMEENYQTLLSLGSPTFTPKIISHIKHGEEPYIRGEPESEERESGKSNC

SEQ ID NO: 27289 - protein, 81 aa, Pseudonaja textilis
IGLFTLQEVAVHFTKEEWTLLEPDQKAPHRETMEEISGILASLGKSHLSLETERRNHEASSYVESWDETSDRNMSWKSHPG

SEQ ID NO: 27290 - protein, 81 aa, Pseudonaja textilis
DLISFEDVAVFFSVEEWALLDSEQKALYQEVMLENKRNVASLGDGWEMEDSGQEAAAPLPKDKKEVVGKMYGKPSCELSQL

SEQ ID NO: 27291 - protein, 81 aa, Pseudonaja textilis
DLVSFEDVAVFFSVEEWALLDSEQKALYQEVMLENKRNVASLGDGWEMEDSGQEAAAPLPKDKKEVVGKMYGKPSCELSQL

SEQ ID NO: 27292 - protein, 81 aa, Colinus virginianus
TQSGSISMEEIRRDVHAAAAAAALLDPAQRALYRDVMLETYECVASLGEGFAAFPPLLGSFGSAECASTSRAQNNHHAVLS

SEQ ID NO: 27293 - protein, 81 aa, Geotrypetes seraphini
DQTSVTFKDVAAYFLEMEWDVLGEWQKELYKKVIKEIHDILISRGYVIVNPDVIFRIKKEDEKYFAQHCELEGKVNPNEPT

SEQ ID NO: 27294 - protein, 81 aa, Geotrypetes seraphini
DQASITFKDVAAYFLEVEWDILGEWQKELYKKIIKEIHDILISRGCLIVNPDVIFKIRKEDEKYFTQHFEWEEKENLNDPT

SEQ ID NO: 27295 - protein, 81 aa, Geotrypetes seraphini
QMRLRFEDISVSFSQEEWAYLDEEQKELYREVMMDNYQTLISLGTGSPPATPDIISHIEQGEEPYIKDEPGSEERETGRSS

SEQ ID NO: 27296 - protein, 81 aa, Geotrypetes seraphini
ASAQVTFEDIAVSFCHEEWRYLDEGQKELYKEVMKENYETLISLGFLCEKPSLISKIEQEEDPCVRDQQNSRERRRRLKNF

SEQ ID NO: 27297 - protein, 81 aa, Geotrypetes seraphini
VTFEDITVAFSQEEWEYLDEGQKELHREVMKENYEILKSLGKDDPKNNPWKLSEKPEGVKMLSEGEKENWGEKEKNQNPKY

SEQ ID NO: 27298 - protein, 81 aa, Geotrypetes seraphini
DWVSVTFSEVAAYFWEVEWDGLGERQKELYKMVIFEIHGILMSRGYSIFNPDAIFKLKRQDGKYFTPLCEWKRKENPNDPP

SEQ ID NO: 27299 - protein, 81 aa, Geotrypetes seraphini
QMPVKFEDIAVSFSQEEWEYLNEEQKELYREVMEENYQTLISLGIGSPSVTPDIISHIEGGEEPYIREEPGSEEREPGRSS

SEQ ID NO: 27300 - protein, 81 aa, Geotrypetes seraphini
QLHVKFEDVAVSFSQEEWEYLNEEQKELYREVMEENYQTLLSLATGSPTFTPKIISHIKHGEEPYIRGEPESEERESGKSN

SEQ ID NO: 27301 - protein, 81 aa, Geotrypetes seraphini
YQASVTFNDVAVYFSQEEWRLLDEWQKRLYKDVTKEIQSVLISLGYTIVNPNVLFRIKDSDRPSKEGRRERVHRGREKLKG

SEQ ID NO: 27302 - protein, 81 aa, Geotrypetes seraphini
QVPVTFEDVAVSFSQEEWKYLDEAQKNLYWEVMKENYETLISLADSEVHQEEEREKNQEEYPMLWGLISRQSRKNHEKVYW

SEQ ID NO: 27303 - protein, 81 aa, Geotrypetes seraphini
AQMQVKFEDVAVSFSQEEWEYLDEGQKELYREVMKENYETLLSLGSVRISPDLFSWIKQDGEPNIQDPQESGEREVRHSDT

SEQ ID NO: 27304 - protein, 81 aa, Pelodiscus sinensis
EVEPVSFEEVAVYFSEDEWALLHPAQRALYGDVMQENYESVNWLKFQVSKTDVISWMELEEELRVPDPQSVCPLFYSSFRV

SEQ ID NO: 27305 - protein, 81 aa, Pelodiscus sinensis
VMEPVSFEEVAVYFSEEEWALLGPRQRALYRDVMQENNEAVNWLRFSILKPDLVAQLERGEEPWVSDFQSSKEMEILRVTR

SEQ ID NO: 27306 - protein, 81 aa, Geotrypetes seraphini
QMQVKFEDIAISFSQEEWEYLNEEQKELYREVMEENYQTLLSLATGSLTFTPKIISYIERGEEPYIKDEPESEEKESGKSS

SEQ ID NO: 27307 - protein, 81 aa, Geotrypetes seraphini
GRMQVTFEEIFISFSQEEWDYLNEEQKELYREVMKENYQTLISLADQQIRHEWKRQKNQGEDVVEMEQSQTQSENVCENIS

SEQ ID NO: 27308 - protein, 81 aa, Geotrypetes seraphini
AQMQLKFEDVAVSFSQEEWEYLDEGQKELYREVMKENYETLISLGSVRISPDLLSWIKQEGETHIQDPQESGEREVRHSDT

SEQ ID NO: 27309 - protein, 81 aa, Geotrypetes seraphini
TRASVTFRDVAVCFSEEEWETLEEWQKELYRNAMKKIHGALISLGYAIVNPGVLFKIRKEDETRYGGEHASKGRENNDIAD

SEQ ID NO: 27310 - protein, 81 aa, Geotrypetes seraphini
MRVTFEDIAVSFSQEEWEYLDQGQKDLYREVMKENYEILISLGSSNPIPEIISRIERGEEPYIRGEPGSEERKTGKSSCSD

SEQ ID NO: 27311 - protein, 81 aa, Geotrypetes seraphini
GQMRLSFEDISVSFSQEEWAYLDEEQKELYREVMKENYQTLISLGSPTVTPDIISHIERGEEPYVKDEAGTEERESGTSSC

SEQ ID NO: 27312 - protein, 81 aa, Geotrypetes seraphini
DQASITFKDVAAYFLEVEWNILGEWQKQLYKKFIKEIHDILISRGYSIINPDVIFKIRREDDKYFTQQFEWKEEEDLNDPI

SEQ ID NO: 27313 - protein, 81 aa, Geotrypetes seraphini
QVPVTFEDIAVYFSQEEWEDLEEQQRELYKDVMKENYETLSSLGTGPPAVTPDIISHIERGEEPYIRFESGPEEREIGKSS

SEQ ID NO: 27314 - protein, 81 aa, Geotrypetes seraphini
AQKQVTFEDITVSFTQEEWAYLDEEQKKLYMEVMKDNYQMLISLADHQIQPEWQRIKSQREDPVEMDQIQTQSENIYENIS

SEQ ID NO: 27315 - protein, 81 aa, Geotrypetes seraphini
EDCMQTWVTFEDVAVSFSLEEWQYLNEGQKDLYREVMKENVELLTSLSSLVAQLEQNRELFVKGQRGTLLSPSTGNIVGPG

SEQ ID NO: 27316 - protein, 81 aa, Geotrypetes seraphini
DWVSVTFSEVAAYFWEVEWDGLGERQKELYKMVIFEIHGILMSRGSSSVKPDILIRFKLEGFQTEPRGFEDRGNLPISDFS

SEQ ID NO: 27317 - protein, 81 aa, Geotrypetes seraphini
VMFEDIFIFFSQEEWEYLDEEQKKLYKEVMKENYEILMSLGKDDPKNNPWKLSEKPEGVKMLSEGEKEETSSCSVWEEKEK

SEQ ID NO: 27318 - protein, 81 aa, Geotrypetes seraphini
AAQMQVTFEDITVTFSPEEWEYLNEGQKELYREVMKENYQTLISLGYQIAQERKREKNQGEEPVEIEQIQKQSENICETVS

SEQ ID NO: 27319 - protein, 81 aa, Geotrypetes seraphini
VQMPVTFDDVAIYFSQEEWEELNEQQRELYQEVMRENLELLTSLGYPKATHDITLKIKEWEESCIWEQQDTQGDEILLSFH

SEQ ID NO: 27320 - protein, 81 aa, Geotrypetes seraphini
VTFEDIAVSFSQEEWEYLDEGQKELYREVMKENYQTLMFLADNEAVWEPKREPNREPQVDMEKGPPKSGNGCQNISERNER

SEQ ID NO: 27321 - protein, 81 aa, Geotrypetes seraphini
DQPLVTFKDVAAYFLEVEWNILGEQRQELYKKVIKEVHGILLSRGYSIVNPDVIFRIKKEDENYFTQHFEWEGKGNPHDPM

SEQ ID NO: 27322 - protein, 81 aa, Geotrypetes seraphini
AQVPITFEDIALYFSRAEWEYLQEQQKELYKDVMKENYEILISLAGSPIVTPDIISHIERGEELYIMNDPISEERETGKSS

SEQ ID NO: 27323 - protein, 81 aa, Geotrypetes seraphini
DQALVTFKDVAAYFWDVEWNILGERQKELYKKVIKEVHGILLSRGYSIVNPDVIFKIKKEDEKHFTQDFEWEGKENPHDSM

SEQ ID NO: 27324 - protein, 81 aa, Geotrypetes seraphini
SAQKQVTFEDITVSFTQEEWAYLDEEQKKLYMEVMKDNYQMLISLDHQIQPEWQRIKSQREDPVEMDQIQTQSENIYENIS

SEQ ID NO: 27325 - protein, 81 aa, Geotrypetes seraphini
MEVTFEEIAISFSEEEWQCLNEEQKELYREVMKENYQTLISLGPGAPTVIPAIISRIERGEEPRLEKKKRGKSSCSDNEAS

SEQ ID NO: 27326 - protein, 81 aa, Geotrypetes seraphini
DQTSVTFKNVAAYFLETEWNVLEEWQKELYKKVIKEIQDILISRGYLIVNPDVIFRIKKEDEKYIAQHGELEGKGNPNEPT

SEQ ID NO: 27327 - protein, 81 aa, Geotrypetes seraphini
DLVSVTFRDVAAYFLEMEWDILGEWQKEMYKKVIKEIHGILRSHGYSIVNPNVVFKFKKEDEKYSTQLFEWEGEESPNDPM

SEQ ID NO: 27328 - protein, 81 aa, Geotrypetes seraphini
GLPQVTFDDAAIYFSEEQWKNLEEWQQEMYKELMKEIYETMIALGHQIPKPDILSLIERGEEPCALPSKRKKTEPHPQTTE

SEQ ID NO: 27329 - protein, 81 aa, Pelodiscus sinensis
VVEPVSFEEVAVYFSEEEWALLDAGQRALYWDVMQENYEAVSWLGFPASTAHAISWVEQGEELWIPDVQGCEEGEIISDPH

SEQ ID NO: 27330 - protein, 81 aa, Pelodiscus sinensis
VVELLTFEEVAVYFSKEEWALLDPGQRALYRDVMQENYEAVSWLGFPVSKTDVISWVEREEEFWVPDPRSCEEGVIISNTH

SEQ ID NO: 27331 - protein, 81 aa, Pelodiscus sinensis
AQRLVAFEEVAVYFTKEEWALLDPSQRAVYWDIMQENYENVTSLGLPLSTPEVTPQLEGGEELWVSDLQGSEGREIPRGTY

SEQ ID NO: 27332 - protein, 81 aa, Colinus virginianus
PKVPLTFDDIAVYFNEEEWERLDSWQKDLYKAVMRGNYETLVSLDYAVSKPDILSRIERGEELFVKDCWESPQTFNQVSPE

SEQ ID NO: 27333 - protein, 81 aa, Pelodiscus sinensis
PKVPVMFEDGAVFSQDEWENLEDWQKELYKNVMKGNYEYMISLGTDYAISKPDILSRIERGEEPCARGQQESEGKSCMTNR

SEQ ID NO: 27334 - protein, 81 aa, Colinus virginianus
RLLHKEPVSFEEVAVYFSREEWALLDPAQRALYRDVMLEMYECVASLGEGFAAFPPLLGTFGCAEYESEIRAQNNHHAVPS

SEQ ID NO: 27335 - protein, 81 aa, Pelodiscus sinensis
QQPPVAFEDVALYFTRAEWELLSPPEKQLYREQMLRNYRALVSLGFSGSTPDLICRIELGEAELWIQDAENFKESSWPEGE

SEQ ID NO: 27336 - protein, 81 aa, Pelodiscus sinensis
VEPVSFEEVAVYFSEEEWALLDPGQRALYWDVMQENYEAVSWLAGDGMLSENNEGSLHQEGPEQVAPCEILLGRSEGHVSQ

SEQ ID NO: 27337 - protein, 81 aa, Pelodiscus sinensis
PEPVNFEEVAVYFSEEEWALLDPGQRALYRDVMQENYEAVSWLAGDKMLNENSERSLQEEGPERMAPCGMLVGRSEWHVSQ

SEQ ID NO: 27338 - protein, 81 aa, Pelodiscus sinensis
QESVTFEEVAVYFTRAEWALLDPAQRALYRAVMQENYEMVALLGKQNEESFWENDAEEYEEQVEPQGMLSERLKGTVSENC

SEQ ID NO: 27339 - protein, 81 aa, Pelodiscus sinensis
EPMPFKEVAVYFTWEEWALLDPAQRALYRAVMRENYENVTSLGCGMTSMCCSRPSRLPLGRGREMAALELVQGPVTFEEVA

SEQ ID NO: 27340 - protein, 81 aa, Pelodiscus sinensis
VAKPVSFQEVAVYFSEEEWALLAPGQRALYWDAMQENYEAVSWLGFPVPKAHVLSWVEQREELQTLDIQGCEEGEIISDTH

SEQ ID NO: 27341 - protein, 81 aa, Pelodiscus sinensis
AAAGLVTFEEVAVYFSEEEWALLDPGQRALYWDVMQENYEAVSWLAFELLQPEGFEGKGGFSPLAGDGTLRENNESPERGE

SEQ ID NO: 27342 - protein, 81 aa, Pelodiscus sinensis
KVPVTFDDVSVYFSEQEWGNLDDWQKDLYKNVMKGNYESLISLGTDYAISKPDLLSRIERGEEPWGGEQENAEEREIPMEP

SEQ ID NO: 27343 - protein, 81 aa, Colinus virginianus
LQEPVSFAEVAVYFSREEWALLDPAQRALYRDVMLEMYECVTSLGEGFAAFPPLLDTFGCAECASAIRAQSNRHAVPSWQT

SEQ ID NO: 27344 - protein, 81 aa, Pseudonaja textilis
VSFEEVAVCFSKEEWTQLNPHQKALHGEVMRENLRNVKRHFVEPALWPKANHTRGGIQQVLTRGYYLLLCRALPASQDLFL

SEQ ID NO: 27345 - protein, 81 aa, Pelodiscus sinensis
PVTFEEVAVYFSEEEWALLDPGQRALYWDVMQENYEAVSWLGFPVCKAHVISWMDRGEELLVPDLQACEEGENGSDTHTGE

SEQ ID NO: 27346 - protein, 81 aa, Pelodiscus sinensis
FQVPVTFEELSVYFTVGQGALLSPAQRDLYEDVMQENYETVASLGFSILKPDLIAQLERGEELWVPDLQPFKEMEILRGTH

SEQ ID NO: 27347 - protein, 81 aa, Pelodiscus sinensis
QGLVTFEEVAVHFTEEEWVLLDPAQRALYRDVMQENYENVSSLGMEPSTDDENDRDTFEDQKHEAKLLTNFQEMVSFSLQN

SEQ ID NO: 27348 - protein, 81 aa, Pelodiscus sinensis
GFPISKPDLLSWMERGEEPWVPDLQAPEEREIPRSSSPGEQEESEGENHVRTEKEVESPSPGPEGKLEILEGKTPEKPAGQ

SEQ ID NO: 27349 - protein, 81 aa, Pelodiscus sinensis
EIPKVPVTFDDVSVYFNEQEWGCLEEWQKELYKNVMKGNYEALISLDTGPDSPLVLEECGTWLKVPRQPLVSLPATTQHPL

SEQ ID NO: 27350 - protein, 81 aa, Pseudonaja textilis
WACHLLVAIHFNNEEWLLLDPSQKALYQEVMLETSRMVASLGKGSSGGKFTSEQGVTRYIIYNLDLYPHQRKTAQSVPKIS

SEQ ID NO: 27351 - protein, 81 aa, Pelodiscus sinensis
PKVPVTFNNASFNFSEQEWKSLDEWQKELYRHIMKGNYEAVISLDAAISKPDLLSRIERGEAPGVGNQGDSESRQIPEDPS

SEQ ID NO: 27352 - protein, 81 aa, Colinus virginianus
SQEPVSFEEVAVYFSREEWALLDPAQRALYRDVMLETYECVASLAPLPAPKPMVISLLEEGEEPWIPDVGSPEAVAGDVSP

SEQ ID NO: 27353 - protein, 81 aa, Pelodiscus sinensis
FQVPVTFEEVAVYFTQGQGALLGPAQRALYRDVMRENYEMVTSLGFPVPKPDLVTRLERGEELWVPDCQASEEGGICRGEE

SEQ ID NO: 27354 - protein, 81 aa, Pelodiscus sinensis
PKVPVKFDEVSGCFSGQEWGVLEQRQEELHRNTERSHYETLISLDHAASTPDAQSWIEAREEPRVQGGQGSPKRETPTAPS

SEQ ID NO: 27355 - protein, 81 aa, Pelodiscus sinensis
VSEPVTFEEVALYFSEEEWALLDAGQRALYRDVMKENYEAVRWLDNGRLNENHDKSLQNEGPEQMAPCGMMLGISEGHVSQ

SEQ ID NO: 27356 - protein, 81 aa, Colinus virginianus
WQEPVTFEDIAVYLSRAEWDMVSEEQRELYCSVMLDNYELLASLGYPGPKPDIVHRLERGEEPWVSTPQSPVKWDGPDRSL

SEQ ID NO: 27357 - protein, 81 aa, Geotrypetes seraphini
SGRMQVTFEEIFISFSQEEWDYLNEEQKELYREVMKENYQTLISLDQQIRHEWERKKNPGEEAVEMEQIQTHSENVCKNIS

SEQ ID NO: 27358 - protein, 81 aa, Geotrypetes seraphini
QMPVKFEDIAVSFSQEEWEYLNEEQKELYREVMKENYETLISLGTGSPPVTPDIISHIERGEEPYIKEEPGSEERGPVRSS

SEQ ID NO: 27359 - protein, 81 aa, Geotrypetes seraphini
SAQKQVTFEDITISFTQEEWAYLDEEQKKLYREVMKDNYQMLISLDHQIRPEWQRIKSQREDPVEMDQIQTQSENIYENIS

SEQ ID NO: 27360 - protein, 81 aa, Geotrypetes seraphini
MWVTFEDVAVSFSQEEWEYLDEGQKELYREVMKENYETVMSLAGIEFSQQKEKEENLEQHSLKWRLRPRRVDVILETVKGE

SEQ ID NO: 27361 - protein, 81 aa, Geotrypetes seraphini
DQALVTFKDVAAYFWEVEWNILGEQQKKLYKKVIKEVHGILLSRGYSIVNPDVLFKIKKEDEKYFTQHFEWEGKGKPHGHM

SEQ ID NO: 27362 - protein, 81 aa, Geotrypetes seraphini
GLKKATFDDVAVYFSSEEWSQLDEDQKTIYRDVMQDNYQIMISLGYDIPKPKVLLLVEEGRDPCIDDHIDSARENIDGMVI

SEQ ID NO: 27363 - protein, 81 aa, Geotrypetes seraphini
QVQETFEDIAVSFSQEEWGYLDEEQKELYREVMKENYQTLLSLGTGSLTVAPDIICRIERGEEPYIKDEPGSEEREPGRSS

SEQ ID NO: 27364 - protein, 81 aa, Geotrypetes seraphini
AQMQVEFEDIAVSFSQEEWEYLDEGQKELYREVMKENYETLISLGSPTFTPKIISYIERGEEPYIRGEPESEERESGKGSC

SEQ ID NO: 27365 - protein, 81 aa, Geotrypetes seraphini
RIPVTFEDIIIYFSQEEWEYLEEWQKELYKDVIKENYETLILLGMYSPTDTPDIISRIERGEEPYIRDETGSEERETGKSI

SEQ ID NO: 27366 - protein, 81 aa, Geotrypetes seraphini
DQASVTFSDVAAYFWKAEWDILGEWQKELYKKVIKEIHNFLMLQGYSIVNPDVIFKIKKEEDKCFTQHCELEGDENLKDST

SEQ ID NO: 27367 - protein, 81 aa, Geotrypetes seraphini
DQKSVTFKDVAAYFLEMEWDILGEWQKKLYKKVIKEIHDILISRGYLIVNPDVIFKIKKEDENYFSQHCELEEKGNPNEST

SEQ ID NO: 27368 - protein, 81 aa, Geotrypetes seraphini
MQVKFEDVAVSFSQEEWEYLDEGQKELYREVMKENYETLISLGSVRISPDLLSWIKQDGEPNIQDPQESGEREVRHLDTGL

SEQ ID NO: 27369 - protein, 81 aa, Geotrypetes seraphini
PVTLEDIFISFSQEEWEYLNEEQKELYREVMAENYETLMSLDHEITQERKREGEHSIEREEIQRQSENVCENISQGTKRIH

SEQ ID NO: 27370 - protein, 81 aa, Geotrypetes seraphini
AQMQVKFEDVAVSFSQEEWEYLDEGQKELYREVMKENYETLISLGSVRISPDLLSWIKQDGETRIQDPHESGEREVRRSDT

SEQ ID NO: 27371 - protein, 81 aa, Geotrypetes seraphini
RMWVSFEEIFISFSQEEWDYLNEEQKELYMEVMKENYETLISLDDRITQERTRAKKQGEDPVEIEQVQRQSENVCENISQN

SEQ ID NO: 27372 - protein, 81 aa, Geotrypetes seraphini
AQMQVTFEEIAVSFSQEEWEYLDEEQKELYREVMKENYEILISLGSLAFTPKIISHIERGEEPYIRGEPGSEEREHGKSSC

SEQ ID NO: 27373 - protein, 81 aa, Geotrypetes seraphini
AQKQVTFEDITVSFTQEEWAYLDEEQKKLYREVMKDNYQMLISLADHQIRPEWQRIKSQREDPVEMDQIQTQSENIYENIS

SEQ ID NO: 27374 - protein, 81 aa, Geotrypetes seraphini
RASAQMPVKFEDIAVSFSQEEWEYLNEEQKELYREVMEENYQTLISLDHQITQEKKQGEDPVEIEQVQRQSGNVCENISQG

SEQ ID NO: 27375 - protein, 81 aa, Geotrypetes seraphini
SAQMPVTFEDITVSFTQEEWEYLNEEQKKLYREVMKENYQTLISLDHQIRHEWKRIKKRGEDPVKMEQIQTQSENVCENIS

SEQ ID NO: 27376 - protein, 81 aa, Geotrypetes seraphini
AQMQVKFEDVVVSFTQEEWEYLDEGQKELYKEVMKENYETLISLGSVRISPDLFSWIKQDGEPKIQDPQESGKREVRHSDT

SEQ ID NO: 27377 - protein, 81 aa, Geotrypetes seraphini
QMQVKFEDIAISFSQEEWEYLNEEQKELYREVMEENYQTLLSLATGSLTFTPKIISYIERGEEQYIKDEPESEEKESGKSS

SEQ ID NO: 27378 - protein, 81 aa, Geotrypetes seraphini
DQALVTFSDVAAYFWEVEWDILGEWQKELYKKVIKEIHSFLIAQGYSILNPDVIFKIKKEDEKYLTHYCESEEKENMNDPT

SEQ ID NO: 27379 - protein, 81 aa, Geotrypetes seraphini
QVPVTFEDITIYFSQEEWQDLEEWQKELYKDVMKENYETLVSLGAGSPILTPDTISHIERGEEPYIRDDPRSAERETGKSS

SEQ ID NO: 27380 - protein, 81 aa, Geotrypetes seraphini
EQISVTFRDVVASFSEEEWKVLEDWQKELYGNVMKEIHGTLISLDFLSIKPDILLRIKEEEEEEEEEEDVEAFCWDAQEVE

SEQ ID NO: 27381 - protein, 81 aa, Lonchura striata
EQEPVTFKDVTVFLSRAEWDALTAGQRELYRDVVSDTYELLTSLGYPGPKPDILHRLERGEEPWICSSPGHAKSWLEEPSS

SEQ ID NO: 27382 - protein, 81 aa, Geotrypetes seraphini
DQESVIFSDVAAYFLEAEWDILGEWQKNLYKKVIREIHDILMSRGYSIANPDVIFKIKKEDEKYLIPHFEWERKENLNDPT

SEQ ID NO: 27383 - protein, 81 aa, Geotrypetes seraphini
AQMRVTFQDIAVYFSEEEWEYLDEGQKELYWDVMKENYQTLLSLGDNEVIQEQQRELDQEKPPVKMEQIPKQSGNVFENIS

SEQ ID NO: 27384 - protein, 81 aa, Geotrypetes seraphini
KLKPVKFQDVAVYFSEEEWQLLENQQKELYRSVMKENYENLTSLGFTTTKPNILKRMEQGRPLWVSTRRKVIKHSFREGEP

SEQ ID NO: 27385 - protein, 81 aa, Geotrypetes seraphini
MKENYETLVSLGAGSPILTPDTISHIERGEEPYIRDDPRSAERETGKSSCSDYEIGAKYEETQDGNLAENLDWNKMLFPEE

SEQ ID NO: 27386 - protein, 81 aa, Geotrypetes seraphini
DQTSVTFKDVAAYFLEMEWDILGEWQKELYKKVIKEIHDILMSRGYLIVNPDVVFKIKKEDKYFPQHCDLEEKGNPNESTK

SEQ ID NO: 27387 - protein, 81 aa, Geotrypetes seraphini
VARMQTRVTFDDIAVSFSQEEWEYLDEGQKELYREVMEENLELLTSLGSLVAQPEQMEELYMMDHHDMGLRGTLLSLCTED

SEQ ID NO: 27388 - protein, 81 aa, Geotrypetes seraphini
AQVPVSFEDITICFSQAEWEMLKEWQKELYKDVMKENYQTLISLGFPIVSPDIISHIERGEEPYIRDQQGSKEREPGKRSC

SEQ ID NO: 27389 - protein, 81 aa, Geotrypetes seraphini
DQASITFKDVAAYFLEVEWSILGEWQKELYKKVIKEVHDILISRGYSIVNPDVIFRIKKGDDKYFTQQFEREEKENLTDPT

SEQ ID NO: 27390 - protein, 81 aa, Geotrypetes seraphini
QMQVTFEEIAVSFSQEEWEYLDEEQKELYREVMKENYQILISLGIGSPTFTPKIISQIEREEEPYIRGEPGSEERGNGKSS

SEQ ID NO: 27391 - protein, 81 aa, Geotrypetes seraphini
QMPVKFEDIAVSFSQEEWEYLNEEQKELYREVMEENYQTLISLGTGSPPVTPDIISHIERGEEPYIREEPGSEEREPGRSS

SEQ ID NO: 27392 - protein, 81 aa, Geotrypetes seraphini
QMRLSFEDISVSFSQEEWAYLDEEQKELYREVMKENYQTLISLGTGSPSVTPDIISHIERGEEPYVRDEPGSEEREPGTSS

SEQ ID NO: 27393 - protein, 81 aa, Geotrypetes seraphini
ASAQMRVTFEDIAVSFSQEEWEYLDEKQKELYREVMKENYEILISLDTEAMQWIKREENEEKWLLEIEHIPRQPGNVSENI

SEQ ID NO: 27394 - protein, 81 aa, Geotrypetes seraphini
DQASVSFSDIAVYFSEEEWQLLEEWQKELYRNVMMENYVTLASLGHTSVKPVIVSKIEDGEAPCTSQFSDAEKRKAFKCHS

SEQ ID NO: 27395 - protein, 81 aa, Geotrypetes seraphini
QVQETFEDIAVSFSQEEWGYLDEEQKELYREVMRENYQTLLSLGTGSLTVAPDIICRIERGEEPYIKDEPGSEEREPGRSS

SEQ ID NO: 27396 - protein, 81 aa, Geotrypetes seraphini
AQMPVTLEDIFISFSQEEWEYLNEEQKELYREVMEENYQILLSLADHQIHHEWKREKNKGEDPVEMEQIQTQSENVCENIS

SEQ ID NO: 27397 - protein, 81 aa, Geotrypetes seraphini
MEWDILGEWQKELYKKVIKEIHDILISRGYVILNPDVIFKIKKEDEKYFAQHCELEGKGNPNEPIEMFPIVTSVFSLSVKQ

SEQ ID NO: 27398 - protein, 81 aa, Geotrypetes seraphini
VIFHNVAAYFSEDDWEALEDWRKEMYRNAMREIHRALVSLGYGIVNKEVLFQITQEDKLFFRDPGASKIREDINGCAASSP

SEQ ID NO: 27399 - protein, 81 aa, Geotrypetes seraphini
AFVQVTFQDISISFSQEEWGYLDEEQKDLYREVMKENYQTLISLADQQLSQEWKREKNQGEDPVEMGDIQRQSKPVCENIF

SEQ ID NO: 27400 - protein, 81 aa, Geotrypetes seraphini
EPASVTFSDVAAYFWEAEWDVLGEWQKDLYRKVIKEIHGILMSLGYSIVNPDVIFRIKQREERYLSQHYDWKEKENGDNPS

SEQ ID NO: 27401 - protein, 81 aa, Anas platyrhynchos
PQELPAFEDVAVFLSRAEWELAAEEQRELYRAVMLDNFALLASLGYAGPKPDLLYRLEHGEEPWVCTPQGSETWDGPNSPS

SEQ ID NO: 27402 - protein, 81 aa, Geotrypetes seraphini
AQMPVTFEDITVSFTQEEWEYLNEEQKKLYREVMKENYQTLISLADHQIRHEWKRIKKRGEDPVKMEQIQTQSENVCENIS

SEQ ID NO: 27403 - protein, 81 aa, Geotrypetes seraphini
AQMQVKFEDIAISFSQEEWEYLNEEQKELYREVMEETYQILLSLADHRIQHEWKREKNKGEDPVEMEQIQTLSKNVCENNS

SEQ ID NO: 27404 - protein, 81 aa, Geotrypetes seraphini
AQMQVKFEDIAISFSQEEWEYLNEEQKQLYREVMEENYQILLSLADHQIQHEWKREKNQGEDPVEMEQIQTLSKNVCENNS

SEQ ID NO: 27405 - protein, 81 aa, Geotrypetes seraphini
QMPVKFEDVAVSFSQEEWEYLNEEQKELYREVMKENYQTLISLGTGSPPITPDIISHIEWGEEPYIREEPGSEEREPGRSS

SEQ ID NO: 27406 - protein, 81 aa, Geotrypetes seraphini
EDCMQTWVTFEDVAVSFSQEEWQYLSEGQKELYREVMKENLELLTSLSSLVAQLEQNRELFMKGQRGTLLSPSTGNRVAPG

SEQ ID NO: 27407 - protein, 81 aa, Geotrypetes seraphini
AQASVIFNKVAIYFSEEEWQLLEEWQKELYKNVMKEIHGTLISLGHTVLNRGILFRIKNEDVQPHGREERQLLGLARALVT

SEQ ID NO: 27408 - protein, 81 aa, Geotrypetes seraphini
QQMQVTFEDIAVSFSQEEWEYLDEGQKELYREVMMENYELLMSLGDQIILETEREKESEECGKSFKHKRRSAQGLKKYRKK

SEQ ID NO: 27409 - protein, 81 aa, Geotrypetes seraphini
EPVTFEDVTVHFSREQWESLNEGQKELYREVMKENYETLISLENNDTRNNDTEIHRWKLSEETEEEKLFERNKEVTSSCSD

SEQ ID NO: 27410 - protein, 81 aa, Anas platyrhynchos
AAVAFEDVAIYFSPEEWVELAAWQRELYQEVMMDNYDLVACLGKEEPCQGLGWPKTCVGSALGVSPTQALLIPHPSSSPKW

SEQ ID NO: 27411 - protein, 81 aa, Geotrypetes seraphini
QMQVTFEEVAISFSQEEWEYLDEEQKELYREVMKENYQTLISLATGSPTVTPKIIAHIERGEEPYIRGEPGSEERETGNSS

SEQ ID NO: 27412 - protein, 81 aa, Geotrypetes seraphini
KVRVTFENVALSFSQEGWGYLDGGPKDLYKEAMKENYENLRCLDTDHERINPNLLSSIKQEGNLNGQDPQKSGDGEVTHSY

SEQ ID NO: 27413 - protein, 81 aa, Geotrypetes seraphini
QMQVKFEDVAISFSQEEWEYLNEEQKQLYREVMEENYQTLLSLATGSLTFTPKIISHIKHEEEPYIRGEPESEERESGKSS

SEQ ID NO: 27414 - protein, 81 aa, Geotrypetes seraphini
VTFEDITVAFSQEEWEYLDEGQKELHREVMKENYEILKSLGKDDPKNNPWKLSEKPEGVKMLSEAEKMNWGEKEKNQNPKY

SEQ ID NO: 27415 - protein, 81 aa, Geotrypetes seraphini
AQMQVKFEDIAIYFSQEEWEYLDEEQKELYREVMEENYQTLLSLADHQIQHEWKREKNQGEDLVEMEQIQTLSKNVCENNS

SEQ ID NO: 27416 - protein, 81 aa, Hirundo rustica
KAPAVALENDATGFSTQEWENLEEWQRELYGKVLTGKREALVPLDDVISEPALLSRLQGGEAPCNEEEVAPREIPAEPEAL

SEQ ID NO: 27417 - protein, 81 aa, Colinus virginianus
PKVPVTFDDVSVYFNDKEWEKLEEWQKELYKNVMKGNYESLISLDYAISKPGVLSQIEQGEEPRVRNEQDLEESEMMTDAT

SEQ ID NO: 27418 - protein, 81 aa, Geotrypetes seraphini
QIPVIFEDIVIYFSQEEWKDLEEWQKELYKDVMKENYQTLISLGTGFPTPPPDIISHIERGEEPYIRDELESEKRETGKRG

SEQ ID NO: 27419 - protein, 81 aa, Geotrypetes seraphini
AQMQVAFEDIAISFSQEEWEYLDEGQKELYREVMKENYETLISLGFVRISPDLLSWIKQDGESNIQDPQESGEREVRHSYT

SEQ ID NO: 27420 - protein, 81 aa, Geotrypetes seraphini
AQVPVSFEDITIYFSQEEWQRLDEGQKELYKNVMKENYEALSSLGFPIATPDIITLIEHGKEPYIKNEPGLEERYQGESNC

SEQ ID NO: 27421 - protein, 81 aa, Geotrypetes seraphini
PITFEDIAIYFSQEEWEDLEEWQKKLYKEVMKENYQMLNSLEIESKRRHEVALPEELTRHLKATKTELEKERRDTCPCCDW

SEQ ID NO: 27422 - protein, 81 aa, Geotrypetes seraphini
RMQVTFEEIFISFSQEEWDYLNEEQKELYREVMKENYQTLISLETGSPTVIPDIISHIERGEELYIRNEPGSEERETGKSS

SEQ ID NO: 27423 - protein, 81 aa, Geotrypetes seraphini
QMRIKFEDIALFFSQEEWEYLDEEQKELYREVMKENYQTLISLETGSPTVIPDIISHIERGEQPYIRGEPGSEEREIGKNS

SEQ ID NO: 27424 - protein, 81 aa, Geotrypetes seraphini
QQMQVTFEDVAVSFSQEEWEYLDEGQKELYREVMKENYETVVSLGSPASTPKIISCIECGEEAYIRGEPGSEGRETGKSSC

SEQ ID NO: 27425 - protein, 81 aa, Geotrypetes seraphini
QMPIKFEDIAVSFSQEEWEYLNEEQKELYREVMKENYQTLISLGTGSPPVTPDIISHIERGEEPYIREEPGSEEREPGRSS

SEQ ID NO: 27426 - protein, 81 aa, Geotrypetes seraphini
MQVTFEDIAVSFSQEEWRYLDEGQKELYREVMMENYETLIFLGTDSSAIAPEIISRIERGEELYIKDEPGFEERETGEGSC

SEQ ID NO: 27427 - protein, 81 aa, Geotrypetes seraphini
AQMQVKFEDIAISFSQEEWEYLDEEQKQLYREVMEENYQTLLSLATGSPTTPKIISHIKQGEEPYIRGEPELEERETGKSS

SEQ ID NO: 27428 - protein, 81 aa, Geotrypetes seraphini
AQMQVTFEEIAVSFSQEEWEYLDEEQKELYREVMKENYEILISLAGSPTFIPNIISYIERGEEPYIRDEPGSEERETVKSS

SEQ ID NO: 27429 - protein, 81 aa, Geotrypetes seraphini
VKLEDVTVSFSQEEWEYLDEGQKELHREVMKENYELLRSLEKDDPKNNPWKLSEKPEGVKMLSEGEKENWGEKEKHQNQKY

SEQ ID NO: 27430 - protein, 81 aa, Geotrypetes seraphini
TQVHITFEDIAVSFSREEWGYLDEGQKELYREVMKENYETLISLGNERVRPDILSRIKREEEPYVQDSQESGEREVATSFT

SEQ ID NO: 27431 - protein, 81 aa, Geotrypetes seraphini
MPVTFEDITVSFSQEQWDYLDEGQKELYREVMKENYEILISLGIDHESMNPEVLARINQEERLNVWDPEKSGESEVAHLYT

SEQ ID NO: 27432 - protein, 81 aa, Geotrypetes seraphini
QPVSITFSDVAAYFWEAEWDVLGEWQKEMYKKVIKGIHGVLRSWGYSIVHPDVVFKIKKEDEKYFAQHCEWEEKEDSGSLS

SEQ ID NO: 27433 - protein, 81 aa, Hirundo rustica
AQEPVTFEDVMVFLSRAEWDVLPTGRRQLYRDVVSDTYELLTSLGYPGPKPDILHRMERGEEPWICSSSEHDGSWLEEPSS

SEQ ID NO: 27434 - protein, 81 aa, Geotrypetes seraphini
DQTLVTFKDVAAYFLEVEWNILGEWQKELYKKVIKEVHGILLSRGYSIVNPDVIFRIKKEDENYFTQHFEWEGKGNPHDPL

SEQ ID NO: 27435 - protein, 81 aa, Geotrypetes seraphini
EQMRVKLEDVTISFSQEEWEYLDEGQKELHREVMKENYELLRSLEKDDPKYNSWKLSEKTERVKMLSEREKEETSSCSVWG

SEQ ID NO: 27436 - protein, 81 aa, Geotrypetes seraphini
DQALVTFKDVAAYFWEVEWNILGEWQKELYKKVIKEVHGILLSRGYSIVNPDVIFKIKKEDEKYFTQDFKWEGKENPLDSM

SEQ ID NO: 27437 - protein, 81 aa, Geotrypetes seraphini
VTFEDITVSFSQEEWEYLDEGQKELHREVMKENYELLSYLGKDEPKNNLWNLSEKSEGVKMLSEGEKENWGEKEKNQNKKY

SEQ ID NO: 27438 - protein, 81 aa, Geotrypetes seraphini
QMQVAFEDVAIAFTQEEWRYLDAEQKELYWEVTKENYETLMSLGLEVTQGRKSEENREEGAIEMDQMSRQSGFDCDIVLLG

SEQ ID NO: 27439 - protein, 81 aa, Geotrypetes seraphini
DQASVTFKDVAGYFSEAEWDVVGEWQKELYKKVVEELRDNLISRGYSIVNPDVIVRIKKEDEKYFTQHFEWDGKENPHDPM

SEQ ID NO: 27440 - protein, 81 aa, Geotrypetes seraphini
AQMPVKFEDVAVSFSQEEWEYLKEEQKELYREVMKENYETLISLGSPPVTPDIISHIERGEEPYIREEPGSEERGPVRSSC

SEQ ID NO: 27441 - protein, 81 aa, Geotrypetes seraphini
MQVKFEDVAVSFSQEEWEYLDEGQKELYREVMKENYETLLSLGLKCLQKIHESDRPFTYPACGKSFNHQSNLRKHKRNHTG

SEQ ID NO: 27442 - protein, 81 aa, Geotrypetes seraphini
ASAQMRVTFEDIAVSFSQEEWEYLDEKQKELYREVMKENYEILISLDTEAMQEMKREENEEKCLLEIEHIPRQPGNVSENI

SEQ ID NO: 27443 - protein, 81 aa, Geotrypetes seraphini
SDQALVTFKDVAAYFWEVEWNILGELQELYKKAIKEVHGILLSRGYSIVNPDVIFKIKKADEKYFTQHFEWEGKENPHDPM

SEQ ID NO: 27444 - protein, 81 aa, Geotrypetes seraphini
HQASVTFSDVAVYFSEEEWQLLEEWQKELYRNVMMEIHGALISLGYPTVSPDILLRIKHEAEPCHREQHLPDGRERISTSN

SEQ ID NO: 27445 - protein, 81 aa, Geotrypetes seraphini
RLPVTLEDITVYFSQEQWEYLNEGQKELYREVMKENYETLISLGTNHESIDPEVLSRIKQEEKLRIWDLQESGDREDARSY

SEQ ID NO: 27446 - protein, 81 aa, Geotrypetes seraphini
AQVPVTFEDVAVYFCKDEWELLAGWQKDLYTETMKENYETLTSLGSSSEKPSLISKIERQEDLCVIDQQDPREKLKSPWRG

SEQ ID NO: 27447 - protein, 81 aa, Pelodiscus sinensis
LQMRVTFEEVAVYFTQGQGALLGPAQRALYRDVMQENYEAVTSLGFPVPKPELIARLERGEEPWEPDLQARDETGDGTGSE

SEQ ID NO: 27448 - protein, 81 aa, Pelodiscus sinensis
VVEPVNFEEVAVYFSEEEWALLDPGQRALYRDVMQENYEAVSWLGIPVSKAHVLSWMERGEELQILDLQGCEEGEIISDTH

SEQ ID NO: 27449 - protein, 81 aa, Pelodiscus sinensis
PTGLVTFEEVAVYFTREEWALLDSAQRALYRAVMQENYESVALLGFPVPKPDVISWLERGEDPWVSDLQSSEEREILRNAC

SEQ ID NO: 27450 - protein, 81 aa, Geotrypetes seraphini
ASAQVTFEDIAVSFSQEEWEYLDEEQKQLYREVMKENYQTLLSLADQQIQHEWKREKNQGEDPVEMEQIQTQSENVCENIS

SEQ ID NO: 27451 - protein, 81 aa, Geotrypetes seraphini
DQAPVTFREVAAYFWEEEWCILGEWEKKMYKGVIKEVHGFLISRGYSIFNPDVVFKIKKDDGKYFPQHCEQEGKENLNDPK

SEQ ID NO: 27452 - protein, 81 aa, Geotrypetes seraphini
SAREMVTFEDIAVSFSEEEWAYLDEEQKKLYREVMEENYQTLVSLEQELKQERESEKNQGEDRLEMEQIQRQSGNVCANIS

SEQ ID NO: 27453 - protein, 81 aa, Geotrypetes seraphini
GQVPLTFDDVAVYFSFDEWRKLEDWQKELYKTTMQENYDSLESLGFAMKKPEVVSRIEQGEEPWVMENAGSSISGTNTILT

SEQ ID NO: 27454 - protein, 81 aa, Colinus virginianus
EPVSFEEVAVYFSREEWALLDPAQRALYRDVMLETYECVASLAPLPGPKPMVISLLEEGEEPWIPDVGSPEAVAGDVSPGE

SEQ ID NO: 27455 - protein, 81 aa, Pelodiscus sinensis
PKVPVTFDDVSVYFNEQEWGHLNEWQKELYKNVMKSNYETLISLDYAISKPDILSRIERGEELSVGDQGDGDEREISINHS

SEQ ID NO: 27456 - protein, 81 aa, Pelodiscus sinensis
ETVTFEEVAVYFSEEEWALLDPDQRALYWDVMQENYEAVSWLVGDGTLSENNEKSLLQEQMPPRGLLLERSEGQVSQRPEQ

SEQ ID NO: 27457 - protein, 81 aa, Pelodiscus sinensis
EPVSFEEVAVYFSEEEWALLDPGQRALYRDVMQENYEAVNRLSKGWVSFHKRERLASSLKNNGHKQDNHRHQKPVYSRCFH

SEQ ID NO: 27458 - protein, 81 aa, Pelodiscus sinensis
VQVSVTFEEVAVYFTSAEWALLDPAQRALYRAVMQENYKNMSSLGILVSKPDVISQLERGEEPWVPDLQSLVEREILRGIP

SEQ ID NO: 27459 - protein, 81 aa, Pelodiscus sinensis
AQGLVPFEEVAVYFTRTEWALLDPAQRALYRAVMQENYENVTSLGFAVSKPDVISQLERGEEPWVPELQGSEHREILGGTG

SEQ ID NO: 27460 - protein, 81 aa, Pelodiscus sinensis
FQVPVTFEEVAVYFTTGQGALLSPAQRALYKDVMQENYETVASLGFPISKPDLLTQLEQGEKLWVPDLQPSKEMRILRDIH

SEQ ID NO: 27461 - protein, 81 aa, Pelodiscus sinensis
VSFEEVAVYFSEEEWALLDPCQRALYRDVMQENYESVSWLGFPVSKAHVISWVEQGEELWIPDLQDCERDFRILFPTGDGR

SEQ ID NO: 27462 - protein, 81 aa, Pelodiscus sinensis
VSFEEVAVYFSEAEWALLDPGQRALYRDVMQENYEAVNWLGKDSCPHGILSQIYRENAPCLLESVLQHWVLRTESHCYRLS

SEQ ID NO: 27463 - protein, 81 aa, Pelodiscus sinensis
EPVTFAEVAVYFSVEEWVLLDPGQRALYWDVMQENYEAVSWLGFQVSKVHISWEELQIPDLQGSKEGEIIHDTHSGDGMTS

SEQ ID NO: 27464 - protein, 81 aa, Pelodiscus sinensis
LQMRVTFEEVAVYFTQGQGALLGPAQRALYRDVMQENYEAVTSLGFPVPKPELIARLERGEEPWEPDLQARDEREILRGTR

SEQ ID NO: 27465 - protein, 81 aa, Pelodiscus sinensis
LGAFRQGCRTPMFVSSSAPGLQSQGQEVAVAEPVSFEEVAVYFSEEEWALLDLGQRALYRDVMQENYEAVNWLSKDSCPLG

SEQ ID NO: 27466 - protein, 81 aa, Pelodiscus sinensis
GAVTFEEVAVYFTEEEWALLDPAQRHLYRAVMRENYETVTSLGKQPRSLGYSKPEEVADQPEIVRTKEVPLSGAPENTDLH

SEQ ID NO: 27467 - protein, 81 aa, Pelodiscus sinensis
VEEPVSFEEVAVYFSEEEWALLDPGQRALYWDVMQENYEAVSWLGFPISKADVISWVEQGEELWIPGLQGFEEGEIIRHIH

SEQ ID NO: 27468 - protein, 81 aa, Pelodiscus sinensis
KVPVAFENDSVYFAEHEWQNLEEWQKELYKNVMKGNYESLISLAERGQGEGEPREEGACAKALEEWGPEPGTHPSGAAGVS

SEQ ID NO: 27469 - protein, 81 aa, Pelodiscus sinensis
EPLTFEEVAVYFSEEEWAFLDPGQRALYRDVMQENYEAGRWLGFPVSTPHMISWVEQGDALWIPALQGCENGKIMTDTHTG

SEQ ID NO: 27470 - protein, 81 aa, Pelodiscus sinensis
LAEPVSFEEVAVCFSEEEWALLDLGQRTLYGDVMQENYEAVSWLGFPLRKPDLIAQLERGEEPWVPDLQPSKDLEIQRDTH

SEQ ID NO: 27471 - protein, 81 aa, Pelodiscus sinensis
VAELVSFEEVAVYFFEEEWALLDPGQRALYRDVMQENYEAVSWLGFPVSEAHEISWVEQEEELQVPDPQSCEEGEIINNTH

SEQ ID NO: 27472 - protein, 81 aa, Pelodiscus sinensis
VEPVSFEEVAVYFSEEEWALLDPGQRALYWDVMQENYEAVSWLVRGRGVSKAHVISWVERGEELWIPDRQGCEEGESISDI

SEQ ID NO: 27473 - protein, 81 aa, Pelodiscus sinensis
FQMPVTFEEVAVYFTAGQGVLLSPMQRDLYEDVMQENYETVASLGFSISKPDLIIQLERGEEPWVPDLQPSKEMGFLRESR

SEQ ID NO: 27474 - protein, 81 aa, Pelodiscus sinensis
AQMQVTFEEVAVYFTQGQGALLGPAQRALYRDVMQENYEAVTSLGFPVPKPELITRLERGEEPWVPDLQASEEREILRGTR

SEQ ID NO: 27475 - protein, 81 aa, Pelodiscus sinensis
SKVPMTFDDVSIQIAREKWENLEEWQKELYKNVMKGNYESLISLDHAISKPDILSRIEQGEELCVGDPQDLEVRAIHIESS

SEQ ID NO: 27476 - protein, 81 aa, Pelodiscus sinensis
AEPVTFEEVAVYFSEEEWALLAPGQRALYRDVMQENYEAVSWLAGDGMLNENSERSLQEEGPKEMAPCGVLVERCEGHVSQ

SEQ ID NO: 27477 - protein, 81 aa, Pelodiscus sinensis
AEPVSFEEVAVYFSEEEWALLDPGQRALYRDVMQENYEAVNRLSSSVEENIREQGETCERQHSLERQHENHPGEGQGNFSH

SEQ ID NO: 27478 - protein, 81 aa, Pseudonaja textilis
DDLMFLCFVAIHFNNEEWLLLDPSQKALYQEVMLETSRMVASLGVTRYIIYNLDLCVTLIDKSMHRDIKVDVVDYSNLFFF

SEQ ID NO: 27479 - protein, 81 aa, Micrurus corallinus
QDSTQESRKPSLDFLESPLCAGAEGFAEPLLQDIVSFEEVAVHFSAEEWSQLDADQKALHGEVMLENSRNLAFLGFNEKEN

SEQ ID NO: 27480 - protein, 81 aa, Micrurus corallinus
EDQSQDSTQESRKLSLDFLESLHCAETEPLLQDIVSFEEVAVYFSEEEWSQLDADQKALHGEVMLENSRNLAFLGFNEKEN

SEQ ID NO: 27481 - protein, 81 aa, Micrurus corallinus
QGSVSFEDVAVYFTEEEWALLDSSQRALHREVMLENSRNLAAVGYGQEHENYQELNFTLLQSEERMLGIQRVLQKSTNSCL

SEQ ID NO: 27482 - protein, 81 aa, Micrurus corallinus
FDHVEEVALDFTEEEWRLLDSGQKALCWEVMQEVFRNMAALDDGPANENDKSAKLNLQQLEKNEVEVMFGTQGDITRQERS

SEQ ID NO: 27483 - protein, 81 aa, Pseudonaja textilis
QNSISFEDVAVFFSMGEWALLDLEQKTLYREVMLENARNLASLSKRLCFSGMKFWWKVFSSESQTVFPSYADHLMCSFYTF

SEQ ID NO: 27484 - protein, 81 aa, Micrurus corallinus
VLVFFEDVTVFFSEEEWALLDFDQKSLYREVMLENAKNVESMGDRGEPEYYKEPGVNSLEKTETTKGIFQNQKKPNVTEEH

SEQ ID NO: 27485 - protein, 81 aa, Pseudonaja textilis
PKVPLNFSDASVHFNEQEWRKLEEWQRELYRTVMRSNYDMLVSLDHAISKPDILSQMDQGEEVRMEESEVLENREIPKDPS

SEQ ID NO: 27486 - protein, 81 aa, Pseudonaja textilis
SPDLVSFEDVAVFFSMEEWALVDSEQKALYREVTLENKRSKKEPSSSFTCFLSLHKKIHKAEDPHICLDCGRTFRQKNHLN

SEQ ID NO: 27487 - protein, 81 aa, Pseudonaja textilis
QNFVSFEDVAVFFSVEEWALLDSEEKALYREVMLENKRNVASLGKGFCYNTVLENSSGLPCPDINALLDADDCHEKEVCSK

SEQ ID NO: 27488 - protein, 81 aa, Pseudonaja textilis
TCDLVSFEDVAVFFSMEEWALVDSEQKALYREVTLENKRSKASLGGNPYKYTECAETFGTSCFLSLHKKIHKAEDPHICLD

SEQ ID NO: 27489 - protein, 81 aa, Anas platyrhynchos
PTAGAGEDDAACLPEQEWGGLDSRQQELYRMAVKGSYEAVVSLGPGDASSKPSLLLPAEDGEDLGTRTHGLLEKGAVSGHV

SEQ ID NO: 27490 - protein, 81 aa, Pseudonaja textilis
RAGPVSFEEVAIHFNNEEWLLLDPNQKTLHREVMLETSRIVDSLGKGSFRGKLSQTGETLNALMVQYKRKGRCTEPPLKYF

SEQ ID NO: 27491 - protein, 81 aa, Pseudonaja textilis
PKVPVTFDDLSVHFNEHEWGNLDELQKDLYKTVMKSNYEMLVSMDYAIAKPEILTRIEQGEALCDTNIDTMPGINTPTPPG

SEQ ID NO: 27492 - protein, 81 aa, Pseudonaja textilis
FLPQVTFEDVAIYFSREEWDELSEWQRELYQAVMMENYEAVLSLGKNDFIAQCTWGLREGEKRASGKSEKARNRPVSNLWR

SEQ ID NO: 27493 - protein, 81 aa, Micrurus corallinus
CQVSVTFEEVAVYFTKEEWALLDPSQRALHEEVMLENSRNVTALGKPRLWMETTETSPPCGGAATSQGLASFEEVVVYFTE

SEQ ID NO: 27494 - protein, 81 aa, Pseudonaja textilis
QLGGWQCVAVYFSEEEWSQLDPDQKVLHLEVMFENHRNVVSLGKSFLKIRKKYPGKSVNLFKGKIQLNEHYYTPNKREDAI

SEQ ID NO: 27495 - protein, 81 aa, Pseudonaja textilis
PKVPITFEDNAVYFSEQEWGNLEKWQKELYKNVMKSNYESLVSLGKKKKELLLLMGLPLQGAPKTYCHHRRQSIQMGCSCS

SEQ ID NO: 27496 - protein, 81 aa, Pseudonaja textilis
LVSFEEVAVYFSEEEWSQLDPDQKVLHLEVMFENHRNVVSLGEERPLCFQRLLPWISCSPQFLKEHRPKINRKFSPNSSLD

SEQ ID NO: 27497 - protein, 81 aa, Pseudonaja textilis
MEEWALVDSEQKALYREVTLENKRSKASLVWKNIDTVQIQQWYLIAFALNVVLTFLFFIDSGQEAAAPLPKDKKEVAEKMY

SEQ ID NO: 27498 - protein, 81 aa, Anas platyrhynchos
MEPYVLLDPRQRALYRDVMQESYETLMALEFPVSKPDLLSRLAHEDEPTALDLHVPKDAPSGEPPPPPPQKCADCGKRLNH

SEQ ID NO: 27499 - protein, 81 aa, Micrurus corallinus
RRIPQEDPNQDTSEVKHRMMCGLYGSVETVDETAENQDTLSFEEVAVHFSEEEWSQLDADQKTLHWEVMLENYRNMASLVR

SEQ ID NO: 27500 - protein, 81 aa, Pseudonaja textilis
ESLVSFEEVAVYFSEEEWSQLDPHQKVLHREVMLENHTNVVSLGKKPFRVIPHKDSLEKPANQKVEMHERNQSSNWNQESL

SEQ ID NO: 27501 - protein, 81 aa, Pseudonaja textilis
LQNSVTFEDVAVYFTEDQGALLDRKQRTLYEDVMVENYGIVASLGFLALKPALISQIEHGEEPWLPEISKLDDTEISNANA

SEQ ID NO: 27502 - protein, 81 aa, Pseudonaja textilis
LVSFEDVAVFFSMEEWALVDSEQKALYREVTLENKRSKASLDESRQHPRRSLPPPLRERINEGGNPYKYTECAETFGTSCF

SEQ ID NO: 27503 - protein, 81 aa, Pseudonaja textilis
VPVTFDDMSVYFNEKEWEKLEEWQKELYKNLMKGNHQSLVSLGKGEAPLEEEEEEEEEEEEEEEDPVSLENRGLFSSRAEP

SEQ ID NO: 27504 - protein, 81 aa, Pseudonaja textilis
MEEWALVDSEQKALYREVTLENKRSKFGRILILFKYSNVAEKMYGKPSLKQKQLTGELENCSGLPCPDINVLLDTDDSHEK

SEQ ID NO: 27505 - protein, 81 aa, Micrurus corallinus
ESTPDSRKLSLEILESPPLCGGAEELAEPLLQGVVSFEDVAVYFSKEEWSQLDADQKALHGEVMLENSRNLAFLGFNEKEN

SEQ ID NO: 27506 - protein, 81 aa, Pseudonaja textilis
VGGYLGWDISVTFSEEEWALLNPDQRALHRDVMAENSGICLECGKRFIHNTSLTYHRQHHTGVKPYKCSECGKRFSHRTSL

SEQ ID NO: 27507 - protein, 81 aa, Pseudonaja textilis
RKSLGARETFLSFQGLVTLDKVALGFTEEKCELLDLEQKALHEEVMEEIKGIVVSLGKPPHPRFGSRFSRPACQSHPVYFF

SEQ ID NO: 27508 - protein, 81 aa, Pseudonaja textilis
AKGEAPKVRAGVGFSEQEWRGLDESQKDLYRHIMMHNYQAVVSVGKSGLASGLGPTGENGPPPRRGAGGRLGHAHPATSPA

SEQ ID NO: 27509 - protein, 81 aa, Thamnophis sirtalis
MPVTFVDIAVYFSAEEWKNLADWQKDLYNNLLKENYESLLALGANINVAKPEGHPRAERVAPEPSVPEPSAKERDVIPEPC

SEQ ID NO: 27510 - protein, 81 aa, Thamnophis sirtalis
KNSICFEDIAVFFSMEEWALLDLEQKKLHREVMLDNSRNLASLTGDGWKMEGQEAAIPFPKEIKEVLERMFGKKDSEENQL

SEQ ID NO: 27511 - protein, 81 aa, Thamnophis sirtalis
PKVPLNFSDASVHFNEQEWRNLEEWQRELYRTVMRSNYDMLVSLDHAISKPDILSQMDQGEEVCMEESEVLENREIPKDPS

SEQ ID NO: 27512 - protein, 81 aa, Micrurus corallinus
SQEMFFRRISQDDPNQDRTRGKNRRKFTVPDGGTETMIETPIQEGLISFEDVAVYFSEEEWTELDPDQKALHQEVMLEHYR

SEQ ID NO: 27513 - protein, 81 aa, Micrurus corallinus
NSISFEDVAVFFSVEEWALLDLEQKTLYQEVMLENARNVASLTDEWETGGSSQEEEASMSTARNEVAERMFGKQGLHEDQL

SEQ ID NO: 27514 - protein, 81 aa, Pseudonaja textilis
ENLVSFEEVAVYFSEEEWSQLDPDQKALHSEVMLENHRNVVSLGKCFLVSNQEVIMKKYTGKSVKLIKAKVQVNEHYLTQN

SEQ ID NO: 27515 - protein, 81 aa, Micrurus corallinus
KNPSNPPQELFFRRIPWEDPSLDTSGEEQRMKLSSFYDGDQTAVEPPNQEGLVSFEEVAVYFSEEEWSQLHPDQKALHSEV

SEQ ID NO: 27516 - protein, 81 aa, Pseudonaja textilis
MQRLVSFKDVAVYFTESQGALLDPTQRALYREVMVENYENVASLGFPVPKPNLISRLERGEPPWLLDSQGLDANSSGALRK

SEQ ID NO: 27517 - protein, 81 aa, Pseudonaja textilis
VMLEEVSVTFSEEEWALLNPDQRALHRDVMAENSGIASSLGKFPLKKKKGWCCDSGIGICSVDRCETSLTYHQRSHTGVKP

SEQ ID NO: 27518 - protein, 81 aa, Pseudonaja textilis
VKSEPACLPVCVFSVTFSEEEWALLNPDQRALHRDVMAENKDLAVKFEPALLSDSEGSQDEELPVREKIEDGIEWSQCLLC

SEQ ID NO: 27519 - protein, 81 aa, Anas platyrhynchos
EDEVPSASICVLGTEKPLGLELLSSTGCFYMEPLCLQEPVTFVEVAVYFSREEWELLHPAQRVLYRDVMLETYESITSLGE

SEQ ID NO: 27520 - protein, 81 aa, Micrurus corallinus
TSGEKQRMKLSGFYDGDQTAVEPPNQEGLVSFEEVAVYFSEDEWSQLDPDQKVLHLEVMLENHRNVVSLGNNGQENLDSCE

SEQ ID NO: 27521 - protein, 81 aa, Micrurus corallinus
EGLVSFEEVAVYFSNEEWSQLDPDQKMLHLEVMLENHRNVASLDNGRENKDTGEPFQVFSAGDETQKSEIQMEIERHERNQ

SEQ ID NO: 27522 - protein, 81 aa, Micrurus corallinus
QAPPFSFEEVAVYFTEVEWTLLDAEQRDLYWDVMQENYETVASLAVAIPKPELICRLERGEDPWIPAQAASEEKKIPLNLY

SEQ ID NO: 27523 - protein, 81 aa, Pelodiscus sinensis
EPVTFKEVAVYFSEEEWALLDTSQRDLYWDVMQENYEAVSWLEFSFSSAQGMTPLWILSLSQQRPMRRSQCSPQRQQGNHL

SEQ ID NO: 27524 - protein, 81 aa, Pelodiscus sinensis
MVEPVSFEEVAVYFSEEEWALLDPGQRALYWAVMQENYEAVSWLGFPVSTAHVISWVERGEELRVPVLQGCEEGKIISNTH

SEQ ID NO: 27525 - protein, 81 aa, Pelodiscus sinensis
VVEPVSFEEVAVYFSEEEWALLDPGQRALYWDVMQENYEAVSWLGFPVSKAHVISWVERGEELWIPDRQGCEEGESISDIH

SEQ ID NO: 27526 - protein, 81 aa, Colinus virginianus
PSVPVTFRDVFVQFSRDEWALLDDEQKELHQSVMQSNYEMLMSLYCDLAKPEVSLQMERGEPCLPAEPDLQGTAVSLNPAA

SEQ ID NO: 27527 - protein, 81 aa, Pseudonaja textilis
LYCLTYVAVRFSDEEWMLLDAGQQDLYREVMAENSGMVASLSKDPWLIFSLLLPPIHPTSPKKGVAGSEEVAKRLGNGRVL

SEQ ID NO: 27528 - protein, 81 aa, Pelodiscus sinensis
PVSFEEVAVYFSEEEWALLDPCQRALYMDVMQENYEAGLSSPWESGWSEGKSCRSQISKAVRKGRSSVTPTQVRNQSPEQG

SEQ ID NO: 27529 - protein, 81 aa, Pelodiscus sinensis
GIILFQEVAVHSTKEEWELRDSSKRAIYRDIMKENNFPNLSSVGRGSGQLEATDHLLAPFPSPMSPAPTSVSLSIPAGCYY

SEQ ID NO: 27530 - protein, 81 aa, Pelodiscus sinensis
TKMRVTFEEVAVYFTPGQGALLGPAQRALYRDVMQENYEAVTSLGFPVPKPELIARLEQGDEPWVLDMQAGGEREMLRHTC

SEQ ID NO: 27531 - protein, 81 aa, Pelodiscus sinensis
MYFTRAEWALLDPAQRALYRAVMQENYENVISLGFPVSKPDVISQLEGGEEPWVPELQGSVKREIQRSPCTGEETVNLLRI

SEQ ID NO: 27532 - protein, 81 aa, Pelodiscus sinensis
PKMPVTFVDVAVYFSAEEWKNLEDWQKELYNNLMKENYESLSSLESLMSTPDILSRIKQEEGPFVGEHQFSEERGIPVDPC

SEQ ID NO: 27533 - protein, 81 aa, Pelodiscus sinensis
FQGPVTFDEVAVYFTKEEWALLDPAQRALYRDVMQENYETVTSLGLPVSRPDVISQMEQGEEPWASALQGSEDRLILRGIC

SEQ ID NO: 27534 - protein, 81 aa, Pelodiscus sinensis
FLMPVTFEEVAVYFTPGQGALLDPAQRALYRDVMQENYETVASLGFSIPKPDLIAQLEQGEEPWVPDLQPSKEMVILRGIC

SEQ ID NO: 27535 - protein, 81 aa, Pelodiscus sinensis
VVEPVSFEEVAVYFSEEEWALLDPGQRALYWAVMQENYEAVSWLGFSIPKPDLITQLDRGEEPWVPDLQPSKKLEILRGTR

SEQ ID NO: 27536 - protein, 81 aa, Pelodiscus sinensis
AQVPVTFEEVAVYFTQGQGALLGPAQRALYRDVMRENYEMVTSLGFPVPKPDLVARLERGEEPWVSDCLASEEGGTRRGRG

SEQ ID NO: 27537 - protein, 81 aa, Pelodiscus sinensis
PKMRVTFEEVAVYFTPGQGALLGPAQRALYRDVMQENYEAVTSLGFPIPKPELITQLEHGEEPWVPDLQADKEMESLKGTR

SEQ ID NO: 27538 - protein, 81 aa, Pelodiscus sinensis
LLFQGPVPVEEVAVHFTREEGALLDPAQRAPYRAVMPENVTSLECPVPKPDVISQLERGEDPGVLKLQGSEDGEIPRGACA

SEQ ID NO: 27539 - protein, 81 aa, Pelodiscus sinensis
VAEPVSFEEVAVYFSEEEWALLDPCQRALYRDVMQENYEAVSWLAITHPGLGHLRGTTKGRPGWNPHKEDSAGGRVEPRQQ

SEQ ID NO: 27540 - protein, 81 aa, Pelodiscus sinensis
MRENYETVAGLGLPVPKPDLIARLEAGEDPWVPDLQVSEEKMILRGSGTGDDETGNPPLEGPEKGELQGTLMRRTEELFSQ

SEQ ID NO: 27541 - protein, 81 aa, Pelodiscus sinensis
MQENDEAVSWLGFFIPKPDLIAWLEQGEELWVQYLQHSKEMEIQRCIYTAGASTVRENNEENQQQEGSELVESQGTFVEEA

SEQ ID NO: 27542 - protein, 81 aa, Pelodiscus sinensis
AQVPVTFEEVAVYFTAGQGALLGPNQRALYRDVMQENYETVASLGFSIPKPDLITQLERGEEPWVPDLQPSKEMEFLRGTC

SEQ ID NO: 27543 - protein, 81 aa, Pelodiscus sinensis
FQGPVTFKEVAVYFTRAEWALLDPAQRALYRAVMQENYENVTSLGFQVSKPDVISQMERGEEPWVLELQGSEAGAGMGSEN

SEQ ID NO: 27544 - protein, 81 aa, Pelodiscus sinensis
MRVTFEEVAVYFTQGQGALLGPAQRALYRDVMQEIYEMVTSLGFPVPKPELVARLERGEEPWVSDLQAIGESESLRGTRTG

SEQ ID NO: 27545 - protein, 81 aa, Pelodiscus sinensis
VAEPVSFEEVAVYFSEEEWALLDPGQRALYRDVMQENYEAVSWLGFSILKPDLILWLERGEVPWALILKETELLRQTGAVE

SEQ ID NO: 27546 - protein, 81 aa, Pelodiscus sinensis
VAEQVTFEEVAVYFSEEEWALLDPGQRALYWAVMQENYEAVSWLGFSIPKPDLIPWLEQGEESWAPDLQAAKETEILRAGA

SEQ ID NO: 27547 - protein, 81 aa, Pelodiscus sinensis
LSPCTLTWAGFTPCAGFPAPKPELIARLERGEEPWVPDLQADAGGETPRGARPAGSGAEGENKKENQQQEGPGGVEPPETF

SEQ ID NO: 27548 - protein, 81 aa, Pelodiscus sinensis
PVSFEEVAVHFSEEEWALLDLGQRALYRDVMQENYEAVNWLVLSQLVCRLLSTGTEEALAFGQGDGMLSENNEKSLQQPNG

SEQ ID NO: 27549 - protein, 81 aa, Pelodiscus sinensis
VAGPVTFEEVAVYFSEEEWALLDPGQRALYRDVMQENYEAVSWLGFPVSKPGETSWLERAGKLQEWESRSHANTARPRGNQ

SEQ ID NO: 27550 - protein, 81 aa, Pelodiscus sinensis
AQRPVTFEEVAVYFTRAEWALLDPAQRALYRAVMQENYENVTSLDFPVFTPDGISHIEEVKEPRVPNLHDSEEREILRGAC

SEQ ID NO: 27551 - protein, 81 aa, Pelodiscus sinensis
AQMPVTFEEVAVYFTAGQGALLGPAQRALYRDVMQENYETVVSLGFSIPKPDLIARLEREEEPWVPDLQPSKEMEIQRGTR

SEQ ID NO: 27552 - protein, 81 aa, Pelodiscus sinensis
AQELVSFEEVAVYFSEEEWALLDPAQRALYWDVMQENYETVTSLDFPVPKPDVIYQLARREEPRITALQGAEEKGTLRDSH

SEQ ID NO: 27553 - protein, 81 aa, Pelodiscus sinensis
MRENYETVTGLGLPIPKPDLIARLEAGEEPWVPDPQTTEERNIPRGSETGNETKNENVEGVLQQQGLQPMELQENFLRRAG

SEQ ID NO: 27554 - protein, 81 aa, Pelodiscus sinensis
FQMRVTFEEVAVYFTVGQGALLDPAQRALYRDVMQENYETVASLGLPVPKPALIARLEAGEELWVPDLQTSEERKIPRGSS

SEQ ID NO: 27555 - protein, 81 aa, Micrurus corallinus
ENVENLLKNRNFWILRLPLGPKGEIPKVPVTFDEEQAVNFSTPEWAKLEDCQKGLYPNITRGSYEPLVSLGKSRVCLVGNW

SEQ ID NO: 27556 - protein, 81 aa, Micrurus corallinus
VYFSEEEWLQLDADQKALYGEVMLETSRNLASLGKMSAKRKSYSIEFKKEVVEDSLGKNLTVFCKEKKLGLRMVRKWRAEY

SEQ ID NO: 27557 - protein, 81 aa, Micrurus corallinus
MEEWALLDCEQKAPHQEVMVEDAKKMASFGDGLKIVDAAQEMATPFLTAEKEVAERMREKERPEEKELKEELRKYSNSQYV

SEQ ID NO: 27558 - protein, 81 aa, Pelodiscus sinensis
SEMRVTFEEVAVYFTKGQGALLDARQKALYRDVMLENYEAVTSLGFPVPKPELIARLERGEEPWVPDLQAGEEREILRGTR

SEQ ID NO: 27559 - protein, 81 aa, Pelodiscus sinensis
AQMLVTFEEVAVYFTQVQGALLDPGQRALYRAVMQENYETVTSLGLHIPKPALITQLEAGEEPWVPDLQASEERKIPRGTS

SEQ ID NO: 27560 - protein, 81 aa, Micrurus corallinus
LVSFEEVAVYFSEEEWSQLDSDQKALHSEVMLENHRNVVSLGNKGQENQDSYELFQVINAKDGMEKFGFRMEFESHEKNQA

SEQ ID NO: 27561 - protein, 81 aa, Micrurus corallinus
PNQVQEGLVSFGEVAVHFSEEEWSQLDPDQKELHWEVMMENYRNVASLGNNGQENQDSCELFQVINAGDETEKSAERHERN

SEQ ID NO: 27562 - protein, 81 aa, Pseudonaja textilis
PTQVGRKRLAAYMEERFQGPVSFGEVAIHFNSEEWLLLDPSQKALYQEVILEISRMVASLSKGSSIRTLQKLGKCPEYGKS

SEQ ID NO: 27563 - protein, 81 aa, Pseudonaja textilis
PWPRSLLSSLQAPPFSFEEVAVYFTEVEWTLLDAEQKDLYWDVMQENYETVASLGKNSLPQSRSGLQKFFSNGHFWLEAPQ

SEQ ID NO: 27564 - protein, 81 aa, Pelodiscus sinensis
VMEPVSFEEVAVYFSEEEWALLDPGQRALYWDVMQENYEDVSWLGFPVSKAHVISWVEQREELWVPGLQGCEEGTEEWIVE

SEQ ID NO: 27565 - protein, 81 aa, Pelodiscus sinensis
MLRNYRALVSLGYSGSTPDLIHLIERGQAELWIQDAEDSRERSGPESPSSAGPEIPERTRALSERRESTEGKLHPTSLMGS

SEQ ID NO: 27566 - protein, 81 aa, Micrurus corallinus
SFEEVAVYFSEEEWSQLDPDQKALHSEVMLENHRNVVSLGNNGQENQDSCELFQVISAKDGTEKFGIRMKFKSHERNQSKN

SEQ ID NO: 27567 - protein, 81 aa, Pseudonaja textilis
PNFVSFEDVAVFFSVEEWALLDSEEKALYREVMLENKRNVSLMGLSLHVFPPCRLRPCEVPQGSVLGPVLFNIFTNDLDEG

SEQ ID NO: 27568 - protein, 81 aa, Pelodiscus sinensis
VAFAEVTVWFSREEWGLLDPGQRQLYRDVMRENYQMLLSLGFPVPDPAMICGMEQGEELRVLDLQGSEEREIPRGACTAGS

SEQ ID NO: 27569 - protein, 81 aa, Pelodiscus sinensis
AQESVTFEEVAVYFTRAEWALLDPAQRALYRAVMQENYEMVALLGFPVSKPDMIFRLERGEEPWVPDLEGSEKQVPPRAAC

SEQ ID NO: 27570 - protein, 81 aa, Pelodiscus sinensis
VPEPVNFEEVAVYFSEEEWALLDPGQRAFYWDVMQENYEAVSWLGFPISDAHVISWVALEKELWIPGFQGSEEGEIIRNTH

SEQ ID NO: 27571 - protein, 81 aa, Pelodiscus sinensis
PVSFEEVAVYFSEEEWALLDPGQRALYWDVMQENYEAVSWLGFPVSKAHGISWVERGEELGTQKIPNQERPYTCSKCGKSF

SEQ ID NO: 27572 - protein, 81 aa, Pelodiscus sinensis
AQMPVTFEEVAVYFTAGQGVLLDPAQRALYRDVMQENYETVASLGFPVPKPELITRLERGEEPWVLNLQVARKRESPRGTQ

SEQ ID NO: 27573 - protein, 81 aa, Pseudonaja textilis
FPPGSKGETPKVEFGTGEWGNLEKWQKELYKNVMKSNYESLVSLDYAIAKPDLLSRIEQGERPCTEEEEAATTDRVIPLEP

SEQ ID NO: 27574 - protein, 81 aa, Pelodiscus sinensis
VAEPVTFEEVAVYFSEEEWALLDPGQRALYRDVMRENYETVASLGFPVSKPSVTSWLERGGKLQEWEILRVPSTAGDGMVN

SEQ ID NO: 27575 - protein, 81 aa, Pelodiscus sinensis
VAEPVTFEEVAVYFSEEEWALLDPGQRALYWDVMQENYEAVSWLGFPVSKAHGISWVERRAELRIPDRQGSEEGESVSDTR

SEQ ID NO: 27576 - protein, 81 aa, Pelodiscus sinensis
LSMRVTFEEVAVYFTPGQGALLGPAQRALYRDVMQENYETVASLGFPVPKPELIARLERGDEPWVPDLQVCEERGIPRGSP

SEQ ID NO: 27577 - protein, 81 aa, Pelodiscus sinensis
AQVPVTFEEVAVYFTAGQGVLLSPAQRALYEDVMQKNYETVASLGFSISKPDLIARLERGEEPWVPDLQPSKEMGILRDTR

SEQ ID NO: 27578 - protein, 81 aa, Pelodiscus sinensis
MTIRIYDQPPLQPVPKLQTQSVLMNSAAIRLPIPKPDLIARLEAGEDPWVPELQVSEERKIPGGTGKGNPSPEGPEEVEWQ

SEQ ID NO: 27579 - protein, 81 aa, Pelodiscus sinensis
VAELVSFEEVAVYFSEEEWALLDPGQRALYWDVMQENYEAVSWLGIFPVLNEGPRRDLAEGVRNVPTRYRPSREQQNTHLP

SEQ ID NO: 27580 - protein, 81 aa, Pelodiscus sinensis
MRVTFEEVAVYFTQGQGALLDPAQRALYRDVMQENYETVASLGFSIPKPNLIAQLEQGEEPWVPDLQPSKETEILRGTCTS

SEQ ID NO: 27581 - protein, 81 aa, Pelodiscus sinensis
QPPVAFEDVALYFTRAEWELLSPPEKQLYREQMLRNYRALVSLGYSGSKPDLIHQIELGAAELWVGDAEDSRKSSRLESPI

SEQ ID NO: 27582 - protein, 81 aa, Pelodiscus sinensis
DSMRVTFEEVAVYFTPGQGALLGPAQRALYRDVMQENYEAVTSLGFPVPKPELIARLERGEEPWVPDLQAREEREIPRGTC

SEQ ID NO: 27583 - protein, 81 aa, Pelodiscus sinensis
VAEPVTFKEVAVYFSVEEWALLDPGQRALYRDVMQENYEAVSWLGFPVSTANVISWVERGEDLWVLDLQGCKEGEIIRDTH

SEQ ID NO: 27584 - protein, 81 aa, Pelodiscus sinensis
KAVQRFWKSVEFMCREQEWENLEEWQKELYKNVMKGNYETLVSLDYAVSKPDVLARIERGLEERLPKEEGLVEREVSSAGR

SEQ ID NO: 27585 - protein, 81 aa, Pelodiscus sinensis
RVTFEEVAVYFTQGQGALLGPAQRALYRDVMQENYEAVTSLESAGMGTENEEKPPRESSEEAGLQGTVLCRSKGSLSQNRK

SEQ ID NO: 27586 - protein, 81 aa, Pelodiscus sinensis
VVEPVSFEEVAVYFSEEEWALLDPGQRALYRDVMQENYEAVSWLGFPVSKAHVLSWVEELQILDLQGCEEGEIKSDTDTAG

SEQ ID NO: 27587 - protein, 81 aa, Pelodiscus sinensis
VEEPVSFEEVAVYFSEEEWALLDPDQRAFYEDVMQENYEAVNWLRFPASQTDVISWVEREGELQVPYPQSCEEGESISNTQ

SEQ ID NO: 27588 - protein, 81 aa, Pelodiscus sinensis
VTFEEVAVYFSAEEWALLGPAQRALYREVMRENYEAVTSLAWAGLPISKPDLISCMERGEEPWVAHLQSQRRRELPRGRNS

SEQ ID NO: 27589 - protein, 81 aa, Pseudonaja textilis
MDSSFFREVTIHFNSEEWLLLDPSQKVLHEEVMLGTSRMVASLGKGSSMRNLGVVRREGEESHTFIQSSDLTSHKRIHTGE

SEQ ID NO: 27590 - protein, 81 aa, Pelodiscus sinensis
VAELVTFEEVAVYFSEEEWTLLDPGQRALHRDVMQENYEAVCFLAGFPVSKTSVISWVEQREDLQVCEEGVIISDTHTGDE

SEQ ID NO: 27591 - protein, 81 aa, Pelodiscus sinensis
VAEPVSFEEVAVYFTEEEWALLDPGQRTLFKDVMQENYEAVSWLGKDSCPLGSILKLQSEGAGWSHRSRGLKTNTKTVQQK

SEQ ID NO: 27592 - protein, 81 aa, Geotrypetes seraphini
QMQLRFEDISVSFSQEEWAYLDEEQKELYREVMMDNYQTLISLGTGSLPVTPHIISRIEQGEEPYIKDEPESEEREPGRSS

SEQ ID NO: 27593 - protein, 81 aa, Geotrypetes seraphini
SGQVTFQDISISFSQEEWEYLDEEQKNLYREVMKENYQTLISLGSSSPILTPKIISHIERGEEPYIKDEPESEEREIGKSS

SEQ ID NO: 27594 - protein, 81 aa, Geotrypetes seraphini
QMQVAFEDIAVSFSQEEWEYLDEGQKELYREVMKENYETLISLETGYVRINPDLLSWIKQEGEPNIQDPQESGEREVRHLY

SEQ ID NO: 27595 - protein, 81 aa, Geotrypetes seraphini
MEWDVLGEWQKELYKKVIKEIHDILISRGYLIVNPDVIFKIKKEDEKYVAQHCELEGNEDPNEPTKMFPIVTSVFSLSVKQ

SEQ ID NO: 27596 - protein, 81 aa, Geotrypetes seraphini
NEALITFKDVAAYFLETEWDILGDRKKEIYKQIIKDIHDLFISRGYSIVNPDVIFKIEKEDKSFNQHFEWEGKENPNDSSK

SEQ ID NO: 27597 - protein, 81 aa, Geotrypetes seraphini
SQALVEFRDVAISFTKEEWLQLEDWQRQLYKNVIQEIHQALISLGYTILKSDIVIRIRDEDEHYTNDQDQPQKYGCDNDPT

SEQ ID NO: 27598 - protein, 81 aa, Geotrypetes seraphini
RQEPVTFDDIAVYFSEEEWDILEGWQKEIYKDVMRENYGMLASLGFPVPSPEVFLSLVDRQKTPCTESLGHWGERDTLSRS

SEQ ID NO: 27599 - protein, 81 aa, Geotrypetes seraphini
QMRVTFEDIAVSFSQEEWDYLDQGQKELYREVMKENYEILISLGTGCPNLTPEIISCIERGEEPYIRGEPGSEERETGKSS

SEQ ID NO: 27600 - protein, 81 aa, Geotrypetes seraphini
QMQVTFEEIAVSFSQEEWEYLDEEQKELYREVMKENYEILISLETDSPTVIPDIISQIERGEEPFIRDEPGSEERETGKSS

SEQ ID NO: 27601 - protein, 81 aa, Geotrypetes seraphini
VTFEDITVVFSQEEWEYLDEGQKELHREVMKENYEILKSLGKDDPKNNPWKLSEKPEGVKMLSEGEKENWGEKEKNQNKKY

SEQ ID NO: 27602 - protein, 81 aa, Geotrypetes seraphini
DQESVIFSDVAAYFLEAEWDILGEWQKNLYKKVIREIHDILMSRGYSIANPDVIFKIKKEDEKYFTPHFEWEKKENLNDPT

SEQ ID NO: 27603 - protein, 81 aa, Geotrypetes seraphini
AQMQVKFEDIAISFSQEEWEYLNEEQKELYREVMEENYQTLLSLDHQIQHEWKREKNEEEEDPVEMEQIQTLSENVCENIS

SEQ ID NO: 27604 - protein, 81 aa, Geotrypetes seraphini
DQTSVTFKDVAAYFLEMEWNLLAEWQKDLYKKVIEEIHDILISRGYLIVNPDVVFKIKKEDEKYFPQHCDLEEKGNPNEST

SEQ ID NO: 27605 - protein, 81 aa, Geotrypetes seraphini
MRVTFEDIAVSFSLEEWEYLDQGQKELYREVMKENYEILISLGTGCPNLTPEIISRIERGEEPYIRGEPGSEERETGKSSC

SEQ ID NO: 27606 - protein, 81 aa, Geotrypetes seraphini
VTFEEIFISFSQEEWDYLNEEQKELYREVMKENYQTLISLDQQIRHEWKRQKNQGEDVVEMEQSQTQSENVCENISQSPER

SEQ ID NO: 27607 - protein, 81 aa, Geotrypetes seraphini
SQGSVTFRDVAAYFLEVEWGILGEWQKELYKRVIKEIHSFLISQGYSIANPDVIFKIKEEEEKYFTQRCEWEGKENVNDAT

SEQ ID NO: 27608 - protein, 81 aa, Geotrypetes seraphini
GQMSVTFEDIAVYFSREEWEDLEEWQKEFYKEVMKENYEILNSLGYGTLRPEILCRMDRGEEPWVSDRQERERSIHLYSGD

SEQ ID NO: 27609 - protein, 81 aa, Geotrypetes seraphini
QMQVKFEDIAVSFSQEEWEYLDEEQKELYREVMKENYQTVLSLETGSPTVIPDIISQIKRGEEPYIRDEPGSEERETGKSS

SEQ ID NO: 27610 - protein, 81 aa, Geotrypetes seraphini
ASAQMRVTFEDIAVSFSQEEWEYLDEEQKELYREVMKENYETLISLDTEAMHETKREENEEKCLLEIENISKQSGNVSENI

SEQ ID NO: 27611 - protein, 81 aa, Geotrypetes seraphini
SGRMQVTFEDIAVSFSQEEWDYLNEEQKELHREVMKDNYQTLISLDPQISQEWTREGNQGEDTVEMEQIQTQSENVCENIS

SEQ ID NO: 27612 - protein, 81 aa, Geotrypetes seraphini
RMQVTFEEVAVSFSQEEWEYLDEEQKELYREVMKDNYQTLISLGTGFPTITPKIISYIERGEEPYIRGEPGSEERETGNSS

SEQ ID NO: 27613 - protein, 81 aa, Geotrypetes seraphini
DQKLVTFKDVAAYFWEVEWNILGEWQKELYKKVIKEVHGNLLSQGYSIVNPDVIFKIKKEDEKHFTHDSMKGLPVVTSVFS

SEQ ID NO: 27614 - protein, 81 aa, Geotrypetes seraphini
QMWVTFEDVAVSFSQEEWVYLDEGQKELYREVMKENYETVMSLGEEFSRGKEKEGSIEQQSLKTEVHEMNKRVKLFKCSEC

SEQ ID NO: 27615 - protein, 81 aa, Geotrypetes seraphini
QMPVKFEDIAVSFSQEEWEYLDEEQKELYREVMKENYQTLISLGTGSPSITPDIISHIERGEEPYIREEPGSEEREPGRSS

SEQ ID NO: 27616 - protein, 81 aa, Geotrypetes seraphini
MRVTFEDITVSFSQEEWMYLDEGQKELYREVMMENYEILMSLDHEVTDEVRESREEHCLKWKPHPRNVGVSQGTEWKERHP

SEQ ID NO: 27617 - protein, 81 aa, Geotrypetes seraphini
AQMQVTFEEIAVSFSQEEWEYLDEEQKELYREVMKENYEILISLGSLAFIPKIISHIERGEEPYIRGEPGSEEREHGKSNC

SEQ ID NO: 27618 - protein, 81 aa, Geotrypetes seraphini
QMQVKFEDVAVSFSQEEWEYLNEEQKELYREVMEENYQTLLSLATGSPTFTPKIISHIKHGEEPYIRGEPESEERETGKSS

SEQ ID NO: 27619 - protein, 81 aa, Geotrypetes seraphini
EMRVMFEEITVSFSQEEWEYLDEGQKELYQEVMKENHETLIFLETNLQFVNPDMLSKIRRDSRMSRKRKATRSYADDEAKQ

SEQ ID NO: 27620 - protein, 81 aa, Geotrypetes seraphini
AQVPVTFEDIAVYFSQEEWEDLEEQQRELYKDVMKENYETLSSLGPPAVTPDIISHIERGEEPYIRFESGPEEREIGKSSC

SEQ ID NO: 27621 - protein, 81 aa, Geotrypetes seraphini
DQTSVIFKDVAGYFLEMEWDVLGEWQKELYKKVIKEVHDILISRGYSIVNPDVIFKIKKEDEKYFAQPCEMEGKENVNEPT

SEQ ID NO: 27622 - protein, 81 aa, Geotrypetes seraphini
MEWNILGEQQKELYKKVIKEVHGILLSLGYSIVNPDVIFKIKKEDEKHFTQHFEWEGKENPHDPMKSLPVVTSVFSLRVKQ

SEQ ID NO: 27623 - protein, 81 aa, Geotrypetes seraphini
DQTSVTFKDVAAYFLEMEWDVLGEWQKELYKKVIKEIHDILISRGYLIVNPDVVVKIKKEDEKYFPQHCDLEEKGNPNEST

SEQ ID NO: 27624 - protein, 81 aa, Geotrypetes seraphini
EQVPVTFADVMVCFSEEEWKELEDWQKELYDSVMKENYECLLSLGYPVVKPEFISKTEAGAKPCLGDPCDFIVAEDAKTGT

SEQ ID NO: 27625 - protein, 81 aa, Geotrypetes seraphini
VSVTFEDVTVSFSREQWEYLNEGQKELYREVMKENYETLISLGLGIEHERINPEVLSRIKQEEEPHVWDPTELGVREVTPS

SEQ ID NO: 27626 - protein, 81 aa, Geotrypetes seraphini
QMQVAFEDIAVSFSQEEWEYLEEEQRELYREVMKENYQTLISLGIGSQTVTPEIMSHNERGEKVYTRNELGSEERETRKSS

SEQ ID NO: 27627 - protein, 81 aa, Geotrypetes seraphini
ASAQMQLKFEDVAVSFSQEEWEYLDEGQKELYREVMKENYETLISLDTEAMQEMKMEENQENWLLEIELIPRQSGNVSENI

SEQ ID NO: 27628 - protein, 81 aa, Geotrypetes seraphini
QMRLSFEDISVSFSQEEWAYLDEEQKELYREVMKENYQTLISLGTGSPTVTPDIISHIERGEEPYVKDEAGTEERESGTSS

SEQ ID NO: 27629 - protein, 81 aa, Geotrypetes seraphini
EQITVTFNDVAAYFSEQEWQALEEWQRELYRGVMKQIHRALFSLGYSIANPDVLFRIKQDDEPYFRDPFDSEGSNNIGGKD

SEQ ID NO: 27630 - protein, 81 aa, Geotrypetes seraphini
DQTSVTFKDVAAYFLEMEWDVLGEWQKELYKKVIKEIHDILISRGYLIVNPDVIFKIKKEDEKYFAQHCELEGNGDPNEPT

SEQ ID NO: 27631 - protein, 81 aa, Geotrypetes seraphini
SAQMQVTFKDIAVSFSQEEWEYLAEEQKELYIEVMEENFQSLIFLEQQLKQERESEKNQGEDPLEMGQIQRRSQNVCANIS

SEQ ID NO: 27632 - protein, 81 aa, Geotrypetes seraphini
MYRGVMRENYEIMLSLGYQFSKPEILLMMERGEEPCVEDCQRRIPVTFREKHLGQIPEDVIVLDSSDEEEPTKNTKPSPTV

SEQ ID NO: 27633 - protein, 81 aa, Geotrypetes seraphini
QGLVSFEDIAIYFSQEEWEDLEEPQKELYKDVMKDNYQTLSSLENMCHRRYEEMHVIKTVSKRERWNTCLCCDWGKNFQTE

SEQ ID NO: 27634 - protein, 81 aa, Geotrypetes seraphini
VTFEDITVAFSQEEWEYLDEGQKELHREVMKENYEILRSLEKDDPKNNPWKLSEKPEGVKMLSEAEKMNWGEKEKNQKYSP

SEQ ID NO: 27635 - protein, 81 aa, Geotrypetes seraphini
DQTLVTFKDVAAYFWEVEWNILGELQKELYKKAIKEVHGILLSRGYSIVNPDVIVKIKKEDEKYFTQNFEWEGKGNPHDSM

SEQ ID NO: 27636 - protein, 81 aa, Geotrypetes seraphini
AQMQVAFEDIAISFSQEEWEYLDEGQKELYREVMKENYETLISLGFVRISPDLLSWIKQDGEPNIQDPQESGEREVRHSYT

SEQ ID NO: 27637 - protein, 81 aa, Geotrypetes seraphini
AQMRVTFEDIAVSFSPEEWEYLDQGQKELYREVMKENYEILISLGCPNLTPEIISRIERGEEPYIRGEPGSEERETGKSSC

SEQ ID NO: 27638 - protein, 81 aa, Geotrypetes seraphini
QMPVKFEDIAVSFSQEEWKYLNDEQKELYREVMKENYQTMISLGIGSPSVTPDIIFHIEGGEEPYIREEPGSEEREPGRSS

SEQ ID NO: 27639 - protein, 81 aa, Geotrypetes seraphini
ASGQVTFEDIAVTFSQEEWEYLDEGQKELYREVMKENYETLISLVDIGAMQEMKREENQEKCLLEIERISRQSGNVSDNIS

SEQ ID NO: 27640 - protein, 81 aa, Geotrypetes seraphini
DKAVVTFSDVAAYFLEVEWGIMGERQKQLYMKVIKEIHSFLISQGYSILNPDVLFKIKKEDEIYLAQQCEGEGKECMNDST

SEQ ID NO: 27641 - protein, 81 aa, Geotrypetes seraphini
AKVPITFEDVTVNFSQEEWEDLEEWQKELYKDVMKENYETIISLESDEPGSQNEPTCLEENMESSNVLPEGGGEDVSSCSG

SEQ ID NO: 27642 - protein, 81 aa, Geotrypetes seraphini
SAQVTFEDITVSFSQEEWRYLDEGQKELYREVMKENYQILISLGTSSTTFTPELISRIEEGKELYIRDELGSKDRESSCSD

SEQ ID NO: 27643 - protein, 81 aa, Geotrypetes seraphini
QVPVTFDDVAAYFSEEEWKDLEECQKELYKDMMKENYVPFISLDDGPMIEKEKHHLKYNEKLEPNEPLPVTVLENTSQCSD

SEQ ID NO: 27644 - protein, 81 aa, Geotrypetes seraphini
EDCMQTWVTFEDVAVSFSLEEWQYLNEGQKDLYREVMKENLELLTSLSSLVAQLEQNQELFVKRQRKTPLSPSTGNIVGPG

SEQ ID NO: 27645 - protein, 81 aa, Geotrypetes seraphini
FVQVTFQDISISFSQEEWGYLDEEQKDLYREVMKENYQTLISLDQQLSQEWKREKNQGEDPVEMGDIQRQSKPVCENIFQR

SEQ ID NO: 27646 - protein, 81 aa, Geotrypetes seraphini
ASAQMRVTFEDIAVSFSQEEWEYLDEEQKELYREVMKENYEILISLDTEAMQEMKREQNEEKWLLEIEPIPRQPGNVSENI

SEQ ID NO: 27647 - protein, 81 aa, Geotrypetes seraphini
RTMRVTFEDITVAFSQEEWEYLDEGQKELHREVMKENYQTLISLSSEWINLDVLSNIKQEEETRVWDAQETKKRAVTRSDT

SEQ ID NO: 27648 - protein, 81 aa, Geotrypetes seraphini
GRMQVTFEDIAVSFSQEEWDYLNEEQKELHREVMKDNYQTLISLADPQISQEWTREGNQGEDTVEMEQIQTQSENVCENIS

SEQ ID NO: 27649 - protein, 81 aa, Geotrypetes seraphini
ASVIFHDVAVYFSSEEWEILTDWQKELYKNVMREIHGTLVALATSYPSVKPDIYLRIEREDTACPWTQQDSGCPVFDPKLS

SEQ ID NO: 27650 - protein, 81 aa, Geotrypetes seraphini
SAQVAFEDISISFSQEEWEYLNEEQKELYREVMKENYQTLISLVTGSMAFTPKIISHIERGEEPYIRGEPGSEEREHEKSS

SEQ ID NO: 27651 - protein, 81 aa, Geotrypetes seraphini
MKENYEILISLADSPTFTPKIISYIERGEEPYIRDEPGSEERETEKSSCSADHQNRHDWKRIENQGEGPVEMEEIQTQSEN

SEQ ID NO: 27652 - protein, 81 aa, Geotrypetes seraphini
RMQVTFEEVAVSFSQEEWEYLDEEQKELYREVMKDNYQTLISLGTGSPTFTPKIISYIERGEEPYIRGEPGSEERETGNSS

SEQ ID NO: 27653 - protein, 81 aa, Geotrypetes seraphini
TQIPVTFEDTAIYFSQEEWDDLEEWQKELYKDVMKENYEILISLGSPAVTPDIISYIERVKELYIGDELGSEERETRKSSC

SEQ ID NO: 27654 - protein, 81 aa, Geotrypetes seraphini
DQTLVTFKDVAAYFWEVEWNILGEQQKELYQKVIKEVHGILMSRGYSIVNPDVIFKIKKEDEKYFTQHFEWEEKGNLHDPM

SEQ ID NO: 27655 - protein, 81 aa, Geotrypetes seraphini
QVQETFEDIAVSFSQEEWEYLDEEQKELYREVMKENYQTLLSLGTGSLTVAPDIICRIERGEEPYIKDEPGSEEREPGRSS

SEQ ID NO: 27656 - protein, 81 aa, Geotrypetes seraphini
SAQLRVTFEDIAVFFSQEEWEYLDEEQKELYREVMKENYETLISLADTETMQEIKREENEEKCLLEIENIPKQSGNVSENI

SEQ ID NO: 27657 - protein, 81 aa, Geotrypetes seraphini
QMPLTFDDVTVHFSEEQWGCLDEGQKELYREVMKENYETLISLGTGLESIDPKVLSRIKQENELHVWYRKESGEREATPSY

SEQ ID NO: 27658 - protein, 81 aa, Geotrypetes seraphini
VTFEDITVSFSQEEWEYLDEGQKELHREVMKENYEILRSLGKDDPKNNPWKLSEKPEGVKMLSEGVKKNWGEKEKNQNQKY

SEQ ID NO: 27659 - protein, 81 aa, Geotrypetes seraphini
DQASVAFKDVAAYFLEVEWNLLAEWQKDLYKVVIQEIHDILISRGYSIVNPDVIFKIKKEDEKYFTQHLEQEGKETLNDPT

SEQ ID NO: 27660 - protein, 81 aa, Geotrypetes seraphini
AQMQVTFKDIAVSFSQEEWEYLAEEQKELYIEVMEENFQSLIFLAEQQLKQERESEKNQGEDPLEMGQIQRRSQNVCANIS

SEQ ID NO: 27661 - protein, 81 aa, Geotrypetes seraphini
ASGQVTFEDIAVSFSQEEWEYLDEGQKELYREVMKENYETLISLGYIRISPDLLSWIKQDGEPNIQDPQESGEREVRHSYS

SEQ ID NO: 27662 - protein, 81 aa, Geotrypetes seraphini
QMQVAFEDIAISFSQEEWEYLDEGQKELYREVMKENYETLISLETGFVRISPDLLSWIKQDGEPNIQDPQESGEREVRHSY

SEQ ID NO: 27663 - protein, 81 aa, Geotrypetes seraphini
AQMQVTFEEIAVSFSQEEWEYLDEEQKKLYREVMRENYQILISLAGSPTFTPKIISYIERGEEPYIRDEPVSEERETEKSI

SEQ ID NO: 27664 - protein, 81 aa, Geotrypetes seraphini
MRVTFEDIAVSFSLEEWEYLDQGQKELYREVMKENYEILISLGCPNLTPEIISRIERGEEPYIRGEPGSEERETGKSSCSA

SEQ ID NO: 27665 - protein, 81 aa, Geotrypetes seraphini
MFEDVAIYFGEEEWELLEEWQKKLYKETMKENYETLVSLGMGLLAEKPDLIVRIEREENPCVKAQWDSRDEKRWRSSCTGY

SEQ ID NO: 27666 - protein, 81 aa, Anas platyrhynchos
PHILKWDLLLLQEPERWVLLDPVQRTLYVDVMLENYETITSLGKESWPLEFWSQELLELWLLAFMFFVAFKSEADSLPDVP

SEQ ID NO: 27667 - protein, 81 aa, Geotrypetes seraphini
NMMQVTFEDVAVSFSQEEWEYLDEGQKELYREVMKENYETLISLGSVRISPDLLSWIKQDGEPNIQDPQEREKLDIQIRQI

SEQ ID NO: 27668 - protein, 81 aa, Geotrypetes seraphini
MYKELMKEIYETMIALGHQIPKPDILSLIERGEEPCALPSKRKKTEPHPQTTEICVHDSDLTEAEKDKLFLESFYHILQPQ

SEQ ID NO: 27669 - protein, 81 aa, Geotrypetes seraphini
QMRLRFEDISVSFSQEEWAYLDEEQKELYREVMMDNYQTLISLGTGSPPATPDIISHIEQGEEPYIKDEPGSEEREPGRSS

SEQ ID NO: 27670 - protein, 81 aa, Geotrypetes seraphini
QMLVKFEDIAVSFSQEEWEYLNEGQKALYREVMKENYQILTSLGTGTLTVTPEIISHVERGEELNIKDEPRAEEREMGESS

SEQ ID NO: 27671 - protein, 81 aa, Geotrypetes seraphini
VTFDDITVYFSQEEWEYLDEEQQELYREVMKENYETLIFLADNEALWEQKREKKRESQVYMEEVPRQSGNVCQNISEGNER

SEQ ID NO: 27672 - protein, 81 aa, Geotrypetes seraphini
MPVTFEDIFISFSQEEWDYLNEEQKELYREVMKDNYQTLISLDHQITQEQRDPAGDSSYEHQFKRKGKTHQKELQSMHKRN

SEQ ID NO: 27673 - protein, 81 aa, Geotrypetes seraphini
SAQMPVKFEDIAVSFSQEEWEYLNEEQKELYREVMEENYQTLISLDHQITQEGKREKKQGEDPVEIEQVQRQSGNVCENIS

SEQ ID NO: 27674 - protein, 81 aa, Geotrypetes seraphini
QMRVTLKDIFISFSQEEWEYLNEEQKELYWEVMAENYETLISLETSSPTFIPDIISYMAQREEPYIRNEPGSEERETGTSS

SEQ ID NO: 27675 - protein, 81 aa, Geotrypetes seraphini
TGASITFCDVAAYFLELEWEALEEWQKELYKKVIKEIHTFLTSRGFPDVTSAFSLNIKQEEDMPFMDNVKTEMIEEIHPPV

SEQ ID NO: 27676 - protein, 81 aa, Geotrypetes seraphini
QKPVTFEDITISFTQEEWAYLDEDQKKLYREVMKENYQMLISLGTGSPTFTLKILSHIKPRQKPNIRSEPGSEERETGKSS

SEQ ID NO: 27677 - protein, 81 aa, Geotrypetes seraphini
QMQVKFEDVAVSFSQEEWEYLDEEQKQLYREVMEENYQTLLSLATGSLTFTPKIISHIKHGEEPYIRGEPESEERESGKSS

SEQ ID NO: 27678 - protein, 81 aa, Geotrypetes seraphini
MNRIGDWASTNKLKFNAKWDILREWQKEIYKKVIKEIHSFLISQGYSILNPDVIFKIKKEDEKYFTQHYESEEKENMNDSS

SEQ ID NO: 27679 - protein, 81 aa, Geotrypetes seraphini
SRATVTFNDVAAYFSEAEWEVLEEGRKELYRGVMKEIHWVLMSLGYTIVNDDVLLKIKPGEEPYHKYHFGSEDAGGTMDLS

SEQ ID NO: 27680 - protein, 81 aa, Geotrypetes seraphini
AQMQVTFEEIAVSFSQEEWEYLDEEQKELYREVMKENYEILISLGSLAFTPKIISHIERGEEPYIRGEPGSQEREHGKSSC

SEQ ID NO: 27681 - protein, 81 aa, Geotrypetes seraphini
AAAQVTFEDVAVSFSQEEWEYLDEEQKELYREVMEENYQTLISLADLQISQEWKSVKNQGEGPVEKEEIQTQSENVCENIS

SEQ ID NO: 27682 - protein, 81 aa, Lonchura striata
PKVPVAFNDASFNFSEEEWKSLNEWQKELYRHIMKGNYEAVISMDAAISKPDLLTRIEQGEDPNAEDQEDSEGGETPTDPS

SEQ ID NO: 27683 - protein, 81 aa, Geotrypetes seraphini
VTFEDITVSFSQEEWEYLDQGQKELYREVMKENYEILISLDHQISQEWKKEKNQGEDPVKMEQMQTQENVGQNISQGTERI

SEQ ID NO: 27684 - protein, 81 aa, Geotrypetes seraphini
MWVTFEDVAVSFSQEEWEYLDEGQKELYREVMKENYETVMSLGIEFSQQKEKEENLEQHSLKWRLRPRRVDVILETVKGET

SEQ ID NO: 27685 - protein, 81 aa, Geotrypetes seraphini
QVPVSFEDITICFSQAEWEMLKEWQKELYKDVMKENYQTLISLGTGFPIVSPDIISHIERGEEPYIRDQQGSKEREPGKRS

SEQ ID NO: 27686 - protein, 81 aa, Geotrypetes seraphini
SAQMQVTFEDIAISFTQEEWEFLDEEQKELYREVMKENNQILISLDQQIPHEWKREKNQGEDPVEMEQIQTQSENVCENIS

SEQ ID NO: 27687 - protein, 81 aa, Geotrypetes seraphini
AQMQVTFEEIAVSFSQEEWEYLDEEQKELYREVMKENYEILISLAGSPTFTPKIISYIERGEEPYIRDEPVSEERETEKSI

SEQ ID NO: 27688 - protein, 81 aa, Geotrypetes seraphini
SAREMVTFEDIAVSFSEEEWAYLDEEQKKLYREVMEENYQTLVSLEQELKQERESEKNQGKYRLEMEQIQRQSGNVCANIS

SEQ ID NO: 27689 - protein, 81 aa, Geotrypetes seraphini
DQTLVTFKDVAAYFWEVEWNILGEWQKELYKKAIKEVHGILLSRGYSIVNPDVIVKIKKEDEKYFTQNFEWEGKGNPHDSM

SEQ ID NO: 27690 - protein, 81 aa, Geotrypetes seraphini
MRVTFEDITISFSQEEWEYLDEGQKELYREVMKENYEALISLGYETFKGEEEPNVQDTQETGEKEVSHLYTESEGLLEQKR

SEQ ID NO: 27691 - protein, 81 aa, Geotrypetes seraphini
AQMQVKFEDIAISFSQEEWEYLNEEQKELYREVMEENYQTLLSLADHQIQHEWKREKNEEEEDPVEMEQIQTLSENVCENI

SEQ ID NO: 27692 - protein, 81 aa, Geotrypetes seraphini
GRMQVTFEEIFISFSQEEWDYLNEEQKELYREVMKENYQTLISLADQQIRHEWERKKNPGEEAVEMEQIQTHSENVCKNIS

SEQ ID NO: 27693 - protein, 81 aa, Geotrypetes seraphini
QIPVTFEDLVIYFSKEEWEDLEEWQKELYKEVMKENYKSLISLGTGSPTITPDVISLIERGEEPYVRDDPGSEERDSGKSS

SEQ ID NO: 27694 - protein, 81 aa, Geotrypetes seraphini
QKQVTFEDITISFTQEEWAYLDEEQKKLYREVMKDNYQMLISLDHQIRPEWQRIKSQREDSVEMDQIQTESENIYENISLR

SEQ ID NO: 27695 - protein, 81 aa, Geotrypetes seraphini
ASAQMQVTFEDIAVSFSQEEWEYLDEEQKELYREVMKENYEILISLDTKAMQETKREENEEKWLLEHIPRQPGNVSENISQ

SEQ ID NO: 27696 - protein, 81 aa, Geotrypetes seraphini
QQVPVTFEDVAVSFSQEEWKYLDEAQKNLYWEVMKENYETLISLDSEVHQEEEREKNQEEYPMLWGLISRQSRKNHEKVYW

SEQ ID NO: 27697 - protein, 81 aa, Geotrypetes seraphini
MAAGASAQEEWEYLNEEQKELYREVMKENYQTLISLVTGSMAFTPKIISHIERGEEPYIRGEPGSEEREHEKSSCIDHQNQ

SEQ ID NO: 27698 - protein, 81 aa, Nipponia nippon
MAALEPAQVPEALQEVTIATMAASEQAWPLAARLPAGFPVYNPDLLARLEQGEEVWIPDIQSSEEEEEEQLARPLLRLWTR

SEQ ID NO: 27699 - protein, 81 aa, Hirundo rustica
HGVPLLFEDVAVQFSRQEWASLDEGQKEMYRSVMEGNYEMLMSLYCALSKPELLLQLEREELSTPPESEPEAAEVSPELAV

SEQ ID NO: 27700 - protein, 81 aa, Nipponia nippon
EKPSFSQLPVPLPTMEPWVMLDPRQKALYRDVMQESYETLMSLAQGLVSEKAAEEGAAEESCEELEACSSRSPEREKTLGS

SEQ ID NO: 27701 - protein, 81 aa, Geotrypetes seraphini
QMQITFEDIAFSFSQEEWEYLDEEQKELYKEVMKENYQTLISLGTGSPPVTPDIIFHIERGEEPYIREEPGSEEREPGRSS

SEQ ID NO: 27702 - protein, 81 aa, Geotrypetes seraphini
AQVPITFEDIALYFSRAEWEYLQEQQKELYKDVMKENYEILISLGSPIVTPDIISHIERGEELYIMNDPISEERETGKSSH

SEQ ID NO: 27703 - protein, 81 aa, Geotrypetes seraphini
AQMLVTFDNAANYFSEEEWKGADEGQKTTYKEMKEDTSETPVLLDSTTTDSEVLSRIKVEDEPLCNDYSAFEGKENNPSPS

SEQ ID NO: 27704 - protein, 81 aa, Geotrypetes seraphini
QMQVTFEDVAVSFSEEEWAYLDEEQKKLYREVMEENYHTLISLEQELKQERENEKNQGEDGLEMGQIQRQSGNDCANTSQR

SEQ ID NO: 27705 - protein, 81 aa, Geotrypetes seraphini
TRVTFEDIAVSFSQEEWEYLNEEQKDLYREVMKENYETLSSLDHQIIQEQRDPAGDLRYEYHGKRKGKTHQRELQSMHKRN

SEQ ID NO: 27706 - protein, 81 aa, Geotrypetes seraphini
AQMQVAFEDISISFSQEEWEYLNEEQKELYREVMKENYQTLISLGSLTFTPKIISHIERGEEPYIRGEPGSEEREHEKSSC

SEQ ID NO: 27707 - protein, 81 aa, Nipponia nippon
LPKAPVAFESAAAYFSAQEWENLEEWQRELYKNVLRGKSESLISLDYAISKPELLSRLQRGETPCDEDKATSREIPAEPSA

SEQ ID NO: 27708 - protein, 81 aa, Cariama cristata
PKAPVTFESNAAYFSAQEWENLEEWQRELYKNVLRGKNESLISLDYAISKPNLLSQLQRGEAPCGGDEAASRDVPAEPTDY

SEQ ID NO: 27709 - protein, 81 aa, Cuculus canorus
PKVPVTFVDIAVYFSAEEWKNLEEWQKELYNNLVKENYESLISLESLISTSDILSRIKQEVAFVGEQQFTEERAMPADPCA

SEQ ID NO: 27710 - protein, 81 aa, Nipponia nippon
MEPYVLLDPRQRALYRDVMQESYETLMALEFPVSKPDLLSRLDHGDEPTALDLHVPRDTPATEDGAGVEQEPPREEAAEKE

SEQ ID NO: 27711 - protein, 81 aa, Hirundo rustica
PKVPLTFDDISVYFNELEWERLERWQKDLYRAVMRGNYETLVSLDYAVSKPDILSRMERDEELGDKEGQEPPWMQSGDAQE

SEQ ID NO: 27712 - protein, 81 aa, Lonchura striata
LQVPLLFEDVAVRFSRQEWASLSEGQKEMYRSVMEGNYEMLVSLYCALSKPELLLQLEREELNTPPESEAEAAEVSPELAV

SEQ ID NO: 27713 - protein, 81 aa, Lonchura striata
PEVTFEEVAVSFSPEEWAQLAPWQRALHREVMADNYGLVASLEPNSRFTHMKEESHGRVPCAGGHSGDTDTTDTRASSGSD

SEQ ID NO: 27714 - protein, 81 aa, Geotrypetes seraphini
VTFDDITVYFSQEEWEYLDEEQQELYREVMKENYETLIFLDNEALWEQKREKKRESQVYMEEVPRQSGNVCQNISEGNERR

SEQ ID NO: 27715 - protein, 81 aa, Geotrypetes seraphini
DQGPVVFKDVAAHFVEAEWNALGEWKKEFYKKVVREIHSFLWSRGYSVLNPDVLFKIKKEDEKYIIQHYEWEEKENPLYPT

SEQ ID NO: 27716 - protein, 81 aa, Geotrypetes seraphini
MLAEWQKDLYKETMKENYEMLTVLGSLSEKPSLISKIEQEKDLYVRNRQDSPGRLKSSWKGYRPSCENGKHQESCAEKQET

SEQ ID NO: 27717 - protein, 81 aa, Hirundo rustica
PKVPVAFNDASFNFSEEEWKSLNEWQKELYRHIMKGNYEAVISMDAAISKPELLTRIEQGEDPNAEDQEDSEGGETPTDPS

SEQ ID NO: 27718 - protein, 81 aa, Nipponia nippon
MEPWVMLDPRQKALYRDVMQESYETLMSLAAQGLVSEKAAEEGAAEESCEELEACSSRSPEREKTLGSNRRKMKRPDKAVP

SEQ ID NO: 27719 - protein, 81 aa, Callipepla squamata
MLETYECVASLAPLPAPRPMVISLLEEGEEPWVPDLGSPEAVAGDVSPAPLPGPKPIVISLLEEGEEPWIPDVGSPEALAG

SEQ ID NO: 27720 - protein, 81 aa, Alligator mississippiensis
WQKWQGKLEKQAESMELREAFEEVAVYFTREEWELLEDAQKGLYRDQMLRNWRALVSLGKSTSSPQCDHASLMFNTNICFI

SEQ ID NO: 27721 - protein, 81 aa, Alligator mississippiensis
QLQLVFEDVALYFTQKEWELLDDGDKVLYRDQMLRNYQTVVSLGSKRQTSPEDLYQCRECGEPCGDQQELGARGASHKQET

SEQ ID NO: 27722 - protein, 81 aa, Callipepla squamata
FQEPVSFEEVAVYFSREEWALLDPAQRALYRDVMLEKYECVASPAPLPAPKPMVISLLEEGEEPWIPDLGSPEAVAGDVSP

SEQ ID NO: 27723 - protein, 81 aa, Callipepla squamata
MLETYECVASLDPVPGPKPMVISLLEEGEEPWIPDVGSHEAMAGDVSPGSLSSPCEPQGDDACSMEERCFLHLREQGPGVV

SEQ ID NO: 27724 - protein, 81 aa, Alligator mississippiensis
REVFEAVAVYFTREEWELLEDEDKVLYRDPMLRNYQALLSLGWDSGGIPEAVATTASKAAAAAGADPTLGQEMMQTMQPPS

SEQ ID NO: 27725 - protein, 81 aa, Gopherus agassizii
MSGPVTFEEVAVYFTREEWALLDPVQRALYRDVMQENYEMVVLLGFPISKPDVISQLERGEEPWVADLQGSEKEVLPRAAC

SEQ ID NO: 27726 - protein, 81 aa, Gopherus agassizii
VPVVFDDIAVYFSREEWDMFAEWQKDLYREVMTENYEMLLSLGKELFSFFSNGRSRSSSEEQHPDEGAETLQPYRVLFRGS

SEQ ID NO: 27727 - protein, 81 aa, Gopherus agassizii
MEPWVMLDPRQRALYRDVMQESYQTLMSLADGLVSDNEEEDAEEEEEEEGSEELEPRTSQNPEWEKSPANSDEQKKRGAAG

SEQ ID NO: 27728 - protein, 81 aa, Gopherus agassizii
KLDGWGSVACLLGFPVSKPDVISQLEQGEEPWVPDLQGSEEREIMRALRTGEKTLNQLRICKCLKETSGMPSKALGRSLSS

SEQ ID NO: 27729 - protein, 81 aa, Micrurus lemniscatus
SFEDVAVYFSKEEWSQLDADQKALHGEVMLENSMNLASLGLNGQENKKGGKEKFADQMQPKSDKTKQLQSRIKKGFPRVSW

SEQ ID NO: 27730 - protein, 81 aa, Gopherus agassizii
SSMDHCTSASPATAIPLSLCKLCHAELSCLSFQMSVTFEDVAMYFSPAEWALLGEEQKQLYRYVMWENYQTLVSLGEELCL

SEQ ID NO: 27731 - protein, 81 aa, Taeniopygia guttata
HGVPVLFEDVAVRFSRQEWANLSEGQKEMYRSVMEGNYEMLVSLYCALSKPELLLQLEREELSTPPESEAEAAEVSPELAV

SEQ ID NO: 27732 - protein, 81 aa, Gopherus agassizii
AMPVTFEEVAVYFTKGQGALLDPAQRALYRDVMLETYETVTLLALGSACLTLLSWIRKEWGHIVPWLSTRGSCGAARRFQG

SEQ ID NO: 27733 - protein, 81 aa, Gopherus agassizii
LPSGPFDSALFLRQGALLDPAQTALYRDVMLENYETVTSLGKGFPSPRLLESVGPAMLMLVTFFPASLFTSLPGTSSSHGK

SEQ ID NO: 27734 - protein, 81 aa, Gopherus agassizii
MPVTFEEVALYFTQRQGALLDPTQRALYRDVMQENYEMVTSLGKGFPFIQLLEAVGPTYLNVPCFTSGKTKSSVTLPGPAA

SEQ ID NO: 27735 - protein, 81 aa, Gopherus agassizii
FQGRVTFEEVAVYFTREEGALLDPAQRALYWDVMQENYEMVVLCRPKVVPSSLLWGRVWGKSAPDRFDLSRTYFGLFIPFS

SEQ ID NO: 27736 - protein, 81 aa, Gopherus agassizii
LSQECKWFSETAGTGEWALLNPAQRALYREVTQENYATVASLGFPVSKPDVISQLERGEEPWVPDLQGSEERELQKGAQIG

SEQ ID NO: 27737 - protein, 81 aa, Gopherus agassizii
MPVTFEEVAVYFTQGQGALLDPAQRALYRDVMQENYETGPQRPCSCPLGFHVPPEEHGDGNGGREEDPRAQQTNPKEETPC

SEQ ID NO: 27738 - protein, 81 aa, Gopherus agassizii
SGRDHEGVAVYFTREEWALLDPTQRALYRDVMQQNYETVTSLGKDSLKVHVTPQCNLNSALFQQHPNMPVTHTPALCPPLL

SEQ ID NO: 27739 - protein, 81 aa, Gopherus agassizii
EMGFEEVAVYFTAGQGALLDPAQRALYRDVMQENYENVSSLGKDSCPLKCPMNSPDLPCFLSPGQGVQKNTCAEIHTGEKP

SEQ ID NO: 27740 - protein, 81 aa, Gopherus agassizii
GIGLVTFEEVAVYFTESEWALLDPAQRALYRDVMEENYENVTSLAFPVSKPDVISWLEQGEEPWVPDLQNAEEKETLRHTC

SEQ ID NO: 27741 - protein, 81 aa, Gopherus agassizii
GVGPVIFEEVAVYFTSEEWALLDPTQRALYWDVMQENYENVTSLGFPVSKPHIISQLEQGEEPWPAEKMGKFISCRGTQKS

SEQ ID NO: 27742 - protein, 81 aa, Gopherus agassizii
FQMPVTFEEVAVYFTQGQRALLDPAQRALYRDIMQENYKTVTSLVRGLQKTEAFSCLEDEEEYPSSNGSRQRLLGYDLGKK

SEQ ID NO: 27743 - protein, 81 aa, Gopherus agassizii
FQRPMTFEEVAVYFTREEWALLDPTQRTIYRDVMQENYETVTSLGFPVSKPDVISQLEQGEEPWVPDLQGSKERLILRAPC

SEQ ID NO: 27744 - protein, 81 aa, Podarcis muralis
RQICFEDVTIRFTDEEWAFLDPDQRALHQDVMEETRGIVASLGKAPCGIIISYSHNGHANLRQPLAWVLFEEKHQEHCVEC

SEQ ID NO: 27745 - protein, 81 aa, Gopherus agassizii
QMPVTFEEVAVYFTKGQGALLDPAQRALYRDVMLETYETVTLLALGSALELQGIFLRRAKGNFSQGLEQRTAWGDRHRSEM

SEQ ID NO: 27746 - protein, 81 aa, Gopherus agassizii
ISRPDVISLLERGEELWVPDLQGFEKEVLLRVPCTGEVLISILSGAGNDLYLDSLCLPSGDGMVSENEEEKPLQEDAEQVE

SEQ ID NO: 27747 - protein, 81 aa, Gopherus agassizii
LLGLGKPGVAVYFTREEWALLDPAQRALYRDVMQENYENVTSLGKDSRPVGSWKAKCRVKVHPTPTIPPLLCPVSTSPQYA

SEQ ID NO: 27748 - protein, 81 aa, Micrurus lemniscatus
KFSGFYDGDQVAVESPNQESLVSFKEVAVYFSEQEWSQLDSDQKELYSEVMLENHRNVVSLGNNGQDNQDSCELSQGINAN

SEQ ID NO: 27749 - protein, 81 aa, Micrurus lemniscatus
YWDVMQENYETVASLEYLTSTPDLICQQEPWWLQRLEERENRESQSLGKGQVEPSRILSEGDSEGHKSLTGPAAPYNGTRS

SEQ ID NO: 27750 - protein, 81 aa, Gopherus agassizii
GAPVTFEDVAVYFSPEEWKELVEWQKELYWDVMKENYELITSLGKETCLSTGNHAAHEKPGPQTVTWDSPCMECVRSVSLT

SEQ ID NO: 27751 - protein, 81 aa, Micrurus lemniscatus
WSQLDPDQKALHSEVMLENHRNMVSLGNNGQENQDSCELFQVINAKDGTEKFGIRTALESHEKNQSKNWNLESSSSTDAPM

SEQ ID NO: 27752 - protein, 81 aa, Gopherus agassizii
MELPLFEVAVYFTREEGTLLDPTQRALYRDVMQQNYENVTSLAGFLVFQHDVISQLEQGEEPWVPDLQGSEEREILRSSCT

SEQ ID NO: 27753 - protein, 81 aa, Gopherus agassizii
FQGPVTFEEVAVYFTSEEWALLDPTQRALYWDVMQENYENVTSLGFPVSKPHIISQLEQGAEPWVPDLQGSEEILSKHQRI

SEQ ID NO: 27754 - protein, 81 aa, Phasianus colchicus
MEEPVTFEDIAIYLSRAEWDMVAEEQRELYRSVMLDNYELLASLGYPGPKPDILHRLERGEEPWVNTPQSPVKWDGPDRPF

SEQ ID NO: 27755 - protein, 81 aa, Gopherus agassizii
FPMPVTFEEVAVYFTQGQGALLDPAQRALYRDVMQENYKMVTSLAGFPIPKPDLIAQLERGEEPWVPDLQADEERESPRGT

SEQ ID NO: 27756 - protein, 81 aa, Gopherus agassizii
TPRLAETFTGRLRPSIELVTFEEVAVHFTQGEWALLDPIQRALYRDVMQENYENVTSLATQTNYQNPKNPTNHCYCFALCE

SEQ ID NO: 27757 - protein, 81 aa, Gopherus agassizii
PPALVTFREVAVYFSKEEWALMDPGQKALYRDVMQDNYETLISLGFVTPKPDLISQLERGEVSWVLDLQGSEKSDMLTGTC

SEQ ID NO: 27758 - protein, 81 aa, Gopherus agassizii
SNVAFEDVALYFTREEWELLSQPEQQLYRDQMLRNYWTLVSPPPPMNIIILTVHLNNSLIPATTQPQSKLRRVIDVAVSEY

SEQ ID NO: 27759 - protein, 81 aa, Gopherus agassizii
DKGQVTFEEVAVYFSREEGTLLDPTQRALYRDVMQENYENVTSLGKACERQHRPERQQGIQPREKVGKSINCQGTHQNLNE

SEQ ID NO: 27760 - protein, 81 aa, Gopherus agassizii
TLVPVQFEDVAVTLSEAEWLLLDEEKQQLYRDIMYENYQSISSLGELHYYPDFLPTVEALGRAVQKIINLFHRILFFKETE

SEQ ID NO: 27761 - protein, 81 aa, Gopherus agassizii
GPVTFEEVAVYFTREEWALLDPVQRALYRDVMQENYETVVLLGKESCPLDAEQREPHGMLSGRSKGNVSGSCALPEKPKAC

SEQ ID NO: 27762 - protein, 81 aa, Podarcis muralis
YWICFEDVTIRFTDEEWAFLDPDQRALHQDVMEETRGIVASLGKAPCGIIISAWKFKTYLYGTNLIYFHRAQHSKLTSHQI

SEQ ID NO: 27763 - protein, 81 aa, Gopherus agassizii
VSQLVPRDAMYFNEQEWGSLEEWQKELYKNVMKGNYETLISLGKDLFSLLSDDEGIVIKTEVQQVEDVPGTLLERAKEEAV

SEQ ID NO: 27764 - protein, 81 aa, Taeniopygia guttata
NFWILRLPPGRKGEVPKEWEKLEEWQKELYKNVMKGNYESLISLDYAISKPGVLSQIEQGEESRGRNEQDLEESEIITDAT

SEQ ID NO: 27765 - protein, 81 aa, Phasianus colchicus
HCALSPPNSPKAAVAFEDVALYFSAEEWALLARWQRELYQEVMMDNYDLVACLGKEQCCAAPPVPPAPGVPLLPLHPSLLP

SEQ ID NO: 27766 - protein, 81 aa, Gopherus agassizii
VGFEEVAVYFSWEEWGLLDKGQRQLYRDVMQENYQTLISLGEVPLPLGDQELMKQGVLDSFGSGLFPGPVDFWRIGPCPKP

SEQ ID NO: 27767 - protein, 81 aa, Gopherus agassizii
PVTFEEVAVYFTREEGALLDPAQRALYRDVMQENYENVASYCRTELNTLCWTKSSPKKASSLDMRLPEMKNLPLPLNSRPY

SEQ ID NO: 27768 - protein, 81 aa, Gopherus agassizii
LLMLVTFEEVAVYFTEGQGALLDPSQRALYRDVMQENYETVTSLGLPIPKPDLVARLEAGEEPWLPDFQASEERKLPSTGE

SEQ ID NO: 27769 - protein, 81 aa, Gopherus agassizii
DPVTFEEVAVYFTREEWALLDPVQRALYRDVMQENYETVTSLGKESWINNKKVKYTLGTHQVEATKEEKDLGGNVKTPYTC

SEQ ID NO: 27770 - protein, 81 aa, Gopherus agassizii
RVTFEEVAVYFTREEWALLDPAQRALYWDVMQENYETVVLLGKEFDLSYTYFGLFVPFSIRLSEMSFLSGSDLCLDSLCLL

SEQ ID NO: 27771 - protein, 81 aa, Gopherus agassizii
GALVGFEEVAVYFSWEEWGLLDEGQRQLYRDVMQENYQTLISLGEAPLPLGDQERVGGSEVPVVVLAHQISYLCGVRPRFY

SEQ ID NO: 27772 - protein, 81 aa, Gopherus agassizii
LMFQMLVTFEEVAVYFTQEQGALLDPTQRALYRDVMQENYETVTSLGKGFLAPWLLEAVGSAYLTLVRFFPGELVWRVRVS

SEQ ID NO: 27773 - protein, 81 aa, Gopherus agassizii
QGPVIFEEVAVYFTSEEWALLDPTQRALYWDVMQENYENVTSLVKVYASPTMPLLLCPVSASPQYAIQFLFLFDLSQALVL

SEQ ID NO: 27774 - protein, 81 aa, Gopherus agassizii
GCGPVTFEEVAVYFSREEWALLDPVQRALYRDVMQENYETVTSLVGSPVSEPDVISQLERGEEPWVPDRQSSEKEVPPRAT

SEQ ID NO: 27775 - protein, 81 aa, Gopherus agassizii
VPVTFDDVSVYFNEKEWEKLDEWQKELYKNVMKGNYESLISLGKDQNKALTFFTMVAEVMESAPGGWNDGIVIKTEEEDDP

SEQ ID NO: 27776 - protein, 81 aa, Micrurus lemniscatus
ITSEGNGATLWFTEKTPLLCGGTETAVVIPTQNCMSFEDIAVFFSEEEWALLNPDQKLLYREIMLENARNVTCLGERREKE

SEQ ID NO: 27777 - protein, 81 aa, Gopherus agassizii
PTYITSVAVYFTREEWALLDPVQRALYRDVMQENYETVVLLGKEFWGKSAPDRFDLSHTYVGFFIPFSIPLSEIFFLSGAG

SEQ ID NO: 27778 - protein, 81 aa, Xenopus laevis
EEDSIKPDNVAVCFSVEELESFEERQKEPCKNVMREIHQTPTVVGYIYVKPETVSLIRRGEELCVSSNLYARKPDLRSSPA

SEQ ID NO: 27779 - protein, 81 aa, Phasianus colchicus
CQEPVSFAQVAVYFSREEWALLDPAQRALYRDVMLETYQCVASLAPLPAPKPVLISQLEGEEDPCISDVRSPEAVPGDLSP

SEQ ID NO: 27780 - protein, 81 aa, Gopherus agassizii
APGPVTFEDVAVYFTREEWALLDPTQRALYRAIMQENYENVTSLGFPVSKPDVISQLEQGEEPWMRGPFWPFFSLPCFEVD

SEQ ID NO: 27781 - protein, 81 aa, Gopherus agassizii
PGPVTFEEVAVYFTREERALLDLSQRDLYRDVMQENYETVKLLVSFLDMCFFGAVSHFKIAFNVSLLDTLITVAFMPFPHF

SEQ ID NO: 27782 - protein, 80 aa, Gopherus agassizii
LPSPPVSFADVSVSFTQEEWEILAEWQKELYWDVMRENYEILISLDKGLKSSLEGTETLMLQGCSLPLIEEGTLRKNFPL

SEQ ID NO: 27783 - protein, 81 aa, Gopherus agassizii
PPVPVTFEEVAVYFTEEEWALLDLCQRNLYIDVMQENYENVTSLGFPIPKLEVISQLEQGKELWVTELQDGSLNDLNETVI

SEQ ID NO: 27784 - protein, 81 aa, Gopherus agassizii
MESLEVAVYFTREEWALLDPAQRALYRAIMQENYENVTSLGKDSFKVHATSTRPPLHCPLSASPQYANLSPLPPSSLPKAL

SEQ ID NO: 27785 - protein, 81 aa, Phasianus colchicus
MEPYVLLDPRQRALYRDVMQESYETLMSLEFPISKHNPLSHRDEPTALHLHVPKDTLLGDNGAVQEPPQEDPKATKPTEEG

SEQ ID NO: 27786 - protein, 81 aa, Alligator sinensis
AQALVTFEEVAVYFSKGQWALLDPSQRALYRDVMQENYEMVASLAGFPVPQPDVISQLERGEEPWVMDLQEREILGYIHTD

SEQ ID NO: 27787 - protein, 81 aa, Alligator sinensis
MLRNYQALVSLGYQGFAPDLICCIQRGEMELWVCDDEDPGERSWSETSSLAGAGTMTRAEQRPPEQEPANLELIPARNQLS

SEQ ID NO: 27788 - protein, 81 aa, Alligator sinensis
MLRNWRALVSLGYRGPTPDLICRIAQGQEELWVCDDEDHGDISKSEDLLSGSTWLLSRVEKQSLEDGSANLEPPWAFPGGL

SEQ ID NO: 27789 - protein, 81 aa, Alligator sinensis
MYFAEIQWALLDPGQRPVYRDVVPDGYGTLVSLADGGMTNANPQQGCLETAQPHGTLPGLRSEVNIYQALGHAITRPEGQQ

SEQ ID NO: 27790 - protein, 81 aa, Alligator sinensis
LELQEVFEDVAVYFTRKEWELLEDKDKVLYRDQMLRNFQALVSLGYQGPTPDLICSIQQGQVELWVCDDEDCRLEDLLPGG

SEQ ID NO: 27791 - protein, 81 aa, Alligator sinensis
LGLQEVFEDVAVYFTRKEWELLEDEDKVLYRDQMLRNFQALISLGHRGPTPDLICRIQRGLVELWVCDDEDGGEISRSEEL

SEQ ID NO: 27792 - protein, 81 aa, Alligator sinensis
FGLREAFEDVALYFTQKGWELLEDGDKVLYRDQMLRNYQALVSLGCRGPTPDLICRIQRGQGELWVGDDKEPGESAWFEGL

SEQ ID NO: 27793 - protein, 81 aa, Alligator sinensis
LELREVFEDVAVYFTRKEWELLEGEDKVLYRDQMLRNFQALVSLGYRGLAPDLICHIQRGQVELWVCDDEDGGEISRSEDL

SEQ ID NO: 27794 - protein, 81 aa, Alligator sinensis
PVTFEDVAVYFSPEEWKELVEWQKELYWDVMKENYELVTSLDDGLTNESLEEKSREEEVESLPIQPFLAKLKEKVPQSPAK

SEQ ID NO: 27795 - protein, 81 aa, Alligator sinensis
MLTPEPETPAGFPITKPDMISRMEQKEEPWVLRVQGYEEKEILNGMRTAGGGILSENEKNPHQDDPKSMEPYDTVSDASRG

SEQ ID NO: 27796 - protein, 81 aa, Alligator sinensis
LELQEVFQDVAVYFTRKEWELLEDEDKVLYRDQMLRNFQALVSLGHRGPTPDLICRIQRGLVELWVCDDEDGGEISRSEEL

SEQ ID NO: 27797 - protein, 81 aa, Paroedura picta
LVAFEDVAVFFSEEEWALLDRGQKTLHRKVAVENSRNLAFLERSRNRRGKQQRRRIEVKLQGMNDSVTSECCNSHRSPVQG

SEQ ID NO: 27798 - protein, 81 aa, Paroedura picta
MLSPVTFEDVAVYFTEGQGALLDPNQRALYREVMMENYENMASLGFLFIKPALISQLEQGEELWAPESQGLDAAEISDTSD

SEQ ID NO: 27799 - protein, 81 aa, Paroedura picta
QGLVSFEEVAVYFTQEEWALLSPAQKVLYKEVMQENFGIVASLGGLQRMQTGEKKYQCLECGKIFTRSSSLRYHRRIHTGE

SEQ ID NO: 27800 - protein, 81 aa, Paroedura picta
SWLQVVFEDVALYFSPEEWLELAEWQRELYQAVMMENYLAILSLGHSSAKPEVICKIERGEDVCLGEGWTPPVWRKPPSLW

SEQ ID NO: 27801 - protein, 81 aa, Paroedura picta
KLSRWASEKTCFAMEPWVYLDPRQRALYRDVMQESYETLMSLAADKLLNSSNNDEEEEEEEDEEEDEGPEELRPGTSQSTP

SEQ ID NO: 27802 - protein, 81 aa, Paroedura picta
PVYFEEVAVDFTEAEWALLDPDQRALYWEVTLENYENVAFLEEARNVGDRIMEPDRGPLCPGGLESFSRGESISFPCDSAE

SEQ ID NO: 27803 - protein, 81 aa, Magnetospirillum magneticum
RLPNGTLDRLVAFTAEELAALESATRLFERDNREDEAAELATLGAKLRALLKPDVARRVEPDLEALLEAEGLAMRPGPRPR

SEQ ID NO: 27804 - protein, 81 aa, Gordonia sp. 852002-10350_SCH5691597
VDEAFADLTVDPVTGEREPQSLASMRNDDIVVIRSVTKTFGLAGLRAGYLLASPEIVERLSRGRRPWPLSTPALAALAECV

SEQ ID NO: 27805 - protein, 81 aa, Microcaecilia unicolor
SAQVTFEEIAVSFSQEEWGYLNEEQKELYREVMKENYQILLSLGTGSPTIIPDIISHVEQGEELYIRDERGSEERETGKSI

SEQ ID NO: 27806 - protein, 81 aa, Pipra filicauda
MEPWAPLDPRQKELYRDVMHESYETLLSLAAQGLLSEKAAVEDAGAAEPAEGPGAVSEREKPLGSHRRKAKRPDRAVPPGT

SEQ ID NO: 27807 - protein, 81 aa, Micrurus spixii
LQGVVSFEDVGVYFSKEEWSQLDADQKALHREVMLENSRNLSSLGFKGQENKNCKQECQAIHPKEGKMNFTDQLQPKSNET

SEQ ID NO: 27808 - protein, 81 aa, Amazona aestiva
PKVPVTFDDVSVYFNDKEWEKLEEWQKELYKNVMKGNYESLISLDYAISKPGVLSQIEQGEESRVRNEPDLEESEIITDAT

SEQ ID NO: 27809 - protein, 81 aa, Micrurus lemniscatus
MITFEDVSIHFTEEEWTLLNHKEKNLYWNVMHQNYDNIAYLASDQIKGKSQKEDPLQEDFEPAVEWLEKSKEIILQHPEPK

SEQ ID NO: 27810 - protein, 81 aa, Micrurus lemniscatus
LEGRRNPSNPFQELFSRRIPQEGPNQDTLEVKHRMMCGLYGSVETADETAENQKDILSFEEVAVHFSEEEWSQLDADQKTL

SEQ ID NO: 27811 - protein, 81 aa, Micrurus lemniscatus
MSFEDIAVFFSEEEWALLNPDQKLLYREIMLENARNVICLGERREKEDSKKEIVEDLPIVKNEIGETMFQCQRGVQSPEEN

SEQ ID NO: 27812 - protein, 81 aa, Micrurus lemniscatus
GFLTQGPVSFGEVAIHFSSEEWLLLHPSQKALYQEVMLETSRMVTSLAFYAQKKENDQEPNLVPLQIIKTETPGETSTNKW

SEQ ID NO: 27813 - protein, 81 aa, Micrurus spixii
IKNSVTFEDVAVYFTEDQGVLLDRKQRTLYEDVMMENYGIVASLGFLAFKPALISQIECGEEPWLPEIPKLDDIEISNANA

SEQ ID NO: 27814 - protein, 81 aa, Micrurus spixii
QDLVSFEDVAVFFSMEEWALLDSEEKALYWEVMLENKRNMASLDPLMAFSSSPGTSVLCSGRSTAAELPTQHHPSHQQQQQ

SEQ ID NO: 27815 - protein, 81 aa, Micrurus spixii
QEGLVSFEDVAVYFFEEEWTELDPDQKALHREVMLENYRNVASLGNDEQDHKEPRESFQGFRHGDVMEKRAIQTKFQRQKR

SEQ ID NO: 27816 - protein, 81 aa, Micrurus spixii
AGFLTQGPVSFGEVAIHFSSEEWLLLDPSQKALYQEVMLETSRMVTSLAFYVQKENDQEPNLVPLQIIKTETPGETSTNKW

SEQ ID NO: 27817 - protein, 81 aa, Pantherophis guttatus
MYFAEIQWALLDPCQRPVYRDIVQDNFGTLLSLDGGTMNSNSQPGGPEGMQKQVQGRPEGSAYGGQLSAGQLSEEAGKGWV

SEQ ID NO: 27818 - protein, 81 aa, Ophiophagus hannah
CLPPTQGFISFDEVAVDFTLEEWALLDWSQRALWREVMLEISLNIAALSYGQSDENDQQPWLVPLQTADYEVEEVMFGHQG

SEQ ID NO: 27819 - protein, 81 aa, Ophiophagus hannah
VAEGLGGEPKYVALNKMKLPRETAPPFSFEEVAVYFTEVEWTLLDAEQRDLYWDVMQENYETVASLVLATGSLPAFWVGVA

SEQ ID NO: 27820 - protein, 81 aa, Microcaecilia unicolor
QVPVTFEDIALYFSQAEWEFLQDQQRELYRDVMKENYEIFISLGVDSPTVTPDIIAHIERGEEPYIRDDPRAEEKVTEKSS

SEQ ID NO: 27821 - protein, 81 aa, Microcaecilia unicolor
QIPVTFEDIAIYFSQEEWEDLEETQKELYEDVMMVNYQTLISLETDSVTVTPDIISHIERGEAPYIRHELGSEERKTGKSS

SEQ ID NO: 27822 - protein, 81 aa, Pantherophis guttatus
MEPWVYLDQRQKALYRDVMQESYETLMSLAANQLLNNSNHDDEDEDEDDEEEHEGMEELRPGTSQSAPRRVKPLTRRETPK

SEQ ID NO: 27823 - protein, 81 aa, Pogona vitticeps
LLKQLMSFQEVAVSFTQQEWDLLDPGQRGLYKEVMLEIYRMVTSLAVPKPELTFLLEGGGDPFVQDSEEQKRWAGGCLGLD

SEQ ID NO: 27824 - protein, 81 aa, Micrurus lemniscatus
VSFEEVAVYFSEEEWSQLDADQKALHGEVMLENSRNLFSLGFNGQENKNCNEECQAIHLKMEKGKFADQMQSNSDETKQSQ

SEQ ID NO: 27825 - protein, 81 aa, Micrurus lemniscatus
PKVPVTFSDLSVHFNEHEWGNLDELQKDLYKTVMKSNYEMLVSMDYAIAKPEILTRIEQGDALCDTNVDTMPGNNTPAHLG

SEQ ID NO: 27826 - protein, 81 aa, Micrurus spixii
HFSEEEWSQLDADQKTLHWEVMLENYRNMASLGYNGQENEDSGKPFLINTSGDRIETPTMQMELESHERSQSNTWDEESSS

SEQ ID NO: 27827 - protein, 81 aa, Micrurus spixii
RYFLYFLLNIQDLETREFVLYFQVPVTFNDLSVHFNEHEWGNLDELQKDLYKTVMKSNYEMLVSMDYAIAKPEILTRIEQG

SEQ ID NO: 27828 - protein, 81 aa, Patagioenas fasciata
MSVTFEDVALYFSPEEWAKLSGCQRQLYREVMLENYEMVASLGWASDKPEIICKMEREETPCVPEPPRDWQRHQSPVAAAV

SEQ ID NO: 27829 - protein, 81 aa, Micrurus spixii
MEEWALLDCEQKAPHQEVMVEDAKNMASFGDGLKIVDAAQEMATPFLIAEKEVAERMREKERPEEKELKEELGKYSSSQYV

SEQ ID NO: 27830 - protein, 81 aa, Aquila chrysaetos
PKVPLTFDDISVYFNEQEWERLDRWQKDLYRAVMRGNYEMLISLDYAVSKPDILSRIERDEELCVKDGQKPPLMPIGGSQE

SEQ ID NO: 27831 - protein, 81 aa, Patagioenas fasciata
MSVTFKDVALYFSPEEWAKLSGCQRQLYREVMLENYEMVASLGWASDKPEIICKMEREETPCVPEPPGEQQRHQSPVPDPG

SEQ ID NO: 27832 - protein, 81 aa, Micrurus spixii
TLAKGFLLNCVEQKIQRKQIPVSFEDVIIFFSVEEWALLDFDQKSLYREVMLENAKNVESMGKRYVLLWVQINGEVYSDER

SEQ ID NO: 27833 - protein, 81 aa, Aquila chrysaetos
PKVPLTFDDISVYFNEQEWERLDRWQKDLYRAVMRGNYEMLISLDYAVSKPDILSRIERDEELCVKDGQEPPQTSVRDGQE

SEQ ID NO: 27834 - protein, 81 aa, Aquila chrysaetos
TQEPVTFEDVAVYLSHAEWDAIAAGQRELYRTVMLDNYKLLTSLGYPGPKPDVLYRIEHGEEPWVCTPQSPVRWDGHDSPS

SEQ ID NO: 27835 - protein, 81 aa, Aquila chrysaetos
KGEVPKVTVFCSEEWKSLNEWQKELYRHIMKESLSCKGKGNFLILFLHADAAISKPDLLSRIEQGEDPNAEDQDDSEGGET

SEQ ID NO: 27836 - protein, 81 aa, Strigops habroptila
AVPVTFDDVSVYFNDKEWEKLEEWQKELYKNVMKGNYESLISLGKYGFSRAPGCLQAWAPSESSLEIPLDPLETQIPENPE

SEQ ID NO: 27837 - protein, 81 aa, Strigops habroptila
NFWILRLPPGRKGEVPKEWEKLEEWQKELYKNVMKGNYESLISLDYAISKPGVLSQIEQGEESRVRNEPDLEESEIITDAT

SEQ ID NO: 27838 - protein, 81 aa, Micrurus lemniscatus
GFLTQGPVSFGEVAIHFSSEEWLLLDPSQKALYQEVMLETSRMVTSLAFYAQKKENDQEPNLVPLQIIKTETPGETSTNKR

SEQ ID NO: 27839 - protein, 81 aa, Micrurus lemniscatus
DVVCFEEVAVYFSEEEWSQLDADQEELYREVMVENSRNLLSLGFNGPEKKNCKEECQAIHSKGGNRKFVDQMQLKSDETKQ

SEQ ID NO: 27840 - protein, 81 aa, Micrurus lemniscatus
GVSFEEVAVYFSKEEWSQLDPAQKALHGEVMLENSRNLASLGYNGQKNKNSKEECQAIHLKEGKGKRYQCMQCGKTFPLSS

SEQ ID NO: 27841 - protein, 81 aa, Micrurus spixii
VTFEDVAVYFSAEEWSQLDPDQKALHKEVMLENYRNVASLVALQRLKREQIISGRISEKPRLESVVSESALDHIKQSQTQP

SEQ ID NO: 27842 - protein, 81 aa, Meleagris gallopavo
QEPVSFAEVAVCFSREEWALLDPAQRVLYRDVMLETYQCVASLAGDGLTNIKEDKQKSVVAERQLSGTSVEEIRRAVQGGL

SEQ ID NO: 27843 - protein, 81 aa, Micrurus spixii
EEWSQLDPHQKALHWEVMLENYMNMASLDNNGQENKESIESFQKFKLGNRTEKPANQMEQQSQERNLSNNWNKESLSSVDA

SEQ ID NO: 27844 - protein, 81 aa, Aquila chrysaetos
NFWILRLPPGRKGEVPKEWEKLEEWQKELYKNVMKGNYESLISLDYAISKPGVLSQIEQGEESRVRNEQDLEESEIITDAT

SEQ ID NO: 27845 - protein, 81 aa, Strigops habroptila
MEPWVLLDPRQKALYRDVMQESYETLMSLAQGLVSGKAAEEGAGAGSRGEPAARSSRSPDSEQTPGSNRRKAKRPDKAAPP

SEQ ID NO: 27846 - protein, 81 aa, Patagioenas fasciata
PKVQVMFDSGTADVSAPEREDLEGWQRELHTNVLRGENEPLISLDYAISKPDLLSRLQSGETPCDSDKVTSREIPAEPSAA

SEQ ID NO: 27847 - protein, 81 aa, Chloebia gouldiae
PQVPVAFNDASFNFSEEEWKSLNEWQKELYRHIMKGNYEAVISMGNDGPGFALSLLAQSFPGNWWMEGAVCPAGSGRGWCA

SEQ ID NO: 27848 - protein, 81 aa, Strigops habroptila
MKEDPARPVALGYTVTKPDILAEVERGEEAAAASGHYREHQSPGPRMAPAGPSQGDWLGKEVKSEEGVSPPPGSPPSHRTG

SEQ ID NO: 27849 - protein, 81 aa, Meleagris gallopavo
HPSQEPVSFADVAVYFSREEWALLDPAQRVLYRDVMLETYECIASLAPKPAVISMLEGEEDPWIPEVHGLKDMAGDLGPAD

SEQ ID NO: 27850 - protein, 81 aa, Micrurus spixii
SLVSFKEVAVYFSEEEWSELDPDQKALHWEVMMENYWNVASLEDEWEMLGSRHEAAAPLPKNKMKTAETFLGKQNSEGKQL

SEQ ID NO: 27851 - protein, 81 aa, Meleagris gallopavo
CSKEPLCLQEPVSFADVAVYFSREEWALLDPAQRALYWDVMLETYECIASLGGEDPWIPDVHGLKDMAGDTCPGDGIADLK

SEQ ID NO: 27852 - protein, 81 aa, Patagioenas fasciata
PKVPVTFVDIAVYFSAEEWKNLEEWQKELYNNLVKENYESLISLDGAVSRNEAQPRGERGDGPCIPEQRDLEQRELPPDAC

SEQ ID NO: 27853 - protein, 81 aa, Micrurus spixii
DLVSFEDVAVFFSVEEWALLDSEQKALYREVMLENKRNVASLGDGWEMEDSGQEAAAPLPKDKKEEKIYRKQSSEKIQLTG

SEQ ID NO: 27854 - protein, 81 aa, Micrurus spixii
MSFEDIAVLFSEEEWALLNPDQKLLYREITLENARNVTCLVERWEKEDSKKEMVEDLSIVKNEIGETMFRCQRGVQSPEEN

SEQ ID NO: 27855 - protein, 81 aa, Micrurus spixii
RSFPLDKMESPLFAESSPSIGEAERTARFLTQGHVSFGEVAIHFNSEEWLLLDPSQKALYQEVLLETSRIVASLAFDPQKK

SEQ ID NO: 27856 - protein, 81 aa, Micrurus spixii
PPKAPVSFKDVAVYFAEEEWSLLDQDQRILYREVMLETYGIVASLEFPKPDIKSWMEEGEDLVVQQDEEGERSAGICSGLV

SEQ ID NO: 27857 - protein, 81 aa, Meleagris gallopavo
VSFADVAVYFSREEWALLDPAQRALYWDVMLETYECIASLGDQASKPVVISLLEGGEDPWIPDVHGLKDMAGDTCPGEVVE

SEQ ID NO: 27858 - protein, 81 aa, Strigops habroptila
MGLLVTFEDIVVHFSGAEWASLDDGQKELYRTVMEDNYEMLVSLALPGAGPSQSQDSVQVPLLWEPSAEPWQELHPGCARE

SEQ ID NO: 27859 - protein, 81 aa, Amazona aestiva
VTFEDVAVRFSAEEWELLEEWQRELHWEVTEGTSQLLASLGPPSSPALAALVQLVKEIPEFLFGGPKADVDPGATTSGDTE

SEQ ID NO: 27860 - protein, 81 aa, Terrapene carolina
PVTFKEVAVYFTREEWALLDPAQRALYRDVMQENYENVTSLGKDSFKVHHILRYNLNSALFQQHPNMPVTHTPAIPSESSV

SEQ ID NO: 27861 - protein, 81 aa, Amazona aestiva
PKVPVTFVDIAVYFSAEEWKNLEEWQKELYNNLVKENYESLISLDGALSRSEAQPRSERPEGPCVPEQRDLEQRELPTYGA

SEQ ID NO: 27862 - protein, 81 aa, Micrurus spixii
PSWKTPSEDRATRMVSFETSILCAGGIETFGLPRKNSISFEDVAVFFSVWEWALLDLEQKNLYQEVMLDNARNLASLSDEW

SEQ ID NO: 27863 - protein, 81 aa, Alligator sinensis
MEPYVLLDPRQRALYRDVMQESYETLMALEFPISKPDLLSRLDHGDEPTALDLHVPKGARAAEGATSENEEENPARESPKE

SEQ ID NO: 27864 - protein, 81 aa, Pogona vitticeps
PVTFEDVVIYFTEAEWALLTWTQRALYKEVMQENYQNVMSLGTSPISQAPTATAKDTQESQRQRAKFWSKEEIGLFVDLWI

SEQ ID NO: 27865 - protein, 81 aa, Micrurus lemniscatus
VHGEVAVYFSEEERSQLDAEQKELYREVMVENSRNLFFLGFNGQEDKNCKEKHQAIHSKRGKRKFVDQKQLKSDEAKQSQS

SEQ ID NO: 27866 - protein, 81 aa, Amazona aestiva
PKVPLTFDDISVYFNEQEWEQLDCWQKDLYRAVMRGNYETLISLDYAVSKPDILCRIERGEELCIRDSQESPQTCIRGDQE

SEQ ID NO: 27867 - protein, 81 aa, Microcaecilia unicolor
AAISVTFSDVAVYFSEKEWGLLDEWQKELYRNVMKEIHGALLSMGYKILNPGNLFRIKKAEEPYDRDPDDATQRDFTIHTT

SEQ ID NO: 27868 - protein, 81 aa, Ophiophagus hannah
STPVTFEDVVVYFTAAEWVHLTNWQRDFYQAVMMETYELVASVAGDGVPMAEDEEGGVERPVWQYIPRGKRRRKTPQPRAD

SEQ ID NO: 27869 - protein, 81 aa, Micrurus lemniscatus
VGKKNPSNPPQELFCRQIPWEDPSQDTSGDKQRMKLYGFYDGDQTAVEPPNQEGLVSFEEVAVYFSEEEWSQLHPDQKALH

SEQ ID NO: 27870 - protein, 81 aa, Micrurus lemniscatus
EVRDPEGRKNPSNPPQELLFRRIPWEDPSLDTSGEEQRMKLFGFYDGDQTAVEPPNQEGLVSFEEVAVYFSEEEWSRLDPD

SEQ ID NO: 27871 - protein, 81 aa, Micrurus lemniscatus
LVPLSFEDVAVYFTEEESPLLNASQMALQMEVMVENYQNLSSLGREVWRNEEEDESQRVSLKRARSIQEGLQSEGIEERPK

SEQ ID NO: 27872 - protein, 81 aa, Micrurus lemniscatus
PKVPMTFEDNGVYFSEQEWGNLEEWQKELYKNVMKSNYESLVSLDYAIAKPDLLSRIEQGERPCAEEEEATMTDRVIPSEP

SEQ ID NO: 27873 - protein, 81 aa, Alligator sinensis
MLRNCRALVSLGYRGPTPDLICCIKQGQEELWVSDNGDRGDTSRLKELLPGSAWMLSRAEDQNLVVGPANLELPWTSPGRL

SEQ ID NO: 27874 - protein, 81 aa, Pogona vitticeps
QVPEAFVEVTVSSTGGLRSLVSRHPQKALHKNTMQEDYTIKASLGGFPIHTSELLTRLDRGEVAWVPDLQSSDESTDEGPV

SEQ ID NO: 27875 - protein, 81 aa, Ophiophagus hannah
MEPWVYLDQRQKALYRDVMQESYETLMSLAANQLLNNSNHEDEDEEDEEEPEGVEELRPGTSQSAPRKVKPLTRRETPKQP

SEQ ID NO: 27876 - protein, 81 aa, Micrurus lemniscatus
IPLEDPSQDTSGEIQRMKLSVFYDGAQTVDEPPNQENLMSFEEVAVHFSKEEWSQLDSDQKALHSEVMLENHRNMVSLGNN

SEQ ID NO: 27877 - protein, 81 aa, Microcaecilia unicolor
VSFEDIAIYFSQEEWEDLEEWQKDLYVDVMKENYQTLISLEIDDPRSNNMEGDHWELSESVEGNKTLSERDRGAATSCSDW

SEQ ID NO: 27878 - protein, 81 aa, Alligator sinensis
QMLVTFKEAAVHFTEEQWNLLDPDQRSLYTDVIQEIYEMVVSLGSLSPSTENGPPLDALSVPAGYWMASENEEESPQQKGP

SEQ ID NO: 27879 - protein, 81 aa, Amazona aestiva
RPGQGAVAFEDVAVHFSPEEWRRLERWQRQLYWEVMLENRDLVASLVFESKLVCKMEAEEESYVRDPCGGGDGEAPDASGT

SEQ ID NO: 27880 - protein, 81 aa, Micrurus lemniscatus
MEEWALLDCEQKAPHQEVMVEDAKNMASFGDGLKIVDAAQEMATPFLTAEKEVAERMREKERPEEKELKEELGKYSSSQYV

SEQ ID NO: 27881 - protein, 81 aa, Micrurus lemniscatus
MAVDFTEEEWAMLDSGQKALCREVMLELFRNMAALCDGLVSEKEKQLRLLTLQREVSAKSHSFPFTLSKILNRKYKLHTFA

SEQ ID NO: 27882 - protein, 81 aa, Micrurus lemniscatus
MSFEDIAVFFSEEEWALLNPDQKLLYREIMLENARNVICLGERREKEDSKKEIVEDLPIVKNEIGETMFRCQRGVQSPEEN

SEQ ID NO: 27883 - protein, 81 aa, Microcaecilia unicolor
MMEIHGALISLGYGILNPDVLFRFKKEEEPYYRSQQKSKGKERVVDLNTGYPTVSPDILLRIKHEAEPCHRDQHMPDGRER

SEQ ID NO: 27884 - protein, 81 aa, Pogona vitticeps
VAFEDVAVYFTEEEWALLDRNQKALYWEVMEENLVTVFSLEGGEQESEKGGEASKAALLERVTWEEKEEQQTTSETKEKNE

SEQ ID NO: 27885 - protein, 81 aa, Micrurus lemniscatus
KEDPSHDISGGKSQMKSSALYDGDETIVELPTQESPVSYEEVAVYFSEEEWSQLDVHQKVLHWEVMLENQRNVASLCNNGK

SEQ ID NO: 27886 - protein, 81 aa, Micrurus lemniscatus
VQDFVTFEDVAVYFSADEWSQLDPDQKALHKEVMLENYRNVASLVALQRMKKEQIPSVRISEKPRSESVVSESALDHIKQS

SEQ ID NO: 27887 - protein, 81 aa, Geotrypetes seraphini
ALTSVVFSDVAACFWELEWDILKEWQKEIYKKVIKDIHSILMSQGCLIVNPHVIFKIKKEDDKYFTQQYKLEGKENMSDPT

SEQ ID NO: 27888 - protein, 81 aa, Geotrypetes seraphini
VRFEDISVSFSQEEWAYLDEEQKELYREVMRDNYQTLISLDHWLTQEMKREKKQGEHPIEREESQRQSENVYENISQGTER

SEQ ID NO: 27889 - protein, 81 aa, Geotrypetes seraphini
RMQVTFKDITVSFSQEEWEYLDEGQKELYREVMKENYRTLISLGTGLPRVTPDIISHIERGEEPYIREEPGSEEREPGRSS

SEQ ID NO: 27890 - protein, 81 aa, Micrurus lemniscatus
SFEDVAVYFSKEEWCQLDADQKALHGEVMLENSRNLFSLGFNEQEVNNCNKECQAIHLKGEKEKFAGHMKSNSDETKQSQS

SEQ ID NO: 27891 - protein, 81 aa, Geotrypetes seraphini
VNGSVFQIPVVLCFTEEQRMDLEEQQTELSKDMMENYQTLISLGSGSVAVTPDIISHTEEGEELYIKDELGSEERESGRSS

SEQ ID NO: 27892 - protein, 81 aa, Geotrypetes seraphini
AQMQVKFEDIAISFSQEEWEYLNEEQKQLYREVMEENYQILLSLADHQIQHEWKREKNQGEDPVEMEQIQTLLKNVCENNS

SEQ ID NO: 27893 - protein, 81 aa, Terrapene carolina
LQVPVQFEDVAVTLSGAEWLLLDEEKKQLYRDVMNENYQSISSLGELHYDPNVLPTVEALDRAWKIYTFQCNPNIFGSKTA

SEQ ID NO: 27894 - protein, 81 aa, Microcaecilia unicolor
RVPPVTFHDVAAYFSEDDWEALEDWRKEVYTNAMREIHGALVSLGYGIVNTNVLFRIKQEEEPFFKDPGASKIREGTNSRA

SEQ ID NO: 27895 - protein, 81 aa, Amazona aestiva
MKEDPERPVALGYTVTKPDILAEVERGEEAAAAAAAGHCREHQSPGPRMAPAGPSQGEWDKGAGAQVVGQILLNRRAWSHG

SEQ ID NO: 27896 - protein, 81 aa, Pantherophis guttatus
VTIEDVTVYFSEEEWSQLDPDQKALHKEVMLENSRNVASLVALNRMKRRQNFSARINKKPRLESVVSELALDGIKQSQAQP

SEQ ID NO: 27897 - protein, 81 aa, Aquila chrysaetos
MMENYQLIASLGSSGPKPEVIQKLERGEEPHLGDPPAAPMGGTPQAPGTADSRRRRLSGCAAAAATCKRKELSLADRVKLL

SEQ ID NO: 27898 - protein, 81 aa, Strigops habroptila
PKVPVTFVDIAVYFSAEEWKNLEEWQKELYNNLVKENYESLISLDGVLSRSEAQPRSERPEGPCVPEQRDLEQRELPTDTC

SEQ ID NO: 27899 - protein, 81 aa, Meleagris gallopavo
EEPVSFAEVAVYFSREEWALLDPAQRALYRDVMLETYQCVASMESLLPAPKPIVISLLEGGEDLWIPDMQSPEDVAGDLRP

SEQ ID NO: 27900 - protein, 81 aa, Meleagris gallopavo
LQEPVSFAEVAVYFSREEWALLDPAQRALYRDVMLETYQCVASLAPLPVPKPMLISQLEGGEDPWIPDACSPEAVPGDLSP

SEQ ID NO: 27901 - protein, 81 aa, Meleagris gallopavo
MEPYVLLDPRQRALYRDVMQESYETLISHLERHRRLHRGENPYQCGLCGKGFAWSSHYDRHRLTHTGEKPFSCAQCGKCFG

SEQ ID NO: 27902 - protein, 81 aa, Meleagris gallopavo
EPVSFAEVAVYFSREEWALLDPAQRALYRDVMLETYQCVASLVTETPVPAPKPVLISLLEGRKEPWIPDMRSPEAMPGDLS

SEQ ID NO: 27903 - protein, 81 aa, Aquila chrysaetos
VTKGSLRAGVRGHEWENLEEWQRELYKNVLRGKNESLISLGRYHFPADEVITFKIEQLDSEERPQSSASPATLSSESKELL

SEQ ID NO: 27904 - protein, 81 aa, Strigops habroptila
LSHLEDVWLQFSEQEWRALRGWQRALHQAIMRSNYHILLNVSVSVHDENTKRDPAVDCFESTARDSEVPGRPGEQFSKDPS

SEQ ID NO: 27905 - protein, 81 aa, Strigops habroptila
KMPAACEDEAASLPEQEWGSMDSQQKEISRMAMKGNYNEAGVFLGPADASSKPPLLPLAEDREDPGARTQGLPEEASVLGH

SEQ ID NO: 27906 - protein, 81 aa, Strigops habroptila
LQMLVTFEDVSVHFSSEEWAVLAGWQRELYCSVMRDNYRLLTSLGYPGPKPDILYRMERGEEPWVCSPQSPARWEGPSCPS

SEQ ID NO: 27907 - protein, 81 aa, Aythya fuligula
MEPYVLLDPRQRALYRDVMQESYETLMALEFPVSKPDLLSRLAHEGEPTALDLQVPKDAPSGEDGARAEQEPPGEETVEKE

SEQ ID NO: 27908 - protein, 81 aa, Aythya fuligula
QVPTAGEDDAACLPEQEWGGLDSRQQELYRMAVKGSYEAVVSLGPGDASSKPSLLLPAEDGEDLGTRTHGLLEKGAVSGHV

SEQ ID NO: 27909 - protein, 81 aa, Aquila chrysaetos
MEPYVLLDPRQRALYRDVMQESYETLMALEFPVSKPDLLSRLDHGNEPTALDLHMPRDTLATEDGAGEEQEPPQEEAVEKE

SEQ ID NO: 27910 - protein, 81 aa, Aquila chrysaetos
MEPWVMLDPRQKALYRDVMQESYETLMSLAAQGLVSEKAAEEGAAEESCKELEEHSSRSPEREKTLGSNRRKTKRPDKAMP

SEQ ID NO: 27911 - protein, 81 aa, Aquila chrysaetos
PKVTVSWGAGVRICTQKEWEKLEEWQKELYKNVMKGNYESLISLGKYGGSLPVPRRGEAEEKGWPRAEHVVSGAELEAGSP

SEQ ID NO: 27912 - protein, 81 aa, Aquila chrysaetos
NKNFWILQLPPGDEVPKEWENLEEWQRELYKNVLRGKNESLISLDYVISKPDFLSQLQRGEAPCNGDKEVLEGSTMLAEPG

SEQ ID NO: 27913 - protein, 81 aa, Meleagris gallopavo
LQEPVSFAEVAVYFSREEWALLDPAQRALYRDVMLETYQCVASLASLPVPRRLLISLLEGGEDPWIPDVRCPETVRTDLSP

SEQ ID NO: 27914 - protein, 81 aa, Meleagris gallopavo
SQEPVSFAEVAVYFSREEWALLDPAQRALYRDVMLETYQCVASLAPLPAPKPMLISLLEGGEEPWIPDVRSPEAVPGDLSP

SEQ ID NO: 27915 - protein, 81 aa, Aythya fuligula
FQAAVAFEDVAIYFSPEEWVELAAWQRELYQEVMMDNYDLVACLGSVDTSSKLVPKMEPEEEPCGGASPGEGDRETPDTAG

SEQ ID NO: 27916 - protein, 81 aa, Aythya fuligula
PKVPVTFVDIAVYFSAEEWKNLEEWQKELYNNLVKENYESLISLDAALARSDPQPRLERGEVPCVPEQRDLEPRELPADAC

SEQ ID NO: 27917 - protein, 81 aa, Strigops habroptila
KAPTVVFQSETTCFSAQEWSNLEEQQRELHINELRGKNDPQICLNYTISKHDLLSQLQRGEASCNGDEAASKEVPAELSAA

SEQ ID NO: 27918 - protein, 81 aa, Strigops habroptila
MQRGAVAFEDVAVHFSPEEWGQLARWQRQLYWEVMLDNRDLVASLVSESKFVCKMEAEEESYVGDPCSRGNSGAPDTSGTS

SEQ ID NO: 27919 - protein, 81 aa, Meleagris gallopavo
SQEPVSFADVAVYFSREEWALLDPAQRVLYRDVMLETYECIASLACPAPKPAVISMLEGEEDPWIPEDMAGDLGPGEPVRE

SEQ ID NO: 27920 - protein, 81 aa, Meleagris gallopavo
LKAPEASESDTACFAEQEWENLEEWQKELYKNVLRGNNESLNSLDYAISKPDLLSRLQRGEVPCSEVTSGQKEIPTEPSAA

SEQ ID NO: 27921 - protein, 81 aa, Aquila chrysaetos
RGAVTFEDVAVYFSPEEWVELVAWQRELYQEVMMDNYDLIATLGPESKLTHRMEPREESRGGVPYGGGDGRAPDASGTSAW

SEQ ID NO: 27922 - protein, 81 aa, Aquila chrysaetos
GKMPVTFEDVAVYFSPEEWAELAGWQRRLYREVMLENYQAVASLGWPAVKPEIICKMEREEMPCMPAPPRARWRHRTPVPA

SEQ ID NO: 27923 - protein, 81 aa, Strigops habroptila
MQENYDSLLLLEFPIPKPTVISRLELEEELGVPDPNDSKEWEILRVAPADDGTWSGNDEDPPAPPHPDIPLSHGIKAAASH

SEQ ID NO: 27924 - protein, 81 aa, Meleagris gallopavo
LQEPVSFAEVAVYFSREEWLLDPAQRALYRDVMLETYQCVASMGPLPAPKPVVISLLEGGDDPWIPDVRRWREGGWAVKAL

SEQ ID NO: 27925 - protein, 81 aa, Meleagris gallopavo
MEEPVTFEDIAIYLSRAEWDMVAEEQRELYRSVMLDNYELLASLGYPGPKPDILHRLEHGEEPWVNAPQSPVKWDGPDRLF

SEQ ID NO: 27926 - protein, 81 aa, Meleagris gallopavo
QVPVTFDDIAVYFNEQEWERLDSWQKDLYKAVMRGNYETLISLDYAVSKPDILSRIERGEEDGQELTQTHSPSSEEPLQAH

SEQ ID NO: 27927 - protein, 81 aa, Pogona vitticeps
SVTFEKVAVCFTQEEWALLDPDQRALQREVMEENSRMVTSLDNLKKTAICAKSSKCFVQKMDLVRHWQTHTNVKRITGGKP

SEQ ID NO: 27928 - protein, 81 aa, Meleagris gallopavo
QVPVTFVDIAVYFSAEEWKNLEEWQKELYNNLVKENYESLISLGADAALSRSDTQPRLERGDVPCVPEQQDLEQREMPADA

SEQ ID NO: 27929 - protein, 81 aa, Meleagris gallopavo
LQEPVSFAEVAVCFSREEWALLDPAQRVLYRDVMLETYQCVASLASLLTPKPVLISLLEGGEEPWIPDDFLCHPAGDGLTN

SEQ ID NO: 27930 - protein, 81 aa, Chloebia gouldiae
LQVPVLFEDVAVRFSRQEWASLSKGQKEMYRSVMEGNYEMLVSLYCALSKPELLLQLEREELSTPPESETEEAENCTSDDA

SEQ ID NO: 27931 - protein, 81 aa, Aythya fuligula
QVPTAGEDDAACLPEQEWGGLDSRQQELYRMAVKGSYEAVVSLAGEKIVIKTEEQQPQEEGPESLALPQAPSMRLEEEVPL

SEQ ID NO: 27932 - protein, 81 aa, Aythya fuligula
AEEPVTFVEVAVYFSREEWELLHPAQRVLYRDVMLETYESITSLGLLPSPKPVVISQLEEGEDPWIPDLHGVEDVTGDLSP

SEQ ID NO: 27933 - protein, 81 aa, Pogona vitticeps
EETQKLVTFEDVAVCFTKEEWVLLASDQRSLYKEVMMENYETVFSLVPKSERISHMEQEEELCVQNPLDVEQVEIMDLGSS

SEQ ID NO: 27934 - protein, 81 aa, Pogona vitticeps
PWQFVSFEEVAVYFTKEEWDRLDPGQKTLYTEVMLEIRGMVASLGDGQANENCQRLSLVSWEDEESEDGQDLFGNPEKLNI

SEQ ID NO: 27935 - protein, 81 aa, Pogona vitticeps
GPVTFEEVAVNFTQEEWALLDSDERSLHRDVTVENRQMVASLNCKEYGKSFIHNSVLLTHQKVHRQKLYKCQECGECFPHN

SEQ ID NO: 27936 - protein, 81 aa, Pogona vitticeps
VTFDEVAVNFTEAEWALLDQNQRACHRDVMEETHENVLSLAHEGRHSENQEELCWEDLETFLFKESHLPGRRSEANTYSRN

SEQ ID NO: 27937 - protein, 81 aa, Pogona vitticeps
QGLATFEEVAVSFTQEEWTLLDPDQKALHREVMEEIRGILASLAGNAWKMGKKENPHLVERDSRTTSKAKQNKRNKSIFPG

SEQ ID NO: 27938 - protein, 81 aa, Pogona vitticeps
EWPQNPLTFSDVALYFTEGQWALLDHDQRALYWEVMQENYDHVACLGLPGMAMKLEKEKEPPDVLQWEENTFPEFTVGSPP

SEQ ID NO: 27939 - protein, 81 aa, Pogona vitticeps
AQGPVTFEEVAVYFTDEEWARLDPGQRSLYAEVMFDNYKTVTWLESALSAKPHLISWLEEREKDSFLQSAAEKERLSAKAD

SEQ ID NO: 27940 - protein, 81 aa, Aythya fuligula
PKVPEGFDSSAAGFSEPEWENLEEWQRELYRNVLRGSGESLISLDYAISKPNLLSRLQREVRCDEVDLGEREIPVEPSAAE

SEQ ID NO: 27941 - protein, 81 aa, Pogona vitticeps
VTFEEVAVFFTQEEWALLDPDQKALHQEVMEENWQTASSLEIIHREISVCPHCGKRFRYKLELVEHPRTHTEEERYIREKP

SEQ ID NO: 27942 - protein, 81 aa, Pogona vitticeps
DQSPVTFEEVAVSFTQEEWRLLDLDQKALHQEVMEKNWQMISSLRSVKMPTTGIASSLPEDAALPDQGSVTFEEVAVSFTQ

SEQ ID NO: 27943 - protein, 81 aa, Pogona vitticeps
MGSITFEDVTVYFTQEEWALLDPGQKALHQEVMEENWQTVSSLDIWREKNVCPKCGKSSRHKFKLPEHQRIHTEDKWCIQE

SEQ ID NO: 27944 - protein, 81 aa, Pogona vitticeps
MFEDVAVYFTRGEWKALSEWQKDLYRAVMVENYEAVASSAGDGIRIEEEAEGEGPGPIRPPKARRGRKKRGRPPGTETPAT

SEQ ID NO: 27945 - protein, 81 aa, Pogona vitticeps
QSLKDVLMHFEDIAIHFTEEEWALLDEGKRALHQEVMEENIATLIPLAANGIPLPLSSSGYQMAGAGEQLLLKGVGPGLRH

SEQ ID NO: 27946 - protein, 81 aa, Pogona vitticeps
MFEDVAVYFTRGEWKALSEWQKDLYRAVMVENYEAVASSGDGIRIEEEAEGEGPGPIRPPKARRGRKKRGRPPGTETPATW

SEQ ID NO: 27947 - protein, 81 aa, Pogona vitticeps
QGSVAFEEVAVYFTWEEWALLDPDQKALHQEVMEENWKTASALGAGWRPATNVSSPLPWDGAEPDQGPVTFEEVAVSFTQE

SEQ ID NO: 27948 - protein, 81 aa, Pogona vitticeps
AESLVIFEEVAVRFTEEEWALLDRGQRVLYREVMLGNYEMAISLRTLLLPKPGLISWLEEEEMRDQFTQEAVRWAGVASWE

SEQ ID NO: 27949 - protein, 81 aa, Pogona vitticeps
PVAFEEVAVSFTQEEWALLDLDQRALYQEVMEENWRTVSFLGVERMPSTTIHSFLPSDGAEPDQDPVAFEEVAIYFSQEEW

SEQ ID NO: 27950 - protein, 81 aa, Pogona vitticeps
GVTSVTFEDVTLFFTKGQWNLLDQHQRALYKEVMQENYDNMASLACTMECPFPPRSKKRESMATVEEAQEPVTFEEVAVYF

SEQ ID NO: 27951 - protein, 81 aa, Pogona vitticeps
MEPWVYLDPRQRALYRDVMQESYETLMSLAADKLLNSNNNEEEEDDDDEEEEDEGPEELRPGTSQSIPRRMKPVPRRVAPK

SEQ ID NO: 27952 - protein, 81 aa, Micrurus surinamensis
PWEDPSQDTSGGGQRMKLSGFYDGDQTAVESPNQESLVSFEEVAVYFSEEEWSQLDPDQKVLHSEVMLENHRNVVCLGNNG

SEQ ID NO: 27953 - protein, 81 aa, Micrurus surinamensis
FSAGDEKVEHPTQVLVSFEEVAVHFSKEEWSRLDPDQKSLYREIMLENSRNLAFLRNHVQENKEASQTFGDEERRVQFENP

SEQ ID NO: 27954 - protein, 81 aa, Micrurus surinamensis
LVSFKEVAVYFSEQEWSQLDSDQKALHSEVMVENHRNVVSLGNNMQENQDSCELFQVINAKDGTEKFVIRMEFKSHERNLS

SEQ ID NO: 27955 - protein, 81 aa, Dipodomys ordii
MQVSLEDVAVNFTQEEWECLDTGQRTLYVDVMTEILKNLESVGFKEGKEKEGEEEEEEEEEEEEEHQEPGQDLSNEGTNDK

SEQ ID NO: 27956 - protein, 81 aa, Peromyscus maniculatus
PKVPVSFEDVSVYFTNTEWKLLNLKQRNLYKQVMLENYSHLVSVGFAFSKPNLVSQLERGEKPWITDGGKETAAGSCAGNG

SEQ ID NO: 27957 - protein, 81 aa, Rattus norvegicus
KPGTVSFSDVAVYFSSEEWRCLQPAERALYREVMRETYGLLGSFGIRGAKPALICWVEEETELWGPRAQDPEVAMCKTEVH

SEQ ID NO: 27958 - protein, 81 aa, Rattus norvegicus
YKEPVIFKDVAVYFSQKEWQLLEPAQKDLYKDVMLENYGNLISVEYYIFKPKLITRLEQGIDLFAKENDTPGDPQQGEAGV

SEQ ID NO: 27959 - protein, 81 aa, Mus caroli
VSFEDLVVHFTQDEWDLLAPSQKTLYGDVMLETFRNFTDTGCEWEDQKIGDHSEEPEINLRKIITHSEYTQYECEEYEEKP

SEQ ID NO: 27960 - protein, 81 aa, Mus musculus
PKGLLRFKDVAVDFSQEEWECLDCAQRALYMDVMLENYNNLFFVENLCIFPKYENGLDQDTQHIVHKHVTIQKKSYKYYEH

SEQ ID NO: 27961 - protein, 81 aa, Cavia porcellus
QVPISFKDLAVRFSEEEWRLLEEGQREFYRDVMRENYETLVSVGTAELLPLSAFLLPVEPGGAPRAENRTEQRQEPTAGAS

SEQ ID NO: 27962 - protein, 81 aa, Cavia porcellus
SRALENDGVCFSEQEWENLADWQKELYRNVMQSNYEALVSLKVLGQPEGEAELGAEMLGDLEEEESLVGAHPADGAVLRPE

SEQ ID NO: 27963 - protein, 81 aa, Octodon degus
IQELVTFEDVAVYFTKEEWALLDLTQRDLYRDVMLETFQNLASLGYQIPMPQLISQWEKGEDLLRVKGGLIQGTCMGEQKE

SEQ ID NO: 27964 - protein, 81 aa, Octodon degus
IQGLLTFKDVAIEFSQEEWTDLDPAQRTLYREVMLENYRNLVSLGIHRFDLGVVSMLEQGTEPWSVDGRVKVARNLDEWES

SEQ ID NO: 27965 - protein, 81 aa, Peromyscus maniculatus
LQGLLTFRDVSVEFHQEEWECLDSAQRALYIDVMLENYNNLVFVENYCKCDPVHQHVKTEKESYRCNEVDKVLHDPSTCTL

SEQ ID NO: 27966 - protein, 81 aa, Rattus norvegicus
LWEPLTFRDVAVSFSQDEWLHLDPAQRTLYREVMLENYSNLASLGILSPKPKVISQLEQADFQMVESGMFQGVYLGWKSLF

SEQ ID NO: 27967 - protein, 81 aa, Rattus norvegicus
MLENYRNLVSVGYQLSKPTVISQLEKGEGPWTAESQGPKDSILDVKTKLETKESTSEDDISVKFYHGAMRGRLSEDHIVCS

SEQ ID NO: 27968 - protein, 81 aa, Rattus norvegicus
MASPSPPLESKEEWGYLDAAPRSLYKDVVMDSYGKLVSLDVLNRNEDEEPTVKEEIEKDIEPQGIIVTRIKSELDQDPMGS

SEQ ID NO: 27969 - protein, 81 aa, Mus caroli
FETLNDVAMDFTVEDWKDLESELDQRDLFWDVTLNDYQDMFSFTDTPQPSLTSQPDVREELEATSTEVPETKNSPLQNGFL

SEQ ID NO: 27970 - protein, 81 aa, Mus caroli
SLGPLSFKDVAVAFSQEEWQQLDPEERTTYRDVMLETYSNLVSLGYDIIKPDVIIKLEQGEEPWIVEGAFSPQSYPDEIRH

SEQ ID NO: 27971 - protein, 81 aa, Mus musculus
MNAVTYEDVHVNFTQEEWALLDPSQKKLYKDVMVETYRNLNAIGFNWEAHNIEEYCQSSRRHRRCERSQSAEKPSEYTQCG

SEQ ID NO: 27972 - protein, 81 aa, Mus musculus
SVEMLSFRDVAIDFSAGELECLEPAQWDLYRDVMLENFSHLVFLGFSFSKPLLVRFLEKNQELRNVKRKAATVPRGKKPYK

SEQ ID NO: 27973 - protein, 81 aa, Cavia porcellus
MASPNSPLEPKEEWDYLDPAQRSLYKDVMMENYGNLVSLDVLNRDKDEEPTVKQEIEEIEDEVEPQSVIVTRIKSEIDQDP

SEQ ID NO: 27974 - protein, 81 aa, Marmota monax
VTFEDVVVNFTEEEWALLDPSQRNLYRDVMLEVFRNLAFVENKWHEKNIQDEIKNSEIILRHITSHSEHKSYKHEECEEKP

SEQ ID NO: 27975 - protein, 81 aa, Peromyscus maniculatus
VQEPVTFKDVAVAFTQEEWGQLDIVQRTLYRDVMLETYGHLLSVGNQIAKPEVISLLEQGEEPWSVEQAYPQSTCPEWMRN

SEQ ID NO: 27976 - protein, 81 aa, Rattus norvegicus
MLENYSNLLFLGHCKTKPELIFNLEQRLGSWIVEASHQSIPDFQKVNTLNETSPETKARHVCQVPLNSDTSEELAGIGNTC

SEQ ID NO: 27977 - protein, 81 aa, Rattus norvegicus
VSFEDLVVHFTQDEWDLLEASQKSLYGDVMLETFRNLTAVGYEWEDEAIEDHCEEPEVNLRDIVSHSEYTHEYEHKEYEEK

SEQ ID NO: 27978 - protein, 81 aa, Mesocricetus auratus
YQDLVSFKDVTVDFTQEEWTSLNPAQRCLYRDVMLENYKNLATVGYQLIKPSLVSWLEQEEFSTGQKIVFPEWKMQLETKC

SEQ ID NO: 27979 - protein, 81 aa, Mesocricetus auratus
SQRSVSFKDLAVDFTREEWQCLGPAQRLLYRDVMLETYRNLISLGFRVSKPEVILKLEQGKEPWTVEELPSQNHAGKCEDR

SEQ ID NO: 27980 - protein, 81 aa, Peromyscus maniculatus
PLGSELFRDVAITFSQEEWERLEPAQKDLYREVMLENYGHLVSLGLTISKPDVIAILEQGREPWLEERGTAGGLPSALESG

SEQ ID NO: 27981 - protein, 81 aa, Octodon degus
CEVLVSFEDVIVDFSREEWQQLDSNQRCLYHDVMLENYSHLLSVGFEVPKPEVIFKLEHGEEPWMWEKKTPHYGCSGGTFW

SEQ ID NO: 27982 - protein, 81 aa, Mus caroli
PHKSVKFEDVSLTFTKEEWAQLDLQQKCLYREIMMENYSNMISVEHHFSKPYVISQLEEAEDCWPMQREIPQDTLPECSWP

SEQ ID NO: 27983 - protein, 81 aa, Mus caroli
SKGPLSFKDVAVAFSQEEWQQLDPEERTTYRDVMLETYSNLVSLGYDVTKPNMIIKLEQGEEPWTVEGDRHAQRHLEISKV

SEQ ID NO: 27984 - protein, 81 aa, Blattella germanica
MESDNYGDLSTFFSVTEWDSLTAYEKKRYFNILDNYRKMVTLGLNPKKPSFMHTKTEGEEDSIFNRNNNHFISPKHLKRKD

SEQ ID NO: 27985 - protein, 81 aa, Candidatus Lokiarchaeota archaeon
RKAPPTPPKGKETTTPAITTKKVMKALSEDEWQTIKHLIFKLRIKDMMDARYLQIKLKELVRKDKILMEIKKGKKHWKLKE

SEQ ID NO: 27986 - protein, 81 aa, Halomonas sp. R57-5
LDTFRKLWFTASLEQWSQMDDHQRTLLDSGMIANARKAEPWKAVELFRALADRAELTQRLEHFNQEYHLLMTPSVAIQPFE

SEQ ID NO: 27987 - protein, 81 aa, Aciduliprofundum sp.
IGVAARETALYFPIVPWQNEDEVKKHQWREEGLDPIDSLIEMLRPDSLLNIIKNYLFFRIEHGSATKVIARYMQYRAAEKI

SEQ ID NO: 27988 - protein, 81 aa, Mus musculus
MAKDLRFEDVVIYFSLEEWECLRHSHRNLYRAVMLDNYSNLLSLSLADTKPRVVSLLEQGKEPWMVMRNETKIWHPDWVSR

SEQ ID NO: 27989 - protein, 81 aa, Pan troglodytes
VKIEEVADVAVSFILEEWGHLDQSQKSLYRDDRKENYGSITSMGYESRDNMELIVKQISDDSESRWVAPEHTERSVPQDPD

SEQ ID NO: 27990 - protein, 81 aa, Rattus norvegicus
RDQEVGTALLPSLQEEQWRHLDSTQKEQYWDLMLETYGKMVSGVAGISNSKPDLTNMAEYGEELVGLHLHSAEKMARAPCK

SEQ ID NO: 27991 - protein, 81 aa, Homo sapiens; identical to SEQ ID NO: 871

SEQ ID NO: 27992 - protein, 81 aa, Homo sapiens; identical to SEQ ID NO: 872

SEQ ID NO: 27993 - protein, 81 aa, Mus musculus
VVTKDLVTFNDVAVDITQEDWELMPPVQKELYKTVTLQNYWNMVSLGLTVYRPTVIPVLEEPWMVIKEIVEGPNPEWEPKA

SEQ ID NO: 27994 - protein, 81 aa, Pongo abelii
GMVTFEDMAVSLTWEEWERLDPARRDFCRESAQKDSGSTVPPSLESRVENKELIPMQQILEEVEPQGQLQEAFQGKHPLFS

SEQ ID NO: 27995 - protein, 81 aa, Homo sapiens; identical to SEQ ID NO: 873

SEQ ID NO: 27996 - protein, 81 aa, Homo sapiens; identical to SEQ ID NO: 874

SEQ ID NO: 27997 - protein, 81 aa, Pongo abelii
QEPVTFKDVVVEFSKEEWGQLDSAVKNLYRNVMLENFRNLNSLRKAHLLSKPFESLKLESRKKRWIMEKEIPRKTIFDMKS

SEQ ID NO: 27998 - protein, 81 aa, Bos taurus
SQELLTFKDISVDFTQEEWGQLAPAHRNLYREVMLENYGNLVSVAGCQLSKPSVISQLEKGEEPWMTEKEGPGDPNSDLKS

SEQ ID NO: 27999 - protein, 81 aa, Homo sapiens; identical to SEQ ID NO: 875

SEQ ID NO: 28000 - protein, 81 aa, Homo sapiens; identical to SEQ ID NO: 876

SEQ ID NO: 28001 - protein, 81 aa, Homo sapiens; identical to SEQ ID NO: 877

SEQ ID NO: 28002 - protein, 81 aa, Mus musculus
RDQELGTAVLPPLQEEQWRHLDSTQKEQYWDLMLETYGKMVSGVAGISNSKPDLTNLAEYGEELVGLHLHGAEKMARLPCK

SEQ ID NO: 28003 - protein, 81 aa, Mus musculus
LVKTEDVADVAVSFILEEWAHLDQSQKSLGRDSRKEDCESTTPVDYEPKEGNLEFTVQQVSDAADPHWVAAERTEKNGVQR

SEQ ID NO: 28004 - protein, 81 aa, Mus musculus
NRVSPFKDMILCFSEEDWSLLDPAQTGFYGEFIIGEDYAVSMPPNEPPVQPGHSHEEENGLRVTEWTTDLQDKEIPQASCL

SEQ ID NO: 28005 - protein, 81 aa, Homo sapiens; identical to SEQ ID NO: 878

SEQ ID NO: 28006 - protein, 81 aa, Homo sapiens; identical to SEQ ID NO: 879

SEQ ID NO: 28007 - protein, 81 aa, Pan paniscus
GMVTFEDMAVSLTWEEWERLDPARSDFCRESAQKDSGSTVPPSLESRVENKELIPVQQILEEAEPQGRLQEAFQGKRPLFS

SEQ ID NO: 28008 - protein, 81 aa, Aspergillus steynii IBT 23096
WSITLGKIRCLHALQDWQALSGISEEKWSHASLEHQRAIAPLAVTAAWRLKNWDLIQTLLHGIKPGTADRSFFGAVLAVHH

SEQ ID NO: 28009 - protein, 81 aa, Homo sapiens; identical to SEQ ID NO: 880

SEQ ID NO: 28010 - protein, 81 aa, Homo sapiens; identical to SEQ ID NO: 881

SEQ ID NO: 28011 - protein, 81 aa, Homo sapiens; identical to SEQ ID NO: 882

SEQ ID NO: 28012 - protein, 81 aa, Homo sapiens; identical to SEQ ID NO: 883

SEQ ID NO: 28013 - protein, 81 aa, Homo sapiens; identical to SEQ ID NO: 884

SEQ ID NO: 28014 - protein, 81 aa, Homo sapiens; identical to SEQ ID NO: 885

SEQ ID NO: 28015 - protein, 81 aa, Homo sapiens; identical to SEQ ID NO: 886

SEQ ID NO: 28016 - protein, 81 aa, Myotis brandtii
SQGLVTFKDVAVCFSQEQWDDLDPTQKEFYGEYVLEEDCGIVVSLSFPIPRLDEISHIIEEEPLVPDILEPQEPQEPDILT

SEQ ID NO: 28017 - protein, 81 aa, Balaenoptera acutorostrata
QEAAEFEFLSVDYTQKKWKGPALSQKAALYRNIMPENCCSLASLGENRMESSELPPKQEISEESESSDRTSGILYGVIPGG

SEQ ID NO: 28018 - protein, 81 aa, Cervus elaphus
EDPVTFLDVAVDFSTEEWGLLDPMQRTEYHDVMLETFGHLVSVGWETTLDSKQLTPQPGPPEEGPACPLKEEEGSSADDAR

SEQ ID NO: 28019 - protein, 81 aa, Colobus angolensis
TLTQVGNSGDQAGATILRMVRPQDTVAYEDLCVDYTQKKWKGPALSQRALQWNMMLENDHSMASLGWSTMVRSWLTSISSS

SEQ ID NO: 28020 - protein, 81 aa, Fusarium mangiferae
ELKLIDFLDDAIRFVDTDTEVINLAPLQLYHSVLVFAPTNSIVRKTFVAEIPSCLRRVTGGRTDWDPRLRSLENSAPTLWH

SEQ ID NO: 28021 - protein, 81 aa, Octodon degus
TCEPIAFKDVVMSFSRREWRKLEPSQKELFKDVLLENLKHLEFLGFQVSKLDLISQLKWVELPRLVERKLLKDSRAECEPK

SEQ ID NO: 28022 - protein, 81 aa, Fukomys damarensis
SQEPVKDVHVIRSLSHKKTVHQIPVHRDLYREIRKENVGNTVSLGNTVSPSNKIARLEQRKEPWTVGLHSSNKRNVLQSTY

SEQ ID NO: 28023 - protein, 81 aa, Paroedura picta
QHLFSFEEVAVYFTGEEFALLDPGQIALYREVMLENSGSVAFLARNIRETAVETNKSLASGERLESFSSASPGRNSFPDEL

SEQ ID NO: 28024 - protein, 81 aa, Paroedura picta
GRVTLEEVFVHFTEEEWALLDPDQRRLHQEVMEENGQNVASLESEAQMTSVEEPHHHHLLEKKQQKRIKGTKWTRSCLQNA

SEQ ID NO: 28025 - protein, 81 aa, Podarcis muralis
SLCFEDVAIHFTDEEWALLDPDQRALHQEVMEENRGIMASLGGDELEMKNKGDHNKIRRVEKPQKHLECAESFNQNSNLTS

SEQ ID NO: 28026 - protein, 81 aa, Paroedura picta
PFSFEEVSVSFSEAEWALLDPGQRALHREVMLENCENVAFLEARCITEFMAERGNGLAFQEKLQSSARGSQAEESQGNGEE

SEQ ID NO: 28027 - protein, 81 aa, Micrurus lemniscatus
FLAILPKEIQSWVWQQHPENCGKAVDLVENFLTGLSLLERHGKKALVTFEEVSMYFSEEEWRLLDESQRKIFTKVMMENYE

SEQ ID NO: 28028 - protein, 81 aa, Micrurus lemniscatus
GQIMDMVILEQFLHVLPLGMQAWVRARKPSTSQEAAQLAEAYLEQQCPVAFQDVAVYFTPEEWDLLDNEQRFLYYTVMQEN

SEQ ID NO: 28029 - protein, 81 aa, Podarcis muralis
GPVCFEDVAVCFTDEEWAFLDPDQRALHKDVMEENCGIVASLDKAPCGIIISAWKFTELNSAPYNPWEPNTPTINNCDESE

SEQ ID NO: 28030 - protein, 81 aa, Alligator sinensis
LELQKMFEDVAVYFTRKEWELLEDEDKGLYRDQMLRNYQALVSLGYRGPTPDLIYRIRRGQVELWVYDDEDHEDISRLEYM

SEQ ID NO: 28031 - protein, 81 aa, Podarcis muralis
QGPAPFEKMSVHFMEEKRTLPEPGQASLHRGSAEENTGDLVFLGNGQEGCQEGEGQRRAAEETQKWGAKAFVFEGGEADEI

SEQ ID NO: 28032 - protein, 81 aa, Podarcis muralis
FQGSVSFEDVAVWFTEEEWDLLDPDQRALHNQTMFPPPYSLFFGQETDERKETGIPRVNRGSRSSKRGRKPSVKTRPRENS

SEQ ID NO: 28033 - protein, 81 aa, Alligator sinensis
MELRDAFEDVAVYFTRKEWALLDDGDKGLYRDQMLRNYQAVVSLGYRGPTPDLICRIQRGEVELWVGDDEDCGESSRLEDL

SEQ ID NO: 28034 - protein, 81 aa, Podarcis muralis
GSVSFDEVSVRFTNEEWALLDPGQRALYEEVMEEIREMMTSVGDVWGIQTERETSEVPHERAEEHNAQRKLRVQVGTYRNE

SEQ ID NO: 28035 - protein, 81 aa, Alligator sinensis
LELREVFEDVAVYFTWEEWELLEEEDKVLYWDQMLKNYQALVSLGYRGPTPALICSIQQGQVELWGCDDETRGKISRSEEL

SEQ ID NO: 28036 - protein, 81 aa, Podarcis muralis
SVSFEDVAVCFTAEEWALLDPAQRALHKEVMEETWRTMISLGGDELEMKNKGDHDEIHTEEKPYKNLECAKSFSQSSQSTS

SEQ ID NO: 28037 - protein, 81 aa, Podarcis muralis
VCFEDVTVCFTDEEWALLDPDQRALHKDVMEENHGIVASLGKAPCEIVRFTRSSSLSSHHRIHTGEKPYQCVECGKSFRQS

SEQ ID NO: 28038 - protein, 81 aa, Alligator sinensis
SELREVFEDVAVYFTRKEWELLDDEDKVLYQDQMLKNYQALISLGYRGPTPDLISSIERGQVELGECDEEDSGEISRSEDV

SEQ ID NO: 28039 - protein, 81 aa, Paroedura picta
PPFSFEEVAVSFTEAEWALLDPGQRALHREVMLENYGSVASLETKSIRAKLAETDNGLASEERLESFSSGSQEHVSFPDQL

SEQ ID NO: 28040 - protein, 81 aa, Paroedura picta
AQGPVSFEEVAVHFSPGEWSLLRPAQRALYKEVMLENFGHVASLGCLLAKPGLVSWLEEEVQPFALGAEHEEGLPDGGSAV

SEQ ID NO: 28041 - protein, 81 aa, Alligator sinensis
DKGLVTFKDVAVYFTKEQWALLDPGQKALYRDVMQENYETVTSLGLLIPKYNMISQLEEGTKPWSPDPQGEIPRDADTHKA

SEQ ID NO: 28042 - protein, 81 aa, Paroedura picta
VQGPFSLEEVSVSFTEAEWALLDPGQRALHREVMREISQDLAFLAKEARSTGQTVGETEEGPASQGRLPPSSKEPPDQISS

SEQ ID NO: 28043 - protein, 81 aa, Paroedura picta
QHPFSFEEVAVSFAEAEWELLDPGQKALYREVMLENCGNLASLDARREAAVETDKGLAPAEGLENFSRASQEHISFPSELA

SEQ ID NO: 28044 - protein, 81 aa, Alligator sinensis
PETVVSFEDVAVRFSPDEWHLLDDGQRRLYRDVLRENYSHVRSLGFPVPDLAVIFRMERGEEPWPPGLPAGTKSDDQEEER

SEQ ID NO: 28045 - protein, 81 aa, Alligator sinensis
MELQEVFEDVAVYFTWEEWELLEDEDKVLYWDQMLKNYRALVSLGYRGPTPDLICHIQQKQVELWVCDVENYGEISSLEDL

SEQ ID NO: 28046 - protein, 81 aa, Paroedura picta
LEKLATFEDVAVCFTEEEWSVLDSGQRALYREVMVENYRNVGLLEHLLIPKPELICWLEEEELREGCTDTGERSAGEKHEN

SEQ ID NO: 28047 - protein, 81 aa, Podarcis muralis
GSVSFDEVSVRFSNEEWALLDPGQRALYEEVMEEIREMMTSVGDVWGIQTERETSEVPHERAEEHNAQRKLRVQVGTYRNE

SEQ ID NO: 28048 - protein, 81 aa, Alligator sinensis
MEVREVFEDVAVYFTWEEWELLEEEDKGLFQDQMLRNHQALVCLGFRGPTPDLICHIQPGQVELWVCDDEDRGEMLRSEDL

SEQ ID NO: 28049 - protein, 81 aa, Podarcis muralis
PVCFEDVAVRLTDGEWAMLDPDQRALHKDVMEENWGIVASLDCDELESKNKGDHNTICRVEKAHKNLQCGKSCSQSSHSTS

SEQ ID NO: 28050 - protein, 81 aa, Alligator sinensis
MELREVFEDVAVYFTWEEWELLEEEDKELYRDQMLKNYQALIFLGYQGPTPDLLCRIQSGQVQLWVCDDEDSGEILRSEDL

SEQ ID NO: 28051 - protein, 81 aa, Alligator sinensis
LELQEVFEDMAVYFTRKEWELLEDEDKVLYRDEMLKNYQALVSLGYRGPTPALICSIQQGQVELWVCDDEDSGEISRSQDL

SEQ ID NO: 28052 - protein, 81 aa, Alligator sinensis
LELWEVFEDVAVYFTRKEWELLDDDDKVLYQDQMLKNYQALVSLGYRGPTPDLICSIQKGQVELWVCDGEDRGEISGFMGK

SEQ ID NO: 28053 - protein, 81 aa, Paroedura picta
EKRDQLIPYQRGGFCDAEWALLDRGQRALYRDVMLENYGMVASLEGDQGTEEDNEMHRLLPEEVKAADLGGNFSHRVEKRD

SEQ ID NO: 28054 - protein, 81 aa, Paroedura picta
DQGPLTFDQVAVHFTDGEWALLDADQRALHREIMEGNCQNVASLEGPLIRNLDFNSWQEEGDARFVQVPKEESLRSCMGSV

SEQ ID NO: 28055 - protein, 81 aa, Alligator sinensis
ELQEVFEDMAVYFTRKEWELLEDEDKVLYRDEMLKNYQALVSLGGVWMLSRAEEQPTAEGSADLEPAQASPGSLGEMDSLR

SEQ ID NO: 28056 - protein, 81 aa, Paroedura picta
PVSFAEVAVDFAEAEWALLDPAQRALYLEVMQENYGSVAFLEEASNVRDTAWEPDRGLVSVGGLESFSRGSSETVSFLNDP

SEQ ID NO: 28057 - protein, 81 aa, Paroedura picta
VQGPFSFEEVAVSFTEAEWALLDPSQRALYREVMLEIDGSVATLGDDLRKEKDQDLHNLSSDEVKSEDLKAAEVLSDVLQK

SEQ ID NO: 28058 - protein, 81 aa, Paroedura picta
VQCPFSLEEVSVSFTEAEWALLDPGQRALHREVMLENYGNVAFLAKNDRRNEEGDKLHQQMPDTSKNEDLQENVRNRGRPK

SEQ ID NO: 28059 - protein, 81 aa, Paroedura picta
AQGLVTFEEVAVCFFEEEWALLDRDQRALYQEVMMENYDNVAALGLWIPKPELISWLEGGEDAFIRDSKEVEGFAGDTTVN

SEQ ID NO: 28060 - protein, 81 aa, Paroedura picta
KAALVTFEEVAMYFSEEEWRLLGETQRQIYREVMLDNYGNVQSLGFPIQKPYLISRMESGKDQDPCFCDPPKSDRKEARKD

SEQ ID NO: 28061 - protein, 81 aa, Paroedura picta
PVTFEEVAIYFTKDEMALLDLAQKALYAEVMLENYIAVVSLGDVLGSKTEGELPQLLLGGAKDAEKMGSQHRAKETQRSRS

SEQ ID NO: 28062 - protein, 81 aa, Podarcis muralis
QGLVCFEDVAVHFTDKELALLDPDQRALHEEVMEENCGLLDSLGGDEMEINNKGNQERVHTVEEPYKYSDGEDNFSQSSQT

SEQ ID NO: 28063 - protein, 81 aa, Podarcis muralis
EKALVTFEEVGVYFFEEEWRFLDETQRQIYREVMLENYENVRSLGFPTRKPDLISKMESSKNPVPCFQDLQESKKGVPPRD

SEQ ID NO: 28064 - protein, 81 aa, Paroedura picta
SLMFFEEVAVFFTREEWALLDSGQRKVFWEVMEENYEAVTSLGAYLGEMVGEKEPGRVILKKDEAKFRDQVIPKRQKRTKR

SEQ ID NO: 28065 - protein, 81 aa, Alligator sinensis
SKILEAFEDVAVFFTREEWELLEAGDKGLYQDQMLRNYQALVSLGLQGPAPDLICRMQLGEMELWVCDDEEAGESSLSEDF

SEQ ID NO: 28066 - protein, 81 aa, Alligator sinensis
MELQEVFEDVAMYFTREEWELLEEEDKGLYQDQMLRNYQALLSLGYQGPTPDLIGRIQRGQVELWVCDDEDRGEISKSEDL

SEQ ID NO: 28067 - protein, 81 aa, Paroedura picta
NKGLVTLEDVSVHFTPEEWALLDPGQRALHTEVMMENCRNLASLVELLILESDLASWLEEGQDPFSQGVEGGERMSGREVK

SEQ ID NO: 28068 - protein, 81 aa, Paroedura picta
PAASVEPEQASVEEEWALLDPDQRRLHREVMEENRQGVSSLEADFSHNKSKAEPQQHPLEEKPERRNPGTKQGRENEWPVS

SEQ ID NO: 28069 - protein, 81 aa, Lithobates catesbeianus
IRCQDVTVYFSMKEWEYLEGHKDLYKDVMMENQRTFSHGHIIKKPYHLSKVILNHTLEVINLLTGEVKMILGLYNHITYLC

SEQ ID NO: 28070 - protein, 81 aa, Lithobates catesbeianus
INLLTGEVPIRCQDVAVYFSMEEWEYLEGNKDLYKDIIMENQPPLTSPGKRRFYCKGESSTEGPLRLTSNAESIPIFSLCL

SEQ ID NO: 28071 - protein, 81 aa, Terrapene carolina
EELVTWKEETVCSSGAERAELDPGQSEICREVKEENKEDILILLEGFTIPDLAAIPRMEPEEEPRVPNLQGSEEREIPKGA

SEQ ID NO: 28072 - protein, 81 aa, Terrapene carolina
PYACCECGKTAAAARPYACCECGKTFTRGSHLIRHQRTHTGTRPYEIWFPLSKPEVMSQLEPGEEPWVSDLQGSEAREILI

SEQ ID NO: 28073 - protein, 81 aa, Paroedura picta
VQSPFAFEEVAVSFTEAEWALLDLGQRALYREVMLENYGSVASLEGDQSNEEDEQLEIKNEVQRGSIRSQGRPRREGGSHA

SEQ ID NO: 28074 - protein, 81 aa, Paroedura picta
HFLAVLPGEMQSWVRECEPETCAQAVAAAEDFVMFLEQQGLVTFEEVAVRFTEEEWALLDQDQRALHSEIMQGNFANVAYL

SEQ ID NO: 28075 - protein, 81 aa, Paroedura picta
CPVSFEEVAVYFTEAEWALLDQGQRALYREVMLDNYRSVASLSRNGRGTTVETEEGLESSSRGFQQNVSFPSELSAAGDAE

SEQ ID NO: 28076 - protein, 81 aa, Alligator sinensis
MELREVFEAVAVYFTRKEWELLGDEDKVLYRDQMLRNFHALVSLGYRGPTPDLICHIRRGEVELWVCEEEKLGENPWSGSL

SEQ ID NO: 28077 - protein, 81 aa, Paroedura picta
QSLPSFEEVVVDFTEAEWALLDLGQKALYREVMLENYGSVAFLEDNRGNEEDEELHHLSPGELKKEDLRENIRNQDGPKRQ

SEQ ID NO: 28078 - protein, 81 aa, Paroedura picta
VSLEEVDVDFTREEWELLDPGQRALAMEVTLENFGNVASLEADGARNKSKGESQQHLLEEQLDGRNPGMKQERGNKFPASP

SEQ ID NO: 28079 - protein, 81 aa, Paroedura picta
LCRGMETSGPPLGQAEWALLDPGQRALYREVMQENYGNVASLARNVKETMVETDKGLALEEWLESFSRRCRERISLPDEQP

SEQ ID NO: 28080 - protein, 81 aa, Paroedura picta
SEVEGDIHVQDVLPCGTGEMPFGCHLFGAVEMTDSLPVQVPFSFKEVSVSLTEAEWALLDPSQRALYREVMLENSETVISL

SEQ ID NO: 28081 - protein, 81 aa, Paroedura picta
EKNQEQQISKYHFIVRRLCHQTRETPSFCDRIATMKPEQGRVTLEEVSVRFSEEEWALLDPDQRNLHQEVMEENGQNVASL

SEQ ID NO: 28082 - protein, 81 aa, Paroedura picta
VEGPVSFEEVAVYFTEEEWALLDLGQRALYREVMMENFGSVAFVEGPWTCKPDLISWLEEVGEILVQDSAKVKASTADLPC

SEQ ID NO: 28083 - protein, 81 aa, Paroedura picta
KAKQEAPAGFGTASLTLLGPSPLCPGVGGAIIRPARTEEGPVSFEEVDVDFTQEEWELLDPGQRALAMEVTLENLGNVASL

SEQ ID NO: 28084 - protein, 81 aa, Paroedura picta
PEEWQRAQAQEALSHGSGGTLSSPGLFRGVEMTPAPPVQFMFSFEDVAVYLTEAEWALLDPGQRALYGEVMLENYGNVASL

SEQ ID NO: 28085 - protein, 81 aa, Paroedura picta
SKGSVSFEEVAVYFTEEEWALLDPGQRALYTEVMLEIYGNLASQGLWTCKPDLISWLEELDAVFVQDSEDKESSTGTSLDV

SEQ ID NO: 28086 - protein, 81 aa, Alligator sinensis
NELLEAFEDVAVYFTQKEWELLEAGDKELYRDQMLRNYQALVSLGYQGPAPDLICRIQRGEMELWVGDKKAAGESSLSEDL

SEQ ID NO: 28087 - protein, 81 aa, Paroedura picta
DQSPVTFEEVHVYFTEEEWSLLDPDQRALYIEVMLENCGNVASLDGGLQWKDTLCCLPFGEGKGATMKPAQGGVSFEEVAV

SEQ ID NO: 28088 - protein, 81 aa, Paroedura picta
GRVTLEEVSVYFTQEEWALLDPDQRNLHQEVMAENGQNVASLENDVPQNTYKEEAQRFIFEEKEQRRNTETEWEVGNESSS

SEQ ID NO: 28089 - protein, 81 aa, Paroedura picta
SDEGLVSFEEVAVRFTEEEWALLSQGQRALYKEVMLENYENVTFLSFLRPDSLSCLEEDEGPFGLDSEEEEWSAATEMAAT

SEQ ID NO: 28090 - protein, 81 aa, Microcaecilia unicolor
RKVSVTFSDVAACVSEEEWEILDDWERDLYRNVMREIHMVLISLGYTIVNPNVLLRIKPGEALNFRDPVDFEGTVGMRSPG

SEQ ID NO: 28091 - protein, 81 aa, Pantherophis guttatus
PGSSKEAVQLAMAYHKQEPAKPIQDMITFEDVSIHFTAEEWTLLDHKEKNLYWNVMHQNYDNVACLGKNSEEILERSSSED

SEQ ID NO: 28092 - protein, 81 aa, Pantherophis guttatus
LVSFEEVAVSFSEEEWSQLDPDQKALHSEVMLENHRNVVSLGNNGQENQDSCELFQVINAKDGTEKFGIRMEFESHERNQS

SEQ ID NO: 28093 - protein, 81 aa, Pantherophis guttatus
LVTFEEVAVHFSEEEWSQLGPDQKELHWEVMVENHRNVASLGNNVQENQDSFEMFQVINAGDGTEKSAIQKEIERHERNQL

SEQ ID NO: 28094 - protein, 81 aa, Pantherophis guttatus
VSFEEVAVYFSKEEWSQLDSDQKALHGEVMLENSRNLASLGYNGQENKNCNKECQPIYLKEGKGKQYQCMERGKAFTHSSN

SEQ ID NO: 28095 - protein, 81 aa, Pantherophis guttatus
QQCPVAFQDVAVYFTPEEWDLLDNEQRILYYTVMQENSENVTSLELLISKPDPYLQLDWGEISQMADLQTMKGKDTIDQGI

SEQ ID NO: 28096 - protein, 81 aa, Pantherophis guttatus
VSDSDPFEEVAMDFTEEEWALLDSGQKALCREVMLEVSMNLAALAGDGDSDELGNEDEKQPPLLTLQKAPSAKSHAFSFTS

SEQ ID NO: 28097 - protein, 81 aa, Xenopus laevis
RKTPTAFNRIAVYFSDEEWEMLEEWQRDLYKNTMKENSEALTSLGYSNISPNILLKIKDEDVMRFTSDCSPEDVEQADNPN

SEQ ID NO: 28098 - protein, 81 aa, Pantherophis guttatus
NHMSFEDIAVFFSEEEWALLNPDQKLLYREIMLENARNVTCIGERWENEDSKKEMIEHLPTVNNEITERMFRCQWGVQSPE

SEQ ID NO: 28099 - protein, 81 aa, Pantherophis guttatus
ATIEELAVYFTEEEWVLLDPDQKALYKQIMEENFEIVTSLRHDQYKVKENPTGTKPYMCLECGKSFGYKINLTSHQRIHTG

SEQ ID NO: 28100 - protein, 81 aa, Pantherophis guttatus
LVSFEEVTVYFSKEEWSQLDPDQRALHWEVMLENHRNLVSLGKGLLRSTHKIWEDSFKLDEMNYFFFLFVISLLKISCRNK

SEQ ID NO: 28101 - protein, 81 aa, Pantherophis guttatus
GLVSFEEVAVYFSKEEWSQLAPDQKLLHSEVMLENHRNVASLGNNGQENKDTEEPFQVFNAGDETEKSEIQMEIESHERNQ

SEQ ID NO: 28102 - protein, 81 aa, Pantherophis guttatus
GLVFFEQVAVCFSEEEWSQLDAQQKVLHWEVMLENHRNVASLSNNGEENEESEDLFQTMSRKYSTKNYAIQMVVESHERNH

SEQ ID NO: 28103 - protein, 81 aa, Pantherophis guttatus
GLVFFEEVAVYFSKEEWCQLDAQQKVLHWDVMLENHRNVASLSNNGEENEDSEDLFQTMSHKYSTKNPAIQMVVKSHERNQ

SEQ ID NO: 28104 - protein, 81 aa, Notechis scutatus
LATIEELAVYFTEEEWILLDPDQKALYKQIMEENFEIVTSLRRDRYKTKEHLTGTKPYMCLECGKSFGYKNHLTCHRRIHT

SEQ ID NO: 28105 - protein, 81 aa, Pantherophis guttatus
SVSFKEVAVYFSKEEWSRLDAHQKALHKEVMLENSRNVASLGGNEQGNKKCKEILQTLMLEEGKELFANQTEPKTRGESHS

SEQ ID NO: 28106 - protein, 81 aa, Pantherophis guttatus
PQDVVSFEEVAVYFSEEEWSQLDADQKALHGEVMLETIRNLSSLGKMSAKRKSYSVEFKKGIVEDSLGKNLVAFCKEKKLD

SEQ ID NO: 28107 - protein, 81 aa, Pantherophis guttatus
VSFEEVAVYFSEEEWSQLDPDQKALHSEVMLENHRNVVSLDTETGSHLWSLQGKLFSWGKKKKGGITWRAQLWSTRNGPVK

SEQ ID NO: 28108 - protein, 81 aa, Pantherophis guttatus
DFVSLEEVTVHFSKEEWSQLDPDQKALHGEVMLENSRNLVYLGYNGQESKNCKEECQAIHSKGRKGKFADQMQPKSDETKQ

SEQ ID NO: 28109 - protein, 81 aa, Pantherophis guttatus
MVPVSFEDVAVYFTDEECPLLNASQVALQLEVMVENYQNMTSLGREAWWNEDEDESQRVSLKRARSTQEGLQSEGTEERVK

SEQ ID NO: 28110 - protein, 81 aa, Pantherophis guttatus
LVSFEEVAVYFSEEEWSQLDPHQKALHSEVLLENYRNVASLGNNGQENKESMEPFQKFRLGNRTEKPANQMEQQKQERNPS

SEQ ID NO: 28111 - protein, 81 aa, Pantherophis guttatus
LVSFEEVAVCFSKEEWTQLDPRQKALHGEVMRENLRNVASVDTVGQENTCYRQILEALRRKEGRDQTELKSHERNQSKYGS

SEQ ID NO: 28112 - protein, 81 aa, Pantherophis guttatus
LVSFKEVAVYFSKEEWSQLDPDQKALYSEVMLENYRNVVSLGNNGQENQDSCELFKVINAKDGTEKFGIQMELETHNRKQS

SEQ ID NO: 28113 - protein, 81 aa, Pantherophis guttatus
LVSFKEVAVSFSEEEWSQLDSDQKALHLEVMLENHRNVVSLGNSEQENQDSCELFQVLNRNDGTEKFGIQMELESHEKKQS

SEQ ID NO: 28114 - protein, 81 aa, Pantherophis guttatus
LVSFKEVAVYFSEEEWSQLDPDQKALHSEVMLENHRNVVSLGNNGQENQDSCELFQVINAKDGTEKFGIRMELETHDRNQS

SEQ ID NO: 28115 - protein, 81 aa, Pantherophis guttatus
VSFQDVVVCFSKEEWALLDSTQKSLHGEVMEENSRHVASLEADENSENWQPSDTATSQPTRAKVGNEIFENRRRSGTFGEK

SEQ ID NO: 28116 - protein, 81 aa, Pantherophis guttatus
QQWPVAFEEVAVYFTPEEWDLLDEEQRILYYTVMQENSENVTSLELLVSKPDPRLQTVWEEGLQMADLQIFKEKDSIVKGI

SEQ ID NO: 28117 - protein, 81 aa, Pantherophis guttatus
QKCPMAFQDVAIYFTQDEWDLLNEEQRILYYTVMRENSENITSLELLISKPDQSLQSDWDEEAQRAFKGKDSIEEVVNWED

SEQ ID NO: 28118 - protein, 81 aa, Xenopus laevis
AQDPVTFDDISVYFSRDEWALLDAGQKQLYREVMAENYRALVSVGYVMEEPGLVSHIEHEQQGSPIRSRSSLHAGRHCGFI

SEQ ID NO: 28119 - protein, 81 aa, Alligator mississippiensis
REAFGDVAMYFTREEWELLEEEDKGLYRDQMLRNHQTLVSLVFCFVVCSPNRSQPAVLHGQTLKTEPVAVLQEVLQEHSSE

SEQ ID NO: 28120 - protein, 81 aa, Alligator mississippiensis
DKGLVTFKDVALYFTKEQWALLDPGQKALYRDVMQENYETVTSLGLLIPKYNMISQLEEGTKPWSPDPQGEIPRDADTQKA

SEQ ID NO: 28121 - protein, 81 aa, Notechis scutatus
IRDPEGKKNPSNPPRELFFRKIPWEDPRQDPSGEKQRMKISGFYEGDQTAVEPPNQEGLVSFEEVAVYFSEEEWSQLDPDQ

SEQ ID NO: 28122 - protein, 81 aa, Notechis scutatus
LVSFEEVAVYFSEEEWSQLDPDQKALHLEVMLENHRSVVSLGNNGQGNQDSCELFQVISAKDGTEKFGIQMELESHETNQS

SEQ ID NO: 28123 - protein, 81 aa, Pantherophis guttatus
SKELMDLKDAGVSLNVVEPTPIQSGQQTMFWQVMQEEDGDAESLEGLLVPKPDLASNPEEGEEEPSYIQFPVDSERIPNHE

SEQ ID NO: 28124 - protein, 81 aa, Pantherophis guttatus
VSFEEVAVYFSKEEWSQLDSDQKALHGEVMLENSRNLASLGYNGQENKNCNMECQPIYSKEGKGKQYQCMECGKTFTHSSN

SEQ ID NO: 28125 - protein, 81 aa, Pantherophis guttatus
DSDPFEEVAMDFTEEEWALLDSGQKALCREVMLEVSMNLAALGDGDSDELGNEDEKQPPLLTLQKAPSAKSHAFSFTSPNI

SEQ ID NO: 28126 - protein, 81 aa, Xenopus laevis
RKTPTTFNRIAVYFSDEEWEMLEEWQRDLYKNMIKENSEALTSLGYSNINPNILKIKDEDVKHFTADCSPDDVEQADSPKA

SEQ ID NO: 28127 - protein, 81 aa, Pantherophis guttatus
ISFKELFVFFTKEEWDLLDPKQKALHGEVMLETSWNVASLYNERKNEIYQEPEDKPLQVFKVKVGEETFQNQWQRISEDGI

SEQ ID NO: 28128 - protein, 81 aa, Pantherophis guttatus
DPFEEVAVDFTEEEWALLDSSQKALCREVMLEVTRNMAALGDGDGLENEKQLKLQRAVSSKSQSDFCTRHNLTHHQRSHSS

SEQ ID NO: 28129 - protein, 81 aa, Notechis scutatus
DPVSFEEVAIHFTSEEWSLLDLGQKALHQEVMLETCRIMASLDDEPKNENDQEPNVLPSQIILESAKKSGRKRCEKNQSCN

SEQ ID NO: 28130 - protein, 81 aa, Pantherophis guttatus
SPNQESLVSFKEVAVSFSEEEWSLLDPDQKALHSEVMLENHRNVASLGEKPYKCMECGKTFAQRGHLTSHKMIHTREKPYK

SEQ ID NO: 28131 - protein, 81 aa, Pantherophis guttatus
EKQRMKLSGFSDGDQTAVEPPNQESLVSFEEVAVSFSEEEWSQLDPDQKALHSEVMLENHRNVASLGKSSLVSNQRVQEDR

SEQ ID NO: 28132 - protein, 81 aa, Pantherophis guttatus
LVSFEEVAVYFPEEEWSQLDPHQRALHWEVMVENYKNVVSLGENENDNKDSGEPIKVFRQGDVMEKPAIQSEFQRQERNLS

SEQ ID NO: 28133 - protein, 81 aa, Pantherophis guttatus
LVSFKEVAVSFSEEEWSLLDPDQKALHSEVMLENHRNVASLGNNGQENQDFCELFQVIDAKDGTEKFGIRMELETHERNQS

SEQ ID NO: 28134 - protein, 81 aa, Notechis scutatus
GVSFEDVAVYFSKEEWSQLDADQKELYRAVMLENSRNLASLGYNGQKNKNCKEKCQAIHLKEGKEKRYQCMECGKMYTQSS

SEQ ID NO: 28135 - protein, 81 aa, Notechis scutatus
LVSFEDVTVFFSEEEWALLDFDQKSLYREVMLENAKHVESMVDKQEPENYKESDVNSLKQTETGEGILQNQEEPNMIENQL

SEQ ID NO: 28136 - protein, 81 aa, Notechis scutatus
GVVSFEDVAVYFSKEEWSQLDADQKALHGEVMLENSRNLFSLGFNGQEIKNCNEECQAIHRKKEKGKFADQTQSNSDETKQ

SEQ ID NO: 28137 - protein, 81 aa, Notechis scutatus
GSGPFEEVTVDFTLEEWELLDSGQKTLCREVMWEILKNMAALGGDGLENENSKQAKLKTEKGEVEEVIFGHEEDTRRQERN

SEQ ID NO: 28138 - protein, 81 aa, Alligator mississippiensis
ESMEHQEVFEHMALYFMRKEWELLEDADKVLYRNQMLKNYQALVNLGSLGEMDSLRSEKEPWHKSHGRPQKQKNIAVNEHQ

SEQ ID NO: 28139 - protein, 81 aa, Notechis scutatus
RKLSLVFLERPSLCDRAERVAEPLPQGGVSFEEVAVHFSEEEWSQLDPAQKALHGEVMLENSRNLASLGKNLCAQKCREGM

SEQ ID NO: 28140 - protein, 81 aa, Notechis scutatus
GVSFEEVAVYFSKEEWSQLDADQKALHREVMLENSRNLASLGYNEQKNKNCKEEGQAIHLKEGKEKRYQCMECGKTYIHSS

SEQ ID NO: 28141 - protein, 81 aa, Notechis scutatus
VVLGETSLSGETETNVGLPGQGTISFKELFVFFTEEEWDLLDPKQKALHGEVMLETSWNVASLCKKSPIQIWCFVIGSHLF

SEQ ID NO: 28142 - protein, 81 aa, Alligator mississippiensis
MELREAFEDVAVYFTRKEWERLEDGDKGLYRDQMLRNYQALISLGFLSTPCNSVIWGQATAPHGCCGSMKSPVIHGSYYPP

SEQ ID NO: 28143 - protein, 81 aa, Notechis scutatus
LDHVMLEEVSVTFSEEEWALLDPDQRALHRDVMAENSGIASSLGSDWLESESGEIYEILFGKIGSEEEDKQRPDTEAGKVK

SEQ ID NO: 28144 - protein, 81 aa, Notechis scutatus
DIVTFEEVAVYFSKEEWSQLDADQQELYREVMLENSRNLLSLGFNGQENKKCKEERQAIHSKGAERKFVDQMQPKSDETKQ

SEQ ID NO: 28145 - protein, 81 aa, Notechis scutatus
PLSTSTAINFSGEEWTLLDFDQKTIYTEVMLENAKIVASIRDEQKFEDDKKPVAEKLQAVKNKIKETFFENPQGPKRPKEN

SEQ ID NO: 28146 - protein, 81 aa, Alligator mississippiensis
GEAPVTFEDVAVYLTTEEWKELVDWQRELYQDVMKENYELATSVEAVLEKPEIVARLERGEEPYVADLLDSRKGRRAGSPS

SEQ ID NO: 28147 - protein, 81 aa, Notechis scutatus
QEDQSQDATQESRKLTVDFLESPLCAGAEPVLQDIFSFEEVAVYFSEEEWSQLDADQKALHAEVMLENSRNLFSLCKKPFL

SEQ ID NO: 28148 - protein, 81 aa, Notechis scutatus
IVPFEEVAVYFSDEEWSQLDPHQKGLHREVMLENYRNAASLGNNGQENTESIEPFQKFRLGNRTEKPANQMEQQRQERNLS

SEQ ID NO: 28149 - protein, 81 aa, Notechis scutatus
SISFKEVAIYFTKEEWALLDPDQKALHEEIMLETCRNVAFLSNERKNKQETEIEPLRVIKVEVGEETFQNQCPSKNPEEIQ

SEQ ID NO: 28150 - protein, 81 aa, Notechis scutatus
SVPFEEVAVEFTEEEWALLNSGQKALCREVMLDVSANIASLTGDCDWNGLENKKDKQQRLLKRQRGVSAESHSFSFTIPNI

SEQ ID NO: 28151 - protein, 81 aa, Alligator mississippiensis
PETVVSFEDVAVRFSPDEWHLLDDGQRRLYRDVLRENYSHVRSLGFPVPDLAVIFRMERGEEPWPPGLPAGEWPWGQGQAP

SEQ ID NO: 28152 - protein, 81 aa, Alligator mississippiensis
TRDPGQLHRGQGKPPKQELREAFEDVAVYFTQKEWELLGDEDKELYRNQMLRNYQALVSLGAIDSLLQSLSTTWVSRTIVY

SEQ ID NO: 28153 - protein, 81 aa, Notechis scutatus
LVSFKDVAVYFSEEEWSRLDPDQKALHSEVMLENHRNVVSLGNNGQENQDSYELFQVINAKDGTEKFGIQIEFESHERNQS

SEQ ID NO: 28154 - protein, 81 aa, Notechis scutatus
VSFEEVAVHFSKEEWSQLDTDQKALHGEVMLENSRNLASLGYNGQKNTNCKEECQAIHSKEGKGKQYQCIECGKIFTHSSS

SEQ ID NO: 28155 - protein, 81 aa, Alligator mississippiensis
GRPPNQGETVELPKVFEEVAVYFTRKEWELLEDEDKVLYRDQMLKNYQALVSLDHTPITVIRRNGLGAGPSENQFSFPEDL

SEQ ID NO: 28156 - protein, 81 aa, Notechis scutatus
FRRIPWEDQSEDISKEKQRMKFSVFYDGAQTAVDPPNQGSLVSFEEVAVYFSEEEWSQLDSDQKALHSEVMLENYRNVVSL

SEQ ID NO: 28157 - protein, 81 aa, Alligator mississippiensis
RISPGRLEESGSRTPEPGQVQKGQDRPPKLGETLELWEVFENVALHFTRTEWELLEDEDKVLYRDQMLRNYQALVSLVLSS

SEQ ID NO: 28158 - protein, 81 aa, Notechis scutatus
LVSFEEVAVYFSEEEWSQLDPDQKALHSEVMLENHRNVVSLGNNGQENQDSCELFQVISAKDGTEKFGIRMEFENHKRNQS

SEQ ID NO: 28159 - protein, 81 aa, Notechis scutatus
DLQSLEDLAVHFSKEEWSQLDPNQKALHGEVMLEISRNVAFLSVNGQENENDKELCQTISQKAGKEKIQVQQNHVGESFIF

SEQ ID NO: 28160 - protein, 81 aa, Notechis scutatus
EGLVSFEEVAVYFSKEEWSQLDPDQKVLHLEVMLENHRNVASLDNSKENKDTEEPFQVFNAGDETQKSEIQMEIESHERNQ

SEQ ID NO: 28161 - protein, 81 aa, Notechis scutatus
GLVSFKEVAVYFSEEEWSELDPDQKALHWEVMMENYRNVASLEDEWEMLSSGHEAAAPLPKDKVKTAETFFGKQNSEEKRL

SEQ ID NO: 28162 - protein, 81 aa, Notechis scutatus
VQDFVTFEDVAVYFSAEEWSQLDPDQKALHKEVMLENYRNVASLEKLLYRCRECGESFSSNSSLISHQITHTGVKPYKCME

SEQ ID NO: 28163 - protein, 81 aa, Alligator mississippiensis
KLREAFEDVAVYFTQEEWELLEEEDKGLYRDQMLRNYQALISLGKALVLALPWSHSGYEKRIRPHGTTIVAAAAFLDAFQK

SEQ ID NO: 28164 - protein, 81 aa, Alligator mississippiensis
RLGERSSLTPEPGQVQKGQSRPPKQEESLELQEVFEDMAVYFTRKEWELLEDEDKVLYRDEMLKNYQALVSLGKALVLASP

SEQ ID NO: 28165 - protein, 81 aa, Alligator mississippiensis
VQKGQGMPPNQEESSELREMFEDVAVYFTRKEWELLDDEDKVLYRDQMVKNHQALISLGKALGLASPRRYANSFVVTSLFQ

SEQ ID NO: 28166 - protein, 81 aa, Notechis scutatus
GVSFEDVAVYFSKEEWSQLDPVQKALHGEVMLENSRNLASLGYNGQKNKNYKEECQAIHFLCKGKRYQCMECGKSFSYYIS

SEQ ID NO: 28167 - protein, 81 aa, Notechis scutatus
LVSFEEVAVCFSKEEWTQLNPHQKALHGEVMRENLRNVASLDTVGQENMCCRQILEALRRKEGRDQTELKSYERNQSKDGS

SEQ ID NO: 28168 - protein, 81 aa, Notechis scutatus
LVSFEEVAVYFSEEEWSQLDPDQKALHSEVMLENHRNVVSLGNNGQEDQDSCKPFQVMTAKDGMEKFVIRAEFESHERNQS

SEQ ID NO: 28169 - protein, 81 aa, Alligator mississippiensis
RMGEMGSLMPEPGQLEKGQSMPPKQGESLELWDAFEDVALHFTRKEWELLEDEDKVLYRDQMLRNYQALISLGKALVLGYP

SEQ ID NO: 28170 - protein, 81 aa, Notechis scutatus
NFQEDQSQDATQESRKLSLDFLESPLCAGAEGLAEPLLQDIVSYEEVAVYFSEEEWSQLDADQKELYREVMLENSRNLFSL

SEQ ID NO: 28171 - protein, 81 aa, Notechis scutatus
LVSFEEVAVYFSEDEWSQLDPDQKALHLEVMLENHRNVVSLGDNGQENQDSSELFQVINAKGGTDKFGIRMEFESHEINQS

SEQ ID NO: 28172 - protein, 81 aa, Alligator mississippiensis
SKILEAFEDVAVFFTREEWELLEAGDKGLYQNQMLRNYQALVSLGLQGPAPDLICRMQLGEMELWVCDDEEAGESSLSEDF

SEQ ID NO: 28173 - protein, 81 aa, Alligator mississippiensis
EGQGRPAKQGESMQLWEVFEDVAVYFTREEWELLEEEDKGLYRDQMLMNHQALLSLGLPEIKDKHCRWVSPKHWGMWSMSA

SEQ ID NO: 28174 - protein, 81 aa, Notechis scutatus
LVSFEEVAVYFSKEEWSQLDPDQKALHSEVMLENYRNVVSLGYNGQENQNSCELFQVISAKDGREKFGIRMEFESHERNQS

SEQ ID NO: 28175 - protein, 81 aa, Notechis scutatus
SGEKQRMKISGFYEGNQTAVEPPNQEGLVSFEEVAVYFSEEEWSQLDPDQKALHSEVMLENHRNVVSLGKIFLVPNQEERL

SEQ ID NO: 28176 - protein, 81 aa, Notechis scutatus
LVSFEEVAVYFSEEEWSQLDPDQKALHLEVMLENHRSVVSLGNNGQGNQDSCELFQVISAKDGTEKFGIQVELESHETNQS

SEQ ID NO: 28177 - protein, 81 aa, Notechis scutatus
NEPPVPFKDIDVKFSNEEWALLTEEQRALYDDVTQENFQNLSTLGIPLEKPEIITRTQQGGDLYFQNNTINSPKVQFIGSQ

SEQ ID NO: 28178 - protein, 81 aa, Micrurus lemniscatus
QDLVSFEDVAVFFSMEEWALLDSEQKALYRKVMLESKRNVAFLRPLMAFSSSPGTSVLCNGGSTAAELPTQDLVSFEDVAV

SEQ ID NO: 28179 - protein, 81 aa, Gopherus agassizii
VTFEEVAVYFSEEEWALLDPGQRALYRDVMQENYETVISLGKDFCPLSPEQVALCGMLCGRSEGHVSQSPEQRETCKRQHK

SEQ ID NO: 28180 - protein, 81 aa, Podarcis muralis
PVCFEDVAVRFTDEEWELLDPDQRAMHKDVMEGNRGIVASLDCGELESKNKEEHNTICRVEKARKKLECGKSCSQSSHSTS

SEQ ID NO: 28181 - protein, 81 aa, Gopherus agassizii
QMPVTFEEVAVYFTQGQGALLDPAQRALYRDVMQENYETVTSLGKGFPSPRLLEQTTPKEDKHHEWFGYGNEFILRPQFVS

SEQ ID NO: 28182 - protein, 81 aa, Podarcis muralis
GPLETTALNFSTAEWTLSDIWQKHLSRGSKLEGDRDAGLLGGGRSEDQKSLLLRRSEQMTTLKQAKENVVQCPNQGDALKN

SEQ ID NO: 28183 - protein, 81 aa, Microcaecilia unicolor
NKALVTFKDVTGYFLDVDWDILGERQKELYKKVIKEIHDILMSRGYSIVNPDVIFKIKKEDEKYFTQQFEWEGKENSNDST

SEQ ID NO: 28184 - protein, 81 aa, Microcaecilia unicolor
IKASNKFKDVSAYFLEANWDILGEWQKELYKKVIKEIHDTLISRGYSILNPDVIFKIKKEDEKYFTQQCEWEGKENPNDST

SEQ ID NO: 28185 - protein, 81 aa, Microcaecilia unicolor
NEALVIFKDVAAYFLEVDWDILGERQKELYKKVIKEIHDILMSRGYSIVNPDVIFKIKKEDEKYFSHQSEWEGKENLNDST

SEQ ID NO: 28186 - protein, 81 aa, Microcaecilia unicolor
HLALVTFADIAAYFWEVEWDVLGERRKELYKKVIKEIHSILISRGYSIANPDAVFKIKKEDKKYFTQSCEWEAKESLNDPL

SEQ ID NO: 28187 - protein, 81 aa, Micrurus paraensis
LEQFLSVLPVDMQTWLNAQEPGSSKEAIQLALAYHKQEPAKPIQDMITFEDVSIHFTEEEWTLLDHKEKNLYWNVMHQNYD

SEQ ID NO: 28188 - protein, 81 aa, Microcaecilia unicolor
SHEALVTFKDVAAYFLDWDLLGEWQKELYKKVIKEIHNILMSRGYSIVNPDVIFKIEKEDEKYFTQQSEWERKKTPNDSTN

SEQ ID NO: 28189 - protein, 81 aa, Lithobates catesbeianus
ITVPPPSFLTLERNSKKILEVTKKMTKLLTGEVPIRCQDVTVYFSMEEWEFLERHKDLYKDVMMENQPPLTWPGKMNLNCK

SEQ ID NO: 28190 - protein, 81 aa, Microcaecilia unicolor
ARALVTFHDVAIYFSDEEWQLLEEWQKELYKNVMTEIHEALIILGHTSTSPGISCRIKEEEEPYFGDHDNSSRNLSKRPTA

SEQ ID NO: 28191 - protein, 81 aa, Microcaecilia unicolor
NEALVIFKDVAAYFLEVDWDILGERQKDLYKKVIKEIHDILMSRGYSIVNPDVVFKIENEDEKYFTQQSEWKGKENPNDSN

SEQ ID NO: 28192 - protein, 81 aa, Microcaecilia unicolor
NEVLVTFKDVSAYFLEMDWDLLGERQKELYKKVIKEIHDILISRGYSIVNPDVIFKIKKEDEKYFNHQFEWEGQENPNDST

SEQ ID NO: 28193 - protein, 81 aa, Terrapene carolina
PKVPVTFDDISVYFNEQEWKSLSEWQKELYKNTMKGNYETLISLDYAVSKPDILSRIERGEEPYIGDPRDSEERKISVEPC

SEQ ID NO: 28194 - protein, 81 aa, Microcaecilia unicolor
NEALVTFRDVAAYFLDVEWDILGERQKELYKEVIKEIHDILLSQGYSIVNPDVIFKIKKEDEKYFTQQFEWEGKENLNDSN

SEQ ID NO: 28195 - protein, 81 aa, Microcaecilia unicolor
HEALVTFKDVAAYFLEVDWDLLGERQKELYKKVIKEIHDILTSRGYSIINPDIIFKIEKEDEKYFTQQSEWEGKKTPNDST

SEQ ID NO: 28196 - protein, 81 aa, Microcaecilia unicolor
NEALVTFKDVAAYFLEVDWDLLGDWQKELYKKVIKEIHAILLSRGYSIVNPDALFKIKMEDEKYFTQQFKWEGKENPNDFN

SEQ ID NO: 28197 - protein, 81 aa, Microcaecilia unicolor
PEASDEATIKASNEALVTFKIVAAYFMEVEWNILEEWQKELYKKVIREIHDILISRSKCAYVIDDRGTYYGISGVKFTGTR

SEQ ID NO: 28198 - protein, 81 aa, Lithobates catesbeianus
VPIRCQDVTVYFSMEEWEYLEGHKDLYKDIMMENQSPLTSMDGSSNGNPPERWPHPLYSRDSTQEDHTIPQLYIGYSHLKQ

SEQ ID NO: 28199 - protein, 81 aa, Terrapene carolina
APVVFEEVAVYFTPAEWAPLDQRQRDLYRDVMQENFRNIHLLGEASSPLDISCCLVSGVQVTQRSHLIQHQRVHTGEKPYP

SEQ ID NO: 28200 - protein, 81 aa, Microcaecilia unicolor
HEALVTFKDVSAYFVEVDWDLLGEWQKELYKKVIKEIHDILMSRGYSIVNPDVIFKIKREDEKYFTQQFEWEGKENLNDST

SEQ ID NO: 28201 - protein, 81 aa, Microcaecilia unicolor
RQEPVTFDDIAVYFSEEEWSILEDWQKEVYKNVMRENYDMLVSLGFPVPSSEVFLSLVERQKAPCTESPRHWGERDMLSRS

SEQ ID NO: 28202 - protein, 81 aa, Microcaecilia unicolor
NEALVTFKDVAAYFLDVDWDLLGERQKELYKKLIKEIHNILISRGYSIVNPDVIFKIKKEDEKYFTQQFEWEGKENPNDST

SEQ ID NO: 28203 - protein, 81 aa, Lithobates catesbeianus
YFSPIRCQDVTVYFSMEEWEYIEGHKDLYKDVMMENQPPLTSPDGSSNGNPPERCPRPLYSRDSTQEDQEIPQVDHQVLQD

SEQ ID NO: 28204 - protein, 81 aa, Lithobates catesbeianus
PLLALQENNEKKILEVTKKMMELLTGEVPIRCQDVTVYFSMEEWEYLEGHKDLYKDIMMENQSPLTSMGKRRLYCKESRNT

SEQ ID NO: 28205 - protein, 81 aa, Microcaecilia unicolor
NEALVTVKDVAAYFSEVNWDILGEWQKEMYMTVVKEIHDILISRGYSILNPVVIFKIKMEQKYFTQQFEWEGKENPNDSTN

SEQ ID NO: 28206 - protein, 81 aa, Microcaecilia unicolor
IEALVEFRDVALCFTKEEWMQLEEWQKQLYRNVIQEIHQTLISLGYTILKSDILIRIRDEDEHYISDQDEPQKHECHNGPT

SEQ ID NO: 28207 - protein, 81 aa, Microcaecilia unicolor
IKASNQFKDVAAYFLEADWDLLGEWQKQLYKKVIKEIHVILISRGYSIVNPDVIFKIKKEDEKYFTQQCEWEGKENPNGST

SEQ ID NO: 28208 - protein, 81 aa, Microcaecilia unicolor
NEALVTFKDVAAYFLEVDWDLLGGRQKELYKKVIKEIHDILISRGYSILNPDQEEDLPFMENPESQMSEQTLPSVTDDGFG

SEQ ID NO: 28209 - protein, 81 aa, Xenopus tropicalis
PTTFNRIAVYFSDEEWEMLEEWQRDLYKNMIKENSEALTSLDYSVSPNILLNIKDEDVKHYTSNSSPDDVEQAQSPKTEDH

SEQ ID NO: 28210 - protein, 81 aa, Microcaecilia unicolor
NEVLVAFKDVAAYFLEVDWDILGEWQKELYKKVVKEIHDILISQGYSIVNPDVIFKIKNEDEKYFTPHFEWEEKGNPDLMK

SEQ ID NO: 28211 - protein, 81 aa, Microcaecilia unicolor
GNLTTTGTSEELQEACDEASIKASDEVLVTFKDVAAYFSEVDWDILGEWHKELYKKVIKEIHDILMSRGYSIVSPDVEIGH

SEQ ID NO: 28212 - protein, 81 aa, Notechis scutatus
LVSFEEVAVYFSEEEWSQLDPDQKSLHWEVMLENHRNLVSLGNNGQENQDSSELSQVINAKDGTEKFGIRMEFESHERNQS

SEQ ID NO: 28213 - protein, 81 aa, Notechis scutatus
LPPTQGFISFEEVAVDFTLEEWALLDWSQKALWREVMLEIFLNIAALAGYGQSDENDQHAWLAPLQTAEYEMEEVMFGHQG

SEQ ID NO: 28214 - protein, 81 aa, Pantherophis guttatus
SLVTFKEVAVNFSEEEWSQLDPDQKLLHWEVMLENHRNVASLDDNRQESQDSCELFQVINAGEGMEKSAIQMEAESHERKQ

SEQ ID NO: 28215 - protein, 81 aa, Pantherophis guttatus
LLPFKEVAVYFSEEEWSQLNPHQRALHWEVMLENYKNVASLGANENDNKVSGEPIKLFRQRDVMENPIIQMEFQRQERNPS

SEQ ID NO: 28216 - protein, 81 aa, Pantherophis guttatus
QEGLVSFKEVAVYFSEEEWSQLDADQKALYREVMLENHRNVTSLGNNGEEDEDSRELFEMISHSYSMKNRIILMEVESHER

SEQ ID NO: 28217 - protein, 81 aa, Pantherophis guttatus
HLVSFEEVAVYFSEEEWSQLDAAQKALHWEVMLENHRNVASLGNNGQENKDSCELFQVISAGDRTFPIQMKKERHERNQSN

SEQ ID NO: 28218 - protein, 81 aa, Pantherophis guttatus
PQDDVSFEEVAVYFSEEEWSQLDADQKALHGEVMLETIRNLSSLGKMSAKRKSYSVEFKKGIVEDSLGKNLTAFCKEKKLD

SEQ ID NO: 28219 - protein, 81 aa, Pantherophis guttatus
PQDVVSFEEVAVYFSEEEWSQLDPAQKALHGEVMLENSRNLASLGYNRQENKNYKAEGQAMHPKEEKGKFADQSSETSQSQ

SEQ ID NO: 28220 - protein, 81 aa, Pantherophis guttatus
LVSFKEVAVSFSEEEWSLLDPDQKALHSEVMLENHRNVASLGNNGQENQDSCELFQVINAKDGREKFGIRMELESHERNQS

SEQ ID NO: 28221 - protein, 81 aa, Gopherus agassizii
PVQFKDVAVTLTEAEWLLLDEEQRQLYGTVMQENYRSISSLGYVSTNPPSLVSSANLLRVQSTPSSRSLMKILNKTGSPTS

SEQ ID NO: 28222 - protein, 81 aa, Micrurus lemniscatus
SSSQEMFFRRISRDDPYQDTNRGKNRRKFTIPDGGTETMIETPIQEGLVSFEDVAVYFSEEEWTELDPDQKALHREVILEN

SEQ ID NO: 28223 - protein, 81 aa, Pantherophis guttatus
LVSFKEVAVYFSEEEWSQLDPDQKALHSEVMLENHRNVVSLGNNGQENQDSCELFKVINAKDGTEKFGIQMELETHNRKQS

SEQ ID NO: 28224 - protein, 81 aa, Micrurus lemniscatus
RNVASLDPLMAFSSSPGTSVLCNGGSTAAELPTQDLVSFEDVAVFFSMEEWALLDSEQKALYREVMLENKRNVASLGDGWE

SEQ ID NO: 28225 - protein, 81 aa, Micrurus lemniscatus
DLVSFEDVAVFFSMEEWALLDSEQKALYRKVMLESKRNVAFLRKGFYYDTVVQYIVVAFTIYSLPFVKNQIQSCTCFAGKE

SEQ ID NO: 28226 - protein, 81 aa, Pantherophis guttatus
VSFEEVAVHFSEEEWSQLDADQKALHGEVMLENSRNLFSLGFNGQENKNCKEECQAILLKKEKGKFAIQMQPKSNETKQSQ

SEQ ID NO: 28227 - protein, 81 aa, Podarcis muralis
SSVSFEDVAVCFTAEEWALLDPAQRALHKEVMEETWRTMISLGKVPCWVIISVLEFSRYFSGTNLPYLDGSQRCHLDFSQS

SEQ ID NO: 28228 - protein, 81 aa, Podarcis muralis
VFILLICCSYRERIFLQKRVLIPLRQRGLRWTPERGLCFEDVAVCFMAEEWALLDPAQRALHKEVMEENCGILASLSKVPS

SEQ ID NO: 28229 - protein, 81 aa, Alligator sinensis
LELQQVFEDVAVCFTRKEWKLLEDDDKVLYRDQMLRNYQALVSLGYRGPTPDLICRIQRGEVELWVCEDEDQEKILKLEDL

SEQ ID NO: 28230 - protein, 81 aa, Paroedura picta
AQSPFSLEEVSIIFTEAEWALLDPGQRALYKEVMLENSGHVAFLARSIRETMVKMENSFGKDREQLEHSSRGSQEHICFPN

SEQ ID NO: 28231 - protein, 81 aa, Paroedura picta
RQAEQTWGPPVKTEAAFSEAEGASLEQGQQDRVQRPVSFEEVAVYFTEAEWALLDSEQRALCKEVILEIYGNVDFLGKDLS

SEQ ID NO: 28232 - protein, 81 aa, Paroedura picta
EQGRVTLEEVSVHFSEEEWALLDADQRNLHQEVMAENRQEVASLETLLLLRPDSMSTMDEAGNLFLQDPEERKRSAEVDSE

SEQ ID NO: 28233 - protein, 81 aa, Podarcis muralis
QGPVCFEDVAVCFTDEEWALLDPDQRALHKDVMEENRGIVASLDCDELEIESKGDNEKFPREEKPVKNLECGESCSQSSHS

SEQ ID NO: 28234 - protein, 81 aa, Paroedura picta
SLPSFEEVAVDFTEAEWALLDSGQRALHWEVMLENYGSVAFLASNVREVTVEPGRGLASFSRGPPERISFPNNPVERKAEE

SEQ ID NO: 28235 - protein, 81 aa, Alligator sinensis
AEEGPVILELQRTCAGSLWELLDDEDKVLYQDQMVKNYQALVSLGYRGPTPDLICSIQRGQVELWVCGDEEIGEISRSEYV

SEQ ID NO: 28236 - protein, 81 aa, Paroedura picta
PPVSFEEVTVSFTGEEWALLDPGQRKVFWEVMEDNSETVASLEDSISQKALRAPERRTLPFLGDQSEVFPHSGDGSLWAVQ

SEQ ID NO: 28237 - protein, 81 aa, Paroedura picta
SGLPVSFKEVAVFFTQEEWALLDPAQRALYWEGFGTLDHPLMHGTEQGKCDPSTAVRNQEGVQVAPCQGPSEKMNGRHSPL

SEQ ID NO: 28238 - protein, 81 aa, Paroedura picta
CPFSLEEVSVSFTEAEWALLDPGERALHWEVMLEFFGDVVFLVENDERNEEVDEINHRMSEGDQNVKDFKENIQNQGGKAA

SEQ ID NO: 28239 - protein, 81 aa, Paroedura picta
QCAPVTFEDVAVHFTEGEWALLRPKQRALYKEVMQENYNIVVSLGYPVAKPDLICRLEGGEVLWLPDPLGTTLRDMPPDYS

SEQ ID NO: 28240 - protein, 81 aa, Paroedura picta
PPVQTPFSFEEVAVSFTEAEWALLDPGQRALYREVMLETYETVASLGTLLPPPTLLSAKEPRNVKETAAETDKSLPPKERL

SEQ ID NO: 28241 - protein, 81 aa, Paroedura picta
PVAFQEVAVYFTQEEWDLLDEDQRYLYYSVMQENSENMASLGKDPFHEILCATSDPVLHPGCVEESHIVKLQKTNKKEITA

SEQ ID NO: 28242 - protein, 81 aa, Paroedura picta
AQGGVSFEEVAVHLSPAEWALLHPAQRALYKEVMLENFGIVASLGPWISKPDFISRLEEGEEPFLLGPEEAEGLAAGGRWQ

SEQ ID NO: 28243 - protein, 81 aa, Chelonia mydas
QLEQGEEPLRNHIHISLQVGPSSRRQRREMAVMEPAQMPVTFEEVAVYFTPGQGALLDPAQRALYRDVMQENYETVTSLAQ

SEQ ID NO: 28244 - protein, 81 aa, Anolis carolinensis
VIFEDVAVHFSVEEWALLDPDQRALHWEVMEENYRMVSSLGGDAQGSENGEVQNKMWLKIARSKKEEERSVRIEAGEYKRK

SEQ ID NO: 28245 - protein, 81 aa, Anolis carolinensis
DQVMFEDVAVHFSEAEWALLNTDQRSLHREVMEENYRMVSSLGDDGQGSENGGAPNKMWLKTGRRKKEAERSPRIEAEGYN

SEQ ID NO: 28246 - protein, 81 aa, Anolis carolinensis
ITLSVTFEDVSVDFSEEEWALLDPSQKALHQQIVEENLGIVSSLGKAPVITSNLNYVWKQMGSQWSRGSHGEKMISMLEAW

SEQ ID NO: 28247 - protein, 81 aa, Anolis carolinensis
NAEQCNEVSFEELAVYFTAEEWALLDPSQRRLHEEIMTENWGTVSFLGEPPPFLGLDRFNSRKSPWLKSGIQKNSRRGPHF

SEQ ID NO: 28248 - protein, 81 aa, Anolis carolinensis
DQVIFEDVSVDFSEEEWALLDPSQKALHQQIMEENLGIVSSLAMPIEETPFKYLQDGMDFNSKETLTFSQETHTRDKPFKC

SEQ ID NO: 28249 - protein, 81 aa, Anolis carolinensis
IIMGPQTKARGPDAALQGHLPGPRPQFYNIIFLYKQQQGSITFEDLAVNFSLEEWMLLNPGQKVLHMQIMEEIRGIVDSLG

SEQ ID NO: 28250 - protein, 81 aa, Anolis carolinensis
AEEETEKQQQVPPERGESEPTHTGFPLPFDAFSTHSVTPHQVTFQEVAVSFSEEEWALLNPDQRALHQQVMKENFETLSSL

SEQ ID NO: 28251 - protein, 81 aa, Anolis carolinensis
QGPIAFEDVAVHFSLEEWALLNPDQKALHMQIIKQINGIVDSLDKQEKNRKDGLKTEILKWLQKVSPSLNGVETNKERAHR

SEQ ID NO: 28252 - protein, 81 aa, Anolis carolinensis
KQQATFEEVAVYFTEEEWDLLDPEQRDLHREVMEESMEVLSFLDGENKENSTEVSLVKNKTDKTWSGHIWVRKTRFKPEKK

SEQ ID NO: 28253 - protein, 81 aa, Anolis carolinensis
QMTFEDVSLHFSKEEWELLDSDQQTLHWEVMEENYKMLASFGGPGQVSEYAPCKTWLKTEDCKDEEAENLRMEAEVYRGNQ

SEQ ID NO: 28254 - protein, 81 aa, Anolis carolinensis
RSYPCIEVTRYLDDVAVDFSLEEWVLLNPDQKALHKQIMEEMNGIVDSLDWLERGAGEWLIKHQLSSLSESHTRIGEHGKR

SEQ ID NO: 28255 - protein, 81 aa, Anolis carolinensis
KKPPVPFKDVSVKFSDAEWTLLSDKQRTLYQDVMLENFQNVSSLGFPREKYKLIVPIKKGGELDFQDDAERGYFLEREVTG

SEQ ID NO: 28256 - protein, 81 aa, Anolis carolinensis
ADRCLVMFEEVAVNFSPEEWALLDSDQRALHREVMEENHEIVTSLASVPEPNTNQKEEEEEDLKVPDSQVVGLTKILETGD

SEQ ID NO: 28257 - protein, 81 aa, Anolis carolinensis
VSHCCFSPFPVKKRSGLLGDQAGGVILHNYLMSDTVDFEDVAVHFSEEEWALLDLNQRALHTEVMEKNYGMVASLGKGLLA

SEQ ID NO: 28258 - protein, 81 aa, Anolis carolinensis
PVTFEEVAVSFLPEEWGFLNADQRALYNEVMEETCSIMSALGNWKGKNAFANHRNPHTQIFPKHEEACIEEKCPEEMSCIC

SEQ ID NO: 28259 - protein, 81 aa, Anolis carolinensis
GAETSSQAVALAEGFLLSREQERKQDKLQVTFQDVSVDFTEEEQALLDPGQRALHQQVMEEDLEIVSSLGKAPLFILKPAL

SEQ ID NO: 28260 - protein, 81 aa, Anolis carolinensis
NQGPIAFEDVTVHFSSEEWVILNLGQKILHMQIMEEIHGIVASLADNWKESNEYTKRRKRLGHNGSLPRHQQTHSEDEDSA

SEQ ID NO: 28261 - protein, 81 aa, Anolis carolinensis
SSTTFRNSFLRRDSVGPDQDIFNECVIQSHKSQLQVTFEDVSVDFSEDEWALLDLNQKALHQQIMEENLGIVTTLGKAPLC

SEQ ID NO: 28262 - protein, 81 aa, Anolis carolinensis
QNQVTFEDVAVTFSDAEWALLDPDQQVLYKEVMDQNVKMVVSFGGDGQGSKNGQVPCEGWLQTDRCVEENITTEAEESRRS

SEQ ID NO: 28263 - protein, 81 aa, Anolis carolinensis
IAFEDVAVDFSLEEWVLLNPDQKALHKQIMEEMNGIVDSLVSQIEASLSLSLSLSECLCERQGEGGSRLAGERGQRMDHEE

SEQ ID NO: 28264 - protein, 81 aa, Anolis carolinensis
DQVIFEDVAVHFSVEEWASLDPDQRALHWEVMEENYRMVASLGGDGQGSKNRGVPNKMWLKTGRSKKVEERSPRMEAEGYN

SEQ ID NO: 28265 - protein, 81 aa, Anolis carolinensis
QEEERKREKPQVQDSFPDETNQGEESVSHIWLVHIGEGSDQVIFEDVSVDFSEEEWALLDPSQKALHQQIMEENLGIVSSL

SEQ ID NO: 28266 - protein, 81 aa, Anolis carolinensis
PDQAIFQEVAVSFSKEEWALLDPDQRDLHQKVMEENLEAVASLGAGDWENVKEELVRSLMEGDRSAEREDRVISFWTVRQT

SEQ ID NO: 28267 - protein, 81 aa, Anolis carolinensis
EEERKREKPQVQDSFPDETNQGEESVSHIWLVHIGEGSDQVIFEDVSVDFSEEEWALLDPSQKALHQQIMEENLGIVSSLG

SEQ ID NO: 28268 - protein, 81 aa, Anolis carolinensis
YQVTFEDVAVYFTEEEWALLNPGQKALHWEVMQENLGVLFSLASDGEMDQYKGESCQTLLQRDHCKQLNETERETDTKGMW

SEQ ID NO: 28269 - protein, 81 aa, Thamnophis sirtalis
RESRRLSLEMLESPPLCAGAEELAEPLRRAVVSFEEVAVYFSEEEWSQLDADQKALHGQVMLENSRNLASLGKNPHLCSET

SEQ ID NO: 28270 - protein, 81 aa, Thamnophis sirtalis
LMTFEDVAVSFSEEEWSQLDPDEKILHSEVMLENHRNVVSLGNNGQEKQDSCELFQVISAKDGTEKFGIQMEIESHDRNQS

SEQ ID NO: 28271 - protein, 81 aa, Thamnophis sirtalis
KKRMKFSGFSDGDQATAESPNQESLVSFEEVAVYFSEEEWFQLDPDQKALHSEVMLENHRDVVSLGKSFLVPNQRVQEDRL

SEQ ID NO: 28272 - protein, 81 aa, Thamnophis sirtalis
PVSFEDVTVFFSEEEWVLLDFDQKSLYREVMLENATNVEFVVDRQKPENCNESGVNSLKRTETGEEILQNQEEPNMTKNQL

SEQ ID NO: 28273 - protein, 81 aa, Pogona vitticeps
AAFEEVTVSFSQEEWALLDPDQRALHQKVMEENWQMVSSLNHLNGKNVCSKYEKSFTHNLETAGHQRNNTEEDNYIQEKPY

SEQ ID NO: 28274 - protein, 81 aa, Pogona vitticeps
ECPVTFEEVAVCFTQEEWALMDPDQRALYREVMEENWRIVASPSMPDIICTDHEQNRISEPQQNHKSSNRLGNVKREGGNS

SEQ ID NO: 28275 - protein, 81 aa, Pogona vitticeps
VPVTFEDVAVCFTEEEWVLLDPGQRTLQWEVMLENYMNLNYPADDALDDEEKEESCRVSLKKARDVERTEQSEATETEAAR

SEQ ID NO: 28276 - protein, 81 aa, Chelonia mydas
PSIMMPVTFAEVAVYFTQGQGALLDPTQRALYTDVMQENYETVTSLVGFCPGQHVVSGGLLFQGPVTFEEVAVYFTLGQGA

SEQ ID NO: 28277 - protein, 81 aa, Chelonia mydas
PQVPVTFNDVSVYFNEQEWESLDEWQKELYKNVMKGNYETLISLDYAISKPDILARIEQGEEPCVRDQQDSEKAEIPVEPC

SEQ ID NO: 28278 - protein, 81 aa, Pogona vitticeps
LVIFQDVAVGFAEEEWALMDLNQKALHKDVMEDISWMLGSLGNTVASEANPRSSPLLGRVGTFSRSCFPISRHTKNILNGP

SEQ ID NO: 28279 - protein, 81 aa, Pogona vitticeps
QVPVTFEEVTVHFTEEEWLLLDPAQRVLHEEVMEENHTNVASLGDWGKRRNESKELRIKTENKEDWRQGSIMSKGSAFWEI

SEQ ID NO: 28280 - protein, 81 aa, Pogona vitticeps
DQGPVTFEEVAVHFTQEEWALLDRDQRSLHREVMEENRTIVASLGNLRKRNVWGKCEKYFMHTTGLDGHLQTHTKGESCTR

SEQ ID NO: 28281 - protein, 81 aa, Pogona vitticeps
LMTFEDIAVHFTEEEWTLLDEDQRALHREVMEENIASLISLATLTREKRSEEEGGIISLRPLIDIKWKQPLESSGSISGRS

SEQ ID NO: 28282 - protein, 81 aa, Pogona vitticeps
PVTFDEVAVNFTEAEWALLDHNQRACHRDVMEETRENVVSLAHEGRHSENQEELYWLDLETDVCKESYLQGRRCEANKHNR

SEQ ID NO: 28283 - protein, 81 aa, Pogona vitticeps
DPVTLEDVAVSFTEEEWALLDPGQRALHWEVMKENLAHVVSLAPGVGGSRSEEEWLQICLEKFTEREKTQGIKTESEEKRN

SEQ ID NO: 28284 - protein, 81 aa, Pogona vitticeps
DWAAFADLAVYFTEEEWALLDPGQRTLHTQVMEENYELLTSLRKDSSSTIKSGENTSGGLENAEVVNETSAFNVHEIIPAR

SEQ ID NO: 28285 - protein, 81 aa, Pogona vitticeps
DPVTFQDVAVYFSEEEWTLLDPGQKALHREVVEENLAHLVSLAPDTRRNRNEKEQLQICLKRITKKEGKRQKRKKTEVEQK

SEQ ID NO: 28286 - protein, 81 aa, Pogona vitticeps
DVLATFEDIAVHFMEEEWALLNERQRALHRKVMEENVASLISLAMSRRVKMSEEEEGAVFLGAIMAKKQKEPLKCSKTVPR

SEQ ID NO: 28287 - protein, 81 aa, Pogona vitticeps
PVALEDVAVSFTDDEWALLDRGQRALHWEVMVENFANVVSLASGMREDRSKEDQDEVFLENSTKEEGKPQRRKAEIEEKRN

SEQ ID NO: 28288 - protein, 81 aa, Pogona vitticeps
SALRDVRTMLETDPRSSLRCEGTETAPVRMEQGPVTLEDVGVSFTGEEWALLDPGQRALHWEVMEENLALLVSLGKLSFPS

SEQ ID NO: 28289 - protein, 81 aa, Pogona vitticeps
GPVTFEEVAVSFTQEEWALLDPDQRALHQEVMEENWQMISSLDNWRDKKMCPKSENTFMHKSEFTEHKRIHADVESCIREK

SEQ ID NO: 28290 - protein, 81 aa, Pogona vitticeps
REGNQEETDRSATLQGVGTRLATHAESSLLLDDGEKGEESPVTFEEVTVDFTQEEWALLDPDQRALHKEVMEENWGMVVSL

SEQ ID NO: 28291 - protein, 81 aa, Pogona vitticeps
KVQKLLLAFEEVAVYFSREEWDLLDLGQRALYRGVMLENYGNVASVAPKPALISMLEEGDDPFVQDSLDTEMSAGGCPGDR

SEQ ID NO: 28292 - protein, 81 aa, Pogona vitticeps
RAHMGICEEVVVHFTAEEWALLDPDQKALYWEVLLENYRNVASLGLPVPTSDVLSCLEKSDGPFVEGSKEGETPDVTAPVG

SEQ ID NO: 28293 - protein, 81 aa, Pogona vitticeps
SVMMAFEDIAVHFAEEEWALLDKDQKALHREVMAENVVSLISLATGTREKRSEEEGGIDMDEKQKEVLKGSTALSDRRSLG

SEQ ID NO: 28294 - protein, 81 aa, Pogona vitticeps
VADAFEELAVSFTEEELALLDPVQRALYREVMEENLAHAVFLAGEVGERRSKEEQHQICLGKCTEAKKTQGIKTETVEKKD

SEQ ID NO: 28295 - protein, 81 aa, Pogona vitticeps
NEPPIPLEDVCVKFSEEEWALLTEEQRALYRDIVLENFQNASALGIPQEKPTLIKQIQEERIPCFQDYVLRGDSQDNPFTG

SEQ ID NO: 28296 - protein, 81 aa, Pogona vitticeps
KKALVTFDEVAVYFSEEQLNLLDKTQSGIYREVMLENFENVQSLGFPVHKPDLIFEMEKSKNQEIFSQDPENSKEGTPMGT

SEQ ID NO: 28297 - protein, 81 aa, Pogona vitticeps
GPVAFEDIAMHFSEEEWALLDPGQRALHWEVMVENFAHVVSLAPGVGERKGEEEPLQVLEKGEEKEKKPQKMKTETEMKKN

SEQ ID NO: 28298 - protein, 81 aa, Pogona vitticeps
GEEAVFIDLGNQQGTHPCSSLFDGRMATASVQLEQGPVAFEDLAVLFSEEEWALLDPGQKALHWEVMEENWAHLMSLDPCV

SEQ ID NO: 28299 - protein, 81 aa, Pogona vitticeps
GNLMATQAGSGPSPLYGQVERDAIKPLRQLVSFEEVAVCFTKGEWALLEPAEKVLYKEVMLANYGVVASLGKDTFPLIDIN

SEQ ID NO: 28300 - protein, 81 aa, Pogona vitticeps
PVTFDDVAVNFTEAEWALLDQNQRACHRDVMEETRENVVALARDVRDSKNEEELHGVCLDRVIGKESEHQGRRNEAKTHGR

SEQ ID NO: 28301 - protein, 81 aa, Pogona vitticeps
DIADDLQNPVSLEDVAVYFTGEEWSLLDPDQKALYTEVMLENYKNVASSAWKSDLVSQSEEKEDLWFSRVQDVDGAEATES

SEQ ID NO: 28302 - protein, 81 aa, Pogona vitticeps
VAFEDIAVHFSEEEWALLDPSQRTLHQEVMEENFAILLSVAPGVRERRPEEGGLQKCLGNVTEKEEKPQRRETGIEQKGNE

SEQ ID NO: 28303 - protein, 81 aa, Pogona vitticeps
VPVTFEEVTVHFTEEEWLLLDPAQRVLHEEVMEENHTNVASLAGDWGKRRNESKELRIKTENKEDWRQGSIMSKGSAFWEI

SEQ ID NO: 28304 - protein, 81 aa, Pogona vitticeps
LCPVTFGEVAVCFTQEEWALMDPDQRALHREVMEENWRIVASPSMPDIICTDHEQNRISEPQQDHKSSDRLGNVKREPGYS

SEQ ID NO: 28305 - protein, 81 aa, Pogona vitticeps
AVVTFEEVAVDFTLEEWALLDPEQRALHREVMEENRLFVASLADQEIYAREETYTCTMCGKHFAERLALTLHEQIHTEDLC

SEQ ID NO: 28306 - protein, 81 aa, Pogona vitticeps
DAVVPFEEVTVRFSKEERALMDPGQKALHREVMEENYGMVASLGDGRESSKGSEQQMRETEAKHKWNKSVSSREMDPLEIP

SEQ ID NO: 28307 - protein, 81 aa, Pogona vitticeps
GRERSALQLSKLVSFQEVAIYFTQEEWELLNPGQRALYNEVMLENYGTVSSLGRNHFPLVSFQEVAIYFTQEEWELLNPGQ

SEQ ID NO: 28308 - protein, 81 aa, Pogona vitticeps
VTFEEVAVNFTQEEWVLLDPDQRFLHREVMEENRSIVASFDGGENISAAAEPLDFPATITPLHGNEKGDLCLTADEVSCAT

SEQ ID NO: 28309 - protein, 81 aa, Pogona vitticeps
NEESSSSVGSVKIPATSIPSSLPGDAVELDQGPVTFEEVAVSFTQEEWALLDPDQKALHQEVMEENWQMLSSVGKTPFFSS

SEQ ID NO: 28310 - protein, 81 aa, Pogona vitticeps
HLPQLMAFKEVAVHFTQREWNFLDLGQRALYHEVMVEIWEMVCSLAIPKPDLIFSLEEGDDPFVQDSEEQKKWQGACLGDD

SEQ ID NO: 28311 - protein, 81 aa, Micrurus surinamensis
ETMIETPIQEGLVSFEDVAVYFSEEEWTELDPDQKALHRKVMLENYRNVASLGDDEQDHKEPRESFQGFRHGDVMEKRAIQ

SEQ ID NO: 28312 - protein, 81 aa, Pogona vitticeps
PQDWVTFEDVAVHFTEQEYALLDPAQKALHWEVMEEVSAHVAFVGDKENEEQRTKTECEQQQSTSLPHHPGIQTAEKKFKC

SEQ ID NO: 28313 - protein, 81 aa, Geotrypetes seraphini
NEASVIFKDVAAYFLEMEWNILEEWQKELYKKAMKEVLDILMSRGYSVVYPDIIFKIRKEDEKYFTQHFEWEGKENPNDST

SEQ ID NO: 28314 - protein, 81 aa, Alligator sinensis
LELRDVFEDVAVYFTRKEWELLEDDDKVLYQDEMLKNYQALISLGHRGPTPDLICRIQCGQVELWVCDDEDSGEISRSEDL

SEQ ID NO: 28315 - protein, 81 aa, Geotrypetes seraphini
QLALVSFSDLAAYFRQEEWDFLGERQKELYRKVIKYLHGILVSRGSSIVNPDVTLKIKKADEKYFTQCCEWEGKENLNDPL

SEQ ID NO: 28316 - protein, 81 aa, Notechis scutatus
QQCPVAFQDVAVYFTPEEWDLLDNEQRILYYTVMQENSENMTSLELLISKPDPCLQLDWEEISQMTDLQTLKGKDTIDQGV

SEQ ID NO: 28317 - protein, 81 aa, Pantherophis guttatus
VSFEEVAVHFTSEEWSLLDSRQKALHQEVTLEASRIVNSLVDVQKNENYQEPSVVPSQIIRTEIQEEISASKWGRRRYDKK

SEQ ID NO: 28318 - protein, 81 aa, Thamnophis sirtalis
KKALVTFEEVSMYFSEEEWRLLDESQRKIFTKVMMENYENVRELGFPTNNPDLVFKMGRNKNNELYMDKIQNLEEGASPEV

SEQ ID NO: 28319 - protein, 81 aa, Pantherophis guttatus
SWNTSGEKQRMKFSSFYDGDQTAVEPPNQEGFVSFEEVAVSFSEEEWSQLDPDQKALHSEVMLENHRNVVSLGKRFLVPNQ

SEQ ID NO: 28320 - protein, 81 aa, Micrurus spixii
QAWVRARNPSTSQEAAQLAETYLEQQWPVAFEEVAVYFTPEEWDLLNEEQRILYYTVMQENSENVISLGKVPIPVKPYKPF

SEQ ID NO: 28321 - protein, 81 aa, Micrurus spixii
SSQEMFFRRISQDDPYQDTNRGKNRRKFTIPDGGTETMIETPIQEGLVSFEDVAVYFSEEEWTELDPDQKALHREVMLENY

SEQ ID NO: 28322 - protein, 81 aa, Micrurus spixii
QQWPVAFEEVAVYFTPEEWDLLNEEQRILYYTVMQENSENVISLELLVSKPDLRVQTEWEEELQMADFLLFKKKDSIVEGV

SEQ ID NO: 28323 - protein, 81 aa, Micrurus lemniscatus
DVGNHIPKGLVSFEEVAVYFSEEEWSQMDAHQKALHKEVMLENSQNVASLGAREQENEGCKEPFQKINQKKEERLKKREKP

SEQ ID NO: 28324 - protein, 81 aa, Micrurus spixii
DLVSFEDVAVSFSEEEWALLDSEQKALYREVMLENKRNVASLGDGWEMEDSGQEAAAPLPKDKKEEKIYRKQSSEKIQLTG

SEQ ID NO: 28325 - protein, 81 aa, Micrurus spixii
DLVSFEDVAVSFSEEEWALLDSEQKALYREVMLENKRNVASLGDGWEMEDSGQEAAAPLPKDKKEIAEKMYGKQSLEENQL

SEQ ID NO: 28326 - protein, 81 aa, Anolis carolinensis
VRRNSLGLNHQTSVETENIEPRNILLIHQGPIAFEDVAVQFSLEEWVLLNPDQKVLHMQIMEEIPEAPCRSLHPVHLLSKP

SEQ ID NO: 28327 - protein, 81 aa, Anolis carolinensis
QGPIAFEDVAVHFSLEEWILLNPDQKVLHMQTMEEIHGIVDSLDLSQQEIFEETEDFVSQECEEYFLQRLHLVKHERFHTG

SEQ ID NO: 28328 - protein, 81 aa, Anolis carolinensis
PHQVTFQEVAVSFSEEEWALLDPDQRALHQQVMKENLETVSSLKTHREGESSQYGDCGEKKDLGLSGQQAMYAKRKPFKCL

SEQ ID NO: 28329 - protein, 81 aa, Anolis carolinensis
QDQVTIEDVSIHFSEEEWTLLDRHQRALHWEVMGENYKMLASFGDDGQGSQSPPKCSQLEESSGCRIPLFHHETSHREDKP

SEQ ID NO: 28330 - protein, 81 aa, Anolis carolinensis
PIAFEDVAVDFSLEEWVLLNPDQKALHKQIMEEMNGIVDSLGKAPSLMGISISKCSIIPRSKPSEQMQLRPRSKKNCTDRL

SEQ ID NO: 28331 - protein, 81 aa, Anolis carolinensis
DQMMFEDVAVHFTVEEWALLDLNQQALHWEVMEENYRIVASLGGDGQGSENGGAPNKMWLKTGRSKKVEERSLRMEAEGYN

SEQ ID NO: 28332 - protein, 81 aa, Anolis carolinensis
EEIAFEDVAVNFSPEEWVTLNPDQKVLHVQIMEEIRGIVDSLADNWKKSNVCTKNRKHFEHNGGLPIHQQTNREDGNSARE

SEQ ID NO: 28333 - protein, 81 aa, Anolis carolinensis
RRVIFEEVAVYFTEEEWALLDSGQRALHWEVMEENLGILSSLGDKSFSRKETLLRHQATHTGEKPFKCLECGKSFSRKINL

SEQ ID NO: 28334 - protein, 81 aa, Anolis carolinensis
EQVTFEEVAVFFTEEEWALLNPGQWALHREVMQENLGLVSSLGGEEQLGEIEGKPFKALSRGSKCQQMEKNGRNPDSQQKG

SEQ ID NO: 28335 - protein, 81 aa, Anolis carolinensis
DQVTLDELAVGFTPEEWALLDPEQRALHKEVMEENYGMVASLGDTAPLGGRNEDEPCLTWLENANWKEDEELSIDTEGELE

SEQ ID NO: 28336 - protein, 81 aa, Anolis carolinensis
GKNEEKTKDVAVDFSLEEWVLLNPDQKALHKQIMEEMNGIVGSLEIYDIRVIIKITNSDSKMEEWSSPKVTDVNAPTPPDA

SEQ ID NO: 28337 - protein, 81 aa, Anolis carolinensis
AQLAEAYFRECQPDHAIQSSFHLDYQENVSVSFTTEEWALLNHGEKSLYWNVMHQNYDNVTGLVSLSLTHTHTHTHKDCTP

SEQ ID NO: 28338 - protein, 81 aa, Anolis carolinensis
EGPIAFEDVAVDFSLEEWVLLNPDQKALHKQIMEEMNGIVDSLGKAPSLMGISVSKVNDWGSGPFVHRERHRAAVKLCPSP

SEQ ID NO: 28339 - protein, 81 aa, Anolis carolinensis
ETGPVTFEAIAVYFTKEEWALLDPGQRTLYWEVMEENLTNLMSLIPSVSGSKNEKELQRRFLEGLVGKEGRRQTRQNEITQ

SEQ ID NO: 28340 - protein, 81 aa, Anolis carolinensis
GPDQVTFEDVSVDFSEEEWALLDPSQKVLHQQIMEENLGMVSSLEETQFEYLEDGMNFNRKEALTFSQETHTRDKPFKCLE

SEQ ID NO: 28341 - protein, 81 aa, Anolis carolinensis
QDLVSFEEVAVRFTEEEWALLSPDQKTLHRQVMEENSKNLISVGDWRNNEKTNQERKKTEAKEKRRKESIASEGVEFDNCT

SEQ ID NO: 28342 - protein, 81 aa, Anolis carolinensis
CLDVEVSMSFLPEEWALLNPDQRALFKEVMEETLKTISVLKHQTCKKKNSMQALRGFLRFLRAEGQNIWGPTSQGSYVQVT

SEQ ID NO: 28343 - protein, 81 aa, Anolis carolinensis
LHCVQDVAVDFSLEEWVLLNPDQKALHKQIMEEMNGIVASLGKAPSLMGFLFQKLKWEDFHNWSQVKVSRRGIEQPSNSAP

SEQ ID NO: 28344 - protein, 81 aa, Anolis carolinensis
QGLVSFEEVAVRFSEEEWALLDADQRALHRDVIEETRGIVASLGAMRKNKSKDEQERPQSTSEQTGMQKCGFPESVGSHKI

SEQ ID NO: 28345 - protein, 81 aa, Anolis carolinensis
LHGEVTFEEIAVDFSEEEWALLDPGQRALHTEVICSNLTRNRVGFTQVNSKQLLAPLNTFLPMVPASCLGSDLLFLAFQGG

SEQ ID NO: 28346 - protein, 81 aa, Thamnophis sirtalis
ASVSFEEVAVYFVAEEWEILDSNQKALHREVMLENSQHVTALACEQESENYKEENAARLQTAQNEAEEETFGNKGETNSSE

SEQ ID NO: 28347 - protein, 81 aa, Thamnophis sirtalis
AVSFKEVAVYFSKDEWSRLDAHQKALHEEVMLENSRNVASLGRKGQGNKNCKETLQTWMLEEGKELFANQMEPKTSVDSCF

SEQ ID NO: 28348 - protein, 81 aa, Anolis carolinensis
CGHHQGPIAFEDVAVHFSLEEWVLLNPDQKILHMQTMEEIHEIVDSLVESHLSKLNGPAEPWVMILQIKHKNIMLYNKFDR

SEQ ID NO: 28349 - protein, 81 aa, Anolis carolinensis
PVMFEDVAVHFSEEEWALLDVDQRSLHWEIMEPPHCQTATYFTAKQQNMKEGTPGAVSPLNSHLGSSSALQDEVEGQLVST

SEQ ID NO: 28350 - protein, 81 aa, Anolis carolinensis
TIAYEDVAIHFSPEEWVTLNPDQKVLHLQIMEEIQGIVESLVREAYDSNQTLCPYLSNKTERHKVTPPHSRQIPDTNTADE

SEQ ID NO: 28351 - protein, 81 aa, Thamnophis sirtalis
QILVSLEEVAVCFSEEEWSRLDPVQKDLHREVMLENSRNVAFLGNNLQENKEAVQMFRDEERRKAFSYPMKTTENERNLSN

SEQ ID NO: 28352 - protein, 81 aa, Thamnophis sirtalis
IRDVASFEEVVVCFSEEEWSQLDADQKALHKEVMLENSRNLFSLGYKGQEECQVIHSKKGKRKRYQCMECGKMFTHSSSLH

SEQ ID NO: 28353 - protein, 81 aa, Anolis carolinensis
IAHLFVKQEKRSPWNRIRERRLLCVHPRGLVTFEDVSVHFTEEEWVLLDPDQRALHWEVMGENHKMLASFGYRTKNARKEQ

SEQ ID NO: 28354 - protein, 81 aa, Anolis carolinensis
RYLDDVAVDFSLEEWVLLNPDQKALHKQVMEEMNGIVDSLGKAPSLMGISVSKIPDNLSCRHLAPEHGNFWRNLPAQPVYV

SEQ ID NO: 28355 - protein, 81 aa, Anolis carolinensis
FLQEVTFQEVAVSFSEEEWALLDPDQRALHQQVMKENLETVSSLSSQQDKITLNVPFSYRTSLFGRGRNFQQATYAKRKPF

SEQ ID NO: 28356 - protein, 81 aa, Thamnophis sirtalis
GFVPFEEVAVYFSEEEWSQLDSDQKALHWEVMLENYRNMASLGNNGQENKESVELFQKFRHGNRTEKPANQMEQQRQERNP

SEQ ID NO: 28357 - protein, 81 aa, Anolis carolinensis
KRQDEQPCRDSGSFLGIRWKIVVENVFFSLQNPVTFEDVAVYFSTEEWDLLDPDQKALHAQIMTETHGIMASLGKVPSLMK

SEQ ID NO: 28358 - protein, 81 aa, Anolis carolinensis
HHQQQQQQCLTLPSLAQVVPSQGGAFQDRCIEPFQVTFQEVTVSFSEEEWAMLNPDQRALHQQVMKENVEMVSFLIWFLIR

SEQ ID NO: 28359 - protein, 81 aa, Anolis carolinensis
GAAALQGKEEPFGVFCFLFIFLDYPNGPIAFEEVAVHFSPEEWVLLTPDQKGLHVEIMEEIHGIVDSLAHSFLKTRREGNN

SEQ ID NO: 28360 - protein, 81 aa, Thamnophis sirtalis
ISFKELFVFFTKEEWDLLDPTQKALHGEVMLETSWNVASLCNEQKNEIYQEPEDTPLQIFKVKVGEETFQNHWQPKSEDGI

SEQ ID NO: 28361 - protein, 81 aa, Thamnophis sirtalis
LVSFEEVAVYFSEEEWSQLDPDQKALHSEVMLENHRNVVSLLGNNGQENQDSCELFQVKKAKDGTEKLGFEMEFESHERIQ

SEQ ID NO: 28362 - protein, 81 aa, Anolis carolinensis
VIFEEVAVSFSEEEWALLDPDQRALHKEVIEETCRIMVALASRRSFRGDTLSLAKAVFKEQPSSSSQAGTLFLFVLWQRPS

SEQ ID NO: 28363 - protein, 81 aa, Anolis carolinensis
KGPIAFEDVAVDFSLEEWVLLNPDQKALHKQIMEEMNGIVDSLVDNGEKSHVCTKYRKHLGHNGCLHRHQQAHREDGGSAR

SEQ ID NO: 28364 - protein, 81 aa, Thamnophis sirtalis
QEAAQLAEAYLEQQCPMAFQDVAVYFTQEEWDLLNEEQRILYYTVMQENSENITSLGKGSCKIKESFLKLSTLFCLYNSPY

SEQ ID NO: 28365 - protein, 81 aa, Anolis carolinensis
DQVTFEDVSVDFSEEEWALMDPSQKALHQEIMEENLGIVSSLAMSIEETSFKYLEDGMNFNRKEALTFSQETHTRDKPFKC

SEQ ID NO: 28366 - protein, 81 aa, Thamnophis sirtalis
EGMTPVIQSWWPPYGNGIETAHEEPPQDLVTFEDVAVYFTDEEWALLDPDQRALHVEVMEENCGNLAFLAGDSWKAKTEEE

SEQ ID NO: 28367 - protein, 81 aa, Thamnophis sirtalis
NEPPVPLKDIDVKFSSEEWALLTEEQRALYDDVTLENFQNVSTLGIPLEKPEIITRIQQGGELYFQNNTINSPKDRFTGNQ

SEQ ID NO: 28368 - protein, 81 aa, Micrurus corallinus
ILLALKESKIAPCLLLVTPYSSSVAFHQVSFEEVAMHFSEQEWALLNVSERALYKDVMQENYKHILSLGQLQSLLIFLSSS

SEQ ID NO: 28369 - protein, 81 aa, Thamnophis sirtalis
VVSFEEVAVYFSKEEWSQLDPAQKALHGEVMLENSRNLFSLEQYLRCYITYQQTNWAELLPFAEVAYNNAIHSSTSHTPFK

SEQ ID NO: 28370 - protein, 81 aa, Thamnophis sirtalis
VSFEEVAMHFSEQEWALLNVNERALYKDVMQENYKHILSLGEISQPGSPINTTSFGRLVDHLQATESPNSDLRYLREECQE

SEQ ID NO: 28371 - protein, 81 aa, Thamnophis sirtalis
PGQVPASFGEVAIHFNSEEWLLLDPSQKALHEEVMLETSRMVASLAFDEPDTENYQEPGVVPSQIIKIEIQRDTSADMCEK

SEQ ID NO: 28372 - protein, 81 aa, Micrurus corallinus
KDQSNKSRPESRKLSLEILESPFCGRAEGLAKLQLQGVVSFEDVAVYFSKEEWSQLDADQKALHGEVMLENSRNLASLVSH

SEQ ID NO: 28373 - protein, 81 aa, Thamnophis sirtalis
PESRKPSLEFFESPPLCGGAEELAEPLFQAVVSFEEVSVYFSEEEWSQLDADQKALHGEVMLENSRNLFSVGKNPYQCSKT

SEQ ID NO: 28374 - protein, 81 aa, Thamnophis sirtalis
ILLALKESKIAPCLLLVTPYSSSVTFRQVSFEEVAMHFSEQEWALLNVNERALYKDVMQENYKHILSLGQLQSLLISLSNP

SEQ ID NO: 28375 - protein, 81 aa, Thamnophis sirtalis
QQCPVSFEEVAVYFTPEEWDLLDDEQRILYYTVMQENSENVTSLELLISKPDPCLQLDWGEVSQMADLQTLKGKNTIDQRI

SEQ ID NO: 28376 - protein, 81 aa, Thamnophis sirtalis
VSFDEVAIYFTSEEWLLLDPSEKATYREIMLETCEIVASLVDDQENDNYQELSVVPEVIKIEIKEETSTDKFGRRQYEKKQ

SEQ ID NO: 28377 - protein, 81 aa, Thamnophis sirtalis
DSDPFEEVAVDFTEEEWALLDSGQKALCREVMLEVSMNLATLAGDGDDLRNENEKQPPLFTLQNALSAKSHSFSFALPNIP

SEQ ID NO: 28378 - protein, 81 aa, Micrurus corallinus
KPRLWMETTETSPPCGGAATSQGLASFEEVVVYFTEDEWELLDPSQRALYGDVMLENSRNMAALAYVKDHENNKKPSMVVF

SEQ ID NO: 28379 - protein, 81 aa, Micrurus corallinus
PRLWMETTETSPPCGGAATSQGLASFEEVVVYFTEDEWELLDPSQRALYGDVMLENSRNVTALGKPRLWMETTETSPLCGG

SEQ ID NO: 28380 - protein, 81 aa, Thamnophis sirtalis
LVSFEEVAVYFSKEEWSQLDPDQKALHSEVMLENHRNVVSLGNNGQENQDSCELFQVINAKDGMEKFGIRMELKSFKRNQL

SEQ ID NO: 28381 - protein, 81 aa, Thamnophis sirtalis
LVSFEEVAVYFSEEEWSQLDPDQKALHSEVMLENHRNVVSLGNNGQEDQDSCELFQVINGKDGMETFGIRMELKTHDRNQS

SEQ ID NO: 28382 - protein, 81 aa, Pelodiscus sinensis
PKVPLTFDDISVYFNEQEWKSLSDWQKVLYKDTMKGNYETLISLDYAVSKPDLLSRIERGEEPYIVDPRDSEERTVSIEPH

SEQ ID NO: 28383 - protein, 81 aa, Pelodiscus sinensis
AVELVTFEEVAVYFSEEEWALLDPGQRALYWDVMRENYEAVSWLGFPVFKTHVISWVKQREELWIPDLHGYVEGEIINDTH

SEQ ID NO: 28384 - protein, 81 aa, Pseudonaja textilis
QQCPVAFQDVAVYFTPEEWDLLDNEQRILYYMVMQENSENVTSLELLISKPDPCLQLDWEEISQMTDLQTLKEKDTIDQGV

SEQ ID NO: 28385 - protein, 81 aa, Pantherophis guttatus
LVTFEEVAVHFSEEEWSQLGPDQKELHWEVMVENHRNVASLGNNGQENQDSFELFQVINTGDGTEKSAIQKEVERHERNQL

SEQ ID NO: 28386 - protein, 81 aa, Pantherophis guttatus
VSFEEVAVYFSEEEWSQLDPDQKALHSEVMLENHRNVVSLGNNGQENQESCELFQVTNAKDETEKFGFRMEFESHERSQSN

SEQ ID NO: 28387 - protein, 81 aa, Pantherophis guttatus
APVSLKEVAVGFTEEEWALLDSSQRALHQEVMLENSRTLASLAGEGKENLAWQDLGTTPLGKSMHPIKEEKLHNQRKPERF

SEQ ID NO: 28388 - protein, 81 aa, Pantherophis guttatus
PLSFEEVAVHFSEEEWSQLDAHQKTLHWEVMLENYRNMASLGNNGKENEDCGEPFLMNTSGDRTEKSAIQMELETQERSQS

SEQ ID NO: 28389 - protein, 81 aa, Notechis scutatus
DAVSFKEVAVYFSKEEWSWLDAHQKALHEEVMLENSRNVASLGDKRQNKNCKESLQTLMLEEGKEPFANQTEPKTCSESHS

SEQ ID NO: 28390 - protein, 81 aa, Notechis scutatus
KKALVTFEEVSMYFSEEEWRLLDESQRKIFTKVMMENYENVRALGFPTNDPDLIFKMRRNESHELYTDKIENGVSPEGVSP

SEQ ID NO: 28391 - protein, 81 aa, Pantherophis guttatus
KKALVTFEEVSLYFSEEEWRLLDESQRKIFTKVMMENYENVRALGFPTSNPDFIFKMGRNENHELCMDKIQNLSEGASPEV

SEQ ID NO: 28392 - protein, 81 aa, Alligator mississippiensis
GKFPEAFEDVALYFTQKEWELLGDGDKVLYQDQMLRNYQALVSLGCQGPMPDLINRIQRGELELWVCDDEDLGENAWFEGL

SEQ ID NO: 28393 - protein, 81 aa, Pantherophis guttatus
QVLVSFQEVAVHFSEEEWSQLDPDQKSLYREIMLENSRNLAFLRNHVQENKETFQRFGDEGRRAEFANPTETKEHERNLSG

SEQ ID NO: 28394 - protein, 81 aa, Dipodomys ordii
PPNRVSPFKDMILCFSEEDWSLLDPAQTGYYGEFIIGEDYEVSVSPNEAPAQPDLSQGEESEPRVPEFQDLQGKEGPQVPH

SEQ ID NO: 28395 - protein, 81 aa, Cricetulus griseus
PPNRVSPFKDMILCFSEEDWSLLDPAQTGFYGEFIIGEDYGVSMPPNDPAAQPDFSPEEENRPRVTEMADLQGKEALQVSC

SEQ ID NO: 28396 - protein, 81 aa, Cricetulus griseus
EEGLVTFEDVCVDFTWDEWQDLDDAQRKLYRDVMLETYSSLLSLNMQHVNDPNEISQDNRQIHGCNLVIAKSSTSAEERAK

SEQ ID NO: 28397 - protein, 81 aa, Mesocricetus auratus
KPLALGDIPFYFSQEEWGSLDSAQRDLFWDIKRENSRNAVLGLGSKSQSKSAPPDEAVPALSGQTDCEVTMSWNPKEAETE

SEQ ID NO: 28398 - protein, 81 aa, Cavia porcellus
SQNLLNFKDISVDFTQEEWGQLAPAHRNLYREVMLENFRNLVSVAGYQFSKPSVISQLEKGEEPWMTEKEDLGNPSADLKS

SEQ ID NO: 28399 - protein, 81 aa, Cricetulus griseus
GCVTFEDVAVYFCREEWELLDESQRLLYLDVMLENFALIASLDCWHEAETGETACTQSVSPTEEPQVRAPKEGLPTKKTHP

SEQ ID NO: 28400 - protein, 81 aa, Cricetulus griseus
VKIEDVADVAVSFILEEWGHLDQSQKSLSRDGREENCESITPVDYESREGNSELMVQQVSDGADSHWVAAESREKNGAQSQ

SEQ ID NO: 28401 - protein, 81 aa, Cricetulus griseus
SQLPENFEDVAMYISQEWGHQDPSKRALSREMVQDSYENVGTLESCIPGQEVISTQVEQGGKPWDPSVQSCKGGRSPRDPV

SEQ ID NO: 28402 - protein, 81 aa, Ictidomys tridecemlineatus
ETATNEDLSVDCTQKKWKGPAVRQRALYRNTVLENYSIMNSLAGENRMESSEFTPKQTISKGSESSDRSPGGLFGVTSMGP

SEQ ID NO: 28403 - protein, 81 aa, Ictidomys tridecemlineatus
SQGLVTFKDVAICFSQDQWSDLDPTQKEFYGEYVLEEDCGIVVSLSFPIPRLDAISQVREEEPQVPDIHEPQEPEEPEILS

SEQ ID NO: 28404 - protein, 81 aa, Peromyscus maniculatus
YQEALTFQDVKVTFSQEEWGCLDSAQRNLYRDVMLENYGNVVSVVGSSPKPALISWLEARKPSTVNICKVQPKRDSGTAPE

SEQ ID NO: 28405 - protein, 81 aa, Cavia porcellus
HQESASTSLQPPRSQEQWALLDPSQKELYWDAMLRKYGSVVSLGLPDQERKPDQEPSPHPAYQDPVVPRKPYMCAQCGCSF

SEQ ID NO: 28406 - protein, 81 aa, Cricetulus griseus
NGNTGESEGKEQVLCYHQTHDKSSQEDISEPIQKLLPGVLDILTFKDVAIGFSREEWECLDSAQRALYRDVMLENYSNLVS

SEQ ID NO: 28407 - protein, 81 aa, Castor canadensis
PNRVSPFKDMILCFSEEDWSLLDPAQTGFYGEFIIGEDCGVSMPPNDPPAQPDLSQREENEPRPAELQDLQGKEGPQVSYL

SEQ ID NO: 28408 - protein, 81 aa, Peromyscus maniculatus
PRESVTFEDVSVDFTRGEWKMLELSQRELYKEVLLETLKNLEFLGLPVSKFELISKLKWVKLPRVLEKEISEGPRPEAEPR

SEQ ID NO: 28409 - protein, 81 aa, Octodon degus
HRESASTSLESVRTQEQWALLDPSQKELYWDAMLQKYGSAMSLGLPDRESNPDRELSPRRPHQDPPEPRKPYMCAQCGCGF

SEQ ID NO: 28410 - protein, 81 aa, Cricetulus griseus
TQEPVKDVHTVRSFSYKKGVHQIPTHRDLYHGIRKESAENMVSLGSTVSTSNKTAQLEQRKEPWTVGLHSSNKRNSVLRSN

SEQ ID NO: 28411 - protein, 81 aa, Mesocricetus auratus
YQEALTFQDVEVIFSQEEWRLLGAAQRNLYRDVMLENYRNVVSVVGSSPKPALISWLEARKPLAVNICTAQPKTDSGTAPE

SEQ ID NO: 28412 - protein, 81 aa, Mus caroli
PRESVTFEDVSVDFSRGEWKLLEPSQRELYKEVLLENLGTLEFLGSPVSKLDLISHLKWVKLPRVLEKEISKDPRPGELVK

SEQ ID NO: 28413 - protein, 81 aa, Rattus norvegicus
PREAVTFEDVSVDFTRGEWKLLEPSQRELYKEVLLENLGSLEVLGSPVSKFDLISHLKWVKLPRVLEKELSKDPRPGESVK

SEQ ID NO: 28414 - protein, 81 aa, Mus caroli
MAKDLRFEDVVIYFSLEEWERLGHSHRNLYRAVMLDNYSNLLSLSLADTKPRVVSLLEQGKEPWMVMRNETKIWHPDWESR

SEQ ID NO: 28415 - protein, 81 aa, Cricetulus griseus
PVTFQDVAVDFSQDEWQLLGRMQKTEYRDVMLETLGNLVSVGWKPTSGKQELTQESSSSVLEPICVPKSKHFSRNDTKFTV

SEQ ID NO: 28416 - protein, 81 aa, Cricetulus griseus
SQGLVTFKDVALCFSQDQWSDLDPTQKEFYGEYVLEEDCGIVVSLSFPIPRLDDTSQISEQEPQVPDVQQSQEPTEPEILS

SEQ ID NO: 28417 - protein, 81 aa, Cricetulus griseus
LVTKESMTFTDVAVDITQEDWELMRPVQKELYKTVTLQNYWNMVSLGLTVYRPTVIPILEEPWMVIKEIVEGPNPEWETKT

SEQ ID NO: 28418 - protein, 81 aa, Mesocricetus auratus
PREPVTFEDVSVNFTRGEWKLLEPSQRELFKEVLLENLHNLEFLGFPVSKVDLISQLKWVKLPRALEKEISKGPRAEGESG

SEQ ID NO: 28419 - protein, 81 aa, Cavia porcellus
SQGLVTFKDVAVCFSQDQWSDLDPTQKEFYGEYVLEEDCGIVVSLSFPIPRLDDISQVIEEEPLVPDTHEPEEPEILSFTY

SEQ ID NO: 28420 - protein, 81 aa, Mesocricetus auratus
QQLPENFEDVTMYISQEWGHQDPSKRALSRDMVQESYENMGSLESCIPGQEVLSTQAEQGGKPWDPSVQSCKGGRSPGDPV

SEQ ID NO: 28421 - protein, 81 aa, Ictidomys tridecemlineatus
PNRVSPFKDMILCFSEEDWSLLDPAQTGFYGEFIIGEDYGVSMPANDAAAQPDLLQGEENGPRVPELQDLQGKEEPQISYL

SEQ ID NO: 28422 - protein, 81 aa, Cavia porcellus
EFQPLQEHEVPVLQEPDLPAERSSGDSEMVALLTALSQGLVTFKDVAVCFSQDQWSDLDPTQKEFYGEYVLEEDCGIVVSL

SEQ ID NO: 28423 - protein, 81 aa, Cavia porcellus
LVTEESMTFKDVAVDITQEDWELMRPVQKELYKTVTLQNYWNMVSLGLTVYRPTVIPTLEEPWMVIKEILEGPSPECKTEA

SEQ ID NO: 28424 - protein, 81 aa, Cricetulus griseus
TEESTGYQDVTVTFSKEEWGYLDSAQRKLYRDVMLENYGNVVSVVGSFPKPALISWLEARKPRAVNICKVQPKRDSDTAPE

SEQ ID NO: 28425 - protein, 81 aa, Octodon degus
FEDVADVAVSFILEEWGHLDQSQKSLYRDGRKEKYGNITSLDYESKNNNVELRVKQISNEASSPSSQWVAAGSTQRNVSLS

SEQ ID NO: 28426 - protein, 81 aa, Cavia porcellus
YIPEAITFKDVEVTFSQDEWGCLDSAQRNLYRDVMLENYGNSVSLAGSFSKPALISWLETRGPWQMSVQTARPKRLLRSAP

SEQ ID NO: 28427 - protein, 81 aa, Cricetulus griseus
PREPVTFEDVSVNFTRGEWKMLEPSQRELYKEVLLENLRNLEFLGLPVSKVDLISQLKWVKLPRALEKEISKGPRPEDESR

SEQ ID NO: 28428 - protein, 81 aa, Dipodomys ordii
EHQEPASTSCHPPRTQEEWGLLGPSQKELYWDVMLEKYGAVMSLGLQPPGQVMAAESEAGTRGMEPQHLGAGDTGPGLGQA

SEQ ID NO: 28429 - protein, 81 aa, Octodon degus
HKTRASPFKDMILCFSEEDWSLLDPAQTGFYGEFIIGEDCGVSVPPDNPEAQPDLSPREDSEPRVPELPELPGKEVLQDPS

SEQ ID NO: 28430 - protein, 81 aa, Cricetulus griseus
KPVALGDIPFYFSREEWGSLDPAQRDLFWDIKRENSRNAALGLGSKSQSERAPPDEAMTALSGQTDCEVTVSWNPEEAETE

SEQ ID NO: 28431 - protein, 81 aa, Peromyscus maniculatus
LEKIEDMAVSLIREEWLLDPSQKDLNRDNRPEKYRNMFSLGNIDRNPATWTDSCQLQWGCYPGSCSWKNPRPSGQIREAAG

SEQ ID NO: 28432 - protein, 81 aa, Octodon degus
LVTEESMTFKDVAVDITQEDWELMRPVQKELYKTVTLQNYWNMVSLGLTVYRPTVIPTLEEPWMVIKEILEGPSEECKTEA

SEQ ID NO: 28433 - protein, 81 aa, Cavia porcellus
HDSPAPEASILSQEENPRNQLMALMLLTAQPQELVMFEEVSVCFTSEEWACLGPIQRALYWDVMLENYGNVTSLGKDSFFL

SEQ ID NO: 28434 - protein, 81 aa, Cricetulus griseus
GELPATFEDVAIYFTQEEWSLLDRQQKELYRDVMQMNYELLVSLEPPAAKPDLIIRLKQRAAPWIKDPNGLKSGKSRSLGK

SEQ ID NO: 28435 - protein, 81 aa, Mesocricetus auratus
KVDAVTFEDVTVDFTQEEWTSLDPVQRNLYRDVMLENYQNLATVGGQLFKPSLISWLEQKVELTVTEQEILQEWEMHLKTK

SEQ ID NO: 28436 - protein, 81 aa, Ictidomys tridecemlineatus
LVTLKDVAVSLPWEEWEQLDPAQRDFCRENVQKDNGSTVLPSLETKAENKGLIPKEEILEEAEPQVWLQEVSQGKASLFSK

SEQ ID NO: 28437 - protein, 81 aa, Ictidomys tridecemlineatus
LVKIEDVADVAVSFILEEWEHLDQSQKSLYREGRKENYGSITSMDYESRDNDMELIVKQISDEADTHWMASGSPERNAPQS

SEQ ID NO: 28438 - protein, 81 aa, Rattus norvegicus
LVTKESVTFNDVAVDITQEDWELMRPVEKELYKTVTLQNYWNMVSLGLTVYRPTVIPILEEPWMVIKEIVEGPSPEWETKA

SEQ ID NO: 28439 - protein, 81 aa, Mesocricetus auratus
SQGLVTFKDVAVCFSQDQWSDLDPTQKEFYGEYVLEEDCGIVVSLSFPIPRLDDTSQISEGEPQVPDVHESQEPAEPEILS

SEQ ID NO: 28440 - protein, 81 aa, Mus caroli
RDQELGTAVLPALQEEQWRHLDSTQKEQYWDLMLETYGKMVSGVAGISNSKPDLTNLAEYGEELVGLHLHGAEKMARLPCK

SEQ ID NO: 28441 - protein, 81 aa, Ictidomys tridecemlineatus
GELPAVFEDVAVYFTREEWGLLDKWQKELYRDVMRMNYELLASLGPAAAKPDLISKLERRAAPWIRDPFGLKWRSGRSPGK

SEQ ID NO: 28442 - protein, 81 aa, Marmota monax
LVTLKDVAVSLPWEEWEQLDTAQRDFCRENVQKDNGSTVLHSLETKAENKELIPKEEILEEAEPQVWLQEVSQGKASLFSK

SEQ ID NO: 28443 - protein, 81 aa, Marmota monax
LVKIEDVADVAVSFILEEWEHLDQSQKSLYREGRKENYGSITSMDYESRDNDMELIVKQISDEADTHWMAPGSPERNAPQS

SEQ ID NO: 28444 - protein, 81 aa, Cricetulus griseus
VKIEDMAVSLILEEWGCQNLARRNLNRDSRQENLGNVFSQGSENRNGKESTSKTDVKEDSTSHGETAGRVQKEFGEKREQQ

SEQ ID NO: 28445 - protein, 81 aa, Cricetulus griseus
SRDQDMGTAFLPAVHQEQWRHLDSTQKEQYWDFMLETYGKMVSGAGISNSKPDLTNIADYGEELAGLQLHISEKIPRLTCK

SEQ ID NO: 28446 - protein, 81 aa, Rattus norvegicus
NALPVLQVPSVPLKDSQEPTASLLSAGPQKLVKIEDVADVAVSFILEEWGHLDQSQKSLSRDGRKEDCERTTPVVSVCIPK

SEQ ID NO: 28447 - protein, 81 aa, Castor canadensis
GDQEALTFKDVEITFSQDEWGCLNSAQRNLYRDVMLENYRTLASLVGPFSKPALISWLEAREPWGLNVCTVQPKRDPGIVP

SEQ ID NO: 28448 - protein, 81 aa, Marmota monax
GELPAVFEDVAVYFTREEWGLLDKWQKELYRDVMRMNYELLASLGPAAAKPDLISKLERRAAPWIRDPIGLKWGSGRSPGK

SEQ ID NO: 28449 - protein, 81 aa, Cavia porcellus
MEDVADVAVSFILEEWGHVDQSQKSVYRDGRKENYGSIASLDCESKDNNVDLIVKQISNEASSPHSHWVAAGSTQKDIPQS

SEQ ID NO: 28450 - protein, 81 aa, Cavia porcellus
TCESIAFKDVVMSFSRREWKKLEPSQKELYKDVLLENLKNLEFLGFPVSKLDLISRLKWVELPRLVEKELSKHSRPGKLES

SEQ ID NO: 28451 - protein, 81 aa, Heterocephalus glaber
GHPFLAMTVASPQERWVLLDRSQKELYWDAMLQKYGSAVSLGEDRFALGPQAPLPVRVYACLMAPSAGLPDREPNPDPELS

SEQ ID NO: 28452 - protein, 81 aa, Cricetulus griseus
QVDAVTFEDVTVDFTQEEWTSLDPIQRSLYRDVMLENYQNLATVGGQLFKPSLISWLEQKVELTVTEQEILQDVSQKMSTL

SEQ ID NO: 28453 - protein, 81 aa, Marmota monax
SQGLVTFKDVAICFSQDQWSDLDPTQKEFYGEYVLEEDCGIVVSLSFPIPRLDDISQVREEEPQVPDIHEPQEPEEPEILS

SEQ ID NO: 28454 - protein, 81 aa, Peromyscus maniculatus
VKIEDMAVSLILEEWGCQNLARRNLNRDSRQENLGNVFSQGSENRNGHESTSKADVKEDSTVRGETAGRFQKEFGEKREQQ

SEQ ID NO: 28455 - protein, 81 aa, Peromyscus maniculatus
LVTKESVTFTDVAVDITQEDWELMRPVQKELYKTVTLQNYWNMVSLGLTVYRPTVIPILEEPWMVIKEIVEGPSPESETKA

SEQ ID NO: 28456 - protein, 81 aa, Ictidomys tridecemlineatus
DMTLLSVEEAWPACCPEVIAQQEKEQEDVAICPEAVPNEEPVTFQDVAVGFSREEWGLLGPTQRTEYHDVMLETFGNLVSV

SEQ ID NO: 28457 - protein, 81 aa, Ictidomys tridecemlineatus
IRDQDFGAALLPAAPQEHWRHLDSSQKEQYWDLMLETYGKMVSGGISNTKPDLTNSTVYGQELTGLQLHVSEKIPRLTCVG

SEQ ID NO: 28458 - protein, 81 aa, Peromyscus maniculatus
MAKSLKFKDVVIYFSRDEWACLYPSHRNLYRDVMLENYSNLISLGLADTKPSVISLLERGKEPWMVRRNETKEWHSDWASI

SEQ ID NO: 28459 - protein, 81 aa, Ictidomys tridecemlineatus
PQLPESIEDVAMYISQEEWGHQDPNKRVLSRDTVQESYENVDSLESHIPSQEALNTQVEQGGKPWDPSVQSCKEGVSPRSA

SEQ ID NO: 28460 - protein, 81 aa, Ictidomys tridecemlineatus
SQRMLKMENVALTFSPGWTQLNSSQMNLYRDERQENCGNLVSLGGKIQATIQDLPPAKEHLEKPGQKLYHLGEDIAQISAG

SEQ ID NO: 28461 - protein, 81 aa, Mesocricetus auratus
QNRVSPFKDMILCFSEEDWSLLDPAQTGFYGEFIIGEDYGVSMPPNDPAAQPDLSPEENGPRVTEMADLQSKDAPQVSCLD

SEQ ID NO: 28462 - protein, 81 aa, Peromyscus maniculatus
GEPPATFEDVAVYFSREEWGLLGKRQKELYRDVMRMNYELLASLEPPAAKPDLITRLKRRAAPWIKDPNRLKPGRSRSLGK

SEQ ID NO: 28463 - protein, 81 aa, Marmota monax
PNQLSEDPVPQDTSLLQEESMGDAEQMTTLQLPPNRVSPFKDMILCFSEEDWSLLDPAQTGFYGEFIIGEDYGVSMPASKA

SEQ ID NO: 28464 - protein, 81 aa, Marmota monax
LVTKESVTFKDVAVDITQEDWELMRPVQKELYKTVTLQNYWNMVSLGLTVYRPTVIPILEEPWMVIKEILEGPSPEWETEA

SEQ ID NO: 28465 - protein, 81 aa, Neotoma lepida
LVKIEDAADVAVSFILEEWGHLDQSQKSLSRDGRKDNCESITPVDYESREDNLELVVQQASDGADSHWVAAESTERNGAQS

SEQ ID NO: 28466 - protein, 81 aa, Cricetulus griseus
PVQQNRGDLEGERRQKLRIQGLLTFRDVTVDFSQEEWECLDSAQRALYKDVMLENYSNLVFVGENSLFVEFLTHLLFVLTP

SEQ ID NO: 28467 - protein, 81 aa, Ictidomys tridecemlineatus
LVMFEEVSVCFTSEEWACLGPIQRALYWDVMLENYGNVTSLEWETMTDNEEVTSKPSISQRADAQKGISKRLQGSVSQVPG

SEQ ID NO: 28468 - protein, 81 aa, Cricetulus griseus
QSPTPSQKGSSGDQEVTARLLTAGFQTLEKIEDMAVSLIREEWLLDPSQKDLNRDNRPEKYRNMFSLGNIFWNPATWTNSC

SEQ ID NO: 28469 - protein, 81 aa, Marmota monax
QEPLTFKDVVVEFTKEEWGQLDPAVKNLYRDVMLENYRNLHSLHKVHPLSKPVEIPKLESKKERWIMEGEVPRRTICDMET

SEQ ID NO: 28470 - protein, 81 aa, Peromyscus maniculatus
VRDQDMGTAFLPAVHQEQWRNLDTTQKEQYWDFMLETYGKMVSGGISNSKPELTNIAEYGEELAGLHLHVGEKTPRLACKE

SEQ ID NO: 28471 - protein, 81 aa, Heterocephalus glaber
VKIEDMAVSLILEEWGCQNLARRNLNRDSRQENYGNMFSQGRENRSENKESTSKGEDTQDSGSHGETAGRCQKDLGEKREQ

SEQ ID NO: 28472 - protein, 81 aa, Heterocephalus glaber
EPQEAATFKDVEVTFSQDEWGCLDSTQRNLYRDVMLENYGNAASLAISCSKPALISWLEAREPWGLDVQTAQTKQLPGSGP

SEQ ID NO: 28473 - protein, 81 aa, Cricetulus griseus
LGCLPTQSLLTFVDVAINFSKEEWECLNTSQRDLFRGVMLENYSNLVSVVTCLEQNQEPWKVNIEEAEGLEPVPHISSNDF

SEQ ID NO: 28474 - protein, 81 aa, Marmota monax
QAMVKIEDMAVSLILEEWGCQNLARRNLNRDSRQENYGNVFSQGCETRNENEESTSKAEVTEDSASHGEKAGRFQKEFGEK

SEQ ID NO: 28475 - protein, 81 aa, Marmota monax
IRDQDFGAALLPAAPQEHWRHLDSSQKEQYWDLMLETYGKMVSGGISNTKPDLTNSTVYGEELTGLQLHVSEKIPRLTCVG

SEQ ID NO: 28476 - protein, 81 aa, Marmota monax
SQSLLTFEEVAMYFSQEEWELLDPTQKALYNDVMQENYETVISLALFVLPKPKVISCLEQGEEPWVQGSSEFKDYPRESPT

SEQ ID NO: 28477 - protein, 81 aa, Cricetulus griseus
SYTLSLKEDVSVDLSQEEWECLDCAQRALYMDVMLENYSNLLFVENHHIVGKCEKVLPQETKHFIQDHANIQVKTYKCSEL

SEQ ID NO: 28478 - protein, 81 aa, Mesocricetus auratus
VTFQDVDVDFSQDEWRLLGPMQRTEYHDVMLETLGNLVSVGWEPTSGKEELTLESPSSVVEPIHDPKPKGFSREDTQSTVS

SEQ ID NO: 28479 - protein, 81 aa, Heterocephalus glaber
IREQDFGAALLSAAPQEQWRHLDSTQKEQYWDLMLETYGKMVSGAGISNSKPNLTNSAECGEDPAGLHLHVGEKIPRLSCV

SEQ ID NO: 28480 - protein, 81 aa, Peromyscus maniculatus
QEALTFQDVKVTFSQEEWGCLDSAQRNLYRDVMLENYGNVVSVAGKPQIKSSKFILKQDPSEYTETFAVPSVCPETSVSEG

SEQ ID NO: 28481 - protein, 81 aa, Mesocricetus auratus
SRDQDMGTAFLPAVHQEQWRNLDSTQKEQYWDFMLETYGKMVSGGISNSKPDLTNIAEYGEELAGLQLHISEKIPRLTCKE

SEQ ID NO: 28482 - protein, 81 aa, Neotoma lepida
AMVKIEDMAVSLILEEWGCQNLSRRNLNRGSRQENLGNVLKTGMGMSQPQRLKSKKIPPYMGRQQEDSRKNWERNVNSRAE

SEQ ID NO: 28483 - protein, 81 aa, Dipodomys ordii
SSEPIMFEEVAVDFSRSEWKKLEPSQRELYKEVLLESLGNLESLGFPVSKFNLLSQLKWIKLPKLLEKELSKDSRPGNNFD

SEQ ID NO: 28484 - protein, 81 aa, Ictidomys tridecemlineatus
QLESVTFEDVAVDFTQEEWTSLDPTQRNLYKDVMLENFQNLSTVGRQLLKPSLISWLEEEVQLTLVERGILQEWEMHLQTK

SEQ ID NO: 28485 - protein, 81 aa, Heterocephalus glaber
SQGLVTFKDVAVCFSQDQWSDLDPTQKEFYGEYVLEEDCGIVVSLSFPIPRLDDISQVPDIHEPQEPEEPEILSFTYTGDR

SEQ ID NO: 28486 - protein, 81 aa, Neotoma lepida
PVALGDIPFYFSREEWGSLDPAQRELFWDIKRENSRNAALGLGSKSQSDRVPAEEAVTALLGQTDCEVTMSWNPEEAETEV

SEQ ID NO: 28487 - protein, 81 aa, Cricetulus griseus
QGLLTFRDVAVDFSQEEWECLDSVQRALYIDVMLENYSNLVSVENYCMCAIVHQHVESEEKYSKCNELGKMLHESTRCTVY

SEQ ID NO: 28488 - protein, 81 aa, Heterocephalus glaber
QELVMFEEVSVCFTSEEWACLGPIQRALYWDVMLENYGNVTSLEWETMMENEEVTPKLSISQRADSQRETSKRLQEGVLQV

SEQ ID NO: 28489 - protein, 81 aa, Heterocephalus glaber
SQLPESLEDVAMYISQEEWGHQDPSKRTLSRDTIQESYENVDSLEPHIPSQELLTTQVEQGGKPWDPSVQSCKEAMSPRSP

SEQ ID NO: 28490 - protein, 81 aa, Mus musculus
SQGLVTFKDVALCFSQDQWSDLDPTQKEFYGEYVLEEDCGIVVSLSFPIPRLDDTSQIREEEPQVPGVHESQEPAEPEILS

SEQ ID NO: 28491 - protein, 81 aa, Cavia porcellus
ETQPGLVAIADMAIDFTPQLEPAQKSFCGNVLWESHAGLGPLGHCVSKPDFVAFLELGKEHWVVQRELVAGLFPAQQCARE

SEQ ID NO: 28492 - protein, 81 aa, Rattus norvegicus
EHQETLTFQDVEVTFSQEEWGCLNSAQRNLYRDVILENYGNVVSVVGSSPKPALISWLEARKPWGMNICTVQLKREPDAAP

SEQ ID NO: 28493 - protein, 81 aa, Cricetulus griseus
VSQEMVTFRDVAVVFSEEELVLLDAAQRKLYRNVMLETFKNVVSLGARNPDGMESLQEVGWRYLPHQELFCSRIRHQVSRA

SEQ ID NO: 28494 - protein, 81 aa, Ictidomys tridecemlineatus
SCETITFKDVTVNFSRGEWKKLEPSQKELYKEVLLENLRNLEFLGSSVSQLDVISQLKWIELPRVLAKEISKDSRPGELVK

SEQ ID NO: 28495 - protein, 81 aa, Fukomys damarensis
PQGLVTLEAVSVTWEEWERLDAAQRDFHRESSQKNYRNMVPPSLETRAENKELIPKQKILEAKPQPWLQEVSQGKGPLFSE

SEQ ID NO: 28496 - protein, 81 aa, Heterocephalus glaber
MVKGMNFKDVAIYFSQKEWECLHSVQKALYRDVMLENYQNLISLRLSDTTPSVISLLEQGKEPWMVSRKEIKGCYPDWESR

SEQ ID NO: 28497 - protein, 81 aa, Heterocephalus glaber
QLDSVTFEDVAVDFTKEEWTSLDPTQRNLYKDVMLENYQNLSTVGRQLLKPSLISWLEEEVELTIVERGFFQEWEMHLKTK

SEQ ID NO: 28498 - protein, 81 aa, Mus caroli
VRDQELGTAVLPALQEEQWRHLDSTQKEQYWDLMLETYGKMVSGAGISNSKPDLTNLAEYGEELVGLHLHGAEKMARLPCK

SEQ ID NO: 28499 - protein, 81 aa, Ictidomys tridecemlineatus
QAMVKIEDMAVSLILEEWGCQNLARRNLNRDSRQENYGNVFSQGCETRNENKESTSKAEVTEDSASHGEKAGRFQKEFGEK

SEQ ID NO: 28500 - protein, 81 aa, Neotoma lepida
SQLPENFEDMAMYISQEWGHQDPSKRALSRDMVQDSYENVGTLESCIPGQEVLSTQAEQGGKPWDPSVPSCKEGGGPRDPV

SEQ ID NO: 28501 - protein, 81 aa, Octodon degus
SEKLLNFKDISVDFTQEEWKQLAPAHRNLYREVMLENFRNLVSVGYPLSKPSVISQLEKGEEPWMTAKEDLGNHNADLKSK

SEQ ID NO: 28502 - protein, 81 aa, Dipodomys ordii
IVDGLKFNDVVIYFSQLEWECLSSAQKDLYQDVMLENYNNLVSLGLCDTKPYVISLLEQGKESWMVMRKTTVWHPDCESRW

SEQ ID NO: 28503 - protein, 81 aa, Octodon degus
GPVALGDIPFYFSREEWGSLDPAQRDLFWDIKRENSRNSTLETTGTERAALSPPFAGLELHSKSKRVLLEEGVKVLPGQAG

SEQ ID NO: 28504 - protein, 81 aa, Octodon degus
LLTFEDVAVHFSEEEWQLLDPNQKTLYNEVMWDICEAASFVGLKFKNDTGNAEPSSVSALEIQAAERQGSKTRKNVARKRK

SEQ ID NO: 28505 - protein, 81 aa, Mus caroli
TQEPIRDVHTERSFSYKKSVQQVPTHKDLYYDIRKESAGSMASLGDSVSAPNKIAQLEQKKEPWSVGLHSSNKRNSVLQSN

SEQ ID NO: 28506 - protein, 81 aa, Dipodomys ordii
RSSMCLDDVAVSLTWEEWEQLDAAERNICRESTQDYGSPPVLPSLETRAENERLIPKQENLEDQPQDWLQEIGPGKALPFP

SEQ ID NO: 28507 - protein, 81 aa, Peromyscus maniculatus
VRDQDMGTAFLPAVHQEQWRNLDTTQKEQYWDFMLETYGKMVSGAGISNSKPELTNIAEYGEELAGLHLHVGEKTPRLACK

SEQ ID NO: 28508 - protein, 81 aa, Mesocricetus auratus
DAVTFEDVTVDFTQEEWTSLDPVQRNLYRDVMLENYQNLATVEWEMHLKTKGPANGTQLGRKYNGGMRGDSIQVGTVISEE

SEQ ID NO: 28509 - protein, 81 aa, Neotoma lepida
SQGLVTFKDVALCFSQDQWSDLDPTQKEFYGEYVLEEDCGIVVSLSFPIPRLDDTSQIREEEPRVPNVQESQEPAEPEILS

SEQ ID NO: 28510 - protein, 81 aa, Dipodomys ordii
SQELLTFKDISVDFTQEEWGQLVPTYRNLYREVMLENYRNLVSVAGYQLSKPSIISQLEKGEEPWMRVNEGPGDPILDLKN

SEQ ID NO: 28511 - protein, 81 aa, Octodon degus
QLDSVTFEDVAVDFTKEEWTSLDPTQRNLYKDVMLENYQNLSTVGHQLLKPSLISWLEEEVELTIVEQGFLKEWEMHLKTK

SEQ ID NO: 28512 - protein, 81 aa, Fukomys damarensis
SQGLVTFKDVAVCFSQDQWSDLDSTQKEFYGEYVLEEDCGIVVSLSFPIPRLDDISQVREEEPQVPDIHEPQEPEEPEILS

SEQ ID NO: 28513 - protein, 81 aa, Octodon degus
SEKLLNFKDISVDFTQEEWKQLAPAHRNLYREVMLENFRNLVSVAGYPLSKPSVISQLEKGEEPWMTAKEDLGNHNADLKS

SEQ ID NO: 28514 - protein, 81 aa, Cricetulus griseus
YQEALTFQDVTVTFSKEEWGYLDSAQRKLYRDVMLENYGNVVSVVGSFPKPALISWLEARKPRAVNICKVQPKRDSDTAPE

SEQ ID NO: 28515 - protein, 81 aa, Rattus norvegicus
SQGLVTFKDVALCFSQDQWSDLDPTQKEFYGEYVLEEDCGIVVSLSFPIPRLDDPSQIREEEPQVPGVHESQEPAEPEILS

SEQ ID NO: 28516 - protein, 81 aa, Octodon degus
SQSLLTFEEVAMYFSQEEWELLDTTQKALYNDVMQENYKNVISIALFGLPKPKVISCLEQGEEPWVQGSLDFKDTPRESLT

SEQ ID NO: 28517 - protein, 81 aa, Octodon degus
ETCEPIAFKDVVMSFSRREWRKLEPSQKELFKDVLLENLKHLEFLECEPKGELEEVSAQNRDVFMEELTLEKIIEECFKDD

SEQ ID NO: 28518 - protein, 81 aa, Cavia porcellus
EGLVTLEAVSVTWEEWKHLDAAQRYFGRESALKDYRSMVLPNLETKAENKELIPEEQIFEEVKPQPWLQTVSEGKASLFSE

SEQ ID NO: 28519 - protein, 81 aa, Cricetulus griseus
KPVALGDIPFYFSREEWGSLDPAQRDLFWDIKRENSRNAALEEGKDQAPVYWEPEPGSKFWAWRKPHLVLMAFLVSGTLQA

SEQ ID NO: 28520 - protein, 81 aa, Dipodomys ordii
LPTFEDVAVYFTEDEWQLLEPSQKNLYNDVMQENYENVIFLGLKLKKNTGNDQPKSVTASEIQAPKKTRAKVAQKTAGKEK

SEQ ID NO: 28521 - protein, 81 aa, Dipodomys ordii
PITLRDVVVEFSEEEWGLLDPAVKKLYRDEMLENYRNLNSLHSGTVSEHQDSVPQQIVSAEESSPEAGLTKSTHSSLPERN

SEQ ID NO: 28522 - protein, 81 aa, Dipodomys ordii
SQELLTFKDISVDFTQEEWGQLVPTYRNLYREVMLENYRNLVSVGYQLSKPSIISQLEKGEEPWMRVNEGPGDPILDLKNK

SEQ ID NO: 28523 - protein, 81 aa, Octodon degus
QQLPESLEDMAMYISHEEWGHQDPSKRTLSRDTVQESYETVDSLGPHIPSQEALSTQVEQGEKPWDPNIQSCKEDRSPRSP

SEQ ID NO: 28524 - protein, 81 aa, Peromyscus maniculatus
SVTFTDVAVDITQEDWELMRPVQKELYKTVTLQNYWNMVSLESETKAEAHIPLKDLPTFKQDGTQTVKQDGTQTVKLEEAD

SEQ ID NO: 28525 - protein, 81 aa, Mesocricetus auratus
LVTKESMTFTDVAVDITQEDWELMHPFQKELYKTVTLQNYWNMVSLGLTIYRPSVIPILEEPWMVIKEIVEGPSPVSEWET

SEQ ID NO: 28526 - protein, 81 aa, Ictidomys tridecemlineatus
GQHVAPLSPLLPTQSPKGHLRHQDTASTSFHPPRIQEWGLLDPSQKELYWDAMLEKYGTVVSLGEDHRPFPPGLGCRLLAW

SEQ ID NO: 28527 - protein, 81 aa, Heterocephalus glaber
QKHHPQNIRQAVVLVECLQRESGGTKNENLLTFEDVAVYFSEEEWQLLDPNQKALYNDVMQDTYETASFLGKDFSFSLCTS

SEQ ID NO: 28528 - protein, 81 aa, Cavia porcellus
VKIEDMAVSLILEEWGCQNLARRNLSRDSRQENYGNVFSQGRENKSENEESTSKAKDTEDSASHGKTAGRFQKDLGEKREQ

SEQ ID NO: 28529 - protein, 81 aa, Cricetulus griseus
SQGVLTFRDVTVDFPQEEWECLDSAQRALYIDVMLENYSNLVSVENYCKCDPVHHHVKTEKESCQCNELGKVLHDPATCAL

SEQ ID NO: 28530 - protein, 81 aa, Mesocricetus auratus
WDVNTGEIEDKDQGNIDIRRHGHRHLSGGMGMPGFCTEILYKDIMLEACRNLVSGGLTVSKPELINSLEQSKEPLNRRNRS

SEQ ID NO: 28531 - protein, 81 aa, Ictidomys tridecemlineatus
SQEPMKDVQMTRGFSYKKSVHQIPAHRHLYRDIRKESVGTMVSLGSTVSTSNKISRLEQRKEPWTIGLHSSNKRNILRSNC

SEQ ID NO: 28532 - protein, 81 aa, Mus caroli
VTFQDLAVDFSQEEWQLLGPMQRTKYHDVMLETLGNLVSVGWEPTLGNRELIPDSPIPVVKPIHDPNSKDLSRNRTQFTVF

SEQ ID NO: 28533 - protein, 81 aa, Mus caroli
EHLPLPECEVPVSQDVDFPTEQGSGHPEMVALLTALSQGLVTFKDVALCFSQDQWSDLDPTQKEFYGEYVLEEDCGIVVSL

SEQ ID NO: 28534 - protein, 81 aa, Dipodomys ordii
VKIEDVADVAVSFILEEWGHLDPAQKSLYRDSRKDNYGRITCMDYESKDAVELVVKQISEEAESHWMAAAGPAGSGSPGGE

SEQ ID NO: 28535 - protein, 81 aa, Heterocephalus glaber
NILGDNTIEFCRQGPAEEGLLEVPVVLEKLPAMFEDVAVYFTREEWGLLDKQQKELYRNVMQMNYELLASLGKAPICATIT

SEQ ID NO: 28536 - protein, 81 aa, Dipodomys ordii
LVTKESMTFKDVAVDITQEDWELMRPVQKELYKTVTLQNYWNMVSLGLTVYRPTVIPILEEPWMVIKEILEGPSQGGLLYS

SEQ ID NO: 28537 - protein, 81 aa, Octodon degus
ALEAAPLSQEENPRNQLMALMLLTAQPQELVMFEEVSVCFTAEEWACLGPIQRALYWDVMLENYGSVTSLENPHWRETLQM

SEQ ID NO: 28538 - protein, 81 aa, Mesocricetus auratus
VKIEDMAVSLILEEWGCQNLARRNLNRDSRQENLGNVFSQGSENRNGKESTSKAEVKEDSTSHGETAGRVQKEFGQKREQQ

SEQ ID NO: 28539 - protein, 81 aa, Heterocephalus glaber
PQGLVTLEAVSVTWEEWEHLDAAQRDFHRESSHKDYQSMVLPSLETRAENKELIPKQKILEVKPQPWLQEVSQGKGPRFSE

SEQ ID NO: 28540 - protein, 81 aa, Rattus norvegicus
TQEPVRDIHTVRSFPYKRSVQQVPAHRDLYHEIRKESACSVVSLGDTVSAPNKIAQLEQKKEPWTVGLHSSNKRTSVLQSK

SEQ ID NO: 28541 - protein, 81 aa, Octodon degus
EPQEATTFKDVEVTFSQDEWGCLDAAQRNLYRDVMLENYGNSASLAGSFSKPALISWLETRGPWGLNVQMAQPERLLGSTQ

SEQ ID NO: 28542 - protein, 81 aa, Fukomys damarensis
LLTFEDVAVYFSEEEWQLLDPNQKALYNDVMQDTYETASFLGLKLKNDTRNDQPKSVSASEIQAPERKVSTKTRMKVAQKT

SEQ ID NO: 28543 - protein, 81 aa, Octodon degus
ECQPLQENEVPVLQDRDPPAERSSGDPDMVALLTALSQGLVTFKDVAVCFSQDQWSDLDPTQKEFYGEYVLKEDCGIVVSL

SEQ ID NO: 28544 - protein, 81 aa, Fukomys damarensis
FQLPESLEDVAMYISQEEWGHQDPSKRTLSRDTVQESYENVDSLEPHIPSQEVLTTQAEQEGKPWDPNVQSCKEAMSPRSP

SEQ ID NO: 28545 - protein, 81 aa, Dipodomys ordii
FLKLMSFDDVVVDFSWEEWQHLGIAQRTLYRDVMLETYSNMVSLGHHIPKPNLIVKLEQGVEPWRREDSDKNLTDVQAMED

SEQ ID NO: 28546 - protein, 81 aa, Octodon degus
VALGDIPFYFSREEWGSLDPAQRDLFWDIKRENSRNSTLGLELHSKSKRVLLEEGVKVLPGQAGGEGTGSWSPGHSEAWER

SEQ ID NO: 28547 - protein, 81 aa, Dipodomys ordii
QELLTFKDISVDFTQEEWGQLVPTYRNLYREVMLENYRNLVSVDLKNKTETSESTAKNDISQEQLYHDMVGRLIRDDIIYS

SEQ ID NO: 28548 - protein, 81 aa, Mus caroli
TQLPESLEDMAMYISQEWDHQDPSKRALSRDTVQDSYENVGTLESCIPSQEVSSTHVEQGEKLWDSSVQTCKEGMNPRNPV

SEQ ID NO: 28549 - protein, 81 aa, Octodon degus
LVMFEEVSVCFTAEEWACLGPIQRALYWDVMLENYGSVTSLEWETMMENEEVTPEQNISQRSDSQRGTSKRLQDGVPQDLD

SEQ ID NO: 28550 - protein, 81 aa, Heterocephalus glaber
SQEPVKDVHVLRGFSHKKTVHQIPVHRDLYREIRKENVGNTVSLGNTVSPSNKIARLEQRKEPWTVGLHSSNKRNVLRSAY

SEQ ID NO: 28551 - protein, 81 aa, Mus musculus
PRESVTFEDVSVDFSRGEWKLLEPSQRELYKEVLLENLGTLEFLGSPVSKLDLISHLKWVKLPRVLEKEILKDPRPGELVK

SEQ ID NO: 28552 - protein, 81 aa, Mus musculus
MAKDLRFEDVVIYFSLEEWECLRHSHRNLYRAVMLDNYSNLLSLSLADTKPRVVSLLEQGKEPWMVRRNETKIWHPDWVSR

SEQ ID NO: 28553 - protein, 81 aa, Dipodomys ordii
SQSLLAFDDVAMYFSQEEWELLNPTQKSLYNDVMQENYNTVISLALFVLPKPKVIFCLEQGEEPWVQGSSDFKESRRGFCT

SEQ ID NO: 28554 - protein, 81 aa, Dipodomys ordii
GDQEALTFKDVEVIFSQDEWGCLNSAQRNLYQDVMLENYGTLASLVGSFSKPALISWLETREPWGLNIYTVQPEGETDTAC

SEQ ID NO: 28555 - protein, 81 aa, Fukomys damarensis
IREQDLGAALLSAAPQEQWRHLDSTQKEQYWDLMLETYGKMVSGGISNSKPNLTNSAEYGEELVGLHLHVSEKIPRLSCVG

SEQ ID NO: 28556 - protein, 81 aa, Mustela putorius
QAMVKIEDMAVSLILEEWGCQNLARRNLNRDNRQENYGNVFSQGCENRSENEESTSKAEVAEDSAPRGETTGRFQKDFGEK

SEQ ID NO: 28557 - protein, 81 aa, Mustela putorius
RKESMTIKDVVVSFSRGEWRRLEPFQKELYKEVLLENFRSLEFVGFPVSKLDLISQFKWVELPWLLEKEISKGSRPERPCV

SEQ ID NO: 28558 - protein, 81 aa, Carlito syrichta
SQERLTFKDISIDFTQEEWGQLAPAHQNLYREVMLENYRNLVSVAGYQLSKPCVISQLEKGEEPWMTKKEGPDPSSDLKSK

SEQ ID NO: 28559 - protein, 81 aa, Gulo gulo
VRDQDFGASFLQAAPPEQWRHLDSSQKEQYWDLMLETYGKMVSGGISNSKSDLTNSTEYGEELAGLHLHVGEKIPRPTCVG

SEQ ID NO: 28560 - protein, 81 aa, Erinaceus europaeus
LVTKESVNFKDVAVDISPEDWELMRPVQKELYKTVTLQNYWNMVSLGLTVYRPTVIPMLEEPWMVVKEILEGPSTDWKTEI

SEQ ID NO: 28561 - protein, 81 aa, Ornithorhynchus anatinus
SQRSKKYENASMSLSQERQNHLVPPRRNLHRHLKQENYGNISSLGFGVSKPDISGLKPGEEELGDLDLQGSKDKDILRGSC

SEQ ID NO: 28562 - protein, 81 aa, Vicugna pacos
EELPVVFEDVAVYFTREEWGVLDKRQKELYRDVMRMNYELLASLGPAAAKPDLISKLERRAAPWIKDSNGPKWGKGRVPGK

SEQ ID NO: 28563 - protein, 81 aa, Odobenus rosmarus
RQVPVTLEDMAAYLSQEEWECMDPAQQDRSWDVLPEHGGLGLQLEDGQDTREDVSMGRERDRELVRGMARPEQPLERGGPR

SEQ ID NO: 28564 - protein, 81 aa, Odobenus rosmarus
SQGLLTFKDISVDFTQEEWGQLAPAHRNLYREVMLENYGNLVSVGYQLSKPSVISQLEKGQEPWMTEKEGPGDPSSDLNKT

SEQ ID NO: 28565 - protein, 81 aa, Vicugna pacos
HRQESLTFDDVAVDFTWEEWQLLVPAQKALYRDVMLENYSHLVSVGYQASTPGVLSELDQERPWMMEDEVHCQASSEIWKV

SEQ ID NO: 28566 - protein, 81 aa, Delphinapterus leucas
MVPVTLEDVAVYLSQEEWGCLDLAQQDHSCNMLQEDEAGLPAPGPCLTAQDGPGQGLRDPACAASGLREVSGSAGSELGRQ

SEQ ID NO: 28567 - protein, 81 aa, Carlito syrichta
ETQPVLVTIKNMAVNFSQQLDPGQKSFCKNRILENCNDLGSVGHHVSKPDLVCLLEQGKDSWMVKRELTGGLFSGKQSVHE

SEQ ID NO: 28568 - protein, 81 aa, Erinaceus europaeus
SQGSTRDVHMTRGFSYKKSMHQIPAHRDLYRETRKESVGNMVSLGSSVPTSDKLAQLGQRKEPWAVGLHSTHKRNLLRSNY

SEQ ID NO: 28569 - protein, 81 aa, Erinaceus europaeus
SQGSVTLKDVVVSFSRGEWRKLEPFQKELYKEVLLENFMNLDFLGFPVSKSDLLSQLRWVELPWLLGKDVSRPESDPKGEL

SEQ ID NO: 28570 - protein, 81 aa, Vicugna pacos
KIEDVADVAVSFILEEWGHLDQSQKSLYRDDRKENYGSVTSMDYESRNDSMEVLVKQISEEAESPWMTSGSTERNVPPSQG

SEQ ID NO: 28571 - protein, 81 aa, Odobenus rosmarus
VTVENMAVSLTWEEWDRLDPAQRDFCPESALKDCRNTVSLVSLSLETRTENKEFIPKQEVLEEVEPQGQLQEGSHRKAPPF

SEQ ID NO: 28572 - protein, 81 aa, Carlito syrichta
GREQVTFEDVVVDFTQEEWGQLKPAQRTLYCDVMLETFELLVSVGHWFLKPGITSLQEQGAKPWLVDSGVPQGLCPDLETR

SEQ ID NO: 28573 - protein, 81 aa, Ornithorhynchus anatinus
SQVVRTFEDLAVRFSQERWEQPDPAQRELYRDIGRENYGNEGALGDRFPKEALERGVQEFPEIQPRQAPGEAAPRPAGDRA

SEQ ID NO: 28574 - protein, 81 aa, Colobus angolensis
ESCESITLKDVAVNFSRGEWKKLEPFQKELYKEVLLENFRNLEFLDFPVSKLELISQLKWVELPWLLKEVSEGSRPDESAL

SEQ ID NO: 28575 - protein, 81 aa, Colobus angolensis
IRDQDLGASLLPAAPQEQWRHLDSTQKEQYWDLMLETYGKMVSGAGISHSKPDLTNSIEYGEELAGLYLHVNEKIPRPTYI

SEQ ID NO: 28576 - protein, 81 aa, Odobenus rosmarus
LLTFEEVAMYFSQEEWELLDPTQKALYNDVMRENYETVISLGLKVKTDNENHQPVCLSDLEIQAPEDIVSKKTRVKVPQKT

SEQ ID NO: 28577 - protein, 81 aa, Delphinapterus leucas
PQLPESLEDVAMYISQEEWGHQHPSKRALSQDTVQESYENVDSLESQVPSQEALSTQVEQEGKPWDPSVQTCKEGLSPRSP

SEQ ID NO: 28578 - protein, 81 aa, Odobenus rosmarus
SQGPVKDVHMARGFSYKKSVHQIPAHRDLYRDIRKESVGNMVSLGSAVSVSNKIARLEQRKEPWTLGLHSSNKRNIILRSN

SEQ ID NO: 28579 - protein, 81 aa, Ornithorhynchus anatinus
QGSMTFEDVAVSLNQEEWKILDPAQRSLYQEVMLENFGNLVSLAKQSGNSTRRKLRKFPNQEREFRNEMRRRIPSKKSSYE

SEQ ID NO: 28580 - protein, 81 aa, Carlito syrichta
EEVADVAVSFILEEWGHLDQSQKSLYRDDRKENYGSITSMDYASRDNNVELIVKQISDEAESQWTESGNTERSVPQSQEFA

SEQ ID NO: 28581 - protein, 81 aa, Gulo gulo
PQLPESLEDVAMYISQEEWGHQDPSKRALSRDTVQESYENVDSLESQVPSQEALSTHVEQGGKPWDPSVQTCKEGPSPSSP

SEQ ID NO: 28582 - protein, 81 aa, Delphinapterus leucas
QGLVTVQDVAVSLTWEEWERLGPAQRDLYRESAPKDYGNAVSPSLETRTENKELILKQEILEEVEPQGQLQESQEKGPLSS

SEQ ID NO: 28583 - protein, 81 aa, Erinaceus europaeus
LSPLEPQQDPPVPETSALSQEENPRNALMALKLLTAQPQELVMFEEVSVCFTPEEWACLAPAQRALYWDVILENYGNVTSL

SEQ ID NO: 28584 - protein, 81 aa, Cervus elaphus
SLLTFEEVAMYFSQEEWELLDPTQKALYNDVMQENYETVISLAVPAHQLLAFPEQTNTSEWTVAPELILPESQSLLTFEEV

SEQ ID NO: 28585 - protein, 81 aa, Carlito syrichta
QEPVAFKDVVLEFSKEELGQLDPAVKNVYGDVMLESFQNLNSPWKVHLLSKLVEIPAAESKKKDAIMEGDISRRTIFVKNQ

SEQ ID NO: 28586 - protein, 81 aa, Carlito syrichta
IRSQDFGASLLPVAPQEQWRHLDSTQKEQYWDLMLETYGKMVSGGISNSKPDSTNLTEYGEELTGLHFNVIEKIPRPTCVG

SEQ ID NO: 28587 - protein, 81 aa, Ornithorhynchus anatinus
TAGSQLPVTFEDVAVYLSRDEWGHQDSAKENQENYESAVALGSQIPSQEAASNLEQREKAWDSELQNSREKNSSSSCSGED

SEQ ID NO: 28588 - protein, 81 aa, Ornithorhynchus anatinus
TQGLATFKDVALCFSQEQWGHLDPSQKDFYGEYVLQEDCGIVVSLSFPIPRLEEIPPMGGEEEGLQAPGPHDSEESEILTF

SEQ ID NO: 28589 - protein, 81 aa, Mustela putorius
GHREPASTSFHAPRIQEEWGLLDPSQKELYWDAMLEKYGTVVSLAGIPAPQPEAQVELEPGALRTGTEGRRSLHPGDESES

SEQ ID NO: 28590 - protein, 81 aa, Erinaceus europaeus
LLTFEEVAIYFSQEEWELLDPTQKALYHDVIQENYETVISLGLKLKNDIENHQPICLSNLEIQSPGDLVSKKVRVKIPQKT

SEQ ID NO: 28591 - protein, 81 aa, Erinaceus europaeus
ACRKEAEGAGRLHQEEWMLLNRSQKELHWDVMLEKYGSVVSLGLPAPQTDTAAESHHGVLLTGPQGAGSVHPGVQGQGPGA

SEQ ID NO: 28592 - protein, 81 aa, Ornithorhynchus anatinus
APQESTENQEMTTSLFMARSQDEWRRLDPGSKTCYRDVTLGFTVPKPGMISWLEGGEEPWISGSQSSSEEEIPGEVHKGFE

SEQ ID NO: 28593 - protein, 81 aa, Gulo gulo
GHREPASTSFHPPRIQEEWGLLDPSQKELYWDAMLEKYGTVVSLAGIPAPQPEARAELEPGVLRTGTEGRRSLHPGGESES

SEQ ID NO: 28594 - protein, 81 aa, Delphinapterus leucas
ENPRNQLMALMLLTAQPQELVMFEEVSVCFTSEEWACLGPIQRALYWDVMLENYGNVTSLVDITHPGPGKKLKKKLLRLKD

SEQ ID NO: 28595 - protein, 81 aa, Delphinapterus leucas
LQEPVTFADVAVLFTPEEWLFLDSAQRSLYRDVMLENYRNLASVEPQLQPQDSIPNQDIFAEIPSIGTKRYQRIPAGGNPC

SEQ ID NO: 28596 - protein, 81 aa, Gulo gulo
VMFEEVSVCFTSEEWECLGPIQRALYWDVMLENYGNVTSLEWETMTENEEVTPKPSISQRADSQKGTSKRLQGGIPQTLDF

SEQ ID NO: 28597 - protein, 81 aa, Mustela putorius
KIEDVADVAVSFILEEWGHLDQSQKSLYRDDRKEKFGSITSMDYESGHDNVELAVKQISDDAEPHWMTSGSPARNVPQSQG

SEQ ID NO: 28598 - protein, 81 aa, Vicugna pacos
SQGLVTFKDVAVCISQDQWSDLDPTQKEFYGEYVLEEDCGIVVSLSFPIPRLDEISPAGEEESLIPDIAEPPEPQEPGILS

SEQ ID NO: 28599 - protein, 81 aa, Carlito syrichta
QVWVREHGPESGEEAVAVVRDLQRALEGNSPQRMMTSEDVAVSLSQEEREHLEPAPRDFSRESVQKDYKSTVLPSDIVYEP

SEQ ID NO: 28600 - protein, 81 aa, Odobenus rosmarus
SQSLLTFEEVAMYFSQEEWELLDPTQKALYNDVMRENYETVISLALFVLPKPKVISYLEQGEEPWVQGPLELKNSPGELPS

SEQ ID NO: 28601 - protein, 81 aa, Delphinapterus leucas
TEGLVTFKDVAVDFSPEELTYLTAAQRKLYRELMLENYRNLVSLGYQFPKPDIISRLEAEESRAVEEDSSTMICQDWEKKP

SEQ ID NO: 28602 - protein, 81 aa, Odobenus rosmarus
SRESVTFKDVVVSFSRGEWRRLEPFQKELYKEVLLENFRNLEFLGFPVSKLDLISQFKWVELPWLLEKEISKGSRPEGEPR

SEQ ID NO: 28603 - protein, 81 aa, Delphinapterus leucas
SQSLLTFEEVAMYFSQEEWELLDPTQKALYNDVMQENYKTVISLELSLGCSKTEGREIHSHSSTAVPAHQILAFPEQTNAK

SEQ ID NO: 28604 - protein, 81 aa, Delphinapterus leucas
KIEDVADVAVSFILEEWGHLDQSQKSLYRDDRKENYGSITSMDYESRNDNVELIVKQISDEAESPWMTSGSPERNVPPSQE

SEQ ID NO: 28605 - protein, 81 aa, Ornithorhynchus anatinus
AQGPATQADMTRYLSHEKWGRLVPAHRDRHRGVVQENYGTVVPLGFQVPAADVTPRLERGEEPWAVALQGSKEREFPRGSH

SEQ ID NO: 28606 - protein, 81 aa, Delphinapterus leucas
TGHVIFEDVAVSFSQEEWGLLNNAQRLLYCDVMLENLSLIASLGFWHGVEAEEAVSEQCVSVEQVTEDRNPKLEPSILKPL

SEQ ID NO: 28607 - protein, 81 aa, Chelonia mydas
NQEPATFEEVAVYLTTEEWKELKDWQRELYQDVMKENYELVTSVGGTMAKPEIVSRLERGEEPYNPRETRVPGPHGMGKRQ

SEQ ID NO: 28608 - protein, 81 aa, Chelonia mydas
AQMPVTFEEVAVYFTQGQGALLDPAQRALYRDVMQENYETVTALGFPIPKPELITQLERGEEPWVPDLQASEEREISRGAR

SEQ ID NO: 28609 - protein, 81 aa, Chelonia mydas
EHLKVPGTFDDVAAPDEKNLEEWQKELYKKVIKDNYESLISLGKVSIHDMQSREELRVKAQQGLEEREMSMNPSIVDDGIV

SEQ ID NO: 28610 - protein, 81 aa, Chelonia mydas
REGSVTFEEVAVYFTKEEWSLLDPAQRALYRDVMQENYENVTSLAGFPVSKPDVISQLEQRDEPWVSDLHGSEEREIPRGA

SEQ ID NO: 28611 - protein, 81 aa, Chelonia mydas
QTRAELIKFLTVIIYWSLAQHAAVNSGQGIWGEDPPVLCAVPWGFPVSKPDVISQLERGEEPWVLDLQGFEEGEIPRGACA

SEQ ID NO: 28612 - protein, 81 aa, Capra hircus
QAMVKIEDMAVSLILEEWGCQNLARRNLNRDARQENYGNVISQGCENRSENEESTSKAESAEDSASHGETAGKFQKDVGEK

SEQ ID NO: 28613 - protein, 81 aa, Chlorocebus sabaeus
GHQEAASTSFHPPRIQEEWGLLDRSQKELYWDTMLEKYGTVVSLGLPPHQPEAQAQSELGMLLMGTGVCRSLRSGTPPVPT

SEQ ID NO: 28614 - protein, 81 aa, Suricata suricatta
QQVPVTLEDVAAYLSQEEWECPDLARRGGGCDVLPKSRGLGLQPEDGEGARQDMPMRREEGQEPAGGVTRPERPLERGGPR

SEQ ID NO: 28615 - protein, 81 aa, Chlorocebus sabaeus
QEPVTFADVAVVFTPEEWVFLDSTQRSLYRDVMLENYRNLASVGAADQLCKPNALSYLEQRGEQWTTDRGILSDTCAEPQL

SEQ ID NO: 28616 - protein, 81 aa, Mandrillus leucophaeus
DTQPGLVTIKNLAVDFPQQLHPAQKNFSKNGIWENHSDLGSAGHCVAKPDLVSLLQQEKEPWMVKQQLTGSLLSGACRREI

SEQ ID NO: 28617 - protein, 81 aa, Sus scrofa
QPQEALTFKDVEVTFSQDEWGWLDASQRNLYRDVMLENYGNIASLMGPFTKPALISWLETREPWVLNVQGAQPEGNPGADV

SEQ ID NO: 28618 - protein, 81 aa, Mandrillus leucophaeus
DPIQKSCLDVAVNFSRGEWKKLEPFQKELYKEVLLENFRNLEFLDFPVSKLELISQLKWVELPWLLEEVSKGSRPDESALD

SEQ ID NO: 28619 - protein, 81 aa, Bos mutus
SQELLTFKDISVDFTQEEWGQLAPAHRNLYREVMLENYGNLVSVGCQLSKPSVISQLEKGEEPWMTEKEGPGDPNSDLKSK

SEQ ID NO: 28620 - protein, 81 aa, Bos indicus
KIEDVADVAVSFILEEWGHLDQSQKSLYRNDRKENYGSMTSMDYESRNDNVELTVKQISDEAESSWMTSGGPERIIPPSQE

SEQ ID NO: 28621 - protein, 81 aa, Mandrillus leucophaeus
QGLLKMEDVALTLSPGWTQLDSSQVNIYRDEKQENHSSLVSLGGEIQTESRGLPPVKKLSKKEHGKICHLREDIAQNPTCA

SEQ ID NO: 28622 - protein, 81 aa, Bos mutus
QAMVKIEDMAVSLILEEWGCQNLARRNLNRDTRQENYGNVISQGCENRNENEESTSKAESAEDSASRGETAGKFQKDVGEK

SEQ ID NO: 28623 - protein, 81 aa, Bos mutus
WEATSRVSGRWAGFQSQGHREDFGESQVVRDQGIDQGIAVTGTAIARLSISKPNMISLLEQGKEPWMVEREMSDGQHADFF

SEQ ID NO: 28624 - protein, 81 aa, Chlorocebus sabaeus
PPNRVSPFKDMILCFSEEDWSLLDPAQTGFYGEFIIGEDCGVSIPPNELAAQPDLSQREENEPRVPELQDLQGKEVPQVSY

SEQ ID NO: 28625 - protein, 81 aa, Bos mutus
QPQGTMTFKDVEVTFSQDEWGLLDASQRNLYRDVMLENYGNMASVVGPFTKPALISWLEAREPWGLNVQGVQFKGNPGAAP

SEQ ID NO: 28626 - protein, 81 aa, Neophocaena asiaeorientalis
SQEMLTFRDVFVDFTLEEWQQLDATQKNLCRDVMLENYSHLVSVGFLVAQPGRISRLGQGGEEARMAAGESTTRRCPGEPM

SEQ ID NO: 28627 - protein, 81 aa, Bos indicus
QGLVTVRDVAVSLTWEEWERLYPAQKHFFRESAPKDHGNAVSPSSETRIVNKELIPKQEILEVELQGQLQGFQEKAPLSSE

SEQ ID NO: 28628 - protein, 81 aa, Capra hircus
GNQDFGASLLHTASQEQWRHLDSTQKEQYWDLMLETYGKMVSGGAGISSARPGLTDPAGYGIELAGPHLHASEKIPRPTCI

SEQ ID NO: 28629 - protein, 81 aa, Sus scrofa
SLTFEDVALSFSEEEWQMLDPAQKILYNNVMQENYENVISLGLKLKNDTGNDQPISLSTLEIQASGCKALREARVKVAPKT

SEQ ID NO: 28630 - protein, 81 aa, Sus scrofa
PQEPVTFMDVAVLFTPEEWLFLDSAQRSLYRDVMLENYRNLVFVGDQLCKASRFSHVEQREELCITERRIFLGAHLGEHQA

SEQ ID NO: 28631 - protein, 81 aa, Suricata suricatta
QEPISFKDVIVEFSEEEWGQLDPAVKNVYRDVMLENYRNLNSLHQERLFPKPVELSELESKDRRWIIEQEIPSTSVFDRER

SEQ ID NO: 28632 - protein, 81 aa, Chrysochloris asiatica
QAMVKIEDMAVSLILEEWGCQNLARRNLSRDTRQEMYGNMLSQGCGNRNENEESSSKTKIGEDSASHGETTGRFQKVFGEK

SEQ ID NO: 28633 - protein, 81 aa, Mandrillus leucophaeus
QAMVKIEDMAVSLILEEWGCQNLARRNLSRDHRQENYGSTFPQGGENRNENEESTSKAETTEDSASRGETAGRFQKEFGEK

SEQ ID NO: 28634 - protein, 81 aa, Nomascus leucogenys
SCESITLKDVAVNFSRGEWKKLEPFQKELYKEVLLENLRNLEFLDFPVSKLELISQLKWVELPWLLEEVSKGSRTDESALD

SEQ ID NO: 28635 - protein, 81 aa, Muntiacus muntjak
TEELVTFEDVAVDFSPEELPYLSASQRNLYREVMLENYRNLVSLGYQFPKPDIISQLEEEESHAREEDGSTVTCQDWEEQP

SEQ ID NO: 28636 - protein, 81 aa, Capra hircus
QEPVKFEDVVVEFSKEEWGQLDPAVKNLYRHVMLENYRNLNSLHKEHLLSKPVETSKLESKKESWIMEQEIQRTAVFDRER

SEQ ID NO: 28637 - protein, 81 aa, Chlorocebus sabaeus
IRDQDLGASVLPAAPQEQWRHLDSTQKEQYWDLMLETYGKMVSGAGISHSKPDLTNSIEYGEELAGLYLHVNEKIPRPTCI

SEQ ID NO: 28638 - protein, 81 aa, Mandrillus leucophaeus
QEPVTFKDVVVEFSKEEWGQLDSAVKNLYRNVMLENFRNLNSLRKAYLLSKPVESLKLESKKKRWIMEKEIPRKTVFDMQS

SEQ ID NO: 28639 - protein, 81 aa, Neophocaena asiaeorientalis
SQESMTLKDVAVTFSRGEWRALEPSQKEIYKEVLLENYRNLEFLGFPVSKLDLISQLKWAGLPRLLQKQASRGSRPECELS

SEQ ID NO: 28640 - protein, 81 aa, Suricata suricatta
LLTFEDVAVYFTEEEWALLDPNQKILYNDVMQENYENVICLGLKLKNDTGNDQPTSVSTLEIQASGCKVLRKARIKVAQKT

SEQ ID NO: 28641 - protein, 81 aa, Nomascus leucogenys
IRDQDLGASLLPAAPQEQWRHLDSTQKEQYWDLMLETYGKMVSGAGISHSKSDLTNSIEYGEELAGLYLHVNEKIPRPTCI

SEQ ID NO: 28642 - protein, 81 aa, Equus caballus
PQLPESLEDVAMYISQEWGHQDPSKRALSRDTVQDSYENVDSLESQVPSQEALSTQVEQAGKPWYPSVQTCKEGLSPRSPA

SEQ ID NO: 28643 - protein, 81 aa, Neophocaena asiaeorientalis
QAMVKIEDMAVSLILEEWGCQNLARRNLNRDTREENYGNVISQGCENRNENEESTSKAEIAEDSASHGETTGKFQKDFGEK

SEQ ID NO: 28644 - protein, 81 aa, Nomascus leucogenys
QEPVTFKDVVVEFSKEEWGQLDSAVKNLYRSVMLENFRNLNSLRKAHLLSKPFESLKLESKKKRWIMEKEIPRKIIFDMKS

SEQ ID NO: 28645 - protein, 81 aa, Nomascus leucogenys
QMDLVTFDSVAVEFTQEEWTLLDPTQRNLYSDVMLENYKNLSSVGYQLFKPSLISWLEEEEELSTLPRVLQEWKMCLKTNG

SEQ ID NO: 28646 - protein, 81 aa, Trichechus manatus
SLESMAFKDVAVNFSRGEWKRLKPFQKKLFMEVLLENFRNLEFLGFPVSKLELISQLKWVVMPWLLDKEVSKGSRPECDPI

SEQ ID NO: 28647 - protein, 81 aa, Trichechus manatus
SVVIEDVAVVFSQEEWALLDLAQRKLYIDVMMENFRNLASVVSQNPNDVEKLSSDHVMVQFMKSKTWFSMLGEISELHGSK

SEQ ID NO: 28648 - protein, 81 aa, Sus scrofa
RQEPTSAPFHPSRIQEEWGLLDPSQKELYWDVMLEKYGTVVSLGEEGPFSSRSCVCRASQGAPPSPARAPTPSLHVRTPHT

SEQ ID NO: 28649 - protein, 81 aa, Trichechus manatus
SQELVTFKDVVVDFSPEELSYLSAAQRNLYREVTLENYRNLVSLGSQFTKPDLISQLEAEESCGMEEDSNAVAFQDWETSP

SEQ ID NO: 28650 - protein, 81 aa, Equus caballus
LLTFEDVAVSFSEEEWKLLDPAQKILYNDVMQENYETVISLGLKLKNDTGNDQPISVSTLEIQASGCKALRKSRMKVAQKT

SEQ ID NO: 28651 - protein, 81 aa, Capra hircus
QGLVTVQDVAVSLTWEEWERLGPAQRHFFRESAPKDHGNAISPSSETRIENKELVPKQEILEVESQGQLQGFQERAPVSSE

SEQ ID NO: 28652 - protein, 81 aa, Suricata suricatta
AASTSFRPPRIQEEWGLLDRSQKELYWDVMLEKYGTVVSLAGLPAPPPESRVESEPGVLRSGTEGQRSLHPGDESESHRDG

SEQ ID NO: 28653 - protein, 81 aa, Loxodonta africana
EEVPVVFEDVAVYFTREEWGLLDKRQKELYRGVMWMNYELLASLGPAAAKPDLISKLERRAAPWINNPKGSKWGKGRPPGK

SEQ ID NO: 28654 - protein, 81 aa, Chrysochloris asiatica
VGDQDCGGALLAAPSQEQWRHLDSTQKEHYWDLMLETYGKMVSGGISSPKADAAHSAEYGDELAGLHLRILSLSFTRELTL

SEQ ID NO: 28655 - protein, 81 aa, Suricata suricatta
AHREAASTSFRPPRIQEEWGLLDRSQKELYWDVMLEKYGTVVSLAGLPAPPPESRVESEPGVLRSGTEGQRSLHPGECLST

SEQ ID NO: 28656 - protein, 81 aa, Suricata suricatta
SRESITFKDVAVSFSRGEWRRLEPFQKELFKEVLLENFRNLEFLGFAVSTLDLISQFKWVELPWLLEKEVSKGSRPECEPR

SEQ ID NO: 28657 - protein, 81 aa, Canis lupus
EEPVTFLDVAVDFSKEEWGLLDPMQRTEYHDVMLETFGHLVSVGWETTLESKELTPKSDVPEKEPAHDLKLEEFSRDDTRS

SEQ ID NO: 28658 - protein, 81 aa, Chlorocebus sabaeus
VKIEEVADVAVSFILEEWGHLDQSQKSLYRDDRKENYGSITSMGYESRDNMELIVKQISDEAESHWVAPEHTERSVPQDPD

SEQ ID NO: 28659 - protein, 81 aa, Bos indicus
AEELVTFEDVAVHFSPEELPYLSASQRNLYRDVMLENYRNLVSLGYQFPKPDIISQLEEEESHAREEDGSTVTCQDWEEQS

SEQ ID NO: 28660 - protein, 81 aa, Mandrillus leucophaeus
ATFEDMAVSLTWEEWERLDPARRDFCRESAQKDSGSTVPPSLESRAENKELIPMQEILEAEPQGGLQAALQGKRPLLSKCG

SEQ ID NO: 28661 - protein, 81 aa, Neophocaena asiaeorientalis
SAWSQVPVTLEDVAVYLSQEEWGCLDLAQQDHSCDMLQEDEAGLPAPGPCLTAQDGPGQGLWDPAFAASGLREVSGSAGSE

SEQ ID NO: 28662 - protein, 81 aa, Nomascus leucogenys
VKIEEVADVAVSFILEEWGHLDQSQKSLYRDDRKENYGSITSMGYESRDNMELIAKQISDDSESHWVVPEHTERSVPQDPD

SEQ ID NO: 28663 - protein, 81 aa, Nomascus leucogenys
EENPRNQLMALMLLTAQPQELVMFEEVSVCFTSEEWACLGPIQRALYWDVMLENYGNVTSLDDYRNIKYTRQSKIIGTRVA

SEQ ID NO: 28664 - protein, 81 aa, Muntiacus muntjak
SQGPVKDDHMARGFSYKKSVRQIPAHKDLYWDIRKESVGNMASLGSTVPTANKIAQLEPRKEPWTIGLQSSNRRTVLRSNY

SEQ ID NO: 28665 - protein, 81 aa, Suricata suricatta
GDQAFGASVLQAAPQEQWKHPDPAQEEQHWDVMLETYRKMVSGGDRPENDKENLNLENCRGLEPSDVPCHAPGEVPPQASL

SEQ ID NO: 28666 - protein, 81 aa, Chlorocebus sabaeus
SQEPVKDVHVARGFSYKKSVHQIPAHRDLYRDFRKENVGNMVSLGSTASTSNKITPLEQRKEPWTLGLHSSNKRSILRSNY

SEQ ID NO: 28667 - protein, 81 aa, Sus scrofa
PTSAPFHPSRIQEEWGLLDPSQKELYWDVMLEKYGTVVSLGLPRPLPEALAESEPEGLSPGPEGQRSLRPAGESASSGAEG

SEQ ID NO: 28668 - protein, 81 aa, Muntiacus muntjak
QRLVAVQDVAVSPTWEEWERLGPAQKHFFRESAPKDHGNSVSPSSETRIENKELIPKQEILEVELQGQLQGFQEKAPLSSE

SEQ ID NO: 28669 - protein, 81 aa, Canis lupus
QPQEAVTFKDVEVTFSQDEWGWLDPAERNLYRDVMLENYRNMVSLVGPFAKPILISWLEAREPWGLDVQGAQPKGNPGVAL

SEQ ID NO: 28670 - protein, 81 aa, Chlorocebus sabaeus
SQELLTFKDISVDFTQEEWGHLAPAHRNLYREVMLENYGNLVSVAGYQLSKPGVISQLEKGEEPWLMEREISGVPSSDLES

SEQ ID NO: 28671 - protein, 81 aa, Sus scrofa
LVMFEEVSVCFTSEEWACLGPIQRALYWDVMLENYGTVTSLEWETMAENEEVTSKSSISQRADSQKGTSKRLQGGVPQVLD

SEQ ID NO: 28672 - protein, 81 aa, Sus scrofa
ESMTLKDVAVTFSRGEWRKLEPFQKDIYKELLQKISKSSRREYELSGEWKESGGNQDVLVEESTLDKIIERYLMNRDCNLT

SEQ ID NO: 28673 - protein, 81 aa, Canis lupus
SLESVTFKDVAVNFSRGEWRRLEPFQKELYKEVLLENLKNLEFLGFPVSKLDLISQFKWVELPWLLEKEVSKGSRSECEPT

SEQ ID NO: 28674 - protein, 81 aa, Muntiacus muntjak
EALPVVFEDVAVYFTREEWGALDKRQKEMYRDVMRMNYELLASLGPAAAKPDLISKLERRAAPWIKDPHRLKWGKGRPPGK

SEQ ID NO: 28675 - protein, 81 aa, Sus scrofa
SQESMTLKDVAVTFSRGEWRKLEPFQKDIYKEVLLENFRSLEFLGFPVSKLDLISQLKWAGLPRLLQKISKSSRRESFFSL

SEQ ID NO: 28676 - protein, 81 aa, Nomascus leucogenys
PQLPESLEDVAMYISQEEWGHQDPSKRVLSRDTVQESYENVDSLESHIPSQEVPGTQVGQGGKLWDPSVQSCKEGLSPRGP

SEQ ID NO: 28677 - protein, 81 aa, Bos mutus
SQESMTLKDVAVTFSRGEWRKLEPSQKEIYKEVLLENYRNLELLGFPVSKLDLVSQLKWAGLPRLLQKEVSKGCRPDVLME

SEQ ID NO: 28678 - protein, 81 aa, Bos indicus
SAWSQVPVTLEDVAVYLSQEEWGCLDLAQQDHSCDVLLEDAGLPTPGPCLTALQGQGEDPRDSAQAASGPREVSGGASSER

SEQ ID NO: 28679 - protein, 81 aa, Neovison vison
PLPQVPALSQREVCPGDPLTSQAQEAVTFKDVEVTFSQDEWGWLDPAQRNLYKNMMLENYQNLVSLGLCISKPYVISLLEQ

SEQ ID NO: 28680 - protein, 81 aa, Loxodonta africana
SQGPVKDTHVARGFSYKKRVHQIPAHRDLFREIRKESVGNVASLGSSVSTSSKIARLEQRKEPWTRGLHSSNKRNILRSNY

SEQ ID NO: 28681 - protein, 81 aa, Nomascus leucogenys
TESCESITLKDVAVNFSRGEWKKLEPFQKELYKEVLLENLRNLEFLDFPVSKLELISQLKWVELPWLLEEVSKGSRTGSVI

SEQ ID NO: 28682 - protein, 81 aa, Muntiacus muntjak
QPQGTVTFKDVEVTFSQDEWGLLDASQRNLYRDVMLENYGNMASVVGPFTKPALISWLEAREPWGLNVQGVQFKGNPGAAP

SEQ ID NO: 28683 - protein, 81 aa, Canis lupus
ERQPGLVTITNMAVDFSQQLDPAQKSFCKNVIWENRSDLGSVGPCVSKPDLVSLLEHGKEPWMVERELTRSLFSGQQSIHE

SEQ ID NO: 28684 - protein, 81 aa, Loxodonta africana
SQGLVTFKDVAVCFSQDQWSDLDPAQKEFHGEYVLEEDCGIVVSLSFPIPRLDEISQVREEESWVPDIQEPQEPQETEILS

SEQ ID NO: 28685 - protein, 81 aa, Muntiacus muntjak
QLTFEDVALSFSKEEWQIMDPNQKTLYIDVMREIYETVTSLGLKLKNDTGNDQPVSLSTSEIQPSGCKVLRKARMKVAQTT

SEQ ID NO: 28686 - protein, 81 aa, Neophocaena asiaeorientalis
TLLTAGFQTLEKIEDMAVSLIREEWLLDSSQKDLSRDNRPENYRNMFSLGGETRNENRELASKQHSSIFLHIPPSLTPLSH

SEQ ID NO: 28687 - protein, 81 aa, Canis lupus
QAMVKIEDMAVSLILEEWGCQNLARKNLNRDNRQENYGNVFSQGCENRNENEESTSKAEIAEDSAPRGEMTGRFQKDFGEK

SEQ ID NO: 28688 - protein, 81 aa, Canis lupus
PVTFGDIPFYFSREEWGSLDPAQRELFWDIKRENSRNVTLALVPEPSGTEEAAPSRLAGLGLKSQGQQAGLEETVASAGQA

SEQ ID NO: 28689 - protein, 81 aa, Neophocaena asiaeorientalis
SQGPLKDVHMARGFSYKKSVRQIPAHRDLYRDIRKESIGNMVSLGNTVSTANKMAQLEQRKEPWTIGRQSPNKRNVLQSNY

SEQ ID NO: 28690 - protein, 81 aa, Neophocaena asiaeorientalis
FVTKESMTFTDVAVDITREDWELMRPVQKELYKTVTLQNYWNMVSLGLTVYRPTVIPILEEPWMVIKEILEGPSPEWETEA

SEQ ID NO: 28691 - protein, 81 aa, Bos indicus
EPTSAPFQPPRLQEWGLLEPSQKELYWDAMLEKYGTVVSLGLPHPLPESRAESQPEVLSTGSEGRRRLRPGDESEGRPGGP

SEQ ID NO: 28692 - protein, 81 aa, Canis lupus
PQLPESLEDVAMYISQEEWGHQDPSKRALSRDTVQESYENVDSLESQVPRQEALSTQVERGGKPWDPSLQTCKEGLSPRSP

SEQ ID NO: 28693 - protein, 81 aa, Canis lupus
SQGSLSFRDVTVGFTQEEWQHLNLAQRTLYRDVMLENYSHLVSVGYSIDKPEVILKLEQGEEPWILEEAFPSQSDPELINS

SEQ ID NO: 28694 - protein, 81 aa, Bos mutus
SQGPVKDVHMARGFSYKKSVHQIPAHKDLYRDIRKESVGNMVSLGSTVSAANKIARLEPRKEPWTIGLQSSNKRTVLQSNY

SEQ ID NO: 28695 - protein, 81 aa, Bos mutus
AEELVTFEDVAVHFSPEELPYLSASQRNLYREVMLENYRNLVSLGYQFPKPDIISQLEEEESRAREEDGSPVTCQDWEEQS

SEQ ID NO: 28696 - protein, 81 aa, Muntiacus muntjak
LVTKESITFKDVAVDITQEDWELMRPVQKELYKTVTLQNYWNMVSLGLTVYRPTVIPMLEEPWMVLKEILEGPSPEWETKA

SEQ ID NO: 28697 - protein, 81 aa, Neophocaena asiaeorientalis
SQSLLTFEEVAMYFSQEEWELLDPTQKALYNDVMQENYETVISLELSLGCSKTEGREISSHSSTAVPAHQILAFPEQTNAK

SEQ ID NO: 28698 - protein, 81 aa, Muntiacus muntjak
SQELLTFKDISVDFTQEEWGQLAPAHRNLYREVMLENYGNLVSVAGCQLSKPSVISQLEKGEEPWMTEKEGPGDPSSDLKS

SEQ ID NO: 28699 - protein, 81 aa, Ailuropoda melanoleuca
SRVPVTLEDMAAYLSQEEWECLDPAQRDCSWDVLPENRGLVPPLEDGEDPGEDMSMRREQDREPGRGMTRPEKPLEGGGPQ

SEQ ID NO: 28700 - protein, 81 aa, Canis lupus
LLTFEDVAVFFSEEEWKLLNPTQKILYSDVMQENYETVISLGLKLKNDTGNDQPISLSTLELQASGCKVLRKARVKVAQKT

SEQ ID NO: 28701 - protein, 81 aa, Bos mutus
QEPVKLEDVVVEFSKEEWGQLDPAVKNLYRHVMLENYRNLNSLHKEHLLSKPVETSKLESKKESWIMEQEIPRTAVFVPKQ

SEQ ID NO: 28702 - protein, 81 aa, Muntiacus muntjak
SQGLVTFKDVAVCFSQDQWSGLDPTQKEFYGEYVLEEDCGIVVSLSFPIPRLDEISHVREEEPLVPDAPEPQEPEEPEILS

SEQ ID NO: 28703 - protein, 81 aa, Bos mutus
SQGLVAFKDVAVCFSQDQWSDLDPTQKEFYGEYVLEDDCGIVVSLSFPIPRLDEISHVREEEPLVPDVPEPQEPEEPEILS

SEQ ID NO: 28704 - protein, 81 aa, Nomascus leucogenys
SQEPVTFADVAVVFTPEEWVFLDSTQRSLYRDVMLENYRNLASVADQPCKPSALSYLEERGEQWTTDRGILSDTCAEPQCQ

SEQ ID NO: 28705 - protein, 81 aa, Neophocaena asiaeorientalis
SQEMLTFRDVFVDFTLEEWQQLDATQKNLCRDVMLENYSHLVSDSSWPNQVGSPGWDKEERRPGWQLEKAQHGGVQVSPCR

SEQ ID NO: 28706 - protein, 81 aa, Canis lupus
SVTFKDVAVNFSRGEWRRLEPFQKELYKEVLLENLKNLEFLECEPTGELKESFRNQDVLLDESTLDKIIERCLMSGNYGSM

SEQ ID NO: 28707 - protein, 81 aa, Muntiacus muntjak
VKIEDMAVSLILEEWGCQNLARRNLNRDARQENYGNVISQGCENRNETKESTSKAESAEDSASRGETAGKFQKDVGEKREQ

SEQ ID NO: 28708 - protein, 81 aa, Muntiacus muntjak
KIEDVADVAVSFILEEWGHLDQSQKSLYRDDRKENYGSMTSMDYESRNDNVELTVKQISDEAESSWMTSGGPERTVPSSQE

SEQ ID NO: 28709 - protein, 81 aa, Nomascus leucogenys
DAVAYEDLSVDYTQKKWKGLPLSQRALQWNMMPENDRSMASLAGENMMKGSELTPKQEIFKGSESSNRTSGGLFGVVPGAA

SEQ ID NO: 28710 - protein, 81 aa, Nomascus leucogenys
QLQETMTFKDVEVTFSQDEWGWLDSAQRNLYRDVMLENYRNMASLVGPFTKPALISWLEAREPWGLNVQAAQPKGNPGAAH

SEQ ID NO: 28711 - protein, 81 aa, Ailuropoda melanoleuca
GALFGRQPGLVTIRNMAVDFSQQLDPAQKSFCKNVIWENRCDLGSVGPCVSKPDLVSLLEQGKEPWMVERELTRGLFSGEC

SEQ ID NO: 28712 - protein, 81 aa, Lynx canadensis
LVTKESMTFKDVAVDITQEDWEIMRPVQKELYKTVTLQNYWNMVSLGLTVYRPTVIPMLEEPWMVIKEILEGPSPEWKTEA

SEQ ID NO: 28713 - protein, 81 aa, Bos mutus
PQLPESLEDVAMYISQEEWGRQHPSKRALSRDTVQESYENVDSLESQVPSQEALSTQVEHGGKPWHPSVQTCKEGLSSRTP

SEQ ID NO: 28714 - protein, 81 aa, Bos mutus
VTFGDIPFYFSREEWGSLDPAQRDLFWDIKRENSRNVALGLGHRSHSEKSRLEEVVTALPDQAAGNETASWRPEEAWEAEK

SEQ ID NO: 28715 - protein, 81 aa, Canis lupus
FSLQDAQHDSPAPEASALSQEENPRNQLMALMLLTAQPQELVMFEEVSVCFTSEEWECLGPIQRALYWDVMLENYGNVTSL

SEQ ID NO: 28716 - protein, 81 aa, Ailuropoda melanoleuca
SWESLTFKDVIVSFSRGEWRRLEPFQKELYKEVLLENFRNLEFLGFPVSKLDLISQFKWVELPWLLEKEIAKGSRPDVLLE

SEQ ID NO: 28717 - protein, 81 aa, Gorilla gorilla
GHQEPASTSFHPPRIQEEWGLLDRSQKELYWDVMLEKYGTVVSLGLPPHQPEAQAQSELGMLLTGTGVCRSLGSGNESEGP

SEQ ID NO: 28718 - protein, 81 aa, Muntiacus muntjak
PVGNQDFGASLHTASQEQWRHLDSTQKEQYWDLMLETYGKMVSGGISNARPDLTDPAGYGAELAGPHLQASEKIPRPTCIG

SEQ ID NO: 28719 - protein, 81 aa, Ailuropoda melanoleuca
LVTKESMTFKDVAVDITQEDWEIMRPVQKELYKTVTLQNYWNMVSLGLTVYRPTVIPILEEPWMVIKEILEGPSPEWKAEA

SEQ ID NO: 28720 - protein, 81 aa, Canis lupus
QEPVTFKDVIVEFSEEEWGQLDPAVKNLYRDVMLENYKNLNSLHQEPLLSKPAEISNLESKERRWIMEQEIPSTSVFDRGV

SEQ ID NO: 28721 - protein, 81 aa, Muntiacus muntjak
LLTFEEVAMYFSQEEWELLDPTQKALYNDVMQENYETVISLGLKLKNDTENIQSLCLSDLEIQAPVAIASRKAKLKVPQKT

SEQ ID NO: 28722 - protein, 81 aa, Ailuropoda melanoleuca
QEPVTFKDVIVEFSEEEWGLLDPAVKTLYRDVMLENYRNLNSLHQEQLLSKPVEISKLESKERRWTVEQETPSTSVLVPKQ

SEQ ID NO: 28723 - protein, 81 aa, Ailuropoda melanoleuca
LLTFEDVAVSFSEEEWELLDPPQKTLYNDVMQENYETVISLGLKLKNDTGNDQPISISALEMQASGSKVLRKARMKVAQKT

SEQ ID NO: 28724 - protein, 81 aa, Lynx canadensis
PPNRVSPFKDMIFCFSQEDWSLLDPAQTGFYGEFIIGEDCGVSLPPSDPGTQLHLSQGEENEPRVPELQDLQGKDVPQVSY

SEQ ID NO: 28725 - protein, 81 aa, Bos indicus
SQESMTLKDVAVTFSRGEWRKLEPSQKEIYKEVLLENYKNLELLGFPVSKLDLVSQLKWAGLPRLLQKEVSKDVLMEESTL

SEQ ID NO: 28726 - protein, 81 aa, Gorilla gorilla
AEGLKFKDVVIYFSQKEWECLHSAQKDLYRDVMLENYGNLVLLDNSGLSDTKPNVISLLEQKKEPWMVKRKETKEWCPDWE

SEQ ID NO: 28727 - protein, 81 aa, Nomascus leucogenys
ETQPGLVTIKNLAVDFPQQLHPAQKNFCKNGIWENYSDLGSAGHCVAKPDLVSLLEQEKEPWMVKRELTGSLFSGQRSVRE

SEQ ID NO: 28728 - protein, 81 aa, Gorilla gorilla
PQLPESLEDVAMYISQEEWGRQDPSKRALSRDTVQESYENVDSLESHIPSQEVPGTQVGQGGKLWDPSVQSCKEGLSPRGP

SEQ ID NO: 28729 - protein, 81 aa, Gorilla gorilla
SITLKDIAVNFSRGEWKKLEPFQKELYKEVLLENLRNLEFLALFENHRNYIPYNPKYNSFLSCKQEIFYFLYLLDESALDK

SEQ ID NO: 28730 - protein, 81 aa, Bos indicus
SAEPLTFKDIIVDFTQEEWGHLAPAHQNLYREVMLENYGNLVSVAGYQLSKPGVVSQLEKGEEPWLMKREVSGGPSPGKSK

SEQ ID NO: 28731 - protein, 81 aa, Bos indicus
SQSLLTFEEVAMYFSQEEWELLDPTQKALYNDVMQENYETVISLALFVLPKPKVISCLEQGEEPWVQRPLEFKDSSEELPT

SEQ ID NO: 28732 - protein, 81 aa, Bos indicus
SQGPVKDVHTARGFSYKKSVHPIPAHKDLYWDIRKESVGNMVSLGSTVSAANKIARLEPRKEPWTIGLQSSNKRTVLQSNY

SEQ ID NO: 28733 - protein, 81 aa, Muntiacus muntjak
EPTSAPFQPPRLQEWGLLEPSQKELYWDAMLEKYGSVVSLGLPHPLPESREKSQPEALSTGSRSEGRRKLRPGDESEGRPG

SEQ ID NO: 28734 - protein, 81 aa, Macaca fascicularis
SRESITLKDVAVNFSRGEWKKLEPFQKELYKEVLLENFRNLEFLDFPVSKLELISQLKWVELPWLLEEVSKGSRPDESALD

SEQ ID NO: 28735 - protein, 81 aa, Macaca fascicularis
DTVAYEDLSVGYTQKKWKCPALSQRALQWNMMPENDRSMASLAGENMMKGSELTPKQEIFKGSESSNKTSGGLFGMVPGGA

SEQ ID NO: 28736 - protein, 81 aa, Phascolarctos cinereus
TRDKDEAASLSTSGSQEQWQCLNHTQKELYWDAMLEDYGKVVSLAIPISKPNPTNLVVGKEEPDGSHSHADEAIPRSICIG

SEQ ID NO: 28737 - protein, 81 aa, Puma concolor
EPVSFKDVIVEFSKEEWGQLDPAVKNLYRDVMLENYRNLNSLHQDREVISENQDSVTKERISGESSSHGEIMRRLTKSGPP

SEQ ID NO: 28738 - protein, 81 aa, Sapajus apella
QELVMFEEVSVCFTSEEWACLGPIQRALYWDVMLENYGNVTSLEWETMTENEEVTSKLSSSQRADSQKGTSKRLQGSVPQV

SEQ ID NO: 28739 - protein, 81 aa, Sapajus apella
QQLPESLEDVAMYISQEEWGHQDPSKRALSRDTVQESYENVDSLESHIPSQEVPSTQVGQGGKLWDPSVQSCKEGLNPRGP

SEQ ID NO: 28740 - protein, 81 aa, Myotis lucifugus
KIEDVADVAVSFILEEWEHLDQSQKSLYRDDRKENYESITSMDCKSKNDNMELIVKQISDEAKSHWMTSERSVAQSQEFGE

SEQ ID NO: 28741 - protein, 81 aa, Puma concolor
SRESITFKDVAVNFSRGEWRKLEPYQKELFKEVLLENFRNLEFLGFAVSKLDLISQLKWVELPWLLEKEVSKGSRPECEPR

SEQ ID NO: 28742 - protein, 81 aa, Ailuropoda melanoleuca
VHSLESALGWKMKVNIYAYIIYIWEPVSSLDVAVDFTWEEWQLLAPTQKNLYRDMMLENYRNLVSVAGYQASRPDVLSRLE

SEQ ID NO: 28743 - protein, 81 aa, Desmodus rotundus
FQRQPGLVAIVDVATDFSQQLDPARESFHKNVTWETRDLEAAGCCVSRPDVVSVLGQGKEPWLVKRELTDGLLSGHQSVHE

SEQ ID NO: 28744 - protein, 81 aa, Macaca fascicularis
GHQAAASTSFHPPRIQEEWGLLDRSQKELYWDTMLEKYGTVVSLGLPPHQPEAQAQSELGMLLMGTGVCRSLRSGNESEGP

SEQ ID NO: 28745 - protein, 81 aa, Phascolarctos cinereus
LVKIEDMAVSLIQEEWGLLDPAQKDLCSDGRPDSYGHMYSLGGETRSENRDLTQKQVISAEMEPNGERTAKRNGNVPERDH

SEQ ID NO: 28746 - protein, 81 aa, Sapajus apella
PPNRVSPFKDMILCFSEEDWSLLDPAQTGFYGEFIIGEDCGVSMPPNELAAQPDLSQGEEHEPRVPELQDLQGKEVPQVSY

SEQ ID NO: 28747 - protein, 81 aa, Oryctolagus cuniculus
FETRPGFGSVTDMALDSSQLDPAQRSLWKSAVWENHSDLGSPEHCASKPDFVSLLEEGKEPWMGRRDVRGGLFSRQQSVKE

SEQ ID NO: 28748 - protein, 81 aa, Canis lupus
SQGPVKDVHMARGFSYKKSVHQIPAHRDLYRDIRKESVGNMVSLGSTASASSKIARLEQRKEPWTLGLHSSNKRNIILRSN

SEQ ID NO: 28749 - protein, 81 aa, Phyllostomus discolor
TLVESLKGDPQRLWQWEPWWHLDSTQKEQYWDLLLETYGKMVSGGISNSKPDLTNSTEYGEELAGFHLYVSEKLPKPTCIG

SEQ ID NO: 28750 - protein, 81 aa, Phyllostomus discolor
PQLPESLEDVAMYISQEEWGHQDPSKRAVSRDTVQESYENVDSLESQVSNQEALSTQVEQGRKPWDPSVQTCKEGLNPRSP

SEQ ID NO: 28751 - protein, 81 aa, Desmodus rotundus
SQTLLTFEEVAVYFSREEWELLDPSQKALYNDVMHENYETVISLALFVLPKPKVISCLEQGKEPWVQGSTEFMDSPGELPI

SEQ ID NO: 28752 - protein, 81 aa, Macaca fascicularis
QGLLKMEDVALTLSPGWTQLDSSQVNIYRDEKQENHSSLVSLGGEKQTESRDLPPVKKLSKKEHGKICHLREDIAQNPTCA

SEQ ID NO: 28753 - protein, 81 aa, Phyllostomus discolor
PQELVLFEEVSVCFTAEEWACLGPIQRALYWDVMLENYGSVTSLEWETMTEGDEVTSQPSASQRVDSQKGAPKRLQGGIPQ

SEQ ID NO: 28754 - protein, 81 aa, Phyllostomus discolor
FQGPVKDVLTSKGISYKKSVHQIPVHRDVYRDTREESVGNMVSLGSAVSNSNKIAQVEQRKEPWTIGLHSSNKRNILQSSY

SEQ ID NO: 28755 - protein, 81 aa, Myotis lucifugus
LPGLVKVKDVPVTWEEWEHLDPVQRDIYRESTLKDYGNTVLPSLETRTENKELIPKQESLEVEPQMQLQERSQGNAPLLSK

SEQ ID NO: 28756 - protein, 81 aa, Sapajus apella
SQELLTFKDVSVDFTQEEWGQLAPAHRNLYREVMLENYGNLVSVAGYQLSKPGVISQLEKGEEPWLMEREISGVPSLDLES

SEQ ID NO: 28757 - protein, 81 aa, Macaca fascicularis
DTQPGLVTIKNLAVDFPQQLHPAQKNFSKNGIWENHSDLGSAGHCVAKPDLVSLLQQEKEPWMVKQELTGSLLSGQRSVRE

SEQ ID NO: 28758 - protein, 81 aa, Macaca fascicularis
QTDLVTFDSVAVEFTQEEWTLLDPTQRNLYRDVMLENYKNLSSVGYQLFKPSLISWLEEEEELSTLPRVLQEWKMCLKTKG

SEQ ID NO: 28759 - protein, 81 aa, Phascolarctos cinereus
LNGLGRKELVTFEDISVDFAKKEWKTSAPAQRAFFRDLMLENYRDVVSLGISRREEEPWGLNRQGPLDLEGGRSTCTEGDN

SEQ ID NO: 28760 - protein, 81 aa, Myotis lucifugus
APGEPDAASFHPPRMQEEWVLLDPSQKELYWDAMLEKYGSVVSQGLPPPLPDPRAELEPGLEPGSPSAGAEGPGSLRTGER

SEQ ID NO: 28761 - protein, 81 aa, Puma concolor
LLTFEDVAVSFSEEEWKLLDPAQKILYNDVMQENYETVISLGLKLKNDTGNDQPISVSALEIQASGRKVLRKARMKVAQKT

SEQ ID NO: 28762 - protein, 81 aa, Oryctolagus cuniculus
SQGRVTFKDVAVCFSQDQWSDLDPTQKEFYGEYVLEEDCGIVVSLSFPIPRLEEIPQEREEEPQVLDVPEPPQEPDEPEIL

SEQ ID NO: 28763 - protein, 81 aa, Oryctolagus cuniculus
VKIEDMAVSLILEEWGCQNLARRNLNRDNRQENYGNTFSQGCENRNENEESTSKAEVREDSASRGETAGRFQKEFGEKREQ

SEQ ID NO: 28764 - protein, 81 aa, Puma concolor
LVKIEDVADVAVSFILEEWGHLDQSQKSLYRDDRKENYGSIPSMDYESRNDNVELMVKQISDDAEAHWVTSASTERNVPQS

SEQ ID NO: 28765 - protein, 81 aa, Sapajus apella
QGMMTFEDVAMSLTWEEWERLDPAQKDFYRESVQKDSGSTVPPSLESRTENKELIPMQEILEEAEPQEQLQEAFQGKPPLF

SEQ ID NO: 28766 - protein, 81 aa, Sapajus apella
SQEPVKDVHVARGFSYKKSVHQISAHRGLYRDFRKENVGNVVSLGSTVSTSNRITRLEQRKEPWTLGLHSSNKKSTLRSNY

SEQ ID NO: 28767 - protein, 81 aa, Sapajus apella
SQELLTFKDVSVDFTQEEWGQLAPAHRNLYREVMLENYGNLVSVGYQLSKPGVISQLEKGEEPWLMEREISGVPSLDLESK

SEQ ID NO: 28768 - protein, 81 aa, Puma concolor
SQGPVKDVRVARGFSYKKSVHQIPVHRDLYRDIRKESAGNMVSLGSAVSVSNKIARLEQRKEPWTPGVHSSNKRSILRSNY

SEQ ID NO: 28769 - protein, 81 aa, Pteropus alecto
PVTFGDIPFYFSQEEWGSLDPAQRDLFWDIKRENSRNVALGLGLKSQSQRSQLEEAVTALPGQTGVDVTVAWNPEEAKAWE

SEQ ID NO: 28770 - protein, 81 aa, Macaca fascicularis
QGMATFEDMAVSLTWEEWERLDPARRDFCRESAQKDSGSTVPPSLESRAENKELIPMQEILEAEPQGRLQEAFQGKRPLLS

SEQ ID NO: 28771 - protein, 81 aa, Macaca fascicularis
YMNRVSPFKDMILCFSEEDWSLLDPAQTGFYGEFIIGEDCGVSIPPNELAAQPDLSQREENEPRVPEPQDLQGKEVPQVSY

SEQ ID NO: 28772 - protein, 81 aa, Phascolarctos cinereus
QALVKIEDMAVSLILEEWGCQNLARRNLCRDNRPENYGNVFSQGCGSRTTNEESTSKEEISEATGSHGEISGRFQKEFGAT

SEQ ID NO: 28773 - protein, 81 aa, Macaca fascicularis
SRESITLKDVAVNFSRGEWKKLEPFQKELYKEVLLENFRNLEFLDFPVSKLELISQLKWVELPWLLEEVSKGSRPGIHGAE

SEQ ID NO: 28774 - protein, 81 aa, Sapajus apella
QTDLVTFDSVAVEFTQEEWTLLDPTERNLYRDVMLENYKNLSSVGYQLFKPSLISWMEEEEELSTLPRVLQEWKMCLKMNG

SEQ ID NO: 28775 - protein, 81 aa, Pteropus alecto
SAAYEFLSVDYSERKWKGPALSQRARRRNVMPETHRSVASWGDTRMENSELPPKQEISKGSESSDGTSGDLCEVVPAGPEA

SEQ ID NO: 28776 - protein, 81 aa, Pteropus alecto
SQEQLTFKDISVNFTQEEWGQLTPAHQNLYREVMLENYGNLVSVGYQISKPRVISQLEKGEDPWMTEKEGPGHPSSDLKSK

SEQ ID NO: 28777 - protein, 81 aa, Phyllostomus discolor
SQSLLTFEEVAVYFSQEEWELLDPNQKALYSDVMQENYETVIFLAMFVHLKPKVIFLEQGKESWVQGSTEFLNSPGELPVG

SEQ ID NO: 28778 - protein, 81 aa, Phyllostomus discolor
GHGEPDSASFHPPRIQEEWGLLNPSQKELYWDAMLEKYGSVVSLAGLPPPRLEAPAELEPGALSAGTEDPGSLCQRGESEG

SEQ ID NO: 28779 - protein, 81 aa, Sapajus apella
SQEPVTFADVAVVFTPEEWVFLDSTQRSLYRDVMLENYRNLASVGDQLRKPNASSDLEQRGEQWNTERGVISDTCPEPQLQ

SEQ ID NO: 28780 - protein, 81 aa, Macaca fascicularis
AQLQTMTFKDVEVTFSQDEWGWLDSAQRNLYRDVMLENYRNMAFLVGPFTKPALISWLEAREPWGLNLQAAQPKGNAGVAP

SEQ ID NO: 28781 - protein, 81 aa, Phascolarctos cinereus
PQELLTFEDVALSLTLEEWVQLDLHQKDLYRNVMLENYENVVSLGLSFSKPAVISQLEREKELWLLDIQGAENREVWKSSS

SEQ ID NO: 28782 - protein, 81 aa, Phascolarctos cinereus
FLESVTFKDVAPDFTWEEWEQLEPVQQDLCRDVLLENYRNLVFLGLSTSKTNVTSQIEHMKVPWVKESEAPRGISLYWNTG

SEQ ID NO: 28783 - protein, 81 aa, Desmodus rotundus
ESQSLLTFEEVAVYFSREEWELLDLSQKAVYSDVMQENYETVISLAVPAHQTLAFPEQTNTKDWTVTSELFLPESQTLLTF

SEQ ID NO: 28784 - protein, 81 aa, Oryctolagus cuniculus
IRDQDFGASLLPTAPQEQWRHLDSTQKEQYWDLMLETYGKMVSGAGTSSSKPDLTNSAEYGEELAGLHLHVSEKIPRPACV

SEQ ID NO: 28785 - protein, 81 aa, Rhinolophus ferrumequinum
SQEKLTFRDVSVDFTQEEWGQLAPAHQNLYREVMLENYGNLVSVGYQLSKPRVISQLEKGEDPWITEKEGPGYPSSDLKSK

SEQ ID NO: 28786 - protein, 81 aa, Phascolarctos cinereus
FQESVTFKDVDPDFTWEEWAQLAPVHQDLYKEVLLENYRNLVFLGLSIPKPDVISQLEREEMPWVLESKAPRTICPYFDTD

SEQ ID NO: 28787 - protein, 81 aa, Puma concolor
QAMVKIEDMAVSLILEEWGCQNLARRNLNRDNRQENYGNVFSQGCENRNENEESASKAENAEDSASRGETTGRFQKDFAEK

SEQ ID NO: 28788 - protein, 81 aa, Pteropus alecto
HGKVDSKPCHPPRIQEEWGLLDPSQKELHWDAMLEKYGAGVSLAGLPRPPSDPHGVLELRAPNEGTKSQGNLPPGGESKSR

SEQ ID NO: 28789 - protein, 81 aa, Lynx canadensis
GPVTFGDIPFYFSREEWGSLDPAQRDLFWDIKRENSRNVALGLGPESQSEQSRLEEAATALQGQAGGDVTVSWSPEEAETW

SEQ ID NO: 28790 - protein, 81 aa, Phascolarctos cinereus
PQESFTFKDMAMEFTGEEWVQLNPSQKKLYRDVMLENYRKLVSLGFAISRPDVGKKRNILNARGRYSRRHKEIFQTQLTVH

SEQ ID NO: 28791 - protein, 81 aa, Oryctolagus cuniculus
ALVEGLQRDPGQLLGWEWGLLDPLQKELYWDVMLEKYGTVVSLGLPPPQPGPQHLESEVRGSHRPASESQSLREDPPGCPE

SEQ ID NO: 28792 - protein, 81 aa, Lynx canadensis
SQGPVKDVRVARGFSYKKSVHQIPVHRDLYRDIRKESAGNMVSLGSAVSVSNKIARLEQRKEPWTLGIHSSNKRSILRSNY

SEQ ID NO: 28793 - protein, 81 aa, Lynx canadensis
SQGLVTFKDVAVCFSQDQWSDMDPTQKEFYGEYVLEEDCGIVVSLSFPIPRLDEISHVREEEPLVPDIPEPQEPQEPEILS

SEQ ID NO: 28794 - protein, 81 aa, Phyllostomus discolor
SGESMTLEDISVNFSRGEWRKLEPFQRQLYRDVLLENFRNLEFVGFPVSKLDLVSQLKWVDLPRLLEKEVSKGSRPECEPR

SEQ ID NO: 28795 - protein, 81 aa, Sapajus apella
RLKPEESQSVGVSQDEAFWKTYQGLQEQLSRNTHKETEPVYERALFVLPKPKVISCLEQGEEPWVQVSPEFKDSARGSSTG

SEQ ID NO: 28796 - protein, 81 aa, Phascolarctos cinereus
FQETVTFQDVAPDFTWEEWAQLDPGQQDLCRDVLMENYSNLAFVGLSNSKSDVISQLEHGEMPWLPRSEAPRGVCPDKDIE

SEQ ID NO: 28797 - protein, 81 aa, Phascolarctos cinereus
QTLVKTEEEVKFLVSEEWQCFDPAQKNTCGNVALKNFRNLDSLTGEIIIKDGMLLPKQEISKEIDSQEEVSHALRRDCSPQ

SEQ ID NO: 28798 - protein, 81 aa, Oryctolagus cuniculus
SLGSELFRDVAIVFSQEEWQWLAPVQRDLYRDVMLETYSSLVSLGLCISKPDVISFLEQGREPWIEERVTVGDLCPVLESQ

SEQ ID NO: 28799 - protein, 81 aa, Myotis lucifugus
FQERLTFKDITVNFTQEEWGQLTPAHRNLYREVMLENYGNLVSVAGYEFSKPRVISQLEKGEEPWITEKEGPGHPSADLKS

SEQ ID NO: 28800 - protein, 81 aa, Myotis lucifugus
HSAHCASPVSALPQVRNIGDQAAETVLQMVRPQGSAVYKLLSVDYTEQKWEDPSLSQRAPYQNIMLETNCSMASLGNDSVP

SEQ ID NO: 28801 - protein, 81 aa, Sapajus apella
ETQPGLVTMKHLAIDFPQQLHPAQKNFCKNGLWENYSDVGSAGHCMAKPDLVSLLEQEKEPWMVKRELTGSLFSGQQSVCE

SEQ ID NO: 28802 - protein, 81 aa, Phyllostomus discolor
QPQEALIFKDVEVTFSQDEWGWVAPAQRNLYRDVMLENYGNLASLVGPLAKPALISWLETREPWGLNVQGAQPKGDPGAAP

SEQ ID NO: 28803 - protein, 81 aa, Macaca fascicularis
VKIEDMAVSLILEEWGCQNLARRNLSRDHRQENYGSTFPQGGENRNENEESTSKAETTEDLASRGETAGRFQKEFGEKRDQ

SEQ ID NO: 28804 - protein, 81 aa, Phascolarctos cinereus
FQETITFQDVAPDFTWEEWAQLDPGQQDLYRDVLMENYRNLVFIGLSISKPDVISQLEHGEVPWLLKNEAPRSICPYWDIG

SEQ ID NO: 28805 - protein, 81 aa, Phascolarctos cinereus
FQESVTFKDVVPDFTWEELVQLDPVEQNLYRDVLLENYRNLVFLGLSASKPDVISQLEHGKVPWMLESEAPRDSDSSPEAR

SEQ ID NO: 28806 - protein, 81 aa, Phascolarctos cinereus
SAWSQMPVTFEDMTMYLSQEEWRCLDPVQRERYRDVLQEKYGLPVPKPNLIAQLDRREGLWTSSLQAFKERNIPRDNHKEC

SEQ ID NO: 28807 - protein, 81 aa, Myotis lucifugus
PQLPESLEDVAMYISQEEWGHQDPSKRALSRDTVQESYENVDSLESQVPNQEALSIQVEQGRKPWEPSAQICKEGLSPRNP

SEQ ID NO: 28808 - protein, 81 aa, Phascolarctos cinereus
GFQEPVTCEDVTMSFSPEEWRCLNSAQRVLYRGIVQENYRNVDSVGLAKPLLISRVEHGKDTCIPDLQGCKETEVLSSSCT

SEQ ID NO: 28809 - protein, 81 aa, Myotis lucifugus
AAQELVTFQDVFVDFSQEELNSLSAAQRRLHREVTLENYRSLVSLGYRFPKPDIIAQLEEEESRAMEEDGDTKTGPDWETG

SEQ ID NO: 28810 - protein, 81 aa, Macaca fascicularis
IRDQDLGASLLPAAPQEQWRHLDSTQKEQYWDLMLETYGKMVSGAGISHSKPDLTNSIEYGEELAGLYLHVNEKVPRPTCI

SEQ ID NO: 28811 - protein, 81 aa, Phascolarctos cinereus
SQESVTFKDVAVDFTQEEWGQLDSDQRDLYQAVMLENYRNLVFLGLPVSKPELISHMDQGEEPGILERETCGESIHITQHP

SEQ ID NO: 28812 - protein, 81 aa, Myotis lucifugus
IGDQDFGTSLLHTAPQEHWKHLDSIQKEQYWDLMLETYGKMVSGDCISNSKPDLTNSTECGEELAGLHLHVSEKIPRPTCR

SEQ ID NO: 28813 - protein, 81 aa, Phyllostomus discolor
SQSLLTFEEVAVYFSREEWELLDPSQKALYSDVMKENYETVVSLAVPAHQTLVFPEQTNTKDWTVASELFLPESQPYLCSP

SEQ ID NO: 28814 - protein, 81 aa, Phyllostomus discolor
AEELVTFQDVFVDFNLEELTSLNAAERKLHREVTLENYQNLVSVGYQFSKPDIISQLEEEESCVMQEESATETGQDWERGP

SEQ ID NO: 28815 - protein, 81 aa, Phyllostomus discolor
SQSLLTFEEVAVYFSREEWELLDPSQKALYSDVMKENYETVVSLALFVLPKPKVISCLEQGKEPWVQGSTEFMESPGELPI

SEQ ID NO: 28816 - protein, 81 aa, Phascolarctos cinereus
SQDSVTFKDVAVMFSRKEWWHLQPAQMELYRDVMLENYKNMVSVGLLTSKPELIAQLERGEAPWMRSRNVPRGPGAGSETR

SEQ ID NO: 28817 - protein, 81 aa, Phascolarctos cinereus
NHVTQLKDVILCFSEEEWSLLDPAQTGFYGEFIIEEDYGVSLPMNYPGPQPVPERINELPKVMQLPDSRVEEDEPCVPEFQ

SEQ ID NO: 28818 - protein, 81 aa, Desmodus rotundus
QAMVKIEDMAVSLILEEWGCQNLARRNLNRDNRQETYGNVFSQGCESRNENEQSTSKAEIAEDSASRGETRGRTQKDFGEK

SEQ ID NO: 28819 - protein, 81 aa, Phascolarctos cinereus
SQELVTFGDVAVYFSQEAQGQLDPTPPDLLQDQTQENYENGVSQRFPVPRPNMISQLKQEEKLQNPDLQGSKEKENSKDSQ

SEQ ID NO: 28820 - protein, 81 aa, Phyllostomus discolor
LRDQPFGASLLQTTPQEPWWHLDSTQKEQYWDLLLETYGKMVSGGISNSKPDLTNSTEYGEELAGFHLYVSEKLPKPTCIG

SEQ ID NO: 28821 - protein, 81 aa, Puma concolor
SQELLTFKDISVDFTQEEWGQLAPAHRSLYREVMLENYGNLVSVGYQLSKPGVISQLEKGEEPWLIEREVSGGPRSDLESK

SEQ ID NO: 28822 - protein, 81 aa, Gorilla gorilla
DTVAYEDLSVDYTQKKWKGLTLSQRALQWNMMPENHYSMASLAGENVMKGSELTPKQEIFKGSESSNRTSGGLFGVVPGAA

SEQ ID NO: 28823 - protein, 81 aa, Gorilla gorilla
QEPVTFKDVVVEFSKEEWGQLDSAVKNLYRNVMLENFRNLNSLRKAHLLSKPFESLKLESKKKRWIMEKEIPRNTIFDMKS

SEQ ID NO: 28824 - protein, 81 aa, Phascolarctos cinereus
AQDALTFQDVAVDFTWEEWGQLDPAQQNLYRDVMLENYQNLISLGFPVSKPEVISQLEQGEVPWALKRAVAEGSCPDWEAR

SEQ ID NO: 28825 - protein, 81 aa, Ailuropoda melanoleuca
EPVTFKDVIVEFSEEEWGLLDPAVKTLYRDVMLENYRNLNSLHQGTEQLLSKPVEISKLESKERRWTVEQETPSTSVLDRE

SEQ ID NO: 28826 - protein, 81 aa, Gorilla gorilla
SQEPVKDVHVARGFSYRKNVHQIPAQRDLYRDFRKENVGNVVSLGSAVSTSNKITRLEQRKEPWTLGLHSSNKRSILRSNY

SEQ ID NO: 28827 - protein, 81 aa, Lynx canadensis
EGESITFKDVAVNFSRGEWRKLEPFQKELFKEVLLENFRNLEFLGFAVSKLDLISQLKWVELPWLLEKEVSKDALLDESTL

SEQ ID NO: 28828 - protein, 81 aa, Macaca fascicularis
IRDQDLGASLLPAAPQEQWRHLDSTQKEQYWDLMLETYGKMVSGGISHSKPDLTNSIEYGEELAGLYLHVNEKVPRPTCIG

SEQ ID NO: 28829 - protein, 81 aa, Phascolarctos cinereus
GRKDLVTFEDVSVDLPKKEWKSSAAAQRFFRDLMLENYRDVVSLAGFPFSKPTGISRREEEPWGLNRQEPLDLEGGRSTCT

SEQ ID NO: 28830 - protein, 81 aa, Phascolarctos cinereus
GKESVTFKDVAVEFTKEEWVQLNPSQKKLYRDVMLENYRNLVSLGFAASRPNDSDQLERKEVSSLPEADIPRSSCPESREF

SEQ ID NO: 28831 - protein, 81 aa, Canis lupus
SQDLVTFKDVVVDFSPEELTYLSAAQRNLYREVMLENYRNLVSLGYQFSKPDIISQLEEEESHVREEDINTDKCQDWEKRP

SEQ ID NO: 28832 - protein, 81 aa, Gorilla gorilla
SCESITLKDIAVNFSRGEWKKLEPFQKELYKEVLLENLRNLEFLDFPVSKLELISQLKWVELPWLLEEVSKGSRLDIHGAV

SEQ ID NO: 28833 - protein, 81 aa, Ailuropoda melanoleuca
PQEPVTFADVAVLFTPEEWMFLDSAQRSLYRDVMLENYRNLASVGDQLGKPSTFSHLEPGEERWPPERRSFPGTHPEPQHQ

SEQ ID NO: 28834 - protein, 81 aa, Puma concolor
GPVTFGDVPFYFSREEWGSLDPAQRDLFWDIKRENSRNVALGLGPESQSKQSRLEEAAAALQGQAGGGGGRGGDVTVSWSP

SEQ ID NO: 28835 - protein, 81 aa, Canis lupus
GHREPTSTSFHPPRIQEEWGLLDPSQKELYWDAMLEKYGTVVSLAGIPAPQPEAQAELEPGALRTGTESLHLGDENESHCE

SEQ ID NO: 28836 - protein, 81 aa, Gorilla gorilla
VKIEEVADVAVSFILEEWGHLDQSQKSLYRDDRKENYGSITSMGYESRDNMELIVKQISDDSESHWVAPEHTERSIPQDPD

SEQ ID NO: 28837 - protein, 81 aa, Phyllostomus discolor
QEPVTLKDVVVEFSTEEWGQLDLAVRNLYRDVMLENYRNCNSLRKELQFSKPIEVPKLEIKTKRWMMEQEIPRTMVFGKKQ

SEQ ID NO: 28838 - protein, 81 aa, Canis lupus
IRDQDFGASFLQAASPEQWRHLDSTQKEQYWDLMLETYGKMVSGGISSSKSDLTNSAEYGEELAGLHLHVSEKIPRPTLIG

SEQ ID NO: 28839 - protein, 81 aa, Neophocaena asiaeorientalis
ASVTFEDVAVYFSWEEWSLLDKAQRHLYHDVMLEIFTLISSLGCLCGIENDKAPSGQSVSQERMPQIRTLKPDPSTQKAHL

SEQ ID NO: 28840 - protein, 81 aa, Canis lupus
HREPTSTSFHPPRIQEEWGLLDPSQKELYWDAMLEKYGTVVSLGAPRHPPGPPPLALTCKSPSPAPMSGLLPDCPSPQQEY

SEQ ID NO: 28841 - protein, 81 aa, Ailuropoda melanoleuca
DQEFGASFLQASPPEHWRHLDSTQKEQYWDLMLETYGKMVSGALCVPGISNSKCDLTNSTEYGEELAGLHLHVGEKISRPT

SEQ ID NO: 28842 - protein, 81 aa, Ailuropoda melanoleuca
QPQEAVTFKDVEVTFSQDEWGWLDPAQRNLYRDVMLENYRNVVSLVGPFTKPVLISWLEAREPWGLNAQGAQPKGNLGVAP

SEQ ID NO: 28843 - protein, 81 aa, Phyllostomus discolor
SLLTFEDVIVSFSEEEWELLDPTQKILYHDVMQENYETVISLGLKLRHDTGNEPLISASTLEIEASGCKVLRKARMKVAQK

SEQ ID NO: 28844 - protein, 81 aa, Canis lupus
LVTKESMTFRDVAVDITQEDWEIMRPVQKELYKTVTLQNYWNMVSLGLTVYRPTVIPILEEPWMVIKEILEGPSPEWKTEP

SEQ ID NO: 28845 - protein, 81 aa, Canis lupus
FQSLLTFEEVAVYFSQEEWELLDPTQKALYNDVMRENYETVISLALFVLPKPKVISCLEQGEEPWVQGPLEFKDNPGELPT

SEQ ID NO: 28846 - protein, 81 aa, Nomascus leucogenys
SQEPVKDIHVARGFSYKKNVHQIPAHRDLYRDFRKENIGNVVSLGSTVSTSNKITRLEQRKEPWTLGLHSSNKRSILRSNY

SEQ ID NO: 28847 - protein, 81 aa, Muntiacus muntjak
AQESMTLKDVAVTFSRGEWRKLEPSQKEIYKEVLLENYRNLEFLGFPVSKLDLVSQLKWAGPPRLLQKEVSKGCRPDVLME

SEQ ID NO: 28848 - protein, 81 aa, Muntiacus muntjak
LLTFEEVAIYFSQEEWELLDPTQKALYNDVMHENYETVVSLARRFNPETVPRQDTLLLYNPKECRGKKVCPFFLLENSRPL

SEQ ID NO: 28849 - protein, 81 aa, Ailuropoda melanoleuca
HALPATHVPAPPHEGGPRDQAMASALFTADSQAMVKIEDMAVSLILEEWGCQNLARRNLNRDNRQENYGNVFSQGSFCCLK

SEQ ID NO: 28850 - protein, 81 aa, Gorilla gorilla
ETQPGLVTIKNLAVDFPQQLHPAQKNFCKNRIWENNSDLGSAGHCVAKPDLVSLLEQEKEPWMVKRELTGSLFSGQRSVRE

SEQ ID NO: 28851 - protein, 81 aa, Ailuropoda melanoleuca
LESVTFEEVAVDFSQEEWALLDAAQKILYRDVMLENYRNLASLDWDIQLKSKDGIPMQNVPGEKTCNGIKLAPTQPGKKPL

SEQ ID NO: 28852 - protein, 81 aa, Desmodus rotundus
QPQEALTFKDVEVTFSQDEWGWLAPAQRNLYRDVMLENYSNLASLVGPLIKPALISWLETREPWGLNVQGAQPKDDPGAAP

SEQ ID NO: 28853 - protein, 81 aa, Macaca fascicularis
QTDLVTFDSVAVEFTQEEWTLLDPTQRNLYCDVMLENYKNLSSVGYQLFKPSLISWLEEEEELSTLPRVLQEWKMCLKTKG

SEQ ID NO: 28854 - protein, 81 aa, Ailuropoda melanoleuca
AASISFHAPRIQEEWGLLDPSQKELYWDAMLEKYGTVVSLAGIPAPPPEAQAESEPEALRSGTEGRRSLHPGDESESHCEG

SEQ ID NO: 28855 - protein, 81 aa, Gorilla gorilla
QTDLVTFDSVAVEFTQEEWTLLDPTQRNLYSDVMLENYKNLSSVVYQLFKPSLISWLEEEEELSTLPRVLQEWKMCLKTNG

SEQ ID NO: 28856 - protein, 81 aa, Phyllostomus discolor
SQEQLTFKDISVNFSQEEWGQLTPAHRSLYREVMLENYGNLVSVAGYELCKPRVISKLEKGEEPWISEKEGPGHHSSDLKS

SEQ ID NO: 28857 - protein, 81 aa, Phyllostomus discolor
FERQLGLVTIVNMASDFSQQLDPSPESFHKNMTWETRDLEAAGCCVSRPDVVSVLDQGKEPWLVKREFTGLLSGHQSVHET

SEQ ID NO: 28858 - protein, 81 aa, Phascolarctos cinereus
RLQDSVMFEDVAIHFSEAEWSHLSPAQRALYRNVMLENYGNLASLASPFPKPGVISKLEQASWDLQEALDQEDLKNTYADG

SEQ ID NO: 28859 - protein, 81 aa, Gorilla gorilla
IRDQDLGASLLPAAPQEQWRHLDSTQKEQYWDLMLETYGKMVSGAGISHPKSDLTNSIEFGEELAGLYLHVSEKIPRPTCV

SEQ ID NO: 28860 - protein, 81 aa, Ailuropoda melanoleuca
SVTFRDVAVLFSRDEWRHLDSTQRTLYREVMLENYGTLVSLGLKTQPEMEALPPRQGISIEETFQGMMKKRSIKCSHWDNN

SEQ ID NO: 28861 - protein, 81 aa, Phyllostomus discolor
GHGEPDSASFHPPRIQEEWGLLNPSQKELYWDAMLEKYGSVVSLGLPPPRLEAPAELEPGALSAGTEDPGSLCQRGESEGP

SEQ ID NO: 28862 - protein, 81 aa, Gorilla gorilla
GMVTFEDMAVSLTWEEWERLDPARRDFCRESAQKDSGSTVPPSLESRVENKELIPMQQILEEVEPQGRLQEAFQGKRPLFC

SEQ ID NO: 28863 - protein, 81 aa, Lynx canadensis
QEPISFKDVIVEFSKEEWGQLDPAVKNLYRDVMLENYRNLNSLHQEHVFSKPVELSELESKDRRWIIEQEIPSTSFFDRER

SEQ ID NO: 28864 - protein, 81 aa, Macaca fascicularis
SQEPVKDVHVARGFSYKKSVHQIPAHRDLYQDFRKENVGNMVSLGSTASTSNKITRLEQRREPWTLGLHSSNKRSILRSNY

SEQ ID NO: 28865 - protein, 81 aa, Gorilla gorilla
SCESITLKDIAVNFSRGEWKKLEPFQKELYKEVLLENLRNLEFLDFPVSKLELISQLKWVELPWLLEEVSKGSRLASQEGD

SEQ ID NO: 28866 - protein, 81 aa, Phyllostomus discolor
SQEQLTFKDISVNFSQEEWGQLTPAHRSLYREVMLENYGNLVSVGYELCKPRVISKLEKGEEPWISEKEGPGHHSSDLKSK

SEQ ID NO: 28867 - protein, 81 aa, Macaca fascicularis
SQELLTFKDVSVDFTQEEWGQLAPAHRNLYREVMLENYGNLVSVGYQLSKPGVISQLEKGEEPWLMEREISGVPSSDLESK

SEQ ID NO: 28868 - protein, 81 aa, Phyllostomus discolor
ESQSLLTFEEVAVYFSREEWELLDPSQKALYSDVMKENYETVVSLAVPAHQTLVFPEQTNTKDWTVASELFLPESQTLLTL

SEQ ID NO: 28869 - protein, 81 aa, Acinonyx jubatus
PAATSFHPPRIQEEWGLLDRSQKELYWDAMLEKYGTVVSLAGLPAPLPEARVESEPGVLRSGTEGQRSLHPGLHREQGWRP

SEQ ID NO: 28870 - protein, 81 aa, Acinonyx jubatus
SQGPVKDVRVARGFSYKKSVHQIPVHRDLYRDIRKESAGNMVSLGSAVSVSNNIARLEQRKEPWTLGVHSSNKRSILRSNY

SEQ ID NO: 28871 - protein, 81 aa, Odocoileus virginianus
GDQDFGASLLHTASQEQWRHLDSTQKEQYWDLMLETYGKMVSGGAGISNARPDLTDPAGYGAELAGPHLQASEKIPRPTCI

SEQ ID NO: 28872 - protein, 81 aa, Cebus imitator
TVVFEDLSVDYTQKKQKCPALSQRAMHWNVMPENDHSMASLGGTETGDVCGDTFKELEGQTSDEEGSRLENDFLEITDEDK

SEQ ID NO: 28873 - protein, 81 aa, Ovis aries
SQSLLTFEEVAMYFSQEEWELLDPTQKALYNDVMQENYETVISLAVFVLPKPKVISYLEQGKDPYIQGSPVFKDNPEELLS

SEQ ID NO: 28874 - protein, 81 aa, Ovis aries
LVTFEDVAVDFSPEELPYLSASQRNLYREVMLENYRNQPPSYKSPSSTGYQFPKPDIISQLEEEESHAREEDGSTVTCQDW

SEQ ID NO: 28875 - protein, 81 aa, Rhinopithecus roxellana
PQLPESLEDVAMYISQEEWGHQDPSKRALSRDTVQESYENVDSLESHIPSQDVPGTQVGQGGKLWDPSVQSCKEGLSPRGP

SEQ ID NO: 28876 - protein, 81 aa, Callithrix jacchus
VKIEEVADVAVSFILEEWGHLDQSQKSLYRDDRKENYGSITSMDYESRDNMELMVKQVSDDTESQWMAPEHTERSVPQDPD

SEQ ID NO: 28877 - protein, 81 aa, Odocoileus virginianus
NFALTASMVCLHETETKEIPSEQNVSLEALSQVRTPKVVTFKDVAMTFTQEEWRQLDLDQRTLFREVMLETCGLLVSLGTC

SEQ ID NO: 28878 - protein, 81 aa, Bos taurus
AEELVTFEDVAVHFSPEELPYLSASQRNLYREVMLENYRNLVSLGYQFPKPDIISQLEEEESHAREEDGSTVTCQDWEEQS

SEQ ID NO: 28879 - protein, 81 aa, Rhinopithecus roxellana
SQEPVKDVHVARGFSYKKSVHQIPAHRDLYRDFRKENVGNVVSLGSTASTSNKITRLEQRKEPWTLGLHSSNKRSMLRSSY

SEQ ID NO: 28880 - protein, 81 aa, Odocoileus virginianus
EPTPAPFQPPRLQEWGLLEPSQKELYWDAMLEKYGSVVSLGLPHPLPESRAKSQPEALSTGSGSEGRRNLRPGDESEGRPG

SEQ ID NO: 28881 - protein, 81 aa, Odocoileus virginianus
QEPVKFKDVVVEFSKEEWGQLDPDVKTLYRRVMLENYRNLNSLHKEHLLSKPVETSKLESKKESWIMEQEIPRTAVADRER

SEQ ID NO: 28882 - protein, 81 aa, Odocoileus virginianus
LLTFEEVAMYFSQEEWELLDPTQKALYNDVMQENYETVISLAVPAHQLLAFSEQTNTSEWTVAPELILPESQSLLTFEEVA

SEQ ID NO: 28883 - protein, 81 aa, Bos taurus
QELLTFKDISVDFTQEEWGQLAPAHRNLYREVMLENYGNLVSVGKDRLHIHPESYLKSKTETSASNAKYNILQEQLYHGMM

SEQ ID NO: 28884 - protein, 81 aa, Acinonyx jubatus
PAATSFHPPRIQEEWGLLDRSQKELYWDAMLEKYGTVVSLGLPAPLPEARVESEPGVLRSGTEGQRSLHPGDESESHCEGP

SEQ ID NO: 28885 - protein, 81 aa, Cebus imitator
GHQEPASTSFHPPRIQEEWGLLDRSQKELYWDAMLEKYGTVVSLGLPPHQPEAQAQSELGVLLTGAGVCRNLGSGDENEGL

SEQ ID NO: 28886 - protein, 81 aa, Callithrix jacchus
SQTLVTFKDVFVDFTREEWKLLDTAQQIVYRNVMLENYKNLVSLGYQLTKPDVILRLEKGEEPWVVERGIHQETHPDSETA

SEQ ID NO: 28887 - protein, 81 aa, Bos taurus
PLTFEDVALYFSEEEWKIMTPDEKTLYLDVMQELYEDVASVGLKLKNDTGNDPPVSLPTLEIQPSGCEVLRKATMKDAETT

SEQ ID NO: 28888 - protein, 81 aa, Cebus imitator
PPNRVSPFKDMILCFSEEDWSLLDPAQTGFYGEFIIGEDCGVSMPPNELAAQPDLSQGEENEPRVPELQDLQGKEVPQVSY

SEQ ID NO: 28889 - protein, 81 aa, Ursus maritimus
SQSFLTFEEVAMYFSQEEWELLDPTQEALYNDVMWENYETVISLALFVLPKPKVISYLDHEEEPWVQGPLEFKNSPGDLPA

SEQ ID NO: 28890 - protein, 81 aa, Rhinopithecus roxellana
GRQEAASTSFHPPRIQEEWGLLDRSQKELYWDTMLEKYGTVVSLGLPPHQPEAQAQSELGMMLMGTGVCRSLRSGNESEGP

SEQ ID NO: 28891 - protein, 81 aa, Odocoileus virginianus
QGLVPAQDVAVPLTWEEWERLGPAQKPFFRESAPEGHENAVSPSSETRIENKELIPKQEILEVEPPGQLQGFQERAPLSSE

SEQ ID NO: 28892 - protein, 81 aa, Cebus imitator
QEPVTFKDVVVEFSKEEWGQLDSAVKNLYRDVMLENFRNLNSLRKAHLLSKPVGSLELKNKKKRWITEKEISRKTISDMQS

SEQ ID NO: 28893 - protein, 81 aa, Bos taurus
SQGPVKDVHMARGFSYKKSVHQIPAHKDLYRDIRKESVGNMVSLGSTVSAANKIARLEPRKEPWTISLQSSNKRTVLQSNY

SEQ ID NO: 28894 - protein, 81 aa, Ovis aries
HHLERLTSEDVAIKFTQEEWEFLDPAQRALYRDVMLETYRNLLSVGEDDFLPELPLGICIFPVCPLGGPDVFHLRVLVTGA

SEQ ID NO: 28895 - protein, 81 aa, Odocoileus virginianus
KIEDVADVAVSFILEEWGHLDQSQKSLYRDDRKENYGSMTSMDYESRSDNVELTVKQISDEAESSWMTSGGPERTVPSSQE

SEQ ID NO: 28896 - protein, 81 aa, Odocoileus virginianus
PQEPVTFADVAVLFTPEEWLFLDSAQKSLYRDVMLENYRNLASVGDQLCKTRMSSHMEQREELCVTERGVFPGAQLGPHLQ

SEQ ID NO: 28897 - protein, 81 aa, Callithrix jacchus
VKIEEVADVAVSFILEEWGHLDQSQQSLYRDDRKENYGSITSMDYESRDNMELMVKQVSDDTESQWMAPEHTERSVPQGPD

SEQ ID NO: 28898 - protein, 81 aa, Acinonyx jubatus
SQGLVTFKDVAVCFSQDQWSDMDPTQKEFYGEYVLEEDCGIVVSLSFPIPRLDEISHVREDEPLVPDIPEPQEPQEPEILS

SEQ ID NO: 28899 - protein, 81 aa, Cebus imitator
SCESITLNDVAVNFSRGEWKKLEPFQKELYKEVLLENFRNLEFLDFPVSKLELISQLKWVELPWLLEKEVSKGSHPDESAL

SEQ ID NO: 28900 - protein, 81 aa, Monodon monoceros
QGLVTFKDVAVCFSQDQWSDLDPTQKEFYGEYVLEEDCGIVVSLSAFPIPRLDEISHMGEEEPLIPEIPEAQEPQEPEILS

SEQ ID NO: 28901 - protein, 81 aa, Macaca mulatta
SQSLLTFEEVAMYFSQEEWELLDPTQKALYNDVMQENYETVISLALFVLPKPKVISCLEQGEEPWVQVSPEFQDSAGKSPT

SEQ ID NO: 28902 - protein, 81 aa, Ovis aries
GNQDFGASLLHTASQEQWRHLDSTQKEQYWDLMLETYGKMVSGGAGISSARPDLTDPAGYGTELAGPHLHASEKIPRPTCI

SEQ ID NO: 28903 - protein, 81 aa, Ovis aries
SYRSKTMAQGSLTFSDVAIGFSQQEWECLDPVQKTLYRDVMMENYGNLVSLGHSISKPNVITLLEQGKEPWIVVREETRSW

SEQ ID NO: 28904 - protein, 81 aa, Ovis aries
KLPVVFEDVAVYFTREEWGTLDKRQKELYRDVMRMNYELLASLATGPAAAKPDLISKLERRAAPWIRDPHRPKWGKGHPPS

SEQ ID NO: 28905 - protein, 81 aa, Ovis aries
EKLPVVFEDVAVYFTREEWGTLDKRQKELYRDVMRMNYELLASLGPAAAKPDLISKLERRAAPWIRDPHRPKWGKGHPPSA

SEQ ID NO: 28906 - protein, 81 aa, Ovis aries
SQRPLTFEDVALYFSEEEWLIMDPNQRTLYLDVMQELYENVTSLGLLGNVSNYGLKIQSSNESFKAIQFKMTLKKYKCDTK

SEQ ID NO: 28907 - protein, 81 aa, Vulpes vulpes
VMFEEVSVCFTSEEWECLGPIQRALYWDVMLENYGNVTSLEWETMTENEEVTPKPTISQRADSQKGTFKRLQGSVPQTLDF

SEQ ID NO: 28908 - protein, 81 aa, Otolemur garnettii
QELVTFKDVVVDFSLEELSYLSAAQRNLYREVMLENYRNLVSIGSLFILLKVSVSLSKESRRNFTFLLDWEKTSKTKELTP

SEQ ID NO: 28909 - protein, 81 aa, Vulpes vulpes
SLLTFEEVAMYFSQEEWELLDPTQKALYNDVMRENYETVISLAVPVHKILAFPEQIITKESTVAPELVLPESQSLLTFEEV

SEQ ID NO: 28910 - protein, 81 aa, Otolemur garnettii
LPKMGSVGDWEVLAESQDALGLGRHAEREFKDLLEDNYGDSVCLGVPVPKPSITSQKEQGPEFWCVSLKNSGKRNTTDYSL

SEQ ID NO: 28911 - protein, 81 aa, Ovis aries
QAMVKIEDMAVSLILEEWGCQNLARRNLNRDARQENYGNVISQGCEHRNENEESTSKAESAEDSASHGETAGKFQKDVGEK

SEQ ID NO: 28912 - protein, 81 aa, Rhinopithecus roxellana
SQELLTFKDVSVDFTQEEWGQLAPAHRNLYREVMLENYGNLVSVGYQLSKPGVIFQLEKGEEPWLMEREISGVPSSDLESK

SEQ ID NO: 28913 - protein, 81 aa, Rhinopithecus roxellana
QEPVTFKDVVVEFSKEEWGQLDSAVKNLYRNVMLENFRNLNSLRKAYLFSKPVESLKLESKKKRWIMEKEIPWKTVFDMQS

SEQ ID NO: 28914 - protein, 81 aa, Ovis aries
KIEDVADVAVSFILEEWGHLDQSQKSLYRDDRKENYGSMTSMDYESRNDNVELTVKQISDEAESSWMTSGGPERIVPLSQE

SEQ ID NO: 28915 - protein, 81 aa, Acinonyx jubatus
LLTFEEVAMYFSQEEWEFLDPTQEALYNDVMRENYETVISLGIKHKSDTENHQPIRVSDLEIQAPGDIVSKKARAKVPQKT

SEQ ID NO: 28916 - protein, 81 aa, Bos taurus
PLTFEDVALYFSEEEWKIMTPDEKTLYLDVMQDVYEDVASVGLKLKNDTGNDPPVSLPTLEIQPSGCEVLRKATMKDAETT

SEQ ID NO: 28917 - protein, 81 aa, Ovis aries
QAQSTFKDVFLDFTPEKWECLDPAQRTLYKDMIVETLRNLLSVDVSQIQTIKKLQAKGNSGKEEIFQRVMFGRAKSHEIED

SEQ ID NO: 28918 - protein, 81 aa, Ovis aries
RAKFPQVPVTLEDVAVYLSQEEWGCLDVAQQDHSCDVLLEDAGAVHGSHLEDGEDASLSTAWAQALQDLGPGPGQARPQRP

SEQ ID NO: 28919 - protein, 81 aa, Otolemur garnettii
PQLPESIEDVAVYISQEEWGHQDPSKRALSRDTVQESYENVDSLESHIPRQEIPTTQVEQERKPWDANVQSCKEGLSLRSP

SEQ ID NO: 28920 - protein, 81 aa, Rhinopithecus roxellana
DTQPGLVAIKNLAVDFPQHLHSAQKNFCKNGIWENHSDLGSAGHCVAKPDLVSLLQQEKEPWMVKRELTGSLLSGQLSVRE

SEQ ID NO: 28921 - protein, 81 aa, Tursiops truncatus
QEPVTFKDVVVEFSEEEWGQLDPAVKNLYRDVMLENYRNLNSLHKEHLLSKPVETSRLESKEKSWIMEQEILRTTVFDREI

SEQ ID NO: 28922 - protein, 81 aa, Odocoileus virginianus
SQELLTFKDISVDFTQEEWGQLAPAHRNLYREVMLENYGNLVSVGCQLSKPSVISQLEKGEEPWMTEKEGAGDPSSDLKSK

SEQ ID NO: 28923 - protein, 81 aa, Cebus imitator
SQEPVKDVHVPRGFSYKKSVHQIPAHRGLYRDFRKENVGNVVSLGSTVSTSNRITRLEQRKEPWTLGLHSSNKKSTLRSNY

SEQ ID NO: 28924 - protein, 81 aa, Bison bison
SAWSQVPVALEDVAVYLSQEEWGCLDLAQQDHSCDVLLEDAGLPTPGPCLTALQGQGEDPRDPAQAASGPREVSGGASSER

SEQ ID NO: 28925 - protein, 81 aa, Callithrix jacchus
SQELLTFKDVSVDFTQEEWGQLAPAHRNLYREVMLENYGNLVSVGYQLSKPGLISQLEKGEEPWLMEREISGVPSSDLESK

SEQ ID NO: 28926 - protein, 81 aa, Callithrix jacchus
GPVASADIPFYFSQEEWGTLDPAQRDLFWDIKRENSRNTTLGLGLKGQSERSRPEEVVPALPGQAALGPVVGARRGRPPTR

SEQ ID NO: 28927 - protein, 81 aa, Bison bison
SAEPLTFKDIIVDFTQEEWGHLAPAHQNLYREVMLENYGNLVSVAGYQLSKPGVVSQLEKGEEPWLMKREISGGPSPGKSK

SEQ ID NO: 28928 - protein, 81 aa, Cebus imitator
AELPVVFEDVAVYFTREEWGMLDKRQKELYRDVMRMNYELMASLGPAAAKPDLISKLERRAAPWIKDPNGPKWGKGRPPGN

SEQ ID NO: 28929 - protein, 81 aa, Callithrix jacchus
LLKVEDVALSLAPEWTQLDSSQVNLYRDEKQENHGSLASLGGEIQTQSRDLPPAEELPEKEHGKISCHLSEDIVQIPTCAE

SEQ ID NO: 28930 - protein, 81 aa, Callithrix jacchus
TQGSLTFKDVAIEFSQEEWKCLDPVQKALYRDVMLENYRNLGFLGLCLPDLDIISMLEQGKEPWTVVSQVKITRNPNCGEC

SEQ ID NO: 28931 - protein, 81 aa, Saimiri boliviensis
DSVVFEDLSVDYTQKKQKCPALSQRAMHWNMMLENDHSMASLAGENKLESSELTPKQKIFKGSESSNRTSGELFGVVPGGT

SEQ ID NO: 28932 - protein, 81 aa, Acinonyx jubatus
PHWLVTFRDVAIDFSQEEWECLSSTQRDLYRDVMLENYSNLISLAGCAIPKPDVFSLLEQGKDPWMVTRAMTRRWSSDLES

SEQ ID NO: 28933 - protein, 81 aa, Odocoileus virginianus
EDPVTFLDVAVDFSTEEWGLLDPTQRTEYHDVMLETFGHLVSVGWETTLDSKQLPPQPGLSEEGPACPLKEEEWSSADDAR

SEQ ID NO: 28934 - protein, 81 aa, Cebus imitator
LPLQGLVTMKHLAIDFPQQLHPAQKNFCKNGLWENYSDVGSAGHCMAKPDLVSLLEQEKEPWMVKRELTGNLFSGECKRAC

SEQ ID NO: 28935 - protein, 81 aa, Rhinolophus ferrumequinum
LVTKESMTFKDVAVDITQEDWELMRPVQKELYKTVTLQNYWNMVSLGLTVYRPTVIPLLEEPWMVIKEILEGPSPEWETEA

SEQ ID NO: 28936 - protein, 81 aa, Phyllostomus discolor
SIQDLVKAKDVCLTWGEWKQLDPIQRDFYRENVLKDYGNTVLPSLETRTQNKELIPKQEILEVEPQMQLQEGSPWKAPLYS

SEQ ID NO: 28937 - protein, 81 aa, Bison bison
SQSLLTFEEVAMYFSQEEWELLDPTQKALYNDVMQENYESVIFLALFVLPKPKVISCLEQGEEPWVQRPLEFKDSSKELPT

SEQ ID NO: 28938 - protein, 81 aa, Odocoileus virginianus
SAWSQVPVTLGGVAMYLSQEEWGCLDLAQQDHSCDVLLEDAGLPTPGPCLTALQGQGEGPWDPAQAASGPREVSGGASSGR

SEQ ID NO: 28939 - protein, 81 aa, Cebus imitator
HHFANGDFAQPASPVPTLPQVGNSGDQAGATVLRMVRPQDTVVFEDLSVDYTQKKQKCPALSQRAMHWNVMPENDHSMASL

SEQ ID NO: 28940 - protein, 81 aa, Lipotes vexillifer
LSQGLVTFKDVAVCFSQDQWSDLDPTQKEFYGEYVLEEDCGIVVSLSFPIPRLDEISHMGEEPLIPEIPEAQEPQEPEILS

SEQ ID NO: 28941 - protein, 81 aa, Cebus imitator
QGMMTFEDVAMSITWEEWERLDPARKDFYRESVQKDSGSTVPPSLESRTENKELIPMQEILEEAEPQEQLQEAFQGKPPLF

SEQ ID NO: 28942 - protein, 81 aa, Callithrix jacchus
ESCESITLNDVAVNFSRGEWKKLEPFQKELYKEVLLENFRNLEFLDFPVSKLELISQLKWVELSWLLEKEVSKGCQPGSII

SEQ ID NO: 28943 - protein, 81 aa, Saimiri boliviensis
QLQENMTFKDVEVTFSQDEWGLLDSAQRNLYRDVMLENYRNMVFLVGPFTKPALISWLEAREPWGLNLQVAQPKGNPGAAP

SEQ ID NO: 28944 - protein, 81 aa, Cebus imitator
VKIEEVADVAVSFILEEWGHLDQSQKSLYRDDRKENYGSITSMDYESRDNMELMVKQVSDDTESHWVAPEHTERSVPQGPD

SEQ ID NO: 28945 - protein, 81 aa, Callithrix jacchus
SQEPVKDVHVTRGFSYKKSVHQIPAHRGLYRDFRKENVGNVVSLGSTVSASNRITRLEQRKEPWTLGLHSSNKRSTLRSNY

SEQ ID NO: 28946 - protein, 81 aa, Vulpes vulpes
SQELLTFKDIFVDFTQEEWGQLAPAHRNLYREVMLENYGNLVSVGYQLSKPGVISQLEKGEEPWLIEREISGSPSSDLENK

SEQ ID NO: 28947 - protein, 81 aa, Ovis aries
SQRPLTFEDVALYFSEEEWLIMDPNQRTLYLDVMQELYENVTSLGLLGNVSNYGLKIQSSNESFKAIQFKALSAVLSSESC

SEQ ID NO: 28948 - protein, 81 aa, Cebus imitator
GPVASGDIPFYFSQEEWGTLDPAQRDLFWDIKRENSRNTTLGLGLKGQSERSRLEEVVPALPGQADLGPVVGARRGRPPTR

SEQ ID NO: 28949 - protein, 81 aa, Callithrix jacchus
IRDQDLGTTLLPAAPQEQWRHLDSTQKEQYWDLMLETYGKMVSGGISHSKPDLTNSIEYGEELAGLYLHVNDKIPRPSCIG

SEQ ID NO: 28950 - protein, 81 aa, Otolemur garnettii
EGMVTFEDMAVALTWEEWEHLDSARKDFCKESTQREYGSTIQPSLESTFENKQLILKQEISEETEPQEWLQEVCQGKPSLF

SEQ ID NO: 28951 - protein, 81 aa, Pongo abelii
GMVTFEDMAVSLTWEEWERLDPARRDFCRESVQKDSGSTVPPSLESRVENKELIPMQQILEEVEPQGQLQEAFQGKHPLFS

SEQ ID NO: 28952 - protein, 81 aa, Callithrix jacchus
EELPVVFEDVAVYFTREEWGMLDKRQKELYRDVMRMNYELLASLGPAAAKPDLISKLERRAAPWIKHPNGPKWGKGRPPGN

SEQ ID NO: 28953 - protein, 81 aa, Ovis aries
SQGPVKDVHTARGFSYKKSVHQIPAHKDLYRDIRKESVGNMVSLGSTVSAANKIARLEPRKEPWTIGLQSSNKRTVLRSNY

SEQ ID NO: 28954 - protein, 81 aa, Ovis aries
SQSLLTFEEVAMYFSQEEWELLDPTQKALYNDVMQENYETVISLALFVLPKPKVISCLEQGEEPWVQRPLEFKDSSQELPT

SEQ ID NO: 28955 - protein, 81 aa, Ovis aries
SQVPVTLEDVAVYLSQEEWGCLDVAQQDHSCDVLLEDAGLPMPGPYLTALQGQGEGLRDPARAASGPREVSGGASSEHGSH

SEQ ID NO: 28956 - protein, 81 aa, Vulpes vulpes
PVTFGDIPFYFSREEWGSLDPAQRELFWDIKRENSRNVTLGLGLKSQGQQAGLEETAASAGQAGSSSSGSGRGDVTVSWSP

SEQ ID NO: 28957 - protein, 81 aa, Otolemur garnettii
QPQEAMTFKDVEVTFSQDEWGWLNSAQRNLYRNVMLENYKNMAFLVGPFTKPALISWLEAREPWGLNVQSAHPKENPGAAA

SEQ ID NO: 28958 - protein, 81 aa, Callithrix jacchus
PQLPESLEDVAVYISQEEWGHQDPSKRALSRDTVQESYENVDSLESHIPSQEVPSTQVGQGGKLWDPSVQSCKESLSPRGP

SEQ ID NO: 28959 - protein, 81 aa, Otolemur garnettii
FETQLGLTTITDMAIIFSQQLDPTQKHFWNVMWENHDDPGSVGYCVSKPALVSLLEQGKEPWVVKGQLAGGLFSGQQSVCE

SEQ ID NO: 28960 - protein, 81 aa, Callithrix jacchus
TSVIQVKDMAMSLTWEEWERLDPARKDFYRESVQKDSGSTVLPSLESRTENKELIPMQEILEAEPQEQLQEAFQGKPPLFS

SEQ ID NO: 28961 - protein, 81 aa, Callithrix jacchus
GHQEPGSTSFHPPRIQEEWGLLDRSQKELYWDAMLEKYGTVVSLGLPTHQPEAQAQSELGMLLTGAGVCRNLGSGDENEGL

SEQ ID NO: 28962 - protein, 81 aa, Vulpes vulpes
GHREPTSTSFHPPRIQEEWGLLDPSQKELYWDAMLEKYGTVVSLAGIPAPQPEAQAELEPGALRTGTESLRSLHLGDENES

SEQ ID NO: 28963 - protein, 81 aa, Macaca mulatta
FLKKVTFEDVAIDFTQEEWAMMDTSKRKLYRDVMLENVSHLVSLGYQISKSYITLQLEEGKELWREGREFLQGQNLDKESA

SEQ ID NO: 28964 - protein, 81 aa, Cebus imitator
SQEPVTFADVAVVFTPEEWVFLDSTQRSLYRDVMLENYRNLASVGDQLCKPNASSDLEQSGEQWNTERGVISDTCPEPQLQ

SEQ ID NO: 28965 - protein, 81 aa, Ovis aries
SLLTFEEVAMYFSQEEWELLDPTQKALYNDVMQENYETVISLAVPAHQLLAFPEQTDTSEWTMAPELILPESQSLLTFEEV

SEQ ID NO: 28966 - protein, 81 aa, Ovis aries
SQESMTLKDVAVTFSRGEWRKLEPSQKEIYKEVLLENYRNLEFLGFPVSKLDLVSQLKWAGLPRLLQKEVSKGCRPEVIYN

SEQ ID NO: 28967 - protein, 81 aa, Vulpes vulpes
QPQEAVTFKDVEVTFSQDEWAWLDPAERNLYRDVMLENYRNMVSLVGPFAKPILISWLEAREPWGLNVQGPQPNGNPGVAL

SEQ ID NO: 28968 - protein, 81 aa, Vulpes vulpes
SPAPEASALSQEENPRNQLMALMLLTAQPQELVMFEEVSVCFTSEEWECLGPIQRALYWDVMLENYGNVTSLANMKTSLIW

SEQ ID NO: 28969 - protein, 81 aa, Callorhinus ursinus
SQGLLTFKDISVDFTQEEWGHLAPAHRNLYREVMLENYGNLVSVGYQLCKPGVISQLEKGEEPWLIEREISGSPSSDLENK

SEQ ID NO: 28970 - protein, 81 aa, Enhydra lutris
VTFGDIPFYFSREEWGSLDPAQREFFWDIKRENSQNVALALVPEPSGTEEAAPSRLAGLGLRSHREQPGLEESVTAPRGQA

SEQ ID NO: 28971 - protein, 81 aa, Enhydra lutris
VKIEDMAVSLILEEWGCQNLARRNLNRDNRQENYGNVFSQGCENRSENEESTSKAEIAEDSVPRGETTGRFQKDFGEKREQ

SEQ ID NO: 28972 - protein, 81 aa, Enhydra lutris
SQELLTFKDISVDFTQEEWGQLPLAHRNLYREVMLENYGNLVSVGYQLSKPSVISQLEKGQEPWMTEKEVPEDPSSGETQT

SEQ ID NO: 28973 - protein, 81 aa, Enhydra lutris
SQGLLTFKDISVDFTQEEWGQLAPAHRNLYREVMLENYGNLVSVAGYQLSKPGVISQLEKGEEPWLIEREISGSPSSDLEN

SEQ ID NO: 28974 - protein, 81 aa, Pongo abelii
SQEPVKDVHVARGFSYKKSVHQIPAHRDLYRDFRKENVGNVVSLGSAVSTSNKITRLEQRKEPWTVGLHSSNKRSILRSNY

SEQ ID NO: 28975 - protein, 81 aa, Ovis aries
EWLLISQEQPEAKKSWGPLSFMDVFVDFTWEEWQLLDSAQKHLYRSVMLENYRNLVSLGYQYTKPSIIFQLEQEELWMMHS

SEQ ID NO: 28976 - protein, 81 aa, Ovis aries
QGLVTVQDVAVSLTWEEWERLGPAQKHFFRESAPKDHGNAISPSSETRIENKELVPKQEILEERAPLSSECGDAQQDRREK

SEQ ID NO: 28977 - protein, 81 aa, Otolemur garnettii
ACESMALKDVIVSFSRGEWKKLDPSQKELYQEVLLENFENLEFLGCPVSKLDLLSQLKWSELPWLLEKEISKDSRPGKSTS

SEQ ID NO: 28978 - protein, 81 aa, Otolemur garnettii
VKIEDMAVSLILEEWGCQNLARRNPSRDNRQENFGNVFSQGCESRNENEESTSKAENAEDVSHGETAGRFQKEFGEKRDQQ

SEQ ID NO: 28979 - protein, 81 aa, Enhydra lutris
QAQEAVTFKDVEVTFSQDEWGWLDPAQRNLYRDVMLENYRNVVSLVGPFTKPVLISWLEAREPWGLNVQGAQPKGNPGVAP

SEQ ID NO: 28980 - protein, 81 aa, Enhydra lutris
PQLPESLEDVAMYISQEEWGHQDPSKRALSRDTVQESYENVDSLESQVPSQEALSTQVEQGGKPWDPSVQTCKEGPSPSSP

SEQ ID NO: 28981 - protein, 81 aa, Vulpes vulpes
MAEGFRFKDVAIYFSQKEWECLHSAQKSLYRDVMLENYNNLISLGLFDSKPDVIFLLEQEKEPWMVKSKEPKEWCPDWESR

SEQ ID NO: 28982 - protein, 81 aa, Bos taurus
QEPVKLEDVVVEFSKEEWGQLYPAVKNLYRHVMLENYRNLNSLHKEHLLSKPVETSKLESKKESWIMEQEIPRTAVFDRER

SEQ ID NO: 28983 - protein, 81 aa, Ovis aries
IQAWVRGQQPGSPEEAVVLVEDLQRDPGQLLGWVSVVVVASLREWGLLEPSQKELNWDAMLEKYGTVVSLGEAPSPSLGPW

SEQ ID NO: 28984 - protein, 81 aa, Pongo abelii
SCESITLKDVSVNFSRGEWKKLEPFQKELYKEVLLENLRNLEFLDFPVSKLELISQLKWVELPWLLEEVSKCSRLDESALD

SEQ ID NO: 28985 - protein, 81 aa, Pongo abelii
SQEPVTFADVAVVFTPEEWVFLDSTQRSLYRDVMLENYRNLASVADQLCKPNALSYLEERGEQWTTDRGILSDTCAEPQCQ

SEQ ID NO: 28986 - protein, 81 aa, Acinonyx jubatus
LLTFEDVAVSFSEEEWKLLDPAQKVLYNDVMQENYETVISLGLKLKNDTGNDQPISVSALEIQASGRKVLRKARMKVAQKT

SEQ ID NO: 28987 - protein, 81 aa, Pongo abelii
IRDQDLGASLLPAAPQEQWRHLDSTQKEQYWDLMLETYGKMVSGAGISHPKSDLTNSIEFGDEPAGLYLHVNEKIPRPTCI

SEQ ID NO: 28988 - protein, 81 aa, Sapajus apella
EEPVTFQDVAVDFSREEWGLLGPTQRTEYRDVMLETFGHLVSVGWETTLENKQLALNSGIPGEEPAASLKVQESSRDYALS

SEQ ID NO: 28989 - protein, 81 aa, Rhinolophus ferrumequinum
LVMFEEVSVCFTSEEWACLGPMQRALYWDVMLENYGNVTSLEWETMTENVEVTSKSSISQRADSQKGTSKRLQGGIPQDLD

SEQ ID NO: 28990 - protein, 81 aa, Acinonyx jubatus
SQELLTFKDISVDFTQEEWGQLAPAHRSLYREVMLENYGNLVSVGYQLSKPGVISQLEKGQEPWLIEREVSGGPRSDLESK

SEQ ID NO: 28991 - protein, 81 aa, Acinonyx jubatus
SQESITFKDVAVNFSRGEWRKLEPFQKELFKEVLLENFRNLEFLGFAVSKLDLISQLKWVELPWLLEKEVSKGSRPECEPR

SEQ ID NO: 28992 - protein, 81 aa, Callorhinus ursinus
QESITFKDVIVEFSEEEWGQLDPAVKTLYRDVMLENYRNLNSVHQEHLLYKPVEISKLESKERRWAVEQEIPSTSVLDREV

SEQ ID NO: 28993 - protein, 81 aa, Rhinolophus ferrumequinum
LRDQDFGPSLLQTAPQEQWRHLDSTQKEQYWDLMLETYGKMVSGAGISNSKPDLTNSAEYGEELAGLHLHVSERIPRPTCI

SEQ ID NO: 28994 - protein, 81 aa, Bison bison
SQSLLTFEEVAMYFSQEEWELLDPTQKALYNDVMQENYETVISLALFVLPKPKVISCLEQGEEPWVQRPLEFKDSSKELPT

SEQ ID NO: 28995 - protein, 81 aa, Callorhinus ursinus
QSLLTFEDVAVSFSEEEWKLLDPTQKILYNDVMQENYETVISLAWEDSSSSPPDSVGSRDSAGEEGTETAITQSRLQMDLG

SEQ ID NO: 28996 - protein, 81 aa, Acinonyx jubatus
EPISFKDVIVEFSKEEWGQLDPAVKNLYRDVMLENYRNLNSLHQDREVISENQDSVTKERISEESSSHGEIMRRLTKSGPH

SEQ ID NO: 28997 - protein, 81 aa, Odocoileus virginianus
PVTFGDIPFYFSREEWGSLDPAQRDLFWDIKRENSRNIALGLGRRSHSERSQLEEVVTALPDQAAGDETTSWRPEEAEAWE

SEQ ID NO: 28998 - protein, 81 aa, Cebus imitator
QAMVKIEDMAVSLILEEWGCQNLARRNLSRDNRQENYGSAFPQGGENRNENEESTSKAETAEDSASRGETVGRFQKEFGEK

SEQ ID NO: 28999 - protein, 81 aa, Callorhinus ursinus
PGHREPASMSFHPPRIQEEWGLLDPSQKELYWDAMLEKYGTVVSLGIPAPPPEARAESGPGAMCTGTEGRRNLHPGEERES

SEQ ID NO: 29000 - protein, 81 aa, Acinonyx jubatus
SQVPAVSQAGKSGDQAAAAVLRMVRPQGSAAYEFLSVDYTERKWKGPALSQRAVYRSLMPENYRRVASLDSKGKIELFSFL

SEQ ID NO: 29001 - protein, 81 aa, Odocoileus virginianus
SQGPVKDVHMARGFSCKRSVHQIPAHKDLYRDIRKESVGNMVSLGSTVPTANKIARLEPRKEPWTIGLQSSNKRTVLRSNY

SEQ ID NO: 29002 - protein, 81 aa, Rhinopithecus roxellana
TLTQVGNSGDQAGATVLRMVRPQDTVAYEDLCVDYTQKKWKGPALSQRALQWNMMPGNDRIMASLGWSTMARSWLTSISSS

SEQ ID NO: 29003 - protein, 81 aa, Rhinopithecus roxellana
ATFEDMAVSLTWEEWERLDPARRDFRRESAQKDSGSTVLPSLESRAENKELIPMQEILEAEPQGRLQEVFQGKRPLLSKCG

SEQ ID NO: 29004 - protein, 81 aa, Acinonyx jubatus
EEPVTFLDVAVDFSKDEWGLLDPMQRTEYHDVMLETFGHLVSVGWETTLESKELTPKSDIPEEEPAPDLKMEEFSRDDTWS

SEQ ID NO: 29005 - protein, 81 aa, Bison bison
PQEPVTFADVAVLFTPEEWLFLDSAQKSLYRDVMLENYRNLASVGDQLCKTRMSSHLEQREELCVTERGIFPGAHLGPHFQ

SEQ ID NO: 29006 - protein, 81 aa, Cebus imitator
GLPTGQSQELLTFKDISIDFTQQEWGQLTPAHQNLYREVMLENYSNLVSVLEKGEEPWMTEKGSLGDPSSDLKSNTETTES

SEQ ID NO: 29007 - protein, 81 aa, Macaca mulatta
ESMTFKDVAVDITQEDWELMRPVQKELYKTVTLQNYWNMVSLEWETKVQACTPVENMSKLTKEETQTIKLEDSYDYNDRLQ

SEQ ID NO: 29008 - protein, 81 aa, Ailuropoda melanoleuca
QAMVKIEDMAVSLILEEWGCQNLARRNLNRDNRQENYGNVFSQGCENRNENEESTSKAEIAEDSASRGETTGRFQKDFGEK

SEQ ID NO: 29009 - protein, 81 aa, Ursus maritimus
ELVTVDNAAVSLTWEEWDRLDPDQRDFCRESALKGCRDTVSLVSPSLETRTENKEFIPKQEVLEEVEPQGQLQEGSHRKGP

SEQ ID NO: 29010 - protein, 81 aa, Ursus maritimus
PQLPESLEDVAMYISQEEWGHQDPSKRALSRDTVQESYENVDSLESQVPSQEALSTQVEQGGKPWDPSVQTCKEGLRPRSP

SEQ ID NO: 29011 - protein, 81 aa, Phyllostomus discolor
LVTKESMTFRDVAVDITQEDWELMRPVQKELYKTVTLQNYWNMVSLGLTVYRPTVIPILEEPWMVIKEILEGPSPGQETEA

SEQ ID NO: 29012 - protein, 81 aa, Zalophus californianus
SLLTFEEVAMYFSQEEWELLDPTQKALYNDVMRENYETVISLAVPAHQILAFPEQIITKDWTVAPELVLPESQSLLTFEEV

SEQ ID NO: 29013 - protein, 81 aa, Vicugna pacos
EEPVTFLDVAVDFSREEWGLLDTTQRTEYHDVMLETFGHLVSVGWATTLESKELTPKPNVPEEEPALHLKVEEFSREDARP

SEQ ID NO: 29014 - protein, 81 aa, Phascolarctos cinereus
PQETVMFEDVAVYFRKEEWADLNPAQRVLYRDVMLENYRNIASLAYLFPKPLVISKLEQVSGNLQEAQDIGQWFVCAGGEV

SEQ ID NO: 29015 - protein, 81 aa, Callorhinus ursinus
SQELVTFKDVVVDFSPEELTYLSAAQRNLYREVMLENYRNLVSLGYQFSKPDIISQLEEEESRVREEDSNTEICQDGEKRP

SEQ ID NO: 29016 - protein, 81 aa, Callorhinus ursinus
SQSLLTFEEVAMYFSQEEWELLDPTQEALYNDVMRENYETVISLALFVLPKPKVISYLEQGEDPWVQGPLELKNSPGELPS

SEQ ID NO: 29017 - protein, 81 aa, Pteropus vampyrus
QPQEAITFKDVEVTFSQDEWGWLNPAQRNLYRDVMLENYGNLASLVGPFTKPALISWLEAREPWGLNVQGPQPKGNPGAPP

SEQ ID NO: 29018 - protein, 81 aa, Ursus arctos
IRDQDFGASFLQATPPEQWRHLDSTQKEQYWDLMLETYGKMVSGGISNSKSDLTNSTEYGEELAGLHLHVGEKISRPTCIG

SEQ ID NO: 29019 - protein, 81 aa, Pan troglodytes
QLQETMTFKDVEVTFSQDEWGWLDSAQRNLYRDVMLENYRNMASLVGPFTKPALISWLEAREPWGLNIQAAQPKGNPVAAP

SEQ ID NO: 29020 - protein, 81 aa, Ailuropoda melanoleuca
PQLPESLEDVAMYISQEEWGHQDPSKRAHSRDTVQESYENVDSLESQVPSQEALSTQVEQGGNPWDPSVQTCKEGLRPRSP

SEQ ID NO: 29021 - protein, 81 aa, Vulpes vulpes
SQELLTFKDVSVDFTQEEWGQLSLAHRNLYREVMLENYGNLVSVAGYQLSKPSVISQLEKGQEPWMTEKKGPGDPSPDLKN

SEQ ID NO: 29022 - protein, 81 aa, Callorhinus ursinus
QEPVTFLDVAVDFSKEEWGLLDLTQRTEYHDVMLETFGHLVSVGWETTLESKELTTKSDIPEKEPAHDLKMEEFSRDDTWS

SEQ ID NO: 29023 - protein, 81 aa, Bos indicus
QEPVKLEDVVVEFSKEEWGQLDPAVKNLYRHVMLENYRNLNSLHKEHLLSKPVETSKLESKKESWITEQDIPRTAVFDRER

SEQ ID NO: 29024 - protein, 81 aa, Bos indicus x Bos taurus
APEASALSQEENPRNQLMALMLLTAQPQELVMFEEVSVCFTSEEWACLSPVQRALYWDVMLENYGNVTSLVYRKYRKQRNK

SEQ ID NO: 29025 - protein, 81 aa, Callithrix jacchus
QAMVKIEDMAVSLILEEWGCQNLARRNLSRDNRQENYGSAFSQGGENRNENEESTSKAETAEDSASHGETAGRFQKEFGEK

SEQ ID NO: 29026 - protein, 81 aa, Callorhinus ursinus
PQLPESLEDVAMYISQEEWGHQDPSKRALSRDTVQESYENVDSLESQVPSQETLSTHLEQGGKPWDPSVQTCKEGLSLRSP

SEQ ID NO: 29027 - protein, 81 aa, Sus scrofa
KIEDVADVAVSFILEEWGHLDPSQKSLCRDDRKENYGSIPSMDYESRNDNVELRVKQVSDEAEAPWMTSGSPGSTAAPSQG

SEQ ID NO: 29028 - protein, 81 aa, Bos indicus
EDPVTFLDVAVDFSTEEWGLLDPTQRTEYHDVMLETFGHLVSVGWETTLDSKQLTPQPGPPEEGPACPLKEEEGSSAADAR

SEQ ID NO: 29029 - protein, 81 aa, Physeter macrocephalus
KIEDVADVAVSFILEEWGHLDQAQKSLYRDDRKENYGSITSMDYESRNDNVELIVKQISDEAESPWMTSGSPERNVPPSQE

SEQ ID NO: 29030 - protein, 81 aa, Balaenoptera acutorostrata
EQGLVTFKDVAVCFSQDQWSDLDPTQKEFYGEYVLEEDCGIVVSLSFPIPRLDEISHMGEEEPLIPEIPEAQEPREPEILS

SEQ ID NO: 29031 - protein, 81 aa, Erinaceus europaeus
QAMVKIEDMAVSLILEEWGCQNLARRNLGRDGRQENYGNVLSQGCENRNENEESTSKAEAAEDSASRGETRSRFQKEFGEK

SEQ ID NO: 29032 - protein, 81 aa, Callorhinus ursinus
PGHREPASMSFHPPRIQEEWGLLDPSQKELYWDAMLEKYGTVVSLAGIPAPPPEARAESGPGAMCTGTEGRRNLHPGEERE

SEQ ID NO: 29033 - protein, 81 aa, Rhinolophus ferrumequinum
FGRQPGLVTIANVAIDLSQQLDPAQKSFCKNVMWENHDLGSVGCCVSEPGLVSLLEQGKEPWLVKRELTGVLFSGQQSVRE

SEQ ID NO: 29034 - protein, 81 aa, Phyllostomus discolor
LSQGLVTFKDVAVCFSEDQWNDLDPTQKEFYGEYVLEEDCGIVVSLSFPIPRLDEISHVREEPLVPDTLEPQEPEILSFTY

SEQ ID NO: 29035 - protein, 81 aa, Camelus dromedarius
FNSLLLSLLVPLTFMDVAIRFSQEEQEFLDPAQRALYRDVMLETYRNLLSVGERTALQKLGSVLGCVCIFPVHPFRSPRFA

SEQ ID NO: 29036 - protein, 81 aa, Pan troglodytes
GMVTFEDMAVSLTWEEWERLDPARRDFCRESAQKDSGSTVPPSLESRVENKELIPVQQILEEAEPQGRLQEAFQGKRPLFS

SEQ ID NO: 29037 - protein, 81 aa, Ursus maritimus
SLLTFEDVAMYFSQEEWELLDPTQEALYNDVMWENYETVISLAVPAHQILAFPEQIITKDWTVAPELVLPESQSLLTFEEV

SEQ ID NO: 29038 - protein, 81 aa, Acinonyx jubatus
ELVKIENVAVSLNCEEWEPLDPAPREFCWESAQEDHRTSVSLVSPSLETRTENKDFIPKQEILEEVEPQGQLQEGSHRKAP

SEQ ID NO: 29039 - protein, 81 aa, Odocoileus virginianus
CERVVPAHRILAFPEQTDTKDWTVAPELVLPESQSLLTFEEVAMYFSQEEWELLDPTQKALYNDVMQENYETVISLEFVDI

SEQ ID NO: 29040 - protein, 81 aa, Cebus imitator
IRDQDLGTSLLPAAPQEQWRHLDSTQKEQYWDLMLETYGKMVSGGISHSKPDLTNSIEYGEELAGLYLHVNEKIPRPSCIG

SEQ ID NO: 29041 - protein, 81 aa, Camelus dromedarius
LLETLSFKDVAVDFTWEEWQLLAPAQKALYRDVMLENYSHLLSVGYQVRRPDALAELERGEDLWAREEETGSGPCPGEGGP

SEQ ID NO: 29042 - protein, 81 aa, Ailuropoda melanoleuca
SQGPVKDVHMARGFSYKKSVHQIPAHRDLYRDFRKESVGNMVSLGSTVSVSNKIARLEQRKEPWTLGLHSSNKRNIILRSN

SEQ ID NO: 29043 - protein, 81 aa, Callorhinus ursinus
ERQPGLVTITNMAVDFSRQLDLAQKSFCKNVIWENHGDLGSVGPCVSKPDLVSLLEQGKEPWMVERELTRGLFSGQQSINE

SEQ ID NO: 29044 - protein, 81 aa, Ursus maritimus
QAMVKIEDMAVSLILEEWGCQNLARRNLNRDNRQENYGNVFSQGCENRNENEESTSKAEIAEDSASRGETAGRFQKDFGEK

SEQ ID NO: 29045 - protein, 81 aa, Rhinolophus ferrumequinum
QPQEALTFKDVEVTFSQDEWGWLTPAQRNLYRDVMLENYGNLASLVGPFTKPVLISWLETREPWGLNVQEAQPQENPGAAP

SEQ ID NO: 29046 - protein, 81 aa, Vulpes vulpes
PVTFGDIPFYFSREEWGSLDPAQRELFWDIKRENSRNVTLALVPEPSGTEEAAPSRLAGLGLKSQGQQAGLEETAASAGQA

SEQ ID NO: 29047 - protein, 81 aa, Acinonyx jubatus
ERPPGLVTITNMAVDFSQQLDPAQKSFCKNVMWENHSDLGSVGPCVSKADLVSLLQQEKEPWMVDRELPKGLGSGQQSIHE

SEQ ID NO: 29048 - protein, 81 aa, Acinonyx jubatus
ISLAVPAHQILAFPEQTITKDWTVAPELVLPESQSLLTFEEVAMYFSQEEWEFLDPTQEALYNDVMRENYETVISLGVSMD

SEQ ID NO: 29049 - protein, 81 aa, Rhinopithecus roxellana
PQELVMFEEVSVCFTSEEWACLGPIQRALYWDVMLENYGNVTSLEWETMTENEEVTSKPSSSQRAESHKGTSKRLQGSVPQ

SEQ ID NO: 29050 - protein, 81 aa, Odocoileus virginianus
TEELVTFEDVAVDFSPEELPYLSASQRNLYREVMLENYRNLVSLGYQFPKPDIISQLEEEESHAREEDGSTMTCQDWEEHS

SEQ ID NO: 29051 - protein, 81 aa, Ursus maritimus
SRVPVTLEDMAAYLSQEEWECLDPAQRDCSWDVLPENRGLVPPLEDGEDPGEDVSMRREQDREPGKSMTRPEKPLEGGGPR

SEQ ID NO: 29052 - protein, 81 aa, Colobus angolensis
SQEPVTFADVAVVFTPEEWVFLDSTQRSLYRDVMLENYRNLASVADQLCKPNALSYLEQRGEQWTTDRGILSDTCAEPQLQ

SEQ ID NO: 29053 - protein, 81 aa, Camelus dromedarius
QEPVTFKDVVVEFSEEEWGQLDPAVKNLYRDVMLDNYRNLNSLHKEHLLSKPAEIAKLESKEKSWIMEQEIPRATVLVHGI

SEQ ID NO: 29054 - protein, 81 aa, Tursiops truncatus
EEPVTFLDVAVDFSREEWGLLDLTQRTEYHDVMLETFGHLVSVGWETTLESKQLTPNPNTPEEEPACHLKVEEFSRDDTQP

SEQ ID NO: 29055 - protein, 81 aa, Physeter macrocephalus
PPNRVSSFKDMIFCFSEEDWSLLDPAQTGFYGEFIIGEDCGVTLPPNDPSAQLDLSQGEENEPRVPELQDLQGKDVSPVSY

SEQ ID NO: 29056 - protein, 81 aa, Pan troglodytes
IRDQDLGASLLPAAPQEQWRHLDSTQKEQYWDLMLETYGKMVSGAGISHPKSDLTNSIEFGEELAGLYLHVNEKIPRPTCI

SEQ ID NO: 29057 - protein, 81 aa, Callithrix jacchus
IRDQDLGTTLLPAAPQEQWRHLDSTQKEQYWDLMLETYGKMVSGAGISHSKPDLTNSIEYGEELAGLYLHVNDKIPRPSCI

SEQ ID NO: 29058 - protein, 81 aa, Rhinolophus ferrumequinum
SQGLVTFKDVAVCFSQDQWSDLDPAQKEFYGEYVLEEDCGIVVSLSFPIPRLDEVSHIREEEPLVPDIRELQEPQEPEILS

SEQ ID NO: 29059 - protein, 81 aa, Vicugna pacos
QEPVTFKDVVVEFSEEEWGQLDPAVKNLYRDVMLDNYRNLNSLRKEHLLSKPVEIAKLESKEKSWIMEQEIPRATVFDSKI

SEQ ID NO: 29060 - protein, 81 aa, Rhinolophus ferrumequinum
GHRAPDSESFHPPRIQEEWGLLDPSQKELYWDVMLEKYGTVVSLGLPPPRPDALAESEPLAPKAGTDSKGSLCLGGDSESH

SEQ ID NO: 29061 - protein, 81 aa, Rhinopithecus roxellana
QDTVAYEDLCVDYTQKKWKGPALSQRALQWNMMPGNDRIMASLAGENMMKGSELTPKQEIFKGSESSNRMGLFGVVPRGAE

SEQ ID NO: 29062 - protein, 81 aa, Ursus arctos
SEQKSTPNWKMASELILPEFQSLLTFEDVAVSFSEEEWKLLDPSQKILYNDVMQENYETVISLAILVSRRIVVLICISLIN

SEQ ID NO: 29063 - protein, 81 aa, Rhinolophus ferrumequinum
PLNRVSPFKDMIFCFSEEDWSLLDPAQTGFYGEFIIGEDCGVSLPPNDPAAQLDLSQGEENEPRVPELQDIQGKEATQPVC

SEQ ID NO: 29064 - protein, 81 aa, Acinonyx jubatus
PQELVTFQDVAVDFSLEELTYLSAAQRNLYREVMLENYRNLVSLGYQFSKPDIISQLEEEESHVMEEDSDTEMHHDPRDPS

SEQ ID NO: 29065 - protein, 81 aa, Balaenoptera acutorostrata
GPVTFGDIPFYFSREEWGSLDPAQRDLFWDIKRENSQNVALGLGLTSHSERSRLEEVVTALPGQAAGDVTVSWRLEEAEAR

SEQ ID NO: 29066 - protein, 81 aa, Acinonyx jubatus
LQVPVTLEDVAAYLSQDEWECLDPAQRGCVWDVLPDSGGLGLQLEDGEGARQDVLTRREQDRELVGGMTRPEQSLERGGPR

SEQ ID NO: 29067 - protein, 81 aa, Callithrix jacchus
PPNRVSPFKDMILCFSEEDWSLLDPAQTGFYGEFIIGEDCGVSMPPNDLAAQPDLSQGEENEPRVPELQDLQGKEVPQVSY

SEQ ID NO: 29068 - protein, 81 aa, Pteropus vampyrus
SQSLLTFEEVAVYFSQEEWELLDPSQKALYNDVMQKNYETVISLATAEPAHQTLTFPEQINTKDWIMAPELFLPESQTLLT

SEQ ID NO: 29069 - protein, 81 aa, Ovis aries
SQVPVTLEDVAVYLSQEEWGCLDVAQQDHSCDVLLEDAGAVGRRCLTPCCVPEWASLWEGAASFGLIEGLPMPGPYLTALQ

SEQ ID NO: 29070 - protein, 81 aa, Camelus dromedarius
EEPVTFLDVAVDFSREEWGLLDTTQRTEYHDVMLETFGHLVSVGWATTLESKELTPKPNVPEEEPALHLKVEEFSGEDTRP

SEQ ID NO: 29071 - protein, 81 aa, Pongo abelii
PEEPVKDVHVARGFSYKKSVHQIPAHRDLYRDFRKENVGNVVSLGSAVSTSNKITRLEQRKEPWTLGLHSSNKRSILRSNY

SEQ ID NO: 29072 - protein, 81 aa, Pongo abelii
KETEPVYERAVPTQQILAFPGQTNTKDWTVTPERVLPESQSLLTFEEVAMYFSQEEWELLDPTQKALYNDVMQETMRLSSL

SEQ ID NO: 29073 - protein, 81 aa, Pongo abelii
EELPVVFEDVAVYFTREEWGMLDKWQKELYRDVMRMNYELLASLGPAAAKPDLISKLERRAAPWIRDTNGPKWGKSRPPGN

SEQ ID NO: 29074 - protein, 81 aa, Camelus dromedarius
GSLTLKDVAVDFTREEWQLLTPAQKALYREVTLQNYSHLVSVAFENHRFVPSRERPKEEDLARRTAIPEKMAAPGQDPRTG

SEQ ID NO: 29075 - protein, 81 aa, Myotis davidii
QPQEALTFKDVEVTFSQDEWAWLNPAQRNLYRDVMLENYGSLASLVGPLAKPALISWLEAREPWGLNVQRAQPKAKPGAAP

SEQ ID NO: 29076 - protein, 81 aa, Leptonychotes weddellii
PVTFGDIPFYFSREEWGSLDPAQRELFWDIKRENSRNVALGVGLQSQSERSGLEEAVTALPGQAGGGGGGGRAPARRRPLR

SEQ ID NO: 29077 - protein, 81 aa, Neomonachus schauinslandi
IRDQDFGASFLQAAPPEQWRHLDSTQKEQYWDLMLETYGKMVSGGISSSKSDLTNSAEYGEELVGLHLPVGEKIPRPTCMG

SEQ ID NO: 29078 - protein, 81 aa, Neomonachus schauinslandi
QSLSLTFEEVAMYFSPEEWELLDPTQEALYNDVMRENCETVISLALFVLPKPKVISYLEQGEEPWIQGPLEFKNSPGGLPT

SEQ ID NO: 29079 - protein, 81 aa, Cebus imitator
SQELLTFKDVSVDFTQEEWGQLAPAHRNLYREVMLENYGNLVSVGYQLSKPGVISQLEKGEEPWLMEREVSGVPSLDLESK

SEQ ID NO: 29080 - protein, 81 aa, Monodon monoceros
SQGPLKDVHMARGFSYKKSVRQIPAHRDLYRDIRKESIGNMVSLGNTVSTANKVAQLEQRKEPWTIGLQSPNKRNVLQSNC

SEQ ID NO: 29081 - protein, 81 aa, Enhydra lutris
SQGPVKDVHMARGFSYKKSIHQIPAHRDLYRDIRKESVGNMVSLGSTVSVSNKIAQMEQRKEPWTLGLHSSNKRNIMLRSN

SEQ ID NO: 29082 - protein, 81 aa, Enhydra lutris
EEPVTFLDVAVDFSKEEWGLLDPTQRTEYHDVMLETFGHLVSLGWETTLESKELTPKSDTPEKEPAHDLKLEEFSRDDTWS

SEQ ID NO: 29083 - protein, 81 aa, Cercocebus atys
VKIEEVADVAVSFILEEWGHLDQSQKSLYRDDRKENYGSITSMGYDFFDNMELIVKQISDDAESHWVAPEHTERSVPQDPD

SEQ ID NO: 29084 - protein, 81 aa, Neomonachus schauinslandi
SQGLLTFKDISVDFTQEEWGQLAPAHRNLYREVMLENYGNLVSVGYQLSKPSVISQLEKGQEPWMTEKEGPGDSSSDLKNK

SEQ ID NO: 29085 - protein, 81 aa, Camelus dromedarius
SQESVTLKDVAVTFSRGEWRRLEPFQKEIYKEVLLENFRNLEFLGFPVSKLDLVSQLKWAGLPRLLQKEVSKRSKPECELS

SEQ ID NO: 29086 - protein, 81 aa, Felis catus
PVTFGDVPFYFSREEWGSLDPAQRDLFWDIKRENSRNVALALVPEPSGTEEAAPSRLAGLGPESQSEQSRLEEAATALQGR

SEQ ID NO: 29087 - protein, 81 aa, Aotus trivirgatus
IRDQDLGTSLLPAAPQEQWRHLDSTQKEQYWDLMLETYGKMVSGAGISHSKPDLTNSIEYGEELAGLYLHVNEKIPKPSCI

SEQ ID NO: 29088 - protein, 81 aa, Camelus dromedarius
KGHLVTFEDVAVNFTQEEWTLLDQTQRDLYRDVMLENYQNLMALGSESCKPHLNSPLEGAEELRKRARRILQSEFMAESDL

SEQ ID NO: 29089 - protein, 81 aa, Cercocebus atys
HHPPNGDFAQCASPVPTLPQVGNSGLRMVRPQDTVAYEDLCVDYTQKKWKCPALSQRALQWNMIPENDRSMASLGWSTMAR

SEQ ID NO: 29090 - protein, 81 aa, Neomonachus schauinslandi
QAMVKIEDMAVSLILEEWGCQNLARRNLNRDNRQENYGNVFSQGCENRNENEESASKAEIAEDSASRGETTGRFQKDFGEK

SEQ ID NO: 29091 - protein, 81 aa, Camelus dromedarius
RKSVTFEDVAVYFTEKEWASLVPAQRALYRDVMLENHGAVVFLGSITHFYTSSDLPSGAREGAMFHPATESPKQKERESRL

SEQ ID NO: 29092 - protein, 81 aa, Myotis davidii
ESVTFEDIAVDFTQEEWALLGTPQKKLYRDVVLENISDLVSVGYRICNSGVTFQLDQGQLRSEGTGFLQGQIADMRDPLKK

SEQ ID NO: 29093 - protein, 81 aa, Cercocebus atys
PPNRVSPFKDMILCFSEEDWSLLDPAQTGFYGEFIIGEDCGVSVPPNELAAQPDLSQREENEPRVPEPQDLQGKEVPQVSY

SEQ ID NO: 29094 - protein, 81 aa, Leptonychotes weddellii
PQLPESLEDVAMYISQEEWGHQDPSKRALSRDTVQESYENVDSLGSQVPSQETLSTHVEQGGKPWDPSVQTCKEGLSLRSP

SEQ ID NO: 29095 - protein, 81 aa, Monodelphis domestica
PGTFKDGEVSLSQEEQESLDAAPKDLCGDVMQENYGNDLSHDFEIQSENEENSNQEIFEAVEENMLSGRPEGEGIQHSDWG

SEQ ID NO: 29096 - protein, 81 aa, Leptonychotes weddellii
QEPITFKDVIVEFSEEEWGQLDPAVKTLYRDVMLENYRNLNSLHQEHLLYKPVEISKLESKERRWTVEQEIPSTSVLGKNQ

SEQ ID NO: 29097 - protein, 81 aa, Monodelphis domestica
GQKDLVTFEGVSADFTEKEWKGSAPAQRAFFRDLMLENYRDVVSLGFPFSKPTGISWREEEPWNLNHQGPLDLEDRKSTCT

SEQ ID NO: 29098 - protein, 81 aa, Physeter macrocephalus
QEPVTFKDVVVEFSKEEWGQLDPAVKNLYRDVMLENYRNLNSLHKEHLLSKPVETSRLESKEKSWIMEQEILRTAVFDREI

SEQ ID NO: 29099 - protein, 81 aa, Aotus trivirgatus
QGMMTFEDMAMSLTWEEWERLDPARKDFYRESMQKDSGSTVPPSLESRTENKELIPMQEILEEAEPQEQLHEAFQGKPPLF

SEQ ID NO: 29100 - protein, 81 aa, Camelus dromedarius
QGLVTFGDVAVDFSQEEWEWLDCAQRTLYRSVMLENYRSLVSLARDDLVTGTEERAMDGEEKVHARPVPRQCGKAFSQSTH

SEQ ID NO: 29101 - protein, 81 aa, Felis catus
SQGPVKDVRVARGFSYKKSVHQIPVHRDLYRDIRKESAGNMVSLGSTMSVSNKIARLEQRKEPWTLGVHSSNKRSILRSNY

SEQ ID NO: 29102 - protein, 81 aa, Myotis davidii
LIVDMNFEDVAVAFSQEEWGLLDEAQRLLYCKMMLEVFALVSSVGCGHKMDDVEACSEQSVSVQVEAQVRVSETEPATQRT

SEQ ID NO: 29103 - protein, 81 aa, Leptonychotes weddellii
SLLTFEDVAVSFSEEEWKLLDPTQKILYNDVMQENYETVISLDREAGNAVGGAGTRGTRARTAERPPGVAPTASDGTRPGR

SEQ ID NO: 29104 - protein, 81 aa, Physeter macrocephalus
QGLVTVQDVAVSLTWEEWERLGPAQRDLYRESAPKDYGNAVSPSLETRIENKGLILKQEILEEVEPQGQLQGSQEKGPLSS

SEQ ID NO: 29105 - protein, 81 aa, Monodelphis domestica
QESMTFEDVAVYFSKAEWTLLSPAQQVLYRNVMLENYENLASLGDESQKENKKLAPARESAEADPEASSPGGLQTCAPQQP

SEQ ID NO: 29106 - protein, 81 aa, Neomonachus schauinslandi
QEPVTFLDVAVDFSKEEWGLLDPTQRTEYHDVMLETFGHLVSVGWETTLESKELTPKSEIPEKEPAHDLKMEEFSRDDTWS

SEQ ID NO: 29107 - protein, 81 aa, Camelus dromedarius
LLTFEDVALSFTEEEWQLLDPTQKILYNDVMQENYETVISLGLKLKNDTGNDQPISLSTLEIQGSGCKVLRKARVKVAQKT

SEQ ID NO: 29108 - protein, 81 aa, Camelus dromedarius
TQEPVTFADVAVLFTPEEWLFLDSAQRSLYRDVMLENYRNLASVGDQLCTPSMFSHLEPREELCITERGLFPGAHAEPQLQ

SEQ ID NO: 29109 - protein, 81 aa, Leptonychotes weddellii
PNRVSPFKDMIFCFSQEDWSLLDPAQTGFYGEFIIGEDCGVSLPPNFPSLQPFQIEERRKRDELQVPEFQTFQQLTLTQNT

SEQ ID NO: 29110 - protein, 81 aa, Neomonachus schauinslandi
EAHGPVTFGDIPFYFSREEWGSLDPAQRELFWDIKRENSRNVALGVGLQSQSERSGLEEAVTALPGQAGGGGGGGRGDVTV

SEQ ID NO: 29111 - protein, 81 aa, Pongo abelii
ETQPGLVTIKNLAVDFPQKLHPAQKNFCKNGIWENHSDLGSAGHCVAKPDLVSLLEQKKESWMVKRELTGSLFSGECRRAW

SEQ ID NO: 29112 - protein, 81 aa, Myotis davidii
GPLTFRDVAIDFSQEEWECLDPDQRKLYLDVMLENYSNLVSVAVAKQAQRPSTSGLGQNACIVTMATTQCPGPAAAIFVME

SEQ ID NO: 29113 - protein, 81 aa, Pan troglodytes
ETQPGLVTIKNLAVDFPQQLHPAQKNFCKNGIWENNSDLGSAGHCVAKPDLVSLLEQEKEPWMVKRELTGSLFSGQRSVRE

SEQ ID NO: 29114 - protein, 81 aa, Pan troglodytes
IRDQDLGASLLPAAPQEQWRHLDSTQKEQYWDLMLETYGKMVSGGISHPKSDLTNSIEFGEELAGLYLHVNEKIPRPTCIG

SEQ ID NO: 29115 - protein, 81 aa, Leptonychotes weddellii
SQELVTFKDVVVDFSPEELTYLSAAQRNLYREVMLENYRNLVSLGYQFPKPDIISQLEEEESRVREEDSNTEICQGESSPD

SEQ ID NO: 29116 - protein, 81 aa, Camelus dromedarius
SASQSPTPSQKGSPGDQEMTAALLTAGFQTLEKIEDMAVSLIREEWLLDPSQKDLSRDNRPENYRNMFSLGVLETGESFAV

SEQ ID NO: 29117 - protein, 81 aa, Vulpes vulpes
SQDLVTFKDVVVDFSPEELTYLSAAQRNLYREVMLENYRNLVFLGYQFSKPDIISQLEKEESHVREEDINTDKCQDWEKRP

SEQ ID NO: 29118 - protein, 81 aa, Otolemur garnettii
LVMFEEVSVCFTSEEWACLGPIQRALYWDVMLENYGNVTSLEWESMIENEEVTSKPSISQRADSQKGTSKRLQGGVPQVPD

SEQ ID NO: 29119 - protein, 81 aa, Otolemur garnettii
SQGLVTVKDVAVCFSQDQWSDLDPTQKEFYGEYVLEEDCGIVVSLSFPIPRPDEISQVREEESWVPDIQEPQETQEPEILN

SEQ ID NO: 29120 - protein, 81 aa, Myotis davidii
SRGLVKVKDVPVTREEWEHLDPVQRDFYREGMLKDYGNTFLPSLETRTENKELIPKQEILEVEPQMQLQERSQGNASLLSK

SEQ ID NO: 29121 - protein, 81 aa, Leptonychotes weddellii
PGHREPASTSFHPPRIQEEWGLLDPSQKELYWDAMLEKYGTVVSLAGIPAPPPEAGAESGPGAMRTGIEGRRSLHPGDESE

SEQ ID NO: 29122 - protein, 81 aa, Aotus trivirgatus
ESCESITLNDVAVNFSRGEWKKLEPFQKELYKEVLLENFRNLEFLDFPVSKLELISQLKWVELPWLLEKEVSKGSQPGSII

SEQ ID NO: 29123 - protein, 81 aa, Camelus dromedarius
AMPQGLVTFGDVAVDFSQEEWEWLDCAQRTLYRSVMLENYRSLVSLARDDLVTGTEERAMDGEEKVHARPVPRTWCVSAWS

SEQ ID NO: 29124 - protein, 81 aa, Camelus dromedarius
AGEALMPGSVTFEDVAVYFSCEEWCLLDEVQIRLYLDVMLENFALEQLCCSHLWTMGAPFLYNYLRRCCGYYGDAECIPTP

SEQ ID NO: 29125 - protein, 81 aa, Aotus trivirgatus
PQELVMFEEVSVCFTSEEWACLGPIQRALYWDVMLENYGNVTSLEWETMTENEEVTSKPSSSQRADSQKGTSKRLQGSVPQ

SEQ ID NO: 29126 - protein, 81 aa, Papio anubis
THHLPNGDFAQCASPVPTLPQVGNSGLRMVRPQDTVAYEDLCVDYTQKKWKCPALSQRALQWNMMPENDRSMASLGWSTMA

SEQ ID NO: 29127 - protein, 81 aa, Neomonachus schauinslandi
PQLPESLEDVAMYISQEEWGHQDPSKRALSRDTVQESYENVDSLESQVPSQETLSTHVEQGGKPWDPSVQTCKEGLSLRSP

SEQ ID NO: 29128 - protein, 81 aa, Aotus trivirgatus
PQLPESLEDVAMYISQEEWGHQDPSKRALSRDTVQESYENVDSLESHIPSQEIPSTQVGQGGKLWDPSVQSCKEGLSPRGP

SEQ ID NO: 29129 - protein, 81 aa, Physeter macrocephalus
TEELVTFKDVAVDFSPEELTYLSAAQRKLYWEVMLENYMNLVSLGYQFPKPDIISGLKVKESRAVEEDSSKMICHDWEKKP

SEQ ID NO: 29130 - protein, 81 aa, Aotus trivirgatus
PPNRVSPFKDMILCFSEEDWSLLDPAQTGFYGEFIIGEDCGVSMPPNDLAAQPDLSQGEENEPHVPELQDLQGKEVPQVSC

SEQ ID NO: 29131 - protein, 81 aa, Aotus trivirgatus
ETQPGLVTMKNLAIDFPQQLHPALKNFCKNGLWENYSDLGSAGRCMAKPDLVSLLEQEKEPWMVKRELTGSLFSGQQSVCE

SEQ ID NO: 29132 - protein, 81 aa, Myotis davidii
EPVTFLDVALDFNRDEWELLDPTQRTEYHDVMLETFRHLVSVGWETTLEGEQLPPKSALPEAEPAPNLKVEELSGAEAQPS

SEQ ID NO: 29133 - protein, 81 aa, Cercocebus atys
SQEPVKDVHVARGFSYKKSVHQIPAHRDLYRDFRKENVGNMVSLGSTASTSNKITRLEQRREPWTLGLRSSNKRSILRSNY

SEQ ID NO: 29134 - protein, 81 aa, Leptonychotes weddellii
FQSLLTFEDVAVSFSEEEWKLLDPTQKILYNDVMQENYETVISLEIQASGCKVLRKARMKVAQKTTGKENHGGTRRVRRRH

SEQ ID NO: 29135 - protein, 81 aa, Leptonychotes weddellii
ERQPGLVTITNMAVDFSQQLDPAQKSFCKNVIWESHGDLGSVGPCVSKPDLVSLLEQGKEPWMVERELARGLFSGQQSINE

SEQ ID NO: 29136 - protein, 81 aa, Aotus trivirgatus
QLQETMTFKDVEVTFSQDEWGLLDSAQRNLYRDVMLENYRNMAFLVGPFTKPALISWLEAREPWGLNMQVAQPKGNPGAAP

SEQ ID NO: 29137 - protein, 81 aa, Monodelphis domestica
SQGLATFKDVTLSFSQEQWGDLDPTQKEFYGEYVLQEDCGIVVSLTFPIPRLEEISQVEEEEESWVPDLEYPQDPEETEIL

SEQ ID NO: 29138 - protein, 81 aa, Papio anubis
QGMATFEDMAVSLTWEDWERLDPARRDFCRESAQKDSGSTVPPSLESRAENKELIPMQEILEAEPQGRLQEAFQGKRPLLS

SEQ ID NO: 29139 - protein, 81 aa, Lipotes vexillifer
LLTFEDVALFFTEEEWQLLDPAQKILYNNVMQENYETVTFLGLKLKNDTGNDQPISLSTLEIQASGCKVLRKARMKVAQKT

SEQ ID NO: 29140 - protein, 81 aa, Leptonychotes weddellii
MAEGFTFKDVAIYFSQKEWECLHSAQKDLYRDVMLENYNNLISLDWESRRVTKNLFPKEHSYEIKSLHLEIKRLTSSDLEC

SEQ ID NO: 29141 - protein, 81 aa, Physeter macrocephalus
SQGPVKDVHMARGFSYKKSVRQIPAHRDLYRDIRKESIGNMVSLGNTVSTANKTAQLEQRKEPWTIGLQSPNKRNVLRNDY

SEQ ID NO: 29142 - protein, 81 aa, Physeter macrocephalus
SQESMTLKDVAVTFSRGEWRTLEPSQKEIYKEVLLENYRNLEFLGFPVSKLDLISQLKWAGLPWLLQKQASRGSRPECELS

SEQ ID NO: 29143 - protein, 81 aa, Monodelphis domestica
FQESVTFKDVDPDFTLEEWAQLAPVQQDLYKEVLLENYRNLVFLGLSVPKPDVISQLERGEMPWMLESEAPRTICPYFDTL

SEQ ID NO: 29144 - protein, 81 aa, Sarcophilus harrisii
TRDKNETASLHLSSSQVQWQCLNQTQKELYWDAMLEDYGKVVSLGIPISKPNPINLVDGREELDGSHSCSSEEMAKSICIG

SEQ ID NO: 29145 - protein, 81 aa, Sarcophilus harrisii
GQKDLVTFEDVSVDFTQKEWKSSTPAQRAFFRDLMLENYRDVVSLGFPFSKPMGISQREEKPWGLNHQAPLALEDGKSTCT

SEQ ID NO: 29146 - protein, 81 aa, Monodelphis domestica
SQEPVICLGMSRNLSHKKWGHLNPAHKNFCRGIMKENYRNMVSLGIPISTSKKVSPLAQRKKPWVLGLQGSNKKYILRGSH

SEQ ID NO: 29147 - protein, 81 aa, Physeter macrocephalus
SQELLTFKDISVDFTQEEWGQLAPAHRNLYREVMLENYGNLVSVGYQLSKPGVISQLEKGEEPWLMEREISGGPSPDLEDE

SEQ ID NO: 29148 - protein, 81 aa, Camelus dromedarius
VTARDVAASLTWEEWQHLGPALRDAYREGTLQGCGNTASPGSETGTENRELIPKQETLDEVEPQGQLPGSQEHLSCEWGEA

SEQ ID NO: 29149 - protein, 81 aa, Camelus dromedarius
RVTFEDVAVYFTQNEWGILAPAQRALYRELLRFLLFQTQKTVPGARGHQPCSKPLGLRADLPWGSESWTLAGPSLPCSSDC

SEQ ID NO: 29150 - protein, 81 aa, Physeter macrocephalus
FVTKESVTFTDVAVDITREDWELMRPVQKELYKTVTLQNYWNMVSLGLTVYRPTVIPILEEPWMVIKEILEGPSPEWETEA

SEQ ID NO: 29151 - protein, 81 aa, Monodelphis domestica
VKIEDMAVSLILEEWGCQNLARRNLCRDNRQENYGTMFSQGCGSRTTNEESTSKEDVAEATGSHGEIPGRFQREFGETCEQ

SEQ ID NO: 29152 - protein, 81 aa, Camelus dromedarius
SQSLLTFEEVAIYFSQEEWELLDPTQKALYGDVMQETYETVISLALFVVPKPKVISCLEHGEEPWIQRPPEFKDSPGELLT

SEQ ID NO: 29153 - protein, 81 aa, Myotis davidii
FQERLTFKDITVNFTQEEWGQLTPAHRNLYREVMLENYGNLVSVGYEFSKPRVISQLEKGEEPWITEKEGPGHPSADLKSK

SEQ ID NO: 29154 - protein, 81 aa, Camelus dromedarius
SQMSVTFEDVAVLFTRDEWRKLGPSQRSLYQDVMLENYSNLLSLAGLPFSKPKVISLLQQGEDPWKVERDSPGGASLEEGS

SEQ ID NO: 29155 - protein, 81 aa, Neomonachus schauinslandi
PASTSFHPPRIQEEWGLLDPSQKELYWDAMLEKYGTVVSLAGIPAPPPEAWADSGPGAMRTGTEGRRSLHPGDESESHCEG

SEQ ID NO: 29156 - protein, 81 aa, Monodelphis domestica
AQDSVTFKDVAVMFSRKEWWHLQPTQMELYRDVMLENYRNMVSVGLLTSKPELIAQLERGEAPWMRSRTVSRGPGAGSETR

SEQ ID NO: 29157 - protein, 81 aa, Camelus dromedarius
NLLTFEEVAMYFSQEEWELLDPTQKALYNDVMQENYETVISLAVPAHQILASPEQTDTKDWTVAPELFLPESQSLLTFEEV

SEQ ID NO: 29158 - protein, 81 aa, Neomonachus schauinslandi
SQGLLTFKDISVDFTQEEWGQLAPAHRNLYREVMLENYGNLVSLGYQLSKPGVISQLEKGEEPWLIEREISGSPSSDLENK

SEQ ID NO: 29159 - protein, 81 aa, Monodelphis domestica
SQESVTFKDVAVDFTEEEWERLDSDQRDLYLTVMLENYRNLVFLGLPVSKPELIFQMDQEEESRILEREVSKAWDIGTESK

SEQ ID NO: 29160 - protein, 81 aa, Papio anubis
SQEPVKDVHVARGFSYKKSVHQIPAHRDLYRDFRKENVGNMVSLGSTASTSNKITRLEQRREPWTLGLHSSNKRSILRSNY

SEQ ID NO: 29161 - protein, 81 aa, Neomonachus schauinslandi
SQGLLTFKDISVDFTQEEWGQLAPAHRNLYREVMLENYGNLVSLAGYQLSKPGVISQLEKGEEPWLIEREISGSPSSDLEN

SEQ ID NO: 29162 - protein, 81 aa, Monodelphis domestica
FQESVTFKDVVPDFTWEELVQLDPVEQDLYRDVLLENYRNLVFLGLLASKPDVIIQLECGEVPWILENEVPKDSDINPEAN

SEQ ID NO: 29163 - protein, 81 aa, Camelus dromedarius
QERVTFEDVAVYFTQNEWGILAPAQRALYREVMLENYANVASLAFKVLAFPNPEDSAWSQGTSAMLQTTWPQEPVAFEDVA

SEQ ID NO: 29164 - protein, 81 aa, Cercocebus atys
GHQEAASTSFHPPRIQEEWGLLDRSQKELYWDTMLEKYGTVVSLGLPPHQPEAQAQSELGMLLMGTGVCRSLHSGNESEGP

SEQ ID NO: 29165 - protein, 81 aa, Cercocebus atys
DTVAYEDLCVDYTQKKWKCPALSQRALQWNMIPENDRSMASLAGENMMKGSELTPKQEIFKGSESSNKTSGGLFGMVPGGA

SEQ ID NO: 29166 - protein, 81 aa, Monodelphis domestica
QNHVTQLKDVILCFSEEEWSLLDPAQTGFYGEFIIEEDYGVSLPMNYPGPQPIPERINELPKVMQLPDSRVEEDEPCVLEF

SEQ ID NO: 29167 - protein, 81 aa, Cercocebus atys
SQELLTFKDISVDFTQEEWGQLAPAHRNLYREVMLENYGNLVSVGYQLSKPGVISQLEKGEEPWLMEREISGVPSSDLESK

SEQ ID NO: 29168 - protein, 81 aa, Cercocebus atys
VKIEDMAVSLILEEWGCQNLARRNLSRDHRQENYGSTFPQGGENRNENEESTSKAETTENSASRGETAGRFQKEFGEKRDQ

SEQ ID NO: 29169 - protein, 81 aa, Neomonachus schauinslandi
SQELVTFKDVVVDFSPEELTYLSAAQRNLYREVMLENYRNLVSLGYQFPKPDIISQLEEEESRVREEDSNTEICQDGEKRP

SEQ ID NO: 29170 - protein, 81 aa, Neomonachus schauinslandi
SQGLLTFKDISVDFTQEEWGQLAPAHRNLYREVMLENYGNLVSVAGYQLSKPSVISQLEKGQEPWMTEKEGPGDSSSDLKN

SEQ ID NO: 29171 - protein, 81 aa, Camelus dromedarius
GLVTFKDVAVCISQDQWSDLDPAQKEFYGEYVLEEDCGIVVSLCKEFQVFLESFPIPRLDEISPAGEEEPLIPDISEPPEP

SEQ ID NO: 29172 - protein, 81 aa, Physeter macrocephalus
QVPVTLEDVAVYLSQEEWGCLDLAQQDHSCDMLLEDEGLPAPGPCLTAQEGPGQGLRDPACAASGLREVSGSAGSELGRQF

SEQ ID NO: 29173 - protein, 81 aa, Monodelphis domestica
GFQEPVTCEDVTVPLSQEEWRCLNSAQRVLYKGIAQEKFRNVDSVGLPKSLLISGMNHGKDICIPDLQGSKETEILSSSHT

SEQ ID NO: 29174 - protein, 81 aa, Cercocebus atys
PQLPESLEDVAMYISQEEWGHQDPSKRALSRDTVQESYENVDSLESHIPSQEVPGTQVGQGGKLWDPSVQSCKEDLSPRGP

SEQ ID NO: 29175 - protein, 81 aa, Cercocebus atys
QTDLVTFDSVAVEFTQEEWTLLNPTQRNLYSDVMLENYKNLSSVGYQLFKPSLISWLEEEEELSTLPRVLQEWKMCLKTKG

SEQ ID NO: 29176 - protein, 81 aa, Felis catus
QQVPVTLEDVAAYLSQKEWECLDPAQRGCVWDVLPDSGGLGLQLEDGEGARQNVPTRREQDRELVGGMTRPEQSLEGGGPR

SEQ ID NO: 29177 - protein, 81 aa, Pan troglodytes
EEPVTFQDVAVDFSREEWGLLGPTQRTEYRDVMLETFGHLVSVGWETTLENKELAPNSDIPEEEPAPSLKVQESSRDCALS

SEQ ID NO: 29178 - protein, 81 aa, Camelus dromedarius
QLPESLEDVAMYISQEEWGHQDPSKRALSGDTVQESYENVDSLGEEKFENLEDSAQSSSPESVHPQALQPGQARGEMVSLG

SEQ ID NO: 29179 - protein, 81 aa, Camelus dromedarius
EEEAQERRKRREKRSGMALSQGQLTFKDVAVVFTQEEWECLDPAQRALYRDVMLETCRNLISVEFVLGNLMIGFPIIKEAS

SEQ ID NO: 29180 - protein, 81 aa, Camelus dromedarius
PAKVTGSVTFGDVAVFFSRDEWLHLNPTQRALYREVMLDNFSALASLGIPFSTPKVICRLQLGEDPCMVEREIPEDPRLGE

SEQ ID NO: 29181 - protein, 81 aa, Myotis davidii
ASIVTFEDVAVNFTLEEWALMDTSQKKLYRDVMWETFRNLASVGKNWKNHDIEDLYRNQRRKRTSGACGPEAPGAPLKLQA

SEQ ID NO: 29182 - protein, 81 aa, Vulpes vulpes
SQELLTFKDVSVDFTQEEWGQLSLAHRNLYREVMLENYGNLVSVGYQLSKPSVISQLEKGQEPWMTEKKGPGDPSPDLKNK

SEQ ID NO: 29183 - protein, 81 aa, Pongo abelii
IRDQDLGASLLPAAPQEQWRHLDSTQKEQYWDLMLETYGKMVSGGISHPKSDLTNSIEFGDEPAGLYLHVNEKIPRPTCIG

SEQ ID NO: 29184 - protein, 81 aa, Vulpes vulpes
SQSLLTFEEVAMYFSQEEWELLDPTQKALYNDVMRENYETVISLALFVLPKPKVISYLEQGEEPWVQGPLEFKASLGELPT

SEQ ID NO: 29185 - protein, 81 aa, Enhydra lutris
SQELVTFQDVVVDFSPEELTYLSAAQRNLYREVMLENYRNLVSLGYRFSKPDIISQLEEEESRVREEDSNTELCQDGEERP

SEQ ID NO: 29186 - protein, 81 aa, Enhydra lutris
ERQPGLVAIANVAVDFSPQLDPAQKSVCKNVRWESHGDLGSVGPCVPKPDLVSLLEQGREPWMVRTELTRGLCSGQQSICE

SEQ ID NO: 29187 - protein, 81 aa, Bos indicus x Bos taurus
TKDWTVAPELVLPESQEEWELLNPTQKALYNDVMHENYETVISLALFVLPKPKVIYLEQGEEPYIQGSPMFKDNPGELLSE

SEQ ID NO: 29188 - protein, 81 aa, Ovis aries
LLTFEEVAIYFSQEEWELLNPTQKALYNDVMHENYETVISLEIKLKNDMENHQLMCLSDLEIQAPGDIVSKKASVNVHQKT

SEQ ID NO: 29189 - protein, 81 aa, Pan troglodytes
SITLKDVAVTFSRGEWKKLEPFQKELYKEVLLENLRNLEFLALFENHGNYIPYNPKYNSFLSCKQEIFYFLYLLDESALDK

SEQ ID NO: 29190 - protein, 81 aa, Enhydra lutris
LLTFEDVAVSFSEEEWRLLDPTQKSLYNDVMQENYETVVSLGLKLKNDTGNDQPISLSALEIQASGCRVLRKARMKVAQKT

SEQ ID NO: 29191 - protein, 81 aa, Pongo abelii
TESCESITLKDVSVNFSRGEWKKLEPFQKELYKEVLLENLRNLEFLDFPVSKLELISQLKWVELPWLLEEVSKCSRLGSVI

SEQ ID NO: 29192 - protein, 81 aa, Enhydra lutris
PQGSAAYQFLSVDYTERKWKGPALSQRAVYRSIMPENCCSVASMGETRMQHSELPAKQEVSKEPLLPDGTSGGLCGVVSEE

SEQ ID NO: 29193 - protein, 81 aa, Enhydra lutris
SQVPVTLEDMAAYLSQEEWESPDPAQRDCSWDTLPEHRGLGLQLDGEDAREDVSMRRERDREPAGGMTRPEQPLERAGPRR

SEQ ID NO: 29194 - protein, 81 aa, Enhydra lutris
TKDWTVAPELVLPESQEEWELLDPTQKALYNDVMRENYETVISLALFVLPKPKVISYLEHGEEPWVQGSLEFKNSPGELPS

SEQ ID NO: 29195 - protein, 81 aa, Pan troglodytes
GHQEPASTSFHPPRIQEEWGLLDRSQKELYWDAMLEKYGTVVSLGLPPHQPEAQAQSELGMLLTGTGVCRSLRSGECPTPS

SEQ ID NO: 29196 - protein, 81 aa, Otolemur garnettii
IRDQDFTASLLPSAPQEQWRHLDSTQKEQYWDLMLETYGKMVSGAGVSNSRADLTNSTEFGEELAGLHLHVSEKLPRPTCI

SEQ ID NO: 29197 - protein, 81 aa, Bos indicus x Bos taurus
VEEDFRFKDVVIYFSWKEWECLHSAQKDLYQDVMLENYNNLISLGFTNFKPDVISLLEQRKEPWMVKGKETEEWCPDWKSR

SEQ ID NO: 29198 - protein, 81 aa, Ovis aries
VTVQDVAVSLTWEEWERLGPAQKHFFRESTPKDHGNAISPSSETRIENKELVPKQEILEEVESQGQLRGFQERAPLSSECG

SEQ ID NO: 29199 - protein, 81 aa, Otolemur garnettii
VKIEDVADVAVSFILEEWGHLDQSQKSLCRDDRKENYGSITSMDYESRDNNMELIVKQISDDAESHWMASGSTERNVPQSQ

SEQ ID NO: 29200 - protein, 81 aa, Camelus dromedarius
PQELLTFKDICVDFTQEEWKQLAPSHRNLYREVMLENYGHLVSVGCQLSKPGVISQLEKGEEPWLTEREVSGGPSPDLESK

SEQ ID NO: 29201 - protein, 81 aa, Pongo abelii
SQELLTFKDVSVDFTQEEWGQLAPAHRNLYREVMLENYGNLVSVAGYQLSKPGVISQLEKGEEPWLMERDISGVPSSDLES

SEQ ID NO: 29202 - protein, 81 aa, Camelus dromedarius
QAMVKIEDMAVSLILEEWGCQNLARRNPSRDNRQENYGNVISQGKTDAGLLSDEIVLPFCFGCENRNENEESTSKAEIADD

SEQ ID NO: 29203 - protein, 81 aa, Otolemur garnettii
IQTDLVTFDSVAVEFTQEEWTLLDTTQRNLYRDVMLENYKNLSSVGYQLFKPSLISQLEEEFRTVQRSIFQEWKMCLKTNG

SEQ ID NO: 29204 - protein, 81 aa, Enhydra lutris
SQELLTFKDISVDFTQEEWGQLPLAHRNLYREVMLENYGNLVSVAGYQLSKPSVISQLEKGQEPWMTEKEVPEDPSSDLRT

SEQ ID NO: 29205 - protein, 81 aa, Pan troglodytes
ALSQEENPRNQLMALMLLTAQPQELVMFEEVSVCFTSEEWACLGPIQRALYWDVMLENYGNVTSLDTKYTRQSKIIGTRVA

SEQ ID NO: 29206 - protein, 81 aa, Camelus dromedarius
MTFTDVAVDITPEDWELMRPVQKELYKTVTLQNYWNMVSLEVRASSWMRSQVIKFEQLFSSRTKLILFLLNRTYGVQTNCD

SEQ ID NO: 29207 - protein, 81 aa, Myotis davidii
FQLPESLEDVAMYISQEKWGHQDPSKRALSRDTVQESYENVDSLESQVPNQEALSIQVEQGRKPWEPSVQICKEGLSPRNP

SEQ ID NO: 29208 - protein, 81 aa, Cercocebus atys
QGMATFEDMAVSLTWEEWERLDPARRDFCRESAQKDSGSTVPPSLESRAENKELIPMQEILEAEPQGGLQAAFQGKCPLLS

SEQ ID NO: 29209 - protein, 81 aa, Otolemur garnettii
SQKPLKDVHMTRGYSYKKSVHQIPAHRGLYQGIRKESVGNMVSLGSTVSISNKATRLDQRKEPWTLGLHSSNKRSILRSNY

SEQ ID NO: 29210 - protein, 81 aa, Pongo abelii
EEPVTFQDVAVDFSREEWGLLGPTQRTEYRDVMLETFGHLVSVGWETTLENKELAPNSDIPEEEPAPSLKVQESSGDYALS

SEQ ID NO: 29211 - protein, 81 aa, Pan troglodytes
TESCESITLKDVAVTFSRGEWKKLEPFQKELYKEVLLENLRNLEFLDFPVSKLELISQLKWVELPWLLEEVSKGSRLGSVI

SEQ ID NO: 29212 - protein, 81 aa, Camelus dromedarius
KIEDVADVAVSFILEEWGHLDQSQKSLYRDDRKENYGSVTSMDYESRNDSMEVLVKQISKEAESPWMTSGSTERNVPPSQG

SEQ ID NO: 29213 - protein, 81 aa, Pongo abelii
MVTFEDMAVSLTWEEWERLDPARRDFCRESVQKDSGSTVPPSPVKMKGRGCLLSSTRGSHHHGQATTVSLMQVTLFMDRKS

SEQ ID NO: 29214 - protein, 81 aa, Camelus dromedarius
RLMLHEEEAQERRKRREKRSGMALSQGQLTFKDVAVVFTQEEWECLDPAQRALYRDVMLETCRNLISVGEDFFPLEAGLCP

SEQ ID NO: 29215 - protein, 81 aa, Enhydra lutris
GHREPASTSFHPPRIQEEWGLLDPSQKELYWDAMLEKYGTVVSLGIPAPQPEARVELEPGALRTGTEGRRSLHPGDESESH

SEQ ID NO: 29216 - protein, 81 aa, Physeter macrocephalus
LERHLGLVTITNMAIDVSQQPDPTRKSFCKNVVWEDHNLGAVGRCVSEPDLVSLLDLGKEPWVVKGELARGPSPGQQSIHE

SEQ ID NO: 29217 - protein, 81 aa, Papio anubis
QEPVTFKDVVVEFSKEEWGQLDSAVKNLYRNVMLENFRNLNSLRKAYLFSKPVESLKLESKKKRWIMEKEIPRKTVFDMQS

SEQ ID NO: 29218 - protein, 81 aa, Sarcophilus harrisii
VKIEDVADVAVSFILEEWGHLDQTEKDLSRNDRQENYETITAVDYEPRNENMELIVKQEISEEAESLWMTPGSIQKNDSQD

SEQ ID NO: 29219 - protein, 81 aa, Leptonychotes weddellii
PGHREPASTSFHPPRIQEEWGLLDPSQKELYWDAMLEKYGTVVSLGIPAPPPEAGAESGPGAMRTGIEGRRSLHPGDESES

SEQ ID NO: 29220 - protein, 81 aa, Physeter macrocephalus
PTSVPFQPPRIPEEWGLLDPSQKEVYWDAMLQKYGTVVSLAGLPCPLPEARTEPEPEALSTGSEGARSLLPGGESESSREG

SEQ ID NO: 29221 - protein, 81 aa, Monodelphis domestica
SAWSQMPVTFEDMAMYLSQEEWGRLNPEQREHYQNVLQENYGLPALKPNLIAQMERKEGLWNSNVPAFKERDVPRDNPTEC

SEQ ID NO: 29222 - protein, 81 aa, Physeter macrocephalus
LLTFEDVALFFTEEEWQLLDPAQKILYYNVMQENYETVTSLGLKLKNDTGNDQPISLSTLEIQASGCKVLRKARMKVAQKT

SEQ ID NO: 29223 - protein, 81 aa, Monodelphis domestica
SQLPVTFEDVAVYLSQEEWGHQEPSKKALSREVMQENYENVVSLESQIPSQDPASQIEQEEKPWDPNLQSAKEPGISKIPY

SEQ ID NO: 29224 - protein, 81 aa, Monodelphis domestica
TSDNNEAASLLTPGSQEQWQYLNHIQKEIYWDAMLEDYGKVVSLGIPVSKPDLTNLVDRREKLDGSHSLANEEIPRNICIG

SEQ ID NO: 29225 - protein, 81 aa, Physeter macrocephalus
SQSLLTFEEVAIYFSQEEWELLDPTQKALYNDVMQENYETVISLALFVLPKTKVNCCLEQGEEPWVQGSPVFKDSPGELFS

SEQ ID NO: 29226 - protein, 81 aa, Aotus trivirgatus
QEPVTFKDVVVEFSKEEWGQLDSAVKNLYRDVMLENFRNVNSLRKAHLLSKPVESLELTNKKKRWITEKEISRKTISDMQS

SEQ ID NO: 29227 - protein, 81 aa, Monodelphis domestica
SITFKDMAVDFTQEEWCLLDPSQKELYREVMLENVQNLLFVEAETNFEVKEMSPELSLFVEGSGPQKGMNPLYFLLREIWD

SEQ ID NO: 29228 - protein, 81 aa, Physeter macrocephalus
SQELLTFKDISVDFTQEEWGQLAPAHRNLYREVMLENYGNLVSVVGCQLSKPSVISQLEKGEAPWMTEKEGPGDPSSDLKS

SEQ ID NO: 29229 - protein, 81 aa, Monodelphis domestica
FQETITFQDVTPDFTWEEWAQLDTVQQDLCRDVLMENYRNLVFIGLSVSKPDVISQMEHGEVPWLLRSEVPRGICPYWDFG

SEQ ID NO: 29230 - protein, 81 aa, Papio anubis
SQEPVTFADVAVVFTPEEWVFLDSTQRSLYRDVMLENYRNLASVADQLCKPNALSYLEQRGEQWTTDRGILLDTCAEPQLQ

SEQ ID NO: 29231 - protein, 81 aa, Aotus trivirgatus
QTDLVTFDSVAVEFTQEEWTLLDPTERNLYRDMMLENYKNLSSVGYQLFKPSLISWMEEEEELSTLPRVLQEWKMCLKTNG

SEQ ID NO: 29232 - protein, 81 aa, Monodelphis domestica
QETITFQDVTPDFTQEEWAQLNPAQQDLCMDVLMENYRNLVFIGLELSVSKPDVISQMEHGKGPWLLKSEALRGISPYKDI

SEQ ID NO: 29233 - protein, 81 aa, Monodelphis domestica
KSQDLVTFGDVAIYFSQEAQGQLDSAPQDFCQDQTQENENGVSQRFPIPRTSMISQIEQGEKLQNLDLQGCKEKENSRDSR

SEQ ID NO: 29234 - protein, 81 aa, Papio anubis
QGLLKMEDVALTLSPGWTQLDSSQVNIYRDEKQENHSSLVSLGAEIQTESRDLPPVKKLSKKEHGKICHLREDIAQNPTCA

SEQ ID NO: 29235 - protein, 81 aa, Enhydra lutris
VKIEDVADVAVSFILEEWGHLDQSQKSLYRDDRKEKFGSITSMDYESGHDNVELAVKQISDDVEPHWMTSGSPERNVPQSQ

SEQ ID NO: 29236 - protein, 81 aa, Monodelphis domestica
LPKMKSFGDYKLVSGSQEAPGHRSPVQDLCKDSEGKDYGNEFLKEFAVPNSDIILPLKQGREPWAPNLQSSEEKKNNPRGY

SEQ ID NO: 29237 - protein, 81 aa, Aotus trivirgatus
EELPVVFEDVAVYFTREEWGMLDKRQKELYRDVMRMNYELLASLGPAAAKPDLISKLERRAAPWIRDPNGPKWGKGRPSGN

SEQ ID NO: 29238 - protein, 81 aa, Enhydra lutris
QEPVTFKDVIVEFNEEEWGQLDPAIKTLHRDVMLENYRNLNSLYQEHLFSKPVEISKLESKERRWTVEHKIPSTSVLDREI

SEQ ID NO: 29239 - protein, 81 aa, Vulpes vulpes
GHREPTSTSFHPPRIQEEWGLLDPSQKELYWDAMLEKYGTVVSLGIPAPQPEAQAELEPGALRTGTESLRSLHLGDENESH

SEQ ID NO: 29240 - protein, 81 aa, Enhydra lutris
SRESMMIKDVVVSFSRGEWRRLEPFQKELYKEVLLENFRSLEFLGFPVSKLDLISQFKWVELPWLLEREISKGSRPECEPR

SEQ ID NO: 29241 - protein, 81 aa, Bos indicus x Bos taurus
LLTFEEVAMYFSQEEWELLDPTQKALYNDVMQENYESVIFLGLKLKNDTENIQSLCLSDLEIQVPVAIASRKARLKVPQKT

SEQ ID NO: 29242 - protein, 81 aa, Rhinolophus ferrumequinum
SGEPMTFKDVAVSFSRGEWRKLEPFQKELYKEVLMENFRNLEFLGFPVSKLDLISQLKWVELPWLLEKEVSEGSRPECDPR

SEQ ID NO: 29243 - protein, 81 aa, Callithrix jacchus
QGMMTFEDMAMSLTWEEWERLDPARKDFYRESMQKDSGSTVLPSLESRTENKELIPMQEILEAEPQEQLQEAFQGKPPLFS

SEQ ID NO: 29244 - protein, 81 aa, Neophocaena asiaeorientalis
KIEDVADVAVSFILEEWGHLDHSQKSLYRDDRKENYGSITSMDYESRNDNVELMVKQISDEAESPWMTSGSPERNVPPSQE

SEQ ID NO: 29245 - protein, 81 aa, Acinonyx jubatus
PAATSFHPPRIQEEWGLLDRSQKELYWDAMLEKYGTVVSLGLPAPLPEARVESEPGVLRSGTEGQRSLHPGECFSMRSEPP

SEQ ID NO: 29246 - protein, 81 aa, Zalophus californianus
SRESVAFKDVVVTFSRGEWRRLEPFQKELYKEVLLENFRNLEFLGFPVSKLDLISQFKWVELPWLLEKEISKGSRPEGEPR

SEQ ID NO: 29247 - protein, 81 aa, Phyllostomus discolor
LEKIEDMAVSLIREEWLLDPSQKDLSRDDKPENYRNVFTLGSETRNENRELASKQVISTGVQLHGERAAKCNGDADGSPEL

SEQ ID NO: 29248 - protein, 81 aa, Ursus maritimus
EEPVTFLDVAVDFSKEEWGLLDTMQRTEYHDVMLETFGHLVSVGWETTLESKELTSKSDIPEKELAHDLKIEEISRDDTCS

SEQ ID NO: 29249 - protein, 81 aa, Sus scrofa
SLLTFEEVAIYFSQEEWELLDPTQKALYNDVMHENYETVISVAVPAHQILAFPEQTNSRDWTVAPELVLPEAQSLLTFEEV

SEQ ID NO: 29250 - protein, 81 aa, Panthera pardus
PQELVTFQDVAVDFSLEELTYLSAAQRNLYREVMLENYRNLVSLGYQFSKPDIISQLEEEESHVREEDSDTEMHHDPRGPS

SEQ ID NO: 29251 - protein, 81 aa, Rhinolophus ferrumequinum
QGLVKVKDVAVSLTWEDWEHLDAVQRDFYRESTPKDYGNTVPPRLETRTENKELIPKQEFLDVEPQRQLQEGSQGKAPPFS

SEQ ID NO: 29252 - protein, 81 aa, Bison bison
WTVAPELVLPESQEEWELLDPTQKALYNDVMQENYETVISLAVPAHQLLAFPKQTNTSEWTVAPELILPESQSLLTFEEVA

SEQ ID NO: 29253 - protein, 81 aa, Zalophus californianus
IRDQDFGASFLQAAPLEQWRHLDSTQKEQYWDLMLETYGKMVSGGISSSKSDLTNSTEYGEELVGLHLPVGEKIPRPTCIG

SEQ ID NO: 29254 - protein, 81 aa, Acinonyx jubatus
ESQELLTFKDISVDFTQEEWGQLAPAHRSLYREVMLENYGNLVSVDLESKAETKESAVKNDTSWEELHHGLMKEQSTRGST

SEQ ID NO: 29255 - protein, 81 aa, Panthera pardus
VGDQDFTASVLQAAPQETWRHLESVQKEQYWDLMLETYGKMVSGGISSSKPDPTGSTEYGEEPAGRHPHLSEKIPRPTCLG

SEQ ID NO: 29256 - protein, 81 aa, Panthera pardus
SQELLTFKDISVDFTQEEWGQLPLAHRNLYREVMLENYGNLLSVAGYQLSKPSVISQLEKGQEPWMTEKEGPGDPRSDLKN

SEQ ID NO: 29257 - protein, 81 aa, Sus scrofa
PQLPESLEDVAMYISQEEWGHQDPSKRALSRDTVQESYENVDPLESQVPSQEALSTQVEQGRKPWDPNVQICKEGLSPRSP

SEQ ID NO: 29258 - protein, 81 aa, Acinonyx jubatus
VGDQDFTASVLQTAPQEPWRHLESVQKEQYWDLMLETYGKMVSGGISSSKPDPTGSTEYGEEPAGRHPHLSEKIPRPTCLG

SEQ ID NO: 29259 - protein, 81 aa, Panthera pardus
KSRGSISFEDVTVNFTQEEWGQLDPDQRTLYRDVMLENDGFFISLGHSITKPEEIFKLEQGASWILEEEFASQCYLREQSR

SEQ ID NO: 29260 - protein, 81 aa, Sus scrofa
GGPVTFGDIPFYFSREEWGSLDPSQRDLFWDIKRENSRNVAPGLGFKSPSERPQLEEVVTAIPGQAVGDVAASWRPEAAEA

SEQ ID NO: 29261 - protein, 81 aa, Tursiops truncatus
LERHLGLVTITNMAVDVSQQPDPTRKSFCKNVVWEDHNLGAVGHCVSEPDLVSLLDLGKEPWVVKGELARGPSPDPEGFWS

SEQ ID NO: 29262 - protein, 81 aa, Carlito syrichta
VMFEEVSVCFTSEEWACLGPIQRALYWDVMLENYGNVTSLEWETMTENEEVTSKPNISQRADSHKGTSKRLQGGIPKALDF

SEQ ID NO: 29263 - protein, 81 aa, Acinonyx jubatus
LVTKESMTFKDVAVDITQEDWEIMRPIQKELYKTVTLQNYWNMVSLGLTVYRPTVIPMLEEPWMVIKEILEGPSPEWKTEA

SEQ ID NO: 29264 - protein, 81 aa, Carlito syrichta
SQGLVTFKDVAVCFSQDQWSDLDPTQKEFYGEYVLEEDCGIVVSLSFPIPRPDEISQVREEEPWVPDIQEPQETQDPEILS

SEQ ID NO: 29265 - protein, 81 aa, Vicugna pacos
PQLPESLEDVAMYISQEEWGHQDPSKRALSGDTVQESYENVDSLESQVPSQEALSAQVEQGGKPWDPNVQARKEGLSPRSP

SEQ ID NO: 29266 - protein, 81 aa, Callithrix jacchus
QGMMTFEDMAMSLTWEEWERLDPARKDFYRESVQKDSGSTVLPSLESRTENKELIPMQEILEAEPQEQLQEAFQGKPPLFS

SEQ ID NO: 29267 - protein, 81 aa, Enhydra lutris
GHREPASTSFHPPRIQEEWGLLDPSQKELYWDAMLEKYGTVVSLAGIPAPQPEARVELEPGALRTGTEGRRSLHPGDESES

SEQ ID NO: 29268 - protein, 81 aa, Sus scrofa
TRDEDLGASLLQAAPQAQWSHLDSTQKEQYWDLMLETYGKMVSGGISNPKPDLTSPAGYGAELAGLHLHGSEKIPRPTCTG

SEQ ID NO: 29269 - protein, 81 aa, Sus scrofa
SQEQLTFRDVSVDFTQEEWGQLAPAHRHLYREVMLENYGNLVSVGYQLSKPGVISQLEKGEEPWLMEREVSGGPSPDLKGE

SEQ ID NO: 29270 - protein, 81 aa, Phascolarctos cinereus
MTFEDMTMSFALEKWGQLDPVQKSLCSDKRHDNYGNVVALDGVTTMENGESAQNQDIKADTESKGELPDRLNGHIPQGLEL

SEQ ID NO: 29271 - protein, 81 aa, Pteropus vampyrus
QEPVTFKDVVVEFSEEEWGHLDPAVKSLYRDVMLENYRNLNSLRKEHLFSKPDEVPKLECKKKRWITEQEIPRTIVFDRQT

SEQ ID NO: 29272 - protein, 81 aa, Physeter macrocephalus
PQELVMFEEVSVCFTSEEWACLGPIQRALYWDVMLENYGNVTSLEWETMTENEEVTSKSSLSQRADFQKGTSKRLQGSVPQ

SEQ ID NO: 29273 - protein, 81 aa, Ursus arctos
SLLTFEDVAMYFSQEEWELLDPTQKALYNDVMRENYETVISLAVPAHQILAFPEQIITKDWTVAPELVLPESQSLLTFEEV

SEQ ID NO: 29274 - protein, 81 aa, Neophocaena asiaeorientalis
QEPVTLKDVVVEFSEEEWGQLDPAVKNLYRDVMLENYRNLNSLHKEHLLSKPVETSRLESKEKSWIMEQEILRTAVFDREI

SEQ ID NO: 29275 - protein, 81 aa, Leptonychotes weddellii
SQGLLTFKDISVDFTQEEWGQLAPAHRNLYREVMLENYGNLVSVAGYQLSKPSVISQLEKGQEPWMTEKEGPGDPSSDLKN

SEQ ID NO: 29276 - protein, 81 aa, Odocoileus virginianus
SGQSVSVEGMSQILMIFKYLAMTFTWEEWGQLDLAKRTLYWEVMLETCGLLVSLGYPIPKPEVIHLLENEQNLCLVKRGFS

SEQ ID NO: 29277 - protein, 81 aa, Odocoileus virginianus
QLTFEDVALSFSKEEWQIMDPNQKTLYIDVMQEIYETVTSLGLKLKNDTGNDQPVSLSTSEIQPSGCKVLRKARMKVAQTT

SEQ ID NO: 29278 - protein, 81 aa, Vicugna pacos
PQELLTFKDICVDFTQEEWGQLAPAHRNLYREVMLENYGHLVSVGYQLSKPGVISQLEKGEEPWLTEREVSGGPSPDLESK

SEQ ID NO: 29279 - protein, 81 aa, Pongo abelii
DTVVYEDLSVDYTQKKWKGLTLSQRALQWNMMPENDHSMASLAGENMMKGSELTPKQKIFKGSESSNRTSGGLFGVVPGAA

SEQ ID NO: 29280 - protein, 81 aa, Delphinapterus leucas
QEPVTFKDVVVEFSEEEWGRLDPAVKNLYRDVMLENYRNLNSLHKEHLLSKPVGTSRLESKEKSWIMEQEILRTVFDREII

SEQ ID NO: 29281 - protein, 81 aa, Balaenoptera acutorostrata
SQESMTLKDVAVTFSRGEWRTLEPSQKEIYKEVLLENYRNLEFLGFPVSKLDLISQLKWAGLPRLLQKQASRGSRPECELS

SEQ ID NO: 29282 - protein, 81 aa, Odocoileus virginianus
PQLPESLEDVAMYISQEEWGRQHPSKRALSRDTVQESYENVDSLESQVPSQEALSTQVEHGGRPWHPSVQTCKEGLSSRTP

SEQ ID NO: 29283 - protein, 81 aa, Callithrix jacchus
QLQETMTFKDVEVTFSQDEWGLLDSAQRNLYRDVMLENYRNMAFLVGPFTKPALISWLEAREPWGLNVQVAQPKRNPGAAP

SEQ ID NO: 29284 - protein, 81 aa, Acinonyx jubatus
PVTFGDVPFYFSREEWGSLDPAQRDLFWDIKRENSRNVALALVPEPSGTEEAAPSRLAGLGPESQSKQSRLEEAAAALQGQ

SEQ ID NO: 29285 - protein, 81 aa, Leptonychotes weddellii
QEPVTFLDVAVDFSKEEWGLLDPTQRTEYHDVMLETFGHLVSVGWETTLESKELTPKSDIPEKEPAHDLKMEEFSRDDTWS

SEQ ID NO: 29286 - protein, 81 aa, Leptonychotes weddellii
SQSLLTFEEVAMYFSQEEWELLDPTQKALYNDVMRENYETVISLALFVLPKPKVISYLEQGEEPWIQGPLEFKNSPGGLPT

SEQ ID NO: 29287 - protein, 81 aa, Zalophus californianus
ERAVPAQQILAFSEQKSPPNWKMASELILPEFQSLLTFEDVAVSFSEEEWKLLDPTQKILYNDVMQENYETVISLAVGGSP

SEQ ID NO: 29288 - protein, 81 aa, Ursus arctos
FQSLLTFEDVAVSFSEEEWKLLDPSQKILYNDVMQENYETVISLGFLRCAPSEAICSVNESCRKGALKSVPAHPSRASRGR

SEQ ID NO: 29289 - protein, 81 aa, Panthera pardus
QQVPVTLEDVAAYLSQEEWECLDPAQRGCVWDVLPDSGGLGLQLEDGEGARQDVPTRREQDRELVGGMTRPEQSLERGGPR

SEQ ID NO: 29290 - protein, 81 aa, Pongo abelii
SQELLTFKDVSVDFTQEEWGQLAPAHRNLYREVMLENYGNLVSVGYQLSKPGVISQLEKGEEPWLMERDISGVPSSDLESK

SEQ ID NO: 29291 - protein, 81 aa, Chrysochloris asiatica
QEPVTFQDVVVEFSEEEWGKLDPDVKNLYKDVILENYRNLNALQKGHLLSKPVEVSKLESKKNPQITGGEIPRRTVLGKET

SEQ ID NO: 29292 - protein, 81 aa, Bos mutus
PLTFADVALYFSEEEWKIMTPDEKTLYLDVMQELYEDVASVGLKLTNDTGNDPPVSLPTLEIQPSGCEVLRKATMKDAETT

SEQ ID NO: 29293 - protein, 81 aa, Neophocaena asiaeorientalis
TEGLVTFKDVAVDFSPEELTYLTAAQRKLYRELMLENYRNLVSLGYQFPKPDIISRLEAEESCAVEEDSSTMICQDWEKKP

SEQ ID NO: 29294 - protein, 81 aa, Nomascus leucogenys
QAMVKIEDMAVSLILEEWGCQNLARRNLSRDNRQENYGSAFPQGGENRNENEESTSKAETTEDSASCGETAGRFQKEFGEK

SEQ ID NO: 29295 - protein, 81 aa, Equus caballus
FERQPGLVPITSVAVDFSQQLEPAQKSFCKNVMWKNHDLGPVGCCVSKPDLVSVLEREKEPWLVKRELTRGLFSGQQSIRE

SEQ ID NO: 29296 - protein, 81 aa, Chrysochloris asiatica
QPQEAMTFKDVEVTFFQDEWEWLDHSKRNLYRDVMLENYGNMVSLVGPFHKPALISWLEGREPWGLNDQGVQQREKPGAAP

SEQ ID NO: 29297 - protein, 81 aa, Mandrillus leucophaeus
QCASPVPTLPQVGNSGLRMVRPQDTVAYEDLCVDYTQKKWKCPALSQRALQWNMMPENDRSMASLGWSTMARSWLTSISGS

SEQ ID NO: 29298 - protein, 81 aa, Nomascus leucogenys
GMVTFEDMAVSLTWEEWERLDPARRDFCRESTQKDSGSTVGPSLESRVENKELIPMQQILEEVEPQGRLQEAFQGKRPLFS

SEQ ID NO: 29299 - protein, 81 aa, Chrysochloris asiatica
SQGLVTFQDVAVCFSHDQWSNLDPTQKEFYGEYVFEEDCGIVVSLSFPIPRLDEISQVREEESWVPDIQEPQERQETEILS

SEQ ID NO: 29300 - protein, 81 aa, Mandrillus leucophaeus
GHQEAASTSFHPPRIQEEWGLLDRSQKELYWDTMLEKYGTVVSLGLPPHQPEAQAQSELGMLLLGTGVCRSLRSGNESEGP

SEQ ID NO: 29301 - protein, 81 aa, Sus scrofa
AQSLLTFEEVAMYFSQEEWELLDPTQKALYNDVMHENYETVISVALFVFPKPNVIACLEQGEEPWVQRSLEFKDSSEELPA

SEQ ID NO: 29302 - protein, 81 aa, Loxodonta africana
QESAAYEDLSVDYTQKKWKGPALSQRALYRNMMLENYRSMASLASENRMESSELTPKPELSKGPGSSERTSGGLHGMALGA

SEQ ID NO: 29303 - protein, 81 aa, Suricata suricatta
VQELHPESGEEAVTLVEGMQRELGRLRLQLPESLEDVAMYISQEEWGRQDPSKRALSRDTVQDSYENVDSLGKDFFFRDED

SEQ ID NO: 29304 - protein, 81 aa, Sus scrofa
ESQEQLTFRDVSVDFTQEEWGQLAPAHRHLYREVMLENYGNLVSVDLKGETETKESALKNELSWKELHHCLMMEKSTRGST

SEQ ID NO: 29305 - protein, 81 aa, Sus scrofa
APEASALSQEENPRNQLMALMLLTAQPQELVMFEEVSVCFTSEEWACLGPIQRALYWDVMLENYGTVTSLVYRNCRRQRNK

SEQ ID NO: 29306 - protein, 81 aa, Loxodonta africana
LVKIEDVIDMAFSFILEEWGHLDQSQKNLYRGDRKENCGSITSIDYESRNDNMELIVEQISDEAESHWMTSGSTERNVPQS

SEQ ID NO: 29307 - protein, 81 aa, Loxodonta africana
QAMVKIEDMAVSLILEEWGCQNLARRNLNRDNRQETYGNVFSQGCGNRNENEESTSKTKIAEDSASHGETTGRLQKAFGEK

SEQ ID NO: 29308 - protein, 81 aa, Chrysochloris asiatica
SSESVSFKDVAVNFSRGEWKKLQPFQKKLFMEVLLENCRNLEFLGFPVSKLDLISPLKWVVMPWLLQKEVSKSSRLESSLD

SEQ ID NO: 29309 - protein, 81 aa, Suricata suricatta
FGDQAFGASVLQAAPQEQWKHPDPAQEEQHWDVMLETYRKMVSGGISSSKSDPTDPAECGEELAGRRRPLRETSPRPPCSG

SEQ ID NO: 29310 - protein, 81 aa, Bos mutus
KIEDVADVAVSFILEEWGHLDQSQKSLYRNDRKENYGSMTSMDYESRNDNMELTVKQISDEAESSWMTSGGPERIIPPSQE

SEQ ID NO: 29311 - protein, 81 aa, Neophocaena asiaeorientalis
VTVQDVAVSLTWEEWERLGPAQRDLYRESAPKDYGNAVSPSLETRTENKELILKQEILEEVEPQGQLQESQEKGPLSSECG

SEQ ID NO: 29312 - protein, 81 aa, Equus caballus
FQELLTFKDISVDFTQEEWGQLAPGHRTLYREVMLENYGNLVSVGYQLSKPGVISQLEKGEEPWLIEREISDGPTSDLESK

SEQ ID NO: 29313 - protein, 81 aa, Mandrillus leucophaeus
DTVAYEDLCVDYTQKKWKCPALSQRALQWNMMPENDRSMASLAGENMMKGSELTPKQEIFKGSESSNKTSGGLFGMVPGGA

SEQ ID NO: 29314 - protein, 81 aa, Neophocaena asiaeorientalis
EQQELTSVPFQPPRIQEEWGLLDRSQKEVYWDAMLQKYGTVVSLGLPCPLPEARTEPEPEPEALSTGSEGARSLPPGGESE

SEQ ID NO: 29315 - protein, 81 aa, Loxodonta africana
WGSAALFVKQPGLVIVGDVAVDFSQQKSFCKNVTWENYGDLGSVGHSVSKPDLVSLLAQGMEPWMVKRELTGGLFSGECGR

SEQ ID NO: 29316 - protein, 81 aa, Suricata suricatta
PQLPESLEDVAMYISQEEWGRQDPSKRALSRDTVQDSYENVDSLEPQVPSQEALSAQVEQGGKPWDPSAQTCKEGLSPRGP

SEQ ID NO: 29317 - protein, 81 aa, Sus scrofa
RSQELVTFKDVAVDFSPEELTYLSSAQRNLYREVMLENYRNLVSLGYQFPKPDIISWLEEEEAWAEEEDSRTTLRQDWEKK

SEQ ID NO: 29318 - protein, 81 aa, Chrysochloris asiatica
GPFVLKFKDVAIYFSEKEWECLKPTQKDLYRDVMLKNYNNLVSLGLSDSKPDVIFLLEQGKEPWRVKREETEEWCPDWESR

SEQ ID NO: 29319 - protein, 81 aa, Mandrillus leucophaeus
SQEPVKDVHVARGFSYKKSVHQIPAHRDLYRDFRKENVGNMVSLGSTASTSNKITRLEQRREPWTLGLHSSNKKSILRSNY

SEQ ID NO: 29320 - protein, 81 aa, Sus scrofa
PQELVMFEEVSVCFTSEEWACLGPIQRALYWDVMLENYGTVTSLAMEWTWTREVWRIGEWETMAENEEVTSKSSISQRADS

SEQ ID NO: 29321 - protein, 81 aa, Suricata suricatta
EDAVTFLDVAVDFSKEEWGLLDPTQRTEYHDVMLETFGHLVSVGWETTLESKELTPKSDIPEEELAPDLKMEESSRDDTCS

SEQ ID NO: 29322 - protein, 81 aa, Sus scrofa
PTSAPFHPSRIQEEWGLLDPSQKELYWDAMLEKYGTVVSLGLPRPLPEAFAESEPEGLSPGPEGQRSLRPAGESASSGAEG

SEQ ID NO: 29323 - protein, 81 aa, Neophocaena asiaeorientalis
QSLLTFEDVALFFTEEEWQLLDPAQKILYNNVMQENYETVISLGPLGTVSDCGLKIQLPRESCKAIQCQMTLKKDKWDDKT

SEQ ID NO: 29324 - protein, 81 aa, Chrysochloris asiatica
VMFEEVSVCFTSEEWACLGPIQRALYWDVMLENYGNVTSLEWETMTENEEVTSKPGISQRSDSQKGASKRLRSIPKVLDFE

SEQ ID NO: 29325 - protein, 81 aa, Chrysochloris asiatica
NWNAEAPFKRQPGLLTVRNVAVDFAQQRRFCKHWMQENHGDLGSIGLCISKPEVISLLEQGKEPWQVNGQRTAESPAWEEH

SEQ ID NO: 29326 - protein, 81 aa, Sus scrofa
QLTFRDVSVDFTQEEWGQLAPAHRHLYREVMLENYGNLVSVGLTSKTETSVSTAENDIVQEQLYHSMMMERLMRDDVIYST

SEQ ID NO: 29327 - protein, 81 aa, Sus scrofa
QEPAEYEFLSVDYTQKKWKGPALSQRALYRNIVPENCHSLASLAGENGMECSDLPPEQESSKESEASDRTSGVLYEVIPGG

SEQ ID NO: 29328 - protein, 81 aa, Mandrillus leucophaeus
QTDLVTFDSVAVEFTQEEWTLLDPTQRNLYSDVMLENYKNLSSVGYQLFKPSLISWLEEEEELSTLPRVLQEWQMCLKTKG

SEQ ID NO: 29329 - protein, 81 aa, Neophocaena asiaeorientalis
QSLLTFEDVALFFTEEEWQLLDPAQKILYNNVMQENYETVISLGPLGTVSDCGLKIQLPRESCKAIQCQATSVGCALFLKL

SEQ ID NO: 29330 - protein, 81 aa, Equus caballus
SQSLLTFEEVAMYFSQEEWELLDPTQKALYNDVMQENYETLISLALFVLPKPKVISCLEQGEDPWVQGSPEFNDRPRELPT

SEQ ID NO: 29331 - protein, 81 aa, Suricata suricatta
VMFEEVSVCFTSEEWACLGPIQRALYWDVMLENYGNVTSLEWETMTEHEEVTPKPSTSPRADAQKGPSKRLQGSVPQTLDF

SEQ ID NO: 29332 - protein, 81 aa, Chrysochloris asiatica
LVTKESVTFVDVAVDITQEDWGLMRPVQKELYKTVTLQNYWNMVSLGLTVYRPSVIPILEEPWLVIKEIVEGPSPEWQTKV

SEQ ID NO: 29333 - protein, 81 aa, Sus scrofa
EPTSAPFHPSRIQEEWGLLDPSQKELYWDAMLEKYGTVVSLAGLPRPLPEAFAESEPEGLSPGPEGQRSLRPGKGPPAPGG

SEQ ID NO: 29334 - protein, 81 aa, Capra hircus
SQGLLTFEEVAIYFSQEEWELLNPTQKALYNDVMHENYETVISLALFVLPKPKVISYLEQGEDPYIQGSPVFKDNPEELLS

SEQ ID NO: 29335 - protein, 81 aa, Mandrillus leucophaeus
EENPRNQLMALMLLTAQPQELVMFEEVSVCFTSEEWACLGPIQRALYWDVMLENYGNVTSLVYYRNIKYARQSKIIGTRVA

SEQ ID NO: 29336 - protein, 81 aa, Capra hircus
TEELVTFEDVAVDFSPEELPYLSASQRNLYREVMLENYRNLVSLGYQFPKPDLISQLEEEESHAREEDGSTVTRQDWEEQS

SEQ ID NO: 29337 - protein, 81 aa, Suricata suricatta
VKIEDVADVAVSFILEEWGHLDQSQKSLYRDDRKENYGSIPSMDYESRNDNVELIVKQISDDAESHWMMSGSAERNIPQSQ

SEQ ID NO: 29338 - protein, 81 aa, Suricata suricatta
QLELVTFQDVAVDFSPEELTYLSAAQRNLYREVMLENYRNLVSLGKTAFSMELGFRKNSGTFTFLLDGEERPKTKDLTPEQ

SEQ ID NO: 29339 - protein, 81 aa, Chrysochloris asiatica
VTCENVAVSLTWEEWGHLGPAQRDISRESAQKECGSTVLLSLETRAKNKLMFPKQEILEAEPQVQELEGSQGKVSMFSKYG

SEQ ID NO: 29340 - protein, 81 aa, Chlorocebus sabaeus
DTQPGLVTIKNLAVDFPQQLHPAQKNFCKNGIWENHSDLGSAGHCVAKPDLVSLLQQEKEPWMVKQELTGSLLSGQRSVRE

SEQ ID NO: 29341 - protein, 81 aa, Lipotes vexillifer
PQLPESLEDVAMYISQEEWGHQHPSKRALSQDTVQESYENVDSLESQVPTQEALSTQVEQEGKPWDPSVQTCKEGLSPRSP

SEQ ID NO: 29342 - protein, 81 aa, Equus caballus
SWESVTFKDVAVNFSRGEWRKLEPFQKELYKEVLLENFRNLEFVGLPVSKLDLVSQLTWAELPRLLEKEISKGSRSDCKRR

SEQ ID NO: 29343 - protein, 81 aa, Chrysochloris asiatica
VGDQDCGGSLLAAPSQEQWRHLDSTQKEHYWDLMLETYGKMVSGGLSSPKADAAHSAEYGDELAGLHLRILSLSFTRELTL

SEQ ID NO: 29344 - protein, 81 aa, Suricata suricatta
QPQEAVTFKDVEVIFSQDEWGWLDPAQRNLYRDVMLENYGNMVSLVGPFTKPVLISWLEAREPWGLNGQGAWPKAKSGVAP

SEQ ID NO: 29345 - protein, 81 aa, Loxodonta africana
RDQDLGASLLQASSQEQWRHLDSTQKEYYWDLMLEAYGKMVSEGPDISSPKPDRANSAEHGQERGRLHLHAREKISMQACT

SEQ ID NO: 29346 - protein, 81 aa, Pteropus vampyrus
QGLVNVKDVAVSLTWEEWEHLDPVQRVFYRESKPKDYGNIAPPSLETRTENKELIPKQEILEVEPQRQLQEASQGKAPLFS

SEQ ID NO: 29347 - protein, 81 aa, Zalophus californianus
SQELVTFKDVVVDFSPEELTYLSAAQRNLYREVMLENYRNLVSLGYQFSKPDIISQLEEEESRVREEDSNTEICQGNGITV

SEQ ID NO: 29348 - protein, 81 aa, Zalophus californianus
LILPEFQSLLTFEDVAVSFSEEEWKLLDPTQKILYNDVMQENYETVISLAIWSISESWRKDALKSIPAYPSRASRGRQMHT

SEQ ID NO: 29349 - protein, 81 aa, Trichechus manatus
QGLVTFKDVASSLTWEEWVHLDPAQRIFSRESTQKDYGNTILLSLESRTEDKELILKQEILEEAEPQGQLQEGSQGKAPLF

SEQ ID NO: 29350 - protein, 81 aa, Pteropus vampyrus
AEELVTFQDVVVDFSPEELASLSAAQRNLYREVMLENYRNLVSLGYQFSKPDVISQLEEEESRAIEEDSDKKMCQDWEKRT

SEQ ID NO: 29351 - protein, 81 aa, Trichechus manatus
ALFEKQPGLVTVRDVAVDFSQQKSFCKTVMWENHGGLGSVGCSVSKPDLVSLLEQGTEPWMVKRELTGGLFSGQQSVCETQ

SEQ ID NO: 29352 - protein, 81 aa, Loxodonta africana
QGLVTFKDVAMSVTWEEWVHLDPAQRTFSRDSTQKDYGNTVLLSLESRTENKELIPKQEILEEAEPQGQLEEGSQGKAPLF

SEQ ID NO: 29353 - protein, 81 aa, Chlorocebus sabaeus
EPVTFKDVVVEFSKEEWGQLDSAVKNLYRNVMLENFRNLNSLRKGTAYLLSKPVESLKLESKKKRWIMEKDIPWKTVFDMQ

SEQ ID NO: 29354 - protein, 81 aa, Sus scrofa
QQVLLTLEDMAVYLTQEEWRCLDLARQGHGCGVLPEDEGNVRRDPGFVHQTLCCVSDLGESQGGWRSPRAGCGAVVASRPR

SEQ ID NO: 29355 - protein, 81 aa, Capra hircus
PVTFGDIPFYFSREEWGSLDPAQRDLFWDIKRENSRNVALGLGHRSHSERTQLEEVVTALPDQAAGDKTASRSPEEAEAWE

SEQ ID NO: 29356 - protein, 81 aa, Chrysochloris asiatica
YQELLTFNDISVDFTQEEWGQLAPAHRNLYREVMLENYGNLVSVGYQFSKPGVISQLEKGEEPWLTEREISEGPSSDLESK

SEQ ID NO: 29357 - protein, 81 aa, Chlorocebus sabaeus
QDTVAFEDLSVGYTQKKWKCPALSQRALQWNMMPENDRSMASLGENMMKGSELTPKQEIFKGSESSNKISGGLFGMVPGGA

SEQ ID NO: 29358 - protein, 81 aa, Tursiops truncatus
PTSVPFQPPRIQEEWGLLDRSQKEVYWDAMLQKYGTVVSLAGLPCPLPEARTEPEPEALSTGSEGARSLLPGGESESSREG

SEQ ID NO: 29359 - protein, 81 aa, Tursiops truncatus
LPESVTFEDVAINFTQEEWALLDTSQKTLFRNVMLENITHLVSVGYQISKSDVISQLEQGKELRKRNVSKQCGNSLSQGSF

SEQ ID NO: 29360 - protein, 81 aa, Loxodonta africana
SAEASVSLRSLIFLWLMENWKRALQRHQKIRKKFLLTIMNNIEFLGLPVSKLELISQLKWVVMPWLLEKEGSKGSRPGKLV

SEQ ID NO: 29361 - protein, 81 aa, Tursiops truncatus
LQEPVTFADVAVLFTPEEWLFLDSAQRSLYRDVMLENYRNLTSVGDQLCKASTFSHLEQREELCVTERGIFPGTHLEPQLQ

SEQ ID NO: 29362 - protein, 81 aa, Trichechus manatus
ENWEEAAAVVQAFQRALDGTAPQGLVTFKDVASSLTWEEWVHLDPAQRIFSRESTQKDYGNTILLKPQTRLPLWECGLPQL

SEQ ID NO: 29363 - protein, 81 aa, Zalophus californianus
LTFEDVAVSFSEEEWKLLDPTQKILYNDVMQENYETVISLGFLCCALSKAIWSISESWRKDALKSIPAYPSRASRGRQMHT

SEQ ID NO: 29364 - protein, 81 aa, Capra hircus
KIEDVADVAVSFILEEWGHLDQSQKSVYRDDRKENYGSMTSMDYESRNDNVELTVKQISDEAESSWMTSGGPERIVPLSQE

SEQ ID NO: 29365 - protein, 81 aa, Trichechus manatus
PSNRVSPFKDMIFCFSEEDWSLLDPAQTGFYGEFIIGEDCGVSLPPSDPVSQPALSQGEESEPRVPELQDLQGKNVPQVSY

SEQ ID NO: 29366 - protein, 81 aa, Zalophus californianus
TLVESLKGDPQRLWQWEQWRHLDSTQKEQYWDLMLETYGKMVSGGISSSKSDLTNSTEYGEELVGLHLPVGEKIPRPTCIG

SEQ ID NO: 29367 - protein, 81 aa, Equus caballus
SLLTFEEVAMYFSQEEWELLDPTQKALYNDVMQENYETLISLAVPAHQILASPEQTNTKDWTMAPELVLPESQSLLTFEEV

SEQ ID NO: 29368 - protein, 81 aa, Lipotes vexillifer
QEPVTFKDVVVEFSEEEWGQLDPAVKNLYRDVMLENYKNLNSLHKEHLLSKPAETSRLESKEKSWIMEQEILRTNVFDREI

SEQ ID NO: 29369 - protein, 81 aa, Callorhinus ursinus
SRVPVTLEDMAAYLSQEEWECVDPAQRDCSWDMLPEHGGLGLQLEDGQDTREDVSMGRERDQELVRGLARPEQPLERGGPR

SEQ ID NO: 29370 - protein, 81 aa, Tursiops truncatus
QVPVTLEDVAVYLSQEEWGCLDLAQQDHSCGRLQEDEAGLPAPGPCLTAQDGPGQGLRDPACAASGLREVSGSAGSELGRQ

SEQ ID NO: 29371 - protein, 81 aa, Tursiops truncatus
PTSVPFQPPRIQEEWGLLDRSQKEVYWDAMLQKYGTVVSLGLPCPLPEARTEPEPEALSTGSEGARSLLPGGESESSREGR

SEQ ID NO: 29372 - protein, 81 aa, Equus caballus
LMRDQDFGASLLHTAPQEQWRHLDSSQKEQYWDLMLETYGKMVSGGMSNSKPDPTSTECGEELAGVYLHISEKIPRPTCTG

SEQ ID NO: 29373 - protein, 81 aa, Zalophus californianus
SQSLLTFEEVAMYFSQEEWELLDPTQEALYNDVMRENYETVISLALFVLPKPKVISYLEQGEDPWVQGPLEFKNSPGGLPT

SEQ ID NO: 29374 - protein, 81 aa, Tursiops truncatus
SQEMLTFRDVFVDFTLEEWQQLDATQKNLCKDVMLENYSHLVSDSSWPNQVGPSGWDKEKRRPGWQLEKAQHGGVQGARVR

SEQ ID NO: 29375 - protein, 81 aa, Equus caballus
SQSLLTFEEVAMYFSQEEWELLDPTQKALYNDVMQENYETLISLALFVLPKPKVISCLEQGEEPWVQGSPEFKDCPRELPT

SEQ ID NO: 29376 - protein, 81 aa, Trichechus manatus
PQLPESLEDVALYISQEEWGHQEPRKRALSRDTVQESYENVDSLASPIPSQEALSTQVEPEGKPWDPRVQTCKEGPSPRSP

SEQ ID NO: 29377 - protein, 81 aa, Trichechus manatus
LMTKESMTFKDVAVDITQEDWELMRPVQKELYKTVTLQNYWNMVSLGLTVYRPSVIPILEEPWLVIKEILEGPSSEWQTKA

SEQ ID NO: 29378 - protein, 81 aa, Loxodonta africana
PQLPESLEDVAMYLSQEDCRHLEPGKRALSRDTVQENYKNVDSLESPIPNHGALSTQVEPGGKPWDPRVQSCKERRRPQSP

SEQ ID NO: 29379 - protein, 81 aa, Loxodonta africana
LVTKESMTFKDVAVDITQEDWELMRPVQKELYKTVTLQNYWNMVSLGLTVYRPSVIPILEEPWLVIKEILEGPSPEWQTKA

SEQ ID NO: 29380 - protein, 81 aa, Sousa chinensis
PVTFKDVVVEFSEEEWGQLDPAVKNLYRDVMLENYRNLNSLHKEIISENQDLVPKQRISGEESSHAVIMKRLTENGHPPLD

SEQ ID NO: 29381 - protein, 81 aa, Trichechus manatus
EPQEAVTFKDVEVIFFQDEWGWLDSAKKNLYRDVMLENYGNVASLVGPFPKPALISWLEGRGPWGLNVQGAQQRENPGAAS

SEQ ID NO: 29382 - protein, 81 aa, Equus caballus
VTVEDVAVSLSWEEWERLDPAQRDFHRESAPKDYGDTVSPSLETRPENKELIPKQEILEEVEPQGKPRGSQEKAPLLSECG

SEQ ID NO: 29383 - protein, 81 aa, Trichechus manatus
SQGLVTFKDVAVCFSHDQWSDLDPTQKEFHGEYVLEEDCGIVVSLSFPIPRLDEISQVREEESWVPDIQEPQEPQETEILS

SEQ ID NO: 29384 - protein, 81 aa, Trichechus manatus
QEPVTFKDVVVEFSEEEWGQLDPAVKSLYRDVMLENYRNLNSLRKGHLLSKPVEISKLDSKKKPQIMEGEIPRRTIFAMKK

SEQ ID NO: 29385 - protein, 81 aa, Trichechus manatus
YQELLTFKDVSVEFTQEEWRQLAPAHQNLYREVMLENYGNLVSVGYQLSKPGVISQLEKGEEPWMSEREISGGPVSDLENE

SEQ ID NO: 29386 - protein, 81 aa, Equus caballus
EPQEAMTFKDVEVTFSQDEWGWLDFAQRNLYRDVMLENYGNVASLVGPFTKPALISWLEAREPWGLNIQGAKGNPGATPAG

SEQ ID NO: 29387 - protein, 81 aa, Pan paniscus
MAEGLKFKDVAIYFSQKEWECLHSAQKDLYRDVMLENYGNLVLLGLSDTKPNVISLLEQKKEPWMVKRKETKEWCPDWEFG

SEQ ID NO: 29388 - protein, 81 aa, Tursiops truncatus
TEGLVTFKDVAVDFSPEELTYLTAAQRKLYREVMLENFRNLVSLGYQFPKPDIISRLETEESRTVEEDSSTMICQDWEKKP

SEQ ID NO: 29389 - protein, 81 aa, Neomonachus schauinslandi
SQESVTFKDVVVSFSRGEWRRLEPFQKELYKEVLLENFRNLEFLGFPVSKLDLLSQFKWVELPWLLEKEISKGSRPDVLLE

SEQ ID NO: 29390 - protein, 81 aa, Monodelphis domestica
RLQESMTFEDVAVYFSKAEWTLLSPAQQVLYRNVMLENYENLASLACPFPKPIVISNLEQASWDLQEALVQDLRNTYAGDE

SEQ ID NO: 29391 - protein, 81 aa, Monodelphis domestica
TEEVVMFQDVAVDFTREEWRLLSPPQKELYKEVMLENARNLLSVGLPAPPQEVISYLEQREVQCMLKPEGLQSCCPEGEIS

SEQ ID NO: 29392 - protein, 81 aa, Aotus trivirgatus
SCESITLNDVAVNFSRGEWKKLEPFQKELYKEVLLENFRNLEFLDESALDKIIERCLRDDDDDLMEEFHKYCGISEEEHGN

SEQ ID NO: 29393 - protein, 81 aa, Callorhinus ursinus
ERLIRDQDFGASFLQAAPLWRHLDSTQKEQYWDLMLETYGKMVSGGISSSKSDLTNSTEYGEELVGLHLPVGEKIPRPTCI

SEQ ID NO: 29394 - protein, 81 aa, Monodelphis domestica
PVTFEDMAMYLSQEEWGRLNPEQREHYQNVLQENYECEIKIEDEEDSREDSTMEMELYRTQAGKSKGCGHQPAHQGQACVT

SEQ ID NO: 29395 - protein, 81 aa, Monodelphis domestica
SQELVTFKDVAVDFTQEEWKKLDSTQRNLYWAVMLENYMNMVYLGFPVSKLEVISHMDQGEESWILEKEISKATCPDWEID

SEQ ID NO: 29396 - protein, 81 aa, Lipotes vexillifer
SQSLLTFEEVAMYFSQEEWELLDPTQKALYNDVMQENYETVISLALFVLPKPKVISCLEQGEEPWVQSSLEFKDNSGELPT

SEQ ID NO: 29397 - protein, 81 aa, Monodelphis domestica
RAQEAPTFQDVAVDFTWEEWRQLDPAQRDLYRDVMLENYQNLVSLGLPVSKPDIISQLEQEAPWSLKRDVANGSCLDWGTR

SEQ ID NO: 29398 - protein, 81 aa, Monodelphis domestica
CQESVTFRDVAPDFTWEEWTQLNPIQQALYREVLLETYRNLVFLGFSTSKPDVISQLEDEEITRILDSETPKGTCSYWDTV

SEQ ID NO: 29399 - protein, 81 aa, Equus caballus
QEPVTFKDVVVEFSEEEWGQLDPAVKNLYRDVMLENYRHLNSLRKDHLLSKPVEMSKLESKKKRWIMEREIPRATIFDRQR

SEQ ID NO: 29400 - protein, 81 aa, Loxodonta africana
PLNRVSPFKDMIFCFSEEDWSLLDPAQTGFYGEFIIGEDCGVSLPPSEPGIQPDLSQGEQNEPRITELQDLQGKNMPQVSY

SEQ ID NO: 29401 - protein, 81 aa, Tursiops truncatus
SQELLTFKDISVDFTQEEWGQLAPAHRNLYREVMLENYGNLVSVGCQLSKPSVISQLEKGEAPWMTEKEGPGNPSSDLKSK

SEQ ID NO: 29402 - protein, 81 aa, Capra hircus
SLGSVTFEDVAVNFSWEEWGLLDESHKRLYHDVMLENYALISSLGFWSGEEKVETSFAQSVSEAVSQARTSKEASSSQKTH

SEQ ID NO: 29403 - protein, 81 aa, Pteropus vampyrus
PVTFGDIPFYFSQEEWGSLDLAQRDLFWDIKRENSRNVALGLGLKSQSQRSQLEEAVTALPGQTGVDVTVAWNPEEAKAWE

SEQ ID NO: 29404 - protein, 81 aa, Capra hircus
GGPVTFGDIPFYFSREEWGSLDPAQRDLFWDIKRENSRNPGLWGDPSERTQLEEVVTALPDQAAGDKTASRSPEEAEAWEG

SEQ ID NO: 29405 - protein, 81 aa, Chrysochloris asiatica
GSQELVTFQDVAVDFTPEELSYLTAAQRNLYREVMLENYQNLVSVGHQFDKPDLISQLEKEEWCGMDEDTDVVTQDWEMNP

SEQ ID NO: 29406 - protein, 81 aa, Chrysochloris asiatica
LVEIEEVIDMAVSFSLVEWGRLDPSAKNLYTDGRKENYGSILSIGSESRNGKMELRVEQISDDARSHWMAHGSTERNVPQR

SEQ ID NO: 29407 - protein, 81 aa, Suricata suricatta
PQNLLTFEEVAMYFSQEEWELLDPTQKALYNDVMRENYETLISLALFVLPKPKVISYLEQGEEPWVQGSTEFKDSPGELPT

SEQ ID NO: 29408 - protein, 81 aa, Equus caballus
SQGLVTFKDVAVCFSQDQWSDLDPTQKEFYGEYVLEEDCGIVVSLSFPIPRLDEISHVREEEPLVPDIPEPQESQEPEILS

SEQ ID NO: 29409 - protein, 81 aa, Chlorocebus sabaeus
QGMATFEDMAVSLTWEEWERLDPARRDFCRESAQKDSGGTVPPSLESRAENKELIPMQEILEAEPQGRLQEAFQGKRPLLS

SEQ ID NO: 29410 - protein, 81 aa, Pteropus vampyrus
SQSLLTFEEVAVYFSQEEWELLDPSQKALYNDVMQKNYETVISLAIFVLPKPKVISCLEQGEEPWVQGSPNLKNNDKELPT

SEQ ID NO: 29411 - protein, 81 aa, Pteropus vampyrus
FQEPVTFKDVVVEFSEEEWGHLDPAVKSLYRDVMLENYRNLNSLQHLFSKPDEVPKLECKKKRWITEQEIPRTIVFDRQTI

SEQ ID NO: 29412 - protein, 81 aa, Equus caballus
PQELVMFEEVSVCFTSEEWACLGPIQRALYWDVMLENYGNVTSLEWETMTENEEVTSKSSISQRADSQKGTSKRLQGGVPQ

SEQ ID NO: 29413 - protein, 81 aa, Suricata suricatta
LVTKESMTFKDVAVDITQEDWEMMRPVQKELYKTVTLQNYWNMVSLGLTVYRPTVIPMLEEPWMVIKEILEGPSPEWKTEA

SEQ ID NO: 29414 - protein, 81 aa, Suricata suricatta
VKIEDMAVSLILEEWGCQNLARRNLNRDNRQENYGNVFFQGCEKRNESEESASKAETTEDSASRGETTGRFQKDFAEKREQ

SEQ ID NO: 29415 - protein, 81 aa, Lipotes vexillifer
QAMVKIEDMAVSLILEEWGCQNLARRNLNRDTRQENYGHVISQGCENRNENEESTSKAEIAEDSASHGETTGKFQKDFGEK

SEQ ID NO: 29416 - protein, 81 aa, Equus caballus
MTSGFQSFGSFLVPEELSCLTAAQRNLYREVMLENYRNLVSLGKSAFSMELRTFTFLLDWEKKLETKDVTPEQSLPVQKSS

SEQ ID NO: 29417 - protein, 81 aa, Neovison vison
APWEQHSCGAQLPALKEGRTRETADTCFASEAYGPVTFGDIPFYFSREEWGSLDPAQRELFWDIKRENSRNVALALVPEPS

SEQ ID NO: 29418 - protein, 81 aa, Capra hircus
QPQGTVTFKDVEVTFSQDEWGLLDASQRNLYRDVMLENYGNMASVVGPFTKPALISWLEAREPWGLNVQGVQLKGNPGAAP

SEQ ID NO: 29419 - protein, 81 aa, Capra hircus
SQELLTFKDVSVDFTQEEWGQLAPAHRNLYREVMLENYGNLVSVAGCQLSKPSVISQLEKGEEPWMTEKEGPGDPSSDLES

SEQ ID NO: 29420 - protein, 81 aa, Suricata suricatta
SQDLLTFKDISVDFTQEEWGQLAPAHRSLYREVMLENYGNLLSVGYQLSKPGVISQLEKGEEPWLIEREVSGGPCADLENK

SEQ ID NO: 29421 - protein, 81 aa, Trichechus manatus
SRELLTFKDIAVDFTQEEWRQLDPAHRNLYREVMLENYGNLVSVGYQLSKPSVISQLEKGEEPWLTEKEAPGDTSSDLESK

SEQ ID NO: 29422 - protein, 81 aa, Zalophus californianus
RQVPVTLEDMAAYLSQEEWECVDPAQRDCSWDMLPEHGGLGLQLEDGQDTREDVSMGRERDQELVRGMARPEQPLERGGPR

SEQ ID NO: 29423 - protein, 81 aa, Lipotes vexillifer
SQGPVKDDHMARGFSYKKSVRQIPAHRDLYRHIRKESIGNMVSLGNTVSTANKMAQLEQRKEPWTIGLQSSNKRNVLRSNY

SEQ ID NO: 29424 - protein, 81 aa, Trichechus manatus
SAAYDDLSVDYTQKKWKGPALSQRALYRNMMLENYHSVASLAGENRMNSSELTPNQVISKGPGSSDGTSGGLHGMVPGTPE

SEQ ID NO: 29425 - protein, 81 aa, Callorhinus ursinus
QELVTVENMAVSLTWEEWDRLDPAQRDFCPESALKDRRNMVSLVSLSLETRTENKEFIPKQEVLEEVEPQGQLQEESHWKA

SEQ ID NO: 29426 - protein, 81 aa, Zalophus californianus
SQELVTFKDVVVDFSPEELTYLSAAQRNLYREVMLENYRNLVSLGYQFSKPDIISQLEEEESRVREEDSNTEICQVDFACH

SEQ ID NO: 29427 - protein, 81 aa, Equus caballus
GSAAYEFLCVDYTQKKWRGPAVSQRALYQKVMPENHCSAASLAGENRMESSELPAKHEISKGSDSSNRISGGLYVVVPGGP

SEQ ID NO: 29428 - protein, 81 aa, Pteropus vampyrus
AEVPVAFEDVAVYFTQEEWGSLDKRQKELYRDVMWMNYELLASLGPAAAKPDLISKLERRAAPWIKDTRGPKWGKGKRKTV

SEQ ID NO: 29429 - protein, 81 aa, Lipotes vexillifer
QGLVTVQDVAVSLTWEEWERLGPAQRDLYRESAPKDYGNAVSPSLETRIENKELILKQEILEEVEPQGQLQGPQEKGPLSS

SEQ ID NO: 29430 - protein, 81 aa, Tursiops truncatus
SQSLLTFEEVAMYFSQEEWELLDPTQKALYNDVMQENYETVISLALFVLPKPKVISCLEQGEEPWVQRSLEFKDNSGELPT

SEQ ID NO: 29431 - protein, 81 aa, Equus caballus
VTFGDIPFYFSREEWGSLDPAQRDLFWDIKRENTRNIALGLGLKSHSEHSRPEEALPGQAGGDVTVSWSPAEAEVWESEAR

SEQ ID NO: 29432 - protein, 81 aa, Trichechus manatus
VRDQDFGASLLQASSQEQWRHLDSTQKEYYWDLMLEAYGKMVSGDISSPKSDLANSAEHGQELARLHLDAGENIPMPTCTG

SEQ ID NO: 29433 - protein, 81 aa, Trichechus manatus
SQGPVKDIHTARGFSYKENVHKIPAHRDLYQEIRKESVGNMVSLGGSVSTTSKIAQLEQRKEPRTIGLHSSNKRNTLRSNY

SEQ ID NO: 29434 - protein, 81 aa, Trichechus manatus
TVIFEDVAVVFSQGEWALLDLAQKKLYRDVMMETFRSLAAIVSQNLYDGESLSSEHVMVQFMKNNTWSSMLGEIFESHGTK

SEQ ID NO: 29435 - protein, 81 aa, Trichechus manatus
QEPVTFKDVVVEFSEEEWGQLDPAVKSLYRDVMLENYRNLNSLRKGHLLSKPVEISKLDSKKKPQIMEGEIPRRTVFDRET

SEQ ID NO: 29436 - protein, 81 aa, Pteropus vampyrus
QAMVKIEDMAVSLILEEWGCQNLARRNLSRDNRQENYGNVFSQGCENRNENEESTSKAEIAEDSTSHAETRGRIQKDFGEK

SEQ ID NO: 29437 - protein, 81 aa, Zalophus californianus
LILPESQSLLTFEEVAMYFSQEEWELLDPTQKALYNDVMRENYETVISLAVPAHQILAFPEQIITKDWTVAPELVLPESQG

SEQ ID NO: 29438 - protein, 81 aa, Equus caballus
WELASASFHPPRIQEEWGLLDPSQKELYWDAMLEKYGTVVSLGLPPPRREAPAESEPRALSAGTEGPGSLRTGDESESPRE

SEQ ID NO: 29439 - protein, 81 aa, Zalophus californianus
LTFGDIPFYFSREEWGSLDPAQRELFWDIKRENSRNVALGAGLQSQSQRSGLGEAVTVLPGQAGGGGGGGGRGDVTVSWSP

SEQ ID NO: 29440 - protein, 81 aa, Pan paniscus
DFAQCTSPVPTLPQVGNSGDQAGATVLRMVRPQDTVAYEDLSVDYTQKKWKGLTLSQRALQWNMMPENHHSMASLGNDSVS

SEQ ID NO: 29441 - protein, 81 aa, Pteropus vampyrus
KLKPAEPQPVGMSQDEEFWNTYQGVQEQLSRNTHKETEPVFERAIFVLPKPKVISCLEQGEEPWVQGSPNLKNNDKELPTG

SEQ ID NO: 29442 - protein, 81 aa, Zalophus californianus
QPVYERAVPAQQILAFSEQKSPPNWKMASELILPEFQSLLTFEDVAVSFSEEEWKLLDPTQKILYNDVMQENYETVISLDR

SEQ ID NO: 29443 - protein, 81 aa, Lipotes vexillifer
LERHLGLVTITNMAVDVSQQPDPTRKSFCKNVVWEDHNLGAVGRCVSEPDLVSLLDLGKEPWVVKGELARGPSPGQKSIHE

SEQ ID NO: 29444 - protein, 81 aa, Callorhinus ursinus
MAEGFTFKDVAIYFSQKEWECLHSAQKDLYRDVMLENYNNLISLGLSYSKPDVISLLEQGKEPWMVKSQETKEWCPDWESR

SEQ ID NO: 29445 - protein, 81 aa, Lipotes vexillifer
LPPNRVSSFKDMIFCFSEEDWSLLDPAQTGFYGEFIIGEDCGVSLPPDDPAAQLDLSQGEENEPLVPELQDLQGKDVSQVS

SEQ ID NO: 29446 - protein, 81 aa, Tursiops truncatus
SQESMTLKDVAVTFSRGEWRALEPSQKEIYKEVLLENYRNLEFLGFPVSKLDLVSQLKWAGLPRLLQKQASRGSRPECELS

SEQ ID NO: 29447 - protein, 81 aa, Callorhinus ursinus
PQALLTFRDVAIEFSQEEWGCLTHTQRQLYRDVMLENYGHLLFLGLVLSKPDLMMFLEQEKQLWDVKRKETVAFHPALNRS

SEQ ID NO: 29448 - protein, 81 aa, Sarcophilus harrisii
GSQEPICSGMSRNLSYKKWEHPNPAHKNFCRGIIKENYRNMVSLGIPISTAKKVSQLTRGKKPWVLALQGSSKRHVLRGIH

SEQ ID NO: 29449 - protein, 81 aa, Pteropus vampyrus
SQRPVKDVHVARGFSYRKSMRQVPAHRGLFRDGREESAEDVVSLGSAVSASNEIARLEHRRAPWTVDPHPAHSRSGLRSSH

SEQ ID NO: 29450 - protein, 81 aa, Monodelphis domestica
FQESVTFKDVVPDFTWEELVQLDPVEQDLYRDVLLENYRNLVFLGLLASKPDVIIQLECGEVPWILENEVPKGLIGLRESS

SEQ ID NO: 29451 - protein, 81 aa, Monodelphis domestica
VTPTFQDVAVDFTWEEWKQLDPAQQDLYRSVTLENYQNLVSLGKEKNSITFNCTTVYQSLNCDKGWKGFHPFHPLSQYTMF

SEQ ID NO: 29452 - protein, 81 aa, Aotus trivirgatus
GSQEAVKDVHVARGFSYKKSVHQIPVHRGLYRDFRKENVGNMVSLVTVSTSNRITRLEQRKEPWTLGLHSLIEKSLQGVQE

SEQ ID NO: 29453 - protein, 81 aa, Aotus trivirgatus
VKIEEVADVAVSFILEEWGHLDQSQKSLYRDDRKENYGSITSMDYESRDNMDLMVKQVSDDTESHWVALEHTERSVPQGPD

SEQ ID NO: 29454 - protein, 81 aa, Pan paniscus
EELPVVFEDVAVYFTREEWGMLDKRQKELYRDVMRMNYELLASLGPAAAKPDLISKLERRAAPWIKDPNGAKSGGKGRPPG

SEQ ID NO: 29455 - protein, 81 aa, Pan paniscus
ALSQEENPRNQLMALMLLTAQPQELVMFEEVSVCFTSEEWACLGPIQRALYWDVMLENYGNVTSLDIKYTRQSKIIGTRVA

SEQ ID NO: 29456 - protein, 81 aa, Tursiops truncatus
SQELLTFKDISVDFTQEEWGQLAPAHRNLYREVMLENYGNLVSVVGCQLSKPSVISQLEKGEAPWMTEKEGPGNPSSDLKS

SEQ ID NO: 29457 - protein, 81 aa, Gorilla gorilla
KPRLLEENALPVLQVPSLPLKDSQELTASLLSTGSQKLVKIEEVADVAVSFILEEWGHLDQSQKSLYRDDRKENYGSITSM

SEQ ID NO: 29458 - protein, 81 aa, Pan paniscus
PQLPESLEDVAMYISQEEWGHQDPSKRALSRDTVQESYENVDSLESHIPSQEVPGTQVGQGGKLWDPSVQSCKESLSPRGP

SEQ ID NO: 29459 - protein, 81 aa, Ailuropoda melanoleuca
LIGDQEFGASFLQASPPEHWRHLDSTQKEQYWDLMLETYGKMVSGGISNSKCDLTNSTEYGEELAGLHLHVGEKISRPTCI

SEQ ID NO: 29460 - protein, 81 aa, Homo sapiens; identical to SEQ ID NO: 887

SEQ ID NO: 29461 - protein, 81 aa, Homo sapiens; identical to SEQ ID NO: 888

SEQ ID NO: 29462 - protein, 81 aa, Pteropus alecto
DSVAFEDVAVTFTLEEWSLLDSSQKKLYRDVMRETFRNLTSIGKKWEDYDVEDQCKNQGRKRRSHMDSVAYEDVAVNFSVE

SEQ ID NO: 29463 - protein, 81 aa, Ursus arctos
EELPVVFEDVAVYFTREEWGMLVKRQKELYRDVMRMNYELLAALGPAAAKPDLISKLERRAAPWIKDPNGPKWGKGRPPGK

SEQ ID NO: 29464 - protein, 81 aa, Saimiri boliviensis
SCESITLKDVAVNFSRGEWKKLEPFQKELYKEVLLENFRNLEFLDFPVSKLELISQLKWVELSWLLEKEVSKGSQPDESAL

SEQ ID NO: 29465 - protein, 81 aa, Panthera pardus
SQELLTFKDISVDFTQEEWGQLPLAHRNLYREVMLENYGNLLSVGYQLSKPSVISQLEKGQEPWMTEKEGPGDPRSDLKNK

SEQ ID NO: 29466 - protein, 81 aa, Vombatus ursinus
SQESLICSGISRNLSHKKWGHLNPAHKNFCRGIMKENYRNMVSLGIPISTAKKMSQLARGKKPWVLAFQGSNKRHVLRGIH
